United States Patent 11,369,692 (MATERIALS AND METHODS FOR TREATMENT OF DUCHENNE MUSCULAR DYSTROPHY) - sequence listing, part 3

SEQ ID NO: 65200 - DNA, 20 bp, Artificial Sequence
  chemically synthesized
ggcaacagcctagacaatta

SEQ ID NO: 65201 - DNA, 20 bp, Artificial Sequence
  chemically synthesized
cagcctagacaattatggta

SEQ ID NO: 65202 - DNA, 20 bp, Artificial Sequence
  chemically synthesized
gtatggtttgaaaaacactg

SEQ ID NO: 65203 - DNA, 20 bp, Artificial Sequence
  chemically synthesized
tccagttgattatgaagcta

SEQ ID NO: 65204 - DNA, 20 bp, Artificial Sequence
  chemically synthesized
gacaaatccagttgattatg

SEQ ID NO: 65205 - DNA, 20 bp, Artificial Sequence
  chemically synthesized
actgtagcttcataatcaac

SEQ ID NO: 65206 - DNA, 20 bp, Artificial Sequence
  chemically synthesized
tcataatcaactggatttgt

SEQ ID NO: 65207 - DNA, 20 bp, Artificial Sequence
  chemically synthesized
atccaataaactgacaaatc

SEQ ID NO: 65208 - DNA, 20 bp, Artificial Sequence
  chemically synthesized
aactggatttgtcagtttat

SEQ ID NO: 65209 - DNA, 20 bp, Artificial Sequence
  chemically synthesized
tttgtcagtttattggatgt

SEQ ID NO: 65210 - DNA, 20 bp, Artificial Sequence
  chemically synthesized
ttgtcagtttattggatgtc

SEQ ID NO: 65211 - DNA, 20 bp, Artificial Sequence
  chemically synthesized
tcagtttattggatgtcagg

SEQ ID NO: 65212 - DNA, 20 bp, Artificial Sequence
  chemically synthesized
cagtttattggatgtcaggc

SEQ ID NO: 65213 - DNA, 20 bp, Artificial Sequence
  chemically synthesized
agtttattggatgtcaggca

SEQ ID NO: 65214 - DNA, 20 bp, Artificial Sequence
  chemically synthesized
ttattggatgtcaggcaggg

SEQ ID NO: 65215 - DNA, 20 bp, Artificial Sequence
  chemically synthesized
ggatgtcaggcagggtggat

SEQ ID NO: 65216 - DNA, 20 bp, Artificial Sequence
  chemically synthesized
gatgtcaggcagggtggatt

SEQ ID NO: 65217 - DNA, 20 bp, Artificial Sequence
  chemically synthesized
atgtcaggcagggtggatta

SEQ ID NO: 65218 - DNA, 20 bp, Artificial Sequence
  chemically synthesized
tgtcaggcagggtggattag

SEQ ID NO: 65219 - DNA, 20 bp, Artificial Sequence
  chemically synthesized
caggcagggtggattagggg

SEQ ID NO: 65220 - DNA, 20 bp, Artificial Sequence
  chemically synthesized
aggcagggtggattagggga

SEQ ID NO: 65221 - DNA, 20 bp, Artificial Sequence
  chemically synthesized
gattaggggaaggtcactct

SEQ ID NO: 65222 - DNA, 20 bp, Artificial Sequence
  chemically synthesized
attaggggaaggtcactcta

SEQ ID NO: 65223 - DNA, 20 bp, Artificial Sequence
  chemically synthesized
taagccaagctcagacctta

SEQ ID NO: 65224 - DNA, 20 bp, Artificial Sequence
  chemically synthesized
ggaaggtcactctaaggtct

SEQ ID NO: 65225 - DNA, 20 bp, Artificial Sequence
  chemically synthesized
agtaagccaagctcagacct

SEQ ID NO: 65226 - DNA, 20 bp, Artificial Sequence
  chemically synthesized
gtcactctaaggtctgagct

SEQ ID NO: 65227 - DNA, 20 bp, Artificial Sequence
  chemically synthesized
ttctctaagtaagccaagct

SEQ ID NO: 65228 - DNA, 20 bp, Artificial Sequence
  chemically synthesized
ttctgttctctaagtaagcc

SEQ ID NO: 65229 - DNA, 20 bp, Artificial Sequence
  chemically synthesized
aggtctgagcttggcttact

SEQ ID NO: 65230 - DNA, 20 bp, Artificial Sequence
  chemically synthesized
gtctgagcttggcttactta

SEQ ID NO: 65231 - DNA, 20 bp, Artificial Sequence
  chemically synthesized
cttatttctgttctctaagt

SEQ ID NO: 65232 - DNA, 20 bp, Artificial Sequence
  chemically synthesized
agcttggcttacttagagaa

SEQ ID NO: 65233 - DNA, 20 bp, Artificial Sequence
  chemically synthesized
tttccttatttctgttctct

SEQ ID NO: 65234 - DNA, 20 bp, Artificial Sequence
  chemically synthesized
cttacttagagaacagaaat

SEQ ID NO: 65235 - DNA, 20 bp, Artificial Sequence
  chemically synthesized
ttacttagagaacagaaata

SEQ ID NO: 65236 - DNA, 20 bp, Artificial Sequence
  chemically synthesized
gagaacagaaataaggaaat

SEQ ID NO: 65237 - DNA, 20 bp, Artificial Sequence
  chemically synthesized
agaacagaaataaggaaatc

SEQ ID NO: 65238 - DNA, 20 bp, Artificial Sequence
  chemically synthesized
agaaataaggaaatcaggta

SEQ ID NO: 65239 - DNA, 20 bp, Artificial Sequence
  chemically synthesized
gaaataaggaaatcaggtat

SEQ ID NO: 65240 - DNA, 20 bp, Artificial Sequence
  chemically synthesized
aaataaggaaatcaggtata

SEQ ID NO: 65241 - DNA, 20 bp, Artificial Sequence
  chemically synthesized
atcaggtatagggctgcttt

SEQ ID NO: 65242 - DNA, 20 bp, Artificial Sequence
  chemically synthesized
tcaggtatagggctgctttg

SEQ ID NO: 65243 - DNA, 20 bp, Artificial Sequence
  chemically synthesized
aggtatagggctgctttgag

SEQ ID NO: 65244 - DNA, 20 bp, Artificial Sequence
  chemically synthesized
atccgtttatctcctcaaag

SEQ ID NO: 65245 - DNA, 20 bp, Artificial Sequence
  chemically synthesized
cccatccgtttatctcctca

SEQ ID NO: 65246 - DNA, 20 bp, Artificial Sequence
  chemically synthesized
ggctgctttgaggagataaa

SEQ ID NO: 65247 - DNA, 20 bp, Artificial Sequence
  chemically synthesized
gctttgaggagataaacgga

SEQ ID NO: 65248 - DNA, 20 bp, Artificial Sequence
  chemically synthesized
ctttgaggagataaacggat

SEQ ID NO: 65249 - DNA, 20 bp, Artificial Sequence
  chemically synthesized
gataaacggatgggccgata

SEQ ID NO: 65250 - DNA, 20 bp, Artificial Sequence
  chemically synthesized
cttgccaccataagctttat

SEQ ID NO: 65251 - DNA, 20 bp, Artificial Sequence
  chemically synthesized
ggatgggccgataaagctta

SEQ ID NO: 65252 - DNA, 20 bp, Artificial Sequence
  chemically synthesized
tgggccgataaagcttatgg

SEQ ID NO: 65253 - DNA, 20 bp, Artificial Sequence
  chemically synthesized
ataagggatcttgccaccat

SEQ ID NO: 65254 - DNA, 20 bp, Artificial Sequence
  chemically synthesized
ccgataaagcttatggtggc

SEQ ID NO: 65255 - DNA, 20 bp, Artificial Sequence
  chemically synthesized
tatggtggcaagatccctta

SEQ ID NO: 65256 - DNA, 20 bp, Artificial Sequence
  chemically synthesized
tgaagcagccaaaactataa

SEQ ID NO: 65257 - DNA, 20 bp, Artificial Sequence
  chemically synthesized
gtgaagcagccaaaactata

SEQ ID NO: 65258 - DNA, 20 bp, Artificial Sequence
  chemically synthesized
ggcaagatcccttatagttt

SEQ ID NO: 65259 - DNA, 20 bp, Artificial Sequence
  chemically synthesized
agtgaagcagccaaaactat

SEQ ID NO: 65260 - DNA, 20 bp, Artificial Sequence
  chemically synthesized
aacacaactagttagtgaag

SEQ ID NO: 65261 - DNA, 20 bp, Artificial Sequence
  chemically synthesized
gttttggctgcttcactaac

SEQ ID NO: 65262 - DNA, 20 bp, Artificial Sequence
  chemically synthesized
cataacacaactagttagtg

SEQ ID NO: 65263 - DNA, 20 bp, Artificial Sequence
  chemically synthesized
cctgccataacacaactagt

SEQ ID NO: 65264 - DNA, 20 bp, Artificial Sequence
  chemically synthesized
tttgcctgccataacacaac

SEQ ID NO: 65265 - DNA, 20 bp, Artificial Sequence
  chemically synthesized
ttcactaactagttgtgtta

SEQ ID NO: 65266 - DNA, 20 bp, Artificial Sequence
  chemically synthesized
actaactagttgtgttatgg

SEQ ID NO: 65267 - DNA, 20 bp, Artificial Sequence
  chemically synthesized
ctaactagttgtgttatggc

SEQ ID NO: 65268 - DNA, 20 bp, Artificial Sequence
  chemically synthesized
gttatggcaggcaaaaaaat

SEQ ID NO: 65269 - DNA, 20 bp, Artificial Sequence
  chemically synthesized
gcaaaaaaattagcttctct

SEQ ID NO: 65270 - DNA, 20 bp, Artificial Sequence
  chemically synthesized
taggatactgaagccaagag

SEQ ID NO: 65271 - DNA, 20 bp, Artificial Sequence
  chemically synthesized
aaattagcttctcttggctt

SEQ ID NO: 65272 - DNA, 20 bp, Artificial Sequence
  chemically synthesized
ctttaggatactgaagccaa

SEQ ID NO: 65273 - DNA, 20 bp, Artificial Sequence
  chemically synthesized
tactttaggatactgaagcc

SEQ ID NO: 65274 - DNA, 20 bp, Artificial Sequence
  chemically synthesized
ttttgtactttaggatactg

SEQ ID NO: 65275 - DNA, 20 bp, Artificial Sequence
  chemically synthesized
ctcttggcttcagtatccta

SEQ ID NO: 65276 - DNA, 20 bp, Artificial Sequence
  chemically synthesized
acaccctcgttttgtacttt

SEQ ID NO: 65277 - DNA, 20 bp, Artificial Sequence
  chemically synthesized
aacaccctcgttttgtactt

SEQ ID NO: 65278 - DNA, 20 bp, Artificial Sequence
  chemically synthesized
agtatcctaaagtacaaaac

SEQ ID NO: 65279 - DNA, 20 bp, Artificial Sequence
  chemically synthesized
gtatcctaaagtacaaaacg

SEQ ID NO: 65280 - DNA, 20 bp, Artificial Sequence
  chemically synthesized
tatcctaaagtacaaaacga

SEQ ID NO: 65281 - DNA, 20 bp, Artificial Sequence
  chemically synthesized
acaaaacgagggtgttgaat

SEQ ID NO: 65282 - DNA, 20 bp, Artificial Sequence
  chemically synthesized
aacgagggtgttgaattaga

SEQ ID NO: 65283 - DNA, 20 bp, Artificial Sequence
  chemically synthesized
tgttgaattagatggtccct

SEQ ID NO: 65284 - DNA, 20 bp, Artificial Sequence
  chemically synthesized
tatcactagaagtaaactaa

SEQ ID NO: 65285 - DNA, 20 bp, Artificial Sequence
  chemically synthesized
ttatcactagaagtaaacta

SEQ ID NO: 65286 - DNA, 20 bp, Artificial Sequence
  chemically synthesized
attatcactagaagtaaact

SEQ ID NO: 65287 - DNA, 20 bp, Artificial Sequence
  chemically synthesized
atggtcccttagtttacttc

SEQ ID NO: 65288 - DNA, 20 bp, Artificial Sequence
  chemically synthesized
aactggaacattatcactag

SEQ ID NO: 65289 - DNA, 20 bp, Artificial Sequence
  chemically synthesized
accaactggaacattatcac

SEQ ID NO: 65290 - DNA, 20 bp, Artificial Sequence
  chemically synthesized
tacttctagtgataatgttc

SEQ ID NO: 65291 - DNA, 20 bp, Artificial Sequence
  chemically synthesized
tctagtgataatgttccagt

SEQ ID NO: 65292 - DNA, 20 bp, Artificial Sequence
  chemically synthesized
ttcctttgcttttcaccaac

SEQ ID NO: 65293 - DNA, 20 bp, Artificial Sequence
  chemically synthesized
ataatgttccagttggtgaa

SEQ ID NO: 65294 - DNA, 20 bp, Artificial Sequence
  chemically synthesized
gttccagttggtgaaaagca

SEQ ID NO: 65295 - DNA, 20 bp, Artificial Sequence
  chemically synthesized
ttccagttggtgaaaagcaa

SEQ ID NO: 65296 - DNA, 20 bp, Artificial Sequence
  chemically synthesized
tgaaaagcaaaggaaaattc

SEQ ID NO: 65297 - DNA, 20 bp, Artificial Sequence
  chemically synthesized
gaaaagcaaaggaaaattct

SEQ ID NO: 65298 - DNA, 20 bp, Artificial Sequence
  chemically synthesized
tctttcttttggcagtttcc

SEQ ID NO: 65299 - DNA, 20 bp, Artificial Sequence
  chemically synthesized
aaattctaggaaactgccaa

SEQ ID NO: 65300 - DNA, 20 bp, Artificial Sequence
  chemically synthesized
ttctaggctctttcttttgg

SEQ ID NO: 65301 - DNA, 20 bp, Artificial Sequence
  chemically synthesized
tctaggaaactgccaaaaga

SEQ ID NO: 65302 - DNA, 20 bp, Artificial Sequence
  chemically synthesized
taggaaactgccaaaagaaa

SEQ ID NO: 65303 - DNA, 20 bp, Artificial Sequence
  chemically synthesized
ctattctaggctctttcttt

SEQ ID NO: 65304 - DNA, 20 bp, Artificial Sequence
  chemically synthesized
aactgccaaaagaaagagcc

SEQ ID NO: 65305 - DNA, 20 bp, Artificial Sequence
  chemically synthesized
ccaaaagaaagagcctagaa

SEQ ID NO: 65306 - DNA, 20 bp, Artificial Sequence
  chemically synthesized
caaaagaaagagcctagaat

SEQ ID NO: 65307 - DNA, 20 bp, Artificial Sequence
  chemically synthesized
tccctcaaaaagcctattct

SEQ ID NO: 65308 - DNA, 20 bp, Artificial Sequence
  chemically synthesized
ttccctcaaaaagcctattc

SEQ ID NO: 65309 - DNA, 20 bp, Artificial Sequence
  chemically synthesized
gagcctagaataggcttttt

SEQ ID NO: 65310 - DNA, 20 bp, Artificial Sequence
  chemically synthesized
agcctagaataggctttttg

SEQ ID NO: 65311 - DNA, 20 bp, Artificial Sequence
  chemically synthesized
gcctagaataggctttttga

SEQ ID NO: 65312 - DNA, 20 bp, Artificial Sequence
  chemically synthesized
tcagaaatcgttccctcaaa

SEQ ID NO: 65313 - DNA, 20 bp, Artificial Sequence
  chemically synthesized
tgagggaacgatttctgaaa

SEQ ID NO: 65314 - DNA, 20 bp, Artificial Sequence
  chemically synthesized
ccttctgttcaattcttttt

SEQ ID NO: 65315 - DNA, 20 bp, Artificial Sequence
  chemically synthesized
atttctgaaaaagaattgaa

SEQ ID NO: 65316 - DNA, 20 bp, Artificial Sequence
  chemically synthesized
tctgaaaaagaattgaacag

SEQ ID NO: 65317 - DNA, 20 bp, Artificial Sequence
  chemically synthesized
ctgaaaaagaattgaacaga

SEQ ID NO: 65318 - DNA, 20 bp, Artificial Sequence
  chemically synthesized
tgaaaaagaattgaacagaa

SEQ ID NO: 65319 - DNA, 20 bp, Artificial Sequence
  chemically synthesized
ttgaacagaagggtgctaaa

SEQ ID NO: 65320 - DNA, 20 bp, Artificial Sequence
  chemically synthesized
aagaattacaataaactttt

SEQ ID NO: 65321 - DNA, 20 bp, Artificial Sequence
  chemically synthesized
tgctgagagcagtaagacag

SEQ ID NO: 65322 - DNA, 20 bp, Artificial Sequence
  chemically synthesized
atttgctgagagcagtaaga

SEQ ID NO: 65323 - DNA, 20 bp, Artificial Sequence
  chemically synthesized
ctttatttgctgagagcagt

SEQ ID NO: 65324 - DNA, 20 bp, Artificial Sequence
  chemically synthesized
ttcttctgtcttactgctct

SEQ ID NO: 65325 - DNA, 20 bp, Artificial Sequence
  chemically synthesized
tgatctttatttgctgagag

SEQ ID NO: 65326 - DNA, 20 bp, Artificial Sequence
  chemically synthesized
gtttgatctttatttgctga

SEQ ID NO: 65327 - DNA, 20 bp, Artificial Sequence
  chemically synthesized
ctgtttgatctttatttgct

SEQ ID NO: 65328 - DNA, 20 bp, Artificial Sequence
  chemically synthesized
cttactgctctcagcaaata

SEQ ID NO: 65329 - DNA, 20 bp, Artificial Sequence
  chemically synthesized
ctcagcaaataaagatcaaa

SEQ ID NO: 65330 - DNA, 20 bp, Artificial Sequence
  chemically synthesized
tcagcaaataaagatcaaac

SEQ ID NO: 65331 - DNA, 20 bp, Artificial Sequence
  chemically synthesized
cagcaaataaagatcaaaca

SEQ ID NO: 65332 - DNA, 20 bp, Artificial Sequence
  chemically synthesized
aacagggtatttgtgtttgc

SEQ ID NO: 65333 - DNA, 20 bp, Artificial Sequence
  chemically synthesized
acagggtatttgtgtttgca

SEQ ID NO: 65334 - DNA, 20 bp, Artificial Sequence
  chemically synthesized
tatttgtgtttgcaaggtca

SEQ ID NO: 65335 - DNA, 20 bp, Artificial Sequence
  chemically synthesized
tttgcaaggtcaaagtaaac

SEQ ID NO: 65336 - DNA, 20 bp, Artificial Sequence
  chemically synthesized
agccatttgataatggacac

SEQ ID NO: 65337 - DNA, 20 bp, Artificial Sequence
  chemically synthesized
gtcattcagccatttgataa

SEQ ID NO: 65338 - DNA, 20 bp, Artificial Sequence
  chemically synthesized
aactagtgtccattatcaaa

SEQ ID NO: 65339 - DNA, 20 bp, Artificial Sequence
  chemically synthesized
tgagccagttaagagtcatt

SEQ ID NO: 65340 - DNA, 20 bp, Artificial Sequence
  chemically synthesized
atggctgaatgactcttaac

SEQ ID NO: 65341 - DNA, 20 bp, Artificial Sequence
  chemically synthesized
tctttctctgagccagttaa

SEQ ID NO: 65342 - DNA, 20 bp, Artificial Sequence
  chemically synthesized
gatctttctctgagccagtt

SEQ ID NO: 65343 - DNA, 20 bp, Artificial Sequence
  chemically synthesized
tgaatgactcttaactggct

SEQ ID NO: 65344 - DNA, 20 bp, Artificial Sequence
  chemically synthesized
aatgactcttaactggctca

SEQ ID NO: 65345 - DNA, 20 bp, Artificial Sequence
  chemically synthesized
tttctgatctttctctgagc

SEQ ID NO: 65346 - DNA, 20 bp, Artificial Sequence
  chemically synthesized
actcttaactggctcagaga

SEQ ID NO: 65347 - DNA, 20 bp, Artificial Sequence
  chemically synthesized
acattttctgatctttctct

SEQ ID NO: 65348 - DNA, 20 bp, Artificial Sequence
  chemically synthesized
taactggctcagagaaagat

SEQ ID NO: 65349 - DNA, 20 bp, Artificial Sequence
  chemically synthesized
gagaaagatcagaaaatgta

SEQ ID NO: 65350 - DNA, 20 bp, Artificial Sequence
  chemically synthesized
agaaagatcagaaaatgtat

SEQ ID NO: 65351 - DNA, 20 bp, Artificial Sequence
  chemically synthesized
aaagatcagaaaatgtatag

SEQ ID NO: 65352 - DNA, 20 bp, Artificial Sequence
  chemically synthesized
aatgtataggagaaaactaa

SEQ ID NO: 65353 - DNA, 20 bp, Artificial Sequence
  chemically synthesized
tataggagaaaactaatgga

SEQ ID NO: 65354 - DNA, 20 bp, Artificial Sequence
  chemically synthesized
taggagaaaactaatggaaa

SEQ ID NO: 65355 - DNA, 20 bp, Artificial Sequence
  chemically synthesized
acgttaatcactctttccat

SEQ ID NO: 65356 - DNA, 20 bp, Artificial Sequence
  chemically synthesized
gtgattaacgtgatcgtttc

SEQ ID NO: 65357 - DNA, 20 bp, Artificial Sequence
  chemically synthesized
cgtgatcgtttctggctcca

SEQ ID NO: 65358 - DNA, 20 bp, Artificial Sequence
  chemically synthesized
gtttccttattctttggagc

SEQ ID NO: 65359 - DNA, 20 bp, Artificial Sequence
  chemically synthesized
ccatgtttccttattctttg

SEQ ID NO: 65360 - DNA, 20 bp, Artificial Sequence
  chemically synthesized
cgtttctggctccaaagaat

SEQ ID NO: 65361 - DNA, 20 bp, Artificial Sequence
  chemically synthesized
gtttctggctccaaagaata

SEQ ID NO: 65362 - DNA, 20 bp, Artificial Sequence
  chemically synthesized
tcccatgtttccttattctt

SEQ ID NO: 65363 - DNA, 20 bp, Artificial Sequence
  chemically synthesized
ctccaaagaataaggaaaca

SEQ ID NO: 65364 - DNA, 20 bp, Artificial Sequence
  chemically synthesized
tccaaagaataaggaaacat

SEQ ID NO: 65365 - DNA, 20 bp, Artificial Sequence
  chemically synthesized
ataaggaaacatgggaaatg

SEQ ID NO: 65366 - DNA, 20 bp, Artificial Sequence
  chemically synthesized
atgggaaatgaagaaatatg

SEQ ID NO: 65367 - DNA, 20 bp, Artificial Sequence
  chemically synthesized
ggaaatgaagaaatatgaag

SEQ ID NO: 65368 - DNA, 20 bp, Artificial Sequence
  chemically synthesized
gaagaaatatgaagaagtat

SEQ ID NO: 65369 - DNA, 20 bp, Artificial Sequence
  chemically synthesized
aagaaatatgaagaagtatg

SEQ ID NO: 65370 - DNA, 20 bp, Artificial Sequence
  chemically synthesized
aatatgaagaagtatgaggc

SEQ ID NO: 65371 - DNA, 20 bp, Artificial Sequence
  chemically synthesized
gaagtatgaggcaagaaata

SEQ ID NO: 65372 - DNA, 20 bp, Artificial Sequence
  chemically synthesized
ataaagataatataaatgaa

SEQ ID NO: 65373 - DNA, 20 bp, Artificial Sequence
  chemically synthesized
taaagataatataaatgaac

SEQ ID NO: 65374 - DNA, 20 bp, Artificial Sequence
  chemically synthesized
ataggcaacccaaataatca

SEQ ID NO: 65375 - DNA, 20 bp, Artificial Sequence
  chemically synthesized
aacaggtcactatgattatt

SEQ ID NO: 65376 - DNA, 20 bp, Artificial Sequence
  chemically synthesized
acaggtcactatgattattt

SEQ ID NO: 65377 - DNA, 20 bp, Artificial Sequence
  chemically synthesized
gattatttgggttgcctatt

SEQ ID NO: 65378 - DNA, 20 bp, Artificial Sequence
  chemically synthesized
ccctattttcttgtctaaat

SEQ ID NO: 65379 - DNA, 20 bp, Artificial Sequence
  chemically synthesized
tttgggttgcctatttagac

SEQ ID NO: 65380 - DNA, 20 bp, Artificial Sequence
  chemically synthesized
gccctattttcttgtctaaa

SEQ ID NO: 65381 - DNA, 20 bp, Artificial Sequence
  chemically synthesized
tgcctatttagacaagaaaa

SEQ ID NO: 65382 - DNA, 20 bp, Artificial Sequence
  chemically synthesized
gcctatttagacaagaaaat

SEQ ID NO: 65383 - DNA, 20 bp, Artificial Sequence
  chemically synthesized
cctatttagacaagaaaata

SEQ ID NO: 65384 - DNA, 20 bp, Artificial Sequence
  chemically synthesized
aattgtactaggaggcatga

SEQ ID NO: 65385 - DNA, 20 bp, Artificial Sequence
  chemically synthesized
ccaattgtactaggaggcat

SEQ ID NO: 65386 - DNA, 20 bp, Artificial Sequence
  chemically synthesized
cgataatctctcatgcctcc

SEQ ID NO: 65387 - DNA, 20 bp, Artificial Sequence
  chemically synthesized
tcttttccaattgtactagg

SEQ ID NO: 65388 - DNA, 20 bp, Artificial Sequence
  chemically synthesized
ttcttttccaattgtactag

SEQ ID NO: 65389 - DNA, 20 bp, Artificial Sequence
  chemically synthesized
ttttcttttccaattgtact

SEQ ID NO: 65390 - DNA, 20 bp, Artificial Sequence
  chemically synthesized
ctcatgcctcctagtacaat

SEQ ID NO: 65391 - DNA, 20 bp, Artificial Sequence
  chemically synthesized
gttttcttttccaattgtac

SEQ ID NO: 65392 - DNA, 20 bp, Artificial Sequence
  chemically synthesized
gcctcctagtacaattggaa

SEQ ID NO: 65393 - DNA, 20 bp, Artificial Sequence
  chemically synthesized
ttggaaaagaaaactaatgc

SEQ ID NO: 65394 - DNA, 20 bp, Artificial Sequence
  chemically synthesized
tttcctagtgatactagcat

SEQ ID NO: 65395 - DNA, 20 bp, Artificial Sequence
  chemically synthesized
aaaactaatgctagtatcac

SEQ ID NO: 65396 - DNA, 20 bp, Artificial Sequence
  chemically synthesized
atgtcttttcctagtgatac

SEQ ID NO: 65397 - DNA, 20 bp, Artificial Sequence
  chemically synthesized
aaactaatgctagtatcact

SEQ ID NO: 65398 - DNA, 20 bp, Artificial Sequence
  chemically synthesized
aatgctagtatcactaggaa

SEQ ID NO: 65399 - DNA, 20 bp, Artificial Sequence
  chemically synthesized
aattcttctatgtcttttcc

SEQ ID NO: 65400 - DNA, 20 bp, Artificial Sequence
  chemically synthesized
agtatcactaggaaaagaca

SEQ ID NO: 65401 - DNA, 20 bp, Artificial Sequence
  chemically synthesized
atcactaggaaaagacatag

SEQ ID NO: 65402 - DNA, 20 bp, Artificial Sequence
  chemically synthesized
agacatagaagaattacttt

SEQ ID NO: 65403 - DNA, 20 bp, Artificial Sequence
  chemically synthesized
ttattttttgatgattctaa

SEQ ID NO: 65404 - DNA, 20 bp, Artificial Sequence
  chemically synthesized
ttttagaatcatcaaaaaat

SEQ ID NO: 65405 - DNA, 20 bp, Artificial Sequence
  chemically synthesized
tcatcaaaaaataagtttga

SEQ ID NO: 65406 - DNA, 20 bp, Artificial Sequence
  chemically synthesized
agtttgaaagcttttgcaaa

SEQ ID NO: 65407 - DNA, 20 bp, Artificial Sequence
  chemically synthesized
cacttctgtgctttttgcaa

SEQ ID NO: 65408 - DNA, 20 bp, Artificial Sequence
  chemically synthesized
gaaagcttttgcaaaaagca

SEQ ID NO: 65409 - DNA, 20 bp, Artificial Sequence
  chemically synthesized
agcttttgcaaaaagcacag

SEQ ID NO: 65410 - DNA, 20 bp, Artificial Sequence
  chemically synthesized
gcacagaagtgaatgttttg

SEQ ID NO: 65411 - DNA, 20 bp, Artificial Sequence
  chemically synthesized
tttgaagcaaatgaaactaa

SEQ ID NO: 65412 - DNA, 20 bp, Artificial Sequence
  chemically synthesized
ttgaagcaaatgaaactaat

SEQ ID NO: 65413 - DNA, 20 bp, Artificial Sequence
  chemically synthesized
tgtctcattataattcccat

SEQ ID NO: 65414 - DNA, 20 bp, Artificial Sequence
  chemically synthesized
aaactaatgggaattataat

SEQ ID NO: 65415 - DNA, 20 bp, Artificial Sequence
  chemically synthesized
gggaattataatgagacaca

SEQ ID NO: 65416 - DNA, 20 bp, Artificial Sequence
  chemically synthesized
aattataatgagacacatag

SEQ ID NO: 65417 - DNA, 20 bp, Artificial Sequence
  chemically synthesized
tgacacattacaagagaggc

SEQ ID NO: 65418 - DNA, 20 bp, Artificial Sequence
  chemically synthesized
tctctgacacattacaagag

SEQ ID NO: 65419 - DNA, 20 bp, Artificial Sequence
  chemically synthesized
ttctctgacacattacaaga

SEQ ID NO: 65420 - DNA, 20 bp, Artificial Sequence
  chemically synthesized
tgttctctgacacattacaa

SEQ ID NO: 65421 - DNA, 20 bp, Artificial Sequence
  chemically synthesized
cttgttctctgacacattac

SEQ ID NO: 65422 - DNA, 20 bp, Artificial Sequence
  chemically synthesized
ttgcctctcttgtaatgtgt

SEQ ID NO: 65423 - DNA, 20 bp, Artificial Sequence
  chemically synthesized
gcctctcttgtaatgtgtca

SEQ ID NO: 65424 - DNA, 20 bp, Artificial Sequence
  chemically synthesized
cttgtaatgtgtcagagaac

SEQ ID NO: 65425 - DNA, 20 bp, Artificial Sequence
  chemically synthesized
caaagcgtgttaaaatagca

SEQ ID NO: 65426 - DNA, 20 bp, Artificial Sequence
  chemically synthesized
acaaagcgtgttaaaatagc

SEQ ID NO: 65427 - DNA, 20 bp, Artificial Sequence
  chemically synthesized
gacaaagcgtgttaaaatag

SEQ ID NO: 65428 - DNA, 20 bp, Artificial Sequence
  chemically synthesized
atagacaaagcgtgttaaaa

SEQ ID NO: 65429 - DNA, 20 bp, Artificial Sequence
  chemically synthesized
gtgttggcaccgtatagaca

SEQ ID NO: 65430 - DNA, 20 bp, Artificial Sequence
  chemically synthesized
tttaacacgctttgtctata

SEQ ID NO: 65431 - DNA, 20 bp, Artificial Sequence
  chemically synthesized
agttcagtgttggcaccgta

SEQ ID NO: 65432 - DNA, 20 bp, Artificial Sequence
  chemically synthesized
cttcgtgtcaagttcagtgt

SEQ ID NO: 65433 - DNA, 20 bp, Artificial Sequence
  chemically synthesized
tcttctcttcgtgtcaagtt

SEQ ID NO: 65434 - DNA, 20 bp, Artificial Sequence
  chemically synthesized
ccaacactgaacttgacacg

SEQ ID NO: 65435 - DNA, 20 bp, Artificial Sequence
  chemically synthesized
gactttcttctcttcgtgtc

SEQ ID NO: 65436 - DNA, 20 bp, Artificial Sequence
  chemically synthesized
aacactgaacttgacacgaa

SEQ ID NO: 65437 - DNA, 20 bp, Artificial Sequence
  chemically synthesized
actgaacttgacacgaagag

SEQ ID NO: 65438 - DNA, 20 bp, Artificial Sequence
  chemically synthesized
aacttgacacgaagagaaga

SEQ ID NO: 65439 - DNA, 20 bp, Artificial Sequence
  chemically synthesized
agaagaaagtcctttctgat

SEQ ID NO: 65440 - DNA, 20 bp, Artificial Sequence
  chemically synthesized
actacatgctctcatcagaa

SEQ ID NO: 65441 - DNA, 20 bp, Artificial Sequence
  chemically synthesized
tactacatgctctcatcaga

SEQ ID NO: 65442 - DNA, 20 bp, Artificial Sequence
  chemically synthesized
aagaaagtcctttctgatga

SEQ ID NO: 65443 - DNA, 20 bp, Artificial Sequence
  chemically synthesized
cagatactacatgctctcat

SEQ ID NO: 65444 - DNA, 20 bp, Artificial Sequence
  chemically synthesized
tcctttctgatgagagcatg

SEQ ID NO: 65445 - DNA, 20 bp, Artificial Sequence
  chemically synthesized
tgatgagagcatgtagtatc

SEQ ID NO: 65446 - DNA, 20 bp, Artificial Sequence
  chemically synthesized
acatagtctagaaacagatc

SEQ ID NO: 65447 - DNA, 20 bp, Artificial Sequence
  chemically synthesized
gtagtatctggatctgtttc

SEQ ID NO: 65448 - DNA, 20 bp, Artificial Sequence
  chemically synthesized
tgaatcacatagtctagaaa

SEQ ID NO: 65449 - DNA, 20 bp, Artificial Sequence
  chemically synthesized
ttaaaatgaatcacatagtc

SEQ ID NO: 65450 - DNA, 20 bp, Artificial Sequence
  chemically synthesized
aatctttaaaatgaatcaca

SEQ ID NO: 65451 - DNA, 20 bp, Artificial Sequence
  chemically synthesized
agactatgtgattcatttta

SEQ ID NO: 65452 - DNA, 20 bp, Artificial Sequence
  chemically synthesized
gattcattttaaagatttct

SEQ ID NO: 65453 - DNA, 20 bp, Artificial Sequence
  chemically synthesized
attcattttaaagatttcta

SEQ ID NO: 65454 - DNA, 20 bp, Artificial Sequence
  chemically synthesized
attttaaagatttctaagga

SEQ ID NO: 65455 - DNA, 20 bp, Artificial Sequence
  chemically synthesized
ttttaaagatttctaaggaa

SEQ ID NO: 65456 - DNA, 20 bp, Artificial Sequence
  chemically synthesized
atctagatgtgtcctttcct

SEQ ID NO: 65457 - DNA, 20 bp, Artificial Sequence
  chemically synthesized
ttctaaggaaaggacacatc

SEQ ID NO: 65458 - DNA, 20 bp, Artificial Sequence
  chemically synthesized
atttaacgtcatagatgatc

SEQ ID NO: 65459 - DNA, 20 bp, Artificial Sequence
  chemically synthesized
gaacagcggatttaacgtca

SEQ ID NO: 65460 - DNA, 20 bp, Artificial Sequence
  chemically synthesized
ttgatattatttcagaacag

SEQ ID NO: 65461 - DNA, 20 bp, Artificial Sequence
  chemically synthesized
ttattgatattatttcagaa

SEQ ID NO: 65462 - DNA, 20 bp, Artificial Sequence
  chemically synthesized
ttgtattattgatattattt

SEQ ID NO: 65463 - DNA, 20 bp, Artificial Sequence
  chemically synthesized
ttttttcacatacataaaat

SEQ ID NO: 65464 - DNA, 20 bp, Artificial Sequence
  chemically synthesized
tgaatatgagtttatataag

SEQ ID NO: 65465 - DNA, 20 bp, Artificial Sequence
  chemically synthesized
gaatgaatatgagtttatat

SEQ ID NO: 65466 - DNA, 20 bp, Artificial Sequence
  chemically synthesized
tttgtttctcgaatgaatat

SEQ ID NO: 65467 - DNA, 20 bp, Artificial Sequence
  chemically synthesized
atataaactcatattcattc

SEQ ID NO: 65468 - DNA, 20 bp, Artificial Sequence
  chemically synthesized
attcgagaaacaaatactcc

SEQ ID NO: 65469 - DNA, 20 bp, Artificial Sequence
  chemically synthesized
gagaaacaaatactccaagt

SEQ ID NO: 65470 - DNA, 20 bp, Artificial Sequence
  chemically synthesized
actccttgatatccaacttg

SEQ ID NO: 65471 - DNA, 20 bp, Artificial Sequence
  chemically synthesized
aaactccttgatatccaact

SEQ ID NO: 65472 - DNA, 20 bp, Artificial Sequence
  chemically synthesized
aatactccaagttggatatc

SEQ ID NO: 65473 - DNA, 20 bp, Artificial Sequence
  chemically synthesized
atactccaagttggatatca

SEQ ID NO: 65474 - DNA, 20 bp, Artificial Sequence
  chemically synthesized
actccaagttggatatcaag

SEQ ID NO: 65475 - DNA, 20 bp, Artificial Sequence
  chemically synthesized
gatatcaaggagtttccttt

SEQ ID NO: 65476 - DNA, 20 bp, Artificial Sequence
  chemically synthesized
ctgaacaaaggataactgaa

SEQ ID NO: 65477 - DNA, 20 bp, Artificial Sequence
  chemically synthesized
actgaacaaaggataactga

SEQ ID NO: 65478 - DNA, 20 bp, Artificial Sequence
  chemically synthesized
cctttcagttatcctttgtt

SEQ ID NO: 65479 - DNA, 20 bp, Artificial Sequence
  chemically synthesized
catttatatccactgaacaa

SEQ ID NO: 65480 - DNA, 20 bp, Artificial Sequence
  chemically synthesized
ttcagttatcctttgttcag

SEQ ID NO: 65481 - DNA, 20 bp, Artificial Sequence
  chemically synthesized
gcatttatatccactgaaca

SEQ ID NO: 65482 - DNA, 20 bp, Artificial Sequence
  chemically synthesized
gtacccagtattaaggagca

SEQ ID NO: 65483 - DNA, 20 bp, Artificial Sequence
  chemically synthesized
tttttgtacccagtattaag

SEQ ID NO: 65484 - DNA, 20 bp, Artificial Sequence
  chemically synthesized
aatgctgtgctccttaatac

SEQ ID NO: 65485 - DNA, 20 bp, Artificial Sequence
  chemically synthesized
atgctgtgctccttaatact

SEQ ID NO: 65486 - DNA, 20 bp, Artificial Sequence
  chemically synthesized
tctttttgtacccagtatta

SEQ ID NO: 65487 - DNA, 20 bp, Artificial Sequence
  chemically synthesized
ttctttttgtacccagtatt

SEQ ID NO: 65488 - DNA, 20 bp, Artificial Sequence
  chemically synthesized
cttatttttctttttgtacc

SEQ ID NO: 65489 - DNA, 20 bp, Artificial Sequence
  chemically synthesized
tccttaatactgggtacaaa

SEQ ID NO: 65490 - DNA, 20 bp, Artificial Sequence
  chemically synthesized
ctgggtacaaaaagaaaaat

SEQ ID NO: 65491 - DNA, 20 bp, Artificial Sequence
  chemically synthesized
aaaaagaaaaataagtttat

SEQ ID NO: 65492 - DNA, 20 bp, Artificial Sequence
  chemically synthesized
tagcttctcatttttttcag

SEQ ID NO: 65493 - DNA, 20 bp, Artificial Sequence
  chemically synthesized
caatagcttctcattttttt

SEQ ID NO: 65494 - DNA, 20 bp, Artificial Sequence
  chemically synthesized
aatacacttctgaaaaaaat

SEQ ID NO: 65495 - DNA, 20 bp, Artificial Sequence
  chemically synthesized
acacttctgaaaaaaatgag

SEQ ID NO: 65496 - DNA, 20 bp, Artificial Sequence
  chemically synthesized
aaatgagaagctattgaaat

SEQ ID NO: 65497 - DNA, 20 bp, Artificial Sequence
  chemically synthesized
tttagttgacctcatttcaa

SEQ ID NO: 65498 - DNA, 20 bp, Artificial Sequence
  chemically synthesized
aatgagaagctattgaaatg

SEQ ID NO: 65499 - DNA, 20 bp, Artificial Sequence
  chemically synthesized
ttgaaatgaggtcaactaaa

SEQ ID NO: 65500 - DNA, 20 bp, Artificial Sequence
  chemically synthesized
cctacaaatagatttctgtt

SEQ ID NO: 65501 - DNA, 20 bp, Artificial Sequence
  chemically synthesized
actaaacagaaatctatttg

SEQ ID NO: 65502 - DNA, 20 bp, Artificial Sequence
  chemically synthesized
ctaaacagaaatctatttgt

SEQ ID NO: 65503 - DNA, 20 bp, Artificial Sequence
  chemically synthesized
taaacagaaatctatttgta

SEQ ID NO: 65504 - DNA, 20 bp, Artificial Sequence
  chemically synthesized
ggtgttttaaaccctacaaa

SEQ ID NO: 65505 - DNA, 20 bp, Artificial Sequence
  chemically synthesized
gggtttaaaacaccatgaat

SEQ ID NO: 65506 - DNA, 20 bp, Artificial Sequence
  chemically synthesized
acaaaagatgatctcattca

SEQ ID NO: 65507 - DNA, 20 bp, Artificial Sequence
  chemically synthesized
aaggatagatggaatcacaa

SEQ ID NO: 65508 - DNA, 20 bp, Artificial Sequence
  chemically synthesized
ttgagaaatgcaaggataga

SEQ ID NO: 65509 - DNA, 20 bp, Artificial Sequence
  chemically synthesized
gaatttgagaaatgcaagga

SEQ ID NO: 65510 - DNA, 20 bp, Artificial Sequence
  chemically synthesized
aatagaatttgagaaatgca

SEQ ID NO: 65511 - DNA, 20 bp, Artificial Sequence
  chemically synthesized
aaatagaatttgagaaatgc

SEQ ID NO: 65512 - DNA, 20 bp, Artificial Sequence
  chemically synthesized
gtgatttcaaaatagaattt

SEQ ID NO: 65513 - DNA, 20 bp, Artificial Sequence
  chemically synthesized
cataggcagtgatttcaaaa

SEQ ID NO: 65514 - DNA, 20 bp, Artificial Sequence
  chemically synthesized
ttttaggcaatgaacatagg

SEQ ID NO: 65515 - DNA, 20 bp, Artificial Sequence
  chemically synthesized
ctattttaggcaatgaacat

SEQ ID NO: 65516 - DNA, 20 bp, Artificial Sequence
  chemically synthesized
gctattttaggcaatgaaca

SEQ ID NO: 65517 - DNA, 20 bp, Artificial Sequence
  chemically synthesized
cctatgttcattgcctaaaa

SEQ ID NO: 65518 - DNA, 20 bp, Artificial Sequence
  chemically synthesized
atcaaaggaaaagctatttt

SEQ ID NO: 65519 - DNA, 20 bp, Artificial Sequence
  chemically synthesized
aatcaaaggaaaagctattt

SEQ ID NO: 65520 - DNA, 20 bp, Artificial Sequence
  chemically synthesized
tcatctaagaatcaaaggaa

SEQ ID NO: 65521 - DNA, 20 bp, Artificial Sequence
  chemically synthesized
taagatcatctaagaatcaa

SEQ ID NO: 65522 - DNA, 20 bp, Artificial Sequence
  chemically synthesized
atagcttttcctttgattct

SEQ ID NO: 65523 - DNA, 20 bp, Artificial Sequence
  chemically synthesized
ataagatcatctaagaatca

SEQ ID NO: 65524 - DNA, 20 bp, Artificial Sequence
  chemically synthesized
tcattttcataagatcatct

SEQ ID NO: 65525 - DNA, 20 bp, Artificial Sequence
  chemically synthesized
atatatattttcattttcat

SEQ ID NO: 65526 - DNA, 20 bp, Artificial Sequence
  chemically synthesized
atgaaaatgaaaatatatat

SEQ ID NO: 65527 - DNA, 20 bp, Artificial Sequence
  chemically synthesized
tgaaaatgaaaatatatata

SEQ ID NO: 65528 - DNA, 20 bp, Artificial Sequence
  chemically synthesized
atatataaggctattttgca

SEQ ID NO: 65529 - DNA, 20 bp, Artificial Sequence
  chemically synthesized
ctaatcatttctatgcaaaa

SEQ ID NO: 65530 - DNA, 20 bp, Artificial Sequence
  chemically synthesized
ctattttgcatagaaatgat

SEQ ID NO: 65531 - DNA, 20 bp, Artificial Sequence
  chemically synthesized
tgcatagaaatgattagaca

SEQ ID NO: 65532 - DNA, 20 bp, Artificial Sequence
  chemically synthesized
agataaatatttacaccaaa

SEQ ID NO: 65533 - DNA, 20 bp, Artificial Sequence
  chemically synthesized
aatatttacaccaaacagtt

SEQ ID NO: 65534 - DNA, 20 bp, Artificial Sequence
  chemically synthesized
tccccactccctaaactgtt

SEQ ID NO: 65535 - DNA, 20 bp, Artificial Sequence
  chemically synthesized
atatttacaccaaacagttt

SEQ ID NO: 65536 - DNA, 20 bp, Artificial Sequence
  chemically synthesized
tatttacaccaaacagttta

SEQ ID NO: 65537 - DNA, 20 bp, Artificial Sequence
  chemically synthesized
tttacaccaaacagtttagg

SEQ ID NO: 65538 - DNA, 20 bp, Artificial Sequence
  chemically synthesized
acaccaaacagtttagggag

SEQ ID NO: 65539 - DNA, 20 bp, Artificial Sequence
  chemically synthesized
caccaaacagtttagggagt

SEQ ID NO: 65540 - DNA, 20 bp, Artificial Sequence
  chemically synthesized
accaaacagtttagggagtg

SEQ ID NO: 65541 - DNA, 20 bp, Artificial Sequence
  chemically synthesized
acagtttagggagtggggac

SEQ ID NO: 65542 - DNA, 20 bp, Artificial Sequence
  chemically synthesized
ggagtggggactagttattt

SEQ ID NO: 65543 - DNA, 20 bp, Artificial Sequence
  chemically synthesized
tgtataatctctgaaataac

SEQ ID NO: 65544 - DNA, 20 bp, Artificial Sequence
  chemically synthesized
agtggggactagttatttca

SEQ ID NO: 65545 - DNA, 20 bp, Artificial Sequence
  chemically synthesized
agattatacaatgaaaattt

SEQ ID NO: 65546 - DNA, 20 bp, Artificial Sequence
  chemically synthesized
ataaaataatatgtttaaat

SEQ ID NO: 65547 - DNA, 20 bp, Artificial Sequence
  chemically synthesized
aaacatattattttatatgc

SEQ ID NO: 65548 - DNA, 20 bp, Artificial Sequence
  chemically synthesized
tattattttatatgccagtt

SEQ ID NO: 65549 - DNA, 20 bp, Artificial Sequence
  chemically synthesized
attattttatatgccagttt

SEQ ID NO: 65550 - DNA, 20 bp, Artificial Sequence
  chemically synthesized
acttattcatcatcctaaac

SEQ ID NO: 65551 - DNA, 20 bp, Artificial Sequence
  chemically synthesized
gccagtttaggatgatgaat

SEQ ID NO: 65552 - DNA, 20 bp, Artificial Sequence
  chemically synthesized
taggaagggagggagaaatt

SEQ ID NO: 65553 - DNA, 20 bp, Artificial Sequence
  chemically synthesized
gctgggggtaggaagggagg

SEQ ID NO: 65554 - DNA, 20 bp, Artificial Sequence
  chemically synthesized
aggctgggggtaggaaggga

SEQ ID NO: 65555 - DNA, 20 bp, Artificial Sequence
  chemically synthesized
aaggctgggggtaggaaggg

SEQ ID NO: 65556 - DNA, 20 bp, Artificial Sequence
  chemically synthesized
gaaggctgggggtaggaagg

SEQ ID NO: 65557 - DNA, 20 bp, Artificial Sequence
  chemically synthesized
aagaaggctgggggtaggaa

SEQ ID NO: 65558 - DNA, 20 bp, Artificial Sequence
  chemically synthesized
gaagaaggctgggggtagga

SEQ ID NO: 65559 - DNA, 20 bp, Artificial Sequence
  chemically synthesized
tgaagaaggctgggggtagg

SEQ ID NO: 65560 - DNA, 20 bp, Artificial Sequence
  chemically synthesized
tctccctcccttcctacccc

SEQ ID NO: 65561 - DNA, 20 bp, Artificial Sequence
  chemically synthesized
aagtgaagaaggctgggggt

SEQ ID NO: 65562 - DNA, 20 bp, Artificial Sequence
  chemically synthesized
gaagtgaagaaggctggggg

SEQ ID NO: 65563 - DNA, 20 bp, Artificial Sequence
  chemically synthesized
aaagaagtgaagaaggctgg

SEQ ID NO: 65564 - DNA, 20 bp, Artificial Sequence
  chemically synthesized
gaaagaagtgaagaaggctg

SEQ ID NO: 65565 - DNA, 20 bp, Artificial Sequence
  chemically synthesized
ggaaagaagtgaagaaggct

SEQ ID NO: 65566 - DNA, 20 bp, Artificial Sequence
  chemically synthesized
aggaaagaagtgaagaaggc

SEQ ID NO: 65567 - DNA, 20 bp, Artificial Sequence
  chemically synthesized
aaggaggaaagaagtgaaga

SEQ ID NO: 65568 - DNA, 20 bp, Artificial Sequence
  chemically synthesized
aaaggaggaaagaagtgaag

SEQ ID NO: 65569 - DNA, 20 bp, Artificial Sequence
  chemically synthesized
aataaaggaggaaagaagtg

SEQ ID NO: 65570 - DNA, 20 bp, Artificial Sequence
  chemically synthesized
gaaggaataaaggaggaaag

SEQ ID NO: 65571 - DNA, 20 bp, Artificial Sequence
  chemically synthesized
aatgaaggaataaaggagga

SEQ ID NO: 65572 - DNA, 20 bp, Artificial Sequence
  chemically synthesized
aagaaatgaaggaataaagg

SEQ ID NO: 65573 - DNA, 20 bp, Artificial Sequence
  chemically synthesized
aaagaaatgaaggaataaag

SEQ ID NO: 65574 - DNA, 20 bp, Artificial Sequence
  chemically synthesized
ataaagaaatgaaggaataa

SEQ ID NO: 65575 - DNA, 20 bp, Artificial Sequence
  chemically synthesized
aataaagaaatgaaggaata

SEQ ID NO: 65576 - DNA, 20 bp, Artificial Sequence
  chemically synthesized
gtatgtcaataaagaaatga

SEQ ID NO: 65577 - DNA, 20 bp, Artificial Sequence
  chemically synthesized
tgtatgtcaataaagaaatg

SEQ ID NO: 65578 - DNA, 20 bp, Artificial Sequence
  chemically synthesized
actacgtatgtatgtcaata

SEQ ID NO: 65579 - DNA, 20 bp, Artificial Sequence
  chemically synthesized
tctttattgacatacatacg

SEQ ID NO: 65580 - DNA, 20 bp, Artificial Sequence
  chemically synthesized
gggttactttagaagatggg

SEQ ID NO: 65581 - DNA, 20 bp, Artificial Sequence
  chemically synthesized
ggggttactttagaagatgg

SEQ ID NO: 65582 - DNA, 20 bp, Artificial Sequence
  chemically synthesized
tggggttactttagaagatg

SEQ ID NO: 65583 - DNA, 20 bp, Artificial Sequence
  chemically synthesized
atggggttactttagaagat

SEQ ID NO: 65584 - DNA, 20 bp, Artificial Sequence
  chemically synthesized
tgtacaccccccatcttcta

SEQ ID NO: 65585 - DNA, 20 bp, Artificial Sequence
  chemically synthesized
catggggttactttagaaga

SEQ ID NO: 65586 - DNA, 20 bp, Artificial Sequence
  chemically synthesized
ttcccatggggttactttag

SEQ ID NO: 65587 - DNA, 20 bp, Artificial Sequence
  chemically synthesized
ttcttcccatggggttactt

SEQ ID NO: 65588 - DNA, 20 bp, Artificial Sequence
  chemically synthesized
catcttctaaagtaacccca

SEQ ID NO: 65589 - DNA, 20 bp, Artificial Sequence
  chemically synthesized
atcttctaaagtaaccccat

SEQ ID NO: 65590 - DNA, 20 bp, Artificial Sequence
  chemically synthesized
ttctaaagtaaccccatggg

SEQ ID NO: 65591 - DNA, 20 bp, Artificial Sequence
  chemically synthesized
cctgagcgtttcttcccatg

SEQ ID NO: 65592 - DNA, 20 bp, Artificial Sequence
  chemically synthesized
acctgagcgtttcttcccat

SEQ ID NO: 65593 - DNA, 20 bp, Artificial Sequence
  chemically synthesized
cacctgagcgtttcttccca

SEQ ID NO: 65594 - DNA, 20 bp, Artificial Sequence
  chemically synthesized
accccatgggaagaaacgct

SEQ ID NO: 65595 - DNA, 20 bp, Artificial Sequence
  chemically synthesized
ccccatgggaagaaacgctc

SEQ ID NO: 65596 - DNA, 20 bp, Artificial Sequence
  chemically synthesized
catgggaagaaacgctcagg

SEQ ID NO: 65597 - DNA, 20 bp, Artificial Sequence
  chemically synthesized
tttttttaatataaccacct

SEQ ID NO: 65598 - DNA, 20 bp, Artificial Sequence
  chemically synthesized
gtggttatattaaaaaaatc

SEQ ID NO: 65599 - DNA, 20 bp, Artificial Sequence
  chemically synthesized
tggttatattaaaaaaatcg

SEQ ID NO: 65600 - DNA, 20 bp, Artificial Sequence
  chemically synthesized
ggttatattaaaaaaatcga

SEQ ID NO: 65601 - DNA, 20 bp, Artificial Sequence
  chemically synthesized
aatcgagggtatgaaaatct

SEQ ID NO: 65602 - DNA, 20 bp, Artificial Sequence
  chemically synthesized
atcgagggtatgaaaatctc

SEQ ID NO: 65603 - DNA, 20 bp, Artificial Sequence
  chemically synthesized
tcgagggtatgaaaatctca

SEQ ID NO: 65604 - DNA, 20 bp, Artificial Sequence
  chemically synthesized
gtgtttgggcatacgaccct

SEQ ID NO: 65605 - DNA, 20 bp, Artificial Sequence
  chemically synthesized
tttatatcgcattggtgttt

SEQ ID NO: 65606 - DNA, 20 bp, Artificial Sequence
  chemically synthesized
ttttatatcgcattggtgtt

SEQ ID NO: 65607 - DNA, 20 bp, Artificial Sequence
  chemically synthesized
ccttaatttttatatcgcat

SEQ ID NO: 65608 - DNA, 20 bp, Artificial Sequence
  chemically synthesized
accaatgcgatataaaaatt

SEQ ID NO: 65609 - DNA, 20 bp, Artificial Sequence
  chemically synthesized
ccaatgcgatataaaaatta

SEQ ID NO: 65610 - DNA, 20 bp, Artificial Sequence
  chemically synthesized
tttttatgtgtgaatgaatt

SEQ ID NO: 65611 - DNA, 20 bp, Artificial Sequence
  chemically synthesized
ttatgtgtgaatgaatttgg

SEQ ID NO: 65612 - DNA, 20 bp, Artificial Sequence
  chemically synthesized
gaaagtctggagtgtatgaa

SEQ ID NO: 65613 - DNA, 20 bp, Artificial Sequence
  chemically synthesized
agaaagtctggagtgtatga

SEQ ID NO: 65614 - DNA, 20 bp, Artificial Sequence
  chemically synthesized
gaaaaacctttcatacactc

SEQ ID NO: 65615 - DNA, 20 bp, Artificial Sequence
  chemically synthesized
tacaaaacacagaaagtctg

SEQ ID NO: 65616 - DNA, 20 bp, Artificial Sequence
  chemically synthesized
gctacaaaacacagaaagtc

SEQ ID NO: 65617 - DNA, 20 bp, Artificial Sequence
  chemically synthesized
ctgtggctacaaaacacaga

SEQ ID NO: 65618 - DNA, 20 bp, Artificial Sequence
  chemically synthesized
tccagactttctgtgttttg

SEQ ID NO: 65619 - DNA, 20 bp, Artificial Sequence
  chemically synthesized
aaggctgtggctacaaaaca

SEQ ID NO: 65620 - DNA, 20 bp, Artificial Sequence
  chemically synthesized
ctttctgtgttttgtagcca

SEQ ID NO: 65621 - DNA, 20 bp, Artificial Sequence
  chemically synthesized
agagttgcaaatgaaggctg

SEQ ID NO: 65622 - DNA, 20 bp, Artificial Sequence
  chemically synthesized
catgtcagagttgcaaatga

SEQ ID NO: 65623 - DNA, 20 bp, Artificial Sequence
  chemically synthesized
ccatgtcagagttgcaaatg

SEQ ID NO: 65624 - DNA, 20 bp, Artificial Sequence
  chemically synthesized
cttcatttgcaactctgaca

SEQ ID NO: 65625 - DNA, 20 bp, Artificial Sequence
  chemically synthesized
aacagcagcttgccatgtca

SEQ ID NO: 65626 - DNA, 20 bp, Artificial Sequence
  chemically synthesized
atttgcaactctgacatggc

SEQ ID NO: 65627 - DNA, 20 bp, Artificial Sequence
  chemically synthesized
aaaacagcagcttgccatgt

SEQ ID NO: 65628 - DNA, 20 bp, Artificial Sequence
  chemically synthesized
aaatgaaatctagaaaacag

SEQ ID NO: 65629 - DNA, 20 bp, Artificial Sequence
  chemically synthesized
catggcaagctgctgttttc

SEQ ID NO: 65630 - DNA, 20 bp, Artificial Sequence
  chemically synthesized
cacaaatgaaatctagaaaa

SEQ ID NO: 65631 - DNA, 20 bp, Artificial Sequence
  chemically synthesized
gcgcccacacaaatgaaatc

SEQ ID NO: 65632 - DNA, 20 bp, Artificial Sequence
  chemically synthesized
ttttctagatttcatttgtg

SEQ ID NO: 65633 - DNA, 20 bp, Artificial Sequence
  chemically synthesized
tttctagatttcatttgtgt

SEQ ID NO: 65634 - DNA, 20 bp, Artificial Sequence
  chemically synthesized
aatatatattggtgtgcagc

SEQ ID NO: 65635 - DNA, 20 bp, Artificial Sequence
  chemically synthesized
aaatatatattggtgtgcag

SEQ ID NO: 65636 - DNA, 20 bp, Artificial Sequence
  chemically synthesized
agaaaatatatattggtgtg

SEQ ID NO: 65637 - DNA, 20 bp, Artificial Sequence
  chemically synthesized
tgtaaagagaaaatatatat

SEQ ID NO: 65638 - DNA, 20 bp, Artificial Sequence
  chemically synthesized
acatggtggatggttgtaaa

SEQ ID NO: 65639 - DNA, 20 bp, Artificial Sequence
  chemically synthesized
ccacatggtggatggttgta

SEQ ID NO: 65640 - DNA, 20 bp, Artificial Sequence
  chemically synthesized
aaatgcatccacatggtgga

SEQ ID NO: 65641 - DNA, 20 bp, Artificial Sequence
  chemically synthesized
ctttacaaccatccaccatg

SEQ ID NO: 65642 - DNA, 20 bp, Artificial Sequence
  chemically synthesized
aaagaaatgcatccacatgg

SEQ ID NO: 65643 - DNA, 20 bp, Artificial Sequence
  chemically synthesized
aataaagaaatgcatccaca

SEQ ID NO: 65644 - DNA, 20 bp, Artificial Sequence
  chemically synthesized
atgtggatgcatttctttat

SEQ ID NO: 65645 - DNA, 20 bp, Artificial Sequence
  chemically synthesized
agaatatatattgactaata

SEQ ID NO: 65646 - DNA, 20 bp, Artificial Sequence
  chemically synthesized
attagtcaatatatattctg

SEQ ID NO: 65647 - DNA, 20 bp, Artificial Sequence
  chemically synthesized
ttagtcaatatatattctgt

SEQ ID NO: 65648 - DNA, 20 bp, Artificial Sequence
  chemically synthesized
aatttgcagaatgtaaccta

SEQ ID NO: 65649 - DNA, 20 bp, Artificial Sequence
  chemically synthesized
tttgtccatgttcaaatttg

SEQ ID NO: 65650 - DNA, 20 bp, Artificial Sequence
  chemically synthesized
acattctgcaaatttgaaca

SEQ ID NO: 65651 - DNA, 20 bp, Artificial Sequence
  chemically synthesized
aagacatctgtgcagtgtta

SEQ ID NO: 65652 - DNA, 20 bp, Artificial Sequence
  chemically synthesized
atataatccataacactgca

SEQ ID NO: 65653 - DNA, 20 bp, Artificial Sequence
  chemically synthesized
atctctccaagacatctgtg

SEQ ID NO: 65654 - DNA, 20 bp, Artificial Sequence
  chemically synthesized
ataacactgcacagatgtct

SEQ ID NO: 65655 - DNA, 20 bp, Artificial Sequence
  chemically synthesized
aacactgcacagatgtcttg

SEQ ID NO: 65656 - DNA, 20 bp, Artificial Sequence
  chemically synthesized
cactgcacagatgtcttgga

SEQ ID NO: 65657 - DNA, 20 bp, Artificial Sequence
  chemically synthesized
atgatttctgcaatctctcc

SEQ ID NO: 65658 - DNA, 20 bp, Artificial Sequence
  chemically synthesized
cagatgtcttggagagattg

SEQ ID NO: 65659 - DNA, 20 bp, Artificial Sequence
  chemically synthesized
agattgcagaaatcattcac

SEQ ID NO: 65660 - DNA, 20 bp, Artificial Sequence
  chemically synthesized
gattgcagaaatcattcacc

SEQ ID NO: 65661 - DNA, 20 bp, Artificial Sequence
  chemically synthesized
ttgcagaaatcattcaccag

SEQ ID NO: 65662 - DNA, 20 bp, Artificial Sequence
  chemically synthesized
tgcagaaatcattcaccagg

SEQ ID NO: 65663 - DNA, 20 bp, Artificial Sequence
  chemically synthesized
ttcttcgacattcagcctcc

SEQ ID NO: 65664 - DNA, 20 bp, Artificial Sequence
  chemically synthesized
caccaggaggctgaatgtcg

SEQ ID NO: 65665 - DNA, 20 bp, Artificial Sequence
  chemically synthesized
ttttataattcttcgacatt

SEQ ID NO: 65666 - DNA, 20 bp, Artificial Sequence
  chemically synthesized
aagaattataaaattgcatt

SEQ ID NO: 65667 - DNA, 20 bp, Artificial Sequence
  chemically synthesized
attataaaattgcatttaga

SEQ ID NO: 65668 - DNA, 20 bp, Artificial Sequence
  chemically synthesized
aaaattgcatttagatggac

SEQ ID NO: 65669 - DNA, 20 bp, Artificial Sequence
  chemically synthesized
ttgcatttagatggacaagt

SEQ ID NO: 65670 - DNA, 20 bp, Artificial Sequence
  chemically synthesized
tagatggacaagtcagaaaa

SEQ ID NO: 65671 - DNA, 20 bp, Artificial Sequence
  chemically synthesized
agatggacaagtcagaaaac

SEQ ID NO: 65672 - DNA, 20 bp, Artificial Sequence
  chemically synthesized
agtcagaaaacaggtttaaa

SEQ ID NO: 65673 - DNA, 20 bp, Artificial Sequence
  chemically synthesized
cagaaaacaggtttaaaaag

SEQ ID NO: 65674 - DNA, 20 bp, Artificial Sequence
  chemically synthesized
ttgtgatttcattatgacca

SEQ ID NO: 65675 - DNA, 20 bp, Artificial Sequence
  chemically synthesized
tttcattatgaccatggaat

SEQ ID NO: 65676 - DNA, 20 bp, Artificial Sequence
  chemically synthesized
ttcattatgaccatggaatg

SEQ ID NO: 65677 - DNA, 20 bp, Artificial Sequence
  chemically synthesized
tatgcttttacctcattcca

SEQ ID NO: 65678 - DNA, 20 bp, Artificial Sequence
  chemically synthesized
atgaccatggaatgaggtaa

SEQ ID NO: 65679 - DNA, 20 bp, Artificial Sequence
  chemically synthesized
atgaggtaaaagcataactg

SEQ ID NO: 65680 - DNA, 20 bp, Artificial Sequence
  chemically synthesized
ggtaaaagcataactgtagt

SEQ ID NO: 65681 - DNA, 20 bp, Artificial Sequence
  chemically synthesized
taagtgtaaattgctgacta

SEQ ID NO: 65682 - DNA, 20 bp, Artificial Sequence
  chemically synthesized
cagcaatttacacttaaata

SEQ ID NO: 65683 - DNA, 20 bp, Artificial Sequence
  chemically synthesized
cttttgcattttctgtattt

SEQ ID NO: 65684 - DNA, 20 bp, Artificial Sequence
  chemically synthesized
cttaaatacagaaaatgcaa

SEQ ID NO: 65685 - DNA, 20 bp, Artificial Sequence
  chemically synthesized
tgcaaaagacactatgtaca

SEQ ID NO: 65686 - DNA, 20 bp, Artificial Sequence
  chemically synthesized
gcaaaagacactatgtacat

SEQ ID NO: 65687 - DNA, 20 bp, Artificial Sequence
  chemically synthesized
ctcctttcctcctatgtaca

SEQ ID NO: 65688 - DNA, 20 bp, Artificial Sequence
  chemically synthesized
aaaagacactatgtacatag

SEQ ID NO: 65689 - DNA, 20 bp, Artificial Sequence
  chemically synthesized
aaagacactatgtacatagg

SEQ ID NO: 65690 - DNA, 20 bp, Artificial Sequence
  chemically synthesized
acactatgtacataggagga

SEQ ID NO: 65691 - DNA, 20 bp, Artificial Sequence
  chemically synthesized
cactatgtacataggaggaa

SEQ ID NO: 65692 - DNA, 20 bp, Artificial Sequence
  chemically synthesized
ctatgtacataggaggaaag

SEQ ID NO: 65693 - DNA, 20 bp, Artificial Sequence
  chemically synthesized
tatgtacataggaggaaagg

SEQ ID NO: 65694 - DNA, 20 bp, Artificial Sequence
  chemically synthesized
acataggaggaaaggaggta

SEQ ID NO: 65695 - DNA, 20 bp, Artificial Sequence
  chemically synthesized
aggaaaggaggtatggatgt

SEQ ID NO: 65696 - DNA, 20 bp, Artificial Sequence
  chemically synthesized
aaaggaggtatggatgtgag

SEQ ID NO: 65697 - DNA, 20 bp, Artificial Sequence
  chemically synthesized
ggtatggatgtgagaagaaa

SEQ ID NO: 65698 - DNA, 20 bp, Artificial Sequence
  chemically synthesized
gtatggatgtgagaagaaac

SEQ ID NO: 65699 - DNA, 20 bp, Artificial Sequence
  chemically synthesized
atggatgtgagaagaaacag

SEQ ID NO: 65700 - DNA, 20 bp, Artificial Sequence
  chemically synthesized
tggatgtgagaagaaacagg

SEQ ID NO: 65701 - DNA, 20 bp, Artificial Sequence
  chemically synthesized
ggatgtgagaagaaacagga

SEQ ID NO: 65702 - DNA, 20 bp, Artificial Sequence
  chemically synthesized
atgtgagaagaaacaggagg

SEQ ID NO: 65703 - DNA, 20 bp, Artificial Sequence
  chemically synthesized
tgagaagaaacaggagggag

SEQ ID NO: 65704 - DNA, 20 bp, Artificial Sequence
  chemically synthesized
tcatctgaagatcattcatt

SEQ ID NO: 65705 - DNA, 20 bp, Artificial Sequence
  chemically synthesized
ttcatctgaagatcattcat

SEQ ID NO: 65706 - DNA, 20 bp, Artificial Sequence
  chemically synthesized
gaagcctaatgaatgatctt

SEQ ID NO: 65707 - DNA, 20 bp, Artificial Sequence
  chemically synthesized
tcattgattcttttcatctg

SEQ ID NO: 65708 - DNA, 20 bp, Artificial Sequence
  chemically synthesized
atgaatgatcttcagatgaa

SEQ ID NO: 65709 - DNA, 20 bp, Artificial Sequence
  chemically synthesized
aagaatcaatgaaaaatatc

SEQ ID NO: 65710 - DNA, 20 bp, Artificial Sequence
  chemically synthesized
caatgaaaaatatccagctg

SEQ ID NO: 65711 - DNA, 20 bp, Artificial Sequence
  chemically synthesized
tgaaagcatttaaccacagc

SEQ ID NO: 65712 - DNA, 20 bp, Artificial Sequence
  chemically synthesized
aatttgaaagcatttaacca

SEQ ID NO: 65713 - DNA, 20 bp, Artificial Sequence
  chemically synthesized
ttgcataaatggcaatttga

SEQ ID NO: 65714 - DNA, 20 bp, Artificial Sequence
  chemically synthesized
ccatgcatcaattgcataaa

SEQ ID NO: 65715 - DNA, 20 bp, Artificial Sequence
  chemically synthesized
ccatttatgcaattgatgca

SEQ ID NO: 65716 - DNA, 20 bp, Artificial Sequence
  chemically synthesized
tatgcaattgatgcatggaa

SEQ ID NO: 65717 - DNA, 20 bp, Artificial Sequence
  chemically synthesized
atgcaattgatgcatggaat

SEQ ID NO: 65718 - DNA, 20 bp, Artificial Sequence
  chemically synthesized
tgcatggaataggtatttgt

SEQ ID NO: 65719 - DNA, 20 bp, Artificial Sequence
  chemically synthesized
ggaataggtatttgtcagtg

SEQ ID NO: 65720 - DNA, 20 bp, Artificial Sequence
  chemically synthesized
aataggtatttgtcagtgca

SEQ ID NO: 65721 - DNA, 20 bp, Artificial Sequence
  chemically synthesized
taggtatttgtcagtgcaga

SEQ ID NO: 65722 - DNA, 20 bp, Artificial Sequence
  chemically synthesized
gtcagtgcagagagtgcgaa

SEQ ID NO: 65723 - DNA, 20 bp, Artificial Sequence
  chemically synthesized
aacagaacattattatgaaa

SEQ ID NO: 65724 - DNA, 20 bp, Artificial Sequence
  chemically synthesized
cagaacattattatgaaaca

SEQ ID NO: 65725 - DNA, 20 bp, Artificial Sequence
  chemically synthesized
aacattattatgaaacagag

SEQ ID NO: 65726 - DNA, 20 bp, Artificial Sequence
  chemically synthesized
acattattatgaaacagagc

SEQ ID NO: 65727 - DNA, 20 bp, Artificial Sequence
  chemically synthesized
atgaaacagagcaggatcct

SEQ ID NO: 65728 - DNA, 20 bp, Artificial Sequence
  chemically synthesized
atttcattggtattttgcca

SEQ ID NO: 65729 - DNA, 20 bp, Artificial Sequence
  chemically synthesized
tatttcattggtattttgcc

SEQ ID NO: 65730 - DNA, 20 bp, Artificial Sequence
  chemically synthesized
tattgaaaactgtatttcat

SEQ ID NO: 65731 - DNA, 20 bp, Artificial Sequence
  chemically synthesized
ggcaaaataccaatgaaata

SEQ ID NO: 65732 - DNA, 20 bp, Artificial Sequence
  chemically synthesized
caatgaaatacagttttcaa

SEQ ID NO: 65733 - DNA, 20 bp, Artificial Sequence
  chemically synthesized
gaaatacagttttcaatagt

SEQ ID NO: 65734 - DNA, 20 bp, Artificial Sequence
  chemically synthesized
aaatacagttttcaatagta

SEQ ID NO: 65735 - DNA, 20 bp, Artificial Sequence
  chemically synthesized
gttttcaatagtaaggaaaa

SEQ ID NO: 65736 - DNA, 20 bp, Artificial Sequence
  chemically synthesized
tttcaatagtaaggaaaatg

SEQ ID NO: 65737 - DNA, 20 bp, Artificial Sequence
  chemically synthesized
tcaatagtaaggaaaatgga

SEQ ID NO: 65738 - DNA, 20 bp, Artificial Sequence
  chemically synthesized
gagtgtgaaataatgtcaat

SEQ ID NO: 65739 - DNA, 20 bp, Artificial Sequence
  chemically synthesized
gtgtgaaataatgtcaatta

SEQ ID NO: 65740 - DNA, 20 bp, Artificial Sequence
  chemically synthesized
gtgaaataatgtcaattaga

SEQ ID NO: 65741 - DNA, 20 bp, Artificial Sequence
  chemically synthesized
gagagaaatgcatgctgctg

SEQ ID NO: 65742 - DNA, 20 bp, Artificial Sequence
  chemically synthesized
atagtgccgagagtcttcag

SEQ ID NO: 65743 - DNA, 20 bp, Artificial Sequence
  chemically synthesized
ggaatagtgccgagagtctt

SEQ ID NO: 65744 - DNA, 20 bp, Artificial Sequence
  chemically synthesized
tgcatgctgctgaagactct

SEQ ID NO: 65745 - DNA, 20 bp, Artificial Sequence
  chemically synthesized
tcttccaggaatagtgccga

SEQ ID NO: 65746 - DNA, 20 bp, Artificial Sequence
  chemically synthesized
attcttccaggaatagtgcc

SEQ ID NO: 65747 - DNA, 20 bp, Artificial Sequence
  chemically synthesized
aagactctcggcactattcc

SEQ ID NO: 65748 - DNA, 20 bp, Artificial Sequence
  chemically synthesized
actctcggcactattcctgg

SEQ ID NO: 65749 - DNA, 20 bp, Artificial Sequence
  chemically synthesized
ggtggttattcttccaggaa

SEQ ID NO: 65750 - DNA, 20 bp, Artificial Sequence
  chemically synthesized
agcatggtggttattcttcc

SEQ ID NO: 65751 - DNA, 20 bp, Artificial Sequence
  chemically synthesized
aagcatggtggttattcttc

SEQ ID NO: 65752 - DNA, 20 bp, Artificial Sequence
  chemically synthesized
ggaagaataaccaccatgct

SEQ ID NO: 65753 - DNA, 20 bp, Artificial Sequence
  chemically synthesized
ctccggatttctaagcatgg

SEQ ID NO: 65754 - DNA, 20 bp, Artificial Sequence
  chemically synthesized
actctccggatttctaagca

SEQ ID NO: 65755 - DNA, 20 bp, Artificial Sequence
  chemically synthesized
aaccaccatgcttagaaatc

SEQ ID NO: 65756 - DNA, 20 bp, Artificial Sequence
  chemically synthesized
ccagaactctccggatttct

SEQ ID NO: 65757 - DNA, 20 bp, Artificial Sequence
  chemically synthesized
ccaccatgcttagaaatccg

SEQ ID NO: 65758 - DNA, 20 bp, Artificial Sequence
  chemically synthesized
accatgcttagaaatccgga

SEQ ID NO: 65759 - DNA, 20 bp, Artificial Sequence
  chemically synthesized
cattgtttcccagaactctc

SEQ ID NO: 65760 - DNA, 20 bp, Artificial Sequence
  chemically synthesized
cttagaaatccggagagttc

SEQ ID NO: 65761 - DNA, 20 bp, Artificial Sequence
  chemically synthesized
ttagaaatccggagagttct

SEQ ID NO: 65762 - DNA, 20 bp, Artificial Sequence
  chemically synthesized
tttctgtggccattgtttcc

SEQ ID NO: 65763 - DNA, 20 bp, Artificial Sequence
  chemically synthesized
cggagagttctgggaaacaa

SEQ ID NO: 65764 - DNA, 20 bp, Artificial Sequence
  chemically synthesized
gttctgggaaacaatggcca

SEQ ID NO: 65765 - DNA, 20 bp, Artificial Sequence
  chemically synthesized
gaaacaatggccacagaaac

SEQ ID NO: 65766 - DNA, 20 bp, Artificial Sequence
  chemically synthesized
atcaataagtcttgtttctg

SEQ ID NO: 65767 - DNA, 20 bp, Artificial Sequence
  chemically synthesized
aaatcttaatttaaatcaat

SEQ ID NO: 65768 - DNA, 20 bp, Artificial Sequence
  chemically synthesized
aagacttattgatttaaatt

SEQ ID NO: 65769 - DNA, 20 bp, Artificial Sequence
  chemically synthesized
attgatttaaattaagattt

SEQ ID NO: 65770 - DNA, 20 bp, Artificial Sequence
  chemically synthesized
ttaagatttcagttgtgctt

SEQ ID NO: 65771 - DNA, 20 bp, Artificial Sequence
  chemically synthesized
gtagtcattacatgtttctt

SEQ ID NO: 65772 - DNA, 20 bp, Artificial Sequence
  chemically synthesized
cttgtcagatgatataattg

SEQ ID NO: 65773 - DNA, 20 bp, Artificial Sequence
  chemically synthesized
ctacaattatatcatctgac

SEQ ID NO: 65774 - DNA, 20 bp, Artificial Sequence
  chemically synthesized
atacatattatttttcttgt

SEQ ID NO: 65775 - DNA, 20 bp, Artificial Sequence
  chemically synthesized
gacaagaaaaataatatgta

SEQ ID NO: 65776 - DNA, 20 bp, Artificial Sequence
  chemically synthesized
acaagaaaaataatatgtat

SEQ ID NO: 65777 - DNA, 20 bp, Artificial Sequence
  chemically synthesized
gaaaaataatatgtataggc

SEQ ID NO: 65778 - DNA, 20 bp, Artificial Sequence
  chemically synthesized
aaaataatatgtataggcaa

SEQ ID NO: 65779 - DNA, 20 bp, Artificial Sequence
  chemically synthesized
tccatctgatacgaatggtt

SEQ ID NO: 65780 - DNA, 20 bp, Artificial Sequence
  chemically synthesized
ttgtacttaaccattcgtat

SEQ ID NO: 65781 - DNA, 20 bp, Artificial Sequence
  chemically synthesized
ctgtatccatctgatacgaa

SEQ ID NO: 65782 - DNA, 20 bp, Artificial Sequence
  chemically synthesized
acttaaccattcgtatcaga

SEQ ID NO: 65783 - DNA, 20 bp, Artificial Sequence
  chemically synthesized
ccattcgtatcagatggata

SEQ ID NO: 65784 - DNA, 20 bp, Artificial Sequence
  chemically synthesized
tcagatggatacagaacaat

SEQ ID NO: 65785 - DNA, 20 bp, Artificial Sequence
  chemically synthesized
cagatggatacagaacaatc

SEQ ID NO: 65786 - DNA, 20 bp, Artificial Sequence
  chemically synthesized
ggatacagaacaatcaggca

SEQ ID NO: 65787 - DNA, 20 bp, Artificial Sequence
  chemically synthesized
gatacagaacaatcaggcac

SEQ ID NO: 65788 - DNA, 20 bp, Artificial Sequence
  chemically synthesized
aggcacaggcaatgaaaaat

SEQ ID NO: 65789 - DNA, 20 bp, Artificial Sequence
  chemically synthesized
caggcaatgaaaaattagaa

SEQ ID NO: 65790 - DNA, 20 bp, Artificial Sequence
  chemically synthesized
aaaaattagaacagaattaa

SEQ ID NO: 65791 - DNA, 20 bp, Artificial Sequence
  chemically synthesized
aaaattagaacagaattaaa

SEQ ID NO: 65792 - DNA, 20 bp, Artificial Sequence
  chemically synthesized
cagaattaaaaggtttaaaa

SEQ ID NO: 65793 - DNA, 20 bp, Artificial Sequence
  chemically synthesized
attaaaaggtttaaaatgga

SEQ ID NO: 65794 - DNA, 20 bp, Artificial Sequence
  chemically synthesized
aggtttaaaatggaaagaca

SEQ ID NO: 65795 - DNA, 20 bp, Artificial Sequence
  chemically synthesized
atggaaagacatggatgtat

SEQ ID NO: 65796 - DNA, 20 bp, Artificial Sequence
  chemically synthesized
atggatgtattggaacatac

SEQ ID NO: 65797 - DNA, 20 bp, Artificial Sequence
  chemically synthesized
ctcaggcactgatattcagc

SEQ ID NO: 65798 - DNA, 20 bp, Artificial Sequence
  chemically synthesized
ggaacatactggctgaatat

SEQ ID NO: 65799 - DNA, 20 bp, Artificial Sequence
  chemically synthesized
tgccctcaggcactgatatt

SEQ ID NO: 65800 - DNA, 20 bp, Artificial Sequence
  chemically synthesized
ctggctgaatatcagtgcct

SEQ ID NO: 65801 - DNA, 20 bp, Artificial Sequence
  chemically synthesized
tggctgaatatcagtgcctg

SEQ ID NO: 65802 - DNA, 20 bp, Artificial Sequence
  chemically synthesized
ggctgaatatcagtgcctga

SEQ ID NO: 65803 - DNA, 20 bp, Artificial Sequence
  chemically synthesized
atttatcaaccattgccctc

SEQ ID NO: 65804 - DNA, 20 bp, Artificial Sequence
  chemically synthesized
atatcagtgcctgagggcaa

SEQ ID NO: 65805 - DNA, 20 bp, Artificial Sequence
  chemically synthesized
gatttatcaaccattgccct

SEQ ID NO: 65806 - DNA, 20 bp, Artificial Sequence
  chemically synthesized
gcaatggttgataaatctgt

SEQ ID NO: 65807 - DNA, 20 bp, Artificial Sequence
  chemically synthesized
atgcattgaaaaatttctta

SEQ ID NO: 65808 - DNA, 20 bp, Artificial Sequence
  chemically synthesized
atttttcaatgcatatttct

SEQ ID NO: 65809 - DNA, 20 bp, Artificial Sequence
  chemically synthesized
taaagggacaaaagggtgct

SEQ ID NO: 65810 - DNA, 20 bp, Artificial Sequence
  chemically synthesized
attctattaaagggacaaaa

SEQ ID NO: 65811 - DNA, 20 bp, Artificial Sequence
  chemically synthesized
cattctattaaagggacaaa

SEQ ID NO: 65812 - DNA, 20 bp, Artificial Sequence
  chemically synthesized
tcattctattaaagggacaa

SEQ ID NO: 65813 - DNA, 20 bp, Artificial Sequence
  chemically synthesized
gcacccttttgtccctttaa

SEQ ID NO: 65814 - DNA, 20 bp, Artificial Sequence
  chemically synthesized
gaaattatcattctattaaa

SEQ ID NO: 65815 - DNA, 20 bp, Artificial Sequence
  chemically synthesized
ggaaattatcattctattaa

SEQ ID NO: 65816 - DNA, 20 bp, Artificial Sequence
  chemically synthesized
tggaaattatcattctatta

SEQ ID NO: 65817 - DNA, 20 bp, Artificial Sequence
  chemically synthesized
tttaatagaatgataatttc

SEQ ID NO: 65818 - DNA, 20 bp, Artificial Sequence
  chemically synthesized
tctactacttttgattttgc

SEQ ID NO: 65819 - DNA, 20 bp, Artificial Sequence
  chemically synthesized
ataatttccagcaaaatcaa

SEQ ID NO: 65820 - DNA, 20 bp, Artificial Sequence
  chemically synthesized
atttccagcaaaatcaaaag

SEQ ID NO: 65821 - DNA, 20 bp, Artificial Sequence
  chemically synthesized
tccagcaaaatcaaaagtag

SEQ ID NO: 65822 - DNA, 20 bp, Artificial Sequence
  chemically synthesized
tcaaaagtagtagaaataaa

SEQ ID NO: 65823 - DNA, 20 bp, Artificial Sequence
  chemically synthesized
aaggtaattctttaaaagtt

SEQ ID NO: 65824 - DNA, 20 bp, Artificial Sequence
  chemically synthesized
ttcaaaaatcccaactttta

SEQ ID NO: 65825 - DNA, 20 bp, Artificial Sequence
  chemically synthesized
gaaggtaattctttaaaagt

SEQ ID NO: 65826 - DNA, 20 bp, Artificial Sequence
  chemically synthesized
atatgaaggtaattctttaa

SEQ ID NO: 65827 - DNA, 20 bp, Artificial Sequence
  chemically synthesized
gtttggcaaatgtcatatga

SEQ ID NO: 65828 - DNA, 20 bp, Artificial Sequence
  chemically synthesized
ggtttggcaaatgtcatatg

SEQ ID NO: 65829 - DNA, 20 bp, Artificial Sequence
  chemically synthesized
atagatggttgtcaggggtt

SEQ ID NO: 65830 - DNA, 20 bp, Artificial Sequence
  chemically synthesized
caattatagatggttgtcag

SEQ ID NO: 65831 - DNA, 20 bp, Artificial Sequence
  chemically synthesized
tcaattatagatggttgtca

SEQ ID NO: 65832 - DNA, 20 bp, Artificial Sequence
  chemically synthesized
gtcaattatagatggttgtc

SEQ ID NO: 65833 - DNA, 20 bp, Artificial Sequence
  chemically synthesized
tgtcaattatagatggttgt

SEQ ID NO: 65834 - DNA, 20 bp, Artificial Sequence
  chemically synthesized
ttttttttgtcaattataga

SEQ ID NO: 65835 - DNA, 20 bp, Artificial Sequence
  chemically synthesized
tcgcttttttttgtcaatta

SEQ ID NO: 65836 - DNA, 20 bp, Artificial Sequence
  chemically synthesized
catctataattgacaaaaaa

SEQ ID NO: 65837 - DNA, 20 bp, Artificial Sequence
  chemically synthesized
tataattgacaaaaaaaagc

SEQ ID NO: 65838 - DNA, 20 bp, Artificial Sequence
  chemically synthesized
tgacaaaaaaaagcgagcat

SEQ ID NO: 65839 - DNA, 20 bp, Artificial Sequence
  chemically synthesized
tagctctttcttattaattt

SEQ ID NO: 65840 - DNA, 20 bp, Artificial Sequence
  chemically synthesized
ataagttgactcaaattaat

SEQ ID NO: 65841 - DNA, 20 bp, Artificial Sequence
  chemically synthesized
gttgactcaaattaataaga

SEQ ID NO: 65842 - DNA, 20 bp, Artificial Sequence
  chemically synthesized
tgactcaaattaataagaaa

SEQ ID NO: 65843 - DNA, 20 bp, Artificial Sequence
  chemically synthesized
cctactttctaaatattttg

SEQ ID NO: 65844 - DNA, 20 bp, Artificial Sequence
  chemically synthesized
agaaagagctacaaaatatt

SEQ ID NO: 65845 - DNA, 20 bp, Artificial Sequence
  chemically synthesized
agagctacaaaatatttaga

SEQ ID NO: 65846 - DNA, 20 bp, Artificial Sequence
  chemically synthesized
gctacaaaatatttagaaag

SEQ ID NO: 65847 - DNA, 20 bp, Artificial Sequence
  chemically synthesized
ctacaaaatatttagaaagt

SEQ ID NO: 65848 - DNA, 20 bp, Artificial Sequence
  chemically synthesized
ggcagaatttttttaaatat

SEQ ID NO: 65849 - DNA, 20 bp, Artificial Sequence
  chemically synthesized
ggctaaacaggtgatttagg

SEQ ID NO: 65850 - DNA, 20 bp, Artificial Sequence
  chemically synthesized
ttcggctaaacaggtgattt

SEQ ID NO: 65851 - DNA, 20 bp, Artificial Sequence
  chemically synthesized
cttcggctaaacaggtgatt

SEQ ID NO: 65852 - DNA, 20 bp, Artificial Sequence
  chemically synthesized
ttctgcctaaatcacctgtt

SEQ ID NO: 65853 - DNA, 20 bp, Artificial Sequence
  chemically synthesized
attctgaacttcggctaaac

SEQ ID NO: 65854 - DNA, 20 bp, Artificial Sequence
  chemically synthesized
tattctgaacttcggctaaa

SEQ ID NO: 65855 - DNA, 20 bp, Artificial Sequence
  chemically synthesized
ctaaatcacctgtttagccg

SEQ ID NO: 65856 - DNA, 20 bp, Artificial Sequence
  chemically synthesized
tcacctgtttagccgaagtt

SEQ ID NO: 65857 - DNA, 20 bp, Artificial Sequence
  chemically synthesized
ttgttcactattctgaactt

SEQ ID NO: 65858 - DNA, 20 bp, Artificial Sequence
  chemically synthesized
tgtttagccgaagttcagaa

SEQ ID NO: 65859 - DNA, 20 bp, Artificial Sequence
  chemically synthesized
agttcagaatagtgaacaat

SEQ ID NO: 65860 - DNA, 20 bp, Artificial Sequence
  chemically synthesized
tagtgaacaatcagcaataa

SEQ ID NO: 65861 - DNA, 20 bp, Artificial Sequence
  chemically synthesized
tgtaaatcaatttccactta

SEQ ID NO: 65862 - DNA, 20 bp, Artificial Sequence
  chemically synthesized
agggcacttacatccataag

SEQ ID NO: 65863 - DNA, 20 bp, Artificial Sequence
  chemically synthesized
caaagggcacttacatccat

SEQ ID NO: 65864 - DNA, 20 bp, Artificial Sequence
  chemically synthesized
caatttccacttatggatgt

SEQ ID NO: 65865 - DNA, 20 bp, Artificial Sequence
  chemically synthesized
ttatggatgtaagtgccctt

SEQ ID NO: 65866 - DNA, 20 bp, Artificial Sequence
  chemically synthesized
tttcaaaaagtatttccaaa

SEQ ID NO: 65867 - DNA, 20 bp, Artificial Sequence
  chemically synthesized
ttttcaaaaagtatttccaa

SEQ ID NO: 65868 - DNA, 20 bp, Artificial Sequence
  chemically synthesized
cttttcaaaaagtatttcca

SEQ ID NO: 65869 - DNA, 20 bp, Artificial Sequence
  chemically synthesized
ctttggaaatactttttgaa

SEQ ID NO: 65870 - DNA, 20 bp, Artificial Sequence
  chemically synthesized
tggtctcttaacttttcaaa

SEQ ID NO: 65871 - DNA, 20 bp, Artificial Sequence
  chemically synthesized
gaaatactttttgaaaagtt

SEQ ID NO: 65872 - DNA, 20 bp, Artificial Sequence
  chemically synthesized
aatactttttgaaaagttaa

SEQ ID NO: 65873 - DNA, 20 bp, Artificial Sequence
  chemically synthesized
tttgaaaagttaagagacca

SEQ ID NO: 65874 - DNA, 20 bp, Artificial Sequence
  chemically synthesized
gaaaagttaagagaccacag

SEQ ID NO: 65875 - DNA, 20 bp, Artificial Sequence
  chemically synthesized
tagtatatggtttaccactg

SEQ ID NO: 65876 - DNA, 20 bp, Artificial Sequence
  chemically synthesized
catagattgcttttagtata

SEQ ID NO: 65877 - DNA, 20 bp, Artificial Sequence
  chemically synthesized
agtggtaaaccatatactaa

SEQ ID NO: 65878 - DNA, 20 bp, Artificial Sequence
  chemically synthesized
aaattgtcatagattgcttt

SEQ ID NO: 65879 - DNA, 20 bp, Artificial Sequence
  chemically synthesized
gaggccttagaaaattgtca

SEQ ID NO: 65880 - DNA, 20 bp, Artificial Sequence
  chemically synthesized
gcaatctatgacaattttct

SEQ ID NO: 65881 - DNA, 20 bp, Artificial Sequence
  chemically synthesized
caatctatgacaattttcta

SEQ ID NO: 65882 - DNA, 20 bp, Artificial Sequence
  chemically synthesized
gtatagaatttcagaggcct

SEQ ID NO: 65883 - DNA, 20 bp, Artificial Sequence
  chemically synthesized
gaacctgtatagaatttcag

SEQ ID NO: 65884 - DNA, 20 bp, Artificial Sequence
  chemically synthesized
agaacctgtatagaatttca

SEQ ID NO: 65885 - DNA, 20 bp, Artificial Sequence
  chemically synthesized
tgagaacctgtatagaattt

SEQ ID NO: 65886 - DNA, 20 bp, Artificial Sequence
  chemically synthesized
aaggcctctgaaattctata

SEQ ID NO: 65887 - DNA, 20 bp, Artificial Sequence
  chemically synthesized
aggcctctgaaattctatac

SEQ ID NO: 65888 - DNA, 20 bp, Artificial Sequence
  chemically synthesized
agtacttttgagaacctgta

SEQ ID NO: 65889 - DNA, 20 bp, Artificial Sequence
  chemically synthesized
aattctatacaggttctcaa

SEQ ID NO: 65890 - DNA, 20 bp, Artificial Sequence
  chemically synthesized
cacttctgaatagtactttt

SEQ ID NO: 65891 - DNA, 20 bp, Artificial Sequence
  chemically synthesized
aggttctcaaaagtactatt

SEQ ID NO: 65892 - DNA, 20 bp, Artificial Sequence
  chemically synthesized
ttctcaaaagtactattcag

SEQ ID NO: 65893 - DNA, 20 bp, Artificial Sequence
  chemically synthesized
ttggaactttcacttctgaa

SEQ ID NO: 65894 - DNA, 20 bp, Artificial Sequence
  chemically synthesized
aaagtactattcagaagtga

SEQ ID NO: 65895 - DNA, 20 bp, Artificial Sequence
  chemically synthesized
agaagtgaaagttccaataa

SEQ ID NO: 65896 - DNA, 20 bp, Artificial Sequence
  chemically synthesized
tcgttgaaagcatctattat

SEQ ID NO: 65897 - DNA, 20 bp, Artificial Sequence
  chemically synthesized
ttttgctttaatatcgttga

SEQ ID NO: 65898 - DNA, 20 bp, Artificial Sequence
  chemically synthesized
agatgctttcaacgatatta

SEQ ID NO: 65899 - DNA, 20 bp, Artificial Sequence
  chemically synthesized
cgatattaaagcaaaaacac

SEQ ID NO: 65900 - DNA, 20 bp, Artificial Sequence
  chemically synthesized
atattaaagcaaaaacacaa

SEQ ID NO: 65901 - DNA, 20 bp, Artificial Sequence
  chemically synthesized
tattaaagcaaaaacacaag

SEQ ID NO: 65902 - DNA, 20 bp, Artificial Sequence
  chemically synthesized
attaaagcaaaaacacaaga

SEQ ID NO: 65903 - DNA, 20 bp, Artificial Sequence
  chemically synthesized
ttaaagcaaaaacacaagag

SEQ ID NO: 65904 - DNA, 20 bp, Artificial Sequence
  chemically synthesized
acacaagaggggaacaatga

SEQ ID NO: 65905 - DNA, 20 bp, Artificial Sequence
  chemically synthesized
ggggaacaatgacagatata

SEQ ID NO: 65906 - DNA, 20 bp, Artificial Sequence
  chemically synthesized
gggaacaatgacagatataa

SEQ ID NO: 65907 - DNA, 20 bp, Artificial Sequence
  chemically synthesized
agatataaaggttttatacc

SEQ ID NO: 65908 - DNA, 20 bp, Artificial Sequence
  chemically synthesized
taaaggttttatacctagaa

SEQ ID NO: 65909 - DNA, 20 bp, Artificial Sequence
  chemically synthesized
ctagctattaagtcttttct

SEQ ID NO: 65910 - DNA, 20 bp, Artificial Sequence
  chemically synthesized
tctagctattaagtcttttc

SEQ ID NO: 65911 - DNA, 20 bp, Artificial Sequence
  chemically synthesized
tatacctagaaaagacttaa

SEQ ID NO: 65912 - DNA, 20 bp, Artificial Sequence
  chemically synthesized
cctagaaaagacttaatagc

SEQ ID NO: 65913 - DNA, 20 bp, Artificial Sequence
  chemically synthesized
tgtgacaacgtctagctatt

SEQ ID NO: 65914 - DNA, 20 bp, Artificial Sequence
  chemically synthesized
tagtaatttgtgacaacgtc

SEQ ID NO: 65915 - DNA, 20 bp, Artificial Sequence
  chemically synthesized
tcatgcactgtttgttagtg

SEQ ID NO: 65916 - DNA, 20 bp, Artificial Sequence
  chemically synthesized
caaattactacactaacaaa

SEQ ID NO: 65917 - DNA, 20 bp, Artificial Sequence
  chemically synthesized
gaaattcatgcactgtttgt

SEQ ID NO: 65918 - DNA, 20 bp, Artificial Sequence
  chemically synthesized
aacaaacagtgcatgaattt

SEQ ID NO: 65919 - DNA, 20 bp, Artificial Sequence
  chemically synthesized
ccatcttttgttaagttgaa

SEQ ID NO: 65920 - DNA, 20 bp, Artificial Sequence
  chemically synthesized
tcagcttttcaacttaacaa

SEQ ID NO: 65921 - DNA, 20 bp, Artificial Sequence
  chemically synthesized
tatattgcccatcttttgtt

SEQ ID NO: 65922 - DNA, 20 bp, Artificial Sequence
  chemically synthesized
cttttcaacttaacaaaaga

SEQ ID NO: 65923 - DNA, 20 bp, Artificial Sequence
  chemically synthesized
ttttcaacttaacaaaagat

SEQ ID NO: 65924 - DNA, 20 bp, Artificial Sequence
  chemically synthesized
ttaacaaaagatgggcaata

SEQ ID NO: 65925 - DNA, 20 bp, Artificial Sequence
  chemically synthesized
tcaagagctcatgtaaatga

SEQ ID NO: 65926 - DNA, 20 bp, Artificial Sequence
  chemically synthesized
agtcaaaccatcatttacat

SEQ ID NO: 65927 - DNA, 20 bp, Artificial Sequence
  chemically synthesized
catcatttacatgagctctt

SEQ ID NO: 65928 - DNA, 20 bp, Artificial Sequence
  chemically synthesized
atcatttacatgagctcttg

SEQ ID NO: 65929 - DNA, 20 bp, Artificial Sequence
  chemically synthesized
ttaatatgttcaagcctcaa

SEQ ID NO: 65930 - DNA, 20 bp, Artificial Sequence
  chemically synthesized
tattaatatgttcaagcctc

SEQ ID NO: 65931 - DNA, 20 bp, Artificial Sequence
  chemically synthesized
aatttggtattaatatgttc

SEQ ID NO: 65932 - DNA, 20 bp, Artificial Sequence
  chemically synthesized
tgaacatattaataccaaat

SEQ ID NO: 65933 - DNA, 20 bp, Artificial Sequence
  chemically synthesized
tctgctcttagtttctaatt

SEQ ID NO: 65934 - DNA, 20 bp, Artificial Sequence
  chemically synthesized
ttaataccaaattagaaact

SEQ ID NO: 65935 - DNA, 20 bp, Artificial Sequence
  chemically synthesized
aataccaaattagaaactaa

SEQ ID NO: 65936 - DNA, 20 bp, Artificial Sequence
  chemically synthesized
accaaattagaaactaagag

SEQ ID NO: 65937 - DNA, 20 bp, Artificial Sequence
  chemically synthesized
gtatgggtacaatctgctct

SEQ ID NO: 65938 - DNA, 20 bp, Artificial Sequence
  chemically synthesized
caactctgtattgaatgtat

SEQ ID NO: 65939 - DNA, 20 bp, Artificial Sequence
  chemically synthesized
gcaactctgtattgaatgta

SEQ ID NO: 65940 - DNA, 20 bp, Artificial Sequence
  chemically synthesized
ttgtacccatacattcaata

SEQ ID NO: 65941 - DNA, 20 bp, Artificial Sequence
  chemically synthesized
gtacccatacattcaataca

SEQ ID NO: 65942 - DNA, 20 bp, Artificial Sequence
  chemically synthesized
tacagagttgctgaatatct

SEQ ID NO: 65943 - DNA, 20 bp, Artificial Sequence
  chemically synthesized
gtacattgcacttagatatt

SEQ ID NO: 65944 - DNA, 20 bp, Artificial Sequence
  chemically synthesized
ctaacacagtacattgcact

SEQ ID NO: 65945 - DNA, 20 bp, Artificial Sequence
  chemically synthesized
ctaagtgcaatgtactgtgt

SEQ ID NO: 65946 - DNA, 20 bp, Artificial Sequence
  chemically synthesized
agtgcaatgtactgtgttag

SEQ ID NO: 65947 - DNA, 20 bp, Artificial Sequence
  chemically synthesized
atttcctatggcttctaaca

SEQ ID NO: 65948 - DNA, 20 bp, Artificial Sequence
  chemically synthesized
atgtactgtgttagaagcca

SEQ ID NO: 65949 - DNA, 20 bp, Artificial Sequence
  chemically synthesized
tgtactgtgttagaagccat

SEQ ID NO: 65950 - DNA, 20 bp, Artificial Sequence
  chemically synthesized
aaaaacattgatatttccta

SEQ ID NO: 65951 - DNA, 20 bp, Artificial Sequence
  chemically synthesized
atatcaatgttttttcaaca

SEQ ID NO: 65952 - DNA, 20 bp, Artificial Sequence
  chemically synthesized
tcaacatggatcctaatttt

SEQ ID NO: 65953 - DNA, 20 bp, Artificial Sequence
  chemically synthesized
actatacatatcttaaaatt

SEQ ID NO: 65954 - DNA, 20 bp, Artificial Sequence
  chemically synthesized
tactatacatatcttaaaat

SEQ ID NO: 65955 - DNA, 20 bp, Artificial Sequence
  chemically synthesized
tcctaattttaagatatgta

SEQ ID NO: 65956 - DNA, 20 bp, Artificial Sequence
  chemically synthesized
taagatatgtatagtatact

SEQ ID NO: 65957 - DNA, 20 bp, Artificial Sequence
  chemically synthesized
aagatatgtatagtatactt

SEQ ID NO: 65958 - DNA, 20 bp, Artificial Sequence
  chemically synthesized
agatatgtatagtatacttg

SEQ ID NO: 65959 - DNA, 20 bp, Artificial Sequence
  chemically synthesized
ctcgtattttcattatcccc

SEQ ID NO: 65960 - DNA, 20 bp, Artificial Sequence
  chemically synthesized
cttggggataatgaaaatac

SEQ ID NO: 65961 - DNA, 20 bp, Artificial Sequence
  chemically synthesized
ggggataatgaaaatacgag

SEQ ID NO: 65962 - DNA, 20 bp, Artificial Sequence
  chemically synthesized
gggataatgaaaatacgagt

SEQ ID NO: 65963 - DNA, 20 bp, Artificial Sequence
  chemically synthesized
ataatgaaaatacgagtagg

SEQ ID NO: 65964 - DNA, 20 bp, Artificial Sequence
  chemically synthesized
gaaaatacgagtaggcagaa

SEQ ID NO: 65965 - DNA, 20 bp, Artificial Sequence
  chemically synthesized
aggcagaaaagataactatt

SEQ ID NO: 65966 - DNA, 20 bp, Artificial Sequence
  chemically synthesized
atattaagcccagtactcaa

SEQ ID NO: 65967 - DNA, 20 bp, Artificial Sequence
  chemically synthesized
aaaagataactattgagtac

SEQ ID NO: 65968 - DNA, 20 bp, Artificial Sequence
  chemically synthesized
aaagataactattgagtact

SEQ ID NO: 65969 - DNA, 20 bp, Artificial Sequence
  chemically synthesized
tatcacccagatattaagcc

SEQ ID NO: 65970 - DNA, 20 bp, Artificial Sequence
  chemically synthesized
tgagtactgggcttaatatc

SEQ ID NO: 65971 - DNA, 20 bp, Artificial Sequence
  chemically synthesized
gagtactgggcttaatatct

SEQ ID NO: 65972 - DNA, 20 bp, Artificial Sequence
  chemically synthesized
tattttatcacccagatatt

SEQ ID NO: 65973 - DNA, 20 bp, Artificial Sequence
  chemically synthesized
gtacacattattttatcacc

SEQ ID NO: 65974 - DNA, 20 bp, Artificial Sequence
  chemically synthesized
taggtaaacacatgtcatgg

SEQ ID NO: 65975 - DNA, 20 bp, Artificial Sequence
  chemically synthesized
ataggtaaacacatgtcatg

SEQ ID NO: 65976 - DNA, 20 bp, Artificial Sequence
  chemically synthesized
acataggtaaacacatgtca

SEQ ID NO: 65977 - DNA, 20 bp, Artificial Sequence
  chemically synthesized
catgtgaaggtttgttacat

SEQ ID NO: 65978 - DNA, 20 bp, Artificial Sequence
  chemically synthesized
acatgtgaaggtttgttaca

SEQ ID NO: 65979 - DNA, 20 bp, Artificial Sequence
  chemically synthesized
aggtttgacggtacatgtga

SEQ ID NO: 65980 - DNA, 20 bp, Artificial Sequence
  chemically synthesized
taggtttgacggtacatgtg

SEQ ID NO: 65981 - DNA, 20 bp, Artificial Sequence
  chemically synthesized
agcttttattttaggtttga

SEQ ID NO: 65982 - DNA, 20 bp, Artificial Sequence
  chemically synthesized
taccgtcaaacctaaaataa

SEQ ID NO: 65983 - DNA, 20 bp, Artificial Sequence
  chemically synthesized
ctttttttagcttttatttt

SEQ ID NO: 65984 - DNA, 20 bp, Artificial Sequence
  chemically synthesized
tctttttttagcttttattt

SEQ ID NO: 65985 - DNA, 20 bp, Artificial Sequence
  chemically synthesized
cctaaaataaaagctaaaaa

SEQ ID NO: 65986 - DNA, 20 bp, Artificial Sequence
  chemically synthesized
ctagttgtattttctttttt

SEQ ID NO: 65987 - DNA, 20 bp, Artificial Sequence
  chemically synthesized
ctaaaaaaagaaaatacaac

SEQ ID NO: 65988 - DNA, 20 bp, Artificial Sequence
  chemically synthesized
aaaagaaaatacaactagaa

SEQ ID NO: 65989 - DNA, 20 bp, Artificial Sequence
  chemically synthesized
tattaataatattacttttc

SEQ ID NO: 65990 - DNA, 20 bp, Artificial Sequence
  chemically synthesized
aaaagtaatattattaatat

SEQ ID NO: 65991 - DNA, 20 bp, Artificial Sequence
  chemically synthesized
gagaattaattattttcata

SEQ ID NO: 65992 - DNA, 20 bp, Artificial Sequence
  chemically synthesized
gaattaattattttcatatg

SEQ ID NO: 65993 - DNA, 20 bp, Artificial Sequence
  chemically synthesized
aattaattattttcatatgg

SEQ ID NO: 65994 - DNA, 20 bp, Artificial Sequence
  chemically synthesized
ttattttcatatggaggaat

SEQ ID NO: 65995 - DNA, 20 bp, Artificial Sequence
  chemically synthesized
tattttcatatggaggaatc

SEQ ID NO: 65996 - DNA, 20 bp, Artificial Sequence
  chemically synthesized
attttcatatggaggaatca

SEQ ID NO: 65997 - DNA, 20 bp, Artificial Sequence
  chemically synthesized
ttcatatggaggaatcaggg

SEQ ID NO: 65998 - DNA, 20 bp, Artificial Sequence
  chemically synthesized
tcatatggaggaatcaggga

SEQ ID NO: 65999 - DNA, 20 bp, Artificial Sequence
  chemically synthesized
tcagggaaggctccatgata

SEQ ID NO: 66000 - DNA, 20 bp, Artificial Sequence
  chemically synthesized
caagaccatgctgtatcatg

SEQ ID NO: 66001 - DNA, 20 bp, Artificial Sequence
  chemically synthesized
gtcaagaccatgctgtatca

SEQ ID NO: 66002 - DNA, 20 bp, Artificial Sequence
  chemically synthesized
gaaggctccatgatacagca

SEQ ID NO: 66003 - DNA, 20 bp, Artificial Sequence
  chemically synthesized
tacagcatggtcttgacatt

SEQ ID NO: 66004 - DNA, 20 bp, Artificial Sequence
  chemically synthesized
ttccacaaactcttaatgtc

SEQ ID NO: 66005 - DNA, 20 bp, Artificial Sequence
  chemically synthesized
cagcatggtcttgacattaa

SEQ ID NO: 66006 - DNA, 20 bp, Artificial Sequence
  chemically synthesized
gtcttgacattaagagtttg

SEQ ID NO: 66007 - DNA, 20 bp, Artificial Sequence
  chemically synthesized
acattaagagtttgtggaat

SEQ ID NO: 66008 - DNA, 20 bp, Artificial Sequence
  chemically synthesized
agtttgtggaattggtgttc

SEQ ID NO: 66009 - DNA, 20 bp, Artificial Sequence
  chemically synthesized
gtttgtggaattggtgttcc

SEQ ID NO: 66010 - DNA, 20 bp, Artificial Sequence
  chemically synthesized
tgtggaattggtgttccagg

SEQ ID NO: 66011 - DNA, 20 bp, Artificial Sequence
  chemically synthesized
tggaattggtgttccaggta

SEQ ID NO: 66012 - DNA, 20 bp, Artificial Sequence
  chemically synthesized
ttattattattttctctacc

SEQ ID NO: 66013 - DNA, 20 bp, Artificial Sequence
  chemically synthesized
aatgacaataataataataa

SEQ ID NO: 66014 - DNA, 20 bp, Artificial Sequence
  chemically synthesized
caataataataataacagta

SEQ ID NO: 66015 - DNA, 20 bp, Artificial Sequence
  chemically synthesized
aataataataacagtaaaga

SEQ ID NO: 66016 - DNA, 20 bp, Artificial Sequence
  chemically synthesized
aataacagtaaagacagtga

SEQ ID NO: 66017 - DNA, 20 bp, Artificial Sequence
  chemically synthesized
actcaaagattattgggtat

SEQ ID NO: 66018 - DNA, 20 bp, Artificial Sequence
  chemically synthesized
gacataactcaaagattatt

SEQ ID NO: 66019 - DNA, 20 bp, Artificial Sequence
  chemically synthesized
tgacataactcaaagattat

SEQ ID NO: 66020 - DNA, 20 bp, Artificial Sequence
  chemically synthesized
tctgatacccaataatcttt

SEQ ID NO: 66021 - DNA, 20 bp, Artificial Sequence
  chemically synthesized
aatgaaaatgacataactca

SEQ ID NO: 66022 - DNA, 20 bp, Artificial Sequence
  chemically synthesized
atgtcattttcattctccaa

SEQ ID NO: 66023 - DNA, 20 bp, Artificial Sequence
  chemically synthesized
ccaacttcgtgaggcttttg

SEQ ID NO: 66024 - DNA, 20 bp, Artificial Sequence
  chemically synthesized
aaccaacttcgtgaggcttt

SEQ ID NO: 66025 - DNA, 20 bp, Artificial Sequence
  chemically synthesized
cattctccaaaagcctcacg

SEQ ID NO: 66026 - DNA, 20 bp, Artificial Sequence
  chemically synthesized
aattaaaaaccaacttcgtg

SEQ ID NO: 66027 - DNA, 20 bp, Artificial Sequence
  chemically synthesized
ctccaaaagcctcacgaagt

SEQ ID NO: 66028 - DNA, 20 bp, Artificial Sequence
  chemically synthesized
gaattaaaaaccaacttcgt

SEQ ID NO: 66029 - DNA, 20 bp, Artificial Sequence
  chemically synthesized
tggtttttaattccatttta

SEQ ID NO: 66030 - DNA, 20 bp, Artificial Sequence
  chemically synthesized
cagtttcctcatctgtaaaa

SEQ ID NO: 66031 - DNA, 20 bp, Artificial Sequence
  chemically synthesized
tttaattccattttacagat

SEQ ID NO: 66032 - DNA, 20 bp, Artificial Sequence
  chemically synthesized
ttaattccattttacagatg

SEQ ID NO: 66033 - DNA, 20 bp, Artificial Sequence
  chemically synthesized
attttacagatgaggaaact

SEQ ID NO: 66034 - DNA, 20 bp, Artificial Sequence
  chemically synthesized
ttttacagatgaggaaactg

SEQ ID NO: 66035 - DNA, 20 bp, Artificial Sequence
  chemically synthesized
cagatgaggaaactgaggca

SEQ ID NO: 66036 - DNA, 20 bp, Artificial Sequence
  chemically synthesized
agatgaggaaactgaggcac

SEQ ID NO: 66037 - DNA, 20 bp, Artificial Sequence
  chemically synthesized
cttgagtccttcctgtgcct

SEQ ID NO: 66038 - DNA, 20 bp, Artificial Sequence
  chemically synthesized
tgaggaaactgaggcacagg

SEQ ID NO: 66039 - DNA, 20 bp, Artificial Sequence
  chemically synthesized
gaggaaactgaggcacagga

SEQ ID NO: 66040 - DNA, 20 bp, Artificial Sequence
  chemically synthesized
ctgaggcacaggaaggactc

SEQ ID NO: 66041 - DNA, 20 bp, Artificial Sequence
  chemically synthesized
tgaggcacaggaaggactca

SEQ ID NO: 66042 - DNA, 20 bp, Artificial Sequence
  chemically synthesized
attgatagatatataacctt

SEQ ID NO: 66043 - DNA, 20 bp, Artificial Sequence
  chemically synthesized
caaggttatatatctatcaa

SEQ ID NO: 66044 - DNA, 20 bp, Artificial Sequence
  chemically synthesized
aggttatatatctatcaatg

SEQ ID NO: 66045 - DNA, 20 bp, Artificial Sequence
  chemically synthesized
taatcaatccactccattga

SEQ ID NO: 66046 - DNA, 20 bp, Artificial Sequence
  chemically synthesized
ttatatatctatcaatggag

SEQ ID NO: 66047 - DNA, 20 bp, Artificial Sequence
  chemically synthesized
tatcaatggagtggattgat

SEQ ID NO: 66048 - DNA, 20 bp, Artificial Sequence
  chemically synthesized
tggagtggattgattagaat

SEQ ID NO: 66049 - DNA, 20 bp, Artificial Sequence
  chemically synthesized
acaggggctctgcaattgga

SEQ ID NO: 66050 - DNA, 20 bp, Artificial Sequence
  chemically synthesized
gaattggatctgtccaattg

SEQ ID NO: 66051 - DNA, 20 bp, Artificial Sequence
  chemically synthesized
attggatctgtccaattgca

SEQ ID NO: 66052 - DNA, 20 bp, Artificial Sequence
  chemically synthesized
aggaacaggggctctgcaat

SEQ ID NO: 66053 - DNA, 20 bp, Artificial Sequence
  chemically synthesized
aaaaggcggtataggaacag

SEQ ID NO: 66054 - DNA, 20 bp, Artificial Sequence
  chemically synthesized
gaaaaggcggtataggaaca

SEQ ID NO: 66055 - DNA, 20 bp, Artificial Sequence
  chemically synthesized
tgaaaaggcggtataggaac

SEQ ID NO: 66056 - DNA, 20 bp, Artificial Sequence
  chemically synthesized
atgaaaaggcggtataggaa

SEQ ID NO: 66057 - DNA, 20 bp, Artificial Sequence
  chemically synthesized
tgtttatgaaaaggcggtat

SEQ ID NO: 66058 - DNA, 20 bp, Artificial Sequence
  chemically synthesized
ctgtttatgaaaaggcggta

SEQ ID NO: 66059 - DNA, 20 bp, Artificial Sequence
  chemically synthesized
ttgatctgtttatgaaaagg

SEQ ID NO: 66060 - DNA, 20 bp, Artificial Sequence
  chemically synthesized
accttgatctgtttatgaaa

SEQ ID NO: 66061 - DNA, 20 bp, Artificial Sequence
  chemically synthesized
gaccttgatctgtttatgaa

SEQ ID NO: 66062 - DNA, 20 bp, Artificial Sequence
  chemically synthesized
ctataccgccttttcataaa

SEQ ID NO: 66063 - DNA, 20 bp, Artificial Sequence
  chemically synthesized
cgccttttcataaacagatc

SEQ ID NO: 66064 - DNA, 20 bp, Artificial Sequence
  chemically synthesized
gccttttcataaacagatca

SEQ ID NO: 66065 - DNA, 20 bp, Artificial Sequence
  chemically synthesized
tttcataaacagatcaaggt

SEQ ID NO: 66066 - DNA, 20 bp, Artificial Sequence
  chemically synthesized
taaacagatcaaggtcagtt

SEQ ID NO: 66067 - DNA, 20 bp, Artificial Sequence
  chemically synthesized
cagatcaaggtcagtttagt

SEQ ID NO: 66068 - DNA, 20 bp, Artificial Sequence
  chemically synthesized
aggtcagtttagttggcatg

SEQ ID NO: 66069 - DNA, 20 bp, Artificial Sequence
  chemically synthesized
agttggcatgtagtttgtaa

SEQ ID NO: 66070 - DNA, 20 bp, Artificial Sequence
  chemically synthesized
ggcatgtagtttgtaaaaga

SEQ ID NO: 66071 - DNA, 20 bp, Artificial Sequence
  chemically synthesized
gcatgtagtttgtaaaagaa

SEQ ID NO: 66072 - DNA, 20 bp, Artificial Sequence
  chemically synthesized
atgtagtttgtaaaagaaag

SEQ ID NO: 66073 - DNA, 20 bp, Artificial Sequence
  chemically synthesized
tagtttgtaaaagaaaggag

SEQ ID NO: 66074 - DNA, 20 bp, Artificial Sequence
  chemically synthesized
tttgtaaaagaaaggagtag

SEQ ID NO: 66075 - DNA, 20 bp, Artificial Sequence
  chemically synthesized
taaaagaaaggagtagcagt

SEQ ID NO: 66076 - DNA, 20 bp, Artificial Sequence
  chemically synthesized
gaaaggagtagcagttagac

SEQ ID NO: 66077 - DNA, 20 bp, Artificial Sequence
  chemically synthesized
aggagtagcagttagactag

SEQ ID NO: 66078 - DNA, 20 bp, Artificial Sequence
  chemically synthesized
ggagtagcagttagactaga

SEQ ID NO: 66079 - DNA, 20 bp, Artificial Sequence
  chemically synthesized
gagtagcagttagactagaa

SEQ ID NO: 66080 - DNA, 20 bp, Artificial Sequence
  chemically synthesized
gagactccaagtcacccttc

SEQ ID NO: 66081 - DNA, 20 bp, Artificial Sequence
  chemically synthesized
gttagactagaagggtgact

SEQ ID NO: 66082 - DNA, 20 bp, Artificial Sequence
  chemically synthesized
tagactagaagggtgacttg

SEQ ID NO: 66083 - DNA, 20 bp, Artificial Sequence
  chemically synthesized
aaatgcagctaggagactcc

SEQ ID NO: 66084 - DNA, 20 bp, Artificial Sequence
  chemically synthesized
aagggtgacttggagtctcc

SEQ ID NO: 66085 - DNA, 20 bp, Artificial Sequence
  chemically synthesized
gcctttgtaaatgcagctag

SEQ ID NO: 66086 - DNA, 20 bp, Artificial Sequence
  chemically synthesized
gtgcctttgtaaatgcagct

SEQ ID NO: 66087 - DNA, 20 bp, Artificial Sequence
  chemically synthesized
tgtgcctttgtaaatgcagc

SEQ ID NO: 66088 - DNA, 20 bp, Artificial Sequence
  chemically synthesized
taaatgtgcctttgtaaatg

SEQ ID NO: 66089 - DNA, 20 bp, Artificial Sequence
  chemically synthesized
gtctcctagctgcatttaca

SEQ ID NO: 66090 - DNA, 20 bp, Artificial Sequence
  chemically synthesized
tctcctagctgcatttacaa

SEQ ID NO: 66091 - DNA, 20 bp, Artificial Sequence
  chemically synthesized
gcatttacaaaggcacattt

SEQ ID NO: 66092 - DNA, 20 bp, Artificial Sequence
  chemically synthesized
catttacaaaggcacattta

SEQ ID NO: 66093 - DNA, 20 bp, Artificial Sequence
  chemically synthesized
catttaaggcaccctaatcc

SEQ ID NO: 66094 - DNA, 20 bp, Artificial Sequence
  chemically synthesized
atttaaggcaccctaatcca

SEQ ID NO: 66095 - DNA, 20 bp, Artificial Sequence
  chemically synthesized
aatgaacatgccttggatta

SEQ ID NO: 66096 - DNA, 20 bp, Artificial Sequence
  chemically synthesized
aaatgaacatgccttggatt

SEQ ID NO: 66097 - DNA, 20 bp, Artificial Sequence
  chemically synthesized
gaaatgaacatgccttggat

SEQ ID NO: 66098 - DNA, 20 bp, Artificial Sequence
  chemically synthesized
ttgtggaaatgaacatgcct

SEQ ID NO: 66099 - DNA, 20 bp, Artificial Sequence
  chemically synthesized
caaggcatgttcatttccac

SEQ ID NO: 66100 - DNA, 20 bp, Artificial Sequence
  chemically synthesized
aaaaattgtggtaaagcttg

SEQ ID NO: 66101 - DNA, 20 bp, Artificial Sequence
  chemically synthesized
attaataaaaaattgtggta

SEQ ID NO: 66102 - DNA, 20 bp, Artificial Sequence
  chemically synthesized
atggtattaataaaaaattg

SEQ ID NO: 66103 - DNA, 20 bp, Artificial Sequence
  chemically synthesized
ctatattcttttggtgttta

SEQ ID NO: 66104 - DNA, 20 bp, Artificial Sequence
  chemically synthesized
attaataccataaacaccaa

SEQ ID NO: 66105 - DNA, 20 bp, Artificial Sequence
  chemically synthesized
atgatggcactatattcttt

SEQ ID NO: 66106 - DNA, 20 bp, Artificial Sequence
  chemically synthesized
ccataaacaccaaaagaata

SEQ ID NO: 66107 - DNA, 20 bp, Artificial Sequence
  chemically synthesized
agaatatagtgccatcatca

SEQ ID NO: 66108 - DNA, 20 bp, Artificial Sequence
  chemically synthesized
gtaatggatttctatgatga

SEQ ID NO: 66109 - DNA, 20 bp, Artificial Sequence
  chemically synthesized
tcatagaaatccattacatt

SEQ ID NO: 66110 - DNA, 20 bp, Artificial Sequence
  chemically synthesized
tcattgatgacttaatgtaa

SEQ ID NO: 66111 - DNA, 20 bp, Artificial Sequence
  chemically synthesized
tacattaagtcatcaatgaa

SEQ ID NO: 66112 - DNA, 20 bp, Artificial Sequence
  chemically synthesized
tcatcaatgaaaagtatact

SEQ ID NO: 66113 - DNA, 20 bp, Artificial Sequence
  chemically synthesized
tcaatgaaaagtatactcag

SEQ ID NO: 66114 - DNA, 20 bp, Artificial Sequence
  chemically synthesized
agcagagttcaagaacttct

SEQ ID NO: 66115 - DNA, 20 bp, Artificial Sequence
  chemically synthesized
gaatttcatgagcagagttc

SEQ ID NO: 66116 - DNA, 20 bp, Artificial Sequence
  chemically synthesized
ataactgaatttcatgagca

SEQ ID NO: 66117 - DNA, 20 bp, Artificial Sequence
  chemically synthesized
agataactgaatttcatgag

SEQ ID NO: 66118 - DNA, 20 bp, Artificial Sequence
  chemically synthesized
aaaagataactgaatttcat

SEQ ID NO: 66119 - DNA, 20 bp, Artificial Sequence
  chemically synthesized
tgaactctgctcatgaaatt

SEQ ID NO: 66120 - DNA, 20 bp, Artificial Sequence
  chemically synthesized
atgatgcctatgatattcaa

SEQ ID NO: 66121 - DNA, 20 bp, Artificial Sequence
  chemically synthesized
cagttatcttttgaatatca

SEQ ID NO: 66122 - DNA, 20 bp, Artificial Sequence
  chemically synthesized
agttatcttttgaatatcat

SEQ ID NO: 66123 - DNA, 20 bp, Artificial Sequence
  chemically synthesized
tttgaatatcataggcatca

SEQ ID NO: 66124 - DNA, 20 bp, Artificial Sequence
  chemically synthesized
gcatcatagaaaaatgcatg

SEQ ID NO: 66125 - DNA, 20 bp, Artificial Sequence
  chemically synthesized
aaagtatcacaagtaagatg

SEQ ID NO: 66126 - DNA, 20 bp, Artificial Sequence
  chemically synthesized
taagataaagtatcacaagt

SEQ ID NO: 66127 - DNA, 20 bp, Artificial Sequence
  chemically synthesized
aaaataagataaagtatcac

SEQ ID NO: 66128 - DNA, 20 bp, Artificial Sequence
  chemically synthesized
taataataaaaaataagata

SEQ ID NO: 66129 - DNA, 20 bp, Artificial Sequence
  chemically synthesized
ataaaataataataaaaaat

SEQ ID NO: 66130 - DNA, 20 bp, Artificial Sequence
  chemically synthesized
tattttatttcattttattt

SEQ ID NO: 66131 - DNA, 20 bp, Artificial Sequence
  chemically synthesized
ttatttcattttatttgaga

SEQ ID NO: 66132 - DNA, 20 bp, Artificial Sequence
  chemically synthesized
atttcattttatttgagaca

SEQ ID NO: 66133 - DNA, 20 bp, Artificial Sequence
  chemically synthesized
agagtttcgttcttgttgcc

SEQ ID NO: 66134 - DNA, 20 bp, Artificial Sequence
  chemically synthesized
gagtttcgttcttgttgccc

SEQ ID NO: 66135 - DNA, 20 bp, Artificial Sequence
  chemically synthesized
tgcactccagcctgggcaac

SEQ ID NO: 66136 - DNA, 20 bp, Artificial Sequence
  chemically synthesized
ttcgttcttgttgcccaggc

SEQ ID NO: 66137 - DNA, 20 bp, Artificial Sequence
  chemically synthesized
cgttcttgttgcccaggctg

SEQ ID NO: 66138 - DNA, 20 bp, Artificial Sequence
  chemically synthesized
gtgccattgcactccagcct

SEQ ID NO: 66139 - DNA, 20 bp, Artificial Sequence
  chemically synthesized
tgtgccattgcactccagcc

SEQ ID NO: 66140 - DNA, 20 bp, Artificial Sequence
  chemically synthesized
gagattgtgccattgcactc

SEQ ID NO: 66141 - DNA, 20 bp, Artificial Sequence
  chemically synthesized
ttgcccaggctggagtgcaa

SEQ ID NO: 66142 - DNA, 20 bp, Artificial Sequence
  chemically synthesized
ggagtgcaatggcacaatct

SEQ ID NO: 66143 - DNA, 20 bp, Artificial Sequence
  chemically synthesized
ggcagaggttgcagtgagcc

SEQ ID NO: 66144 - DNA, 20 bp, Artificial Sequence
  chemically synthesized
caggaggcagaggttgcagt

SEQ ID NO: 66145 - DNA, 20 bp, Artificial Sequence
  chemically synthesized
aacccaggaggcagaggttg

SEQ ID NO: 66146 - DNA, 20 bp, Artificial Sequence
  chemically synthesized
tgcttgaacccaggaggcag

SEQ ID NO: 66147 - DNA, 20 bp, Artificial Sequence
  chemically synthesized
tcactgcaacctctgcctcc

SEQ ID NO: 66148 - DNA, 20 bp, Artificial Sequence
  chemically synthesized
ttgcttgaacccaggaggca

SEQ ID NO: 66149 - DNA, 20 bp, Artificial Sequence
  chemically synthesized
cactgcaacctctgcctcct

SEQ ID NO: 66150 - DNA, 20 bp, Artificial Sequence
  chemically synthesized
aattgcttgaacccaggagg

SEQ ID NO: 66151 - DNA, 20 bp, Artificial Sequence
  chemically synthesized
gagaattgcttgaacccagg

SEQ ID NO: 66152 - DNA, 20 bp, Artificial Sequence
  chemically synthesized
ggagaattgcttgaacccag

SEQ ID NO: 66153 - DNA, 20 bp, Artificial Sequence
  chemically synthesized
aacctctgcctcctgggttc

SEQ ID NO: 66154 - DNA, 20 bp, Artificial Sequence
  chemically synthesized
caggagaattgcttgaaccc

SEQ ID NO: 66155 - DNA, 20 bp, Artificial Sequence
  chemically synthesized
gcaggagaattgcttgaacc

SEQ ID NO: 66156 - DNA, 20 bp, Artificial Sequence
  chemically synthesized
ttcaagcaattctcctgcct

SEQ ID NO: 66157 - DNA, 20 bp, Artificial Sequence
  chemically synthesized
tactacggaggctgaggcag

SEQ ID NO: 66158 - DNA, 20 bp, Artificial Sequence
  chemically synthesized
gctactacggaggctgaggc

SEQ ID NO: 66159 - DNA, 20 bp, Artificial Sequence
  chemically synthesized
agctactacggaggctgagg

SEQ ID NO: 66160 - DNA, 20 bp, Artificial Sequence
  chemically synthesized
cacagctactacggaggctg

SEQ ID NO: 66161 - DNA, 20 bp, Artificial Sequence
  chemically synthesized
tcacagctactacggaggct

SEQ ID NO: 66162 - DNA, 20 bp, Artificial Sequence
  chemically synthesized
ttctcctgcctcagcctccg

SEQ ID NO: 66163 - DNA, 20 bp, Artificial Sequence
  chemically synthesized
tcctgcctcagcctccgtag

SEQ ID NO: 66164 - DNA, 20 bp, Artificial Sequence
  chemically synthesized
tgtaatcacagctactacgg

SEQ ID NO: 66165 - DNA, 20 bp, Artificial Sequence
  chemically synthesized
ctgtaatcacagctactacg

SEQ ID NO: 66166 - DNA, 20 bp, Artificial Sequence
  chemically synthesized
acctgtaatcacagctacta

SEQ ID NO: 66167 - DNA, 20 bp, Artificial Sequence
  chemically synthesized
ctccgtagtagctgtgatta

SEQ ID NO: 66168 - DNA, 20 bp, Artificial Sequence
  chemically synthesized
tccgtagtagctgtgattac

SEQ ID NO: 66169 - DNA, 20 bp, Artificial Sequence
  chemically synthesized
gtgacaggcacctgtaatca

SEQ ID NO: 66170 - DNA, 20 bp, Artificial Sequence
  chemically synthesized
aattagctggacgtggtgac

SEQ ID NO: 66171 - DNA, 20 bp, Artificial Sequence
  chemically synthesized
aaattagctggacgtggtga

SEQ ID NO: 66172 - DNA, 20 bp, Artificial Sequence
  chemically synthesized
caggtgcctgtcaccacgtc

SEQ ID NO: 66173 - DNA, 20 bp, Artificial Sequence
  chemically synthesized
tacaaaaaattagctggacg

SEQ ID NO: 66174 - DNA, 20 bp, Artificial Sequence
  chemically synthesized
taaaaatacaaaaaattagc

SEQ ID NO: 66175 - DNA, 20 bp, Artificial Sequence
  chemically synthesized
ctactaaaaatacaaaaaat

SEQ ID NO: 66176 - DNA, 20 bp, Artificial Sequence
  chemically synthesized
cagctaattttttgtatttt

SEQ ID NO: 66177 - DNA, 20 bp, Artificial Sequence
  chemically synthesized
ctaattttttgtatttttag

SEQ ID NO: 66178 - DNA, 20 bp, Artificial Sequence
  chemically synthesized
aattttttgtatttttagta

SEQ ID NO: 66179 - DNA, 20 bp, Artificial Sequence
  chemically synthesized
ttttgtatttttagtagaga

SEQ ID NO: 66180 - DNA, 20 bp, Artificial Sequence
  chemically synthesized
tttgtatttttagtagagac

SEQ ID NO: 66181 - DNA, 20 bp, Artificial Sequence
  chemically synthesized
ttgtatttttagtagagaca

SEQ ID NO: 66182 - DNA, 20 bp, Artificial Sequence
  chemically synthesized
gagacagggtttcactatgt

SEQ ID NO: 66183 - DNA, 20 bp, Artificial Sequence
  chemically synthesized
cagggtttcactatgttggc

SEQ ID NO: 66184 - DNA, 20 bp, Artificial Sequence
  chemically synthesized
cgagaccagcctggccaaca

SEQ ID NO: 66185 - DNA, 20 bp, Artificial Sequence
  chemically synthesized
agggtttcactatgttggcc

SEQ ID NO: 66186 - DNA, 20 bp, Artificial Sequence
  chemically synthesized
tttcactatgttggccaggc

SEQ ID NO: 66187 - DNA, 20 bp, Artificial Sequence
  chemically synthesized
tcaggaattcgagaccagcc

SEQ ID NO: 66188 - DNA, 20 bp, Artificial Sequence
  chemically synthesized
tgaggtcaggaattcgagac

SEQ ID NO: 66189 - DNA, 20 bp, Artificial Sequence
  chemically synthesized
tcacctgaggtcaggaattc

SEQ ID NO: 66190 - DNA, 20 bp, Artificial Sequence
  chemically synthesized
tggtctcgaattcctgacct

SEQ ID NO: 66191 - DNA, 20 bp, Artificial Sequence
  chemically synthesized
ggtctcgaattcctgacctc

SEQ ID NO: 66192 - DNA, 20 bp, Artificial Sequence
  chemically synthesized
tgggtggatcacctgaggtc

SEQ ID NO: 66193 - DNA, 20 bp, Artificial Sequence
  chemically synthesized
gtgggtggatcacctgaggt

SEQ ID NO: 66194 - DNA, 20 bp, Artificial Sequence
  chemically synthesized
cgaggtgggtggatcacctg

SEQ ID NO: 66195 - DNA, 20 bp, Artificial Sequence
  chemically synthesized
ccgaggtgggtggatcacct

SEQ ID NO: 66196 - DNA, 20 bp, Artificial Sequence
  chemically synthesized
ctcaggtgatccacccacct

SEQ ID NO: 66197 - DNA, 20 bp, Artificial Sequence
  chemically synthesized
ctttgagaggccgaggtggg

SEQ ID NO: 66198 - DNA, 20 bp, Artificial Sequence
  chemically synthesized
gcactttgagaggccgaggt

SEQ ID NO: 66199 - DNA, 20 bp, Artificial Sequence
  chemically synthesized
agcactttgagaggccgagg

SEQ ID NO: 66200 - DNA, 20 bp, Artificial Sequence
  chemically synthesized
cccagcactttgagaggccg

SEQ ID NO: 66201 - DNA, 20 bp, Artificial Sequence
  chemically synthesized
tcccagcactttgagaggcc

SEQ ID NO: 66202 - DNA, 20 bp, Artificial Sequence
  chemically synthesized
ccacccacctcggcctctca

SEQ ID NO: 66203 - DNA, 20 bp, Artificial Sequence
  chemically synthesized
tgtaatcccagcactttgag

SEQ ID NO: 66204 - DNA, 20 bp, Artificial Sequence
  chemically synthesized
ctgtaatcccagcactttga

SEQ ID NO: 66205 - DNA, 20 bp, Artificial Sequence
  chemically synthesized
acctcggcctctcaaagtgc

SEQ ID NO: 66206 - DNA, 20 bp, Artificial Sequence
  chemically synthesized
acctgtaatcccagcacttt

SEQ ID NO: 66207 - DNA, 20 bp, Artificial Sequence
  chemically synthesized
cctcggcctctcaaagtgct

SEQ ID NO: 66208 - DNA, 20 bp, Artificial Sequence
  chemically synthesized
ctctcaaagtgctgggatta

SEQ ID NO: 66209 - DNA, 20 bp, Artificial Sequence
  chemically synthesized
tctcaaagtgctgggattac

SEQ ID NO: 66210 - DNA, 20 bp, Artificial Sequence
  chemically synthesized
ctggctcacacctgtaatcc

SEQ ID NO: 66211 - DNA, 20 bp, Artificial Sequence
  chemically synthesized
agtgctgggattacaggtgt

SEQ ID NO: 66212 - DNA, 20 bp, Artificial Sequence
  chemically synthesized
ctgggattacaggtgtgagc

SEQ ID NO: 66213 - DNA, 20 bp, Artificial Sequence
  chemically synthesized
caggtgtgagccagcatgct

SEQ ID NO: 66214 - DNA, 20 bp, Artificial Sequence
  chemically synthesized
aaaaaaagggccaagcatgc

SEQ ID NO: 66215 - DNA, 20 bp, Artificial Sequence
  chemically synthesized
aaagaaaaaaaaaaagggcc

SEQ ID NO: 66216 - DNA, 20 bp, Artificial Sequence
  chemically synthesized
aaaaaaaagaaaaaaaaaaa

SEQ ID NO: 66217 - DNA, 20 bp, Artificial Sequence
  chemically synthesized
aaaaaaaaagaaaaaaaaaa

SEQ ID NO: 66218 - DNA, 20 bp, Artificial Sequence
  chemically synthesized
aaaaaaaaaagaaaaaaaaa

SEQ ID NO: 66219 - DNA, 20 bp, Artificial Sequence
  chemically synthesized
gactctgtctcaaaaaaaaa

SEQ ID NO: 66220 - DNA, 20 bp, Artificial Sequence
  chemically synthesized
ttttttttcttttttttttt

SEQ ID NO: 66221 - DNA, 20 bp, Artificial Sequence
  chemically synthesized
ttttctttttttttttgaga

SEQ ID NO: 66222 - DNA, 20 bp, Artificial Sequence
  chemically synthesized
ttctttttttttttgagaca

SEQ ID NO: 66223 - DNA, 20 bp, Artificial Sequence
  chemically synthesized
tttttttttgagacagagtc

SEQ ID NO: 66224 - DNA, 20 bp, Artificial Sequence
  chemically synthesized
tccagcctgggcaacagagc

SEQ ID NO: 66225 - DNA, 20 bp, Artificial Sequence
  chemically synthesized
cagagtctggctctgttgcc

SEQ ID NO: 66226 - DNA, 20 bp, Artificial Sequence
  chemically synthesized
gcactccagcctgggcaaca

SEQ ID NO: 66227 - DNA, 20 bp, Artificial Sequence
  chemically synthesized
agagtctggctctgttgccc

SEQ ID NO: 66228 - DNA, 20 bp, Artificial Sequence
  chemically synthesized
ctgcactccagcctgggcaa

SEQ ID NO: 66229 - DNA, 20 bp, Artificial Sequence
  chemically synthesized
tctggctctgttgcccaggc

SEQ ID NO: 66230 - DNA, 20 bp, Artificial Sequence
  chemically synthesized
tggctctgttgcccaggctg

SEQ ID NO: 66231 - DNA, 20 bp, Artificial Sequence
  chemically synthesized
gcaccactgcactccagcct

SEQ ID NO: 66232 - DNA, 20 bp, Artificial Sequence
  chemically synthesized
tgcaccactgcactccagcc

SEQ ID NO: 66233 - DNA, 20 bp, Artificial Sequence
  chemically synthesized
ctgttgcccaggctggagtg

SEQ ID NO: 66234 - DNA, 20 bp, Artificial Sequence
  chemically synthesized
aagattgcaccactgcactc

SEQ ID NO: 66235 - DNA, 20 bp, Artificial Sequence
  chemically synthesized
ttgcccaggctggagtgcag

SEQ ID NO: 66236 - DNA, 20 bp, Artificial Sequence
  chemically synthesized
ggagtgcagtggtgcaatct

SEQ ID NO: 66237 - DNA, 20 bp, Artificial Sequence
  chemically synthesized
ggtgaagctcgcagtgagcc

SEQ ID NO: 66238 - DNA, 20 bp, Artificial Sequence
  chemically synthesized
gtgcaatcttggctcactgc

SEQ ID NO: 66239 - DNA, 20 bp, Artificial Sequence
  chemically synthesized
cgggaggtgaagctcgcagt

SEQ ID NO: 66240 - DNA, 20 bp, Artificial Sequence
  chemically synthesized
aacccgggaggtgaagctcg

SEQ ID NO: 66241 - DNA, 20 bp, Artificial Sequence
  chemically synthesized
tcactgcgagcttcacctcc

SEQ ID NO: 66242 - DNA, 20 bp, Artificial Sequence
  chemically synthesized
tggcgtgaacccgggaggtg

SEQ ID NO: 66243 - DNA, 20 bp, Artificial Sequence
  chemically synthesized
cactgcgagcttcacctccc

SEQ ID NO: 66244 - DNA, 20 bp, Artificial Sequence
  chemically synthesized
gagaatggcgtgaacccggg

SEQ ID NO: 66245 - DNA, 20 bp, Artificial Sequence
  chemically synthesized
ggagaatggcgtgaacccgg

SEQ ID NO: 66246 - DNA, 20 bp, Artificial Sequence
  chemically synthesized
caggagaatggcgtgaaccc

SEQ ID NO: 66247 - DNA, 20 bp, Artificial Sequence
  chemically synthesized
gcaggagaatggcgtgaacc

SEQ ID NO: 66248 - DNA, 20 bp, Artificial Sequence
  chemically synthesized
gggaggctgaggcaggagaa

SEQ ID NO: 66249 - DNA, 20 bp, Artificial Sequence
  chemically synthesized
ttcacgccattctcctgcct

SEQ ID NO: 66250 - DNA, 20 bp, Artificial Sequence
  chemically synthesized
tactcgggaggctgaggcag

SEQ ID NO: 66251 - DNA, 20 bp, Artificial Sequence
  chemically synthesized
gctactcgggaggctgaggc

SEQ ID NO: 66252 - DNA, 20 bp, Artificial Sequence
  chemically synthesized
agctactcgggaggctgagg

SEQ ID NO: 66253 - DNA, 20 bp, Artificial Sequence
  chemically synthesized
cccagctactcgggaggctg

SEQ ID NO: 66254 - DNA, 20 bp, Artificial Sequence
  chemically synthesized
tcccagctactcgggaggct

SEQ ID NO: 66255 - DNA, 20 bp, Artificial Sequence
  chemically synthesized
ttctcctgcctcagcctccc

SEQ ID NO: 66256 - DNA, 20 bp, Artificial Sequence
  chemically synthesized
tcctgcctcagcctcccgag

SEQ ID NO: 66257 - DNA, 20 bp, Artificial Sequence
  chemically synthesized
tgtagtcccagctactcggg

SEQ ID NO: 66258 - DNA, 20 bp, Artificial Sequence
  chemically synthesized
ctgtagtcccagctactcgg

SEQ ID NO: 66259 - DNA, 20 bp, Artificial Sequence
  chemically synthesized
gcctcagcctcccgagtagc

SEQ ID NO: 66260 - DNA, 20 bp, Artificial Sequence
  chemically synthesized
gcctgtagtcccagctactc

SEQ ID NO: 66261 - DNA, 20 bp, Artificial Sequence
  chemically synthesized
cctcagcctcccgagtagct

SEQ ID NO: 66262 - DNA, 20 bp, Artificial Sequence
  chemically synthesized
tgcctgtagtcccagctact

SEQ ID NO: 66263 - DNA, 20 bp, Artificial Sequence
  chemically synthesized
ctcccgagtagctgggacta

SEQ ID NO: 66264 - DNA, 20 bp, Artificial Sequence
  chemically synthesized
tcccgagtagctgggactac

SEQ ID NO: 66265 - DNA, 20 bp, Artificial Sequence
  chemically synthesized
gtggtgggtgcctgtagtcc

SEQ ID NO: 66266 - DNA, 20 bp, Artificial Sequence
  chemically synthesized
ggcgtggtggtgggtgcctg

SEQ ID NO: 66267 - DNA, 20 bp, Artificial Sequence
  chemically synthesized
aattagccaggcgtggtggt

SEQ ID NO: 66268 - DNA, 20 bp, Artificial Sequence
  chemically synthesized
aaattagccaggcgtggtgg

SEQ ID NO: 66269 - DNA, 20 bp, Artificial Sequence
  chemically synthesized
caggcacccaccaccacgcc

SEQ ID NO: 66270 - DNA, 20 bp, Artificial Sequence
  chemically synthesized
aaaaaattagccaggcgtgg

SEQ ID NO: 66271 - DNA, 20 bp, Artificial Sequence
  chemically synthesized
tacaaaaaattagccaggcg

SEQ ID NO: 66272 - DNA, 20 bp, Artificial Sequence
  chemically synthesized
aaaaatacaaaaaattagcc

SEQ ID NO: 66273 - DNA, 20 bp, Artificial Sequence
  chemically synthesized
aaaaaatacaaaaaattagc

SEQ ID NO: 66274 - DNA, 20 bp, Artificial Sequence
  chemically synthesized
aaaaaaaaaatacaaaaaat

SEQ ID NO: 66275 - DNA, 20 bp, Artificial Sequence
  chemically synthesized
ttttgtattttttttttttt

SEQ ID NO: 66276 - DNA, 20 bp, Artificial Sequence
  chemically synthesized
tgtatttttttttttttaag

SEQ ID NO: 66277 - DNA, 20 bp, Artificial Sequence
  chemically synthesized
tatttttttttttttaagta

SEQ ID NO: 66278 - DNA, 20 bp, Artificial Sequence
  chemically synthesized
tttttttttttaagtagaga

SEQ ID NO: 66279 - DNA, 20 bp, Artificial Sequence
  chemically synthesized
ttttttttttaagtagagat

SEQ ID NO: 66280 - DNA, 20 bp, Artificial Sequence
  chemically synthesized
tttttttttaagtagagatg

SEQ ID NO: 66281 - DNA, 20 bp, Artificial Sequence
  chemically synthesized
gagatggggtttcaccatgt

SEQ ID NO: 66282 - DNA, 20 bp, Artificial Sequence
  chemically synthesized
tggggtttcaccatgttagc

SEQ ID NO: 66283 - DNA, 20 bp, Artificial Sequence
  chemically synthesized
cgagaccatcctggctaaca

SEQ ID NO: 66284 - DNA, 20 bp, Artificial Sequence
  chemically synthesized
ggggtttcaccatgttagcc

SEQ ID NO: 66285 - DNA, 20 bp, Artificial Sequence
  chemically synthesized
tttcaccatgttagccagga

SEQ ID NO: 66286 - DNA, 20 bp, Artificial Sequence
  chemically synthesized
tcaggagttcgagaccatcc

SEQ ID NO: 66287 - DNA, 20 bp, Artificial Sequence
  chemically synthesized
gatcacgaggtcaggagttc

SEQ ID NO: 66288 - DNA, 20 bp, Artificial Sequence
  chemically synthesized
cggatggatcacgaggtcag

SEQ ID NO: 66289 - DNA, 20 bp, Artificial Sequence
  chemically synthesized
ggcggatggatcacgaggtc

SEQ ID NO: 66290 - DNA, 20 bp, Artificial Sequence
  chemically synthesized
aggcggatggatcacgaggt

SEQ ID NO: 66291 - DNA, 20 bp, Artificial Sequence
  chemically synthesized
gccgaggcggatggatcacg

SEQ ID NO: 66292 - DNA, 20 bp, Artificial Sequence
  chemically synthesized
ggccgaggcggatggatcac

SEQ ID NO: 66293 - DNA, 20 bp, Artificial Sequence
  chemically synthesized
acctcgtgatccatccgcct

SEQ ID NO: 66294 - DNA, 20 bp, Artificial Sequence
  chemically synthesized
ctttgagaggccgaggcgga

SEQ ID NO: 66295 - DNA, 20 bp, Artificial Sequence
  chemically synthesized
agcactttgagaggccgagg

SEQ ID NO: 66296 - DNA, 20 bp, Artificial Sequence
  chemically synthesized
cccagcactttgagaggccg

SEQ ID NO: 66297 - DNA, 20 bp, Artificial Sequence
  chemically synthesized
tcccagcactttgagaggcc

SEQ ID NO: 66298 - DNA, 20 bp, Artificial Sequence
  chemically synthesized
ccatccgcctcggcctctca

SEQ ID NO: 66299 - DNA, 20 bp, Artificial Sequence
  chemically synthesized
taaaatcccagcactttgag

SEQ ID NO: 66300 - DNA, 20 bp, Artificial Sequence
  chemically synthesized
ctaaaatcccagcactttga

SEQ ID NO: 66301 - DNA, 20 bp, Artificial Sequence
  chemically synthesized
gcctcggcctctcaaagtgc

SEQ ID NO: 66302 - DNA, 20 bp, Artificial Sequence
  chemically synthesized
gcctaaaatcccagcacttt

SEQ ID NO: 66303 - DNA, 20 bp, Artificial Sequence
  chemically synthesized
cctcggcctctcaaagtgct

SEQ ID NO: 66304 - DNA, 20 bp, Artificial Sequence
  chemically synthesized
ctctcaaagtgctgggattt

SEQ ID NO: 66305 - DNA, 20 bp, Artificial Sequence
  chemically synthesized
tctcaaagtgctgggatttt

SEQ ID NO: 66306 - DNA, 20 bp, Artificial Sequence
  chemically synthesized
gtggctcatgcctaaaatcc

SEQ ID NO: 66307 - DNA, 20 bp, Artificial Sequence
  chemically synthesized
agtgctgggattttaggcat

SEQ ID NO: 66308 - DNA, 20 bp, Artificial Sequence
  chemically synthesized
ataagatagatcgggtgcgg

SEQ ID NO: 66309 - DNA, 20 bp, Artificial Sequence
  chemically synthesized
aaaataagatagatcgggtg

SEQ ID NO: 66310 - DNA, 20 bp, Artificial Sequence
  chemically synthesized
ttttaaaaataagatagatc

SEQ ID NO: 66311 - DNA, 20 bp, Artificial Sequence
  chemically synthesized
tttttaaaaataagatagat

SEQ ID NO: 66312 - DNA, 20 bp, Artificial Sequence
  chemically synthesized
gataatttttaaaaataaga

SEQ ID NO: 66313 - DNA, 20 bp, Artificial Sequence
  chemically synthesized
gagtgataatttttaaaaat

SEQ ID NO: 66314 - DNA, 20 bp, Artificial Sequence
  chemically synthesized
aaaaattatcactcaacgta

SEQ ID NO: 66315 - DNA, 20 bp, Artificial Sequence
  chemically synthesized
gatgatttgagctgtacgtt

SEQ ID NO: 66316 - DNA, 20 bp, Artificial Sequence
  chemically synthesized
aattatactatggatgattt

SEQ ID NO: 66317 - DNA, 20 bp, Artificial Sequence
  chemically synthesized
cgtacagctcaaatcatcca

SEQ ID NO: 66318 - DNA, 20 bp, Artificial Sequence
  chemically synthesized
agctaaataaaattatacta

SEQ ID NO: 66319 - DNA, 20 bp, Artificial Sequence
  chemically synthesized
atccatagtataattttatt

SEQ ID NO: 66320 - DNA, 20 bp, Artificial Sequence
  chemically synthesized
agtataattttatttagctg

SEQ ID NO: 66321 - DNA, 20 bp, Artificial Sequence
  chemically synthesized
gtataattttatttagctga

SEQ ID NO: 66322 - DNA, 20 bp, Artificial Sequence
  chemically synthesized
aattttatttagctgaagga

SEQ ID NO: 66323 - DNA, 20 bp, Artificial Sequence
  chemically synthesized
ctaatgacaaatccatcctt

SEQ ID NO: 66324 - DNA, 20 bp, Artificial Sequence
  chemically synthesized
ctgaaggatggatttgtcat

SEQ ID NO: 66325 - DNA, 20 bp, Artificial Sequence
  chemically synthesized
aagagagagaacaggagtta

SEQ ID NO: 66326 - DNA, 20 bp, Artificial Sequence
  chemically synthesized
aaagtcaagagagagaacag

SEQ ID NO: 66327 - DNA, 20 bp, Artificial Sequence
  chemically synthesized
ataaagtcaagagagagaac

SEQ ID NO: 66328 - DNA, 20 bp, Artificial Sequence
  chemically synthesized
aataaagtcaagagagagaa

SEQ ID NO: 66329 - DNA, 20 bp, Artificial Sequence
  chemically synthesized
taaaaaataaagtcaagaga

SEQ ID NO: 66330 - DNA, 20 bp, Artificial Sequence
  chemically synthesized
tataaaaaataaagtcaaga

SEQ ID NO: 66331 - DNA, 20 bp, Artificial Sequence
  chemically synthesized
tgtataaaaaataaagtcaa

SEQ ID NO: 66332 - DNA, 20 bp, Artificial Sequence
  chemically synthesized
tgtgtataaaaaataaagtc

SEQ ID NO: 66333 - DNA, 20 bp, Artificial Sequence
  chemically synthesized
tgttgtgtgtataaaaaata

SEQ ID NO: 66334 - DNA, 20 bp, Artificial Sequence
  chemically synthesized
ttatacacacaacatttaac

SEQ ID NO: 66335 - DNA, 20 bp, Artificial Sequence
  chemically synthesized
tacacacaacatttaaccag

SEQ ID NO: 66336 - DNA, 20 bp, Artificial Sequence
  chemically synthesized
cacaacatttaaccagaaga

SEQ ID NO: 66337 - DNA, 20 bp, Artificial Sequence
  chemically synthesized
tttttattgggtctgtcttc

SEQ ID NO: 66338 - DNA, 20 bp, Artificial Sequence
  chemically synthesized
taatttaataaatttttatt

SEQ ID NO: 66339 - DNA, 20 bp, Artificial Sequence
  chemically synthesized
ataatttaataaatttttat

SEQ ID NO: 66340 - DNA, 20 bp, Artificial Sequence
  chemically synthesized
aaatttattaaattatgaaa

SEQ ID NO: 66341 - DNA, 20 bp, Artificial Sequence
  chemically synthesized
aatttattaaattatgaaac

SEQ ID NO: 66342 - DNA, 20 bp, Artificial Sequence
  chemically synthesized
attatgaaacaggataaaac

SEQ ID NO: 66343 - DNA, 20 bp, Artificial Sequence
  chemically synthesized
tttgtttgtctcattatgtc

SEQ ID NO: 66344 - DNA, 20 bp, Artificial Sequence
  chemically synthesized
aggataaaactggacataat

SEQ ID NO: 66345 - DNA, 20 bp, Artificial Sequence
  chemically synthesized
caaacaaacaaacaaacgca

SEQ ID NO: 66346 - DNA, 20 bp, Artificial Sequence
  chemically synthesized
acaaacaaacaaacgcaaag

SEQ ID NO: 66347 - DNA, 20 bp, Artificial Sequence
  chemically synthesized
atcattaaatcgaaacattt

SEQ ID NO: 66348 - DNA, 20 bp, Artificial Sequence
  chemically synthesized
atgtttcgatttaatgatga

SEQ ID NO: 66349 - DNA, 20 bp, Artificial Sequence
  chemically synthesized
tctcatatatgaatgattgc

SEQ ID NO: 66350 - DNA, 20 bp, Artificial Sequence
  chemically synthesized
ctctcatatatgaatgattg

SEQ ID NO: 66351 - DNA, 20 bp, Artificial Sequence
  chemically synthesized
acctgcaatcattcatatat

SEQ ID NO: 66352 - DNA, 20 bp, Artificial Sequence
  chemically synthesized
ctgcaatcattcatatatga

SEQ ID NO: 66353 - DNA, 20 bp, Artificial Sequence
  chemically synthesized
caatcattcatatatgagag

SEQ ID NO: 66354 - DNA, 20 bp, Artificial Sequence
  chemically synthesized
aatcattcatatatgagaga

SEQ ID NO: 66355 - DNA, 20 bp, Artificial Sequence
  chemically synthesized
tatatgagagaaggcatcat

SEQ ID NO: 66356 - DNA, 20 bp, Artificial Sequence
  chemically synthesized
atatgagagaaggcatcatg

SEQ ID NO: 66357 - DNA, 20 bp, Artificial Sequence
  chemically synthesized
agaaggcatcatgaggatct

SEQ ID NO: 66358 - DNA, 20 bp, Artificial Sequence
  chemically synthesized
catcatgaggatctcagctt

SEQ ID NO: 66359 - DNA, 20 bp, Artificial Sequence
  chemically synthesized
atcatgaggatctcagcttt

SEQ ID NO: 66360 - DNA, 20 bp, Artificial Sequence
  chemically synthesized
ggaaaacctatcccaaagct

SEQ ID NO: 66361 - DNA, 20 bp, Artificial Sequence
  chemically synthesized
tgaggatctcagctttggga

SEQ ID NO: 66362 - DNA, 20 bp, Artificial Sequence
  chemically synthesized
gaggatctcagctttgggat

SEQ ID NO: 66363 - DNA, 20 bp, Artificial Sequence
  chemically synthesized
ttcctggaaaacctatccca

SEQ ID NO: 66364 - DNA, 20 bp, Artificial Sequence
  chemically synthesized
cagctttgggataggttttc

SEQ ID NO: 66365 - DNA, 20 bp, Artificial Sequence
  chemically synthesized
agctttgggataggttttcc

SEQ ID NO: 66366 - DNA, 20 bp, Artificial Sequence
  chemically synthesized
tttgggataggttttccagg

SEQ ID NO: 66367 - DNA, 20 bp, Artificial Sequence
  chemically synthesized
ttgggataggttttccagga

SEQ ID NO: 66368 - DNA, 20 bp, Artificial Sequence
  chemically synthesized
tgggataggttttccaggaa

SEQ ID NO: 66369 - DNA, 20 bp, Artificial Sequence
  chemically synthesized
taatgctctagttcccttcc

SEQ ID NO: 66370 - DNA, 20 bp, Artificial Sequence
  chemically synthesized
aggttttccaggaagggaac

SEQ ID NO: 66371 - DNA, 20 bp, Artificial Sequence
  chemically synthesized
gttttccaggaagggaacta

SEQ ID NO: 66372 - DNA, 20 bp, Artificial Sequence
  chemically synthesized
caggaagggaactagagcat

SEQ ID NO: 66373 - DNA, 20 bp, Artificial Sequence
  chemically synthesized
acagggctggactaatgctc

SEQ ID NO: 66374 - DNA, 20 bp, Artificial Sequence
  chemically synthesized
agggaactagagcattagtc

SEQ ID NO: 66375 - DNA, 20 bp, Artificial Sequence
  chemically synthesized
ccttgctgaaacaacagggc

SEQ ID NO: 66376 - DNA, 20 bp, Artificial Sequence
  chemically synthesized
gggtccttgctgaaacaaca

SEQ ID NO: 66377 - DNA, 20 bp, Artificial Sequence
  chemically synthesized
ttagtccagccctgttgttt

SEQ ID NO: 66378 - DNA, 20 bp, Artificial Sequence
  chemically synthesized
ggggtccttgctgaaacaac

SEQ ID NO: 66379 - DNA, 20 bp, Artificial Sequence
  chemically synthesized
aggggtccttgctgaaacaa

SEQ ID NO: 66380 - DNA, 20 bp, Artificial Sequence
  chemically synthesized
tccagccctgttgtttcagc

SEQ ID NO: 66381 - DNA, 20 bp, Artificial Sequence
  chemically synthesized
ccagccctgttgtttcagca

SEQ ID NO: 66382 - DNA, 20 bp, Artificial Sequence
  chemically synthesized
gtttcagcaaggacccctgt

SEQ ID NO: 66383 - DNA, 20 bp, Artificial Sequence
  chemically synthesized
atgcctgtcattgctaacag

SEQ ID NO: 66384 - DNA, 20 bp, Artificial Sequence
  chemically synthesized
aatgcctgtcattgctaaca

SEQ ID NO: 66385 - DNA, 20 bp, Artificial Sequence
  chemically synthesized
aaatgcctgtcattgctaac

SEQ ID NO: 66386 - DNA, 20 bp, Artificial Sequence
  chemically synthesized
taaatgcctgtcattgctaa

SEQ ID NO: 66387 - DNA, 20 bp, Artificial Sequence
  chemically synthesized
aggacccctgttagcaatga

SEQ ID NO: 66388 - DNA, 20 bp, Artificial Sequence
  chemically synthesized
ggacccctgttagcaatgac

SEQ ID NO: 66389 - DNA, 20 bp, Artificial Sequence
  chemically synthesized
tagcaatgacaggcatttat

SEQ ID NO: 66390 - DNA, 20 bp, Artificial Sequence
  chemically synthesized
caatgacaggcatttataag

SEQ ID NO: 66391 - DNA, 20 bp, Artificial Sequence
  chemically synthesized
gacaggcatttataagaagt

SEQ ID NO: 66392 - DNA, 20 bp, Artificial Sequence
  chemically synthesized
acaggcatttataagaagtg

SEQ ID NO: 66393 - DNA, 20 bp, Artificial Sequence
  chemically synthesized
agaagtgaggccacactcat

SEQ ID NO: 66394 - DNA, 20 bp, Artificial Sequence
  chemically synthesized
tgctctgcacctgatgagtg

SEQ ID NO: 66395 - DNA, 20 bp, Artificial Sequence
  chemically synthesized
gaagtgaggccacactcatc

SEQ ID NO: 66396 - DNA, 20 bp, Artificial Sequence
  chemically synthesized
tgctgtgctctgcacctgat

SEQ ID NO: 66397 - DNA, 20 bp, Artificial Sequence
  chemically synthesized
gaggccacactcatcaggtg

SEQ ID NO: 66398 - DNA, 20 bp, Artificial Sequence
  chemically synthesized
ggccacactcatcaggtgca

SEQ ID NO: 66399 - DNA, 20 bp, Artificial Sequence
  chemically synthesized
cactcatcaggtgcagagca

SEQ ID NO: 66400 - DNA, 20 bp, Artificial Sequence
  chemically synthesized
atcaggtgcagagcacagca

SEQ ID NO: 66401 - DNA, 20 bp, Artificial Sequence
  chemically synthesized
cagagcacagcaaagctgca

SEQ ID NO: 66402 - DNA, 20 bp, Artificial Sequence
  chemically synthesized
cagtactctagtgagccatg

SEQ ID NO: 66403 - DNA, 20 bp, Artificial Sequence
  chemically synthesized
agcaaagctgcatggctcac

SEQ ID NO: 66404 - DNA, 20 bp, Artificial Sequence
  chemically synthesized
caaagctgcatggctcacta

SEQ ID NO: 66405 - DNA, 20 bp, Artificial Sequence
  chemically synthesized
gccagattcagtactctagt

SEQ ID NO: 66406 - DNA, 20 bp, Artificial Sequence
  chemically synthesized
tgatgccagattcagtactc

SEQ ID NO: 66407 - DNA, 20 bp, Artificial Sequence
  chemically synthesized
gctcactagagtactgaatc

SEQ ID NO: 66408 - DNA, 20 bp, Artificial Sequence
  chemically synthesized
catgagcgtgatgccagatt

SEQ ID NO: 66409 - DNA, 20 bp, Artificial Sequence
  chemically synthesized
ggataacatgagcgtgatgc

SEQ ID NO: 66410 - DNA, 20 bp, Artificial Sequence
  chemically synthesized
ggttactaagtggataacat

SEQ ID NO: 66411 - DNA, 20 bp, Artificial Sequence
  chemically synthesized
tcacgctcatgttatccact

SEQ ID NO: 66412 - DNA, 20 bp, Artificial Sequence
  chemically synthesized
ctgccccattggttactaag

SEQ ID NO: 66413 - DNA, 20 bp, Artificial Sequence
  chemically synthesized
aaactgccccattggttact

SEQ ID NO: 66414 - DNA, 20 bp, Artificial Sequence
  chemically synthesized
gttatccacttagtaaccaa

SEQ ID NO: 66415 - DNA, 20 bp, Artificial Sequence
  chemically synthesized
ttatccacttagtaaccaat

SEQ ID NO: 66416 - DNA, 20 bp, Artificial Sequence
  chemically synthesized
tatccacttagtaaccaatg

SEQ ID NO: 66417 - DNA, 20 bp, Artificial Sequence
  chemically synthesized
ccacttagtaaccaatgggg

SEQ ID NO: 66418 - DNA, 20 bp, Artificial Sequence
  chemically synthesized
ggtttttaaaactgccccat

SEQ ID NO: 66419 - DNA, 20 bp, Artificial Sequence
  chemically synthesized
cagatccctacaaacatttg

SEQ ID NO: 66420 - DNA, 20 bp, Artificial Sequence
  chemically synthesized
ttaaaaaccacaaatgtttg

SEQ ID NO: 66421 - DNA, 20 bp, Artificial Sequence
  chemically synthesized
taaaaaccacaaatgtttgt

SEQ ID NO: 66422 - DNA, 20 bp, Artificial Sequence
  chemically synthesized
aaaaaccacaaatgtttgta

SEQ ID NO: 66423 - DNA, 20 bp, Artificial Sequence
  chemically synthesized
aagaggcttaatagagaaaa

SEQ ID NO: 66424 - DNA, 20 bp, Artificial Sequence
  chemically synthesized
agggatctgttttctctatt

SEQ ID NO: 66425 - DNA, 20 bp, Artificial Sequence
  chemically synthesized
caggagaaagaggcttaata

SEQ ID NO: 66426 - DNA, 20 bp, Artificial Sequence
  chemically synthesized
cgcaggagaaagaggcttaa

SEQ ID NO: 66427 - DNA, 20 bp, Artificial Sequence
  chemically synthesized
atatgtttcgcaggagaaag

SEQ ID NO: 66428 - DNA, 20 bp, Artificial Sequence
  chemically synthesized
gatatgtttcgcaggagaaa

SEQ ID NO: 66429 - DNA, 20 bp, Artificial Sequence
  chemically synthesized
gagatatgtttcgcaggaga

SEQ ID NO: 66430 - DNA, 20 bp, Artificial Sequence
  chemically synthesized
tcaggagatatgtttcgcag

SEQ ID NO: 66431 - DNA, 20 bp, Artificial Sequence
  chemically synthesized
cttcaggagatatgtttcgc

SEQ ID NO: 66432 - DNA, 20 bp, Artificial Sequence
  chemically synthesized
gcttcaggagatatgtttcg

SEQ ID NO: 66433 - DNA, 20 bp, Artificial Sequence
  chemically synthesized
cctgcgaaacatatctcctg

SEQ ID NO: 66434 - DNA, 20 bp, Artificial Sequence
  chemically synthesized
gttatttctccatgcttcag

SEQ ID NO: 66435 - DNA, 20 bp, Artificial Sequence
  chemically synthesized
gaaacatatctcctgaagca

SEQ ID NO: 66436 - DNA, 20 bp, Artificial Sequence
  chemically synthesized
aagttatttctccatgcttc

SEQ ID NO: 66437 - DNA, 20 bp, Artificial Sequence
  chemically synthesized
aacatatctcctgaagcatg

SEQ ID NO: 66438 - DNA, 20 bp, Artificial Sequence
  chemically synthesized
taagttatttctccatgctt

SEQ ID NO: 66439 - DNA, 20 bp, Artificial Sequence
  chemically synthesized
aaaaaagtttaaagaaaaat

SEQ ID NO: 66440 - DNA, 20 bp, Artificial Sequence
  chemically synthesized
ttaaaaaaaaaaaaagttta

SEQ ID NO: 66441 - DNA, 20 bp, Artificial Sequence
  chemically synthesized
tctcaaattaaaaaaaaaaa

SEQ ID NO: 66442 - DNA, 20 bp, Artificial Sequence
  chemically synthesized
actttttttttttttaattt

SEQ ID NO: 66443 - DNA, 20 bp, Artificial Sequence
  chemically synthesized
tttttttttttaatttgaga

SEQ ID NO: 66444 - DNA, 20 bp, Artificial Sequence
  chemically synthesized
tttttttttaatttgagaca

SEQ ID NO: 66445 - DNA, 20 bp, Artificial Sequence
  chemically synthesized
tctaatgtgggcaacaaagc

SEQ ID NO: 66446 - DNA, 20 bp, Artificial Sequence
  chemically synthesized
gcactctaatgtgggcaaca

SEQ ID NO: 66447 - DNA, 20 bp, Artificial Sequence
  chemically synthesized
tcttgctttgttgcccacat

SEQ ID NO: 66448 - DNA, 20 bp, Artificial Sequence
  chemically synthesized
ttgctttgttgcccacatta

SEQ ID NO: 66449 - DNA, 20 bp, Artificial Sequence
  chemically synthesized
gcaccactgcactctaatgt

SEQ ID NO: 66450 - DNA, 20 bp, Artificial Sequence
  chemically synthesized
tgcaccactgcactctaatg

SEQ ID NO: 66451 - DNA, 20 bp, Artificial Sequence
  chemically synthesized
ttgttgcccacattagagtg

SEQ ID NO: 66452 - DNA, 20 bp, Artificial Sequence
  chemically synthesized
ttgcccacattagagtgcag

SEQ ID NO: 66453 - DNA, 20 bp, Artificial Sequence
  chemically synthesized
agagtgcagtggtgcaatct

SEQ ID NO: 66454 - DNA, 20 bp, Artificial Sequence
  chemically synthesized
ggcagaggttgcagtgagct

SEQ ID NO: 66455 - DNA, 20 bp, Artificial Sequence
  chemically synthesized
tgggaggcagaggttgcagt

SEQ ID NO: 66456 - DNA, 20 bp, Artificial Sequence
  chemically synthesized
aacctgggaggcagaggttg

SEQ ID NO: 66457 - DNA, 20 bp, Artificial Sequence
  chemically synthesized
cacttaaacctgggaggcag

SEQ ID NO: 66458 - DNA, 20 bp, Artificial Sequence
  chemically synthesized
tcactgcaacctctgcctcc

SEQ ID NO: 66459 - DNA, 20 bp, Artificial Sequence
  chemically synthesized
tcacttaaacctgggaggca

SEQ ID NO: 66460 - DNA, 20 bp, Artificial Sequence
  chemically synthesized
cactgcaacctctgcctccc

SEQ ID NO: 66461 - DNA, 20 bp, Artificial Sequence
  chemically synthesized
aatcacttaaacctgggagg

SEQ ID NO: 66462 - DNA, 20 bp, Artificial Sequence
  chemically synthesized
gagaatcacttaaacctggg

SEQ ID NO: 66463 - DNA, 20 bp, Artificial Sequence
  chemically synthesized
tgagaatcacttaaacctgg

SEQ ID NO: 66464 - DNA, 20 bp, Artificial Sequence
  chemically synthesized
aacctctgcctcccaggttt

SEQ ID NO: 66465 - DNA, 20 bp, Artificial Sequence
  chemically synthesized
catgagaatcacttaaacct

SEQ ID NO: 66466 - DNA, 20 bp, Artificial Sequence
  chemically synthesized
gcatgagaatcacttaaacc

SEQ ID NO: 66467 - DNA, 20 bp, Artificial Sequence
  chemically synthesized
tttaagtgattctcatgcct

SEQ ID NO: 66468 - DNA, 20 bp, Artificial Sequence
  chemically synthesized
tcccagctacactgaggcat

SEQ ID NO: 66469 - DNA, 20 bp, Artificial Sequence
  chemically synthesized
gtgattctcatgcctcagtg

SEQ ID NO: 66470 - DNA, 20 bp, Artificial Sequence
  chemically synthesized
ctgtaatcccagctacactg

SEQ ID NO: 66471 - DNA, 20 bp, Artificial Sequence
  chemically synthesized
cctgtaatcccagctacact

SEQ ID NO: 66472 - DNA, 20 bp, Artificial Sequence
  chemically synthesized
ttctcatgcctcagtgtagc

SEQ ID NO: 66473 - DNA, 20 bp, Artificial Sequence
  chemically synthesized
tctcatgcctcagtgtagct

SEQ ID NO: 66474 - DNA, 20 bp, Artificial Sequence
  chemically synthesized
cctcagtgtagctgggatta

SEQ ID NO: 66475 - DNA, 20 bp, Artificial Sequence
  chemically synthesized
ctcagtgtagctgggattac

SEQ ID NO: 66476 - DNA, 20 bp, Artificial Sequence
  chemically synthesized
atggtgcgtacctgtaatcc

SEQ ID NO: 66477 - DNA, 20 bp, Artificial Sequence
  chemically synthesized
caggtacgcaccatcatatc

SEQ ID NO: 66478 - DNA, 20 bp, Artificial Sequence
  chemically synthesized
caaaaattagctggatatga

SEQ ID NO: 66479 - DNA, 20 bp, Artificial Sequence
  chemically synthesized
ctaaaaatacaaaaattagc

SEQ ID NO: 66480 - DNA, 20 bp, Artificial Sequence
  chemically synthesized
tccactaaaaatacaaaaat

SEQ ID NO: 66481 - DNA, 20 bp, Artificial Sequence
  chemically synthesized
ccagctaatttttgtatttt

SEQ ID NO: 66482 - DNA, 20 bp, Artificial Sequence
  chemically synthesized
gctaatttttgtatttttag

SEQ ID NO: 66483 - DNA, 20 bp, Artificial Sequence
  chemically synthesized
tttgtatttttagtggaaac

SEQ ID NO: 66484 - DNA, 20 bp, Artificial Sequence
  chemically synthesized
ttgtatttttagtggaaacg

SEQ ID NO: 66485 - DNA, 20 bp, Artificial Sequence
  chemically synthesized
gaaacgaggtttcaccgtgt

SEQ ID NO: 66486 - DNA, 20 bp, Artificial Sequence
  chemically synthesized
cgaggtttcaccgtgttggc

SEQ ID NO: 66487 - DNA, 20 bp, Artificial Sequence
  chemically synthesized
cgagaccagcctggccaaca

SEQ ID NO: 66488 - DNA, 20 bp, Artificial Sequence
  chemically synthesized
gaggtttcaccgtgttggcc

SEQ ID NO: 66489 - DNA, 20 bp, Artificial Sequence
  chemically synthesized
tttcaccgtgttggccaggc

SEQ ID NO: 66490 - DNA, 20 bp, Artificial Sequence
  chemically synthesized
tcaggacttcgagaccagcc

SEQ ID NO: 66491 - DNA, 20 bp, Artificial Sequence
  chemically synthesized
tgttggccaggctggtctcg

SEQ ID NO: 66492 - DNA, 20 bp, Artificial Sequence
  chemically synthesized
tgaagtcaggacttcgagac

SEQ ID NO: 66493 - DNA, 20 bp, Artificial Sequence
  chemically synthesized
tcacttgaagtcaggacttc

SEQ ID NO: 66494 - DNA, 20 bp, Artificial Sequence
  chemically synthesized
ggtctcgaagtcctgacttc

SEQ ID NO: 66495 - DNA, 20 bp, Artificial Sequence
  chemically synthesized
caggcggatcacttgaagtc

SEQ ID NO: 66496 - DNA, 20 bp, Artificial Sequence
  chemically synthesized
gcaggcggatcacttgaagt

SEQ ID NO: 66497 - DNA, 20 bp, Artificial Sequence
  chemically synthesized
cgaggcaggcggatcacttg

SEQ ID NO: 66498 - DNA, 20 bp, Artificial Sequence
  chemically synthesized
ttcaagtgatccgcctgcct

SEQ ID NO: 66499 - DNA, 20 bp, Artificial Sequence
  chemically synthesized
ctttgggaggccgaggcagg

SEQ ID NO: 66500 - DNA, 20 bp, Artificial Sequence
  chemically synthesized
gcactttgggaggccgaggc

SEQ ID NO: 66501 - DNA, 20 bp, Artificial Sequence
  chemically synthesized
agcactttgggaggccgagg

SEQ ID NO: 66502 - DNA, 20 bp, Artificial Sequence
  chemically synthesized
cccagcactttgggaggccg

SEQ ID NO: 66503 - DNA, 20 bp, Artificial Sequence
  chemically synthesized
tcccagcactttgggaggcc

SEQ ID NO: 66504 - DNA, 20 bp, Artificial Sequence
  chemically synthesized
ccgcctgcctcggcctccca

SEQ ID NO: 66505 - DNA, 20 bp, Artificial Sequence
  chemically synthesized
tgtaatcccagcactttggg

SEQ ID NO: 66506 - DNA, 20 bp, Artificial Sequence
  chemically synthesized
ctgtaatcccagcactttgg

SEQ ID NO: 66507 - DNA, 20 bp, Artificial Sequence
  chemically synthesized
gcctcggcctcccaaagtgc

SEQ ID NO: 66508 - DNA, 20 bp, Artificial Sequence
  chemically synthesized
gcctgtaatcccagcacttt

SEQ ID NO: 66509 - DNA, 20 bp, Artificial Sequence
  chemically synthesized
cctcggcctcccaaagtgct

SEQ ID NO: 66510 - DNA, 20 bp, Artificial Sequence
  chemically synthesized
cgcctgtaatcccagcactt

SEQ ID NO: 66511 - DNA, 20 bp, Artificial Sequence
  chemically synthesized
ctcccaaagtgctgggatta

SEQ ID NO: 66512 - DNA, 20 bp, Artificial Sequence
  chemically synthesized
tcccaaagtgctgggattac

SEQ ID NO: 66513 - DNA, 20 bp, Artificial Sequence
  chemically synthesized
gtggctcacgcctgtaatcc

SEQ ID NO: 66514 - DNA, 20 bp, Artificial Sequence
  chemically synthesized
agtgctgggattacaggcgt

SEQ ID NO: 66515 - DNA, 20 bp, Artificial Sequence
  chemically synthesized
caggcgtgagccactgcacc

SEQ ID NO: 66516 - DNA, 20 bp, Artificial Sequence
  chemically synthesized
ttcaaagaggccgggtgcag

SEQ ID NO: 66517 - DNA, 20 bp, Artificial Sequence
  chemically synthesized
aagttcaaagaggccgggtg

SEQ ID NO: 66518 - DNA, 20 bp, Artificial Sequence
  chemically synthesized
aaaaaaagttcaaagaggcc

SEQ ID NO: 66519 - DNA, 20 bp, Artificial Sequence
  chemically synthesized
aaaaaaaagttcaaagaggc

SEQ ID NO: 66520 - DNA, 20 bp, Artificial Sequence
  chemically synthesized
aaacaaaaaaaagttcaaag

SEQ ID NO: 66521 - DNA, 20 bp, Artificial Sequence
  chemically synthesized
aaaacaaaaaaaagttcaaa

SEQ ID NO: 66522 - DNA, 20 bp, Artificial Sequence
  chemically synthesized
acaaaacaaaaaaaagttca

SEQ ID NO: 66523 - DNA, 20 bp, Artificial Sequence
  chemically synthesized
aaacaaaacaaaacaaaaaa

SEQ ID NO: 66524 - DNA, 20 bp, Artificial Sequence
  chemically synthesized
ttgttttgttttgtttttac

SEQ ID NO: 66525 - DNA, 20 bp, Artificial Sequence
  chemically synthesized
ataaaagtagtaagataaac

SEQ ID NO: 66526 - DNA, 20 bp, Artificial Sequence
  chemically synthesized
cattgtataataaaagtagt

SEQ ID NO: 66527 - DNA, 20 bp, Artificial Sequence
  chemically synthesized
aaagcattgtataataaaag

SEQ ID NO: 66528 - DNA, 20 bp, Artificial Sequence
  chemically synthesized
gtaaaagcattgtataataa

SEQ ID NO: 66529 - DNA, 20 bp, Artificial Sequence
  chemically synthesized
aataataaaattttttgtaa

SEQ ID NO: 66530 - DNA, 20 bp, Artificial Sequence
  chemically synthesized
ttttattattattatactta

SEQ ID NO: 66531 - DNA, 20 bp, Artificial Sequence
  chemically synthesized
tattattatacttaaagttt

SEQ ID NO: 66532 - DNA, 20 bp, Artificial Sequence
  chemically synthesized
cacatgtaccctaaaacttt

SEQ ID NO: 66533 - DNA, 20 bp, Artificial Sequence
  chemically synthesized
attattatacttaaagtttt

SEQ ID NO: 66534 - DNA, 20 bp, Artificial Sequence
  chemically synthesized
ttattatacttaaagtttta

SEQ ID NO: 66535 - DNA, 20 bp, Artificial Sequence
  chemically synthesized
gggtacatgtgcacaacgtg

SEQ ID NO: 66536 - DNA, 20 bp, Artificial Sequence
  chemically synthesized
ggtacatgtgcacaacgtgc

SEQ ID NO: 66537 - DNA, 20 bp, Artificial Sequence
  chemically synthesized
tatgtatacatgtgccatgc

SEQ ID NO: 66538 - DNA, 20 bp, Artificial Sequence
  chemically synthesized
atgggtgcagcacaccagca

SEQ ID NO: 66539 - DNA, 20 bp, Artificial Sequence
  chemically synthesized
agttaatgggtgcagcacac

SEQ ID NO: 66540 - DNA, 20 bp, Artificial Sequence
  chemically synthesized
aaatgatgagttaatgggtg

SEQ ID NO: 66541 - DNA, 20 bp, Artificial Sequence
  chemically synthesized
acgctaaatgatgagttaat

SEQ ID NO: 66542 - DNA, 20 bp, Artificial Sequence
  chemically synthesized
aacgctaaatgatgagttaa

SEQ ID NO: 66543 - DNA, 20 bp, Artificial Sequence
  chemically synthesized
gcacccattaactcatcatt

SEQ ID NO: 66544 - DNA, 20 bp, Artificial Sequence
  chemically synthesized
tatacgtaacgctaaatgat

SEQ ID NO: 66545 - DNA, 20 bp, Artificial Sequence
  chemically synthesized
gtggggagggatagcattag

SEQ ID NO: 66546 - DNA, 20 bp, Artificial Sequence
  chemically synthesized
gagtggggagggatagcatt

SEQ ID NO: 66547 - DNA, 20 bp, Artificial Sequence
  chemically synthesized
ggagtggggagggatagcat

SEQ ID NO: 66548 - DNA, 20 bp, Artificial Sequence
  chemically synthesized
gttgggggagtggggaggga

SEQ ID NO: 66549 - DNA, 20 bp, Artificial Sequence
  chemically synthesized
tggggttgggggagtgggga

SEQ ID NO: 66550 - DNA, 20 bp, Artificial Sequence
  chemically synthesized
ttggggttgggggagtgggg

SEQ ID NO: 66551 - DNA, 20 bp, Artificial Sequence
  chemically synthesized
tttggggttgggggagtggg

SEQ ID NO: 66552 - DNA, 20 bp, Artificial Sequence
  chemically synthesized
gttttggggttgggggagtg

SEQ ID NO: 66553 - DNA, 20 bp, Artificial Sequence
  chemically synthesized
tgttttggggttgggggagt

SEQ ID NO: 66554 - DNA, 20 bp, Artificial Sequence
  chemically synthesized
atgttttggggttgggggag

SEQ ID NO: 66555 - DNA, 20 bp, Artificial Sequence
  chemically synthesized
ggaatgttttggggttgggg

SEQ ID NO: 66556 - DNA, 20 bp, Artificial Sequence
  chemically synthesized
ggggaatgttttggggttgg

SEQ ID NO: 66557 - DNA, 20 bp, Artificial Sequence
  chemically synthesized
cggggaatgttttggggttg

SEQ ID NO: 66558 - DNA, 20 bp, Artificial Sequence
  chemically synthesized
ccggggaatgttttggggtt

SEQ ID NO: 66559 - DNA, 20 bp, Artificial Sequence
  chemically synthesized
accggggaatgttttggggt

SEQ ID NO: 66560 - DNA, 20 bp, Artificial Sequence
  chemically synthesized
acacaccggggaatgttttg

SEQ ID NO: 66561 - DNA, 20 bp, Artificial Sequence
  chemically synthesized
cacacaccggggaatgtttt

SEQ ID NO: 66562 - DNA, 20 bp, Artificial Sequence
  chemically synthesized
tcacacaccggggaatgttt

SEQ ID NO: 66563 - DNA, 20 bp, Artificial Sequence
  chemically synthesized
cccaaccccaaaacattccc

SEQ ID NO: 66564 - DNA, 20 bp, Artificial Sequence
  chemically synthesized
aaggggaacatcacacaccg

SEQ ID NO: 66565 - DNA, 20 bp, Artificial Sequence
  chemically synthesized
gaaggggaacatcacacacc

SEQ ID NO: 66566 - DNA, 20 bp, Artificial Sequence
  chemically synthesized
ggaaggggaacatcacacac

SEQ ID NO: 66567 - DNA, 20 bp, Artificial Sequence
  chemically synthesized
gaacacatggacaaaggaag

SEQ ID NO: 66568 - DNA, 20 bp, Artificial Sequence
  chemically synthesized
agaacacatggacaaaggaa

SEQ ID NO: 66569 - DNA, 20 bp, Artificial Sequence
  chemically synthesized
gagaacacatggacaaagga

SEQ ID NO: 66570 - DNA, 20 bp, Artificial Sequence
  chemically synthesized
tgagaacacatggacaaagg

SEQ ID NO: 66571 - DNA, 20 bp, Artificial Sequence
  chemically synthesized
caatgagaacacatggacaa

SEQ ID NO: 66572 - DNA, 20 bp, Artificial Sequence
  chemically synthesized
acaatgagaacacatggaca

SEQ ID NO: 66573 - DNA, 20 bp, Artificial Sequence
  chemically synthesized
aattgaacaatgagaacaca

SEQ ID NO: 66574 - DNA, 20 bp, Artificial Sequence
  chemically synthesized
ataggtgggaattgaacaat

SEQ ID NO: 66575 - DNA, 20 bp, Artificial Sequence
  chemically synthesized
attgttcaattcccacctat

SEQ ID NO: 66576 - DNA, 20 bp, Artificial Sequence
  chemically synthesized
ccatgttctcactcataggt

SEQ ID NO: 66577 - DNA, 20 bp, Artificial Sequence
  chemically synthesized
cccatgttctcactcatagg

SEQ ID NO: 66578 - DNA, 20 bp, Artificial Sequence
  chemically synthesized
ttcaattcccacctatgagt

SEQ ID NO: 66579 - DNA, 20 bp, Artificial Sequence
  chemically synthesized
caccccatgttctcactcat

SEQ ID NO: 66580 - DNA, 20 bp, Artificial Sequence
  chemically synthesized
acaccccatgttctcactca

SEQ ID NO: 66581 - DNA, 20 bp, Artificial Sequence
  chemically synthesized
cccacctatgagtgagaaca

SEQ ID NO: 66582 - DNA, 20 bp, Artificial Sequence
  chemically synthesized
ccacctatgagtgagaacat

SEQ ID NO: 66583 - DNA, 20 bp, Artificial Sequence
  chemically synthesized
cacctatgagtgagaacatg

SEQ ID NO: 66584 - DNA, 20 bp, Artificial Sequence
  chemically synthesized
gagtgagaacatggggtgtt

SEQ ID NO: 66585 - DNA, 20 bp, Artificial Sequence
  chemically synthesized
aacatggggtgtttggtttt

SEQ ID NO: 66586 - DNA, 20 bp, Artificial Sequence
  chemically synthesized
ttggtttttggtccttgtga

SEQ ID NO: 66587 - DNA, 20 bp, Artificial Sequence
  chemically synthesized
attctcagcaaactatcaca

SEQ ID NO: 66588 - DNA, 20 bp, Artificial Sequence
  chemically synthesized
cattctcagcaaactatcac

SEQ ID NO: 66589 - DNA, 20 bp, Artificial Sequence
  chemically synthesized
ggtccttgtgatagtttgct

SEQ ID NO: 66590 - DNA, 20 bp, Artificial Sequence
  chemically synthesized
tgatagtttgctgagaatga

SEQ ID NO: 66591 - DNA, 20 bp, Artificial Sequence
  chemically synthesized
aagctggaaaccatcattct

SEQ ID NO: 66592 - DNA, 20 bp, Artificial Sequence
  chemically synthesized
ttgctgagaatgatggtttc

SEQ ID NO: 66593 - DNA, 20 bp, Artificial Sequence
  chemically synthesized
tgtagggacatggatgaagc

SEQ ID NO: 66594 - DNA, 20 bp, Artificial Sequence
  chemically synthesized
cctttgtagggacatggatg

SEQ ID NO: 66595 - DNA, 20 bp, Artificial Sequence
  chemically synthesized
tcatgtcctttgtagggaca

SEQ ID NO: 66596 - DNA, 20 bp, Artificial Sequence
  chemically synthesized
gcttcatccatgtccctaca

SEQ ID NO: 66597 - DNA, 20 bp, Artificial Sequence
  chemically synthesized
cttcatccatgtccctacaa

SEQ ID NO: 66598 - DNA, 20 bp, Artificial Sequence
  chemically synthesized
atgaattcatgtcctttgta

SEQ ID NO: 66599 - DNA, 20 bp, Artificial Sequence
  chemically synthesized
gatgaattcatgtcctttgt

SEQ ID NO: 66600 - DNA, 20 bp, Artificial Sequence
  chemically synthesized
tgatgaattcatgtcctttg

SEQ ID NO: 66601 - DNA, 20 bp, Artificial Sequence
  chemically synthesized
catgaattcatcatttttta

SEQ ID NO: 66602 - DNA, 20 bp, Artificial Sequence
  chemically synthesized
catcattttttatggctgca

SEQ ID NO: 66603 - DNA, 20 bp, Artificial Sequence
  chemically synthesized
atacaccagagaatactatg

SEQ ID NO: 66604 - DNA, 20 bp, Artificial Sequence
  chemically synthesized
tatggctgcatagtattctc

SEQ ID NO: 66605 - DNA, 20 bp, Artificial Sequence
  chemically synthesized
caaagagcacatatacacca

SEQ ID NO: 66606 - DNA, 20 bp, Artificial Sequence
  chemically synthesized
ttcaaagagcacatatacac

SEQ ID NO: 66607 - DNA, 20 bp, Artificial Sequence
  chemically synthesized
accaagatcaaatgttcaaa

SEQ ID NO: 66608 - DNA, 20 bp, Artificial Sequence
  chemically synthesized
ataccaagatcaaatgttca

SEQ ID NO: 66609 - DNA, 20 bp, Artificial Sequence
  chemically synthesized
gctctttgaacatttgatct

SEQ ID NO: 66610 - DNA, 20 bp, Artificial Sequence
  chemically synthesized
aaggataacattaagatacc

SEQ ID NO: 66611 - DNA, 20 bp, Artificial Sequence
  chemically synthesized
ggatgggaaaggataacatt

SEQ ID NO: 66612 - DNA, 20 bp, Artificial Sequence
  chemically synthesized
tacctttccttggatgggaa

SEQ ID NO: 66613 - DNA, 20 bp, Artificial Sequence
  chemically synthesized
atacctttccttggatggga

SEQ ID NO: 66614 - DNA, 20 bp, Artificial Sequence
  chemically synthesized
aatgttatcctttcccatcc

SEQ ID NO: 66615 - DNA, 20 bp, Artificial Sequence
  chemically synthesized
atgttatcctttcccatcca

SEQ ID NO: 66616 - DNA, 20 bp, Artificial Sequence
  chemically synthesized
ctagatacctttccttggat

SEQ ID NO: 66617 - DNA, 20 bp, Artificial Sequence
  chemically synthesized
gctagatacctttccttgga

SEQ ID NO: 66618 - DNA, 20 bp, Artificial Sequence
  chemically synthesized
tatcctttcccatccaagga

SEQ ID NO: 66619 - DNA, 20 bp, Artificial Sequence
  chemically synthesized
atcctttcccatccaaggaa

SEQ ID NO: 66620 - DNA, 20 bp, Artificial Sequence
  chemically synthesized
atgggctagatacctttcct

SEQ ID NO: 66621 - DNA, 20 bp, Artificial Sequence
  chemically synthesized
cccatccaaggaaaggtatc

SEQ ID NO: 66622 - DNA, 20 bp, Artificial Sequence
  chemically synthesized
taaacgcaaagaaaatgggc

SEQ ID NO: 66623 - DNA, 20 bp, Artificial Sequence
  chemically synthesized
ggagtaaacgcaaagaaaat

SEQ ID NO: 66624 - DNA, 20 bp, Artificial Sequence
  chemically synthesized
gggagtaaacgcaaagaaaa

SEQ ID NO: 66625 - DNA, 20 bp, Artificial Sequence
  chemically synthesized
atctggagggagtaaacgca

SEQ ID NO: 66626 - DNA, 20 bp, Artificial Sequence
  chemically synthesized
ttctttgcgtttactccctc

SEQ ID NO: 66627 - DNA, 20 bp, Artificial Sequence
  chemically synthesized
gacattagaacatctggagg

SEQ ID NO: 66628 - DNA, 20 bp, Artificial Sequence
  chemically synthesized
cagacattagaacatctgga

SEQ ID NO: 66629 - DNA, 20 bp, Artificial Sequence
  chemically synthesized
gcagacattagaacatctgg

SEQ ID NO: 66630 - DNA, 20 bp, Artificial Sequence
  chemically synthesized
agcagacattagaacatctg

SEQ ID NO: 66631 - DNA, 20 bp, Artificial Sequence
  chemically synthesized
ggagcagacattagaacatc

SEQ ID NO: 66632 - DNA, 20 bp, Artificial Sequence
  chemically synthesized
cagcattttggagcagacat

SEQ ID NO: 66633 - DNA, 20 bp, Artificial Sequence
  chemically synthesized
ggtcacccagcattttggag

SEQ ID NO: 66634 - DNA, 20 bp, Artificial Sequence
  chemically synthesized
tggggtcacccagcattttg

SEQ ID NO: 66635 - DNA, 20 bp, Artificial Sequence
  chemically synthesized
taatgtctgctccaaaatgc

SEQ ID NO: 66636 - DNA, 20 bp, Artificial Sequence
  chemically synthesized
aatgtctgctccaaaatgct

SEQ ID NO: 66637 - DNA, 20 bp, Artificial Sequence
  chemically synthesized
gatggggtcacccagcattt

SEQ ID NO: 66638 - DNA, 20 bp, Artificial Sequence
  chemically synthesized
agctctaggatggggtcacc

SEQ ID NO: 66639 - DNA, 20 bp, Artificial Sequence
  chemically synthesized
aatgctgggtgaccccatcc

SEQ ID NO: 66640 - DNA, 20 bp, Artificial Sequence
  chemically synthesized
tgctgggtgaccccatccta

SEQ ID NO: 66641 - DNA, 20 bp, Artificial Sequence
  chemically synthesized
atgtgagcagctctaggatg

SEQ ID NO: 66642 - DNA, 20 bp, Artificial Sequence
  chemically synthesized
catgtgagcagctctaggat

SEQ ID NO: 66643 - DNA, 20 bp, Artificial Sequence
  chemically synthesized
ccatgtgagcagctctagga

SEQ ID NO: 66644 - DNA, 20 bp, Artificial Sequence
  chemically synthesized
tataccatgtgagcagctct

SEQ ID NO: 66645 - DNA, 20 bp, Artificial Sequence
  chemically synthesized
gtataccatgtgagcagctc

SEQ ID NO: 66646 - DNA, 20 bp, Artificial Sequence
  chemically synthesized
ccatcctagagctgctcaca

SEQ ID NO: 66647 - DNA, 20 bp, Artificial Sequence
  chemically synthesized
gatcctgtataccatgtgag

SEQ ID NO: 66648 - DNA, 20 bp, Artificial Sequence
  chemically synthesized
tatgatcctgtataccatgt

SEQ ID NO: 66649 - DNA, 20 bp, Artificial Sequence
  chemically synthesized
agagctgctcacatggtata

SEQ ID NO: 66650 - DNA, 20 bp, Artificial Sequence
  chemically synthesized
gagctgctcacatggtatac

SEQ ID NO: 66651 - DNA, 20 bp, Artificial Sequence
  chemically synthesized
tcacatggtatacaggatca

SEQ ID NO: 66652 - DNA, 20 bp, Artificial Sequence
  chemically synthesized
ggatcatagcacttttgctt

SEQ ID NO: 66653 - DNA, 20 bp, Artificial Sequence
  chemically synthesized
aagtcaattcacttaagcaa

SEQ ID NO: 66654 - DNA, 20 bp, Artificial Sequence
  chemically synthesized
agaaataagtcaattcactt

SEQ ID NO: 66655 - DNA, 20 bp, Artificial Sequence
  chemically synthesized
gggcatgacttacaagaaat

SEQ ID NO: 66656 - DNA, 20 bp, Artificial Sequence
  chemically synthesized
tgaattgacttatttcttgt

SEQ ID NO: 66657 - DNA, 20 bp, Artificial Sequence
  chemically synthesized
tgctgctgggcatgacttac

SEQ ID NO: 66658 - DNA, 20 bp, Artificial Sequence
  chemically synthesized
tatttcttgtaagtcatgcc

SEQ ID NO: 66659 - DNA, 20 bp, Artificial Sequence
  chemically synthesized
ttcttgtaagtcatgcccag

SEQ ID NO: 66660 - DNA, 20 bp, Artificial Sequence
  chemically synthesized
gaggaagtattaatgctgct

SEQ ID NO: 66661 - DNA, 20 bp, Artificial Sequence
  chemically synthesized
ggaggaagtattaatgctgc

SEQ ID NO: 66662 - DNA, 20 bp, Artificial Sequence
  chemically synthesized
ttgtggttgtgttgaggagg

SEQ ID NO: 66663 - DNA, 20 bp, Artificial Sequence
  chemically synthesized
ctcttgtggttgtgttgagg

SEQ ID NO: 66664 - DNA, 20 bp, Artificial Sequence
  chemically synthesized
gctcttgtggttgtgttgag

SEQ ID NO: 66665 - DNA, 20 bp, Artificial Sequence
  chemically synthesized
gagctcttgtggttgtgttg

SEQ ID NO: 66666 - DNA, 20 bp, Artificial Sequence
  chemically synthesized
agagctcttgtggttgtgtt

SEQ ID NO: 66667 - DNA, 20 bp, Artificial Sequence
  chemically synthesized
ttcctcctcaacacaaccac

SEQ ID NO: 66668 - DNA, 20 bp, Artificial Sequence
  chemically synthesized
cctcctcaacacaaccacaa

SEQ ID NO: 66669 - DNA, 20 bp, Artificial Sequence
  chemically synthesized
ggttccctccagagctcttg

SEQ ID NO: 66670 - DNA, 20 bp, Artificial Sequence
  chemically synthesized
caacacaaccacaagagctc

SEQ ID NO: 66671 - DNA, 20 bp, Artificial Sequence
  chemically synthesized
acacaaccacaagagctctg

SEQ ID NO: 66672 - DNA, 20 bp, Artificial Sequence
  chemically synthesized
cacaaccacaagagctctgg

SEQ ID NO: 66673 - DNA, 20 bp, Artificial Sequence
  chemically synthesized
acaaccacaagagctctgga

SEQ ID NO: 66674 - DNA, 20 bp, Artificial Sequence
  chemically synthesized
taaaggaggggttccctcca

SEQ ID NO: 66675 - DNA, 20 bp, Artificial Sequence
  chemically synthesized
agtaaaggaggggttccctc

SEQ ID NO: 66676 - DNA, 20 bp, Artificial Sequence
  chemically synthesized
cccccattgtagtaaaggag

SEQ ID NO: 66677 - DNA, 20 bp, Artificial Sequence
  chemically synthesized
acccccattgtagtaaagga

SEQ ID NO: 66678 - DNA, 20 bp, Artificial Sequence
  chemically synthesized
aacccccattgtagtaaagg

SEQ ID NO: 66679 - DNA, 20 bp, Artificial Sequence
  chemically synthesized
aaacccccattgtagtaaag

SEQ ID NO: 66680 - DNA, 20 bp, Artificial Sequence
  chemically synthesized
gaaaacccccattgtagtaa

SEQ ID NO: 66681 - DNA, 20 bp, Artificial Sequence
  chemically synthesized
agaaaacccccattgtagta

SEQ ID NO: 66682 - DNA, 20 bp, Artificial Sequence
  chemically synthesized
gaacccctcctttactacaa

SEQ ID NO: 66683 - DNA, 20 bp, Artificial Sequence
  chemically synthesized
aacccctcctttactacaat

SEQ ID NO: 66684 - DNA, 20 bp, Artificial Sequence
  chemically synthesized
acccctcctttactacaatg

SEQ ID NO: 66685 - DNA, 20 bp, Artificial Sequence
  chemically synthesized
cccctcctttactacaatgg

SEQ ID NO: 66686 - DNA, 20 bp, Artificial Sequence
  chemically synthesized
agcagagaaaacccccattg

SEQ ID NO: 66687 - DNA, 20 bp, Artificial Sequence
  chemically synthesized
tgggggttttctctgctttc

SEQ ID NO: 66688 - DNA, 20 bp, Artificial Sequence
  chemically synthesized
catttccccactggaaagca

SEQ ID NO: 66689 - DNA, 20 bp, Artificial Sequence
  chemically synthesized
cccatttccccactggaaag

SEQ ID NO: 66690 - DNA, 20 bp, Artificial Sequence
  chemically synthesized
gggttttctctgctttccag

SEQ ID NO: 66691 - DNA, 20 bp, Artificial Sequence
  chemically synthesized
ggttttctctgctttccagt

SEQ ID NO: 66692 - DNA, 20 bp, Artificial Sequence
  chemically synthesized
gttttctctgctttccagtg

SEQ ID NO: 66693 - DNA, 20 bp, Artificial Sequence
  chemically synthesized
gcccccatttccccactgga

SEQ ID NO: 66694 - DNA, 20 bp, Artificial Sequence
  chemically synthesized
agaagcccccatttccccac

SEQ ID NO: 66695 - DNA, 20 bp, Artificial Sequence
  chemically synthesized
tctgctttccagtggggaaa

SEQ ID NO: 66696 - DNA, 20 bp, Artificial Sequence
  chemically synthesized
ctgctttccagtggggaaat

SEQ ID NO: 66697 - DNA, 20 bp, Artificial Sequence
  chemically synthesized
tgctttccagtggggaaatg

SEQ ID NO: 66698 - DNA, 20 bp, Artificial Sequence
  chemically synthesized
gctttccagtggggaaatgg

SEQ ID NO: 66699 - DNA, 20 bp, Artificial Sequence
  chemically synthesized
aggctagtaaatcatgggag

SEQ ID NO: 66700 - DNA, 20 bp, Artificial Sequence
  chemically synthesized
gagaggctagtaaatcatgg

SEQ ID NO: 66701 - DNA, 20 bp, Artificial Sequence
  chemically synthesized
ttgagaggctagtaaatcat

SEQ ID NO: 66702 - DNA, 20 bp, Artificial Sequence
  chemically synthesized
cttgagaggctagtaaatca

SEQ ID NO: 66703 - DNA, 20 bp, Artificial Sequence
  chemically synthesized
gggcttctcccatgatttac

SEQ ID NO: 66704 - DNA, 20 bp, Artificial Sequence
  chemically synthesized
ccatgatttactagcctctc

SEQ ID NO: 66705 - DNA, 20 bp, Artificial Sequence
  chemically synthesized
ccacaatagtcttgagaggc

SEQ ID NO: 66706 - DNA, 20 bp, Artificial Sequence
  chemically synthesized
attgccacaatagtcttgag

SEQ ID NO: 66707 - DNA, 20 bp, Artificial Sequence
  chemically synthesized
aattgccacaatagtcttga

SEQ ID NO: 66708 - DNA, 20 bp, Artificial Sequence
  chemically synthesized
caaattgccacaatagtctt

SEQ ID NO: 66709 - DNA, 20 bp, Artificial Sequence
  chemically synthesized
ctagcctctcaagactattg

SEQ ID NO: 66710 - DNA, 20 bp, Artificial Sequence
  chemically synthesized
atcttaccaaattgccacaa

SEQ ID NO: 66711 - DNA, 20 bp, Artificial Sequence
  chemically synthesized
tcaagactattgtggcaatt

SEQ ID NO: 66712 - DNA, 20 bp, Artificial Sequence
  chemically synthesized
gactattgtggcaatttggt

SEQ ID NO: 66713 - DNA, 20 bp, Artificial Sequence
  chemically synthesized
gagttgactgagcattttca

SEQ ID NO: 66714 - DNA, 20 bp, Artificial Sequence
  chemically synthesized
gataatactttgaaaatgct

SEQ ID NO: 66715 - DNA, 20 bp, Artificial Sequence
  chemically synthesized
attgcactttagagttgact

SEQ ID NO: 66716 - DNA, 20 bp, Artificial Sequence
  chemically synthesized
aaaatgctcagtcaactcta

SEQ ID NO: 66717 - DNA, 20 bp, Artificial Sequence
  chemically synthesized
tatatctgcattgcacttta

SEQ ID NO: 66718 - DNA, 20 bp, Artificial Sequence
  chemically synthesized
tttatatctgcattgcactt

SEQ ID NO: 66719 - DNA, 20 bp, Artificial Sequence
  chemically synthesized
gtcaactctaaagtgcaatg

SEQ ID NO: 66720 - DNA, 20 bp, Artificial Sequence
  chemically synthesized
taaagtgcaatgcagatata

SEQ ID NO: 66721 - DNA, 20 bp, Artificial Sequence
  chemically synthesized
gcaatgcagatataaagtat

SEQ ID NO: 66722 - DNA, 20 bp, Artificial Sequence
  chemically synthesized
cagatataaagtataagtaa

SEQ ID NO: 66723 - DNA, 20 bp, Artificial Sequence
  chemically synthesized
ggatatttaaaatatttcag

SEQ ID NO: 66724 - DNA, 20 bp, Artificial Sequence
  chemically synthesized
caaggatatttaaaatattt

SEQ ID NO: 66725 - DNA, 20 bp, Artificial Sequence
  chemically synthesized
tgaaatattttaaatatcct

SEQ ID NO: 66726 - DNA, 20 bp, Artificial Sequence
  chemically synthesized
gaaatattttaaatatcctt

SEQ ID NO: 66727 - DNA, 20 bp, Artificial Sequence
  chemically synthesized
catgattgtattagggccca

SEQ ID NO: 66728 - DNA, 20 bp, Artificial Sequence
  chemically synthesized
tcatgattgtattagggccc

SEQ ID NO: 66729 - DNA, 20 bp, Artificial Sequence
  chemically synthesized
attttatcatgattgtatta

SEQ ID NO: 66730 - DNA, 20 bp, Artificial Sequence
  chemically synthesized
gattttatcatgattgtatt

SEQ ID NO: 66731 - DNA, 20 bp, Artificial Sequence
  chemically synthesized
tgattttatcatgattgtat

SEQ ID NO: 66732 - DNA, 20 bp, Artificial Sequence
  chemically synthesized
taatacaatcatgataaaat

SEQ ID NO: 66733 - DNA, 20 bp, Artificial Sequence
  chemically synthesized
tacaatcatgataaaatcag

SEQ ID NO: 66734 - DNA, 20 bp, Artificial Sequence
  chemically synthesized
aaaatcagcagtcttctaca

SEQ ID NO: 66735 - DNA, 20 bp, Artificial Sequence
  chemically synthesized
aaatcagcagtcttctacat

SEQ ID NO: 66736 - DNA, 20 bp, Artificial Sequence
  chemically synthesized
ttttatttgttcctatgtag

SEQ ID NO: 66737 - DNA, 20 bp, Artificial Sequence
  chemically synthesized
ctgttttatttgttcctatg

SEQ ID NO: 66738 - DNA, 20 bp, Artificial Sequence
  chemically synthesized
ctacataggaacaaataaaa

SEQ ID NO: 66739 - DNA, 20 bp, Artificial Sequence
  chemically synthesized
taaaacagattctccccatt

SEQ ID NO: 66740 - DNA, 20 bp, Artificial Sequence
  chemically synthesized
agttttgtttacttaatggg

SEQ ID NO: 66741 - DNA, 20 bp, Artificial Sequence
  chemically synthesized
taagttttgtttacttaatg

SEQ ID NO: 66742 - DNA, 20 bp, Artificial Sequence
  chemically synthesized
ctaagttttgtttacttaat

SEQ ID NO: 66743 - DNA, 20 bp, Artificial Sequence
  chemically synthesized
cctaagttttgtttacttaa

SEQ ID NO: 66744 - DNA, 20 bp, Artificial Sequence
  chemically synthesized
cccattaagtaaacaaaact

SEQ ID NO: 66745 - DNA, 20 bp, Artificial Sequence
  chemically synthesized
ccattaagtaaacaaaactt

SEQ ID NO: 66746 - DNA, 20 bp, Artificial Sequence
  chemically synthesized
cattaagtaaacaaaactta

SEQ ID NO: 66747 - DNA, 20 bp, Artificial Sequence
  chemically synthesized
taagtaaacaaaacttaggg

SEQ ID NO: 66748 - DNA, 20 bp, Artificial Sequence
  chemically synthesized
aagtaaacaaaacttagggt

SEQ ID NO: 66749 - DNA, 20 bp, Artificial Sequence
  chemically synthesized
tcctttttcaagcctaccct

SEQ ID NO: 66750 - DNA, 20 bp, Artificial Sequence
  chemically synthesized
aacttagggtaggcttgaaa

SEQ ID NO: 66751 - DNA, 20 bp, Artificial Sequence
  chemically synthesized
acttagggtaggcttgaaaa

SEQ ID NO: 66752 - DNA, 20 bp, Artificial Sequence
  chemically synthesized
ttcacaacttgtcctttttc

SEQ ID NO: 66753 - DNA, 20 bp, Artificial Sequence
  chemically synthesized
gggtaggcttgaaaaaggac

SEQ ID NO: 66754 - DNA, 20 bp, Artificial Sequence
  chemically synthesized
aagttgtgaaattaaatttc

SEQ ID NO: 66755 - DNA, 20 bp, Artificial Sequence
  chemically synthesized
cctaaattgaattaaaaatc

SEQ ID NO: 66756 - DNA, 20 bp, Artificial Sequence
  chemically synthesized
tccagatttttaattcaatt

SEQ ID NO: 66757 - DNA, 20 bp, Artificial Sequence
  chemically synthesized
ccagatttttaattcaattt

SEQ ID NO: 66758 - DNA, 20 bp, Artificial Sequence
  chemically synthesized
aattcaatttaggtgttttc

SEQ ID NO: 66759 - DNA, 20 bp, Artificial Sequence
  chemically synthesized
atttaggtgttttctggtgc

SEQ ID NO: 66760 - DNA, 20 bp, Artificial Sequence
  chemically synthesized
aacttcaaaccatctggcac

SEQ ID NO: 66761 - DNA, 20 bp, Artificial Sequence
  chemically synthesized
aggtgttttctggtgccaga

SEQ ID NO: 66762 - DNA, 20 bp, Artificial Sequence
  chemically synthesized
tttaagaacttcaaaccatc

SEQ ID NO: 66763 - DNA, 20 bp, Artificial Sequence
  chemically synthesized
ttctggtgccagatggtttg

SEQ ID NO: 66764 - DNA, 20 bp, Artificial Sequence
  chemically synthesized
aaataaaataaaaatggttt

SEQ ID NO: 66765 - DNA, 20 bp, Artificial Sequence
  chemically synthesized
tgaataaaataaaataaaaa

SEQ ID NO: 66766 - DNA, 20 bp, Artificial Sequence
  chemically synthesized
ttttattcatttattttttt

SEQ ID NO: 66767 - DNA, 20 bp, Artificial Sequence
  chemically synthesized
attcatttatttttttgaga

SEQ ID NO: 66768 - DNA, 20 bp, Artificial Sequence
  chemically synthesized
atttatttttttgagataga

SEQ ID NO: 66769 - DNA, 20 bp, Artificial Sequence
  chemically synthesized
ttatttttttgagatagata

SEQ ID NO: 66770 - DNA, 20 bp, Artificial Sequence
  chemically synthesized
tccagcctgggcgatagagc

SEQ ID NO: 66771 - DNA, 20 bp, Artificial Sequence
  chemically synthesized
tagagtcttgctctatcgcc

SEQ ID NO: 66772 - DNA, 20 bp, Artificial Sequence
  chemically synthesized
gccctccagcctgggcgata

SEQ ID NO: 66773 - DNA, 20 bp, Artificial Sequence
  chemically synthesized
agagtcttgctctatcgccc

SEQ ID NO: 66774 - DNA, 20 bp, Artificial Sequence
  chemically synthesized
ctgccctccagcctgggcga

SEQ ID NO: 66775 - DNA, 20 bp, Artificial Sequence
  chemically synthesized
tcttgctctatcgcccaggc

SEQ ID NO: 66776 - DNA, 20 bp, Artificial Sequence
  chemically synthesized
ttgctctatcgcccaggctg

SEQ ID NO: 66777 - DNA, 20 bp, Artificial Sequence
  chemically synthesized
tgctctatcgcccaggctgg

SEQ ID NO: 66778 - DNA, 20 bp, Artificial Sequence
  chemically synthesized
gtgtcactgccctccagcct

SEQ ID NO: 66779 - DNA, 20 bp, Artificial Sequence
  chemically synthesized
gctctatcgcccaggctgga

SEQ ID NO: 66780 - DNA, 20 bp, Artificial Sequence
  chemically synthesized
cgtgtcactgccctccagcc

SEQ ID NO: 66781 - DNA, 20 bp, Artificial Sequence
  chemically synthesized
ctatcgcccaggctggaggg

SEQ ID NO: 66782 - DNA, 20 bp, Artificial Sequence
  chemically synthesized
gagatcgtgtcactgccctc

SEQ ID NO: 66783 - DNA, 20 bp, Artificial Sequence
  chemically synthesized
ggcagaggttgcagtgagca

SEQ ID NO: 66784 - DNA, 20 bp, Artificial Sequence
  chemically synthesized
aaggcagaggttgcagtgag

SEQ ID NO: 66785 - DNA, 20 bp, Artificial Sequence
  chemically synthesized
cggaaggcagaggttgcagt

SEQ ID NO: 66786 - DNA, 20 bp, Artificial Sequence
  chemically synthesized
aacccggaaggcagaggttg

SEQ ID NO: 66787 - DNA, 20 bp, Artificial Sequence
  chemically synthesized
ctctggaacccggaaggcag

SEQ ID NO: 66788 - DNA, 20 bp, Artificial Sequence
  chemically synthesized
tcactgcaacctctgccttc

SEQ ID NO: 66789 - DNA, 20 bp, Artificial Sequence
  chemically synthesized
tctctggaacccggaaggca

SEQ ID NO: 66790 - DNA, 20 bp, Artificial Sequence
  chemically synthesized
cactgcaacctctgccttcc

SEQ ID NO: 66791 - DNA, 20 bp, Artificial Sequence
  chemically synthesized
aatctctggaacccggaagg

SEQ ID NO: 66792 - DNA, 20 bp, Artificial Sequence
  chemically synthesized
gacaatctctggaacccgga

SEQ ID NO: 66793 - DNA, 20 bp, Artificial Sequence
  chemically synthesized
ggacaatctctggaacccgg

SEQ ID NO: 66794 - DNA, 20 bp, Artificial Sequence
  chemically synthesized
aacctctgccttccgggttc

SEQ ID NO: 66795 - DNA, 20 bp, Artificial Sequence
  chemically synthesized
cctctgccttccgggttcca

SEQ ID NO: 66796 - DNA, 20 bp, Artificial Sequence
  chemically synthesized
gcaggacaatctctggaacc

SEQ ID NO: 66797 - DNA, 20 bp, Artificial Sequence
  chemically synthesized
ggctgaggcaggacaatctc

SEQ ID NO: 66798 - DNA, 20 bp, Artificial Sequence
  chemically synthesized
ttccagagattgtcctgcct

SEQ ID NO: 66799 - DNA, 20 bp, Artificial Sequence
  chemically synthesized
gctactcgggaggctgaggc

SEQ ID NO: 66800 - DNA, 20 bp, Artificial Sequence
  chemically synthesized
agctactcgggaggctgagg

SEQ ID NO: 66801 - DNA, 20 bp, Artificial Sequence
  chemically synthesized
cccagctactcgggaggctg

SEQ ID NO: 66802 - DNA, 20 bp, Artificial Sequence
  chemically synthesized
tcccagctactcgggaggct

SEQ ID NO: 66803 - DNA, 20 bp, Artificial Sequence
  chemically synthesized
ttgtcctgcctcagcctccc

SEQ ID NO: 66804 - DNA, 20 bp, Artificial Sequence
  chemically synthesized
tcctgcctcagcctcccgag

SEQ ID NO: 66805 - DNA, 20 bp, Artificial Sequence
  chemically synthesized
tgtaatcccagctactcggg

SEQ ID NO: 66806 - DNA, 20 bp, Artificial Sequence
  chemically synthesized
ctgtaatcccagctactcgg

SEQ ID NO: 66807 - DNA, 20 bp, Artificial Sequence
  chemically synthesized
gcctcagcctcccgagtagc

SEQ ID NO: 66808 - DNA, 20 bp, Artificial Sequence
  chemically synthesized
gcctgtaatcccagctactc

SEQ ID NO: 66809 - DNA, 20 bp, Artificial Sequence
  chemically synthesized
cctcagcctcccgagtagct

SEQ ID NO: 66810 - DNA, 20 bp, Artificial Sequence
  chemically synthesized
cgcctgtaatcccagctact

SEQ ID NO: 66811 - DNA, 20 bp, Artificial Sequence
  chemically synthesized
ctcccgagtagctgggatta

SEQ ID NO: 66812 - DNA, 20 bp, Artificial Sequence
  chemically synthesized
tcccgagtagctgggattac

SEQ ID NO: 66813 - DNA, 20 bp, Artificial Sequence
  chemically synthesized
gtggcgggcgcctgtaatcc

SEQ ID NO: 66814 - DNA, 20 bp, Artificial Sequence
  chemically synthesized
aattagtcaggcatggtggc

SEQ ID NO: 66815 - DNA, 20 bp, Artificial Sequence
  chemically synthesized
aaattagtcaggcatggtgg

SEQ ID NO: 66816 - DNA, 20 bp, Artificial Sequence
  chemically synthesized
caaaaattagtcaggcatgg

SEQ ID NO: 66817 - DNA, 20 bp, Artificial Sequence
  chemically synthesized
atacaaaaattagtcaggca

SEQ ID NO: 66818 - DNA, 20 bp, Artificial Sequence
  chemically synthesized
aaaaaatacaaaaattagtc

SEQ ID NO: 66819 - DNA, 20 bp, Artificial Sequence
  chemically synthesized
taaaaaatacaaaaattagt

SEQ ID NO: 66820 - DNA, 20 bp, Artificial Sequence
  chemically synthesized
ctactaaaaaatacaaaaat

SEQ ID NO: 66821 - DNA, 20 bp, Artificial Sequence
  chemically synthesized
tgactaatttttgtattttt

SEQ ID NO: 66822 - DNA, 20 bp, Artificial Sequence
  chemically synthesized
ctaatttttgtattttttag

SEQ ID NO: 66823 - DNA, 20 bp, Artificial Sequence
  chemically synthesized
aatttttgtattttttagta

SEQ ID NO: 66824 - DNA, 20 bp, Artificial Sequence
  chemically synthesized
tttgtattttttagtagaga

SEQ ID NO: 66825 - DNA, 20 bp, Artificial Sequence
  chemically synthesized
ttgtattttttagtagagac

SEQ ID NO: 66826 - DNA, 20 bp, Artificial Sequence
  chemically synthesized
tgtattttttagtagagaca

SEQ ID NO: 66827 - DNA, 20 bp, Artificial Sequence
  chemically synthesized
gagacagggttttgccatgt

SEQ ID NO: 66828 - DNA, 20 bp, Artificial Sequence
  chemically synthesized
cagggttttgccatgttggc

SEQ ID NO: 66829 - DNA, 20 bp, Artificial Sequence
  chemically synthesized
caagaccagcctggccaaca

SEQ ID NO: 66830 - DNA, 20 bp, Artificial Sequence
  chemically synthesized
agggttttgccatgttggcc

SEQ ID NO: 66831 - DNA, 20 bp, Artificial Sequence
  chemically synthesized
ttttgccatgttggccaggc

SEQ ID NO: 66832 - DNA, 20 bp, Artificial Sequence
  chemically synthesized
tcagacgttcaagaccagcc

SEQ ID NO: 66833 - DNA, 20 bp, Artificial Sequence
  chemically synthesized
cgaggtcagacgttcaagac

SEQ ID NO: 66834 - DNA, 20 bp, Artificial Sequence
  chemically synthesized
tcacccgaggtcagacgttc

SEQ ID NO: 66835 - DNA, 20 bp, Artificial Sequence
  chemically synthesized
tggtcttgaacgtctgacct

SEQ ID NO: 66836 - DNA, 20 bp, Artificial Sequence
  chemically synthesized
ggtcttgaacgtctgacctc

SEQ ID NO: 66837 - DNA, 20 bp, Artificial Sequence
  chemically synthesized
gtgggcagatcacccgaggt

SEQ ID NO: 66838 - DNA, 20 bp, Artificial Sequence
  chemically synthesized
tgaggtgggcagatcacccg

SEQ ID NO: 66839 - DNA, 20 bp, Artificial Sequence
  chemically synthesized
ctgaggtgggcagatcaccc

SEQ ID NO: 66840 - DNA, 20 bp, Artificial Sequence
  chemically synthesized
ctcgggtgatctgcccacct

SEQ ID NO: 66841 - DNA, 20 bp, Artificial Sequence
  chemically synthesized
ctttgggaggctgaggtggg

SEQ ID NO: 66842 - DNA, 20 bp, Artificial Sequence
  chemically synthesized
gcactttgggaggctgaggt

SEQ ID NO: 66843 - DNA, 20 bp, Artificial Sequence
  chemically synthesized
ggcactttgggaggctgagg

SEQ ID NO: 66844 - DNA, 20 bp, Artificial Sequence
  chemically synthesized
cctggcactttgggaggctg

SEQ ID NO: 66845 - DNA, 20 bp, Artificial Sequence
  chemically synthesized
tcctggcactttgggaggct

SEQ ID NO: 66846 - DNA, 20 bp, Artificial Sequence
  chemically synthesized
ctgcccacctcagcctccca

SEQ ID NO: 66847 - DNA, 20 bp, Artificial Sequence
  chemically synthesized
tataatcctggcactttggg

SEQ ID NO: 66848 - DNA, 20 bp, Artificial Sequence
  chemically synthesized
ctataatcctggcactttgg

SEQ ID NO: 66849 - DNA, 20 bp, Artificial Sequence
  chemically synthesized
acctcagcctcccaaagtgc

SEQ ID NO: 66850 - DNA, 20 bp, Artificial Sequence
  chemically synthesized
gtctataatcctggcacttt

SEQ ID NO: 66851 - DNA, 20 bp, Artificial Sequence
  chemically synthesized
cctcagcctcccaaagtgcc

SEQ ID NO: 66852 - DNA, 20 bp, Artificial Sequence
  chemically synthesized
cgtctataatcctggcactt

SEQ ID NO: 66853 - DNA, 20 bp, Artificial Sequence
  chemically synthesized
ctcccaaagtgccaggatta

SEQ ID NO: 66854 - DNA, 20 bp, Artificial Sequence
  chemically synthesized
gtgactcacgtctataatcc

SEQ ID NO: 66855 - DNA, 20 bp, Artificial Sequence
  chemically synthesized
agtgccaggattatagacgt

SEQ ID NO: 66856 - DNA, 20 bp, Artificial Sequence
  chemically synthesized
tagacgtgagtcaccgtgtc

SEQ ID NO: 66857 - DNA, 20 bp, Artificial Sequence
  chemically synthesized
aatggtttaagggccggaca

SEQ ID NO: 66858 - DNA, 20 bp, Artificial Sequence
  chemically synthesized
tttaaaaatggtttaagggc

SEQ ID NO: 66859 - DNA, 20 bp, Artificial Sequence
  chemically synthesized
ccgctttaaaaatggtttaa

SEQ ID NO: 66860 - DNA, 20 bp, Artificial Sequence
  chemically synthesized
gccgctttaaaaatggttta

SEQ ID NO: 66861 - DNA, 20 bp, Artificial Sequence
  chemically synthesized
tgccgctttaaaaatggttt

SEQ ID NO: 66862 - DNA, 20 bp, Artificial Sequence
  chemically synthesized
cggcccttaaaccattttta

SEQ ID NO: 66863 - DNA, 20 bp, Artificial Sequence
  chemically synthesized
gatgcatgccgctttaaaaa

SEQ ID NO: 66864 - DNA, 20 bp, Artificial Sequence
  chemically synthesized
cccttaaaccatttttaaag

SEQ ID NO: 66865 - DNA, 20 bp, Artificial Sequence
  chemically synthesized
gttctttacattaaaggtta

SEQ ID NO: 66866 - DNA, 20 bp, Artificial Sequence
  chemically synthesized
gatcatgttctttacattaa

SEQ ID NO: 66867 - DNA, 20 bp, Artificial Sequence
  chemically synthesized
catctttaacctttaatgta

SEQ ID NO: 66868 - DNA, 20 bp, Artificial Sequence
  chemically synthesized
tgatcatgttctttacatta

SEQ ID NO: 66869 - DNA, 20 bp, Artificial Sequence
  chemically synthesized
taatgtaaagaacatgatca

SEQ ID NO: 66870 - DNA, 20 bp, Artificial Sequence
  chemically synthesized
taaagaacatgatcatagaa

SEQ ID NO: 66871 - DNA, 20 bp, Artificial Sequence
  chemically synthesized
agcattgcattgcatgaata

SEQ ID NO: 66872 - DNA, 20 bp, Artificial Sequence
  chemically synthesized
aagcattgcattgcatgaat

SEQ ID NO: 66873 - DNA, 20 bp, Artificial Sequence
  chemically synthesized
caatgcaatgctttaaactg

SEQ ID NO: 66874 - DNA, 20 bp, Artificial Sequence
  chemically synthesized
aagttgacatctacagttta

SEQ ID NO: 66875 - DNA, 20 bp, Artificial Sequence
  chemically synthesized
gagtgcaaagttgacatcta

SEQ ID NO: 66876 - DNA, 20 bp, Artificial Sequence
  chemically synthesized
ttttgtggtcatagagtgca

SEQ ID NO: 66877 - DNA, 20 bp, Artificial Sequence
  chemically synthesized
gtgcatattttgtggtcata

SEQ ID NO: 66878 - DNA, 20 bp, Artificial Sequence
  chemically synthesized
atgtgcatattttgtggtca

SEQ ID NO: 66879 - DNA, 20 bp, Artificial Sequence
  chemically synthesized
ggtgatatgtgcatattttg

SEQ ID NO: 66880 - DNA, 20 bp, Artificial Sequence
  chemically synthesized
taccgagttctataataaaa

SEQ ID NO: 66881 - DNA, 20 bp, Artificial Sequence
  chemically synthesized
cacatatcacccttttatta

SEQ ID NO: 66882 - DNA, 20 bp, Artificial Sequence
  chemically synthesized
gtaccgagttctataataaa

SEQ ID NO: 66883 - DNA, 20 bp, Artificial Sequence
  chemically synthesized
ggtaccgagttctataataa

SEQ ID NO: 66884 - DNA, 20 bp, Artificial Sequence
  chemically synthesized
cacccttttattatagaact

SEQ ID NO: 66885 - DNA, 20 bp, Artificial Sequence
  chemically synthesized
atatcatacctagtggtacc

SEQ ID NO: 66886 - DNA, 20 bp, Artificial Sequence
  chemically synthesized
attatagaactcggtaccac

SEQ ID NO: 66887 - DNA, 20 bp, Artificial Sequence
  chemically synthesized
ttatagaactcggtaccact

SEQ ID NO: 66888 - DNA, 20 bp, Artificial Sequence
  chemically synthesized
accatttatatcatacctag

SEQ ID NO: 66889 - DNA, 20 bp, Artificial Sequence
  chemically synthesized
gtaaccatttatatcatacc

SEQ ID NO: 66890 - DNA, 20 bp, Artificial Sequence
  chemically synthesized
accactaggtatgatataaa

SEQ ID NO: 66891 - DNA, 20 bp, Artificial Sequence
  chemically synthesized
gtatgatataaatggttact

SEQ ID NO: 66892 - DNA, 20 bp, Artificial Sequence
  chemically synthesized
tataaatggttactgagaaa

SEQ ID NO: 66893 - DNA, 20 bp, Artificial Sequence
  chemically synthesized
taaatggttactgagaaaca

SEQ ID NO: 66894 - DNA, 20 bp, Artificial Sequence
  chemically synthesized
atgcagcaaactctgtttct

SEQ ID NO: 66895 - DNA, 20 bp, Artificial Sequence
  chemically synthesized
ttctcactagaagcacgatg

SEQ ID NO: 66896 - DNA, 20 bp, Artificial Sequence
  chemically synthesized
agtttgctgcatcgtgcttc

SEQ ID NO: 66897 - DNA, 20 bp, Artificial Sequence
  chemically synthesized
tgctgcatcgtgcttctagt

SEQ ID NO: 66898 - DNA, 20 bp, Artificial Sequence
  chemically synthesized
gtgcaactatttctcactag

SEQ ID NO: 66899 - DNA, 20 bp, Artificial Sequence
  chemically synthesized
actgtgcaactatttctcac

SEQ ID NO: 66900 - DNA, 20 bp, Artificial Sequence
  chemically synthesized
atcgtgcttctagtgagaaa

SEQ ID NO: 66901 - DNA, 20 bp, Artificial Sequence
  chemically synthesized
tctagtgagaaatagttgca

SEQ ID NO: 66902 - DNA, 20 bp, Artificial Sequence
  chemically synthesized
gaaatagttgcacagtattt

SEQ ID NO: 66903 - DNA, 20 bp, Artificial Sequence
  chemically synthesized
aaatagttgcacagtattta

SEQ ID NO: 66904 - DNA, 20 bp, Artificial Sequence
  chemically synthesized
atagttgcacagtatttaag

SEQ ID NO: 66905 - DNA, 20 bp, Artificial Sequence
  chemically synthesized
aggagttgttcattatgtaa

SEQ ID NO: 66906 - DNA, 20 bp, Artificial Sequence
  chemically synthesized
ggagttgttcattatgtaat

SEQ ID NO: 66907 - DNA, 20 bp, Artificial Sequence
  chemically synthesized
tgtaatgggaactttgtgct

SEQ ID NO: 66908 - DNA, 20 bp, Artificial Sequence
  chemically synthesized
gtggagctgttctaagcaca

SEQ ID NO: 66909 - DNA, 20 bp, Artificial Sequence
  chemically synthesized
tgggaactttgtgcttagaa

SEQ ID NO: 66910 - DNA, 20 bp, Artificial Sequence
  chemically synthesized
tctccctgtggagctgttct

SEQ ID NO: 66911 - DNA, 20 bp, Artificial Sequence
  chemically synthesized
ttgtgcttagaacagctcca

SEQ ID NO: 66912 - DNA, 20 bp, Artificial Sequence
  chemically synthesized
tgtgcttagaacagctccac

SEQ ID NO: 66913 - DNA, 20 bp, Artificial Sequence
  chemically synthesized
gtgcttagaacagctccaca

SEQ ID NO: 66914 - DNA, 20 bp, Artificial Sequence
  chemically synthesized
gcttagaacagctccacagg

SEQ ID NO: 66915 - DNA, 20 bp, Artificial Sequence
  chemically synthesized
ctctattgcttctccctgtg

SEQ ID NO: 66916 - DNA, 20 bp, Artificial Sequence
  chemically synthesized
tagaacagctccacagggag

SEQ ID NO: 66917 - DNA, 20 bp, Artificial Sequence
  chemically synthesized
agctctattgcttctccctg

SEQ ID NO: 66918 - DNA, 20 bp, Artificial Sequence
  chemically synthesized
agctccacagggagaagcaa

SEQ ID NO: 66919 - DNA, 20 bp, Artificial Sequence
  chemically synthesized
ctccacagggagaagcaata

SEQ ID NO: 66920 - DNA, 20 bp, Artificial Sequence
  chemically synthesized
acagggagaagcaatagagc

SEQ ID NO: 66921 - DNA, 20 bp, Artificial Sequence
  chemically synthesized
atggagaacatttttacatc

SEQ ID NO: 66922 - DNA, 20 bp, Artificial Sequence
  chemically synthesized
aacttctacattgtgaaatg

SEQ ID NO: 66923 - DNA, 20 bp, Artificial Sequence
  chemically synthesized
taaacttctacattgtgaaa

SEQ ID NO: 66924 - DNA, 20 bp, Artificial Sequence
  chemically synthesized
atgttctccatttcacaatg

SEQ ID NO: 66925 - DNA, 20 bp, Artificial Sequence
  chemically synthesized
ttctccatttcacaatgtag

SEQ ID NO: 66926 - DNA, 20 bp, Artificial Sequence
  chemically synthesized
atgtagaagtttaatttttg

SEQ ID NO: 66927 - DNA, 20 bp, Artificial Sequence
  chemically synthesized
aattatgatagtataaggaa

SEQ ID NO: 66928 - DNA, 20 bp, Artificial Sequence
  chemically synthesized
tgtaaaattatgatagtata

SEQ ID NO: 66929 - DNA, 20 bp, Artificial Sequence
  chemically synthesized
atgtaaaattatgatagtat

SEQ ID NO: 66930 - DNA, 20 bp, Artificial Sequence
  chemically synthesized
cccaacatgtaaaattatga

SEQ ID NO: 66931 - DNA, 20 bp, Artificial Sequence
  chemically synthesized
actatcataattttacatgt

SEQ ID NO: 66932 - DNA, 20 bp, Artificial Sequence
  chemically synthesized
ctatcataattttacatgtt

SEQ ID NO: 66933 - DNA, 20 bp, Artificial Sequence
  chemically synthesized
cataattttacatgttgggt

SEQ ID NO: 66934 - DNA, 20 bp, Artificial Sequence
  chemically synthesized
caaattgtacatagaattca

SEQ ID NO: 66935 - DNA, 20 bp, Artificial Sequence
  chemically synthesized
acaggaggccaaattgtaca

SEQ ID NO: 66936 - DNA, 20 bp, Artificial Sequence
  chemically synthesized
catgaattctatgtacaatt

SEQ ID NO: 66937 - DNA, 20 bp, Artificial Sequence
  chemically synthesized
ggcaaaacaaagatgacagg

SEQ ID NO: 66938 - DNA, 20 bp, Artificial Sequence
  chemically synthesized
gggcaaaacaaagatgacag

SEQ ID NO: 66939 - DNA, 20 bp, Artificial Sequence
  chemically synthesized
gagggcaaaacaaagatgac

SEQ ID NO: 66940 - DNA, 20 bp, Artificial Sequence
  chemically synthesized
agagggcaaaacaaagatga

SEQ ID NO: 66941 - DNA, 20 bp, Artificial Sequence
  chemically synthesized
gaaagggagagggcaaaaca

SEQ ID NO: 66942 - DNA, 20 bp, Artificial Sequence
  chemically synthesized
aactataagagaaagggaga

SEQ ID NO: 66943 - DNA, 20 bp, Artificial Sequence
  chemically synthesized
caactataagagaaagggag

SEQ ID NO: 66944 - DNA, 20 bp, Artificial Sequence
  chemically synthesized
ccaactataagagaaaggga

SEQ ID NO: 66945 - DNA, 20 bp, Artificial Sequence
  chemically synthesized
ttccaactataagagaaagg

SEQ ID NO: 66946 - DNA, 20 bp, Artificial Sequence
  chemically synthesized
cattccaactataagagaaa

SEQ ID NO: 66947 - DNA, 20 bp, Artificial Sequence
  chemically synthesized
tcattccaactataagagaa

SEQ ID NO: 66948 - DNA, 20 bp, Artificial Sequence
  chemically synthesized
tgccctctccctttctctta

SEQ ID NO: 66949 - DNA, 20 bp, Artificial Sequence
  chemically synthesized
ttcattccaactataagaga

SEQ ID NO: 66950 - DNA, 20 bp, Artificial Sequence
  chemically synthesized
ctctccctttctcttatagt

SEQ ID NO: 66951 - DNA, 20 bp, Artificial Sequence
  chemically synthesized
ctgtttcattccaactataa

SEQ ID NO: 66952 - DNA, 20 bp, Artificial Sequence
  chemically synthesized
ctctgtttcattccaactat

SEQ ID NO: 66953 - DNA, 20 bp, Artificial Sequence
  chemically synthesized
ctcttatagttggaatgaaa

SEQ ID NO: 66954 - DNA, 20 bp, Artificial Sequence
  chemically synthesized
cttatagttggaatgaaaca

SEQ ID NO: 66955 - DNA, 20 bp, Artificial Sequence
  chemically synthesized
ttatagttggaatgaaacag

SEQ ID NO: 66956 - DNA, 20 bp, Artificial Sequence
  chemically synthesized
tagttggaatgaaacagagg

SEQ ID NO: 66957 - DNA, 20 bp, Artificial Sequence
  chemically synthesized
agttggaatgaaacagagga

SEQ ID NO: 66958 - DNA, 20 bp, Artificial Sequence
  chemically synthesized
ttggaatgaaacagaggaag

SEQ ID NO: 66959 - DNA, 20 bp, Artificial Sequence
  chemically synthesized
gaatgaaacagaggaaggag

SEQ ID NO: 66960 - DNA, 20 bp, Artificial Sequence
  chemically synthesized
gaaacagaggaaggagtaga

SEQ ID NO: 66961 - DNA, 20 bp, Artificial Sequence
  chemically synthesized
agaggaaggagtagacagta

SEQ ID NO: 66962 - DNA, 20 bp, Artificial Sequence
  chemically synthesized
tgtaggtcaaaatcagaaaa

SEQ ID NO: 66963 - DNA, 20 bp, Artificial Sequence
  chemically synthesized
atgtaggtcaaaatcagaaa

SEQ ID NO: 66964 - DNA, 20 bp, Artificial Sequence
  chemically synthesized
aatgtaatgtaggtcaaaat

SEQ ID NO: 66965 - DNA, 20 bp, Artificial Sequence
  chemically synthesized
aaactctcaaaatgtaatgt

SEQ ID NO: 66966 - DNA, 20 bp, Artificial Sequence
  chemically synthesized
taaactctcaaaatgtaatg

SEQ ID NO: 66967 - DNA, 20 bp, Artificial Sequence
  chemically synthesized
tttgacctacattacatttt

SEQ ID NO: 66968 - DNA, 20 bp, Artificial Sequence
  chemically synthesized
tgacctacattacattttga

SEQ ID NO: 66969 - DNA, 20 bp, Artificial Sequence
  chemically synthesized
tacattacattttgagagtt

SEQ ID NO: 66970 - DNA, 20 bp, Artificial Sequence
  chemically synthesized
cattacattttgagagttta

SEQ ID NO: 66971 - DNA, 20 bp, Artificial Sequence
  chemically synthesized
attttgagagtttagagtaa

SEQ ID NO: 66972 - DNA, 20 bp, Artificial Sequence
  chemically synthesized
ttttgagagtttagagtaat

SEQ ID NO: 66973 - DNA, 20 bp, Artificial Sequence
  chemically synthesized
tttgagagtttagagtaatg

SEQ ID NO: 66974 - DNA, 20 bp, Artificial Sequence
  chemically synthesized
gattgattaatattattata

SEQ ID NO: 66975 - DNA, 20 bp, Artificial Sequence
  chemically synthesized
atatatatttatatatttat

SEQ ID NO: 66976 - DNA, 20 bp, Artificial Sequence
  chemically synthesized
atatttatatatttatgaga

SEQ ID NO: 66977 - DNA, 20 bp, Artificial Sequence
  chemically synthesized
tccagcctgagtgacagagt

SEQ ID NO: 66978 - DNA, 20 bp, Artificial Sequence
  chemically synthesized
tggaatctcactctgtcact

SEQ ID NO: 66979 - DNA, 20 bp, Artificial Sequence
  chemically synthesized
tcactccagcctgagtgaca

SEQ ID NO: 66980 - DNA, 20 bp, Artificial Sequence
  chemically synthesized
ggaatctcactctgtcactc

SEQ ID NO: 66981 - DNA, 20 bp, Artificial Sequence
  chemically synthesized
cttcactccagcctgagtga

SEQ ID NO: 66982 - DNA, 20 bp, Artificial Sequence
  chemically synthesized
tctcactctgtcactcaggc

SEQ ID NO: 66983 - DNA, 20 bp, Artificial Sequence
  chemically synthesized
tcactctgtcactcaggctg

SEQ ID NO: 66984 - DNA, 20 bp, Artificial Sequence
  chemically synthesized
gcaccacttcactccagcct

SEQ ID NO: 66985 - DNA, 20 bp, Artificial Sequence
  chemically synthesized
ctgtcactcaggctggagtg

SEQ ID NO: 66986 - DNA, 20 bp, Artificial Sequence
  chemically synthesized
gagatcgcaccacttcactc

SEQ ID NO: 66987 - DNA, 20 bp, Artificial Sequence
  chemically synthesized
tcactcaggctggagtgaag

SEQ ID NO: 66988 - DNA, 20 bp, Artificial Sequence
  chemically synthesized
ggagtgaagtggtgcgatct

SEQ ID NO: 66989 - DNA, 20 bp, Artificial Sequence
  chemically synthesized
ggtggaggttgcagtgagcc

SEQ ID NO: 66990 - DNA, 20 bp, Artificial Sequence
  chemically synthesized
tgagaggtggaggttgcagt

SEQ ID NO: 66991 - DNA, 20 bp, Artificial Sequence
  chemically synthesized
aacctgagaggtggaggttg

SEQ ID NO: 66992 - DNA, 20 bp, Artificial Sequence
  chemically synthesized
cgcttgaacctgagaggtgg

SEQ ID NO: 66993 - DNA, 20 bp, Artificial Sequence
  chemically synthesized
tcactgcaacctccacctct

SEQ ID NO: 66994 - DNA, 20 bp, Artificial Sequence
  chemically synthesized
tcgcttgaacctgagaggtg

SEQ ID NO: 66995 - DNA, 20 bp, Artificial Sequence
  chemically synthesized
cactgcaacctccacctctc

SEQ ID NO: 66996 - DNA, 20 bp, Artificial Sequence
  chemically synthesized
aatcgcttgaacctgagagg

SEQ ID NO: 66997 - DNA, 20 bp, Artificial Sequence
  chemically synthesized
aagaatcgcttgaacctgag

SEQ ID NO: 66998 - DNA, 20 bp, Artificial Sequence
  chemically synthesized
gaagaatcgcttgaacctga

SEQ ID NO: 66999 - DNA, 20 bp, Artificial Sequence
  chemically synthesized
aacctccacctctcaggttc

SEQ ID NO: 67000 - DNA, 20 bp, Artificial Sequence
  chemically synthesized
tggaagaatcgcttgaacct

SEQ ID NO: 67001 - DNA, 20 bp, Artificial Sequence
  chemically synthesized
ttcaagcgattcttccacat

SEQ ID NO: 67002 - DNA, 20 bp, Artificial Sequence
  chemically synthesized
tacttgggaggctgatgtgg

SEQ ID NO: 67003 - DNA, 20 bp, Artificial Sequence
  chemically synthesized
agctacttgggaggctgatg

SEQ ID NO: 67004 - DNA, 20 bp, Artificial Sequence
  chemically synthesized
ttcttccacatcagcctccc

SEQ ID NO: 67005 - DNA, 20 bp, Artificial Sequence
  chemically synthesized
ttccacatcagcctcccaag

SEQ ID NO: 67006 - DNA, 20 bp, Artificial Sequence
  chemically synthesized
tgtagtcccagctacttggg

SEQ ID NO: 67007 - DNA, 20 bp, Artificial Sequence
  chemically synthesized
ctgtagtcccagctacttgg

SEQ ID NO: 67008 - DNA, 20 bp, Artificial Sequence
  chemically synthesized
acatcagcctcccaagtagc

SEQ ID NO: 67009 - DNA, 20 bp, Artificial Sequence
  chemically synthesized
gcctgtagtcccagctactt

SEQ ID NO: 67010 - DNA, 20 bp, Artificial Sequence
  chemically synthesized
catcagcctcccaagtagct

SEQ ID NO: 67011 - DNA, 20 bp, Artificial Sequence
  chemically synthesized
tgcctgtagtcccagctact

SEQ ID NO: 67012 - DNA, 20 bp, Artificial Sequence
  chemically synthesized
ctcccaagtagctgggacta

SEQ ID NO: 67013 - DNA, 20 bp, Artificial Sequence
  chemically synthesized
tcccaagtagctgggactac

SEQ ID NO: 67014 - DNA, 20 bp, Artificial Sequence
  chemically synthesized
gcggtacatgcctgtagtcc

SEQ ID NO: 67015 - DNA, 20 bp, Artificial Sequence
  chemically synthesized
ggtatggcggtacatgcctg

SEQ ID NO: 67016 - DNA, 20 bp, Artificial Sequence
  chemically synthesized
caggcatgtaccgccatacc

SEQ ID NO: 67017 - DNA, 20 bp, Artificial Sequence
  chemically synthesized
gaaaaattagccaggtatgg

SEQ ID NO: 67018 - DNA, 20 bp, Artificial Sequence
  chemically synthesized
acagaaaaattagccaggta

SEQ ID NO: 67019 - DNA, 20 bp, Artificial Sequence
  chemically synthesized
cacacacagaaaaattagcc

SEQ ID NO: 67020 - DNA, 20 bp, Artificial Sequence
  chemically synthesized
acacacacagaaaaattagc

SEQ ID NO: 67021 - DNA, 20 bp, Artificial Sequence
  chemically synthesized
aaacacacacacagaaaaat

SEQ ID NO: 67022 - DNA, 20 bp, Artificial Sequence
  chemically synthesized
aaaaaaaaaaaacacacaca

SEQ ID NO: 67023 - DNA, 20 bp, Artificial Sequence
  chemically synthesized
tttttttttttttttttttt

SEQ ID NO: 67024 - DNA, 20 bp, Artificial Sequence
  chemically synthesized
tttttttttttttttttcag

SEQ ID NO: 67025 - DNA, 20 bp, Artificial Sequence
  chemically synthesized
tttttttttttttttcagta

SEQ ID NO: 67026 - DNA, 20 bp, Artificial Sequence
  chemically synthesized
tttttttttttcagtagaga

SEQ ID NO: 67027 - DNA, 20 bp, Artificial Sequence
  chemically synthesized
ttttttttttcagtagagac

SEQ ID NO: 67028 - DNA, 20 bp, Artificial Sequence
  chemically synthesized
tttttttttcagtagagaca

SEQ ID NO: 67029 - DNA, 20 bp, Artificial Sequence
  chemically synthesized
cagggtgtcaccatgttgcc

SEQ ID NO: 67030 - DNA, 20 bp, Artificial Sequence
  chemically synthesized
cgagaccagcctgggcaaca

SEQ ID NO: 67031 - DNA, 20 bp, Artificial Sequence
  chemically synthesized
agggtgtcaccatgttgccc

SEQ ID NO: 67032 - DNA, 20 bp, Artificial Sequence
  chemically synthesized
tgtcaccatgttgcccaggc

SEQ ID NO: 67033 - DNA, 20 bp, Artificial Sequence
  chemically synthesized
caggagttcgagaccagcct

SEQ ID NO: 67034 - DNA, 20 bp, Artificial Sequence
  chemically synthesized
tcaggagttcgagaccagcc

SEQ ID NO: 67035 - DNA, 20 bp, Artificial Sequence
  chemically synthesized
tgaggtcaggagttcgagac

SEQ ID NO: 67036 - DNA, 20 bp, Artificial Sequence
  chemically synthesized
tcacttgaggtcaggagttc

SEQ ID NO: 67037 - DNA, 20 bp, Artificial Sequence
  chemically synthesized
gggggatcacttgaggtcag

SEQ ID NO: 67038 - DNA, 20 bp, Artificial Sequence
  chemically synthesized
ggtctcgaactcctgacctc

SEQ ID NO: 67039 - DNA, 20 bp, Artificial Sequence
  chemically synthesized
cagggggatcacttgaggtc

SEQ ID NO: 67040 - DNA, 20 bp, Artificial Sequence
  chemically synthesized
gcagggggatcacttgaggt

SEQ ID NO: 67041 - DNA, 20 bp, Artificial Sequence
  chemically synthesized
cgaagcagggggatcacttg

SEQ ID NO: 67042 - DNA, 20 bp, Artificial Sequence
  chemically synthesized
ccgaagcagggggatcactt

SEQ ID NO: 67043 - DNA, 20 bp, Artificial Sequence
  chemically synthesized
ctcaagtgatccccctgctt

SEQ ID NO: 67044 - DNA, 20 bp, Artificial Sequence
  chemically synthesized
ctttgggaggccgaagcagg

SEQ ID NO: 67045 - DNA, 20 bp, Artificial Sequence
  chemically synthesized
actttgggaggccgaagcag

SEQ ID NO: 67046 - DNA, 20 bp, Artificial Sequence
  chemically synthesized
cactttgggaggccgaagca

SEQ ID NO: 67047 - DNA, 20 bp, Artificial Sequence
  chemically synthesized
acactttgggaggccgaagc

SEQ ID NO: 67048 - DNA, 20 bp, Artificial Sequence
  chemically synthesized
aacactttgggaggccgaag

SEQ ID NO: 67049 - DNA, 20 bp, Artificial Sequence
  chemically synthesized
cccaacactttgggaggccg

SEQ ID NO: 67050 - DNA, 20 bp, Artificial Sequence
  chemically synthesized
ccccctgcttcggcctccca

SEQ ID NO: 67051 - DNA, 20 bp, Artificial Sequence
  chemically synthesized
tgtaatcccaacactttggg

SEQ ID NO: 67052 - DNA, 20 bp, Artificial Sequence
  chemically synthesized
ctgtaatcccaacactttgg

SEQ ID NO: 67053 - DNA, 20 bp, Artificial Sequence
  chemically synthesized
gcttcggcctcccaaagtgt

SEQ ID NO: 67054 - DNA, 20 bp, Artificial Sequence
  chemically synthesized
gcctgtaatcccaacacttt

SEQ ID NO: 67055 - DNA, 20 bp, Artificial Sequence
  chemically synthesized
cttcggcctcccaaagtgtt

SEQ ID NO: 67056 - DNA, 20 bp, Artificial Sequence
  chemically synthesized
cgcctgtaatcccaacactt

SEQ ID NO: 67057 - DNA, 20 bp, Artificial Sequence
  chemically synthesized
ctcccaaagtgttgggatta

SEQ ID NO: 67058 - DNA, 20 bp, Artificial Sequence
  chemically synthesized
tcccaaagtgttgggattac

SEQ ID NO: 67059 - DNA, 20 bp, Artificial Sequence
  chemically synthesized
agtgttgggattacaggcgt

SEQ ID NO: 67060 - DNA, 20 bp, Artificial Sequence
  chemically synthesized
gttatcggggttgggtgcag

SEQ ID NO: 67061 - DNA, 20 bp, Artificial Sequence
  chemically synthesized
aaagttatcggggttgggtg

SEQ ID NO: 67062 - DNA, 20 bp, Artificial Sequence
  chemically synthesized
cagaaaaagttatcggggtt

SEQ ID NO: 67063 - DNA, 20 bp, Artificial Sequence
  chemically synthesized
acagaaaaagttatcggggt

SEQ ID NO: 67064 - DNA, 20 bp, Artificial Sequence
  chemically synthesized
ttacacagaaaaagttatcg

SEQ ID NO: 67065 - DNA, 20 bp, Artificial Sequence
  chemically synthesized
cttacacagaaaaagttatc

SEQ ID NO: 67066 - DNA, 20 bp, Artificial Sequence
  chemically synthesized
ccttacacagaaaaagttat

SEQ ID NO: 67067 - DNA, 20 bp, Artificial Sequence
  chemically synthesized
cctacgcccttacacagaaa

SEQ ID NO: 67068 - DNA, 20 bp, Artificial Sequence
  chemically synthesized
cccgataactttttctgtgt

SEQ ID NO: 67069 - DNA, 20 bp, Artificial Sequence
  chemically synthesized
ccgataactttttctgtgta

SEQ ID NO: 67070 - DNA, 20 bp, Artificial Sequence
  chemically synthesized
cgataactttttctgtgtaa

SEQ ID NO: 67071 - DNA, 20 bp, Artificial Sequence
  chemically synthesized
aaagtacctacgcccttaca

SEQ ID NO: 67072 - DNA, 20 bp, Artificial Sequence
  chemically synthesized
actttttctgtgtaagggcg

SEQ ID NO: 67073 - DNA, 20 bp, Artificial Sequence
  chemically synthesized
ctttttctgtgtaagggcgt

SEQ ID NO: 67074 - DNA, 20 bp, Artificial Sequence
  chemically synthesized
catttctcactttgcattta

SEQ ID NO: 67075 - DNA, 20 bp, Artificial Sequence
  chemically synthesized
gcgtaggtactttaaatgca

SEQ ID NO: 67076 - DNA, 20 bp, Artificial Sequence
  chemically synthesized
aggtactttaaatgcaaagt

SEQ ID NO: 67077 - DNA, 20 bp, Artificial Sequence
  chemically synthesized
taaatgcaaagtgagaaatg

SEQ ID NO: 67078 - DNA, 20 bp, Artificial Sequence
  chemically synthesized
agtgagaaatgcagtattac

SEQ ID NO: 67079 - DNA, 20 bp, Artificial Sequence
  chemically synthesized
gtgagaaatgcagtattacc

SEQ ID NO: 67080 - DNA, 20 bp, Artificial Sequence
  chemically synthesized
tgagaaatgcagtattacca

SEQ ID NO: 67081 - DNA, 20 bp, Artificial Sequence
  chemically synthesized
gaaatgcagtattaccaggg

SEQ ID NO: 67082 - DNA, 20 bp, Artificial Sequence
  chemically synthesized
cagagcatgtttttctgccc

SEQ ID NO: 67083 - DNA, 20 bp, Artificial Sequence
  chemically synthesized
tgaattcacataagttcaca

SEQ ID NO: 67084 - DNA, 20 bp, Artificial Sequence
  chemically synthesized
aatgaattcacataagttca

SEQ ID NO: 67085 - DNA, 20 bp, Artificial Sequence
  chemically synthesized
aaggaataatgaattcacat

SEQ ID NO: 67086 - DNA, 20 bp, Artificial Sequence
  chemically synthesized
gtgaacaatcattgtaagta

SEQ ID NO: 67087 - DNA, 20 bp, Artificial Sequence
  chemically synthesized
tgtgaacaatcattgtaagt

SEQ ID NO: 67088 - DNA, 20 bp, Artificial Sequence
  chemically synthesized
gggatgtgaacaatcattgt

SEQ ID NO: 67089 - DNA, 20 bp, Artificial Sequence
  chemically synthesized
aatgattgttcacatccctg

SEQ ID NO: 67090 - DNA, 20 bp, Artificial Sequence
  chemically synthesized
ttgttcacatccctgtagta

SEQ ID NO: 67091 - DNA, 20 bp, Artificial Sequence
  chemically synthesized
agagaagtttctttactaca

SEQ ID NO: 67092 - DNA, 20 bp, Artificial Sequence
  chemically synthesized
tagagaagtttctttactac

SEQ ID NO: 67093 - DNA, 20 bp, Artificial Sequence
  chemically synthesized
gtagagaagtttctttacta

SEQ ID NO: 67094 - DNA, 20 bp, Artificial Sequence
  chemically synthesized
atgggaagttgtaagtagag

SEQ ID NO: 67095 - DNA, 20 bp, Artificial Sequence
  chemically synthesized
cctatgggaagttgtaagta

SEQ ID NO: 67096 - DNA, 20 bp, Artificial Sequence
  chemically synthesized
tacctatgggaagttgtaag

SEQ ID NO: 67097 - DNA, 20 bp, Artificial Sequence
  chemically synthesized
tgctacctatgggaagttgt

SEQ ID NO: 67098 - DNA, 20 bp, Artificial Sequence
  chemically synthesized
tctctacttacaacttccca

SEQ ID NO: 67099 - DNA, 20 bp, Artificial Sequence
  chemically synthesized
ctctacttacaacttcccat

SEQ ID NO: 67100 - DNA, 20 bp, Artificial Sequence
  chemically synthesized
cctttattgctacctatggg

SEQ ID NO: 67101 - DNA, 20 bp, Artificial Sequence
  chemically synthesized
tacttacaacttcccatagg

SEQ ID NO: 67102 - DNA, 20 bp, Artificial Sequence
  chemically synthesized
ggacctttattgctacctat

SEQ ID NO: 67103 - DNA, 20 bp, Artificial Sequence
  chemically synthesized
gggacctttattgctaccta

SEQ ID NO: 67104 - DNA, 20 bp, Artificial Sequence
  chemically synthesized
acttcccataggtagcaata

SEQ ID NO: 67105 - DNA, 20 bp, Artificial Sequence
  chemically synthesized
cttcccataggtagcaataa

SEQ ID NO: 67106 - DNA, 20 bp, Artificial Sequence
  chemically synthesized
ataggtagcaataaaggtcc

SEQ ID NO: 67107 - DNA, 20 bp, Artificial Sequence
  chemically synthesized
taggtagcaataaaggtccc

SEQ ID NO: 67108 - DNA, 20 bp, Artificial Sequence
  chemically synthesized
agcaataaaggtcccaggca

SEQ ID NO: 67109 - DNA, 20 bp, Artificial Sequence
  chemically synthesized
gccatgcttctgctgtgcct

SEQ ID NO: 67110 - DNA, 20 bp, Artificial Sequence
  chemically synthesized
aataaaggtcccaggcacag

SEQ ID NO: 67111 - DNA, 20 bp, Artificial Sequence
  chemically synthesized
tgccatgcttctgctgtgcc

SEQ ID NO: 67112 - DNA, 20 bp, Artificial Sequence
  chemically synthesized
aaaggtcccaggcacagcag

SEQ ID NO: 67113 - DNA, 20 bp, Artificial Sequence
  chemically synthesized
tcccaggcacagcagaagca

SEQ ID NO: 67114 - DNA, 20 bp, Artificial Sequence
  chemically synthesized
acagcagaagcatggcaatg

SEQ ID NO: 67115 - DNA, 20 bp, Artificial Sequence
  chemically synthesized
gcaatgaagaataccaccaa

SEQ ID NO: 67116 - DNA, 20 bp, Artificial Sequence
  chemically synthesized
aatgaagaataccaccaaca

SEQ ID NO: 67117 - DNA, 20 bp, Artificial Sequence
  chemically synthesized
atgaagaataccaccaacag

SEQ ID NO: 67118 - DNA, 20 bp, Artificial Sequence
  chemically synthesized
gttctgatgtcctctgttgg

SEQ ID NO: 67119 - DNA, 20 bp, Artificial Sequence
  chemically synthesized
taagttctgatgtcctctgt

SEQ ID NO: 67120 - DNA, 20 bp, Artificial Sequence
  chemically synthesized
ataccaccaacagaggacat

SEQ ID NO: 67121 - DNA, 20 bp, Artificial Sequence
  chemically synthesized
gaggacatcagaacttactt

SEQ ID NO: 67122 - DNA, 20 bp, Artificial Sequence
  chemically synthesized
aggacatcagaacttacttt

SEQ ID NO: 67123 - DNA, 20 bp, Artificial Sequence
  chemically synthesized
acctaatggtggcctaaagt

SEQ ID NO: 67124 - DNA, 20 bp, Artificial Sequence
  chemically synthesized
gaaaacctaatggtggccta

SEQ ID NO: 67125 - DNA, 20 bp, Artificial Sequence
  chemically synthesized
aacttactttaggccaccat

SEQ ID NO: 67126 - DNA, 20 bp, Artificial Sequence
  chemically synthesized
acttactttaggccaccatt

SEQ ID NO: 67127 - DNA, 20 bp, Artificial Sequence
  chemically synthesized
aggctaagaaaacctaatgg

SEQ ID NO: 67128 - DNA, 20 bp, Artificial Sequence
  chemically synthesized
cacaggctaagaaaacctaa

SEQ ID NO: 67129 - DNA, 20 bp, Artificial Sequence
  chemically synthesized
aggccaccattaggttttct

SEQ ID NO: 67130 - DNA, 20 bp, Artificial Sequence
  chemically synthesized
cacaaaacacaacacaggct

SEQ ID NO: 67131 - DNA, 20 bp, Artificial Sequence
  chemically synthesized
atgcacacaaaacacaacac

SEQ ID NO: 67132 - DNA, 20 bp, Artificial Sequence
  chemically synthesized
tatgcacacaaaacacaaca

SEQ ID NO: 67133 - DNA, 20 bp, Artificial Sequence
  chemically synthesized
ttttgtacttttgaacatag

SEQ ID NO: 67134 - DNA, 20 bp, Artificial Sequence
  chemically synthesized
attaacaccgctatgttcaa

SEQ ID NO: 67135 - DNA, 20 bp, Artificial Sequence
  chemically synthesized
ctcttttgtacttttgaaca

SEQ ID NO: 67136 - DNA, 20 bp, Artificial Sequence
  chemically synthesized
cgctatgttcaaaagtacaa

SEQ ID NO: 67137 - DNA, 20 bp, Artificial Sequence
  chemically synthesized
ctatgttcaaaagtacaaaa

SEQ ID NO: 67138 - DNA, 20 bp, Artificial Sequence
  chemically synthesized
aaagtacaaaagagtcaaaa

SEQ ID NO: 67139 - DNA, 20 bp, Artificial Sequence
  chemically synthesized
agtcaaaaaagtgttccttt

SEQ ID NO: 67140 - DNA, 20 bp, Artificial Sequence
  chemically synthesized
aaaaagtgttcctttaagaa

SEQ ID NO: 67141 - DNA, 20 bp, Artificial Sequence
  chemically synthesized
aatcgcatgtcttttcttaa

SEQ ID NO: 67142 - DNA, 20 bp, Artificial Sequence
  chemically synthesized
taatcgcatgtcttttctta

SEQ ID NO: 67143 - DNA, 20 bp, Artificial Sequence
  chemically synthesized
gaaaagacatgcgattacta

SEQ ID NO: 67144 - DNA, 20 bp, Artificial Sequence
  chemically synthesized
taagttctcttttgttgccg

SEQ ID NO: 67145 - DNA, 20 bp, Artificial Sequence
  chemically synthesized
tgcgattactacggcaacaa

SEQ ID NO: 67146 - DNA, 20 bp, Artificial Sequence
  chemically synthesized
cgattactacggcaacaaaa

SEQ ID NO: 67147 - DNA, 20 bp, Artificial Sequence
  chemically synthesized
caacaaaagagaacttattg

SEQ ID NO: 67148 - DNA, 20 bp, Artificial Sequence
  chemically synthesized
caaaagagaacttattgtag

SEQ ID NO: 67149 - DNA, 20 bp, Artificial Sequence
  chemically synthesized
aatgtacacccttctacaat

SEQ ID NO: 67150 - DNA, 20 bp, Artificial Sequence
  chemically synthesized
aaaagagaacttattgtaga

SEQ ID NO: 67151 - DNA, 20 bp, Artificial Sequence
  chemically synthesized
aaagagaacttattgtagaa

SEQ ID NO: 67152 - DNA, 20 bp, Artificial Sequence
  chemically synthesized
agggtgtacattgtatatat

SEQ ID NO: 67153 - DNA, 20 bp, Artificial Sequence
  chemically synthesized
aagtccaaaatgacatacaa

SEQ ID NO: 67154 - DNA, 20 bp, Artificial Sequence
  chemically synthesized
gtcacttttgtatgtcattt

SEQ ID NO: 67155 - DNA, 20 bp, Artificial Sequence
  chemically synthesized
gtatgtcattttggacttaa

SEQ ID NO: 67156 - DNA, 20 bp, Artificial Sequence
  chemically synthesized
tatgtcattttggacttaaa

SEQ ID NO: 67157 - DNA, 20 bp, Artificial Sequence
  chemically synthesized
ttggaaattcatttcctttt

SEQ ID NO: 67158 - DNA, 20 bp, Artificial Sequence
  chemically synthesized
aaaggaaatgaatttccaaa

SEQ ID NO: 67159 - DNA, 20 bp, Artificial Sequence
  chemically synthesized
attggttctcaagggctgtt

SEQ ID NO: 67160 - DNA, 20 bp, Artificial Sequence
  chemically synthesized
tgaatttccaaacagccctt

SEQ ID NO: 67161 - DNA, 20 bp, Artificial Sequence
  chemically synthesized
caaagagaattggttctcaa

SEQ ID NO: 67162 - DNA, 20 bp, Artificial Sequence
  chemically synthesized
acaaagagaattggttctca

SEQ ID NO: 67163 - DNA, 20 bp, Artificial Sequence
  chemically synthesized
tacaaagagaattggttctc

SEQ ID NO: 67164 - DNA, 20 bp, Artificial Sequence
  chemically synthesized
cctttctctacaaagagaat

SEQ ID NO: 67165 - DNA, 20 bp, Artificial Sequence
  chemically synthesized
ttgagaaccaattctctttg

SEQ ID NO: 67166 - DNA, 20 bp, Artificial Sequence
  chemically synthesized
gagaaccaattctctttgta

SEQ ID NO: 67167 - DNA, 20 bp, Artificial Sequence
  chemically synthesized
caacctcctttctctacaaa

SEQ ID NO: 67168 - DNA, 20 bp, Artificial Sequence
  chemically synthesized
tacaacctcctttctctaca

SEQ ID NO: 67169 - DNA, 20 bp, Artificial Sequence
  chemically synthesized
accaattctctttgtagaga

SEQ ID NO: 67170 - DNA, 20 bp, Artificial Sequence
  chemically synthesized
ccaattctctttgtagagaa

SEQ ID NO: 67171 - DNA, 20 bp, Artificial Sequence
  chemically synthesized
aattctctttgtagagaaag

SEQ ID NO: 67172 - DNA, 20 bp, Artificial Sequence
  chemically synthesized
attctctttgtagagaaagg

SEQ ID NO: 67173 - DNA, 20 bp, Artificial Sequence
  chemically synthesized
tgtatgttgtctataaatta

SEQ ID NO: 67174 - DNA, 20 bp, Artificial Sequence
  chemically synthesized
gtctatgatcctataattta

SEQ ID NO: 67175 - DNA, 20 bp, Artificial Sequence
  chemically synthesized
gtatgttgtctataaattat

SEQ ID NO: 67176 - DNA, 20 bp, Artificial Sequence
  chemically synthesized
gtctataaattataggatca

SEQ ID NO: 67177 - DNA, 20 bp, Artificial Sequence
  chemically synthesized
actcaaaaaacaaacaaaaa

SEQ ID NO: 67178 - DNA, 20 bp, Artificial Sequence
  chemically synthesized
taactcaaaaaacaaacaaa

SEQ ID NO: 67179 - DNA, 20 bp, Artificial Sequence
  chemically synthesized
actctttttgtttgtttttt

SEQ ID NO: 67180 - DNA, 20 bp, Artificial Sequence
  chemically synthesized
tttttgtttgttttttgagt

SEQ ID NO: 67181 - DNA, 20 bp, Artificial Sequence
  chemically synthesized
tttgtttgttttttgagtta

SEQ ID NO: 67182 - DNA, 20 bp, Artificial Sequence
  chemically synthesized
actccagcctgggtgacagt

SEQ ID NO: 67183 - DNA, 20 bp, Artificial Sequence
  chemically synthesized
gttagagtctcactgtcacc

SEQ ID NO: 67184 - DNA, 20 bp, Artificial Sequence
  chemically synthesized
ttagagtctcactgtcaccc

SEQ ID NO: 67185 - DNA, 20 bp, Artificial Sequence
  chemically synthesized
ctgcactccagcctgggtga

SEQ ID NO: 67186 - DNA, 20 bp, Artificial Sequence
  chemically synthesized
agtctcactgtcacccaggc

SEQ ID NO: 67187 - DNA, 20 bp, Artificial Sequence
  chemically synthesized
tctcactgtcacccaggctg

SEQ ID NO: 67188 - DNA, 20 bp, Artificial Sequence
  chemically synthesized
gtgccactgcactccagcct

SEQ ID NO: 67189 - DNA, 20 bp, Artificial Sequence
  chemically synthesized
cgtgccactgcactccagcc

SEQ ID NO: 67190 - DNA, 20 bp, Artificial Sequence
  chemically synthesized
ctgtcacccaggctggagtg

SEQ ID NO: 67191 - DNA, 20 bp, Artificial Sequence
  chemically synthesized
gagatcgtgccactgcactc

SEQ ID NO: 67192 - DNA, 20 bp, Artificial Sequence
  chemically synthesized
tcacccaggctggagtgcag

SEQ ID NO: 67193 - DNA, 20 bp, Artificial Sequence
  chemically synthesized
ggagtgcagtggcacgatct

SEQ ID NO: 67194 - DNA, 20 bp, Artificial Sequence
  chemically synthesized
ggccaaggttacagtgagcc

SEQ ID NO: 67195 - DNA, 20 bp, Artificial Sequence
  chemically synthesized
caggaggccaaggttacagt

SEQ ID NO: 67196 - DNA, 20 bp, Artificial Sequence
  chemically synthesized
atctcggctcactgtaacct

SEQ ID NO: 67197 - DNA, 20 bp, Artificial Sequence
  chemically synthesized
aacccaggaggccaaggtta

SEQ ID NO: 67198 - DNA, 20 bp, Artificial Sequence
  chemically synthesized
agcttgaacccaggaggcca

SEQ ID NO: 67199 - DNA, 20 bp, Artificial Sequence
  chemically synthesized
tcactgtaaccttggcctcc

SEQ ID NO: 67200 - DNA, 20 bp, Artificial Sequence
  chemically synthesized
tagcttgaacccaggaggcc

SEQ ID NO: 67201 - DNA, 20 bp, Artificial Sequence
  chemically synthesized
cactgtaaccttggcctcct

SEQ ID NO: 67202 - DNA, 20 bp, Artificial Sequence
  chemically synthesized
gagaatagcttgaacccagg

SEQ ID NO: 67203 - DNA, 20 bp, Artificial Sequence
  chemically synthesized
ggagaatagcttgaacccag

SEQ ID NO: 67204 - DNA, 20 bp, Artificial Sequence
  chemically synthesized
aaccttggcctcctgggttc

SEQ ID NO: 67205 - DNA, 20 bp, Artificial Sequence
  chemically synthesized
caggagaatagcttgaaccc

SEQ ID NO: 67206 - DNA, 20 bp, Artificial Sequence
  chemically synthesized
gcaggagaatagcttgaacc

SEQ ID NO: 67207 - DNA, 20 bp, Artificial Sequence
  chemically synthesized
gggaggctgaggcaggagaa

SEQ ID NO: 67208 - DNA, 20 bp, Artificial Sequence
  chemically synthesized
ttcaagctattctcctgcct

SEQ ID NO: 67209 - DNA, 20 bp, Artificial Sequence
  chemically synthesized
tactcgggaggctgaggcag

SEQ ID NO: 67210 - DNA, 20 bp, Artificial Sequence
  chemically synthesized
gctactcgggaggctgaggc

SEQ ID NO: 67211 - DNA, 20 bp, Artificial Sequence
  chemically synthesized
agctactcgggaggctgagg

SEQ ID NO: 67212 - DNA, 20 bp, Artificial Sequence
  chemically synthesized
cccagctactcgggaggctg

SEQ ID NO: 67213 - DNA, 20 bp, Artificial Sequence
  chemically synthesized
tcccagctactcgggaggct

SEQ ID NO: 67214 - DNA, 20 bp, Artificial Sequence
  chemically synthesized
ttctcctgcctcagcctccc

SEQ ID NO: 67215 - DNA, 20 bp, Artificial Sequence
  chemically synthesized
tcctgcctcagcctcccgag

SEQ ID NO: 67216 - DNA, 20 bp, Artificial Sequence
  chemically synthesized
tgtagtcccagctactcggg

SEQ ID NO: 67217 - DNA, 20 bp, Artificial Sequence
  chemically synthesized
ctgtagtcccagctactcgg

SEQ ID NO: 67218 - DNA, 20 bp, Artificial Sequence
  chemically synthesized
gcctcagcctcccgagtagc

SEQ ID NO: 67219 - DNA, 20 bp, Artificial Sequence
  chemically synthesized
aactgtagtcccagctactc

SEQ ID NO: 67220 - DNA, 20 bp, Artificial Sequence
  chemically synthesized
cctcagcctcccgagtagct

SEQ ID NO: 67221 - DNA, 20 bp, Artificial Sequence
  chemically synthesized
caactgtagtcccagctact

SEQ ID NO: 67222 - DNA, 20 bp, Artificial Sequence
  chemically synthesized
ctcccgagtagctgggacta

SEQ ID NO: 67223 - DNA, 20 bp, Artificial Sequence
  chemically synthesized
gtggcaggcaactgtagtcc

SEQ ID NO: 67224 - DNA, 20 bp, Artificial Sequence
  chemically synthesized
ggtgtggtggcaggcaactg

SEQ ID NO: 67225 - DNA, 20 bp, Artificial Sequence
  chemically synthesized
aattagctgggtgtggtggc

SEQ ID NO: 67226 - DNA, 20 bp, Artificial Sequence
  chemically synthesized
aaattagctgggtgtggtgg

SEQ ID NO: 67227 - DNA, 20 bp, Artificial Sequence
  chemically synthesized
cagttgcctgccaccacacc

SEQ ID NO: 67228 - DNA, 20 bp, Artificial Sequence
  chemically synthesized
caaaaattagctgggtgtgg

SEQ ID NO: 67229 - DNA, 20 bp, Artificial Sequence
  chemically synthesized
gtacaaaaattagctgggtg

SEQ ID NO: 67230 - DNA, 20 bp, Artificial Sequence
  chemically synthesized
taaaagtacaaaaattagct

SEQ ID NO: 67231 - DNA, 20 bp, Artificial Sequence
  chemically synthesized
ctaaaagtacaaaaattagc

SEQ ID NO: 67232 - DNA, 20 bp, Artificial Sequence
  chemically synthesized
tctactaaaagtacaaaaat

SEQ ID NO: 67233 - DNA, 20 bp, Artificial Sequence
  chemically synthesized
ccagctaatttttgtacttt

SEQ ID NO: 67234 - DNA, 20 bp, Artificial Sequence
  chemically synthesized
gctaatttttgtacttttag

SEQ ID NO: 67235 - DNA, 20 bp, Artificial Sequence
  chemically synthesized
taatttttgtacttttagta

SEQ ID NO: 67236 - DNA, 20 bp, Artificial Sequence
  chemically synthesized
cgaaaccctgtctctactaa

SEQ ID NO: 67237 - DNA, 20 bp, Artificial Sequence
  chemically synthesized
ttttgtacttttagtagaga

SEQ ID NO: 67238 - DNA, 20 bp, Artificial Sequence
  chemically synthesized
tttgtacttttagtagagac

SEQ ID NO: 67239 - DNA, 20 bp, Artificial Sequence
  chemically synthesized
ttgtacttttagtagagaca

SEQ ID NO: 67240 - DNA, 20 bp, Artificial Sequence
  chemically synthesized
gagacagggtttcgtcatgt

SEQ ID NO: 67241 - DNA, 20 bp, Artificial Sequence
  chemically synthesized
cagggtttcgtcatgttggc

SEQ ID NO: 67242 - DNA, 20 bp, Artificial Sequence
  chemically synthesized
tttcgtcatgttggccggac

SEQ ID NO: 67243 - DNA, 20 bp, Artificial Sequence
  chemically synthesized
tcaggagtttgaggccagtc

SEQ ID NO: 67244 - DNA, 20 bp, Artificial Sequence
  chemically synthesized
tgaggtcaggagtttgaggc

SEQ ID NO: 67245 - DNA, 20 bp, Artificial Sequence
  chemically synthesized
cacttgaggtcaggagtttg

SEQ ID NO: 67246 - DNA, 20 bp, Artificial Sequence
  chemically synthesized
tcacttgaggtcaggagttt

SEQ ID NO: 67247 - DNA, 20 bp, Artificial Sequence
  chemically synthesized
gggggatcacttgaggtcag

SEQ ID NO: 67248 - DNA, 20 bp, Artificial Sequence
  chemically synthesized
ggcctcaaactcctgacctc

SEQ ID NO: 67249 - DNA, 20 bp, Artificial Sequence
  chemically synthesized
cagggggatcacttgaggtc

SEQ ID NO: 67250 - DNA, 20 bp, Artificial Sequence
  chemically synthesized
gcagggggatcacttgaggt

SEQ ID NO: 67251 - DNA, 20 bp, Artificial Sequence
  chemically synthesized
ggaggcagggggatcacttg

SEQ ID NO: 67252 - DNA, 20 bp, Artificial Sequence
  chemically synthesized
tggaggcagggggatcactt

SEQ ID NO: 67253 - DNA, 20 bp, Artificial Sequence
  chemically synthesized
agatcatctctggaggcagg

SEQ ID NO: 67254 - DNA, 20 bp, Artificial Sequence
  chemically synthesized
tcaagtgatccccctgcctc

SEQ ID NO: 67255 - DNA, 20 bp, Artificial Sequence
  chemically synthesized
cagatcatctctggaggcag

SEQ ID NO: 67256 - DNA, 20 bp, Artificial Sequence
  chemically synthesized
ccagatcatctctggaggca

SEQ ID NO: 67257 - DNA, 20 bp, Artificial Sequence
  chemically synthesized
aagtgatccccctgcctcca

SEQ ID NO: 67258 - DNA, 20 bp, Artificial Sequence
  chemically synthesized
gccagatcatctctggaggc

SEQ ID NO: 67259 - DNA, 20 bp, Artificial Sequence
  chemically synthesized
agccagatcatctctggagg

SEQ ID NO: 67260 - DNA, 20 bp, Artificial Sequence
  chemically synthesized
cccagccagatcatctctgg

SEQ ID NO: 67261 - DNA, 20 bp, Artificial Sequence
  chemically synthesized
gcccagccagatcatctctg

SEQ ID NO: 67262 - DNA, 20 bp, Artificial Sequence
  chemically synthesized
acgcccagccagatcatctc

SEQ ID NO: 67263 - DNA, 20 bp, Artificial Sequence
  chemically synthesized
ccctgcctccagagatgatc

SEQ ID NO: 67264 - DNA, 20 bp, Artificial Sequence
  chemically synthesized
gcctccagagatgatctggc

SEQ ID NO: 67265 - DNA, 20 bp, Artificial Sequence
  chemically synthesized
cctccagagatgatctggct

SEQ ID NO: 67266 - DNA, 20 bp, Artificial Sequence
  chemically synthesized
catgagccaccacgcccagc

SEQ ID NO: 67267 - DNA, 20 bp, Artificial Sequence
  chemically synthesized
agagatgatctggctgggcg

SEQ ID NO: 67268 - DNA, 20 bp, Artificial Sequence
  chemically synthesized
gatgatctggctgggcgtgg

SEQ ID NO: 67269 - DNA, 20 bp, Artificial Sequence
  chemically synthesized
caggcatgagccaccacgcc

SEQ ID NO: 67270 - DNA, 20 bp, Artificial Sequence
  chemically synthesized
gggattgggattacaggcat

SEQ ID NO: 67271 - DNA, 20 bp, Artificial Sequence
  chemically synthesized
agtgctgggattgggattac

SEQ ID NO: 67272 - DNA, 20 bp, Artificial Sequence
  chemically synthesized
aagtgctgggattgggatta

SEQ ID NO: 67273 - DNA, 20 bp, Artificial Sequence
  chemically synthesized
catgcctgtaatcccaatcc

SEQ ID NO: 67274 - DNA, 20 bp, Artificial Sequence
  chemically synthesized
cctccctaagtgctgggatt

SEQ ID NO: 67275 - DNA, 20 bp, Artificial Sequence
  chemically synthesized
acctccctaagtgctgggat

SEQ ID NO: 67276 - DNA, 20 bp, Artificial Sequence
  chemically synthesized
gtaatcccaatcccagcact

SEQ ID NO: 67277 - DNA, 20 bp, Artificial Sequence
  chemically synthesized
taatcccaatcccagcactt

SEQ ID NO: 67278 - DNA, 20 bp, Artificial Sequence
  chemically synthesized
cctcgacctccctaagtgct

SEQ ID NO: 67279 - DNA, 20 bp, Artificial Sequence
  chemically synthesized
aatcccaatcccagcactta

SEQ ID NO: 67280 - DNA, 20 bp, Artificial Sequence
  chemically synthesized
gcctcgacctccctaagtgc

SEQ ID NO: 67281 - DNA, 20 bp, Artificial Sequence
  chemically synthesized
tcccaatcccagcacttagg

SEQ ID NO: 67282 - DNA, 20 bp, Artificial Sequence
  chemically synthesized
cccaatcccagcacttaggg

SEQ ID NO: 67283 - DNA, 20 bp, Artificial Sequence
  chemically synthesized
tcgcccgcctcgacctccct

SEQ ID NO: 67284 - DNA, 20 bp, Artificial Sequence
  chemically synthesized
tcccagcacttagggaggtc

SEQ ID NO: 67285 - DNA, 20 bp, Artificial Sequence
  chemically synthesized
cccagcacttagggaggtcg

SEQ ID NO: 67286 - DNA, 20 bp, Artificial Sequence
  chemically synthesized
agcacttagggaggtcgagg

SEQ ID NO: 67287 - DNA, 20 bp, Artificial Sequence
  chemically synthesized
gcacttagggaggtcgaggc

SEQ ID NO: 67288 - DNA, 20 bp, Artificial Sequence
  chemically synthesized
ttagggaggtcgaggcgggc

SEQ ID NO: 67289 - DNA, 20 bp, Artificial Sequence
  chemically synthesized
tcgaggcgggcgagtcacct

SEQ ID NO: 67290 - DNA, 20 bp, Artificial Sequence
  chemically synthesized
cgaggcgggcgagtcacctg

SEQ ID NO: 67291 - DNA, 20 bp, Artificial Sequence
  chemically synthesized
gcgggcgagtcacctgaggt

SEQ ID NO: 67292 - DNA, 20 bp, Artificial Sequence
  chemically synthesized
cgggcgagtcacctgaggtc

SEQ ID NO: 67293 - DNA, 20 bp, Artificial Sequence
  chemically synthesized
ggtctcgaactcctgacctc

SEQ ID NO: 67294 - DNA, 20 bp, Artificial Sequence
  chemically synthesized
ggcgagtcacctgaggtcag

SEQ ID NO: 67295 - DNA, 20 bp, Artificial Sequence
  chemically synthesized
tggtctcgaactcctgacct

SEQ ID NO: 67296 - DNA, 20 bp, Artificial Sequence
  chemically synthesized
tcacctgaggtcaggagttc

SEQ ID NO: 67297 - DNA, 20 bp, Artificial Sequence
  chemically synthesized
tgaggtcaggagttcgagac

SEQ ID NO: 67298 - DNA, 20 bp, Artificial Sequence
  chemically synthesized
tcaggagttcgagaccagcc

SEQ ID NO: 67299 - DNA, 20 bp, Artificial Sequence
  chemically synthesized
tttcaccgtgttggccaggc

SEQ ID NO: 67300 - DNA, 20 bp, Artificial Sequence
  chemically synthesized
ggggtttcaccgtgttggcc

SEQ ID NO: 67301 - DNA, 20 bp, Artificial Sequence
  chemically synthesized
cgagaccagcctggccaaca

SEQ ID NO: 67302 - DNA, 20 bp, Artificial Sequence
  chemically synthesized
cggggtttcaccgtgttggc

SEQ ID NO: 67303 - DNA, 20 bp, Artificial Sequence
  chemically synthesized
gagacggggtttcaccgtgt

SEQ ID NO: 67304 - DNA, 20 bp, Artificial Sequence
  chemically synthesized
ttgtatttttagtagagacg

SEQ ID NO: 67305 - DNA, 20 bp, Artificial Sequence
  chemically synthesized
tttgtatttttagtagagac

SEQ ID NO: 67306 - DNA, 20 bp, Artificial Sequence
  chemically synthesized
ttttgtatttttagtagaga

SEQ ID NO: 67307 - DNA, 20 bp, Artificial Sequence
  chemically synthesized
taatttttgtatttttagta

SEQ ID NO: 67308 - DNA, 20 bp, Artificial Sequence
  chemically synthesized
gctaatttttgtatttttag

SEQ ID NO: 67309 - DNA, 20 bp, Artificial Sequence
  chemically synthesized
ctggctaatttttgtatttt

SEQ ID NO: 67310 - DNA, 20 bp, Artificial Sequence
  chemically synthesized
tctactaaaaatacaaaaat

SEQ ID NO: 67311 - DNA, 20 bp, Artificial Sequence
  chemically synthesized
ctaaaaatacaaaaattagc

SEQ ID NO: 67312 - DNA, 20 bp, Artificial Sequence
  chemically synthesized
taaaaatacaaaaattagcc

SEQ ID NO: 67313 - DNA, 20 bp, Artificial Sequence
  chemically synthesized
atacaaaaattagccaggca

SEQ ID NO: 67314 - DNA, 20 bp, Artificial Sequence
  chemically synthesized
caaaaattagccaggcatgg

SEQ ID NO: 67315 - DNA, 20 bp, Artificial Sequence
  chemically synthesized
caggcgcccgccaccatgcc

SEQ ID NO: 67316 - DNA, 20 bp, Artificial Sequence
  chemically synthesized
aaattagccaggcatggtgg

SEQ ID NO: 67317 - DNA, 20 bp, Artificial Sequence
  chemically synthesized
aattagccaggcatggtggc

SEQ ID NO: 67318 - DNA, 20 bp, Artificial Sequence
  chemically synthesized
ggcatggtggcgggcgcctg

SEQ ID NO: 67319 - DNA, 20 bp, Artificial Sequence
  chemically synthesized
gtggcgggcgcctgcagtcc

SEQ ID NO: 67320 - DNA, 20 bp, Artificial Sequence
  chemically synthesized
tcccgagtagctgggactgc

SEQ ID NO: 67321 - DNA, 20 bp, Artificial Sequence
  chemically synthesized
ctcccgagtagctgggactg

SEQ ID NO: 67322 - DNA, 20 bp, Artificial Sequence
  chemically synthesized
cgcctgcagtcccagctact

SEQ ID NO: 67323 - DNA, 20 bp, Artificial Sequence
  chemically synthesized
cctcagcctcccgagtagct

SEQ ID NO: 67324 - DNA, 20 bp, Artificial Sequence
  chemically synthesized
gcctgcagtcccagctactc

SEQ ID NO: 67325 - DNA, 20 bp, Artificial Sequence
  chemically synthesized
gcctcagcctcccgagtagc

SEQ ID NO: 67326 - DNA, 20 bp, Artificial Sequence
  chemically synthesized
ctgcagtcccagctactcgg

SEQ ID NO: 67327 - DNA, 20 bp, Artificial Sequence
  chemically synthesized
tgcagtcccagctactcggg

SEQ ID NO: 67328 - DNA, 20 bp, Artificial Sequence
  chemically synthesized
ttctgcctcagcctcccgag

SEQ ID NO: 67329 - DNA, 20 bp, Artificial Sequence
  chemically synthesized
ttcttctgcctcagcctccc

SEQ ID NO: 67330 - DNA, 20 bp, Artificial Sequence
  chemically synthesized
tcccagctactcgggaggct

SEQ ID NO: 67331 - DNA, 20 bp, Artificial Sequence
  chemically synthesized
cccagctactcgggaggctg

SEQ ID NO: 67332 - DNA, 20 bp, Artificial Sequence
  chemically synthesized
agctactcgggaggctgagg

SEQ ID NO: 67333 - DNA, 20 bp, Artificial Sequence
  chemically synthesized
tactcgggaggctgaggcag

SEQ ID NO: 67334 - DNA, 20 bp, Artificial Sequence
  chemically synthesized
ttcaagtgattcttctgcct

SEQ ID NO: 67335 - DNA, 20 bp, Artificial Sequence
  chemically synthesized
gcagaagaatcacttgaacc

SEQ ID NO: 67336 - DNA, 20 bp, Artificial Sequence
  chemically synthesized
cagaagaatcacttgaaccc

SEQ ID NO: 67337 - DNA, 20 bp, Artificial Sequence
  chemically synthesized
aacctccacctcccgggttc

SEQ ID NO: 67338 - DNA, 20 bp, Artificial Sequence
  chemically synthesized
gaagaatcacttgaacccgg

SEQ ID NO: 67339 - DNA, 20 bp, Artificial Sequence
  chemically synthesized
aagaatcacttgaacccggg

SEQ ID NO: 67340 - DNA, 20 bp, Artificial Sequence
  chemically synthesized
aatcacttgaacccgggagg

SEQ ID NO: 67341 - DNA, 20 bp, Artificial Sequence
  chemically synthesized
cactgtaacctccacctccc

SEQ ID NO: 67342 - DNA, 20 bp, Artificial Sequence
  chemically synthesized
tcacttgaacccgggaggtg

SEQ ID NO: 67343 - DNA, 20 bp, Artificial Sequence
  chemically synthesized
tcactgtaacctccacctcc

SEQ ID NO: 67344 - DNA, 20 bp, Artificial Sequence
  chemically synthesized
cacttgaacccgggaggtgg

SEQ ID NO: 67345 - DNA, 20 bp, Artificial Sequence
  chemically synthesized
aacccgggaggtggaggtta

SEQ ID NO: 67346 - DNA, 20 bp, Artificial Sequence
  chemically synthesized
cgggaggtggaggttacagt

SEQ ID NO: 67347 - DNA, 20 bp, Artificial Sequence
  chemically synthesized
ggtggaggttacagtgagcc

SEQ ID NO: 67348 - DNA, 20 bp, Artificial Sequence
  chemically synthesized
ggaatgtagtggtgcgatct

SEQ ID NO: 67349 - DNA, 20 bp, Artificial Sequence
  chemically synthesized
tcacccaggctggaatgtag

SEQ ID NO: 67350 - DNA, 20 bp, Artificial Sequence
  chemically synthesized
gagatcgcaccactacattc

SEQ ID NO: 67351 - DNA, 20 bp, Artificial Sequence
  chemically synthesized
ctgtcacccaggctggaatg

SEQ ID NO: 67352 - DNA, 20 bp, Artificial Sequence
  chemically synthesized
cgcaccactacattccagcc

SEQ ID NO: 67353 - DNA, 20 bp, Artificial Sequence
  chemically synthesized
gcaccactacattccagcct

SEQ ID NO: 67354 - DNA, 20 bp, Artificial Sequence
  chemically synthesized
tctcgctctgtcacccaggc

SEQ ID NO: 67355 - DNA, 20 bp, Artificial Sequence
  chemically synthesized
ctacattccagcctgggtga

SEQ ID NO: 67356 - DNA, 20 bp, Artificial Sequence
  chemically synthesized
agagtctcgctctgtcaccc

SEQ ID NO: 67357 - DNA, 20 bp, Artificial Sequence
  chemically synthesized
acattccagcctgggtgaca

SEQ ID NO: 67358 - DNA, 20 bp, Artificial Sequence
  chemically synthesized
aagagtctcgctctgtcacc

SEQ ID NO: 67359 - DNA, 20 bp, Artificial Sequence
  chemically synthesized
tccagcctgggtgacagagc

SEQ ID NO: 67360 - DNA, 20 bp, Artificial Sequence
  chemically synthesized
tttttttttttttgagacaa

SEQ ID NO: 67361 - DNA, 20 bp, Artificial Sequence
  chemically synthesized
tttttttttttttttgagac

SEQ ID NO: 67362 - DNA, 20 bp, Artificial Sequence
  chemically synthesized
tttttttttttttttttttt

SEQ ID NO: 67363 - DNA, 20 bp, Artificial Sequence
  chemically synthesized
caaaaaaaaaaaaaaaaaaa

SEQ ID NO: 67364 - DNA, 20 bp, Artificial Sequence
  chemically synthesized
aaaaaaaaaaaaaaaaaaaa

SEQ ID NO: 67365 - DNA, 20 bp, Artificial Sequence
  chemically synthesized
aaaaaaaaaaaaaaaaaaga

SEQ ID NO: 67366 - DNA, 20 bp, Artificial Sequence
  chemically synthesized
aaaaaaaaaaaaaaaagaga

SEQ ID NO: 67367 - DNA, 20 bp, Artificial Sequence
  chemically synthesized
aaaaaaaaaaaaaagagaga

SEQ ID NO: 67368 - DNA, 20 bp, Artificial Sequence
  chemically synthesized
aaaaaaaaaaaagagagaga

SEQ ID NO: 67369 - DNA, 20 bp, Artificial Sequence
  chemically synthesized
aaaaaaaaaagagagagaga

SEQ ID NO: 67370 - DNA, 20 bp, Artificial Sequence
  chemically synthesized
aaagagagagagagagttga

SEQ ID NO: 67371 - DNA, 20 bp, Artificial Sequence
  chemically synthesized
aagagagagagagagttgat

SEQ ID NO: 67372 - DNA, 20 bp, Artificial Sequence
  chemically synthesized
agagagttgataggatctta

SEQ ID NO: 67373 - DNA, 20 bp, Artificial Sequence
  chemically synthesized
aattttacaagataaacttt

SEQ ID NO: 67374 - DNA, 20 bp, Artificial Sequence
  chemically synthesized
cttttacctgggaattttac

SEQ ID NO: 67375 - DNA, 20 bp, Artificial Sequence
  chemically synthesized
agtttatcttgtaaaattcc

SEQ ID NO: 67376 - DNA, 20 bp, Artificial Sequence
  chemically synthesized
gtttatcttgtaaaattccc

SEQ ID NO: 67377 - DNA, 20 bp, Artificial Sequence
  chemically synthesized
cttgtaaaattcccaggtaa

SEQ ID NO: 67378 - DNA, 20 bp, Artificial Sequence
  chemically synthesized
agagaattactcttttacct

SEQ ID NO: 67379 - DNA, 20 bp, Artificial Sequence
  chemically synthesized
tgtaaaattcccaggtaaaa

SEQ ID NO: 67380 - DNA, 20 bp, Artificial Sequence
  chemically synthesized
cagagaattactcttttacc

SEQ ID NO: 67381 - DNA, 20 bp, Artificial Sequence
  chemically synthesized
ttgcacaaagatgttttaca

SEQ ID NO: 67382 - DNA, 20 bp, Artificial Sequence
  chemically synthesized
acttgcacaaagatgtttta

SEQ ID NO: 67383 - DNA, 20 bp, Artificial Sequence
  chemically synthesized
tctgtaaaacatctttgtgc

SEQ ID NO: 67384 - DNA, 20 bp, Artificial Sequence
  chemically synthesized
caatcaacagtacttgcaca

SEQ ID NO: 67385 - DNA, 20 bp, Artificial Sequence
  chemically synthesized
aaatatatggggacaatcaa

SEQ ID NO: 67386 - DNA, 20 bp, Artificial Sequence
  chemically synthesized
gaaaaaatggaaaatatatg

SEQ ID NO: 67387 - DNA, 20 bp, Artificial Sequence
  chemically synthesized
agaaaaaatggaaaatatat

SEQ ID NO: 67388 - DNA, 20 bp, Artificial Sequence
  chemically synthesized
aagaaaaaatggaaaatata

SEQ ID NO: 67389 - DNA, 20 bp, Artificial Sequence
  chemically synthesized
tctattgccacaagaaaaaa

SEQ ID NO: 67390 - DNA, 20 bp, Artificial Sequence
  chemically synthesized
atattttccattttttcttg

SEQ ID NO: 67391 - DNA, 20 bp, Artificial Sequence
  chemically synthesized
tccattttttcttgtggcaa

SEQ ID NO: 67392 - DNA, 20 bp, Artificial Sequence
  chemically synthesized
attatgagttctattgccac

SEQ ID NO: 67393 - DNA, 20 bp, Artificial Sequence
  chemically synthesized
catacccaactgaaaattat

SEQ ID NO: 67394 - DNA, 20 bp, Artificial Sequence
  chemically synthesized
gcaatagaactcataatttt

SEQ ID NO: 67395 - DNA, 20 bp, Artificial Sequence
  chemically synthesized
tagaactcataattttcagt

SEQ ID NO: 67396 - DNA, 20 bp, Artificial Sequence
  chemically synthesized
agaactcataattttcagtt

SEQ ID NO: 67397 - DNA, 20 bp, Artificial Sequence
  chemically synthesized
ataattttcagttgggtatg

SEQ ID NO: 67398 - DNA, 20 bp, Artificial Sequence
  chemically synthesized
gttgggtatgtagatgcctg

SEQ ID NO: 67399 - DNA, 20 bp, Artificial Sequence
  chemically synthesized
ttgggtatgtagatgcctga

SEQ ID NO: 67400 - DNA, 20 bp, Artificial Sequence
  chemically synthesized
gtatgtagatgcctgaagga

SEQ ID NO: 67401 - DNA, 20 bp, Artificial Sequence
  chemically synthesized
agaaatatattctttccttc

SEQ ID NO: 67402 - DNA, 20 bp, Artificial Sequence
  chemically synthesized
aagaaatatattctttcctt

SEQ ID NO: 67403 - DNA, 20 bp, Artificial Sequence
  chemically synthesized
gaaggaaagaatatatttct

SEQ ID NO: 67404 - DNA, 20 bp, Artificial Sequence
  chemically synthesized
atttacatctatgtgaggct

SEQ ID NO: 67405 - DNA, 20 bp, Artificial Sequence
  chemically synthesized
atatatttcttagcctcaca

SEQ ID NO: 67406 - DNA, 20 bp, Artificial Sequence
  chemically synthesized
attatatttacatctatgtg

SEQ ID NO: 67407 - DNA, 20 bp, Artificial Sequence
  chemically synthesized
gattatatttacatctatgt

SEQ ID NO: 67408 - DNA, 20 bp, Artificial Sequence
  chemically synthesized
catagatgtaaatataatca

SEQ ID NO: 67409 - DNA, 20 bp, Artificial Sequence
  chemically synthesized
atagatgtaaatataatcat

SEQ ID NO: 67410 - DNA, 20 bp, Artificial Sequence
  chemically synthesized
gtaaatataatcatgggaca

SEQ ID NO: 67411 - DNA, 20 bp, Artificial Sequence
  chemically synthesized
ataatcatgggacaaagttc

SEQ ID NO: 67412 - DNA, 20 bp, Artificial Sequence
  chemically synthesized
catgggacaaagttctggtg

SEQ ID NO: 67413 - DNA, 20 bp, Artificial Sequence
  chemically synthesized
atgggacaaagttctggtga

SEQ ID NO: 67414 - DNA, 20 bp, Artificial Sequence
  chemically synthesized
tcccctgatagttccttcac

SEQ ID NO: 67415 - DNA, 20 bp, Artificial Sequence
  chemically synthesized
agttctggtgaaggaactat

SEQ ID NO: 67416 - DNA, 20 bp, Artificial Sequence
  chemically synthesized
gttctggtgaaggaactatc

SEQ ID NO: 67417 - DNA, 20 bp, Artificial Sequence
  chemically synthesized
ttctggtgaaggaactatca

SEQ ID NO: 67418 - DNA, 20 bp, Artificial Sequence
  chemically synthesized
tctggtgaaggaactatcag

SEQ ID NO: 67419 - DNA, 20 bp, Artificial Sequence
  chemically synthesized
tcatgaaatgtatcccctga

SEQ ID NO: 67420 - DNA, 20 bp, Artificial Sequence
  chemically synthesized
tcaggggatacatttcatga

SEQ ID NO: 67421 - DNA, 20 bp, Artificial Sequence
  chemically synthesized
catttcatgacagtttctga

SEQ ID NO: 67422 - DNA, 20 bp, Artificial Sequence
  chemically synthesized
agtgttgtgagaaaatcttt

SEQ ID NO: 67423 - DNA, 20 bp, Artificial Sequence
  chemically synthesized
gcgtgtgccagcagtgttgt

SEQ ID NO: 67424 - DNA, 20 bp, Artificial Sequence
  chemically synthesized
agattttctcacaacactgc

SEQ ID NO: 67425 - DNA, 20 bp, Artificial Sequence
  chemically synthesized
acagagagggcgtgtgccag

SEQ ID NO: 67426 - DNA, 20 bp, Artificial Sequence
  chemically synthesized
ggcacagagagggcgtgtgc

SEQ ID NO: 67427 - DNA, 20 bp, Artificial Sequence
  chemically synthesized
gaaggaaggaggcacagaga

SEQ ID NO: 67428 - DNA, 20 bp, Artificial Sequence
  chemically synthesized
agaaggaaggaggcacagag

SEQ ID NO: 67429 - DNA, 20 bp, Artificial Sequence
  chemically synthesized
aagaaggaaggaggcacaga

SEQ ID NO: 67430 - DNA, 20 bp, Artificial Sequence
  chemically synthesized
ggaagaaggaaggaggcaca

SEQ ID NO: 67431 - DNA, 20 bp, Artificial Sequence
  chemically synthesized
atggaagaaggaaggaggca

SEQ ID NO: 67432 - DNA, 20 bp, Artificial Sequence
  chemically synthesized
gcaacatggaagaaggaagg

SEQ ID NO: 67433 - DNA, 20 bp, Artificial Sequence
  chemically synthesized
agcaacatggaagaaggaag

SEQ ID NO: 67434 - DNA, 20 bp, Artificial Sequence
  chemically synthesized
ccagcaacatggaagaagga

SEQ ID NO: 67435 - DNA, 20 bp, Artificial Sequence
  chemically synthesized
cccagcaacatggaagaagg

SEQ ID NO: 67436 - DNA, 20 bp, Artificial Sequence
  chemically synthesized
gcccccagcaacatggaaga

SEQ ID NO: 67437 - DNA, 20 bp, Artificial Sequence
  chemically synthesized
agcccccagcaacatggaag

SEQ ID NO: 67438 - DNA, 20 bp, Artificial Sequence
  chemically synthesized
tccagcccccagcaacatgg

SEQ ID NO: 67439 - DNA, 20 bp, Artificial Sequence
  chemically synthesized
ccttccttcttccatgttgc

SEQ ID NO: 67440 - DNA, 20 bp, Artificial Sequence
  chemically synthesized
cttccttcttccatgttgct

SEQ ID NO: 67441 - DNA, 20 bp, Artificial Sequence
  chemically synthesized
agttccagcccccagcaaca

SEQ ID NO: 67442 - DNA, 20 bp, Artificial Sequence
  chemically synthesized
ttccttcttccatgttgctg

SEQ ID NO: 67443 - DNA, 20 bp, Artificial Sequence
  chemically synthesized
tccttcttccatgttgctgg

SEQ ID NO: 67444 - DNA, 20 bp, Artificial Sequence
  chemically synthesized
tcttccatgttgctgggggc

SEQ ID NO: 67445 - DNA, 20 bp, Artificial Sequence
  chemically synthesized
cacatctgagttccagcccc

SEQ ID NO: 67446 - DNA, 20 bp, Artificial Sequence
  chemically synthesized
tgttgctgggggctggaact

SEQ ID NO: 67447 - DNA, 20 bp, Artificial Sequence
  chemically synthesized
cagccaacacatctgagttc

SEQ ID NO: 67448 - DNA, 20 bp, Artificial Sequence
  chemically synthesized
cagctccagccaacacatct

SEQ ID NO: 67449 - DNA, 20 bp, Artificial Sequence
  chemically synthesized
gggctggaactcagatgtgt

SEQ ID NO: 67450 - DNA, 20 bp, Artificial Sequence
  chemically synthesized
tggaactcagatgtgttggc

SEQ ID NO: 67451 - DNA, 20 bp, Artificial Sequence
  chemically synthesized
gaactcagatgtgttggctg

SEQ ID NO: 67452 - DNA, 20 bp, Artificial Sequence
  chemically synthesized
agatgtgttggctggagctg

SEQ ID NO: 67453 - DNA, 20 bp, Artificial Sequence
  chemically synthesized
caatatgtctgcttcagctc

SEQ ID NO: 67454 - DNA, 20 bp, Artificial Sequence
  chemically synthesized
tgtgttggctggagctgaag

SEQ ID NO: 67455 - DNA, 20 bp, Artificial Sequence
  chemically synthesized
atggtccaatatgtctgctt

SEQ ID NO: 67456 - DNA, 20 bp, Artificial Sequence
  chemically synthesized
tggagctgaagcagacatat

SEQ ID NO: 67457 - DNA, 20 bp, Artificial Sequence
  chemically synthesized
agcagacatattggaccatg

SEQ ID NO: 67458 - DNA, 20 bp, Artificial Sequence
  chemically synthesized
caattctcgttgtcaccaca

SEQ ID NO: 67459 - DNA, 20 bp, Artificial Sequence
  chemically synthesized
ttggaccatgtggtgacaac

SEQ ID NO: 67460 - DNA, 20 bp, Artificial Sequence
  chemically synthesized
atgtggtgacaacgagaatt

SEQ ID NO: 67461 - DNA, 20 bp, Artificial Sequence
  chemically synthesized
tgtggtgacaacgagaattg

SEQ ID NO: 67462 - DNA, 20 bp, Artificial Sequence
  chemically synthesized
aacgagaattgaggccacca

SEQ ID NO: 67463 - DNA, 20 bp, Artificial Sequence
  chemically synthesized
gagaattgaggccaccatgg

SEQ ID NO: 67464 - DNA, 20 bp, Artificial Sequence
  chemically synthesized
agaattgaggccaccatggc

SEQ ID NO: 67465 - DNA, 20 bp, Artificial Sequence
  chemically synthesized
tttaccttgtcctgccatgg

SEQ ID NO: 67466 - DNA, 20 bp, Artificial Sequence
  chemically synthesized
tcctttaccttgtcctgcca

SEQ ID NO: 67467 - DNA, 20 bp, Artificial Sequence
  chemically synthesized
tgaggccaccatggcaggac

SEQ ID NO: 67468 - DNA, 20 bp, Artificial Sequence
  chemically synthesized
gaggccaccatggcaggaca

SEQ ID NO: 67469 - DNA, 20 bp, Artificial Sequence
  chemically synthesized
caccatggcaggacaaggta

SEQ ID NO: 67470 - DNA, 20 bp, Artificial Sequence
  chemically synthesized
accatggcaggacaaggtaa

SEQ ID NO: 67471 - DNA, 20 bp, Artificial Sequence
  chemically synthesized
catggcaggacaaggtaaag

SEQ ID NO: 67472 - DNA, 20 bp, Artificial Sequence
  chemically synthesized
atggcaggacaaggtaaagg

SEQ ID NO: 67473 - DNA, 20 bp, Artificial Sequence
  chemically synthesized
gacaaggtaaaggaggactt

SEQ ID NO: 67474 - DNA, 20 bp, Artificial Sequence
  chemically synthesized
gtaaaggaggacttcggact

SEQ ID NO: 67475 - DNA, 20 bp, Artificial Sequence
  chemically synthesized
attctgcttcactaagtccg

SEQ ID NO: 67476 - DNA, 20 bp, Artificial Sequence
  chemically synthesized
ggaggacttcggacttagtg

SEQ ID NO: 67477 - DNA, 20 bp, Artificial Sequence
  chemically synthesized
ggacttcggacttagtgaag

SEQ ID NO: 67478 - DNA, 20 bp, Artificial Sequence
  chemically synthesized
ttccgctattctgcttcact

SEQ ID NO: 67479 - DNA, 20 bp, Artificial Sequence
  chemically synthesized
tcggacttagtgaagcagaa

SEQ ID NO: 67480 - DNA, 20 bp, Artificial Sequence
  chemically synthesized
gacttagtgaagcagaatag

SEQ ID NO: 67481 - DNA, 20 bp, Artificial Sequence
  chemically synthesized
ttagtgaagcagaatagcgg

SEQ ID NO: 67482 - DNA, 20 bp, Artificial Sequence
  chemically synthesized
tagtgaagcagaatagcgga

SEQ ID NO: 67483 - DNA, 20 bp, Artificial Sequence
  chemically synthesized
gtgaagcagaatagcggaag

SEQ ID NO: 67484 - DNA, 20 bp, Artificial Sequence
  chemically synthesized
tgaagcagaatagcggaagg

SEQ ID NO: 67485 - DNA, 20 bp, Artificial Sequence
  chemically synthesized
agcccagaactaggtagatc

SEQ ID NO: 67486 - DNA, 20 bp, Artificial Sequence
  chemically synthesized
ggaaggaggcctgatctacc

SEQ ID NO: 67487 - DNA, 20 bp, Artificial Sequence
  chemically synthesized
aagcccagaactaggtagat

SEQ ID NO: 67488 - DNA, 20 bp, Artificial Sequence
  chemically synthesized
tgtacaagcccagaactagg

SEQ ID NO: 67489 - DNA, 20 bp, Artificial Sequence
  chemically synthesized
aggcctgatctacctagttc

SEQ ID NO: 67490 - DNA, 20 bp, Artificial Sequence
  chemically synthesized
ggcctgatctacctagttct

SEQ ID NO: 67491 - DNA, 20 bp, Artificial Sequence
  chemically synthesized
tcatgtacaagcccagaact

SEQ ID NO: 67492 - DNA, 20 bp, Artificial Sequence
  chemically synthesized
ctcatgtacaagcccagaac

SEQ ID NO: 67493 - DNA, 20 bp, Artificial Sequence
  chemically synthesized
gtctctctcatgtacaagcc

SEQ ID NO: 67494 - DNA, 20 bp, Artificial Sequence
  chemically synthesized
ctagttctgggcttgtacat

SEQ ID NO: 67495 - DNA, 20 bp, Artificial Sequence
  chemically synthesized
tgtaggtctctctcatgtac

SEQ ID NO: 67496 - DNA, 20 bp, Artificial Sequence
  chemically synthesized
agttctgggcttgtacatga

SEQ ID NO: 67497 - DNA, 20 bp, Artificial Sequence
  chemically synthesized
ttctgggcttgtacatgaga

SEQ ID NO: 67498 - DNA, 20 bp, Artificial Sequence
  chemically synthesized
cttaaacaatagagaaatgt

SEQ ID NO: 67499 - DNA, 20 bp, Artificial Sequence
  chemically synthesized
gcttaaacaatagagaaatg

SEQ ID NO: 67500 - DNA, 20 bp, Artificial Sequence
  chemically synthesized
taacaatagcttaaacaata

SEQ ID NO: 67501 - DNA, 20 bp, Artificial Sequence
  chemically synthesized
cctacatttctctattgttt

SEQ ID NO: 67502 - DNA, 20 bp, Artificial Sequence
  chemically synthesized
tgtaacaatagcttaaacaa

SEQ ID NO: 67503 - DNA, 20 bp, Artificial Sequence
  chemically synthesized
tattgtttaagctattgtta

SEQ ID NO: 67504 - DNA, 20 bp, Artificial Sequence
  chemically synthesized
aataggacaaactgtaacaa

SEQ ID NO: 67505 - DNA, 20 bp, Artificial Sequence
  chemically synthesized
attgttacagtttgtcctat

SEQ ID NO: 67506 - DNA, 20 bp, Artificial Sequence
  chemically synthesized
gttacagtttgtcctattag

SEQ ID NO: 67507 - DNA, 20 bp, Artificial Sequence
  chemically synthesized
aatctgattcatctgctaat

SEQ ID NO: 67508 - DNA, 20 bp, Artificial Sequence
  chemically synthesized
taatctgattcatctgctaa

SEQ ID NO: 67509 - DNA, 20 bp, Artificial Sequence
  chemically synthesized
tgtcctattagcagatgaat

SEQ ID NO: 67510 - DNA, 20 bp, Artificial Sequence
  chemically synthesized
tgaatcagattaaaaaatga

SEQ ID NO: 67511 - DNA, 20 bp, Artificial Sequence
  chemically synthesized
aaaaatgatggaaatttgtg

SEQ ID NO: 67512 - DNA, 20 bp, Artificial Sequence
  chemically synthesized
aatgatggaaatttgtgaag

SEQ ID NO: 67513 - DNA, 20 bp, Artificial Sequence
  chemically synthesized
gagttgttattaagtggcat

SEQ ID NO: 67514 - DNA, 20 bp, Artificial Sequence
  chemically synthesized
agagttgttattaagtggca

SEQ ID NO: 67515 - DNA, 20 bp, Artificial Sequence
  chemically synthesized
acgttagagttgttattaag

SEQ ID NO: 67516 - DNA, 20 bp, Artificial Sequence
  chemically synthesized
taaacgttagagttgttatt

SEQ ID NO: 67517 - DNA, 20 bp, Artificial Sequence
  chemically synthesized
taaggaaaatgtaaacgtta

SEQ ID NO: 67518 - DNA, 20 bp, Artificial Sequence
  chemically synthesized
agtaaggaaaatgtaaacgt

SEQ ID NO: 67519 - DNA, 20 bp, Artificial Sequence
  chemically synthesized
acgtttacattttccttact

SEQ ID NO: 67520 - DNA, 20 bp, Artificial Sequence
  chemically synthesized
gtttacattttccttactca

SEQ ID NO: 67521 - DNA, 20 bp, Artificial Sequence
  chemically synthesized
agtggagcttactctgagta

SEQ ID NO: 67522 - DNA, 20 bp, Artificial Sequence
  chemically synthesized
cagtggagcttactctgagt

SEQ ID NO: 67523 - DNA, 20 bp, Artificial Sequence
  chemically synthesized
acattttccttactcagagt

SEQ ID NO: 67524 - DNA, 20 bp, Artificial Sequence
  chemically synthesized
gttacagtggagcttactct

SEQ ID NO: 67525 - DNA, 20 bp, Artificial Sequence
  chemically synthesized
tatgggcaagtgttacagtg

SEQ ID NO: 67526 - DNA, 20 bp, Artificial Sequence
  chemically synthesized
actatgggcaagtgttacag

SEQ ID NO: 67527 - DNA, 20 bp, Artificial Sequence
  chemically synthesized
agaactatgggcaagtgtta

SEQ ID NO: 67528 - DNA, 20 bp, Artificial Sequence
  chemically synthesized
tccactgtaacacttgccca

SEQ ID NO: 67529 - DNA, 20 bp, Artificial Sequence
  chemically synthesized
tgtagaagagaactatgggc

SEQ ID NO: 67530 - DNA, 20 bp, Artificial Sequence
  chemically synthesized
agattgtagaagagaactat

SEQ ID NO: 67531 - DNA, 20 bp, Artificial Sequence
  chemically synthesized
aagattgtagaagagaacta

SEQ ID NO: 67532 - DNA, 20 bp, Artificial Sequence
  chemically synthesized
aattaagtaagattgtagaa

SEQ ID NO: 67533 - DNA, 20 bp, Artificial Sequence
  chemically synthesized
ttaattaagtaagattgtag

SEQ ID NO: 67534 - DNA, 20 bp, Artificial Sequence
  chemically synthesized
cacttaattaagtaagattg

SEQ ID NO: 67535 - DNA, 20 bp, Artificial Sequence
  chemically synthesized
cacagcacacttaattaagt

SEQ ID NO: 67536 - DNA, 20 bp, Artificial Sequence
  chemically synthesized
ttctacaatcttacttaatt

SEQ ID NO: 67537 - DNA, 20 bp, Artificial Sequence
  chemically synthesized
aggacacagcacacttaatt

SEQ ID NO: 67538 - DNA, 20 bp, Artificial Sequence
  chemically synthesized
gggagggtgggtaaaggaca

SEQ ID NO: 67539 - DNA, 20 bp, Artificial Sequence
  chemically synthesized
catctggggagggtgggtaa

SEQ ID NO: 67540 - DNA, 20 bp, Artificial Sequence
  chemically synthesized
gcatctggggagggtgggta

SEQ ID NO: 67541 - DNA, 20 bp, Artificial Sequence
  chemically synthesized
ttcatgcatctggggagggt

SEQ ID NO: 67542 - DNA, 20 bp, Artificial Sequence
  chemically synthesized
tgtcctttacccaccctccc

SEQ ID NO: 67543 - DNA, 20 bp, Artificial Sequence
  chemically synthesized
cttcatgcatctggggaggg

SEQ ID NO: 67544 - DNA, 20 bp, Artificial Sequence
  chemically synthesized
cttcttcatgcatctgggga

SEQ ID NO: 67545 - DNA, 20 bp, Artificial Sequence
  chemically synthesized
gcttcttcatgcatctgggg

SEQ ID NO: 67546 - DNA, 20 bp, Artificial Sequence
  chemically synthesized
agcttcttcatgcatctggg

SEQ ID NO: 67547 - DNA, 20 bp, Artificial Sequence
  chemically synthesized
acagcttcttcatgcatctg

SEQ ID NO: 67548 - DNA, 20 bp, Artificial Sequence
  chemically synthesized
gacagcttcttcatgcatct

SEQ ID NO: 67549 - DNA, 20 bp, Artificial Sequence
  chemically synthesized
ggacagcttcttcatgcatc

SEQ ID NO: 67550 - DNA, 20 bp, Artificial Sequence
  chemically synthesized
ccaccctccccagatgcatg

SEQ ID NO: 67551 - DNA, 20 bp, Artificial Sequence
  chemically synthesized
ccctccccagatgcatgaag

SEQ ID NO: 67552 - DNA, 20 bp, Artificial Sequence
  chemically synthesized
gataacatgaaaatacagga

SEQ ID NO: 67553 - DNA, 20 bp, Artificial Sequence
  chemically synthesized
agaagataacatgaaaatac

SEQ ID NO: 67554 - DNA, 20 bp, Artificial Sequence
  chemically synthesized
aagaagataacatgaaaata

SEQ ID NO: 67555 - DNA, 20 bp, Artificial Sequence
  chemically synthesized
aatctagaatgttcagtaag

SEQ ID NO: 67556 - DNA, 20 bp, Artificial Sequence
  chemically synthesized
aagaatctagaatgttcagt

SEQ ID NO: 67557 - DNA, 20 bp, Artificial Sequence
  chemically synthesized
tatcttcttactgaacattc

SEQ ID NO: 67558 - DNA, 20 bp, Artificial Sequence
  chemically synthesized
ttgaaagaatctagaatgtt

SEQ ID NO: 67559 - DNA, 20 bp, Artificial Sequence
  chemically synthesized
gacaaatatttgaaagaatc

SEQ ID NO: 67560 - DNA, 20 bp, Artificial Sequence
  chemically synthesized
gttatatgacaaatatttga

SEQ ID NO: 67561 - DNA, 20 bp, Artificial Sequence
  chemically synthesized
gattgtgaaaggtatagcga

SEQ ID NO: 67562 - DNA, 20 bp, Artificial Sequence
  chemically synthesized
aaccaagattgtgaaaggta

SEQ ID NO: 67563 - DNA, 20 bp, Artificial Sequence
  chemically synthesized
agggcaaccaagattgtgaa

SEQ ID NO: 67564 - DNA, 20 bp, Artificial Sequence
  chemically synthesized
cagggcaaccaagattgtga

SEQ ID NO: 67565 - DNA, 20 bp, Artificial Sequence
  chemically synthesized
cgctatacctttcacaatct

SEQ ID NO: 67566 - DNA, 20 bp, Artificial Sequence
  chemically synthesized
acattgacagcagggcaacc

SEQ ID NO: 67567 - DNA, 20 bp, Artificial Sequence
  chemically synthesized
atcataatacattgacagca

SEQ ID NO: 67568 - DNA, 20 bp, Artificial Sequence
  chemically synthesized
aatcataatacattgacagc

SEQ ID NO: 67569 - DNA, 20 bp, Artificial Sequence
  chemically synthesized
aaatcataatacattgacag

SEQ ID NO: 67570 - DNA, 20 bp, Artificial Sequence
  chemically synthesized
gaaaaatcataatacattga

SEQ ID NO: 67571 - DNA, 20 bp, Artificial Sequence
  chemically synthesized
gtcaatgtattatgattttt

SEQ ID NO: 67572 - DNA, 20 bp, Artificial Sequence
  chemically synthesized
ttatgagcatcacgtatgat

SEQ ID NO: 67573 - DNA, 20 bp, Artificial Sequence
  chemically synthesized
tcatcatacgtgatgctcat

SEQ ID NO: 67574 - DNA, 20 bp, Artificial Sequence
  chemically synthesized
ctgcagtcatattgacttat

SEQ ID NO: 67575 - DNA, 20 bp, Artificial Sequence
  chemically synthesized
ctcataagtcaatatgactg

SEQ ID NO: 67576 - DNA, 20 bp, Artificial Sequence
  chemically synthesized
agtcaatatgactgcagatg

SEQ ID NO: 67577 - DNA, 20 bp, Artificial Sequence
  chemically synthesized
cactagttaaaccacatctg

SEQ ID NO: 67578 - DNA, 20 bp, Artificial Sequence
  chemically synthesized
gactgcagatgtggtttaac

SEQ ID NO: 67579 - DNA, 20 bp, Artificial Sequence
  chemically synthesized
cagatgtggtttaactagtg

SEQ ID NO: 67580 - DNA, 20 bp, Artificial Sequence
  chemically synthesized
gatgtggtttaactagtgaa

SEQ ID NO: 67581 - DNA, 20 bp, Artificial Sequence
  chemically synthesized
tgttccattaatctcttcac

SEQ ID NO: 67582 - DNA, 20 bp, Artificial Sequence
  chemically synthesized
ttaactagtgaagagattaa

SEQ ID NO: 67583 - DNA, 20 bp, Artificial Sequence
  chemically synthesized
tgtacgaggcaatacagtat

SEQ ID NO: 67584 - DNA, 20 bp, Artificial Sequence
  chemically synthesized
gcttactgtacgaggcaata

SEQ ID NO: 67585 - DNA, 20 bp, Artificial Sequence
  chemically synthesized
taatactgtattgcctcgta

SEQ ID NO: 67586 - DNA, 20 bp, Artificial Sequence
  chemically synthesized
ctggtgtggcttactgtacg

SEQ ID NO: 67587 - DNA, 20 bp, Artificial Sequence
  chemically synthesized
actgtattgcctcgtacagt

SEQ ID NO: 67588 - DNA, 20 bp, Artificial Sequence
  chemically synthesized
tctggtgtggcttactgtac

SEQ ID NO: 67589 - DNA, 20 bp, Artificial Sequence
  chemically synthesized
cctcgtacagtaagccacac

SEQ ID NO: 67590 - DNA, 20 bp, Artificial Sequence
  chemically synthesized
atctccagtatgatctggtg

SEQ ID NO: 67591 - DNA, 20 bp, Artificial Sequence
  chemically synthesized
tattaatctccagtatgatc

SEQ ID NO: 67592 - DNA, 20 bp, Artificial Sequence
  chemically synthesized
taagccacaccagatcatac

SEQ ID NO: 67593 - DNA, 20 bp, Artificial Sequence
  chemically synthesized
agccacaccagatcatactg

SEQ ID NO: 67594 - DNA, 20 bp, Artificial Sequence
  chemically synthesized
acaaggactgtattaatctc

SEQ ID NO: 67595 - DNA, 20 bp, Artificial Sequence
  chemically synthesized
gatcatactggagattaata

SEQ ID NO: 67596 - DNA, 20 bp, Artificial Sequence
  chemically synthesized
ggagattaatacagtccttg

SEQ ID NO: 67597 - DNA, 20 bp, Artificial Sequence
  chemically synthesized
tgggattttaaataaccaca

SEQ ID NO: 67598 - DNA, 20 bp, Artificial Sequence
  chemically synthesized
ttgggattttaaataaccac

SEQ ID NO: 67599 - DNA, 20 bp, Artificial Sequence
  chemically synthesized
ctttatatgaaaaacaaatt

SEQ ID NO: 67600 - DNA, 20 bp, Artificial Sequence
  chemically synthesized
gctttatatgaaaaacaaat

SEQ ID NO: 67601 - DNA, 20 bp, Artificial Sequence
  chemically synthesized
cccaatttgtttttcatata

SEQ ID NO: 67602 - DNA, 20 bp, Artificial Sequence
  chemically synthesized
ttttcatataaagcgccaca

SEQ ID NO: 67603 - DNA, 20 bp, Artificial Sequence
  chemically synthesized
catataaagcgccacaaagt

SEQ ID NO: 67604 - DNA, 20 bp, Artificial Sequence
  chemically synthesized
ctgaggaacatctgactttg

SEQ ID NO: 67605 - DNA, 20 bp, Artificial Sequence
  chemically synthesized
ccacaaagtcagatgttcct

SEQ ID NO: 67606 - DNA, 20 bp, Artificial Sequence
  chemically synthesized
ttttgtacaaatataggctg

SEQ ID NO: 67607 - DNA, 20 bp, Artificial Sequence
  chemically synthesized
cttttgtacaaatataggct

SEQ ID NO: 67608 - DNA, 20 bp, Artificial Sequence
  chemically synthesized
aaagtcttttgtacaaatat

SEQ ID NO: 67609 - DNA, 20 bp, Artificial Sequence
  chemically synthesized
taaagtcttttgtacaaata

SEQ ID NO: 67610 - DNA, 20 bp, Artificial Sequence
  chemically synthesized
ctcagcctatatttgtacaa

SEQ ID NO: 67611 - DNA, 20 bp, Artificial Sequence
  chemically synthesized
tcctgcctttaagattttta

SEQ ID NO: 67612 - DNA, 20 bp, Artificial Sequence
  chemically synthesized
aaaagactttaaaaatctta

SEQ ID NO: 67613 - DNA, 20 bp, Artificial Sequence
  chemically synthesized
aaagactttaaaaatcttaa

SEQ ID NO: 67614 - DNA, 20 bp, Artificial Sequence
  chemically synthesized
gactttaaaaatcttaaagg

SEQ ID NO: 67615 - DNA, 20 bp, Artificial Sequence
  chemically synthesized
actttaaaaatcttaaaggc

SEQ ID NO: 67616 - DNA, 20 bp, Artificial Sequence
  chemically synthesized
aagcaagatgtcctgccttt

SEQ ID NO: 67617 - DNA, 20 bp, Artificial Sequence
  chemically synthesized
aaaatttaacaagaacaagc

SEQ ID NO: 67618 - DNA, 20 bp, Artificial Sequence
  chemically synthesized
aaataaaatttaacaagaac

SEQ ID NO: 67619 - DNA, 20 bp, Artificial Sequence
  chemically synthesized
aaattaaaataaaatttaac

SEQ ID NO: 67620 - DNA, 20 bp, Artificial Sequence
  chemically synthesized
ttattttaatttttttattt

SEQ ID NO: 67621 - DNA, 20 bp, Artificial Sequence
  chemically synthesized
ttaatttttttattttggta

SEQ ID NO: 67622 - DNA, 20 bp, Artificial Sequence
  chemically synthesized
tttattttggtacagtatcc

SEQ ID NO: 67623 - DNA, 20 bp, Artificial Sequence
  chemically synthesized
aaataagattataacagact

SEQ ID NO: 67624 - DNA, 20 bp, Artificial Sequence
  chemically synthesized
aaaataagattataacagac

SEQ ID NO: 67625 - DNA, 20 bp, Artificial Sequence
  chemically synthesized
gactcaaaataagattataa

SEQ ID NO: 67626 - DNA, 20 bp, Artificial Sequence
  chemically synthesized
gtctgttataatcttatttt

SEQ ID NO: 67627 - DNA, 20 bp, Artificial Sequence
  chemically synthesized
tcaaaatcaagactcaaaat

SEQ ID NO: 67628 - DNA, 20 bp, Artificial Sequence
  chemically synthesized
cacactgaaagatcaaaatc

SEQ ID NO: 67629 - DNA, 20 bp, Artificial Sequence
  chemically synthesized
gagtcttgattttgatcttt

SEQ ID NO: 67630 - DNA, 20 bp, Artificial Sequence
  chemically synthesized
aatgggagtcaacacactga

SEQ ID NO: 67631 - DNA, 20 bp, Artificial Sequence
  chemically synthesized
tgacacaaaggtgagaatgg

SEQ ID NO: 67632 - DNA, 20 bp, Artificial Sequence
  chemically synthesized
aatgacacaaaggtgagaat

SEQ ID NO: 67633 - DNA, 20 bp, Artificial Sequence
  chemically synthesized
aaatgacacaaaggtgagaa

SEQ ID NO: 67634 - DNA, 20 bp, Artificial Sequence
  chemically synthesized
ttttcaaatgacacaaaggt

SEQ ID NO: 67635 - DNA, 20 bp, Artificial Sequence
  chemically synthesized
taatttttcaaatgacacaa

SEQ ID NO: 67636 - DNA, 20 bp, Artificial Sequence
  chemically synthesized
ttaatttttcaaatgacaca

SEQ ID NO: 67637 - DNA, 20 bp, Artificial Sequence
  chemically synthesized
gtgtcatttgaaaaattaat

SEQ ID NO: 67638 - DNA, 20 bp, Artificial Sequence
  chemically synthesized
gcacaatgtatatgcttatc

SEQ ID NO: 67639 - DNA, 20 bp, Artificial Sequence
  chemically synthesized
tttttgtcatttttctagat

SEQ ID NO: 67640 - DNA, 20 bp, Artificial Sequence
  chemically synthesized
ccagatttttgtcatttttc

SEQ ID NO: 67641 - DNA, 20 bp, Artificial Sequence
  chemically synthesized
ctagaaaaatgacaaaaatc

SEQ ID NO: 67642 - DNA, 20 bp, Artificial Sequence
  chemically synthesized
tagaaaaatgacaaaaatct

SEQ ID NO: 67643 - DNA, 20 bp, Artificial Sequence
  chemically synthesized
aatgacaaaaatctgggtca

SEQ ID NO: 67644 - DNA, 20 bp, Artificial Sequence
  chemically synthesized
tccttgcctgtactttgacc

SEQ ID NO: 67645 - DNA, 20 bp, Artificial Sequence
  chemically synthesized
caaaaatctgggtcaaagta

SEQ ID NO: 67646 - DNA, 20 bp, Artificial Sequence
  chemically synthesized
aaaaatctgggtcaaagtac

SEQ ID NO: 67647 - DNA, 20 bp, Artificial Sequence
  chemically synthesized
atctgggtcaaagtacaggc

SEQ ID NO: 67648 - DNA, 20 bp, Artificial Sequence
  chemically synthesized
tctgggtcaaagtacaggca

SEQ ID NO: 67649 - DNA, 20 bp, Artificial Sequence
  chemically synthesized
tgggtcaaagtacaggcaag

SEQ ID NO: 67650 - DNA, 20 bp, Artificial Sequence
  chemically synthesized
gggtcaaagtacaggcaagg

SEQ ID NO: 67651 - DNA, 20 bp, Artificial Sequence
  chemically synthesized
aggcaaggaggcaccacttt

SEQ ID NO: 67652 - DNA, 20 bp, Artificial Sequence
  chemically synthesized
ggcaaggaggcaccactttt

SEQ ID NO: 67653 - DNA, 20 bp, Artificial Sequence
  chemically synthesized
gcaaggaggcaccactttta

SEQ ID NO: 67654 - DNA, 20 bp, Artificial Sequence
  chemically synthesized
caaggaggcaccacttttag

SEQ ID NO: 67655 - DNA, 20 bp, Artificial Sequence
  chemically synthesized
taaatagtgccccctaaaag

SEQ ID NO: 67656 - DNA, 20 bp, Artificial Sequence
  chemically synthesized
aaggaggcaccacttttagg

SEQ ID NO: 67657 - DNA, 20 bp, Artificial Sequence
  chemically synthesized
ccataaatagtgccccctaa

SEQ ID NO: 67658 - DNA, 20 bp, Artificial Sequence
  chemically synthesized
cttttagggggcactattta

SEQ ID NO: 67659 - DNA, 20 bp, Artificial Sequence
  chemically synthesized
tttagggggcactatttatg

SEQ ID NO: 67660 - DNA, 20 bp, Artificial Sequence
  chemically synthesized
ttagggggcactatttatgg

SEQ ID NO: 67661 - DNA, 20 bp, Artificial Sequence
  chemically synthesized
atttcacaaccctccataaa

SEQ ID NO: 67662 - DNA, 20 bp, Artificial Sequence
  chemically synthesized
tagggggcactatttatgga

SEQ ID NO: 67663 - DNA, 20 bp, Artificial Sequence
  chemically synthesized
ttatggagggttgtgaaatg

SEQ ID NO: 67664 - DNA, 20 bp, Artificial Sequence
  chemically synthesized
tggagggttgtgaaatgaag

SEQ ID NO: 67665 - DNA, 20 bp, Artificial Sequence
  chemically synthesized
tgctaaccacagagtgaatt

SEQ ID NO: 67666 - DNA, 20 bp, Artificial Sequence
  chemically synthesized
gtagaactgaattcactctg

SEQ ID NO: 67667 - DNA, 20 bp, Artificial Sequence
  chemically synthesized
aactgaattcactctgtggt

SEQ ID NO: 67668 - DNA, 20 bp, Artificial Sequence
  chemically synthesized
gttttgtggtgctaaccaca

SEQ ID NO: 67669 - DNA, 20 bp, Artificial Sequence
  chemically synthesized
gtgttttgtggtgctaacca

SEQ ID NO: 67670 - DNA, 20 bp, Artificial Sequence
  chemically synthesized
tcaatttgagaagtgttttg

SEQ ID NO: 67671 - DNA, 20 bp, Artificial Sequence
  chemically synthesized
tgttaaactgtcaatttgag

SEQ ID NO: 67672 - DNA, 20 bp, Artificial Sequence
  chemically synthesized
caaaacacttctcaaattga

SEQ ID NO: 67673 - DNA, 20 bp, Artificial Sequence
  chemically synthesized
ttgtgttaaactgtcaattt

SEQ ID NO: 67674 - DNA, 20 bp, Artificial Sequence
  chemically synthesized
tttaacacaacattcctcct

SEQ ID NO: 67675 - DNA, 20 bp, Artificial Sequence
  chemically synthesized
ttaacacaacattcctcctt

SEQ ID NO: 67676 - DNA, 20 bp, Artificial Sequence
  chemically synthesized
ttcaataaccatgcccaagg

SEQ ID NO: 67677 - DNA, 20 bp, Artificial Sequence
  chemically synthesized
tttcaataaccatgcccaag

SEQ ID NO: 67678 - DNA, 20 bp, Artificial Sequence
  chemically synthesized
acaacattcctccttgggca

SEQ ID NO: 67679 - DNA, 20 bp, Artificial Sequence
  chemically synthesized
tgtttcaataaccatgccca

SEQ ID NO: 67680 - DNA, 20 bp, Artificial Sequence
  chemically synthesized
atgtttcaataaccatgccc

SEQ ID NO: 67681 - DNA, 20 bp, Artificial Sequence
  chemically synthesized
gaaatataatttggtaaatt

SEQ ID NO: 67682 - DNA, 20 bp, Artificial Sequence
  chemically synthesized
acatggagagaaatataatt

SEQ ID NO: 67683 - DNA, 20 bp, Artificial Sequence
  chemically synthesized
ctacatgaattatacatgga

SEQ ID NO: 67684 - DNA, 20 bp, Artificial Sequence
  chemically synthesized
aactacatgaattatacatg

SEQ ID NO: 67685 - DNA, 20 bp, Artificial Sequence
  chemically synthesized
taaactacatgaattataca

SEQ ID NO: 67686 - DNA, 20 bp, Artificial Sequence
  chemically synthesized
ctctccatgtataattcatg

SEQ ID NO: 67687 - DNA, 20 bp, Artificial Sequence
  chemically synthesized
tataattcatgtagtttaat

SEQ ID NO: 67688 - DNA, 20 bp, Artificial Sequence
  chemically synthesized
atgtagtttaataagattgt

SEQ ID NO: 67689 - DNA, 20 bp, Artificial Sequence
  chemically synthesized
tagtttaataagattgtgag

SEQ ID NO: 67690 - DNA, 20 bp, Artificial Sequence
  chemically synthesized
gattgtgagcagccacgtaa

SEQ ID NO: 67691 - DNA, 20 bp, Artificial Sequence
  chemically synthesized
attgtgagcagccacgtaaa

SEQ ID NO: 67692 - DNA, 20 bp, Artificial Sequence
  chemically synthesized
tttcagcagtgccttttacg

SEQ ID NO: 67693 - DNA, 20 bp, Artificial Sequence
  chemically synthesized
gcagtgtatctgaatttcag

SEQ ID NO: 67694 - DNA, 20 bp, Artificial Sequence
  chemically synthesized
taaaaggcactgctgaaatt

SEQ ID NO: 67695 - DNA, 20 bp, Artificial Sequence
  chemically synthesized
gcagcagtgtatctgaattt

SEQ ID NO: 67696 - DNA, 20 bp, Artificial Sequence
  chemically synthesized
gaaattcagatacactgctg

SEQ ID NO: 67697 - DNA, 20 bp, Artificial Sequence
  chemically synthesized
aaagtggtgttatgctgcag

SEQ ID NO: 67698 - DNA, 20 bp, Artificial Sequence
  chemically synthesized
tttaaagtggtgttatgctg

SEQ ID NO: 67699 - DNA, 20 bp, Artificial Sequence
  chemically synthesized
cttaactggcttttttaaag

SEQ ID NO: 67700 - DNA, 20 bp, Artificial Sequence
  chemically synthesized
agcataacaccactttaaaa

SEQ ID NO: 67701 - DNA, 20 bp, Artificial Sequence
  chemically synthesized
caacttaactggctttttta

SEQ ID NO: 67702 - DNA, 20 bp, Artificial Sequence
  chemically synthesized
taacaccactttaaaaaagc

SEQ ID NO: 67703 - DNA, 20 bp, Artificial Sequence
  chemically synthesized
ccactttaaaaaagccagtt

SEQ ID NO: 67704 - DNA, 20 bp, Artificial Sequence
  chemically synthesized
tttaaaaaagccagttaagt

SEQ ID NO: 67705 - DNA, 20 bp, Artificial Sequence
  chemically synthesized
ttttactttgccaacttaac

SEQ ID NO: 67706 - DNA, 20 bp, Artificial Sequence
  chemically synthesized
aaaagccagttaagttggca

SEQ ID NO: 67707 - DNA, 20 bp, Artificial Sequence
  chemically synthesized
gcaaagtaaaaaaaaaaaaa

SEQ ID NO: 67708 - DNA, 20 bp, Artificial Sequence
  chemically synthesized
agttttcaccttaatattgt

SEQ ID NO: 67709 - DNA, 20 bp, Artificial Sequence
  chemically synthesized
aaaaaaaagcctacaatatt

SEQ ID NO: 67710 - DNA, 20 bp, Artificial Sequence
  chemically synthesized
aagttttcaccttaatattg

SEQ ID NO: 67711 - DNA, 20 bp, Artificial Sequence
  chemically synthesized
aaaaaaagcctacaatatta

SEQ ID NO: 67712 - DNA, 20 bp, Artificial Sequence
  chemically synthesized
ttcactagagtcatgttgta

SEQ ID NO: 67713 - DNA, 20 bp, Artificial Sequence
  chemically synthesized
aaaactttacaacatgactc

SEQ ID NO: 67714 - DNA, 20 bp, Artificial Sequence
  chemically synthesized
ttagactttaatattcacta

SEQ ID NO: 67715 - DNA, 20 bp, Artificial Sequence
  chemically synthesized
ttttagactttaatattcac

SEQ ID NO: 67716 - DNA, 20 bp, Artificial Sequence
  chemically synthesized
catgactctagtgaatatta

SEQ ID NO: 67717 - DNA, 20 bp, Artificial Sequence
  chemically synthesized
gaatattaaagtctaaaata

SEQ ID NO: 67718 - DNA, 20 bp, Artificial Sequence
  chemically synthesized
aatattaaagtctaaaataa

SEQ ID NO: 67719 - DNA, 20 bp, Artificial Sequence
  chemically synthesized
ctgtttcttttcctttattt

SEQ ID NO: 67720 - DNA, 20 bp, Artificial Sequence
  chemically synthesized
taaagtctaaaataaaggaa

SEQ ID NO: 67721 - DNA, 20 bp, Artificial Sequence
  chemically synthesized
ctaaaataaaggaaaagaaa

SEQ ID NO: 67722 - DNA, 20 bp, Artificial Sequence
  chemically synthesized
aaaccgtatttggaaacatt

SEQ ID NO: 67723 - DNA, 20 bp, Artificial Sequence
  chemically synthesized
ttgctcaatgtttccaaata

SEQ ID NO: 67724 - DNA, 20 bp, Artificial Sequence
  chemically synthesized
aatctgggagaaaccgtatt

SEQ ID NO: 67725 - DNA, 20 bp, Artificial Sequence
  chemically synthesized
tttccaaatacggtttctcc

SEQ ID NO: 67726 - DNA, 20 bp, Artificial Sequence
  chemically synthesized
aaagaaaactataaatctgg

SEQ ID NO: 67727 - DNA, 20 bp, Artificial Sequence
  chemically synthesized
tacggtttctcccagattta

SEQ ID NO: 67728 - DNA, 20 bp, Artificial Sequence
  chemically synthesized
ataaagaaaactataaatct

SEQ ID NO: 67729 - DNA, 20 bp, Artificial Sequence
  chemically synthesized
aataaagaaaactataaatc

SEQ ID NO: 67730 - DNA, 20 bp, Artificial Sequence
  chemically synthesized
aataataaaataaagaaata

SEQ ID NO: 67731 - DNA, 20 bp, Artificial Sequence
  chemically synthesized
caaaaaataataataaaata

SEQ ID NO: 67732 - DNA, 20 bp, Artificial Sequence
  chemically synthesized
ttattttattattatttttt

SEQ ID NO: 67733 - DNA, 20 bp, Artificial Sequence
  chemically synthesized
tttattattattttttgaga

SEQ ID NO: 67734 - DNA, 20 bp, Artificial Sequence
  chemically synthesized
tattattattttttgagatg

SEQ ID NO: 67735 - DNA, 20 bp, Artificial Sequence
  chemically synthesized
tggagtttcactctgttgcc

SEQ ID NO: 67736 - DNA, 20 bp, Artificial Sequence
  chemically synthesized
gcactccagcctgggcaaca

SEQ ID NO: 67737 - DNA, 20 bp, Artificial Sequence
  chemically synthesized
ggagtttcactctgttgccc

SEQ ID NO: 67738 - DNA, 20 bp, Artificial Sequence
  chemically synthesized
ctgcactccagcctgggcaa

SEQ ID NO: 67739 - DNA, 20 bp, Artificial Sequence
  chemically synthesized
tttcactctgttgcccaggc

SEQ ID NO: 67740 - DNA, 20 bp, Artificial Sequence
  chemically synthesized
tcactctgttgcccaggctg

SEQ ID NO: 67741 - DNA, 20 bp, Artificial Sequence
  chemically synthesized
gcaccactgcactccagcct

SEQ ID NO: 67742 - DNA, 20 bp, Artificial Sequence
  chemically synthesized
tgcaccactgcactccagcc

SEQ ID NO: 67743 - DNA, 20 bp, Artificial Sequence
  chemically synthesized
ctgttgcccaggctggagtg

SEQ ID NO: 67744 - DNA, 20 bp, Artificial Sequence
  chemically synthesized
gatattgcaccactgcactc

SEQ ID NO: 67745 - DNA, 20 bp, Artificial Sequence
  chemically synthesized
ttgcccaggctggagtgcag

SEQ ID NO: 67746 - DNA, 20 bp, Artificial Sequence
  chemically synthesized
ggggctaaggttgcagtgag

SEQ ID NO: 67747 - DNA, 20 bp, Artificial Sequence
  chemically synthesized
cagggggctaaggttgcagt

SEQ ID NO: 67748 - DNA, 20 bp, Artificial Sequence
  chemically synthesized
atatctgctcactgcaacct

SEQ ID NO: 67749 - DNA, 20 bp, Artificial Sequence
  chemically synthesized
aacccagggggctaaggttg

SEQ ID NO: 67750 - DNA, 20 bp, Artificial Sequence
  chemically synthesized
tgctggaacccagggggcta

SEQ ID NO: 67751 - DNA, 20 bp, Artificial Sequence
  chemically synthesized
tcactgcaaccttagccccc

SEQ ID NO: 67752 - DNA, 20 bp, Artificial Sequence
  chemically synthesized
ttgctggaacccagggggct

SEQ ID NO: 67753 - DNA, 20 bp, Artificial Sequence
  chemically synthesized
cactgcaaccttagccccct

SEQ ID NO: 67754 - DNA, 20 bp, Artificial Sequence
  chemically synthesized
gagaattgctggaacccagg

SEQ ID NO: 67755 - DNA, 20 bp, Artificial Sequence
  chemically synthesized
ggagaattgctggaacccag

SEQ ID NO: 67756 - DNA, 20 bp, Artificial Sequence
  chemically synthesized
aaccttagccccctgggttc

SEQ ID NO: 67757 - DNA, 20 bp, Artificial Sequence
  chemically synthesized
aggagaattgctggaaccca

SEQ ID NO: 67758 - DNA, 20 bp, Artificial Sequence
  chemically synthesized
caggagaattgctggaaccc

SEQ ID NO: 67759 - DNA, 20 bp, Artificial Sequence
  chemically synthesized
gcaggagaattgctggaacc

SEQ ID NO: 67760 - DNA, 20 bp, Artificial Sequence
  chemically synthesized
ggctgaggcaggagaattgc

SEQ ID NO: 67761 - DNA, 20 bp, Artificial Sequence
  chemically synthesized
ttccagcaattctcctgcct

SEQ ID NO: 67762 - DNA, 20 bp, Artificial Sequence
  chemically synthesized
tacttgggaggctgaggcag

SEQ ID NO: 67763 - DNA, 20 bp, Artificial Sequence
  chemically synthesized
gctacttgggaggctgaggc

SEQ ID NO: 67764 - DNA, 20 bp, Artificial Sequence
  chemically synthesized
agctacttgggaggctgagg

SEQ ID NO: 67765 - DNA, 20 bp, Artificial Sequence
  chemically synthesized
cccagctacttgggaggctg

SEQ ID NO: 67766 - DNA, 20 bp, Artificial Sequence
  chemically synthesized
tcccagctacttgggaggct

SEQ ID NO: 67767 - DNA, 20 bp, Artificial Sequence
  chemically synthesized
ttctcctgcctcagcctccc

SEQ ID NO: 67768 - DNA, 20 bp, Artificial Sequence
  chemically synthesized
tcctgcctcagcctcccaag

SEQ ID NO: 67769 - DNA, 20 bp, Artificial Sequence
  chemically synthesized
tgtaatcccagctacttggg

SEQ ID NO: 67770 - DNA, 20 bp, Artificial Sequence
  chemically synthesized
ctgtaatcccagctacttgg

SEQ ID NO: 67771 - DNA, 20 bp, Artificial Sequence
  chemically synthesized
gcctcagcctcccaagtagc

SEQ ID NO: 67772 - DNA, 20 bp, Artificial Sequence
  chemically synthesized
gcctgtaatcccagctactt

SEQ ID NO: 67773 - DNA, 20 bp, Artificial Sequence
  chemically synthesized
cctcagcctcccaagtagct

SEQ ID NO: 67774 - DNA, 20 bp, Artificial Sequence
  chemically synthesized
tgcctgtaatcccagctact

SEQ ID NO: 67775 - DNA, 20 bp, Artificial Sequence
  chemically synthesized
ctcccaagtagctgggatta

SEQ ID NO: 67776 - DNA, 20 bp, Artificial Sequence
  chemically synthesized
tcccaagtagctgggattac

SEQ ID NO: 67777 - DNA, 20 bp, Artificial Sequence
  chemically synthesized
gtggtgcatgcctgtaatcc

SEQ ID NO: 67778 - DNA, 20 bp, Artificial Sequence
  chemically synthesized
caggcatgcaccaccacacc

SEQ ID NO: 67779 - DNA, 20 bp, Artificial Sequence
  chemically synthesized
aaaaaactagccgggtgtgg

SEQ ID NO: 67780 - DNA, 20 bp, Artificial Sequence
  chemically synthesized
caaaaaaaactagccgggtg

SEQ ID NO: 67781 - DNA, 20 bp, Artificial Sequence
  chemically synthesized
catgcaccaccacacccggc

SEQ ID NO: 67782 - DNA, 20 bp, Artificial Sequence
  chemically synthesized
gaatacaaaaaaaactagcc

SEQ ID NO: 67783 - DNA, 20 bp, Artificial Sequence
  chemically synthesized
tgaatacaaaaaaaactagc

SEQ ID NO: 67784 - DNA, 20 bp, Artificial Sequence
  chemically synthesized
ctactgaatacaaaaaaaac

SEQ ID NO: 67785 - DNA, 20 bp, Artificial Sequence
  chemically synthesized
cggctagttttttttgtatt

SEQ ID NO: 67786 - DNA, 20 bp, Artificial Sequence
  chemically synthesized
ctagttttttttgtattcag

SEQ ID NO: 67787 - DNA, 20 bp, Artificial Sequence
  chemically synthesized
agttttttttgtattcagta

SEQ ID NO: 67788 - DNA, 20 bp, Artificial Sequence
  chemically synthesized
ttttttgtattcagtagaga

SEQ ID NO: 67789 - DNA, 20 bp, Artificial Sequence
  chemically synthesized
tttttgtattcagtagagac

SEQ ID NO: 67790 - DNA, 20 bp, Artificial Sequence
  chemically synthesized
ttttgtattcagtagagaca

SEQ ID NO: 67791 - DNA, 20 bp, Artificial Sequence
  chemically synthesized
gagacagggtttcgtcatgt

SEQ ID NO: 67792 - DNA, 20 bp, Artificial Sequence
  chemically synthesized
cagggtttcgtcatgttggt

SEQ ID NO: 67793 - DNA, 20 bp, Artificial Sequence
  chemically synthesized
agggtttcgtcatgttggtc

SEQ ID NO: 67794 - DNA, 20 bp, Artificial Sequence
  chemically synthesized
tttcgtcatgttggtcaggc

SEQ ID NO: 67795 - DNA, 20 bp, Artificial Sequence
  chemically synthesized
tgatgtcaggagttcaagac

SEQ ID NO: 67796 - DNA, 20 bp, Artificial Sequence
  chemically synthesized
tcatttgatgtcaggagttc

SEQ ID NO: 67797 - DNA, 20 bp, Artificial Sequence
  chemically synthesized
ggtagatcatttgatgtcag

SEQ ID NO: 67798 - DNA, 20 bp, Artificial Sequence
  chemically synthesized
tgggtagatcatttgatgtc

SEQ ID NO: 67799 - DNA, 20 bp, Artificial Sequence
  chemically synthesized
gtgggtagatcatttgatgt

SEQ ID NO: 67800 - DNA, 20 bp, Artificial Sequence
  chemically synthesized
atcaaatgatctacccacct

SEQ ID NO: 67801 - DNA, 20 bp, Artificial Sequence
  chemically synthesized
ctttgggaggccgaggtggg

SEQ ID NO: 67802 - DNA, 20 bp, Artificial Sequence
  chemically synthesized
gcactttgggaggccgaggt

SEQ ID NO: 67803 - DNA, 20 bp, Artificial Sequence
  chemically synthesized
agcactttgggaggccgagg

SEQ ID NO: 67804 - DNA, 20 bp, Artificial Sequence
  chemically synthesized
cccagcactttgggaggccg

SEQ ID NO: 67805 - DNA, 20 bp, Artificial Sequence
  chemically synthesized
tcccagcactttgggaggcc

SEQ ID NO: 67806 - DNA, 20 bp, Artificial Sequence
  chemically synthesized
ctacccacctcggcctccca

SEQ ID NO: 67807 - DNA, 20 bp, Artificial Sequence
  chemically synthesized
tgtaatcccagcactttggg

SEQ ID NO: 67808 - DNA, 20 bp, Artificial Sequence
  chemically synthesized
ctgtaatcccagcactttgg

SEQ ID NO: 67809 - DNA, 20 bp, Artificial Sequence
  chemically synthesized
acctcggcctcccaaagtgc

SEQ ID NO: 67810 - DNA, 20 bp, Artificial Sequence
  chemically synthesized
gcctgtaatcccagcacttt

SEQ ID NO: 67811 - DNA, 20 bp, Artificial Sequence
  chemically synthesized
cctcggcctcccaaagtgct

SEQ ID NO: 67812 - DNA, 20 bp, Artificial Sequence
  chemically synthesized
tgcctgtaatcccagcactt

SEQ ID NO: 67813 - DNA, 20 bp, Artificial Sequence
  chemically synthesized
ctcccaaagtgctgggatta

SEQ ID NO: 67814 - DNA, 20 bp, Artificial Sequence
  chemically synthesized
tcccaaagtgctgggattac

SEQ ID NO: 67815 - DNA, 20 bp, Artificial Sequence
  chemically synthesized
gtggctcatgcctgtaatcc

SEQ ID NO: 67816 - DNA, 20 bp, Artificial Sequence
  chemically synthesized
agtgctgggattacaggcat

SEQ ID NO: 67817 - DNA, 20 bp, Artificial Sequence
  chemically synthesized
caggcatgagccactgcacc

SEQ ID NO: 67818 - DNA, 20 bp, Artificial Sequence
  chemically synthesized
aatctgggggccgggtgcag

SEQ ID NO: 67819 - DNA, 20 bp, Artificial Sequence
  chemically synthesized
ataaatctgggggccgggtg

SEQ ID NO: 67820 - DNA, 20 bp, Artificial Sequence
  chemically synthesized
gagccactgcacccggcccc

SEQ ID NO: 67821 - DNA, 20 bp, Artificial Sequence
  chemically synthesized
aaactataaatctgggggcc

SEQ ID NO: 67822 - DNA, 20 bp, Artificial Sequence
  chemically synthesized
aaaactataaatctgggggc

SEQ ID NO: 67823 - DNA, 20 bp, Artificial Sequence
  chemically synthesized
cttaaaaactataaatctgg

SEQ ID NO: 67824 - DNA, 20 bp, Artificial Sequence
  chemically synthesized
tcttaaaaactataaatctg

SEQ ID NO: 67825 - DNA, 20 bp, Artificial Sequence
  chemically synthesized
gcacccggcccccagattta

SEQ ID NO: 67826 - DNA, 20 bp, Artificial Sequence
  chemically synthesized
atcttaaaaactataaatct

SEQ ID NO: 67827 - DNA, 20 bp, Artificial Sequence
  chemically synthesized
tatcttaaaaactataaatc

SEQ ID NO: 67828 - DNA, 20 bp, Artificial Sequence
  chemically synthesized
cccccagatttatagttttt

SEQ ID NO: 67829 - DNA, 20 bp, Artificial Sequence
  chemically synthesized
atttatagtttttaagataa

SEQ ID NO: 67830 - DNA, 20 bp, Artificial Sequence
  chemically synthesized
gtttttaagataaaagcgac

SEQ ID NO: 67831 - DNA, 20 bp, Artificial Sequence
  chemically synthesized
agctttttaaaacattaatt

SEQ ID NO: 67832 - DNA, 20 bp, Artificial Sequence
  chemically synthesized
agccaaattaatgttttaaa

SEQ ID NO: 67833 - DNA, 20 bp, Artificial Sequence
  chemically synthesized
tttttccccccatatgtttc

SEQ ID NO: 67834 - DNA, 20 bp, Artificial Sequence
  chemically synthesized
tttaaaaagctcgaaacata

SEQ ID NO: 67835 - DNA, 20 bp, Artificial Sequence
  chemically synthesized
ttaaaaagctcgaaacatat

SEQ ID NO: 67836 - DNA, 20 bp, Artificial Sequence
  chemically synthesized
taaaaagctcgaaacatatg

SEQ ID NO: 67837 - DNA, 20 bp, Artificial Sequence
  chemically synthesized
aaaaagctcgaaacatatgg

SEQ ID NO: 67838 - DNA, 20 bp, Artificial Sequence
  chemically synthesized
aaaagctcgaaacatatggg

SEQ ID NO: 67839 - DNA, 20 bp, Artificial Sequence
  chemically synthesized
atggggggaaaaattaaaca

SEQ ID NO: 67840 - DNA, 20 bp, Artificial Sequence
  chemically synthesized
gaaaaattaaacaaagtgcc

SEQ ID NO: 67841 - DNA, 20 bp, Artificial Sequence
  chemically synthesized
aaattaaacaaagtgccaag

SEQ ID NO: 67842 - DNA, 20 bp, Artificial Sequence
  chemically synthesized
ttagctgtatgttcactact

SEQ ID NO: 67843 - DNA, 20 bp, Artificial Sequence
  chemically synthesized
agtgccaagtagtgaacata

SEQ ID NO: 67844 - DNA, 20 bp, Artificial Sequence
  chemically synthesized
tatgactactttttattatt

SEQ ID NO: 67845 - DNA, 20 bp, Artificial Sequence
  chemically synthesized
acatacagctaaataataaa

SEQ ID NO: 67846 - DNA, 20 bp, Artificial Sequence
  chemically synthesized
tacagctaaataataaaaag

SEQ ID NO: 67847 - DNA, 20 bp, Artificial Sequence
  chemically synthesized
atttttgaataacaaagcat

SEQ ID NO: 67848 - DNA, 20 bp, Artificial Sequence
  chemically synthesized
aaaatgatttttgaataaca

SEQ ID NO: 67849 - DNA, 20 bp, Artificial Sequence
  chemically synthesized
tcaaaaatcatttttcctca

SEQ ID NO: 67850 - DNA, 20 bp, Artificial Sequence
  chemically synthesized
aaaaatcatttttcctcaaa

SEQ ID NO: 67851 - DNA, 20 bp, Artificial Sequence
  chemically synthesized
tttttcacccttactctttg

SEQ ID NO: 67852 - DNA, 20 bp, Artificial Sequence
  chemically synthesized
atcatttttcctcaaagagt

SEQ ID NO: 67853 - DNA, 20 bp, Artificial Sequence
  chemically synthesized
atttttcacccttactcttt

SEQ ID NO: 67854 - DNA, 20 bp, Artificial Sequence
  chemically synthesized
tcatttttcctcaaagagta

SEQ ID NO: 67855 - DNA, 20 bp, Artificial Sequence
  chemically synthesized
catttttcctcaaagagtaa

SEQ ID NO: 67856 - DNA, 20 bp, Artificial Sequence
  chemically synthesized
gagtaagggtgaaaaattgt

SEQ ID NO: 67857 - DNA, 20 bp, Artificial Sequence
  chemically synthesized
agtaagggtgaaaaattgta

SEQ ID NO: 67858 - DNA, 20 bp, Artificial Sequence
  chemically synthesized
taattgaacatgtagtggga

SEQ ID NO: 67859 - DNA, 20 bp, Artificial Sequence
  chemically synthesized
catttaattgaacatgtagt

SEQ ID NO: 67860 - DNA, 20 bp, Artificial Sequence
  chemically synthesized
tcatttaattgaacatgtag

SEQ ID NO: 67861 - DNA, 20 bp, Artificial Sequence
  chemically synthesized
tagtcatttaattgaacatg

SEQ ID NO: 67862 - DNA, 20 bp, Artificial Sequence
  chemically synthesized
taaatgtctctacattaatt

SEQ ID NO: 67863 - DNA, 20 bp, Artificial Sequence
  chemically synthesized
attaaatgactaaattaatg

SEQ ID NO: 67864 - DNA, 20 bp, Artificial Sequence
  chemically synthesized
taaatgactaaattaatgta

SEQ ID NO: 67865 - DNA, 20 bp, Artificial Sequence
  chemically synthesized
aatgtagagacatttaatta

SEQ ID NO: 67866 - DNA, 20 bp, Artificial Sequence
  chemically synthesized
acatttaattaaagttccac

SEQ ID NO: 67867 - DNA, 20 bp, Artificial Sequence
  chemically synthesized
atagcatttggaaaaactag

SEQ ID NO: 67868 - DNA, 20 bp, Artificial Sequence
  chemically synthesized
ttaatagcatttggaaaaac

SEQ ID NO: 67869 - DNA, 20 bp, Artificial Sequence
  chemically synthesized
gcggcgtaattaatagcatt

SEQ ID NO: 67870 - DNA, 20 bp, Artificial Sequence
  chemically synthesized
ttagatagcggcgtaattaa

SEQ ID NO: 67871 - DNA, 20 bp, Artificial Sequence
  chemically synthesized
agagatttaattttagatag

SEQ ID NO: 67872 - DNA, 20 bp, Artificial Sequence
  chemically synthesized
gggagagatttaattttaga

SEQ ID NO: 67873 - DNA, 20 bp, Artificial Sequence
  chemically synthesized
tttggggagagatttaattt

SEQ ID NO: 67874 - DNA, 20 bp, Artificial Sequence
  chemically synthesized
aatgtaaaagggtttgggga

SEQ ID NO: 67875 - DNA, 20 bp, Artificial Sequence
  chemically synthesized
gaaatgtaaaagggtttggg

SEQ ID NO: 67876 - DNA, 20 bp, Artificial Sequence
  chemically synthesized
aagaaatgtaaaagggtttg

SEQ ID NO: 67877 - DNA, 20 bp, Artificial Sequence
  chemically synthesized
gaagaaatgtaaaagggttt

SEQ ID NO: 67878 - DNA, 20 bp, Artificial Sequence
  chemically synthesized
ggaagaaatgtaaaagggtt

SEQ ID NO: 67879 - DNA, 20 bp, Artificial Sequence
  chemically synthesized
tgagcggaagaaatgtaaaa

SEQ ID NO: 67880 - DNA, 20 bp, Artificial Sequence
  chemically synthesized
atgagcggaagaaatgtaaa

SEQ ID NO: 67881 - DNA, 20 bp, Artificial Sequence
  chemically synthesized
gatgagcggaagaaatgtaa

SEQ ID NO: 67882 - DNA, 20 bp, Artificial Sequence
  chemically synthesized
tgtctgtatcagatgagcgg

SEQ ID NO: 67883 - DNA, 20 bp, Artificial Sequence
  chemically synthesized
ttatgtctgtatcagatgag

SEQ ID NO: 67884 - DNA, 20 bp, Artificial Sequence
  chemically synthesized
taattatgtctgtatcagat

SEQ ID NO: 67885 - DNA, 20 bp, Artificial Sequence
  chemically synthesized
tttcttccgctcatctgata

SEQ ID NO: 67886 - DNA, 20 bp, Artificial Sequence
  chemically synthesized
cattttaattatgtctgtat

SEQ ID NO: 67887 - DNA, 20 bp, Artificial Sequence
  chemically synthesized
agacataattaaaatgctgc

SEQ ID NO: 67888 - DNA, 20 bp, Artificial Sequence
  chemically synthesized
gatgcgtttaggtaaacttg

SEQ ID NO: 67889 - DNA, 20 bp, Artificial Sequence
  chemically synthesized
tataatatttggatgcgttt

SEQ ID NO: 67890 - DNA, 20 bp, Artificial Sequence
  chemically synthesized
ttataatatttggatgcgtt

SEQ ID NO: 67891 - DNA, 20 bp, Artificial Sequence
  chemically synthesized
atattttcttttataatatt

SEQ ID NO: 67892 - DNA, 20 bp, Artificial Sequence
  chemically synthesized
aacgcatccaaatattataa

SEQ ID NO: 67893 - DNA, 20 bp, Artificial Sequence
  chemically synthesized
taaaagaaaatatgaaaaac

SEQ ID NO: 67894 - DNA, 20 bp, Artificial Sequence
  chemically synthesized
aaagaaaatatgaaaaactg

SEQ ID NO: 67895 - DNA, 20 bp, Artificial Sequence
  chemically synthesized
aatatgaaaaactggagttt

SEQ ID NO: 67896 - DNA, 20 bp, Artificial Sequence
  chemically synthesized
ttaaggagctactgaaactc

SEQ ID NO: 67897 - DNA, 20 bp, Artificial Sequence
  chemically synthesized
atgaaaaactggagtttcag

SEQ ID NO: 67898 - DNA, 20 bp, Artificial Sequence
  chemically synthesized
tggagtttcagtagctcctt

SEQ ID NO: 67899 - DNA, 20 bp, Artificial Sequence
  chemically synthesized
agtttcagtagctccttaag

SEQ ID NO: 67900 - DNA, 20 bp, Artificial Sequence
  chemically synthesized
taaaattccagcttcttaag

SEQ ID NO: 67901 - DNA, 20 bp, Artificial Sequence
  chemically synthesized
attaaaattccagcttctta

SEQ ID NO: 67902 - DNA, 20 bp, Artificial Sequence
  chemically synthesized
tcagtagctccttaagaagc

SEQ ID NO: 67903 - DNA, 20 bp, Artificial Sequence
  chemically synthesized
cattaaaattccagcttctt

SEQ ID NO: 67904 - DNA, 20 bp, Artificial Sequence
  chemically synthesized
tagaaatcccattaaaattc

SEQ ID NO: 67905 - DNA, 20 bp, Artificial Sequence
  chemically synthesized
ttaagaagctggaattttaa

SEQ ID NO: 67906 - DNA, 20 bp, Artificial Sequence
  chemically synthesized
taagaagctggaattttaat

SEQ ID NO: 67907 - DNA, 20 bp, Artificial Sequence
  chemically synthesized
aatgggatttctacaatcct

SEQ ID NO: 67908 - DNA, 20 bp, Artificial Sequence
  chemically synthesized
ttggttttccccaaggattg

SEQ ID NO: 67909 - DNA, 20 bp, Artificial Sequence
  chemically synthesized
atgggatttctacaatcctt

SEQ ID NO: 67910 - DNA, 20 bp, Artificial Sequence
  chemically synthesized
tgggatttctacaatccttg

SEQ ID NO: 67911 - DNA, 20 bp, Artificial Sequence
  chemically synthesized
acatctattggttttcccca

SEQ ID NO: 67912 - DNA, 20 bp, Artificial Sequence
  chemically synthesized
cacatctattggttttcccc

SEQ ID NO: 67913 - DNA, 20 bp, Artificial Sequence
  chemically synthesized
caatccttggggaaaaccaa

SEQ ID NO: 67914 - DNA, 20 bp, Artificial Sequence
  chemically synthesized
atgcctgcttacacatctat

SEQ ID NO: 67915 - DNA, 20 bp, Artificial Sequence
  chemically synthesized
gggaaaaccaatagatgtgt

SEQ ID NO: 67916 - DNA, 20 bp, Artificial Sequence
  chemically synthesized
aaaaccaatagatgtgtaag

SEQ ID NO: 67917 - DNA, 20 bp, Artificial Sequence
  chemically synthesized
aaaccaatagatgtgtaagc

SEQ ID NO: 67918 - DNA, 20 bp, Artificial Sequence
  chemically synthesized
acacacacacaaactgtctc

SEQ ID NO: 67919 - DNA, 20 bp, Artificial Sequence
  chemically synthesized
ttttcagaggaatcttgaga

SEQ ID NO: 67920 - DNA, 20 bp, Artificial Sequence
  chemically synthesized
tttattttcagaggaatctt

SEQ ID NO: 67921 - DNA, 20 bp, Artificial Sequence
  chemically synthesized
agagagaaatttattttcag

SEQ ID NO: 67922 - DNA, 20 bp, Artificial Sequence
  chemically synthesized
aagagagaaatttattttca

SEQ ID NO: 67923 - DNA, 20 bp, Artificial Sequence
  chemically synthesized
taaagagagaaatttatttt

SEQ ID NO: 67924 - DNA, 20 bp, Artificial Sequence
  chemically synthesized
cagcaccttagatataaaga

SEQ ID NO: 67925 - DNA, 20 bp, Artificial Sequence
  chemically synthesized
tgcagcaccttagatataaa

SEQ ID NO: 67926 - DNA, 20 bp, Artificial Sequence
  chemically synthesized
aaatttctctctttatatct

SEQ ID NO: 67927 - DNA, 20 bp, Artificial Sequence
  chemically synthesized
actgcagcaccttagatata

SEQ ID NO: 67928 - DNA, 20 bp, Artificial Sequence
  chemically synthesized
aatttctctctttatatcta

SEQ ID NO: 67929 - DNA, 20 bp, Artificial Sequence
  chemically synthesized
tggtattcactgcagcacct

SEQ ID NO: 67930 - DNA, 20 bp, Artificial Sequence
  chemically synthesized
tctttatatctaaggtgctg

SEQ ID NO: 67931 - DNA, 20 bp, Artificial Sequence
  chemically synthesized
gttgtctgtggtattcactg

SEQ ID NO: 67932 - DNA, 20 bp, Artificial Sequence
  chemically synthesized
aggtgctgcagtgaatacca

SEQ ID NO: 67933 - DNA, 20 bp, Artificial Sequence
  chemically synthesized
tttgaaactatagttgtctg

SEQ ID NO: 67934 - DNA, 20 bp, Artificial Sequence
  chemically synthesized
gtgaataccacagacaacta

SEQ ID NO: 67935 - DNA, 20 bp, Artificial Sequence
  chemically synthesized
gtagaaaacctttgaaacta

SEQ ID NO: 67936 - DNA, 20 bp, Artificial Sequence
  chemically synthesized
cacagacaactatagtttca

SEQ ID NO: 67937 - DNA, 20 bp, Artificial Sequence
  chemically synthesized
acagacaactatagtttcaa

SEQ ID NO: 67938 - DNA, 20 bp, Artificial Sequence
  chemically synthesized
tagtttcaaaggttttctac

SEQ ID NO: 67939 - DNA, 20 bp, Artificial Sequence
  chemically synthesized
caaaggttttctaccagcaa

SEQ ID NO: 67940 - DNA, 20 bp, Artificial Sequence
  chemically synthesized
aaattcttgtcttttgctgg

SEQ ID NO: 67941 - DNA, 20 bp, Artificial Sequence
  chemically synthesized
caaaaattcttgtcttttgc

SEQ ID NO: 67942 - DNA, 20 bp, Artificial Sequence
  chemically synthesized
gttttctaccagcaaaagac

SEQ ID NO: 67943 - DNA, 20 bp, Artificial Sequence
  chemically synthesized
gcaaaagacaagaatttttg

SEQ ID NO: 67944 - DNA, 20 bp, Artificial Sequence
  chemically synthesized
acaagaatttttgaagacac

SEQ ID NO: 67945 - DNA, 20 bp, Artificial Sequence
  chemically synthesized
caagaatttttgaagacact

SEQ ID NO: 67946 - DNA, 20 bp, Artificial Sequence
  chemically synthesized
tgtgcctgcaattaattacc

SEQ ID NO: 67947 - DNA, 20 bp, Artificial Sequence
  chemically synthesized
agacactgggtaattaattg

SEQ ID NO: 67948 - DNA, 20 bp, Artificial Sequence
  chemically synthesized
gacactgggtaattaattgc

SEQ ID NO: 67949 - DNA, 20 bp, Artificial Sequence
  chemically synthesized
gggtaattaattgcaggcac

SEQ ID NO: 67950 - DNA, 20 bp, Artificial Sequence
  chemically synthesized
ggtaattaattgcaggcaca

SEQ ID NO: 67951 - DNA, 20 bp, Artificial Sequence
  chemically synthesized
tgcaggcacaaggtgtactc

SEQ ID NO: 67952 - DNA, 20 bp, Artificial Sequence
  chemically synthesized
gcacagaagtgttataacta

SEQ ID NO: 67953 - DNA, 20 bp, Artificial Sequence
  chemically synthesized
tagcacagaagtgttataac

SEQ ID NO: 67954 - DNA, 20 bp, Artificial Sequence
  chemically synthesized
tttcgaaaatggtagcacag

SEQ ID NO: 67955 - DNA, 20 bp, Artificial Sequence
  chemically synthesized
ttgtttcgaaaatggtagca

SEQ ID NO: 67956 - DNA, 20 bp, Artificial Sequence
  chemically synthesized
gcttattgtttcgaaaatgg

SEQ ID NO: 67957 - DNA, 20 bp, Artificial Sequence
  chemically synthesized
aatgcttattgtttcgaaaa

SEQ ID NO: 67958 - DNA, 20 bp, Artificial Sequence
  chemically synthesized
gctaccattttcgaaacaat

SEQ ID NO: 67959 - DNA, 20 bp, Artificial Sequence
  chemically synthesized
aaacaataagcattccttaa

SEQ ID NO: 67960 - DNA, 20 bp, Artificial Sequence
  chemically synthesized
caataagcattccttaatag

SEQ ID NO: 67961 - DNA, 20 bp, Artificial Sequence
  chemically synthesized
gcctttctgagccgctatta

SEQ ID NO: 67962 - DNA, 20 bp, Artificial Sequence
  chemically synthesized
tgcctttctgagccgctatt

SEQ ID NO: 67963 - DNA, 20 bp, Artificial Sequence
  chemically synthesized
agcattccttaatagcggct

SEQ ID NO: 67964 - DNA, 20 bp, Artificial Sequence
  chemically synthesized
ttccttaatagcggctcaga

SEQ ID NO: 67965 - DNA, 20 bp, Artificial Sequence
  chemically synthesized
tccttaatagcggctcagaa

SEQ ID NO: 67966 - DNA, 20 bp, Artificial Sequence
  chemically synthesized
ctcttaaagagtgcctttct

SEQ ID NO: 67967 - DNA, 20 bp, Artificial Sequence
  chemically synthesized
ggctcagaaaggcactcttt

SEQ ID NO: 67968 - DNA, 20 bp, Artificial Sequence
  chemically synthesized
ctcagaaaggcactctttaa

SEQ ID NO: 67969 - DNA, 20 bp, Artificial Sequence
  chemically synthesized
tccaaactgtttctcttaaa

SEQ ID NO: 67970 - DNA, 20 bp, Artificial Sequence
  chemically synthesized
attccaaactgtttctctta

SEQ ID NO: 67971 - DNA, 20 bp, Artificial Sequence
  chemically synthesized
aaggcactctttaagagaaa

SEQ ID NO: 67972 - DNA, 20 bp, Artificial Sequence
  chemically synthesized
actctttaagagaaacagtt

SEQ ID NO: 67973 - DNA, 20 bp, Artificial Sequence
  chemically synthesized
aagagaaacagtttggaatt

SEQ ID NO: 67974 - DNA, 20 bp, Artificial Sequence
  chemically synthesized
agagaaacagtttggaattc

SEQ ID NO: 67975 - DNA, 20 bp, Artificial Sequence
  chemically synthesized
agtttggatacaatacaagg

SEQ ID NO: 67976 - DNA, 20 bp, Artificial Sequence
  chemically synthesized
ggaagtttggatacaataca

SEQ ID NO: 67977 - DNA, 20 bp, Artificial Sequence
  chemically synthesized
tggaagtttggatacaatac

SEQ ID NO: 67978 - DNA, 20 bp, Artificial Sequence
  chemically synthesized
tttttttccatttggaagtt

SEQ ID NO: 67979 - DNA, 20 bp, Artificial Sequence
  chemically synthesized
attgtatccaaacttccaaa

SEQ ID NO: 67980 - DNA, 20 bp, Artificial Sequence
  chemically synthesized
gctggtttttttccatttgg

SEQ ID NO: 67981 - DNA, 20 bp, Artificial Sequence
  chemically synthesized
caggctggtttttttccatt

SEQ ID NO: 67982 - DNA, 20 bp, Artificial Sequence
  chemically synthesized
acttccaaatggaaaaaaac

SEQ ID NO: 67983 - DNA, 20 bp, Artificial Sequence
  chemically synthesized
caaatggaaaaaaaccagcc

SEQ ID NO: 67984 - DNA, 20 bp, Artificial Sequence
  chemically synthesized
gaagctgggattgtccaggc

SEQ ID NO: 67985 - DNA, 20 bp, Artificial Sequence
  chemically synthesized
gaatgaagctgggattgtcc

SEQ ID NO: 67986 - DNA, 20 bp, Artificial Sequence
  chemically synthesized
agaatgaagctgggattgtc

SEQ ID NO: 67987 - DNA, 20 bp, Artificial Sequence
  chemically synthesized
aaaaccagcctggacaatcc

SEQ ID NO: 67988 - DNA, 20 bp, Artificial Sequence
  chemically synthesized
cttgcatatagaatgaagct

SEQ ID NO: 67989 - DNA, 20 bp, Artificial Sequence
  chemically synthesized
acttgcatatagaatgaagc

SEQ ID NO: 67990 - DNA, 20 bp, Artificial Sequence
  chemically synthesized
aataacttgcatatagaatg

SEQ ID NO: 67991 - DNA, 20 bp, Artificial Sequence
  chemically synthesized
cccagcttcattctatatgc

SEQ ID NO: 67992 - DNA, 20 bp, Artificial Sequence
  chemically synthesized
actggagaataacttgcata

SEQ ID NO: 67993 - DNA, 20 bp, Artificial Sequence
  chemically synthesized
tctatatgcaagttattctc

SEQ ID NO: 67994 - DNA, 20 bp, Artificial Sequence
  chemically synthesized
tatgcaagttattctccagt

SEQ ID NO: 67995 - DNA, 20 bp, Artificial Sequence
  chemically synthesized
caacctttgtttactcactg

SEQ ID NO: 67996 - DNA, 20 bp, Artificial Sequence
  chemically synthesized
atcaacctttgtttactcac

SEQ ID NO: 67997 - DNA, 20 bp, Artificial Sequence
  chemically synthesized
tattctccagtgagtaaaca

SEQ ID NO: 67998 - DNA, 20 bp, Artificial Sequence
  chemically synthesized
attctccagtgagtaaacaa

SEQ ID NO: 67999 - DNA, 20 bp, Artificial Sequence
  chemically synthesized
ataaaataagtttgggagtt

SEQ ID NO: 68000 - DNA, 20 bp, Artificial Sequence
  chemically synthesized
aataaaataagtttgggagt

SEQ ID NO: 68001 - DNA, 20 bp, Artificial Sequence
  chemically synthesized
gattaataaaataagtttgg

SEQ ID NO: 68002 - DNA, 20 bp, Artificial Sequence
  chemically synthesized
atgattaataaaataagttt

SEQ ID NO: 68003 - DNA, 20 bp, Artificial Sequence
  chemically synthesized
tatgattaataaaataagtt

SEQ ID NO: 68004 - DNA, 20 bp, Artificial Sequence
  chemically synthesized
ttgtatatgattaataaaat

SEQ ID NO: 68005 - DNA, 20 bp, Artificial Sequence
  chemically synthesized
ttattttattaatcatatac

SEQ ID NO: 68006 - DNA, 20 bp, Artificial Sequence
  chemically synthesized
tgaaaacacattgatcaaac

SEQ ID NO: 68007 - DNA, 20 bp, Artificial Sequence
  chemically synthesized
gaaaacacattgatcaaaca

SEQ ID NO: 68008 - DNA, 20 bp, Artificial Sequence
  chemically synthesized
caaacaaggtctactaacat

SEQ ID NO: 68009 - DNA, 20 bp, Artificial Sequence
  chemically synthesized
taagagaagtctcatgttag

SEQ ID NO: 68010 - DNA, 20 bp, Artificial Sequence
  chemically synthesized
aaataagagaagtctcatgt

SEQ ID NO: 68011 - DNA, 20 bp, Artificial Sequence
  chemically synthesized
taagagaaaggaaataagag

SEQ ID NO: 68012 - DNA, 20 bp, Artificial Sequence
  chemically synthesized
aagtaagagaaaggaaataa

SEQ ID NO: 68013 - DNA, 20 bp, Artificial Sequence
  chemically synthesized
tcaagtaagagaaaggaaat

SEQ ID NO: 68014 - DNA, 20 bp, Artificial Sequence
  chemically synthesized
gtcagaatcaagtaagagaa

SEQ ID NO: 68015 - DNA, 20 bp, Artificial Sequence
  chemically synthesized
tgtcagaatcaagtaagaga

SEQ ID NO: 68016 - DNA, 20 bp, Artificial Sequence
  chemically synthesized
caactgtcagaatcaagtaa

SEQ ID NO: 68017 - DNA, 20 bp, Artificial Sequence
  chemically synthesized
gacaactgtcagaatcaagt

SEQ ID NO: 68018 - DNA, 20 bp, Artificial Sequence
  chemically synthesized
aaaggacaactgtcagaatc

SEQ ID NO: 68019 - DNA, 20 bp, Artificial Sequence
  chemically synthesized
tttctcttacttgattctga

SEQ ID NO: 68020 - DNA, 20 bp, Artificial Sequence
  chemically synthesized
gcaattaaaaggacaactgt

SEQ ID NO: 68021 - DNA, 20 bp, Artificial Sequence
  chemically synthesized
atccgtgcagagcaattaaa

SEQ ID NO: 68022 - DNA, 20 bp, Artificial Sequence
  chemically synthesized
tatccgtgcagagcaattaa

SEQ ID NO: 68023 - DNA, 20 bp, Artificial Sequence
  chemically synthesized
gtccttttaattgctctgca

SEQ ID NO: 68024 - DNA, 20 bp, Artificial Sequence
  chemically synthesized
ggctgaatactatccgtgca

SEQ ID NO: 68025 - DNA, 20 bp, Artificial Sequence
  chemically synthesized
ttttaattgctctgcacgga

SEQ ID NO: 68026 - DNA, 20 bp, Artificial Sequence
  chemically synthesized
atggctgaatactatccgtg

SEQ ID NO: 68027 - DNA, 20 bp, Artificial Sequence
  chemically synthesized
tgctctgcacggatagtatt

SEQ ID NO: 68028 - DNA, 20 bp, Artificial Sequence
  chemically synthesized
gagaatttgttgattttaga

SEQ ID NO: 68029 - DNA, 20 bp, Artificial Sequence
  chemically synthesized
aatagagaatttgttgattt

SEQ ID NO: 68030 - DNA, 20 bp, Artificial Sequence
  chemically synthesized
gaagacgactggggtaaata

SEQ ID NO: 68031 - DNA, 20 bp, Artificial Sequence
  chemically synthesized
aacaaattctctatttaccc

SEQ ID NO: 68032 - DNA, 20 bp, Artificial Sequence
  chemically synthesized
tggaagacgactggggtaaa

SEQ ID NO: 68033 - DNA, 20 bp, Artificial Sequence
  chemically synthesized
agcaatctggaagacgactg

SEQ ID NO: 68034 - DNA, 20 bp, Artificial Sequence
  chemically synthesized
cagcaatctggaagacgact

SEQ ID NO: 68035 - DNA, 20 bp, Artificial Sequence
  chemically synthesized
acagcaatctggaagacgac

SEQ ID NO: 68036 - DNA, 20 bp, Artificial Sequence
  chemically synthesized
tatttaccccagtcgtcttc

SEQ ID NO: 68037 - DNA, 20 bp, Artificial Sequence
  chemically synthesized
atgaacctacagcaatctgg

SEQ ID NO: 68038 - DNA, 20 bp, Artificial Sequence
  chemically synthesized
ataatgaacctacagcaatc

SEQ ID NO: 68039 - DNA, 20 bp, Artificial Sequence
  chemically synthesized
agtcgtcttccagattgctg

SEQ ID NO: 68040 - DNA, 20 bp, Artificial Sequence
  chemically synthesized
gtcgtcttccagattgctgt

SEQ ID NO: 68041 - DNA, 20 bp, Artificial Sequence
  chemically synthesized
acatttgcataatgaaccta

SEQ ID NO: 68042 - DNA, 20 bp, Artificial Sequence
  chemically synthesized
cattatgcaaatgttccttt

SEQ ID NO: 68043 - DNA, 20 bp, Artificial Sequence
  chemically synthesized
agtaactctgtatttcttaa

SEQ ID NO: 68044 - DNA, 20 bp, Artificial Sequence
  chemically synthesized
gagtaactctgtatttctta

SEQ ID NO: 68045 - DNA, 20 bp, Artificial Sequence
  chemically synthesized
aaatgttcctttaagaaata

SEQ ID NO: 68046 - DNA, 20 bp, Artificial Sequence
  chemically synthesized
atgttcctttaagaaataca

SEQ ID NO: 68047 - DNA, 20 bp, Artificial Sequence
  chemically synthesized
taagaaatacagagttactc

SEQ ID NO: 68048 - DNA, 20 bp, Artificial Sequence
  chemically synthesized
aagaaatacagagttactcc

SEQ ID NO: 68049 - DNA, 20 bp, Artificial Sequence
  chemically synthesized
gcaggtagtggtcattcctg

SEQ ID NO: 68050 - DNA, 20 bp, Artificial Sequence
  chemically synthesized
tggcaggtagtggtcattcc

SEQ ID NO: 68051 - DNA, 20 bp, Artificial Sequence
  chemically synthesized
tccatagtaatggcaggtag

SEQ ID NO: 68052 - DNA, 20 bp, Artificial Sequence
  chemically synthesized
gactccatagtaatggcagg

SEQ ID NO: 68053 - DNA, 20 bp, Artificial Sequence
  chemically synthesized
ctggactccatagtaatggc

SEQ ID NO: 68054 - DNA, 20 bp, Artificial Sequence
  chemically synthesized
tctggactccatagtaatgg

SEQ ID NO: 68055 - DNA, 20 bp, Artificial Sequence
  chemically synthesized
accactacctgccattacta

SEQ ID NO: 68056 - DNA, 20 bp, Artificial Sequence
  chemically synthesized
acctctggactccatagtaa

SEQ ID NO: 68057 - DNA, 20 bp, Artificial Sequence
  chemically synthesized
cactacctgccattactatg

SEQ ID NO: 68058 - DNA, 20 bp, Artificial Sequence
  chemically synthesized
cctgccattactatggagtc

SEQ ID NO: 68059 - DNA, 20 bp, Artificial Sequence
  chemically synthesized
gaccctacctctggactcca

SEQ ID NO: 68060 - DNA, 20 bp, Artificial Sequence
  chemically synthesized
tgccattactatggagtcca

SEQ ID NO: 68061 - DNA, 20 bp, Artificial Sequence
  chemically synthesized
gccattactatggagtccag

SEQ ID NO: 68062 - DNA, 20 bp, Artificial Sequence
  chemically synthesized
attactatggagtccagagg

SEQ ID NO: 68063 - DNA, 20 bp, Artificial Sequence
  chemically synthesized
ttactatggagtccagaggt

SEQ ID NO: 68064 - DNA, 20 bp, Artificial Sequence
  chemically synthesized
tactatggagtccagaggta

SEQ ID NO: 68065 - DNA, 20 bp, Artificial Sequence
  chemically synthesized
cctgtacctgaccctacctc

SEQ ID NO: 68066 - DNA, 20 bp, Artificial Sequence
  chemically synthesized
atggagtccagaggtagggt

SEQ ID NO: 68067 - DNA, 20 bp, Artificial Sequence
  chemically synthesized
tggagtccagaggtagggtc

SEQ ID NO: 68068 - DNA, 20 bp, Artificial Sequence
  chemically synthesized
tccagaggtagggtcaggta

SEQ ID NO: 68069 - DNA, 20 bp, Artificial Sequence
  chemically synthesized
ccagaggtagggtcaggtac

SEQ ID NO: 68070 - DNA, 20 bp, Artificial Sequence
  chemically synthesized
aggtagggtcaggtacaggc

SEQ ID NO: 68071 - DNA, 20 bp, Artificial Sequence
  chemically synthesized
ggtagggtcaggtacaggct

SEQ ID NO: 68072 - DNA, 20 bp, Artificial Sequence
  chemically synthesized
gtagggtcaggtacaggctg

SEQ ID NO: 68073 - DNA, 20 bp, Artificial Sequence
  chemically synthesized
aagtcactttcaaaagaccc

SEQ ID NO: 68074 - DNA, 20 bp, Artificial Sequence
  chemically synthesized
tacaggctggggtcttttga

SEQ ID NO: 68075 - DNA, 20 bp, Artificial Sequence
  chemically synthesized
aagagacaagtcactttcaa

SEQ ID NO: 68076 - DNA, 20 bp, Artificial Sequence
  chemically synthesized
tgaaattttggaaaagagac

SEQ ID NO: 68077 - DNA, 20 bp, Artificial Sequence
  chemically synthesized
gcaaatgaaattttggaaaa

SEQ ID NO: 68078 - DNA, 20 bp, Artificial Sequence
  chemically synthesized
aagcaaatgaaattttggaa

SEQ ID NO: 68079 - DNA, 20 bp, Artificial Sequence
  chemically synthesized
attagaagcaaatgaaattt

SEQ ID NO: 68080 - DNA, 20 bp, Artificial Sequence
  chemically synthesized
aatttcatttgcttctaatc

SEQ ID NO: 68081 - DNA, 20 bp, Artificial Sequence
  chemically synthesized
tttaccagactcttgattag

SEQ ID NO: 68082 - DNA, 20 bp, Artificial Sequence
  chemically synthesized
tttcatttgcttctaatcaa

SEQ ID NO: 68083 - DNA, 20 bp, Artificial Sequence
  chemically synthesized
taatttaccagactcttgat

SEQ ID NO: 68084 - DNA, 20 bp, Artificial Sequence
  chemically synthesized
tttgcttctaatcaagagtc

SEQ ID NO: 68085 - DNA, 20 bp, Artificial Sequence
  chemically synthesized
taatcaagagtctggtaaat

SEQ ID NO: 68086 - DNA, 20 bp, Artificial Sequence
  chemically synthesized
aatcaagagtctggtaaatt

SEQ ID NO: 68087 - DNA, 20 bp, Artificial Sequence
  chemically synthesized
aaggactcctcctaatttac

SEQ ID NO: 68088 - DNA, 20 bp, Artificial Sequence
  chemically synthesized
tcaagagtctggtaaattag

SEQ ID NO: 68089 - DNA, 20 bp, Artificial Sequence
  chemically synthesized
caagagtctggtaaattagg

SEQ ID NO: 68090 - DNA, 20 bp, Artificial Sequence
  chemically synthesized
agagtctggtaaattaggag

SEQ ID NO: 68091 - DNA, 20 bp, Artificial Sequence
  chemically synthesized
ctacgatgatgagtgagaaa

SEQ ID NO: 68092 - DNA, 20 bp, Artificial Sequence
  chemically synthesized
gctacgatgatgagtgagaa

SEQ ID NO: 68093 - DNA, 20 bp, Artificial Sequence
  chemically synthesized
ctttggctacgatgatgagt

SEQ ID NO: 68094 - DNA, 20 bp, Artificial Sequence
  chemically synthesized
ccttttctcactcatcatcg

SEQ ID NO: 68095 - DNA, 20 bp, Artificial Sequence
  chemically synthesized
gagactttggctacgatgat

SEQ ID NO: 68096 - DNA, 20 bp, Artificial Sequence
  chemically synthesized
ctcactcatcatcgtagcca

SEQ ID NO: 68097 - DNA, 20 bp, Artificial Sequence
  chemically synthesized
agccttgtctcatgagactt

SEQ ID NO: 68098 - DNA, 20 bp, Artificial Sequence
  chemically synthesized
catcgtagccaaagtctcat

SEQ ID NO: 68099 - DNA, 20 bp, Artificial Sequence
  chemically synthesized
tagccaaagtctcatgagac

SEQ ID NO: 68100 - DNA, 20 bp, Artificial Sequence
  chemically synthesized
gagacccagccttgtctcat

SEQ ID NO: 68101 - DNA, 20 bp, Artificial Sequence
  chemically synthesized
agccaaagtctcatgagaca

SEQ ID NO: 68102 - DNA, 20 bp, Artificial Sequence
  chemically synthesized
aaagtctcatgagacaaggc

SEQ ID NO: 68103 - DNA, 20 bp, Artificial Sequence
  chemically synthesized
aagtctcatgagacaaggct

SEQ ID NO: 68104 - DNA, 20 bp, Artificial Sequence
  chemically synthesized
catgagacaaggctgggtct

SEQ ID NO: 68105 - DNA, 20 bp, Artificial Sequence
  chemically synthesized
atcacagtcctactgagacc

SEQ ID NO: 68106 - DNA, 20 bp, Artificial Sequence
  chemically synthesized
gagacaaggctgggtctcag

SEQ ID NO: 68107 - DNA, 20 bp, Artificial Sequence
  chemically synthesized
agacaaggctgggtctcagt

SEQ ID NO: 68108 - DNA, 20 bp, Artificial Sequence
  chemically synthesized
tcatgaatcacagtcctact

SEQ ID NO: 68109 - DNA, 20 bp, Artificial Sequence
  chemically synthesized
aattgacttttcatgaatca

SEQ ID NO: 68110 - DNA, 20 bp, Artificial Sequence
  chemically synthesized
gtaggactgtgattcatgaa

SEQ ID NO: 68111 - DNA, 20 bp, Artificial Sequence
  chemically synthesized
gattcatgaaaagtcaatta

SEQ ID NO: 68112 - DNA, 20 bp, Artificial Sequence
  chemically synthesized
ccaggaatgaggaaggatat

SEQ ID NO: 68113 - DNA, 20 bp, Artificial Sequence
  chemically synthesized
agcagaaccaggaatgagga

SEQ ID NO: 68114 - DNA, 20 bp, Artificial Sequence
  chemically synthesized
aagcagaaccaggaatgagg

SEQ ID NO: 68115 - DNA, 20 bp, Artificial Sequence
  chemically synthesized
ccaatatccttcctcattcc

SEQ ID NO: 68116 - DNA, 20 bp, Artificial Sequence
  chemically synthesized
gccaagcagaaccaggaatg

SEQ ID NO: 68117 - DNA, 20 bp, Artificial Sequence
  chemically synthesized
tgccaagcagaaccaggaat

SEQ ID NO: 68118 - DNA, 20 bp, Artificial Sequence
  chemically synthesized
gctgtttgccaagcagaacc

SEQ ID NO: 68119 - DNA, 20 bp, Artificial Sequence
  chemically synthesized
ggctgtttgccaagcagaac

SEQ ID NO: 68120 - DNA, 20 bp, Artificial Sequence
  chemically synthesized
tcctcattcctggttctgct

SEQ ID NO: 68121 - DNA, 20 bp, Artificial Sequence
  chemically synthesized
agggatggctgtttgccaag

SEQ ID NO: 68122 - DNA, 20 bp, Artificial Sequence
  chemically synthesized
tcctggttctgcttggcaaa

SEQ ID NO: 68123 - DNA, 20 bp, Artificial Sequence
  chemically synthesized
aggagggatggctgtttgcc

SEQ ID NO: 68124 - DNA, 20 bp, Artificial Sequence
  chemically synthesized
taagagaatgggaggaggga

SEQ ID NO: 68125 - DNA, 20 bp, Artificial Sequence
  chemically synthesized
gtaataagagaatgggagga

SEQ ID NO: 68126 - DNA, 20 bp, Artificial Sequence
  chemically synthesized
tgtaataagagaatgggagg

SEQ ID NO: 68127 - DNA, 20 bp, Artificial Sequence
  chemically synthesized
ttgtaataagagaatgggag

SEQ ID NO: 68128 - DNA, 20 bp, Artificial Sequence
  chemically synthesized
ccttgtaataagagaatggg

SEQ ID NO: 68129 - DNA, 20 bp, Artificial Sequence
  chemically synthesized
cccttgtaataagagaatgg

SEQ ID NO: 68130 - DNA, 20 bp, Artificial Sequence
  chemically synthesized
aacccttgtaataagagaat

SEQ ID NO: 68131 - DNA, 20 bp, Artificial Sequence
  chemically synthesized
aaacccttgtaataagagaa

SEQ ID NO: 68132 - DNA, 20 bp, Artificial Sequence
  chemically synthesized
tcctcccattctcttattac

SEQ ID NO: 68133 - DNA, 20 bp, Artificial Sequence
  chemically synthesized
tttgcaaacccttgtaataa

SEQ ID NO: 68134 - DNA, 20 bp, Artificial Sequence
  chemically synthesized
cctcccattctcttattaca

SEQ ID NO: 68135 - DNA, 20 bp, Artificial Sequence
  chemically synthesized
ctcccattctcttattacaa

SEQ ID NO: 68136 - DNA, 20 bp, Artificial Sequence
  chemically synthesized
agtttgcaaacccttgtaat

SEQ ID NO: 68137 - DNA, 20 bp, Artificial Sequence
  chemically synthesized
caggattacaaagtgcggtg

SEQ ID NO: 68138 - DNA, 20 bp, Artificial Sequence
  chemically synthesized
atccccaggattacaaagtg

SEQ ID NO: 68139 - DNA, 20 bp, Artificial Sequence
  chemically synthesized
tgaaaatccccaggattaca

SEQ ID NO: 68140 - DNA, 20 bp, Artificial Sequence
  chemically synthesized
ttcaccgcactttgtaatcc

SEQ ID NO: 68141 - DNA, 20 bp, Artificial Sequence
  chemically synthesized
tcaccgcactttgtaatcct

SEQ ID NO: 68142 - DNA, 20 bp, Artificial Sequence
  chemically synthesized
caccgcactttgtaatcctg

SEQ ID NO: 68143 - DNA, 20 bp, Artificial Sequence
  chemically synthesized
agcatttgttgaaaatcccc

SEQ ID NO: 68144 - DNA, 20 bp, Artificial Sequence
  chemically synthesized
cagcatttgttgaaaatccc

SEQ ID NO: 68145 - DNA, 20 bp, Artificial Sequence
  chemically synthesized
tttcaacaaatgctgatgct

SEQ ID NO: 68146 - DNA, 20 bp, Artificial Sequence
  chemically synthesized
tcaacaaatgctgatgcttg

SEQ ID NO: 68147 - DNA, 20 bp, Artificial Sequence
  chemically synthesized
tgggggtgggctccaagcat

SEQ ID NO: 68148 - DNA, 20 bp, Artificial Sequence
  chemically synthesized
aatctctgggggtgggctcc

SEQ ID NO: 68149 - DNA, 20 bp, Artificial Sequence
  chemically synthesized
tgatgcttggagcccacccc

SEQ ID NO: 68150 - DNA, 20 bp, Artificial Sequence
  chemically synthesized
atgcttggagcccaccccca

SEQ ID NO: 68151 - DNA, 20 bp, Artificial Sequence
  chemically synthesized
ccaattcaatctctgggggt

SEQ ID NO: 68152 - DNA, 20 bp, Artificial Sequence
  chemically synthesized
accaattcaatctctggggg

SEQ ID NO: 68153 - DNA, 20 bp, Artificial Sequence
  chemically synthesized
cagaccaattcaatctctgg

SEQ ID NO: 68154 - DNA, 20 bp, Artificial Sequence
  chemically synthesized
tcagaccaattcaatctctg

SEQ ID NO: 68155 - DNA, 20 bp, Artificial Sequence
  chemically synthesized
ctcagaccaattcaatctct

SEQ ID NO: 68156 - DNA, 20 bp, Artificial Sequence
  chemically synthesized
tctcagaccaattcaatctc

SEQ ID NO: 68157 - DNA, 20 bp, Artificial Sequence
  chemically synthesized
cccacccccagagattgaat

SEQ ID NO: 68158 - DNA, 20 bp, Artificial Sequence
  chemically synthesized
cccagagattgaattggtct

SEQ ID NO: 68159 - DNA, 20 bp, Artificial Sequence
  chemically synthesized
gattgaattggtctgagatg

SEQ ID NO: 68160 - DNA, 20 bp, Artificial Sequence
  chemically synthesized
ctcatgcccaggctgcatct

SEQ ID NO: 68161 - DNA, 20 bp, Artificial Sequence
  chemically synthesized
aattggtctgagatgcagcc

SEQ ID NO: 68162 - DNA, 20 bp, Artificial Sequence
  chemically synthesized
attggtctgagatgcagcct

SEQ ID NO: 68163 - DNA, 20 bp, Artificial Sequence
  chemically synthesized
ctgagatgcagcctgggcat

SEQ ID NO: 68164 - DNA, 20 bp, Artificial Sequence
  chemically synthesized
tgagatgcagcctgggcatg

SEQ ID NO: 68165 - DNA, 20 bp, Artificial Sequence
  chemically synthesized
ttataaagctcctcatgccc

SEQ ID NO: 68166 - DNA, 20 bp, Artificial Sequence
  chemically synthesized
cttataaagctcctcatgcc

SEQ ID NO: 68167 - DNA, 20 bp, Artificial Sequence
  chemically synthesized
agatgcagcctgggcatgag

SEQ ID NO: 68168 - DNA, 20 bp, Artificial Sequence
  chemically synthesized
ctgggcatgaggagctttat

SEQ ID NO: 68169 - DNA, 20 bp, Artificial Sequence
  chemically synthesized
aatcccctgggcagcttata

SEQ ID NO: 68170 - DNA, 20 bp, Artificial Sequence
  chemically synthesized
gaggagctttataagctgcc

SEQ ID NO: 68171 - DNA, 20 bp, Artificial Sequence
  chemically synthesized
aggagctttataagctgccc

SEQ ID NO: 68172 - DNA, 20 bp, Artificial Sequence
  chemically synthesized
ggagctttataagctgccca

SEQ ID NO: 68173 - DNA, 20 bp, Artificial Sequence
  chemically synthesized
gagctttataagctgcccag

SEQ ID NO: 68174 - DNA, 20 bp, Artificial Sequence
  chemically synthesized
acatatcagaatcccctggg

SEQ ID NO: 68175 - DNA, 20 bp, Artificial Sequence
  chemically synthesized
accacatatcagaatcccct

SEQ ID NO: 68176 - DNA, 20 bp, Artificial Sequence
  chemically synthesized
gaccacatatcagaatcccc

SEQ ID NO: 68177 - DNA, 20 bp, Artificial Sequence
  chemically synthesized
gcccaggggattctgatatg

SEQ ID NO: 68178 - DNA, 20 bp, Artificial Sequence
  chemically synthesized
ctaaagcgcagaccacatat

SEQ ID NO: 68179 - DNA, 20 bp, Artificial Sequence
  chemically synthesized
ctgatatgtggtctgcgctt

SEQ ID NO: 68180 - DNA, 20 bp, Artificial Sequence
  chemically synthesized
tgatatgtggtctgcgcttt

SEQ ID NO: 68181 - DNA, 20 bp, Artificial Sequence
  chemically synthesized
accttgacaggcctaaagcg

SEQ ID NO: 68182 - DNA, 20 bp, Artificial Sequence
  chemically synthesized
atcccaccttgacaggccta

SEQ ID NO: 68183 - DNA, 20 bp, Artificial Sequence
  chemically synthesized
gtctgcgctttaggcctgtc

SEQ ID NO: 68184 - DNA, 20 bp, Artificial Sequence
  chemically synthesized
tctgcgctttaggcctgtca

SEQ ID NO: 68185 - DNA, 20 bp, Artificial Sequence
  chemically synthesized
gcgctttaggcctgtcaagg

SEQ ID NO: 68186 - DNA, 20 bp, Artificial Sequence
  chemically synthesized
agttgttatcccaccttgac

SEQ ID NO: 68187 - DNA, 20 bp, Artificial Sequence
  chemically synthesized
cgctttaggcctgtcaaggt

SEQ ID NO: 68188 - DNA, 20 bp, Artificial Sequence
  chemically synthesized
aagttgttatcccaccttga

SEQ ID NO: 68189 - DNA, 20 bp, Artificial Sequence
  chemically synthesized
gggataacaacttgataata

SEQ ID NO: 68190 - DNA, 20 bp, Artificial Sequence
  chemically synthesized
ggaaataaacctttattatc

SEQ ID NO: 68191 - DNA, 20 bp, Artificial Sequence
  chemically synthesized
ggataacaacttgataataa

SEQ ID NO: 68192 - DNA, 20 bp, Artificial Sequence
  chemically synthesized
ataaaggtttatttcctgat

SEQ ID NO: 68193 - DNA, 20 bp, Artificial Sequence
  chemically synthesized
ggtaacccctttaactgatc

SEQ ID NO: 68194 - DNA, 20 bp, Artificial Sequence
  chemically synthesized
tggtaacccctttaactgat

SEQ ID NO: 68195 - DNA, 20 bp, Artificial Sequence
  chemically synthesized
gtttatttcctgatcagtta

SEQ ID NO: 68196 - DNA, 20 bp, Artificial Sequence
  chemically synthesized
tttatttcctgatcagttaa

SEQ ID NO: 68197 - DNA, 20 bp, Artificial Sequence
  chemically synthesized
ttatttcctgatcagttaaa

SEQ ID NO: 68198 - DNA, 20 bp, Artificial Sequence
  chemically synthesized
tatttcctgatcagttaaag

SEQ ID NO: 68199 - DNA, 20 bp, Artificial Sequence
  chemically synthesized
aaaggggttaccacatctca

SEQ ID NO: 68200 - DNA, 20 bp, Artificial Sequence
  chemically synthesized
caaaatatttctttgagatg

SEQ ID NO: 68201 - DNA, 20 bp, Artificial Sequence
  chemically synthesized
agtatgcaaaatatttcttt

SEQ ID NO: 68202 - DNA, 20 bp, Artificial Sequence
  chemically synthesized
agaaatattttgcatactca

SEQ ID NO: 68203 - DNA, 20 bp, Artificial Sequence
  chemically synthesized
gaaatattttgcatactcaa

SEQ ID NO: 68204 - DNA, 20 bp, Artificial Sequence
  chemically synthesized
aattccattacaggtccttt

SEQ ID NO: 68205 - DNA, 20 bp, Artificial Sequence
  chemically synthesized
catactcaaaggacctgtaa

SEQ ID NO: 68206 - DNA, 20 bp, Artificial Sequence
  chemically synthesized
tttaacttaaattccattac

SEQ ID NO: 68207 - DNA, 20 bp, Artificial Sequence
  chemically synthesized
atttaacttaaattccatta

SEQ ID NO: 68208 - DNA, 20 bp, Artificial Sequence
  chemically synthesized
aaggacctgtaatggaattt

SEQ ID NO: 68209 - DNA, 20 bp, Artificial Sequence
  chemically synthesized
atggaatttaagttaaataa

SEQ ID NO: 68210 - DNA, 20 bp, Artificial Sequence
  chemically synthesized
gagatatttaaaattaatta

SEQ ID NO: 68211 - DNA, 20 bp, Artificial Sequence
  chemically synthesized
taattttaaatatctcaaca

SEQ ID NO: 68212 - DNA, 20 bp, Artificial Sequence
  chemically synthesized
aatatccaactatctatgtt

SEQ ID NO: 68213 - DNA, 20 bp, Artificial Sequence
  chemically synthesized
tttaaatatctcaacataga

SEQ ID NO: 68214 - DNA, 20 bp, Artificial Sequence
  chemically synthesized
aatatctcaacatagatagt

SEQ ID NO: 68215 - DNA, 20 bp, Artificial Sequence
  chemically synthesized
agttggatattttatatgtg

SEQ ID NO: 68216 - DNA, 20 bp, Artificial Sequence
  chemically synthesized
ggatattttatatgtgcagt

SEQ ID NO: 68217 - DNA, 20 bp, Artificial Sequence
  chemically synthesized
gttagtgcaaccttcaactc

SEQ ID NO: 68218 - DNA, 20 bp, Artificial Sequence
  chemically synthesized
cctcaagcctctagagttga

SEQ ID NO: 68219 - DNA, 20 bp, Artificial Sequence
  chemically synthesized
gcctcaagcctctagagttg

SEQ ID NO: 68220 - DNA, 20 bp, Artificial Sequence
  chemically synthesized
tagtgcaaccttcaactcta

SEQ ID NO: 68221 - DNA, 20 bp, Artificial Sequence
  chemically synthesized
agtgcaaccttcaactctag

SEQ ID NO: 68222 - DNA, 20 bp, Artificial Sequence
  chemically synthesized
ccatttgcctcaagcctcta

SEQ ID NO: 68223 - DNA, 20 bp, Artificial Sequence
  chemically synthesized
accttcaactctagaggctt

SEQ ID NO: 68224 - DNA, 20 bp, Artificial Sequence
  chemically synthesized
aaccatttgcctcaagcctc

SEQ ID NO: 68225 - DNA, 20 bp, Artificial Sequence
  chemically synthesized
ccttcaactctagaggcttg

SEQ ID NO: 68226 - DNA, 20 bp, Artificial Sequence
  chemically synthesized
ttaaaataaccatttgcctc

SEQ ID NO: 68227 - DNA, 20 bp, Artificial Sequence
  chemically synthesized
ctctagaggcttgaggcaaa

SEQ ID NO: 68228 - DNA, 20 bp, Artificial Sequence
  chemically synthesized
aggcaaatggttattttaat

SEQ ID NO: 68229 - DNA, 20 bp, Artificial Sequence
  chemically synthesized
ggcaaatggttattttaatt

SEQ ID NO: 68230 - DNA, 20 bp, Artificial Sequence
  chemically synthesized
ttaattaggaattcatattc

SEQ ID NO: 68231 - DNA, 20 bp, Artificial Sequence
  chemically synthesized
taattaggaattcatattct

SEQ ID NO: 68232 - DNA, 20 bp, Artificial Sequence
  chemically synthesized
taggaattcatattctagga

SEQ ID NO: 68233 - DNA, 20 bp, Artificial Sequence
  chemically synthesized
agatgaaggctgtgctgtcc

SEQ ID NO: 68234 - DNA, 20 bp, Artificial Sequence
  chemically synthesized
attcatattctaggacagca

SEQ ID NO: 68235 - DNA, 20 bp, Artificial Sequence
  chemically synthesized
tggcctttttcataagatga

SEQ ID NO: 68236 - DNA, 20 bp, Artificial Sequence
  chemically synthesized
ttggcctttttcataagatg

SEQ ID NO: 68237 - DNA, 20 bp, Artificial Sequence
  chemically synthesized
acagccttcatcttatgaaa

SEQ ID NO: 68238 - DNA, 20 bp, Artificial Sequence
  chemically synthesized
cagccttcatcttatgaaaa

SEQ ID NO: 68239 - DNA, 20 bp, Artificial Sequence
  chemically synthesized
tgggttttggcctttttcat

SEQ ID NO: 68240 - DNA, 20 bp, Artificial Sequence
  chemically synthesized
ttatgaaaaaggccaaaacc

SEQ ID NO: 68241 - DNA, 20 bp, Artificial Sequence
  chemically synthesized
atgaaaaaggccaaaaccca

SEQ ID NO: 68242 - DNA, 20 bp, Artificial Sequence
  chemically synthesized
tagtagcagtctctgggttt

SEQ ID NO: 68243 - DNA, 20 bp, Artificial Sequence
  chemically synthesized
atatagtagtagcagtctct

SEQ ID NO: 68244 - DNA, 20 bp, Artificial Sequence
  chemically synthesized
tatatagtagtagcagtctc

SEQ ID NO: 68245 - DNA, 20 bp, Artificial Sequence
  chemically synthesized
acagagatatatagtagtag

SEQ ID NO: 68246 - DNA, 20 bp, Artificial Sequence
  chemically synthesized
ttcacagagatatatagtag

SEQ ID NO: 68247 - DNA, 20 bp, Artificial Sequence
  chemically synthesized
aggttcacagagatatatag

SEQ ID NO: 68248 - DNA, 20 bp, Artificial Sequence
  chemically synthesized
ccaaggttcacagagatata

SEQ ID NO: 68249 - DNA, 20 bp, Artificial Sequence
  chemically synthesized
aaaatcctccaaggttcaca

SEQ ID NO: 68250 - DNA, 20 bp, Artificial Sequence
  chemically synthesized
ctatatatctctgtgaacct

SEQ ID NO: 68251 - DNA, 20 bp, Artificial Sequence
  chemically synthesized
acaaaatcctccaaggttca

SEQ ID NO: 68252 - DNA, 20 bp, Artificial Sequence
  chemically synthesized
atatatctctgtgaaccttg

SEQ ID NO: 68253 - DNA, 20 bp, Artificial Sequence
  chemically synthesized
tatatctctgtgaaccttgg

SEQ ID NO: 68254 - DNA, 20 bp, Artificial Sequence
  chemically synthesized
atgcattacaaaatcctcca

SEQ ID NO: 68255 - DNA, 20 bp, Artificial Sequence
  chemically synthesized
catgcattacaaaatcctcc

SEQ ID NO: 68256 - DNA, 20 bp, Artificial Sequence
  chemically synthesized
ggattttgtaatgcatgtaa

SEQ ID NO: 68257 - DNA, 20 bp, Artificial Sequence
  chemically synthesized
atcgcaaatgtgtttttgct

SEQ ID NO: 68258 - DNA, 20 bp, Artificial Sequence
  chemically synthesized
tcgcaaatgtgtttttgctg

SEQ ID NO: 68259 - DNA, 20 bp, Artificial Sequence
  chemically synthesized
cgcaaatgtgtttttgctga

SEQ ID NO: 68260 - DNA, 20 bp, Artificial Sequence
  chemically synthesized
tgtgtttttgctgagggaaa

SEQ ID NO: 68261 - DNA, 20 bp, Artificial Sequence
  chemically synthesized
ttgcaatccactatttccct

SEQ ID NO: 68262 - DNA, 20 bp, Artificial Sequence
  chemically synthesized
gtttttgctgagggaaatag

SEQ ID NO: 68263 - DNA, 20 bp, Artificial Sequence
  chemically synthesized
gattgcaatgaatatcccta

SEQ ID NO: 68264 - DNA, 20 bp, Artificial Sequence
  chemically synthesized
attgcaatgaatatccctat

SEQ ID NO: 68265 - DNA, 20 bp, Artificial Sequence
  chemically synthesized
tttactaatgagatcctata

SEQ ID NO: 68266 - DNA, 20 bp, Artificial Sequence
  chemically synthesized
ttttactaatgagatcctat

SEQ ID NO: 68267 - DNA, 20 bp, Artificial Sequence
  chemically synthesized
attttactaatgagatccta

SEQ ID NO: 68268 - DNA, 20 bp, Artificial Sequence
  chemically synthesized
atatccctataggatctcat

SEQ ID NO: 68269 - DNA, 20 bp, Artificial Sequence
  chemically synthesized
ttgtcttaaattttactaat

SEQ ID NO: 68270 - DNA, 20 bp, Artificial Sequence
  chemically synthesized
ggatctcattagtaaaattt

SEQ ID NO: 68271 - DNA, 20 bp, Artificial Sequence
  chemically synthesized
tagtaaaatttaagacaatc

SEQ ID NO: 68272 - DNA, 20 bp, Artificial Sequence
  chemically synthesized
tttaagacaatcaagataca

SEQ ID NO: 68273 - DNA, 20 bp, Artificial Sequence
  chemically synthesized
gggatgtcattaaaatattt

SEQ ID NO: 68274 - DNA, 20 bp, Artificial Sequence
  chemically synthesized
tcctgtttatgcaatgttag

SEQ ID NO: 68275 - DNA, 20 bp, Artificial Sequence
  chemically synthesized
atcctgtttatgcaatgtta

SEQ ID NO: 68276 - DNA, 20 bp, Artificial Sequence
  chemically synthesized
tatcctgtttatgcaatgtt

SEQ ID NO: 68277 - DNA, 20 bp, Artificial Sequence
  chemically synthesized
atatcctgtttatgcaatgt

SEQ ID NO: 68278 - DNA, 20 bp, Artificial Sequence
  chemically synthesized
atcccctaacattgcataaa

SEQ ID NO: 68279 - DNA, 20 bp, Artificial Sequence
  chemically synthesized
tcccctaacattgcataaac

SEQ ID NO: 68280 - DNA, 20 bp, Artificial Sequence
  chemically synthesized
acattgcataaacaggatat

SEQ ID NO: 68281 - DNA, 20 bp, Artificial Sequence
  chemically synthesized
ataaacaggatataagaatc

SEQ ID NO: 68282 - DNA, 20 bp, Artificial Sequence
  chemically synthesized
gcccaagcaacaggttttgc

SEQ ID NO: 68283 - DNA, 20 bp, Artificial Sequence
  chemically synthesized
atccagcaaaacctgttgct

SEQ ID NO: 68284 - DNA, 20 bp, Artificial Sequence
  chemically synthesized
tccagcaaaacctgttgctt

SEQ ID NO: 68285 - DNA, 20 bp, Artificial Sequence
  chemically synthesized
aaattaaaagcccaagcaac

SEQ ID NO: 68286 - DNA, 20 bp, Artificial Sequence
  chemically synthesized
aaaattaaaagcccaagcaa

SEQ ID NO: 68287 - DNA, 20 bp, Artificial Sequence
  chemically synthesized
agacgtaaaattaaaagccc

SEQ ID NO: 68288 - DNA, 20 bp, Artificial Sequence
  chemically synthesized
gagaccagacgtaaaattaa

SEQ ID NO: 68289 - DNA, 20 bp, Artificial Sequence
  chemically synthesized
tgggcttttaattttacgtc

SEQ ID NO: 68290 - DNA, 20 bp, Artificial Sequence
  chemically synthesized
gatacaaggccattggagac

SEQ ID NO: 68291 - DNA, 20 bp, Artificial Sequence
  chemically synthesized
attttacgtctggtctccaa

SEQ ID NO: 68292 - DNA, 20 bp, Artificial Sequence
  chemically synthesized
ggttggatacaaggccattg

SEQ ID NO: 68293 - DNA, 20 bp, Artificial Sequence
  chemically synthesized
atggttggatacaaggccat

SEQ ID NO: 68294 - DNA, 20 bp, Artificial Sequence
  chemically synthesized
taagccaatggttggataca

SEQ ID NO: 68295 - DNA, 20 bp, Artificial Sequence
  chemically synthesized
ctaagccaatggttggatac

SEQ ID NO: 68296 - DNA, 20 bp, Artificial Sequence
  chemically synthesized
atggccttgtatccaaccat

SEQ ID NO: 68297 - DNA, 20 bp, Artificial Sequence
  chemically synthesized
attcttcctaagccaatggt

SEQ ID NO: 68298 - DNA, 20 bp, Artificial Sequence
  chemically synthesized
cttgtatccaaccattggct

SEQ ID NO: 68299 - DNA, 20 bp, Artificial Sequence
  chemically synthesized
ttgtatccaaccattggctt

SEQ ID NO: 68300 - DNA, 20 bp, Artificial Sequence
  chemically synthesized
aagaattcttcctaagccaa

SEQ ID NO: 68301 - DNA, 20 bp, Artificial Sequence
  chemically synthesized
tatccaaccattggcttagg

SEQ ID NO: 68302 - DNA, 20 bp, Artificial Sequence
  chemically synthesized
aggtcacaagaattcttcct

SEQ ID NO: 68303 - DNA, 20 bp, Artificial Sequence
  chemically synthesized
tagatttggcatcaggtcac

SEQ ID NO: 68304 - DNA, 20 bp, Artificial Sequence
  chemically synthesized
ttacctttagatttggcatc

SEQ ID NO: 68305 - DNA, 20 bp, Artificial Sequence
  chemically synthesized
cttacctttagatttggcat

SEQ ID NO: 68306 - DNA, 20 bp, Artificial Sequence
  chemically synthesized
gtgacctgatgccaaatcta

SEQ ID NO: 68307 - DNA, 20 bp, Artificial Sequence
  chemically synthesized
tgacctgatgccaaatctaa

SEQ ID NO: 68308 - DNA, 20 bp, Artificial Sequence
  chemically synthesized
tattctcttacctttagatt

SEQ ID NO: 68309 - DNA, 20 bp, Artificial Sequence
  chemically synthesized
ctgatgccaaatctaaaggt

SEQ ID NO: 68310 - DNA, 20 bp, Artificial Sequence
  chemically synthesized
gatgccaaatctaaaggtaa

SEQ ID NO: 68311 - DNA, 20 bp, Artificial Sequence
  chemically synthesized
atacagtattctcttacctt

SEQ ID NO: 68312 - DNA, 20 bp, Artificial Sequence
  chemically synthesized
aattgacaccattgcaaata

SEQ ID NO: 68313 - DNA, 20 bp, Artificial Sequence
  chemically synthesized
agagaatactgtatttgcaa

SEQ ID NO: 68314 - DNA, 20 bp, Artificial Sequence
  chemically synthesized
atttgcaatggtgtcaattt

SEQ ID NO: 68315 - DNA, 20 bp, Artificial Sequence
  chemically synthesized
tttatgaagtgtaggatttt

SEQ ID NO: 68316 - DNA, 20 bp, Artificial Sequence
  chemically synthesized
ttttatgaagtgtaggattt

SEQ ID NO: 68317 - DNA, 20 bp, Artificial Sequence
  chemically synthesized
ctacaatttttatgaagtgt

SEQ ID NO: 68318 - DNA, 20 bp, Artificial Sequence
  chemically synthesized
tctacaatttttatgaagtg

SEQ ID NO: 68319 - DNA, 20 bp, Artificial Sequence
  chemically synthesized
cctgttctacaatttttatg

SEQ ID NO: 68320 - DNA, 20 bp, Artificial Sequence
  chemically synthesized
cctacacttcataaaaattg

SEQ ID NO: 68321 - DNA, 20 bp, Artificial Sequence
  chemically synthesized
acttcataaaaattgtagaa

SEQ ID NO: 68322 - DNA, 20 bp, Artificial Sequence
  chemically synthesized
cttcataaaaattgtagaac

SEQ ID NO: 68323 - DNA, 20 bp, Artificial Sequence
  chemically synthesized
aaaattgtagaacaggctgt

SEQ ID NO: 68324 - DNA, 20 bp, Artificial Sequence
  chemically synthesized
ggcaggcagaagtcagctta

SEQ ID NO: 68325 - DNA, 20 bp, Artificial Sequence
  chemically synthesized
gttagaaggcaggcagaagt

SEQ ID NO: 68326 - DNA, 20 bp, Artificial Sequence
  chemically synthesized
atttgttagaaggcaggcag

SEQ ID NO: 68327 - DNA, 20 bp, Artificial Sequence
  chemically synthesized
aacatttgttagaaggcagg

SEQ ID NO: 68328 - DNA, 20 bp, Artificial Sequence
  chemically synthesized
accaacatttgttagaaggc

SEQ ID NO: 68329 - DNA, 20 bp, Artificial Sequence
  chemically synthesized
aaccaacatttgttagaagg

SEQ ID NO: 68330 - DNA, 20 bp, Artificial Sequence
  chemically synthesized
gttaaccaacatttgttaga

SEQ ID NO: 68331 - DNA, 20 bp, Artificial Sequence
  chemically synthesized
cgttaaccaacatttgttag

SEQ ID NO: 68332 - DNA, 20 bp, Artificial Sequence
  chemically synthesized
tgtcgttaaccaacatttgt

SEQ ID NO: 68333 - DNA, 20 bp, Artificial Sequence
  chemically synthesized
gcctgccttctaacaaatgt

SEQ ID NO: 68334 - DNA, 20 bp, Artificial Sequence
  chemically synthesized
taacgacatgattgcacttg

SEQ ID NO: 68335 - DNA, 20 bp, Artificial Sequence
  chemically synthesized
acgacatgattgcacttgtg

SEQ ID NO: 68336 - DNA, 20 bp, Artificial Sequence
  chemically synthesized
cgacatgattgcacttgtgg

SEQ ID NO: 68337 - DNA, 20 bp, Artificial Sequence
  chemically synthesized
ttcatgctgaagtcctccac

SEQ ID NO: 68338 - DNA, 20 bp, Artificial Sequence
  chemically synthesized
attgcacttgtggaggactt

SEQ ID NO: 68339 - DNA, 20 bp, Artificial Sequence
  chemically synthesized
ttgtggaggacttcagcatg

SEQ ID NO: 68340 - DNA, 20 bp, Artificial Sequence
  chemically synthesized
cagcttcatgcttcatgctg

SEQ ID NO: 68341 - DNA, 20 bp, Artificial Sequence
  chemically synthesized
ggacttcagcatgaagcatg

SEQ ID NO: 68342 - DNA, 20 bp, Artificial Sequence
  chemically synthesized
cagcatgaagcatgaagctg

SEQ ID NO: 68343 - DNA, 20 bp, Artificial Sequence
  chemically synthesized
gaagcatgaagctgcggctt

SEQ ID NO: 68344 - DNA, 20 bp, Artificial Sequence
  chemically synthesized
aagcatgaagctgcggcttg

SEQ ID NO: 68345 - DNA, 20 bp, Artificial Sequence
  chemically synthesized
ggaatggctacctcaagccg

SEQ ID NO: 68346 - DNA, 20 bp, Artificial Sequence
  chemically synthesized
catgaagctgcggcttgagg

SEQ ID NO: 68347 - DNA, 20 bp, Artificial Sequence
  chemically synthesized
ggatgaggaatggctacctc

SEQ ID NO: 68348 - DNA, 20 bp, Artificial Sequence
  chemically synthesized
tgtttgaggtggatgaggaa

SEQ ID NO: 68349 - DNA, 20 bp, Artificial Sequence
  chemically synthesized
agatgtgtttgaggtggatg

SEQ ID NO: 68350 - DNA, 20 bp, Artificial Sequence
  chemically synthesized
cagatgtgtttgaggtggat

SEQ ID NO: 68351 - DNA, 20 bp, Artificial Sequence
  chemically synthesized
aaccacagatgtgtttgagg

SEQ ID NO: 68352 - DNA, 20 bp, Artificial Sequence
  chemically synthesized
gagaaccacagatgtgtttg

SEQ ID NO: 68353 - DNA, 20 bp, Artificial Sequence
  chemically synthesized
ggagaaccacagatgtgttt

SEQ ID NO: 68354 - DNA, 20 bp, Artificial Sequence
  chemically synthesized
atccacctcaaacacatctg

SEQ ID NO: 68355 - DNA, 20 bp, Artificial Sequence
  chemically synthesized
tgggaaataatggagaacca

SEQ ID NO: 68356 - DNA, 20 bp, Artificial Sequence
  chemically synthesized
gttctttttgggaaataatg

SEQ ID NO: 68357 - DNA, 20 bp, Artificial Sequence
  chemically synthesized
aggttctttttgggaaataa

SEQ ID NO: 68358 - DNA, 20 bp, Artificial Sequence
  chemically synthesized
gttctccattatttcccaaa

SEQ ID NO: 68359 - DNA, 20 bp, Artificial Sequence
  chemically synthesized
gcaactattaggttcttttt

SEQ ID NO: 68360 - DNA, 20 bp, Artificial Sequence
  chemically synthesized
tgcaactattaggttctttt

SEQ ID NO: 68361 - DNA, 20 bp, Artificial Sequence
  chemically synthesized
atttcccaaaaagaacctaa

SEQ ID NO: 68362 - DNA, 20 bp, Artificial Sequence
  chemically synthesized
ttaggtcacgtgcaactatt

SEQ ID NO: 68363 - DNA, 20 bp, Artificial Sequence
  chemically synthesized
tttaggtcacgtgcaactat

SEQ ID NO: 68364 - DNA, 20 bp, Artificial Sequence
  chemically synthesized
gaactgacctaagtgaattt

SEQ ID NO: 68365 - DNA, 20 bp, Artificial Sequence
  chemically synthesized
tgaactgacctaagtgaatt

SEQ ID NO: 68366 - DNA, 20 bp, Artificial Sequence
  chemically synthesized
gcacgtgacctaaattcact

SEQ ID NO: 68367 - DNA, 20 bp, Artificial Sequence
  chemically synthesized
cacgtgacctaaattcactt

SEQ ID NO: 68368 - DNA, 20 bp, Artificial Sequence
  chemically synthesized
tgacctaaattcacttaggt

SEQ ID NO: 68369 - DNA, 20 bp, Artificial Sequence
  chemically synthesized
cacctgctgtgaactgacct

SEQ ID NO: 68370 - DNA, 20 bp, Artificial Sequence
  chemically synthesized
aattcacttaggtcagttca

SEQ ID NO: 68371 - DNA, 20 bp, Artificial Sequence
  chemically synthesized
tcacttaggtcagttcacag

SEQ ID NO: 68372 - DNA, 20 bp, Artificial Sequence
  chemically synthesized
cacttaggtcagttcacagc

SEQ ID NO: 68373 - DNA, 20 bp, Artificial Sequence
  chemically synthesized
ttaggtcagttcacagcagg

SEQ ID NO: 68374 - DNA, 20 bp, Artificial Sequence
  chemically synthesized
gttcacagcaggtggaattt

SEQ ID NO: 68375 - DNA, 20 bp, Artificial Sequence
  chemically synthesized
ttcacagcaggtggaatttg

SEQ ID NO: 68376 - DNA, 20 bp, Artificial Sequence
  chemically synthesized
acagcaggtggaatttgagg

SEQ ID NO: 68377 - DNA, 20 bp, Artificial Sequence
  chemically synthesized
aggcagtgtgccaataaaat

SEQ ID NO: 68378 - DNA, 20 bp, Artificial Sequence
  chemically synthesized
ttacttaccgctcattttat

SEQ ID NO: 68379 - DNA, 20 bp, Artificial Sequence
  chemically synthesized
cagtgtgccaataaaatgag

SEQ ID NO: 68380 - DNA, 20 bp, Artificial Sequence
  chemically synthesized
gtgccaataaaatgagcggt

SEQ ID NO: 68381 - DNA, 20 bp, Artificial Sequence
  chemically synthesized
atgagcggtaagtaaatatt

SEQ ID NO: 68382 - DNA, 20 bp, Artificial Sequence
  chemically synthesized
tgagcggtaagtaaatattt

SEQ ID NO: 68383 - DNA, 20 bp, Artificial Sequence
  chemically synthesized
gagcggtaagtaaatatttg

SEQ ID NO: 68384 - DNA, 20 bp, Artificial Sequence
  chemically synthesized
ggtaagtaaatatttggggt

SEQ ID NO: 68385 - DNA, 20 bp, Artificial Sequence
  chemically synthesized
taagtaaatatttggggtaa

SEQ ID NO: 68386 - DNA, 20 bp, Artificial Sequence
  chemically synthesized
aagtaaatatttggggtaag

SEQ ID NO: 68387 - DNA, 20 bp, Artificial Sequence
  chemically synthesized
agtaaatatttggggtaaga

SEQ ID NO: 68388 - DNA, 20 bp, Artificial Sequence
  chemically synthesized
actatttaatcgttgtgcag

SEQ ID NO: 68389 - DNA, 20 bp, Artificial Sequence
  chemically synthesized
agaactatttaatcgttgtg

SEQ ID NO: 68390 - DNA, 20 bp, Artificial Sequence
  chemically synthesized
tcttctgcacaacgattaaa

SEQ ID NO: 68391 - DNA, 20 bp, Artificial Sequence
  chemically synthesized
gcacaacgattaaatagttc

SEQ ID NO: 68392 - DNA, 20 bp, Artificial Sequence
  chemically synthesized
cacaacgattaaatagttct

SEQ ID NO: 68393 - DNA, 20 bp, Artificial Sequence
  chemically synthesized
gaggagattagaaaatcacc

SEQ ID NO: 68394 - DNA, 20 bp, Artificial Sequence
  chemically synthesized
actcttataaatgaggagat

SEQ ID NO: 68395 - DNA, 20 bp, Artificial Sequence
  chemically synthesized
ggaccactcttataaatgag

SEQ ID NO: 68396 - DNA, 20 bp, Artificial Sequence
  chemically synthesized
tttctaatctcctcatttat

SEQ ID NO: 68397 - DNA, 20 bp, Artificial Sequence
  chemically synthesized
tgggaccactcttataaatg

SEQ ID NO: 68398 - DNA, 20 bp, Artificial Sequence
  chemically synthesized
ctgggaccactcttataaat

SEQ ID NO: 68399 - DNA, 20 bp, Artificial Sequence
  chemically synthesized
tctaatctcctcatttataa

SEQ ID NO: 68400 - DNA, 20 bp, Artificial Sequence
  chemically synthesized
aatctcctcatttataagag

SEQ ID NO: 68401 - DNA, 20 bp, Artificial Sequence
  chemically synthesized
ctcatttataagagtggtcc

SEQ ID NO: 68402 - DNA, 20 bp, Artificial Sequence
  chemically synthesized
tttataagagtggtcccagc

SEQ ID NO: 68403 - DNA, 20 bp, Artificial Sequence
  chemically synthesized
tttcagtctctgttcttgct

SEQ ID NO: 68404 - DNA, 20 bp, Artificial Sequence
  chemically synthesized
aagagtggtcccagcaagaa

SEQ ID NO: 68405 - DNA, 20 bp, Artificial Sequence
  chemically synthesized
atttcagtctctgttcttgc

SEQ ID NO: 68406 - DNA, 20 bp, Artificial Sequence
  chemically synthesized
gagtggtcccagcaagaaca

SEQ ID NO: 68407 - DNA, 20 bp, Artificial Sequence
  chemically synthesized
caagaacagagactgaaata

SEQ ID NO: 68408 - DNA, 20 bp, Artificial Sequence
  chemically synthesized
ttgaaacgaccactttattt

SEQ ID NO: 68409 - DNA, 20 bp, Artificial Sequence
  chemically synthesized
gaacagagactgaaataaag

SEQ ID NO: 68410 - DNA, 20 bp, Artificial Sequence
  chemically synthesized
gaaataaagtggtcgtttca

SEQ ID NO: 68411 - DNA, 20 bp, Artificial Sequence
  chemically synthesized
agctgaaagcagagtattta

SEQ ID NO: 68412 - DNA, 20 bp, Artificial Sequence
  chemically synthesized
agctttaaatactctgcttt

SEQ ID NO: 68413 - DNA, 20 bp, Artificial Sequence
  chemically synthesized
ggacagagtagctgaaagca

SEQ ID NO: 68414 - DNA, 20 bp, Artificial Sequence
  chemically synthesized
gtggacagagtagctgaaag

SEQ ID NO: 68415 - DNA, 20 bp, Artificial Sequence
  chemically synthesized
taagtggacagagtagctga

SEQ ID NO: 68416 - DNA, 20 bp, Artificial Sequence
  chemically synthesized
ctttgaataagtggacagag

SEQ ID NO: 68417 - DNA, 20 bp, Artificial Sequence
  chemically synthesized
tgtctttgaataagtggaca

SEQ ID NO: 68418 - DNA, 20 bp, Artificial Sequence
  chemically synthesized
tttgtctttgaataagtgga

SEQ ID NO: 68419 - DNA, 20 bp, Artificial Sequence
  chemically synthesized
caagtttgtctttgaataag

SEQ ID NO: 68420 - DNA, 20 bp, Artificial Sequence
  chemically synthesized
ctactctgtccacttattca

SEQ ID NO: 68421 - DNA, 20 bp, Artificial Sequence
  chemically synthesized
tttcaagtttgtctttgaat

SEQ ID NO: 68422 - DNA, 20 bp, Artificial Sequence
  chemically synthesized
ttattcaaagacaaacttga

SEQ ID NO: 68423 - DNA, 20 bp, Artificial Sequence
  chemically synthesized
tattcaaagacaaacttgaa

SEQ ID NO: 68424 - DNA, 20 bp, Artificial Sequence
  chemically synthesized
atgggctcctgtttcctttc

SEQ ID NO: 68425 - DNA, 20 bp, Artificial Sequence
  chemically synthesized
aagacaaacttgaaaggaaa

SEQ ID NO: 68426 - DNA, 20 bp, Artificial Sequence
  chemically synthesized
agacaaacttgaaaggaaac

SEQ ID NO: 68427 - DNA, 20 bp, Artificial Sequence
  chemically synthesized
acaaacttgaaaggaaacag

SEQ ID NO: 68428 - DNA, 20 bp, Artificial Sequence
  chemically synthesized
ggaaacaggagcccatatta

SEQ ID NO: 68429 - DNA, 20 bp, Artificial Sequence
  chemically synthesized
aaaagcctgtgctataatat

SEQ ID NO: 68430 - DNA, 20 bp, Artificial Sequence
  chemically synthesized
taaaagcctgtgctataata

SEQ ID NO: 68431 - DNA, 20 bp, Artificial Sequence
  chemically synthesized
caggagcccatattatagca

SEQ ID NO: 68432 - DNA, 20 bp, Artificial Sequence
  chemically synthesized
aggagcccatattatagcac

SEQ ID NO: 68433 - DNA, 20 bp, Artificial Sequence
  chemically synthesized
cctcatattgacaaatttaa

SEQ ID NO: 68434 - DNA, 20 bp, Artificial Sequence
  chemically synthesized
gcttttaaatttgtcaatat

SEQ ID NO: 68435 - DNA, 20 bp, Artificial Sequence
  chemically synthesized
cttttaaatttgtcaatatg

SEQ ID NO: 68436 - DNA, 20 bp, Artificial Sequence
  chemically synthesized
aatttgtcaatatgaggaac

SEQ ID NO: 68437 - DNA, 20 bp, Artificial Sequence
  chemically synthesized
atttgtcaatatgaggaacc

SEQ ID NO: 68438 - DNA, 20 bp, Artificial Sequence
  chemically synthesized
aagaagaacagggcatttcc

SEQ ID NO: 68439 - DNA, 20 bp, Artificial Sequence
  chemically synthesized
aagagccccgaagaagaaca

SEQ ID NO: 68440 - DNA, 20 bp, Artificial Sequence
  chemically synthesized
aaagagccccgaagaagaac

SEQ ID NO: 68441 - DNA, 20 bp, Artificial Sequence
  chemically synthesized
gaaagagccccgaagaagaa

SEQ ID NO: 68442 - DNA, 20 bp, Artificial Sequence
  chemically synthesized
ggaaatgccctgttcttctt

SEQ ID NO: 68443 - DNA, 20 bp, Artificial Sequence
  chemically synthesized
gaaatgccctgttcttcttc

SEQ ID NO: 68444 - DNA, 20 bp, Artificial Sequence
  chemically synthesized
aaatgccctgttcttcttcg

SEQ ID NO: 68445 - DNA, 20 bp, Artificial Sequence
  chemically synthesized
taaatgaaagagccccgaag

SEQ ID NO: 68446 - DNA, 20 bp, Artificial Sequence
  chemically synthesized
agctaaatgaaagagccccg

SEQ ID NO: 68447 - DNA, 20 bp, Artificial Sequence
  chemically synthesized
ttcttcggggctctttcatt

SEQ ID NO: 68448 - DNA, 20 bp, Artificial Sequence
  chemically synthesized
ggaatgcaagctaaatgaaa

SEQ ID NO: 68449 - DNA, 20 bp, Artificial Sequence
  chemically synthesized
ctggaatgcaagctaaatga

SEQ ID NO: 68450 - DNA, 20 bp, Artificial Sequence
  chemically synthesized
ctttcatttagcttgcattc

SEQ ID NO: 68451 - DNA, 20 bp, Artificial Sequence
  chemically synthesized
tttcatttagcttgcattcc

SEQ ID NO: 68452 - DNA, 20 bp, Artificial Sequence
  chemically synthesized
aatgaacattcctggaatgc

SEQ ID NO: 68453 - DNA, 20 bp, Artificial Sequence
  chemically synthesized
ttggaacaaatgaacattcc

SEQ ID NO: 68454 - DNA, 20 bp, Artificial Sequence
  chemically synthesized
caggaatgttcatttgttcc

SEQ ID NO: 68455 - DNA, 20 bp, Artificial Sequence
  chemically synthesized
cattaatttctaatgttgct

SEQ ID NO: 68456 - DNA, 20 bp, Artificial Sequence
  chemically synthesized
tcatttgttccaagcaacat

SEQ ID NO: 68457 - DNA, 20 bp, Artificial Sequence
  chemically synthesized
caagcaacattagaaattaa

SEQ ID NO: 68458 - DNA, 20 bp, Artificial Sequence
  chemically synthesized
aagcaacattagaaattaat

SEQ ID NO: 68459 - DNA, 20 bp, Artificial Sequence
  chemically synthesized
agcaacattagaaattaatg

SEQ ID NO: 68460 - DNA, 20 bp, Artificial Sequence
  chemically synthesized
acattagaaattaatggggt

SEQ ID NO: 68461 - DNA, 20 bp, Artificial Sequence
  chemically synthesized
gaaattaatggggtaagtgc

SEQ ID NO: 68462 - DNA, 20 bp, Artificial Sequence
  chemically synthesized
aaattaatggggtaagtgct

SEQ ID NO: 68463 - DNA, 20 bp, Artificial Sequence
  chemically synthesized
accgattacctacattcacc

SEQ ID NO: 68464 - DNA, 20 bp, Artificial Sequence
  chemically synthesized
gggtaagtgctgggtgaatg

SEQ ID NO: 68465 - DNA, 20 bp, Artificial Sequence
  chemically synthesized
ggtaagtgctgggtgaatgt

SEQ ID NO: 68466 - DNA, 20 bp, Artificial Sequence
  chemically synthesized
gctgggtgaatgtaggtaat

SEQ ID NO: 68467 - DNA, 20 bp, Artificial Sequence
  chemically synthesized
gaatgtaggtaatcggtata

SEQ ID NO: 68468 - DNA, 20 bp, Artificial Sequence
  chemically synthesized
aatgtaggtaatcggtataa

SEQ ID NO: 68469 - DNA, 20 bp, Artificial Sequence
  chemically synthesized
ggtataaaggctgctttctt

SEQ ID NO: 68470 - DNA, 20 bp, Artificial Sequence
  chemically synthesized
caggcattaactcaagaaag

SEQ ID NO: 68471 - DNA, 20 bp, Artificial Sequence
  chemically synthesized
tctcaggcattaactcaaga

SEQ ID NO: 68472 - DNA, 20 bp, Artificial Sequence
  chemically synthesized
gatttctcaggcattaactc

SEQ ID NO: 68473 - DNA, 20 bp, Artificial Sequence
  chemically synthesized
gctttcttgagttaatgcct

SEQ ID NO: 68474 - DNA, 20 bp, Artificial Sequence
  chemically synthesized
tataggcttggtgatttctc

SEQ ID NO: 68475 - DNA, 20 bp, Artificial Sequence
  chemically synthesized
ttataggcttggtgatttct

SEQ ID NO: 68476 - DNA, 20 bp, Artificial Sequence
  chemically synthesized
ttaatgcctgagaaatcacc

SEQ ID NO: 68477 - DNA, 20 bp, Artificial Sequence
  chemically synthesized
gaaaaaagaaattataggct

SEQ ID NO: 68478 - DNA, 20 bp, Artificial Sequence
  chemically synthesized
gaaaagaaaaaagaaattat

SEQ ID NO: 68479 - DNA, 20 bp, Artificial Sequence
  chemically synthesized
agaaaagaaaaaagaaatta

SEQ ID NO: 68480 - DNA, 20 bp, Artificial Sequence
  chemically synthesized
aagaaaaaaagaaaagaaaa

SEQ ID NO: 68481 - DNA, 20 bp, Artificial Sequence
  chemically synthesized
gaaaaaaaagaaaaaaagaa

SEQ ID NO: 68482 - DNA, 20 bp, Artificial Sequence
  chemically synthesized
aaaaagaaaaaaaagaaaaa

SEQ ID NO: 68483 - DNA, 20 bp, Artificial Sequence
  chemically synthesized
ctcaaaaaaaaaagaaaaaa

SEQ ID NO: 68484 - DNA, 20 bp, Artificial Sequence
  chemically synthesized
agactccgtctcaaaaaaaa

SEQ ID NO: 68485 - DNA, 20 bp, Artificial Sequence
  chemically synthesized
cttttttttctttttttttt

SEQ ID NO: 68486 - DNA, 20 bp, Artificial Sequence
  chemically synthesized
tttttcttttttttttgaga

SEQ ID NO: 68487 - DNA, 20 bp, Artificial Sequence
  chemically synthesized
tttcttttttttttgagacg

SEQ ID NO: 68488 - DNA, 20 bp, Artificial Sequence
  chemically synthesized
ctccagcctggcgacagagc

SEQ ID NO: 68489 - DNA, 20 bp, Artificial Sequence
  chemically synthesized
acggagtctcgctctgtcgc

SEQ ID NO: 68490 - DNA, 20 bp, Artificial Sequence
  chemically synthesized
cggagtctcgctctgtcgcc

SEQ ID NO: 68491 - DNA, 20 bp, Artificial Sequence
  chemically synthesized
tgcactccagcctggcgaca

SEQ ID NO: 68492 - DNA, 20 bp, Artificial Sequence
  chemically synthesized
actgcactccagcctggcga

SEQ ID NO: 68493 - DNA, 20 bp, Artificial Sequence
  chemically synthesized
gtctcgctctgtcgccaggc

SEQ ID NO: 68494 - DNA, 20 bp, Artificial Sequence
  chemically synthesized
ctcgctctgtcgccaggctg

SEQ ID NO: 68495 - DNA, 20 bp, Artificial Sequence
  chemically synthesized
cgcgccactgcactccagcc

SEQ ID NO: 68496 - DNA, 20 bp, Artificial Sequence
  chemically synthesized
tctgtcgccaggctggagtg

SEQ ID NO: 68497 - DNA, 20 bp, Artificial Sequence
  chemically synthesized
gagatcgcgccactgcactc

SEQ ID NO: 68498 - DNA, 20 bp, Artificial Sequence
  chemically synthesized
gtcgccaggctggagtgcag

SEQ ID NO: 68499 - DNA, 20 bp, Artificial Sequence
  chemically synthesized
ggagtgcagtggcgcgatct

SEQ ID NO: 68500 - DNA, 20 bp, Artificial Sequence
  chemically synthesized
ggaggaggttgcagtgagcc

SEQ ID NO: 68501 - DNA, 20 bp, Artificial Sequence
  chemically synthesized
tgggaggaggaggttgcagt

SEQ ID NO: 68502 - DNA, 20 bp, Artificial Sequence
  chemically synthesized
aacctgggaggaggaggttg

SEQ ID NO: 68503 - DNA, 20 bp, Artificial Sequence
  chemically synthesized
cacttgaacctgggaggagg

SEQ ID NO: 68504 - DNA, 20 bp, Artificial Sequence
  chemically synthesized
tcactgcaacctcctcctcc

SEQ ID NO: 68505 - DNA, 20 bp, Artificial Sequence
  chemically synthesized
tcacttgaacctgggaggag

SEQ ID NO: 68506 - DNA, 20 bp, Artificial Sequence
  chemically synthesized
cactgcaacctcctcctccc

SEQ ID NO: 68507 - DNA, 20 bp, Artificial Sequence
  chemically synthesized
aatcacttgaacctgggagg

SEQ ID NO: 68508 - DNA, 20 bp, Artificial Sequence
  chemically synthesized
gaatcacttgaacctgggag

SEQ ID NO: 68509 - DNA, 20 bp, Artificial Sequence
  chemically synthesized
gagaatcacttgaacctggg

SEQ ID NO: 68510 - DNA, 20 bp, Artificial Sequence
  chemically synthesized
ggagaatcacttgaacctgg

SEQ ID NO: 68511 - DNA, 20 bp, Artificial Sequence
  chemically synthesized
aacctcctcctcccaggttc

SEQ ID NO: 68512 - DNA, 20 bp, Artificial Sequence
  chemically synthesized
caggagaatcacttgaacct

SEQ ID NO: 68513 - DNA, 20 bp, Artificial Sequence
  chemically synthesized
gcaggagaatcacttgaacc

SEQ ID NO: 68514 - DNA, 20 bp, Artificial Sequence
  chemically synthesized
ttcaagtgattctcctgcct

SEQ ID NO: 68515 - DNA, 20 bp, Artificial Sequence
  chemically synthesized
tactcgggaggctgaggcag

SEQ ID NO: 68516 - DNA, 20 bp, Artificial Sequence
  chemically synthesized
gctactcgggaggctgaggc

SEQ ID NO: 68517 - DNA, 20 bp, Artificial Sequence
  chemically synthesized
agctactcgggaggctgagg

SEQ ID NO: 68518 - DNA, 20 bp, Artificial Sequence
  chemically synthesized
cccagctactcgggaggctg

SEQ ID NO: 68519 - DNA, 20 bp, Artificial Sequence
  chemically synthesized
tcccagctactcgggaggct

SEQ ID NO: 68520 - DNA, 20 bp, Artificial Sequence
  chemically synthesized
ttctcctgcctcagcctccc

SEQ ID NO: 68521 - DNA, 20 bp, Artificial Sequence
  chemically synthesized
tcctgcctcagcctcccgag

SEQ ID NO: 68522 - DNA, 20 bp, Artificial Sequence
  chemically synthesized
cgtagtcccagctactcggg

SEQ ID NO: 68523 - DNA, 20 bp, Artificial Sequence
  chemically synthesized
ccgtagtcccagctactcgg

SEQ ID NO: 68524 - DNA, 20 bp, Artificial Sequence
  chemically synthesized
gcctcagcctcccgagtagc

SEQ ID NO: 68525 - DNA, 20 bp, Artificial Sequence
  chemically synthesized
acccgtagtcccagctactc

SEQ ID NO: 68526 - DNA, 20 bp, Artificial Sequence
  chemically synthesized
cctcagcctcccgagtagct

SEQ ID NO: 68527 - DNA, 20 bp, Artificial Sequence
  chemically synthesized
cacccgtagtcccagctact

SEQ ID NO: 68528 - DNA, 20 bp, Artificial Sequence
  chemically synthesized
ctcccgagtagctgggacta

SEQ ID NO: 68529 - DNA, 20 bp, Artificial Sequence
  chemically synthesized
tcccgagtagctgggactac

SEQ ID NO: 68530 - DNA, 20 bp, Artificial Sequence
  chemically synthesized
gtggtgcacacccgtagtcc

SEQ ID NO: 68531 - DNA, 20 bp, Artificial Sequence
  chemically synthesized
ggcgtggtggtgcacacccg

SEQ ID NO: 68532 - DNA, 20 bp, Artificial Sequence
  chemically synthesized
cgggtgtgcaccaccacgcc

SEQ ID NO: 68533 - DNA, 20 bp, Artificial Sequence
  chemically synthesized
caaaaattagctgggcgtgg

SEQ ID NO: 68534 - DNA, 20 bp, Artificial Sequence
  chemically synthesized
atacaaaaattagctgggcg

SEQ ID NO: 68535 - DNA, 20 bp, Artificial Sequence
  chemically synthesized
taaaaatacaaaaattagct

SEQ ID NO: 68536 - DNA, 20 bp, Artificial Sequence
  chemically synthesized
ctaaaaatacaaaaattagc

SEQ ID NO: 68537 - DNA, 20 bp, Artificial Sequence
  chemically synthesized
tctactaaaaatacaaaaat

SEQ ID NO: 68538 - DNA, 20 bp, Artificial Sequence
  chemically synthesized
ccagctaatttttgtatttt

SEQ ID NO: 68539 - DNA, 20 bp, Artificial Sequence
  chemically synthesized
gctaatttttgtatttttag

SEQ ID NO: 68540 - DNA, 20 bp, Artificial Sequence
  chemically synthesized
taatttttgtatttttagta

SEQ ID NO: 68541 - DNA, 20 bp, Artificial Sequence
  chemically synthesized
tttgtatttttagtagagac

SEQ ID NO: 68542 - DNA, 20 bp, Artificial Sequence
  chemically synthesized
agagacgagtttcaccatgt

SEQ ID NO: 68543 - DNA, 20 bp, Artificial Sequence
  chemically synthesized
acgagtttcaccatgttggc

SEQ ID NO: 68544 - DNA, 20 bp, Artificial Sequence
  chemically synthesized
tggtgccatcctggccaaca

SEQ ID NO: 68545 - DNA, 20 bp, Artificial Sequence
  chemically synthesized
cgagtttcaccatgttggcc

SEQ ID NO: 68546 - DNA, 20 bp, Artificial Sequence
  chemically synthesized
tttcaccatgttggccagga

SEQ ID NO: 68547 - DNA, 20 bp, Artificial Sequence
  chemically synthesized
ttataggcttggtgccatcc

SEQ ID NO: 68548 - DNA, 20 bp, Artificial Sequence
  chemically synthesized
atgttggccaggatggcacc

SEQ ID NO: 68549 - DNA, 20 bp, Artificial Sequence
  chemically synthesized
gactttagaaattataggct

SEQ ID NO: 68550 - DNA, 20 bp, Artificial Sequence
  chemically synthesized
aacaggactttagaaattat

SEQ ID NO: 68551 - DNA, 20 bp, Artificial Sequence
  chemically synthesized
aaacaggactttagaaatta

SEQ ID NO: 68552 - DNA, 20 bp, Artificial Sequence
  chemically synthesized
caccaagcctataatttcta

SEQ ID NO: 68553 - DNA, 20 bp, Artificial Sequence
  chemically synthesized
cttcaaatgaaacaggactt

SEQ ID NO: 68554 - DNA, 20 bp, Artificial Sequence
  chemically synthesized
attcaaacttcaaatgaaac

SEQ ID NO: 68555 - DNA, 20 bp, Artificial Sequence
  chemically synthesized
cattcaaacttcaaatgaaa

SEQ ID NO: 68556 - DNA, 20 bp, Artificial Sequence
  chemically synthesized
ctaaagtcctgtttcatttg

SEQ ID NO: 68557 - DNA, 20 bp, Artificial Sequence
  chemically synthesized
catttgaagtttgaatgcaa

SEQ ID NO: 68558 - DNA, 20 bp, Artificial Sequence
  chemically synthesized
tgcaaaagtactaatgactg

SEQ ID NO: 68559 - DNA, 20 bp, Artificial Sequence
  chemically synthesized
catccctcccctgcagtcat

SEQ ID NO: 68560 - DNA, 20 bp, Artificial Sequence
  chemically synthesized
gcaaaagtactaatgactgc

SEQ ID NO: 68561 - DNA, 20 bp, Artificial Sequence
  chemically synthesized
caaaagtactaatgactgca

SEQ ID NO: 68562 - DNA, 20 bp, Artificial Sequence
  chemically synthesized
aaaagtactaatgactgcag

SEQ ID NO: 68563 - DNA, 20 bp, Artificial Sequence
  chemically synthesized
aagtactaatgactgcaggg

SEQ ID NO: 68564 - DNA, 20 bp, Artificial Sequence
  chemically synthesized
agtactaatgactgcagggg

SEQ ID NO: 68565 - DNA, 20 bp, Artificial Sequence
  chemically synthesized
gtactaatgactgcagggga

SEQ ID NO: 68566 - DNA, 20 bp, Artificial Sequence
  chemically synthesized
tagaaaacatccctcccctg

SEQ ID NO: 68567 - DNA, 20 bp, Artificial Sequence
  chemically synthesized
agggatgttttctatatctt

SEQ ID NO: 68568 - DNA, 20 bp, Artificial Sequence
  chemically synthesized
tttacgtatttcttaagata

SEQ ID NO: 68569 - DNA, 20 bp, Artificial Sequence
  chemically synthesized
atattatttacgtatttctt

SEQ ID NO: 68570 - DNA, 20 bp, Artificial Sequence
  chemically synthesized
agaaatacgtaaataatatg

SEQ ID NO: 68571 - DNA, 20 bp, Artificial Sequence
  chemically synthesized
tacgtaaataatatgtggca

SEQ ID NO: 68572 - DNA, 20 bp, Artificial Sequence
  chemically synthesized
atatgtggcatagcttctga

SEQ ID NO: 68573 - DNA, 20 bp, Artificial Sequence
  chemically synthesized
ttatattgcagtactatcag

SEQ ID NO: 68574 - DNA, 20 bp, Artificial Sequence
  chemically synthesized
tagttatattgcagtactat

SEQ ID NO: 68575 - DNA, 20 bp, Artificial Sequence
  chemically synthesized
agttatagatagttatattg

SEQ ID NO: 68576 - DNA, 20 bp, Artificial Sequence
  chemically synthesized
ctgtatatattagttataga

SEQ ID NO: 68577 - DNA, 20 bp, Artificial Sequence
  chemically synthesized
tttgctgtatatattagtta

SEQ ID NO: 68578 - DNA, 20 bp, Artificial Sequence
  chemically synthesized
ctatctataactaatatata

SEQ ID NO: 68579 - DNA, 20 bp, Artificial Sequence
  chemically synthesized
aatatatttgctgtatatat

SEQ ID NO: 68580 - DNA, 20 bp, Artificial Sequence
  chemically synthesized
tctccaaaaaaaaaaaaaag

SEQ ID NO: 68581 - DNA, 20 bp, Artificial Sequence
  chemically synthesized
ctgtctccaaaaaaaaaaaa

SEQ ID NO: 68582 - DNA, 20 bp, Artificial Sequence
  chemically synthesized
tcacttcttttttttttttt

SEQ ID NO: 68583 - DNA, 20 bp, Artificial Sequence
  chemically synthesized
acttcttttttttttttttg

SEQ ID NO: 68584 - DNA, 20 bp, Artificial Sequence
  chemically synthesized
cttttttttttttttggaga

SEQ ID NO: 68585 - DNA, 20 bp, Artificial Sequence
  chemically synthesized
cactctagcctggacaagaa

SEQ ID NO: 68586 - DNA, 20 bp, Artificial Sequence
  chemically synthesized
acagtttcactattcttgtc

SEQ ID NO: 68587 - DNA, 20 bp, Artificial Sequence
  chemically synthesized
cagtttcactattcttgtcc

SEQ ID NO: 68588 - DNA, 20 bp, Artificial Sequence
  chemically synthesized
cattgcactctagcctggac

SEQ ID NO: 68589 - DNA, 20 bp, Artificial Sequence
  chemically synthesized
ttcactattcttgtccaggc

SEQ ID NO: 68590 - DNA, 20 bp, Artificial Sequence
  chemically synthesized
cactattcttgtccaggcta

SEQ ID NO: 68591 - DNA, 20 bp, Artificial Sequence
  chemically synthesized
cccaccattgcactctagcc

SEQ ID NO: 68592 - DNA, 20 bp, Artificial Sequence
  chemically synthesized
aagatcccaccattgcactc

SEQ ID NO: 68593 - DNA, 20 bp, Artificial Sequence
  chemically synthesized
ttgtccaggctagagtgcaa

SEQ ID NO: 68594 - DNA, 20 bp, Artificial Sequence
  chemically synthesized
tccaggctagagtgcaatgg

SEQ ID NO: 68595 - DNA, 20 bp, Artificial Sequence
  chemically synthesized
ccaggctagagtgcaatggt

SEQ ID NO: 68596 - DNA, 20 bp, Artificial Sequence
  chemically synthesized
agagtgcaatggtgggatct

SEQ ID NO: 68597 - DNA, 20 bp, Artificial Sequence
  chemically synthesized
ggcagaggttgcagtgagcc

SEQ ID NO: 68598 - DNA, 20 bp, Artificial Sequence
  chemically synthesized
caggaggcagaggttgcagt

SEQ ID NO: 68599 - DNA, 20 bp, Artificial Sequence
  chemically synthesized
aactcaggaggcagaggttg

SEQ ID NO: 68600 - DNA, 20 bp, Artificial Sequence
  chemically synthesized
cacttgaactcaggaggcag

SEQ ID NO: 68601 - DNA, 20 bp, Artificial Sequence
  chemically synthesized
tcacttgaactcaggaggca

SEQ ID NO: 68602 - DNA, 20 bp, Artificial Sequence
  chemically synthesized
cactgcaacctctgcctcct

SEQ ID NO: 68603 - DNA, 20 bp, Artificial Sequence
  chemically synthesized
aatcacttgaactcaggagg

SEQ ID NO: 68604 - DNA, 20 bp, Artificial Sequence
  chemically synthesized
gagaatcacttgaactcagg

SEQ ID NO: 68605 - DNA, 20 bp, Artificial Sequence
  chemically synthesized
ggagaatcacttgaactcag

SEQ ID NO: 68606 - DNA, 20 bp, Artificial Sequence
  chemically synthesized
aacctctgcctcctgagttc

SEQ ID NO: 68607 - DNA, 20 bp, Artificial Sequence
  chemically synthesized
caggagaatcacttgaactc

SEQ ID NO: 68608 - DNA, 20 bp, Artificial Sequence
  chemically synthesized
gcaggagaatcacttgaact

SEQ ID NO: 68609 - DNA, 20 bp, Artificial Sequence
  chemically synthesized
ttcaagtgattctcctgcct

SEQ ID NO: 68610 - DNA, 20 bp, Artificial Sequence
  chemically synthesized
tactcaggaggctgaggcag

SEQ ID NO: 68611 - DNA, 20 bp, Artificial Sequence
  chemically synthesized
gctactcaggaggctgaggc

SEQ ID NO: 68612 - DNA, 20 bp, Artificial Sequence
  chemically synthesized
agctactcaggaggctgagg

SEQ ID NO: 68613 - DNA, 20 bp, Artificial Sequence
  chemically synthesized
cctagctactcaggaggctg

SEQ ID NO: 68614 - DNA, 20 bp, Artificial Sequence
  chemically synthesized
tcctagctactcaggaggct

SEQ ID NO: 68615 - DNA, 20 bp, Artificial Sequence
  chemically synthesized
ttctcctgcctcagcctcct

SEQ ID NO: 68616 - DNA, 20 bp, Artificial Sequence
  chemically synthesized
tcctgcctcagcctcctgag

SEQ ID NO: 68617 - DNA, 20 bp, Artificial Sequence
  chemically synthesized
tataatcctagctactcagg

SEQ ID NO: 68618 - DNA, 20 bp, Artificial Sequence
  chemically synthesized
ctataatcctagctactcag

SEQ ID NO: 68619 - DNA, 20 bp, Artificial Sequence
  chemically synthesized
gcctcagcctcctgagtagc

SEQ ID NO: 68620 - DNA, 20 bp, Artificial Sequence
  chemically synthesized
acctataatcctagctactc

SEQ ID NO: 68621 - DNA, 20 bp, Artificial Sequence
  chemically synthesized
cctcagcctcctgagtagct

SEQ ID NO: 68622 - DNA, 20 bp, Artificial Sequence
  chemically synthesized
tacctataatcctagctact

SEQ ID NO: 68623 - DNA, 20 bp, Artificial Sequence
  chemically synthesized
ctcctgagtagctaggatta

SEQ ID NO: 68624 - DNA, 20 bp, Artificial Sequence
  chemically synthesized
tcctgagtagctaggattat

SEQ ID NO: 68625 - DNA, 20 bp, Artificial Sequence
  chemically synthesized
gtggtgggtacctataatcc

SEQ ID NO: 68626 - DNA, 20 bp, Artificial Sequence
  chemically synthesized
aattagccgggcatggtggt

SEQ ID NO: 68627 - DNA, 20 bp, Artificial Sequence
  chemically synthesized
aaattagccgggcatggtgg

SEQ ID NO: 68628 - DNA, 20 bp, Artificial Sequence
  chemically synthesized
taggtacccaccaccatgcc

SEQ ID NO: 68629 - DNA, 20 bp, Artificial Sequence
  chemically synthesized
aaaaaattagccgggcatgg

SEQ ID NO: 68630 - DNA, 20 bp, Artificial Sequence
  chemically synthesized
tacaaaaaattagccgggca

SEQ ID NO: 68631 - DNA, 20 bp, Artificial Sequence
  chemically synthesized
aaaaatacaaaaaattagcc

SEQ ID NO: 68632 - DNA, 20 bp, Artificial Sequence
  chemically synthesized
taaaaatacaaaaaattagc

SEQ ID NO: 68633 - DNA, 20 bp, Artificial Sequence
  chemically synthesized
ctactaaaaatacaaaaaat

SEQ ID NO: 68634 - DNA, 20 bp, Artificial Sequence
  chemically synthesized
cggctaattttttgtatttt

SEQ ID NO: 68635 - DNA, 20 bp, Artificial Sequence
  chemically synthesized
ctaattttttgtatttttag

SEQ ID NO: 68636 - DNA, 20 bp, Artificial Sequence
  chemically synthesized
aattttttgtatttttagta

SEQ ID NO: 68637 - DNA, 20 bp, Artificial Sequence
  chemically synthesized
ttttgtatttttagtagaga

SEQ ID NO: 68638 - DNA, 20 bp, Artificial Sequence
  chemically synthesized
tttgtatttttagtagagac

SEQ ID NO: 68639 - DNA, 20 bp, Artificial Sequence
  chemically synthesized
ttgtatttttagtagagacg

SEQ ID NO: 68640 - DNA, 20 bp, Artificial Sequence
  chemically synthesized
gagacggggttccaccatgt

SEQ ID NO: 68641 - DNA, 20 bp, Artificial Sequence
  chemically synthesized
gaccagcctggccaacatgg

SEQ ID NO: 68642 - DNA, 20 bp, Artificial Sequence
  chemically synthesized
cggggttccaccatgttggc

SEQ ID NO: 68643 - DNA, 20 bp, Artificial Sequence
  chemically synthesized
cgagaccagcctggccaaca

SEQ ID NO: 68644 - DNA, 20 bp, Artificial Sequence
  chemically synthesized
ggggttccaccatgttggcc

SEQ ID NO: 68645 - DNA, 20 bp, Artificial Sequence
  chemically synthesized
ttccaccatgttggccaggc

SEQ ID NO: 68646 - DNA, 20 bp, Artificial Sequence
  chemically synthesized
tcaggagttcgagaccagcc

SEQ ID NO: 68647 - DNA, 20 bp, Artificial Sequence
  chemically synthesized
tgaggtcaggagttcgagac

SEQ ID NO: 68648 - DNA, 20 bp, Artificial Sequence
  chemically synthesized
tcacctgaggtcaggagttc

SEQ ID NO: 68649 - DNA, 20 bp, Artificial Sequence
  chemically synthesized
tggtctcgaactcctgacct

SEQ ID NO: 68650 - DNA, 20 bp, Artificial Sequence
  chemically synthesized
ggtggatcacctgaggtcag

SEQ ID NO: 68651 - DNA, 20 bp, Artificial Sequence
  chemically synthesized
ggtctcgaactcctgacctc

SEQ ID NO: 68652 - DNA, 20 bp, Artificial Sequence
  chemically synthesized
tgggtggatcacctgaggtc

SEQ ID NO: 68653 - DNA, 20 bp, Artificial Sequence
  chemically synthesized
gtgggtggatcacctgaggt

SEQ ID NO: 68654 - DNA, 20 bp, Artificial Sequence
  chemically synthesized
cacagtgggtggatcacctg

SEQ ID NO: 68655 - DNA, 20 bp, Artificial Sequence
  chemically synthesized
ccacagtgggtggatcacct

SEQ ID NO: 68656 - DNA, 20 bp, Artificial Sequence
  chemically synthesized
ctcaggtgatccacccactg

SEQ ID NO: 68657 - DNA, 20 bp, Artificial Sequence
  chemically synthesized
ctttgggaggccacagtggg

SEQ ID NO: 68658 - DNA, 20 bp, Artificial Sequence
  chemically synthesized
gcactttgggaggccacagt

SEQ ID NO: 68659 - DNA, 20 bp, Artificial Sequence
  chemically synthesized
agcactttgggaggccacag

SEQ ID NO: 68660 - DNA, 20 bp, Artificial Sequence
  chemically synthesized
cccagcactttgggaggcca

SEQ ID NO: 68661 - DNA, 20 bp, Artificial Sequence
  chemically synthesized
ccacccactgtggcctccca

SEQ ID NO: 68662 - DNA, 20 bp, Artificial Sequence
  chemically synthesized
tgtaatcccagcactttggg

SEQ ID NO: 68663 - DNA, 20 bp, Artificial Sequence
  chemically synthesized
ctgtaatcccagcactttgg

SEQ ID NO: 68664 - DNA, 20 bp, Artificial Sequence
  chemically synthesized
actgtggcctcccaaagtgc

SEQ ID NO: 68665 - DNA, 20 bp, Artificial Sequence
  chemically synthesized
gcctgtaatcccagcacttt

SEQ ID NO: 68666 - DNA, 20 bp, Artificial Sequence
  chemically synthesized
ctgtggcctcccaaagtgct

SEQ ID NO: 68667 - DNA, 20 bp, Artificial Sequence
  chemically synthesized
cgcctgtaatcccagcactt

SEQ ID NO: 68668 - DNA, 20 bp, Artificial Sequence
  chemically synthesized
ctcccaaagtgctgggatta

SEQ ID NO: 68669 - DNA, 20 bp, Artificial Sequence
  chemically synthesized
tcccaaagtgctgggattac

SEQ ID NO: 68670 - DNA, 20 bp, Artificial Sequence
  chemically synthesized
gtggctcacgcctgtaatcc

SEQ ID NO: 68671 - DNA, 20 bp, Artificial Sequence
  chemically synthesized
agtgctgggattacaggcgt

SEQ ID NO: 68672 - DNA, 20 bp, Artificial Sequence
  chemically synthesized
caggcgtgagccaccgtgcc

SEQ ID NO: 68673 - DNA, 20 bp, Artificial Sequence
  chemically synthesized
aataatagggccaggcacgg

SEQ ID NO: 68674 - DNA, 20 bp, Artificial Sequence
  chemically synthesized
agtaataatagggccaggca

SEQ ID NO: 68675 - DNA, 20 bp, Artificial Sequence
  chemically synthesized
tgcagagtaataatagggcc

SEQ ID NO: 68676 - DNA, 20 bp, Artificial Sequence
  chemically synthesized
atgcagagtaataatagggc

SEQ ID NO: 68677 - DNA, 20 bp, Artificial Sequence
  chemically synthesized
aaacatgcagagtaataata

SEQ ID NO: 68678 - DNA, 20 bp, Artificial Sequence
  chemically synthesized
gaaacatgcagagtaataat

SEQ ID NO: 68679 - DNA, 20 bp, Artificial Sequence
  chemically synthesized
agaaacatgcagagtaataa

SEQ ID NO: 68680 - DNA, 20 bp, Artificial Sequence
  chemically synthesized
gatctctgcagaaacatgca

SEQ ID NO: 68681 - DNA, 20 bp, Artificial Sequence
  chemically synthesized
cagatctctgcagaaacatg

SEQ ID NO: 68682 - DNA, 20 bp, Artificial Sequence
  chemically synthesized
tattactctgcatgtttctg

SEQ ID NO: 68683 - DNA, 20 bp, Artificial Sequence
  chemically synthesized
ttactctgcatgtttctgca

SEQ ID NO: 68684 - DNA, 20 bp, Artificial Sequence
  chemically synthesized
taattttctacagatctctg

SEQ ID NO: 68685 - DNA, 20 bp, Artificial Sequence
  chemically synthesized
catgtttctgcagagatctg

SEQ ID NO: 68686 - DNA, 20 bp, Artificial Sequence
  chemically synthesized
tttttttttttaattttcta

SEQ ID NO: 68687 - DNA, 20 bp, Artificial Sequence
  chemically synthesized
aaaattaaaaaaaaaaaaaa

SEQ ID NO: 68688 - DNA, 20 bp, Artificial Sequence
  chemically synthesized
aaaaaaaaaaaaaagaatgc

SEQ ID NO: 68689 - DNA, 20 bp, Artificial Sequence
  chemically synthesized
aatctactccatttataagc

SEQ ID NO: 68690 - DNA, 20 bp, Artificial Sequence
  chemically synthesized
aaagaatgctggcttataaa

SEQ ID NO: 68691 - DNA, 20 bp, Artificial Sequence
  chemically synthesized
agaatgctggcttataaatg

SEQ ID NO: 68692 - DNA, 20 bp, Artificial Sequence
  chemically synthesized
agaaaatctactccatttat

SEQ ID NO: 68693 - DNA, 20 bp, Artificial Sequence
  chemically synthesized
atgctggcttataaatggag

SEQ ID NO: 68694 - DNA, 20 bp, Artificial Sequence
  chemically synthesized
tataaatggagtagattttc

SEQ ID NO: 68695 - DNA, 20 bp, Artificial Sequence
  chemically synthesized
ggactaaaacattcattttc

SEQ ID NO: 68696 - DNA, 20 bp, Artificial Sequence
  chemically synthesized
tttctggaaaatgaatgttt

SEQ ID NO: 68697 - DNA, 20 bp, Artificial Sequence
  chemically synthesized
aaatgaatgttttagtccgt

SEQ ID NO: 68698 - DNA, 20 bp, Artificial Sequence
  chemically synthesized
attttgttatagcattccaa

SEQ ID NO: 68699 - DNA, 20 bp, Artificial Sequence
  chemically synthesized
cagtttatgatattttgtta

SEQ ID NO: 68700 - DNA, 20 bp, Artificial Sequence
  chemically synthesized
tataacaaaatatcataaac

SEQ ID NO: 68701 - DNA, 20 bp, Artificial Sequence
  chemically synthesized
ataacaaaatatcataaact

SEQ ID NO: 68702 - DNA, 20 bp, Artificial Sequence
  chemically synthesized
acaaaatatcataaactggg

SEQ ID NO: 68703 - DNA, 20 bp, Artificial Sequence
  chemically synthesized
ttggttgtctataagccacc

SEQ ID NO: 68704 - DNA, 20 bp, Artificial Sequence
  chemically synthesized
atcataaactgggtggctta

SEQ ID NO: 68705 - DNA, 20 bp, Artificial Sequence
  chemically synthesized
aaaaaactttggttgtctat

SEQ ID NO: 68706 - DNA, 20 bp, Artificial Sequence
  chemically synthesized
gggtggcttatagacaacca

SEQ ID NO: 68707 - DNA, 20 bp, Artificial Sequence
  chemically synthesized
gaattgtgagaaaaaaactt

SEQ ID NO: 68708 - DNA, 20 bp, Artificial Sequence
  chemically synthesized
ttcctagccttcagaattgt

SEQ ID NO: 68709 - DNA, 20 bp, Artificial Sequence
  chemically synthesized
gtttttttctcacaattctg

SEQ ID NO: 68710 - DNA, 20 bp, Artificial Sequence
  chemically synthesized
tttttttctcacaattctga

SEQ ID NO: 68711 - DNA, 20 bp, Artificial Sequence
  chemically synthesized
tttctcacaattctgaaggc

SEQ ID NO: 68712 - DNA, 20 bp, Artificial Sequence
  chemically synthesized
ttctcacaattctgaaggct

SEQ ID NO: 68713 - DNA, 20 bp, Artificial Sequence
  chemically synthesized
atatcagacttcctagcctt

SEQ ID NO: 68714 - DNA, 20 bp, Artificial Sequence
  chemically synthesized
tcacaattctgaaggctagg

SEQ ID NO: 68715 - DNA, 20 bp, Artificial Sequence
  chemically synthesized
cgccttgatatcagacttcc

SEQ ID NO: 68716 - DNA, 20 bp, Artificial Sequence
  chemically synthesized
aggctaggaagtctgatatc

SEQ ID NO: 68717 - DNA, 20 bp, Artificial Sequence
  chemically synthesized
ggctaggaagtctgatatca

SEQ ID NO: 68718 - DNA, 20 bp, Artificial Sequence
  chemically synthesized
atctgccagcgccttgatat

SEQ ID NO: 68719 - DNA, 20 bp, Artificial Sequence
  chemically synthesized
gaagtctgatatcaaggcgc

SEQ ID NO: 68720 - DNA, 20 bp, Artificial Sequence
  chemically synthesized
gtctgatatcaaggcgctgg

SEQ ID NO: 68721 - DNA, 20 bp, Artificial Sequence
  chemically synthesized
tatcaaggcgctggcagatt

SEQ ID NO: 68722 - DNA, 20 bp, Artificial Sequence
  chemically synthesized
tcaccaaacactgaatctgc

SEQ ID NO: 68723 - DNA, 20 bp, Artificial Sequence
  chemically synthesized
gcgctggcagattcagtgtt

SEQ ID NO: 68724 - DNA, 20 bp, Artificial Sequence
  chemically synthesized
ggcagattcagtgtttggtg

SEQ ID NO: 68725 - DNA, 20 bp, Artificial Sequence
  chemically synthesized
gcagattcagtgtttggtga

SEQ ID NO: 68726 - DNA, 20 bp, Artificial Sequence
  chemically synthesized
ctatctatgaacaagaaagc

SEQ ID NO: 68727 - DNA, 20 bp, Artificial Sequence
  chemically synthesized
gctatctatgaacaagaaag

SEQ ID NO: 68728 - DNA, 20 bp, Artificial Sequence
  chemically synthesized
ggtgctatctatgaacaaga

SEQ ID NO: 68729 - DNA, 20 bp, Artificial Sequence
  chemically synthesized
aaggcctgctttcttgttca

SEQ ID NO: 68730 - DNA, 20 bp, Artificial Sequence
  chemically synthesized
agaaggtgctatctatgaac

SEQ ID NO: 68731 - DNA, 20 bp, Artificial Sequence
  chemically synthesized
cctgctttcttgttcataga

SEQ ID NO: 68732 - DNA, 20 bp, Artificial Sequence
  chemically synthesized
tttgccatgagaacacaaga

SEQ ID NO: 68733 - DNA, 20 bp, Artificial Sequence
  chemically synthesized
ttttgccatgagaacacaag

SEQ ID NO: 68734 - DNA, 20 bp, Artificial Sequence
  chemically synthesized
cctttttgccatgagaacac

SEQ ID NO: 68735 - DNA, 20 bp, Artificial Sequence
  chemically synthesized
agcaccttcttgtgttctca

SEQ ID NO: 68736 - DNA, 20 bp, Artificial Sequence
  chemically synthesized
tgctttgccctttttgccat

SEQ ID NO: 68737 - DNA, 20 bp, Artificial Sequence
  chemically synthesized
tcttgtgttctcatggcaaa

SEQ ID NO: 68738 - DNA, 20 bp, Artificial Sequence
  chemically synthesized
cttgtgttctcatggcaaaa

SEQ ID NO: 68739 - DNA, 20 bp, Artificial Sequence
  chemically synthesized
ttgtgttctcatggcaaaaa

SEQ ID NO: 68740 - DNA, 20 bp, Artificial Sequence
  chemically synthesized
ttctcatggcaaaaagggca

SEQ ID NO: 68741 - DNA, 20 bp, Artificial Sequence
  chemically synthesized
tcatggcaaaaagggcaaag

SEQ ID NO: 68742 - DNA, 20 bp, Artificial Sequence
  chemically synthesized
aaaagggcaaagcagctctc

SEQ ID NO: 68743 - DNA, 20 bp, Artificial Sequence
  chemically synthesized
aaagggcaaagcagctctct

SEQ ID NO: 68744 - DNA, 20 bp, Artificial Sequence
  chemically synthesized
ccttataaaagagacccaga

SEQ ID NO: 68745 - DNA, 20 bp, Artificial Sequence
  chemically synthesized
acccttataaaagagaccca

SEQ ID NO: 68746 - DNA, 20 bp, Artificial Sequence
  chemically synthesized
gaacccttataaaagagacc

SEQ ID NO: 68747 - DNA, 20 bp, Artificial Sequence
  chemically synthesized
gctctctgggtctcttttat

SEQ ID NO: 68748 - DNA, 20 bp, Artificial Sequence
  chemically synthesized
ctctctgggtctcttttata

SEQ ID NO: 68749 - DNA, 20 bp, Artificial Sequence
  chemically synthesized
agattagaacccttataaaa

SEQ ID NO: 68750 - DNA, 20 bp, Artificial Sequence
  chemically synthesized
tctctgggtctcttttataa

SEQ ID NO: 68751 - DNA, 20 bp, Artificial Sequence
  chemically synthesized
tgagattagaacccttataa

SEQ ID NO: 68752 - DNA, 20 bp, Artificial Sequence
  chemically synthesized
agagcccacatgaatgagat

SEQ ID NO: 68753 - DNA, 20 bp, Artificial Sequence
  chemically synthesized
gggttctaatctcattcatg

SEQ ID NO: 68754 - DNA, 20 bp, Artificial Sequence
  chemically synthesized
agggcagagcccacatgaat

SEQ ID NO: 68755 - DNA, 20 bp, Artificial Sequence
  chemically synthesized
ggttctaatctcattcatgt

SEQ ID NO: 68756 - DNA, 20 bp, Artificial Sequence
  chemically synthesized
gtgattagatcatgagggca

SEQ ID NO: 68757 - DNA, 20 bp, Artificial Sequence
  chemically synthesized
aggtgattagatcatgaggg

SEQ ID NO: 68758 - DNA, 20 bp, Artificial Sequence
  chemically synthesized
gggaggtgattagatcatga

SEQ ID NO: 68759 - DNA, 20 bp, Artificial Sequence
  chemically synthesized
tgggaggtgattagatcatg

SEQ ID NO: 68760 - DNA, 20 bp, Artificial Sequence
  chemically synthesized
ttgggaggtgattagatcat

SEQ ID NO: 68761 - DNA, 20 bp, Artificial Sequence
  chemically synthesized
taggccccttgggaggtgat

SEQ ID NO: 68762 - DNA, 20 bp, Artificial Sequence
  chemically synthesized
tcatgatctaatcacctccc

SEQ ID NO: 68763 - DNA, 20 bp, Artificial Sequence
  chemically synthesized
catgatctaatcacctccca

SEQ ID NO: 68764 - DNA, 20 bp, Artificial Sequence
  chemically synthesized
atgatctaatcacctcccaa

SEQ ID NO: 68765 - DNA, 20 bp, Artificial Sequence
  chemically synthesized
tgatctaatcacctcccaag

SEQ ID NO: 68766 - DNA, 20 bp, Artificial Sequence
  chemically synthesized
taggaggtaggccccttggg

SEQ ID NO: 68767 - DNA, 20 bp, Artificial Sequence
  chemically synthesized
ttaggaggtaggccccttgg

SEQ ID NO: 68768 - DNA, 20 bp, Artificial Sequence
  chemically synthesized
tattaggaggtaggcccctt

SEQ ID NO: 68769 - DNA, 20 bp, Artificial Sequence
  chemically synthesized
gtattaggaggtaggcccct

SEQ ID NO: 68770 - DNA, 20 bp, Artificial Sequence
  chemically synthesized
atatgatggtattaggaggt

SEQ ID NO: 68771 - DNA, 20 bp, Artificial Sequence
  chemically synthesized
tatatgatggtattaggagg

SEQ ID NO: 68772 - DNA, 20 bp, Artificial Sequence
  chemically synthesized
ccatatatgatggtattagg

SEQ ID NO: 68773 - DNA, 20 bp, Artificial Sequence
  chemically synthesized
tccatatatgatggtattag

SEQ ID NO: 68774 - DNA, 20 bp, Artificial Sequence
  chemically synthesized
attccatatatgatggtatt

SEQ ID NO: 68775 - DNA, 20 bp, Artificial Sequence
  chemically synthesized
aattccatatatgatggtat

SEQ ID NO: 68776 - DNA, 20 bp, Artificial Sequence
  chemically synthesized
cctcctaataccatcatata

SEQ ID NO: 68777 - DNA, 20 bp, Artificial Sequence
  chemically synthesized
aaacctaattccatatatga

SEQ ID NO: 68778 - DNA, 20 bp, Artificial Sequence
  chemically synthesized
aataccatcatatatggaat

SEQ ID NO: 68779 - DNA, 20 bp, Artificial Sequence
  chemically synthesized
ataccatcatatatggaatt

SEQ ID NO: 68780 - DNA, 20 bp, Artificial Sequence
  chemically synthesized
gtctccccaaaattcatatg

SEQ ID NO: 68781 - DNA, 20 bp, Artificial Sequence
  chemically synthesized
aggtttccacatatgaattt

SEQ ID NO: 68782 - DNA, 20 bp, Artificial Sequence
  chemically synthesized
ggtttccacatatgaatttt

SEQ ID NO: 68783 - DNA, 20 bp, Artificial Sequence
  chemically synthesized
gtttccacatatgaattttg

SEQ ID NO: 68784 - DNA, 20 bp, Artificial Sequence
  chemically synthesized
ttccacatatgaattttggg

SEQ ID NO: 68785 - DNA, 20 bp, Artificial Sequence
  chemically synthesized
ttggggagacacaaatattc

SEQ ID NO: 68786 - DNA, 20 bp, Artificial Sequence
  chemically synthesized
agacacaaatattcaagcca

SEQ ID NO: 68787 - DNA, 20 bp, Artificial Sequence
  chemically synthesized
cacaaatattcaagccacag

SEQ ID NO: 68788 - DNA, 20 bp, Artificial Sequence
  chemically synthesized
aatattcaagccacagcagt

SEQ ID NO: 68789 - DNA, 20 bp, Artificial Sequence
  chemically synthesized
ttgtgattgccttactgctg

SEQ ID NO: 68790 - DNA, 20 bp, Artificial Sequence
  chemically synthesized
atattcaagccacagcagta

SEQ ID NO: 68791 - DNA, 20 bp, Artificial Sequence
  chemically synthesized
gcagtaaggcaatcacaaaa

SEQ ID NO: 68792 - DNA, 20 bp, Artificial Sequence
  chemically synthesized
cagtaaggcaatcacaaaat

SEQ ID NO: 68793 - DNA, 20 bp, Artificial Sequence
  chemically synthesized
agtaaggcaatcacaaaata

SEQ ID NO: 68794 - DNA, 20 bp, Artificial Sequence
  chemically synthesized
aaggcaatcacaaaataggg

SEQ ID NO: 68795 - DNA, 20 bp, Artificial Sequence
  chemically synthesized
caatcacaaaatagggcagt

SEQ ID NO: 68796 - DNA, 20 bp, Artificial Sequence
  chemically synthesized
aaaatagggcagttagattt

SEQ ID NO: 68797 - DNA, 20 bp, Artificial Sequence
  chemically synthesized
tagatttaagtgtaatatac

SEQ ID NO: 68798 - DNA, 20 bp, Artificial Sequence
  chemically synthesized
agatttaagtgtaatatact

SEQ ID NO: 68799 - DNA, 20 bp, Artificial Sequence
  chemically synthesized
gatttaagtgtaatatacta

SEQ ID NO: 68800 - DNA, 20 bp, Artificial Sequence
  chemically synthesized
tctctctcattgtcattccc

SEQ ID NO: 68801 - DNA, 20 bp, Artificial Sequence
  chemically synthesized
atatactagggaatgacaat

SEQ ID NO: 68802 - DNA, 20 bp, Artificial Sequence
  chemically synthesized
atactagggaatgacaatga

SEQ ID NO: 68803 - DNA, 20 bp, Artificial Sequence
  chemically synthesized
actagggaatgacaatgaga

SEQ ID NO: 68804 - DNA, 20 bp, Artificial Sequence
  chemically synthesized
tgatgataggggagaaggca

SEQ ID NO: 68805 - DNA, 20 bp, Artificial Sequence
  chemically synthesized
ttccctgatgataggggaga

SEQ ID NO: 68806 - DNA, 20 bp, Artificial Sequence
  chemically synthesized
cttccctgatgataggggag

SEQ ID NO: 68807 - DNA, 20 bp, Artificial Sequence
  chemically synthesized
taccttccctgatgataggg

SEQ ID NO: 68808 - DNA, 20 bp, Artificial Sequence
  chemically synthesized
tttgccttctcccctatcat

SEQ ID NO: 68809 - DNA, 20 bp, Artificial Sequence
  chemically synthesized
ggtaccttccctgatgatag

SEQ ID NO: 68810 - DNA, 20 bp, Artificial Sequence
  chemically synthesized
ttgccttctcccctatcatc

SEQ ID NO: 68811 - DNA, 20 bp, Artificial Sequence
  chemically synthesized
aggtaccttccctgatgata

SEQ ID NO: 68812 - DNA, 20 bp, Artificial Sequence
  chemically synthesized
tgccttctcccctatcatca

SEQ ID NO: 68813 - DNA, 20 bp, Artificial Sequence
  chemically synthesized
taggtaccttccctgatgat

SEQ ID NO: 68814 - DNA, 20 bp, Artificial Sequence
  chemically synthesized
ttaggtaccttccctgatga

SEQ ID NO: 68815 - DNA, 20 bp, Artificial Sequence
  chemically synthesized
cttctcccctatcatcaggg

SEQ ID NO: 68816 - DNA, 20 bp, Artificial Sequence
  chemically synthesized
ttctcccctatcatcaggga

SEQ ID NO: 68817 - DNA, 20 bp, Artificial Sequence
  chemically synthesized
catgtggccttggagcagtt

SEQ ID NO: 68818 - DNA, 20 bp, Artificial Sequence
  chemically synthesized
tcatgtggccttggagcagt

SEQ ID NO: 68819 - DNA, 20 bp, Artificial Sequence
  chemically synthesized
ggaaggtacctaactgctcc

SEQ ID NO: 68820 - DNA, 20 bp, Artificial Sequence
  chemically synthesized
gaaggtacctaactgctcca

SEQ ID NO: 68821 - DNA, 20 bp, Artificial Sequence
  chemically synthesized
ggagtcatgtggccttggag

SEQ ID NO: 68822 - DNA, 20 bp, Artificial Sequence
  chemically synthesized
catggagtcatgtggccttg

SEQ ID NO: 68823 - DNA, 20 bp, Artificial Sequence
  chemically synthesized
cgcatggagtcatgtggcct

SEQ ID NO: 68824 - DNA, 20 bp, Artificial Sequence
  chemically synthesized
ttggtgcgcatggagtcatg

SEQ ID NO: 68825 - DNA, 20 bp, Artificial Sequence
  chemically synthesized
ttttgctattggtgcgcatg

SEQ ID NO: 68826 - DNA, 20 bp, Artificial Sequence
  chemically synthesized
gtttttgctattggtgcgca

SEQ ID NO: 68827 - DNA, 20 bp, Artificial Sequence
  chemically synthesized
catgactccatgcgcaccaa

SEQ ID NO: 68828 - DNA, 20 bp, Artificial Sequence
  chemically synthesized
ttggatgtagtttttgctat

SEQ ID NO: 68829 - DNA, 20 bp, Artificial Sequence
  chemically synthesized
aacctataaagcattggatg

SEQ ID NO: 68830 - DNA, 20 bp, Artificial Sequence
  chemically synthesized
tttcctaacctataaagcat

SEQ ID NO: 68831 - DNA, 20 bp, Artificial Sequence
  chemically synthesized
aaactacatccaatgcttta

SEQ ID NO: 68832 - DNA, 20 bp, Artificial Sequence
  chemically synthesized
aactacatccaatgctttat

SEQ ID NO: 68833 - DNA, 20 bp, Artificial Sequence
  chemically synthesized
acatccaatgctttataggt

SEQ ID NO: 68834 - DNA, 20 bp, Artificial Sequence
  chemically synthesized
ctgtactttcctaacctata

SEQ ID NO: 68835 - DNA, 20 bp, Artificial Sequence
  chemically synthesized
catccaatgctttataggtt

SEQ ID NO: 68836 - DNA, 20 bp, Artificial Sequence
  chemically synthesized
caatgctttataggttagga

SEQ ID NO: 68837 - DNA, 20 bp, Artificial Sequence
  chemically synthesized
ctttataggttaggaaagta

SEQ ID NO: 68838 - DNA, 20 bp, Artificial Sequence
  chemically synthesized
tttataggttaggaaagtac

SEQ ID NO: 68839 - DNA, 20 bp, Artificial Sequence
  chemically synthesized
aagtgagcacatataagtgt

SEQ ID NO: 68840 - DNA, 20 bp, Artificial Sequence
  chemically synthesized
gaagtgagcacatataagtg

SEQ ID NO: 68841 - DNA, 20 bp, Artificial Sequence
  chemically synthesized
aaatggaagtgagcacatat

SEQ ID NO: 68842 - DNA, 20 bp, Artificial Sequence
  chemically synthesized
gggcagcaagaaatggaagt

SEQ ID NO: 68843 - DNA, 20 bp, Artificial Sequence
  chemically synthesized
agaggggcagcaagaaatgg

SEQ ID NO: 68844 - DNA, 20 bp, Artificial Sequence
  chemically synthesized
aagagaggggcagcaagaaa

SEQ ID NO: 68845 - DNA, 20 bp, Artificial Sequence
  chemically synthesized
taaataaagagaggggcagc

SEQ ID NO: 68846 - DNA, 20 bp, Artificial Sequence
  chemically synthesized
ttcgtaaataaagagagggg

SEQ ID NO: 68847 - DNA, 20 bp, Artificial Sequence
  chemically synthesized
cctttcgtaaataaagagag

SEQ ID NO: 68848 - DNA, 20 bp, Artificial Sequence
  chemically synthesized
tcctttcgtaaataaagaga

SEQ ID NO: 68849 - DNA, 20 bp, Artificial Sequence
  chemically synthesized
atcctttcgtaaataaagag

SEQ ID NO: 68850 - DNA, 20 bp, Artificial Sequence
  chemically synthesized
catcctttcgtaaataaaga

SEQ ID NO: 68851 - DNA, 20 bp, Artificial Sequence
  chemically synthesized
ctcatcctttcgtaaataaa

SEQ ID NO: 68852 - DNA, 20 bp, Artificial Sequence
  chemically synthesized
ttctcatcctttcgtaaata

SEQ ID NO: 68853 - DNA, 20 bp, Artificial Sequence
  chemically synthesized
gcccctctctttatttacga

SEQ ID NO: 68854 - DNA, 20 bp, Artificial Sequence
  chemically synthesized
cccctctctttatttacgaa

SEQ ID NO: 68855 - DNA, 20 bp, Artificial Sequence
  chemically synthesized
ctctttatttacgaaaggat

SEQ ID NO: 68856 - DNA, 20 bp, Artificial Sequence
  chemically synthesized
aggatgagaacttgatccac

SEQ ID NO: 68857 - DNA, 20 bp, Artificial Sequence
  chemically synthesized
aatgaaatcacttgtggatc

SEQ ID NO: 68858 - DNA, 20 bp, Artificial Sequence
  chemically synthesized
catctcaatgaaatcacttg

SEQ ID NO: 68859 - DNA, 20 bp, Artificial Sequence
  chemically synthesized
gatccacaagtgatttcatt

SEQ ID NO: 68860 - DNA, 20 bp, Artificial Sequence
  chemically synthesized
cttctctttggataaaataa

SEQ ID NO: 68861 - DNA, 20 bp, Artificial Sequence
  chemically synthesized
cacttctctttggataaaat

SEQ ID NO: 68862 - DNA, 20 bp, Artificial Sequence
  chemically synthesized
tgtaactcttattttatcca

SEQ ID NO: 68863 - DNA, 20 bp, Artificial Sequence
  chemically synthesized
taactcttattttatccaaa

SEQ ID NO: 68864 - DNA, 20 bp, Artificial Sequence
  chemically synthesized
ctcttattttatccaaagag

SEQ ID NO: 68865 - DNA, 20 bp, Artificial Sequence
  chemically synthesized
catgttccaacacttctctt

SEQ ID NO: 68866 - DNA, 20 bp, Artificial Sequence
  chemically synthesized
ttttatccaaagagaagtgt

SEQ ID NO: 68867 - DNA, 20 bp, Artificial Sequence
  chemically synthesized
ttggaacatgctttgattat

SEQ ID NO: 68868 - DNA, 20 bp, Artificial Sequence
  chemically synthesized
gagccctcacctgataatca

SEQ ID NO: 68869 - DNA, 20 bp, Artificial Sequence
  chemically synthesized
tggaacatgctttgattatc

SEQ ID NO: 68870 - DNA, 20 bp, Artificial Sequence
  chemically synthesized
acatgctttgattatcaggt

SEQ ID NO: 68871 - DNA, 20 bp, Artificial Sequence
  chemically synthesized
catgctttgattatcaggtg

SEQ ID NO: 68872 - DNA, 20 bp, Artificial Sequence
  chemically synthesized
atgctttgattatcaggtga

SEQ ID NO: 68873 - DNA, 20 bp, Artificial Sequence
  chemically synthesized
tttgcatgaaaatgtgcaca

SEQ ID NO: 68874 - DNA, 20 bp, Artificial Sequence
  chemically synthesized
catttgcatgaaaatgtgca

SEQ ID NO: 68875 - DNA, 20 bp, Artificial Sequence
  chemically synthesized
acattttcatgcaaatgtct

SEQ ID NO: 68876 - DNA, 20 bp, Artificial Sequence
  chemically synthesized
ttcatgcaaatgtcttagat

SEQ ID NO: 68877 - DNA, 20 bp, Artificial Sequence
  chemically synthesized
tggaggagagttaccaatct

SEQ ID NO: 68878 - DNA, 20 bp, Artificial Sequence
  chemically synthesized
gtcttgcattcattggagga

SEQ ID NO: 68879 - DNA, 20 bp, Artificial Sequence
  chemically synthesized
aggtcttgcattcattggag

SEQ ID NO: 68880 - DNA, 20 bp, Artificial Sequence
  chemically synthesized
gaaggtcttgcattcattgg

SEQ ID NO: 68881 - DNA, 20 bp, Artificial Sequence
  chemically synthesized
agaaggtcttgcattcattg

SEQ ID NO: 68882 - DNA, 20 bp, Artificial Sequence
  chemically synthesized
gcagaaggtcttgcattcat

SEQ ID NO: 68883 - DNA, 20 bp, Artificial Sequence
  chemically synthesized
aactctcctccaatgaatgc

SEQ ID NO: 68884 - DNA, 20 bp, Artificial Sequence
  chemically synthesized
tagtcatcaccgaaggcaga

SEQ ID NO: 68885 - DNA, 20 bp, Artificial Sequence
  chemically synthesized
aatgcaagaccttctgcctt

SEQ ID NO: 68886 - DNA, 20 bp, Artificial Sequence
  chemically synthesized
ttagtcatcaccgaaggcag

SEQ ID NO: 68887 - DNA, 20 bp, Artificial Sequence
  chemically synthesized
accttagtcatcaccgaagg

SEQ ID NO: 68888 - DNA, 20 bp, Artificial Sequence
  chemically synthesized
accaccttagtcatcaccga

SEQ ID NO: 68889 - DNA, 20 bp, Artificial Sequence
  chemically synthesized
taccaccttagtcatcaccg

SEQ ID NO: 68890 - DNA, 20 bp, Artificial Sequence
  chemically synthesized
ttctgccttcggtgatgact

SEQ ID NO: 68891 - DNA, 20 bp, Artificial Sequence
  chemically synthesized
tctgccttcggtgatgacta

SEQ ID NO: 68892 - DNA, 20 bp, Artificial Sequence
  chemically synthesized
gccttcggtgatgactaagg

SEQ ID NO: 68893 - DNA, 20 bp, Artificial Sequence
  chemically synthesized
cctgataactgttaccacct

SEQ ID NO: 68894 - DNA, 20 bp, Artificial Sequence
  chemically synthesized
ggtgatgactaaggtggtaa

SEQ ID NO: 68895 - DNA, 20 bp, Artificial Sequence
  chemically synthesized
actaaggtggtaacagttat

SEQ ID NO: 68896 - DNA, 20 bp, Artificial Sequence
  chemically synthesized
ctaaggtggtaacagttatc

SEQ ID NO: 68897 - DNA, 20 bp, Artificial Sequence
  chemically synthesized
aggtggtaacagttatcagg

SEQ ID NO: 68898 - DNA, 20 bp, Artificial Sequence
  chemically synthesized
acagttatcaggtagttgct

SEQ ID NO: 68899 - DNA, 20 bp, Artificial Sequence
  chemically synthesized
ctagtaaataagtcagtgcc

SEQ ID NO: 68900 - DNA, 20 bp, Artificial Sequence
  chemically synthesized
agaatgtctagtaaataagt

SEQ ID NO: 68901 - DNA, 20 bp, Artificial Sequence
  chemically synthesized
cttggcactgacttatttac

SEQ ID NO: 68902 - DNA, 20 bp, Artificial Sequence
  chemically synthesized
aaaaagaatgtctagtaaat

SEQ ID NO: 68903 - DNA, 20 bp, Artificial Sequence
  chemically synthesized
aaacaaaaaaaaagaatgtc

SEQ ID NO: 68904 - DNA, 20 bp, Artificial Sequence
  chemically synthesized
aaaaacaaaaaacaaaaaaa

SEQ ID NO: 68905 - DNA, 20 bp, Artificial Sequence
  chemically synthesized
ttttgttttttgtttttttc

SEQ ID NO: 68906 - DNA, 20 bp, Artificial Sequence
  chemically synthesized
ttgttttttgtttttttcca

SEQ ID NO: 68907 - DNA, 20 bp, Artificial Sequence
  chemically synthesized
gttttttgtttttttccaga

SEQ ID NO: 68908 - DNA, 20 bp, Artificial Sequence
  chemically synthesized
ggccacagagtgagactctc

SEQ ID NO: 68909 - DNA, 20 bp, Artificial Sequence
  chemically synthesized
ttccagagagtctcactctg

SEQ ID NO: 68910 - DNA, 20 bp, Artificial Sequence
  chemically synthesized
tccggcctgggccacagagt

SEQ ID NO: 68911 - DNA, 20 bp, Artificial Sequence
  chemically synthesized
gagagtctcactctgtggcc

SEQ ID NO: 68912 - DNA, 20 bp, Artificial Sequence
  chemically synthesized
gcactccggcctgggccaca

SEQ ID NO: 68913 - DNA, 20 bp, Artificial Sequence
  chemically synthesized
agagtctcactctgtggccc

SEQ ID NO: 68914 - DNA, 20 bp, Artificial Sequence
  chemically synthesized
ctgcactccggcctgggcca

SEQ ID NO: 68915 - DNA, 20 bp, Artificial Sequence
  chemically synthesized
tctcactctgtggcccaggc

SEQ ID NO: 68916 - DNA, 20 bp, Artificial Sequence
  chemically synthesized
tcactctgtggcccaggccg

SEQ ID NO: 68917 - DNA, 20 bp, Artificial Sequence
  chemically synthesized
atgccactgcactccggcct

SEQ ID NO: 68918 - DNA, 20 bp, Artificial Sequence
  chemically synthesized
catgccactgcactccggcc

SEQ ID NO: 68919 - DNA, 20 bp, Artificial Sequence
  chemically synthesized
ctgtggcccaggccggagtg

SEQ ID NO: 68920 - DNA, 20 bp, Artificial Sequence
  chemically synthesized
gagatcatgccactgcactc

SEQ ID NO: 68921 - DNA, 20 bp, Artificial Sequence
  chemically synthesized
tggcccaggccggagtgcag

SEQ ID NO: 68922 - DNA, 20 bp, Artificial Sequence
  chemically synthesized
ggagtgcagtggcatgatct

SEQ ID NO: 68923 - DNA, 20 bp, Artificial Sequence
  chemically synthesized
agtggcatgatctcagctca

SEQ ID NO: 68924 - DNA, 20 bp, Artificial Sequence
  chemically synthesized
ggcggaagttgccgtgagct

SEQ ID NO: 68925 - DNA, 20 bp, Artificial Sequence
  chemically synthesized
cgggaggcggaagttgccgt

SEQ ID NO: 68926 - DNA, 20 bp, Artificial Sequence
  chemically synthesized
tgcttgaacccgggaggcgg

SEQ ID NO: 68927 - DNA, 20 bp, Artificial Sequence
  chemically synthesized
tcacggcaacttccgcctcc

SEQ ID NO: 68928 - DNA, 20 bp, Artificial Sequence
  chemically synthesized
cacggcaacttccgcctccc

SEQ ID NO: 68929 - DNA, 20 bp, Artificial Sequence
  chemically synthesized
aattgcttgaacccgggagg

SEQ ID NO: 68930 - DNA, 20 bp, Artificial Sequence
  chemically synthesized
gagaattgcttgaacccggg

SEQ ID NO: 68931 - DNA, 20 bp, Artificial Sequence
  chemically synthesized
ggagaattgcttgaacccgg

SEQ ID NO: 68932 - DNA, 20 bp, Artificial Sequence
  chemically synthesized
aacttccgcctcccgggttc

SEQ ID NO: 68933 - DNA, 20 bp, Artificial Sequence
  chemically synthesized
caggagaattgcttgaaccc

SEQ ID NO: 68934 - DNA, 20 bp, Artificial Sequence
  chemically synthesized
gcaggagaattgcttgaacc

SEQ ID NO: 68935 - DNA, 20 bp, Artificial Sequence
  chemically synthesized
ttcaagcaattctcctgcct

SEQ ID NO: 68936 - DNA, 20 bp, Artificial Sequence
  chemically synthesized
tactggggaggctgaggcag

SEQ ID NO: 68937 - DNA, 20 bp, Artificial Sequence
  chemically synthesized
tctactggggaggctgaggc

SEQ ID NO: 68938 - DNA, 20 bp, Artificial Sequence
  chemically synthesized
atctactggggaggctgagg

SEQ ID NO: 68939 - DNA, 20 bp, Artificial Sequence
  chemically synthesized
cccatctactggggaggctg

SEQ ID NO: 68940 - DNA, 20 bp, Artificial Sequence
  chemically synthesized
tcccatctactggggaggct

SEQ ID NO: 68941 - DNA, 20 bp, Artificial Sequence
  chemically synthesized
ttctcctgcctcagcctccc

SEQ ID NO: 68942 - DNA, 20 bp, Artificial Sequence
  chemically synthesized
tcctgcctcagcctccccag

SEQ ID NO: 68943 - DNA, 20 bp, Artificial Sequence
  chemically synthesized
tgtagtcccatctactgggg

SEQ ID NO: 68944 - DNA, 20 bp, Artificial Sequence
  chemically synthesized
ctgtagtcccatctactggg

SEQ ID NO: 68945 - DNA, 20 bp, Artificial Sequence
  chemically synthesized
gcctcagcctccccagtaga

SEQ ID NO: 68946 - DNA, 20 bp, Artificial Sequence
  chemically synthesized
gcctgtagtcccatctactg

SEQ ID NO: 68947 - DNA, 20 bp, Artificial Sequence
  chemically synthesized
cctcagcctccccagtagat

SEQ ID NO: 68948 - DNA, 20 bp, Artificial Sequence
  chemically synthesized
tgcctgtagtcccatctact

SEQ ID NO: 68949 - DNA, 20 bp, Artificial Sequence
  chemically synthesized
gtgcctgtagtcccatctac

SEQ ID NO: 68950 - DNA, 20 bp, Artificial Sequence
  chemically synthesized
ctccccagtagatgggacta

SEQ ID NO: 68951 - DNA, 20 bp, Artificial Sequence
  chemically synthesized
tccccagtagatgggactac

SEQ ID NO: 68952 - DNA, 20 bp, Artificial Sequence
  chemically synthesized
aggtgtggtggtggtgcctg

SEQ ID NO: 68953 - DNA, 20 bp, Artificial Sequence
  chemically synthesized
aaattagccaggtgtggtgg

SEQ ID NO: 68954 - DNA, 20 bp, Artificial Sequence
  chemically synthesized
acaggcaccaccaccacacc

SEQ ID NO: 68955 - DNA, 20 bp, Artificial Sequence
  chemically synthesized
caaaaattagccaggtgtgg

SEQ ID NO: 68956 - DNA, 20 bp, Artificial Sequence
  chemically synthesized
atacaaaaattagccaggtg

SEQ ID NO: 68957 - DNA, 20 bp, Artificial Sequence
  chemically synthesized
taaaaatacaaaaattagcc

SEQ ID NO: 68958 - DNA, 20 bp, Artificial Sequence
  chemically synthesized
ctaaaaatacaaaaattagc

SEQ ID NO: 68959 - DNA, 20 bp, Artificial Sequence
  chemically synthesized
tctgctaaaaatacaaaaat

SEQ ID NO: 68960 - DNA, 20 bp, Artificial Sequence
  chemically synthesized
ctggctaatttttgtatttt

SEQ ID NO: 68961 - DNA, 20 bp, Artificial Sequence
  chemically synthesized
gctaatttttgtatttttag

SEQ ID NO: 68962 - DNA, 20 bp, Artificial Sequence
  chemically synthesized
taatttttgtatttttagca

SEQ ID NO: 68963 - DNA, 20 bp, Artificial Sequence
  chemically synthesized
ttgtatttttagcagagaca

SEQ ID NO: 68964 - DNA, 20 bp, Artificial Sequence
  chemically synthesized
gcagagacacggtttcaccg

SEQ ID NO: 68965 - DNA, 20 bp, Artificial Sequence
  chemically synthesized
gagacacggtttcaccgtgg

SEQ ID NO: 68966 - DNA, 20 bp, Artificial Sequence
  chemically synthesized
cacggtttcaccgtggtggc

SEQ ID NO: 68967 - DNA, 20 bp, Artificial Sequence
  chemically synthesized
tgagaccagcctggccacca

SEQ ID NO: 68968 - DNA, 20 bp, Artificial Sequence
  chemically synthesized
acggtttcaccgtggtggcc

SEQ ID NO: 68969 - DNA, 20 bp, Artificial Sequence
  chemically synthesized
tttcaccgtggtggccaggc

SEQ ID NO: 68970 - DNA, 20 bp, Artificial Sequence
  chemically synthesized
ccaggagtctgagaccagcc

SEQ ID NO: 68971 - DNA, 20 bp, Artificial Sequence
  chemically synthesized
cgtggtggccaggctggtct

SEQ ID NO: 68972 - DNA, 20 bp, Artificial Sequence
  chemically synthesized
tgaggccaggagtctgagac

SEQ ID NO: 68973 - DNA, 20 bp, Artificial Sequence
  chemically synthesized
ccaggctggtctcagactcc

SEQ ID NO: 68974 - DNA, 20 bp, Artificial Sequence
  chemically synthesized
tcacttgaggccaggagtct

SEQ ID NO: 68975 - DNA, 20 bp, Artificial Sequence
  chemically synthesized
ggtggatcacttgaggccag

SEQ ID NO: 68976 - DNA, 20 bp, Artificial Sequence
  chemically synthesized
ggtctcagactcctggcctc

SEQ ID NO: 68977 - DNA, 20 bp, Artificial Sequence
  chemically synthesized
caggtggatcacttgaggcc

SEQ ID NO: 68978 - DNA, 20 bp, Artificial Sequence
  chemically synthesized
gcaggtggatcacttgaggc

SEQ ID NO: 68979 - DNA, 20 bp, Artificial Sequence
  chemically synthesized
caaggcaggtggatcacttg

SEQ ID NO: 68980 - DNA, 20 bp, Artificial Sequence
  chemically synthesized
ccaaggcaggtggatcactt

SEQ ID NO: 68981 - DNA, 20 bp, Artificial Sequence
  chemically synthesized
ctcaagtgatccacctgcct

SEQ ID NO: 68982 - DNA, 20 bp, Artificial Sequence
  chemically synthesized
ctttgggaggccaaggcagg

SEQ ID NO: 68983 - DNA, 20 bp, Artificial Sequence
  chemically synthesized
gcactttgggaggccaaggc

SEQ ID NO: 68984 - DNA, 20 bp, Artificial Sequence
  chemically synthesized
agcactttgggaggccaagg

SEQ ID NO: 68985 - DNA, 20 bp, Artificial Sequence
  chemically synthesized
cccagcactttgggaggcca

SEQ ID NO: 68986 - DNA, 20 bp, Artificial Sequence
  chemically synthesized
tcccagcactttgggaggcc

SEQ ID NO: 68987 - DNA, 20 bp, Artificial Sequence
  chemically synthesized
ccacctgccttggcctccca

SEQ ID NO: 68988 - DNA, 20 bp, Artificial Sequence
  chemically synthesized
tgtaatcccagcactttggg

SEQ ID NO: 68989 - DNA, 20 bp, Artificial Sequence
  chemically synthesized
ctgtaatcccagcactttgg

SEQ ID NO: 68990 - DNA, 20 bp, Artificial Sequence
  chemically synthesized
gccttggcctcccaaagtgc

SEQ ID NO: 68991 - DNA, 20 bp, Artificial Sequence
  chemically synthesized
acctgtaatcccagcacttt

SEQ ID NO: 68992 - DNA, 20 bp, Artificial Sequence
  chemically synthesized
ccttggcctcccaaagtgct

SEQ ID NO: 68993 - DNA, 20 bp, Artificial Sequence
  chemically synthesized
cacctgtaatcccagcactt

SEQ ID NO: 68994 - DNA, 20 bp, Artificial Sequence
  chemically synthesized
ctcccaaagtgctgggatta

SEQ ID NO: 68995 - DNA, 20 bp, Artificial Sequence
  chemically synthesized
tcccaaagtgctgggattac

SEQ ID NO: 68996 - DNA, 20 bp, Artificial Sequence
  chemically synthesized
gtggctcacacctgtaatcc

SEQ ID NO: 68997 - DNA, 20 bp, Artificial Sequence
  chemically synthesized
agtgctgggattacaggtgt

SEQ ID NO: 68998 - DNA, 20 bp, Artificial Sequence
  chemically synthesized
caggtgtgagccacattgcc

SEQ ID NO: 68999 - DNA, 20 bp, Artificial Sequence
  chemically synthesized
atctagtaggccaggcaatg

SEQ ID NO: 69000 - DNA, 20 bp, Artificial Sequence
  chemically synthesized
agccacattgcctggcctac

SEQ ID NO: 69001 - DNA, 20 bp, Artificial Sequence
  chemically synthesized
ttaacagtatctagtaggcc

SEQ ID NO: 69002 - DNA, 20 bp, Artificial Sequence
  chemically synthesized
cttaacagtatctagtaggc

SEQ ID NO: 69003 - DNA, 20 bp, Artificial Sequence
  chemically synthesized
ctgccttaacagtatctagt

SEQ ID NO: 69004 - DNA, 20 bp, Artificial Sequence
  chemically synthesized
cctgccttaacagtatctag

SEQ ID NO: 69005 - DNA, 20 bp, Artificial Sequence
  chemically synthesized
atgcctgccttaacagtatc

SEQ ID NO: 69006 - DNA, 20 bp, Artificial Sequence
  chemically synthesized
ctggcctactagatactgtt

SEQ ID NO: 69007 - DNA, 20 bp, Artificial Sequence
  chemically synthesized
tggcctactagatactgtta

SEQ ID NO: 69008 - DNA, 20 bp, Artificial Sequence
  chemically synthesized
cctactagatactgttaagg

SEQ ID NO: 69009 - DNA, 20 bp, Artificial Sequence
  chemically synthesized
ctactagatactgttaaggc

SEQ ID NO: 69010 - DNA, 20 bp, Artificial Sequence
  chemically synthesized
ttagcacatgcctgccttaa

SEQ ID NO: 69011 - DNA, 20 bp, Artificial Sequence
  chemically synthesized
taaggcaggcatgtgctaaa

SEQ ID NO: 69012 - DNA, 20 bp, Artificial Sequence
  chemically synthesized
aaggcaggcatgtgctaaac

SEQ ID NO: 69013 - DNA, 20 bp, Artificial Sequence
  chemically synthesized
tagaggtcatgtgacctgtt

SEQ ID NO: 69014 - DNA, 20 bp, Artificial Sequence
  chemically synthesized
tataattccagggatagtag

SEQ ID NO: 69015 - DNA, 20 bp, Artificial Sequence
  chemically synthesized
ttataattccagggatagta

SEQ ID NO: 69016 - DNA, 20 bp, Artificial Sequence
  chemically synthesized
cacatgacctctactatccc

SEQ ID NO: 69017 - DNA, 20 bp, Artificial Sequence
  chemically synthesized
tattataattccagggatag

SEQ ID NO: 69018 - DNA, 20 bp, Artificial Sequence
  chemically synthesized
tagtattataattccaggga

SEQ ID NO: 69019 - DNA, 20 bp, Artificial Sequence
  chemically synthesized
taactagtattataattcca

SEQ ID NO: 69020 - DNA, 20 bp, Artificial Sequence
  chemically synthesized
ctaactagtattataattcc

SEQ ID NO: 69021 - DNA, 20 bp, Artificial Sequence
  chemically synthesized
tctaactagtattataattc

SEQ ID NO: 69022 - DNA, 20 bp, Artificial Sequence
  chemically synthesized
tatccctggaattataatac

SEQ ID NO: 69023 - DNA, 20 bp, Artificial Sequence
  chemically synthesized
cctggaattataatactagt

SEQ ID NO: 69024 - DNA, 20 bp, Artificial Sequence
  chemically synthesized
ttgaaaactattgttctaac

SEQ ID NO: 69025 - DNA, 20 bp, Artificial Sequence
  chemically synthesized
tataatactagttagaacaa

SEQ ID NO: 69026 - DNA, 20 bp, Artificial Sequence
  chemically synthesized
cttactgtaggtcatggtca

SEQ ID NO: 69027 - DNA, 20 bp, Artificial Sequence
  chemically synthesized
caaactttgaccatgaccta

SEQ ID NO: 69028 - DNA, 20 bp, Artificial Sequence
  chemically synthesized
gtatttcttactgtaggtca

SEQ ID NO: 69029 - DNA, 20 bp, Artificial Sequence
  chemically synthesized
ctttgaccatgacctacagt

SEQ ID NO: 69030 - DNA, 20 bp, Artificial Sequence
  chemically synthesized
atgaatgtatttcttactgt

SEQ ID NO: 69031 - DNA, 20 bp, Artificial Sequence
  chemically synthesized
gatgaatgtatttcttactg

SEQ ID NO: 69032 - DNA, 20 bp, Artificial Sequence
  chemically synthesized
agtaagaaatacattcatca

SEQ ID NO: 69033 - DNA, 20 bp, Artificial Sequence
  chemically synthesized
atacattcatcatagttact

SEQ ID NO: 69034 - DNA, 20 bp, Artificial Sequence
  chemically synthesized
acgtgtggagaatgtattct

SEQ ID NO: 69035 - DNA, 20 bp, Artificial Sequence
  chemically synthesized
cccatgaatgtatacgtgtg

SEQ ID NO: 69036 - DNA, 20 bp, Artificial Sequence
  chemically synthesized
cacccatgaatgtatacgtg

SEQ ID NO: 69037 - DNA, 20 bp, Artificial Sequence
  chemically synthesized
tctccacacgtatacattca

SEQ ID NO: 69038 - DNA, 20 bp, Artificial Sequence
  chemically synthesized
ctccacacgtatacattcat

SEQ ID NO: 69039 - DNA, 20 bp, Artificial Sequence
  chemically synthesized
ttcctggggaagtggtattt

SEQ ID NO: 69040 - DNA, 20 bp, Artificial Sequence
  chemically synthesized
tgtctaaaataccacttccc

SEQ ID NO: 69041 - DNA, 20 bp, Artificial Sequence
  chemically synthesized
gtctaaaataccacttcccc

SEQ ID NO: 69042 - DNA, 20 bp, Artificial Sequence
  chemically synthesized
tggaaagtttcctggggaag

SEQ ID NO: 69043 - DNA, 20 bp, Artificial Sequence
  chemically synthesized
gcctggaaagtttcctgggg

SEQ ID NO: 69044 - DNA, 20 bp, Artificial Sequence
  chemically synthesized
taggcctggaaagtttcctg

SEQ ID NO: 69045 - DNA, 20 bp, Artificial Sequence
  chemically synthesized
gtaggcctggaaagtttcct

SEQ ID NO: 69046 - DNA, 20 bp, Artificial Sequence
  chemically synthesized
agtaggcctggaaagtttcc

SEQ ID NO: 69047 - DNA, 20 bp, Artificial Sequence
  chemically synthesized
cacttccccaggaaactttc

SEQ ID NO: 69048 - DNA, 20 bp, Artificial Sequence
  chemically synthesized
acttccccaggaaactttcc

SEQ ID NO: 69049 - DNA, 20 bp, Artificial Sequence
  chemically synthesized
cctggtgtagtaggcctgga

SEQ ID NO: 69050 - DNA, 20 bp, Artificial Sequence
  chemically synthesized
ttgacctggtgtagtaggcc

SEQ ID NO: 69051 - DNA, 20 bp, Artificial Sequence
  chemically synthesized
actttccaggcctactacac

SEQ ID NO: 69052 - DNA, 20 bp, Artificial Sequence
  chemically synthesized
gggacttgacctggtgtagt

SEQ ID NO: 69053 - DNA, 20 bp, Artificial Sequence
  chemically synthesized
ctttccaggcctactacacc

SEQ ID NO: 69054 - DNA, 20 bp, Artificial Sequence
  chemically synthesized
agggacttgacctggtgtag

SEQ ID NO: 69055 - DNA, 20 bp, Artificial Sequence
  chemically synthesized
cagagggacttgacctggtg

SEQ ID NO: 69056 - DNA, 20 bp, Artificial Sequence
  chemically synthesized
caggcctactacaccaggtc

SEQ ID NO: 69057 - DNA, 20 bp, Artificial Sequence
  chemically synthesized
tataacagagggacttgacc

SEQ ID NO: 69058 - DNA, 20 bp, Artificial Sequence
  chemically synthesized
tgctgagagagtataacaga

SEQ ID NO: 69059 - DNA, 20 bp, Artificial Sequence
  chemically synthesized
gtgctgagagagtataacag

SEQ ID NO: 69060 - DNA, 20 bp, Artificial Sequence
  chemically synthesized
agtgctgagagagtataaca

SEQ ID NO: 69061 - DNA, 20 bp, Artificial Sequence
  chemically synthesized
agagtgctgagagagtataa

SEQ ID NO: 69062 - DNA, 20 bp, Artificial Sequence
  chemically synthesized
gtccctctgttatactctct

SEQ ID NO: 69063 - DNA, 20 bp, Artificial Sequence
  chemically synthesized
acaaaagcagagtgctgaga

SEQ ID NO: 69064 - DNA, 20 bp, Artificial Sequence
  chemically synthesized
ggacaaaagcagagtgctga

SEQ ID NO: 69065 - DNA, 20 bp, Artificial Sequence
  chemically synthesized
aaggacaaaagcagagtgct

SEQ ID NO: 69066 - DNA, 20 bp, Artificial Sequence
  chemically synthesized
acttagaaaggacaaaagca

SEQ ID NO: 69067 - DNA, 20 bp, Artificial Sequence
  chemically synthesized
gtacttagaaaggacaaaag

SEQ ID NO: 69068 - DNA, 20 bp, Artificial Sequence
  chemically synthesized
tgagtacttagaaaggacaa

SEQ ID NO: 69069 - DNA, 20 bp, Artificial Sequence
  chemically synthesized
actctgcttttgtcctttct

SEQ ID NO: 69070 - DNA, 20 bp, Artificial Sequence
  chemically synthesized
attgtaatgagtacttagaa

SEQ ID NO: 69071 - DNA, 20 bp, Artificial Sequence
  chemically synthesized
aattgtaatgagtacttaga

SEQ ID NO: 69072 - DNA, 20 bp, Artificial Sequence
  chemically synthesized
ttccaattgtaatgagtact

SEQ ID NO: 69073 - DNA, 20 bp, Artificial Sequence
  chemically synthesized
tatttcattccaattgtaat

SEQ ID NO: 69074 - DNA, 20 bp, Artificial Sequence
  chemically synthesized
ttctaagtactcattacaat

SEQ ID NO: 69075 - DNA, 20 bp, Artificial Sequence
  chemically synthesized
aatgaaataattgcataaca

SEQ ID NO: 69076 - DNA, 20 bp, Artificial Sequence
  chemically synthesized
aaagatgttgaacccatctc

SEQ ID NO: 69077 - DNA, 20 bp, Artificial Sequence
  chemically synthesized
tagaatacagatctagagat

SEQ ID NO: 69078 - DNA, 20 bp, Artificial Sequence
  chemically synthesized
ctagaatacagatctagaga

SEQ ID NO: 69079 - DNA, 20 bp, Artificial Sequence
  chemically synthesized
agccctagaatacagatcta

SEQ ID NO: 69080 - DNA, 20 bp, Artificial Sequence
  chemically synthesized
aaagccctagaatacagatc

SEQ ID NO: 69081 - DNA, 20 bp, Artificial Sequence
  chemically synthesized
ccatctctagatctgtattc

SEQ ID NO: 69082 - DNA, 20 bp, Artificial Sequence
  chemically synthesized
catctctagatctgtattct

SEQ ID NO: 69083 - DNA, 20 bp, Artificial Sequence
  chemically synthesized
atctctagatctgtattcta

SEQ ID NO: 69084 - DNA, 20 bp, Artificial Sequence
  chemically synthesized
cctcagaaagccctagaata

SEQ ID NO: 69085 - DNA, 20 bp, Artificial Sequence
  chemically synthesized
tccctgccctcagaaagccc

SEQ ID NO: 69086 - DNA, 20 bp, Artificial Sequence
  chemically synthesized
tctgtattctagggctttct

SEQ ID NO: 69087 - DNA, 20 bp, Artificial Sequence
  chemically synthesized
ctgtattctagggctttctg

SEQ ID NO: 69088 - DNA, 20 bp, Artificial Sequence
  chemically synthesized
tgtattctagggctttctga

SEQ ID NO: 69089 - DNA, 20 bp, Artificial Sequence
  chemically synthesized
agaaggtccctgccctcaga

SEQ ID NO: 69090 - DNA, 20 bp, Artificial Sequence
  chemically synthesized
attctagggctttctgaggg

SEQ ID NO: 69091 - DNA, 20 bp, Artificial Sequence
  chemically synthesized
ttctagggctttctgagggc

SEQ ID NO: 69092 - DNA, 20 bp, Artificial Sequence
  chemically synthesized
tctagggctttctgagggca

SEQ ID NO: 69093 - DNA, 20 bp, Artificial Sequence
  chemically synthesized
aggaagaaggtccctgccct

SEQ ID NO: 69094 - DNA, 20 bp, Artificial Sequence
  chemically synthesized
tgttctataagagaggaaga

SEQ ID NO: 69095 - DNA, 20 bp, Artificial Sequence
  chemically synthesized
ctgttctataagagaggaag

SEQ ID NO: 69096 - DNA, 20 bp, Artificial Sequence
  chemically synthesized
ctgctgttctataagagagg

SEQ ID NO: 69097 - DNA, 20 bp, Artificial Sequence
  chemically synthesized
gggaccttcttcctctctta

SEQ ID NO: 69098 - DNA, 20 bp, Artificial Sequence
  chemically synthesized
atactgctgttctataagag

SEQ ID NO: 69099 - DNA, 20 bp, Artificial Sequence
  chemically synthesized
tatactgctgttctataaga

SEQ ID NO: 69100 - DNA, 20 bp, Artificial Sequence
  chemically synthesized
cctatactgctgttctataa

SEQ ID NO: 69101 - DNA, 20 bp, Artificial Sequence
  chemically synthesized
cttcttcctctcttatagaa

SEQ ID NO: 69102 - DNA, 20 bp, Artificial Sequence
  chemically synthesized
ttcctatactgctgttctat

SEQ ID NO: 69103 - DNA, 20 bp, Artificial Sequence
  chemically synthesized
cttcctctcttatagaacag

SEQ ID NO: 69104 - DNA, 20 bp, Artificial Sequence
  chemically synthesized
tctcttatagaacagcagta

SEQ ID NO: 69105 - DNA, 20 bp, Artificial Sequence
  chemically synthesized
ctcttatagaacagcagtat

SEQ ID NO: 69106 - DNA, 20 bp, Artificial Sequence
  chemically synthesized
gtataggaaaaactgacctg

SEQ ID NO: 69107 - DNA, 20 bp, Artificial Sequence
  chemically synthesized
aaaatgttattgcttcaggt

SEQ ID NO: 69108 - DNA, 20 bp, Artificial Sequence
  chemically synthesized
gtgcaaaatgttattgcttc

SEQ ID NO: 69109 - DNA, 20 bp, Artificial Sequence
  chemically synthesized
tgtgcaaaatgttattgctt

SEQ ID NO: 69110 - DNA, 20 bp, Artificial Sequence
  chemically synthesized
agcaataacattttgcacat

SEQ ID NO: 69111 - DNA, 20 bp, Artificial Sequence
  chemically synthesized
caataacattttgcacataa

SEQ ID NO: 69112 - DNA, 20 bp, Artificial Sequence
  chemically synthesized
gcacataagagctgcttaat

SEQ ID NO: 69113 - DNA, 20 bp, Artificial Sequence
  chemically synthesized
ggtcacaagtactaattaag

SEQ ID NO: 69114 - DNA, 20 bp, Artificial Sequence
  chemically synthesized
tcaggtcacaagtactaatt

SEQ ID NO: 69115 - DNA, 20 bp, Artificial Sequence
  chemically synthesized
ttaattagtacttgtgacct

SEQ ID NO: 69116 - DNA, 20 bp, Artificial Sequence
  chemically synthesized
tatccatttactcaggtcac

SEQ ID NO: 69117 - DNA, 20 bp, Artificial Sequence
  chemically synthesized
gtacttgtgacctgagtaaa

SEQ ID NO: 69118 - DNA, 20 bp, Artificial Sequence
  chemically synthesized
aggtctttatccatttactc

SEQ ID NO: 69119 - DNA, 20 bp, Artificial Sequence
  chemically synthesized
gaggtctttatccatttact

SEQ ID NO: 69120 - DNA, 20 bp, Artificial Sequence
  chemically synthesized
gtgacctgagtaaatggata

SEQ ID NO: 69121 - DNA, 20 bp, Artificial Sequence
  chemically synthesized
gagtaaatggataaagacct

SEQ ID NO: 69122 - DNA, 20 bp, Artificial Sequence
  chemically synthesized
aaatggataaagacctcagc

SEQ ID NO: 69123 - DNA, 20 bp, Artificial Sequence
  chemically synthesized
aatggataaagacctcagca

SEQ ID NO: 69124 - DNA, 20 bp, Artificial Sequence
  chemically synthesized
tggataaagacctcagcaag

SEQ ID NO: 69125 - DNA, 20 bp, Artificial Sequence
  chemically synthesized
acccagggatctccttgctg

SEQ ID NO: 69126 - DNA, 20 bp, Artificial Sequence
  chemically synthesized
gacccagggatctccttgct

SEQ ID NO: 69127 - DNA, 20 bp, Artificial Sequence
  chemically synthesized
gacctcagcaaggagatccc

SEQ ID NO: 69128 - DNA, 20 bp, Artificial Sequence
  chemically synthesized
acctcagcaaggagatccct

SEQ ID NO: 69129 - DNA, 20 bp, Artificial Sequence
  chemically synthesized
ccaaataagaaaaggaccca

SEQ ID NO: 69130 - DNA, 20 bp, Artificial Sequence
  chemically synthesized
tccaaataagaaaaggaccc

SEQ ID NO: 69131 - DNA, 20 bp, Artificial Sequence
  chemically synthesized
ttccaaataagaaaaggacc

SEQ ID NO: 69132 - DNA, 20 bp, Artificial Sequence
  chemically synthesized
caagatttccaaataagaaa

SEQ ID NO: 69133 - DNA, 20 bp, Artificial Sequence
  chemically synthesized
tcaagatttccaaataagaa

SEQ ID NO: 69134 - DNA, 20 bp, Artificial Sequence
  chemically synthesized
ccctgggtccttttcttatt

SEQ ID NO: 69135 - DNA, 20 bp, Artificial Sequence
  chemically synthesized
ctacctcaagatttccaaat

SEQ ID NO: 69136 - DNA, 20 bp, Artificial Sequence
  chemically synthesized
ttttcttatttggaaatctt

SEQ ID NO: 69137 - DNA, 20 bp, Artificial Sequence
  chemically synthesized
tttcttatttggaaatcttg

SEQ ID NO: 69138 - DNA, 20 bp, Artificial Sequence
  chemically synthesized
cttatttggaaatcttgagg

SEQ ID NO: 69139 - DNA, 20 bp, Artificial Sequence
  chemically synthesized
tatttggaaatcttgaggta

SEQ ID NO: 69140 - DNA, 20 bp, Artificial Sequence
  chemically synthesized
acctactccagctctacctc

SEQ ID NO: 69141 - DNA, 20 bp, Artificial Sequence
  chemically synthesized
tggaaatcttgaggtagagc

SEQ ID NO: 69142 - DNA, 20 bp, Artificial Sequence
  chemically synthesized
gaaatcttgaggtagagctg

SEQ ID NO: 69143 - DNA, 20 bp, Artificial Sequence
  chemically synthesized
atcttgaggtagagctggag

SEQ ID NO: 69144 - DNA, 20 bp, Artificial Sequence
  chemically synthesized
tcttgaggtagagctggagt

SEQ ID NO: 69145 - DNA, 20 bp, Artificial Sequence
  chemically synthesized
acatgttggatgacctactc

SEQ ID NO: 69146 - DNA, 20 bp, Artificial Sequence
  chemically synthesized
agctatgccaatgaacatgt

SEQ ID NO: 69147 - DNA, 20 bp, Artificial Sequence
  chemically synthesized
aggtcatccaacatgttcat

SEQ ID NO: 69148 - DNA, 20 bp, Artificial Sequence
  chemically synthesized
atccaacatgttcattggca

SEQ ID NO: 69149 - DNA, 20 bp, Artificial Sequence
  chemically synthesized
atgttcattggcatagctta

SEQ ID NO: 69150 - DNA, 20 bp, Artificial Sequence
  chemically synthesized
tgttgatgctgttgttctgt

SEQ ID NO: 69151 - DNA, 20 bp, Artificial Sequence
  chemically synthesized
tggcatagcttacagaacaa

SEQ ID NO: 69152 - DNA, 20 bp, Artificial Sequence
  chemically synthesized
acagaacaacagcatcaaca

SEQ ID NO: 69153 - DNA, 20 bp, Artificial Sequence
  chemically synthesized
caacagcatcaacatggtgc

SEQ ID NO: 69154 - DNA, 20 bp, Artificial Sequence
  chemically synthesized
aacagcatcaacatggtgcc

SEQ ID NO: 69155 - DNA, 20 bp, Artificial Sequence
  chemically synthesized
gcatcaacatggtgccagga

SEQ ID NO: 69156 - DNA, 20 bp, Artificial Sequence
  chemically synthesized
caacatggtgccaggacaga

SEQ ID NO: 69157 - DNA, 20 bp, Artificial Sequence
  chemically synthesized
cagatacatcctatctgtcc

SEQ ID NO: 69158 - DNA, 20 bp, Artificial Sequence
  chemically synthesized
aacatggtgccaggacagat

SEQ ID NO: 69159 - DNA, 20 bp, Artificial Sequence
  chemically synthesized
caggacagataggatgtatc

SEQ ID NO: 69160 - DNA, 20 bp, Artificial Sequence
  chemically synthesized
aggacagataggatgtatct

SEQ ID NO: 69161 - DNA, 20 bp, Artificial Sequence
  chemically synthesized
ggacagataggatgtatctg

SEQ ID NO: 69162 - DNA, 20 bp, Artificial Sequence
  chemically synthesized
acagataggatgtatctggg

SEQ ID NO: 69163 - DNA, 20 bp, Artificial Sequence
  chemically synthesized
ataggatgtatctggggagc

SEQ ID NO: 69164 - DNA, 20 bp, Artificial Sequence
  chemically synthesized
taggatgtatctggggagca

SEQ ID NO: 69165 - DNA, 20 bp, Artificial Sequence
  chemically synthesized
tcgtatcacaccttgctccc

SEQ ID NO: 69166 - DNA, 20 bp, Artificial Sequence
  chemically synthesized
tggggagcaaggtgtgatac

SEQ ID NO: 69167 - DNA, 20 bp, Artificial Sequence
  chemically synthesized
gggagcaaggtgtgatacga

SEQ ID NO: 69168 - DNA, 20 bp, Artificial Sequence
  chemically synthesized
agcaaggtgtgatacgagag

SEQ ID NO: 69169 - DNA, 20 bp, Artificial Sequence
  chemically synthesized
gcaaggtgtgatacgagagc

SEQ ID NO: 69170 - DNA, 20 bp, Artificial Sequence
  chemically synthesized
agagcgggatgtattattaa

SEQ ID NO: 69171 - DNA, 20 bp, Artificial Sequence
  chemically synthesized
gaaaaaataatgagaaaagg

SEQ ID NO: 69172 - DNA, 20 bp, Artificial Sequence
  chemically synthesized
cctgaaaaaataatgagaaa

SEQ ID NO: 69173 - DNA, 20 bp, Artificial Sequence
  chemically synthesized
ccctgaaaaaataatgagaa

SEQ ID NO: 69174 - DNA, 20 bp, Artificial Sequence
  chemically synthesized
tcaagccctgaaaaaataat

SEQ ID NO: 69175 - DNA, 20 bp, Artificial Sequence
  chemically synthesized
accttttctcattatttttt

SEQ ID NO: 69176 - DNA, 20 bp, Artificial Sequence
  chemically synthesized
ccttttctcattattttttc

SEQ ID NO: 69177 - DNA, 20 bp, Artificial Sequence
  chemically synthesized
cttttctcattattttttca

SEQ ID NO: 69178 - DNA, 20 bp, Artificial Sequence
  chemically synthesized
taccaacaagaaacatgttc

SEQ ID NO: 69179 - DNA, 20 bp, Artificial Sequence
  chemically synthesized
ggcttgaacatgtttcttgt

SEQ ID NO: 69180 - DNA, 20 bp, Artificial Sequence
  chemically synthesized
aaatatgagtggataccaac

SEQ ID NO: 69181 - DNA, 20 bp, Artificial Sequence
  chemically synthesized
aaagaggcaataaatatgag

SEQ ID NO: 69182 - DNA, 20 bp, Artificial Sequence
  chemically synthesized
aagaaagaggcaataaatat

SEQ ID NO: 69183 - DNA, 20 bp, Artificial Sequence
  chemically synthesized
aataaatgagatgaagaaag

SEQ ID NO: 69184 - DNA, 20 bp, Artificial Sequence
  chemically synthesized
aaataaatgagatgaagaaa

SEQ ID NO: 69185 - DNA, 20 bp, Artificial Sequence
  chemically synthesized
ataaataaatgagatgaaga

SEQ ID NO: 69186 - DNA, 20 bp, Artificial Sequence
  chemically synthesized
cacaataaataaatgagatg

SEQ ID NO: 69187 - DNA, 20 bp, Artificial Sequence
  chemically synthesized
taatgacacaataaataaat

SEQ ID NO: 69188 - DNA, 20 bp, Artificial Sequence
  chemically synthesized
taaataaaactgggttaagt

SEQ ID NO: 69189 - DNA, 20 bp, Artificial Sequence
  chemically synthesized
gtgtcattaccaacttaacc

SEQ ID NO: 69190 - DNA, 20 bp, Artificial Sequence
  chemically synthesized
aagataaataaaactgggtt

SEQ ID NO: 69191 - DNA, 20 bp, Artificial Sequence
  chemically synthesized
aaaagaagataaataaaact

SEQ ID NO: 69192 - DNA, 20 bp, Artificial Sequence
  chemically synthesized
aaaaagaagataaataaaac

SEQ ID NO: 69193 - DNA, 20 bp, Artificial Sequence
  chemically synthesized
gccaacaggcagtcaaaaag

SEQ ID NO: 69194 - DNA, 20 bp, Artificial Sequence
  chemically synthesized
tttgccaacaggcagtcaaa

SEQ ID NO: 69195 - DNA, 20 bp, Artificial Sequence
  chemically synthesized
tcttctttttgactgcctgt

SEQ ID NO: 69196 - DNA, 20 bp, Artificial Sequence
  chemically synthesized
gatatttttttgccaacagg

SEQ ID NO: 69197 - DNA, 20 bp, Artificial Sequence
  chemically synthesized
tttgatatttttttgccaac

SEQ ID NO: 69198 - DNA, 20 bp, Artificial Sequence
  chemically synthesized
ttttgatatttttttgccaa

SEQ ID NO: 69199 - DNA, 20 bp, Artificial Sequence
  chemically synthesized
gcaaaaaaatatcaaaactt

SEQ ID NO: 69200 - DNA, 20 bp, Artificial Sequence
  chemically synthesized
agaaaacacccatttttctt

SEQ ID NO: 69201 - DNA, 20 bp, Artificial Sequence
  chemically synthesized
atatcaaaacttaagaaaaa

SEQ ID NO: 69202 - DNA, 20 bp, Artificial Sequence
  chemically synthesized
tatcaaaacttaagaaaaat

SEQ ID NO: 69203 - DNA, 20 bp, Artificial Sequence
  chemically synthesized
taagaaaaatgggtgttttc

SEQ ID NO: 69204 - DNA, 20 bp, Artificial Sequence
  chemically synthesized
aaaaatgggtgttttctaga

SEQ ID NO: 69205 - DNA, 20 bp, Artificial Sequence
  chemically synthesized
atgggtgttttctagaaagt

SEQ ID NO: 69206 - DNA, 20 bp, Artificial Sequence
  chemically synthesized
tgggtgttttctagaaagtt

SEQ ID NO: 69207 - DNA, 20 bp, Artificial Sequence
  chemically synthesized
tgtatttttacccaactttc

SEQ ID NO: 69208 - DNA, 20 bp, Artificial Sequence
  chemically synthesized
gaaattaagcaacaaaacaa

SEQ ID NO: 69209 - DNA, 20 bp, Artificial Sequence
  chemically synthesized
caaggcagcataaagaaatt

SEQ ID NO: 69210 - DNA, 20 bp, Artificial Sequence
  chemically synthesized
tcacagagcaaggcagcata

SEQ ID NO: 69211 - DNA, 20 bp, Artificial Sequence
  chemically synthesized
actttgttcacagagcaagg

SEQ ID NO: 69212 - DNA, 20 bp, Artificial Sequence
  chemically synthesized
tctactttgttcacagagca

SEQ ID NO: 69213 - DNA, 20 bp, Artificial Sequence
  chemically synthesized
ttctactttgttcacagagc

SEQ ID NO: 69214 - DNA, 20 bp, Artificial Sequence
  chemically synthesized
tattttctactttgttcaca

SEQ ID NO: 69215 - DNA, 20 bp, Artificial Sequence
  chemically synthesized
gctgccttgctctgtgaaca

SEQ ID NO: 69216 - DNA, 20 bp, Artificial Sequence
  chemically synthesized
attattttctactttgttca

SEQ ID NO: 69217 - DNA, 20 bp, Artificial Sequence
  chemically synthesized
gccttgctctgtgaacaaag

SEQ ID NO: 69218 - DNA, 20 bp, Artificial Sequence
  chemically synthesized
agaaaataatacatttattt

SEQ ID NO: 69219 - DNA, 20 bp, Artificial Sequence
  chemically synthesized
atacatttattttggaaaat

SEQ ID NO: 69220 - DNA, 20 bp, Artificial Sequence
  chemically synthesized
tttggaaaataagctcaata

SEQ ID NO: 69221 - DNA, 20 bp, Artificial Sequence
  chemically synthesized
tcctaactcctgtctttatt

SEQ ID NO: 69222 - DNA, 20 bp, Artificial Sequence
  chemically synthesized
gaaaataagctcaataaaga

SEQ ID NO: 69223 - DNA, 20 bp, Artificial Sequence
  chemically synthesized
aaaataagctcaataaagac

SEQ ID NO: 69224 - DNA, 20 bp, Artificial Sequence
  chemically synthesized
aataagctcaataaagacag

SEQ ID NO: 69225 - DNA, 20 bp, Artificial Sequence
  chemically synthesized
agctcaataaagacaggagt

SEQ ID NO: 69226 - DNA, 20 bp, Artificial Sequence
  chemically synthesized
gctcaataaagacaggagtt

SEQ ID NO: 69227 - DNA, 20 bp, Artificial Sequence
  chemically synthesized
ctcagtagttagtcaaggga

SEQ ID NO: 69228 - DNA, 20 bp, Artificial Sequence
  chemically synthesized
ttccctcagtagttagtcaa

SEQ ID NO: 69229 - DNA, 20 bp, Artificial Sequence
  chemically synthesized
tttccctcagtagttagtca

SEQ ID NO: 69230 - DNA, 20 bp, Artificial Sequence
  chemically synthesized
ctttccctcagtagttagtc

SEQ ID NO: 69231 - DNA, 20 bp, Artificial Sequence
  chemically synthesized
ccgtcccttgactaactact

SEQ ID NO: 69232 - DNA, 20 bp, Artificial Sequence
  chemically synthesized
cgtcccttgactaactactg

SEQ ID NO: 69233 - DNA, 20 bp, Artificial Sequence
  chemically synthesized
aagggctttccctcagtagt

SEQ ID NO: 69234 - DNA, 20 bp, Artificial Sequence
  chemically synthesized
gtcccttgactaactactga

SEQ ID NO: 69235 - DNA, 20 bp, Artificial Sequence
  chemically synthesized
tagaaagggctttccctcag

SEQ ID NO: 69236 - DNA, 20 bp, Artificial Sequence
  chemically synthesized
cttgactaactactgaggga

SEQ ID NO: 69237 - DNA, 20 bp, Artificial Sequence
  chemically synthesized
ctatagaaagggctttccct

SEQ ID NO: 69238 - DNA, 20 bp, Artificial Sequence
  chemically synthesized
ctgagggaaagccctttcta

SEQ ID NO: 69239 - DNA, 20 bp, Artificial Sequence
  chemically synthesized
taaattctattctatagaaa

SEQ ID NO: 69240 - DNA, 20 bp, Artificial Sequence
  chemically synthesized
gtaaattctattctatagaa

SEQ ID NO: 69241 - DNA, 20 bp, Artificial Sequence
  chemically synthesized
tgtaaattctattctataga

SEQ ID NO: 69242 - DNA, 20 bp, Artificial Sequence
  chemically synthesized
ggaaagccctttctatagaa

SEQ ID NO: 69243 - DNA, 20 bp, Artificial Sequence
  chemically synthesized
aggatgtaaattctattcta

SEQ ID NO: 69244 - DNA, 20 bp, Artificial Sequence
  chemically synthesized
gaatagaatttacatcctgt

SEQ ID NO: 69245 - DNA, 20 bp, Artificial Sequence
  chemically synthesized
agaatttacatcctgtgagt

SEQ ID NO: 69246 - DNA, 20 bp, Artificial Sequence
  chemically synthesized
taaaaacatgaccaactcac

SEQ ID NO: 69247 - DNA, 20 bp, Artificial Sequence
  chemically synthesized
ctaaaaacatgaccaactca

SEQ ID NO: 69248 - DNA, 20 bp, Artificial Sequence
  chemically synthesized
ctgtgagttggtcatgtttt

SEQ ID NO: 69249 - DNA, 20 bp, Artificial Sequence
  chemically synthesized
gagttggtcatgtttttagt

SEQ ID NO: 69250 - DNA, 20 bp, Artificial Sequence
  chemically synthesized
tggtcatgtttttagtaaga

SEQ ID NO: 69251 - DNA, 20 bp, Artificial Sequence
  chemically synthesized
ttaaattgcatgtatatgtc

SEQ ID NO: 69252 - DNA, 20 bp, Artificial Sequence
  chemically synthesized
aaattgcatgtatatgtcca

SEQ ID NO: 69253 - DNA, 20 bp, Artificial Sequence
  chemically synthesized
tgtttcccattaattgactc

SEQ ID NO: 69254 - DNA, 20 bp, Artificial Sequence
  chemically synthesized
atatgtccagagtcaattaa

SEQ ID NO: 69255 - DNA, 20 bp, Artificial Sequence
  chemically synthesized
tatgtccagagtcaattaat

SEQ ID NO: 69256 - DNA, 20 bp, Artificial Sequence
  chemically synthesized
gagtcaattaatgggaaaca

SEQ ID NO: 69257 - DNA, 20 bp, Artificial Sequence
  chemically synthesized
attaatgggaaacatagaac

SEQ ID NO: 69258 - DNA, 20 bp, Artificial Sequence
  chemically synthesized
gaaacatagaaccagaatcc

SEQ ID NO: 69259 - DNA, 20 bp, Artificial Sequence
  chemically synthesized
gacaaaattgacttggattc

SEQ ID NO: 69260 - DNA, 20 bp, Artificial Sequence
  chemically synthesized
agtaatggacaaaattgact

SEQ ID NO: 69261 - DNA, 20 bp, Artificial Sequence
  chemically synthesized
tactcttgagaaagaagtaa

SEQ ID NO: 69262 - DNA, 20 bp, Artificial Sequence
  chemically synthesized
ttgtccattacttctttctc

SEQ ID NO: 69263 - DNA, 20 bp, Artificial Sequence
  chemically synthesized
ggtgtttactcttgagaaag

SEQ ID NO: 69264 - DNA, 20 bp, Artificial Sequence
  chemically synthesized
gtccattacttctttctcaa

SEQ ID NO: 69265 - DNA, 20 bp, Artificial Sequence
  chemically synthesized
gagggtgtttactcttgaga

SEQ ID NO: 69266 - DNA, 20 bp, Artificial Sequence
  chemically synthesized
agctgagggtgtttactctt

SEQ ID NO: 69267 - DNA, 20 bp, Artificial Sequence
  chemically synthesized
ttctcaagagtaaacaccct

SEQ ID NO: 69268 - DNA, 20 bp, Artificial Sequence
  chemically synthesized
caagagtaaacaccctcagc

SEQ ID NO: 69269 - DNA, 20 bp, Artificial Sequence
  chemically synthesized
attatttgtcatccagctga

SEQ ID NO: 69270 - DNA, 20 bp, Artificial Sequence
  chemically synthesized
cattatttgtcatccagctg

SEQ ID NO: 69271 - DNA, 20 bp, Artificial Sequence
  chemically synthesized
tcattatttgtcatccagct

SEQ ID NO: 69272 - DNA, 20 bp, Artificial Sequence
  chemically synthesized
ggcaatcattatttgtcatc

SEQ ID NO: 69273 - DNA, 20 bp, Artificial Sequence
  chemically synthesized
ggatgacaaataatgattgc

SEQ ID NO: 69274 - DNA, 20 bp, Artificial Sequence
  chemically synthesized
gatgacaaataatgattgcc

SEQ ID NO: 69275 - DNA, 20 bp, Artificial Sequence
  chemically synthesized
acaaataatgattgccaggc

SEQ ID NO: 69276 - DNA, 20 bp, Artificial Sequence
  chemically synthesized
caaataatgattgccaggca

SEQ ID NO: 69277 - DNA, 20 bp, Artificial Sequence
  chemically synthesized
gtaataacataaaccttgcc

SEQ ID NO: 69278 - DNA, 20 bp, Artificial Sequence
  chemically synthesized
gtttatgttattacctctac

SEQ ID NO: 69279 - DNA, 20 bp, Artificial Sequence
  chemically synthesized
tatgttattacctctacaag

SEQ ID NO: 69280 - DNA, 20 bp, Artificial Sequence
  chemically synthesized
catcaacttcctacttgtag

SEQ ID NO: 69281 - DNA, 20 bp, Artificial Sequence
  chemically synthesized
atgttattacctctacaagt

SEQ ID NO: 69282 - DNA, 20 bp, Artificial Sequence
  chemically synthesized
gcatcaacttcctacttgta

SEQ ID NO: 69283 - DNA, 20 bp, Artificial Sequence
  chemically synthesized
ttgcatcaacttcctacttg

SEQ ID NO: 69284 - DNA, 20 bp, Artificial Sequence
  chemically synthesized
ttattacctctacaagtagg

SEQ ID NO: 69285 - DNA, 20 bp, Artificial Sequence
  chemically synthesized
acaagtaggaagttgatgca

SEQ ID NO: 69286 - DNA, 20 bp, Artificial Sequence
  chemically synthesized
aaaaaacagatgtcaggtga

SEQ ID NO: 69287 - DNA, 20 bp, Artificial Sequence
  chemically synthesized
aaaaaaaacagatgtcaggt

SEQ ID NO: 69288 - DNA, 20 bp, Artificial Sequence
  chemically synthesized
gattaaaaaaaacagatgtc

SEQ ID NO: 69289 - DNA, 20 bp, Artificial Sequence
  chemically synthesized
tgattaaaaaaaacagatgt

SEQ ID NO: 69290 - DNA, 20 bp, Artificial Sequence
  chemically synthesized
ataagggtgattaaaaaaaa

SEQ ID NO: 69291 - DNA, 20 bp, Artificial Sequence
  chemically synthesized
gttttttttaatcaccctta

SEQ ID NO: 69292 - DNA, 20 bp, Artificial Sequence
  chemically synthesized
tttttaatcacccttatagc

SEQ ID NO: 69293 - DNA, 20 bp, Artificial Sequence
  chemically synthesized
ttaaaactaacttgctataa

SEQ ID NO: 69294 - DNA, 20 bp, Artificial Sequence
  chemically synthesized
tttaaaactaacttgctata

SEQ ID NO: 69295 - DNA, 20 bp, Artificial Sequence
  chemically synthesized
ctttaaaactaacttgctat

SEQ ID NO: 69296 - DNA, 20 bp, Artificial Sequence
  chemically synthesized
taatcacccttatagcaagt

SEQ ID NO: 69297 - DNA, 20 bp, Artificial Sequence
  chemically synthesized
cttatagcaagttagtttta

SEQ ID NO: 69298 - DNA, 20 bp, Artificial Sequence
  chemically synthesized
atagcaagttagttttaaag

SEQ ID NO: 69299 - DNA, 20 bp, Artificial Sequence
  chemically synthesized
caagttagttttaaagaagt

SEQ ID NO: 69300 - DNA, 20 bp, Artificial Sequence
  chemically synthesized
ttagttttaaagaagtgaga

SEQ ID NO: 69301 - DNA, 20 bp, Artificial Sequence
  chemically synthesized
gtgagaaagacatgcgtgaa

SEQ ID NO: 69302 - DNA, 20 bp, Artificial Sequence
  chemically synthesized
tgagaaagacatgcgtgaac

SEQ ID NO: 69303 - DNA, 20 bp, Artificial Sequence
  chemically synthesized
tgaacaggcaattttgctcc

SEQ ID NO: 69304 - DNA, 20 bp, Artificial Sequence
  chemically synthesized
taagaagaagtttgatctgg

SEQ ID NO: 69305 - DNA, 20 bp, Artificial Sequence
  chemically synthesized
tataagaagaagtttgatct

SEQ ID NO: 69306 - DNA, 20 bp, Artificial Sequence
  chemically synthesized
ttataagaagaagtttgatc

SEQ ID NO: 69307 - DNA, 20 bp, Artificial Sequence
  chemically synthesized
ccacgtctggttataagaag

SEQ ID NO: 69308 - DNA, 20 bp, Artificial Sequence
  chemically synthesized
aagccacgtctggttataag

SEQ ID NO: 69309 - DNA, 20 bp, Artificial Sequence
  chemically synthesized
atcaaacttcttcttataac

SEQ ID NO: 69310 - DNA, 20 bp, Artificial Sequence
  chemically synthesized
atgaagccacgtctggttat

SEQ ID NO: 69311 - DNA, 20 bp, Artificial Sequence
  chemically synthesized
cttcttcttataaccagacg

SEQ ID NO: 69312 - DNA, 20 bp, Artificial Sequence
  chemically synthesized
ctggaacatgaagccacgtc

SEQ ID NO: 69313 - DNA, 20 bp, Artificial Sequence
  chemically synthesized
ccagacgtggcttcatgttc

SEQ ID NO: 69314 - DNA, 20 bp, Artificial Sequence
  chemically synthesized
tcttgctttgctggaacatg

SEQ ID NO: 69315 - DNA, 20 bp, Artificial Sequence
  chemically synthesized
cgtggcttcatgttccagca

SEQ ID NO: 69316 - DNA, 20 bp, Artificial Sequence
  chemically synthesized
gcttcatgttccagcaaagc

SEQ ID NO: 69317 - DNA, 20 bp, Artificial Sequence
  chemically synthesized
ctgggaatatcttgctttgc

SEQ ID NO: 69318 - DNA, 20 bp, Artificial Sequence
  chemically synthesized
ccagcaaagcaagatattcc

SEQ ID NO: 69319 - DNA, 20 bp, Artificial Sequence
  chemically synthesized
cagcaaagcaagatattccc

SEQ ID NO: 69320 - DNA, 20 bp, Artificial Sequence
  chemically synthesized
gcaagatattcccaggccat

SEQ ID NO: 69321 - DNA, 20 bp, Artificial Sequence
  chemically synthesized
cctttgttaccttatggcct

SEQ ID NO: 69322 - DNA, 20 bp, Artificial Sequence
  chemically synthesized
caagatattcccaggccata

SEQ ID NO: 69323 - DNA, 20 bp, Artificial Sequence
  chemically synthesized
gcctttgttaccttatggcc

SEQ ID NO: 69324 - DNA, 20 bp, Artificial Sequence
  chemically synthesized
cccaggcctttgttacctta

SEQ ID NO: 69325 - DNA, 20 bp, Artificial Sequence
  chemically synthesized
tcccaggccataaggtaaca

SEQ ID NO: 69326 - DNA, 20 bp, Artificial Sequence
  chemically synthesized
cccaggccataaggtaacaa

SEQ ID NO: 69327 - DNA, 20 bp, Artificial Sequence
  chemically synthesized
gccataaggtaacaaaggcc

SEQ ID NO: 69328 - DNA, 20 bp, Artificial Sequence
  chemically synthesized
ccataaggtaacaaaggcct

SEQ ID NO: 69329 - DNA, 20 bp, Artificial Sequence
  chemically synthesized
tgtggacaccacagtgtccc

SEQ ID NO: 69330 - DNA, 20 bp, Artificial Sequence
  chemically synthesized
atgtggacaccacagtgtcc

SEQ ID NO: 69331 - DNA, 20 bp, Artificial Sequence
  chemically synthesized
aacaaaggcctgggacactg

SEQ ID NO: 69332 - DNA, 20 bp, Artificial Sequence
  chemically synthesized
agtgagaaatgtggacacca

SEQ ID NO: 69333 - DNA, 20 bp, Artificial Sequence
  chemically synthesized
attcatagaagtgagaaatg

SEQ ID NO: 69334 - DNA, 20 bp, Artificial Sequence
  chemically synthesized
gggcactcattcatagaagt

SEQ ID NO: 69335 - DNA, 20 bp, Artificial Sequence
  chemically synthesized
ctgtgggcactcattcatag

SEQ ID NO: 69336 - DNA, 20 bp, Artificial Sequence
  chemically synthesized
catttctcacttctatgaat

SEQ ID NO: 69337 - DNA, 20 bp, Artificial Sequence
  chemically synthesized
ttcctgtgggcactcattca

SEQ ID NO: 69338 - DNA, 20 bp, Artificial Sequence
  chemically synthesized
cttctatgaatgagtgccca

SEQ ID NO: 69339 - DNA, 20 bp, Artificial Sequence
  chemically synthesized
ttctatgaatgagtgcccac

SEQ ID NO: 69340 - DNA, 20 bp, Artificial Sequence
  chemically synthesized
tgttatgaacacattcctgt

SEQ ID NO: 69341 - DNA, 20 bp, Artificial Sequence
  chemically synthesized
atgttatgaacacattcctg

SEQ ID NO: 69342 - DNA, 20 bp, Artificial Sequence
  chemically synthesized
tgtgttcataacatgtaaca

SEQ ID NO: 69343 - DNA, 20 bp, Artificial Sequence
  chemically synthesized
atgtaacaaagtcaacttgt

SEQ ID NO: 69344 - DNA, 20 bp, Artificial Sequence
  chemically synthesized
gatgtgtatcagcaactcac

SEQ ID NO: 69345 - DNA, 20 bp, Artificial Sequence
  chemically synthesized
gacataagagagatgtgtat

SEQ ID NO: 69346 - DNA, 20 bp, Artificial Sequence
  chemically synthesized
agcagttgtatgacataaga

SEQ ID NO: 69347 - DNA, 20 bp, Artificial Sequence
  chemically synthesized
gcagcagttgtatgacataa

SEQ ID NO: 69348 - DNA, 20 bp, Artificial Sequence
  chemically synthesized
tggcagcagttgtatgacat

SEQ ID NO: 69349 - DNA, 20 bp, Artificial Sequence
  chemically synthesized
tgtcatacaactgctgccat

SEQ ID NO: 69350 - DNA, 20 bp, Artificial Sequence
  chemically synthesized
ccatgaatcgctaatggcag

SEQ ID NO: 69351 - DNA, 20 bp, Artificial Sequence
  chemically synthesized
ctgccatgaatcgctaatgg

SEQ ID NO: 69352 - DNA, 20 bp, Artificial Sequence
  chemically synthesized
acactgccatgaatcgctaa

SEQ ID NO: 69353 - DNA, 20 bp, Artificial Sequence
  chemically synthesized
ctgctgccattagcgattca

SEQ ID NO: 69354 - DNA, 20 bp, Artificial Sequence
  chemically synthesized
ctgccattagcgattcatgg

SEQ ID NO: 69355 - DNA, 20 bp, Artificial Sequence
  chemically synthesized
ttcatggcagtgtccttgcc

SEQ ID NO: 69356 - DNA, 20 bp, Artificial Sequence
  chemically synthesized
atggcagtgtccttgcccgg

SEQ ID NO: 69357 - DNA, 20 bp, Artificial Sequence
  chemically synthesized
atatgcatgactgccgggca

SEQ ID NO: 69358 - DNA, 20 bp, Artificial Sequence
  chemically synthesized
gatatgcatgactgccgggc

SEQ ID NO: 69359 - DNA, 20 bp, Artificial Sequence
  chemically synthesized
tttggatatgcatgactgcc

SEQ ID NO: 69360 - DNA, 20 bp, Artificial Sequence
  chemically synthesized
atttggatatgcatgactgc

SEQ ID NO: 69361 - DNA, 20 bp, Artificial Sequence
  chemically synthesized
gcagtcatgcatatccaaat

SEQ ID NO: 69362 - DNA, 20 bp, Artificial Sequence
  chemically synthesized
cagtcatgcatatccaaatg

SEQ ID NO: 69363 - DNA, 20 bp, Artificial Sequence
  chemically synthesized
gctagggagtatgcctcatt

SEQ ID NO: 69364 - DNA, 20 bp, Artificial Sequence
  chemically synthesized
tccaaatgaggcatactccc

SEQ ID NO: 69365 - DNA, 20 bp, Artificial Sequence
  chemically synthesized
ggactcttgtaatagctagg

SEQ ID NO: 69366 - DNA, 20 bp, Artificial Sequence
  chemically synthesized
caggactcttgtaatagcta

SEQ ID NO: 69367 - DNA, 20 bp, Artificial Sequence
  chemically synthesized
acaggactcttgtaatagct

SEQ ID NO: 69368 - DNA, 20 bp, Artificial Sequence
  chemically synthesized
gacaggactcttgtaatagc

SEQ ID NO: 69369 - DNA, 20 bp, Artificial Sequence
  chemically synthesized
gcatactccctagctattac

SEQ ID NO: 69370 - DNA, 20 bp, Artificial Sequence
  chemically synthesized
atactccctagctattacaa

SEQ ID NO: 69371 - DNA, 20 bp, Artificial Sequence
  chemically synthesized
gccagacaggactcttgtaa

SEQ ID NO: 69372 - DNA, 20 bp, Artificial Sequence
  chemically synthesized
gctattacaagagtcctgtc

SEQ ID NO: 69373 - DNA, 20 bp, Artificial Sequence
  chemically synthesized
gtcaatgcctgcagccagac

SEQ ID NO: 69374 - DNA, 20 bp, Artificial Sequence
  chemically synthesized
agtcaatgcctgcagccaga

SEQ ID NO: 69375 - DNA, 20 bp, Artificial Sequence
  chemically synthesized
acaagagtcctgtctggctg

SEQ ID NO: 69376 - DNA, 20 bp, Artificial Sequence
  chemically synthesized
caagagtcctgtctggctgc

SEQ ID NO: 69377 - DNA, 20 bp, Artificial Sequence
  chemically synthesized
agtcagtcaatgcctgcagc

SEQ ID NO: 69378 - DNA, 20 bp, Artificial Sequence
  chemically synthesized
gagaagtcagtcaatgcctg

SEQ ID NO: 69379 - DNA, 20 bp, Artificial Sequence
  chemically synthesized
ttgagataaaaaggagaagt

SEQ ID NO: 69380 - DNA, 20 bp, Artificial Sequence
  chemically synthesized
taagttgagataaaaaggag

SEQ ID NO: 69381 - DNA, 20 bp, Artificial Sequence
  chemically synthesized
ttttaagttgagataaaaag

SEQ ID NO: 69382 - DNA, 20 bp, Artificial Sequence
  chemically synthesized
gattttaagttgagataaaa

SEQ ID NO: 69383 - DNA, 20 bp, Artificial Sequence
  chemically synthesized
tgattttaagttgagataaa

SEQ ID NO: 69384 - DNA, 20 bp, Artificial Sequence
  chemically synthesized
caaggcactgattttaagtt

SEQ ID NO: 69385 - DNA, 20 bp, Artificial Sequence
  chemically synthesized
tttttatctcaacttaaaat

SEQ ID NO: 69386 - DNA, 20 bp, Artificial Sequence
  chemically synthesized
gggagcaaggcactgatttt

SEQ ID NO: 69387 - DNA, 20 bp, Artificial Sequence
  chemically synthesized
tgtggcactggatgggagca

SEQ ID NO: 69388 - DNA, 20 bp, Artificial Sequence
  chemically synthesized
atgtggcactggatgggagc

SEQ ID NO: 69389 - DNA, 20 bp, Artificial Sequence
  chemically synthesized
atcagtgccttgctcccatc

SEQ ID NO: 69390 - DNA, 20 bp, Artificial Sequence
  chemically synthesized
tttcatgtggcactggatgg

SEQ ID NO: 69391 - DNA, 20 bp, Artificial Sequence
  chemically synthesized
gatttcatgtggcactggat

SEQ ID NO: 69392 - DNA, 20 bp, Artificial Sequence
  chemically synthesized
ggatttcatgtggcactgga

SEQ ID NO: 69393 - DNA, 20 bp, Artificial Sequence
  chemically synthesized
ccttggatttcatgtggcac

SEQ ID NO: 69394 - DNA, 20 bp, Artificial Sequence
  chemically synthesized
ttgattccttggatttcatg

SEQ ID NO: 69395 - DNA, 20 bp, Artificial Sequence
  chemically synthesized
tccagtgccacatgaaatcc

SEQ ID NO: 69396 - DNA, 20 bp, Artificial Sequence
  chemically synthesized
ccagtgccacatgaaatcca

SEQ ID NO: 69397 - DNA, 20 bp, Artificial Sequence
  chemically synthesized
gagattacactttgattcct

SEQ ID NO: 69398 - DNA, 20 bp, Artificial Sequence
  chemically synthesized
acatgaaatccaaggaatca

SEQ ID NO: 69399 - DNA, 20 bp, Artificial Sequence
  chemically synthesized
gaacatgaggagtggcagcg

SEQ ID NO: 69400 - DNA, 20 bp, Artificial Sequence
  chemically synthesized
ttgaacatgaggagtggcag

SEQ ID NO: 69401 - DNA, 20 bp, Artificial Sequence
  chemically synthesized
gttttgaacatgaggagtgg

SEQ ID NO: 69402 - DNA, 20 bp, Artificial Sequence
  chemically synthesized
catgttttgaacatgaggag

SEQ ID NO: 69403 - DNA, 20 bp, Artificial Sequence
  chemically synthesized
gtccatgttttgaacatgag

SEQ ID NO: 69404 - DNA, 20 bp, Artificial Sequence
  chemically synthesized
tggtccatgttttgaacatg

SEQ ID NO: 69405 - DNA, 20 bp, Artificial Sequence
  chemically synthesized
atggtccatgttttgaacat

SEQ ID NO: 69406 - DNA, 20 bp, Artificial Sequence
  chemically synthesized
cactcctcatgttcaaaaca

SEQ ID NO: 69407 - DNA, 20 bp, Artificial Sequence
  chemically synthesized
catgctttaatattgcataa

SEQ ID NO: 69408 - DNA, 20 bp, Artificial Sequence
  chemically synthesized
tggaccattatgcaatatta

SEQ ID NO: 69409 - DNA, 20 bp, Artificial Sequence
  chemically synthesized
caatattaaagcatgaatcc

SEQ ID NO: 69410 - DNA, 20 bp, Artificial Sequence
  chemically synthesized
cacaacattaacagagttcc

SEQ ID NO: 69411 - DNA, 20 bp, Artificial Sequence
  chemically synthesized
tcacaacattaacagagttc

SEQ ID NO: 69412 - DNA, 20 bp, Artificial Sequence
  chemically synthesized
cctatttcacaacattaaca

SEQ ID NO: 69413 - DNA, 20 bp, Artificial Sequence
  chemically synthesized
cacctatttcacaacattaa

SEQ ID NO: 69414 - DNA, 20 bp, Artificial Sequence
  chemically synthesized
actctgttaatgttgtgaaa

SEQ ID NO: 69415 - DNA, 20 bp, Artificial Sequence
  chemically synthesized
ctctgttaatgttgtgaaat

SEQ ID NO: 69416 - DNA, 20 bp, Artificial Sequence
  chemically synthesized
gttaatgttgtgaaataggt

SEQ ID NO: 69417 - DNA, 20 bp, Artificial Sequence
  chemically synthesized
aatgttgtgaaataggtgag

SEQ ID NO: 69418 - DNA, 20 bp, Artificial Sequence
  chemically synthesized
ttgtgaaataggtgagtagt

SEQ ID NO: 69419 - DNA, 20 bp, Artificial Sequence
  chemically synthesized
gaaataggtgagtagttagc

SEQ ID NO: 69420 - DNA, 20 bp, Artificial Sequence
  chemically synthesized
agcaagaattaccattctga

SEQ ID NO: 69421 - DNA, 20 bp, Artificial Sequence
  chemically synthesized
tttccactgcactgtcagaa

SEQ ID NO: 69422 - DNA, 20 bp, Artificial Sequence
  chemically synthesized
gaattaccattctgacagtg

SEQ ID NO: 69423 - DNA, 20 bp, Artificial Sequence
  chemically synthesized
aagtttttccactgcactgt

SEQ ID NO: 69424 - DNA, 20 bp, Artificial Sequence
  chemically synthesized
ttaccattctgacagtgcag

SEQ ID NO: 69425 - DNA, 20 bp, Artificial Sequence
  chemically synthesized
cctgctttttacaatgaatg

SEQ ID NO: 69426 - DNA, 20 bp, Artificial Sequence
  chemically synthesized
aaaacttcattcattgtaaa

SEQ ID NO: 69427 - DNA, 20 bp, Artificial Sequence
  chemically synthesized
acttcattcattgtaaaaag

SEQ ID NO: 69428 - DNA, 20 bp, Artificial Sequence
  chemically synthesized
cttcattcattgtaaaaagc

SEQ ID NO: 69429 - DNA, 20 bp, Artificial Sequence
  chemically synthesized
ttcattcattgtaaaaagca

SEQ ID NO: 69430 - DNA, 20 bp, Artificial Sequence
  chemically synthesized
cattcattgtaaaaagcagg

SEQ ID NO: 69431 - DNA, 20 bp, Artificial Sequence
  chemically synthesized
attgtaaaaagcagggagtt

SEQ ID NO: 69432 - DNA, 20 bp, Artificial Sequence
  chemically synthesized
cagggagttgagtttctata

SEQ ID NO: 69433 - DNA, 20 bp, Artificial Sequence
  chemically synthesized
agggagttgagtttctatat

SEQ ID NO: 69434 - DNA, 20 bp, Artificial Sequence
  chemically synthesized
gggagttgagtttctatatg

SEQ ID NO: 69435 - DNA, 20 bp, Artificial Sequence
  chemically synthesized
acgtgaaaggcaaccccata

SEQ ID NO: 69436 - DNA, 20 bp, Artificial Sequence
  chemically synthesized
gcaaggggaggggacgtgaa

SEQ ID NO: 69437 - DNA, 20 bp, Artificial Sequence
  chemically synthesized
tgcaaggggaggggacgtga

SEQ ID NO: 69438 - DNA, 20 bp, Artificial Sequence
  chemically synthesized
cattatctctgcaaggggag

SEQ ID NO: 69439 - DNA, 20 bp, Artificial Sequence
  chemically synthesized
tcattatctctgcaagggga

SEQ ID NO: 69440 - DNA, 20 bp, Artificial Sequence
  chemically synthesized
tttcacgtcccctccccttg

SEQ ID NO: 69441 - DNA, 20 bp, Artificial Sequence
  chemically synthesized
ttcattatctctgcaagggg

SEQ ID NO: 69442 - DNA, 20 bp, Artificial Sequence
  chemically synthesized
tttcattatctctgcaaggg

SEQ ID NO: 69443 - DNA, 20 bp, Artificial Sequence
  chemically synthesized
tcacgtcccctccccttgca

SEQ ID NO: 69444 - DNA, 20 bp, Artificial Sequence
  chemically synthesized
tttttcattatctctgcaag

SEQ ID NO: 69445 - DNA, 20 bp, Artificial Sequence
  chemically synthesized
ttttttcattatctctgcaa

SEQ ID NO: 69446 - DNA, 20 bp, Artificial Sequence
  chemically synthesized
attttttcattatctctgca

SEQ ID NO: 69447 - DNA, 20 bp, Artificial Sequence
  chemically synthesized
cattttttcattatctctgc

SEQ ID NO: 69448 - DNA, 20 bp, Artificial Sequence
  chemically synthesized
agagataatgaaaaaatgcc

SEQ ID NO: 69449 - DNA, 20 bp, Artificial Sequence
  chemically synthesized
atcacatctgaaaaatagct

SEQ ID NO: 69450 - DNA, 20 bp, Artificial Sequence
  chemically synthesized
catcacatctgaaaaatagc

SEQ ID NO: 69451 - DNA, 20 bp, Artificial Sequence
  chemically synthesized
aaaaatgcccagctattttt

SEQ ID NO: 69452 - DNA, 20 bp, Artificial Sequence
  chemically synthesized
taaacatcacatctgaaaaa

SEQ ID NO: 69453 - DNA, 20 bp, Artificial Sequence
  chemically synthesized
aaagaacctcttggaaaaga

SEQ ID NO: 69454 - DNA, 20 bp, Artificial Sequence
  chemically synthesized
tgatgtttactttcttttcc

SEQ ID NO: 69455 - DNA, 20 bp, Artificial Sequence
  chemically synthesized
atgtttactttcttttccaa

SEQ ID NO: 69456 - DNA, 20 bp, Artificial Sequence
  chemically synthesized
tgtttactttcttttccaag

SEQ ID NO: 69457 - DNA, 20 bp, Artificial Sequence
  chemically synthesized
ctccaaagaacctcttggaa

SEQ ID NO: 69458 - DNA, 20 bp, Artificial Sequence
  chemically synthesized
tattcctccaaagaacctct

SEQ ID NO: 69459 - DNA, 20 bp, Artificial Sequence
  chemically synthesized
ttcttttccaagaggttctt

SEQ ID NO: 69460 - DNA, 20 bp, Artificial Sequence
  chemically synthesized
cttttccaagaggttctttg

SEQ ID NO: 69461 - DNA, 20 bp, Artificial Sequence
  chemically synthesized
ttttccaagaggttctttgg

SEQ ID NO: 69462 - DNA, 20 bp, Artificial Sequence
  chemically synthesized
tatttctgtgtattcctcca

SEQ ID NO: 69463 - DNA, 20 bp, Artificial Sequence
  chemically synthesized
aggttctttggaggaataca

SEQ ID NO: 69464 - DNA, 20 bp, Artificial Sequence
  chemically synthesized
gaatacacagaaatatttta

SEQ ID NO: 69465 - DNA, 20 bp, Artificial Sequence
  chemically synthesized
attttacctctattattttg

SEQ ID NO: 69466 - DNA, 20 bp, Artificial Sequence
  chemically synthesized
tttatagaaccacaaaataa

SEQ ID NO: 69467 - DNA, 20 bp, Artificial Sequence
  chemically synthesized
tatagaaccacaaaataata

SEQ ID NO: 69468 - DNA, 20 bp, Artificial Sequence
  chemically synthesized
atagaaccacaaaataatag

SEQ ID NO: 69469 - DNA, 20 bp, Artificial Sequence
  chemically synthesized
caaaataatagaggtaaaat

SEQ ID NO: 69470 - DNA, 20 bp, Artificial Sequence
  chemically synthesized
aatagaggtaaaataagctt

SEQ ID NO: 69471 - DNA, 20 bp, Artificial Sequence
  chemically synthesized
tatttgcttattttattcca

SEQ ID NO: 69472 - DNA, 20 bp, Artificial Sequence
  chemically synthesized
aataagctttggaataaaat

SEQ ID NO: 69473 - DNA, 20 bp, Artificial Sequence
  chemically synthesized
ttggaataaaataagcaaat

SEQ ID NO: 69474 - DNA, 20 bp, Artificial Sequence
  chemically synthesized
ataaaataagcaaataagac

SEQ ID NO: 69475 - DNA, 20 bp, Artificial Sequence
  chemically synthesized
aagcaaataagactagtttc

SEQ ID NO: 69476 - DNA, 20 bp, Artificial Sequence
  chemically synthesized
agaaatcgtagactagaaac

SEQ ID NO: 69477 - DNA, 20 bp, Artificial Sequence
  chemically synthesized
ttttcccagaaatcgtagac

SEQ ID NO: 69478 - DNA, 20 bp, Artificial Sequence
  chemically synthesized
agtttctagtctacgatttc

SEQ ID NO: 69479 - DNA, 20 bp, Artificial Sequence
  chemically synthesized
tcgcattttcccagaaatcg

SEQ ID NO: 69480 - DNA, 20 bp, Artificial Sequence
  chemically synthesized
gtttctagtctacgatttct

SEQ ID NO: 69481 - DNA, 20 bp, Artificial Sequence
  chemically synthesized
ctaaagttctcgcattttcc

SEQ ID NO: 69482 - DNA, 20 bp, Artificial Sequence
  chemically synthesized
tacgatttctgggaaaatgc

SEQ ID NO: 69483 - DNA, 20 bp, Artificial Sequence
  chemically synthesized
ctgggaaaatgcgagaactt

SEQ ID NO: 69484 - DNA, 20 bp, Artificial Sequence
  chemically synthesized
aaaataaacaagtttaacta

SEQ ID NO: 69485 - DNA, 20 bp, Artificial Sequence
  chemically synthesized
tcacctagaataaaataaac

SEQ ID NO: 69486 - DNA, 20 bp, Artificial Sequence
  chemically synthesized
taaacttgtttattttattc

SEQ ID NO: 69487 - DNA, 20 bp, Artificial Sequence
  chemically synthesized
aaacttgtttattttattct

SEQ ID NO: 69488 - DNA, 20 bp, Artificial Sequence
  chemically synthesized
ttaagttaataaaattcacc

SEQ ID NO: 69489 - DNA, 20 bp, Artificial Sequence
  chemically synthesized
aggtgaattttattaactta

SEQ ID NO: 69490 - DNA, 20 bp, Artificial Sequence
  chemically synthesized
ggtgaattttattaacttaa

SEQ ID NO: 69491 - DNA, 20 bp, Artificial Sequence
  chemically synthesized
ttattattttatgatccttt

SEQ ID NO: 69492 - DNA, 20 bp, Artificial Sequence
  chemically synthesized
aaatgtggattttaaaagta

SEQ ID NO: 69493 - DNA, 20 bp, Artificial Sequence
  chemically synthesized
agaaatgtggattttaaaag

SEQ ID NO: 69494 - DNA, 20 bp, Artificial Sequence
  chemically synthesized
gatagaaatgtggattttaa

SEQ ID NO: 69495 - DNA, 20 bp, Artificial Sequence
  chemically synthesized
tataataattgatagaaatg

SEQ ID NO: 69496 - DNA, 20 bp, Artificial Sequence
  chemically synthesized
aatatgcatataataattga

SEQ ID NO: 69497 - DNA, 20 bp, Artificial Sequence
  chemically synthesized
caattattatatgcatattc

SEQ ID NO: 69498 - DNA, 20 bp, Artificial Sequence
  chemically synthesized
tatgcatattccagtgtgta

SEQ ID NO: 69499 - DNA, 20 bp, Artificial Sequence
  chemically synthesized
atctttttatctgtacacac

SEQ ID NO: 69500 - DNA, 20 bp, Artificial Sequence
  chemically synthesized
ttccagtgtgtacagataaa

SEQ ID NO: 69501 - DNA, 20 bp, Artificial Sequence
  chemically synthesized
gtacagataaaaagatattc

SEQ ID NO: 69502 - DNA, 20 bp, Artificial Sequence
  chemically synthesized
tattcaagtacaactaaacc

SEQ ID NO: 69503 - DNA, 20 bp, Artificial Sequence
  chemically synthesized
ttcaagtacaactaaaccta

SEQ ID NO: 69504 - DNA, 20 bp, Artificial Sequence
  chemically synthesized
tctgatgaaatctctaggtt

SEQ ID NO: 69505 - DNA, 20 bp, Artificial Sequence
  chemically synthesized
tattttctgatgaaatctct

SEQ ID NO: 69506 - DNA, 20 bp, Artificial Sequence
  chemically synthesized
ttattttctgatgaaatctc

SEQ ID NO: 69507 - DNA, 20 bp, Artificial Sequence
  chemically synthesized
actaaacctagagatttcat

SEQ ID NO: 69508 - DNA, 20 bp, Artificial Sequence
  chemically synthesized
cagaaaataatccccaaaat

SEQ ID NO: 69509 - DNA, 20 bp, Artificial Sequence
  chemically synthesized
tgcaatagcagctcattttg

SEQ ID NO: 69510 - DNA, 20 bp, Artificial Sequence
  chemically synthesized
ttgcaatagcagctcatttt

SEQ ID NO: 69511 - DNA, 20 bp, Artificial Sequence
  chemically synthesized
tttgcaatagcagctcattt

SEQ ID NO: 69512 - DNA, 20 bp, Artificial Sequence
  chemically synthesized
tattttccattttgcaatag

SEQ ID NO: 69513 - DNA, 20 bp, Artificial Sequence
  chemically synthesized
tcatattttccattttgcaa

SEQ ID NO: 69514 - DNA, 20 bp, Artificial Sequence
  chemically synthesized
aatgagctgctattgcaaaa

SEQ ID NO: 69515 - DNA, 20 bp, Artificial Sequence
  chemically synthesized
aatggaaaatatgatgtaaa

SEQ ID NO: 69516 - DNA, 20 bp, Artificial Sequence
  chemically synthesized
atggaaaatatgatgtaaac

SEQ ID NO: 69517 - DNA, 20 bp, Artificial Sequence
  chemically synthesized
tatgatgtaaacaggcattt

SEQ ID NO: 69518 - DNA, 20 bp, Artificial Sequence
  chemically synthesized
atgatgtaaacaggcatttt

SEQ ID NO: 69519 - DNA, 20 bp, Artificial Sequence
  chemically synthesized
aaacaggcattttgggcttt

SEQ ID NO: 69520 - DNA, 20 bp, Artificial Sequence
  chemically synthesized
aatttatgctgtttatctga

SEQ ID NO: 69521 - DNA, 20 bp, Artificial Sequence
  chemically synthesized
attttgggctttcagataaa

SEQ ID NO: 69522 - DNA, 20 bp, Artificial Sequence
  chemically synthesized
aaacagcataaatttttgaa

SEQ ID NO: 69523 - DNA, 20 bp, Artificial Sequence
  chemically synthesized
aacagcataaatttttgaac

SEQ ID NO: 69524 - DNA, 20 bp, Artificial Sequence
  chemically synthesized
tttttctctttgtggaaaac

SEQ ID NO: 69525 - DNA, 20 bp, Artificial Sequence
  chemically synthesized
gatacgtcttgttttccaca

SEQ ID NO: 69526 - DNA, 20 bp, Artificial Sequence
  chemically synthesized
tacgtcttgttttccacaaa

SEQ ID NO: 69527 - DNA, 20 bp, Artificial Sequence
  chemically synthesized
acaccttgtttttctctttg

SEQ ID NO: 69528 - DNA, 20 bp, Artificial Sequence
  chemically synthesized
ttttccacaaagagaaaaac

SEQ ID NO: 69529 - DNA, 20 bp, Artificial Sequence
  chemically synthesized
tttccacaaagagaaaaaca

SEQ ID NO: 69530 - DNA, 20 bp, Artificial Sequence
  chemically synthesized
acaaagagaaaaacaaggtg

SEQ ID NO: 69531 - DNA, 20 bp, Artificial Sequence
  chemically synthesized
gagaaaaacaaggtgtagtg

SEQ ID NO: 69532 - DNA, 20 bp, Artificial Sequence
  chemically synthesized
gaaaaacaaggtgtagtgaa

SEQ ID NO: 69533 - DNA, 20 bp, Artificial Sequence
  chemically synthesized
ttaaaagcaagatcagaaat

SEQ ID NO: 69534 - DNA, 20 bp, Artificial Sequence
  chemically synthesized
tcatttgttaaaagcaagat

SEQ ID NO: 69535 - DNA, 20 bp, Artificial Sequence
  chemically synthesized
cgttctcatttgttaaaagc

SEQ ID NO: 69536 - DNA, 20 bp, Artificial Sequence
  chemically synthesized
gagacgttctcatttgttaa

SEQ ID NO: 69537 - DNA, 20 bp, Artificial Sequence
  chemically synthesized
tgatcttgcttttaacaaat

SEQ ID NO: 69538 - DNA, 20 bp, Artificial Sequence
  chemically synthesized
tttaacaaatgagaacgtct

SEQ ID NO: 69539 - DNA, 20 bp, Artificial Sequence
  chemically synthesized
caaatgagaacgtctcagct

SEQ ID NO: 69540 - DNA, 20 bp, Artificial Sequence
  chemically synthesized
agtttctggttgacttagct

SEQ ID NO: 69541 - DNA, 20 bp, Artificial Sequence
  chemically synthesized
aacgtctcagctaagtcaac

SEQ ID NO: 69542 - DNA, 20 bp, Artificial Sequence
  chemically synthesized
gaaatagtttctggttgact

SEQ ID NO: 69543 - DNA, 20 bp, Artificial Sequence
  chemically synthesized
atagattaggaaatagtttc

SEQ ID NO: 69544 - DNA, 20 bp, Artificial Sequence
  chemically synthesized
ttaatttatagattaggaaa

SEQ ID NO: 69545 - DNA, 20 bp, Artificial Sequence
  chemically synthesized
aaccctttaatttatagatt

SEQ ID NO: 69546 - DNA, 20 bp, Artificial Sequence
  chemically synthesized
aaaccctttaatttatagat

SEQ ID NO: 69547 - DNA, 20 bp, Artificial Sequence
  chemically synthesized
atttcctaatctataaatta

SEQ ID NO: 69548 - DNA, 20 bp, Artificial Sequence
  chemically synthesized
aggccaaaccctttaattta

SEQ ID NO: 69549 - DNA, 20 bp, Artificial Sequence
  chemically synthesized
tttcctaatctataaattaa

SEQ ID NO: 69550 - DNA, 20 bp, Artificial Sequence
  chemically synthesized
ttcctaatctataaattaaa

SEQ ID NO: 69551 - DNA, 20 bp, Artificial Sequence
  chemically synthesized
aatctataaattaaagggtt

SEQ ID NO: 69552 - DNA, 20 bp, Artificial Sequence
  chemically synthesized
ataaattaaagggtttggcc

SEQ ID NO: 69553 - DNA, 20 bp, Artificial Sequence
  chemically synthesized
gaaaagactagaaattatct

SEQ ID NO: 69554 - DNA, 20 bp, Artificial Sequence
  chemically synthesized
agaaaagactagaaattatc

SEQ ID NO: 69555 - DNA, 20 bp, Artificial Sequence
  chemically synthesized
ggtttggcctagataatttc

SEQ ID NO: 69556 - DNA, 20 bp, Artificial Sequence
  chemically synthesized
gggttgaagccagaaaagac

SEQ ID NO: 69557 - DNA, 20 bp, Artificial Sequence
  chemically synthesized
agataatttctagtcttttc

SEQ ID NO: 69558 - DNA, 20 bp, Artificial Sequence
  chemically synthesized
gggaggggttgaagccagaa

SEQ ID NO: 69559 - DNA, 20 bp, Artificial Sequence
  chemically synthesized
aagcagggaggggttgaagc

SEQ ID NO: 69560 - DNA, 20 bp, Artificial Sequence
  chemically synthesized
gagtaagcagggaggggttg

SEQ ID NO: 69561 - DNA, 20 bp, Artificial Sequence
  chemically synthesized
gagagagagtaagcagggag

SEQ ID NO: 69562 - DNA, 20 bp, Artificial Sequence
  chemically synthesized
agagagagagtaagcaggga

SEQ ID NO: 69563 - DNA, 20 bp, Artificial Sequence
  chemically synthesized
gagagagagagtaagcaggg

SEQ ID NO: 69564 - DNA, 20 bp, Artificial Sequence
  chemically synthesized
agagagagagagtaagcagg

SEQ ID NO: 69565 - DNA, 20 bp, Artificial Sequence
  chemically synthesized
agagagagagagagtaagca

SEQ ID NO: 69566 - DNA, 20 bp, Artificial Sequence
  chemically synthesized
gagagagagagagagtaagc

SEQ ID NO: 69567 - DNA, 20 bp, Artificial Sequence
  chemically synthesized
agagagagagagagagtaag

SEQ ID NO: 69568 - DNA, 20 bp, Artificial Sequence
  chemically synthesized
gagagagagagagagagagt

SEQ ID NO: 69569 - DNA, 20 bp, Artificial Sequence
  chemically synthesized
gagagagagagagagagaga

SEQ ID NO: 69570 - DNA, 20 bp, Artificial Sequence
  chemically synthesized
gagagagagagagagagaga

SEQ ID NO: 69571 - DNA, 20 bp, Artificial Sequence
  chemically synthesized
aagagagagagagagagaga

SEQ ID NO: 69572 - DNA, 20 bp, Artificial Sequence
  chemically synthesized
gaaagagagagagagagaga

SEQ ID NO: 69573 - DNA, 20 bp, Artificial Sequence
  chemically synthesized
tagaaagagagagagagaga

SEQ ID NO: 69574 - DNA, 20 bp, Artificial Sequence
  chemically synthesized
tatagaaagagagagagaga

SEQ ID NO: 69575 - DNA, 20 bp, Artificial Sequence
  chemically synthesized
tatatagaaagagagagaga

SEQ ID NO: 69576 - DNA, 20 bp, Artificial Sequence
  chemically synthesized
tatatatagaaagagagaga

SEQ ID NO: 69577 - DNA, 20 bp, Artificial Sequence
  chemically synthesized
tatatatatagaaagagaga

SEQ ID NO: 69578 - DNA, 20 bp, Artificial Sequence
  chemically synthesized
tatatatatatagaaagaga

SEQ ID NO: 69579 - DNA, 20 bp, Artificial Sequence
  chemically synthesized
tatatatatatatagaaaga

SEQ ID NO: 69580 - DNA, 20 bp, Artificial Sequence
  chemically synthesized
tgtatatatatatatagaaa

SEQ ID NO: 69581 - DNA, 20 bp, Artificial Sequence
  chemically synthesized
tgtgtatatatatatataga

SEQ ID NO: 69582 - DNA, 20 bp, Artificial Sequence
  chemically synthesized
tgtgtgtgtatatatatata

SEQ ID NO: 69583 - DNA, 20 bp, Artificial Sequence
  chemically synthesized
gactctgtctcaaaaagaaa

SEQ ID NO: 69584 - DNA, 20 bp, Artificial Sequence
  chemically synthesized
ttttttttctttttcttttt

SEQ ID NO: 69585 - DNA, 20 bp, Artificial Sequence
  chemically synthesized
ttttctttttctttttgaga

SEQ ID NO: 69586 - DNA, 20 bp, Artificial Sequence
  chemically synthesized
gagtaagactctgtctcaaa

SEQ ID NO: 69587 - DNA, 20 bp, Artificial Sequence
  chemically synthesized
ttctttttctttttgagaca

SEQ ID NO: 69588 - DNA, 20 bp, Artificial Sequence
  chemically synthesized
cggagcctgggtgacagagt

SEQ ID NO: 69589 - DNA, 20 bp, Artificial Sequence
  chemically synthesized
cagagtcttactctgtcacc

SEQ ID NO: 69590 - DNA, 20 bp, Artificial Sequence
  chemically synthesized
aacccggagcctgggtgaca

SEQ ID NO: 69591 - DNA, 20 bp, Artificial Sequence
  chemically synthesized
agagtcttactctgtcaccc

SEQ ID NO: 69592 - DNA, 20 bp, Artificial Sequence
  chemically synthesized
tgaacccggagcctgggtga

SEQ ID NO: 69593 - DNA, 20 bp, Artificial Sequence
  chemically synthesized
ttactctgtcacccaggctc

SEQ ID NO: 69594 - DNA, 20 bp, Artificial Sequence
  chemically synthesized
tactctgtcacccaggctcc

SEQ ID NO: 69595 - DNA, 20 bp, Artificial Sequence
  chemically synthesized
attgcttgaacccggagcct

SEQ ID NO: 69596 - DNA, 20 bp, Artificial Sequence
  chemically synthesized
aattgcttgaacccggagcc

SEQ ID NO: 69597 - DNA, 20 bp, Artificial Sequence
  chemically synthesized
gtcacccaggctccgggttc

SEQ ID NO: 69598 - DNA, 20 bp, Artificial Sequence
  chemically synthesized
gggagaattgcttgaacccg

SEQ ID NO: 69599 - DNA, 20 bp, Artificial Sequence
  chemically synthesized
gtgggagaattgcttgaacc

SEQ ID NO: 69600 - DNA, 20 bp, Artificial Sequence
  chemically synthesized
ttcaagcaattctcccacct

SEQ ID NO: 69601 - DNA, 20 bp, Artificial Sequence
  chemically synthesized
tactcgggaggctgaggtgg

SEQ ID NO: 69602 - DNA, 20 bp, Artificial Sequence
  chemically synthesized
gctactcgggaggctgaggt

SEQ ID NO: 69603 - DNA, 20 bp, Artificial Sequence
  chemically synthesized
agctactcgggaggctgagg

SEQ ID NO: 69604 - DNA, 20 bp, Artificial Sequence
  chemically synthesized
cccagctactcgggaggctg

SEQ ID NO: 69605 - DNA, 20 bp, Artificial Sequence
  chemically synthesized
tcccagctactcgggaggct

SEQ ID NO: 69606 - DNA, 20 bp, Artificial Sequence
  chemically synthesized
ttctcccacctcagcctccc

SEQ ID NO: 69607 - DNA, 20 bp, Artificial Sequence
  chemically synthesized
tcccacctcagcctcccgag

SEQ ID NO: 69608 - DNA, 20 bp, Artificial Sequence
  chemically synthesized
catagtcccagctactcggg

SEQ ID NO: 69609 - DNA, 20 bp, Artificial Sequence
  chemically synthesized
ccatagtcccagctactcgg

SEQ ID NO: 69610 - DNA, 20 bp, Artificial Sequence
  chemically synthesized
acctcagcctcccgagtagc

SEQ ID NO: 69611 - DNA, 20 bp, Artificial Sequence
  chemically synthesized
acccatagtcccagctactc

SEQ ID NO: 69612 - DNA, 20 bp, Artificial Sequence
  chemically synthesized
cctcagcctcccgagtagct

SEQ ID NO: 69613 - DNA, 20 bp, Artificial Sequence
  chemically synthesized
cacccatagtcccagctact

SEQ ID NO: 69614 - DNA, 20 bp, Artificial Sequence
  chemically synthesized
ctcccgagtagctgggacta

SEQ ID NO: 69615 - DNA, 20 bp, Artificial Sequence
  chemically synthesized
tcccgagtagctgggactat

SEQ ID NO: 69616 - DNA, 20 bp, Artificial Sequence
  chemically synthesized
gtggcatgcacccatagtcc

SEQ ID NO: 69617 - DNA, 20 bp, Artificial Sequence
  chemically synthesized
ggtgtggtggcatgcaccca

SEQ ID NO: 69618 - DNA, 20 bp, Artificial Sequence
  chemically synthesized
tgggtgcatgccaccacacc

SEQ ID NO: 69619 - DNA, 20 bp, Artificial Sequence
  chemically synthesized
aaacatttagccgggtgtgg

SEQ ID NO: 69620 - DNA, 20 bp, Artificial Sequence
  chemically synthesized
aaaaaacatttagccgggtg

SEQ ID NO: 69621 - DNA, 20 bp, Artificial Sequence
  chemically synthesized
aatacaaaaaacatttagcc

SEQ ID NO: 69622 - DNA, 20 bp, Artificial Sequence
  chemically synthesized
aaatacaaaaaacatttagc

SEQ ID NO: 69623 - DNA, 20 bp, Artificial Sequence
  chemically synthesized
ctaaaaatacaaaaaacatt

SEQ ID NO: 69624 - DNA, 20 bp, Artificial Sequence
  chemically synthesized
ctaaatgttttttgtatttt

SEQ ID NO: 69625 - DNA, 20 bp, Artificial Sequence
  chemically synthesized
aatgttttttgtatttttag

SEQ ID NO: 69626 - DNA, 20 bp, Artificial Sequence
  chemically synthesized
tgttttttgtatttttagta

SEQ ID NO: 69627 - DNA, 20 bp, Artificial Sequence
  chemically synthesized
ttttgtatttttagtagaga

SEQ ID NO: 69628 - DNA, 20 bp, Artificial Sequence
  chemically synthesized
tttgtatttttagtagagac

SEQ ID NO: 69629 - DNA, 20 bp, Artificial Sequence
  chemically synthesized
ttgtatttttagtagagacg

SEQ ID NO: 69630 - DNA, 20 bp, Artificial Sequence
  chemically synthesized
gagacggggtttcaccatgt

SEQ ID NO: 69631 - DNA, 20 bp, Artificial Sequence
  chemically synthesized
cgagaccagcttggccaaca

SEQ ID NO: 69632 - DNA, 20 bp, Artificial Sequence
  chemically synthesized
ggggtttcaccatgttggcc

SEQ ID NO: 69633 - DNA, 20 bp, Artificial Sequence
  chemically synthesized
tttcaccatgttggccaagc

SEQ ID NO: 69634 - DNA, 20 bp, Artificial Sequence
  chemically synthesized
ccaggagttcgagaccagct

SEQ ID NO: 69635 - DNA, 20 bp, Artificial Sequence
  chemically synthesized
tgaggccaggagttcgagac

SEQ ID NO: 69636 - DNA, 20 bp, Artificial Sequence
  chemically synthesized
ccaagctggtctcgaactcc

SEQ ID NO: 69637 - DNA, 20 bp, Artificial Sequence
  chemically synthesized
tcacctgaggccaggagttc

SEQ ID NO: 69638 - DNA, 20 bp, Artificial Sequence
  chemically synthesized
tggtctcgaactcctggcct

SEQ ID NO: 69639 - DNA, 20 bp, Artificial Sequence
  chemically synthesized
ggcagatcacctgaggccag

SEQ ID NO: 69640 - DNA, 20 bp, Artificial Sequence
  chemically synthesized
ggtctcgaactcctggcctc

SEQ ID NO: 69641 - DNA, 20 bp, Artificial Sequence
  chemically synthesized
caggcagatcacctgaggcc

SEQ ID NO: 69642 - DNA, 20 bp, Artificial Sequence
  chemically synthesized
gcaggcagatcacctgaggc

SEQ ID NO: 69643 - DNA, 20 bp, Artificial Sequence
  chemically synthesized
caaggcaggcagatcacctg

SEQ ID NO: 69644 - DNA, 20 bp, Artificial Sequence
  chemically synthesized
ccaaggcaggcagatcacct

SEQ ID NO: 69645 - DNA, 20 bp, Artificial Sequence
  chemically synthesized
ctcaggtgatctgcctgcct

SEQ ID NO: 69646 - DNA, 20 bp, Artificial Sequence
  chemically synthesized
ctttgagaggccaaggcagg

SEQ ID NO: 69647 - DNA, 20 bp, Artificial Sequence
  chemically synthesized
gcactttgagaggccaaggc

SEQ ID NO: 69648 - DNA, 20 bp, Artificial Sequence
  chemically synthesized
agcactttgagaggccaagg

SEQ ID NO: 69649 - DNA, 20 bp, Artificial Sequence
  chemically synthesized
cccagcactttgagaggcca

SEQ ID NO: 69650 - DNA, 20 bp, Artificial Sequence
  chemically synthesized
tcccagcactttgagaggcc

SEQ ID NO: 69651 - DNA, 20 bp, Artificial Sequence
  chemically synthesized
ctgcctgccttggcctctca

SEQ ID NO: 69652 - DNA, 20 bp, Artificial Sequence
  chemically synthesized
tataatcccagcactttgag

SEQ ID NO: 69653 - DNA, 20 bp, Artificial Sequence
  chemically synthesized
ctataatcccagcactttga

SEQ ID NO: 69654 - DNA, 20 bp, Artificial Sequence
  chemically synthesized
gccttggcctctcaaagtgc

SEQ ID NO: 69655 - DNA, 20 bp, Artificial Sequence
  chemically synthesized
gcctataatcccagcacttt

SEQ ID NO: 69656 - DNA, 20 bp, Artificial Sequence
  chemically synthesized
ccttggcctctcaaagtgct

SEQ ID NO: 69657 - DNA, 20 bp, Artificial Sequence
  chemically synthesized
ctctcaaagtgctgggatta

SEQ ID NO: 69658 - DNA, 20 bp, Artificial Sequence
  chemically synthesized
tctcaaagtgctgggattat

SEQ ID NO: 69659 - DNA, 20 bp, Artificial Sequence
  chemically synthesized
gtggcccatgcctataatcc

SEQ ID NO: 69660 - DNA, 20 bp, Artificial Sequence
  chemically synthesized
aagtgctgggattataggca

SEQ ID NO: 69661 - DNA, 20 bp, Artificial Sequence
  chemically synthesized
agtgctgggattataggcat

SEQ ID NO: 69662 - DNA, 20 bp, Artificial Sequence
  chemically synthesized
taggcatgggccaccgcacc

SEQ ID NO: 69663 - DNA, 20 bp, Artificial Sequence
  chemically synthesized
tgcaatctggccaggtgcgg

SEQ ID NO: 69664 - DNA, 20 bp, Artificial Sequence
  chemically synthesized
acctgcaatctggccaggtg

SEQ ID NO: 69665 - DNA, 20 bp, Artificial Sequence
  chemically synthesized
catgggccaccgcacctggc

SEQ ID NO: 69666 - DNA, 20 bp, Artificial Sequence
  chemically synthesized
aagatacctgcaatctggcc

SEQ ID NO: 69667 - DNA, 20 bp, Artificial Sequence
  chemically synthesized
aaagatacctgcaatctggc

SEQ ID NO: 69668 - DNA, 20 bp, Artificial Sequence
  chemically synthesized
caccgcacctggccagattg

SEQ ID NO: 69669 - DNA, 20 bp, Artificial Sequence
  chemically synthesized
accgcacctggccagattgc

SEQ ID NO: 69670 - DNA, 20 bp, Artificial Sequence
  chemically synthesized
tgttaaagatacctgcaatc

SEQ ID NO: 69671 - DNA, 20 bp, Artificial Sequence
  chemically synthesized
cagattgcaggtatctttaa

SEQ ID NO: 69672 - DNA, 20 bp, Artificial Sequence
  chemically synthesized
agattgcaggtatctttaac

SEQ ID NO: 69673 - DNA, 20 bp, Artificial Sequence
  chemically synthesized
ggtaacactccaacctgtta

SEQ ID NO: 69674 - DNA, 20 bp, Artificial Sequence
  chemically synthesized
tgcaggtatctttaacaggt

SEQ ID NO: 69675 - DNA, 20 bp, Artificial Sequence
  chemically synthesized
caggtatctttaacaggttg

SEQ ID NO: 69676 - DNA, 20 bp, Artificial Sequence
  chemically synthesized
cccaagattgatgaaaattc

SEQ ID NO: 69677 - DNA, 20 bp, Artificial Sequence
  chemically synthesized
tcccaagattgatgaaaatt

SEQ ID NO: 69678 - DNA, 20 bp, Artificial Sequence
  chemically synthesized
acctgaattttcatcaatct

SEQ ID NO: 69679 - DNA, 20 bp, Artificial Sequence
  chemically synthesized
cctgaattttcatcaatctt

SEQ ID NO: 69680 - DNA, 20 bp, Artificial Sequence
  chemically synthesized
ttagcagctatatgtttccc

SEQ ID NO: 69681 - DNA, 20 bp, Artificial Sequence
  chemically synthesized
catcaatcttgggaaacata

SEQ ID NO: 69682 - DNA, 20 bp, Artificial Sequence
  chemically synthesized
gggaaacatatagctgctaa

SEQ ID NO: 69683 - DNA, 20 bp, Artificial Sequence
  chemically synthesized
taggaagttaaaactgttag

SEQ ID NO: 69684 - DNA, 20 bp, Artificial Sequence
  chemically synthesized
gagtaggaagttaaaactgt

SEQ ID NO: 69685 - DNA, 20 bp, Artificial Sequence
  chemically synthesized
cgagttaaacatagagtagg

SEQ ID NO: 69686 - DNA, 20 bp, Artificial Sequence
  chemically synthesized
aaacgagttaaacatagagt

SEQ ID NO: 69687 - DNA, 20 bp, Artificial Sequence
  chemically synthesized
taaacgagttaaacatagag

SEQ ID NO: 69688 - DNA, 20 bp, Artificial Sequence
  chemically synthesized
tgttaaacgagttaaacata

SEQ ID NO: 69689 - DNA, 20 bp, Artificial Sequence
  chemically synthesized
tatgttaaacgagttaaaca

SEQ ID NO: 69690 - DNA, 20 bp, Artificial Sequence
  chemically synthesized
cgtgttttaatatgttaaac

SEQ ID NO: 69691 - DNA, 20 bp, Artificial Sequence
  chemically synthesized
gtttaacatattaaaacacg

SEQ ID NO: 69692 - DNA, 20 bp, Artificial Sequence
  chemically synthesized
acgcagacaatattaaactg

SEQ ID NO: 69693 - DNA, 20 bp, Artificial Sequence
  chemically synthesized
ttcttctccatgtgttgctg

SEQ ID NO: 69694 - DNA, 20 bp, Artificial Sequence
  chemically synthesized
tattaaactgcagcaacaca

SEQ ID NO: 69695 - DNA, 20 bp, Artificial Sequence
  chemically synthesized
ttaaactgcagcaacacatg

SEQ ID NO: 69696 - DNA, 20 bp, Artificial Sequence
  chemically synthesized
aactgcagcaacacatggag

SEQ ID NO: 69697 - DNA, 20 bp, Artificial Sequence
  chemically synthesized
cagcaacacatggagaagaa

SEQ ID NO: 69698 - DNA, 20 bp, Artificial Sequence
  chemically synthesized
catggagaagaaaagcatcg

SEQ ID NO: 69699 - DNA, 20 bp, Artificial Sequence
  chemically synthesized
gaagaaaagcatcgtggaaa

SEQ ID NO: 69700 - DNA, 20 bp, Artificial Sequence
  chemically synthesized
aagaaaagcatcgtggaaat

SEQ ID NO: 69701 - DNA, 20 bp, Artificial Sequence
  chemically synthesized
agaaaagcatcgtggaaatg

SEQ ID NO: 69702 - DNA, 20 bp, Artificial Sequence
  chemically synthesized
aagcatcgtggaaatggggt

SEQ ID NO: 69703 - DNA, 20 bp, Artificial Sequence
  chemically synthesized
atcgtggaaatggggtaaga

SEQ ID NO: 69704 - DNA, 20 bp, Artificial Sequence
  chemically synthesized
tcgtggaaatggggtaagat

SEQ ID NO: 69705 - DNA, 20 bp, Artificial Sequence
  chemically synthesized
aatggggtaagatgggactc

SEQ ID NO: 69706 - DNA, 20 bp, Artificial Sequence
  chemically synthesized
ggggtaagatgggactctag

SEQ ID NO: 69707 - DNA, 20 bp, Artificial Sequence
  chemically synthesized
ggaggttttaaacacttcta

SEQ ID NO: 69708 - DNA, 20 bp, Artificial Sequence
  chemically synthesized
tgggaggttttaaacacttc

SEQ ID NO: 69709 - DNA, 20 bp, Artificial Sequence
  chemically synthesized
acttaaaatttcagcatggg

SEQ ID NO: 69710 - DNA, 20 bp, Artificial Sequence
  chemically synthesized
tacttaaaatttcagcatgg

SEQ ID NO: 69711 - DNA, 20 bp, Artificial Sequence
  chemically synthesized
tttacttaaaatttcagcat

SEQ ID NO: 69712 - DNA, 20 bp, Artificial Sequence
  chemically synthesized
atttacttaaaatttcagca

SEQ ID NO: 69713 - DNA, 20 bp, Artificial Sequence
  chemically synthesized
acctcccatgctgaaatttt

SEQ ID NO: 69714 - DNA, 20 bp, Artificial Sequence
  chemically synthesized
tcaacatttacttaaaattt

SEQ ID NO: 69715 - DNA, 20 bp, Artificial Sequence
  chemically synthesized
aaattttaagtaaatgttga

SEQ ID NO: 69716 - DNA, 20 bp, Artificial Sequence
  chemically synthesized
aattttaagtaaatgttgac

SEQ ID NO: 69717 - DNA, 20 bp, Artificial Sequence
  chemically synthesized
aagtaaatgttgacgggcaa

SEQ ID NO: 69718 - DNA, 20 bp, Artificial Sequence
  chemically synthesized
aatttgttgtcactgaaatt

SEQ ID NO: 69719 - DNA, 20 bp, Artificial Sequence
  chemically synthesized
ggtaggagtattctaaattt

SEQ ID NO: 69720 - DNA, 20 bp, Artificial Sequence
  chemically synthesized
caaaacataagaagaggtag

SEQ ID NO: 69721 - DNA, 20 bp, Artificial Sequence
  chemically synthesized
ggcaaaacataagaagaggt

SEQ ID NO: 69722 - DNA, 20 bp, Artificial Sequence
  chemically synthesized
gggcaaaacataagaagagg

SEQ ID NO: 69723 - DNA, 20 bp, Artificial Sequence
  chemically synthesized
aaagggcaaaacataagaag

SEQ ID NO: 69724 - DNA, 20 bp, Artificial Sequence
  chemically synthesized
aaaagggcaaaacataagaa

SEQ ID NO: 69725 - DNA, 20 bp, Artificial Sequence
  chemically synthesized
ttaaaagggcaaaacataag

SEQ ID NO: 69726 - DNA, 20 bp, Artificial Sequence
  chemically synthesized
atcttaaaagggcaaaacat

SEQ ID NO: 69727 - DNA, 20 bp, Artificial Sequence
  chemically synthesized
ttcttatgttttgccctttt

SEQ ID NO: 69728 - DNA, 20 bp, Artificial Sequence
  chemically synthesized
ttttaatttgtatcttaaaa

SEQ ID NO: 69729 - DNA, 20 bp, Artificial Sequence
  chemically synthesized
attttaatttgtatcttaaa

SEQ ID NO: 69730 - DNA, 20 bp, Artificial Sequence
  chemically synthesized
aattttaatttgtatcttaa

SEQ ID NO: 69731 - DNA, 20 bp, Artificial Sequence
  chemically synthesized
aaattaaaatttttaaaaaa

SEQ ID NO: 69732 - DNA, 20 bp, Artificial Sequence
  chemically synthesized
ttaaaatttttaaaaaatag

SEQ ID NO: 69733 - DNA, 20 bp, Artificial Sequence
  chemically synthesized
aaaatttttaaaaaatagaa

SEQ ID NO: 69734 - DNA, 20 bp, Artificial Sequence
  chemically synthesized
ttttaaaaaatagaagagct

SEQ ID NO: 69735 - DNA, 20 bp, Artificial Sequence
  chemically synthesized
aatagaagagctcagaaata

SEQ ID NO: 69736 - DNA, 20 bp, Artificial Sequence
  chemically synthesized
atccccatcactttatttct

SEQ ID NO: 69737 - DNA, 20 bp, Artificial Sequence
  chemically synthesized
agagctcagaaataaagtga

SEQ ID NO: 69738 - DNA, 20 bp, Artificial Sequence
  chemically synthesized
gagctcagaaataaagtgat

SEQ ID NO: 69739 - DNA, 20 bp, Artificial Sequence
  chemically synthesized
agctcagaaataaagtgatg

SEQ ID NO: 69740 - DNA, 20 bp, Artificial Sequence
  chemically synthesized
aaggaaaagtgtggtagtat

SEQ ID NO: 69741 - DNA, 20 bp, Artificial Sequence
  chemically synthesized
aaaggaaaagtgtggtagta

SEQ ID NO: 69742 - DNA, 20 bp, Artificial Sequence
  chemically synthesized
tggtgaaaggaaaagtgtgg

SEQ ID NO: 69743 - DNA, 20 bp, Artificial Sequence
  chemically synthesized
aactggtgaaaggaaaagtg

SEQ ID NO: 69744 - DNA, 20 bp, Artificial Sequence
  chemically synthesized
aaagtaactggtgaaaggaa

SEQ ID NO: 69745 - DNA, 20 bp, Artificial Sequence
  chemically synthesized
taccacacttttcctttcac

SEQ ID NO: 69746 - DNA, 20 bp, Artificial Sequence
  chemically synthesized
tttccaaagtaactggtgaa

SEQ ID NO: 69747 - DNA, 20 bp, Artificial Sequence
  chemically synthesized
ctttccaaagtaactggtga

SEQ ID NO: 69748 - DNA, 20 bp, Artificial Sequence
  chemically synthesized
tttcctttcaccagttactt

SEQ ID NO: 69749 - DNA, 20 bp, Artificial Sequence
  chemically synthesized
aggatactttccaaagtaac

SEQ ID NO: 69750 - DNA, 20 bp, Artificial Sequence
  chemically synthesized
ctttcaccagttactttgga

SEQ ID NO: 69751 - DNA, 20 bp, Artificial Sequence
  chemically synthesized
actccataggatactttcca

SEQ ID NO: 69752 - DNA, 20 bp, Artificial Sequence
  chemically synthesized
ttactttggaaagtatccta

SEQ ID NO: 69753 - DNA, 20 bp, Artificial Sequence
  chemically synthesized
actttggaaagtatcctatg

SEQ ID NO: 69754 - DNA, 20 bp, Artificial Sequence
  chemically synthesized
tactaaaatcaaaactccat

SEQ ID NO: 69755 - DNA, 20 bp, Artificial Sequence
  chemically synthesized
ctactaaaatcaaaactcca

SEQ ID NO: 69756 - DNA, 20 bp, Artificial Sequence
  chemically synthesized
atcctatggagttttgattt

SEQ ID NO: 69757 - DNA, 20 bp, Artificial Sequence
  chemically synthesized
ctatggagttttgattttag

SEQ ID NO: 69758 - DNA, 20 bp, Artificial Sequence
  chemically synthesized
gattttagtagaattcatgt

SEQ ID NO: 69759 - DNA, 20 bp, Artificial Sequence
  chemically synthesized
attttagtagaattcatgtg

SEQ ID NO: 69760 - DNA, 20 bp, Artificial Sequence
  chemically synthesized
gtagaattcatgtgaggcaa

SEQ ID NO: 69761 - DNA, 20 bp, Artificial Sequence
  chemically synthesized
aattcatgtgaggcaaaaga

SEQ ID NO: 69762 - DNA, 20 bp, Artificial Sequence
  chemically synthesized
ttttacacaatagaaataat

SEQ ID NO: 69763 - DNA, 20 bp, Artificial Sequence
  chemically synthesized
ggtttggagattttacacaa

SEQ ID NO: 69764 - DNA, 20 bp, Artificial Sequence
  chemically synthesized
tataactgcccagtggtttg

SEQ ID NO: 69765 - DNA, 20 bp, Artificial Sequence
  chemically synthesized
gtgtaaaatctccaaaccac

SEQ ID NO: 69766 - DNA, 20 bp, Artificial Sequence
  chemically synthesized
tgtaaaatctccaaaccact

SEQ ID NO: 69767 - DNA, 20 bp, Artificial Sequence
  chemically synthesized
cttataactgcccagtggtt

SEQ ID NO: 69768 - DNA, 20 bp, Artificial Sequence
  chemically synthesized
aaaatctccaaaccactggg

SEQ ID NO: 69769 - DNA, 20 bp, Artificial Sequence
  chemically synthesized
aaagtcttataactgcccag

SEQ ID NO: 69770 - DNA, 20 bp, Artificial Sequence
  chemically synthesized
aaaaaagtcttataactgcc

SEQ ID NO: 69771 - DNA, 20 bp, Artificial Sequence
  chemically synthesized
ccaaaccactgggcagttat

SEQ ID NO: 69772 - DNA, 20 bp, Artificial Sequence
  chemically synthesized
tttgagcttaaaaaaaaaaa

SEQ ID NO: 69773 - DNA, 20 bp, Artificial Sequence
  chemically synthesized
ataagacttttttttttttt

SEQ ID NO: 69774 - DNA, 20 bp, Artificial Sequence
  chemically synthesized
tttttttttaagctcaaaca

SEQ ID NO: 69775 - DNA, 20 bp, Artificial Sequence
  chemically synthesized
ttttttttaagctcaaacac

SEQ ID NO: 69776 - DNA, 20 bp, Artificial Sequence
  chemically synthesized
tatagccttgacctgtgttt

SEQ ID NO: 69777 - DNA, 20 bp, Artificial Sequence
  chemically synthesized
tttaagctcaaacacaggtc

SEQ ID NO: 69778 - DNA, 20 bp, Artificial Sequence
  chemically synthesized
ttaagctcaaacacaggtca

SEQ ID NO: 69779 - DNA, 20 bp, Artificial Sequence
  chemically synthesized
tcaaacacaggtcaaggcta

SEQ ID NO: 69780 - DNA, 20 bp, Artificial Sequence
  chemically synthesized
caaacacaggtcaaggctat

SEQ ID NO: 69781 - DNA, 20 bp, Artificial Sequence
  chemically synthesized
acacaggtcaaggctatagg

SEQ ID NO: 69782 - DNA, 20 bp, Artificial Sequence
  chemically synthesized
cacaggtcaaggctataggt

SEQ ID NO: 69783 - DNA, 20 bp, Artificial Sequence
  chemically synthesized
caggtcaaggctataggtgg

SEQ ID NO: 69784 - DNA, 20 bp, Artificial Sequence
  chemically synthesized
tgttcaagaactcccaccta

SEQ ID NO: 69785 - DNA, 20 bp, Artificial Sequence
  chemically synthesized
tctcactttgtttattgttc

SEQ ID NO: 69786 - DNA, 20 bp, Artificial Sequence
  chemically synthesized
gagttcttgaacaataaaca

SEQ ID NO: 69787 - DNA, 20 bp, Artificial Sequence
  chemically synthesized
tcttgaacaataaacaaagt

SEQ ID NO: 69788 - DNA, 20 bp, Artificial Sequence
  chemically synthesized
acaataaacaaagtgagaaa

SEQ ID NO: 69789 - DNA, 20 bp, Artificial Sequence
  chemically synthesized
agcagcaataacaaaaaatt

SEQ ID NO: 69790 - DNA, 20 bp, Artificial Sequence
  chemically synthesized
tgtctgtgtgtcattcaaag

SEQ ID NO: 69791 - DNA, 20 bp, Artificial Sequence
  chemically synthesized
atgtgtctgtgtgtcattca

SEQ ID NO: 69792 - DNA, 20 bp, Artificial Sequence
  chemically synthesized
ttgctgctttgaatgacaca

SEQ ID NO: 69793 - DNA, 20 bp, Artificial Sequence
  chemically synthesized
cacagacacatgtactaaca

SEQ ID NO: 69794 - DNA, 20 bp, Artificial Sequence
  chemically synthesized
acagacacatgtactaacac

SEQ ID NO: 69795 - DNA, 20 bp, Artificial Sequence
  chemically synthesized
agcaagagtcttgcctgtgt

SEQ ID NO: 69796 - DNA, 20 bp, Artificial Sequence
  chemically synthesized
acacatgtactaacacaggc

SEQ ID NO: 69797 - DNA, 20 bp, Artificial Sequence
  chemically synthesized
tacatatatccgtgcagcaa

SEQ ID NO: 69798 - DNA, 20 bp, Artificial Sequence
  chemically synthesized
caggcaagactcttgctgca

SEQ ID NO: 69799 - DNA, 20 bp, Artificial Sequence
  chemically synthesized
aatacatatatccgtgcagc

SEQ ID NO: 69800 - DNA, 20 bp, Artificial Sequence
  chemically synthesized
caaaaatacatatatccgtg

SEQ ID NO: 69801 - DNA, 20 bp, Artificial Sequence
  chemically synthesized
cacggatatatgtatttttg

SEQ ID NO: 69802 - DNA, 20 bp, Artificial Sequence
  chemically synthesized
atatatgtatttttgtagaa

SEQ ID NO: 69803 - DNA, 20 bp, Artificial Sequence
  chemically synthesized
gccaggcagtgaattcattt

SEQ ID NO: 69804 - DNA, 20 bp, Artificial Sequence
  chemically synthesized
actaaaatgaattcactgcc

SEQ ID NO: 69805 - DNA, 20 bp, Artificial Sequence
  chemically synthesized
gatgaaaacatgatgccagg

SEQ ID NO: 69806 - DNA, 20 bp, Artificial Sequence
  chemically synthesized
gcagatgaaaacatgatgcc

SEQ ID NO: 69807 - DNA, 20 bp, Artificial Sequence
  chemically synthesized
ggcagatgaaaacatgatgc

SEQ ID NO: 69808 - DNA, 20 bp, Artificial Sequence
  chemically synthesized
cccttgtggaaaatggaagg

SEQ ID NO: 69809 - DNA, 20 bp, Artificial Sequence
  chemically synthesized
acacccttgtggaaaatgga

SEQ ID NO: 69810 - DNA, 20 bp, Artificial Sequence
  chemically synthesized
tacacccttgtggaaaatgg

SEQ ID NO: 69811 - DNA, 20 bp, Artificial Sequence
  chemically synthesized
gagtacacccttgtggaaaa

SEQ ID NO: 69812 - DNA, 20 bp, Artificial Sequence
  chemically synthesized
atctgccttccattttccac

SEQ ID NO: 69813 - DNA, 20 bp, Artificial Sequence
  chemically synthesized
tctgccttccattttccaca

SEQ ID NO: 69814 - DNA, 20 bp, Artificial Sequence
  chemically synthesized
ctgccttccattttccacaa

SEQ ID NO: 69815 - DNA, 20 bp, Artificial Sequence
  chemically synthesized
gcaagtggagtacacccttg

SEQ ID NO: 69816 - DNA, 20 bp, Artificial Sequence
  chemically synthesized
tgcctaagtctaagcaagtg

SEQ ID NO: 69817 - DNA, 20 bp, Artificial Sequence
  chemically synthesized
aagggtgtactccacttgct

SEQ ID NO: 69818 - DNA, 20 bp, Artificial Sequence
  chemically synthesized
attgcctaagtctaagcaag

SEQ ID NO: 69819 - DNA, 20 bp, Artificial Sequence
  chemically synthesized
taaattgcctaagtctaagc

SEQ ID NO: 69820 - DNA, 20 bp, Artificial Sequence
  chemically synthesized
gtactccacttgcttagact

SEQ ID NO: 69821 - DNA, 20 bp, Artificial Sequence
  chemically synthesized
tactccacttgcttagactt

SEQ ID NO: 69822 - DNA, 20 bp, Artificial Sequence
  chemically synthesized
tttttaaattgcctaagtct

SEQ ID NO: 69823 - DNA, 20 bp, Artificial Sequence
  chemically synthesized
caagaatttttaaattgcct

SEQ ID NO: 69824 - DNA, 20 bp, Artificial Sequence
  chemically synthesized
ttttagaggacattaagatc

SEQ ID NO: 69825 - DNA, 20 bp, Artificial Sequence
  chemically synthesized
tgtacattttagaggacatt

SEQ ID NO: 69826 - DNA, 20 bp, Artificial Sequence
  chemically synthesized
ataaagtctgtacattttag

SEQ ID NO: 69827 - DNA, 20 bp, Artificial Sequence
  chemically synthesized
tataaagtctgtacatttta

SEQ ID NO: 69828 - DNA, 20 bp, Artificial Sequence
  chemically synthesized
ttaatgtcctctaaaatgta

SEQ ID NO: 69829 - DNA, 20 bp, Artificial Sequence
  chemically synthesized
gctataaagtctgtacattt

SEQ ID NO: 69830 - DNA, 20 bp, Artificial Sequence
  chemically synthesized
tctaaaatgtacagacttta

SEQ ID NO: 69831 - DNA, 20 bp, Artificial Sequence
  chemically synthesized
aatgtacagactttatagct

SEQ ID NO: 69832 - DNA, 20 bp, Artificial Sequence
  chemically synthesized
ctcttaaaatctaagctata

SEQ ID NO: 69833 - DNA, 20 bp, Artificial Sequence
  chemically synthesized
gactttatagcttagatttt

SEQ ID NO: 69834 - DNA, 20 bp, Artificial Sequence
  chemically synthesized
aatggtgtctcttaaaatct

SEQ ID NO: 69835 - DNA, 20 bp, Artificial Sequence
  chemically synthesized
ctttatagcttagattttaa

SEQ ID NO: 69836 - DNA, 20 bp, Artificial Sequence
  chemically synthesized
gtcattaccctgtcaggtaa

SEQ ID NO: 69837 - DNA, 20 bp, Artificial Sequence
  chemically synthesized
taagagacaccattacctga

SEQ ID NO: 69838 - DNA, 20 bp, Artificial Sequence
  chemically synthesized
aagagacaccattacctgac

SEQ ID NO: 69839 - DNA, 20 bp, Artificial Sequence
  chemically synthesized
agagacaccattacctgaca

SEQ ID NO: 69840 - DNA, 20 bp, Artificial Sequence
  chemically synthesized
aaaactgtcattaccctgtc

SEQ ID NO: 69841 - DNA, 20 bp, Artificial Sequence
  chemically synthesized
taaaactgtcattaccctgt

SEQ ID NO: 69842 - DNA, 20 bp, Artificial Sequence
  chemically synthesized
attacctgacagggtaatga

SEQ ID NO: 69843 - DNA, 20 bp, Artificial Sequence
  chemically synthesized
aatgacagttttatttgcac

SEQ ID NO: 69844 - DNA, 20 bp, Artificial Sequence
  chemically synthesized
gttttatttgcactggtgac

SEQ ID NO: 69845 - DNA, 20 bp, Artificial Sequence
  chemically synthesized
atcacagcaaatccagtcac

SEQ ID NO: 69846 - DNA, 20 bp, Artificial Sequence
  chemically synthesized
cttaagtatcacagcaaatc

SEQ ID NO: 69847 - DNA, 20 bp, Artificial Sequence
  chemically synthesized
gtattattgcttaagtatca

SEQ ID NO: 69848 - DNA, 20 bp, Artificial Sequence
  chemically synthesized
ctggatttgctgtgatactt

SEQ ID NO: 69849 - DNA, 20 bp, Artificial Sequence
  chemically synthesized
ttttatttgtattattgctt

SEQ ID NO: 69850 - DNA, 20 bp, Artificial Sequence
  chemically synthesized
aataaaatgataattttttt

SEQ ID NO: 69851 - DNA, 20 bp, Artificial Sequence
  chemically synthesized
taaaatgataatttttttga

SEQ ID NO: 69852 - DNA, 20 bp, Artificial Sequence
  chemically synthesized
aaaatgataatttttttgag

SEQ ID NO: 69853 - DNA, 20 bp, Artificial Sequence
  chemically synthesized
taatttttttgagaggatgt

SEQ ID NO: 69854 - DNA, 20 bp, Artificial Sequence
  chemically synthesized
aatttttttgagaggatgtc

SEQ ID NO: 69855 - DNA, 20 bp, Artificial Sequence
  chemically synthesized
atttttttgagaggatgtca

SEQ ID NO: 69856 - DNA, 20 bp, Artificial Sequence
  chemically synthesized
tttttgagaggatgtcaggg

SEQ ID NO: 69857 - DNA, 20 bp, Artificial Sequence
  chemically synthesized
ttttgagaggatgtcaggga

SEQ ID NO: 69858 - DNA, 20 bp, Artificial Sequence
  chemically synthesized
ttgagaggatgtcagggaag

SEQ ID NO: 69859 - DNA, 20 bp, Artificial Sequence
  chemically synthesized
gaggatgtcagggaaggaga

SEQ ID NO: 69860 - DNA, 20 bp, Artificial Sequence
  chemically synthesized
tgtcagggaaggagaaagaa

SEQ ID NO: 69861 - DNA, 20 bp, Artificial Sequence
  chemically synthesized
aaaatgcatcgcatttaact

SEQ ID NO: 69862 - DNA, 20 bp, Artificial Sequence
  chemically synthesized
gtgtgttgtgtttttaaacc

SEQ ID NO: 69863 - DNA, 20 bp, Artificial Sequence
  chemically synthesized
tttaaaaacacaacacactg

SEQ ID NO: 69864 - DNA, 20 bp, Artificial Sequence
  chemically synthesized
taagaagctttgggaagctg

SEQ ID NO: 69865 - DNA, 20 bp, Artificial Sequence
  chemically synthesized
caacacactgcagcttccca

SEQ ID NO: 69866 - DNA, 20 bp, Artificial Sequence
  chemically synthesized
gtaaaataagaagctttggg

SEQ ID NO: 69867 - DNA, 20 bp, Artificial Sequence
  chemically synthesized
ccagtaaaataagaagcttt

SEQ ID NO: 69868 - DNA, 20 bp, Artificial Sequence
  chemically synthesized
tccagtaaaataagaagctt

SEQ ID NO: 69869 - DNA, 20 bp, Artificial Sequence
  chemically synthesized
tttttttccagtaaaataag

SEQ ID NO: 69870 - DNA, 20 bp, Artificial Sequence
  chemically synthesized
cccaaagcttcttattttac

SEQ ID NO: 69871 - DNA, 20 bp, Artificial Sequence
  chemically synthesized
atttttttttccagtaaaat

SEQ ID NO: 69872 - DNA, 20 bp, Artificial Sequence
  chemically synthesized
tgctaagggatttttttttc

SEQ ID NO: 69873 - DNA, 20 bp, Artificial Sequence
  chemically synthesized
tactggaaaaaaaaatccct

SEQ ID NO: 69874 - DNA, 20 bp, Artificial Sequence
  chemically synthesized
aaaggaagatgaattgctaa

SEQ ID NO: 69875 - DNA, 20 bp, Artificial Sequence
  chemically synthesized
caaaggaagatgaattgcta

SEQ ID NO: 69876 - DNA, 20 bp, Artificial Sequence
  chemically synthesized
ccaaaggaagatgaattgct

SEQ ID NO: 69877 - DNA, 20 bp, Artificial Sequence
  chemically synthesized
cttagcaattcatcttcctt

SEQ ID NO: 69878 - DNA, 20 bp, Artificial Sequence
  chemically synthesized
ttagcaattcatcttccttt

SEQ ID NO: 69879 - DNA, 20 bp, Artificial Sequence
  chemically synthesized
gtcattcatgcgcccaaagg

SEQ ID NO: 69880 - DNA, 20 bp, Artificial Sequence
  chemically synthesized
aatgtcattcatgcgcccaa

SEQ ID NO: 69881 - DNA, 20 bp, Artificial Sequence
  chemically synthesized
aaatgtcattcatgcgccca

SEQ ID NO: 69882 - DNA, 20 bp, Artificial Sequence
  chemically synthesized
tgtttcttataatcacatca

SEQ ID NO: 69883 - DNA, 20 bp, Artificial Sequence
  chemically synthesized
ttttactgtgatgtgattat

SEQ ID NO: 69884 - DNA, 20 bp, Artificial Sequence
  chemically synthesized
ttataagaaacaaaatccct

SEQ ID NO: 69885 - DNA, 20 bp, Artificial Sequence
  chemically synthesized
ataagaaacaaaatccctcg

SEQ ID NO: 69886 - DNA, 20 bp, Artificial Sequence
  chemically synthesized
ttttaaggcagcatctccga

SEQ ID NO: 69887 - DNA, 20 bp, Artificial Sequence
  chemically synthesized
attttaaggcagcatctccg

SEQ ID NO: 69888 - DNA, 20 bp, Artificial Sequence
  chemically synthesized
tattttaaggcagcatctcc

SEQ ID NO: 69889 - DNA, 20 bp, Artificial Sequence
  chemically synthesized
taaagaaaaatattttaagg

SEQ ID NO: 69890 - DNA, 20 bp, Artificial Sequence
  chemically synthesized
ttataaagaaaaatatttta

SEQ ID NO: 69891 - DNA, 20 bp, Artificial Sequence
  chemically synthesized
attataaagaaaaatatttt

SEQ ID NO: 69892 - DNA, 20 bp, Artificial Sequence
  chemically synthesized
gtcgagctcagaacattata

SEQ ID NO: 69893 - DNA, 20 bp, Artificial Sequence
  chemically synthesized
atttttctttataatgttct

SEQ ID NO: 69894 - DNA, 20 bp, Artificial Sequence
  chemically synthesized
ctaccaaggtttgtcgagct

SEQ ID NO: 69895 - DNA, 20 bp, Artificial Sequence
  chemically synthesized
gttttctaccaaggtttgtc

SEQ ID NO: 69896 - DNA, 20 bp, Artificial Sequence
  chemically synthesized
gttctgagctcgacaaacct

SEQ ID NO: 69897 - DNA, 20 bp, Artificial Sequence
  chemically synthesized
ctgagctcgacaaaccttgg

SEQ ID NO: 69898 - DNA, 20 bp, Artificial Sequence
  chemically synthesized
gagtattctgttttctacca

SEQ ID NO: 69899 - DNA, 20 bp, Artificial Sequence
  chemically synthesized
agagtattctgttttctacc

SEQ ID NO: 69900 - DNA, 20 bp, Artificial Sequence
  chemically synthesized
cgacaaaccttggtagaaaa

SEQ ID NO: 69901 - DNA, 20 bp, Artificial Sequence
  chemically synthesized
gttaatttattcataattaa

SEQ ID NO: 69902 - DNA, 20 bp, Artificial Sequence
  chemically synthesized
tagttaatttattcataatt

SEQ ID NO: 69903 - DNA, 20 bp, Artificial Sequence
  chemically synthesized
tatgaataaattaactaaat

SEQ ID NO: 69904 - DNA, 20 bp, Artificial Sequence
  chemically synthesized
tccatctcatgttactaatt

SEQ ID NO: 69905 - DNA, 20 bp, Artificial Sequence
  chemically synthesized
attaactaaattagtaacat

SEQ ID NO: 69906 - DNA, 20 bp, Artificial Sequence
  chemically synthesized
actaaattagtaacatgaga

SEQ ID NO: 69907 - DNA, 20 bp, Artificial Sequence
  chemically synthesized
catgagatggatatgcaatt

SEQ ID NO: 69908 - DNA, 20 bp, Artificial Sequence
  chemically synthesized
atgagatggatatgcaatta

SEQ ID NO: 69909 - DNA, 20 bp, Artificial Sequence
  chemically synthesized
tgagatggatatgcaattaa

SEQ ID NO: 69910 - DNA, 20 bp, Artificial Sequence
  chemically synthesized
aagggattgttaattgaaac

SEQ ID NO: 69911 - DNA, 20 bp, Artificial Sequence
  chemically synthesized
gttaattgaaactggaaaca

SEQ ID NO: 69912 - DNA, 20 bp, Artificial Sequence
  chemically synthesized
gctgtatacagctgtgtttc

SEQ ID NO: 69913 - DNA, 20 bp, Artificial Sequence
  chemically synthesized
actggaaacacagctgtata

SEQ ID NO: 69914 - DNA, 20 bp, Artificial Sequence
  chemically synthesized
attcatctctaagctgtata

SEQ ID NO: 69915 - DNA, 20 bp, Artificial Sequence
  chemically synthesized
aaacacagctgtatacagct

SEQ ID NO: 69916 - DNA, 20 bp, Artificial Sequence
  chemically synthesized
acacagctgtatacagctta

SEQ ID NO: 69917 - DNA, 20 bp, Artificial Sequence
  chemically synthesized
tactggtatgattcatctct

SEQ ID NO: 69918 - DNA, 20 bp, Artificial Sequence
  chemically synthesized
agcttagagatgaatcatac

SEQ ID NO: 69919 - DNA, 20 bp, Artificial Sequence
  chemically synthesized
ataaacatctgcgtcattac

SEQ ID NO: 69920 - DNA, 20 bp, Artificial Sequence
  chemically synthesized
gaatcataccagtaatgacg

SEQ ID NO: 69921 - DNA, 20 bp, Artificial Sequence
  chemically synthesized
ttataaaatgtgattatctt

SEQ ID NO: 69922 - DNA, 20 bp, Artificial Sequence
  chemically synthesized
taaaatgtgattatctttag

SEQ ID NO: 69923 - DNA, 20 bp, Artificial Sequence
  chemically synthesized
aaatgtgattatctttagtg

SEQ ID NO: 69924 - DNA, 20 bp, Artificial Sequence
  chemically synthesized
atgcagcgctgtctccacta

SEQ ID NO: 69925 - DNA, 20 bp, Artificial Sequence
  chemically synthesized
gtgattatctttagtggaga

SEQ ID NO: 69926 - DNA, 20 bp, Artificial Sequence
  chemically synthesized
aagaatgggcttgggagatg

SEQ ID NO: 69927 - DNA, 20 bp, Artificial Sequence
  chemically synthesized
gagacagcgctgcatctccc

SEQ ID NO: 69928 - DNA, 20 bp, Artificial Sequence
  chemically synthesized
caatataagaatgggcttgg

SEQ ID NO: 69929 - DNA, 20 bp, Artificial Sequence
  chemically synthesized
cacaatataagaatgggctt

SEQ ID NO: 69930 - DNA, 20 bp, Artificial Sequence
  chemically synthesized
acacaatataagaatgggct

SEQ ID NO: 69931 - DNA, 20 bp, Artificial Sequence
  chemically synthesized
cagtgacacaatataagaat

SEQ ID NO: 69932 - DNA, 20 bp, Artificial Sequence
  chemically synthesized
tcagtgacacaatataagaa

SEQ ID NO: 69933 - DNA, 20 bp, Artificial Sequence
  chemically synthesized
ccatttcagtgacacaatat

SEQ ID NO: 69934 - DNA, 20 bp, Artificial Sequence
  chemically synthesized
cttatattgtgtcactgaaa

SEQ ID NO: 69935 - DNA, 20 bp, Artificial Sequence
  chemically synthesized
cacgggtttaaaaaccattt

SEQ ID NO: 69936 - DNA, 20 bp, Artificial Sequence
  chemically synthesized
tcctgattcctggtgttcac

SEQ ID NO: 69937 - DNA, 20 bp, Artificial Sequence
  chemically synthesized
gtttttaaacccgtgaacac

SEQ ID NO: 69938 - DNA, 20 bp, Artificial Sequence
  chemically synthesized
atcctgattcctggtgttca

SEQ ID NO: 69939 - DNA, 20 bp, Artificial Sequence
  chemically synthesized
tttttaaacccgtgaacacc

SEQ ID NO: 69940 - DNA, 20 bp, Artificial Sequence
  chemically synthesized
aacccgtgaacaccaggaat

SEQ ID NO: 69941 - DNA, 20 bp, Artificial Sequence
  chemically synthesized
acccgtgaacaccaggaatc

SEQ ID NO: 69942 - DNA, 20 bp, Artificial Sequence
  chemically synthesized
gtccctgagatcctgattcc

SEQ ID NO: 69943 - DNA, 20 bp, Artificial Sequence
  chemically synthesized
aacaccaggaatcaggatct

SEQ ID NO: 69944 - DNA, 20 bp, Artificial Sequence
  chemically synthesized
acaccaggaatcaggatctc

SEQ ID NO: 69945 - DNA, 20 bp, Artificial Sequence
  chemically synthesized
caccaggaatcaggatctca

SEQ ID NO: 69946 - DNA, 20 bp, Artificial Sequence
  chemically synthesized
aggaatcaggatctcaggga

SEQ ID NO: 69947 - DNA, 20 bp, Artificial Sequence
  chemically synthesized
gagcctaatttgccgtccct

SEQ ID NO: 69948 - DNA, 20 bp, Artificial Sequence
  chemically synthesized
ggatctcagggacggcaaat

SEQ ID NO: 69949 - DNA, 20 bp, Artificial Sequence
  chemically synthesized
gatctcagggacggcaaatt

SEQ ID NO: 69950 - DNA, 20 bp, Artificial Sequence
  chemically synthesized
ggacggcaaattaggctccc

SEQ ID NO: 69951 - DNA, 20 bp, Artificial Sequence
  chemically synthesized
cactaattcccatatccagg

SEQ ID NO: 69952 - DNA, 20 bp, Artificial Sequence
  chemically synthesized
caaattaggctccctggata

SEQ ID NO: 69953 - DNA, 20 bp, Artificial Sequence
  chemically synthesized
aaattaggctccctggatat

SEQ ID NO: 69954 - DNA, 20 bp, Artificial Sequence
  chemically synthesized
aacactaattcccatatcca

SEQ ID NO: 69955 - DNA, 20 bp, Artificial Sequence
  chemically synthesized
caacactaattcccatatcc

SEQ ID NO: 69956 - DNA, 20 bp, Artificial Sequence
  chemically synthesized
acaacactaattcccatatc

SEQ ID NO: 69957 - DNA, 20 bp, Artificial Sequence
  chemically synthesized
ggctccctggatatgggaat

SEQ ID NO: 69958 - DNA, 20 bp, Artificial Sequence
  chemically synthesized
aattagtgttgtctgaatgt

SEQ ID NO: 69959 - DNA, 20 bp, Artificial Sequence
  chemically synthesized
agaatcaaattgctgacatt

SEQ ID NO: 69960 - DNA, 20 bp, Artificial Sequence
  chemically synthesized
atgtcagcaatttgattctc

SEQ ID NO: 69961 - DNA, 20 bp, Artificial Sequence
  chemically synthesized
tctacattctttgaaagctg

SEQ ID NO: 69962 - DNA, 20 bp, Artificial Sequence
  chemically synthesized
atttgattctccagctttca

SEQ ID NO: 69963 - DNA, 20 bp, Artificial Sequence
  chemically synthesized
tatctacattctttgaaagc

SEQ ID NO: 69964 - DNA, 20 bp, Artificial Sequence
  chemically synthesized
tccatatctacattctttga

SEQ ID NO: 69965 - DNA, 20 bp, Artificial Sequence
  chemically synthesized
tctccagctttcaaagaatg

SEQ ID NO: 69966 - DNA, 20 bp, Artificial Sequence
  chemically synthesized
gctttcaaagaatgtagata

SEQ ID NO: 69967 - DNA, 20 bp, Artificial Sequence
  chemically synthesized
tttcaaagaatgtagatatg

SEQ ID NO: 69968 - DNA, 20 bp, Artificial Sequence
  chemically synthesized
aactaacagatgtttgttgt

SEQ ID NO: 69969 - DNA, 20 bp, Artificial Sequence
  chemically synthesized
agccaacaacaaacatctgt

SEQ ID NO: 69970 - DNA, 20 bp, Artificial Sequence
  chemically synthesized
tttgaagaccatgcaactaa

SEQ ID NO: 69971 - DNA, 20 bp, Artificial Sequence
  chemically synthesized
acaaacatctgttagttgca

SEQ ID NO: 69972 - DNA, 20 bp, Artificial Sequence
  chemically synthesized
tggttgtttttgtttttttg

SEQ ID NO: 69973 - DNA, 20 bp, Artificial Sequence
  chemically synthesized
aaaaaaacaaaaacaaccaa

SEQ ID NO: 69974 - DNA, 20 bp, Artificial Sequence
  chemically synthesized
actggtttgccagcaacttt

SEQ ID NO: 69975 - DNA, 20 bp, Artificial Sequence
  chemically synthesized
caaaaacaaccaaaagttgc

SEQ ID NO: 69976 - DNA, 20 bp, Artificial Sequence
  chemically synthesized
accaaaagttgctggcaaac

SEQ ID NO: 69977 - DNA, 20 bp, Artificial Sequence
  chemically synthesized
tgaagcagggactggtttgc

SEQ ID NO: 69978 - DNA, 20 bp, Artificial Sequence
  chemically synthesized
tctctgattgaagcagggac

SEQ ID NO: 69979 - DNA, 20 bp, Artificial Sequence
  chemically synthesized
cgtcttctctgattgaagca

SEQ ID NO: 69980 - DNA, 20 bp, Artificial Sequence
  chemically synthesized
ccgtcttctctgattgaagc

SEQ ID NO: 69981 - DNA, 20 bp, Artificial Sequence
  chemically synthesized
aaaccagtccctgcttcaat

SEQ ID NO: 69982 - DNA, 20 bp, Artificial Sequence
  chemically synthesized
accgtcttctctgattgaag

SEQ ID NO: 69983 - DNA, 20 bp, Artificial Sequence
  chemically synthesized
accagtccctgcttcaatca

SEQ ID NO: 69984 - DNA, 20 bp, Artificial Sequence
  chemically synthesized
tttaccgtcttctctgattg

SEQ ID NO: 69985 - DNA, 20 bp, Artificial Sequence
  chemically synthesized
agtccctgcttcaatcagag

SEQ ID NO: 69986 - DNA, 20 bp, Artificial Sequence
  chemically synthesized
cctgcttcaatcagagaaga

SEQ ID NO: 69987 - DNA, 20 bp, Artificial Sequence
  chemically synthesized
ttcaatcagagaagacggta

SEQ ID NO: 69988 - DNA, 20 bp, Artificial Sequence
  chemically synthesized
gacggtaaagtatctgtaaa

SEQ ID NO: 69989 - DNA, 20 bp, Artificial Sequence
  chemically synthesized
cacagcagtgtgactgttta

SEQ ID NO: 69990 - DNA, 20 bp, Artificial Sequence
  chemically synthesized
tttctaacagtcacacacag

SEQ ID NO: 69991 - DNA, 20 bp, Artificial Sequence
  chemically synthesized
atgtttctaacagtcacaca

SEQ ID NO: 69992 - DNA, 20 bp, Artificial Sequence
  chemically synthesized
acactgctgtgtgtgactgt

SEQ ID NO: 69993 - DNA, 20 bp, Artificial Sequence
  chemically synthesized
tcttttctatatgtttctaa

SEQ ID NO: 69994 - DNA, 20 bp, Artificial Sequence
  chemically synthesized
gtgtgactgttagaaacata

SEQ ID NO: 69995 - DNA, 20 bp, Artificial Sequence
  chemically synthesized
actgttagaaacatatagaa

SEQ ID NO: 69996 - DNA, 20 bp, Artificial Sequence
  chemically synthesized
tgttagaaacatatagaaaa

SEQ ID NO: 69997 - DNA, 20 bp, Artificial Sequence
  chemically synthesized
acatatagaaaagagaaccc

SEQ ID NO: 69998 - DNA, 20 bp, Artificial Sequence
  chemically synthesized
catatagaaaagagaacccc

SEQ ID NO: 69999 - DNA, 20 bp, Artificial Sequence
  chemically synthesized
atatagaaaagagaacccca

SEQ ID NO: 70000 - DNA, 20 bp, Artificial Sequence
  chemically synthesized
gaaaagagaaccccagggca

SEQ ID NO: 70001 - DNA, 20 bp, Artificial Sequence
  chemically synthesized
gtctctggcactgtgccctg

SEQ ID NO: 70002 - DNA, 20 bp, Artificial Sequence
  chemically synthesized
ggtctctggcactgtgccct

SEQ ID NO: 70003 - DNA, 20 bp, Artificial Sequence
  chemically synthesized
aggtctctggcactgtgccc

SEQ ID NO: 70004 - DNA, 20 bp, Artificial Sequence
  chemically synthesized
agaaccccagggcacagtgc

SEQ ID NO: 70005 - DNA, 20 bp, Artificial Sequence
  chemically synthesized
aaccccagggcacagtgcca

SEQ ID NO: 70006 - DNA, 20 bp, Artificial Sequence
  chemically synthesized
ccatttgtgcataaggtctc

SEQ ID NO: 70007 - DNA, 20 bp, Artificial Sequence
  chemically synthesized
gcatttaccatttgtgcata

SEQ ID NO: 70008 - DNA, 20 bp, Artificial Sequence
  chemically synthesized
ggcatttaccatttgtgcat

SEQ ID NO: 70009 - DNA, 20 bp, Artificial Sequence
  chemically synthesized
ccagagaccttatgcacaaa

SEQ ID NO: 70010 - DNA, 20 bp, Artificial Sequence
  chemically synthesized
atggtaaatgccccctctgc

SEQ ID NO: 70011 - DNA, 20 bp, Artificial Sequence
  chemically synthesized
agagcctctgccagcagagg

SEQ ID NO: 70012 - DNA, 20 bp, Artificial Sequence
  chemically synthesized
tagagcctctgccagcagag

SEQ ID NO: 70013 - DNA, 20 bp, Artificial Sequence
  chemically synthesized
ttagagcctctgccagcaga

SEQ ID NO: 70014 - DNA, 20 bp, Artificial Sequence
  chemically synthesized
gtaaatgccccctctgctgg

SEQ ID NO: 70015 - DNA, 20 bp, Artificial Sequence
  chemically synthesized
tttagagcctctgccagcag

SEQ ID NO: 70016 - DNA, 20 bp, Artificial Sequence
  chemically synthesized
ttttagagcctctgccagca

SEQ ID NO: 70017 - DNA, 20 bp, Artificial Sequence
  chemically synthesized
aaatgccccctctgctggca

SEQ ID NO: 70018 - DNA, 20 bp, Artificial Sequence
  chemically synthesized
aatgccccctctgctggcag

SEQ ID NO: 70019 - DNA, 20 bp, Artificial Sequence
  chemically synthesized
tgttttagagcctctgccag

SEQ ID NO: 70020 - DNA, 20 bp, Artificial Sequence
  chemically synthesized
aaatgttttagagcctctgc

SEQ ID NO: 70021 - DNA, 20 bp, Artificial Sequence
  chemically synthesized
aaagagcagaaaatgtttta

SEQ ID NO: 70022 - DNA, 20 bp, Artificial Sequence
  chemically synthesized
gaaaagagcagaaaatgttt

SEQ ID NO: 70023 - DNA, 20 bp, Artificial Sequence
  chemically synthesized
gttcactgccgggaaaagag

SEQ ID NO: 70024 - DNA, 20 bp, Artificial Sequence
  chemically synthesized
aacattttctgctcttttcc

SEQ ID NO: 70025 - DNA, 20 bp, Artificial Sequence
  chemically synthesized
tgggttcactgccgggaaaa

SEQ ID NO: 70026 - DNA, 20 bp, Artificial Sequence
  chemically synthesized
attttctgctcttttcccgg

SEQ ID NO: 70027 - DNA, 20 bp, Artificial Sequence
  chemically synthesized
tctgggttcactgccgggaa

SEQ ID NO: 70028 - DNA, 20 bp, Artificial Sequence
  chemically synthesized
tttcttctgggttcactgcc

SEQ ID NO: 70029 - DNA, 20 bp, Artificial Sequence
  chemically synthesized
ttttcttctgggttcactgc

SEQ ID NO: 70030 - DNA, 20 bp, Artificial Sequence
  chemically synthesized
tcttttcccggcagtgaacc

SEQ ID NO: 70031 - DNA, 20 bp, Artificial Sequence
  chemically synthesized
tttcccggcagtgaacccag

SEQ ID NO: 70032 - DNA, 20 bp, Artificial Sequence
  chemically synthesized
aagattttgttttttcttct

SEQ ID NO: 70033 - DNA, 20 bp, Artificial Sequence
  chemically synthesized
gaagattttgttttttcttc

SEQ ID NO: 70034 - DNA, 20 bp, Artificial Sequence
  chemically synthesized
aaaacaaaatcttcacaact

SEQ ID NO: 70035 - DNA, 20 bp, Artificial Sequence
  chemically synthesized
ctactgcttccttagttgtg

SEQ ID NO: 70036 - DNA, 20 bp, Artificial Sequence
  chemically synthesized
aaacaaaatcttcacaacta

SEQ ID NO: 70037 - DNA, 20 bp, Artificial Sequence
  chemically synthesized
caaaatcttcacaactaagg

SEQ ID NO: 70038 - DNA, 20 bp, Artificial Sequence
  chemically synthesized
aatcttcacaactaaggaag

SEQ ID NO: 70039 - DNA, 20 bp, Artificial Sequence
  chemically synthesized
gcattttcctactgcttcct

SEQ ID NO: 70040 - DNA, 20 bp, Artificial Sequence
  chemically synthesized
cttcacaactaaggaagcag

SEQ ID NO: 70041 - DNA, 20 bp, Artificial Sequence
  chemically synthesized
ttcacaactaaggaagcagt

SEQ ID NO: 70042 - DNA, 20 bp, Artificial Sequence
  chemically synthesized
acatacagtgagtgtaatga

SEQ ID NO: 70043 - DNA, 20 bp, Artificial Sequence
  chemically synthesized
agtacatttcaacatacagt

SEQ ID NO: 70044 - DNA, 20 bp, Artificial Sequence
  chemically synthesized
ttttagtacatttcaacata

SEQ ID NO: 70045 - DNA, 20 bp, Artificial Sequence
  chemically synthesized
caacagaatattgataattt

SEQ ID NO: 70046 - DNA, 20 bp, Artificial Sequence
  chemically synthesized
cggaagtttccaaagtgcaa

SEQ ID NO: 70047 - DNA, 20 bp, Artificial Sequence
  chemically synthesized
atcaatattctgttgcactt

SEQ ID NO: 70048 - DNA, 20 bp, Artificial Sequence
  chemically synthesized
gcaaaaaacggaagtttcca

SEQ ID NO: 70049 - DNA, 20 bp, Artificial Sequence
  chemically synthesized
tgtggataagcaaaaaacgg

SEQ ID NO: 70050 - DNA, 20 bp, Artificial Sequence
  chemically synthesized
tggtgtggataagcaaaaaa

SEQ ID NO: 70051 - DNA, 20 bp, Artificial Sequence
  chemically synthesized
tgggggaaaatggtgtggat

SEQ ID NO: 70052 - DNA, 20 bp, Artificial Sequence
  chemically synthesized
gcacatgggggaaaatggtg

SEQ ID NO: 70053 - DNA, 20 bp, Artificial Sequence
  chemically synthesized
gaattgcacatgggggaaaa

SEQ ID NO: 70054 - DNA, 20 bp, Artificial Sequence
  chemically synthesized
caaatgggaattgcacatgg

SEQ ID NO: 70055 - DNA, 20 bp, Artificial Sequence
  chemically synthesized
gcaaatgggaattgcacatg

SEQ ID NO: 70056 - DNA, 20 bp, Artificial Sequence
  chemically synthesized
ggcaaatgggaattgcacat

SEQ ID NO: 70057 - DNA, 20 bp, Artificial Sequence
  chemically synthesized
gggcaaatgggaattgcaca

SEQ ID NO: 70058 - DNA, 20 bp, Artificial Sequence
  chemically synthesized
ttcccttccctggggcaaat

SEQ ID NO: 70059 - DNA, 20 bp, Artificial Sequence
  chemically synthesized
tgtgcaattcccatttgccc

SEQ ID NO: 70060 - DNA, 20 bp, Artificial Sequence
  chemically synthesized
tttcccttccctggggcaaa

SEQ ID NO: 70061 - DNA, 20 bp, Artificial Sequence
  chemically synthesized
gtgcaattcccatttgcccc

SEQ ID NO: 70062 - DNA, 20 bp, Artificial Sequence
  chemically synthesized
tgcaattcccatttgcccca

SEQ ID NO: 70063 - DNA, 20 bp, Artificial Sequence
  chemically synthesized
aattcccatttgccccaggg

SEQ ID NO: 70064 - DNA, 20 bp, Artificial Sequence
  chemically synthesized
attcccatttgccccaggga

SEQ ID NO: 70065 - DNA, 20 bp, Artificial Sequence
  chemically synthesized
ttcccatttgccccagggaa

SEQ ID NO: 70066 - DNA, 20 bp, Artificial Sequence
  chemically synthesized
agagacatttcccttccctg

SEQ ID NO: 70067 - DNA, 20 bp, Artificial Sequence
  chemically synthesized
tagagacatttcccttccct

SEQ ID NO: 70068 - DNA, 20 bp, Artificial Sequence
  chemically synthesized
atagagacatttcccttccc

SEQ ID NO: 70069 - DNA, 20 bp, Artificial Sequence
  chemically synthesized
agggaagggaaatgtctcta

SEQ ID NO: 70070 - DNA, 20 bp, Artificial Sequence
  chemically synthesized
gattaaaatctagaaccata

SEQ ID NO: 70071 - DNA, 20 bp, Artificial Sequence
  chemically synthesized
gggaaatgtctctatggttc

SEQ ID NO: 70072 - DNA, 20 bp, Artificial Sequence
  chemically synthesized
tcgattaaaatctagaacca

SEQ ID NO: 70073 - DNA, 20 bp, Artificial Sequence
  chemically synthesized
catgtaactcgattaaaatc

SEQ ID NO: 70074 - DNA, 20 bp, Artificial Sequence
  chemically synthesized
tatggttctagattttaatc

SEQ ID NO: 70075 - DNA, 20 bp, Artificial Sequence
  chemically synthesized
cgagttacatgatctctgca

SEQ ID NO: 70076 - DNA, 20 bp, Artificial Sequence
  chemically synthesized
gtccaatcacagtctatgca

SEQ ID NO: 70077 - DNA, 20 bp, Artificial Sequence
  chemically synthesized
ttgtccaatcacagtctatg

SEQ ID NO: 70078 - DNA, 20 bp, Artificial Sequence
  chemically synthesized
atctctgcatagactgtgat

SEQ ID NO: 70079 - DNA, 20 bp, Artificial Sequence
  chemically synthesized
ccctcaaccttgtccaatca

SEQ ID NO: 70080 - DNA, 20 bp, Artificial Sequence
  chemically synthesized
tgcatagactgtgattggac

SEQ ID NO: 70081 - DNA, 20 bp, Artificial Sequence
  chemically synthesized
gcatagactgtgattggaca

SEQ ID NO: 70082 - DNA, 20 bp, Artificial Sequence
  chemically synthesized
gactgtgattggacaaggtt

SEQ ID NO: 70083 - DNA, 20 bp, Artificial Sequence
  chemically synthesized
actgtgattggacaaggttg

SEQ ID NO: 70084 - DNA, 20 bp, Artificial Sequence
  chemically synthesized
ctgtgattggacaaggttga

SEQ ID NO: 70085 - DNA, 20 bp, Artificial Sequence
  chemically synthesized
tgtgattggacaaggttgag

SEQ ID NO: 70086 - DNA, 20 bp, Artificial Sequence
  chemically synthesized
tgattggacaaggttgaggg

SEQ ID NO: 70087 - DNA, 20 bp, Artificial Sequence
  chemically synthesized
ggacaaggttgaggggagac

SEQ ID NO: 70088 - DNA, 20 bp, Artificial Sequence
  chemically synthesized
tatggttaggacacagtatc

SEQ ID NO: 70089 - DNA, 20 bp, Artificial Sequence
  chemically synthesized
attaaactatggttaggaca

SEQ ID NO: 70090 - DNA, 20 bp, Artificial Sequence
  chemically synthesized
tggatactgtgtcctaacca

SEQ ID NO: 70091 - DNA, 20 bp, Artificial Sequence
  chemically synthesized
ataatcattaaactatggtt

SEQ ID NO: 70092 - DNA, 20 bp, Artificial Sequence
  chemically synthesized
cataatcattaaactatggt

SEQ ID NO: 70093 - DNA, 20 bp, Artificial Sequence
  chemically synthesized
attccataatcattaaacta

SEQ ID NO: 70094 - DNA, 20 bp, Artificial Sequence
  chemically synthesized
taaccatagtttaatgatta

SEQ ID NO: 70095 - DNA, 20 bp, Artificial Sequence
  chemically synthesized
agtttaatgattatggaatg

SEQ ID NO: 70096 - DNA, 20 bp, Artificial Sequence
  chemically synthesized
gtttaatgattatggaatga

SEQ ID NO: 70097 - DNA, 20 bp, Artificial Sequence
  chemically synthesized
tttaatgattatggaatgaa

SEQ ID NO: 70098 - DNA, 20 bp, Artificial Sequence
  chemically synthesized
tgattatggaatgaagggct

SEQ ID NO: 70099 - DNA, 20 bp, Artificial Sequence
  chemically synthesized
gaatgaagggctcagctaca

SEQ ID NO: 70100 - DNA, 20 bp, Artificial Sequence
  chemically synthesized
aaagactagtctatgtagct

SEQ ID NO: 70101 - DNA, 20 bp, Artificial Sequence
  chemically synthesized
aagggctcagctacatagac

SEQ ID NO: 70102 - DNA, 20 bp, Artificial Sequence
  chemically synthesized
tttccaaagactagtctatg

SEQ ID NO: 70103 - DNA, 20 bp, Artificial Sequence
  chemically synthesized
cagctacatagactagtctt

SEQ ID NO: 70104 - DNA, 20 bp, Artificial Sequence
  chemically synthesized
aaaacctgatttccaaagac

SEQ ID NO: 70105 - DNA, 20 bp, Artificial Sequence
  chemically synthesized
atagactagtctttggaaat

SEQ ID NO: 70106 - DNA, 20 bp, Artificial Sequence
  chemically synthesized
aaccaaaaacctgatttcca

SEQ ID NO: 70107 - DNA, 20 bp, Artificial Sequence
  chemically synthesized
tagactagtctttggaaatc

SEQ ID NO: 70108 - DNA, 20 bp, Artificial Sequence
  chemically synthesized
gtctttggaaatcaggtttt

SEQ ID NO: 70109 - DNA, 20 bp, Artificial Sequence
  chemically synthesized
gaaatcaggtttttggtttc

SEQ ID NO: 70110 - DNA, 20 bp, Artificial Sequence
  chemically synthesized
aggtttttggtttctggaca

SEQ ID NO: 70111 - DNA, 20 bp, Artificial Sequence
  chemically synthesized
ataatgccacaagctttgtc

SEQ ID NO: 70112 - DNA, 20 bp, Artificial Sequence
  chemically synthesized
tggtttctggacaaagcttg

SEQ ID NO: 70113 - DNA, 20 bp, Artificial Sequence
  chemically synthesized
gttggtttgaataatgccac

SEQ ID NO: 70114 - DNA, 20 bp, Artificial Sequence
  chemically synthesized
ccatccagcctaatagttgt

SEQ ID NO: 70115 - DNA, 20 bp, Artificial Sequence
  chemically synthesized
ttattcaaaccaacaactat

SEQ ID NO: 70116 - DNA, 20 bp, Artificial Sequence
  chemically synthesized
tattcaaaccaacaactatt

SEQ ID NO: 70117 - DNA, 20 bp, Artificial Sequence
  chemically synthesized
caaaccaacaactattaggc

SEQ ID NO: 70118 - DNA, 20 bp, Artificial Sequence
  chemically synthesized
gtaagcaccatccagcctaa

SEQ ID NO: 70119 - DNA, 20 bp, Artificial Sequence
  chemically synthesized
ccaacaactattaggctgga

SEQ ID NO: 70120 - DNA, 20 bp, Artificial Sequence
  chemically synthesized
ccatctttgtaagcaccatc

SEQ ID NO: 70121 - DNA, 20 bp, Artificial Sequence
  chemically synthesized
taggctggatggtgcttaca

SEQ ID NO: 70122 - DNA, 20 bp, Artificial Sequence
  chemically synthesized
ctggatggtgcttacaaaga

SEQ ID NO: 70123 - DNA, 20 bp, Artificial Sequence
  chemically synthesized
ctaccatcttccatctttgt

SEQ ID NO: 70124 - DNA, 20 bp, Artificial Sequence
  chemically synthesized
gatggtgcttacaaagatgg

SEQ ID NO: 70125 - DNA, 20 bp, Artificial Sequence
  chemically synthesized
gtgcttacaaagatggaaga

SEQ ID NO: 70126 - DNA, 20 bp, Artificial Sequence
  chemically synthesized
cttacaaagatggaagatgg

SEQ ID NO: 70127 - DNA, 20 bp, Artificial Sequence
  chemically synthesized
agatggaagatggtagacat

SEQ ID NO: 70128 - DNA, 20 bp, Artificial Sequence
  chemically synthesized
agacatcagttttttacgta

SEQ ID NO: 70129 - DNA, 20 bp, Artificial Sequence
  chemically synthesized
tgactacaccttacagtggt

SEQ ID NO: 70130 - DNA, 20 bp, Artificial Sequence
  chemically synthesized
aagtgcaaactaaccactgt

SEQ ID NO: 70131 - DNA, 20 bp, Artificial Sequence
  chemically synthesized
agtgcaaactaaccactgta

SEQ ID NO: 70132 - DNA, 20 bp, Artificial Sequence
  chemically synthesized
tttttgactacaccttacag

SEQ ID NO: 70133 - DNA, 20 bp, Artificial Sequence
  chemically synthesized
aaactaaccactgtaaggtg

SEQ ID NO: 70134 - DNA, 20 bp, Artificial Sequence
  chemically synthesized
tcttttttgactacacctta

SEQ ID NO: 70135 - DNA, 20 bp, Artificial Sequence
  chemically synthesized
actgtaaggtgtagtcaaaa

SEQ ID NO: 70136 - DNA, 20 bp, Artificial Sequence
  chemically synthesized
aaagaaataatacataattt

SEQ ID NO: 70137 - DNA, 20 bp, Artificial Sequence
  chemically synthesized
taattttagatattgaccaa

SEQ ID NO: 70138 - DNA, 20 bp, Artificial Sequence
  chemically synthesized
ttttagatattgaccaacag

SEQ ID NO: 70139 - DNA, 20 bp, Artificial Sequence
  chemically synthesized
gtgacaaatatatcttctgt

SEQ ID NO: 70140 - DNA, 20 bp, Artificial Sequence
  chemically synthesized
agaagatatatttgtcacct

SEQ ID NO: 70141 - DNA, 20 bp, Artificial Sequence
  chemically synthesized
atatatttgtcaccttagct

SEQ ID NO: 70142 - DNA, 20 bp, Artificial Sequence
  chemically synthesized
ttgaaagagaagctaagcta

SEQ ID NO: 70143 - DNA, 20 bp, Artificial Sequence
  chemically synthesized
tttgaaagagaagctaagct

SEQ ID NO: 70144 - DNA, 20 bp, Artificial Sequence
  chemically synthesized
ataattttgaaagagaagct

SEQ ID NO: 70145 - DNA, 20 bp, Artificial Sequence
  chemically synthesized
cattgataattttgaaagag

SEQ ID NO: 70146 - DNA, 20 bp, Artificial Sequence
  chemically synthesized
ggacattgataattttgaaa

SEQ ID NO: 70147 - DNA, 20 bp, Artificial Sequence
  chemically synthesized
aaggacattgataattttga

SEQ ID NO: 70148 - DNA, 20 bp, Artificial Sequence
  chemically synthesized
tacagcactagattttgtta

SEQ ID NO: 70149 - DNA, 20 bp, Artificial Sequence
  chemically synthesized
ttacagcactagattttgtt

SEQ ID NO: 70150 - DNA, 20 bp, Artificial Sequence
  chemically synthesized
tcaatgtccttaacaaaatc

SEQ ID NO: 70151 - DNA, 20 bp, Artificial Sequence
  chemically synthesized
tttattttcctttacagcac

SEQ ID NO: 70152 - DNA, 20 bp, Artificial Sequence
  chemically synthesized
taacaaaatctagtgctgta

SEQ ID NO: 70153 - DNA, 20 bp, Artificial Sequence
  chemically synthesized
aacaaaatctagtgctgtaa

SEQ ID NO: 70154 - DNA, 20 bp, Artificial Sequence
  chemically synthesized
tgttgttttattttccttta

SEQ ID NO: 70155 - DNA, 20 bp, Artificial Sequence
  chemically synthesized
tgtaaaggaaaataaaacaa

SEQ ID NO: 70156 - DNA, 20 bp, Artificial Sequence
  chemically synthesized
aaggaaaataaaacaacaga

SEQ ID NO: 70157 - DNA, 20 bp, Artificial Sequence
  chemically synthesized
aacaacagatagtctgacat

SEQ ID NO: 70158 - DNA, 20 bp, Artificial Sequence
  chemically synthesized
aggaaagtattaactaatgt

SEQ ID NO: 70159 - DNA, 20 bp, Artificial Sequence
  chemically synthesized
tgcatccttttgatagagga

SEQ ID NO: 70160 - DNA, 20 bp, Artificial Sequence
  chemically synthesized
ttaatactttcctctatcaa

SEQ ID NO: 70161 - DNA, 20 bp, Artificial Sequence
  chemically synthesized
tttctgcatccttttgatag

SEQ ID NO: 70162 - DNA, 20 bp, Artificial Sequence
  chemically synthesized
taatactttcctctatcaaa

SEQ ID NO: 70163 - DNA, 20 bp, Artificial Sequence
  chemically synthesized
ttttctgcatccttttgata

SEQ ID NO: 70164 - DNA, 20 bp, Artificial Sequence
  chemically synthesized
agttttctgcatccttttga

SEQ ID NO: 70165 - DNA, 20 bp, Artificial Sequence
  chemically synthesized
tttcctctatcaaaaggatg

SEQ ID NO: 70166 - DNA, 20 bp, Artificial Sequence
  chemically synthesized
tcaaaaggatgcagaaaact

SEQ ID NO: 70167 - DNA, 20 bp, Artificial Sequence
  chemically synthesized
caaaaggatgcagaaaactt

SEQ ID NO: 70168 - DNA, 20 bp, Artificial Sequence
  chemically synthesized
aaaaggatgcagaaaactta

SEQ ID NO: 70169 - DNA, 20 bp, Artificial Sequence
  chemically synthesized
gaattcaaggaggatgccct

SEQ ID NO: 70170 - DNA, 20 bp, Artificial Sequence
  chemically synthesized
ggtctcccctgaattcaagg

SEQ ID NO: 70171 - DNA, 20 bp, Artificial Sequence
  chemically synthesized
aggtctcccctgaattcaag

SEQ ID NO: 70172 - DNA, 20 bp, Artificial Sequence
  chemically synthesized
tagggcatcctccttgaatt

SEQ ID NO: 70173 - DNA, 20 bp, Artificial Sequence
  chemically synthesized
agggcatcctccttgaattc

SEQ ID NO: 70174 - DNA, 20 bp, Artificial Sequence
  chemically synthesized
aaaggtctcccctgaattca

SEQ ID NO: 70175 - DNA, 20 bp, Artificial Sequence
  chemically synthesized
gggcatcctccttgaattca

SEQ ID NO: 70176 - DNA, 20 bp, Artificial Sequence
  chemically synthesized
aaaaggtctcccctgaattc

SEQ ID NO: 70177 - DNA, 20 bp, Artificial Sequence
  chemically synthesized
ggcatcctccttgaattcag

SEQ ID NO: 70178 - DNA, 20 bp, Artificial Sequence
  chemically synthesized
catcctccttgaattcaggg

SEQ ID NO: 70179 - DNA, 20 bp, Artificial Sequence
  chemically synthesized
tcgttaaacgttgtagtaaa

SEQ ID NO: 70180 - DNA, 20 bp, Artificial Sequence
  chemically synthesized
ttcgttaaacgttgtagtaa

SEQ ID NO: 70181 - DNA, 20 bp, Artificial Sequence
  chemically synthesized
aaatacttcgttaaacgttg

SEQ ID NO: 70182 - DNA, 20 bp, Artificial Sequence
  chemically synthesized
ttttactacaacgtttaacg

SEQ ID NO: 70183 - DNA, 20 bp, Artificial Sequence
  chemically synthesized
acaacgtttaacgaagtatt

SEQ ID NO: 70184 - DNA, 20 bp, Artificial Sequence
  chemically synthesized
acgaagtatttggatgactt

SEQ ID NO: 70185 - DNA, 20 bp, Artificial Sequence
  chemically synthesized
cgaagtatttggatgacttg

SEQ ID NO: 70186 - DNA, 20 bp, Artificial Sequence
  chemically synthesized
gagttgtttatttgagcctc

SEQ ID NO: 70187 - DNA, 20 bp, Artificial Sequence
  chemically synthesized
gaaaactgagttgtttattt

SEQ ID NO: 70188 - DNA, 20 bp, Artificial Sequence
  chemically synthesized
tgaggctcaaataaacaact

SEQ ID NO: 70189 - DNA, 20 bp, Artificial Sequence
  chemically synthesized
agtcaacacagtggaaaact

SEQ ID NO: 70190 - DNA, 20 bp, Artificial Sequence
  chemically synthesized
tatgcccacagtcaacacag

SEQ ID NO: 70191 - DNA, 20 bp, Artificial Sequence
  chemically synthesized
ccatatgcccacagtcaaca

SEQ ID NO: 70192 - DNA, 20 bp, Artificial Sequence
  chemically synthesized
gttttccactgtgttgactg

SEQ ID NO: 70193 - DNA, 20 bp, Artificial Sequence
  chemically synthesized
ttttccactgtgttgactgt

SEQ ID NO: 70194 - DNA, 20 bp, Artificial Sequence
  chemically synthesized
agctacaccccatatgccca

SEQ ID NO: 70195 - DNA, 20 bp, Artificial Sequence
  chemically synthesized
ctgtgttgactgtgggcata

SEQ ID NO: 70196 - DNA, 20 bp, Artificial Sequence
  chemically synthesized
tgtgttgactgtgggcatat

SEQ ID NO: 70197 - DNA, 20 bp, Artificial Sequence
  chemically synthesized
gtgttgactgtgggcatatg

SEQ ID NO: 70198 - DNA, 20 bp, Artificial Sequence
  chemically synthesized
gactgtgggcatatggggtg

SEQ ID NO: 70199 - DNA, 20 bp, Artificial Sequence
  chemically synthesized
tgggcatatggggtgtagct

SEQ ID NO: 70200 - DNA, 20 bp, Artificial Sequence
  chemically synthesized
atggggtgtagctgagttgt

SEQ ID NO: 70201 - DNA, 20 bp, Artificial Sequence
  chemically synthesized
cttttaacagactcacaact

SEQ ID NO: 70202 - DNA, 20 bp, Artificial Sequence
  chemically synthesized
ctgagttgtgagtctgttaa

SEQ ID NO: 70203 - DNA, 20 bp, Artificial Sequence
  chemically synthesized
gaaagtgtattttcttttaa

SEQ ID NO: 70204 - DNA, 20 bp, Artificial Sequence
  chemically synthesized
gttaaaagaaaatacacttt

SEQ ID NO: 70205 - DNA, 20 bp, Artificial Sequence
  chemically synthesized
ttaaaagaaaatacactttc

SEQ ID NO: 70206 - DNA, 20 bp, Artificial Sequence
  chemically synthesized
ttctccttattcattcctga

SEQ ID NO: 70207 - DNA, 20 bp, Artificial Sequence
  chemically synthesized
atacactttcaggaatgaat

SEQ ID NO: 70208 - DNA, 20 bp, Artificial Sequence
  chemically synthesized
tacactttcaggaatgaata

SEQ ID NO: 70209 - DNA, 20 bp, Artificial Sequence
  chemically synthesized
cactttcaggaatgaataag

SEQ ID NO: 70210 - DNA, 20 bp, Artificial Sequence
  chemically synthesized
gaaaaacgcaaacacataaa

SEQ ID NO: 70211 - DNA, 20 bp, Artificial Sequence
  chemically synthesized
aaaagacacaccactatata

SEQ ID NO: 70212 - DNA, 20 bp, Artificial Sequence
  chemically synthesized
agagagaaaactatatatag

SEQ ID NO: 70213 - DNA, 20 bp, Artificial Sequence
  chemically synthesized
catagagagaaaactatata

SEQ ID NO: 70214 - DNA, 20 bp, Artificial Sequence
  chemically synthesized
atatagttttctctctatgt

SEQ ID NO: 70215 - DNA, 20 bp, Artificial Sequence
  chemically synthesized
ttataggtatccaacataga

SEQ ID NO: 70216 - DNA, 20 bp, Artificial Sequence
  chemically synthesized
atttataggtatccaacata

SEQ ID NO: 70217 - DNA, 20 bp, Artificial Sequence
  chemically synthesized
acatttataggtatccaaca

SEQ ID NO: 70218 - DNA, 20 bp, Artificial Sequence
  chemically synthesized
atgttggatacctataaatg

SEQ ID NO: 70219 - DNA, 20 bp, Artificial Sequence
  chemically synthesized
tcaacaaatcccacatttat

SEQ ID NO: 70220 - DNA, 20 bp, Artificial Sequence
  chemically synthesized
tgttggatacctataaatgt

SEQ ID NO: 70221 - DNA, 20 bp, Artificial Sequence
  chemically synthesized
ttcaacaaatcccacattta

SEQ ID NO: 70222 - DNA, 20 bp, Artificial Sequence
  chemically synthesized
tttgttgaattttgatcaca

SEQ ID NO: 70223 - DNA, 20 bp, Artificial Sequence
  chemically synthesized
agactaacacataggataga

SEQ ID NO: 70224 - DNA, 20 bp, Artificial Sequence
  chemically synthesized
gtgcagactaacacatagga

SEQ ID NO: 70225 - DNA, 20 bp, Artificial Sequence
  chemically synthesized
agtctttctatcctatgtgt

SEQ ID NO: 70226 - DNA, 20 bp, Artificial Sequence
  chemically synthesized
acttgtgcagactaacacat

SEQ ID NO: 70227 - DNA, 20 bp, Artificial Sequence
  chemically synthesized
tacttgtgcagactaacaca

SEQ ID NO: 70228 - DNA, 20 bp, Artificial Sequence
  chemically synthesized
tcctatgtgttagtctgcac

SEQ ID NO: 70229 - DNA, 20 bp, Artificial Sequence
  chemically synthesized
aggcaaagcctgtacttgtg

SEQ ID NO: 70230 - DNA, 20 bp, Artificial Sequence
  chemically synthesized
tgtgttagtctgcacaagta

SEQ ID NO: 70231 - DNA, 20 bp, Artificial Sequence
  chemically synthesized
gtgttagtctgcacaagtac

SEQ ID NO: 70232 - DNA, 20 bp, Artificial Sequence
  chemically synthesized
caatactgaaattataggca

SEQ ID NO: 70233 - DNA, 20 bp, Artificial Sequence
  chemically synthesized
acaggctttgcctataattt

SEQ ID NO: 70234 - DNA, 20 bp, Artificial Sequence
  chemically synthesized
caaatcaatactgaaattat

SEQ ID NO: 70235 - DNA, 20 bp, Artificial Sequence
  chemically synthesized
gcaaatcaatactgaaatta

SEQ ID NO: 70236 - DNA, 20 bp, Artificial Sequence
  chemically synthesized
agtattgatttgctgttata

SEQ ID NO: 70237 - DNA, 20 bp, Artificial Sequence
  chemically synthesized
gtattgatttgctgttatac

SEQ ID NO: 70238 - DNA, 20 bp, Artificial Sequence
  chemically synthesized
acaagttggaacctgtataa

SEQ ID NO: 70239 - DNA, 20 bp, Artificial Sequence
  chemically synthesized
gtaatgaaatttagacaagt

SEQ ID NO: 70240 - DNA, 20 bp, Artificial Sequence
  chemically synthesized
tcaggtaatgaaatttagac

SEQ ID NO: 70241 - DNA, 20 bp, Artificial Sequence
  chemically synthesized
tcccttcaggtaatgaaatt

SEQ ID NO: 70242 - DNA, 20 bp, Artificial Sequence
  chemically synthesized
tgtctaaatttcattacctg

SEQ ID NO: 70243 - DNA, 20 bp, Artificial Sequence
  chemically synthesized
gtctaaatttcattacctga

SEQ ID NO: 70244 - DNA, 20 bp, Artificial Sequence
  chemically synthesized
tctaaatttcattacctgaa

SEQ ID NO: 70245 - DNA, 20 bp, Artificial Sequence
  chemically synthesized
aatttcattacctgaaggga

SEQ ID NO: 70246 - DNA, 20 bp, Artificial Sequence
  chemically synthesized
gaattgcaagctgtcccttc

SEQ ID NO: 70247 - DNA, 20 bp, Artificial Sequence
  chemically synthesized
ggaattgcaagctgtccctt

SEQ ID NO: 70248 - DNA, 20 bp, Artificial Sequence
  chemically synthesized
atacctgtatatggaattgc

SEQ ID NO: 70249 - DNA, 20 bp, Artificial Sequence
  chemically synthesized
acagcttgcaattccatata

SEQ ID NO: 70250 - DNA, 20 bp, Artificial Sequence
  chemically synthesized
cagcttgcaattccatatac

SEQ ID NO: 70251 - DNA, 20 bp, Artificial Sequence
  chemically synthesized
gcttttattatacctgtata

SEQ ID NO: 70252 - DNA, 20 bp, Artificial Sequence
  chemically synthesized
tccatatacaggtataataa

SEQ ID NO: 70253 - DNA, 20 bp, Artificial Sequence
  chemically synthesized
tatacaggtataataaaagc

SEQ ID NO: 70254 - DNA, 20 bp, Artificial Sequence
  chemically synthesized
aggtataataaaagcaagat

SEQ ID NO: 70255 - DNA, 20 bp, Artificial Sequence
  chemically synthesized
gatgagtacatgcatactgt

SEQ ID NO: 70256 - DNA, 20 bp, Artificial Sequence
  chemically synthesized
aagtgccttttcagagctca

SEQ ID NO: 70257 - DNA, 20 bp, Artificial Sequence
  chemically synthesized
tgcatactgtgagctctgaa

SEQ ID NO: 70258 - DNA, 20 bp, Artificial Sequence
  chemically synthesized
gcatactgtgagctctgaaa

SEQ ID NO: 70259 - DNA, 20 bp, Artificial Sequence
  chemically synthesized
gtagaaaaagtgccttttca

SEQ ID NO: 70260 - DNA, 20 bp, Artificial Sequence
  chemically synthesized
ttgtagaaaaagtgcctttt

SEQ ID NO: 70261 - DNA, 20 bp, Artificial Sequence
  chemically synthesized
tggcacagccattgtagaaa

SEQ ID NO: 70262 - DNA, 20 bp, Artificial Sequence
  chemically synthesized
aaaaggcactttttctacaa

SEQ ID NO: 70263 - DNA, 20 bp, Artificial Sequence
  chemically synthesized
agaatttggcacagccattg

SEQ ID NO: 70264 - DNA, 20 bp, Artificial Sequence
  chemically synthesized
gtctcatgaagaatttggca

SEQ ID NO: 70265 - DNA, 20 bp, Artificial Sequence
  chemically synthesized
taacagtctcatgaagaatt

SEQ ID NO: 70266 - DNA, 20 bp, Artificial Sequence
  chemically synthesized
ggctgtgccaaattcttcat

SEQ ID NO: 70267 - DNA, 20 bp, Artificial Sequence
  chemically synthesized
aacagaataacagtctcatg

SEQ ID NO: 70268 - DNA, 20 bp, Artificial Sequence
  chemically synthesized
caccatttgcaacagaataa

SEQ ID NO: 70269 - DNA, 20 bp, Artificial Sequence
  chemically synthesized
gactgttattctgttgcaaa

SEQ ID NO: 70270 - DNA, 20 bp, Artificial Sequence
  chemically synthesized
tttcttatcaccatttgcaa

SEQ ID NO: 70271 - DNA, 20 bp, Artificial Sequence
  chemically synthesized
attctgttgcaaatggtgat

SEQ ID NO: 70272 - DNA, 20 bp, Artificial Sequence
  chemically synthesized
tgttgcaaatggtgataaga

SEQ ID NO: 70273 - DNA, 20 bp, Artificial Sequence
  chemically synthesized
tagtaaataatgtatgatat

SEQ ID NO: 70274 - DNA, 20 bp, Artificial Sequence
  chemically synthesized
caatatcatacattatttac

SEQ ID NO: 70275 - DNA, 20 bp, Artificial Sequence
  chemically synthesized
gaaaatattagtacaaatgc

SEQ ID NO: 70276 - DNA, 20 bp, Artificial Sequence
  chemically synthesized
aggttcagaattgaaaatat

SEQ ID NO: 70277 - DNA, 20 bp, Artificial Sequence
  chemically synthesized
agtgtgattataatgaggtt

SEQ ID NO: 70278 - DNA, 20 bp, Artificial Sequence
  chemically synthesized
aaacaagtgtgattataatg

SEQ ID NO: 70279 - DNA, 20 bp, Artificial Sequence
  chemically synthesized
gaaacaagtgtgattataat

SEQ ID NO: 70280 - DNA, 20 bp, Artificial Sequence
  chemically synthesized
cattataatcacacttgttt

SEQ ID NO: 70281 - DNA, 20 bp, Artificial Sequence
  chemically synthesized
ccacaaatgggttctgaaac

SEQ ID NO: 70282 - DNA, 20 bp, Artificial Sequence
  chemically synthesized
cttgtttcagaacccatttg

SEQ ID NO: 70283 - DNA, 20 bp, Artificial Sequence
  chemically synthesized
agctgggtatgtccacaaat

SEQ ID NO: 70284 - DNA, 20 bp, Artificial Sequence
  chemically synthesized
tagctgggtatgtccacaaa

SEQ ID NO: 70285 - DNA, 20 bp, Artificial Sequence
  chemically synthesized
aacccatttgtggacatacc

SEQ ID NO: 70286 - DNA, 20 bp, Artificial Sequence
  chemically synthesized
tgttagttaggcaaatagct

SEQ ID NO: 70287 - DNA, 20 bp, Artificial Sequence
  chemically synthesized
ctgttagttaggcaaatagc

SEQ ID NO: 70288 - DNA, 20 bp, Artificial Sequence
  chemically synthesized
atagctgttagttaggcaaa

SEQ ID NO: 70289 - DNA, 20 bp, Artificial Sequence
  chemically synthesized
ccagctatttgcctaactaa

SEQ ID NO: 70290 - DNA, 20 bp, Artificial Sequence
  chemically synthesized
gaagtaaatagctgttagtt

SEQ ID NO: 70291 - DNA, 20 bp, Artificial Sequence
  chemically synthesized
agaagtaaatagctgttagt

SEQ ID NO: 70292 - DNA, 20 bp, Artificial Sequence
  chemically synthesized
aacaagaagtaaatagctgt

SEQ ID NO: 70293 - DNA, 20 bp, Artificial Sequence
  chemically synthesized
accaaggaacaagaagtaaa

SEQ ID NO: 70294 - DNA, 20 bp, Artificial Sequence
  chemically synthesized
cttctttaccaaggaacaag

SEQ ID NO: 70295 - DNA, 20 bp, Artificial Sequence
  chemically synthesized
gctatttacttcttgttcct

SEQ ID NO: 70296 - DNA, 20 bp, Artificial Sequence
  chemically synthesized
gagcttctttaccaaggaac

SEQ ID NO: 70297 - DNA, 20 bp, Artificial Sequence
  chemically synthesized
ttacttcttgttccttggta

SEQ ID NO: 70298 - DNA, 20 bp, Artificial Sequence
  chemically synthesized
ataattgagcttctttacca

SEQ ID NO: 70299 - DNA, 20 bp, Artificial Sequence
  chemically synthesized
cttcttgttccttggtaaag

SEQ ID NO: 70300 - DNA, 20 bp, Artificial Sequence
  chemically synthesized
cataattgagcttctttacc

SEQ ID NO: 70301 - DNA, 20 bp, Artificial Sequence
  chemically synthesized
cccaatatctgaacataatt

SEQ ID NO: 70302 - DNA, 20 bp, Artificial Sequence
  chemically synthesized
taaagaagctcaattatgtt

SEQ ID NO: 70303 - DNA, 20 bp, Artificial Sequence
  chemically synthesized
gctcaattatgttcagatat

SEQ ID NO: 70304 - DNA, 20 bp, Artificial Sequence
  chemically synthesized
ctcaattatgttcagatatt

SEQ ID NO: 70305 - DNA, 20 bp, Artificial Sequence
  chemically synthesized
tgttcagatattgggcaaca

SEQ ID NO: 70306 - DNA, 20 bp, Artificial Sequence
  chemically synthesized
gttcagatattgggcaacaa

SEQ ID NO: 70307 - DNA, 20 bp, Artificial Sequence
  chemically synthesized
atattgggcaacaaaggaca

SEQ ID NO: 70308 - DNA, 20 bp, Artificial Sequence
  chemically synthesized
gcaacaaaggacacagctct

SEQ ID NO: 70309 - DNA, 20 bp, Artificial Sequence
  chemically synthesized
caacaaaggacacagctctg

SEQ ID NO: 70310 - DNA, 20 bp, Artificial Sequence
  chemically synthesized
agattttaattttttcctca

SEQ ID NO: 70311 - DNA, 20 bp, Artificial Sequence
  chemically synthesized
ccagattttaattttttcct

SEQ ID NO: 70312 - DNA, 20 bp, Artificial Sequence
  chemically synthesized
ctgaggaaaaaattaaaatc

SEQ ID NO: 70313 - DNA, 20 bp, Artificial Sequence
  chemically synthesized
aaaaaattaaaatctggtct

SEQ ID NO: 70314 - DNA, 20 bp, Artificial Sequence
  chemically synthesized
ttactgtgattggcttagac

SEQ ID NO: 70315 - DNA, 20 bp, Artificial Sequence
  chemically synthesized
caagcttactgtgattggct

SEQ ID NO: 70316 - DNA, 20 bp, Artificial Sequence
  chemically synthesized
aatctggtctaagccaatca

SEQ ID NO: 70317 - DNA, 20 bp, Artificial Sequence
  chemically synthesized
agaaacaagcttactgtgat

SEQ ID NO: 70318 - DNA, 20 bp, Artificial Sequence
  chemically synthesized
tggtctaagccaatcacagt

SEQ ID NO: 70319 - DNA, 20 bp, Artificial Sequence
  chemically synthesized
aatcactggctatgagaaac

SEQ ID NO: 70320 - DNA, 20 bp, Artificial Sequence
  chemically synthesized
cacagtaagcttgtttctca

SEQ ID NO: 70321 - DNA, 20 bp, Artificial Sequence
  chemically synthesized
gtaagcttgtttctcatagc

SEQ ID NO: 70322 - DNA, 20 bp, Artificial Sequence
  chemically synthesized
ttaagccaatcactggctat

SEQ ID NO: 70323 - DNA, 20 bp, Artificial Sequence
  chemically synthesized
tgtttctcatagccagtgat

SEQ ID NO: 70324 - DNA, 20 bp, Artificial Sequence
  chemically synthesized
aacctctttaagccaatcac

SEQ ID NO: 70325 - DNA, 20 bp, Artificial Sequence
  chemically synthesized
catagccagtgattggctta

SEQ ID NO: 70326 - DNA, 20 bp, Artificial Sequence
  chemically synthesized
tagccagtgattggcttaaa

SEQ ID NO: 70327 - DNA, 20 bp, Artificial Sequence
  chemically synthesized
agccagtgattggcttaaag

SEQ ID NO: 70328 - DNA, 20 bp, Artificial Sequence
  chemically synthesized
ggatctcactgaacctcttt

SEQ ID NO: 70329 - DNA, 20 bp, Artificial Sequence
  chemically synthesized
gtgattggcttaaagaggtt

SEQ ID NO: 70330 - DNA, 20 bp, Artificial Sequence
  chemically synthesized
ttggcttaaagaggttcagt

SEQ ID NO: 70331 - DNA, 20 bp, Artificial Sequence
  chemically synthesized
taaagaggttcagtgagatc

SEQ ID NO: 70332 - DNA, 20 bp, Artificial Sequence
  chemically synthesized
ggttcagtgagatccagttc

SEQ ID NO: 70333 - DNA, 20 bp, Artificial Sequence
  chemically synthesized
tcttatgtgtcaactagaac

SEQ ID NO: 70334 - DNA, 20 bp, Artificial Sequence
  chemically synthesized
atttcttcttatgtgtcaac

SEQ ID NO: 70335 - DNA, 20 bp, Artificial Sequence
  chemically synthesized
tccagttctagttgacacat

SEQ ID NO: 70336 - DNA, 20 bp, Artificial Sequence
  chemically synthesized
agttctagttgacacataag

SEQ ID NO: 70337 - DNA, 20 bp, Artificial Sequence
  chemically synthesized
acacataagaagaaatttgt

SEQ ID NO: 70338 - DNA, 20 bp, Artificial Sequence
  chemically synthesized
cacataagaagaaatttgtt

SEQ ID NO: 70339 - DNA, 20 bp, Artificial Sequence
  chemically synthesized
acataagaagaaatttgttg

SEQ ID NO: 70340 - DNA, 20 bp, Artificial Sequence
  chemically synthesized
ataagaagaaatttgttggg

SEQ ID NO: 70341 - DNA, 20 bp, Artificial Sequence
  chemically synthesized
gaaatttgttggggagcttc

SEQ ID NO: 70342 - DNA, 20 bp, Artificial Sequence
  chemically synthesized
aaatttgttggggagcttct

SEQ ID NO: 70343 - DNA, 20 bp, Artificial Sequence
  chemically synthesized
gaaaagcaaacgtttcccag

SEQ ID NO: 70344 - DNA, 20 bp, Artificial Sequence
  chemically synthesized
ttggaaaagcaaacgtttcc

SEQ ID NO: 70345 - DNA, 20 bp, Artificial Sequence
  chemically synthesized
ctgtgtgtctgtgtttggaa

SEQ ID NO: 70346 - DNA, 20 bp, Artificial Sequence
  chemically synthesized
aacgtttgcttttccaaaca

SEQ ID NO: 70347 - DNA, 20 bp, Artificial Sequence
  chemically synthesized
catgcctgtgtgtctgtgtt

SEQ ID NO: 70348 - DNA, 20 bp, Artificial Sequence
  chemically synthesized
cttttccaaacacagacaca

SEQ ID NO: 70349 - DNA, 20 bp, Artificial Sequence
  chemically synthesized
ttttccaaacacagacacac

SEQ ID NO: 70350 - DNA, 20 bp, Artificial Sequence
  chemically synthesized
aaacacagacacacaggcat

SEQ ID NO: 70351 - DNA, 20 bp, Artificial Sequence
  chemically synthesized
acacacacacgcacacaata

SEQ ID NO: 70352 - DNA, 20 bp, Artificial Sequence
  chemically synthesized
gcaagaaggaataaggttca

SEQ ID NO: 70353 - DNA, 20 bp, Artificial Sequence
  chemically synthesized
ggcaagaaggaataaggttc

SEQ ID NO: 70354 - DNA, 20 bp, Artificial Sequence
  chemically synthesized
aaccaaggcaagaaggaata

SEQ ID NO: 70355 - DNA, 20 bp, Artificial Sequence
  chemically synthesized
taaccaaggcaagaaggaat

SEQ ID NO: 70356 - DNA, 20 bp, Artificial Sequence
  chemically synthesized
caacaataaccaaggcaaga

SEQ ID NO: 70357 - DNA, 20 bp, Artificial Sequence
  chemically synthesized
aaccttattccttcttgcct

SEQ ID NO: 70358 - DNA, 20 bp, Artificial Sequence
  chemically synthesized
acaacaataaccaaggcaag

SEQ ID NO: 70359 - DNA, 20 bp, Artificial Sequence
  chemically synthesized
cagacaacaataaccaaggc

SEQ ID NO: 70360 - DNA, 20 bp, Artificial Sequence
  chemically synthesized
tccgcagacaacaataacca

SEQ ID NO: 70361 - DNA, 20 bp, Artificial Sequence
  chemically synthesized
atccgcagacaacaataacc

SEQ ID NO: 70362 - DNA, 20 bp, Artificial Sequence
  chemically synthesized
gccttggttattgttgtctg

SEQ ID NO: 70363 - DNA, 20 bp, Artificial Sequence
  chemically synthesized
tgcgccaagcaacatatccg

SEQ ID NO: 70364 - DNA, 20 bp, Artificial Sequence
  chemically synthesized
ttgtctgcggatatgttgct

SEQ ID NO: 70365 - DNA, 20 bp, Artificial Sequence
  chemically synthesized
tgcggatatgttgcttggcg

SEQ ID NO: 70366 - DNA, 20 bp, Artificial Sequence
  chemically synthesized
ggatatgttgcttggcgcag

SEQ ID NO: 70367 - DNA, 20 bp, Artificial Sequence
  chemically synthesized
agatggcttcccactgcgcc

SEQ ID NO: 70368 - DNA, 20 bp, Artificial Sequence
  chemically synthesized
gatatgttgcttggcgcagt

SEQ ID NO: 70369 - DNA, 20 bp, Artificial Sequence
  chemically synthesized
atgttgcttggcgcagtggg

SEQ ID NO: 70370 - DNA, 20 bp, Artificial Sequence
  chemically synthesized
ggcgcagtgggaagccatct

SEQ ID NO: 70371 - DNA, 20 bp, Artificial Sequence
  chemically synthesized
gcgcagtgggaagccatctt

SEQ ID NO: 70372 - DNA, 20 bp, Artificial Sequence
  chemically synthesized
ttttcctcatggtcccaaga

SEQ ID NO: 70373 - DNA, 20 bp, Artificial Sequence
  chemically synthesized
gtctttttcctcatggtccc

SEQ ID NO: 70374 - DNA, 20 bp, Artificial Sequence
  chemically synthesized
ggaagccatcttgggaccat

SEQ ID NO: 70375 - DNA, 20 bp, Artificial Sequence
  chemically synthesized
gaagccatcttgggaccatg

SEQ ID NO: 70376 - DNA, 20 bp, Artificial Sequence
  chemically synthesized
ttctcttgtctttttcctca

SEQ ID NO: 70377 - DNA, 20 bp, Artificial Sequence
  chemically synthesized
atcttgggaccatgaggaaa

SEQ ID NO: 70378 - DNA, 20 bp, Artificial Sequence
  chemically synthesized
gggaccatgaggaaaaagac

SEQ ID NO: 70379 - DNA, 20 bp, Artificial Sequence
  chemically synthesized
gaccatgaggaaaaagacaa

SEQ ID NO: 70380 - DNA, 20 bp, Artificial Sequence
  chemically synthesized
ggaaaaagacaagagaatcc

SEQ ID NO: 70381 - DNA, 20 bp, Artificial Sequence
  chemically synthesized
aaaaagacaagagaatccca

SEQ ID NO: 70382 - DNA, 20 bp, Artificial Sequence
  chemically synthesized
aagacaagagaatcccagag

SEQ ID NO: 70383 - DNA, 20 bp, Artificial Sequence
  chemically synthesized
gacttgaggtcagcttctct

SEQ ID NO: 70384 - DNA, 20 bp, Artificial Sequence
  chemically synthesized
agacttgaggtcagcttctc

SEQ ID NO: 70385 - DNA, 20 bp, Artificial Sequence
  chemically synthesized
atcccagagaagctgacctc

SEQ ID NO: 70386 - DNA, 20 bp, Artificial Sequence
  chemically synthesized
gctatatcaagacttgaggt

SEQ ID NO: 70387 - DNA, 20 bp, Artificial Sequence
  chemically synthesized
attagctatatcaagacttg

SEQ ID NO: 70388 - DNA, 20 bp, Artificial Sequence
  chemically synthesized
gattagctatatcaagactt

SEQ ID NO: 70389 - DNA, 20 bp, Artificial Sequence
  chemically synthesized
gctgacctcaagtcttgata

SEQ ID NO: 70390 - DNA, 20 bp, Artificial Sequence
  chemically synthesized
ttcaacagattagctatatc

SEQ ID NO: 70391 - DNA, 20 bp, Artificial Sequence
  chemically synthesized
agctggttaattcaacagat

SEQ ID NO: 70392 - DNA, 20 bp, Artificial Sequence
  chemically synthesized
cctagagctggttaattcaa

SEQ ID NO: 70393 - DNA, 20 bp, Artificial Sequence
  chemically synthesized
agctaatctgttgaattaac

SEQ ID NO: 70394 - DNA, 20 bp, Artificial Sequence
  chemically synthesized
tctgttgaattaaccagctc

SEQ ID NO: 70395 - DNA, 20 bp, Artificial Sequence
  chemically synthesized
ctgttgaattaaccagctct

SEQ ID NO: 70396 - DNA, 20 bp, Artificial Sequence
  chemically synthesized
aagaccatcagacctagagc

SEQ ID NO: 70397 - DNA, 20 bp, Artificial Sequence
  chemically synthesized
tccaaagaccatcagaccta

SEQ ID NO: 70398 - DNA, 20 bp, Artificial Sequence
  chemically synthesized
ttaaccagctctaggtctga

SEQ ID NO: 70399 - DNA, 20 bp, Artificial Sequence
  chemically synthesized
agtccaaagaccatcagacc

SEQ ID NO: 70400 - DNA, 20 bp, Artificial Sequence
  chemically synthesized
aactgaagtccaaagaccat

SEQ ID NO: 70401 - DNA, 20 bp, Artificial Sequence
  chemically synthesized
gctctaggtctgatggtctt

SEQ ID NO: 70402 - DNA, 20 bp, Artificial Sequence
  chemically synthesized
gtctgatggtctttggactt

SEQ ID NO: 70403 - DNA, 20 bp, Artificial Sequence
  chemically synthesized
tcaaaataaactgaagtcca

SEQ ID NO: 70404 - DNA, 20 bp, Artificial Sequence
  chemically synthesized
ccactaatcaaaataaactg

SEQ ID NO: 70405 - DNA, 20 bp, Artificial Sequence
  chemically synthesized
ggacttcagtttattttgat

SEQ ID NO: 70406 - DNA, 20 bp, Artificial Sequence
  chemically synthesized
cttcagtttattttgattag

SEQ ID NO: 70407 - DNA, 20 bp, Artificial Sequence
  chemically synthesized
attttgattagtggttctca

SEQ ID NO: 70408 - DNA, 20 bp, Artificial Sequence
  chemically synthesized
gattagtggttctcaaagtg

SEQ ID NO: 70409 - DNA, 20 bp, Artificial Sequence
  chemically synthesized
gtggtcaggaactgcacttt

SEQ ID NO: 70410 - DNA, 20 bp, Artificial Sequence
  chemically synthesized
caaagtgcagttcctgacca

SEQ ID NO: 70411 - DNA, 20 bp, Artificial Sequence
  chemically synthesized
aaagtgcagttcctgaccac

SEQ ID NO: 70412 - DNA, 20 bp, Artificial Sequence
  chemically synthesized
atgctgctactcctgtggtc

SEQ ID NO: 70413 - DNA, 20 bp, Artificial Sequence
  chemically synthesized
agtgcagttcctgaccacag

SEQ ID NO: 70414 - DNA, 20 bp, Artificial Sequence
  chemically synthesized
tatgctgctactcctgtggt

SEQ ID NO: 70415 - DNA, 20 bp, Artificial Sequence
  chemically synthesized
gcagttcctgaccacaggag

SEQ ID NO: 70416 - DNA, 20 bp, Artificial Sequence
  chemically synthesized
aagttatgctgctactcctg

SEQ ID NO: 70417 - DNA, 20 bp, Artificial Sequence
  chemically synthesized
gttcctgaccacaggagtag

SEQ ID NO: 70418 - DNA, 20 bp, Artificial Sequence
  chemically synthesized
acaggagtagcagcataact

SEQ ID NO: 70419 - DNA, 20 bp, Artificial Sequence
  chemically synthesized
tacatttctagtaggttgcc

SEQ ID NO: 70420 - DNA, 20 bp, Artificial Sequence
  chemically synthesized
agcataacttggcaacctac

SEQ ID NO: 70421 - DNA, 20 bp, Artificial Sequence
  chemically synthesized
cgagattctacatttctagt

SEQ ID NO: 70422 - DNA, 20 bp, Artificial Sequence
  chemically synthesized
ccgagattctacatttctag

SEQ ID NO: 70423 - DNA, 20 bp, Artificial Sequence
  chemically synthesized
ttggcaacctactagaaatg

SEQ ID NO: 70424 - DNA, 20 bp, Artificial Sequence
  chemically synthesized
agtccgagattctacatttc

SEQ ID NO: 70425 - DNA, 20 bp, Artificial Sequence
  chemically synthesized
ctactagaaatgtagaatct

SEQ ID NO: 70426 - DNA, 20 bp, Artificial Sequence
  chemically synthesized
gtaggtccagcgtggagtcc

SEQ ID NO: 70427 - DNA, 20 bp, Artificial Sequence
  chemically synthesized
tagaatctcggactccacgc

SEQ ID NO: 70428 - DNA, 20 bp, Artificial Sequence
  chemically synthesized
gatgcagtaggtccagcgtg

SEQ ID NO: 70429 - DNA, 20 bp, Artificial Sequence
  chemically synthesized
ctgatgcagtaggtccagcg

SEQ ID NO: 70430 - DNA, 20 bp, Artificial Sequence
  chemically synthesized
cgtttctgatgcagtaggtc

SEQ ID NO: 70431 - DNA, 20 bp, Artificial Sequence
  chemically synthesized
ccacgctggacctactgcat

SEQ ID NO: 70432 - DNA, 20 bp, Artificial Sequence
  chemically synthesized
cccagcgtttctgatgcagt

SEQ ID NO: 70433 - DNA, 20 bp, Artificial Sequence
  chemically synthesized
tcccagcgtttctgatgcag

SEQ ID NO: 70434 - DNA, 20 bp, Artificial Sequence
  chemically synthesized
tgctcccagcgtttctgatg

SEQ ID NO: 70435 - DNA, 20 bp, Artificial Sequence
  chemically synthesized
acctactgcatcagaaacgc

SEQ ID NO: 70436 - DNA, 20 bp, Artificial Sequence
  chemically synthesized
cctactgcatcagaaacgct

SEQ ID NO: 70437 - DNA, 20 bp, Artificial Sequence
  chemically synthesized
tactgcatcagaaacgctgg

SEQ ID NO: 70438 - DNA, 20 bp, Artificial Sequence
  chemically synthesized
tgcatcagaaacgctgggag

SEQ ID NO: 70439 - DNA, 20 bp, Artificial Sequence
  chemically synthesized
acaggctggcaggctgctcc

SEQ ID NO: 70440 - DNA, 20 bp, Artificial Sequence
  chemically synthesized
aaacgctgggagcagcctgc

SEQ ID NO: 70441 - DNA, 20 bp, Artificial Sequence
  chemically synthesized
ttgttaaactacaggctggc

SEQ ID NO: 70442 - DNA, 20 bp, Artificial Sequence
  chemically synthesized
cttgttaaactacaggctgg

SEQ ID NO: 70443 - DNA, 20 bp, Artificial Sequence
  chemically synthesized
gggagcagcctgccagcctg

SEQ ID NO: 70444 - DNA, 20 bp, Artificial Sequence
  chemically synthesized
gggcttgttaaactacaggc

SEQ ID NO: 70445 - DNA, 20 bp, Artificial Sequence
  chemically synthesized
ctgggggcttgttaaactac

SEQ ID NO: 70446 - DNA, 20 bp, Artificial Sequence
  chemically synthesized
cctgggggcttgttaaacta

SEQ ID NO: 70447 - DNA, 20 bp, Artificial Sequence
  chemically synthesized
ctgccagcctgtagtttaac

SEQ ID NO: 70448 - DNA, 20 bp, Artificial Sequence
  chemically synthesized
cctgtagtttaacaagcccc

SEQ ID NO: 70449 - DNA, 20 bp, Artificial Sequence
  chemically synthesized
ctgtagtttaacaagccccc

SEQ ID NO: 70450 - DNA, 20 bp, Artificial Sequence
  chemically synthesized
tgtagtttaacaagccccca

SEQ ID NO: 70451 - DNA, 20 bp, Artificial Sequence
  chemically synthesized
gtagtttaacaagcccccag

SEQ ID NO: 70452 - DNA, 20 bp, Artificial Sequence
  chemically synthesized
tatgcatcagaatcccctgg

SEQ ID NO: 70453 - DNA, 20 bp, Artificial Sequence
  chemically synthesized
gtatgcatcagaatcccctg

SEQ ID NO: 70454 - DNA, 20 bp, Artificial Sequence
  chemically synthesized
agtatgcatcagaatcccct

SEQ ID NO: 70455 - DNA, 20 bp, Artificial Sequence
  chemically synthesized
tagtatgcatcagaatcccc

SEQ ID NO: 70456 - DNA, 20 bp, Artificial Sequence
  chemically synthesized
tcccaaactttagtatgcat

SEQ ID NO: 70457 - DNA, 20 bp, Artificial Sequence
  chemically synthesized
ggggattctgatgcatacta

SEQ ID NO: 70458 - DNA, 20 bp, Artificial Sequence
  chemically synthesized
ttctgatgcatactaaagtt

SEQ ID NO: 70459 - DNA, 20 bp, Artificial Sequence
  chemically synthesized
tctgatgcatactaaagttt

SEQ ID NO: 70460 - DNA, 20 bp, Artificial Sequence
  chemically synthesized
ctagcacagttcccaaactt

SEQ ID NO: 70461 - DNA, 20 bp, Artificial Sequence
  chemically synthesized
ctaaagtttgggaactgtgc

SEQ ID NO: 70462 - DNA, 20 bp, Artificial Sequence
  chemically synthesized
agacatttgataatctagca

SEQ ID NO: 70463 - DNA, 20 bp, Artificial Sequence
  chemically synthesized
aatagagacatttgataatc

SEQ ID NO: 70464 - DNA, 20 bp, Artificial Sequence
  chemically synthesized
tagacacattagaaataata

SEQ ID NO: 70465 - DNA, 20 bp, Artificial Sequence
  chemically synthesized
aatagacacattagaaataa

SEQ ID NO: 70466 - DNA, 20 bp, Artificial Sequence
  chemically synthesized
atcgttaataatagacacat

SEQ ID NO: 70467 - DNA, 20 bp, Artificial Sequence
  chemically synthesized
gaaaaccctatcgttaataa

SEQ ID NO: 70468 - DNA, 20 bp, Artificial Sequence
  chemically synthesized
aatgtgtctattattaacga

SEQ ID NO: 70469 - DNA, 20 bp, Artificial Sequence
  chemically synthesized
atgtgtctattattaacgat

SEQ ID NO: 70470 - DNA, 20 bp, Artificial Sequence
  chemically synthesized
tgtgtctattattaacgata

SEQ ID NO: 70471 - DNA, 20 bp, Artificial Sequence
  chemically synthesized
ctccagtggaatcaggcaag

SEQ ID NO: 70472 - DNA, 20 bp, Artificial Sequence
  chemically synthesized
gaactccagtggaatcaggc

SEQ ID NO: 70473 - DNA, 20 bp, Artificial Sequence
  chemically synthesized
acacgaactccagtggaatc

SEQ ID NO: 70474 - DNA, 20 bp, Artificial Sequence
  chemically synthesized
cacttcttgcctgattccac

SEQ ID NO: 70475 - DNA, 20 bp, Artificial Sequence
  chemically synthesized
aacacgaactccagtggaat

SEQ ID NO: 70476 - DNA, 20 bp, Artificial Sequence
  chemically synthesized
cttcttgcctgattccactg

SEQ ID NO: 70477 - DNA, 20 bp, Artificial Sequence
  chemically synthesized
ttttttaacacgaactccag

SEQ ID NO: 70478 - DNA, 20 bp, Artificial Sequence
  chemically synthesized
tttttttttaacacgaactc

SEQ ID NO: 70479 - DNA, 20 bp, Artificial Sequence
  chemically synthesized
ttaaaaaaaaatatattccc

SEQ ID NO: 70480 - DNA, 20 bp, Artificial Sequence
  chemically synthesized
gattctgatgcaatagactt

SEQ ID NO: 70481 - DNA, 20 bp, Artificial Sequence
  chemically synthesized
agattctgatgcaatagact

SEQ ID NO: 70482 - DNA, 20 bp, Artificial Sequence
  chemically synthesized
tattcccaagtctattgcat

SEQ ID NO: 70483 - DNA, 20 bp, Artificial Sequence
  chemically synthesized
cactggagattctgatgcaa

SEQ ID NO: 70484 - DNA, 20 bp, Artificial Sequence
  chemically synthesized
gtctattgcatcagaatctc

SEQ ID NO: 70485 - DNA, 20 bp, Artificial Sequence
  chemically synthesized
ttgcatcagaatctccagtg

SEQ ID NO: 70486 - DNA, 20 bp, Artificial Sequence
  chemically synthesized
tgcatcagaatctccagtga

SEQ ID NO: 70487 - DNA, 20 bp, Artificial Sequence
  chemically synthesized
gcatcagaatctccagtgaa

SEQ ID NO: 70488 - DNA, 20 bp, Artificial Sequence
  chemically synthesized
attcacaagccccttcactg

SEQ ID NO: 70489 - DNA, 20 bp, Artificial Sequence
  chemically synthesized
catcagaatctccagtgaag

SEQ ID NO: 70490 - DNA, 20 bp, Artificial Sequence
  chemically synthesized
taattcacaagccccttcac

SEQ ID NO: 70491 - DNA, 20 bp, Artificial Sequence
  chemically synthesized
tgattaaattattaattcac

SEQ ID NO: 70492 - DNA, 20 bp, Artificial Sequence
  chemically synthesized
tgtgaattaataatttaatc

SEQ ID NO: 70493 - DNA, 20 bp, Artificial Sequence
  chemically synthesized
ataatttaatcaagtgcccc

SEQ ID NO: 70494 - DNA, 20 bp, Artificial Sequence
  chemically synthesized
ctggtcataagaatcaccag

SEQ ID NO: 70495 - DNA, 20 bp, Artificial Sequence
  chemically synthesized
tctggtcataagaatcacca

SEQ ID NO: 70496 - DNA, 20 bp, Artificial Sequence
  chemically synthesized
ttctggtcataagaatcacc

SEQ ID NO: 70497 - DNA, 20 bp, Artificial Sequence
  chemically synthesized
tttctggtcataagaatcac

SEQ ID NO: 70498 - DNA, 20 bp, Artificial Sequence
  chemically synthesized
cccctggtgattcttatgac

SEQ ID NO: 70499 - DNA, 20 bp, Artificial Sequence
  chemically synthesized
tcccaaggttttctggtcat

SEQ ID NO: 70500 - DNA, 20 bp, Artificial Sequence
  chemically synthesized
ttgtctttcccaaggttttc

SEQ ID NO: 70501 - DNA, 20 bp, Artificial Sequence
  chemically synthesized
ttcttatgaccagaaaacct

SEQ ID NO: 70502 - DNA, 20 bp, Artificial Sequence
  chemically synthesized
tcttatgaccagaaaacctt

SEQ ID NO: 70503 - DNA, 20 bp, Artificial Sequence
  chemically synthesized
atgaccagaaaaccttggga

SEQ ID NO: 70504 - DNA, 20 bp, Artificial Sequence
  chemically synthesized
tcttaagtttgtctttccca

SEQ ID NO: 70505 - DNA, 20 bp, Artificial Sequence
  chemically synthesized
ttcttaagtttgtctttccc

SEQ ID NO: 70506 - DNA, 20 bp, Artificial Sequence
  chemically synthesized
accttgggaaagacaaactt

SEQ ID NO: 70507 - DNA, 20 bp, Artificial Sequence
  chemically synthesized
tacctgactttaaagttctt

SEQ ID NO: 70508 - DNA, 20 bp, Artificial Sequence
  chemically synthesized
agacaaacttaagaacttta

SEQ ID NO: 70509 - DNA, 20 bp, Artificial Sequence
  chemically synthesized
aaacttaagaactttaaagt

SEQ ID NO: 70510 - DNA, 20 bp, Artificial Sequence
  chemically synthesized
aacttaagaactttaaagtc

SEQ ID NO: 70511 - DNA, 20 bp, Artificial Sequence
  chemically synthesized
gtaacagatacctgacttta

SEQ ID NO: 70512 - DNA, 20 bp, Artificial Sequence
  chemically synthesized
taaagtcaggtatctgttac

SEQ ID NO: 70513 - DNA, 20 bp, Artificial Sequence
  chemically synthesized
atactttcagaggccagtaa

SEQ ID NO: 70514 - DNA, 20 bp, Artificial Sequence
  chemically synthesized
gttagaatactttcagaggc

SEQ ID NO: 70515 - DNA, 20 bp, Artificial Sequence
  chemically synthesized
tatctgttactggcctctga

SEQ ID NO: 70516 - DNA, 20 bp, Artificial Sequence
  chemically synthesized
gtcagttagaatactttcag

SEQ ID NO: 70517 - DNA, 20 bp, Artificial Sequence
  chemically synthesized
tgtcagttagaatactttca

SEQ ID NO: 70518 - DNA, 20 bp, Artificial Sequence
  chemically synthesized
aatgtcagttagaatacttt

SEQ ID NO: 70519 - DNA, 20 bp, Artificial Sequence
  chemically synthesized
attgcagatggaatgtcagt

SEQ ID NO: 70520 - DNA, 20 bp, Artificial Sequence
  chemically synthesized
ggagattgcagatggaatgt

SEQ ID NO: 70521 - DNA, 20 bp, Artificial Sequence
  chemically synthesized
ttgaaacaggagattgcaga

SEQ ID NO: 70522 - DNA, 20 bp, Artificial Sequence
  chemically synthesized
ccagttgaaacaggagattg

SEQ ID NO: 70523 - DNA, 20 bp, Artificial Sequence
  chemically synthesized
gctgcggccagttgaaacag

SEQ ID NO: 70524 - DNA, 20 bp, Artificial Sequence
  chemically synthesized
gagctgcggccagttgaaac

SEQ ID NO: 70525 - DNA, 20 bp, Artificial Sequence
  chemically synthesized
ctgcaatctcctgtttcaac

SEQ ID NO: 70526 - DNA, 20 bp, Artificial Sequence
  chemically synthesized
ggagctgcggccagttgaaa

SEQ ID NO: 70527 - DNA, 20 bp, Artificial Sequence
  chemically synthesized
tctcctgtttcaactggccg

SEQ ID NO: 70528 - DNA, 20 bp, Artificial Sequence
  chemically synthesized
agtggtcctggagctgcggc

SEQ ID NO: 70529 - DNA, 20 bp, Artificial Sequence
  chemically synthesized
gtttcaactggccgcagctc

SEQ ID NO: 70530 - DNA, 20 bp, Artificial Sequence
  chemically synthesized
tttcaactggccgcagctcc

SEQ ID NO: 70531 - DNA, 20 bp, Artificial Sequence
  chemically synthesized
cctgagtggtcctggagctg

SEQ ID NO: 70532 - DNA, 20 bp, Artificial Sequence
  chemically synthesized
tgcttacctgagtggtcctg

SEQ ID NO: 70533 - DNA, 20 bp, Artificial Sequence
  chemically synthesized
tctgcttacctgagtggtcc

SEQ ID NO: 70534 - DNA, 20 bp, Artificial Sequence
  chemically synthesized
gccgcagctccaggaccact

SEQ ID NO: 70535 - DNA, 20 bp, Artificial Sequence
  chemically synthesized
ccgcagctccaggaccactc

SEQ ID NO: 70536 - DNA, 20 bp, Artificial Sequence
  chemically synthesized
agctccaggaccactcaggt

SEQ ID NO: 70537 - DNA, 20 bp, Artificial Sequence
  chemically synthesized
ctagtatctgcttacctgag

SEQ ID NO: 70538 - DNA, 20 bp, Artificial Sequence
  chemically synthesized
tccaggaccactcaggtaag

SEQ ID NO: 70539 - DNA, 20 bp, Artificial Sequence
  chemically synthesized
gagctagtatctgcttacct

SEQ ID NO: 70540 - DNA, 20 bp, Artificial Sequence
  chemically synthesized
ccactcaggtaagcagatac

SEQ ID NO: 70541 - DNA, 20 bp, Artificial Sequence
  chemically synthesized
atatttgccaaggcaagagc

SEQ ID NO: 70542 - DNA, 20 bp, Artificial Sequence
  chemically synthesized
gcagatactagctcttgcct

SEQ ID NO: 70543 - DNA, 20 bp, Artificial Sequence
  chemically synthesized
taatatatttgccaaggcaa

SEQ ID NO: 70544 - DNA, 20 bp, Artificial Sequence
  chemically synthesized
cataatatatttgccaaggc

SEQ ID NO: 70545 - DNA, 20 bp, Artificial Sequence
  chemically synthesized
acttcataatatatttgcca

SEQ ID NO: 70546 - DNA, 20 bp, Artificial Sequence
  chemically synthesized
gacttcataatatatttgcc

SEQ ID NO: 70547 - DNA, 20 bp, Artificial Sequence
  chemically synthesized
gccttggcaaatatattatg

SEQ ID NO: 70548 - DNA, 20 bp, Artificial Sequence
  chemically synthesized
gcaaatatattatgaagtct

SEQ ID NO: 70549 - DNA, 20 bp, Artificial Sequence
  chemically synthesized
tatattatgaagtcttagct

SEQ ID NO: 70550 - DNA, 20 bp, Artificial Sequence
  chemically synthesized
tattatgaagtcttagcttg

SEQ ID NO: 70551 - DNA, 20 bp, Artificial Sequence
  chemically synthesized
agtcaaaggctctccaagct

SEQ ID NO: 70552 - DNA, 20 bp, Artificial Sequence
  chemically synthesized
ttatgaagtcttagcttgga

SEQ ID NO: 70553 - DNA, 20 bp, Artificial Sequence
  chemically synthesized
ctttaagtcaaaggctctcc

SEQ ID NO: 70554 - DNA, 20 bp, Artificial Sequence
  chemically synthesized
taaacctcactttaagtcaa

SEQ ID NO: 70555 - DNA, 20 bp, Artificial Sequence
  chemically synthesized
cttggagagcctttgactta

SEQ ID NO: 70556 - DNA, 20 bp, Artificial Sequence
  chemically synthesized
gtaaacctcactttaagtca

SEQ ID NO: 70557 - DNA, 20 bp, Artificial Sequence
  chemically synthesized
gagagcctttgacttaaagt

SEQ ID NO: 70558 - DNA, 20 bp, Artificial Sequence
  chemically synthesized
agagcctttgacttaaagtg

SEQ ID NO: 70559 - DNA, 20 bp, Artificial Sequence
  chemically synthesized
agaaatgtaaacctcacttt

SEQ ID NO: 70560 - DNA, 20 bp, Artificial Sequence
  chemically synthesized
aaagtgaggtttacatttct

SEQ ID NO: 70561 - DNA, 20 bp, Artificial Sequence
  chemically synthesized
ggtttacatttctaagatgt

SEQ ID NO: 70562 - DNA, 20 bp, Artificial Sequence
  chemically synthesized
aagtcaagaaaccaacatct

SEQ ID NO: 70563 - DNA, 20 bp, Artificial Sequence
  chemically synthesized
ttcaaatagacagttaagtc

SEQ ID NO: 70564 - DNA, 20 bp, Artificial Sequence
  chemically synthesized
aggaattcaaatagacagtt

SEQ ID NO: 70565 - DNA, 20 bp, Artificial Sequence
  chemically synthesized
agatcaggaattcaaataga

SEQ ID NO: 70566 - DNA, 20 bp, Artificial Sequence
  chemically synthesized
gaaaagatcaggaattcaaa

SEQ ID NO: 70567 - DNA, 20 bp, Artificial Sequence
  chemically synthesized
ggctctgaatggaaaagatc

SEQ ID NO: 70568 - DNA, 20 bp, Artificial Sequence
  chemically synthesized
aggctctgaatggaaaagat

SEQ ID NO: 70569 - DNA, 20 bp, Artificial Sequence
  chemically synthesized
aattcctgatcttttccatt

SEQ ID NO: 70570 - DNA, 20 bp, Artificial Sequence
  chemically synthesized
taaacaggctctgaatggaa

SEQ ID NO: 70571 - DNA, 20 bp, Artificial Sequence
  chemically synthesized
ttcctgatcttttccattca

SEQ ID NO: 70572 - DNA, 20 bp, Artificial Sequence
  chemically synthesized
tcgggtaaacaggctctgaa

SEQ ID NO: 70573 - DNA, 20 bp, Artificial Sequence
  chemically synthesized
agtggggagttcgggtaaac

SEQ ID NO: 70574 - DNA, 20 bp, Artificial Sequence
  chemically synthesized
aagtggggagttcgggtaaa

SEQ ID NO: 70575 - DNA, 20 bp, Artificial Sequence
  chemically synthesized
gtagctgaagtggggagttc

SEQ ID NO: 70576 - DNA, 20 bp, Artificial Sequence
  chemically synthesized
tgtagctgaagtggggagtt

SEQ ID NO: 70577 - DNA, 20 bp, Artificial Sequence
  chemically synthesized
tttacccgaactccccactt

SEQ ID NO: 70578 - DNA, 20 bp, Artificial Sequence
  chemically synthesized
cagactgtagctgaagtggg

SEQ ID NO: 70579 - DNA, 20 bp, Artificial Sequence
  chemically synthesized
ttcagactgtagctgaagtg

SEQ ID NO: 70580 - DNA, 20 bp, Artificial Sequence
  chemically synthesized
attcagactgtagctgaagt

SEQ ID NO: 70581 - DNA, 20 bp, Artificial Sequence
  chemically synthesized
aattcagactgtagctgaag

SEQ ID NO: 70582 - DNA, 20 bp, Artificial Sequence
  chemically synthesized
cgaactccccacttcagcta

SEQ ID NO: 70583 - DNA, 20 bp, Artificial Sequence
  chemically synthesized
aggaattcagactgtagctg

SEQ ID NO: 70584 - DNA, 20 bp, Artificial Sequence
  chemically synthesized
gaggttaggaattcagactg

SEQ ID NO: 70585 - DNA, 20 bp, Artificial Sequence
  chemically synthesized
tgtacacgaggttaggaatt

SEQ ID NO: 70586 - DNA, 20 bp, Artificial Sequence
  chemically synthesized
tcaagaatgtacacgaggtt

SEQ ID NO: 70587 - DNA, 20 bp, Artificial Sequence
  chemically synthesized
atcaagaatgtacacgaggt

SEQ ID NO: 70588 - DNA, 20 bp, Artificial Sequence
  chemically synthesized
actgatcaagaatgtacacg

SEQ ID NO: 70589 - DNA, 20 bp, Artificial Sequence
  chemically synthesized
cactgatcaagaatgtacac

SEQ ID NO: 70590 - DNA, 20 bp, Artificial Sequence
  chemically synthesized
acctcgtgtacattcttgat

SEQ ID NO: 70591 - DNA, 20 bp, Artificial Sequence
  chemically synthesized
gccaccagataacactgatc

SEQ ID NO: 70592 - DNA, 20 bp, Artificial Sequence
  chemically synthesized
cattcttgatcagtgttatc

SEQ ID NO: 70593 - DNA, 20 bp, Artificial Sequence
  chemically synthesized
tcttgatcagtgttatctgg

SEQ ID NO: 70594 - DNA, 20 bp, Artificial Sequence
  chemically synthesized
ggcagggttggtgaggccac

SEQ ID NO: 70595 - DNA, 20 bp, Artificial Sequence
  chemically synthesized
aaattctggcagggttggtg

SEQ ID NO: 70596 - DNA, 20 bp, Artificial Sequence
  chemically synthesized
gaaattctggcagggttggt

SEQ ID NO: 70597 - DNA, 20 bp, Artificial Sequence
  chemically synthesized
ggtggcctcaccaaccctgc

SEQ ID NO: 70598 - DNA, 20 bp, Artificial Sequence
  chemically synthesized
ctctgaaattctggcagggt

SEQ ID NO: 70599 - DNA, 20 bp, Artificial Sequence
  chemically synthesized
ggggctctgaaattctggca

SEQ ID NO: 70600 - DNA, 20 bp, Artificial Sequence
  chemically synthesized
aggggctctgaaattctggc

SEQ ID NO: 70601 - DNA, 20 bp, Artificial Sequence
  chemically synthesized
gaggggctctgaaattctgg

SEQ ID NO: 70602 - DNA, 20 bp, Artificial Sequence
  chemically synthesized
caccaaccctgccagaattt

SEQ ID NO: 70603 - DNA, 20 bp, Artificial Sequence
  chemically synthesized
tgagaggggctctgaaattc

SEQ ID NO: 70604 - DNA, 20 bp, Artificial Sequence
  chemically synthesized
ccaaccctgccagaatttca

SEQ ID NO: 70605 - DNA, 20 bp, Artificial Sequence
  chemically synthesized
agaatttcagagcccctctc

SEQ ID NO: 70606 - DNA, 20 bp, Artificial Sequence
  chemically synthesized
cccctgtaattacttgagag

SEQ ID NO: 70607 - DNA, 20 bp, Artificial Sequence
  chemically synthesized
acccctgtaattacttgaga

SEQ ID NO: 70608 - DNA, 20 bp, Artificial Sequence
  chemically synthesized
tacccctgtaattacttgag

SEQ ID NO: 70609 - DNA, 20 bp, Artificial Sequence
  chemically synthesized
ttacccctgtaattacttga

SEQ ID NO: 70610 - DNA, 20 bp, Artificial Sequence
  chemically synthesized
gattacccctgtaattactt

SEQ ID NO: 70611 - DNA, 20 bp, Artificial Sequence
  chemically synthesized
gagcccctctcaagtaatta

SEQ ID NO: 70612 - DNA, 20 bp, Artificial Sequence
  chemically synthesized
agcccctctcaagtaattac

SEQ ID NO: 70613 - DNA, 20 bp, Artificial Sequence
  chemically synthesized
gcccctctcaagtaattaca

SEQ ID NO: 70614 - DNA, 20 bp, Artificial Sequence
  chemically synthesized
cccctctcaagtaattacag

SEQ ID NO: 70615 - DNA, 20 bp, Artificial Sequence
  chemically synthesized
atcatgcattccttaactct

SEQ ID NO: 70616 - DNA, 20 bp, Artificial Sequence
  chemically synthesized
agaatgcagcctaagagtta

SEQ ID NO: 70617 - DNA, 20 bp, Artificial Sequence
  chemically synthesized
tcatgcattccttaactctt

SEQ ID NO: 70618 - DNA, 20 bp, Artificial Sequence
  chemically synthesized
aagaatgcagcctaagagtt

SEQ ID NO: 70619 - DNA, 20 bp, Artificial Sequence
  chemically synthesized
cccctaagaatgcagcctaa

SEQ ID NO: 70620 - DNA, 20 bp, Artificial Sequence
  chemically synthesized
gccccctaagaatgcagcct

SEQ ID NO: 70621 - DNA, 20 bp, Artificial Sequence
  chemically synthesized
taactcttaggctgcattct

SEQ ID NO: 70622 - DNA, 20 bp, Artificial Sequence
  chemically synthesized
aactcttaggctgcattctt

SEQ ID NO: 70623 - DNA, 20 bp, Artificial Sequence
  chemically synthesized
gaatctgccccctaagaatg

SEQ ID NO: 70624 - DNA, 20 bp, Artificial Sequence
  chemically synthesized
actcttaggctgcattctta

SEQ ID NO: 70625 - DNA, 20 bp, Artificial Sequence
  chemically synthesized
ctcttaggctgcattcttag

SEQ ID NO: 70626 - DNA, 20 bp, Artificial Sequence
  chemically synthesized
tcttaggctgcattcttagg

SEQ ID NO: 70627 - DNA, 20 bp, Artificial Sequence
  chemically synthesized
taggctgcattcttaggggg

SEQ ID NO: 70628 - DNA, 20 bp, Artificial Sequence
  chemically synthesized
taggtaggaatctgccccct

SEQ ID NO: 70629 - DNA, 20 bp, Artificial Sequence
  chemically synthesized
caggttcaaggttagtaggt

SEQ ID NO: 70630 - DNA, 20 bp, Artificial Sequence
  chemically synthesized
gcaggttcaaggttagtagg

SEQ ID NO: 70631 - DNA, 20 bp, Artificial Sequence
  chemically synthesized
tcagcaggttcaaggttagt

SEQ ID NO: 70632 - DNA, 20 bp, Artificial Sequence
  chemically synthesized
atcagcaggttcaaggttag

SEQ ID NO: 70633 - DNA, 20 bp, Artificial Sequence
  chemically synthesized
ggcatcagcaggttcaaggt

SEQ ID NO: 70634 - DNA, 20 bp, Artificial Sequence
  chemically synthesized
catgggcatcagcaggttca

SEQ ID NO: 70635 - DNA, 20 bp, Artificial Sequence
  chemically synthesized
tcatgggcatcagcaggttc

SEQ ID NO: 70636 - DNA, 20 bp, Artificial Sequence
  chemically synthesized
ccagcctcatgggcatcagc

SEQ ID NO: 70637 - DNA, 20 bp, Artificial Sequence
  chemically synthesized
gccagcctcatgggcatcag

SEQ ID NO: 70638 - DNA, 20 bp, Artificial Sequence
  chemically synthesized
catgccagcctcatgggcat

SEQ ID NO: 70639 - DNA, 20 bp, Artificial Sequence
  chemically synthesized
ttgaacctgctgatgcccat

SEQ ID NO: 70640 - DNA, 20 bp, Artificial Sequence
  chemically synthesized
tgaacctgctgatgcccatg

SEQ ID NO: 70641 - DNA, 20 bp, Artificial Sequence
  chemically synthesized
cctgctgatgcccatgaggc

SEQ ID NO: 70642 - DNA, 20 bp, Artificial Sequence
  chemically synthesized
tgctttcatgccagcctcat

SEQ ID NO: 70643 - DNA, 20 bp, Artificial Sequence
  chemically synthesized
ctgctttcatgccagcctca

SEQ ID NO: 70644 - DNA, 20 bp, Artificial Sequence
  chemically synthesized
tgcccatgaggctggcatga

SEQ ID NO: 70645 - DNA, 20 bp, Artificial Sequence
  chemically synthesized
aattgttcctgctttcatgc

SEQ ID NO: 70646 - DNA, 20 bp, Artificial Sequence
  chemically synthesized
ccatgaggctggcatgaaag

SEQ ID NO: 70647 - DNA, 20 bp, Artificial Sequence
  chemically synthesized
catgaggctggcatgaaagc

SEQ ID NO: 70648 - DNA, 20 bp, Artificial Sequence
  chemically synthesized
ggcatgaaagcaggaacaat

SEQ ID NO: 70649 - DNA, 20 bp, Artificial Sequence
  chemically synthesized
aatatatgtttagtttttaa

SEQ ID NO: 70650 - DNA, 20 bp, Artificial Sequence
  chemically synthesized
agacttcaggaatatatgtt

SEQ ID NO: 70651 - DNA, 20 bp, Artificial Sequence
  chemically synthesized
aaactaaacatatattcctg

SEQ ID NO: 70652 - DNA, 20 bp, Artificial Sequence
  chemically synthesized
agaaccttttttcagacttc

SEQ ID NO: 70653 - DNA, 20 bp, Artificial Sequence
  chemically synthesized
tagaaccttttttcagactt

SEQ ID NO: 70654 - DNA, 20 bp, Artificial Sequence
  chemically synthesized
atattcctgaagtctgaaaa

SEQ ID NO: 70655 - DNA, 20 bp, Artificial Sequence
  chemically synthesized
tattcctgaagtctgaaaaa

SEQ ID NO: 70656 - DNA, 20 bp, Artificial Sequence
  chemically synthesized
ggatgagtagaacctttttt

SEQ ID NO: 70657 - DNA, 20 bp, Artificial Sequence
  chemically synthesized
attatttctatttggatgag

SEQ ID NO: 70658 - DNA, 20 bp, Artificial Sequence
  chemically synthesized
aaaggttctactcatccaaa

SEQ ID NO: 70659 - DNA, 20 bp, Artificial Sequence
  chemically synthesized
tcaattatttctatttggat

SEQ ID NO: 70660 - DNA, 20 bp, Artificial Sequence
  chemically synthesized
agttctcaattatttctatt

SEQ ID NO: 70661 - DNA, 20 bp, Artificial Sequence
  chemically synthesized
tcatccaaatagaaataatt

SEQ ID NO: 70662 - DNA, 20 bp, Artificial Sequence
  chemically synthesized
atttaaagttaaatatttta

SEQ ID NO: 70663 - DNA, 20 bp, Artificial Sequence
  chemically synthesized
ccatttaaagttaaatattt

SEQ ID NO: 70664 - DNA, 20 bp, Artificial Sequence
  chemically synthesized
ctaaaatatttaactttaaa

SEQ ID NO: 70665 - DNA, 20 bp, Artificial Sequence
  chemically synthesized
tgatgattccagaccattta

SEQ ID NO: 70666 - DNA, 20 bp, Artificial Sequence
  chemically synthesized
atatttaactttaaatggtc

SEQ ID NO: 70667 - DNA, 20 bp, Artificial Sequence
  chemically synthesized
tgaaagaacattgatgattc

SEQ ID NO: 70668 - DNA, 20 bp, Artificial Sequence
  chemically synthesized
tggaatcatcaatgttcttt

SEQ ID NO: 70669 - DNA, 20 bp, Artificial Sequence
  chemically synthesized
ggaatcatcaatgttctttc

SEQ ID NO: 70670 - DNA, 20 bp, Artificial Sequence
  chemically synthesized
aaaatattcattcaacctga

SEQ ID NO: 70671 - DNA, 20 bp, Artificial Sequence
  chemically synthesized
ccaagtaaacaagggacaga

SEQ ID NO: 70672 - DNA, 20 bp, Artificial Sequence
  chemically synthesized
ttggccaagtaaacaaggga

SEQ ID NO: 70673 - DNA, 20 bp, Artificial Sequence
  chemically synthesized
ttatttggccaagtaaacaa

SEQ ID NO: 70674 - DNA, 20 bp, Artificial Sequence
  chemically synthesized
cttatttggccaagtaaaca

SEQ ID NO: 70675 - DNA, 20 bp, Artificial Sequence
  chemically synthesized
ctttctgtcccttgtttact

SEQ ID NO: 70676 - DNA, 20 bp, Artificial Sequence
  chemically synthesized
ccttatttggccaagtaaac

SEQ ID NO: 70677 - DNA, 20 bp, Artificial Sequence
  chemically synthesized
cctttttaccttatttggcc

SEQ ID NO: 70678 - DNA, 20 bp, Artificial Sequence
  chemically synthesized
ccttgtttacttggccaaat

SEQ ID NO: 70679 - DNA, 20 bp, Artificial Sequence
  chemically synthesized
cttgtttacttggccaaata

SEQ ID NO: 70680 - DNA, 20 bp, Artificial Sequence
  chemically synthesized
tttgacctttttaccttatt

SEQ ID NO: 70681 - DNA, 20 bp, Artificial Sequence
  chemically synthesized
acttggccaaataaggtaaa

SEQ ID NO: 70682 - DNA, 20 bp, Artificial Sequence
  chemically synthesized
cttggccaaataaggtaaaa

SEQ ID NO: 70683 - DNA, 20 bp, Artificial Sequence
  chemically synthesized
taaaaaggtcaaaacaatct

SEQ ID NO: 70684 - DNA, 20 bp, Artificial Sequence
  chemically synthesized
cataaggaaacaatttcact

SEQ ID NO: 70685 - DNA, 20 bp, Artificial Sequence
  chemically synthesized
ctttacatttgtcattcata

SEQ ID NO: 70686 - DNA, 20 bp, Artificial Sequence
  chemically synthesized
tctttacatttgtcattcat

SEQ ID NO: 70687 - DNA, 20 bp, Artificial Sequence
  chemically synthesized
ccttatgaatgacaaatgta

SEQ ID NO: 70688 - DNA, 20 bp, Artificial Sequence
  chemically synthesized
ttatgaatgacaaatgtaaa

SEQ ID NO: 70689 - DNA, 20 bp, Artificial Sequence
  chemically synthesized
tgacaaatgtaaagagtcaa

SEQ ID NO: 70690 - DNA, 20 bp, Artificial Sequence
  chemically synthesized
acaaatgtaaagagtcaaaa

SEQ ID NO: 70691 - DNA, 20 bp, Artificial Sequence
  chemically synthesized
caaatgtaaagagtcaaaag

SEQ ID NO: 70692 - DNA, 20 bp, Artificial Sequence
  chemically synthesized
aaagagtcaaaagaggaatt

SEQ ID NO: 70693 - DNA, 20 bp, Artificial Sequence
  chemically synthesized
aagagtcaaaagaggaatta

SEQ ID NO: 70694 - DNA, 20 bp, Artificial Sequence
  chemically synthesized
tgaaaaacatgtaattaggg

SEQ ID NO: 70695 - DNA, 20 bp, Artificial Sequence
  chemically synthesized
aatgaaaaacatgtaattag

SEQ ID NO: 70696 - DNA, 20 bp, Artificial Sequence
  chemically synthesized
aaatgaaaaacatgtaatta

SEQ ID NO: 70697 - DNA, 20 bp, Artificial Sequence
  chemically synthesized
caaatgaaaaacatgtaatt

SEQ ID NO: 70698 - DNA, 20 bp, Artificial Sequence
  chemically synthesized
gcaaatgaaaaacatgtaat

SEQ ID NO: 70699 - DNA, 20 bp, Artificial Sequence
  chemically synthesized
ttacatgtttttcatttgct

SEQ ID NO: 70700 - DNA, 20 bp, Artificial Sequence
  chemically synthesized
aggtgaaataagtaatatct

SEQ ID NO: 70701 - DNA, 20 bp, Artificial Sequence
  chemically synthesized
gaaggcagcagaggtgaaat

SEQ ID NO: 70702 - DNA, 20 bp, Artificial Sequence
  chemically synthesized
tatggtggggaaggcagcag

SEQ ID NO: 70703 - DNA, 20 bp, Artificial Sequence
  chemically synthesized
atatggtggggaaggcagca

SEQ ID NO: 70704 - DNA, 20 bp, Artificial Sequence
  chemically synthesized
gtatatggtggggaaggcag

SEQ ID NO: 70705 - DNA, 20 bp, Artificial Sequence
  chemically synthesized
cgggtatatggtggggaagg

SEQ ID NO: 70706 - DNA, 20 bp, Artificial Sequence
  chemically synthesized
tatcgggtatatggtgggga

SEQ ID NO: 70707 - DNA, 20 bp, Artificial Sequence
  chemically synthesized
ttatcgggtatatggtgggg

SEQ ID NO: 70708 - DNA, 20 bp, Artificial Sequence
  chemically synthesized
gagttatcgggtatatggtg

SEQ ID NO: 70709 - DNA, 20 bp, Artificial Sequence
  chemically synthesized
tgagttatcgggtatatggt

SEQ ID NO: 70710 - DNA, 20 bp, Artificial Sequence
  chemically synthesized
ctgagttatcgggtatatgg

SEQ ID NO: 70711 - DNA, 20 bp, Artificial Sequence
  chemically synthesized
tgactgagttatcgggtata

SEQ ID NO: 70712 - DNA, 20 bp, Artificial Sequence
  chemically synthesized
ccaccatatacccgataact

SEQ ID NO: 70713 - DNA, 20 bp, Artificial Sequence
  chemically synthesized
tctggaatgactgagttatc

SEQ ID NO: 70714 - DNA, 20 bp, Artificial Sequence
  chemically synthesized
gtctggaatgactgagttat

SEQ ID NO: 70715 - DNA, 20 bp, Artificial Sequence
  chemically synthesized
tttataagtctggaatgact

SEQ ID NO: 70716 - DNA, 20 bp, Artificial Sequence
  chemically synthesized
acccgataactcagtcattc

SEQ ID NO: 70717 - DNA, 20 bp, Artificial Sequence
  chemically synthesized
cctgaggtagtttataagtc

SEQ ID NO: 70718 - DNA, 20 bp, Artificial Sequence
  chemically synthesized
tataacctgaggtagtttat

SEQ ID NO: 70719 - DNA, 20 bp, Artificial Sequence
  chemically synthesized
tccagacttataaactacct

SEQ ID NO: 70720 - DNA, 20 bp, Artificial Sequence
  chemically synthesized
ccagacttataaactacctc

SEQ ID NO: 70721 - DNA, 20 bp, Artificial Sequence
  chemically synthesized
agatctgatataacctgagg

SEQ ID NO: 70722 - DNA, 20 bp, Artificial Sequence
  chemically synthesized
ggaagatctgatataacctg

SEQ ID NO: 70723 - DNA, 20 bp, Artificial Sequence
  chemically synthesized
gggaagatctgatataacct

SEQ ID NO: 70724 - DNA, 20 bp, Artificial Sequence
  chemically synthesized
taaactacctcaggttatat

SEQ ID NO: 70725 - DNA, 20 bp, Artificial Sequence
  chemically synthesized
caggttatatcagatcttcc

SEQ ID NO: 70726 - DNA, 20 bp, Artificial Sequence
  chemically synthesized
ggaagaaaaccaggtctggg

SEQ ID NO: 70727 - DNA, 20 bp, Artificial Sequence
  chemically synthesized
atatcagatcttcccagacc

SEQ ID NO: 70728 - DNA, 20 bp, Artificial Sequence
  chemically synthesized
ctaggaagaaaaccaggtct

SEQ ID NO: 70729 - DNA, 20 bp, Artificial Sequence
  chemically synthesized
tctaggaagaaaaccaggtc

SEQ ID NO: 70730 - DNA, 20 bp, Artificial Sequence
  chemically synthesized
ggttttctaggaagaaaacc

SEQ ID NO: 70731 - DNA, 20 bp, Artificial Sequence
  chemically synthesized
tggttttctaggaagaaaac

SEQ ID NO: 70732 - DNA, 20 bp, Artificial Sequence
  chemically synthesized
cccagacctggttttcttcc

SEQ ID NO: 70733 - DNA, 20 bp, Artificial Sequence
  chemically synthesized
aaatggaatggttttctagg

SEQ ID NO: 70734 - DNA, 20 bp, Artificial Sequence
  chemically synthesized
aaaaaatggaatggttttct

SEQ ID NO: 70735 - DNA, 20 bp, Artificial Sequence
  chemically synthesized
aaaaaaatggaatggttttc

SEQ ID NO: 70736 - DNA, 20 bp, Artificial Sequence
  chemically synthesized
aggtaaagaaaaaaatggaa

SEQ ID NO: 70737 - DNA, 20 bp, Artificial Sequence
  chemically synthesized
ccaagaggtaaagaaaaaaa

SEQ ID NO: 70738 - DNA, 20 bp, Artificial Sequence
  chemically synthesized
ccatttttttctttacctct

SEQ ID NO: 70739 - DNA, 20 bp, Artificial Sequence
  chemically synthesized
gagtagggttccaagaggta

SEQ ID NO: 70740 - DNA, 20 bp, Artificial Sequence
  chemically synthesized
gcaatgagtagggttccaag

SEQ ID NO: 70741 - DNA, 20 bp, Artificial Sequence
  chemically synthesized
agcaatgagtagggttccaa

SEQ ID NO: 70742 - DNA, 20 bp, Artificial Sequence
  chemically synthesized
cgagcaatgagtagggttcc

SEQ ID NO: 70743 - DNA, 20 bp, Artificial Sequence
  chemically synthesized
ttagactcgagcaatgagta

SEQ ID NO: 70744 - DNA, 20 bp, Artificial Sequence
  chemically synthesized
cttagactcgagcaatgagt

SEQ ID NO: 70745 - DNA, 20 bp, Artificial Sequence
  chemically synthesized
gcttagactcgagcaatgag

SEQ ID NO: 70746 - DNA, 20 bp, Artificial Sequence
  chemically synthesized
tggaaccctactcattgctc

SEQ ID NO: 70747 - DNA, 20 bp, Artificial Sequence
  chemically synthesized
tgagcttagactcgagcaat

SEQ ID NO: 70748 - DNA, 20 bp, Artificial Sequence
  chemically synthesized
cctactcattgctcgagtct

SEQ ID NO: 70749 - DNA, 20 bp, Artificial Sequence
  chemically synthesized
tgacatttgagcttagactc

SEQ ID NO: 70750 - DNA, 20 bp, Artificial Sequence
  chemically synthesized
caaggggtgacatttgagct

SEQ ID NO: 70751 - DNA, 20 bp, Artificial Sequence
  chemically synthesized
ttgcacaaggggtgacattt

SEQ ID NO: 70752 - DNA, 20 bp, Artificial Sequence
  chemically synthesized
agcaataaattttgcacaag

SEQ ID NO: 70753 - DNA, 20 bp, Artificial Sequence
  chemically synthesized
tagcaataaattttgcacaa

SEQ ID NO: 70754 - DNA, 20 bp, Artificial Sequence
  chemically synthesized
ttagcaataaattttgcaca

SEQ ID NO: 70755 - DNA, 20 bp, Artificial Sequence
  chemically synthesized
gttagcaataaattttgcac

SEQ ID NO: 70756 - DNA, 20 bp, Artificial Sequence
  chemically synthesized
atattaatgtgcagaagagt

SEQ ID NO: 70757 - DNA, 20 bp, Artificial Sequence
  chemically synthesized
aatgatattaatgtgcagaa

SEQ ID NO: 70758 - DNA, 20 bp, Artificial Sequence
  chemically synthesized
gaaatgatattaatgtgcag

SEQ ID NO: 70759 - DNA, 20 bp, Artificial Sequence
  chemically synthesized
ccagaaatgatattaatgtg

SEQ ID NO: 70760 - DNA, 20 bp, Artificial Sequence
  chemically synthesized
ctgcacattaatatcatttc

SEQ ID NO: 70761 - DNA, 20 bp, Artificial Sequence
  chemically synthesized
tgcacattaatatcatttct

SEQ ID NO: 70762 - DNA, 20 bp, Artificial Sequence
  chemically synthesized
gcacattaatatcatttctg

SEQ ID NO: 70763 - DNA, 20 bp, Artificial Sequence
  chemically synthesized
cacattaatatcatttctgg

SEQ ID NO: 70764 - DNA, 20 bp, Artificial Sequence
  chemically synthesized
acattaatatcatttctggg

SEQ ID NO: 70765 - DNA, 20 bp, Artificial Sequence
  chemically synthesized
cactagagatgtgagccccc

SEQ ID NO: 70766 - DNA, 20 bp, Artificial Sequence
  chemically synthesized
ttctggggggctcacatctc

SEQ ID NO: 70767 - DNA, 20 bp, Artificial Sequence
  chemically synthesized
aagggctccactagagatgt

SEQ ID NO: 70768 - DNA, 20 bp, Artificial Sequence
  chemically synthesized
tggggggctcacatctctag

SEQ ID NO: 70769 - DNA, 20 bp, Artificial Sequence
  chemically synthesized
gggggctcacatctctagtg

SEQ ID NO: 70770 - DNA, 20 bp, Artificial Sequence
  chemically synthesized
gtattacaagggctccacta

SEQ ID NO: 70771 - DNA, 20 bp, Artificial Sequence
  chemically synthesized
cagtattacaagggctccac

SEQ ID NO: 70772 - DNA, 20 bp, Artificial Sequence
  chemically synthesized
aactacatacagtattacaa

SEQ ID NO: 70773 - DNA, 20 bp, Artificial Sequence
  chemically synthesized
gaactacatacagtattaca

SEQ ID NO: 70774 - DNA, 20 bp, Artificial Sequence
  chemically synthesized
tgaactacatacagtattac

SEQ ID NO: 70775 - DNA, 20 bp, Artificial Sequence
  chemically synthesized
agcccttgtaatactgtatg

SEQ ID NO: 70776 - DNA, 20 bp, Artificial Sequence
  chemically synthesized
attaatacatgaactacata

SEQ ID NO: 70777 - DNA, 20 bp, Artificial Sequence
  chemically synthesized
tcatgtattaatcatctttg

SEQ ID NO: 70778 - DNA, 20 bp, Artificial Sequence
  chemically synthesized
catgtattaatcatctttga

SEQ ID NO: 70779 - DNA, 20 bp, Artificial Sequence
  chemically synthesized
atgtattaatcatctttgaa

SEQ ID NO: 70780 - DNA, 20 bp, Artificial Sequence
  chemically synthesized
gtattaatcatctttgaagg

SEQ ID NO: 70781 - DNA, 20 bp, Artificial Sequence
  chemically synthesized
catgacacaggctcccttca

SEQ ID NO: 70782 - DNA, 20 bp, Artificial Sequence
  chemically synthesized
gacaaagatgtacatgacac

SEQ ID NO: 70783 - DNA, 20 bp, Artificial Sequence
  chemically synthesized
ggacaaagatgtacatgaca

SEQ ID NO: 70784 - DNA, 20 bp, Artificial Sequence
  chemically synthesized
tctacccaataggagggaca

SEQ ID NO: 70785 - DNA, 20 bp, Artificial Sequence
  chemically synthesized
tacatctttgtccctcctat

SEQ ID NO: 70786 - DNA, 20 bp, Artificial Sequence
  chemically synthesized
acatctttgtccctcctatt

SEQ ID NO: 70787 - DNA, 20 bp, Artificial Sequence
  chemically synthesized
agaccctctacccaatagga

SEQ ID NO: 70788 - DNA, 20 bp, Artificial Sequence
  chemically synthesized
gagaccctctacccaatagg

SEQ ID NO: 70789 - DNA, 20 bp, Artificial Sequence
  chemically synthesized
cgagaccctctacccaatag

SEQ ID NO: 70790 - DNA, 20 bp, Artificial Sequence
  chemically synthesized
tctttgtccctcctattggg

SEQ ID NO: 70791 - DNA, 20 bp, Artificial Sequence
  chemically synthesized
ctcgagaccctctacccaat

SEQ ID NO: 70792 - DNA, 20 bp, Artificial Sequence
  chemically synthesized
tttgtccctcctattgggta

SEQ ID NO: 70793 - DNA, 20 bp, Artificial Sequence
  chemically synthesized
tctcgagaccctctacccaa

SEQ ID NO: 70794 - DNA, 20 bp, Artificial Sequence
  chemically synthesized
ttgtccctcctattgggtag

SEQ ID NO: 70795 - DNA, 20 bp, Artificial Sequence
  chemically synthesized
tgtccctcctattgggtaga

SEQ ID NO: 70796 - DNA, 20 bp, Artificial Sequence
  chemically synthesized
cctattgggtagagggtctc

SEQ ID NO: 70797 - DNA, 20 bp, Artificial Sequence
  chemically synthesized
tcagtgactacattagtctc

SEQ ID NO: 70798 - DNA, 20 bp, Artificial Sequence
  chemically synthesized
agagggtctcgagactaatg

SEQ ID NO: 70799 - DNA, 20 bp, Artificial Sequence
  chemically synthesized
tattttatcagtgactacat

SEQ ID NO: 70800 - DNA, 20 bp, Artificial Sequence
  chemically synthesized
agttcagttcagtattttat

SEQ ID NO: 70801 - DNA, 20 bp, Artificial Sequence
  chemically synthesized
cttttgcatgaagttcagtt

SEQ ID NO: 70802 - DNA, 20 bp, Artificial Sequence
  chemically synthesized
aatcacttttgcatgaagtt

SEQ ID NO: 70803 - DNA, 20 bp, Artificial Sequence
  chemically synthesized
ctgaactgaacttcatgcaa

SEQ ID NO: 70804 - DNA, 20 bp, Artificial Sequence
  chemically synthesized
tcagaaatcacttttgcatg

SEQ ID NO: 70805 - DNA, 20 bp, Artificial Sequence
  chemically synthesized
ttcatgcaaaagtgatttct

SEQ ID NO: 70806 - DNA, 20 bp, Artificial Sequence
  chemically synthesized
gcaaaagtgatttctgagaa

SEQ ID NO: 70807 - DNA, 20 bp, Artificial Sequence
  chemically synthesized
caaaagtgatttctgagaaa

SEQ ID NO: 70808 - DNA, 20 bp, Artificial Sequence
  chemically synthesized
atttggttaatgccttttct

SEQ ID NO: 70809 - DNA, 20 bp, Artificial Sequence
  chemically synthesized
gagaaaaggcattaaccaaa

SEQ ID NO: 70810 - DNA, 20 bp, Artificial Sequence
  chemically synthesized
aataaaattaaggcactatt

SEQ ID NO: 70811 - DNA, 20 bp, Artificial Sequence
  chemically synthesized
caaaacaagtaataaaatta

SEQ ID NO: 70812 - DNA, 20 bp, Artificial Sequence
  chemically synthesized
gcaaaacaagtaataaaatt

SEQ ID NO: 70813 - DNA, 20 bp, Artificial Sequence
  chemically synthesized
taattttattacttgttttg

SEQ ID NO: 70814 - DNA, 20 bp, Artificial Sequence
  chemically synthesized
aattttattacttgttttgc

SEQ ID NO: 70815 - DNA, 20 bp, Artificial Sequence
  chemically synthesized
gtacataaaacctgcaaaac

SEQ ID NO: 70816 - DNA, 20 bp, Artificial Sequence
  chemically synthesized
ggttttatgtacttaattgc

SEQ ID NO: 70817 - DNA, 20 bp, Artificial Sequence
  chemically synthesized
ttagcctcctacttgcaatt

SEQ ID NO: 70818 - DNA, 20 bp, Artificial Sequence
  chemically synthesized
tttatgtacttaattgcaag

SEQ ID NO: 70819 - DNA, 20 bp, Artificial Sequence
  chemically synthesized
ttatgtacttaattgcaagt

SEQ ID NO: 70820 - DNA, 20 bp, Artificial Sequence
  chemically synthesized
atgtacttaattgcaagtag

SEQ ID NO: 70821 - DNA, 20 bp, Artificial Sequence
  chemically synthesized
tgtacttaattgcaagtagg

SEQ ID NO: 70822 - DNA, 20 bp, Artificial Sequence
  chemically synthesized
aaaaactaaacatttttcat

SEQ ID NO: 70823 - DNA, 20 bp, Artificial Sequence
  chemically synthesized
ggaggctaatgaaaaatgtt

SEQ ID NO: 70824 - DNA, 20 bp, Artificial Sequence
  chemically synthesized
tgaaaaatgtttagtttttg

SEQ ID NO: 70825 - DNA, 20 bp, Artificial Sequence
  chemically synthesized
aatgtttagtttttgcagtg

SEQ ID NO: 70826 - DNA, 20 bp, Artificial Sequence
  chemically synthesized
gtttagtttttgcagtgtgg

SEQ ID NO: 70827 - DNA, 20 bp, Artificial Sequence
  chemically synthesized
tagtttttgcagtgtggtgg

SEQ ID NO: 70828 - DNA, 20 bp, Artificial Sequence
  chemically synthesized
ttttgcagtgtggtggtggt

SEQ ID NO: 70829 - DNA, 20 bp, Artificial Sequence
  chemically synthesized
tttgcagtgtggtggtggtg

SEQ ID NO: 70830 - DNA, 20 bp, Artificial Sequence
  chemically synthesized
ttgcagtgtggtggtggtga

SEQ ID NO: 70831 - DNA, 20 bp, Artificial Sequence
  chemically synthesized
tgcagtgtggtggtggtgag

SEQ ID NO: 70832 - DNA, 20 bp, Artificial Sequence
  chemically synthesized
ggtggtggtgaggggcatcc

SEQ ID NO: 70833 - DNA, 20 bp, Artificial Sequence
  chemically synthesized
ggtgaggggcatcccagctt

SEQ ID NO: 70834 - DNA, 20 bp, Artificial Sequence
  chemically synthesized
ggacctctaccactcaagct

SEQ ID NO: 70835 - DNA, 20 bp, Artificial Sequence
  chemically synthesized
gaggggcatcccagcttgag

SEQ ID NO: 70836 - DNA, 20 bp, Artificial Sequence
  chemically synthesized
gggacctctaccactcaagc

SEQ ID NO: 70837 - DNA, 20 bp, Artificial Sequence
  chemically synthesized
gggcatcccagcttgagtgg

SEQ ID NO: 70838 - DNA, 20 bp, Artificial Sequence
  chemically synthesized
agctgggacctctaccactc

SEQ ID NO: 70839 - DNA, 20 bp, Artificial Sequence
  chemically synthesized
gcatcccagcttgagtggta

SEQ ID NO: 70840 - DNA, 20 bp, Artificial Sequence
  chemically synthesized
catcccagcttgagtggtag

SEQ ID NO: 70841 - DNA, 20 bp, Artificial Sequence
  chemically synthesized
agcttgagtggtagaggtcc

SEQ ID NO: 70842 - DNA, 20 bp, Artificial Sequence
  chemically synthesized
ctaaatttctgtgttaagct

SEQ ID NO: 70843 - DNA, 20 bp, Artificial Sequence
  chemically synthesized
tctaaatttctgtgttaagc

SEQ ID NO: 70844 - DNA, 20 bp, Artificial Sequence
  chemically synthesized
gtagaggtcccagcttaaca

SEQ ID NO: 70845 - DNA, 20 bp, Artificial Sequence
  chemically synthesized
tttatctaaatttctgtgtt

SEQ ID NO: 70846 - DNA, 20 bp, Artificial Sequence
  chemically synthesized
cccagcttaacacagaaatt

SEQ ID NO: 70847 - DNA, 20 bp, Artificial Sequence
  chemically synthesized
cacagaaatttagataaatg

SEQ ID NO: 70848 - DNA, 20 bp, Artificial Sequence
  chemically synthesized
tttagataaatgtggcaaat

SEQ ID NO: 70849 - DNA, 20 bp, Artificial Sequence
  chemically synthesized
agataaatgtggcaaattgg

SEQ ID NO: 70850 - DNA, 20 bp, Artificial Sequence
  chemically synthesized
gataaatgtggcaaattggt

SEQ ID NO: 70851 - DNA, 20 bp, Artificial Sequence
  chemically synthesized
aatgtggcaaattggtggga

SEQ ID NO: 70852 - DNA, 20 bp, Artificial Sequence
  chemically synthesized
atgtggcaaattggtgggat

SEQ ID NO: 70853 - DNA, 20 bp, Artificial Sequence
  chemically synthesized
gcttttctctcagtgcagat

SEQ ID NO: 70854 - DNA, 20 bp, Artificial Sequence
  chemically synthesized
caatgtatctcatctgcact

SEQ ID NO: 70855 - DNA, 20 bp, Artificial Sequence
  chemically synthesized
atgtatctcatctgcactga

SEQ ID NO: 70856 - DNA, 20 bp, Artificial Sequence
  chemically synthesized
cttgagcttttctctcagtg

SEQ ID NO: 70857 - DNA, 20 bp, Artificial Sequence
  chemically synthesized
tctcatctgcactgagagaa

SEQ ID NO: 70858 - DNA, 20 bp, Artificial Sequence
  chemically synthesized
tacaccttgagcttttctct

SEQ ID NO: 70859 - DNA, 20 bp, Artificial Sequence
  chemically synthesized
ctgcactgagagaaaagctc

SEQ ID NO: 70860 - DNA, 20 bp, Artificial Sequence
  chemically synthesized
tgcactgagagaaaagctca

SEQ ID NO: 70861 - DNA, 20 bp, Artificial Sequence
  chemically synthesized
cccagaaatggttacacctt

SEQ ID NO: 70862 - DNA, 20 bp, Artificial Sequence
  chemically synthesized
gctcaaggtgtaaccatttc

SEQ ID NO: 70863 - DNA, 20 bp, Artificial Sequence
  chemically synthesized
ctcaaggtgtaaccatttct

SEQ ID NO: 70864 - DNA, 20 bp, Artificial Sequence
  chemically synthesized
tcaaggtgtaaccatttctg

SEQ ID NO: 70865 - DNA, 20 bp, Artificial Sequence
  chemically synthesized
tagacatgtagccccagaaa

SEQ ID NO: 70866 - DNA, 20 bp, Artificial Sequence
  chemically synthesized
gatgactagacatgtagccc

SEQ ID NO: 70867 - DNA, 20 bp, Artificial Sequence
  chemically synthesized
catttctggggctacatgtc

SEQ ID NO: 70868 - DNA, 20 bp, Artificial Sequence
  chemically synthesized
cttagagatgactagacatg

SEQ ID NO: 70869 - DNA, 20 bp, Artificial Sequence
  chemically synthesized
accaatctcttagagatgac

SEQ ID NO: 70870 - DNA, 20 bp, Artificial Sequence
  chemically synthesized
ctacatgtctagtcatctct

SEQ ID NO: 70871 - DNA, 20 bp, Artificial Sequence
  chemically synthesized
acatgtctagtcatctctaa

SEQ ID NO: 70872 - DNA, 20 bp, Artificial Sequence
  chemically synthesized
ggggagccaccaatctctta

SEQ ID NO: 70873 - DNA, 20 bp, Artificial Sequence
  chemically synthesized
tctagtcatctctaagagat

SEQ ID NO: 70874 - DNA, 20 bp, Artificial Sequence
  chemically synthesized
ctggggagccaccaatctct

SEQ ID NO: 70875 - DNA, 20 bp, Artificial Sequence
  chemically synthesized
agtcatctctaagagattgg

SEQ ID NO: 70876 - DNA, 20 bp, Artificial Sequence
  chemically synthesized
ctaagagattggtggctccc

SEQ ID NO: 70877 - DNA, 20 bp, Artificial Sequence
  chemically synthesized
ccctgcaatggatgtctggg

SEQ ID NO: 70878 - DNA, 20 bp, Artificial Sequence
  chemically synthesized
gtccctgcaatggatgtctg

SEQ ID NO: 70879 - DNA, 20 bp, Artificial Sequence
  chemically synthesized
tgtccctgcaatggatgtct

SEQ ID NO: 70880 - DNA, 20 bp, Artificial Sequence
  chemically synthesized
gtgtccctgcaatggatgtc

SEQ ID NO: 70881 - DNA, 20 bp, Artificial Sequence
  chemically synthesized
ggctccccagacatccattg

SEQ ID NO: 70882 - DNA, 20 bp, Artificial Sequence
  chemically synthesized
gctccccagacatccattgc

SEQ ID NO: 70883 - DNA, 20 bp, Artificial Sequence
  chemically synthesized
ctccccagacatccattgca

SEQ ID NO: 70884 - DNA, 20 bp, Artificial Sequence
  chemically synthesized
cctccttagtgtccctgcaa

SEQ ID NO: 70885 - DNA, 20 bp, Artificial Sequence
  chemically synthesized
acatccattgcagggacact

SEQ ID NO: 70886 - DNA, 20 bp, Artificial Sequence
  chemically synthesized
catccattgcagggacacta

SEQ ID NO: 70887 - DNA, 20 bp, Artificial Sequence
  chemically synthesized
tccattgcagggacactaag

SEQ ID NO: 70888 - DNA, 20 bp, Artificial Sequence
  chemically synthesized
ccattgcagggacactaagg

SEQ ID NO: 70889 - DNA, 20 bp, Artificial Sequence
  chemically synthesized
cttctcctaagagacctcct

SEQ ID NO: 70890 - DNA, 20 bp, Artificial Sequence
  chemically synthesized
gggacactaaggaggtctct

SEQ ID NO: 70891 - DNA, 20 bp, Artificial Sequence
  chemically synthesized
ggacactaaggaggtctctt

SEQ ID NO: 70892 - DNA, 20 bp, Artificial Sequence
  chemically synthesized
acactaaggaggtctcttag

SEQ ID NO: 70893 - DNA, 20 bp, Artificial Sequence
  chemically synthesized
ctaaggaggtctcttaggag

SEQ ID NO: 70894 - DNA, 20 bp, Artificial Sequence
  chemically synthesized
ttcattacgccttctcctaa

SEQ ID NO: 70895 - DNA, 20 bp, Artificial Sequence
  chemically synthesized
taaggaggtctcttaggaga

SEQ ID NO: 70896 - DNA, 20 bp, Artificial Sequence
  chemically synthesized
ctttcattacgccttctcct

SEQ ID NO: 70897 - DNA, 20 bp, Artificial Sequence
  chemically synthesized
cttaggagaaggcgtaatga

SEQ ID NO: 70898 - DNA, 20 bp, Artificial Sequence
  chemically synthesized
tgaaagaacatattataaac

SEQ ID NO: 70899 - DNA, 20 bp, Artificial Sequence
  chemically synthesized
gaaagaacatattataaacc

SEQ ID NO: 70900 - DNA, 20 bp, Artificial Sequence
  chemically synthesized
tttctactgagcaaagcacc

SEQ ID NO: 70901 - DNA, 20 bp, Artificial Sequence
  chemically synthesized
tataaaccaggtgctttgct

SEQ ID NO: 70902 - DNA, 20 bp, Artificial Sequence
  chemically synthesized
aaaccaggtgctttgctcag

SEQ ID NO: 70903 - DNA, 20 bp, Artificial Sequence
  chemically synthesized
cgaggcttttctactgagca

SEQ ID NO: 70904 - DNA, 20 bp, Artificial Sequence
  chemically synthesized
aggtgctttgctcagtagaa

SEQ ID NO: 70905 - DNA, 20 bp, Artificial Sequence
  chemically synthesized
ttgaccgaggcttttctact

SEQ ID NO: 70906 - DNA, 20 bp, Artificial Sequence
  chemically synthesized
tttgctcagtagaaaagcct

SEQ ID NO: 70907 - DNA, 20 bp, Artificial Sequence
  chemically synthesized
tctctttctcttgttgaccg

SEQ ID NO: 70908 - DNA, 20 bp, Artificial Sequence
  chemically synthesized
gtagaaaagcctcggtcaac

SEQ ID NO: 70909 - DNA, 20 bp, Artificial Sequence
  chemically synthesized
ttctctttctcttgttgacc

SEQ ID NO: 70910 - DNA, 20 bp, Artificial Sequence
  chemically synthesized
agaaaagcctcggtcaacaa

SEQ ID NO: 70911 - DNA, 20 bp, Artificial Sequence
  chemically synthesized
aagcctcggtcaacaagaga

SEQ ID NO: 70912 - DNA, 20 bp, Artificial Sequence
  chemically synthesized
gcctcggtcaacaagagaaa

SEQ ID NO: 70913 - DNA, 20 bp, Artificial Sequence
  chemically synthesized
cggtcaacaagagaaagaga

SEQ ID NO: 70914 - DNA, 20 bp, Artificial Sequence
  chemically synthesized
gtcaacaagagaaagagaaa

SEQ ID NO: 70915 - DNA, 20 bp, Artificial Sequence
  chemically synthesized
aacaagagaaagagaaagag

SEQ ID NO: 70916 - DNA, 20 bp, Artificial Sequence
  chemically synthesized
gaaagagaaagagtggtttt

SEQ ID NO: 70917 - DNA, 20 bp, Artificial Sequence
  chemically synthesized
gagtggttttgagaatactg

SEQ ID NO: 70918 - DNA, 20 bp, Artificial Sequence
  chemically synthesized
aatctaagtagcagacacca

SEQ ID NO: 70919 - DNA, 20 bp, Artificial Sequence
  chemically synthesized
atactgtggtgtctgctact

SEQ ID NO: 70920 - DNA, 20 bp, Artificial Sequence
  chemically synthesized
cagaagataaatctaagtag

SEQ ID NO: 70921 - DNA, 20 bp, Artificial Sequence
  chemically synthesized
aaccagaagataaatctaag

SEQ ID NO: 70922 - DNA, 20 bp, Artificial Sequence
  chemically synthesized
ctgaaccagaagataaatct

SEQ ID NO: 70923 - DNA, 20 bp, Artificial Sequence
  chemically synthesized
tgctacttagatttatcttc

SEQ ID NO: 70924 - DNA, 20 bp, Artificial Sequence
  chemically synthesized
cttagatttatcttctggtt

SEQ ID NO: 70925 - DNA, 20 bp, Artificial Sequence
  chemically synthesized
ctcagatatgactgaaccag

SEQ ID NO: 70926 - DNA, 20 bp, Artificial Sequence
  chemically synthesized
ggactcagatatgactgaac

SEQ ID NO: 70927 - DNA, 20 bp, Artificial Sequence
  chemically synthesized
cttctggttcagtcatatct

SEQ ID NO: 70928 - DNA, 20 bp, Artificial Sequence
  chemically synthesized
tgacttagatgcatgggact

SEQ ID NO: 70929 - DNA, 20 bp, Artificial Sequence
  chemically synthesized
taattctgacttagatgcat

SEQ ID NO: 70930 - DNA, 20 bp, Artificial Sequence
  chemically synthesized
tatctgagtcccatgcatct

SEQ ID NO: 70931 - DNA, 20 bp, Artificial Sequence
  chemically synthesized
ataattctgacttagatgca

SEQ ID NO: 70932 - DNA, 20 bp, Artificial Sequence
  chemically synthesized
tgagtcccatgcatctaagt

SEQ ID NO: 70933 - DNA, 20 bp, Artificial Sequence
  chemically synthesized
tcttgcaaataattctgact

SEQ ID NO: 70934 - DNA, 20 bp, Artificial Sequence
  chemically synthesized
tctaagtcagaattatttgc

SEQ ID NO: 70935 - DNA, 20 bp, Artificial Sequence
  chemically synthesized
ttatttgcaagaccatgtgc

SEQ ID NO: 70936 - DNA, 20 bp, Artificial Sequence
  chemically synthesized
aaagcatctcatctggcaca

SEQ ID NO: 70937 - DNA, 20 bp, Artificial Sequence
  chemically synthesized
tgcaagaccatgtgccagat

SEQ ID NO: 70938 - DNA, 20 bp, Artificial Sequence
  chemically synthesized
gcagcagaaagcatctcatc

SEQ ID NO: 70939 - DNA, 20 bp, Artificial Sequence
  chemically synthesized
agatgagatgctttctgctg

SEQ ID NO: 70940 - DNA, 20 bp, Artificial Sequence
  chemically synthesized
tttctacaacctgcagcaga

SEQ ID NO: 70941 - DNA, 20 bp, Artificial Sequence
  chemically synthesized
gatgagatgctttctgctgc

SEQ ID NO: 70942 - DNA, 20 bp, Artificial Sequence
  chemically synthesized
cagttttctacaacctgcag

SEQ ID NO: 70943 - DNA, 20 bp, Artificial Sequence
  chemically synthesized
atgctttctgctgcaggttg

SEQ ID NO: 70944 - DNA, 20 bp, Artificial Sequence
  chemically synthesized
tatcagttttctacaacctg

SEQ ID NO: 70945 - DNA, 20 bp, Artificial Sequence
  chemically synthesized
caggttgtagaaaactgata

SEQ ID NO: 70946 - DNA, 20 bp, Artificial Sequence
  chemically synthesized
aggttgtagaaaactgatat

SEQ ID NO: 70947 - DNA, 20 bp, Artificial Sequence
  chemically synthesized
aacaaacatccaacccatat

SEQ ID NO: 70948 - DNA, 20 bp, Artificial Sequence
  chemically synthesized
tgtagaaaactgatatgggt

SEQ ID NO: 70949 - DNA, 20 bp, Artificial Sequence
  chemically synthesized
atttcagcatgagatttgaa

SEQ ID NO: 70950 - DNA, 20 bp, Artificial Sequence
  chemically synthesized
catttcagcatgagatttga

SEQ ID NO: 70951 - DNA, 20 bp, Artificial Sequence
  chemically synthesized
acatttcagcatgagatttg

SEQ ID NO: 70952 - DNA, 20 bp, Artificial Sequence
  chemically synthesized
tggggattacatttcagcat

SEQ ID NO: 70953 - DNA, 20 bp, Artificial Sequence
  chemically synthesized
caacactggggattacattt

SEQ ID NO: 70954 - DNA, 20 bp, Artificial Sequence
  chemically synthesized
tcatgctgaaatgtaatccc

SEQ ID NO: 70955 - DNA, 20 bp, Artificial Sequence
  chemically synthesized
tgaaatgtaatccccagtgt

SEQ ID NO: 70956 - DNA, 20 bp, Artificial Sequence
  chemically synthesized
gggccccacatccaacactg

SEQ ID NO: 70957 - DNA, 20 bp, Artificial Sequence
  chemically synthesized
cgggccccacatccaacact

SEQ ID NO: 70958 - DNA, 20 bp, Artificial Sequence
  chemically synthesized
ccgggccccacatccaacac

SEQ ID NO: 70959 - DNA, 20 bp, Artificial Sequence
  chemically synthesized
gtaatccccagtgttggatg

SEQ ID NO: 70960 - DNA, 20 bp, Artificial Sequence
  chemically synthesized
taatccccagtgttggatgt

SEQ ID NO: 70961 - DNA, 20 bp, Artificial Sequence
  chemically synthesized
aatccccagtgttggatgtg

SEQ ID NO: 70962 - DNA, 20 bp, Artificial Sequence
  chemically synthesized
ccagtgttggatgtggggcc

SEQ ID NO: 70963 - DNA, 20 bp, Artificial Sequence
  chemically synthesized
gtgttggatgtggggcccgg

SEQ ID NO: 70964 - DNA, 20 bp, Artificial Sequence
  chemically synthesized
tgttggatgtggggcccggt

SEQ ID NO: 70965 - DNA, 20 bp, Artificial Sequence
  chemically synthesized
gttggatgtggggcccggtg

SEQ ID NO: 70966 - DNA, 20 bp, Artificial Sequence
  chemically synthesized
ttggatgtggggcccggtgg

SEQ ID NO: 70967 - DNA, 20 bp, Artificial Sequence
  chemically synthesized
ggatgtggggcccggtgggg

SEQ ID NO: 70968 - DNA, 20 bp, Artificial Sequence
  chemically synthesized
atgatccagtctcccccacc

SEQ ID NO: 70969 - DNA, 20 bp, Artificial Sequence
  chemically synthesized
catgatccagtctcccccac

SEQ ID NO: 70970 - DNA, 20 bp, Artificial Sequence
  chemically synthesized
tggggcccggtgggggagac

SEQ ID NO: 70971 - DNA, 20 bp, Artificial Sequence
  chemically synthesized
cggtgggggagactggatca

SEQ ID NO: 70972 - DNA, 20 bp, Artificial Sequence
  chemically synthesized
ggtgggggagactggatcat

SEQ ID NO: 70973 - DNA, 20 bp, Artificial Sequence
  chemically synthesized
gtgggggagactggatcatg

SEQ ID NO: 70974 - DNA, 20 bp, Artificial Sequence
  chemically synthesized
agggatccagccccatgatc

SEQ ID NO: 70975 - DNA, 20 bp, Artificial Sequence
  chemically synthesized
gggagactggatcatggggc

SEQ ID NO: 70976 - DNA, 20 bp, Artificial Sequence
  chemically synthesized
tgagccattcgtgagggatc

SEQ ID NO: 70977 - DNA, 20 bp, Artificial Sequence
  chemically synthesized
ggggctggatccctcacgaa

SEQ ID NO: 70978 - DNA, 20 bp, Artificial Sequence
  chemically synthesized
tggcactgagccattcgtga

SEQ ID NO: 70979 - DNA, 20 bp, Artificial Sequence
  chemically synthesized
atggcactgagccattcgtg

SEQ ID NO: 70980 - DNA, 20 bp, Artificial Sequence
  chemically synthesized
aatggcactgagccattcgt

SEQ ID NO: 70981 - DNA, 20 bp, Artificial Sequence
  chemically synthesized
tggatccctcacgaatggct

SEQ ID NO: 70982 - DNA, 20 bp, Artificial Sequence
  chemically synthesized
attactgcaagaatggcact

SEQ ID NO: 70983 - DNA, 20 bp, Artificial Sequence
  chemically synthesized
atggctcagtgccattcttg

SEQ ID NO: 70984 - DNA, 20 bp, Artificial Sequence
  chemically synthesized
ctcacttattactgcaagaa

SEQ ID NO: 70985 - DNA, 20 bp, Artificial Sequence
  chemically synthesized
gagaactcacttattactgc

SEQ ID NO: 70986 - DNA, 20 bp, Artificial Sequence
  chemically synthesized
agtgccattcttgcagtaat

SEQ ID NO: 70987 - DNA, 20 bp, Artificial Sequence
  chemically synthesized
ccattcttgcagtaataagt

SEQ ID NO: 70988 - DNA, 20 bp, Artificial Sequence
  chemically synthesized
gtaataagtgagttctcact

SEQ ID NO: 70989 - DNA, 20 bp, Artificial Sequence
  chemically synthesized
aataagtgagttctcactca

SEQ ID NO: 70990 - DNA, 20 bp, Artificial Sequence
  chemically synthesized
cacatgaactcactctgagt

SEQ ID NO: 70991 - DNA, 20 bp, Artificial Sequence
  chemically synthesized
agtgagttctcactcagagt

SEQ ID NO: 70992 - DNA, 20 bp, Artificial Sequence
  chemically synthesized
atcccacatgaactcactct

SEQ ID NO: 70993 - DNA, 20 bp, Artificial Sequence
  chemically synthesized
tcactcagagtgagttcatg

SEQ ID NO: 70994 - DNA, 20 bp, Artificial Sequence
  chemically synthesized
cactcagagtgagttcatgt

SEQ ID NO: 70995 - DNA, 20 bp, Artificial Sequence
  chemically synthesized
gccacactcttttaaacagt

SEQ ID NO: 70996 - DNA, 20 bp, Artificial Sequence
  chemically synthesized
tgtgggatctgactgtttaa

SEQ ID NO: 70997 - DNA, 20 bp, Artificial Sequence
  chemically synthesized
tgggatctgactgtttaaaa

SEQ ID NO: 70998 - DNA, 20 bp, Artificial Sequence
  chemically synthesized
aggtgccacactcttttaaa

SEQ ID NO: 70999 - DNA, 20 bp, Artificial Sequence
  chemically synthesized
tctgactgtttaaaagagtg

SEQ ID NO: 71000 - DNA, 20 bp, Artificial Sequence
  chemically synthesized
agatggagtgagggggtggg

SEQ ID NO: 71001 - DNA, 20 bp, Artificial Sequence
  chemically synthesized
gagatggagtgagggggtgg

SEQ ID NO: 71002 - DNA, 20 bp, Artificial Sequence
  chemically synthesized
gagagatggagtgagggggt

SEQ ID NO: 71003 - DNA, 20 bp, Artificial Sequence
  chemically synthesized
tgagagatggagtgaggggg

SEQ ID NO: 71004 - DNA, 20 bp, Artificial Sequence
  chemically synthesized
tggtgagagatggagtgagg

SEQ ID NO: 71005 - DNA, 20 bp, Artificial Sequence
  chemically synthesized
atggtgagagatggagtgag

SEQ ID NO: 71006 - DNA, 20 bp, Artificial Sequence
  chemically synthesized
catggtgagagatggagtga

SEQ ID NO: 71007 - DNA, 20 bp, Artificial Sequence
  chemically synthesized
acatggtgagagatggagtg

SEQ ID NO: 71008 - DNA, 20 bp, Artificial Sequence
  chemically synthesized
cacatggtgagagatggagt

SEQ ID NO: 71009 - DNA, 20 bp, Artificial Sequence
  chemically synthesized
gtgtcacatggtgagagatg

SEQ ID NO: 71010 - DNA, 20 bp, Artificial Sequence
  chemically synthesized
gcgtgtcacatggtgagaga

SEQ ID NO: 71011 - DNA, 20 bp, Artificial Sequence
  chemically synthesized
accagcgtgtcacatggtga

SEQ ID NO: 71012 - DNA, 20 bp, Artificial Sequence
  chemically synthesized
gaaccagcgtgtcacatggt

SEQ ID NO: 71013 - DNA, 20 bp, Artificial Sequence
  chemically synthesized
aggagaaccagcgtgtcaca

SEQ ID NO: 71014 - DNA, 20 bp, Artificial Sequence
  chemically synthesized
tctctcaccatgtgacacgc

SEQ ID NO: 71015 - DNA, 20 bp, Artificial Sequence
  chemically synthesized
gtggaaggtgaaaggagaac

SEQ ID NO: 71016 - DNA, 20 bp, Artificial Sequence
  chemically synthesized
atcatggtggaaggtgaaag

SEQ ID NO: 71017 - DNA, 20 bp, Artificial Sequence
  chemically synthesized
caatcatggtggaaggtgaa

SEQ ID NO: 71018 - DNA, 20 bp, Artificial Sequence
  chemically synthesized
acaatcatggtggaaggtga

SEQ ID NO: 71019 - DNA, 20 bp, Artificial Sequence
  chemically synthesized
aagcttacaatcatggtgga

SEQ ID NO: 71020 - DNA, 20 bp, Artificial Sequence
  chemically synthesized
caagcttacaatcatggtgg

SEQ ID NO: 71021 - DNA, 20 bp, Artificial Sequence
  chemically synthesized
cagcaagcttacaatcatgg

SEQ ID NO: 71022 - DNA, 20 bp, Artificial Sequence
  chemically synthesized
tcaccttccaccatgattgt

SEQ ID NO: 71023 - DNA, 20 bp, Artificial Sequence
  chemically synthesized
cttcagcaagcttacaatca

SEQ ID NO: 71024 - DNA, 20 bp, Artificial Sequence
  chemically synthesized
ccatgattgtaagcttgctg

SEQ ID NO: 71025 - DNA, 20 bp, Artificial Sequence
  chemically synthesized
cttctggtgagggcttcagc

SEQ ID NO: 71026 - DNA, 20 bp, Artificial Sequence
  chemically synthesized
tctgcttctggtgagggctt

SEQ ID NO: 71027 - DNA, 20 bp, Artificial Sequence
  chemically synthesized
aagcttgctgaagccctcac

SEQ ID NO: 71028 - DNA, 20 bp, Artificial Sequence
  chemically synthesized
cttgctgaagccctcaccag

SEQ ID NO: 71029 - DNA, 20 bp, Artificial Sequence
  chemically synthesized
acagcctctgcttctggtga

SEQ ID NO: 71030 - DNA, 20 bp, Artificial Sequence
  chemically synthesized
gacagcctctgcttctggtg

SEQ ID NO: 71031 - DNA, 20 bp, Artificial Sequence
  chemically synthesized
tgacagcctctgcttctggt

SEQ ID NO: 71032 - DNA, 20 bp, Artificial Sequence
  chemically synthesized
gctgaagccctcaccagaag

SEQ ID NO: 71033 - DNA, 20 bp, Artificial Sequence
  chemically synthesized
tgaagccctcaccagaagca

SEQ ID NO: 71034 - DNA, 20 bp, Artificial Sequence
  chemically synthesized
gaagccctcaccagaagcag

SEQ ID NO: 71035 - DNA, 20 bp, Artificial Sequence
  chemically synthesized
gtggtgacagcctctgcttc

SEQ ID NO: 71036 - DNA, 20 bp, Artificial Sequence
  chemically synthesized
ctgtacaggaagtgtggtga

SEQ ID NO: 71037 - DNA, 20 bp, Artificial Sequence
  chemically synthesized
tgcaggctgtacaggaagtg

SEQ ID NO: 71038 - DNA, 20 bp, Artificial Sequence
  chemically synthesized
ctgtcaccacacttcctgta

SEQ ID NO: 71039 - DNA, 20 bp, Artificial Sequence
  chemically synthesized
ggttctgcaggctgtacagg

SEQ ID NO: 71040 - DNA, 20 bp, Artificial Sequence
  chemically synthesized
catggttctgcaggctgtac

SEQ ID NO: 71041 - DNA, 20 bp, Artificial Sequence
  chemically synthesized
tcatggttctgcaggctgta

SEQ ID NO: 71042 - DNA, 20 bp, Artificial Sequence
  chemically synthesized
cacacttcctgtacagcctg

SEQ ID NO: 71043 - DNA, 20 bp, Artificial Sequence
  chemically synthesized
tcattggctcatggttctgc

SEQ ID NO: 71044 - DNA, 20 bp, Artificial Sequence
  chemically synthesized
ttcattggctcatggttctg

SEQ ID NO: 71045 - DNA, 20 bp, Artificial Sequence
  chemically synthesized
tgtacagcctgcagaaccat

SEQ ID NO: 71046 - DNA, 20 bp, Artificial Sequence
  chemically synthesized
aaagagatttcattggctca

SEQ ID NO: 71047 - DNA, 20 bp, Artificial Sequence
  chemically synthesized
ataaggaaaagagatttcat

SEQ ID NO: 71048 - DNA, 20 bp, Artificial Sequence
  chemically synthesized
tgggtaatttataaggaaaa

SEQ ID NO: 71049 - DNA, 20 bp, Artificial Sequence
  chemically synthesized
gctgggtaatttataaggaa

SEQ ID NO: 71050 - DNA, 20 bp, Artificial Sequence
  chemically synthesized
ctgaggctgggtaatttata

SEQ ID NO: 71051 - DNA, 20 bp, Artificial Sequence
  chemically synthesized
cctgaggctgggtaatttat

SEQ ID NO: 71052 - DNA, 20 bp, Artificial Sequence
  chemically synthesized
tcttttccttataaattacc

SEQ ID NO: 71053 - DNA, 20 bp, Artificial Sequence
  chemically synthesized
ccttataaattacccagcct

SEQ ID NO: 71054 - DNA, 20 bp, Artificial Sequence
  chemically synthesized
cttataaattacccagcctc

SEQ ID NO: 71055 - DNA, 20 bp, Artificial Sequence
  chemically synthesized
ataaaggaatacctgaggct

SEQ ID NO: 71056 - DNA, 20 bp, Artificial Sequence
  chemically synthesized
tataaaggaatacctgaggc

SEQ ID NO: 71057 - DNA, 20 bp, Artificial Sequence
  chemically synthesized
tcactataaaggaatacctg

SEQ ID NO: 71058 - DNA, 20 bp, Artificial Sequence
  chemically synthesized
atcactataaaggaatacct

SEQ ID NO: 71059 - DNA, 20 bp, Artificial Sequence
  chemically synthesized
cagcctcaggtattccttta

SEQ ID NO: 71060 - DNA, 20 bp, Artificial Sequence
  chemically synthesized
ttccatttgcatcactataa

SEQ ID NO: 71061 - DNA, 20 bp, Artificial Sequence
  chemically synthesized
attccatttgcatcactata

SEQ ID NO: 71062 - DNA, 20 bp, Artificial Sequence
  chemically synthesized
ttcctttatagtgatgcaaa

SEQ ID NO: 71063 - DNA, 20 bp, Artificial Sequence
  chemically synthesized
tagtcaagacattttgtgtt

SEQ ID NO: 71064 - DNA, 20 bp, Artificial Sequence
  chemically synthesized
ctagtcaagacattttgtgt

SEQ ID NO: 71065 - DNA, 20 bp, Artificial Sequence
  chemically synthesized
ccaacacaaaatgtcttgac

SEQ ID NO: 71066 - DNA, 20 bp, Artificial Sequence
  chemically synthesized
tctgtgggccttgactagtc

SEQ ID NO: 71067 - DNA, 20 bp, Artificial Sequence
  chemically synthesized
acaaaatgtcttgactagtc

SEQ ID NO: 71068 - DNA, 20 bp, Artificial Sequence
  chemically synthesized
caaaatgtcttgactagtca

SEQ ID NO: 71069 - DNA, 20 bp, Artificial Sequence
  chemically synthesized
ttgcctctgtgggccttgac

SEQ ID NO: 71070 - DNA, 20 bp, Artificial Sequence
  chemically synthesized
tcttgactagtcaaggccca

SEQ ID NO: 71071 - DNA, 20 bp, Artificial Sequence
  chemically synthesized
ttgactagtcaaggcccaca

SEQ ID NO: 71072 - DNA, 20 bp, Artificial Sequence
  chemically synthesized
tgactagtcaaggcccacag

SEQ ID NO: 71073 - DNA, 20 bp, Artificial Sequence
  chemically synthesized
tggagcagctttgcctctgt

SEQ ID NO: 71074 - DNA, 20 bp, Artificial Sequence
  chemically synthesized
ctggagcagctttgcctctg

SEQ ID NO: 71075 - DNA, 20 bp, Artificial Sequence
  chemically synthesized
agtcaaggcccacagaggca

SEQ ID NO: 71076 - DNA, 20 bp, Artificial Sequence
  chemically synthesized
ccacagaggcaaagctgctc

SEQ ID NO: 71077 - DNA, 20 bp, Artificial Sequence
  chemically synthesized
cacagaggcaaagctgctcc

SEQ ID NO: 71078 - DNA, 20 bp, Artificial Sequence
  chemically synthesized
tggattacccagtcctggag

SEQ ID NO: 71079 - DNA, 20 bp, Artificial Sequence
  chemically synthesized
aggcaaagctgctccaggac

SEQ ID NO: 71080 - DNA, 20 bp, Artificial Sequence
  chemically synthesized
ggcaaagctgctccaggact

SEQ ID NO: 71081 - DNA, 20 bp, Artificial Sequence
  chemically synthesized
ttctggattacccagtcctg

SEQ ID NO: 71082 - DNA, 20 bp, Artificial Sequence
  chemically synthesized
gcttctggattacccagtcc

SEQ ID NO: 71083 - DNA, 20 bp, Artificial Sequence
  chemically synthesized
tgctccaggactgggtaatc

SEQ ID NO: 71084 - DNA, 20 bp, Artificial Sequence
  chemically synthesized
cattgtgcttctggattacc

SEQ ID NO: 71085 - DNA, 20 bp, Artificial Sequence
  chemically synthesized
tccaggactgggtaatccag

SEQ ID NO: 71086 - DNA, 20 bp, Artificial Sequence
  chemically synthesized
gaataatgtcattgtgcttc

SEQ ID NO: 71087 - DNA, 20 bp, Artificial Sequence
  chemically synthesized
gaagcacaatgacattattc

SEQ ID NO: 71088 - DNA, 20 bp, Artificial Sequence
  chemically synthesized
aagcacaatgacattattcc

SEQ ID NO: 71089 - DNA, 20 bp, Artificial Sequence
  chemically synthesized
atggaaggatgggaggaacc

SEQ ID NO: 71090 - DNA, 20 bp, Artificial Sequence
  chemically synthesized
tggcagaatggaaggatggg

SEQ ID NO: 71091 - DNA, 20 bp, Artificial Sequence
  chemically synthesized
atggcagaatggaaggatgg

SEQ ID NO: 71092 - DNA, 20 bp, Artificial Sequence
  chemically synthesized
gaatggcagaatggaaggat

SEQ ID NO: 71093 - DNA, 20 bp, Artificial Sequence
  chemically synthesized
agaatggcagaatggaagga

SEQ ID NO: 71094 - DNA, 20 bp, Artificial Sequence
  chemically synthesized
accaagaatggcagaatgga

SEQ ID NO: 71095 - DNA, 20 bp, Artificial Sequence
  chemically synthesized
caccaagaatggcagaatgg

SEQ ID NO: 71096 - DNA, 20 bp, Artificial Sequence
  chemically synthesized
gttcaccaagaatggcagaa

SEQ ID NO: 71097 - DNA, 20 bp, Artificial Sequence
  chemically synthesized
tccttccattctgccattct

SEQ ID NO: 71098 - DNA, 20 bp, Artificial Sequence
  chemically synthesized
ggacagttcaccaagaatgg

SEQ ID NO: 71099 - DNA, 20 bp, Artificial Sequence
  chemically synthesized
tgtggacagttcaccaagaa

SEQ ID NO: 71100 - DNA, 20 bp, Artificial Sequence
  chemically synthesized
gagtatgtggacagttcacc

SEQ ID NO: 71101 - DNA, 20 bp, Artificial Sequence
  chemically synthesized
ctacgttgtgagtatgtgga

SEQ ID NO: 71102 - DNA, 20 bp, Artificial Sequence
  chemically synthesized
gtagctacgttgtgagtatg

SEQ ID NO: 71103 - DNA, 20 bp, Artificial Sequence
  chemically synthesized
ctgtccacatactcacaacg

SEQ ID NO: 71104 - DNA, 20 bp, Artificial Sequence
  chemically synthesized
aatttcagtagctacgttgt

SEQ ID NO: 71105 - DNA, 20 bp, Artificial Sequence
  chemically synthesized
tgaatagatcagaatttcag

SEQ ID NO: 71106 - DNA, 20 bp, Artificial Sequence
  chemically synthesized
gagtgaatagatcagaattt

SEQ ID NO: 71107 - DNA, 20 bp, Artificial Sequence
  chemically synthesized
gaatgaacgagtgaatagat

SEQ ID NO: 71108 - DNA, 20 bp, Artificial Sequence
  chemically synthesized
ttgttgaatgaacgagtgaa

SEQ ID NO: 71109 - DNA, 20 bp, Artificial Sequence
  chemically synthesized
taaatatttgttgaatgaac

SEQ ID NO: 71110 - DNA, 20 bp, Artificial Sequence
  chemically synthesized
caacaaatatttaccacgct

SEQ ID NO: 71111 - DNA, 20 bp, Artificial Sequence
  chemically synthesized
cctaagaatagatcttagcg

SEQ ID NO: 71112 - DNA, 20 bp, Artificial Sequence
  chemically synthesized
aattacctaagaatagatct

SEQ ID NO: 71113 - DNA, 20 bp, Artificial Sequence
  chemically synthesized
accacgctaagatctattct

SEQ ID NO: 71114 - DNA, 20 bp, Artificial Sequence
  chemically synthesized
ccacgctaagatctattctt

SEQ ID NO: 71115 - DNA, 20 bp, Artificial Sequence
  chemically synthesized
gtatccaaattacctaagaa

SEQ ID NO: 71116 - DNA, 20 bp, Artificial Sequence
  chemically synthesized
ctaatgtatccaaattacct

SEQ ID NO: 71117 - DNA, 20 bp, Artificial Sequence
  chemically synthesized
agatctattcttaggtaatt

SEQ ID NO: 71118 - DNA, 20 bp, Artificial Sequence
  chemically synthesized
cttaggtaatttggatacat

SEQ ID NO: 71119 - DNA, 20 bp, Artificial Sequence
  chemically synthesized
ggatacattagctaacaaaa

SEQ ID NO: 71120 - DNA, 20 bp, Artificial Sequence
  chemically synthesized
agggatattgtctgttttgt

SEQ ID NO: 71121 - DNA, 20 bp, Artificial Sequence
  chemically synthesized
aacaaaacagacaatatccc

SEQ ID NO: 71122 - DNA, 20 bp, Artificial Sequence
  chemically synthesized
aggtgagctccatgaggcca

SEQ ID NO: 71123 - DNA, 20 bp, Artificial Sequence
  chemically synthesized
agacaatatccctggcctca

SEQ ID NO: 71124 - DNA, 20 bp, Artificial Sequence
  chemically synthesized
aaggtgagctccatgaggcc

SEQ ID NO: 71125 - DNA, 20 bp, Artificial Sequence
  chemically synthesized
gaaggtgagctccatgaggc

SEQ ID NO: 71126 - DNA, 20 bp, Artificial Sequence
  chemically synthesized
acaatatccctggcctcatg

SEQ ID NO: 71127 - DNA, 20 bp, Artificial Sequence
  chemically synthesized
atgagaaggtgagctccatg

SEQ ID NO: 71128 - DNA, 20 bp, Artificial Sequence
  chemically synthesized
tatgagaaggtgagctccat

SEQ ID NO: 71129 - DNA, 20 bp, Artificial Sequence
  chemically synthesized
gtctttcactatgagaaggt

SEQ ID NO: 71130 - DNA, 20 bp, Artificial Sequence
  chemically synthesized
tcatggagctcaccttctca

SEQ ID NO: 71131 - DNA, 20 bp, Artificial Sequence
  chemically synthesized
aattgtctttcactatgaga

SEQ ID NO: 71132 - DNA, 20 bp, Artificial Sequence
  chemically synthesized
aaattgtctttcactatgag

SEQ ID NO: 71133 - DNA, 20 bp, Artificial Sequence
  chemically synthesized
agctcaccttctcatagtga

SEQ ID NO: 71134 - DNA, 20 bp, Artificial Sequence
  chemically synthesized
tttaaattgtctttcactat

SEQ ID NO: 71135 - DNA, 20 bp, Artificial Sequence
  chemically synthesized
tagtgaaagacaatttaaaa

SEQ ID NO: 71136 - DNA, 20 bp, Artificial Sequence
  chemically synthesized
gacaatttaaaaaagtatat

SEQ ID NO: 71137 - DNA, 20 bp, Artificial Sequence
  chemically synthesized
acaatttaaaaaagtatatt

SEQ ID NO: 71138 - DNA, 20 bp, Artificial Sequence
  chemically synthesized
tttaaaaaagtatattaggc

SEQ ID NO: 71139 - DNA, 20 bp, Artificial Sequence
  chemically synthesized
ttaaaaaagtatattaggcc

SEQ ID NO: 71140 - DNA, 20 bp, Artificial Sequence
  chemically synthesized
aaaaaagtatattaggccgg

SEQ ID NO: 71141 - DNA, 20 bp, Artificial Sequence
  chemically synthesized
aaagtatattaggccgggag

SEQ ID NO: 71142 - DNA, 20 bp, Artificial Sequence
  chemically synthesized
gtatattaggccgggagtgg

SEQ ID NO: 71143 - DNA, 20 bp, Artificial Sequence
  chemically synthesized
caggcatgagccaccactcc

SEQ ID NO: 71144 - DNA, 20 bp, Artificial Sequence
  chemically synthesized
agtgctgggattacaggcat

SEQ ID NO: 71145 - DNA, 20 bp, Artificial Sequence
  chemically synthesized
gtggctcatgcctgtaatcc

SEQ ID NO: 71146 - DNA, 20 bp, Artificial Sequence
  chemically synthesized
ctcccaagtgctgggattac

SEQ ID NO: 71147 - DNA, 20 bp, Artificial Sequence
  chemically synthesized
cctcccaagtgctgggatta

SEQ ID NO: 71148 - DNA, 20 bp, Artificial Sequence
  chemically synthesized
atgcctgtaatcccagcact

SEQ ID NO: 71149 - DNA, 20 bp, Artificial Sequence
  chemically synthesized
tgcctgtaatcccagcactt

SEQ ID NO: 71150 - DNA, 20 bp, Artificial Sequence
  chemically synthesized
gccttggcctcccaagtgct

SEQ ID NO: 71151 - DNA, 20 bp, Artificial Sequence
  chemically synthesized
cgccttggcctcccaagtgc

SEQ ID NO: 71152 - DNA, 20 bp, Artificial Sequence
  chemically synthesized
cctgtaatcccagcacttgg

SEQ ID NO: 71153 - DNA, 20 bp, Artificial Sequence
  chemically synthesized
ctgtaatcccagcacttggg

SEQ ID NO: 71154 - DNA, 20 bp, Artificial Sequence
  chemically synthesized
tctgcccgccttggcctccc

SEQ ID NO: 71155 - DNA, 20 bp, Artificial Sequence
  chemically synthesized
atcccagcacttgggaggcc

SEQ ID NO: 71156 - DNA, 20 bp, Artificial Sequence
  chemically synthesized
tcccagcacttgggaggcca

SEQ ID NO: 71157 - DNA, 20 bp, Artificial Sequence
  chemically synthesized
cagcacttgggaggccaagg

SEQ ID NO: 71158 - DNA, 20 bp, Artificial Sequence
  chemically synthesized
agcacttgggaggccaaggc

SEQ ID NO: 71159 - DNA, 20 bp, Artificial Sequence
  chemically synthesized
acttgggaggccaaggcggg

SEQ ID NO: 71160 - DNA, 20 bp, Artificial Sequence
  chemically synthesized
acctcgtgatctgcccgcct

SEQ ID NO: 71161 - DNA, 20 bp, Artificial Sequence
  chemically synthesized
ggccaaggcgggcagatcac

SEQ ID NO: 71162 - DNA, 20 bp, Artificial Sequence
  chemically synthesized
gccaaggcgggcagatcacg

SEQ ID NO: 71163 - DNA, 20 bp, Artificial Sequence
  chemically synthesized
aggcgggcagatcacgaggt

SEQ ID NO: 71164 - DNA, 20 bp, Artificial Sequence
  chemically synthesized
ggcgggcagatcacgaggtc

SEQ ID NO: 71165 - DNA, 20 bp, Artificial Sequence
  chemically synthesized
cgggcagatcacgaggtcag

SEQ ID NO: 71166 - DNA, 20 bp, Artificial Sequence
  chemically synthesized
gatcacgaggtcaggagttc

SEQ ID NO: 71167 - DNA, 20 bp, Artificial Sequence
  chemically synthesized
cgaggtcaggagttcgagac

SEQ ID NO: 71168 - DNA, 20 bp, Artificial Sequence
  chemically synthesized
tcaggagttcgagaccagcc

SEQ ID NO: 71169 - DNA, 20 bp, Artificial Sequence
  chemically synthesized
gagttcgagaccagcctggc

SEQ ID NO: 71170 - DNA, 20 bp, Artificial Sequence
  chemically synthesized
tttcaccatgctggccaggc

SEQ ID NO: 71171 - DNA, 20 bp, Artificial Sequence
  chemically synthesized
ggggtttcaccatgctggcc

SEQ ID NO: 71172 - DNA, 20 bp, Artificial Sequence
  chemically synthesized
cgagaccagcctggccagca

SEQ ID NO: 71173 - DNA, 20 bp, Artificial Sequence
  chemically synthesized
cggggtttcaccatgctggc

SEQ ID NO: 71174 - DNA, 20 bp, Artificial Sequence
  chemically synthesized
gagacggggtttcaccatgc

SEQ ID NO: 71175 - DNA, 20 bp, Artificial Sequence
  chemically synthesized
ttttatttttagtagagacg

SEQ ID NO: 71176 - DNA, 20 bp, Artificial Sequence
  chemically synthesized
tttttatttttagtagagac

SEQ ID NO: 71177 - DNA, 20 bp, Artificial Sequence
  chemically synthesized
ttttttatttttagtagaga

SEQ ID NO: 71178 - DNA, 20 bp, Artificial Sequence
  chemically synthesized
gtttttttttatttttagta

SEQ ID NO: 71179 - DNA, 20 bp, Artificial Sequence
  chemically synthesized
tagtttttttttatttttag

SEQ ID NO: 71180 - DNA, 20 bp, Artificial Sequence
  chemically synthesized
agctagtttttttttatttt

SEQ ID NO: 71181 - DNA, 20 bp, Artificial Sequence
  chemically synthesized
tactaaaaataaaaaaaaac

SEQ ID NO: 71182 - DNA, 20 bp, Artificial Sequence
  chemically synthesized
aaaaataaaaaaaaactagc

SEQ ID NO: 71183 - DNA, 20 bp, Artificial Sequence
  chemically synthesized
aaaataaaaaaaaactagct

SEQ ID NO: 71184 - DNA, 20 bp, Artificial Sequence
  chemically synthesized
catccaccaccacgcccagc

SEQ ID NO: 71185 - DNA, 20 bp, Artificial Sequence
  chemically synthesized
aaaaaaaaactagctgggcg

SEQ ID NO: 71186 - DNA, 20 bp, Artificial Sequence
  chemically synthesized
aaaaaactagctgggcgtgg

SEQ ID NO: 71187 - DNA, 20 bp, Artificial Sequence
  chemically synthesized
caggcatccaccaccacgcc

SEQ ID NO: 71188 - DNA, 20 bp, Artificial Sequence
  chemically synthesized
aaactagctgggcgtggtgg

SEQ ID NO: 71189 - DNA, 20 bp, Artificial Sequence
  chemically synthesized
ggcgtggtggtggatgcctg

SEQ ID NO: 71190 - DNA, 20 bp, Artificial Sequence
  chemically synthesized
gtggtggatgcctgtagtcc

SEQ ID NO: 71191 - DNA, 20 bp, Artificial Sequence
  chemically synthesized
tcccgagtagctgggactac

SEQ ID NO: 71192 - DNA, 20 bp, Artificial Sequence
  chemically synthesized
ctcccgagtagctgggacta

SEQ ID NO: 71193 - DNA, 20 bp, Artificial Sequence
  chemically synthesized
tgcctgtagtcccagctact

SEQ ID NO: 71194 - DNA, 20 bp, Artificial Sequence
  chemically synthesized
cctcagcctcccgagtagct

SEQ ID NO: 71195 - DNA, 20 bp, Artificial Sequence
  chemically synthesized
gcctgtagtcccagctactc

SEQ ID NO: 71196 - DNA, 20 bp, Artificial Sequence
  chemically synthesized
gcctcagcctcccgagtagc

SEQ ID NO: 71197 - DNA, 20 bp, Artificial Sequence
  chemically synthesized
ctgtagtcccagctactcgg

SEQ ID NO: 71198 - DNA, 20 bp, Artificial Sequence
  chemically synthesized
tgtagtcccagctactcggg

SEQ ID NO: 71199 - DNA, 20 bp, Artificial Sequence
  chemically synthesized
tcctgcctcagcctcccgag

SEQ ID NO: 71200 - DNA, 20 bp, Artificial Sequence
  chemically synthesized
ttctcctgcctcagcctccc

SEQ ID NO: 71201 - DNA, 20 bp, Artificial Sequence
  chemically synthesized
tcccagctactcgggaggct

SEQ ID NO: 71202 - DNA, 20 bp, Artificial Sequence
  chemically synthesized
cccagctactcgggaggctg

SEQ ID NO: 71203 - DNA, 20 bp, Artificial Sequence
  chemically synthesized
agctactcgggaggctgagg

SEQ ID NO: 71204 - DNA, 20 bp, Artificial Sequence
  chemically synthesized
gctactcgggaggctgaggc

SEQ ID NO: 71205 - DNA, 20 bp, Artificial Sequence
  chemically synthesized
tactcgggaggctgaggcag

SEQ ID NO: 71206 - DNA, 20 bp, Artificial Sequence
  chemically synthesized
ttcaagtaattctcctgcct

SEQ ID NO: 71207 - DNA, 20 bp, Artificial Sequence
  chemically synthesized
gcaggagaattacttgaacc

SEQ ID NO: 71208 - DNA, 20 bp, Artificial Sequence
  chemically synthesized
aacctccgcctgctgggttc

SEQ ID NO: 71209 - DNA, 20 bp, Artificial Sequence
  chemically synthesized
ggagaattacttgaacccag

SEQ ID NO: 71210 - DNA, 20 bp, Artificial Sequence
  chemically synthesized
gagaattacttgaacccagc

SEQ ID NO: 71211 - DNA, 20 bp, Artificial Sequence
  chemically synthesized
aattacttgaacccagcagg

SEQ ID NO: 71212 - DNA, 20 bp, Artificial Sequence
  chemically synthesized
cactgcaacctccgcctgct

SEQ ID NO: 71213 - DNA, 20 bp, Artificial Sequence
  chemically synthesized
ttacttgaacccagcaggcg

SEQ ID NO: 71214 - DNA, 20 bp, Artificial Sequence
  chemically synthesized
tcactgcaacctccgcctgc

SEQ ID NO: 71215 - DNA, 20 bp, Artificial Sequence
  chemically synthesized
tacttgaacccagcaggcgg

SEQ ID NO: 71216 - DNA, 20 bp, Artificial Sequence
  chemically synthesized
aacccagcaggcggaggttg

SEQ ID NO: 71217 - DNA, 20 bp, Artificial Sequence
  chemically synthesized
cagcaggcggaggttgcagt

SEQ ID NO: 71218 - DNA, 20 bp, Artificial Sequence
  chemically synthesized
ggcggaggttgcagtgagct

SEQ ID NO: 71219 - DNA, 20 bp, Artificial Sequence
  chemically synthesized
ggagtgcagtggcatgatct

SEQ ID NO: 71220 - DNA, 20 bp, Artificial Sequence
  chemically synthesized
tcgcccaggctggagtgcag

SEQ ID NO: 71221 - DNA, 20 bp, Artificial Sequence
  chemically synthesized
gagatcatgccactgcactc

SEQ ID NO: 71222 - DNA, 20 bp, Artificial Sequence
  chemically synthesized
ctgtcgcccaggctggagtg

SEQ ID NO: 71223 - DNA, 20 bp, Artificial Sequence
  chemically synthesized
catgccactgcactccagcc

SEQ ID NO: 71224 - DNA, 20 bp, Artificial Sequence
  chemically synthesized
atgccactgcactccagcct

SEQ ID NO: 71225 - DNA, 20 bp, Artificial Sequence
  chemically synthesized
tcaatctgtcgcccaggctg

SEQ ID NO: 71226 - DNA, 20 bp, Artificial Sequence
  chemically synthesized
tctcaatctgtcgcccaggc

SEQ ID NO: 71227 - DNA, 20 bp, Artificial Sequence
  chemically synthesized
ctgcactccagcctgggcga

SEQ ID NO: 71228 - DNA, 20 bp, Artificial Sequence
  chemically synthesized
ggagtctcaatctgtcgccc

SEQ ID NO: 71229 - DNA, 20 bp, Artificial Sequence
  chemically synthesized
tggagtctcaatctgtcgcc

SEQ ID NO: 71230 - DNA, 20 bp, Artificial Sequence
  chemically synthesized
tccagcctgggcgacagatt

SEQ ID NO: 71231 - DNA, 20 bp, Artificial Sequence
  chemically synthesized
ttttttttttttttgagatg

SEQ ID NO: 71232 - DNA, 20 bp, Artificial Sequence
  chemically synthesized
ctttttttttttttttgaga

SEQ ID NO: 71233 - DNA, 20 bp, Artificial Sequence
  chemically synthesized
tatacttttttttttttttt

SEQ ID NO: 71234 - DNA, 20 bp, Artificial Sequence
  chemically synthesized
ccatctcaaaaaaaaaaaaa

SEQ ID NO: 71235 - DNA, 20 bp, Artificial Sequence
  chemically synthesized
tattacacatgttaatcctg

SEQ ID NO: 71236 - DNA, 20 bp, Artificial Sequence
  chemically synthesized
acatgttaatcctgcagaat

SEQ ID NO: 71237 - DNA, 20 bp, Artificial Sequence
  chemically synthesized
ctatcatacactcattctgc

SEQ ID NO: 71238 - DNA, 20 bp, Artificial Sequence
  chemically synthesized
cctatcatacactcattctg

SEQ ID NO: 71239 - DNA, 20 bp, Artificial Sequence
  chemically synthesized
cctgcagaatgagtgtatga

SEQ ID NO: 71240 - DNA, 20 bp, Artificial Sequence
  chemically synthesized
ctgcagaatgagtgtatgat

SEQ ID NO: 71241 - DNA, 20 bp, Artificial Sequence
  chemically synthesized
gagtgtatgataggaaaaac

SEQ ID NO: 71242 - DNA, 20 bp, Artificial Sequence
  chemically synthesized
ataggaaaaaccagaaaaaa

SEQ ID NO: 71243 - DNA, 20 bp, Artificial Sequence
  chemically synthesized
aacatctgtcctgttttttc

SEQ ID NO: 71244 - DNA, 20 bp, Artificial Sequence
  chemically synthesized
taggaaaaaccagaaaaaac

SEQ ID NO: 71245 - DNA, 20 bp, Artificial Sequence
  chemically synthesized
aaaaaccagaaaaaacagga

SEQ ID NO: 71246 - DNA, 20 bp, Artificial Sequence
  chemically synthesized
ctagggtgatatatagcaaa

SEQ ID NO: 71247 - DNA, 20 bp, Artificial Sequence
  chemically synthesized
tctagggtgatatatagcaa

SEQ ID NO: 71248 - DNA, 20 bp, Artificial Sequence
  chemically synthesized
gtaagttctagggtgatata

SEQ ID NO: 71249 - DNA, 20 bp, Artificial Sequence
  chemically synthesized
ccttttgctatatatcaccc

SEQ ID NO: 71250 - DNA, 20 bp, Artificial Sequence
  chemically synthesized
tttttagccagtaagttcta

SEQ ID NO: 71251 - DNA, 20 bp, Artificial Sequence
  chemically synthesized
atttttagccagtaagttct

SEQ ID NO: 71252 - DNA, 20 bp, Artificial Sequence
  chemically synthesized
tatttttagccagtaagttc

SEQ ID NO: 71253 - DNA, 20 bp, Artificial Sequence
  chemically synthesized
tatatcaccctagaacttac

SEQ ID NO: 71254 - DNA, 20 bp, Artificial Sequence
  chemically synthesized
aatggttatttttagccagt

SEQ ID NO: 71255 - DNA, 20 bp, Artificial Sequence
  chemically synthesized
gataaatggttatttttagc

SEQ ID NO: 71256 - DNA, 20 bp, Artificial Sequence
  chemically synthesized
tactgataaatggttatttt

SEQ ID NO: 71257 - DNA, 20 bp, Artificial Sequence
  chemically synthesized
ggctaaaaataaccatttat

SEQ ID NO: 71258 - DNA, 20 bp, Artificial Sequence
  chemically synthesized
ccatgagcaatactgataaa

SEQ ID NO: 71259 - DNA, 20 bp, Artificial Sequence
  chemically synthesized
ccatttatcagtattgctca

SEQ ID NO: 71260 - DNA, 20 bp, Artificial Sequence
  chemically synthesized
cagtcaactcacagaaccat

SEQ ID NO: 71261 - DNA, 20 bp, Artificial Sequence
  chemically synthesized
agtattgctcatggttctgt

SEQ ID NO: 71262 - DNA, 20 bp, Artificial Sequence
  chemically synthesized
acctgagcacagtcaactca

SEQ ID NO: 71263 - DNA, 20 bp, Artificial Sequence
  chemically synthesized
ttctgtgagttgactgtgct

SEQ ID NO: 71264 - DNA, 20 bp, Artificial Sequence
  chemically synthesized
tctgtgagttgactgtgctc

SEQ ID NO: 71265 - DNA, 20 bp, Artificial Sequence
  chemically synthesized
aagaaacacccacctgagca

SEQ ID NO: 71266 - DNA, 20 bp, Artificial Sequence
  chemically synthesized
gtgagttgactgtgctcagg

SEQ ID NO: 71267 - DNA, 20 bp, Artificial Sequence
  chemically synthesized
tgagttgactgtgctcaggt

SEQ ID NO: 71268 - DNA, 20 bp, Artificial Sequence
  chemically synthesized
caagcaagaaacacccacct

SEQ ID NO: 71269 - DNA, 20 bp, Artificial Sequence
  chemically synthesized
tcaggtgggtgtttcttgct

SEQ ID NO: 71270 - DNA, 20 bp, Artificial Sequence
  chemically synthesized
caggtgggtgtttcttgctt

SEQ ID NO: 71271 - DNA, 20 bp, Artificial Sequence
  chemically synthesized
acacatgaaagaacccaagc

SEQ ID NO: 71272 - DNA, 20 bp, Artificial Sequence
  chemically synthesized
gcaaacacatgaaagaaccc

SEQ ID NO: 71273 - DNA, 20 bp, Artificial Sequence
  chemically synthesized
atctgactgcaaacacatga

SEQ ID NO: 71274 - DNA, 20 bp, Artificial Sequence
  chemically synthesized
tgggttctttcatgtgtttg

SEQ ID NO: 71275 - DNA, 20 bp, Artificial Sequence
  chemically synthesized
ttctttcatgtgtttgcagt

SEQ ID NO: 71276 - DNA, 20 bp, Artificial Sequence
  chemically synthesized
ttcatgtgtttgcagtcaga

SEQ ID NO: 71277 - DNA, 20 bp, Artificial Sequence
  chemically synthesized
atgtgtttgcagtcagatag

SEQ ID NO: 71278 - DNA, 20 bp, Artificial Sequence
  chemically synthesized
ttgcagtcagatagtagcca

SEQ ID NO: 71279 - DNA, 20 bp, Artificial Sequence
  chemically synthesized
ccttcagatcaattcagctt

SEQ ID NO: 71280 - DNA, 20 bp, Artificial Sequence
  chemically synthesized
atggagccttcagatcaatt

SEQ ID NO: 71281 - DNA, 20 bp, Artificial Sequence
  chemically synthesized
gccaaagctgaattgatctg

SEQ ID NO: 71282 - DNA, 20 bp, Artificial Sequence
  chemically synthesized
ccaaagctgaattgatctga

SEQ ID NO: 71283 - DNA, 20 bp, Artificial Sequence
  chemically synthesized
agccattccaatggagcctt

SEQ ID NO: 71284 - DNA, 20 bp, Artificial Sequence
  chemically synthesized
aattgatctgaaggctccat

SEQ ID NO: 71285 - DNA, 20 bp, Artificial Sequence
  chemically synthesized
ctgtaacagccattccaatg

SEQ ID NO: 71286 - DNA, 20 bp, Artificial Sequence
  chemically synthesized
atctgaaggctccattggaa

SEQ ID NO: 71287 - DNA, 20 bp, Artificial Sequence
  chemically synthesized
aactgtaacagccattccaa

SEQ ID NO: 71288 - DNA, 20 bp, Artificial Sequence
  chemically synthesized
ctccattggaatggctgtta

SEQ ID NO: 71289 - DNA, 20 bp, Artificial Sequence
  chemically synthesized
tacaagtgaaaaaactgtaa

SEQ ID NO: 71290 - DNA, 20 bp, Artificial Sequence
  chemically synthesized
agttttttcacttgtacatc

SEQ ID NO: 71291 - DNA, 20 bp, Artificial Sequence
  chemically synthesized
aagtgaggagccagatgtac

SEQ ID NO: 71292 - DNA, 20 bp, Artificial Sequence
  chemically synthesized
agccatcccaagtgaggagc

SEQ ID NO: 71293 - DNA, 20 bp, Artificial Sequence
  chemically synthesized
tgtacatctggctcctcact

SEQ ID NO: 71294 - DNA, 20 bp, Artificial Sequence
  chemically synthesized
gtacatctggctcctcactt

SEQ ID NO: 71295 - DNA, 20 bp, Artificial Sequence
  chemically synthesized
ccgcagccatcccaagtgag

SEQ ID NO: 71296 - DNA, 20 bp, Artificial Sequence
  chemically synthesized
atccgcagccatcccaagtg

SEQ ID NO: 71297 - DNA, 20 bp, Artificial Sequence
  chemically synthesized
gatccgcagccatcccaagt

SEQ ID NO: 71298 - DNA, 20 bp, Artificial Sequence
  chemically synthesized
atctggctcctcacttggga

SEQ ID NO: 71299 - DNA, 20 bp, Artificial Sequence
  chemically synthesized
cgaagatccgcagccatccc

SEQ ID NO: 71300 - DNA, 20 bp, Artificial Sequence
  chemically synthesized
ctcctcacttgggatggctg

SEQ ID NO: 71301 - DNA, 20 bp, Artificial Sequence
  chemically synthesized
agctgttggccgaagatccg

SEQ ID NO: 71302 - DNA, 20 bp, Artificial Sequence
  chemically synthesized
ttgggatggctgcggatctt

SEQ ID NO: 71303 - DNA, 20 bp, Artificial Sequence
  chemically synthesized
ggctgcggatcttcggccaa

SEQ ID NO: 71304 - DNA, 20 bp, Artificial Sequence
  chemically synthesized
tagcccccagctgttggccg

SEQ ID NO: 71305 - DNA, 20 bp, Artificial Sequence
  chemically synthesized
gcggatcttcggccaacagc

SEQ ID NO: 71306 - DNA, 20 bp, Artificial Sequence
  chemically synthesized
cggatcttcggccaacagct

SEQ ID NO: 71307 - DNA, 20 bp, Artificial Sequence
  chemically synthesized
ggatcttcggccaacagctg

SEQ ID NO: 71308 - DNA, 20 bp, Artificial Sequence
  chemically synthesized
cgtggctagcccccagctgt

SEQ ID NO: 71309 - DNA, 20 bp, Artificial Sequence
  chemically synthesized
gatcttcggccaacagctgg

SEQ ID NO: 71310 - DNA, 20 bp, Artificial Sequence
  chemically synthesized
ttcggccaacagctgggggc

SEQ ID NO: 71311 - DNA, 20 bp, Artificial Sequence
  chemically synthesized
acaaatacgtggctagcccc

SEQ ID NO: 71312 - DNA, 20 bp, Artificial Sequence
  chemically synthesized
tggaaagacaaatacgtggc

SEQ ID NO: 71313 - DNA, 20 bp, Artificial Sequence
  chemically synthesized
tgcatggaaagacaaatacg

SEQ ID NO: 71314 - DNA, 20 bp, Artificial Sequence
  chemically synthesized
cacgtatttgtctttccatg

SEQ ID NO: 71315 - DNA, 20 bp, Artificial Sequence
  chemically synthesized
acatggggaagctgcatgga

SEQ ID NO: 71316 - DNA, 20 bp, Artificial Sequence
  chemically synthesized
agccacatggggaagctgca

SEQ ID NO: 71317 - DNA, 20 bp, Artificial Sequence
  chemically synthesized
ttccatgcagcttccccatg

SEQ ID NO: 71318 - DNA, 20 bp, Artificial Sequence
  chemically synthesized
tctaagctagccacatgggg

SEQ ID NO: 71319 - DNA, 20 bp, Artificial Sequence
  chemically synthesized
aaatctaagctagccacatg

SEQ ID NO: 71320 - DNA, 20 bp, Artificial Sequence
  chemically synthesized
atgcagcttccccatgtggc

SEQ ID NO: 71321 - DNA, 20 bp, Artificial Sequence
  chemically synthesized
caaatctaagctagccacat

SEQ ID NO: 71322 - DNA, 20 bp, Artificial Sequence
  chemically synthesized
acaaatctaagctagccaca

SEQ ID NO: 71323 - DNA, 20 bp, Artificial Sequence
  chemically synthesized
gcttccccatgtggctagct

SEQ ID NO: 71324 - DNA, 20 bp, Artificial Sequence
  chemically synthesized
aagaagccacaaatctaagc

SEQ ID NO: 71325 - DNA, 20 bp, Artificial Sequence
  chemically synthesized
atgtggctagcttagatttg

SEQ ID NO: 71326 - DNA, 20 bp, Artificial Sequence
  chemically synthesized
catgaagaagccacaaatct

SEQ ID NO: 71327 - DNA, 20 bp, Artificial Sequence
  chemically synthesized
agatttgtggcttcttcatg

SEQ ID NO: 71328 - DNA, 20 bp, Artificial Sequence
  chemically synthesized
actgtgctgtctacatgaag

SEQ ID NO: 71329 - DNA, 20 bp, Artificial Sequence
  chemically synthesized
gccactgtgctgtctacatg

SEQ ID NO: 71330 - DNA, 20 bp, Artificial Sequence
  chemically synthesized
ttgtggcttcttcatgtaga

SEQ ID NO: 71331 - DNA, 20 bp, Artificial Sequence
  chemically synthesized
gcttcttcatgtagacagca

SEQ ID NO: 71332 - DNA, 20 bp, Artificial Sequence
  chemically synthesized
tcttcatgtagacagcacag

SEQ ID NO: 71333 - DNA, 20 bp, Artificial Sequence
  chemically synthesized
tgtagacagcacagtggcct

SEQ ID NO: 71334 - DNA, 20 bp, Artificial Sequence
  chemically synthesized
tagacagcacagtggcctta

SEQ ID NO: 71335 - DNA, 20 bp, Artificial Sequence
  chemically synthesized
acagcacagtggccttagag

SEQ ID NO: 71336 - DNA, 20 bp, Artificial Sequence
  chemically synthesized
cctgtactaagtctactcta

SEQ ID NO: 71337 - DNA, 20 bp, Artificial Sequence
  chemically synthesized
ccctgtactaagtctactct

SEQ ID NO: 71338 - DNA, 20 bp, Artificial Sequence
  chemically synthesized
cagtggccttagagtagact

SEQ ID NO: 71339 - DNA, 20 bp, Artificial Sequence
  chemically synthesized
gccttagagtagacttagta

SEQ ID NO: 71340 - DNA, 20 bp, Artificial Sequence
  chemically synthesized
ccttagagtagacttagtac

SEQ ID NO: 71341 - DNA, 20 bp, Artificial Sequence
  chemically synthesized
cttagagtagacttagtaca

SEQ ID NO: 71342 - DNA, 20 bp, Artificial Sequence
  chemically synthesized
aaagtgatctgccctgtact

SEQ ID NO: 71343 - DNA, 20 bp, Artificial Sequence
  chemically synthesized
agagtagacttagtacaggg

SEQ ID NO: 71344 - DNA, 20 bp, Artificial Sequence
  chemically synthesized
acagggcagatcactttccc

SEQ ID NO: 71345 - DNA, 20 bp, Artificial Sequence
  chemically synthesized
agggcagatcactttcccca

SEQ ID NO: 71346 - DNA, 20 bp, Artificial Sequence
  chemically synthesized
tggaatgctcactctgggga

SEQ ID NO: 71347 - DNA, 20 bp, Artificial Sequence
  chemically synthesized
cagatcactttccccagagt

SEQ ID NO: 71348 - DNA, 20 bp, Artificial Sequence
  chemically synthesized
cttctggaatgctcactctg

SEQ ID NO: 71349 - DNA, 20 bp, Artificial Sequence
  chemically synthesized
tcttctggaatgctcactct

SEQ ID NO: 71350 - DNA, 20 bp, Artificial Sequence
  chemically synthesized
gtcttctggaatgctcactc

SEQ ID NO: 71351 - DNA, 20 bp, Artificial Sequence
  chemically synthesized
tttccccagagtgagcattc

SEQ ID NO: 71352 - DNA, 20 bp, Artificial Sequence
  chemically synthesized
ccccagagtgagcattccag

SEQ ID NO: 71353 - DNA, 20 bp, Artificial Sequence
  chemically synthesized
agtgagcattccagaagacc

SEQ ID NO: 71354 - DNA, 20 bp, Artificial Sequence
  chemically synthesized
tagcttctgtcttggtcttc

SEQ ID NO: 71355 - DNA, 20 bp, Artificial Sequence
  chemically synthesized
agcattccagaagaccaaga

SEQ ID NO: 71356 - DNA, 20 bp, Artificial Sequence
  chemically synthesized
attccagaagaccaagacag

SEQ ID NO: 71357 - DNA, 20 bp, Artificial Sequence
  chemically synthesized
gagtcttgtagcttctgtct

SEQ ID NO: 71358 - DNA, 20 bp, Artificial Sequence
  chemically synthesized
aagaccaagacagaagctac

SEQ ID NO: 71359 - DNA, 20 bp, Artificial Sequence
  chemically synthesized
ctaaataagaaggagtcttg

SEQ ID NO: 71360 - DNA, 20 bp, Artificial Sequence
  chemically synthesized
gttcaaagctaaataagaag

SEQ ID NO: 71361 - DNA, 20 bp, Artificial Sequence
  chemically synthesized
ctacaagactccttcttatt

SEQ ID NO: 71362 - DNA, 20 bp, Artificial Sequence
  chemically synthesized
aagttcaaagctaaataaga

SEQ ID NO: 71363 - DNA, 20 bp, Artificial Sequence
  chemically synthesized
gaagttcaaagctaaataag

SEQ ID NO: 71364 - DNA, 20 bp, Artificial Sequence
  chemically synthesized
caagaagttcaaagctaaat

SEQ ID NO: 71365 - DNA, 20 bp, Artificial Sequence
  chemically synthesized
ttgattctgcaagaagttca

SEQ ID NO: 71366 - DNA, 20 bp, Artificial Sequence
  chemically synthesized
atttagctttgaacttcttg

SEQ ID NO: 71367 - DNA, 20 bp, Artificial Sequence
  chemically synthesized
ggtagaattgattctgcaag

SEQ ID NO: 71368 - DNA, 20 bp, Artificial Sequence
  chemically synthesized
ggaggtagaattgattctgc

SEQ ID NO: 71369 - DNA, 20 bp, Artificial Sequence
  chemically synthesized
agaatcaattctacctcctt

SEQ ID NO: 71370 - DNA, 20 bp, Artificial Sequence
  chemically synthesized
gtacaacaaactgaaggagg

SEQ ID NO: 71371 - DNA, 20 bp, Artificial Sequence
  chemically synthesized
cctgtacaacaaactgaagg

SEQ ID NO: 71372 - DNA, 20 bp, Artificial Sequence
  chemically synthesized
tcctgtacaacaaactgaag

SEQ ID NO: 71373 - DNA, 20 bp, Artificial Sequence
  chemically synthesized
gctcctgtacaacaaactga

SEQ ID NO: 71374 - DNA, 20 bp, Artificial Sequence
  chemically synthesized
tgctcctgtacaacaaactg

SEQ ID NO: 71375 - DNA, 20 bp, Artificial Sequence
  chemically synthesized
acctccttcagtttgttgta

SEQ ID NO: 71376 - DNA, 20 bp, Artificial Sequence
  chemically synthesized
cctccttcagtttgttgtac

SEQ ID NO: 71377 - DNA, 20 bp, Artificial Sequence
  chemically synthesized
tccttcagtttgttgtacag

SEQ ID NO: 71378 - DNA, 20 bp, Artificial Sequence
  chemically synthesized
ttcagtttgttgtacaggag

SEQ ID NO: 71379 - DNA, 20 bp, Artificial Sequence
  chemically synthesized
tttgttgtacaggagcagcc

SEQ ID NO: 71380 - DNA, 20 bp, Artificial Sequence
  chemically synthesized
gtacaggagcagcccagatt

SEQ ID NO: 71381 - DNA, 20 bp, Artificial Sequence
  chemically synthesized
tagaggaacacaccaaatct

SEQ ID NO: 71382 - DNA, 20 bp, Artificial Sequence
  chemically synthesized
gtagaggaacacaccaaatc

SEQ ID NO: 71383 - DNA, 20 bp, Artificial Sequence
  chemically synthesized
tttggtgtgttcctctacac

SEQ ID NO: 71384 - DNA, 20 bp, Artificial Sequence
  chemically synthesized
ttggtgtgttcctctacaca

SEQ ID NO: 71385 - DNA, 20 bp, Artificial Sequence
  chemically synthesized
ggcaattgttccttgtgtag

SEQ ID NO: 71386 - DNA, 20 bp, Artificial Sequence
  chemically synthesized
aggcaattgttccttgtgta

SEQ ID NO: 71387 - DNA, 20 bp, Artificial Sequence
  chemically synthesized
ccaggcaattgttccttgtg

SEQ ID NO: 71388 - DNA, 20 bp, Artificial Sequence
  chemically synthesized
ctacacaaggaacaattgcc

SEQ ID NO: 71389 - DNA, 20 bp, Artificial Sequence
  chemically synthesized
acacaaggaacaattgcctg

SEQ ID NO: 71390 - DNA, 20 bp, Artificial Sequence
  chemically synthesized
tccctgtgaatcatgtctcc

SEQ ID NO: 71391 - DNA, 20 bp, Artificial Sequence
  chemically synthesized
ctccctgtgaatcatgtctc

SEQ ID NO: 71392 - DNA, 20 bp, Artificial Sequence
  chemically synthesized
ttgcctggagacatgattca

SEQ ID NO: 71393 - DNA, 20 bp, Artificial Sequence
  chemically synthesized
tgcctggagacatgattcac

SEQ ID NO: 71394 - DNA, 20 bp, Artificial Sequence
  chemically synthesized
gcctggagacatgattcaca

SEQ ID NO: 71395 - DNA, 20 bp, Artificial Sequence
  chemically synthesized
ctggagacatgattcacagg

SEQ ID NO: 71396 - DNA, 20 bp, Artificial Sequence
  chemically synthesized
tggagacatgattcacaggg

SEQ ID NO: 71397 - DNA, 20 bp, Artificial Sequence
  chemically synthesized
gagacatgattcacagggag

SEQ ID NO: 71398 - DNA, 20 bp, Artificial Sequence
  chemically synthesized
agacatgattcacagggagg

SEQ ID NO: 71399 - DNA, 20 bp, Artificial Sequence
  chemically synthesized
gacatgattcacagggagga

SEQ ID NO: 71400 - DNA, 20 bp, Artificial Sequence
  chemically synthesized
catgattcacagggaggagg

SEQ ID NO: 71401 - DNA, 20 bp, Artificial Sequence
  chemically synthesized
gggaggagggagtgccttcc

SEQ ID NO: 71402 - DNA, 20 bp, Artificial Sequence
  chemically synthesized
aggagggagtgccttcctag

SEQ ID NO: 71403 - DNA, 20 bp, Artificial Sequence
  chemically synthesized
ttatgatagctcttctagga

SEQ ID NO: 71404 - DNA, 20 bp, Artificial Sequence
  chemically synthesized
gagggagtgccttcctagaa

SEQ ID NO: 71405 - DNA, 20 bp, Artificial Sequence
  chemically synthesized
tttatgatagctcttctagg

SEQ ID NO: 71406 - DNA, 20 bp, Artificial Sequence
  chemically synthesized
ctttttatgatagctcttct

SEQ ID NO: 71407 - DNA, 20 bp, Artificial Sequence
  chemically synthesized
cctttttatgatagctcttc

SEQ ID NO: 71408 - DNA, 20 bp, Artificial Sequence
  chemically synthesized
cctagaagagctatcataaa

SEQ ID NO: 71409 - DNA, 20 bp, Artificial Sequence
  chemically synthesized
tcccacttacctttttatga

SEQ ID NO: 71410 - DNA, 20 bp, Artificial Sequence
  chemically synthesized
ctagaagagctatcataaaa

SEQ ID NO: 71411 - DNA, 20 bp, Artificial Sequence
  chemically synthesized
aagagctatcataaaaaggt

SEQ ID NO: 71412 - DNA, 20 bp, Artificial Sequence
  chemically synthesized
agctatcataaaaaggtaag

SEQ ID NO: 71413 - DNA, 20 bp, Artificial Sequence
  chemically synthesized
gctatcataaaaaggtaagt

SEQ ID NO: 71414 - DNA, 20 bp, Artificial Sequence
  chemically synthesized
ataaaaaggtaagtgggaaa

SEQ ID NO: 71415 - DNA, 20 bp, Artificial Sequence
  chemically synthesized
aggtaagtgggaaatggatt

SEQ ID NO: 71416 - DNA, 20 bp, Artificial Sequence
  chemically synthesized
aagtgggaaatggattcaga

SEQ ID NO: 71417 - DNA, 20 bp, Artificial Sequence
  chemically synthesized
gggaaatggattcagatggc

SEQ ID NO: 71418 - DNA, 20 bp, Artificial Sequence
  chemically synthesized
ggaaatggattcagatggct

SEQ ID NO: 71419 - DNA, 20 bp, Artificial Sequence
  chemically synthesized
aatggattcagatggctggg

SEQ ID NO: 71420 - DNA, 20 bp, Artificial Sequence
  chemically synthesized
tggattcagatggctgggaa

SEQ ID NO: 71421 - DNA, 20 bp, Artificial Sequence
  chemically synthesized
ggattcagatggctgggaag

SEQ ID NO: 71422 - DNA, 20 bp, Artificial Sequence
  chemically synthesized
gattcagatggctgggaaga

SEQ ID NO: 71423 - DNA, 20 bp, Artificial Sequence
  chemically synthesized
ctgccccatctccctcttcc

SEQ ID NO: 71424 - DNA, 20 bp, Artificial Sequence
  chemically synthesized
ttcagatggctgggaagagg

SEQ ID NO: 71425 - DNA, 20 bp, Artificial Sequence
  chemically synthesized
gatggctgggaagagggaga

SEQ ID NO: 71426 - DNA, 20 bp, Artificial Sequence
  chemically synthesized
atggctgggaagagggagat

SEQ ID NO: 71427 - DNA, 20 bp, Artificial Sequence
  chemically synthesized
tggctgggaagagggagatg

SEQ ID NO: 71428 - DNA, 20 bp, Artificial Sequence
  chemically synthesized
ctgggaagagggagatgggg

SEQ ID NO: 71429 - DNA, 20 bp, Artificial Sequence
  chemically synthesized
tggggcagttgctgtctaat

SEQ ID NO: 71430 - DNA, 20 bp, Artificial Sequence
  chemically synthesized
atttgaccacactaattaga

SEQ ID NO: 71431 - DNA, 20 bp, Artificial Sequence
  chemically synthesized
cagttgctgtctaattagtg

SEQ ID NO: 71432 - DNA, 20 bp, Artificial Sequence
  chemically synthesized
taaaatttgaccacactaat

SEQ ID NO: 71433 - DNA, 20 bp, Artificial Sequence
  chemically synthesized
aattagtgtggtcaaatttt

SEQ ID NO: 71434 - DNA, 20 bp, Artificial Sequence
  chemically synthesized
tagtgtggtcaaattttaag

SEQ ID NO: 71435 - DNA, 20 bp, Artificial Sequence
  chemically synthesized
agtgtggtcaaattttaaga

SEQ ID NO: 71436 - DNA, 20 bp, Artificial Sequence
  chemically synthesized
agaaggtttttttttttttt

SEQ ID NO: 71437 - DNA, 20 bp, Artificial Sequence
  chemically synthesized
gttttttttttttttaagtt

SEQ ID NO: 71438 - DNA, 20 bp, Artificial Sequence
  chemically synthesized
ttttaagttgagatttgaat

SEQ ID NO: 71439 - DNA, 20 bp, Artificial Sequence
  chemically synthesized
tgagatttgaataagacttg

SEQ ID NO: 71440 - DNA, 20 bp, Artificial Sequence
  chemically synthesized
gagatttgaataagacttga

SEQ ID NO: 71441 - DNA, 20 bp, Artificial Sequence
  chemically synthesized
ctaactctgtcatttccttc

SEQ ID NO: 71442 - DNA, 20 bp, Artificial Sequence
  chemically synthesized
ataagacttgaaggaaatga

SEQ ID NO: 71443 - DNA, 20 bp, Artificial Sequence
  chemically synthesized
aagacttgaaggaaatgaca

SEQ ID NO: 71444 - DNA, 20 bp, Artificial Sequence
  chemically synthesized
cttgaaggaaatgacagagt

SEQ ID NO: 71445 - DNA, 20 bp, Artificial Sequence
  chemically synthesized
aaatgacagagttagtcaca

SEQ ID NO: 71446 - DNA, 20 bp, Artificial Sequence
  chemically synthesized
gagttagtcacaaagatttc

SEQ ID NO: 71447 - DNA, 20 bp, Artificial Sequence
  chemically synthesized
gttagtcacaaagatttctg

SEQ ID NO: 71448 - DNA, 20 bp, Artificial Sequence
  chemically synthesized
gtcacaaagatttctggaga

SEQ ID NO: 71449 - DNA, 20 bp, Artificial Sequence
  chemically synthesized
tacctggaacattctttctc

SEQ ID NO: 71450 - DNA, 20 bp, Artificial Sequence
  chemically synthesized
tttctggagaaagaatgttc

SEQ ID NO: 71451 - DNA, 20 bp, Artificial Sequence
  chemically synthesized
ttctggagaaagaatgttcc

SEQ ID NO: 71452 - DNA, 20 bp, Artificial Sequence
  chemically synthesized
tggagaaagaatgttccagg

SEQ ID NO: 71453 - DNA, 20 bp, Artificial Sequence
  chemically synthesized
gcgtagttctttattctacc

SEQ ID NO: 71454 - DNA, 20 bp, Artificial Sequence
  chemically synthesized
agaatgttccaggtagaata

SEQ ID NO: 71455 - DNA, 20 bp, Artificial Sequence
  chemically synthesized
gtagaataaagaactacgca

SEQ ID NO: 71456 - DNA, 20 bp, Artificial Sequence
  chemically synthesized
ccttctccgggcactatgcg

SEQ ID NO: 71457 - DNA, 20 bp, Artificial Sequence
  chemically synthesized
aaagaactacgcatagtgcc

SEQ ID NO: 71458 - DNA, 20 bp, Artificial Sequence
  chemically synthesized
agaactacgcatagtgcccg

SEQ ID NO: 71459 - DNA, 20 bp, Artificial Sequence
  chemically synthesized
actacgcatagtgcccggag

SEQ ID NO: 71460 - DNA, 20 bp, Artificial Sequence
  chemically synthesized
ctacgcatagtgcccggaga

SEQ ID NO: 71461 - DNA, 20 bp, Artificial Sequence
  chemically synthesized
ctaaacaggcatccttctcc

SEQ ID NO: 71462 - DNA, 20 bp, Artificial Sequence
  chemically synthesized
actaaacaggcatccttctc

SEQ ID NO: 71463 - DNA, 20 bp, Artificial Sequence
  chemically synthesized
cccggagaaggatgcctgtt

SEQ ID NO: 71464 - DNA, 20 bp, Artificial Sequence
  chemically synthesized
tctcgtctagagaactaaac

SEQ ID NO: 71465 - DNA, 20 bp, Artificial Sequence
  chemically synthesized
ttctcgtctagagaactaaa

SEQ ID NO: 71466 - DNA, 20 bp, Artificial Sequence
  chemically synthesized
aggatgcctgtttagttctc

SEQ ID NO: 71467 - DNA, 20 bp, Artificial Sequence
  chemically synthesized
gcctgtttagttctctagac

SEQ ID NO: 71468 - DNA, 20 bp, Artificial Sequence
  chemically synthesized
agaaaggtttttctcgtcta

SEQ ID NO: 71469 - DNA, 20 bp, Artificial Sequence
  chemically synthesized
tgagaaaggtttttctcgtc

SEQ ID NO: 71470 - DNA, 20 bp, Artificial Sequence
  chemically synthesized
tagacgagaaaaacctttct

SEQ ID NO: 71471 - DNA, 20 bp, Artificial Sequence
  chemically synthesized
acgagaaaaacctttctcag

SEQ ID NO: 71472 - DNA, 20 bp, Artificial Sequence
  chemically synthesized
gctaagggaccttctgagaa

SEQ ID NO: 71473 - DNA, 20 bp, Artificial Sequence
  chemically synthesized
cgagaaaaacctttctcaga

SEQ ID NO: 71474 - DNA, 20 bp, Artificial Sequence
  chemically synthesized
agctaagggaccttctgaga

SEQ ID NO: 71475 - DNA, 20 bp, Artificial Sequence
  chemically synthesized
attcagctaagggaccttct

SEQ ID NO: 71476 - DNA, 20 bp, Artificial Sequence
  chemically synthesized
acctttctcagaaggtccct

SEQ ID NO: 71477 - DNA, 20 bp, Artificial Sequence
  chemically synthesized
tacaaagggcattcagctaa

SEQ ID NO: 71478 - DNA, 20 bp, Artificial Sequence
  chemically synthesized
atacaaagggcattcagcta

SEQ ID NO: 71479 - DNA, 20 bp, Artificial Sequence
  chemically synthesized
aatacaaagggcattcagct

SEQ ID NO: 71480 - DNA, 20 bp, Artificial Sequence
  chemically synthesized
aataaaatacaaagggcatt

SEQ ID NO: 71481 - DNA, 20 bp, Artificial Sequence
  chemically synthesized
tttaggtaataaaatacaaa

SEQ ID NO: 71482 - DNA, 20 bp, Artificial Sequence
  chemically synthesized
ttttaggtaataaaatacaa

SEQ ID NO: 71483 - DNA, 20 bp, Artificial Sequence
  chemically synthesized
attttaggtaataaaataca

SEQ ID NO: 71484 - DNA, 20 bp, Artificial Sequence
  chemically synthesized
tggtcatattacgcaatttt

SEQ ID NO: 71485 - DNA, 20 bp, Artificial Sequence
  chemically synthesized
atggtcatattacgcaattt

SEQ ID NO: 71486 - DNA, 20 bp, Artificial Sequence
  chemically synthesized
gccctcttcggaattggaca

SEQ ID NO: 71487 - DNA, 20 bp, Artificial Sequence
  chemically synthesized
tatgaccatgtccaattccg

SEQ ID NO: 71488 - DNA, 20 bp, Artificial Sequence
  chemically synthesized
ttgattgccctcttcggaat

SEQ ID NO: 71489 - DNA, 20 bp, Artificial Sequence
  chemically synthesized
tgaccatgtccaattccgaa

SEQ ID NO: 71490 - DNA, 20 bp, Artificial Sequence
  chemically synthesized
gaccatgtccaattccgaag

SEQ ID NO: 71491 - DNA, 20 bp, Artificial Sequence
  chemically synthesized
accatgtccaattccgaaga

SEQ ID NO: 71492 - DNA, 20 bp, Artificial Sequence
  chemically synthesized
gcagtcttgattgccctctt

SEQ ID NO: 71493 - DNA, 20 bp, Artificial Sequence
  chemically synthesized
caattccgaagagggcaatc

SEQ ID NO: 71494 - DNA, 20 bp, Artificial Sequence
  chemically synthesized
aagagggcaatcaagactgc

SEQ ID NO: 71495 - DNA, 20 bp, Artificial Sequence
  chemically synthesized
gagggcaatcaagactgcga

SEQ ID NO: 71496 - DNA, 20 bp, Artificial Sequence
  chemically synthesized
gctatttcatggtgctctcg

SEQ ID NO: 71497 - DNA, 20 bp, Artificial Sequence
  chemically synthesized
actgcgagagcaccatgaaa

SEQ ID NO: 71498 - DNA, 20 bp, Artificial Sequence
  chemically synthesized
gatagtcctgagctatttca

SEQ ID NO: 71499 - DNA, 20 bp, Artificial Sequence
  chemically synthesized
gagagcaccatgaaatagct

SEQ ID NO: 71500 - DNA, 20 bp, Artificial Sequence
  chemically synthesized
agagcaccatgaaatagctc

SEQ ID NO: 71501 - DNA, 20 bp, Artificial Sequence
  chemically synthesized
gaatacataatgatagtcct

SEQ ID NO: 71502 - DNA, 20 bp, Artificial Sequence
  chemically synthesized
cccaagggaatacataatga

SEQ ID NO: 71503 - DNA, 20 bp, Artificial Sequence
  chemically synthesized
actatcattatgtattccct

SEQ ID NO: 71504 - DNA, 20 bp, Artificial Sequence
  chemically synthesized
ctatcattatgtattccctt

SEQ ID NO: 71505 - DNA, 20 bp, Artificial Sequence
  chemically synthesized
cattatgtattcccttgggt

SEQ ID NO: 71506 - DNA, 20 bp, Artificial Sequence
  chemically synthesized
attatgtattcccttgggtt

SEQ ID NO: 71507 - DNA, 20 bp, Artificial Sequence
  chemically synthesized
caagggaagccccaacccaa

SEQ ID NO: 71508 - DNA, 20 bp, Artificial Sequence
  chemically synthesized
ttatgtattcccttgggttg

SEQ ID NO: 71509 - DNA, 20 bp, Artificial Sequence
  chemically synthesized
tcaagggaagccccaaccca

SEQ ID NO: 71510 - DNA, 20 bp, Artificial Sequence
  chemically synthesized
atcaagggaagccccaaccc

SEQ ID NO: 71511 - DNA, 20 bp, Artificial Sequence
  chemically synthesized
catatcatgtgcatcaaggg

SEQ ID NO: 71512 - DNA, 20 bp, Artificial Sequence
  chemically synthesized
ctgcatatcatgtgcatcaa

SEQ ID NO: 71513 - DNA, 20 bp, Artificial Sequence
  chemically synthesized
tctgcatatcatgtgcatca

SEQ ID NO: 71514 - DNA, 20 bp, Artificial Sequence
  chemically synthesized
ctctgcatatcatgtgcatc

SEQ ID NO: 71515 - DNA, 20 bp, Artificial Sequence
  chemically synthesized
cccttgatgcacatgatatg

SEQ ID NO: 71516 - DNA, 20 bp, Artificial Sequence
  chemically synthesized
cttgatgcacatgatatgca

SEQ ID NO: 71517 - DNA, 20 bp, Artificial Sequence
  chemically synthesized
ttgatgcacatgatatgcag

SEQ ID NO: 71518 - DNA, 20 bp, Artificial Sequence
  chemically synthesized
gatgcacatgatatgcagag

SEQ ID NO: 71519 - DNA, 20 bp, Artificial Sequence
  chemically synthesized
atgcacatgatatgcagagg

SEQ ID NO: 71520 - DNA, 20 bp, Artificial Sequence
  chemically synthesized
tgcacatgatatgcagagga

SEQ ID NO: 71521 - DNA, 20 bp, Artificial Sequence
  chemically synthesized
acatgatatgcagaggaggg

SEQ ID NO: 71522 - DNA, 20 bp, Artificial Sequence
  chemically synthesized
gaggagggtagatcctcaac

SEQ ID NO: 71523 - DNA, 20 bp, Artificial Sequence
  chemically synthesized
ggcagccaccaggcttgttg

SEQ ID NO: 71524 - DNA, 20 bp, Artificial Sequence
  chemically synthesized
tggcagccaccaggcttgtt

SEQ ID NO: 71525 - DNA, 20 bp, Artificial Sequence
  chemically synthesized
gggtagatcctcaacaagcc

SEQ ID NO: 71526 - DNA, 20 bp, Artificial Sequence
  chemically synthesized
tagatcctcaacaagcctgg

SEQ ID NO: 71527 - DNA, 20 bp, Artificial Sequence
  chemically synthesized
ctcctttgctggcagccacc

SEQ ID NO: 71528 - DNA, 20 bp, Artificial Sequence
  chemically synthesized
tctcctttgctggcagccac

SEQ ID NO: 71529 - DNA, 20 bp, Artificial Sequence
  chemically synthesized
tcaacaagcctggtggctgc

SEQ ID NO: 71530 - DNA, 20 bp, Artificial Sequence
  chemically synthesized
aagcctggtggctgccagca

SEQ ID NO: 71531 - DNA, 20 bp, Artificial Sequence
  chemically synthesized
agcctggtggctgccagcaa

SEQ ID NO: 71532 - DNA, 20 bp, Artificial Sequence
  chemically synthesized
acacccttctcctttgctgg

SEQ ID NO: 71533 - DNA, 20 bp, Artificial Sequence
  chemically synthesized
cctggtggctgccagcaaag

SEQ ID NO: 71534 - DNA, 20 bp, Artificial Sequence
  chemically synthesized
tatacacccttctcctttgc

SEQ ID NO: 71535 - DNA, 20 bp, Artificial Sequence
  chemically synthesized
ggtggctgccagcaaaggag

SEQ ID NO: 71536 - DNA, 20 bp, Artificial Sequence
  chemically synthesized
gtggctgccagcaaaggaga

SEQ ID NO: 71537 - DNA, 20 bp, Artificial Sequence
  chemically synthesized
tggctgccagcaaaggagaa

SEQ ID NO: 71538 - DNA, 20 bp, Artificial Sequence
  chemically synthesized
gcaaaggagaagggtgtata

SEQ ID NO: 71539 - DNA, 20 bp, Artificial Sequence
  chemically synthesized
agggtgtatatggacacatt

SEQ ID NO: 71540 - DNA, 20 bp, Artificial Sequence
  chemically synthesized
gggtgtatatggacacattt

SEQ ID NO: 71541 - DNA, 20 bp, Artificial Sequence
  chemically synthesized
ggtgtatatggacacatttg

SEQ ID NO: 71542 - DNA, 20 bp, Artificial Sequence
  chemically synthesized
atatggacacatttggggaa

SEQ ID NO: 71543 - DNA, 20 bp, Artificial Sequence
  chemically synthesized
acatttggggaaaagaaaac

SEQ ID NO: 71544 - DNA, 20 bp, Artificial Sequence
  chemically synthesized
atttggggaaaagaaaacaa

SEQ ID NO: 71545 - DNA, 20 bp, Artificial Sequence
  chemically synthesized
tccccagggtgtggggaaga

SEQ ID NO: 71546 - DNA, 20 bp, Artificial Sequence
  chemically synthesized
ttaatccccagggtgtgggg

SEQ ID NO: 71547 - DNA, 20 bp, Artificial Sequence
  chemically synthesized
tatctttcttccccacaccc

SEQ ID NO: 71548 - DNA, 20 bp, Artificial Sequence
  chemically synthesized
tgtttaatccccagggtgtg

SEQ ID NO: 71549 - DNA, 20 bp, Artificial Sequence
  chemically synthesized
atctttcttccccacaccct

SEQ ID NO: 71550 - DNA, 20 bp, Artificial Sequence
  chemically synthesized
ttgtttaatccccagggtgt

SEQ ID NO: 71551 - DNA, 20 bp, Artificial Sequence
  chemically synthesized
tctttcttccccacaccctg

SEQ ID NO: 71552 - DNA, 20 bp, Artificial Sequence
  chemically synthesized
attgtttaatccccagggtg

SEQ ID NO: 71553 - DNA, 20 bp, Artificial Sequence
  chemically synthesized
ggagtattgtttaatcccca

SEQ ID NO: 71554 - DNA, 20 bp, Artificial Sequence
  chemically synthesized
aggagtattgtttaatcccc

SEQ ID NO: 71555 - DNA, 20 bp, Artificial Sequence
  chemically synthesized
aaggagtattgtttaatccc

SEQ ID NO: 71556 - DNA, 20 bp, Artificial Sequence
  chemically synthesized
ggattaaacaatactccttt

SEQ ID NO: 71557 - DNA, 20 bp, Artificial Sequence
  chemically synthesized
gattaaacaatactcctttt

SEQ ID NO: 71558 - DNA, 20 bp, Artificial Sequence
  chemically synthesized
ctgttagacaggcccaaaag

SEQ ID NO: 71559 - DNA, 20 bp, Artificial Sequence
  chemically synthesized
tcctgttagacaggcccaaa

SEQ ID NO: 71560 - DNA, 20 bp, Artificial Sequence
  chemically synthesized
gtcctgttagacaggcccaa

SEQ ID NO: 71561 - DNA, 20 bp, Artificial Sequence
  chemically synthesized
ctccttttgggcctgtctaa

SEQ ID NO: 71562 - DNA, 20 bp, Artificial Sequence
  chemically synthesized
tccttttgggcctgtctaac

SEQ ID NO: 71563 - DNA, 20 bp, Artificial Sequence
  chemically synthesized
gatgagttgtcctgttagac

SEQ ID NO: 71564 - DNA, 20 bp, Artificial Sequence
  chemically synthesized
ggatgagttgtcctgttaga

SEQ ID NO: 71565 - DNA, 20 bp, Artificial Sequence
  chemically synthesized
aatgggatgagttgtcctgt

SEQ ID NO: 71566 - DNA, 20 bp, Artificial Sequence
  chemically synthesized
tagggctgggaaaatgggat

SEQ ID NO: 71567 - DNA, 20 bp, Artificial Sequence
  chemically synthesized
gacaactcatcccattttcc

SEQ ID NO: 71568 - DNA, 20 bp, Artificial Sequence
  chemically synthesized
ggatctagggctgggaaaat

SEQ ID NO: 71569 - DNA, 20 bp, Artificial Sequence
  chemically synthesized
aggatctagggctgggaaaa

SEQ ID NO: 71570 - DNA, 20 bp, Artificial Sequence
  chemically synthesized
tcatcccattttcccagccc

SEQ ID NO: 71571 - DNA, 20 bp, Artificial Sequence
  chemically synthesized
gatagtcaggatctagggct

SEQ ID NO: 71572 - DNA, 20 bp, Artificial Sequence
  chemically synthesized
tgatagtcaggatctagggc

SEQ ID NO: 71573 - DNA, 20 bp, Artificial Sequence
  chemically synthesized
ctgctgatagtcaggatcta

SEQ ID NO: 71574 - DNA, 20 bp, Artificial Sequence
  chemically synthesized
tctgctgatagtcaggatct

SEQ ID NO: 71575 - DNA, 20 bp, Artificial Sequence
  chemically synthesized
ctctgctgatagtcaggatc

SEQ ID NO: 71576 - DNA, 20 bp, Artificial Sequence
  chemically synthesized
cagccctagatcctgactat

SEQ ID NO: 71577 - DNA, 20 bp, Artificial Sequence
  chemically synthesized
agaattctctgctgatagtc

SEQ ID NO: 71578 - DNA, 20 bp, Artificial Sequence
  chemically synthesized
aagaattctctgctgatagt

SEQ ID NO: 71579 - DNA, 20 bp, Artificial Sequence
  chemically synthesized
ccctagatcctgactatcag

SEQ ID NO: 71580 - DNA, 20 bp, Artificial Sequence
  chemically synthesized
ctagatcctgactatcagca

SEQ ID NO: 71581 - DNA, 20 bp, Artificial Sequence
  chemically synthesized
gcacaagaattctctgctga

SEQ ID NO: 71582 - DNA, 20 bp, Artificial Sequence
  chemically synthesized
cagcagagaattcttgtgct

SEQ ID NO: 71583 - DNA, 20 bp, Artificial Sequence
  chemically synthesized
tctgctcttacaccaagcac

SEQ ID NO: 71584 - DNA, 20 bp, Artificial Sequence
  chemically synthesized
agaattcttgtgcttggtgt

SEQ ID NO: 71585 - DNA, 20 bp, Artificial Sequence
  chemically synthesized
aattcttgtgcttggtgtaa

SEQ ID NO: 71586 - DNA, 20 bp, Artificial Sequence
  chemically synthesized
gccttttctgctcttacacc

SEQ ID NO: 71587 - DNA, 20 bp, Artificial Sequence
  chemically synthesized
tcttgtgcttggtgtaagag

SEQ ID NO: 71588 - DNA, 20 bp, Artificial Sequence
  chemically synthesized
tgcttggtgtaagagcagaa

SEQ ID NO: 71589 - DNA, 20 bp, Artificial Sequence
  chemically synthesized
gcttggtgtaagagcagaaa

SEQ ID NO: 71590 - DNA, 20 bp, Artificial Sequence
  chemically synthesized
ggtgtaagagcagaaaaggc

SEQ ID NO: 71591 - DNA, 20 bp, Artificial Sequence
  chemically synthesized
taagagcagaaaaggctgga

SEQ ID NO: 71592 - DNA, 20 bp, Artificial Sequence
  chemically synthesized
aagagcagaaaaggctggaa

SEQ ID NO: 71593 - DNA, 20 bp, Artificial Sequence
  chemically synthesized
agcagaaaaggctggaaagg

SEQ ID NO: 71594 - DNA, 20 bp, Artificial Sequence
  chemically synthesized
ggtcattatcgctgcctttc

SEQ ID NO: 71595 - DNA, 20 bp, Artificial Sequence
  chemically synthesized
ggaaaggcagcgataatgac

SEQ ID NO: 71596 - DNA, 20 bp, Artificial Sequence
  chemically synthesized
gaaaggcagcgataatgacc

SEQ ID NO: 71597 - DNA, 20 bp, Artificial Sequence
  chemically synthesized
gcagcgataatgaccaggat

SEQ ID NO: 71598 - DNA, 20 bp, Artificial Sequence
  chemically synthesized
ggtgagttagatgctgatcc

SEQ ID NO: 71599 - DNA, 20 bp, Artificial Sequence
  chemically synthesized
ggatcagcatctaactcacc

SEQ ID NO: 71600 - DNA, 20 bp, Artificial Sequence
  chemically synthesized
ccctttgccactgggtgagt

SEQ ID NO: 71601 - DNA, 20 bp, Artificial Sequence
  chemically synthesized
tcagcatctaactcacccag

SEQ ID NO: 71602 - DNA, 20 bp, Artificial Sequence
  chemically synthesized
tggcccctttgccactgggt

SEQ ID NO: 71603 - DNA, 20 bp, Artificial Sequence
  chemically synthesized
atctaactcacccagtggca

SEQ ID NO: 71604 - DNA, 20 bp, Artificial Sequence
  chemically synthesized
gtggtggcccctttgccact

SEQ ID NO: 71605 - DNA, 20 bp, Artificial Sequence
  chemically synthesized
tctaactcacccagtggcaa

SEQ ID NO: 71606 - DNA, 20 bp, Artificial Sequence
  chemically synthesized
ggtggtggcccctttgccac

SEQ ID NO: 71607 - DNA, 20 bp, Artificial Sequence
  chemically synthesized
ctaactcacccagtggcaaa

SEQ ID NO: 71608 - DNA, 20 bp, Artificial Sequence
  chemically synthesized
taactcacccagtggcaaag

SEQ ID NO: 71609 - DNA, 20 bp, Artificial Sequence
  chemically synthesized
ggcaaaggggccaccaccca

SEQ ID NO: 71610 - DNA, 20 bp, Artificial Sequence
  chemically synthesized
tttaaaccttctgtgggtgg

SEQ ID NO: 71611 - DNA, 20 bp, Artificial Sequence
  chemically synthesized
aaaggggccaccacccacag

SEQ ID NO: 71612 - DNA, 20 bp, Artificial Sequence
  chemically synthesized
acttttaaaccttctgtggg

SEQ ID NO: 71613 - DNA, 20 bp, Artificial Sequence
  chemically synthesized
aaggggccaccacccacaga

SEQ ID NO: 71614 - DNA, 20 bp, Artificial Sequence
  chemically synthesized
tacacttttaaaccttctgt

SEQ ID NO: 71615 - DNA, 20 bp, Artificial Sequence
  chemically synthesized
gtacacttttaaaccttctg

SEQ ID NO: 71616 - DNA, 20 bp, Artificial Sequence
  chemically synthesized
accacccacagaaggtttaa

SEQ ID NO: 71617 - DNA, 20 bp, Artificial Sequence
  chemically synthesized
gtttaaaagtgtacactcaa

SEQ ID NO: 71618 - DNA, 20 bp, Artificial Sequence
  chemically synthesized
aaagtgtacactcaacagat

SEQ ID NO: 71619 - DNA, 20 bp, Artificial Sequence
  chemically synthesized
ctacctactgcttatctgtt

SEQ ID NO: 71620 - DNA, 20 bp, Artificial Sequence
  chemically synthesized
gtgtacactcaacagataag

SEQ ID NO: 71621 - DNA, 20 bp, Artificial Sequence
  chemically synthesized
tacactcaacagataagcag

SEQ ID NO: 71622 - DNA, 20 bp, Artificial Sequence
  chemically synthesized
acactcaacagataagcagt

SEQ ID NO: 71623 - DNA, 20 bp, Artificial Sequence
  chemically synthesized
ctcaacagataagcagtagg

SEQ ID NO: 71624 - DNA, 20 bp, Artificial Sequence
  chemically synthesized
gcagtaggtagcattcataa

SEQ ID NO: 71625 - DNA, 20 bp, Artificial Sequence
  chemically synthesized
cagtaggtagcattcataat

SEQ ID NO: 71626 - DNA, 20 bp, Artificial Sequence
  chemically synthesized
atgggaaaatatgactctga

SEQ ID NO: 71627 - DNA, 20 bp, Artificial Sequence
  chemically synthesized
cacataaaaattttctttca

SEQ ID NO: 71628 - DNA, 20 bp, Artificial Sequence
  chemically synthesized
gccacataaaaattttcttt

SEQ ID NO: 71629 - DNA, 20 bp, Artificial Sequence
  chemically synthesized
tctgaaagaaaatttttatg

SEQ ID NO: 71630 - DNA, 20 bp, Artificial Sequence
  chemically synthesized
gaaaatttttatgtggcact

SEQ ID NO: 71631 - DNA, 20 bp, Artificial Sequence
  chemically synthesized
tcatgcatctcaaagtatct

SEQ ID NO: 71632 - DNA, 20 bp, Artificial Sequence
  chemically synthesized
atgtggcactgagatacttt

SEQ ID NO: 71633 - DNA, 20 bp, Artificial Sequence
  chemically synthesized
ttcattgatcatgcatctca

SEQ ID NO: 71634 - DNA, 20 bp, Artificial Sequence
  chemically synthesized
tttgagatgcatgatcaatg

SEQ ID NO: 71635 - DNA, 20 bp, Artificial Sequence
  chemically synthesized
ttgagatgcatgatcaatga

SEQ ID NO: 71636 - DNA, 20 bp, Artificial Sequence
  chemically synthesized
tcaatgaaggacctaattca

SEQ ID NO: 71637 - DNA, 20 bp, Artificial Sequence
  chemically synthesized
aatgttaccctctttgaatt

SEQ ID NO: 71638 - DNA, 20 bp, Artificial Sequence
  chemically synthesized
aatgaaggacctaattcaaa

SEQ ID NO: 71639 - DNA, 20 bp, Artificial Sequence
  chemically synthesized
taatgttaccctctttgaat

SEQ ID NO: 71640 - DNA, 20 bp, Artificial Sequence
  chemically synthesized
atgaaggacctaattcaaag

SEQ ID NO: 71641 - DNA, 20 bp, Artificial Sequence
  chemically synthesized
tgaaggacctaattcaaaga

SEQ ID NO: 71642 - DNA, 20 bp, Artificial Sequence
  chemically synthesized
agggtaacattaaaattccc

SEQ ID NO: 71643 - DNA, 20 bp, Artificial Sequence
  chemically synthesized
aacattaaaattcccaagta

SEQ ID NO: 71644 - DNA, 20 bp, Artificial Sequence
  chemically synthesized
tttgtggctgtgctgtactt

SEQ ID NO: 71645 - DNA, 20 bp, Artificial Sequence
  chemically synthesized
ttttgtggctgtgctgtact

SEQ ID NO: 71646 - DNA, 20 bp, Artificial Sequence
  chemically synthesized
taaaattcccaagtacagca

SEQ ID NO: 71647 - DNA, 20 bp, Artificial Sequence
  chemically synthesized
caagtacagcacagccacaa

SEQ ID NO: 71648 - DNA, 20 bp, Artificial Sequence
  chemically synthesized
ccatgtggctacagcttttg

SEQ ID NO: 71649 - DNA, 20 bp, Artificial Sequence
  chemically synthesized
cagcacagccacaaaagctg

SEQ ID NO: 71650 - DNA, 20 bp, Artificial Sequence
  chemically synthesized
taaagttgcccatgtggcta

SEQ ID NO: 71651 - DNA, 20 bp, Artificial Sequence
  chemically synthesized
ccacaaaagctgtagccaca

SEQ ID NO: 71652 - DNA, 20 bp, Artificial Sequence
  chemically synthesized
cacaaaagctgtagccacat

SEQ ID NO: 71653 - DNA, 20 bp, Artificial Sequence
  chemically synthesized
gggcagtaaagttgcccatg

SEQ ID NO: 71654 - DNA, 20 bp, Artificial Sequence
  chemically synthesized
cttaaactgtaggggcagta

SEQ ID NO: 71655 - DNA, 20 bp, Artificial Sequence
  chemically synthesized
gggcaactttactgccccta

SEQ ID NO: 71656 - DNA, 20 bp, Artificial Sequence
  chemically synthesized
agacacttaaactgtagggg

SEQ ID NO: 71657 - DNA, 20 bp, Artificial Sequence
  chemically synthesized
atcagacacttaaactgtag

SEQ ID NO: 71658 - DNA, 20 bp, Artificial Sequence
  chemically synthesized
catcagacacttaaactgta

SEQ ID NO: 71659 - DNA, 20 bp, Artificial Sequence
  chemically synthesized
ctttactgcccctacagttt

SEQ ID NO: 71660 - DNA, 20 bp, Artificial Sequence
  chemically synthesized
ccatcagacacttaaactgt

SEQ ID NO: 71661 - DNA, 20 bp, Artificial Sequence
  chemically synthesized
cccatcagacacttaaactg

SEQ ID NO: 71662 - DNA, 20 bp, Artificial Sequence
  chemically synthesized
cctacagtttaagtgtctga

SEQ ID NO: 71663 - DNA, 20 bp, Artificial Sequence
  chemically synthesized
ctacagtttaagtgtctgat

SEQ ID NO: 71664 - DNA, 20 bp, Artificial Sequence
  chemically synthesized
cttaggtctggcattcccat

SEQ ID NO: 71665 - DNA, 20 bp, Artificial Sequence
  chemically synthesized
taagtgtctgatgggaatgc

SEQ ID NO: 71666 - DNA, 20 bp, Artificial Sequence
  chemically synthesized
ctgatgggaatgccagacct

SEQ ID NO: 71667 - DNA, 20 bp, Artificial Sequence
  chemically synthesized
ccaattccaattcttaggtc

SEQ ID NO: 71668 - DNA, 20 bp, Artificial Sequence
  chemically synthesized
ggaatgccagacctaagaat

SEQ ID NO: 71669 - DNA, 20 bp, Artificial Sequence
  chemically synthesized
gacccccaattccaattctt

SEQ ID NO: 71670 - DNA, 20 bp, Artificial Sequence
  chemically synthesized
ggacccccaattccaattct

SEQ ID NO: 71671 - DNA, 20 bp, Artificial Sequence
  chemically synthesized
ccagacctaagaattggaat

SEQ ID NO: 71672 - DNA, 20 bp, Artificial Sequence
  chemically synthesized
cagacctaagaattggaatt

SEQ ID NO: 71673 - DNA, 20 bp, Artificial Sequence
  chemically synthesized
agacctaagaattggaattg

SEQ ID NO: 71674 - DNA, 20 bp, Artificial Sequence
  chemically synthesized
gacctaagaattggaattgg

SEQ ID NO: 71675 - DNA, 20 bp, Artificial Sequence
  chemically synthesized
taacttgcttcaaacaagtc

SEQ ID NO: 71676 - DNA, 20 bp, Artificial Sequence
  chemically synthesized
ttaacttgcttcaaacaagt

SEQ ID NO: 71677 - DNA, 20 bp, Artificial Sequence
  chemically synthesized
tgggggtcctgacttgtttg

SEQ ID NO: 71678 - DNA, 20 bp, Artificial Sequence
  chemically synthesized
gaccttaacttgcttcaaac

SEQ ID NO: 71679 - DNA, 20 bp, Artificial Sequence
  chemically synthesized
ggtcctgacttgtttgaagc

SEQ ID NO: 71680 - DNA, 20 bp, Artificial Sequence
  chemically synthesized
tgacttgtttgaagcaagtt

SEQ ID NO: 71681 - DNA, 20 bp, Artificial Sequence
  chemically synthesized
gacttgtttgaagcaagtta

SEQ ID NO: 71682 - DNA, 20 bp, Artificial Sequence
  chemically synthesized
aaaaaaaaaaaaaaaaaaaa

SEQ ID NO: 71683 - DNA, 20 bp, Artificial Sequence
  chemically synthesized
tttttttttttttttttttt

SEQ ID NO: 71684 - DNA, 20 bp, Artificial Sequence
  chemically synthesized
ttttttttttttttttttga

SEQ ID NO: 71685 - DNA, 20 bp, Artificial Sequence
  chemically synthesized
tttttttttttttttttgag

SEQ ID NO: 71686 - DNA, 20 bp, Artificial Sequence
  chemically synthesized
ttttttttttttttttgaga

SEQ ID NO: 71687 - DNA, 20 bp, Artificial Sequence
  chemically synthesized
ttttttttttttttgagagg

SEQ ID NO: 71688 - DNA, 20 bp, Artificial Sequence
  chemically synthesized
ctccagactggtgacagagt

SEQ ID NO: 71689 - DNA, 20 bp, Artificial Sequence
  chemically synthesized
agggagtctcactctgtcac

SEQ ID NO: 71690 - DNA, 20 bp, Artificial Sequence
  chemically synthesized
tgcactccagactggtgaca

SEQ ID NO: 71691 - DNA, 20 bp, Artificial Sequence
  chemically synthesized
actgcactccagactggtga

SEQ ID NO: 71692 - DNA, 20 bp, Artificial Sequence
  chemically synthesized
gtctcactctgtcaccagtc

SEQ ID NO: 71693 - DNA, 20 bp, Artificial Sequence
  chemically synthesized
ctcactctgtcaccagtctg

SEQ ID NO: 71694 - DNA, 20 bp, Artificial Sequence
  chemically synthesized
catgccactgcactccagac

SEQ ID NO: 71695 - DNA, 20 bp, Artificial Sequence
  chemically synthesized
tctgtcaccagtctggagtg

SEQ ID NO: 71696 - DNA, 20 bp, Artificial Sequence
  chemically synthesized
gagatcatgccactgcactc

SEQ ID NO: 71697 - DNA, 20 bp, Artificial Sequence
  chemically synthesized
gtcaccagtctggagtgcag

SEQ ID NO: 71698 - DNA, 20 bp, Artificial Sequence
  chemically synthesized
ggagtgcagtggcatgatct

SEQ ID NO: 71699 - DNA, 20 bp, Artificial Sequence
  chemically synthesized
ggcggagcttgcagtgagct

SEQ ID NO: 71700 - DNA, 20 bp, Artificial Sequence
  chemically synthesized
gcatgatctcagctcactgc

SEQ ID NO: 71701 - DNA, 20 bp, Artificial Sequence
  chemically synthesized
tgggaggcggagcttgcagt

SEQ ID NO: 71702 - DNA, 20 bp, Artificial Sequence
  chemically synthesized
aacctgggaggcggagcttg

SEQ ID NO: 71703 - DNA, 20 bp, Artificial Sequence
  chemically synthesized
tcactgcaagctccgcctcc

SEQ ID NO: 71704 - DNA, 20 bp, Artificial Sequence
  chemically synthesized
tggcatgaacctgggaggcg

SEQ ID NO: 71705 - DNA, 20 bp, Artificial Sequence
  chemically synthesized
cactgcaagctccgcctccc

SEQ ID NO: 71706 - DNA, 20 bp, Artificial Sequence
  chemically synthesized
aatggcatgaacctgggagg

SEQ ID NO: 71707 - DNA, 20 bp, Artificial Sequence
  chemically synthesized
gagaatggcatgaacctggg

SEQ ID NO: 71708 - DNA, 20 bp, Artificial Sequence
  chemically synthesized
ggagaatggcatgaacctgg

SEQ ID NO: 71709 - DNA, 20 bp, Artificial Sequence
  chemically synthesized
ctggagaatggcatgaacct

SEQ ID NO: 71710 - DNA, 20 bp, Artificial Sequence
  chemically synthesized
gctggagaatggcatgaacc

SEQ ID NO: 71711 - DNA, 20 bp, Artificial Sequence
  chemically synthesized
cccaggttcatgccattctc

SEQ ID NO: 71712 - DNA, 20 bp, Artificial Sequence
  chemically synthesized
gggaggctgaggctggagaa

SEQ ID NO: 71713 - DNA, 20 bp, Artificial Sequence
  chemically synthesized
ttcatgccattctccagcct

SEQ ID NO: 71714 - DNA, 20 bp, Artificial Sequence
  chemically synthesized
tacttgggaggctgaggctg

SEQ ID NO: 71715 - DNA, 20 bp, Artificial Sequence
  chemically synthesized
gctacttgggaggctgaggc

SEQ ID NO: 71716 - DNA, 20 bp, Artificial Sequence
  chemically synthesized
cccagctacttgggaggctg

SEQ ID NO: 71717 - DNA, 20 bp, Artificial Sequence
  chemically synthesized
tcccagctacttgggaggct

SEQ ID NO: 71718 - DNA, 20 bp, Artificial Sequence
  chemically synthesized
ttctccagcctcagcctccc

SEQ ID NO: 71719 - DNA, 20 bp, Artificial Sequence
  chemically synthesized
tccagcctcagcctcccaag

SEQ ID NO: 71720 - DNA, 20 bp, Artificial Sequence
  chemically synthesized
tgtagtcccagctacttggg

SEQ ID NO: 71721 - DNA, 20 bp, Artificial Sequence
  chemically synthesized
ctgtagtcccagctacttgg

SEQ ID NO: 71722 - DNA, 20 bp, Artificial Sequence
  chemically synthesized
gcctcagcctcccaagtagc

SEQ ID NO: 71723 - DNA, 20 bp, Artificial Sequence
  chemically synthesized
gcctgtagtcccagctactt

SEQ ID NO: 71724 - DNA, 20 bp, Artificial Sequence
  chemically synthesized
cctcagcctcccaagtagct

SEQ ID NO: 71725 - DNA, 20 bp, Artificial Sequence
  chemically synthesized
cgcctgtagtcccagctact

SEQ ID NO: 71726 - DNA, 20 bp, Artificial Sequence
  chemically synthesized
ctcccaagtagctgggacta

SEQ ID NO: 71727 - DNA, 20 bp, Artificial Sequence
  chemically synthesized
tcccaagtagctgggactac

SEQ ID NO: 71728 - DNA, 20 bp, Artificial Sequence
  chemically synthesized
gtggcaggcgcctgtagtcc

SEQ ID NO: 71729 - DNA, 20 bp, Artificial Sequence
  chemically synthesized
ggcatggtggcaggcgcctg

SEQ ID NO: 71730 - DNA, 20 bp, Artificial Sequence
  chemically synthesized
cattagccgggcatggtggc

SEQ ID NO: 71731 - DNA, 20 bp, Artificial Sequence
  chemically synthesized
acattagccgggcatggtgg

SEQ ID NO: 71732 - DNA, 20 bp, Artificial Sequence
  chemically synthesized
caggcgcctgccaccatgcc

SEQ ID NO: 71733 - DNA, 20 bp, Artificial Sequence
  chemically synthesized
aaaacattagccgggcatgg

SEQ ID NO: 71734 - DNA, 20 bp, Artificial Sequence
  chemically synthesized
tacaaaacattagccgggca

SEQ ID NO: 71735 - DNA, 20 bp, Artificial Sequence
  chemically synthesized
tgaaatacaaaacattagcc

SEQ ID NO: 71736 - DNA, 20 bp, Artificial Sequence
  chemically synthesized
ctgaaatacaaaacattagc

SEQ ID NO: 71737 - DNA, 20 bp, Artificial Sequence
  chemically synthesized
tctactgaaatacaaaacat

SEQ ID NO: 71738 - DNA, 20 bp, Artificial Sequence
  chemically synthesized
ccggctaatgttttgtattt

SEQ ID NO: 71739 - DNA, 20 bp, Artificial Sequence
  chemically synthesized
gctaatgttttgtatttcag

SEQ ID NO: 71740 - DNA, 20 bp, Artificial Sequence
  chemically synthesized
taatgttttgtatttcagta

SEQ ID NO: 71741 - DNA, 20 bp, Artificial Sequence
  chemically synthesized
gttttgtatttcagtagaga

SEQ ID NO: 71742 - DNA, 20 bp, Artificial Sequence
  chemically synthesized
ttttgtatttcagtagagac

SEQ ID NO: 71743 - DNA, 20 bp, Artificial Sequence
  chemically synthesized
agagacaggatttcaccatt

SEQ ID NO: 71744 - DNA, 20 bp, Artificial Sequence
  chemically synthesized
acaggatttcaccatttggt

SEQ ID NO: 71745 - DNA, 20 bp, Artificial Sequence
  chemically synthesized
caggatttcaccatttggtc

SEQ ID NO: 71746 - DNA, 20 bp, Artificial Sequence
  chemically synthesized
tcaagaccatcctgaccaaa

SEQ ID NO: 71747 - DNA, 20 bp, Artificial Sequence
  chemically synthesized
atttcaccatttggtcagga

SEQ ID NO: 71748 - DNA, 20 bp, Artificial Sequence
  chemically synthesized
aattacgagatcaggagatc

SEQ ID NO: 71749 - DNA, 20 bp, Artificial Sequence
  chemically synthesized
cgggtgaattacgagatcag

SEQ ID NO: 71750 - DNA, 20 bp, Artificial Sequence
  chemically synthesized
ggcgggtgaattacgagatc

SEQ ID NO: 71751 - DNA, 20 bp, Artificial Sequence
  chemically synthesized
aggcgggtgaattacgagat

SEQ ID NO: 71752 - DNA, 20 bp, Artificial Sequence
  chemically synthesized
ggccgaggcgggtgaattac

SEQ ID NO: 71753 - DNA, 20 bp, Artificial Sequence
  chemically synthesized
atctcgtaattcacccgcct

SEQ ID NO: 71754 - DNA, 20 bp, Artificial Sequence
  chemically synthesized
ccactttgggaggccgaggc

SEQ ID NO: 71755 - DNA, 20 bp, Artificial Sequence
  chemically synthesized
accactttgggaggccgagg

SEQ ID NO: 71756 - DNA, 20 bp, Artificial Sequence
  chemically synthesized
cccaccactttgggaggccg

SEQ ID NO: 71757 - DNA, 20 bp, Artificial Sequence
  chemically synthesized
tcccaccactttgggaggcc

SEQ ID NO: 71758 - DNA, 20 bp, Artificial Sequence
  chemically synthesized
tcacccgcctcggcctccca

SEQ ID NO: 71759 - DNA, 20 bp, Artificial Sequence
  chemically synthesized
cccgcctcggcctcccaaag

SEQ ID NO: 71760 - DNA, 20 bp, Artificial Sequence
  chemically synthesized
tgtaatcccaccactttggg

SEQ ID NO: 71761 - DNA, 20 bp, Artificial Sequence
  chemically synthesized
ctgtaatcccaccactttgg

SEQ ID NO: 71762 - DNA, 20 bp, Artificial Sequence
  chemically synthesized
gcctcggcctcccaaagtgg

SEQ ID NO: 71763 - DNA, 20 bp, Artificial Sequence
  chemically synthesized
gcctgtaatcccaccacttt

SEQ ID NO: 71764 - DNA, 20 bp, Artificial Sequence
  chemically synthesized
cctcggcctcccaaagtggt

SEQ ID NO: 71765 - DNA, 20 bp, Artificial Sequence
  chemically synthesized
cgcctgtaatcccaccactt

SEQ ID NO: 71766 - DNA, 20 bp, Artificial Sequence
  chemically synthesized
ctcccaaagtggtgggatta

SEQ ID NO: 71767 - DNA, 20 bp, Artificial Sequence
  chemically synthesized
tcccaaagtggtgggattac

SEQ ID NO: 71768 - DNA, 20 bp, Artificial Sequence
  chemically synthesized
agtggtgggattacaggcgt

SEQ ID NO: 71769 - DNA, 20 bp, Artificial Sequence
  chemically synthesized
caggcgtgagccaccgcgcc

SEQ ID NO: 71770 - DNA, 20 bp, Artificial Sequence
  chemically synthesized
cttgacttgtccaggcgcgg

SEQ ID NO: 71771 - DNA, 20 bp, Artificial Sequence
  chemically synthesized
gaccttgacttgtccaggcg

SEQ ID NO: 71772 - DNA, 20 bp, Artificial Sequence
  chemically synthesized
gtgagccaccgcgcctggac

SEQ ID NO: 71773 - DNA, 20 bp, Artificial Sequence
  chemically synthesized
aaaaagaccttgacttgtcc

SEQ ID NO: 71774 - DNA, 20 bp, Artificial Sequence
  chemically synthesized
taaaaagaccttgacttgtc

SEQ ID NO: 71775 - DNA, 20 bp, Artificial Sequence
  chemically synthesized
ccaccgcgcctggacaagtc

SEQ ID NO: 71776 - DNA, 20 bp, Artificial Sequence
  chemically synthesized
caccgcgcctggacaagtca

SEQ ID NO: 71777 - DNA, 20 bp, Artificial Sequence
  chemically synthesized
tgacactgaggaaatataaa

SEQ ID NO: 71778 - DNA, 20 bp, Artificial Sequence
  chemically synthesized
aaggtctttttatatttcct

SEQ ID NO: 71779 - DNA, 20 bp, Artificial Sequence
  chemically synthesized
gattattgtaagtgacactg

SEQ ID NO: 71780 - DNA, 20 bp, Artificial Sequence
  chemically synthesized
ggattattgtaagtgacact

SEQ ID NO: 71781 - DNA, 20 bp, Artificial Sequence
  chemically synthesized
aagtgtaggtggattattgt

SEQ ID NO: 71782 - DNA, 20 bp, Artificial Sequence
  chemically synthesized
cagagaaaatcaagtgtagg

SEQ ID NO: 71783 - DNA, 20 bp, Artificial Sequence
  chemically synthesized
taacagagaaaatcaagtgt

SEQ ID NO: 71784 - DNA, 20 bp, Artificial Sequence
  chemically synthesized
gtaacagagaaaatcaagtg

SEQ ID NO: 71785 - DNA, 20 bp, Artificial Sequence
  chemically synthesized
tttttgtaacagagaaaatc

SEQ ID NO: 71786 - DNA, 20 bp, Artificial Sequence
  chemically synthesized
tatactatctttttgtaaca

SEQ ID NO: 71787 - DNA, 20 bp, Artificial Sequence
  chemically synthesized
ttgattttctctgttacaaa

SEQ ID NO: 71788 - DNA, 20 bp, Artificial Sequence
  chemically synthesized
aatatactatctttttgtaa

SEQ ID NO: 71789 - DNA, 20 bp, Artificial Sequence
  chemically synthesized
ttttctctgttacaaaaaga

SEQ ID NO: 71790 - DNA, 20 bp, Artificial Sequence
  chemically synthesized
acaaaaagatagtatattaa

SEQ ID NO: 71791 - DNA, 20 bp, Artificial Sequence
  chemically synthesized
caaaaagatagtatattaaa

SEQ ID NO: 71792 - DNA, 20 bp, Artificial Sequence
  chemically synthesized
aaagatagtatattaaaagg

SEQ ID NO: 71793 - DNA, 20 bp, Artificial Sequence
  chemically synthesized
tagtatattaaaaggtagtt

SEQ ID NO: 71794 - DNA, 20 bp, Artificial Sequence
  chemically synthesized
ggtagttcagtcgatattta

SEQ ID NO: 71795 - DNA, 20 bp, Artificial Sequence
  chemically synthesized
gttcagtcgatatttatgga

SEQ ID NO: 71796 - DNA, 20 bp, Artificial Sequence
  chemically synthesized
tcgatatttatggatggaaa

SEQ ID NO: 71797 - DNA, 20 bp, Artificial Sequence
  chemically synthesized
gatatttatggatggaaaca

SEQ ID NO: 71798 - DNA, 20 bp, Artificial Sequence
  chemically synthesized
atatttatggatggaaacag

SEQ ID NO: 71799 - DNA, 20 bp, Artificial Sequence
  chemically synthesized
tggaaacagaggtgaatatt

SEQ ID NO: 71800 - DNA, 20 bp, Artificial Sequence
  chemically synthesized
aacagaggtgaatatttaga

SEQ ID NO: 71801 - DNA, 20 bp, Artificial Sequence
  chemically synthesized
tttattatctcagtttgatt

SEQ ID NO: 71802 - DNA, 20 bp, Artificial Sequence
  chemically synthesized
tagaaagactaaatcaaact

SEQ ID NO: 71803 - DNA, 20 bp, Artificial Sequence
  chemically synthesized
cttatatttctttattatct

SEQ ID NO: 71804 - DNA, 20 bp, Artificial Sequence
  chemically synthesized
taaatcaaactgagataata

SEQ ID NO: 71805 - DNA, 20 bp, Artificial Sequence
  chemically synthesized
ctgagataataaagaaatat

SEQ ID NO: 71806 - DNA, 20 bp, Artificial Sequence
  chemically synthesized
aagaaatataagctataatt

SEQ ID NO: 71807 - DNA, 20 bp, Artificial Sequence
  chemically synthesized
gaaatataagctataattca

SEQ ID NO: 71808 - DNA, 20 bp, Artificial Sequence
  chemically synthesized
cattccattcctctgaatta

SEQ ID NO: 71809 - DNA, 20 bp, Artificial Sequence
  chemically synthesized
aaatataagctataattcag

SEQ ID NO: 71810 - DNA, 20 bp, Artificial Sequence
  chemically synthesized
taagctataattcagaggaa

SEQ ID NO: 71811 - DNA, 20 bp, Artificial Sequence
  chemically synthesized
tcagaggaatggaatgccaa

SEQ ID NO: 71812 - DNA, 20 bp, Artificial Sequence
  chemically synthesized
aggaatggaatgccaaaagt

SEQ ID NO: 71813 - DNA, 20 bp, Artificial Sequence
  chemically synthesized
ggaatggaatgccaaaagta

SEQ ID NO: 71814 - DNA, 20 bp, Artificial Sequence
  chemically synthesized
gaatggaatgccaaaagtaa

SEQ ID NO: 71815 - DNA, 20 bp, Artificial Sequence
  chemically synthesized
gattccactccccttacttt

SEQ ID NO: 71816 - DNA, 20 bp, Artificial Sequence
  chemically synthesized
aatggaatgccaaaagtaag

SEQ ID NO: 71817 - DNA, 20 bp, Artificial Sequence
  chemically synthesized
tggaatgccaaaagtaaggg

SEQ ID NO: 71818 - DNA, 20 bp, Artificial Sequence
  chemically synthesized
aatgccaaaagtaaggggag

SEQ ID NO: 71819 - DNA, 20 bp, Artificial Sequence
  chemically synthesized
agtaaggggagtggaatctg

SEQ ID NO: 71820 - DNA, 20 bp, Artificial Sequence
  chemically synthesized
gagagcatagtcatgaactt

SEQ ID NO: 71821 - DNA, 20 bp, Artificial Sequence
  chemically synthesized
aggaaaaaaatatgagagca

SEQ ID NO: 71822 - DNA, 20 bp, Artificial Sequence
  chemically synthesized
ctggcaggaaaaaaatatga

SEQ ID NO: 71823 - DNA, 20 bp, Artificial Sequence
  chemically synthesized
agctggcaggaaaaaaatat

SEQ ID NO: 71824 - DNA, 20 bp, Artificial Sequence
  chemically synthesized
ctctcatatttttttcctgc

SEQ ID NO: 71825 - DNA, 20 bp, Artificial Sequence
  chemically synthesized
aatttctaccaacagctggc

SEQ ID NO: 71826 - DNA, 20 bp, Artificial Sequence
  chemically synthesized
taatttctaccaacagctgg

SEQ ID NO: 71827 - DNA, 20 bp, Artificial Sequence
  chemically synthesized
atttttttcctgccagctgt

SEQ ID NO: 71828 - DNA, 20 bp, Artificial Sequence
  chemically synthesized
taataatttctaccaacagc

SEQ ID NO: 71829 - DNA, 20 bp, Artificial Sequence
  chemically synthesized
tttttcctgccagctgttgg

SEQ ID NO: 71830 - DNA, 20 bp, Artificial Sequence
  chemically synthesized
ataataataatttctaccaa

SEQ ID NO: 71831 - DNA, 20 bp, Artificial Sequence
  chemically synthesized
attatgattattattatttt

SEQ ID NO: 71832 - DNA, 20 bp, Artificial Sequence
  chemically synthesized
tgattattattattttgaga

SEQ ID NO: 71833 - DNA, 20 bp, Artificial Sequence
  chemically synthesized
attattattattttgagacg

SEQ ID NO: 71834 - DNA, 20 bp, Artificial Sequence
  chemically synthesized
cactccagccggggcaacaa

SEQ ID NO: 71835 - DNA, 20 bp, Artificial Sequence
  chemically synthesized
gagtttcgctcttgttgccc

SEQ ID NO: 71836 - DNA, 20 bp, Artificial Sequence
  chemically synthesized
tgcactccagccggggcaac

SEQ ID NO: 71837 - DNA, 20 bp, Artificial Sequence
  chemically synthesized
ttcgctcttgttgccccggc

SEQ ID NO: 71838 - DNA, 20 bp, Artificial Sequence
  chemically synthesized
cgctcttgttgccccggctg

SEQ ID NO: 71839 - DNA, 20 bp, Artificial Sequence
  chemically synthesized
acgccattgcactccagccg

SEQ ID NO: 71840 - DNA, 20 bp, Artificial Sequence
  chemically synthesized
cacgccattgcactccagcc

SEQ ID NO: 71841 - DNA, 20 bp, Artificial Sequence
  chemically synthesized
tcacgccattgcactccagc

SEQ ID NO: 71842 - DNA, 20 bp, Artificial Sequence
  chemically synthesized
aagatcacgccattgcactc

SEQ ID NO: 71843 - DNA, 20 bp, Artificial Sequence
  chemically synthesized
ttgccccggctggagtgcaa

SEQ ID NO: 71844 - DNA, 20 bp, Artificial Sequence
  chemically synthesized
ggagtgcaatggcgtgatct

SEQ ID NO: 71845 - DNA, 20 bp, Artificial Sequence
  chemically synthesized
aatggcgtgatcttggctca

SEQ ID NO: 71846 - DNA, 20 bp, Artificial Sequence
  chemically synthesized
ggcggaggttgctgtgagcc

SEQ ID NO: 71847 - DNA, 20 bp, Artificial Sequence
  chemically synthesized
caggaggcggaggttgctgt

SEQ ID NO: 71848 - DNA, 20 bp, Artificial Sequence
  chemically synthesized
ggcttgaacccaggaggcgg

SEQ ID NO: 71849 - DNA, 20 bp, Artificial Sequence
  chemically synthesized
tcacagcaacctccgcctcc

SEQ ID NO: 71850 - DNA, 20 bp, Artificial Sequence
  chemically synthesized
tggcttgaacccaggaggcg

SEQ ID NO: 71851 - DNA, 20 bp, Artificial Sequence
  chemically synthesized
cacagcaacctccgcctcct

SEQ ID NO: 71852 - DNA, 20 bp, Artificial Sequence
  chemically synthesized
aatggcttgaacccaggagg

SEQ ID NO: 71853 - DNA, 20 bp, Artificial Sequence
  chemically synthesized
gagaatggcttgaacccagg

SEQ ID NO: 71854 - DNA, 20 bp, Artificial Sequence
  chemically synthesized
ggagaatggcttgaacccag

SEQ ID NO: 71855 - DNA, 20 bp, Artificial Sequence
  chemically synthesized
aacctccgcctcctgggttc

SEQ ID NO: 71856 - DNA, 20 bp, Artificial Sequence
  chemically synthesized
caggagaatggcttgaaccc

SEQ ID NO: 71857 - DNA, 20 bp, Artificial Sequence
  chemically synthesized
gcaggagaatggcttgaacc

SEQ ID NO: 71858 - DNA, 20 bp, Artificial Sequence
  chemically synthesized
gggaggctgaggcaggagaa

SEQ ID NO: 71859 - DNA, 20 bp, Artificial Sequence
  chemically synthesized
ttcaagccattctcctgcct

SEQ ID NO: 71860 - DNA, 20 bp, Artificial Sequence
  chemically synthesized
tactcgggaggctgaggcag

SEQ ID NO: 71861 - DNA, 20 bp, Artificial Sequence
  chemically synthesized
gctactcgggaggctgaggc

SEQ ID NO: 71862 - DNA, 20 bp, Artificial Sequence
  chemically synthesized
agctactcgggaggctgagg

SEQ ID NO: 71863 - DNA, 20 bp, Artificial Sequence
  chemically synthesized
ctcagctactcgggaggctg

SEQ ID NO: 71864 - DNA, 20 bp, Artificial Sequence
  chemically synthesized
tctcagctactcgggaggct

SEQ ID NO: 71865 - DNA, 20 bp, Artificial Sequence
  chemically synthesized
ttctcctgcctcagcctccc

SEQ ID NO: 71866 - DNA, 20 bp, Artificial Sequence
  chemically synthesized
tcctgcctcagcctcccgag

SEQ ID NO: 71867 - DNA, 20 bp, Artificial Sequence
  chemically synthesized
tgtaatctcagctactcggg

SEQ ID NO: 71868 - DNA, 20 bp, Artificial Sequence
  chemically synthesized
ctgtaatctcagctactcgg

SEQ ID NO: 71869 - DNA, 20 bp, Artificial Sequence
  chemically synthesized
gcctgtaatctcagctactc

SEQ ID NO: 71870 - DNA, 20 bp, Artificial Sequence
  chemically synthesized
cctcagcctcccgagtagct

SEQ ID NO: 71871 - DNA, 20 bp, Artificial Sequence
  chemically synthesized
tgcctgtaatctcagctact

SEQ ID NO: 71872 - DNA, 20 bp, Artificial Sequence
  chemically synthesized
ctcccgagtagctgagatta

SEQ ID NO: 71873 - DNA, 20 bp, Artificial Sequence
  chemically synthesized
tcccgagtagctgagattac

SEQ ID NO: 71874 - DNA, 20 bp, Artificial Sequence
  chemically synthesized
gtggcacatgcctgtaatct

SEQ ID NO: 71875 - DNA, 20 bp, Artificial Sequence
  chemically synthesized
caggcatgtgccaccacgcc

SEQ ID NO: 71876 - DNA, 20 bp, Artificial Sequence
  chemically synthesized
acaaaattagctgggcgtgg

SEQ ID NO: 71877 - DNA, 20 bp, Artificial Sequence
  chemically synthesized
aatacaaaattagctgggcg

SEQ ID NO: 71878 - DNA, 20 bp, Artificial Sequence
  chemically synthesized
ctaaaaatacaaaattagct

SEQ ID NO: 71879 - DNA, 20 bp, Artificial Sequence
  chemically synthesized
actaaaaatacaaaattagc

SEQ ID NO: 71880 - DNA, 20 bp, Artificial Sequence
  chemically synthesized
ctctactaaaaatacaaaat

SEQ ID NO: 71881 - DNA, 20 bp, Artificial Sequence
  chemically synthesized
cccagctaattttgtatttt

SEQ ID NO: 71882 - DNA, 20 bp, Artificial Sequence
  chemically synthesized
agctaattttgtatttttag

SEQ ID NO: 71883 - DNA, 20 bp, Artificial Sequence
  chemically synthesized
ctaattttgtatttttagta

SEQ ID NO: 71884 - DNA, 20 bp, Artificial Sequence
  chemically synthesized
ttttgtatttttagtagaga

SEQ ID NO: 71885 - DNA, 20 bp, Artificial Sequence
  chemically synthesized
tttgtatttttagtagagat

SEQ ID NO: 71886 - DNA, 20 bp, Artificial Sequence
  chemically synthesized
ttgtatttttagtagagatg

SEQ ID NO: 71887 - DNA, 20 bp, Artificial Sequence
  chemically synthesized
gagatggggtttctccatgt

SEQ ID NO: 71888 - DNA, 20 bp, Artificial Sequence
  chemically synthesized
agaccagcctgaccaacatg

SEQ ID NO: 71889 - DNA, 20 bp, Artificial Sequence
  chemically synthesized
tggggtttctccatgttggt

SEQ ID NO: 71890 - DNA, 20 bp, Artificial Sequence
  chemically synthesized
cgagaccagcctgaccaaca

SEQ ID NO: 71891 - DNA, 20 bp, Artificial Sequence
  chemically synthesized
ggggtttctccatgttggtc

SEQ ID NO: 71892 - DNA, 20 bp, Artificial Sequence
  chemically synthesized
tttctccatgttggtcaggc

SEQ ID NO: 71893 - DNA, 20 bp, Artificial Sequence
  chemically synthesized
tgaggtccggagttcgagac

SEQ ID NO: 71894 - DNA, 20 bp, Artificial Sequence
  chemically synthesized
gtcaggctggtctcgaactc

SEQ ID NO: 71895 - DNA, 20 bp, Artificial Sequence
  chemically synthesized
tcacctgaggtccggagttc

SEQ ID NO: 71896 - DNA, 20 bp, Artificial Sequence
  chemically synthesized
tggtctcgaactccggacct

SEQ ID NO: 71897 - DNA, 20 bp, Artificial Sequence
  chemically synthesized
ggtggatcacctgaggtccg

SEQ ID NO: 71898 - DNA, 20 bp, Artificial Sequence
  chemically synthesized
ggtctcgaactccggacctc

SEQ ID NO: 71899 - DNA, 20 bp, Artificial Sequence
  chemically synthesized
cgggtggatcacctgaggtc

SEQ ID NO: 71900 - DNA, 20 bp, Artificial Sequence
  chemically synthesized
cgaggcgggtggatcacctg

SEQ ID NO: 71901 - DNA, 20 bp, Artificial Sequence
  chemically synthesized
ccgaggcgggtggatcacct

SEQ ID NO: 71902 - DNA, 20 bp, Artificial Sequence
  chemically synthesized
ctcaggtgatccacccgcct

SEQ ID NO: 71903 - DNA, 20 bp, Artificial Sequence
  chemically synthesized
ctttgggaggccgaggcggg

SEQ ID NO: 71904 - DNA, 20 bp, Artificial Sequence
  chemically synthesized
gcactttgggaggccgaggc

SEQ ID NO: 71905 - DNA, 20 bp, Artificial Sequence
  chemically synthesized
agcactttgggaggccgagg

SEQ ID NO: 71906 - DNA, 20 bp, Artificial Sequence
  chemically synthesized
cccagcactttgggaggccg

SEQ ID NO: 71907 - DNA, 20 bp, Artificial Sequence
  chemically synthesized
tcccagcactttgggaggcc

SEQ ID NO: 71908 - DNA, 20 bp, Artificial Sequence
  chemically synthesized
ccacccgcctcggcctccca

SEQ ID NO: 71909 - DNA, 20 bp, Artificial Sequence
  chemically synthesized
tgtaatcccagcactttggg

SEQ ID NO: 71910 - DNA, 20 bp, Artificial Sequence
  chemically synthesized
ctgtaatcccagcactttgg

SEQ ID NO: 71911 - DNA, 20 bp, Artificial Sequence
  chemically synthesized
gcctcggcctcccaaagtgc

SEQ ID NO: 71912 - DNA, 20 bp, Artificial Sequence
  chemically synthesized
gcctgtaatcccagcacttt

SEQ ID NO: 71913 - DNA, 20 bp, Artificial Sequence
  chemically synthesized
cctcggcctcccaaagtgct

SEQ ID NO: 71914 - DNA, 20 bp, Artificial Sequence
  chemically synthesized
cgcctgtaatcccagcactt

SEQ ID NO: 71915 - DNA, 20 bp, Artificial Sequence
  chemically synthesized
ctcccaaagtgctgggatta

SEQ ID NO: 71916 - DNA, 20 bp, Artificial Sequence
  chemically synthesized
tcccaaagtgctgggattac

SEQ ID NO: 71917 - DNA, 20 bp, Artificial Sequence
  chemically synthesized
gtggctcacgcctgtaatcc

SEQ ID NO: 71918 - DNA, 20 bp, Artificial Sequence
  chemically synthesized
agtgctgggattacaggcgt

SEQ ID NO: 71919 - DNA, 20 bp, Artificial Sequence
  chemically synthesized
caggcgtgagccactgcgcc

SEQ ID NO: 71920 - DNA, 20 bp, Artificial Sequence
  chemically synthesized
taatttctggccaggcgcag

SEQ ID NO: 71921 - DNA, 20 bp, Artificial Sequence
  chemically synthesized
taataatttctggccaggcg

SEQ ID NO: 71922 - DNA, 20 bp, Artificial Sequence
  chemically synthesized
cgtgagccactgcgcctggc

SEQ ID NO: 71923 - DNA, 20 bp, Artificial Sequence
  chemically synthesized
tcatataataatttctggcc

SEQ ID NO: 71924 - DNA, 20 bp, Artificial Sequence
  chemically synthesized
ttcatataataatttctggc

SEQ ID NO: 71925 - DNA, 20 bp, Artificial Sequence
  chemically synthesized
tagtttcatataataatttc

SEQ ID NO: 71926 - DNA, 20 bp, Artificial Sequence
  chemically synthesized
cagaaattattatatgaaac

SEQ ID NO: 71927 - DNA, 20 bp, Artificial Sequence
  chemically synthesized
aaattattatatgaaactag

SEQ ID NO: 71928 - DNA, 20 bp, Artificial Sequence
  chemically synthesized
gttaaaattgaacaggcttc

SEQ ID NO: 71929 - DNA, 20 bp, Artificial Sequence
  chemically synthesized
tccttttgttaaaattgaac

SEQ ID NO: 71930 - DNA, 20 bp, Artificial Sequence
  chemically synthesized
atccttttgttaaaattgaa

SEQ ID NO: 71931 - DNA, 20 bp, Artificial Sequence
  chemically synthesized
agcctgttcaattttaacaa

SEQ ID NO: 71932 - DNA, 20 bp, Artificial Sequence
  chemically synthesized
gcctgttcaattttaacaaa

SEQ ID NO: 71933 - DNA, 20 bp, Artificial Sequence
  chemically synthesized
tcaattttaacaaaaggatg

SEQ ID NO: 71934 - DNA, 20 bp, Artificial Sequence
  chemically synthesized
ttaatttgtcttatgttcaa

SEQ ID NO: 71935 - DNA, 20 bp, Artificial Sequence
  chemically synthesized
atgatgcaactgttgaacat

SEQ ID NO: 71936 - DNA, 20 bp, Artificial Sequence
  chemically synthesized
gagagaaagaaaagaaaaga

SEQ ID NO: 71937 - DNA, 20 bp, Artificial Sequence
  chemically synthesized
gagagagagaaagaaaagaa

SEQ ID NO: 71938 - DNA, 20 bp, Artificial Sequence
  chemically synthesized
aaagagagagagagaaagaa

SEQ ID NO: 71939 - DNA, 20 bp, Artificial Sequence
  chemically synthesized
gaaagaaagagagagagaga

SEQ ID NO: 71940 - DNA, 20 bp, Artificial Sequence
  chemically synthesized
aaaagaaagaaagagagaga

SEQ ID NO: 71941 - DNA, 20 bp, Artificial Sequence
  chemically synthesized
aaaaaagaaagaaagagaga

SEQ ID NO: 71942 - DNA, 20 bp, Artificial Sequence
  chemically synthesized
ctaaaaaagaaagaaagaga

SEQ ID NO: 71943 - DNA, 20 bp, Artificial Sequence
  chemically synthesized
atctaaaaaagaaagaaaga

SEQ ID NO: 71944 - DNA, 20 bp, Artificial Sequence
  chemically synthesized
ccatctaaaaaagaaagaaa

SEQ ID NO: 71945 - DNA, 20 bp, Artificial Sequence
  chemically synthesized
ctccatctaaaaaagaaaga

SEQ ID NO: 71946 - DNA, 20 bp, Artificial Sequence
  chemically synthesized
ctctctctttctttcttttt

SEQ ID NO: 71947 - DNA, 20 bp, Artificial Sequence
  chemically synthesized
gagactccatctaaaaaaga

SEQ ID NO: 71948 - DNA, 20 bp, Artificial Sequence
  chemically synthesized
ctctttctttcttttttaga

SEQ ID NO: 71949 - DNA, 20 bp, Artificial Sequence
  chemically synthesized
gagggagactccatctaaaa

SEQ ID NO: 71950 - DNA, 20 bp, Artificial Sequence
  chemically synthesized
ctttctttcttttttagatg

SEQ ID NO: 71951 - DNA, 20 bp, Artificial Sequence
  chemically synthesized
ctccagcctgggtagagagg

SEQ ID NO: 71952 - DNA, 20 bp, Artificial Sequence
  chemically synthesized
cactccagcctgggtagaga

SEQ ID NO: 71953 - DNA, 20 bp, Artificial Sequence
  chemically synthesized
atggagtctccctctctacc

SEQ ID NO: 71954 - DNA, 20 bp, Artificial Sequence
  chemically synthesized
gcactccagcctgggtagag

SEQ ID NO: 71955 - DNA, 20 bp, Artificial Sequence
  chemically synthesized
tggagtctccctctctaccc

SEQ ID NO: 71956 - DNA, 20 bp, Artificial Sequence
  chemically synthesized
tgcactccagcctgggtaga

SEQ ID NO: 71957 - DNA, 20 bp, Artificial Sequence
  chemically synthesized
actgcactccagcctgggta

SEQ ID NO: 71958 - DNA, 20 bp, Artificial Sequence
  chemically synthesized
gtctccctctctacccaggc

SEQ ID NO: 71959 - DNA, 20 bp, Artificial Sequence
  chemically synthesized
ccactgcactccagcctggg

SEQ ID NO: 71960 - DNA, 20 bp, Artificial Sequence
  chemically synthesized
ctccctctctacccaggctg

SEQ ID NO: 71961 - DNA, 20 bp, Artificial Sequence
  chemically synthesized
atgccactgcactccagcct

SEQ ID NO: 71962 - DNA, 20 bp, Artificial Sequence
  chemically synthesized
catgccactgcactccagcc

SEQ ID NO: 71963 - DNA, 20 bp, Artificial Sequence
  chemically synthesized
tctctacccaggctggagtg

SEQ ID NO: 71964 - DNA, 20 bp, Artificial Sequence
  chemically synthesized
gagatcatgccactgcactc

SEQ ID NO: 71965 - DNA, 20 bp, Artificial Sequence
  chemically synthesized
ctacccaggctggagtgcag

SEQ ID NO: 71966 - DNA, 20 bp, Artificial Sequence
  chemically synthesized
ggagtgcagtggcatgatct

SEQ ID NO: 71967 - DNA, 20 bp, Artificial Sequence
  chemically synthesized
ggtggaggttgcagtgagct

SEQ ID NO: 71968 - DNA, 20 bp, Artificial Sequence
  chemically synthesized
cgggaggtggaggttgcagt

SEQ ID NO: 71969 - DNA, 20 bp, Artificial Sequence
  chemically synthesized
aacccgggaggtggaggttg

SEQ ID NO: 71970 - DNA, 20 bp, Artificial Sequence
  chemically synthesized
cacttgaacccgggaggtgg

SEQ ID NO: 71971 - DNA, 20 bp, Artificial Sequence
  chemically synthesized
tcactgcaacctccacctcc

SEQ ID NO: 71972 - DNA, 20 bp, Artificial Sequence
  chemically synthesized
tcacttgaacccgggaggtg

SEQ ID NO: 71973 - DNA, 20 bp, Artificial Sequence
  chemically synthesized
cactgcaacctccacctccc

SEQ ID NO: 71974 - DNA, 20 bp, Artificial Sequence
  chemically synthesized
aatcacttgaacccgggagg

SEQ ID NO: 71975 - DNA, 20 bp, Artificial Sequence
  chemically synthesized
gagaatcacttgaacccggg

SEQ ID NO: 71976 - DNA, 20 bp, Artificial Sequence
  chemically synthesized
ggagaatcacttgaacccgg

SEQ ID NO: 71977 - DNA, 20 bp, Artificial Sequence
  chemically synthesized
aacctccacctcccgggttc

SEQ ID NO: 71978 - DNA, 20 bp, Artificial Sequence
  chemically synthesized
caggagaatcacttgaaccc

SEQ ID NO: 71979 - DNA, 20 bp, Artificial Sequence
  chemically synthesized
gcaggagaatcacttgaacc

SEQ ID NO: 71980 - DNA, 20 bp, Artificial Sequence
  chemically synthesized
ttcaagtgattctcctgcct

SEQ ID NO: 71981 - DNA, 20 bp, Artificial Sequence
  chemically synthesized
tactcaggaggctgaggcag

SEQ ID NO: 71982 - DNA, 20 bp, Artificial Sequence
  chemically synthesized
actactcaggaggctgaggc

SEQ ID NO: 71983 - DNA, 20 bp, Artificial Sequence
  chemically synthesized
aactactcaggaggctgagg

SEQ ID NO: 71984 - DNA, 20 bp, Artificial Sequence
  chemically synthesized
cccaactactcaggaggctg

SEQ ID NO: 71985 - DNA, 20 bp, Artificial Sequence
  chemically synthesized
tcccaactactcaggaggct

SEQ ID NO: 71986 - DNA, 20 bp, Artificial Sequence
  chemically synthesized
ttctcctgcctcagcctcct

SEQ ID NO: 71987 - DNA, 20 bp, Artificial Sequence
  chemically synthesized
tcctgcctcagcctcctgag

SEQ ID NO: 71988 - DNA, 20 bp, Artificial Sequence
  chemically synthesized
tgtaatcccaactactcagg

SEQ ID NO: 71989 - DNA, 20 bp, Artificial Sequence
  chemically synthesized
ctgtaatcccaactactcag

SEQ ID NO: 71990 - DNA, 20 bp, Artificial Sequence
  chemically synthesized
gcctcagcctcctgagtagt

SEQ ID NO: 71991 - DNA, 20 bp, Artificial Sequence
  chemically synthesized
gcctgtaatcccaactactc

SEQ ID NO: 71992 - DNA, 20 bp, Artificial Sequence
  chemically synthesized
cctcagcctcctgagtagtt

SEQ ID NO: 71993 - DNA, 20 bp, Artificial Sequence
  chemically synthesized
tgcctgtaatcccaactact

SEQ ID NO: 71994 - DNA, 20 bp, Artificial Sequence
  chemically synthesized
ctcctgagtagttgggatta

SEQ ID NO: 71995 - DNA, 20 bp, Artificial Sequence
  chemically synthesized
tcctgagtagttgggattac

SEQ ID NO: 71996 - DNA, 20 bp, Artificial Sequence
  chemically synthesized
caggcatgcgtcaccatgcc

SEQ ID NO: 71997 - DNA, 20 bp, Artificial Sequence
  chemically synthesized
atacaaaaattagccaggca

SEQ ID NO: 71998 - DNA, 20 bp, Artificial Sequence
  chemically synthesized
caaaaatacaaaaattagcc

SEQ ID NO: 71999 - DNA, 20 bp, Artificial Sequence
  chemically synthesized
tcaaaaatacaaaaattagc

SEQ ID NO: 72000 - DNA, 20 bp, Artificial Sequence
  chemically synthesized
tcaatcaaaaatacaaaaat

SEQ ID NO: 72001 - DNA, 20 bp, Artificial Sequence
  chemically synthesized
taatttttgtatttttgatt

SEQ ID NO: 72002 - DNA, 20 bp, Artificial Sequence
  chemically synthesized
ttttgtatttttgattgaga

SEQ ID NO: 72003 - DNA, 20 bp, Artificial Sequence
  chemically synthesized
tttgtatttttgattgagac

SEQ ID NO: 72004 - DNA, 20 bp, Artificial Sequence
  chemically synthesized
ttgtatttttgattgagacg

SEQ ID NO: 72005 - DNA, 20 bp, Artificial Sequence
  chemically synthesized
gagacggggttttaccatgt

SEQ ID NO: 72006 - DNA, 20 bp, Artificial Sequence
  chemically synthesized
cggggttttaccatgttggt

SEQ ID NO: 72007 - DNA, 20 bp, Artificial Sequence
  chemically synthesized
cgagaccagcctgaccaaca

SEQ ID NO: 72008 - DNA, 20 bp, Artificial Sequence
  chemically synthesized
ggggttttaccatgttggtc

SEQ ID NO: 72009 - DNA, 20 bp, Artificial Sequence
  chemically synthesized
ttttaccatgttggtcaggc

SEQ ID NO: 72010 - DNA, 20 bp, Artificial Sequence
  chemically synthesized
tgaggtcaggcgttcgagac

SEQ ID NO: 72011 - DNA, 20 bp, Artificial Sequence
  chemically synthesized
gatcatgaggtcaggcgttc

SEQ ID NO: 72012 - DNA, 20 bp, Artificial Sequence
  chemically synthesized
ggtgagcagatcatgaggtc

SEQ ID NO: 72013 - DNA, 20 bp, Artificial Sequence
  chemically synthesized
aggtgagcagatcatgaggt

SEQ ID NO: 72014 - DNA, 20 bp, Artificial Sequence
  chemically synthesized
gccgaggtgagcagatcatg

SEQ ID NO: 72015 - DNA, 20 bp, Artificial Sequence
  chemically synthesized
ggccgaggtgagcagatcat

SEQ ID NO: 72016 - DNA, 20 bp, Artificial Sequence
  chemically synthesized
acctcatgatctgctcacct

SEQ ID NO: 72017 - DNA, 20 bp, Artificial Sequence
  chemically synthesized
ctctgggaggccgaggtgag

SEQ ID NO: 72018 - DNA, 20 bp, Artificial Sequence
  chemically synthesized
gcactctgggaggccgaggt

SEQ ID NO: 72019 - DNA, 20 bp, Artificial Sequence
  chemically synthesized
cccagcactctgggaggccg

SEQ ID NO: 72020 - DNA, 20 bp, Artificial Sequence
  chemically synthesized
atctgctcacctcggcctcc

SEQ ID NO: 72021 - DNA, 20 bp, Artificial Sequence
  chemically synthesized
tcccagcactctgggaggcc

SEQ ID NO: 72022 - DNA, 20 bp, Artificial Sequence
  chemically synthesized
ctgctcacctcggcctccca

SEQ ID NO: 72023 - DNA, 20 bp, Artificial Sequence
  chemically synthesized
tgtggtcccagcactctggg

SEQ ID NO: 72024 - DNA, 20 bp, Artificial Sequence
  chemically synthesized
ctgtggtcccagcactctgg

SEQ ID NO: 72025 - DNA, 20 bp, Artificial Sequence
  chemically synthesized
acctcggcctcccagagtgc

SEQ ID NO: 72026 - DNA, 20 bp, Artificial Sequence
  chemically synthesized
acctgtggtcccagcactct

SEQ ID NO: 72027 - DNA, 20 bp, Artificial Sequence
  chemically synthesized
cctcggcctcccagagtgct

SEQ ID NO: 72028 - DNA, 20 bp, Artificial Sequence
  chemically synthesized
cacctgtggtcccagcactc

SEQ ID NO: 72029 - DNA, 20 bp, Artificial Sequence
  chemically synthesized
ctcccagagtgctgggacca

SEQ ID NO: 72030 - DNA, 20 bp, Artificial Sequence
  chemically synthesized
tcccagagtgctgggaccac

SEQ ID NO: 72031 - DNA, 20 bp, Artificial Sequence
  chemically synthesized
gtggctcacacctgtggtcc

SEQ ID NO: 72032 - DNA, 20 bp, Artificial Sequence
  chemically synthesized
agtgctgggaccacaggtgt

SEQ ID NO: 72033 - DNA, 20 bp, Artificial Sequence
  chemically synthesized
ggtgcggtggctcacacctg

SEQ ID NO: 72034 - DNA, 20 bp, Artificial Sequence
  chemically synthesized
caggtgtgagccaccgcacc

SEQ ID NO: 72035 - DNA, 20 bp, Artificial Sequence
  chemically synthesized
ttaatttgggccaggtgcgg

SEQ ID NO: 72036 - DNA, 20 bp, Artificial Sequence
  chemically synthesized
attttaatttgggccaggtg

SEQ ID NO: 72037 - DNA, 20 bp, Artificial Sequence
  chemically synthesized
aaaatattttaatttgggcc

SEQ ID NO: 72038 - DNA, 20 bp, Artificial Sequence
  chemically synthesized
gaaaatattttaatttgggc

SEQ ID NO: 72039 - DNA, 20 bp, Artificial Sequence
  chemically synthesized
caatgaaaatattttaattt

SEQ ID NO: 72040 - DNA, 20 bp, Artificial Sequence
  chemically synthesized
gcaatgaaaatattttaatt

SEQ ID NO: 72041 - DNA, 20 bp, Artificial Sequence
  chemically synthesized
cattgcaaatacaaaatacc

SEQ ID NO: 72042 - DNA, 20 bp, Artificial Sequence
  chemically synthesized
ttgcaaatacaaaataccaa

SEQ ID NO: 72043 - DNA, 20 bp, Artificial Sequence
  chemically synthesized
tgcaaatacaaaataccaag

SEQ ID NO: 72044 - DNA, 20 bp, Artificial Sequence
  chemically synthesized
agattatatatagaacctct

SEQ ID NO: 72045 - DNA, 20 bp, Artificial Sequence
  chemically synthesized
gtactttcaaagattatata

SEQ ID NO: 72046 - DNA, 20 bp, Artificial Sequence
  chemically synthesized
gttctatatataatctttga

SEQ ID NO: 72047 - DNA, 20 bp, Artificial Sequence
  chemically synthesized
aaatagaaagggtactttca

SEQ ID NO: 72048 - DNA, 20 bp, Artificial Sequence
  chemically synthesized
tcctgatctttaaatagaaa

SEQ ID NO: 72049 - DNA, 20 bp, Artificial Sequence
  chemically synthesized
atcctgatctttaaatagaa

SEQ ID NO: 72050 - DNA, 20 bp, Artificial Sequence
  chemically synthesized
aatcctgatctttaaataga

SEQ ID NO: 72051 - DNA, 20 bp, Artificial Sequence
  chemically synthesized
gaaagtaccctttctattta

SEQ ID NO: 72052 - DNA, 20 bp, Artificial Sequence
  chemically synthesized
aaaaaatcctgatctttaaa

SEQ ID NO: 72053 - DNA, 20 bp, Artificial Sequence
  chemically synthesized
taccctttctatttaaagat

SEQ ID NO: 72054 - DNA, 20 bp, Artificial Sequence
  chemically synthesized
accctttctatttaaagatc

SEQ ID NO: 72055 - DNA, 20 bp, Artificial Sequence
  chemically synthesized
aggattttttttcacatgtc

SEQ ID NO: 72056 - DNA, 20 bp, Artificial Sequence
  chemically synthesized
ttttttttcacatgtctaga

SEQ ID NO: 72057 - DNA, 20 bp, Artificial Sequence
  chemically synthesized
aattgaaccaaatttctttc

SEQ ID NO: 72058 - DNA, 20 bp, Artificial Sequence
  chemically synthesized
cacatgtctagaaagaaatt

SEQ ID NO: 72059 - DNA, 20 bp, Artificial Sequence
  chemically synthesized
cccaataaatacatagtgaa

SEQ ID NO: 72060 - DNA, 20 bp, Artificial Sequence
  chemically synthesized
atgggttcccaataaataca

SEQ ID NO: 72061 - DNA, 20 bp, Artificial Sequence
  chemically synthesized
tctattcactatgtatttat

SEQ ID NO: 72062 - DNA, 20 bp, Artificial Sequence
  chemically synthesized
ctattcactatgtatttatt

SEQ ID NO: 72063 - DNA, 20 bp, Artificial Sequence
  chemically synthesized
tgtatttattgggaacccat

SEQ ID NO: 72064 - DNA, 20 bp, Artificial Sequence
  chemically synthesized
gattatattacacatctaat

SEQ ID NO: 72065 - DNA, 20 bp, Artificial Sequence
  chemically synthesized
tgattatattacacatctaa

SEQ ID NO: 72066 - DNA, 20 bp, Artificial Sequence
  chemically synthesized
gtaatataatcaaatatcaa

SEQ ID NO: 72067 - DNA, 20 bp, Artificial Sequence
  chemically synthesized
aatcaaatatcaatagatta

SEQ ID NO: 72068 - DNA, 20 bp, Artificial Sequence
  chemically synthesized
aatatcaatagattatagaa

SEQ ID NO: 72069 - DNA, 20 bp, Artificial Sequence
  chemically synthesized
atcaatagattatagaaaag

SEQ ID NO: 72070 - DNA, 20 bp, Artificial Sequence
  chemically synthesized
caatagattatagaaaagaa

SEQ ID NO: 72071 - DNA, 20 bp, Artificial Sequence
  chemically synthesized
atagattatagaaaagaaga

SEQ ID NO: 72072 - DNA, 20 bp, Artificial Sequence
  chemically synthesized
cctgctgggttgtaagaaaa

SEQ ID NO: 72073 - DNA, 20 bp, Artificial Sequence
  chemically synthesized
ccctgctgggttgtaagaaa

SEQ ID NO: 72074 - DNA, 20 bp, Artificial Sequence
  chemically synthesized
gagtcctttttcttacaacc

SEQ ID NO: 72075 - DNA, 20 bp, Artificial Sequence
  chemically synthesized
tttccgccctgctgggttgt

SEQ ID NO: 72076 - DNA, 20 bp, Artificial Sequence
  chemically synthesized
tcctttttcttacaacccag

SEQ ID NO: 72077 - DNA, 20 bp, Artificial Sequence
  chemically synthesized
cctttttcttacaacccagc

SEQ ID NO: 72078 - DNA, 20 bp, Artificial Sequence
  chemically synthesized
ctttttcttacaacccagca

SEQ ID NO: 72079 - DNA, 20 bp, Artificial Sequence
  chemically synthesized
tttcttacaacccagcaggg

SEQ ID NO: 72080 - DNA, 20 bp, Artificial Sequence
  chemically synthesized
ttaatcctttccgccctgct

SEQ ID NO: 72081 - DNA, 20 bp, Artificial Sequence
  chemically synthesized
tttaatcctttccgccctgc

SEQ ID NO: 72082 - DNA, 20 bp, Artificial Sequence
  chemically synthesized
ttacaacccagcagggcgga

SEQ ID NO: 72083 - DNA, 20 bp, Artificial Sequence
  chemically synthesized
tacaacccagcagggcggaa

SEQ ID NO: 72084 - DNA, 20 bp, Artificial Sequence
  chemically synthesized
aggattaaattcttcttata

SEQ ID NO: 72085 - DNA, 20 bp, Artificial Sequence
  chemically synthesized
ggattaaattcttcttataa

SEQ ID NO: 72086 - DNA, 20 bp, Artificial Sequence
  chemically synthesized
atttgttctccctttataag

SEQ ID NO: 72087 - DNA, 20 bp, Artificial Sequence
  chemically synthesized
gattaaattcttcttataaa

SEQ ID NO: 72088 - DNA, 20 bp, Artificial Sequence
  chemically synthesized
ttaaattcttcttataaagg

SEQ ID NO: 72089 - DNA, 20 bp, Artificial Sequence
  chemically synthesized
tctatttgttctccctttat

SEQ ID NO: 72090 - DNA, 20 bp, Artificial Sequence
  chemically synthesized
tcttataaagggagaacaaa

SEQ ID NO: 72091 - DNA, 20 bp, Artificial Sequence
  chemically synthesized
taaagggagaacaaatagat

SEQ ID NO: 72092 - DNA, 20 bp, Artificial Sequence
  chemically synthesized
ggagaacaaatagattagaa

SEQ ID NO: 72093 - DNA, 20 bp, Artificial Sequence
  chemically synthesized
agattagaaaagacgctgcg

SEQ ID NO: 72094 - DNA, 20 bp, Artificial Sequence
  chemically synthesized
agaaaagacgctgcgtagtc

SEQ ID NO: 72095 - DNA, 20 bp, Artificial Sequence
  chemically synthesized
cttttctgaacttgactacg

SEQ ID NO: 72096 - DNA, 20 bp, Artificial Sequence
  chemically synthesized
agacgctgcgtagtcaagtt

SEQ ID NO: 72097 - DNA, 20 bp, Artificial Sequence
  chemically synthesized
ctgcgtagtcaagttcagaa

SEQ ID NO: 72098 - DNA, 20 bp, Artificial Sequence
  chemically synthesized
gtagtcaagttcagaaaagt

SEQ ID NO: 72099 - DNA, 20 bp, Artificial Sequence
  chemically synthesized
tcaagttcagaaaagtgaga

SEQ ID NO: 72100 - DNA, 20 bp, Artificial Sequence
  chemically synthesized
ttcagaaaagtgagaaagtt

SEQ ID NO: 72101 - DNA, 20 bp, Artificial Sequence
  chemically synthesized
gaaaagtgagaaagtttaga

SEQ ID NO: 72102 - DNA, 20 bp, Artificial Sequence
  chemically synthesized
aaaagtgagaaagtttagaa

SEQ ID NO: 72103 - DNA, 20 bp, Artificial Sequence
  chemically synthesized
gaaagtttagaaaggtttca

SEQ ID NO: 72104 - DNA, 20 bp, Artificial Sequence
  chemically synthesized
aagtttagaaaggtttcata

SEQ ID NO: 72105 - DNA, 20 bp, Artificial Sequence
  chemically synthesized
ggtttcatagagatgaactg

SEQ ID NO: 72106 - DNA, 20 bp, Artificial Sequence
  chemically synthesized
aagttttattattagaactg

SEQ ID NO: 72107 - DNA, 20 bp, Artificial Sequence
  chemically synthesized
aaaatgttaagttttattat

SEQ ID NO: 72108 - DNA, 20 bp, Artificial Sequence
  chemically synthesized
tcaaatgttataaaaatgtt

SEQ ID NO: 72109 - DNA, 20 bp, Artificial Sequence
  chemically synthesized
aacatttttataacatttga

SEQ ID NO: 72110 - DNA, 20 bp, Artificial Sequence
  chemically synthesized
tttataacatttgatagttt

SEQ ID NO: 72111 - DNA, 20 bp, Artificial Sequence
  chemically synthesized
ataacatttgatagtttcgg

SEQ ID NO: 72112 - DNA, 20 bp, Artificial Sequence
  chemically synthesized
acatttgatagtttcggaag

SEQ ID NO: 72113 - DNA, 20 bp, Artificial Sequence
  chemically synthesized
tagtttcggaagcagtttca

SEQ ID NO: 72114 - DNA, 20 bp, Artificial Sequence
  chemically synthesized
ccatgtgaagcaatgagata

SEQ ID NO: 72115 - DNA, 20 bp, Artificial Sequence
  chemically synthesized
tccatgtgaagcaatgagat

SEQ ID NO: 72116 - DNA, 20 bp, Artificial Sequence
  chemically synthesized
caaggtccatgtgaagcaat

SEQ ID NO: 72117 - DNA, 20 bp, Artificial Sequence
  chemically synthesized
ccttatctcattgcttcaca

SEQ ID NO: 72118 - DNA, 20 bp, Artificial Sequence
  chemically synthesized
tgtcttacaaggtccatgtg

SEQ ID NO: 72119 - DNA, 20 bp, Artificial Sequence
  chemically synthesized
ttgcttcacatggaccttgt

SEQ ID NO: 72120 - DNA, 20 bp, Artificial Sequence
  chemically synthesized
ttcacatggaccttgtaaga

SEQ ID NO: 72121 - DNA, 20 bp, Artificial Sequence
  chemically synthesized
caaatcccacctgtcttaca

SEQ ID NO: 72122 - DNA, 20 bp, Artificial Sequence
  chemically synthesized
tcacatggaccttgtaagac

SEQ ID NO: 72123 - DNA, 20 bp, Artificial Sequence
  chemically synthesized
ccaaatcccacctgtcttac

SEQ ID NO: 72124 - DNA, 20 bp, Artificial Sequence
  chemically synthesized
catggaccttgtaagacagg

SEQ ID NO: 72125 - DNA, 20 bp, Artificial Sequence
  chemically synthesized
atggaccttgtaagacaggt

SEQ ID NO: 72126 - DNA, 20 bp, Artificial Sequence
  chemically synthesized
cttgtaagacaggtgggatt

SEQ ID NO: 72127 - DNA, 20 bp, Artificial Sequence
  chemically synthesized
aagacaggtgggatttggat

SEQ ID NO: 72128 - DNA, 20 bp, Artificial Sequence
  chemically synthesized
acaggtgggatttggataag

SEQ ID NO: 72129 - DNA, 20 bp, Artificial Sequence
  chemically synthesized
tattcgaagacattttttaa

SEQ ID NO: 72130 - DNA, 20 bp, Artificial Sequence
  chemically synthesized
atattcgaagacatttttta

SEQ ID NO: 72131 - DNA, 20 bp, Artificial Sequence
  chemically synthesized
gtctaaatgtacaatattcg

SEQ ID NO: 72132 - DNA, 20 bp, Artificial Sequence
  chemically synthesized
gtcttcgaatattgtacatt

SEQ ID NO: 72133 - DNA, 20 bp, Artificial Sequence
  chemically synthesized
attctaataaaggcatttgt

SEQ ID NO: 72134 - DNA, 20 bp, Artificial Sequence
  chemically synthesized
agactgacaaatgcctttat

SEQ ID NO: 72135 - DNA, 20 bp, Artificial Sequence
  chemically synthesized
ttttccctttattctaataa

SEQ ID NO: 72136 - DNA, 20 bp, Artificial Sequence
  chemically synthesized
cttttccctttattctaata

SEQ ID NO: 72137 - DNA, 20 bp, Artificial Sequence
  chemically synthesized
caaatgcctttattagaata

SEQ ID NO: 72138 - DNA, 20 bp, Artificial Sequence
  chemically synthesized
aaatgcctttattagaataa

SEQ ID NO: 72139 - DNA, 20 bp, Artificial Sequence
  chemically synthesized
aatgcctttattagaataaa

SEQ ID NO: 72140 - DNA, 20 bp, Artificial Sequence
  chemically synthesized
ctttattagaataaagggaa

SEQ ID NO: 72141 - DNA, 20 bp, Artificial Sequence
  chemically synthesized
tttattagaataaagggaaa

SEQ ID NO: 72142 - DNA, 20 bp, Artificial Sequence
  chemically synthesized
aataaagggaaaaggtatgt

SEQ ID NO: 72143 - DNA, 20 bp, Artificial Sequence
  chemically synthesized
taaagggaaaaggtatgtga

SEQ ID NO: 72144 - DNA, 20 bp, Artificial Sequence
  chemically synthesized
gaaaaggtatgtgagagaca

SEQ ID NO: 72145 - DNA, 20 bp, Artificial Sequence
  chemically synthesized
aaaggtatgtgagagacata

SEQ ID NO: 72146 - DNA, 20 bp, Artificial Sequence
  chemically synthesized
aggtatgtgagagacataga

SEQ ID NO: 72147 - DNA, 20 bp, Artificial Sequence
  chemically synthesized
gagacatagagagcaaattt

SEQ ID NO: 72148 - DNA, 20 bp, Artificial Sequence
  chemically synthesized
agacatagagagcaaatttt

SEQ ID NO: 72149 - DNA, 20 bp, Artificial Sequence
  chemically synthesized
agagagcaaattttgggttc

SEQ ID NO: 72150 - DNA, 20 bp, Artificial Sequence
  chemically synthesized
cagctagttagttgtggaac

SEQ ID NO: 72151 - DNA, 20 bp, Artificial Sequence
  chemically synthesized
ttcacacagctagttagttg

SEQ ID NO: 72152 - DNA, 20 bp, Artificial Sequence
  chemically synthesized
gttctagttccacaactaac

SEQ ID NO: 72153 - DNA, 20 bp, Artificial Sequence
  chemically synthesized
tcatagttcacacagctagt

SEQ ID NO: 72154 - DNA, 20 bp, Artificial Sequence
  chemically synthesized
tagttcatagttcacacagc

SEQ ID NO: 72155 - DNA, 20 bp, Artificial Sequence
  chemically synthesized
atgatagttcatagttcaca

SEQ ID NO: 72156 - DNA, 20 bp, Artificial Sequence
  chemically synthesized
agacaccacatgatagttca

SEQ ID NO: 72157 - DNA, 20 bp, Artificial Sequence
  chemically synthesized
gtgaactatgaactatcatg

SEQ ID NO: 72158 - DNA, 20 bp, Artificial Sequence
  chemically synthesized
tttacaaagacaccacatga

SEQ ID NO: 72159 - DNA, 20 bp, Artificial Sequence
  chemically synthesized
atccaacccttgagtttaca

SEQ ID NO: 72160 - DNA, 20 bp, Artificial Sequence
  chemically synthesized
tgtggtgtctttgtaaactc

SEQ ID NO: 72161 - DNA, 20 bp, Artificial Sequence
  chemically synthesized
gtggtgtctttgtaaactca

SEQ ID NO: 72162 - DNA, 20 bp, Artificial Sequence
  chemically synthesized
tggtgtctttgtaaactcaa

SEQ ID NO: 72163 - DNA, 20 bp, Artificial Sequence
  chemically synthesized
gtctttgtaaactcaagggt

SEQ ID NO: 72164 - DNA, 20 bp, Artificial Sequence
  chemically synthesized
agtccagaaatccaaccctt

SEQ ID NO: 72165 - DNA, 20 bp, Artificial Sequence
  chemically synthesized
aaactcaagggttggatttc

SEQ ID NO: 72166 - DNA, 20 bp, Artificial Sequence
  chemically synthesized
acacttcagcacagaaagtc

SEQ ID NO: 72167 - DNA, 20 bp, Artificial Sequence
  chemically synthesized
gttttacacttcagcacaga

SEQ ID NO: 72168 - DNA, 20 bp, Artificial Sequence
  chemically synthesized
tttctggactttctgtgctg

SEQ ID NO: 72169 - DNA, 20 bp, Artificial Sequence
  chemically synthesized
tttagttttacacttcagca

SEQ ID NO: 72170 - DNA, 20 bp, Artificial Sequence
  chemically synthesized
atatttttagttttacactt

SEQ ID NO: 72171 - DNA, 20 bp, Artificial Sequence
  chemically synthesized
actgaatattttaatatttt

SEQ ID NO: 72172 - DNA, 20 bp, Artificial Sequence
  chemically synthesized
actaaaaatattaaaatatt

SEQ ID NO: 72173 - DNA, 20 bp, Artificial Sequence
  chemically synthesized
ttaaaatattcagtaattca

SEQ ID NO: 72174 - DNA, 20 bp, Artificial Sequence
  chemically synthesized
aaatattcagtaattcaaag

SEQ ID NO: 72175 - DNA, 20 bp, Artificial Sequence
  chemically synthesized
attcaaagtggatattttaa

SEQ ID NO: 72176 - DNA, 20 bp, Artificial Sequence
  chemically synthesized
ttaaaagcaatgaaacatat

SEQ ID NO: 72177 - DNA, 20 bp, Artificial Sequence
  chemically synthesized
aaagcaatgaaacatatcag

SEQ ID NO: 72178 - DNA, 20 bp, Artificial Sequence
  chemically synthesized
atcaaatcataaaaataaat

SEQ ID NO: 72179 - DNA, 20 bp, Artificial Sequence
  chemically synthesized
gatttgatattttatatttt

SEQ ID NO: 72180 - DNA, 20 bp, Artificial Sequence
  chemically synthesized
ttagatttcaatttttattt

SEQ ID NO: 72181 - DNA, 20 bp, Artificial Sequence
  chemically synthesized
tcaatttttattttagactc

SEQ ID NO: 72182 - DNA, 20 bp, Artificial Sequence
  chemically synthesized
caatttttattttagactca

SEQ ID NO: 72183 - DNA, 20 bp, Artificial Sequence
  chemically synthesized
aatttttattttagactcaa

SEQ ID NO: 72184 - DNA, 20 bp, Artificial Sequence
  chemically synthesized
atttttattttagactcaag

SEQ ID NO: 72185 - DNA, 20 bp, Artificial Sequence
  chemically synthesized
aacctgcacatgtacccctt

SEQ ID NO: 72186 - DNA, 20 bp, Artificial Sequence
  chemically synthesized
agactcaaggggtacatgtg

SEQ ID NO: 72187 - DNA, 20 bp, Artificial Sequence
  chemically synthesized
gactcaaggggtacatgtgc

SEQ ID NO: 72188 - DNA, 20 bp, Artificial Sequence
  chemically synthesized
acatgtgcaggtttattaca

SEQ ID NO: 72189 - DNA, 20 bp, Artificial Sequence
  chemically synthesized
catgtgcaggtttattacat

SEQ ID NO: 72190 - DNA, 20 bp, Artificial Sequence
  chemically synthesized
tgggtatattgtgtgacact

SEQ ID NO: 72191 - DNA, 20 bp, Artificial Sequence
  chemically synthesized
gggtatattgtgtgacactg

SEQ ID NO: 72192 - DNA, 20 bp, Artificial Sequence
  chemically synthesized
tattgtgtgacactgaggtt

SEQ ID NO: 72193 - DNA, 20 bp, Artificial Sequence
  chemically synthesized
ttgtgtgacactgaggtttg

SEQ ID NO: 72194 - DNA, 20 bp, Artificial Sequence
  chemically synthesized
ttcaactgtactccaaacct

SEQ ID NO: 72195 - DNA, 20 bp, Artificial Sequence
  chemically synthesized
tgacactgaggtttggagta

SEQ ID NO: 72196 - DNA, 20 bp, Artificial Sequence
  chemically synthesized
gtacagttgaacctgtcacc

SEQ ID NO: 72197 - DNA, 20 bp, Artificial Sequence
  chemically synthesized
tacagttgaacctgtcaccc

SEQ ID NO: 72198 - DNA, 20 bp, Artificial Sequence
  chemically synthesized
atactcactacctgggtgac

SEQ ID NO: 72199 - DNA, 20 bp, Artificial Sequence
  chemically synthesized
tatactcactacctgggtga

SEQ ID NO: 72200 - DNA, 20 bp, Artificial Sequence
  chemically synthesized
agttgaacctgtcacccagg

SEQ ID NO: 72201 - DNA, 20 bp, Artificial Sequence
  chemically synthesized
gaacctgtcacccaggtagt

SEQ ID NO: 72202 - DNA, 20 bp, Artificial Sequence
  chemically synthesized
gagtactatactcactacct

SEQ ID NO: 72203 - DNA, 20 bp, Artificial Sequence
  chemically synthesized
cgagtactatactcactacc

SEQ ID NO: 72204 - DNA, 20 bp, Artificial Sequence
  chemically synthesized
tgtcacccaggtagtgagta

SEQ ID NO: 72205 - DNA, 20 bp, Artificial Sequence
  chemically synthesized
gtagtgagtatagtactcga

SEQ ID NO: 72206 - DNA, 20 bp, Artificial Sequence
  chemically synthesized
tagtgagtatagtactcgat

SEQ ID NO: 72207 - DNA, 20 bp, Artificial Sequence
  chemically synthesized
tgagtatagtactcgatagg

SEQ ID NO: 72208 - DNA, 20 bp, Artificial Sequence
  chemically synthesized
ggctgaaaaaactacctatc

SEQ ID NO: 72209 - DNA, 20 bp, Artificial Sequence
  chemically synthesized
tactcgataggtagtttttt

SEQ ID NO: 72210 - DNA, 20 bp, Artificial Sequence
  chemically synthesized
ggcaggagggtgtgggacaa

SEQ ID NO: 72211 - DNA, 20 bp, Artificial Sequence
  chemically synthesized
gggcaggagggtgtgggaca

SEQ ID NO: 72212 - DNA, 20 bp, Artificial Sequence
  chemically synthesized
agggcaggagggtgtgggac

SEQ ID NO: 72213 - DNA, 20 bp, Artificial Sequence
  chemically synthesized
tgacaagggcaggagggtgt

SEQ ID NO: 72214 - DNA, 20 bp, Artificial Sequence
  chemically synthesized
gtgacaagggcaggagggtg

SEQ ID NO: 72215 - DNA, 20 bp, Artificial Sequence
  chemically synthesized
cactagtgacaagggcagga

SEQ ID NO: 72216 - DNA, 20 bp, Artificial Sequence
  chemically synthesized
gcactagtgacaagggcagg

SEQ ID NO: 72217 - DNA, 20 bp, Artificial Sequence
  chemically synthesized
ggcactagtgacaagggcag

SEQ ID NO: 72218 - DNA, 20 bp, Artificial Sequence
  chemically synthesized
caggcactagtgacaagggc

SEQ ID NO: 72219 - DNA, 20 bp, Artificial Sequence
  chemically synthesized
acaggcactagtgacaaggg

SEQ ID NO: 72220 - DNA, 20 bp, Artificial Sequence
  chemically synthesized
caccctcctgcccttgtcac

SEQ ID NO: 72221 - DNA, 20 bp, Artificial Sequence
  chemically synthesized
acaacaggcactagtgacaa

SEQ ID NO: 72222 - DNA, 20 bp, Artificial Sequence
  chemically synthesized
aacaacaggcactagtgaca

SEQ ID NO: 72223 - DNA, 20 bp, Artificial Sequence
  chemically synthesized
gaacaacaggcactagtgac

SEQ ID NO: 72224 - DNA, 20 bp, Artificial Sequence
  chemically synthesized
aagttgggaacaacaggcac

SEQ ID NO: 72225 - DNA, 20 bp, Artificial Sequence
  chemically synthesized
gatgtaaagttgggaacaac

SEQ ID NO: 72226 - DNA, 20 bp, Artificial Sequence
  chemically synthesized
ggatgtaaagttgggaacaa

SEQ ID NO: 72227 - DNA, 20 bp, Artificial Sequence
  chemically synthesized
gtacacatggatgtaaagtt

SEQ ID NO: 72228 - DNA, 20 bp, Artificial Sequence
  chemically synthesized
ggtacacatggatgtaaagt

SEQ ID NO: 72229 - DNA, 20 bp, Artificial Sequence
  chemically synthesized
tttgggtacacatggatgta

SEQ ID NO: 72230 - DNA, 20 bp, Artificial Sequence
  chemically synthesized
agctaacctttgggtacaca

SEQ ID NO: 72231 - DNA, 20 bp, Artificial Sequence
  chemically synthesized
tttacatccatgtgtaccca

SEQ ID NO: 72232 - DNA, 20 bp, Artificial Sequence
  chemically synthesized
ttacatccatgtgtacccaa

SEQ ID NO: 72233 - DNA, 20 bp, Artificial Sequence
  chemically synthesized
atccatgtgtacccaaaggt

SEQ ID NO: 72234 - DNA, 20 bp, Artificial Sequence
  chemically synthesized
ataagcaggagctaaccttt

SEQ ID NO: 72235 - DNA, 20 bp, Artificial Sequence
  chemically synthesized
tataagcaggagctaacctt

SEQ ID NO: 72236 - DNA, 20 bp, Artificial Sequence
  chemically synthesized
atgtgctcacttataagcag

SEQ ID NO: 72237 - DNA, 20 bp, Artificial Sequence
  chemically synthesized
aaaggttagctcctgcttat

SEQ ID NO: 72238 - DNA, 20 bp, Artificial Sequence
  chemically synthesized
gcatgtgctcacttataagc

SEQ ID NO: 72239 - DNA, 20 bp, Artificial Sequence
  chemically synthesized
tgcatgtgctcacttataag

SEQ ID NO: 72240 - DNA, 20 bp, Artificial Sequence
  chemically synthesized
gttagctcctgcttataagt

SEQ ID NO: 72241 - DNA, 20 bp, Artificial Sequence
  chemically synthesized
taatgcatgtgctcacttat

SEQ ID NO: 72242 - DNA, 20 bp, Artificial Sequence
  chemically synthesized
aagtgagcacatgcattatt

SEQ ID NO: 72243 - DNA, 20 bp, Artificial Sequence
  chemically synthesized
taagcgaattaaagcagaaa

SEQ ID NO: 72244 - DNA, 20 bp, Artificial Sequence
  chemically synthesized
ttatcctaagcgaattaaag

SEQ ID NO: 72245 - DNA, 20 bp, Artificial Sequence
  chemically synthesized
tcattatcctaagcgaatta

SEQ ID NO: 72246 - DNA, 20 bp, Artificial Sequence
  chemically synthesized
tgtttctgctttaattcgct

SEQ ID NO: 72247 - DNA, 20 bp, Artificial Sequence
  chemically synthesized
gtttctgctttaattcgctt

SEQ ID NO: 72248 - DNA, 20 bp, Artificial Sequence
  chemically synthesized
gaactggaggtcattatcct

SEQ ID NO: 72249 - DNA, 20 bp, Artificial Sequence
  chemically synthesized
tcgcttaggataatgacctc

SEQ ID NO: 72250 - DNA, 20 bp, Artificial Sequence
  chemically synthesized
agcaacatggttggaactgg

SEQ ID NO: 72251 - DNA, 20 bp, Artificial Sequence
  chemically synthesized
tagcaacatggttggaactg

SEQ ID NO: 72252 - DNA, 20 bp, Artificial Sequence
  chemically synthesized
tgtagcaacatggttggaac

SEQ ID NO: 72253 - DNA, 20 bp, Artificial Sequence
  chemically synthesized
gtcctctgtagcaacatggt

SEQ ID NO: 72254 - DNA, 20 bp, Artificial Sequence
  chemically synthesized
tcatgtcctctgtagcaaca

SEQ ID NO: 72255 - DNA, 20 bp, Artificial Sequence
  chemically synthesized
cagttccaaccatgttgcta

SEQ ID NO: 72256 - DNA, 20 bp, Artificial Sequence
  chemically synthesized
gttccaaccatgttgctaca

SEQ ID NO: 72257 - DNA, 20 bp, Artificial Sequence
  chemically synthesized
ttccaaccatgttgctacag

SEQ ID NO: 72258 - DNA, 20 bp, Artificial Sequence
  chemically synthesized
gaaggaaatcatgtcctctg

SEQ ID NO: 72259 - DNA, 20 bp, Artificial Sequence
  chemically synthesized
ctacacagctatgaaaaaga

SEQ ID NO: 72260 - DNA, 20 bp, Artificial Sequence
  chemically synthesized
actacacagctatgaaaaag

SEQ ID NO: 72261 - DNA, 20 bp, Artificial Sequence
  chemically synthesized
catgatttccttctttttca

SEQ ID NO: 72262 - DNA, 20 bp, Artificial Sequence
  chemically synthesized
aatactacacagctatgaaa

SEQ ID NO: 72263 - DNA, 20 bp, Artificial Sequence
  chemically synthesized
ccttctttttcatagctgtg

SEQ ID NO: 72264 - DNA, 20 bp, Artificial Sequence
  chemically synthesized
atgcaccatggaatactaca

SEQ ID NO: 72265 - DNA, 20 bp, Artificial Sequence
  chemically synthesized
catagctgtgtagtattcca

SEQ ID NO: 72266 - DNA, 20 bp, Artificial Sequence
  chemically synthesized
aacgtggcatatatgcacca

SEQ ID NO: 72267 - DNA, 20 bp, Artificial Sequence
  chemically synthesized
tggattggataaagaaaacg

SEQ ID NO: 72268 - DNA, 20 bp, Artificial Sequence
  chemically synthesized
catcaatggtggattggata

SEQ ID NO: 72269 - DNA, 20 bp, Artificial Sequence
  chemically synthesized
ggtgcccatcaatggtggat

SEQ ID NO: 72270 - DNA, 20 bp, Artificial Sequence
  chemically synthesized
tttatccaatccaccattga

SEQ ID NO: 72271 - DNA, 20 bp, Artificial Sequence
  chemically synthesized
acctaggtgcccatcaatgg

SEQ ID NO: 72272 - DNA, 20 bp, Artificial Sequence
  chemically synthesized
ttatccaatccaccattgat

SEQ ID NO: 72273 - DNA, 20 bp, Artificial Sequence
  chemically synthesized
tcaacctaggtgcccatcaa

SEQ ID NO: 72274 - DNA, 20 bp, Artificial Sequence
  chemically synthesized
atccaccattgatgggcacc

SEQ ID NO: 72275 - DNA, 20 bp, Artificial Sequence
  chemically synthesized
tccaccattgatgggcacct

SEQ ID NO: 72276 - DNA, 20 bp, Artificial Sequence
  chemically synthesized
caaagacataaagtcaacct

SEQ ID NO: 72277 - DNA, 20 bp, Artificial Sequence
  chemically synthesized
gcaaagacataaagtcaacc

SEQ ID NO: 72278 - DNA, 20 bp, Artificial Sequence
  chemically synthesized
ttcacaatagcaaagacata

SEQ ID NO: 72279 - DNA, 20 bp, Artificial Sequence
  chemically synthesized
cagcactattcacaatagca

SEQ ID NO: 72280 - DNA, 20 bp, Artificial Sequence
  chemically synthesized
tatgtctttgctattgtgaa

SEQ ID NO: 72281 - DNA, 20 bp, Artificial Sequence
  chemically synthesized
cattgcagcactattcacaa

SEQ ID NO: 72282 - DNA, 20 bp, Artificial Sequence
  chemically synthesized
gtgcgctcatatgttcattg

SEQ ID NO: 72283 - DNA, 20 bp, Artificial Sequence
  chemically synthesized
tagtgctgcaatgaacatat

SEQ ID NO: 72284 - DNA, 20 bp, Artificial Sequence
  chemically synthesized
catatgagcgcacgtctttt

SEQ ID NO: 72285 - DNA, 20 bp, Artificial Sequence
  chemically synthesized
atgagcgcacgtctttttgg

SEQ ID NO: 72286 - DNA, 20 bp, Artificial Sequence
  chemically synthesized
atataaatttttctaccaaa

SEQ ID NO: 72287 - DNA, 20 bp, Artificial Sequence
  chemically synthesized
tagaaaaatttatatttctt

SEQ ID NO: 72288 - DNA, 20 bp, Artificial Sequence
  chemically synthesized
agaaaaatttatatttcttt

SEQ ID NO: 72289 - DNA, 20 bp, Artificial Sequence
  chemically synthesized
cattacttggtatgtaccca

SEQ ID NO: 72290 - DNA, 20 bp, Artificial Sequence
  chemically synthesized
tatttctttgggtacatacc

SEQ ID NO: 72291 - DNA, 20 bp, Artificial Sequence
  chemically synthesized
tttgggtacataccaagtaa

SEQ ID NO: 72292 - DNA, 20 bp, Artificial Sequence
  chemically synthesized
gacccagcacttccattact

SEQ ID NO: 72293 - DNA, 20 bp, Artificial Sequence
  chemically synthesized
gggtacataccaagtaatgg

SEQ ID NO: 72294 - DNA, 20 bp, Artificial Sequence
  chemically synthesized
ataccaagtaatggaagtgc

SEQ ID NO: 72295 - DNA, 20 bp, Artificial Sequence
  chemically synthesized
taccaagtaatggaagtgct

SEQ ID NO: 72296 - DNA, 20 bp, Artificial Sequence
  chemically synthesized
aatggaagtgctgggtcaaa

SEQ ID NO: 72297 - DNA, 20 bp, Artificial Sequence
  chemically synthesized
aaaagaactaccatttgacc

SEQ ID NO: 72298 - DNA, 20 bp, Artificial Sequence
  chemically synthesized
ggaagtgctgggtcaaatgg

SEQ ID NO: 72299 - DNA, 20 bp, Artificial Sequence
  chemically synthesized
aaaaagaaagaaagaaaaaa

SEQ ID NO: 72300 - DNA, 20 bp, Artificial Sequence
  chemically synthesized
aaaaaaaaaaaaaagaaaga

SEQ ID NO: 72301 - DNA, 20 bp, Artificial Sequence
  chemically synthesized
tctcaaaaaaaaaaaaaaga

SEQ ID NO: 72302 - DNA, 20 bp, Artificial Sequence
  chemically synthesized
tctgtctcaaaaaaaaaaaa

SEQ ID NO: 72303 - DNA, 20 bp, Artificial Sequence
  chemically synthesized
tctttctttttttttttttt

SEQ ID NO: 72304 - DNA, 20 bp, Artificial Sequence
  chemically synthesized
tcttttttttttttttgaga

SEQ ID NO: 72305 - DNA, 20 bp, Artificial Sequence
  chemically synthesized
ttttttttttttttgagaca

SEQ ID NO: 72306 - DNA, 20 bp, Artificial Sequence
  chemically synthesized
tccagcctgggcaacagagc

SEQ ID NO: 72307 - DNA, 20 bp, Artificial Sequence
  chemically synthesized
cagagtcttgctctgttgcc

SEQ ID NO: 72308 - DNA, 20 bp, Artificial Sequence
  chemically synthesized
gcactccagcctgggcaaca

SEQ ID NO: 72309 - DNA, 20 bp, Artificial Sequence
  chemically synthesized
agagtcttgctctgttgccc

SEQ ID NO: 72310 - DNA, 20 bp, Artificial Sequence
  chemically synthesized
ctgcactccagcctgggcaa

SEQ ID NO: 72311 - DNA, 20 bp, Artificial Sequence
  chemically synthesized
tcttgctctgttgcccaggc

SEQ ID NO: 72312 - DNA, 20 bp, Artificial Sequence
  chemically synthesized
ttgctctgttgcccaggctg

SEQ ID NO: 72313 - DNA, 20 bp, Artificial Sequence
  chemically synthesized
atgccactgcactccagcct

SEQ ID NO: 72314 - DNA, 20 bp, Artificial Sequence
  chemically synthesized
catgccactgcactccagcc

SEQ ID NO: 72315 - DNA, 20 bp, Artificial Sequence
  chemically synthesized
ctgttgcccaggctggagtg

SEQ ID NO: 72316 - DNA, 20 bp, Artificial Sequence
  chemically synthesized
gagatcatgccactgcactc

SEQ ID NO: 72317 - DNA, 20 bp, Artificial Sequence
  chemically synthesized
ttgcccaggctggagtgcag

SEQ ID NO: 72318 - DNA, 20 bp, Artificial Sequence
  chemically synthesized
ggagtgcagtggcatgatct

SEQ ID NO: 72319 - DNA, 20 bp, Artificial Sequence
  chemically synthesized
ggcggaggttgcagtgagcc

SEQ ID NO: 72320 - DNA, 20 bp, Artificial Sequence
  chemically synthesized
taggaggcggaggttgcagt

SEQ ID NO: 72321 - DNA, 20 bp, Artificial Sequence
  chemically synthesized
aacataggaggcggaggttg

SEQ ID NO: 72322 - DNA, 20 bp, Artificial Sequence
  chemically synthesized
cacttgaacataggaggcgg

SEQ ID NO: 72323 - DNA, 20 bp, Artificial Sequence
  chemically synthesized
ccacttgaacataggaggcg

SEQ ID NO: 72324 - DNA, 20 bp, Artificial Sequence
  chemically synthesized
aaccacttgaacataggagg

SEQ ID NO: 72325 - DNA, 20 bp, Artificial Sequence
  chemically synthesized
gagaaccacttgaacatagg

SEQ ID NO: 72326 - DNA, 20 bp, Artificial Sequence
  chemically synthesized
ggagaaccacttgaacatag

SEQ ID NO: 72327 - DNA, 20 bp, Artificial Sequence
  chemically synthesized
aacctccgcctcctatgttc

SEQ ID NO: 72328 - DNA, 20 bp, Artificial Sequence
  chemically synthesized
caggagaaccacttgaacat

SEQ ID NO: 72329 - DNA, 20 bp, Artificial Sequence
  chemically synthesized
gcaggagaaccacttgaaca

SEQ ID NO: 72330 - DNA, 20 bp, Artificial Sequence
  chemically synthesized
ctccgcctcctatgttcaag

SEQ ID NO: 72331 - DNA, 20 bp, Artificial Sequence
  chemically synthesized
ttcaagtggttctcctgcct

SEQ ID NO: 72332 - DNA, 20 bp, Artificial Sequence
  chemically synthesized
tactcggaaggctgaggcag

SEQ ID NO: 72333 - DNA, 20 bp, Artificial Sequence
  chemically synthesized
gttactcggaaggctgaggc

SEQ ID NO: 72334 - DNA, 20 bp, Artificial Sequence
  chemically synthesized
agttactcggaaggctgagg

SEQ ID NO: 72335 - DNA, 20 bp, Artificial Sequence
  chemically synthesized
cccagttactcggaaggctg

SEQ ID NO: 72336 - DNA, 20 bp, Artificial Sequence
  chemically synthesized
tcccagttactcggaaggct

SEQ ID NO: 72337 - DNA, 20 bp, Artificial Sequence
  chemically synthesized
ttctcctgcctcagccttcc

SEQ ID NO: 72338 - DNA, 20 bp, Artificial Sequence
  chemically synthesized
tgtaatcccagttactcgga

SEQ ID NO: 72339 - DNA, 20 bp, Artificial Sequence
  chemically synthesized
ctgtaatcccagttactcgg

SEQ ID NO: 72340 - DNA, 20 bp, Artificial Sequence
  chemically synthesized
gcctcagccttccgagtaac

SEQ ID NO: 72341 - DNA, 20 bp, Artificial Sequence
  chemically synthesized
cctcagccttccgagtaact

SEQ ID NO: 72342 - DNA, 20 bp, Artificial Sequence
  chemically synthesized
cacctgtaatcccagttact

SEQ ID NO: 72343 - DNA, 20 bp, Artificial Sequence
  chemically synthesized
cttccgagtaactgggatta

SEQ ID NO: 72344 - DNA, 20 bp, Artificial Sequence
  chemically synthesized
ttccgagtaactgggattac

SEQ ID NO: 72345 - DNA, 20 bp, Artificial Sequence
  chemically synthesized
gtggcagacacctgtaatcc

SEQ ID NO: 72346 - DNA, 20 bp, Artificial Sequence
  chemically synthesized
aaattagccgggcatggtgg

SEQ ID NO: 72347 - DNA, 20 bp, Artificial Sequence
  chemically synthesized
caggtgtctgccaccatgcc

SEQ ID NO: 72348 - DNA, 20 bp, Artificial Sequence
  chemically synthesized
aaaaaattagccgggcatgg

SEQ ID NO: 72349 - DNA, 20 bp, Artificial Sequence
  chemically synthesized
acaaaaaaattagccgggca

SEQ ID NO: 72350 - DNA, 20 bp, Artificial Sequence
  chemically synthesized
aaaatacaaaaaaattagcc

SEQ ID NO: 72351 - DNA, 20 bp, Artificial Sequence
  chemically synthesized
aaaaatacaaaaaaattagc

SEQ ID NO: 72352 - DNA, 20 bp, Artificial Sequence
  chemically synthesized
tactaaaaatacaaaaaaat

SEQ ID NO: 72353 - DNA, 20 bp, Artificial Sequence
  chemically synthesized
ggctaatttttttgtatttt

SEQ ID NO: 72354 - DNA, 20 bp, Artificial Sequence
  chemically synthesized
taatttttttgtatttttag

SEQ ID NO: 72355 - DNA, 20 bp, Artificial Sequence
  chemically synthesized
atttttttgtatttttagta

SEQ ID NO: 72356 - DNA, 20 bp, Artificial Sequence
  chemically synthesized
ttttgtatttttagtagaga

SEQ ID NO: 72357 - DNA, 20 bp, Artificial Sequence
  chemically synthesized
tttgtatttttagtagagat

SEQ ID NO: 72358 - DNA, 20 bp, Artificial Sequence
  chemically synthesized
ttgtatttttagtagagata

SEQ ID NO: 72359 - DNA, 20 bp, Artificial Sequence
  chemically synthesized
gagatagggtttcaccatgt

SEQ ID NO: 72360 - DNA, 20 bp, Artificial Sequence
  chemically synthesized
tagggtttcaccatgttggc

SEQ ID NO: 72361 - DNA, 20 bp, Artificial Sequence
  chemically synthesized
cgagaccagcctggccaaca

SEQ ID NO: 72362 - DNA, 20 bp, Artificial Sequence
  chemically synthesized
agggtttcaccatgttggcc

SEQ ID NO: 72363 - DNA, 20 bp, Artificial Sequence
  chemically synthesized
tttcaccatgttggccaggc

SEQ ID NO: 72364 - DNA, 20 bp, Artificial Sequence
  chemically synthesized
ttaggagttcgagaccagcc

SEQ ID NO: 72365 - DNA, 20 bp, Artificial Sequence
  chemically synthesized
tgaggttaggagttcgagac

SEQ ID NO: 72366 - DNA, 20 bp, Artificial Sequence
  chemically synthesized
tcacctgaggttaggagttc

SEQ ID NO: 72367 - DNA, 20 bp, Artificial Sequence
  chemically synthesized
tggtctcgaactcctaacct

SEQ ID NO: 72368 - DNA, 20 bp, Artificial Sequence
  chemically synthesized
ggtggatcacctgaggttag

SEQ ID NO: 72369 - DNA, 20 bp, Artificial Sequence
  chemically synthesized
ggtctcgaactcctaacctc

SEQ ID NO: 72370 - DNA, 20 bp, Artificial Sequence
  chemically synthesized
tgggtggatcacctgaggtt

SEQ ID NO: 72371 - DNA, 20 bp, Artificial Sequence
  chemically synthesized
gtgggtggatcacctgaggt

SEQ ID NO: 72372 - DNA, 20 bp, Artificial Sequence
  chemically synthesized
cgaggtgggtggatcacctg

SEQ ID NO: 72373 - DNA, 20 bp, Artificial Sequence
  chemically synthesized
tcgaggtgggtggatcacct

SEQ ID NO: 72374 - DNA, 20 bp, Artificial Sequence
  chemically synthesized
ctttgggaggtcgaggtggg

SEQ ID NO: 72375 - DNA, 20 bp, Artificial Sequence
  chemically synthesized
gcactttgggaggtcgaggt

SEQ ID NO: 72376 - DNA, 20 bp, Artificial Sequence
  chemically synthesized
agcactttgggaggtcgagg

SEQ ID NO: 72377 - DNA, 20 bp, Artificial Sequence
  chemically synthesized
cccagcactttgggaggtcg

SEQ ID NO: 72378 - DNA, 20 bp, Artificial Sequence
  chemically synthesized
tcccagcactttgggaggtc

SEQ ID NO: 72379 - DNA, 20 bp, Artificial Sequence
  chemically synthesized
ccacccacctcgacctccca

SEQ ID NO: 72380 - DNA, 20 bp, Artificial Sequence
  chemically synthesized
tgtgatcccagcactttggg

SEQ ID NO: 72381 - DNA, 20 bp, Artificial Sequence
  chemically synthesized
ctgtgatcccagcactttgg

SEQ ID NO: 72382 - DNA, 20 bp, Artificial Sequence
  chemically synthesized
acctcgacctcccaaagtgc

SEQ ID NO: 72383 - DNA, 20 bp, Artificial Sequence
  chemically synthesized
gcctgtgatcccagcacttt

SEQ ID NO: 72384 - DNA, 20 bp, Artificial Sequence
  chemically synthesized
cctcgacctcccaaagtgct

SEQ ID NO: 72385 - DNA, 20 bp, Artificial Sequence
  chemically synthesized
cgcctgtgatcccagcactt

SEQ ID NO: 72386 - DNA, 20 bp, Artificial Sequence
  chemically synthesized
ctcccaaagtgctgggatca

SEQ ID NO: 72387 - DNA, 20 bp, Artificial Sequence
  chemically synthesized
tcccaaagtgctgggatcac

SEQ ID NO: 72388 - DNA, 20 bp, Artificial Sequence
  chemically synthesized
gtggctcacgcctgtgatcc

SEQ ID NO: 72389 - DNA, 20 bp, Artificial Sequence
  chemically synthesized
agtgctgggatcacaggcgt

SEQ ID NO: 72390 - DNA, 20 bp, Artificial Sequence
  chemically synthesized
caggcgtgagccacgacacc

SEQ ID NO: 72391 - DNA, 20 bp, Artificial Sequence
  chemically synthesized
aaaaaaatgaccgggtgtcg

SEQ ID NO: 72392 - DNA, 20 bp, Artificial Sequence
  chemically synthesized
actccaagaaaaaaatgacc

SEQ ID NO: 72393 - DNA, 20 bp, Artificial Sequence
  chemically synthesized
aactccaagaaaaaaatgac

SEQ ID NO: 72394 - DNA, 20 bp, Artificial Sequence
  chemically synthesized
acacccggtcatttttttct

SEQ ID NO: 72395 - DNA, 20 bp, Artificial Sequence
  chemically synthesized
acccggtcatttttttcttg

SEQ ID NO: 72396 - DNA, 20 bp, Artificial Sequence
  chemically synthesized
tcatttttttcttggagttt

SEQ ID NO: 72397 - DNA, 20 bp, Artificial Sequence
  chemically synthesized
aatagttttgccaaaactcc

SEQ ID NO: 72398 - DNA, 20 bp, Artificial Sequence
  chemically synthesized
gagttttggcaaaactattt

SEQ ID NO: 72399 - DNA, 20 bp, Artificial Sequence
  chemically synthesized
aaggttaaccaacacttaaa

SEQ ID NO: 72400 - DNA, 20 bp, Artificial Sequence
  chemically synthesized
tggcaaaactatttaagtgt

SEQ ID NO: 72401 - DNA, 20 bp, Artificial Sequence
  chemically synthesized
aagtgttggttaaccttatg

SEQ ID NO: 72402 - DNA, 20 bp, Artificial Sequence
  chemically synthesized
tctaaatttgtggcttcata

SEQ ID NO: 72403 - DNA, 20 bp, Artificial Sequence
  chemically synthesized
atctaaatttgtggcttcat

SEQ ID NO: 72404 - DNA, 20 bp, Artificial Sequence
  chemically synthesized
accttatgaagccacaaatt

SEQ ID NO: 72405 - DNA, 20 bp, Artificial Sequence
  chemically synthesized
agtacttacatctaaatttg

SEQ ID NO: 72406 - DNA, 20 bp, Artificial Sequence
  chemically synthesized
gaagccacaaatttagatgt

SEQ ID NO: 72407 - DNA, 20 bp, Artificial Sequence
  chemically synthesized
agatgtaagtactacgtctt

SEQ ID NO: 72408 - DNA, 20 bp, Artificial Sequence
  chemically synthesized
aactataatttctgaagacg

SEQ ID NO: 72409 - DNA, 20 bp, Artificial Sequence
  chemically synthesized
gaaaaaaactataatttctg

SEQ ID NO: 72410 - DNA, 20 bp, Artificial Sequence
  chemically synthesized
tactacgtcttcagaaatta

SEQ ID NO: 72411 - DNA, 20 bp, Artificial Sequence
  chemically synthesized
taccagaggagaaaaattag

SEQ ID NO: 72412 - DNA, 20 bp, Artificial Sequence
  chemically synthesized
ataccagaggagaaaaatta

SEQ ID NO: 72413 - DNA, 20 bp, Artificial Sequence
  chemically synthesized
tataccagaggagaaaaatt

SEQ ID NO: 72414 - DNA, 20 bp, Artificial Sequence
  chemically synthesized
ttataccagaggagaaaaat

SEQ ID NO: 72415 - DNA, 20 bp, Artificial Sequence
  chemically synthesized
ttcccctaatttttctcctc

SEQ ID NO: 72416 - DNA, 20 bp, Artificial Sequence
  chemically synthesized
agcagaaagttataccagag

SEQ ID NO: 72417 - DNA, 20 bp, Artificial Sequence
  chemically synthesized
taagcagaaagttataccag

SEQ ID NO: 72418 - DNA, 20 bp, Artificial Sequence
  chemically synthesized
ataagcagaaagttatacca

SEQ ID NO: 72419 - DNA, 20 bp, Artificial Sequence
  chemically synthesized
aaataagcagaaagttatac

SEQ ID NO: 72420 - DNA, 20 bp, Artificial Sequence
  chemically synthesized
aaactataaaaataagcaga

SEQ ID NO: 72421 - DNA, 20 bp, Artificial Sequence
  chemically synthesized
ctgaaaactataaaaataag

SEQ ID NO: 72422 - DNA, 20 bp, Artificial Sequence
  chemically synthesized
taactttctgcttattttta

SEQ ID NO: 72423 - DNA, 20 bp, Artificial Sequence
  chemically synthesized
ttactgaaaactataaaaat

SEQ ID NO: 72424 - DNA, 20 bp, Artificial Sequence
  chemically synthesized
ctgcttatttttatagtttt

SEQ ID NO: 72425 - DNA, 20 bp, Artificial Sequence
  chemically synthesized
ttttcagtaacattttaact

SEQ ID NO: 72426 - DNA, 20 bp, Artificial Sequence
  chemically synthesized
atagatgaatgcataaaact

SEQ ID NO: 72427 - DNA, 20 bp, Artificial Sequence
  chemically synthesized
ttttatgcattcatctattc

SEQ ID NO: 72428 - DNA, 20 bp, Artificial Sequence
  chemically synthesized
cattctataaatgtcttgaa

SEQ ID NO: 72429 - DNA, 20 bp, Artificial Sequence
  chemically synthesized
tcatctattcaagacattta

SEQ ID NO: 72430 - DNA, 20 bp, Artificial Sequence
  chemically synthesized
ggcagtgtctttcatatagt

SEQ ID NO: 72431 - DNA, 20 bp, Artificial Sequence
  chemically synthesized
atagaatgcttactatatga

SEQ ID NO: 72432 - DNA, 20 bp, Artificial Sequence
  chemically synthesized
atttggcagtgtctttcata

SEQ ID NO: 72433 - DNA, 20 bp, Artificial Sequence
  chemically synthesized
ccacatctactgacatttgg

SEQ ID NO: 72434 - DNA, 20 bp, Artificial Sequence
  chemically synthesized
tgaaagacactgccaaatgt

SEQ ID NO: 72435 - DNA, 20 bp, Artificial Sequence
  chemically synthesized
ataccacatctactgacatt

SEQ ID NO: 72436 - DNA, 20 bp, Artificial Sequence
  chemically synthesized
aagacactgccaaatgtcag

SEQ ID NO: 72437 - DNA, 20 bp, Artificial Sequence
  chemically synthesized
ctgccaaatgtcagtagatg

SEQ ID NO: 72438 - DNA, 20 bp, Artificial Sequence
  chemically synthesized
atgtcagtagatgtggtatt

SEQ ID NO: 72439 - DNA, 20 bp, Artificial Sequence
  chemically synthesized
tgtcagtagatgtggtattc

SEQ ID NO: 72440 - DNA, 20 bp, Artificial Sequence
  chemically synthesized
gtcagtagatgtggtattca

SEQ ID NO: 72441 - DNA, 20 bp, Artificial Sequence
  chemically synthesized
tgtgagctccataaggacag

SEQ ID NO: 72442 - DNA, 20 bp, Artificial Sequence
  chemically synthesized
atgtgagctccataaggaca

SEQ ID NO: 72443 - DNA, 20 bp, Artificial Sequence
  chemically synthesized
attcagggcctctgtcctta

SEQ ID NO: 72444 - DNA, 20 bp, Artificial Sequence
  chemically synthesized
gaatgtgagctccataagga

SEQ ID NO: 72445 - DNA, 20 bp, Artificial Sequence
  chemically synthesized
tcagggcctctgtccttatg

SEQ ID NO: 72446 - DNA, 20 bp, Artificial Sequence
  chemically synthesized
atctgaatgtgagctccata

SEQ ID NO: 72447 - DNA, 20 bp, Artificial Sequence
  chemically synthesized
tatctgaatgtgagctccat

SEQ ID NO: 72448 - DNA, 20 bp, Artificial Sequence
  chemically synthesized
gtccttatggagctcacatt

SEQ ID NO: 72449 - DNA, 20 bp, Artificial Sequence
  chemically synthesized
tgtttcccctatctgaatgt

SEQ ID NO: 72450 - DNA, 20 bp, Artificial Sequence
  chemically synthesized
ttatggagctcacattcaga

SEQ ID NO: 72451 - DNA, 20 bp, Artificial Sequence
  chemically synthesized
tatggagctcacattcagat

SEQ ID NO: 72452 - DNA, 20 bp, Artificial Sequence
  chemically synthesized
atggagctcacattcagata

SEQ ID NO: 72453 - DNA, 20 bp, Artificial Sequence
  chemically synthesized
tggagctcacattcagatag

SEQ ID NO: 72454 - DNA, 20 bp, Artificial Sequence
  chemically synthesized
tcacattcagataggggaaa

SEQ ID NO: 72455 - DNA, 20 bp, Artificial Sequence
  chemically synthesized
tttggtggcttgtttaatga

SEQ ID NO: 72456 - DNA, 20 bp, Artificial Sequence
  chemically synthesized
gaaacagactttcattaaac

SEQ ID NO: 72457 - DNA, 20 bp, Artificial Sequence
  chemically synthesized
atctatagctatgtgtttgg

SEQ ID NO: 72458 - DNA, 20 bp, Artificial Sequence
  chemically synthesized
taaacaagccaccaaacaca

SEQ ID NO: 72459 - DNA, 20 bp, Artificial Sequence
  chemically synthesized
aaaatctatagctatgtgtt

SEQ ID NO: 72460 - DNA, 20 bp, Artificial Sequence
  chemically synthesized
agccaccaaacacatagcta

SEQ ID NO: 72461 - DNA, 20 bp, Artificial Sequence
  chemically synthesized
acagcacttacgaaaatcta

SEQ ID NO: 72462 - DNA, 20 bp, Artificial Sequence
  chemically synthesized
acatagctatagattttcgt

SEQ ID NO: 72463 - DNA, 20 bp, Artificial Sequence
  chemically synthesized
agattttcgtaagtgctgtg

SEQ ID NO: 72464 - DNA, 20 bp, Artificial Sequence
  chemically synthesized
tttcgtaagtgctgtgaaga

SEQ ID NO: 72465 - DNA, 20 bp, Artificial Sequence
  chemically synthesized
catcctgtttgctttcttca

SEQ ID NO: 72466 - DNA, 20 bp, Artificial Sequence
  chemically synthesized
agtgctgtgaagaaagcaaa

SEQ ID NO: 72467 - DNA, 20 bp, Artificial Sequence
  chemically synthesized
gtgctgtgaagaaagcaaac

SEQ ID NO: 72468 - DNA, 20 bp, Artificial Sequence
  chemically synthesized
tttcccatcattatcacaga

SEQ ID NO: 72469 - DNA, 20 bp, Artificial Sequence
  chemically synthesized
gatttcccatcattatcaca

SEQ ID NO: 72470 - DNA, 20 bp, Artificial Sequence
  chemically synthesized
aagatttcccatcattatca

SEQ ID NO: 72471 - DNA, 20 bp, Artificial Sequence
  chemically synthesized
gatgctctctgtgataatga

SEQ ID NO: 72472 - DNA, 20 bp, Artificial Sequence
  chemically synthesized
atgctctctgtgataatgat

SEQ ID NO: 72473 - DNA, 20 bp, Artificial Sequence
  chemically synthesized
taatgatgggaaatcttccc

SEQ ID NO: 72474 - DNA, 20 bp, Artificial Sequence
  chemically synthesized
taattaagtcacatctaggg

SEQ ID NO: 72475 - DNA, 20 bp, Artificial Sequence
  chemically synthesized
gtataattaagtcacatcta

SEQ ID NO: 72476 - DNA, 20 bp, Artificial Sequence
  chemically synthesized
tgtataattaagtcacatct

SEQ ID NO: 72477 - DNA, 20 bp, Artificial Sequence
  chemically synthesized
atgtataattaagtcacatc

SEQ ID NO: 72478 - DNA, 20 bp, Artificial Sequence
  chemically synthesized
tgcagagttaatgtataatt

SEQ ID NO: 72479 - DNA, 20 bp, Artificial Sequence
  chemically synthesized
ttaattatacattaactctg

SEQ ID NO: 72480 - DNA, 20 bp, Artificial Sequence
  chemically synthesized
atttgaagtaatggactgca

SEQ ID NO: 72481 - DNA, 20 bp, Artificial Sequence
  chemically synthesized
tcatttgaagtaatggactg

SEQ ID NO: 72482 - DNA, 20 bp, Artificial Sequence
  chemically synthesized
ctagggatcatttgaagtaa

SEQ ID NO: 72483 - DNA, 20 bp, Artificial Sequence
  chemically synthesized
gaataactagggatcatttg

SEQ ID NO: 72484 - DNA, 20 bp, Artificial Sequence
  chemically synthesized
ccattacttcaaatgatccc

SEQ ID NO: 72485 - DNA, 20 bp, Artificial Sequence
  chemically synthesized
gtatgtaaattgaataacta

SEQ ID NO: 72486 - DNA, 20 bp, Artificial Sequence
  chemically synthesized
agtatgtaaattgaataact

SEQ ID NO: 72487 - DNA, 20 bp, Artificial Sequence
  chemically synthesized
cagtatgtaaattgaataac

SEQ ID NO: 72488 - DNA, 20 bp, Artificial Sequence
  chemically synthesized
tagttattcaatttacatac

SEQ ID NO: 72489 - DNA, 20 bp, Artificial Sequence
  chemically synthesized
taaacagggttgtaaaattc

SEQ ID NO: 72490 - DNA, 20 bp, Artificial Sequence
  chemically synthesized
tggaattttacaaccctgtt

SEQ ID NO: 72491 - DNA, 20 bp, Artificial Sequence
  chemically synthesized
agcctgggactaactaaaca

SEQ ID NO: 72492 - DNA, 20 bp, Artificial Sequence
  chemically synthesized
attttacaaccctgtttagt

SEQ ID NO: 72493 - DNA, 20 bp, Artificial Sequence
  chemically synthesized
aagcctgggactaactaaac

SEQ ID NO: 72494 - DNA, 20 bp, Artificial Sequence
  chemically synthesized
gaagcctgggactaactaaa

SEQ ID NO: 72495 - DNA, 20 bp, Artificial Sequence
  chemically synthesized
caaccctgtttagttagtcc

SEQ ID NO: 72496 - DNA, 20 bp, Artificial Sequence
  chemically synthesized
aaccctgtttagttagtccc

SEQ ID NO: 72497 - DNA, 20 bp, Artificial Sequence
  chemically synthesized
gtttagttagtcccaggctt

SEQ ID NO: 72498 - DNA, 20 bp, Artificial Sequence
  chemically synthesized
tttagttagtcccaggcttc

SEQ ID NO: 72499 - DNA, 20 bp, Artificial Sequence
  chemically synthesized
ttttaaatggcctgaagcct

SEQ ID NO: 72500 - DNA, 20 bp, Artificial Sequence
  chemically synthesized
gttttaaatggcctgaagcc

SEQ ID NO: 72501 - DNA, 20 bp, Artificial Sequence
  chemically synthesized
cttttgttttaaatggcctg

SEQ ID NO: 72502 - DNA, 20 bp, Artificial Sequence
  chemically synthesized
tctatatcttttgttttaaa

SEQ ID NO: 72503 - DNA, 20 bp, Artificial Sequence
  chemically synthesized
cttcaggccatttaaaacaa

SEQ ID NO: 72504 - DNA, 20 bp, Artificial Sequence
  chemically synthesized
gccatttaaaacaaaagata

SEQ ID NO: 72505 - DNA, 20 bp, Artificial Sequence
  chemically synthesized
aaacaaaagatatagatgaa

SEQ ID NO: 72506 - DNA, 20 bp, Artificial Sequence
  chemically synthesized
caaaagatatagatgaatag

SEQ ID NO: 72507 - DNA, 20 bp, Artificial Sequence
  chemically synthesized
aaagatatagatgaatagaa

SEQ ID NO: 72508 - DNA, 20 bp, Artificial Sequence
  chemically synthesized
agatgaatagaagagtcact

SEQ ID NO: 72509 - DNA, 20 bp, Artificial Sequence
  chemically synthesized
ctgaaggatgaagacaagct

SEQ ID NO: 72510 - DNA, 20 bp, Artificial Sequence
  chemically synthesized
gagatctgaaggatgaagac

SEQ ID NO: 72511 - DNA, 20 bp, Artificial Sequence
  chemically synthesized
ctcagcttgtcttcatcctt

SEQ ID NO: 72512 - DNA, 20 bp, Artificial Sequence
  chemically synthesized
tgaccgagatctgaaggatg

SEQ ID NO: 72513 - DNA, 20 bp, Artificial Sequence
  chemically synthesized
gacctttgaccgagatctga

SEQ ID NO: 72514 - DNA, 20 bp, Artificial Sequence
  chemically synthesized
tgtcttcatccttcagatct

SEQ ID NO: 72515 - DNA, 20 bp, Artificial Sequence
  chemically synthesized
tgacctttgaccgagatctg

SEQ ID NO: 72516 - DNA, 20 bp, Artificial Sequence
  chemically synthesized
catccttcagatctcggtca

SEQ ID NO: 72517 - DNA, 20 bp, Artificial Sequence
  chemically synthesized
atccttcagatctcggtcaa

SEQ ID NO: 72518 - DNA, 20 bp, Artificial Sequence
  chemically synthesized
aataaaagtgacctttgacc

SEQ ID NO: 72519 - DNA, 20 bp, Artificial Sequence
  chemically synthesized
cggtcaaaggtcacttttat

SEQ ID NO: 72520 - DNA, 20 bp, Artificial Sequence
  chemically synthesized
ggtcaaaggtcacttttatt

SEQ ID NO: 72521 - DNA, 20 bp, Artificial Sequence
  chemically synthesized
tcaaaggtcacttttattgg

SEQ ID NO: 72522 - DNA, 20 bp, Artificial Sequence
  chemically synthesized
tcaggacaccctcccaataa

SEQ ID NO: 72523 - DNA, 20 bp, Artificial Sequence
  chemically synthesized
caaaggtcacttttattggg

SEQ ID NO: 72524 - DNA, 20 bp, Artificial Sequence
  chemically synthesized
aaaggtcacttttattggga

SEQ ID NO: 72525 - DNA, 20 bp, Artificial Sequence
  chemically synthesized
agaggcaggaaagggcaatc

SEQ ID NO: 72526 - DNA, 20 bp, Artificial Sequence
  chemically synthesized
gagaggcaggaaagggcaat

SEQ ID NO: 72527 - DNA, 20 bp, Artificial Sequence
  chemically synthesized
taagggtgagaggcaggaaa

SEQ ID NO: 72528 - DNA, 20 bp, Artificial Sequence
  chemically synthesized
gtaagggtgagaggcaggaa

SEQ ID NO: 72529 - DNA, 20 bp, Artificial Sequence
  chemically synthesized
agtaagggtgagaggcagga

SEQ ID NO: 72530 - DNA, 20 bp, Artificial Sequence
  chemically synthesized
ctgcagtaagggtgagaggc

SEQ ID NO: 72531 - DNA, 20 bp, Artificial Sequence
  chemically synthesized
gctgcagtaagggtgagagg

SEQ ID NO: 72532 - DNA, 20 bp, Artificial Sequence
  chemically synthesized
cgcgctgcagtaagggtgag

SEQ ID NO: 72533 - DNA, 20 bp, Artificial Sequence
  chemically synthesized
gcgcgctgcagtaagggtga

SEQ ID NO: 72534 - DNA, 20 bp, Artificial Sequence
  chemically synthesized
gcgcgcgctgcagtaagggt

SEQ ID NO: 72535 - DNA, 20 bp, Artificial Sequence
  chemically synthesized
cctgcctctcacccttactg

SEQ ID NO: 72536 - DNA, 20 bp, Artificial Sequence
  chemically synthesized
gtgcgcgcgcgctgcagtaa

SEQ ID NO: 72537 - DNA, 20 bp, Artificial Sequence
  chemically synthesized
tgtgcgcgcgcgctgcagta

SEQ ID NO: 72538 - DNA, 20 bp, Artificial Sequence
  chemically synthesized
gtgtgcgcgcgcgctgcagt

SEQ ID NO: 72539 - DNA, 20 bp, Artificial Sequence
  chemically synthesized
gtgtgtgtgcgcgcgcgctg

SEQ ID NO: 72540 - DNA, 20 bp, Artificial Sequence
  chemically synthesized
cacacacacacacacacatt

SEQ ID NO: 72541 - DNA, 20 bp, Artificial Sequence
  chemically synthesized
acacacacacacacacattt

SEQ ID NO: 72542 - DNA, 20 bp, Artificial Sequence
  chemically synthesized
cactaccagaatatatagta

SEQ ID NO: 72543 - DNA, 20 bp, Artificial Sequence
  chemically synthesized
acactaccagaatatatagt

SEQ ID NO: 72544 - DNA, 20 bp, Artificial Sequence
  chemically synthesized
taggtccttactatatattc

SEQ ID NO: 72545 - DNA, 20 bp, Artificial Sequence
  chemically synthesized
caggacactaccagaatata

SEQ ID NO: 72546 - DNA, 20 bp, Artificial Sequence
  chemically synthesized
gtccttactatatattctgg

SEQ ID NO: 72547 - DNA, 20 bp, Artificial Sequence
  chemically synthesized
aagaaaatacaggacactac

SEQ ID NO: 72548 - DNA, 20 bp, Artificial Sequence
  chemically synthesized
tgtgtcaggaaagaaaatac

SEQ ID NO: 72549 - DNA, 20 bp, Artificial Sequence
  chemically synthesized
atgtgtcaggaaagaaaata

SEQ ID NO: 72550 - DNA, 20 bp, Artificial Sequence
  chemically synthesized
taattacaaatgtgtcagga

SEQ ID NO: 72551 - DNA, 20 bp, Artificial Sequence
  chemically synthesized
aaaataattacaaatgtgtc

SEQ ID NO: 72552 - DNA, 20 bp, Artificial Sequence
  chemically synthesized
taaaataattacaaatgtgt

SEQ ID NO: 72553 - DNA, 20 bp, Artificial Sequence
  chemically synthesized
cacatttgtaattattttat

SEQ ID NO: 72554 - DNA, 20 bp, Artificial Sequence
  chemically synthesized
tggtttcttgggatgacaga

SEQ ID NO: 72555 - DNA, 20 bp, Artificial Sequence
  chemically synthesized
aaattactgtctgtcatccc

SEQ ID NO: 72556 - DNA, 20 bp, Artificial Sequence
  chemically synthesized
gttatggtttcttgggatga

SEQ ID NO: 72557 - DNA, 20 bp, Artificial Sequence
  chemically synthesized
catggaggttatggtttctt

SEQ ID NO: 72558 - DNA, 20 bp, Artificial Sequence
  chemically synthesized
tcatggaggttatggtttct

SEQ ID NO: 72559 - DNA, 20 bp, Artificial Sequence
  chemically synthesized
ctctgccctcatggaggtta

SEQ ID NO: 72560 - DNA, 20 bp, Artificial Sequence
  chemically synthesized
caagaaaccataacctccat

SEQ ID NO: 72561 - DNA, 20 bp, Artificial Sequence
  chemically synthesized
aagaaaccataacctccatg

SEQ ID NO: 72562 - DNA, 20 bp, Artificial Sequence
  chemically synthesized
agaaaccataacctccatga

SEQ ID NO: 72563 - DNA, 20 bp, Artificial Sequence
  chemically synthesized
gaccttctctgccctcatgg

SEQ ID NO: 72564 - DNA, 20 bp, Artificial Sequence
  chemically synthesized
agaccttctctgccctcatg

SEQ ID NO: 72565 - DNA, 20 bp, Artificial Sequence
  chemically synthesized
aaccataacctccatgaggg

SEQ ID NO: 72566 - DNA, 20 bp, Artificial Sequence
  chemically synthesized
acagaccttctctgccctca

SEQ ID NO: 72567 - DNA, 20 bp, Artificial Sequence
  chemically synthesized
ccataacctccatgagggca

SEQ ID NO: 72568 - DNA, 20 bp, Artificial Sequence
  chemically synthesized
taacctccatgagggcagag

SEQ ID NO: 72569 - DNA, 20 bp, Artificial Sequence
  chemically synthesized
aacctccatgagggcagaga

SEQ ID NO: 72570 - DNA, 20 bp, Artificial Sequence
  chemically synthesized
gatagggattcagtcataga

SEQ ID NO: 72571 - DNA, 20 bp, Artificial Sequence
  chemically synthesized
agatgatagggattcagtca

SEQ ID NO: 72572 - DNA, 20 bp, Artificial Sequence
  chemically synthesized
tgtttgagatgatagggatt

SEQ ID NO: 72573 - DNA, 20 bp, Artificial Sequence
  chemically synthesized
aaactctgtttgagatgata

SEQ ID NO: 72574 - DNA, 20 bp, Artificial Sequence
  chemically synthesized
caaactctgtttgagatgat

SEQ ID NO: 72575 - DNA, 20 bp, Artificial Sequence
  chemically synthesized
ccaaactctgtttgagatga

SEQ ID NO: 72576 - DNA, 20 bp, Artificial Sequence
  chemically synthesized
tgaatccctatcatctcaaa

SEQ ID NO: 72577 - DNA, 20 bp, Artificial Sequence
  chemically synthesized
aatccctatcatctcaaaca

SEQ ID NO: 72578 - DNA, 20 bp, Artificial Sequence
  chemically synthesized
ctctttaccaaactctgttt

SEQ ID NO: 72579 - DNA, 20 bp, Artificial Sequence
  chemically synthesized
ctatcatctcaaacagagtt

SEQ ID NO: 72580 - DNA, 20 bp, Artificial Sequence
  chemically synthesized
atctcaaacagagtttggta

SEQ ID NO: 72581 - DNA, 20 bp, Artificial Sequence
  chemically synthesized
ctcaaacagagtttggtaaa

SEQ ID NO: 72582 - DNA, 20 bp, Artificial Sequence
  chemically synthesized
aaacagagtttggtaaagag

SEQ ID NO: 72583 - DNA, 20 bp, Artificial Sequence
  chemically synthesized
gtttggtaaagagtagacac

SEQ ID NO: 72584 - DNA, 20 bp, Artificial Sequence
  chemically synthesized
attcaataattatttttttc

SEQ ID NO: 72585 - DNA, 20 bp, Artificial Sequence
  chemically synthesized
attgaatgaatgattgaaca

SEQ ID NO: 72586 - DNA, 20 bp, Artificial Sequence
  chemically synthesized
ttgaatgaatgattgaacaa

SEQ ID NO: 72587 - DNA, 20 bp, Artificial Sequence
  chemically synthesized
gaatgaatgattgaacaaag

SEQ ID NO: 72588 - DNA, 20 bp, Artificial Sequence
  chemically synthesized
aatgaatgattgaacaaagg

SEQ ID NO: 72589 - DNA, 20 bp, Artificial Sequence
  chemically synthesized
aggaggatttccgttcactt

SEQ ID NO: 72590 - DNA, 20 bp, Artificial Sequence
  chemically synthesized
caaagtcttgctgaagtgaa

SEQ ID NO: 72591 - DNA, 20 bp, Artificial Sequence
  chemically synthesized
ggatttccgttcacttcagc

SEQ ID NO: 72592 - DNA, 20 bp, Artificial Sequence
  chemically synthesized
gaatcatcaaagtcttgctg

SEQ ID NO: 72593 - DNA, 20 bp, Artificial Sequence
  chemically synthesized
ccaagagggttgaatcatca

SEQ ID NO: 72594 - DNA, 20 bp, Artificial Sequence
  chemically synthesized
ctttgatgattcaaccctct

SEQ ID NO: 72595 - DNA, 20 bp, Artificial Sequence
  chemically synthesized
actcttctgtaggaccaaga

SEQ ID NO: 72596 - DNA, 20 bp, Artificial Sequence
  chemically synthesized
cactcttctgtaggaccaag

SEQ ID NO: 72597 - DNA, 20 bp, Artificial Sequence
  chemically synthesized
tcactcttctgtaggaccaa

SEQ ID NO: 72598 - DNA, 20 bp, Artificial Sequence
  chemically synthesized
attcaaccctcttggtccta

SEQ ID NO: 72599 - DNA, 20 bp, Artificial Sequence
  chemically synthesized
aatcactcttctgtaggacc

SEQ ID NO: 72600 - DNA, 20 bp, Artificial Sequence
  chemically synthesized
caaccctcttggtcctacag

SEQ ID NO: 72601 - DNA, 20 bp, Artificial Sequence
  chemically synthesized
accctcttggtcctacagaa

SEQ ID NO: 72602 - DNA, 20 bp, Artificial Sequence
  chemically synthesized
aactagaatcactcttctgt

SEQ ID NO: 72603 - DNA, 20 bp, Artificial Sequence
  chemically synthesized
aaactagaatcactcttctg

SEQ ID NO: 72604 - DNA, 20 bp, Artificial Sequence
  chemically synthesized
gtcctacagaagagtgattc

SEQ ID NO: 72605 - DNA, 20 bp, Artificial Sequence
  chemically synthesized
agaagagtgattctagtttt

SEQ ID NO: 72606 - DNA, 20 bp, Artificial Sequence
  chemically synthesized
atcattcacagactaaaaac

SEQ ID NO: 72607 - DNA, 20 bp, Artificial Sequence
  chemically synthesized
ctcagagcctgaatcattca

SEQ ID NO: 72608 - DNA, 20 bp, Artificial Sequence
  chemically synthesized
tttttagtctgtgaatgatt

SEQ ID NO: 72609 - DNA, 20 bp, Artificial Sequence
  chemically synthesized
ttttagtctgtgaatgattc

SEQ ID NO: 72610 - DNA, 20 bp, Artificial Sequence
  chemically synthesized
ctgtgaatgattcaggctct

SEQ ID NO: 72611 - DNA, 20 bp, Artificial Sequence
  chemically synthesized
agaattgcctgtttaactca

SEQ ID NO: 72612 - DNA, 20 bp, Artificial Sequence
  chemically synthesized
gattcaggctctgagttaaa

SEQ ID NO: 72613 - DNA, 20 bp, Artificial Sequence
  chemically synthesized
caagaattgcctgtttaact

SEQ ID NO: 72614 - DNA, 20 bp, Artificial Sequence
  chemically synthesized
attcaggctctgagttaaac

SEQ ID NO: 72615 - DNA, 20 bp, Artificial Sequence
  chemically synthesized
gagttaaacaggcaattctt

SEQ ID NO: 72616 - DNA, 20 bp, Artificial Sequence
  chemically synthesized
acaggcaattcttgagatcg

SEQ ID NO: 72617 - DNA, 20 bp, Artificial Sequence
  chemically synthesized
gaatttcagaccacgatctc

SEQ ID NO: 72618 - DNA, 20 bp, Artificial Sequence
  chemically synthesized
taggagggttgtatgaattt

SEQ ID NO: 72619 - DNA, 20 bp, Artificial Sequence
  chemically synthesized
tgaggaaatttaaagtagga

SEQ ID NO: 72620 - DNA, 20 bp, Artificial Sequence
  chemically synthesized
ttgaggaaatttaaagtagg

SEQ ID NO: 72621 - DNA, 20 bp, Artificial Sequence
  chemically synthesized
gttgaggaaatttaaagtag

SEQ ID NO: 72622 - DNA, 20 bp, Artificial Sequence
  chemically synthesized
gagttgaggaaatttaaagt

SEQ ID NO: 72623 - DNA, 20 bp, Artificial Sequence
  chemically synthesized
tgagttgaggaaatttaaag

SEQ ID NO: 72624 - DNA, 20 bp, Artificial Sequence
  chemically synthesized
tcatgagttgaggaaattta

SEQ ID NO: 72625 - DNA, 20 bp, Artificial Sequence
  chemically synthesized
atcacctggatcatgagttg

SEQ ID NO: 72626 - DNA, 20 bp, Artificial Sequence
  chemically synthesized
aatcacctggatcatgagtt

SEQ ID NO: 72627 - DNA, 20 bp, Artificial Sequence
  chemically synthesized
aatttcctcaactcatgatc

SEQ ID NO: 72628 - DNA, 20 bp, Artificial Sequence
  chemically synthesized
atttcctcaactcatgatcc

SEQ ID NO: 72629 - DNA, 20 bp, Artificial Sequence
  chemically synthesized
tcaggaatcacctggatcat

SEQ ID NO: 72630 - DNA, 20 bp, Artificial Sequence
  chemically synthesized
ttaatttgtcaggaatcacc

SEQ ID NO: 72631 - DNA, 20 bp, Artificial Sequence
  chemically synthesized
ctcacatttattaatttgtc

SEQ ID NO: 72632 - DNA, 20 bp, Artificial Sequence
  chemically synthesized
tctcacatttattaatttgt

SEQ ID NO: 72633 - DNA, 20 bp, Artificial Sequence
  chemically synthesized
cctgacaaattaataaatgt

SEQ ID NO: 72634 - DNA, 20 bp, Artificial Sequence
  chemically synthesized
gaccctttaaacaaaaagaa

SEQ ID NO: 72635 - DNA, 20 bp, Artificial Sequence
  chemically synthesized
gattcgaccctttaaacaaa

SEQ ID NO: 72636 - DNA, 20 bp, Artificial Sequence
  chemically synthesized
gatgctgttctttttgttta

SEQ ID NO: 72637 - DNA, 20 bp, Artificial Sequence
  chemically synthesized
atgctgttctttttgtttaa

SEQ ID NO: 72638 - DNA, 20 bp, Artificial Sequence
  chemically synthesized
tgctgttctttttgtttaaa

SEQ ID NO: 72639 - DNA, 20 bp, Artificial Sequence
  chemically synthesized
agggtcgaatcataaatgaa

SEQ ID NO: 72640 - DNA, 20 bp, Artificial Sequence
  chemically synthesized
gggtcgaatcataaatgaat

SEQ ID NO: 72641 - DNA, 20 bp, Artificial Sequence
  chemically synthesized
atgtcaattcaactttttat

SEQ ID NO: 72642 - DNA, 20 bp, Artificial Sequence
  chemically synthesized
gtcaattcaactttttatca

SEQ ID NO: 72643 - DNA, 20 bp, Artificial Sequence
  chemically synthesized
agtaccactcctctgataaa

SEQ ID NO: 72644 - DNA, 20 bp, Artificial Sequence
  chemically synthesized
tcaattcaactttttatcag

SEQ ID NO: 72645 - DNA, 20 bp, Artificial Sequence
  chemically synthesized
aattcaactttttatcagag

SEQ ID NO: 72646 - DNA, 20 bp, Artificial Sequence
  chemically synthesized
tcaactttttatcagaggag

SEQ ID NO: 72647 - DNA, 20 bp, Artificial Sequence
  chemically synthesized
atcagaggagtggtactgca

SEQ ID NO: 72648 - DNA, 20 bp, Artificial Sequence
  chemically synthesized
gaggagtggtactgcatagt

SEQ ID NO: 72649 - DNA, 20 bp, Artificial Sequence
  chemically synthesized
aggagtggtactgcatagtt

SEQ ID NO: 72650 - DNA, 20 bp, Artificial Sequence
  chemically synthesized
tgtcagaactcctaactatg

SEQ ID NO: 72651 - DNA, 20 bp, Artificial Sequence
  chemically synthesized
gagtggtactgcatagttag

SEQ ID NO: 72652 - DNA, 20 bp, Artificial Sequence
  chemically synthesized
tgcatagttaggagttctga

SEQ ID NO: 72653 - DNA, 20 bp, Artificial Sequence
  chemically synthesized
agtctgcctggggaatctgt

SEQ ID NO: 72654 - DNA, 20 bp, Artificial Sequence
  chemically synthesized
aggagttctgacagattccc

SEQ ID NO: 72655 - DNA, 20 bp, Artificial Sequence
  chemically synthesized
ggagttctgacagattcccc

SEQ ID NO: 72656 - DNA, 20 bp, Artificial Sequence
  chemically synthesized
gttctgacagattccccagg

SEQ ID NO: 72657 - DNA, 20 bp, Artificial Sequence
  chemically synthesized
gaacccagacagtctgcctg

SEQ ID NO: 72658 - DNA, 20 bp, Artificial Sequence
  chemically synthesized
tgaacccagacagtctgcct

SEQ ID NO: 72659 - DNA, 20 bp, Artificial Sequence
  chemically synthesized
ttgaacccagacagtctgcc

SEQ ID NO: 72660 - DNA, 20 bp, Artificial Sequence
  chemically synthesized
gattccccaggcagactgtc

SEQ ID NO: 72661 - DNA, 20 bp, Artificial Sequence
  chemically synthesized
attccccaggcagactgtct

SEQ ID NO: 72662 - DNA, 20 bp, Artificial Sequence
  chemically synthesized
agccaggatttgaacccaga

SEQ ID NO: 72663 - DNA, 20 bp, Artificial Sequence
  chemically synthesized
agagagccaggatttgaacc

SEQ ID NO: 72664 - DNA, 20 bp, Artificial Sequence
  chemically synthesized
gactgtctgggttcaaatcc

SEQ ID NO: 72665 - DNA, 20 bp, Artificial Sequence
  chemically synthesized
atcaggtaagtgagagagcc

SEQ ID NO: 72666 - DNA, 20 bp, Artificial Sequence
  chemically synthesized
tatcaggtaagtgagagagc

SEQ ID NO: 72667 - DNA, 20 bp, Artificial Sequence
  chemically synthesized
catatatcaggtaagtgaga

SEQ ID NO: 72668 - DNA, 20 bp, Artificial Sequence
  chemically synthesized
gtcatatatcaggtaagtga

SEQ ID NO: 72669 - DNA, 20 bp, Artificial Sequence
  chemically synthesized
tggtcatatatcaggtaagt

SEQ ID NO: 72670 - DNA, 20 bp, Artificial Sequence
  chemically synthesized
cctgtggtcatatatcaggt

SEQ ID NO: 72671 - DNA, 20 bp, Artificial Sequence
  chemically synthesized
cttgcctgtggtcatatatc

SEQ ID NO: 72672 - DNA, 20 bp, Artificial Sequence
  chemically synthesized
acttgcctgtggtcatatat

SEQ ID NO: 72673 - DNA, 20 bp, Artificial Sequence
  chemically synthesized
acttacctgatatatgacca

SEQ ID NO: 72674 - DNA, 20 bp, Artificial Sequence
  chemically synthesized
cttacctgatatatgaccac

SEQ ID NO: 72675 - DNA, 20 bp, Artificial Sequence
  chemically synthesized
cctgatatatgaccacaggc

SEQ ID NO: 72676 - DNA, 20 bp, Artificial Sequence
  chemically synthesized
agggttaagtgacttgcctg

SEQ ID NO: 72677 - DNA, 20 bp, Artificial Sequence
  chemically synthesized
caggcaagtcacttaaccct

SEQ ID NO: 72678 - DNA, 20 bp, Artificial Sequence
  chemically synthesized
aggcaagtcacttaaccctt

SEQ ID NO: 72679 - DNA, 20 bp, Artificial Sequence
  chemically synthesized
aaatgaggagcccaagggtt

SEQ ID NO: 72680 - DNA, 20 bp, Artificial Sequence
  chemically synthesized
tagaaaaatgaggagcccaa

SEQ ID NO: 72681 - DNA, 20 bp, Artificial Sequence
  chemically synthesized
ttagaaaaatgaggagccca

SEQ ID NO: 72682 - DNA, 20 bp, Artificial Sequence
  chemically synthesized
gttagaaaaatgaggagccc

SEQ ID NO: 72683 - DNA, 20 bp, Artificial Sequence
  chemically synthesized
ttacaggttagaaaaatgag

SEQ ID NO: 72684 - DNA, 20 bp, Artificial Sequence
  chemically synthesized
ttttacaggttagaaaaatg

SEQ ID NO: 72685 - DNA, 20 bp, Artificial Sequence
  chemically synthesized
attttacaggttagaaaaat

SEQ ID NO: 72686 - DNA, 20 bp, Artificial Sequence
  chemically synthesized
tttaacctcattttacaggt

SEQ ID NO: 72687 - DNA, 20 bp, Artificial Sequence
  chemically synthesized
atttttctaacctgtaaaat

SEQ ID NO: 72688 - DNA, 20 bp, Artificial Sequence
  chemically synthesized
caattttaacctcattttac

SEQ ID NO: 72689 - DNA, 20 bp, Artificial Sequence
  chemically synthesized
tttttctaacctgtaaaatg

SEQ ID NO: 72690 - DNA, 20 bp, Artificial Sequence
  chemically synthesized
acaattttaacctcatttta

SEQ ID NO: 72691 - DNA, 20 bp, Artificial Sequence
  chemically synthesized
taaaattgtacctccctcac

SEQ ID NO: 72692 - DNA, 20 bp, Artificial Sequence
  chemically synthesized
ctcacgtaacccagtgaggg

SEQ ID NO: 72693 - DNA, 20 bp, Artificial Sequence
  chemically synthesized
aaaattgtacctccctcact

SEQ ID NO: 72694 - DNA, 20 bp, Artificial Sequence
  chemically synthesized
cctcacgtaacccagtgagg

SEQ ID NO: 72695 - DNA, 20 bp, Artificial Sequence
  chemically synthesized
agcctcacgtaacccagtga

SEQ ID NO: 72696 - DNA, 20 bp, Artificial Sequence
  chemically synthesized
aagcctcacgtaacccagtg

SEQ ID NO: 72697 - DNA, 20 bp, Artificial Sequence
  chemically synthesized
taagcctcacgtaacccagt

SEQ ID NO: 72698 - DNA, 20 bp, Artificial Sequence
  chemically synthesized
cttttaagcctcacgtaacc

SEQ ID NO: 72699 - DNA, 20 bp, Artificial Sequence
  chemically synthesized
cctccctcactgggttacgt

SEQ ID NO: 72700 - DNA, 20 bp, Artificial Sequence
  chemically synthesized
ctccctcactgggttacgtg

SEQ ID NO: 72701 - DNA, 20 bp, Artificial Sequence
  chemically synthesized
ctgggttacgtgaggcttaa

SEQ ID NO: 72702 - DNA, 20 bp, Artificial Sequence
  chemically synthesized
ttgcatgtgctaatgctttt

SEQ ID NO: 72703 - DNA, 20 bp, Artificial Sequence
  chemically synthesized
tacgtgaggcttaaaagcat

SEQ ID NO: 72704 - DNA, 20 bp, Artificial Sequence
  chemically synthesized
aaaagcattagcacatgcaa

SEQ ID NO: 72705 - DNA, 20 bp, Artificial Sequence
  chemically synthesized
tgtatgccattcacaattat

SEQ ID NO: 72706 - DNA, 20 bp, Artificial Sequence
  chemically synthesized
aaagtgcttataattgtgaa

SEQ ID NO: 72707 - DNA, 20 bp, Artificial Sequence
  chemically synthesized
ttataattgtgaatggcata

SEQ ID NO: 72708 - DNA, 20 bp, Artificial Sequence
  chemically synthesized
aattgtgaatggcatacagt

SEQ ID NO: 72709 - DNA, 20 bp, Artificial Sequence
  chemically synthesized
gaatggcatacagtaagtgc

SEQ ID NO: 72710 - DNA, 20 bp, Artificial Sequence
  chemically synthesized
aatggcatacagtaagtgct

SEQ ID NO: 72711 - DNA, 20 bp, Artificial Sequence
  chemically synthesized
gcatacagtaagtgctaggt

SEQ ID NO: 72712 - DNA, 20 bp, Artificial Sequence
  chemically synthesized
attaatagtgagaacttacc

SEQ ID NO: 72713 - DNA, 20 bp, Artificial Sequence
  chemically synthesized
cgcttactgagattaatagt

SEQ ID NO: 72714 - DNA, 20 bp, Artificial Sequence
  chemically synthesized
taagttctcactattaatct

SEQ ID NO: 72715 - DNA, 20 bp, Artificial Sequence
  chemically synthesized
attacgcttactgagattaa

SEQ ID NO: 72716 - DNA, 20 bp, Artificial Sequence
  chemically synthesized
ttctcactattaatctcagt

SEQ ID NO: 72717 - DNA, 20 bp, Artificial Sequence
  chemically synthesized
tagtgagcattacgcttact

SEQ ID NO: 72718 - DNA, 20 bp, Artificial Sequence
  chemically synthesized
aatttgaaaataattttagt

SEQ ID NO: 72719 - DNA, 20 bp, Artificial Sequence
  chemically synthesized
tataaatttgaaaataattt

SEQ ID NO: 72720 - DNA, 20 bp, Artificial Sequence
  chemically synthesized
agacaatcaatgtagtcata

SEQ ID NO: 72721 - DNA, 20 bp, Artificial Sequence
  chemically synthesized
ctttattcagacaatcaatg

SEQ ID NO: 72722 - DNA, 20 bp, Artificial Sequence
  chemically synthesized
ctacattgattgtctgaata

SEQ ID NO: 72723 - DNA, 20 bp, Artificial Sequence
  chemically synthesized
atacatagttttactttatt

SEQ ID NO: 72724 - DNA, 20 bp, Artificial Sequence
  chemically synthesized
ataaagtaaaactatgtata

SEQ ID NO: 72725 - DNA, 20 bp, Artificial Sequence
  chemically synthesized
taaagtaaaactatgtataa

SEQ ID NO: 72726 - DNA, 20 bp, Artificial Sequence
  chemically synthesized
agaagtacagcctttataca

SEQ ID NO: 72727 - DNA, 20 bp, Artificial Sequence
  chemically synthesized
tgattcttatatcagaagta

SEQ ID NO: 72728 - DNA, 20 bp, Artificial Sequence
  chemically synthesized
aaaggctgtacttctgatat

SEQ ID NO: 72729 - DNA, 20 bp, Artificial Sequence
  chemically synthesized
gaagatgattcttatatcag

SEQ ID NO: 72730 - DNA, 20 bp, Artificial Sequence
  chemically synthesized
ttagaagatgattcttatat

SEQ ID NO: 72731 - DNA, 20 bp, Artificial Sequence
  chemically synthesized
gtggaaatataataaattag

SEQ ID NO: 72732 - DNA, 20 bp, Artificial Sequence
  chemically synthesized
agggtggaaatataataaat

SEQ ID NO: 72733 - DNA, 20 bp, Artificial Sequence
  chemically synthesized
tactaaaggagacgggaggg

SEQ ID NO: 72734 - DNA, 20 bp, Artificial Sequence
  chemically synthesized
atttactaaaggagacggga

SEQ ID NO: 72735 - DNA, 20 bp, Artificial Sequence
  chemically synthesized
aatttactaaaggagacggg

SEQ ID NO: 72736 - DNA, 20 bp, Artificial Sequence
  chemically synthesized
taatttactaaaggagacgg

SEQ ID NO: 72737 - DNA, 20 bp, Artificial Sequence
  chemically synthesized
attaatttactaaaggagac

SEQ ID NO: 72738 - DNA, 20 bp, Artificial Sequence
  chemically synthesized
ttccaccctcccgtctcctt

SEQ ID NO: 72739 - DNA, 20 bp, Artificial Sequence
  chemically synthesized
aattaatttactaaaggaga

SEQ ID NO: 72740 - DNA, 20 bp, Artificial Sequence
  chemically synthesized
tattaattaatttactaaag

SEQ ID NO: 72741 - DNA, 20 bp, Artificial Sequence
  chemically synthesized
tatattaattaatttactaa

SEQ ID NO: 72742 - DNA, 20 bp, Artificial Sequence
  chemically synthesized
atatattaattaatttacta

SEQ ID NO: 72743 - DNA, 20 bp, Artificial Sequence
  chemically synthesized
agtaaattaattaatatatt

SEQ ID NO: 72744 - DNA, 20 bp, Artificial Sequence
  chemically synthesized
gtaaattaattaatatatta

SEQ ID NO: 72745 - DNA, 20 bp, Artificial Sequence
  chemically synthesized
taaattaattaatatattaa

SEQ ID NO: 72746 - DNA, 20 bp, Artificial Sequence
  chemically synthesized
aattaattaatatattaagg

SEQ ID NO: 72747 - DNA, 20 bp, Artificial Sequence
  chemically synthesized
ttaattaatatattaaggga

SEQ ID NO: 72748 - DNA, 20 bp, Artificial Sequence
  chemically synthesized
taattaatatattaagggag

SEQ ID NO: 72749 - DNA, 20 bp, Artificial Sequence
  chemically synthesized
ggagaggacaacttatatca

SEQ ID NO: 72750 - DNA, 20 bp, Artificial Sequence
  chemically synthesized
tataatgatcactgtgatat

SEQ ID NO: 72751 - DNA, 20 bp, Artificial Sequence
  chemically synthesized
atcacagtgatcattatatt

SEQ ID NO: 72752 - DNA, 20 bp, Artificial Sequence
  chemically synthesized
tcacagtgatcattatatta

SEQ ID NO: 72753 - DNA, 20 bp, Artificial Sequence
  chemically synthesized
tcattatattaaggacatta

SEQ ID NO: 72754 - DNA, 20 bp, Artificial Sequence
  chemically synthesized
ttatagcatttataaaaata

SEQ ID NO: 72755 - DNA, 20 bp, Artificial Sequence
  chemically synthesized
tagcatttataaaaataaag

SEQ ID NO: 72756 - DNA, 20 bp, Artificial Sequence
  chemically synthesized
aagtgaatttcaaattcata

SEQ ID NO: 72757 - DNA, 20 bp, Artificial Sequence
  chemically synthesized
tgaatttgaaattcactttg

SEQ ID NO: 72758 - DNA, 20 bp, Artificial Sequence
  chemically synthesized
ttttaaaggtaaataccaca

SEQ ID NO: 72759 - DNA, 20 bp, Artificial Sequence
  chemically synthesized
tttgtggtatttacctttaa

SEQ ID NO: 72760 - DNA, 20 bp, Artificial Sequence
  chemically synthesized
gtggtatttacctttaaaag

SEQ ID NO: 72761 - DNA, 20 bp, Artificial Sequence
  chemically synthesized
ttcagaaatgctacttttaa

SEQ ID NO: 72762 - DNA, 20 bp, Artificial Sequence
  chemically synthesized
attcagaaatgctactttta

SEQ ID NO: 72763 - DNA, 20 bp, Artificial Sequence
  chemically synthesized
ggaaactagcgtatgaaatt

SEQ ID NO: 72764 - DNA, 20 bp, Artificial Sequence
  chemically synthesized
catttctgaatttcatacgc

SEQ ID NO: 72765 - DNA, 20 bp, Artificial Sequence
  chemically synthesized
ccataaaggggaatggaaac

SEQ ID NO: 72766 - DNA, 20 bp, Artificial Sequence
  chemically synthesized
gccaactccataaaggggaa

SEQ ID NO: 72767 - DNA, 20 bp, Artificial Sequence
  chemically synthesized
ctagtttccattccccttta

SEQ ID NO: 72768 - DNA, 20 bp, Artificial Sequence
  chemically synthesized
agtttccattcccctttatg

SEQ ID NO: 72769 - DNA, 20 bp, Artificial Sequence
  chemically synthesized
ttaaagccaactccataaag

SEQ ID NO: 72770 - DNA, 20 bp, Artificial Sequence
  chemically synthesized
gttaaagccaactccataaa

SEQ ID NO: 72771 - DNA, 20 bp, Artificial Sequence
  chemically synthesized
tgttaaagccaactccataa

SEQ ID NO: 72772 - DNA, 20 bp, Artificial Sequence
  chemically synthesized
gtgttaaagccaactccata

SEQ ID NO: 72773 - DNA, 20 bp, Artificial Sequence
  chemically synthesized
tccattcccctttatggagt

SEQ ID NO: 72774 - DNA, 20 bp, Artificial Sequence
  chemically synthesized
atggagttggctttaacacg

SEQ ID NO: 72775 - DNA, 20 bp, Artificial Sequence
  chemically synthesized
acatgagaagctgcgtgtta

SEQ ID NO: 72776 - DNA, 20 bp, Artificial Sequence
  chemically synthesized
ttaacacgcagcttctcatg

SEQ ID NO: 72777 - DNA, 20 bp, Artificial Sequence
  chemically synthesized
cccctttcaggccacatgag

SEQ ID NO: 72778 - DNA, 20 bp, Artificial Sequence
  chemically synthesized
aatcccctttcaggccacat

SEQ ID NO: 72779 - DNA, 20 bp, Artificial Sequence
  chemically synthesized
cagcttctcatgtggcctga

SEQ ID NO: 72780 - DNA, 20 bp, Artificial Sequence
  chemically synthesized
agcttctcatgtggcctgaa

SEQ ID NO: 72781 - DNA, 20 bp, Artificial Sequence
  chemically synthesized
gcttctcatgtggcctgaaa

SEQ ID NO: 72782 - DNA, 20 bp, Artificial Sequence
  chemically synthesized
cttctcatgtggcctgaaag

SEQ ID NO: 72783 - DNA, 20 bp, Artificial Sequence
  chemically synthesized
agtagaaagaatcccctttc

SEQ ID NO: 72784 - DNA, 20 bp, Artificial Sequence
  chemically synthesized
aagtagaaagaatccccttt

SEQ ID NO: 72785 - DNA, 20 bp, Artificial Sequence
  chemically synthesized
acattcctctagaaagtaga

SEQ ID NO: 72786 - DNA, 20 bp, Artificial Sequence
  chemically synthesized
aggggattctttctactttc

SEQ ID NO: 72787 - DNA, 20 bp, Artificial Sequence
  chemically synthesized
gggattctttctactttcta

SEQ ID NO: 72788 - DNA, 20 bp, Artificial Sequence
  chemically synthesized
cagcacattcctctagaaag

SEQ ID NO: 72789 - DNA, 20 bp, Artificial Sequence
  chemically synthesized
ggattctttctactttctag

SEQ ID NO: 72790 - DNA, 20 bp, Artificial Sequence
  chemically synthesized
tcacagcacattcctctaga

SEQ ID NO: 72791 - DNA, 20 bp, Artificial Sequence
  chemically synthesized
tccttcacagcacattcctc

SEQ ID NO: 72792 - DNA, 20 bp, Artificial Sequence
  chemically synthesized
ttctagaggaatgtgctgtg

SEQ ID NO: 72793 - DNA, 20 bp, Artificial Sequence
  chemically synthesized
tctagaggaatgtgctgtga

SEQ ID NO: 72794 - DNA, 20 bp, Artificial Sequence
  chemically synthesized
tagaggaatgtgctgtgaag

SEQ ID NO: 72795 - DNA, 20 bp, Artificial Sequence
  chemically synthesized
agaggaatgtgctgtgaagg

SEQ ID NO: 72796 - DNA, 20 bp, Artificial Sequence
  chemically synthesized
gattcccgactcctccttca

SEQ ID NO: 72797 - DNA, 20 bp, Artificial Sequence
  chemically synthesized
aggaatgtgctgtgaaggag

SEQ ID NO: 72798 - DNA, 20 bp, Artificial Sequence
  chemically synthesized
atgtgctgtgaaggaggagt

SEQ ID NO: 72799 - DNA, 20 bp, Artificial Sequence
  chemically synthesized
tgtgctgtgaaggaggagtc

SEQ ID NO: 72800 - DNA, 20 bp, Artificial Sequence
  chemically synthesized
ggaggagtcgggaatcttac

SEQ ID NO: 72801 - DNA, 20 bp, Artificial Sequence
  chemically synthesized
ggagtcgggaatcttactgg

SEQ ID NO: 72802 - DNA, 20 bp, Artificial Sequence
  chemically synthesized
gttctcacatggccgccagt

SEQ ID NO: 72803 - DNA, 20 bp, Artificial Sequence
  chemically synthesized
tgctgttctcacatggccgc

SEQ ID NO: 72804 - DNA, 20 bp, Artificial Sequence
  chemically synthesized
aatcttactggcggccatgt

SEQ ID NO: 72805 - DNA, 20 bp, Artificial Sequence
  chemically synthesized
aaagagctgctgttctcaca

SEQ ID NO: 72806 - DNA, 20 bp, Artificial Sequence
  chemically synthesized
tactggcggccatgtgagaa

SEQ ID NO: 72807 - DNA, 20 bp, Artificial Sequence
  chemically synthesized
tggcggccatgtgagaacag

SEQ ID NO: 72808 - DNA, 20 bp, Artificial Sequence
  chemically synthesized
catcatacccagcattcaaa

SEQ ID NO: 72809 - DNA, 20 bp, Artificial Sequence
  chemically synthesized
aacagcagctctttgaatgc

SEQ ID NO: 72810 - DNA, 20 bp, Artificial Sequence
  chemically synthesized
tacatcatacccagcattca

SEQ ID NO: 72811 - DNA, 20 bp, Artificial Sequence
  chemically synthesized
acagcagctctttgaatgct

SEQ ID NO: 72812 - DNA, 20 bp, Artificial Sequence
  chemically synthesized
ttcccatgctacatcatacc

SEQ ID NO: 72813 - DNA, 20 bp, Artificial Sequence
  chemically synthesized
tttgaatgctgggtatgatg

SEQ ID NO: 72814 - DNA, 20 bp, Artificial Sequence
  chemically synthesized
atgctgggtatgatgtagca

SEQ ID NO: 72815 - DNA, 20 bp, Artificial Sequence
  chemically synthesized
tgctgggtatgatgtagcat

SEQ ID NO: 72816 - DNA, 20 bp, Artificial Sequence
  chemically synthesized
tgatgtagcatgggaactgt

SEQ ID NO: 72817 - DNA, 20 bp, Artificial Sequence
  chemically synthesized
tgtagcatgggaactgtgag

SEQ ID NO: 72818 - DNA, 20 bp, Artificial Sequence
  chemically synthesized
actccgccagtagctgctca

SEQ ID NO: 72819 - DNA, 20 bp, Artificial Sequence
  chemically synthesized
tgggaactgtgagcagctac

SEQ ID NO: 72820 - DNA, 20 bp, Artificial Sequence
  chemically synthesized
gaactgtgagcagctactgg

SEQ ID NO: 72821 - DNA, 20 bp, Artificial Sequence
  chemically synthesized
actgtgagcagctactggcg

SEQ ID NO: 72822 - DNA, 20 bp, Artificial Sequence
  chemically synthesized
catgtgaaacactccgccag

SEQ ID NO: 72823 - DNA, 20 bp, Artificial Sequence
  chemically synthesized
ctgcatgtgaaacactccgc

SEQ ID NO: 72824 - DNA, 20 bp, Artificial Sequence
  chemically synthesized
ctggcggagtgtttcacatg

SEQ ID NO: 72825 - DNA, 20 bp, Artificial Sequence
  chemically synthesized
ggagtgtttcacatgcagcg

SEQ ID NO: 72826 - DNA, 20 bp, Artificial Sequence
  chemically synthesized
gtgtttcacatgcagcgcag

SEQ ID NO: 72827 - DNA, 20 bp, Artificial Sequence
  chemically synthesized
tgtttcacatgcagcgcagc

SEQ ID NO: 72828 - DNA, 20 bp, Artificial Sequence
  chemically synthesized
gtttcacatgcagcgcagcg

SEQ ID NO: 72829 - DNA, 20 bp, Artificial Sequence
  chemically synthesized
tcacatgcagcgcagcgggg

SEQ ID NO: 72830 - DNA, 20 bp, Artificial Sequence
  chemically synthesized
catgcagcgcagcggggcag

SEQ ID NO: 72831 - DNA, 20 bp, Artificial Sequence
  chemically synthesized
atgcagcgcagcggggcagt

SEQ ID NO: 72832 - DNA, 20 bp, Artificial Sequence
  chemically synthesized
agcgcagcggggcagtggga

SEQ ID NO: 72833 - DNA, 20 bp, Artificial Sequence
  chemically synthesized
gcgcagcggggcagtgggaa

SEQ ID NO: 72834 - DNA, 20 bp, Artificial Sequence
  chemically synthesized
gggcagtgggaaaggcaatg

SEQ ID NO: 72835 - DNA, 20 bp, Artificial Sequence
  chemically synthesized
aaggcaatgaagaaaacaac

SEQ ID NO: 72836 - DNA, 20 bp, Artificial Sequence
  chemically synthesized
tcttctgcatttgtttgcac

SEQ ID NO: 72837 - DNA, 20 bp, Artificial Sequence
  chemically synthesized
acaaccagtgcaaacaaatg

SEQ ID NO: 72838 - DNA, 20 bp, Artificial Sequence
  chemically synthesized
accagtgcaaacaaatgcag

SEQ ID NO: 72839 - DNA, 20 bp, Artificial Sequence
  chemically synthesized
gtgcaaacaaatgcagaaga

SEQ ID NO: 72840 - DNA, 20 bp, Artificial Sequence
  chemically synthesized
tgcaaacaaatgcagaagaa

SEQ ID NO: 72841 - DNA, 20 bp, Artificial Sequence
  chemically synthesized
gcaaacaaatgcagaagaaa

SEQ ID NO: 72842 - DNA, 20 bp, Artificial Sequence
  chemically synthesized
aacaaatgcagaagaaaggg

SEQ ID NO: 72843 - DNA, 20 bp, Artificial Sequence
  chemically synthesized
acaaatgcagaagaaagggt

SEQ ID NO: 72844 - DNA, 20 bp, Artificial Sequence
  chemically synthesized
caaatgcagaagaaagggtg

SEQ ID NO: 72845 - DNA, 20 bp, Artificial Sequence
  chemically synthesized
atgcagaagaaagggtgggg

SEQ ID NO: 72846 - DNA, 20 bp, Artificial Sequence
  chemically synthesized
tgcagaagaaagggtggggc

SEQ ID NO: 72847 - DNA, 20 bp, Artificial Sequence
  chemically synthesized
gcagaagaaagggtggggcg

SEQ ID NO: 72848 - DNA, 20 bp, Artificial Sequence
  chemically synthesized
ggtggggcggggtcaaactc

SEQ ID NO: 72849 - DNA, 20 bp, Artificial Sequence
  chemically synthesized
gtggggcggggtcaaactcc

SEQ ID NO: 72850 - DNA, 20 bp, Artificial Sequence
  chemically synthesized
tggggcggggtcaaactcca

SEQ ID NO: 72851 - DNA, 20 bp, Artificial Sequence
  chemically synthesized
ggcggggtcaaactccaggg

SEQ ID NO: 72852 - DNA, 20 bp, Artificial Sequence
  chemically synthesized
gcggggtcaaactccaggga

SEQ ID NO: 72853 - DNA, 20 bp, Artificial Sequence
  chemically synthesized
ctgacctctctccttccctg

SEQ ID NO: 72854 - DNA, 20 bp, Artificial Sequence
  chemically synthesized
ggggtcaaactccagggaag

SEQ ID NO: 72855 - DNA, 20 bp, Artificial Sequence
  chemically synthesized
ggctgacctctctccttccc

SEQ ID NO: 72856 - DNA, 20 bp, Artificial Sequence
  chemically synthesized
ggtcaaactccagggaagga

SEQ ID NO: 72857 - DNA, 20 bp, Artificial Sequence
  chemically synthesized
tcaaactccagggaaggaga

SEQ ID NO: 72858 - DNA, 20 bp, Artificial Sequence
  chemically synthesized
caaactccagggaaggagag

SEQ ID NO: 72859 - DNA, 20 bp, Artificial Sequence
  chemically synthesized
ctccagggaaggagagaggt

SEQ ID NO: 72860 - DNA, 20 bp, Artificial Sequence
  chemically synthesized
gggaaggagagaggtcagcc

SEQ ID NO: 72861 - DNA, 20 bp, Artificial Sequence
  chemically synthesized
gaaggagagaggtcagccca

SEQ ID NO: 72862 - DNA, 20 bp, Artificial Sequence
  chemically synthesized
aggagagaggtcagcccaga

SEQ ID NO: 72863 - DNA, 20 bp, Artificial Sequence
  chemically synthesized
gtaagtgttcttgtctctct

SEQ ID NO: 72864 - DNA, 20 bp, Artificial Sequence
  chemically synthesized
agaggtcagcccagagagac

SEQ ID NO: 72865 - DNA, 20 bp, Artificial Sequence
  chemically synthesized
tgtaagtgttcttgtctctc

SEQ ID NO: 72866 - DNA, 20 bp, Artificial Sequence
  chemically synthesized
agagagacaagaacacttac

SEQ ID NO: 72867 - DNA, 20 bp, Artificial Sequence
  chemically synthesized
gctttattctttgttcttgt

SEQ ID NO: 72868 - DNA, 20 bp, Artificial Sequence
  chemically synthesized
caagaacacttacaagaaca

SEQ ID NO: 72869 - DNA, 20 bp, Artificial Sequence
  chemically synthesized
acttacaagaacaaagaata

SEQ ID NO: 72870 - DNA, 20 bp, Artificial Sequence
  chemically synthesized
tacaagaacaaagaataaag

SEQ ID NO: 72871 - DNA, 20 bp, Artificial Sequence
  chemically synthesized
agaacaaagaataaagcagt

SEQ ID NO: 72872 - DNA, 20 bp, Artificial Sequence
  chemically synthesized
agaataaagcagtgagaaat

SEQ ID NO: 72873 - DNA, 20 bp, Artificial Sequence
  chemically synthesized
aataaagcagtgagaaattg

SEQ ID NO: 72874 - DNA, 20 bp, Artificial Sequence
  chemically synthesized
agcagtgagaaattggagac

SEQ ID NO: 72875 - DNA, 20 bp, Artificial Sequence
  chemically synthesized
gcagtgagaaattggagaca

SEQ ID NO: 72876 - DNA, 20 bp, Artificial Sequence
  chemically synthesized
cagtgagaaattggagacaa

SEQ ID NO: 72877 - DNA, 20 bp, Artificial Sequence
  chemically synthesized
ttggagacaagggcaaatgt

SEQ ID NO: 72878 - DNA, 20 bp, Artificial Sequence
  chemically synthesized
acaagggcaaatgtcagttg

SEQ ID NO: 72879 - DNA, 20 bp, Artificial Sequence
  chemically synthesized
gcaaatgtcagttgcagaat

SEQ ID NO: 72880 - DNA, 20 bp, Artificial Sequence
  chemically synthesized
caaatgtcagttgcagaata

SEQ ID NO: 72881 - DNA, 20 bp, Artificial Sequence
  chemically synthesized
aaatgtcagttgcagaataa

SEQ ID NO: 72882 - DNA, 20 bp, Artificial Sequence
  chemically synthesized
tcagttgcagaataagggaa

SEQ ID NO: 72883 - DNA, 20 bp, Artificial Sequence
  chemically synthesized
cagttgcagaataagggaaa

SEQ ID NO: 72884 - DNA, 20 bp, Artificial Sequence
  chemically synthesized
gcagaataagggaaaaggac

SEQ ID NO: 72885 - DNA, 20 bp, Artificial Sequence
  chemically synthesized
acaagaaaacatgaccatca

SEQ ID NO: 72886 - DNA, 20 bp, Artificial Sequence
  chemically synthesized
ggcatttaaaattgccatga

SEQ ID NO: 72887 - DNA, 20 bp, Artificial Sequence
  chemically synthesized
tcatggcaattttaaatgcc

SEQ ID NO: 72888 - DNA, 20 bp, Artificial Sequence
  chemically synthesized
agaaacatgtatataattcc

SEQ ID NO: 72889 - DNA, 20 bp, Artificial Sequence
  chemically synthesized
tagaaacatgtatataattc

SEQ ID NO: 72890 - DNA, 20 bp, Artificial Sequence
  chemically synthesized
tggaattatatacatgtttc

SEQ ID NO: 72891 - DNA, 20 bp, Artificial Sequence
  chemically synthesized
attatatacatgtttctagt

SEQ ID NO: 72892 - DNA, 20 bp, Artificial Sequence
  chemically synthesized
ttatatacatgtttctagta

SEQ ID NO: 72893 - DNA, 20 bp, Artificial Sequence
  chemically synthesized
tgagacctctagttccttac

SEQ ID NO: 72894 - DNA, 20 bp, Artificial Sequence
  chemically synthesized
acatgtttctagtaaggaac

SEQ ID NO: 72895 - DNA, 20 bp, Artificial Sequence
  chemically synthesized
atgtttctagtaaggaacta

SEQ ID NO: 72896 - DNA, 20 bp, Artificial Sequence
  chemically synthesized
tgtttctagtaaggaactag

SEQ ID NO: 72897 - DNA, 20 bp, Artificial Sequence
  chemically synthesized
tagtaaggaactagaggtct

SEQ ID NO: 72898 - DNA, 20 bp, Artificial Sequence
  chemically synthesized
ttttagtttcctgagacctc

SEQ ID NO: 72899 - DNA, 20 bp, Artificial Sequence
  chemically synthesized
agtaaggaactagaggtctc

SEQ ID NO: 72900 - DNA, 20 bp, Artificial Sequence
  chemically synthesized
tgtatttattttagtttcct

SEQ ID NO: 72901 - DNA, 20 bp, Artificial Sequence
  chemically synthesized
atgcatgcatgtatttattt

SEQ ID NO: 72902 - DNA, 20 bp, Artificial Sequence
  chemically synthesized
tcctagtaaatgtgtttaaa

SEQ ID NO: 72903 - DNA, 20 bp, Artificial Sequence
  chemically synthesized
tgctatttaaacacatttac

SEQ ID NO: 72904 - DNA, 20 bp, Artificial Sequence
  chemically synthesized
gctatttaaacacatttact

SEQ ID NO: 72905 - DNA, 20 bp, Artificial Sequence
  chemically synthesized
ttaaaaatggaatgtgttcc

SEQ ID NO: 72906 - DNA, 20 bp, Artificial Sequence
  chemically synthesized
tttattattgtttttaaaaa

SEQ ID NO: 72907 - DNA, 20 bp, Artificial Sequence
  chemically synthesized
caataataaacacacttaca

SEQ ID NO: 72908 - DNA, 20 bp, Artificial Sequence
  chemically synthesized
gctattatggtaatccatgt

SEQ ID NO: 72909 - DNA, 20 bp, Artificial Sequence
  chemically synthesized
acttacatggattaccataa

SEQ ID NO: 72910 - DNA, 20 bp, Artificial Sequence
  chemically synthesized
acatggattaccataatagc

SEQ ID NO: 72911 - DNA, 20 bp, Artificial Sequence
  chemically synthesized
agttctaaggctagctatta

SEQ ID NO: 72912 - DNA, 20 bp, Artificial Sequence
  chemically synthesized
attaccataatagctagcct

SEQ ID NO: 72913 - DNA, 20 bp, Artificial Sequence
  chemically synthesized
atttttgctagttctaaggc

SEQ ID NO: 72914 - DNA, 20 bp, Artificial Sequence
  chemically synthesized
ataatagctagccttagaac

SEQ ID NO: 72915 - DNA, 20 bp, Artificial Sequence
  chemically synthesized
aactatttttgctagttcta

SEQ ID NO: 72916 - DNA, 20 bp, Artificial Sequence
  chemically synthesized
gaactatttttgctagttct

SEQ ID NO: 72917 - DNA, 20 bp, Artificial Sequence
  chemically synthesized
agccttagaactagcaaaaa

SEQ ID NO: 72918 - DNA, 20 bp, Artificial Sequence
  chemically synthesized
taatcgggaactatttttgc

SEQ ID NO: 72919 - DNA, 20 bp, Artificial Sequence
  chemically synthesized
atttctaatttgttttaatc

SEQ ID NO: 72920 - DNA, 20 bp, Artificial Sequence
  chemically synthesized
aatttctaatttgttttaat

SEQ ID NO: 72921 - DNA, 20 bp, Artificial Sequence
  chemically synthesized
agttcccgattaaaacaaat

SEQ ID NO: 72922 - DNA, 20 bp, Artificial Sequence
  chemically synthesized
gattaaaacaaattagaaat

SEQ ID NO: 72923 - DNA, 20 bp, Artificial Sequence
  chemically synthesized
aaattagaaattagtatata

SEQ ID NO: 72924 - DNA, 20 bp, Artificial Sequence
  chemically synthesized
gaaattagtatataaagatc

SEQ ID NO: 72925 - DNA, 20 bp, Artificial Sequence
  chemically synthesized
tatataaagatcaagcaatc

SEQ ID NO: 72926 - DNA, 20 bp, Artificial Sequence
  chemically synthesized
ataaagatcaagcaatcaag

SEQ ID NO: 72927 - DNA, 20 bp, Artificial Sequence
  chemically synthesized
atcattataaagtattaatt

SEQ ID NO: 72928 - DNA, 20 bp, Artificial Sequence
  chemically synthesized
aatcattataaagtattaat

SEQ ID NO: 72929 - DNA, 20 bp, Artificial Sequence
  chemically synthesized
agtgaacccaaatcattata

SEQ ID NO: 72930 - DNA, 20 bp, Artificial Sequence
  chemically synthesized
attaatactttataatgatt

SEQ ID NO: 72931 - DNA, 20 bp, Artificial Sequence
  chemically synthesized
ttaatactttataatgattt

SEQ ID NO: 72932 - DNA, 20 bp, Artificial Sequence
  chemically synthesized
ttattttcagatattttata

SEQ ID NO: 72933 - DNA, 20 bp, Artificial Sequence
  chemically synthesized
gaaaagcatattattatttt

SEQ ID NO: 72934 - DNA, 20 bp, Artificial Sequence
  chemically synthesized
tatgaatttaagagaatgaa

SEQ ID NO: 72935 - DNA, 20 bp, Artificial Sequence
  chemically synthesized
agaaatatttatgaatttaa

SEQ ID NO: 72936 - DNA, 20 bp, Artificial Sequence
  chemically synthesized
aaagaaatatttatgaattt

SEQ ID NO: 72937 - DNA, 20 bp, Artificial Sequence
  chemically synthesized
taaattcataaatatttctt

SEQ ID NO: 72938 - DNA, 20 bp, Artificial Sequence
  chemically synthesized
aatgaagccatcaggagcca

SEQ ID NO: 72939 - DNA, 20 bp, Artificial Sequence
  chemically synthesized
aatatttctttggctcctga

SEQ ID NO: 72940 - DNA, 20 bp, Artificial Sequence
  chemically synthesized
aatgggaatgaagccatcag

SEQ ID NO: 72941 - DNA, 20 bp, Artificial Sequence
  chemically synthesized
aaaatgggaatgaagccatc

SEQ ID NO: 72942 - DNA, 20 bp, Artificial Sequence
  chemically synthesized
taaaatgggaatgaagccat

SEQ ID NO: 72943 - DNA, 20 bp, Artificial Sequence
  chemically synthesized
tgaagtataaaatgggaatg

SEQ ID NO: 72944 - DNA, 20 bp, Artificial Sequence
  chemically synthesized
aattatatgaagtataaaat

SEQ ID NO: 72945 - DNA, 20 bp, Artificial Sequence
  chemically synthesized
aaattatatgaagtataaaa

SEQ ID NO: 72946 - DNA, 20 bp, Artificial Sequence
  chemically synthesized
tgtgatgaaaaaattatatg

SEQ ID NO: 72947 - DNA, 20 bp, Artificial Sequence
  chemically synthesized
ggggataaatgaacgatgta

SEQ ID NO: 72948 - DNA, 20 bp, Artificial Sequence
  chemically synthesized
atcgttcatttatccccctg

SEQ ID NO: 72949 - DNA, 20 bp, Artificial Sequence
  chemically synthesized
aggatgtgtgaaactacagg

SEQ ID NO: 72950 - DNA, 20 bp, Artificial Sequence
  chemically synthesized
caggatgtgtgaaactacag

SEQ ID NO: 72951 - DNA, 20 bp, Artificial Sequence
  chemically synthesized
tcaggatgtgtgaaactaca

SEQ ID NO: 72952 - DNA, 20 bp, Artificial Sequence
  chemically synthesized
atcaggatgtgtgaaactac

SEQ ID NO: 72953 - DNA, 20 bp, Artificial Sequence
  chemically synthesized
catcaggatgtgtgaaacta

SEQ ID NO: 72954 - DNA, 20 bp, Artificial Sequence
  chemically synthesized
tttttttttttgaaggcatc

SEQ ID NO: 72955 - DNA, 20 bp, Artificial Sequence
  chemically synthesized
ttttttttttttgaaggcat

SEQ ID NO: 72956 - DNA, 20 bp, Artificial Sequence
  chemically synthesized
tctctattttttttttttga

SEQ ID NO: 72957 - DNA, 20 bp, Artificial Sequence
  chemically synthesized
ttctctattttttttttttg

SEQ ID NO: 72958 - DNA, 20 bp, Artificial Sequence
  chemically synthesized
atgccttcaaaaaaaaaaaa

SEQ ID NO: 72959 - DNA, 20 bp, Artificial Sequence
  chemically synthesized
gccttcaaaaaaaaaaaata

SEQ ID NO: 72960 - DNA, 20 bp, Artificial Sequence
  chemically synthesized
aagaatggtctggttttcaa

SEQ ID NO: 72961 - DNA, 20 bp, Artificial Sequence
  chemically synthesized
tagagaattcccttgaaaac

SEQ ID NO: 72962 - DNA, 20 bp, Artificial Sequence
  chemically synthesized
gaagaatggtctggttttca

SEQ ID NO: 72963 - DNA, 20 bp, Artificial Sequence
  chemically synthesized
agaagaatggtctggttttc

SEQ ID NO: 72964 - DNA, 20 bp, Artificial Sequence
  chemically synthesized
accctaggagaagaatggtc

SEQ ID NO: 72965 - DNA, 20 bp, Artificial Sequence
  chemically synthesized
ttctcaccctaggagaagaa

SEQ ID NO: 72966 - DNA, 20 bp, Artificial Sequence
  chemically synthesized
aaaccagaccattcttctcc

SEQ ID NO: 72967 - DNA, 20 bp, Artificial Sequence
  chemically synthesized
aaccagaccattcttctcct

SEQ ID NO: 72968 - DNA, 20 bp, Artificial Sequence
  chemically synthesized
accagaccattcttctccta

SEQ ID NO: 72969 - DNA, 20 bp, Artificial Sequence
  chemically synthesized
tgtctttctcaccctaggag

SEQ ID NO: 72970 - DNA, 20 bp, Artificial Sequence
  chemically synthesized
gaccattcttctcctagggt

SEQ ID NO: 72971 - DNA, 20 bp, Artificial Sequence
  chemically synthesized
gtctgtctttctcaccctag

SEQ ID NO: 72972 - DNA, 20 bp, Artificial Sequence
  chemically synthesized
gagtctgtctttctcaccct

SEQ ID NO: 72973 - DNA, 20 bp, Artificial Sequence
  chemically synthesized
agagtctgtctttctcaccc

SEQ ID NO: 72974 - DNA, 20 bp, Artificial Sequence
  chemically synthesized
attcttctcctagggtgaga

SEQ ID NO: 72975 - DNA, 20 bp, Artificial Sequence
  chemically synthesized
ttctcctagggtgagaaaga

SEQ ID NO: 72976 - DNA, 20 bp, Artificial Sequence
  chemically synthesized
agggtgagaaagacagactc

SEQ ID NO: 72977 - DNA, 20 bp, Artificial Sequence
  chemically synthesized
aatatggcccaaatattcca

SEQ ID NO: 72978 - DNA, 20 bp, Artificial Sequence
  chemically synthesized
aagacagactctggaatatt

SEQ ID NO: 72979 - DNA, 20 bp, Artificial Sequence
  chemically synthesized
ctaatatggcccaaatattc

SEQ ID NO: 72980 - DNA, 20 bp, Artificial Sequence
  chemically synthesized
agacagactctggaatattt

SEQ ID NO: 72981 - DNA, 20 bp, Artificial Sequence
  chemically synthesized
ctggaatatttgggccatat

SEQ ID NO: 72982 - DNA, 20 bp, Artificial Sequence
  chemically synthesized
aggtagccttgaaactaata

SEQ ID NO: 72983 - DNA, 20 bp, Artificial Sequence
  chemically synthesized
atttgggccatattagtttc

SEQ ID NO: 72984 - DNA, 20 bp, Artificial Sequence
  chemically synthesized
tttgggccatattagtttca

SEQ ID NO: 72985 - DNA, 20 bp, Artificial Sequence
  chemically synthesized
tattagtttcaaggctacct

SEQ ID NO: 72986 - DNA, 20 bp, Artificial Sequence
  chemically synthesized
tgttatcgaaattgctcagg

SEQ ID NO: 72987 - DNA, 20 bp, Artificial Sequence
  chemically synthesized
gactgttatcgaaattgctc

SEQ ID NO: 72988 - DNA, 20 bp, Artificial Sequence
  chemically synthesized
ggactgttatcgaaattgct

SEQ ID NO: 72989 - DNA, 20 bp, Artificial Sequence
  chemically synthesized
tacctgagcaatttcgataa

SEQ ID NO: 72990 - DNA, 20 bp, Artificial Sequence
  chemically synthesized
ctaattgtactttagtcaag

SEQ ID NO: 72991 - DNA, 20 bp, Artificial Sequence
  chemically synthesized
gataacagtcctcttgacta

SEQ ID NO: 72992 - DNA, 20 bp, Artificial Sequence
  chemically synthesized
actaattgtactttagtcaa

SEQ ID NO: 72993 - DNA, 20 bp, Artificial Sequence
  chemically synthesized
caactaattgtactttagtc

SEQ ID NO: 72994 - DNA, 20 bp, Artificial Sequence
  chemically synthesized
ttgtacaactaattgtactt

SEQ ID NO: 72995 - DNA, 20 bp, Artificial Sequence
  chemically synthesized
cctcttgactaaagtacaat

SEQ ID NO: 72996 - DNA, 20 bp, Artificial Sequence
  chemically synthesized
ctgtcaagcttaagaacatt

SEQ ID NO: 72997 - DNA, 20 bp, Artificial Sequence
  chemically synthesized
attgaaaaccaaatgttctt

SEQ ID NO: 72998 - DNA, 20 bp, Artificial Sequence
  chemically synthesized
caaagcgtactgtcaagctt

SEQ ID NO: 72999 - DNA, 20 bp, Artificial Sequence
  chemically synthesized
ccaaatgttcttaagcttga

SEQ ID NO: 73000 - DNA, 20 bp, Artificial Sequence
  chemically synthesized
tgaggtcaaagcgtactgtc

SEQ ID NO: 73001 - DNA, 20 bp, Artificial Sequence
  chemically synthesized
ttgacagtacgctttgacct

SEQ ID NO: 73002 - DNA, 20 bp, Artificial Sequence
  chemically synthesized
cttagagcatactgaggtca

SEQ ID NO: 73003 - DNA, 20 bp, Artificial Sequence
  chemically synthesized
accacccttagagcatactg

SEQ ID NO: 73004 - DNA, 20 bp, Artificial Sequence
  chemically synthesized
gaccacccttagagcatact

SEQ ID NO: 73005 - DNA, 20 bp, Artificial Sequence
  chemically synthesized
ctttgacctcagtatgctct

SEQ ID NO: 73006 - DNA, 20 bp, Artificial Sequence
  chemically synthesized
tttgacctcagtatgctcta

SEQ ID NO: 73007 - DNA, 20 bp, Artificial Sequence
  chemically synthesized
ttgacctcagtatgctctaa

SEQ ID NO: 73008 - DNA, 20 bp, Artificial Sequence
  chemically synthesized
acctcagtatgctctaaggg

SEQ ID NO: 73009 - DNA, 20 bp, Artificial Sequence
  chemically synthesized
caggttagtgaccaccctta

SEQ ID NO: 73010 - DNA, 20 bp, Artificial Sequence
  chemically synthesized
cccaggttagtgaccaccct

SEQ ID NO: 73011 - DNA, 20 bp, Artificial Sequence
  chemically synthesized
tctaagggtggtcactaacc

SEQ ID NO: 73012 - DNA, 20 bp, Artificial Sequence
  chemically synthesized
ctaagggtggtcactaacct

SEQ ID NO: 73013 - DNA, 20 bp, Artificial Sequence
  chemically synthesized
ataaatttaaatgcccaggt

SEQ ID NO: 73014 - DNA, 20 bp, Artificial Sequence
  chemically synthesized
gagtataaatttaaatgccc

SEQ ID NO: 73015 - DNA, 20 bp, Artificial Sequence
  chemically synthesized
agagtataaatttaaatgcc

SEQ ID NO: 73016 - DNA, 20 bp, Artificial Sequence
  chemically synthesized
tttaaagaattgaagaagga

SEQ ID NO: 73017 - DNA, 20 bp, Artificial Sequence
  chemically synthesized
cctttaaagaattgaagaag

SEQ ID NO: 73018 - DNA, 20 bp, Artificial Sequence
  chemically synthesized
accctttaaagaattgaaga

SEQ ID NO: 73019 - DNA, 20 bp, Artificial Sequence
  chemically synthesized
aaccctttaaagaattgaag

SEQ ID NO: 73020 - DNA, 20 bp, Artificial Sequence
  chemically synthesized
caaaaccctttaaagaattg

SEQ ID NO: 73021 - DNA, 20 bp, Artificial Sequence
  chemically synthesized
tctccttcttcaattcttta

SEQ ID NO: 73022 - DNA, 20 bp, Artificial Sequence
  chemically synthesized
ctccttcttcaattctttaa

SEQ ID NO: 73023 - DNA, 20 bp, Artificial Sequence
  chemically synthesized
tccttcttcaattctttaaa

SEQ ID NO: 73024 - DNA, 20 bp, Artificial Sequence
  chemically synthesized
gatgtaaacaaaacccttta

SEQ ID NO: 73025 - DNA, 20 bp, Artificial Sequence
  chemically synthesized
tcaactctgttaggaaaaaa

SEQ ID NO: 73026 - DNA, 20 bp, Artificial Sequence
  chemically synthesized
ctcaactctgttaggaaaaa

SEQ ID NO: 73027 - DNA, 20 bp, Artificial Sequence
  chemically synthesized
ttacatcctttttttcctaa

SEQ ID NO: 73028 - DNA, 20 bp, Artificial Sequence
  chemically synthesized
acatcctttttttcctaaca

SEQ ID NO: 73029 - DNA, 20 bp, Artificial Sequence
  chemically synthesized
tgcttaacctcaactctgtt

SEQ ID NO: 73030 - DNA, 20 bp, Artificial Sequence
  chemically synthesized
atgcttaacctcaactctgt

SEQ ID NO: 73031 - DNA, 20 bp, Artificial Sequence
  chemically synthesized
ctttttttcctaacagagtt

SEQ ID NO: 73032 - DNA, 20 bp, Artificial Sequence
  chemically synthesized
tttttttcctaacagagttg

SEQ ID NO: 73033 - DNA, 20 bp, Artificial Sequence
  chemically synthesized
ttcctaacagagttgaggtt

SEQ ID NO: 73034 - DNA, 20 bp, Artificial Sequence
  chemically synthesized
aaacatcttttcagtaagga

SEQ ID NO: 73035 - DNA, 20 bp, Artificial Sequence
  chemically synthesized
gaaaacatcttttcagtaag

SEQ ID NO: 73036 - DNA, 20 bp, Artificial Sequence
  chemically synthesized
attattctctccttactgaa

SEQ ID NO: 73037 - DNA, 20 bp, Artificial Sequence
  chemically synthesized
aggaaaacatcttttcagta

SEQ ID NO: 73038 - DNA, 20 bp, Artificial Sequence
  chemically synthesized
caggaaaacatcttttcagt

SEQ ID NO: 73039 - DNA, 20 bp, Artificial Sequence
  chemically synthesized
gttccaggaaaacatctttt

SEQ ID NO: 73040 - DNA, 20 bp, Artificial Sequence
  chemically synthesized
ttactgaaaagatgttttcc

SEQ ID NO: 73041 - DNA, 20 bp, Artificial Sequence
  chemically synthesized
aaaaaggacaattaagttcc

SEQ ID NO: 73042 - DNA, 20 bp, Artificial Sequence
  chemically synthesized
aaaaaaggacaattaagttc

SEQ ID NO: 73043 - DNA, 20 bp, Artificial Sequence
  chemically synthesized
cccgtgaaaaaaggacaatt

SEQ ID NO: 73044 - DNA, 20 bp, Artificial Sequence
  chemically synthesized
acttaattgtccttttttca

SEQ ID NO: 73045 - DNA, 20 bp, Artificial Sequence
  chemically synthesized
atagaatgacccgtgaaaaa

SEQ ID NO: 73046 - DNA, 20 bp, Artificial Sequence
  chemically synthesized
cttaattgtccttttttcac

SEQ ID NO: 73047 - DNA, 20 bp, Artificial Sequence
  chemically synthesized
aatagaatgacccgtgaaaa

SEQ ID NO: 73048 - DNA, 20 bp, Artificial Sequence
  chemically synthesized
ggatttgttgatattaggaa

SEQ ID NO: 73049 - DNA, 20 bp, Artificial Sequence
  chemically synthesized
cagaaggatttgttgatatt

SEQ ID NO: 73050 - DNA, 20 bp, Artificial Sequence
  chemically synthesized
acagaaggatttgttgatat

SEQ ID NO: 73051 - DNA, 20 bp, Artificial Sequence
  chemically synthesized
tgaaaaggttaggtcacaga

SEQ ID NO: 73052 - DNA, 20 bp, Artificial Sequence
  chemically synthesized
ttgaaaaggttaggtcacag

SEQ ID NO: 73053 - DNA, 20 bp, Artificial Sequence
  chemically synthesized
tttttgaaaaggttaggtca

SEQ ID NO: 73054 - DNA, 20 bp, Artificial Sequence
  chemically synthesized
tgtttgtttttgaaaaggtt

SEQ ID NO: 73055 - DNA, 20 bp, Artificial Sequence
  chemically synthesized
gtgtttgtttttgaaaaggt

SEQ ID NO: 73056 - DNA, 20 bp, Artificial Sequence
  chemically synthesized
gtatgtgtttgtttttgaaa

SEQ ID NO: 73057 - DNA, 20 bp, Artificial Sequence
  chemically synthesized
agtatgtgtttgtttttgaa

SEQ ID NO: 73058 - DNA, 20 bp, Artificial Sequence
  chemically synthesized
aggaaataaaaaaaagaaag

SEQ ID NO: 73059 - DNA, 20 bp, Artificial Sequence
  chemically synthesized
taaaggaaataaaaaaaaga

SEQ ID NO: 73060 - DNA, 20 bp, Artificial Sequence
  chemically synthesized
aaagtaaaggaaataaaaaa

SEQ ID NO: 73061 - DNA, 20 bp, Artificial Sequence
  chemically synthesized
ttttttatttcctttacttt

SEQ ID NO: 73062 - DNA, 20 bp, Artificial Sequence
  chemically synthesized
tttgtaaaagctaaaagtaa

SEQ ID NO: 73063 - DNA, 20 bp, Artificial Sequence
  chemically synthesized
ttttgtaaaagctaaaagta

SEQ ID NO: 73064 - DNA, 20 bp, Artificial Sequence
  chemically synthesized
cagagttttgtaaaagctaa

SEQ ID NO: 73065 - DNA, 20 bp, Artificial Sequence
  chemically synthesized
cactggccagagttttgtaa

SEQ ID NO: 73066 - DNA, 20 bp, Artificial Sequence
  chemically synthesized
ttttagcttttacaaaactc

SEQ ID NO: 73067 - DNA, 20 bp, Artificial Sequence
  chemically synthesized
agcttttacaaaactctggc

SEQ ID NO: 73068 - DNA, 20 bp, Artificial Sequence
  chemically synthesized
ttttacaaaactctggccag

SEQ ID NO: 73069 - DNA, 20 bp, Artificial Sequence
  chemically synthesized
tctgatgtgcccactggcca

SEQ ID NO: 73070 - DNA, 20 bp, Artificial Sequence
  chemically synthesized
tttacaaaactctggccagt

SEQ ID NO: 73071 - DNA, 20 bp, Artificial Sequence
  chemically synthesized
agtctgatgtgcccactggc

SEQ ID NO: 73072 - DNA, 20 bp, Artificial Sequence
  chemically synthesized
atctagtctgatgtgcccac

SEQ ID NO: 73073 - DNA, 20 bp, Artificial Sequence
  chemically synthesized
actctggccagtgggcacat

SEQ ID NO: 73074 - DNA, 20 bp, Artificial Sequence
  chemically synthesized
ggccagtgggcacatcagac

SEQ ID NO: 73075 - DNA, 20 bp, Artificial Sequence
  chemically synthesized
gcacatcagactagatatta

SEQ ID NO: 73076 - DNA, 20 bp, Artificial Sequence
  chemically synthesized
aatatttcaactataatatc

SEQ ID NO: 73077 - DNA, 20 bp, Artificial Sequence
  chemically synthesized
tatagttgaaatatttacat

SEQ ID NO: 73078 - DNA, 20 bp, Artificial Sequence
  chemically synthesized
tagttgaaatatttacataa

SEQ ID NO: 73079 - DNA, 20 bp, Artificial Sequence
  chemically synthesized
atttacataagagcaaccta

SEQ ID NO: 73080 - DNA, 20 bp, Artificial Sequence
  chemically synthesized
cataagagcaacctatagtt

SEQ ID NO: 73081 - DNA, 20 bp, Artificial Sequence
  chemically synthesized
tctaacatattctaaactat

SEQ ID NO: 73082 - DNA, 20 bp, Artificial Sequence
  chemically synthesized
ctctaacatattctaaacta

SEQ ID NO: 73083 - DNA, 20 bp, Artificial Sequence
  chemically synthesized
acctatagtttagaatatgt

SEQ ID NO: 73084 - DNA, 20 bp, Artificial Sequence
  chemically synthesized
ctatagtttagaatatgtta

SEQ ID NO: 73085 - DNA, 20 bp, Artificial Sequence
  chemically synthesized
tagtttagaatatgttagag

SEQ ID NO: 73086 - DNA, 20 bp, Artificial Sequence
  chemically synthesized
aaaatactgcagtaagatgt

SEQ ID NO: 73087 - DNA, 20 bp, Artificial Sequence
  chemically synthesized
caaaatactgcagtaagatg

SEQ ID NO: 73088 - DNA, 20 bp, Artificial Sequence
  chemically synthesized
gtttttcctacatcttactg

SEQ ID NO: 73089 - DNA, 20 bp, Artificial Sequence
  chemically synthesized
ctctcccaaaatactgcagt

SEQ ID NO: 73090 - DNA, 20 bp, Artificial Sequence
  chemically synthesized
gcacctctcccaaaatactg

SEQ ID NO: 73091 - DNA, 20 bp, Artificial Sequence
  chemically synthesized
tacatcttactgcagtattt

SEQ ID NO: 73092 - DNA, 20 bp, Artificial Sequence
  chemically synthesized
acatcttactgcagtatttt

SEQ ID NO: 73093 - DNA, 20 bp, Artificial Sequence
  chemically synthesized
atcttactgcagtattttgg

SEQ ID NO: 73094 - DNA, 20 bp, Artificial Sequence
  chemically synthesized
cttactgcagtattttggga

SEQ ID NO: 73095 - DNA, 20 bp, Artificial Sequence
  chemically synthesized
ttactgcagtattttgggag

SEQ ID NO: 73096 - DNA, 20 bp, Artificial Sequence
  chemically synthesized
cagggttaaaacaaattaga

SEQ ID NO: 73097 - DNA, 20 bp, Artificial Sequence
  chemically synthesized
tacacagggttaaaacaaat

SEQ ID NO: 73098 - DNA, 20 bp, Artificial Sequence
  chemically synthesized
atgttattgagaaatacaca

SEQ ID NO: 73099 - DNA, 20 bp, Artificial Sequence
  chemically synthesized
aatgttattgagaaatacac

SEQ ID NO: 73100 - DNA, 20 bp, Artificial Sequence
  chemically synthesized
gaatgttattgagaaataca

SEQ ID NO: 73101 - DNA, 20 bp, Artificial Sequence
  chemically synthesized
ccagtttttggaatgttatt

SEQ ID NO: 73102 - DNA, 20 bp, Artificial Sequence
  chemically synthesized
ctcaataacattccaaaaac

SEQ ID NO: 73103 - DNA, 20 bp, Artificial Sequence
  chemically synthesized
caataacattccaaaaactg

SEQ ID NO: 73104 - DNA, 20 bp, Artificial Sequence
  chemically synthesized
tgtggcaattctccagtttt

SEQ ID NO: 73105 - DNA, 20 bp, Artificial Sequence
  chemically synthesized
tttattatgtggcaattctc

SEQ ID NO: 73106 - DNA, 20 bp, Artificial Sequence
  chemically synthesized
taagtagtacttttattatg

SEQ ID NO: 73107 - DNA, 20 bp, Artificial Sequence
  chemically synthesized
ggagaattgccacataataa

SEQ ID NO: 73108 - DNA, 20 bp, Artificial Sequence
  chemically synthesized
cacataataaaagtactact

SEQ ID NO: 73109 - DNA, 20 bp, Artificial Sequence
  chemically synthesized
ctcaattagcagatactaag

SEQ ID NO: 73110 - DNA, 20 bp, Artificial Sequence
  chemically synthesized
tttctcaattagcagatact

SEQ ID NO: 73111 - DNA, 20 bp, Artificial Sequence
  chemically synthesized
ctacttagtatctgctaatt

SEQ ID NO: 73112 - DNA, 20 bp, Artificial Sequence
  chemically synthesized
aatagccttttctcaattag

SEQ ID NO: 73113 - DNA, 20 bp, Artificial Sequence
  chemically synthesized
gctaatagccttttctcaat

SEQ ID NO: 73114 - DNA, 20 bp, Artificial Sequence
  chemically synthesized
tagtatctgctaattgagaa

SEQ ID NO: 73115 - DNA, 20 bp, Artificial Sequence
  chemically synthesized
agtatctgctaattgagaaa

SEQ ID NO: 73116 - DNA, 20 bp, Artificial Sequence
  chemically synthesized
gctaattgagaaaaggctat

SEQ ID NO: 73117 - DNA, 20 bp, Artificial Sequence
  chemically synthesized
tacaagtttttatcagctaa

SEQ ID NO: 73118 - DNA, 20 bp, Artificial Sequence
  chemically synthesized
caaagcatacaagtttttat

SEQ ID NO: 73119 - DNA, 20 bp, Artificial Sequence
  chemically synthesized
agttgtgttacaaagcatac

SEQ ID NO: 73120 - DNA, 20 bp, Artificial Sequence
  chemically synthesized
agtaaagcagttgtgttaca

SEQ ID NO: 73121 - DNA, 20 bp, Artificial Sequence
  chemically synthesized
actggtttttgtaagtaaag

SEQ ID NO: 73122 - DNA, 20 bp, Artificial Sequence
  chemically synthesized
accactggtttttgtaagta

SEQ ID NO: 73123 - DNA, 20 bp, Artificial Sequence
  chemically synthesized
catataccactggtttttgt

SEQ ID NO: 73124 - DNA, 20 bp, Artificial Sequence
  chemically synthesized
actgctttacttacaaaaac

SEQ ID NO: 73125 - DNA, 20 bp, Artificial Sequence
  chemically synthesized
gctttacttacaaaaaccag

SEQ ID NO: 73126 - DNA, 20 bp, Artificial Sequence
  chemically synthesized
ttatgttgcccatataccac

SEQ ID NO: 73127 - DNA, 20 bp, Artificial Sequence
  chemically synthesized
ttacaaaaaccagtggtata

SEQ ID NO: 73128 - DNA, 20 bp, Artificial Sequence
  chemically synthesized
tacaaaaaccagtggtatat

SEQ ID NO: 73129 - DNA, 20 bp, Artificial Sequence
  chemically synthesized
ggcaacataattttgtattc

SEQ ID NO: 73130 - DNA, 20 bp, Artificial Sequence
  chemically synthesized
ataattttgtattcaagcta

SEQ ID NO: 73131 - DNA, 20 bp, Artificial Sequence
  chemically synthesized
tttgcatcaagcattgtctg

SEQ ID NO: 73132 - DNA, 20 bp, Artificial Sequence
  chemically synthesized
caaaaatatatttttgcatc

SEQ ID NO: 73133 - DNA, 20 bp, Artificial Sequence
  chemically synthesized
gatgatagagttttacagag

SEQ ID NO: 73134 - DNA, 20 bp, Artificial Sequence
  chemically synthesized
agatgatagagttttacaga

SEQ ID NO: 73135 - DNA, 20 bp, Artificial Sequence
  chemically synthesized
acagatgatagagttttaca

SEQ ID NO: 73136 - DNA, 20 bp, Artificial Sequence
  chemically synthesized
ctacagatgatagagtttta

SEQ ID NO: 73137 - DNA, 20 bp, Artificial Sequence
  chemically synthesized
ttcccaaactacagatgata

SEQ ID NO: 73138 - DNA, 20 bp, Artificial Sequence
  chemically synthesized
ctgtaaaactctatcatctg

SEQ ID NO: 73139 - DNA, 20 bp, Artificial Sequence
  chemically synthesized
cattcccaaactacagatga

SEQ ID NO: 73140 - DNA, 20 bp, Artificial Sequence
  chemically synthesized
aaactctatcatctgtagtt

SEQ ID NO: 73141 - DNA, 20 bp, Artificial Sequence
  chemically synthesized
aactctatcatctgtagttt

SEQ ID NO: 73142 - DNA, 20 bp, Artificial Sequence
  chemically synthesized
agaaattcattcccaaacta

SEQ ID NO: 73143 - DNA, 20 bp, Artificial Sequence
  chemically synthesized
tgggaatgaatttctatatg

SEQ ID NO: 73144 - DNA, 20 bp, Artificial Sequence
  chemically synthesized
tgtctatttgtaaccacata

SEQ ID NO: 73145 - DNA, 20 bp, Artificial Sequence
  chemically synthesized
tttctatatgtggttacaaa

SEQ ID NO: 73146 - DNA, 20 bp, Artificial Sequence
  chemically synthesized
tatatgtggttacaaataga

SEQ ID NO: 73147 - DNA, 20 bp, Artificial Sequence
  chemically synthesized
tacaaatagacagcatctcc

SEQ ID NO: 73148 - DNA, 20 bp, Artificial Sequence
  chemically synthesized
acaaatagacagcatctcct

SEQ ID NO: 73149 - DNA, 20 bp, Artificial Sequence
  chemically synthesized
aaatagacagcatctcctgg

SEQ ID NO: 73150 - DNA, 20 bp, Artificial Sequence
  chemically synthesized
catttctatcatgctcccag

SEQ ID NO: 73151 - DNA, 20 bp, Artificial Sequence
  chemically synthesized
tgcatttctatcatgctccc

SEQ ID NO: 73152 - DNA, 20 bp, Artificial Sequence
  chemically synthesized
ctgcatttctatcatgctcc

SEQ ID NO: 73153 - DNA, 20 bp, Artificial Sequence
  chemically synthesized
agcatctcctgggagcatga

SEQ ID NO: 73154 - DNA, 20 bp, Artificial Sequence
  chemically synthesized
ctgggagcatgatagaaatg

SEQ ID NO: 73155 - DNA, 20 bp, Artificial Sequence
  chemically synthesized
atgatagaaatgcagaattg

SEQ ID NO: 73156 - DNA, 20 bp, Artificial Sequence
  chemically synthesized
tgatagaaatgcagaattgc

SEQ ID NO: 73157 - DNA, 20 bp, Artificial Sequence
  chemically synthesized
cagaaatttagtatcgggtg

SEQ ID NO: 73158 - DNA, 20 bp, Artificial Sequence
  chemically synthesized
ccagaaatttagtatcgggt

SEQ ID NO: 73159 - DNA, 20 bp, Artificial Sequence
  chemically synthesized
gcccccagaaatttagtatc

SEQ ID NO: 73160 - DNA, 20 bp, Artificial Sequence
  chemically synthesized
cgcccccagaaatttagtat

SEQ ID NO: 73161 - DNA, 20 bp, Artificial Sequence
  chemically synthesized
ctcacccgatactaaatttc

SEQ ID NO: 73162 - DNA, 20 bp, Artificial Sequence
  chemically synthesized
tcacccgatactaaatttct

SEQ ID NO: 73163 - DNA, 20 bp, Artificial Sequence
  chemically synthesized
ccaatccgcccccagaaatt

SEQ ID NO: 73164 - DNA, 20 bp, Artificial Sequence
  chemically synthesized
cacccgatactaaatttctg

SEQ ID NO: 73165 - DNA, 20 bp, Artificial Sequence
  chemically synthesized
acccgatactaaatttctgg

SEQ ID NO: 73166 - DNA, 20 bp, Artificial Sequence
  chemically synthesized
cgatactaaatttctggggg

SEQ ID NO: 73167 - DNA, 20 bp, Artificial Sequence
  chemically synthesized
ttgttaaaccaatccgcccc

SEQ ID NO: 73168 - DNA, 20 bp, Artificial Sequence
  chemically synthesized
ctaaatttctgggggcggat

SEQ ID NO: 73169 - DNA, 20 bp, Artificial Sequence
  chemically synthesized
tgggggcggattggtttaac

SEQ ID NO: 73170 - DNA, 20 bp, Artificial Sequence
  chemically synthesized
gattggtttaacaagctttg

SEQ ID NO: 73171 - DNA, 20 bp, Artificial Sequence
  chemically synthesized
attggtttaacaagctttgc

SEQ ID NO: 73172 - DNA, 20 bp, Artificial Sequence
  chemically synthesized
atggataagaatcacctgca

SEQ ID NO: 73173 - DNA, 20 bp, Artificial Sequence
  chemically synthesized
tttcaaaatctagcatggat

SEQ ID NO: 73174 - DNA, 20 bp, Artificial Sequence
  chemically synthesized
caggtgattcttatccatgc

SEQ ID NO: 73175 - DNA, 20 bp, Artificial Sequence
  chemically synthesized
aaagttttcaaaatctagca

SEQ ID NO: 73176 - DNA, 20 bp, Artificial Sequence
  chemically synthesized
gcctaaaagttttcaaaatc

SEQ ID NO: 73177 - DNA, 20 bp, Artificial Sequence
  chemically synthesized
tgctagattttgaaaacttt

SEQ ID NO: 73178 - DNA, 20 bp, Artificial Sequence
  chemically synthesized
gctagattttgaaaactttt

SEQ ID NO: 73179 - DNA, 20 bp, Artificial Sequence
  chemically synthesized
gttggatagcattggcctaa

SEQ ID NO: 73180 - DNA, 20 bp, Artificial Sequence
  chemically synthesized
atatttctgttggatagcat

SEQ ID NO: 73181 - DNA, 20 bp, Artificial Sequence
  chemically synthesized
tttaggccaatgctatccaa

SEQ ID NO: 73182 - DNA, 20 bp, Artificial Sequence
  chemically synthesized
ctcattatatttctgttgga

SEQ ID NO: 73183 - DNA, 20 bp, Artificial Sequence
  chemically synthesized
agcactcattatatttctgt

SEQ ID NO: 73184 - DNA, 20 bp, Artificial Sequence
  chemically synthesized
ctatccaacagaaatataat

SEQ ID NO: 73185 - DNA, 20 bp, Artificial Sequence
  chemically synthesized
aacatttaaaattgtacatg

SEQ ID NO: 73186 - DNA, 20 bp, Artificial Sequence
  chemically synthesized
atgtacaattttaaatgttc

SEQ ID NO: 73187 - DNA, 20 bp, Artificial Sequence
  chemically synthesized
tacaattttaaatgttctag

SEQ ID NO: 73188 - DNA, 20 bp, Artificial Sequence
  chemically synthesized
acaattttaaatgttctagt

SEQ ID NO: 73189 - DNA, 20 bp, Artificial Sequence
  chemically synthesized
aaatttttacatgtgcctac

SEQ ID NO: 73190 - DNA, 20 bp, Artificial Sequence
  chemically synthesized
aggcacatgtaaaaattttg

SEQ ID NO: 73191 - DNA, 20 bp, Artificial Sequence
  chemically synthesized
gcttcggctacaacaatggg

SEQ ID NO: 73192 - DNA, 20 bp, Artificial Sequence
  chemically synthesized
agaaacactgcccattgttg

SEQ ID NO: 73193 - DNA, 20 bp, Artificial Sequence
  chemically synthesized
gttgcttcggctacaacaat

SEQ ID NO: 73194 - DNA, 20 bp, Artificial Sequence
  chemically synthesized
tgttgcttcggctacaacaa

SEQ ID NO: 73195 - DNA, 20 bp, Artificial Sequence
  chemically synthesized
actgcccattgttgtagccg

SEQ ID NO: 73196 - DNA, 20 bp, Artificial Sequence
  chemically synthesized
cattgttgtagccgaagcaa

SEQ ID NO: 73197 - DNA, 20 bp, Artificial Sequence
  chemically synthesized
attgttgtagccgaagcaac

SEQ ID NO: 73198 - DNA, 20 bp, Artificial Sequence
  chemically synthesized
atgaagtgagcctgttgctt

SEQ ID NO: 73199 - DNA, 20 bp, Artificial Sequence
  chemically synthesized
ttcttgaaaatgaatgaagt

SEQ ID NO: 73200 - DNA, 20 bp, Artificial Sequence
  chemically synthesized
atttttcttgaaaatgaatg

SEQ ID NO: 73201 - DNA, 20 bp, Artificial Sequence
  chemically synthesized
ggctcacttcattcattttc

SEQ ID NO: 73202 - DNA, 20 bp, Artificial Sequence
  chemically synthesized
cattttcaagaaaaataacc

SEQ ID NO: 73203 - DNA, 20 bp, Artificial Sequence
  chemically synthesized
ttattatgattattcaaact

SEQ ID NO: 73204 - DNA, 20 bp, Artificial Sequence
  chemically synthesized
tttgaataatcataataaat

SEQ ID NO: 73205 - DNA, 20 bp, Artificial Sequence
  chemically synthesized
ttcattatgacattttaccc

SEQ ID NO: 73206 - DNA, 20 bp, Artificial Sequence
  chemically synthesized
gtatttttatgtatttgctt

SEQ ID NO: 73207 - DNA, 20 bp, Artificial Sequence
  chemically synthesized
agtatttttatgtatttgct

SEQ ID NO: 73208 - DNA, 20 bp, Artificial Sequence
  chemically synthesized
ttgattacatgttgaaatga

SEQ ID NO: 73209 - DNA, 20 bp, Artificial Sequence
  chemically synthesized
gtaatcaatataaaaataat

SEQ ID NO: 73210 - DNA, 20 bp, Artificial Sequence
  chemically synthesized
gatattttacattctttttt

SEQ ID NO: 73211 - DNA, 20 bp, Artificial Sequence
  chemically synthesized
caaagacttagtaccaaaaa

SEQ ID NO: 73212 - DNA, 20 bp, Artificial Sequence
  chemically synthesized
tacattctttttttggtact

SEQ ID NO: 73213 - DNA, 20 bp, Artificial Sequence
  chemically synthesized
tatatcaggatgcaaagact

SEQ ID NO: 73214 - DNA, 20 bp, Artificial Sequence
  chemically synthesized
tatatatatatcaggatgca

SEQ ID NO: 73215 - DNA, 20 bp, Artificial Sequence
  chemically synthesized
tatatatatatatatatatc

SEQ ID NO: 73216 - DNA, 20 bp, Artificial Sequence
  chemically synthesized
ttatatatatatatatatat

SEQ ID NO: 73217 - DNA, 20 bp, Artificial Sequence
  chemically synthesized
tatatgttatatatatgata

SEQ ID NO: 73218 - DNA, 20 bp, Artificial Sequence
  chemically synthesized
tcgaaagtgagatgtgtagt

SEQ ID NO: 73219 - DNA, 20 bp, Artificial Sequence
  chemically synthesized
ccagtcgaaagtgagatgtg

SEQ ID NO: 73220 - DNA, 20 bp, Artificial Sequence
  chemically synthesized
caatgtagccagtcgaaagt

SEQ ID NO: 73221 - DNA, 20 bp, Artificial Sequence
  chemically synthesized
ctacacatctcactttcgac

SEQ ID NO: 73222 - DNA, 20 bp, Artificial Sequence
  chemically synthesized
ccttcaatgtagccagtcga

SEQ ID NO: 73223 - DNA, 20 bp, Artificial Sequence
  chemically synthesized
attgagcccttcaatgtagc

SEQ ID NO: 73224 - DNA, 20 bp, Artificial Sequence
  chemically synthesized
actttcgactggctacattg

SEQ ID NO: 73225 - DNA, 20 bp, Artificial Sequence
  chemically synthesized
ctttcgactggctacattga

SEQ ID NO: 73226 - DNA, 20 bp, Artificial Sequence
  chemically synthesized
tttcgactggctacattgaa

SEQ ID NO: 73227 - DNA, 20 bp, Artificial Sequence
  chemically synthesized
ggccattgagcccttcaatg

SEQ ID NO: 73228 - DNA, 20 bp, Artificial Sequence
  chemically synthesized
ggctacattgaagggctcaa

SEQ ID NO: 73229 - DNA, 20 bp, Artificial Sequence
  chemically synthesized
gatagctacatatggccatt

SEQ ID NO: 73230 - DNA, 20 bp, Artificial Sequence
  chemically synthesized
aagggctcaatggccatatg

SEQ ID NO: 73231 - DNA, 20 bp, Artificial Sequence
  chemically synthesized
tccaatatgatagctacata

SEQ ID NO: 73232 - DNA, 20 bp, Artificial Sequence
  chemically synthesized
gccatatgtagctatcatat

SEQ ID NO: 73233 - DNA, 20 bp, Artificial Sequence
  chemically synthesized
aactgtgctgtccaatatga

SEQ ID NO: 73234 - DNA, 20 bp, Artificial Sequence
  chemically synthesized
tatgtagctatcatattgga

SEQ ID NO: 73235 - DNA, 20 bp, Artificial Sequence
  chemically synthesized
agctatcatattggacagca

SEQ ID NO: 73236 - DNA, 20 bp, Artificial Sequence
  chemically synthesized
catattggacagcacagttc

SEQ ID NO: 73237 - DNA, 20 bp, Artificial Sequence
  chemically synthesized
gtatttcaaatcacatggtc

SEQ ID NO: 73238 - DNA, 20 bp, Artificial Sequence
  chemically synthesized
ttactgtatttcaaatcaca

SEQ ID NO: 73239 - DNA, 20 bp, Artificial Sequence
  chemically synthesized
agaccatgtgatttgaaata

SEQ ID NO: 73240 - DNA, 20 bp, Artificial Sequence
  chemically synthesized
acagtaaatataaatccata

SEQ ID NO: 73241 - DNA, 20 bp, Artificial Sequence
  chemically synthesized
gtaaatataaatccatatag

SEQ ID NO: 73242 - DNA, 20 bp, Artificial Sequence
  chemically synthesized
aaacacaatttgctgctata

SEQ ID NO: 73243 - DNA, 20 bp, Artificial Sequence
  chemically synthesized
atagcagcaaattgtgtttc

SEQ ID NO: 73244 - DNA, 20 bp, Artificial Sequence
  chemically synthesized
tagcagcaaattgtgtttct

SEQ ID NO: 73245 - DNA, 20 bp, Artificial Sequence
  chemically synthesized
agcagcaaattgtgtttctg

SEQ ID NO: 73246 - DNA, 20 bp, Artificial Sequence
  chemically synthesized
ggaaactgttaatagatccc

SEQ ID NO: 73247 - DNA, 20 bp, Artificial Sequence
  chemically synthesized
tgtttctggggatctattaa

SEQ ID NO: 73248 - DNA, 20 bp, Artificial Sequence
  chemically synthesized
ggatgaagggaaactgttaa

SEQ ID NO: 73249 - DNA, 20 bp, Artificial Sequence
  chemically synthesized
agggaaacgtggaggatgaa

SEQ ID NO: 73250 - DNA, 20 bp, Artificial Sequence
  chemically synthesized
aagggaaacgtggaggatga

SEQ ID NO: 73251 - DNA, 20 bp, Artificial Sequence
  chemically synthesized
aaagggaaacgtggaggatg

SEQ ID NO: 73252 - DNA, 20 bp, Artificial Sequence
  chemically synthesized
gaagataaagggaaacgtgg

SEQ ID NO: 73253 - DNA, 20 bp, Artificial Sequence
  chemically synthesized
ggaagataaagggaaacgtg

SEQ ID NO: 73254 - DNA, 20 bp, Artificial Sequence
  chemically synthesized
gaggaagataaagggaaacg

SEQ ID NO: 73255 - DNA, 20 bp, Artificial Sequence
  chemically synthesized
ggcagaaagaggaagataaa

SEQ ID NO: 73256 - DNA, 20 bp, Artificial Sequence
  chemically synthesized
aggcagaaagaggaagataa

SEQ ID NO: 73257 - DNA, 20 bp, Artificial Sequence
  chemically synthesized
gaggcagaaagaggaagata

SEQ ID NO: 73258 - DNA, 20 bp, Artificial Sequence
  chemically synthesized
ttctatgaggcagaaagagg

SEQ ID NO: 73259 - DNA, 20 bp, Artificial Sequence
  chemically synthesized
cttttctatgaggcagaaag

SEQ ID NO: 73260 - DNA, 20 bp, Artificial Sequence
  chemically synthesized
acttttctatgaggcagaaa

SEQ ID NO: 73261 - DNA, 20 bp, Artificial Sequence
  chemically synthesized
taacttttctatgaggcaga

SEQ ID NO: 73262 - DNA, 20 bp, Artificial Sequence
  chemically synthesized
atcttcctctttctgcctca

SEQ ID NO: 73263 - DNA, 20 bp, Artificial Sequence
  chemically synthesized
cacttaacttttctatgagg

SEQ ID NO: 73264 - DNA, 20 bp, Artificial Sequence
  chemically synthesized
cctctttctgcctcatagaa

SEQ ID NO: 73265 - DNA, 20 bp, Artificial Sequence
  chemically synthesized
aagcacttaacttttctatg

SEQ ID NO: 73266 - DNA, 20 bp, Artificial Sequence
  chemically synthesized
caagcacttaacttttctat

SEQ ID NO: 73267 - DNA, 20 bp, Artificial Sequence
  chemically synthesized
ttctgcctcatagaaaagtt

SEQ ID NO: 73268 - DNA, 20 bp, Artificial Sequence
  chemically synthesized
tcatagaaaagttaagtgct

SEQ ID NO: 73269 - DNA, 20 bp, Artificial Sequence
  chemically synthesized
ctgcaggatcatggagaacc

SEQ ID NO: 73270 - DNA, 20 bp, Artificial Sequence
  chemically synthesized
tcaagtgctgcaggatcatg

SEQ ID NO: 73271 - DNA, 20 bp, Artificial Sequence
  chemically synthesized
gttcaagtgctgcaggatca

SEQ ID NO: 73272 - DNA, 20 bp, Artificial Sequence
  chemically synthesized
cttggttctccatgatcctg

SEQ ID NO: 73273 - DNA, 20 bp, Artificial Sequence
  chemically synthesized
gaggagtgttcaagtgctgc

SEQ ID NO: 73274 - DNA, 20 bp, Artificial Sequence
  chemically synthesized
ggaggagtgttcaagtgctg

SEQ ID NO: 73275 - DNA, 20 bp, Artificial Sequence
  chemically synthesized
tctgtgttggaggagtgttc

SEQ ID NO: 73276 - DNA, 20 bp, Artificial Sequence
  chemically synthesized
ccaaaaactctgtgttggag

SEQ ID NO: 73277 - DNA, 20 bp, Artificial Sequence
  chemically synthesized
acttgaacactcctccaaca

SEQ ID NO: 73278 - DNA, 20 bp, Artificial Sequence
  chemically synthesized
tcccaaaaactctgtgttgg

SEQ ID NO: 73279 - DNA, 20 bp, Artificial Sequence
  chemically synthesized
ttgaacactcctccaacaca

SEQ ID NO: 73280 - DNA, 20 bp, Artificial Sequence
  chemically synthesized
atcccaaaaactctgtgttg

SEQ ID NO: 73281 - DNA, 20 bp, Artificial Sequence
  chemically synthesized
ccatcccaaaaactctgtgt

SEQ ID NO: 73282 - DNA, 20 bp, Artificial Sequence
  chemically synthesized
ctcctccaacacagagtttt

SEQ ID NO: 73283 - DNA, 20 bp, Artificial Sequence
  chemically synthesized
tcctccaacacagagttttt

SEQ ID NO: 73284 - DNA, 20 bp, Artificial Sequence
  chemically synthesized
ccaacacagagtttttggga

SEQ ID NO: 73285 - DNA, 20 bp, Artificial Sequence
  chemically synthesized
gtttagactctggggaaatt

SEQ ID NO: 73286 - DNA, 20 bp, Artificial Sequence
  chemically synthesized
ggcattatacttaatttccc

SEQ ID NO: 73287 - DNA, 20 bp, Artificial Sequence
  chemically synthesized
cattatacttaatttcccca

SEQ ID NO: 73288 - DNA, 20 bp, Artificial Sequence
  chemically synthesized
tgtgaagggtttagactctg

SEQ ID NO: 73289 - DNA, 20 bp, Artificial Sequence
  chemically synthesized
ctgtgaagggtttagactct

SEQ ID NO: 73290 - DNA, 20 bp, Artificial Sequence
  chemically synthesized
actgtgaagggtttagactc

SEQ ID NO: 73291 - DNA, 20 bp, Artificial Sequence
  chemically synthesized
gtaagacactgtgaagggtt

SEQ ID NO: 73292 - DNA, 20 bp, Artificial Sequence
  chemically synthesized
cccagagtctaaacccttca

SEQ ID NO: 73293 - DNA, 20 bp, Artificial Sequence
  chemically synthesized
cttctgtaagacactgtgaa

SEQ ID NO: 73294 - DNA, 20 bp, Artificial Sequence
  chemically synthesized
acttctgtaagacactgtga

SEQ ID NO: 73295 - DNA, 20 bp, Artificial Sequence
  chemically synthesized
gacttctgtaagacactgtg

SEQ ID NO: 73296 - DNA, 20 bp, Artificial Sequence
  chemically synthesized
aaacccttcacagtgtctta

SEQ ID NO: 73297 - DNA, 20 bp, Artificial Sequence
  chemically synthesized
cccttcacagtgtcttacag

SEQ ID NO: 73298 - DNA, 20 bp, Artificial Sequence
  chemically synthesized
aatatatatatgacttctgt

SEQ ID NO: 73299 - DNA, 20 bp, Artificial Sequence
  chemically synthesized
tcaggtacagacaaatttaa

SEQ ID NO: 73300 - DNA, 20 bp, Artificial Sequence
  chemically synthesized
tgttaagtacttgtcaggta

SEQ ID NO: 73301 - DNA, 20 bp, Artificial Sequence
  chemically synthesized
taaatttgtctgtacctgac

SEQ ID NO: 73302 - DNA, 20 bp, Artificial Sequence
  chemically synthesized
ttctatgttaagtacttgtc

SEQ ID NO: 73303 - DNA, 20 bp, Artificial Sequence
  chemically synthesized
gttctatgttaagtacttgt

SEQ ID NO: 73304 - DNA, 20 bp, Artificial Sequence
  chemically synthesized
tacctgacaagtacttaaca

SEQ ID NO: 73305 - DNA, 20 bp, Artificial Sequence
  chemically synthesized
gataacccctgttctatgtt

SEQ ID NO: 73306 - DNA, 20 bp, Artificial Sequence
  chemically synthesized
gacaagtacttaacatagaa

SEQ ID NO: 73307 - DNA, 20 bp, Artificial Sequence
  chemically synthesized
acaagtacttaacatagaac

SEQ ID NO: 73308 - DNA, 20 bp, Artificial Sequence
  chemically synthesized
caagtacttaacatagaaca

SEQ ID NO: 73309 - DNA, 20 bp, Artificial Sequence
  chemically synthesized
aagtacttaacatagaacag

SEQ ID NO: 73310 - DNA, 20 bp, Artificial Sequence
  chemically synthesized
acatagaacaggggttatca

SEQ ID NO: 73311 - DNA, 20 bp, Artificial Sequence
  chemically synthesized
gaacaggggttatcaaagtg

SEQ ID NO: 73312 - DNA, 20 bp, Artificial Sequence
  chemically synthesized
tcaaagtgtggtccatgatt

SEQ ID NO: 73313 - DNA, 20 bp, Artificial Sequence
  chemically synthesized
aggctaatgctgctgaatca

SEQ ID NO: 73314 - DNA, 20 bp, Artificial Sequence
  chemically synthesized
aagtgtggtccatgattcag

SEQ ID NO: 73315 - DNA, 20 bp, Artificial Sequence
  chemically synthesized
ggtccatgattcagcagcat

SEQ ID NO: 73316 - DNA, 20 bp, Artificial Sequence
  chemically synthesized
gcagcattagcctcacttga

SEQ ID NO: 73317 - DNA, 20 bp, Artificial Sequence
  chemically synthesized
ctctaacaaactttcaagtg

SEQ ID NO: 73318 - DNA, 20 bp, Artificial Sequence
  chemically synthesized
tctctaacaaactttcaagt

SEQ ID NO: 73319 - DNA, 20 bp, Artificial Sequence
  chemically synthesized
tgcatctctaacaaactttc

SEQ ID NO: 73320 - DNA, 20 bp, Artificial Sequence
  chemically synthesized
agcctcacttgaaagtttgt

SEQ ID NO: 73321 - DNA, 20 bp, Artificial Sequence
  chemically synthesized
cctcacttgaaagtttgtta

SEQ ID NO: 73322 - DNA, 20 bp, Artificial Sequence
  chemically synthesized
ttgaaagtttgttagagatg

SEQ ID NO: 73323 - DNA, 20 bp, Artificial Sequence
  chemically synthesized
tgttagagatgcagattctc

SEQ ID NO: 73324 - DNA, 20 bp, Artificial Sequence
  chemically synthesized
gtgggtctggtgtggagctt

SEQ ID NO: 73325 - DNA, 20 bp, Artificial Sequence
  chemically synthesized
cagattctcaagctccacac

SEQ ID NO: 73326 - DNA, 20 bp, Artificial Sequence
  chemically synthesized
gattcagtgggtctggtgtg

SEQ ID NO: 73327 - DNA, 20 bp, Artificial Sequence
  chemically synthesized
atgattcagtgggtctggtg

SEQ ID NO: 73328 - DNA, 20 bp, Artificial Sequence
  chemically synthesized
ttcaaatgattcagtgggtc

SEQ ID NO: 73329 - DNA, 20 bp, Artificial Sequence
  chemically synthesized
caagtttcaaatgattcagt

SEQ ID NO: 73330 - DNA, 20 bp, Artificial Sequence
  chemically synthesized
ccaagtttcaaatgattcag

SEQ ID NO: 73331 - DNA, 20 bp, Artificial Sequence
  chemically synthesized
ataccaagtttcaaatgatt

SEQ ID NO: 73332 - DNA, 20 bp, Artificial Sequence
  chemically synthesized
ccactgaatcatttgaaact

SEQ ID NO: 73333 - DNA, 20 bp, Artificial Sequence
  chemically synthesized
atcatttgaaacttggtatg

SEQ ID NO: 73334 - DNA, 20 bp, Artificial Sequence
  chemically synthesized
ataactgggctccacatacc

SEQ ID NO: 73335 - DNA, 20 bp, Artificial Sequence
  chemically synthesized
catttgaaacttggtatgtg

SEQ ID NO: 73336 - DNA, 20 bp, Artificial Sequence
  chemically synthesized
gaaacttggtatgtggagcc

SEQ ID NO: 73337 - DNA, 20 bp, Artificial Sequence
  chemically synthesized
ttattaaaacacagataact

SEQ ID NO: 73338 - DNA, 20 bp, Artificial Sequence
  chemically synthesized
cttattaaaacacagataac

SEQ ID NO: 73339 - DNA, 20 bp, Artificial Sequence
  chemically synthesized
ctggaaggcttattaaaaca

SEQ ID NO: 73340 - DNA, 20 bp, Artificial Sequence
  chemically synthesized
ccagttatctgtgttttaat

SEQ ID NO: 73341 - DNA, 20 bp, Artificial Sequence
  chemically synthesized
ctgtgttttaataagccttc

SEQ ID NO: 73342 - DNA, 20 bp, Artificial Sequence
  chemically synthesized
tgtgttttaataagccttcc

SEQ ID NO: 73343 - DNA, 20 bp, Artificial Sequence
  chemically synthesized
aagcatcaaattcacctgga

SEQ ID NO: 73344 - DNA, 20 bp, Artificial Sequence
  chemically synthesized
caagcatcaaattcacctgg

SEQ ID NO: 73345 - DNA, 20 bp, Artificial Sequence
  chemically synthesized
taacaagcatcaaattcacc

SEQ ID NO: 73346 - DNA, 20 bp, Artificial Sequence
  chemically synthesized
agtggttctcaaattttaac

SEQ ID NO: 73347 - DNA, 20 bp, Artificial Sequence
  chemically synthesized
tttgatgcttgttaaaattt

SEQ ID NO: 73348 - DNA, 20 bp, Artificial Sequence
  chemically synthesized
aaatttgagaaccactaatg

SEQ ID NO: 73349 - DNA, 20 bp, Artificial Sequence
  chemically synthesized
aatttgagaaccactaatgt

SEQ ID NO: 73350 - DNA, 20 bp, Artificial Sequence
  chemically synthesized
aatatgttttcctacattag

SEQ ID NO: 73351 - DNA, 20 bp, Artificial Sequence
  chemically synthesized
ataaatatgttttcctacat

SEQ ID NO: 73352 - DNA, 20 bp, Artificial Sequence
  chemically synthesized
tgtaggaaaacatatttatt

SEQ ID NO: 73353 - DNA, 20 bp, Artificial Sequence
  chemically synthesized
taggaaaacatatttatttg

SEQ ID NO: 73354 - DNA, 20 bp, Artificial Sequence
  chemically synthesized
aaacatatttatttggagaa

SEQ ID NO: 73355 - DNA, 20 bp, Artificial Sequence
  chemically synthesized
aggagaaaatgataaatatg

SEQ ID NO: 73356 - DNA, 20 bp, Artificial Sequence
  chemically synthesized
caggagaaaatgataaatat

SEQ ID NO: 73357 - DNA, 20 bp, Artificial Sequence
  chemically synthesized
catatttatcattttctcct

SEQ ID NO: 73358 - DNA, 20 bp, Artificial Sequence
  chemically synthesized
ggttctaccacagaactcag

SEQ ID NO: 73359 - DNA, 20 bp, Artificial Sequence
  chemically synthesized
gtggttctaccacagaactc

SEQ ID NO: 73360 - DNA, 20 bp, Artificial Sequence
  chemically synthesized
tcattttctcctgagttctg

SEQ ID NO: 73361 - DNA, 20 bp, Artificial Sequence
  chemically synthesized
tgtggttctaccacagaact

SEQ ID NO: 73362 - DNA, 20 bp, Artificial Sequence
  chemically synthesized
ttttctcctgagttctgtgg

SEQ ID NO: 73363 - DNA, 20 bp, Artificial Sequence
  chemically synthesized
ttcagcttgtggttctacca

SEQ ID NO: 73364 - DNA, 20 bp, Artificial Sequence
  chemically synthesized
gagttctgtggtagaaccac

SEQ ID NO: 73365 - DNA, 20 bp, Artificial Sequence
  chemically synthesized
gactaaaatgattcagcttg

SEQ ID NO: 73366 - DNA, 20 bp, Artificial Sequence
  chemically synthesized
ttaagaagactaaaatgatt

SEQ ID NO: 73367 - DNA, 20 bp, Artificial Sequence
  chemically synthesized
aaccacaagctgaatcattt

SEQ ID NO: 73368 - DNA, 20 bp, Artificial Sequence
  chemically synthesized
gaatcattttagtcttctta

SEQ ID NO: 73369 - DNA, 20 bp, Artificial Sequence
  chemically synthesized
tgactttttctttctttaag

SEQ ID NO: 73370 - DNA, 20 bp, Artificial Sequence
  chemically synthesized
cattttagtcttcttaaaga

SEQ ID NO: 73371 - DNA, 20 bp, Artificial Sequence
  chemically synthesized
tcttgactttttctttcttt

SEQ ID NO: 73372 - DNA, 20 bp, Artificial Sequence
  chemically synthesized
agtcttcttaaagaaagaaa

SEQ ID NO: 73373 - DNA, 20 bp, Artificial Sequence
  chemically synthesized
tcttaaagaaagaaaaagtc

SEQ ID NO: 73374 - DNA, 20 bp, Artificial Sequence
  chemically synthesized
taaagaaagaaaaagtcaag

SEQ ID NO: 73375 - DNA, 20 bp, Artificial Sequence
  chemically synthesized
aaagaaagaaaaagtcaaga

SEQ ID NO: 73376 - DNA, 20 bp, Artificial Sequence
  chemically synthesized
aaaagtcaagaaggacatgc

SEQ ID NO: 73377 - DNA, 20 bp, Artificial Sequence
  chemically synthesized
gtcaagaaggacatgctaga

SEQ ID NO: 73378 - DNA, 20 bp, Artificial Sequence
  chemically synthesized
gacatctaccgatgtctttc

SEQ ID NO: 73379 - DNA, 20 bp, Artificial Sequence
  chemically synthesized
aggacatgctagaaagacat

SEQ ID NO: 73380 - DNA, 20 bp, Artificial Sequence
  chemically synthesized
acatgctagaaagacatcgg

SEQ ID NO: 73381 - DNA, 20 bp, Artificial Sequence
  chemically synthesized
cactaactggggataaggag

SEQ ID NO: 73382 - DNA, 20 bp, Artificial Sequence
  chemically synthesized
tatcactaactggggataag

SEQ ID NO: 73383 - DNA, 20 bp, Artificial Sequence
  chemically synthesized
agatgtcttctccttatccc

SEQ ID NO: 73384 - DNA, 20 bp, Artificial Sequence
  chemically synthesized
cctatcactaactggggata

SEQ ID NO: 73385 - DNA, 20 bp, Artificial Sequence
  chemically synthesized
gcctatcactaactggggat

SEQ ID NO: 73386 - DNA, 20 bp, Artificial Sequence
  chemically synthesized
gtcttctccttatccccagt

SEQ ID NO: 73387 - DNA, 20 bp, Artificial Sequence
  chemically synthesized
tgtcggcctatcactaactg

SEQ ID NO: 73388 - DNA, 20 bp, Artificial Sequence
  chemically synthesized
atgtcggcctatcactaact

SEQ ID NO: 73389 - DNA, 20 bp, Artificial Sequence
  chemically synthesized
aatgtcggcctatcactaac

SEQ ID NO: 73390 - DNA, 20 bp, Artificial Sequence
  chemically synthesized
tccttatccccagttagtga

SEQ ID NO: 73391 - DNA, 20 bp, Artificial Sequence
  chemically synthesized
ccttatccccagttagtgat

SEQ ID NO: 73392 - DNA, 20 bp, Artificial Sequence
  chemically synthesized
tctgctcttacaaataatgt

SEQ ID NO: 73393 - DNA, 20 bp, Artificial Sequence
  chemically synthesized
gataggccgacattatttgt

SEQ ID NO: 73394 - DNA, 20 bp, Artificial Sequence
  chemically synthesized
taggccgacattatttgtaa

SEQ ID NO: 73395 - DNA, 20 bp, Artificial Sequence
  chemically synthesized
gccgacattatttgtaagag

SEQ ID NO: 73396 - DNA, 20 bp, Artificial Sequence
  chemically synthesized
acattatttgtaagagcaga

SEQ ID NO: 73397 - DNA, 20 bp, Artificial Sequence
  chemically synthesized
tatttgtaagagcagatggc

SEQ ID NO: 73398 - DNA, 20 bp, Artificial Sequence
  chemically synthesized
atttgtaagagcagatggct

SEQ ID NO: 73399 - DNA, 20 bp, Artificial Sequence
  chemically synthesized
tcacttctggacagagagcc

SEQ ID NO: 73400 - DNA, 20 bp, Artificial Sequence
  chemically synthesized
agatggctaggctctctgtc

SEQ ID NO: 73401 - DNA, 20 bp, Artificial Sequence
  chemically synthesized
tggggtcacttctggacaga

SEQ ID NO: 73402 - DNA, 20 bp, Artificial Sequence
  chemically synthesized
tggctaggctctctgtccag

SEQ ID NO: 73403 - DNA, 20 bp, Artificial Sequence
  chemically synthesized
tatggggtcacttctggaca

SEQ ID NO: 73404 - DNA, 20 bp, Artificial Sequence
  chemically synthesized
attatggggtcacttctgga

SEQ ID NO: 73405 - DNA, 20 bp, Artificial Sequence
  chemically synthesized
ttgcattatggggtcacttc

SEQ ID NO: 73406 - DNA, 20 bp, Artificial Sequence
  chemically synthesized
actaatcattttgcattatg

SEQ ID NO: 73407 - DNA, 20 bp, Artificial Sequence
  chemically synthesized
tactaatcattttgcattat

SEQ ID NO: 73408 - DNA, 20 bp, Artificial Sequence
  chemically synthesized
gtactaatcattttgcatta

SEQ ID NO: 73409 - DNA, 20 bp, Artificial Sequence
  chemically synthesized
accccataatgcaaaatgat

SEQ ID NO: 73410 - DNA, 20 bp, Artificial Sequence
  chemically synthesized
ataatgcaaaatgattagta

SEQ ID NO: 73411 - DNA, 20 bp, Artificial Sequence
  chemically synthesized
taatgcaaaatgattagtac

SEQ ID NO: 73412 - DNA, 20 bp, Artificial Sequence
  chemically synthesized
aggatcattaaaaaacaaaa

SEQ ID NO: 73413 - DNA, 20 bp, Artificial Sequence
  chemically synthesized
tcattaaaaaacaaaaaaga

SEQ ID NO: 73414 - DNA, 20 bp, Artificial Sequence
  chemically synthesized
aaaacaaaaaagaaagatat

SEQ ID NO: 73415 - DNA, 20 bp, Artificial Sequence
  chemically synthesized
aaacaaaaaagaaagatatg

SEQ ID NO: 73416 - DNA, 20 bp, Artificial Sequence
  chemically synthesized
tgatcctttaaatgtgttga

SEQ ID NO: 73417 - DNA, 20 bp, Artificial Sequence
  chemically synthesized
aaaatctgtcaacacattta

SEQ ID NO: 73418 - DNA, 20 bp, Artificial Sequence
  chemically synthesized
aaatctgtcaacacatttaa

SEQ ID NO: 73419 - DNA, 20 bp, Artificial Sequence
  chemically synthesized
ttcttaccatcattgagcac

SEQ ID NO: 73420 - DNA, 20 bp, Artificial Sequence
  chemically synthesized
gttcttaccatcattgagca

SEQ ID NO: 73421 - DNA, 20 bp, Artificial Sequence
  chemically synthesized
tcaaatcctgtgctcaatga

SEQ ID NO: 73422 - DNA, 20 bp, Artificial Sequence
  chemically synthesized
tgtttgttcttaccatcatt

SEQ ID NO: 73423 - DNA, 20 bp, Artificial Sequence
  chemically synthesized
atcctgtgctcaatgatggt

SEQ ID NO: 73424 - DNA, 20 bp, Artificial Sequence
  chemically synthesized
atggtaagaacaaacataca

SEQ ID NO: 73425 - DNA, 20 bp, Artificial Sequence
  chemically synthesized
agaacaaacatacatagata

SEQ ID NO: 73426 - DNA, 20 bp, Artificial Sequence
  chemically synthesized
acatacatagatacagataa

SEQ ID NO: 73427 - DNA, 20 bp, Artificial Sequence
  chemically synthesized
atacagataaaagacctgct

SEQ ID NO: 73428 - DNA, 20 bp, Artificial Sequence
  chemically synthesized
tgagataggattttctaagc

SEQ ID NO: 73429 - DNA, 20 bp, Artificial Sequence
  chemically synthesized
gtgagataggattttctaag

SEQ ID NO: 73430 - DNA, 20 bp, Artificial Sequence
  chemically synthesized
ttggtgagataggattttct

SEQ ID NO: 73431 - DNA, 20 bp, Artificial Sequence
  chemically synthesized
attctttactttggtgagat

SEQ ID NO: 73432 - DNA, 20 bp, Artificial Sequence
  chemically synthesized
tattctttactttggtgaga

SEQ ID NO: 73433 - DNA, 20 bp, Artificial Sequence
  chemically synthesized
tagaaaatcctatctcacca

SEQ ID NO: 73434 - DNA, 20 bp, Artificial Sequence
  chemically synthesized
tttatattctttactttggt

SEQ ID NO: 73435 - DNA, 20 bp, Artificial Sequence
  chemically synthesized
aatcctatctcaccaaagta

SEQ ID NO: 73436 - DNA, 20 bp, Artificial Sequence
  chemically synthesized
accatttatattctttactt

SEQ ID NO: 73437 - DNA, 20 bp, Artificial Sequence
  chemically synthesized
accaaagtaaagaatataaa

SEQ ID NO: 73438 - DNA, 20 bp, Artificial Sequence
  chemically synthesized
aatataaatggttctgatat

SEQ ID NO: 73439 - DNA, 20 bp, Artificial Sequence
  chemically synthesized
ccaacaagcaattcttatat

SEQ ID NO: 73440 - DNA, 20 bp, Artificial Sequence
  chemically synthesized
ctgatataagaattgcttgt

SEQ ID NO: 73441 - DNA, 20 bp, Artificial Sequence
  chemically synthesized
ctaaccagtttttttccaac

SEQ ID NO: 73442 - DNA, 20 bp, Artificial Sequence
  chemically synthesized
attgcttgttggaaaaaaac

SEQ ID NO: 73443 - DNA, 20 bp, Artificial Sequence
  chemically synthesized
cttgttggaaaaaaactggt

SEQ ID NO: 73444 - DNA, 20 bp, Artificial Sequence
  chemically synthesized
ttcattttaaaaaaactaac

SEQ ID NO: 73445 - DNA, 20 bp, Artificial Sequence
  chemically synthesized
tggttagtttttttaaaatg

SEQ ID NO: 73446 - DNA, 20 bp, Artificial Sequence
  chemically synthesized
aaacaataggagtatttgtg

SEQ ID NO: 73447 - DNA, 20 bp, Artificial Sequence
  chemically synthesized
catagttagctaaacaatag

SEQ ID NO: 73448 - DNA, 20 bp, Artificial Sequence
  chemically synthesized
acacaaatactcctattgtt

SEQ ID NO: 73449 - DNA, 20 bp, Artificial Sequence
  chemically synthesized
atcatagttagctaaacaat

SEQ ID NO: 73450 - DNA, 20 bp, Artificial Sequence
  chemically synthesized
gatcatagttagctaaacaa

SEQ ID NO: 73451 - DNA, 20 bp, Artificial Sequence
  chemically synthesized
ggatgtgatgggatcatagt

SEQ ID NO: 73452 - DNA, 20 bp, Artificial Sequence
  chemically synthesized
gagaggatgtgatgggatca

SEQ ID NO: 73453 - DNA, 20 bp, Artificial Sequence
  chemically synthesized
gctttgtgagaggatgtgat

SEQ ID NO: 73454 - DNA, 20 bp, Artificial Sequence
  chemically synthesized
agctttgtgagaggatgtga

SEQ ID NO: 73455 - DNA, 20 bp, Artificial Sequence
  chemically synthesized
tcccatcacatcctctcaca

SEQ ID NO: 73456 - DNA, 20 bp, Artificial Sequence
  chemically synthesized
atagtagtaagctttgtgag

SEQ ID NO: 73457 - DNA, 20 bp, Artificial Sequence
  chemically synthesized
catagtagtaagctttgtga

SEQ ID NO: 73458 - DNA, 20 bp, Artificial Sequence
  chemically synthesized
gtcatagtagtaagctttgt

SEQ ID NO: 73459 - DNA, 20 bp, Artificial Sequence
  chemically synthesized
gtctatatagtcatagtagt

SEQ ID NO: 73460 - DNA, 20 bp, Artificial Sequence
  chemically synthesized
cttggtctatatagtcatag

SEQ ID NO: 73461 - DNA, 20 bp, Artificial Sequence
  chemically synthesized
aaacttggtctatatagtca

SEQ ID NO: 73462 - DNA, 20 bp, Artificial Sequence
  chemically synthesized
agcttactactatgactata

SEQ ID NO: 73463 - DNA, 20 bp, Artificial Sequence
  chemically synthesized
tactggaaacttggtctata

SEQ ID NO: 73464 - DNA, 20 bp, Artificial Sequence
  chemically synthesized
ctactatgactatatagacc

SEQ ID NO: 73465 - DNA, 20 bp, Artificial Sequence
  chemically synthesized
gactatatagaccaagtttc

SEQ ID NO: 73466 - DNA, 20 bp, Artificial Sequence
  chemically synthesized
ataatttcttactggaaact

SEQ ID NO: 73467 - DNA, 20 bp, Artificial Sequence
  chemically synthesized
atatagaccaagtttccagt

SEQ ID NO: 73468 - DNA, 20 bp, Artificial Sequence
  chemically synthesized
attattcaataatttcttac

SEQ ID NO: 73469 - DNA, 20 bp, Artificial Sequence
  chemically synthesized
ttattgaataatttgtaaac

SEQ ID NO: 73470 - DNA, 20 bp, Artificial Sequence
  chemically synthesized
attgaataatttgtaaacca

SEQ ID NO: 73471 - DNA, 20 bp, Artificial Sequence
  chemically synthesized
gcagtacccattattatctc

SEQ ID NO: 73472 - DNA, 20 bp, Artificial Sequence
  chemically synthesized
ttgtaaaccagagataataa

SEQ ID NO: 73473 - DNA, 20 bp, Artificial Sequence
  chemically synthesized
tgtaaaccagagataataat

SEQ ID NO: 73474 - DNA, 20 bp, Artificial Sequence
  chemically synthesized
aataatgggtactgcttttg

SEQ ID NO: 73475 - DNA, 20 bp, Artificial Sequence
  chemically synthesized
taacactgatactacaaaag

SEQ ID NO: 73476 - DNA, 20 bp, Artificial Sequence
  chemically synthesized
tcataacactgatactacaa

SEQ ID NO: 73477 - DNA, 20 bp, Artificial Sequence
  chemically synthesized
gggtactgcttttgtagtat

SEQ ID NO: 73478 - DNA, 20 bp, Artificial Sequence
  chemically synthesized
ttgtagtatcagtgttatga

SEQ ID NO: 73479 - DNA, 20 bp, Artificial Sequence
  chemically synthesized
tcagtgttatgatagtatgt

SEQ ID NO: 73480 - DNA, 20 bp, Artificial Sequence
  chemically synthesized
tatgtaagtatgtatatttc

SEQ ID NO: 73481 - DNA, 20 bp, Artificial Sequence
  chemically synthesized
cctttctcagtgttaaaaac

SEQ ID NO: 73482 - DNA, 20 bp, Artificial Sequence
  chemically synthesized
tatttctggtttttaacact

SEQ ID NO: 73483 - DNA, 20 bp, Artificial Sequence
  chemically synthesized
tctggtttttaacactgaga

SEQ ID NO: 73484 - DNA, 20 bp, Artificial Sequence
  chemically synthesized
ctggtttttaacactgagaa

SEQ ID NO: 73485 - DNA, 20 bp, Artificial Sequence
  chemically synthesized
ccacccctctcatcctttct

SEQ ID NO: 73486 - DNA, 20 bp, Artificial Sequence
  chemically synthesized
ttttaacactgagaaaggat

SEQ ID NO: 73487 - DNA, 20 bp, Artificial Sequence
  chemically synthesized
ttaacactgagaaaggatga

SEQ ID NO: 73488 - DNA, 20 bp, Artificial Sequence
  chemically synthesized
taacactgagaaaggatgag

SEQ ID NO: 73489 - DNA, 20 bp, Artificial Sequence
  chemically synthesized
aacactgagaaaggatgaga

SEQ ID NO: 73490 - DNA, 20 bp, Artificial Sequence
  chemically synthesized
acactgagaaaggatgagag

SEQ ID NO: 73491 - DNA, 20 bp, Artificial Sequence
  chemically synthesized
ctgagaaaggatgagagggg

SEQ ID NO: 73492 - DNA, 20 bp, Artificial Sequence
  chemically synthesized
tgagaaaggatgagaggggt

SEQ ID NO: 73493 - DNA, 20 bp, Artificial Sequence
  chemically synthesized
atgagaggggtgggccatca

SEQ ID NO: 73494 - DNA, 20 bp, Artificial Sequence
  chemically synthesized
agaggggtgggccatcatgg

SEQ ID NO: 73495 - DNA, 20 bp, Artificial Sequence
  chemically synthesized
ctcttttattacttccatga

SEQ ID NO: 73496 - DNA, 20 bp, Artificial Sequence
  chemically synthesized
ggccatcatggaagtaataa

SEQ ID NO: 73497 - DNA, 20 bp, Artificial Sequence
  chemically synthesized
ccatcatggaagtaataaaa

SEQ ID NO: 73498 - DNA, 20 bp, Artificial Sequence
  chemically synthesized
taaaagagaacccatcttta

SEQ ID NO: 73499 - DNA, 20 bp, Artificial Sequence
  chemically synthesized
ttaagtaaagctttaaagat

SEQ ID NO: 73500 - DNA, 20 bp, Artificial Sequence
  chemically synthesized
attaagtaaagctttaaaga

SEQ ID NO: 73501 - DNA, 20 bp, Artificial Sequence
  chemically synthesized
ctatattaagtaaagcttta

SEQ ID NO: 73502 - DNA, 20 bp, Artificial Sequence
  chemically synthesized
tgcttatgctatattaagta

SEQ ID NO: 73503 - DNA, 20 bp, Artificial Sequence
  chemically synthesized
ctttaaagctttacttaata

SEQ ID NO: 73504 - DNA, 20 bp, Artificial Sequence
  chemically synthesized
tttactgcttatgctatatt

SEQ ID NO: 73505 - DNA, 20 bp, Artificial Sequence
  chemically synthesized
agctttacttaatatagcat

SEQ ID NO: 73506 - DNA, 20 bp, Artificial Sequence
  chemically synthesized
tttacttaatatagcataag

SEQ ID NO: 73507 - DNA, 20 bp, Artificial Sequence
  chemically synthesized
ttaatatagcataagcagta

SEQ ID NO: 73508 - DNA, 20 bp, Artificial Sequence
  chemically synthesized
taatatagcataagcagtaa

SEQ ID NO: 73509 - DNA, 20 bp, Artificial Sequence
  chemically synthesized
aatatagcataagcagtaaa

SEQ ID NO: 73510 - DNA, 20 bp, Artificial Sequence
  chemically synthesized
tatagcataagcagtaaagg

SEQ ID NO: 73511 - DNA, 20 bp, Artificial Sequence
  chemically synthesized
gcagtaaagggagttttgtt

SEQ ID NO: 73512 - DNA, 20 bp, Artificial Sequence
  chemically synthesized
agttttgtttagtatgtcct

SEQ ID NO: 73513 - DNA, 20 bp, Artificial Sequence
  chemically synthesized
taatgatcctgtttggtcca

SEQ ID NO: 73514 - DNA, 20 bp, Artificial Sequence
  chemically synthesized
gtaatgatcctgtttggtcc

SEQ ID NO: 73515 - DNA, 20 bp, Artificial Sequence
  chemically synthesized
tagtatgtccttggaccaaa

SEQ ID NO: 73516 - DNA, 20 bp, Artificial Sequence
  chemically synthesized
agtatgtccttggaccaaac

SEQ ID NO: 73517 - DNA, 20 bp, Artificial Sequence
  chemically synthesized
gacattgtaatgatcctgtt

SEQ ID NO: 73518 - DNA, 20 bp, Artificial Sequence
  chemically synthesized
aggatcattacaatgtcttc

SEQ ID NO: 73519 - DNA, 20 bp, Artificial Sequence
  chemically synthesized
ggatcattacaatgtcttct

SEQ ID NO: 73520 - DNA, 20 bp, Artificial Sequence
  chemically synthesized
agcatctactgtgtacctag

SEQ ID NO: 73521 - DNA, 20 bp, Artificial Sequence
  chemically synthesized
tacaatgtcttctaggtaca

SEQ ID NO: 73522 - DNA, 20 bp, Artificial Sequence
  chemically synthesized
ttgagcatctactgtgtacc

SEQ ID NO: 73523 - DNA, 20 bp, Artificial Sequence
  chemically synthesized
aatgtcttctaggtacacag

SEQ ID NO: 73524 - DNA, 20 bp, Artificial Sequence
  chemically synthesized
gtacacagtagatgctcaat

SEQ ID NO: 73525 - DNA, 20 bp, Artificial Sequence
  chemically synthesized
tcattcagtcagcactgatt

SEQ ID NO: 73526 - DNA, 20 bp, Artificial Sequence
  chemically synthesized
cctttgttctttcattcagt

SEQ ID NO: 73527 - DNA, 20 bp, Artificial Sequence
  chemically synthesized
aatcagtgctgactgaatga

SEQ ID NO: 73528 - DNA, 20 bp, Artificial Sequence
  chemically synthesized
catccctttgttctttcatt

SEQ ID NO: 73529 - DNA, 20 bp, Artificial Sequence
  chemically synthesized
gctgactgaatgaaagaaca

SEQ ID NO: 73530 - DNA, 20 bp, Artificial Sequence
  chemically synthesized
ctgactgaatgaaagaacaa

SEQ ID NO: 73531 - DNA, 20 bp, Artificial Sequence
  chemically synthesized
tgactgaatgaaagaacaaa

SEQ ID NO: 73532 - DNA, 20 bp, Artificial Sequence
  chemically synthesized
atgaaagaacaaagggatga

SEQ ID NO: 73533 - DNA, 20 bp, Artificial Sequence
  chemically synthesized
aaagaacaaagggatgaaag

SEQ ID NO: 73534 - DNA, 20 bp, Artificial Sequence
  chemically synthesized
aagaacaaagggatgaaaga

SEQ ID NO: 73535 - DNA, 20 bp, Artificial Sequence
  chemically synthesized
aagggatgaaagaaggaatg

SEQ ID NO: 73536 - DNA, 20 bp, Artificial Sequence
  chemically synthesized
agaaggaatgaagtttgcaa

SEQ ID NO: 73537 - DNA, 20 bp, Artificial Sequence
  chemically synthesized
gaatgaagtttgcaaaagat

SEQ ID NO: 73538 - DNA, 20 bp, Artificial Sequence
  chemically synthesized
aatgaagtttgcaaaagatg

SEQ ID NO: 73539 - DNA, 20 bp, Artificial Sequence
  chemically synthesized
gtttgcaaaagatgaggctc

SEQ ID NO: 73540 - DNA, 20 bp, Artificial Sequence
  chemically synthesized
cttgctgtcgcagggatcta

SEQ ID NO: 73541 - DNA, 20 bp, Artificial Sequence
  chemically synthesized
aacttgctgtcgcagggatc

SEQ ID NO: 73542 - DNA, 20 bp, Artificial Sequence
  chemically synthesized
gaggctctagatccctgcga

SEQ ID NO: 73543 - DNA, 20 bp, Artificial Sequence
  chemically synthesized
tgtggtaacttgctgtcgca

SEQ ID NO: 73544 - DNA, 20 bp, Artificial Sequence
  chemically synthesized
ctgtggtaacttgctgtcgc

SEQ ID NO: 73545 - DNA, 20 bp, Artificial Sequence
  chemically synthesized
ctctagatccctgcgacagc

SEQ ID NO: 73546 - DNA, 20 bp, Artificial Sequence
  chemically synthesized
tctgtggtaacttgctgtcg

SEQ ID NO: 73547 - DNA, 20 bp, Artificial Sequence
  chemically synthesized
cctgcgacagcaagttacca

SEQ ID NO: 73548 - DNA, 20 bp, Artificial Sequence
  chemically synthesized
tgcgacagcaagttaccaca

SEQ ID NO: 73549 - DNA, 20 bp, Artificial Sequence
  chemically synthesized
gcgacagcaagttaccacag

SEQ ID NO: 73550 - DNA, 20 bp, Artificial Sequence
  chemically synthesized
actccatctgtatacctctg

SEQ ID NO: 73551 - DNA, 20 bp, Artificial Sequence
  chemically synthesized
caagttaccacagaggtata

SEQ ID NO: 73552 - DNA, 20 bp, Artificial Sequence
  chemically synthesized
ttaccacagaggtatacaga

SEQ ID NO: 73553 - DNA, 20 bp, Artificial Sequence
  chemically synthesized
accacagaggtatacagatg

SEQ ID NO: 73554 - DNA, 20 bp, Artificial Sequence
  chemically synthesized
aagcttcttccaaagtcatg

SEQ ID NO: 73555 - DNA, 20 bp, Artificial Sequence
  chemically synthesized
taatgatgtctacatgactt

SEQ ID NO: 73556 - DNA, 20 bp, Artificial Sequence
  chemically synthesized
tgatgtctacatgactttgg

SEQ ID NO: 73557 - DNA, 20 bp, Artificial Sequence
  chemically synthesized
tgtctacatgactttggaag

SEQ ID NO: 73558 - DNA, 20 bp, Artificial Sequence
  chemically synthesized
ggtttcctaagcttcttcca

SEQ ID NO: 73559 - DNA, 20 bp, Artificial Sequence
  chemically synthesized
acatgactttggaagaagct

SEQ ID NO: 73560 - DNA, 20 bp, Artificial Sequence
  chemically synthesized
catgactttggaagaagctt

SEQ ID NO: 73561 - DNA, 20 bp, Artificial Sequence
  chemically synthesized
atgttttttaaaggtttcct

SEQ ID NO: 73562 - DNA, 20 bp, Artificial Sequence
  chemically synthesized
aaattatgtatgttttttaa

SEQ ID NO: 73563 - DNA, 20 bp, Artificial Sequence
  chemically synthesized
taaattatgtatgtttttta

SEQ ID NO: 73564 - DNA, 20 bp, Artificial Sequence
  chemically synthesized
tctttacatatgtcaaagaa

SEQ ID NO: 73565 - DNA, 20 bp, Artificial Sequence
  chemically synthesized
tagattctttacatatgtca

SEQ ID NO: 73566 - DNA, 20 bp, Artificial Sequence
  chemically synthesized
actgttctttgacatatgta

SEQ ID NO: 73567 - DNA, 20 bp, Artificial Sequence
  chemically synthesized
gacatatgtaaagaatctaa

SEQ ID NO: 73568 - DNA, 20 bp, Artificial Sequence
  chemically synthesized
tatgtaaagaatctaatagc

SEQ ID NO: 73569 - DNA, 20 bp, Artificial Sequence
  chemically synthesized
atgaaggcatttccagctat

SEQ ID NO: 73570 - DNA, 20 bp, Artificial Sequence
  chemically synthesized
gaataatatgaaggcatttc

SEQ ID NO: 73571 - DNA, 20 bp, Artificial Sequence
  chemically synthesized
ttaaaatctgaataatatga

SEQ ID NO: 73572 - DNA, 20 bp, Artificial Sequence
  chemically synthesized
tttaaaatctgaataatatg

SEQ ID NO: 73573 - DNA, 20 bp, Artificial Sequence
  chemically synthesized
ggaaatgccttcatattatt

SEQ ID NO: 73574 - DNA, 20 bp, Artificial Sequence
  chemically synthesized
ttcatattattcagatttta

SEQ ID NO: 73575 - DNA, 20 bp, Artificial Sequence
  chemically synthesized
tcatattattcagattttaa

SEQ ID NO: 73576 - DNA, 20 bp, Artificial Sequence
  chemically synthesized
taaaggtgtttgcattccat

SEQ ID NO: 73577 - DNA, 20 bp, Artificial Sequence
  chemically synthesized
ttattgactgtaggaactca

SEQ ID NO: 73578 - DNA, 20 bp, Artificial Sequence
  chemically synthesized
ttgcattccatgagttccta

SEQ ID NO: 73579 - DNA, 20 bp, Artificial Sequence
  chemically synthesized
gtatttgttttattgactgt

SEQ ID NO: 73580 - DNA, 20 bp, Artificial Sequence
  chemically synthesized
agtatttgttttattgactg

SEQ ID NO: 73581 - DNA, 20 bp, Artificial Sequence
  chemically synthesized
caaaaacactttaacataag

SEQ ID NO: 73582 - DNA, 20 bp, Artificial Sequence
  chemically synthesized
aacaaatactccttatgtta

SEQ ID NO: 73583 - DNA, 20 bp, Artificial Sequence
  chemically synthesized
tgcaaaaacactttaacata

SEQ ID NO: 73584 - DNA, 20 bp, Artificial Sequence
  chemically synthesized
ctgcaaaaacactttaacat

SEQ ID NO: 73585 - DNA, 20 bp, Artificial Sequence
  chemically synthesized
cttatgttaaagtgtttttg

SEQ ID NO: 73586 - DNA, 20 bp, Artificial Sequence
  chemically synthesized
taaacccacaaatagcacaa

SEQ ID NO: 73587 - DNA, 20 bp, Artificial Sequence
  chemically synthesized
tgcagcttttgtgctatttg

SEQ ID NO: 73588 - DNA, 20 bp, Artificial Sequence
  chemically synthesized
gcagcttttgtgctatttgt

SEQ ID NO: 73589 - DNA, 20 bp, Artificial Sequence
  chemically synthesized
ctcatgagtaaacccacaaa

SEQ ID NO: 73590 - DNA, 20 bp, Artificial Sequence
  chemically synthesized
ctatttgtgggtttactcat

SEQ ID NO: 73591 - DNA, 20 bp, Artificial Sequence
  chemically synthesized
tgtgggtttactcatgagta

SEQ ID NO: 73592 - DNA, 20 bp, Artificial Sequence
  chemically synthesized
taccatttttctttactcat

SEQ ID NO: 73593 - DNA, 20 bp, Artificial Sequence
  chemically synthesized
tactcatgagtaaagaaaaa

SEQ ID NO: 73594 - DNA, 20 bp, Artificial Sequence
  chemically synthesized
caagcgcaagtagtatataa

SEQ ID NO: 73595 - DNA, 20 bp, Artificial Sequence
  chemically synthesized
ccaagcgcaagtagtatata

SEQ ID NO: 73596 - DNA, 20 bp, Artificial Sequence
  chemically synthesized
ctttattcaccaagcgcaag

SEQ ID NO: 73597 - DNA, 20 bp, Artificial Sequence
  chemically synthesized
ctttatatactacttgcgct

SEQ ID NO: 73598 - DNA, 20 bp, Artificial Sequence
  chemically synthesized
tctctttattcaccaagcgc

SEQ ID NO: 73599 - DNA, 20 bp, Artificial Sequence
  chemically synthesized
agtcaatctctttattcacc

SEQ ID NO: 73600 - DNA, 20 bp, Artificial Sequence
  chemically synthesized
ctacttgcgcttggtgaata

SEQ ID NO: 73601 - DNA, 20 bp, Artificial Sequence
  chemically synthesized
acttgcgcttggtgaataaa

SEQ ID NO: 73602 - DNA, 20 bp, Artificial Sequence
  chemically synthesized
aagagattgactgcattact

SEQ ID NO: 73603 - DNA, 20 bp, Artificial Sequence
  chemically synthesized
agtacacacactgagtaatg

SEQ ID NO: 73604 - DNA, 20 bp, Artificial Sequence
  chemically synthesized
tttgaaatagtacacacact

SEQ ID NO: 73605 - DNA, 20 bp, Artificial Sequence
  chemically synthesized
aaacctttctaattttgaaa

SEQ ID NO: 73606 - DNA, 20 bp, Artificial Sequence
  chemically synthesized
tgtgtgtactatttcaaaat

SEQ ID NO: 73607 - DNA, 20 bp, Artificial Sequence
  chemically synthesized
tgtactatttcaaaattaga

SEQ ID NO: 73608 - DNA, 20 bp, Artificial Sequence
  chemically synthesized
gtactatttcaaaattagaa

SEQ ID NO: 73609 - DNA, 20 bp, Artificial Sequence
  chemically synthesized
atctaaaccaggtgagaaaa

SEQ ID NO: 73610 - DNA, 20 bp, Artificial Sequence
  chemically synthesized
attttaacttttttctcacc

SEQ ID NO: 73611 - DNA, 20 bp, Artificial Sequence
  chemically synthesized
aacgaatatctaaaccaggt

SEQ ID NO: 73612 - DNA, 20 bp, Artificial Sequence
  chemically synthesized
aacttttttctcacctggtt

SEQ ID NO: 73613 - DNA, 20 bp, Artificial Sequence
  chemically synthesized
tagaaacgaatatctaaacc

SEQ ID NO: 73614 - DNA, 20 bp, Artificial Sequence
  chemically synthesized
gtagaaacgaatatctaaac

SEQ ID NO: 73615 - DNA, 20 bp, Artificial Sequence
  chemically synthesized
tttagatattcgtttctact

SEQ ID NO: 73616 - DNA, 20 bp, Artificial Sequence
  chemically synthesized
aatgctaatatttgaccaag

SEQ ID NO: 73617 - DNA, 20 bp, Artificial Sequence
  chemically synthesized
actaatgctaatatttgacc

SEQ ID NO: 73618 - DNA, 20 bp, Artificial Sequence
  chemically synthesized
gtttctacttggtcaaatat

SEQ ID NO: 73619 - DNA, 20 bp, Artificial Sequence
  chemically synthesized
acttggtcaaatattagcat

SEQ ID NO: 73620 - DNA, 20 bp, Artificial Sequence
  chemically synthesized
gtcaaatattagcattagtt

SEQ ID NO: 73621 - DNA, 20 bp, Artificial Sequence
  chemically synthesized
attagcattagtttggcttt

SEQ ID NO: 73622 - DNA, 20 bp, Artificial Sequence
  chemically synthesized
tagcattagtttggctttaa

SEQ ID NO: 73623 - DNA, 20 bp, Artificial Sequence
  chemically synthesized
tttcagtgaatcagctctta

SEQ ID NO: 73624 - DNA, 20 bp, Artificial Sequence
  chemically synthesized
caaaagtgatttcagtgaat

SEQ ID NO: 73625 - DNA, 20 bp, Artificial Sequence
  chemically synthesized
aaatcagccaaaagtgattt

SEQ ID NO: 73626 - DNA, 20 bp, Artificial Sequence
  chemically synthesized
tgattcactgaaatcacttt

SEQ ID NO: 73627 - DNA, 20 bp, Artificial Sequence
  chemically synthesized
attgtactaaaatcagccaa

SEQ ID NO: 73628 - DNA, 20 bp, Artificial Sequence
  chemically synthesized
aaatcacttttggctgattt

SEQ ID NO: 73629 - DNA, 20 bp, Artificial Sequence
  chemically synthesized
ctcagcaattgtactaaaat

SEQ ID NO: 73630 - DNA, 20 bp, Artificial Sequence
  chemically synthesized
ctgattttagtacaattgct

SEQ ID NO: 73631 - DNA, 20 bp, Artificial Sequence
  chemically synthesized
agtacaattgctgagttcta

SEQ ID NO: 73632 - DNA, 20 bp, Artificial Sequence
  chemically synthesized
tcctcattgcctttagaact

SEQ ID NO: 73633 - DNA, 20 bp, Artificial Sequence
  chemically synthesized
gtacaattgctgagttctaa

SEQ ID NO: 73634 - DNA, 20 bp, Artificial Sequence
  chemically synthesized
attatattcctcattgcctt

SEQ ID NO: 73635 - DNA, 20 bp, Artificial Sequence
  chemically synthesized
tgctgagttctaaaggcaat

SEQ ID NO: 73636 - DNA, 20 bp, Artificial Sequence
  chemically synthesized
gctgagttctaaaggcaatg

SEQ ID NO: 73637 - DNA, 20 bp, Artificial Sequence
  chemically synthesized
gtttcaaatataaaatttta

SEQ ID NO: 73638 - DNA, 20 bp, Artificial Sequence
  chemically synthesized
taaaattttatatttgaaac

SEQ ID NO: 73639 - DNA, 20 bp, Artificial Sequence
  chemically synthesized
ttgaaacaagtgtgatttct

SEQ ID NO: 73640 - DNA, 20 bp, Artificial Sequence
  chemically synthesized
tgaaacaagtgtgatttcta

SEQ ID NO: 73641 - DNA, 20 bp, Artificial Sequence
  chemically synthesized
gaaacaagtgtgatttctaa

SEQ ID NO: 73642 - DNA, 20 bp, Artificial Sequence
  chemically synthesized
aaacaagtgtgatttctaag

SEQ ID NO: 73643 - DNA, 20 bp, Artificial Sequence
  chemically synthesized
acccagttcagtgtacccct

SEQ ID NO: 73644 - DNA, 20 bp, Artificial Sequence
  chemically synthesized
ttctaaggggtacactgaac

SEQ ID NO: 73645 - DNA, 20 bp, Artificial Sequence
  chemically synthesized
tctaaggggtacactgaact

SEQ ID NO: 73646 - DNA, 20 bp, Artificial Sequence
  chemically synthesized
atggattaatgaacccagtt

SEQ ID NO: 73647 - DNA, 20 bp, Artificial Sequence
  chemically synthesized
aaccaatggattaatgaacc

SEQ ID NO: 73648 - DNA, 20 bp, Artificial Sequence
  chemically synthesized
aactgggttcattaatccat

SEQ ID NO: 73649 - DNA, 20 bp, Artificial Sequence
  chemically synthesized
atcttccttttataaaccaa

SEQ ID NO: 73650 - DNA, 20 bp, Artificial Sequence
  chemically synthesized
attaatccattggtttataa

SEQ ID NO: 73651 - DNA, 20 bp, Artificial Sequence
  chemically synthesized
ttaatccattggtttataaa

SEQ ID NO: 73652 - DNA, 20 bp, Artificial Sequence
  chemically synthesized
atccattggtttataaaagg

SEQ ID NO: 73653 - DNA, 20 bp, Artificial Sequence
  chemically synthesized
tttataaaaggaagatttaa

SEQ ID NO: 73654 - DNA, 20 bp, Artificial Sequence
  chemically synthesized
atttaaaagttaatatacct

SEQ ID NO: 73655 - DNA, 20 bp, Artificial Sequence
  chemically synthesized
tcttttttgaaatgattctt

SEQ ID NO: 73656 - DNA, 20 bp, Artificial Sequence
  chemically synthesized
ttcttttttgaaatgattct

SEQ ID NO: 73657 - DNA, 20 bp, Artificial Sequence
  chemically synthesized
acctaagaatcatttcaaaa

SEQ ID NO: 73658 - DNA, 20 bp, Artificial Sequence
  chemically synthesized
taagaatcatttcaaaaaag

SEQ ID NO: 73659 - DNA, 20 bp, Artificial Sequence
  chemically synthesized
aaaagaagatacatgtaaaa

SEQ ID NO: 73660 - DNA, 20 bp, Artificial Sequence
  chemically synthesized
aagatacatgtaaaaaagtg

SEQ ID NO: 73661 - DNA, 20 bp, Artificial Sequence
  chemically synthesized
aaaactattttggacaatac

SEQ ID NO: 73662 - DNA, 20 bp, Artificial Sequence
  chemically synthesized
taaaactattttggacaata

SEQ ID NO: 73663 - DNA, 20 bp, Artificial Sequence
  chemically synthesized
tacacctgtattgtccaaaa

SEQ ID NO: 73664 - DNA, 20 bp, Artificial Sequence
  chemically synthesized
gcaatactttaaaactattt

SEQ ID NO: 73665 - DNA, 20 bp, Artificial Sequence
  chemically synthesized
tattgtccaaaatagtttta

SEQ ID NO: 73666 - DNA, 20 bp, Artificial Sequence
  chemically synthesized
tttccaaaaaaaaaaaaaaa

SEQ ID NO: 73667 - DNA, 20 bp, Artificial Sequence
  chemically synthesized
ttgctttttttttttttttt

SEQ ID NO: 73668 - DNA, 20 bp, Artificial Sequence
  chemically synthesized
tttttttttttttttggaaa

SEQ ID NO: 73669 - DNA, 20 bp, Artificial Sequence
  chemically synthesized
tccagcctgggcaacagagc

SEQ ID NO: 73670 - DNA, 20 bp, Artificial Sequence
  chemically synthesized
tggtgtcttgctctgttgcc

SEQ ID NO: 73671 - DNA, 20 bp, Artificial Sequence
  chemically synthesized
gcactccagcctgggcaaca

SEQ ID NO: 73672 - DNA, 20 bp, Artificial Sequence
  chemically synthesized
ggtgtcttgctctgttgccc

SEQ ID NO: 73673 - DNA, 20 bp, Artificial Sequence
  chemically synthesized
ctgcactccagcctgggcaa

SEQ ID NO: 73674 - DNA, 20 bp, Artificial Sequence
  chemically synthesized
tcttgctctgttgcccaggc

SEQ ID NO: 73675 - DNA, 20 bp, Artificial Sequence
  chemically synthesized
ttgctctgttgcccaggctg

SEQ ID NO: 73676 - DNA, 20 bp, Artificial Sequence
  chemically synthesized
atgccactgcactccagcct

SEQ ID NO: 73677 - DNA, 20 bp, Artificial Sequence
  chemically synthesized
catgccactgcactccagcc

SEQ ID NO: 73678 - DNA, 20 bp, Artificial Sequence
  chemically synthesized
ctgttgcccaggctggagtg

SEQ ID NO: 73679 - DNA, 20 bp, Artificial Sequence
  chemically synthesized
gagatcatgccactgcactc

SEQ ID NO: 73680 - DNA, 20 bp, Artificial Sequence
  chemically synthesized
ttgcccaggctggagtgcag

SEQ ID NO: 73681 - DNA, 20 bp, Artificial Sequence
  chemically synthesized
ggagtgcagtggcatgatct

SEQ ID NO: 73682 - DNA, 20 bp, Artificial Sequence
  chemically synthesized
ggcggatgttgcagtaagct

SEQ ID NO: 73683 - DNA, 20 bp, Artificial Sequence
  chemically synthesized
cgggaggcggatgttgcagt

SEQ ID NO: 73684 - DNA, 20 bp, Artificial Sequence
  chemically synthesized
aacccgggaggcggatgttg

SEQ ID NO: 73685 - DNA, 20 bp, Artificial Sequence
  chemically synthesized
ttactgcaacatccgcctcc

SEQ ID NO: 73686 - DNA, 20 bp, Artificial Sequence
  chemically synthesized
tactgcaacatccgcctccc

SEQ ID NO: 73687 - DNA, 20 bp, Artificial Sequence
  chemically synthesized
aatcgcttgaacccgggagg

SEQ ID NO: 73688 - DNA, 20 bp, Artificial Sequence
  chemically synthesized
gagaatcgcttgaacccggg

SEQ ID NO: 73689 - DNA, 20 bp, Artificial Sequence
  chemically synthesized
ggagaatcgcttgaacccgg

SEQ ID NO: 73690 - DNA, 20 bp, Artificial Sequence
  chemically synthesized
aacatccgcctcccgggttc

SEQ ID NO: 73691 - DNA, 20 bp, Artificial Sequence
  chemically synthesized
caggagaatcgcttgaaccc

SEQ ID NO: 73692 - DNA, 20 bp, Artificial Sequence
  chemically synthesized
gcaggagaatcgcttgaacc

SEQ ID NO: 73693 - DNA, 20 bp, Artificial Sequence
  chemically synthesized
ttcaagcgattctcctgcct

SEQ ID NO: 73694 - DNA, 20 bp, Artificial Sequence
  chemically synthesized
tacttgggaagctgaggcag

SEQ ID NO: 73695 - DNA, 20 bp, Artificial Sequence
  chemically synthesized
gctacttgggaagctgaggc

SEQ ID NO: 73696 - DNA, 20 bp, Artificial Sequence
  chemically synthesized
agctacttgggaagctgagg

SEQ ID NO: 73697 - DNA, 20 bp, Artificial Sequence
  chemically synthesized
atcagctacttgggaagctg

SEQ ID NO: 73698 - DNA, 20 bp, Artificial Sequence
  chemically synthesized
gatcagctacttgggaagct

SEQ ID NO: 73699 - DNA, 20 bp, Artificial Sequence
  chemically synthesized
ttctcctgcctcagcttccc

SEQ ID NO: 73700 - DNA, 20 bp, Artificial Sequence
  chemically synthesized
tcctgcctcagcttcccaag

SEQ ID NO: 73701 - DNA, 20 bp, Artificial Sequence
  chemically synthesized
ttgtagatcagctacttggg

SEQ ID NO: 73702 - DNA, 20 bp, Artificial Sequence
  chemically synthesized
cgcttgtagatcagctactt

SEQ ID NO: 73703 - DNA, 20 bp, Artificial Sequence
  chemically synthesized
acgcttgtagatcagctact

SEQ ID NO: 73704 - DNA, 20 bp, Artificial Sequence
  chemically synthesized
ttcccaagtagctgatctac

SEQ ID NO: 73705 - DNA, 20 bp, Artificial Sequence
  chemically synthesized
ggtggcgcacgcttgtagat

SEQ ID NO: 73706 - DNA, 20 bp, Artificial Sequence
  chemically synthesized
ggtgtggtggcgcacgcttg

SEQ ID NO: 73707 - DNA, 20 bp, Artificial Sequence
  chemically synthesized
caagcgtgcgccaccacacc

SEQ ID NO: 73708 - DNA, 20 bp, Artificial Sequence
  chemically synthesized
caaaaattagctgggtgtgg

SEQ ID NO: 73709 - DNA, 20 bp, Artificial Sequence
  chemically synthesized
atacaaaaattagctgggtg

SEQ ID NO: 73710 - DNA, 20 bp, Artificial Sequence
  chemically synthesized
taaaaatacaaaaattagct

SEQ ID NO: 73711 - DNA, 20 bp, Artificial Sequence
  chemically synthesized
ctaaaaatacaaaaattagc

SEQ ID NO: 73712 - DNA, 20 bp, Artificial Sequence
  chemically synthesized
actactaaaaatacaaaaat

SEQ ID NO: 73713 - DNA, 20 bp, Artificial Sequence
  chemically synthesized
ccagctaatttttgtatttt

SEQ ID NO: 73714 - DNA, 20 bp, Artificial Sequence
  chemically synthesized
gctaatttttgtatttttag

SEQ ID NO: 73715 - DNA, 20 bp, Artificial Sequence
  chemically synthesized
ttttgtatttttagtagtga

SEQ ID NO: 73716 - DNA, 20 bp, Artificial Sequence
  chemically synthesized
tttgtatttttagtagtgat

SEQ ID NO: 73717 - DNA, 20 bp, Artificial Sequence
  chemically synthesized
ttgtatttttagtagtgatg

SEQ ID NO: 73718 - DNA, 20 bp, Artificial Sequence
  chemically synthesized
gatggggtttcactatgtgt

SEQ ID NO: 73719 - DNA, 20 bp, Artificial Sequence
  chemically synthesized
agaccggcctggccaacaca

SEQ ID NO: 73720 - DNA, 20 bp, Artificial Sequence
  chemically synthesized
gggtttcactatgtgttggc

SEQ ID NO: 73721 - DNA, 20 bp, Artificial Sequence
  chemically synthesized
ggtttcactatgtgttggcc

SEQ ID NO: 73722 - DNA, 20 bp, Artificial Sequence
  chemically synthesized
tcactatgtgttggccaggc

SEQ ID NO: 73723 - DNA, 20 bp, Artificial Sequence
  chemically synthesized
tcaggagttcaagaccggcc

SEQ ID NO: 73724 - DNA, 20 bp, Artificial Sequence
  chemically synthesized
tgagatcaggagttcaagac

SEQ ID NO: 73725 - DNA, 20 bp, Artificial Sequence
  chemically synthesized
tcacttgagatcaggagttc

SEQ ID NO: 73726 - DNA, 20 bp, Artificial Sequence
  chemically synthesized
ggtggatcacttgagatcag

SEQ ID NO: 73727 - DNA, 20 bp, Artificial Sequence
  chemically synthesized
ggtcttgaactcctgatctc

SEQ ID NO: 73728 - DNA, 20 bp, Artificial Sequence
  chemically synthesized
cgggtggatcacttgagatc

SEQ ID NO: 73729 - DNA, 20 bp, Artificial Sequence
  chemically synthesized
gcgggtggatcacttgagat

SEQ ID NO: 73730 - DNA, 20 bp, Artificial Sequence
  chemically synthesized
gtgaggcgggtggatcactt

SEQ ID NO: 73731 - DNA, 20 bp, Artificial Sequence
  chemically synthesized
ctttgggagggtgaggcggg

SEQ ID NO: 73732 - DNA, 20 bp, Artificial Sequence
  chemically synthesized
gtactttgggagggtgaggc

SEQ ID NO: 73733 - DNA, 20 bp, Artificial Sequence
  chemically synthesized
agtactttgggagggtgagg

SEQ ID NO: 73734 - DNA, 20 bp, Artificial Sequence
  chemically synthesized
cccagtactttgggagggtg

SEQ ID NO: 73735 - DNA, 20 bp, Artificial Sequence
  chemically synthesized
tcccagtactttgggagggt

SEQ ID NO: 73736 - DNA, 20 bp, Artificial Sequence
  chemically synthesized
ccacccgcctcaccctccca

SEQ ID NO: 73737 - DNA, 20 bp, Artificial Sequence
  chemically synthesized
gtaatcccagtactttggga

SEQ ID NO: 73738 - DNA, 20 bp, Artificial Sequence
  chemically synthesized
tgtaatcccagtactttggg

SEQ ID NO: 73739 - DNA, 20 bp, Artificial Sequence
  chemically synthesized
ctgtaatcccagtactttgg

SEQ ID NO: 73740 - DNA, 20 bp, Artificial Sequence
  chemically synthesized
gcctcaccctcccaaagtac

SEQ ID NO: 73741 - DNA, 20 bp, Artificial Sequence
  chemically synthesized
gcctgtaatcccagtacttt

SEQ ID NO: 73742 - DNA, 20 bp, Artificial Sequence
  chemically synthesized
cctcaccctcccaaagtact

SEQ ID NO: 73743 - DNA, 20 bp, Artificial Sequence
  chemically synthesized
cgcctgtaatcccagtactt

SEQ ID NO: 73744 - DNA, 20 bp, Artificial Sequence
  chemically synthesized
ctcccaaagtactgggatta

SEQ ID NO: 73745 - DNA, 20 bp, Artificial Sequence
  chemically synthesized
tcccaaagtactgggattac

SEQ ID NO: 73746 - DNA, 20 bp, Artificial Sequence
  chemically synthesized
gtggctcacgcctgtaatcc

SEQ ID NO: 73747 - DNA, 20 bp, Artificial Sequence
  chemically synthesized
agtactgggattacaggcgt

SEQ ID NO: 73748 - DNA, 20 bp, Artificial Sequence
  chemically synthesized
caggcgtgagccaccacacc

SEQ ID NO: 73749 - DNA, 20 bp, Artificial Sequence
  chemically synthesized
gcaataatggctgggtgtgg

SEQ ID NO: 73750 - DNA, 20 bp, Artificial Sequence
  chemically synthesized
aaagcaataatggctgggtg

SEQ ID NO: 73751 - DNA, 20 bp, Artificial Sequence
  chemically synthesized
ttaacaaagcaataatggct

SEQ ID NO: 73752 - DNA, 20 bp, Artificial Sequence
  chemically synthesized
cttaacaaagcaataatggc

SEQ ID NO: 73753 - DNA, 20 bp, Artificial Sequence
  chemically synthesized
tggacttaacaaagcaataa

SEQ ID NO: 73754 - DNA, 20 bp, Artificial Sequence
  chemically synthesized
ccagccattattgctttgtt

SEQ ID NO: 73755 - DNA, 20 bp, Artificial Sequence
  chemically synthesized
tattacgtttggacttaaca

SEQ ID NO: 73756 - DNA, 20 bp, Artificial Sequence
  chemically synthesized
tttgttaagtccaaacgtaa

SEQ ID NO: 73757 - DNA, 20 bp, Artificial Sequence
  chemically synthesized
tctcaaaatcctattacgtt

SEQ ID NO: 73758 - DNA, 20 bp, Artificial Sequence
  chemically synthesized
ttgttaagtccaaacgtaat

SEQ ID NO: 73759 - DNA, 20 bp, Artificial Sequence
  chemically synthesized
tccaaacgtaataggatttt

SEQ ID NO: 73760 - DNA, 20 bp, Artificial Sequence
  chemically synthesized
aaacgtaataggattttgag

SEQ ID NO: 73761 - DNA, 20 bp, Artificial Sequence
  chemically synthesized
acgtaataggattttgagaa

SEQ ID NO: 73762 - DNA, 20 bp, Artificial Sequence
  chemically synthesized
cgtaataggattttgagaag

SEQ ID NO: 73763 - DNA, 20 bp, Artificial Sequence
  chemically synthesized
taataggattttgagaagag

SEQ ID NO: 73764 - DNA, 20 bp, Artificial Sequence
  chemically synthesized
ttttgagaagaggagacaaa

SEQ ID NO: 73765 - DNA, 20 bp, Artificial Sequence
  chemically synthesized
ttgagaagaggagacaaaaa

SEQ ID NO: 73766 - DNA, 20 bp, Artificial Sequence
  chemically synthesized
aagaggagacaaaaagagca

SEQ ID NO: 73767 - DNA, 20 bp, Artificial Sequence
  chemically synthesized
agaggagacaaaaagagcat

SEQ ID NO: 73768 - DNA, 20 bp, Artificial Sequence
  chemically synthesized
agacaaaaagagcatgggaa

SEQ ID NO: 73769 - DNA, 20 bp, Artificial Sequence
  chemically synthesized
caaaaagagcatgggaatag

SEQ ID NO: 73770 - DNA, 20 bp, Artificial Sequence
  chemically synthesized
gcagttcgaaaaacctgact

SEQ ID NO: 73771 - DNA, 20 bp, Artificial Sequence
  chemically synthesized
tatcagtcaagatctgagtc

SEQ ID NO: 73772 - DNA, 20 bp, Artificial Sequence
  chemically synthesized
gtatcagtcaagatctgagt

SEQ ID NO: 73773 - DNA, 20 bp, Artificial Sequence
  chemically synthesized
acttgtatcagtcaagatct

SEQ ID NO: 73774 - DNA, 20 bp, Artificial Sequence
  chemically synthesized
tcacataacttgtatcagtc

SEQ ID NO: 73775 - DNA, 20 bp, Artificial Sequence
  chemically synthesized
actcagatcttgactgatac

SEQ ID NO: 73776 - DNA, 20 bp, Artificial Sequence
  chemically synthesized
cacagtcacataacttgtat

SEQ ID NO: 73777 - DNA, 20 bp, Artificial Sequence
  chemically synthesized
aagttatgtgactgtgactg

SEQ ID NO: 73778 - DNA, 20 bp, Artificial Sequence
  chemically synthesized
aacatgaagtaccacagtca

SEQ ID NO: 73779 - DNA, 20 bp, Artificial Sequence
  chemically synthesized
cttagaaacatgaagtacca

SEQ ID NO: 73780 - DNA, 20 bp, Artificial Sequence
  chemically synthesized
aaccgaggcttagaaacatg

SEQ ID NO: 73781 - DNA, 20 bp, Artificial Sequence
  chemically synthesized
ctgtggtacttcatgtttct

SEQ ID NO: 73782 - DNA, 20 bp, Artificial Sequence
  chemically synthesized
tacttcatgtttctaagcct

SEQ ID NO: 73783 - DNA, 20 bp, Artificial Sequence
  chemically synthesized
cgtgtaaggaaaccgaggct

SEQ ID NO: 73784 - DNA, 20 bp, Artificial Sequence
  chemically synthesized
ttttacgtgtaaggaaaccg

SEQ ID NO: 73785 - DNA, 20 bp, Artificial Sequence
  chemically synthesized
cttttacgtgtaaggaaacc

SEQ ID NO: 73786 - DNA, 20 bp, Artificial Sequence
  chemically synthesized
attattcccttttacgtgta

SEQ ID NO: 73787 - DNA, 20 bp, Artificial Sequence
  chemically synthesized
cattattcccttttacgtgt

SEQ ID NO: 73788 - DNA, 20 bp, Artificial Sequence
  chemically synthesized
ctcggtttccttacacgtaa

SEQ ID NO: 73789 - DNA, 20 bp, Artificial Sequence
  chemically synthesized
tcggtttccttacacgtaaa

SEQ ID NO: 73790 - DNA, 20 bp, Artificial Sequence
  chemically synthesized
cggtttccttacacgtaaaa

SEQ ID NO: 73791 - DNA, 20 bp, Artificial Sequence
  chemically synthesized
gtaaaagggaataatgataa

SEQ ID NO: 73792 - DNA, 20 bp, Artificial Sequence
  chemically synthesized
taaaagggaataatgataat

SEQ ID NO: 73793 - DNA, 20 bp, Artificial Sequence
  chemically synthesized
taatcataatacaaaatcac

SEQ ID NO: 73794 - DNA, 20 bp, Artificial Sequence
  chemically synthesized
aatcataatacaaaatcaca

SEQ ID NO: 73795 - DNA, 20 bp, Artificial Sequence
  chemically synthesized
aatcacaaggttgtgattct

SEQ ID NO: 73796 - DNA, 20 bp, Artificial Sequence
  chemically synthesized
caaggttgtgattcttagat

SEQ ID NO: 73797 - DNA, 20 bp, Artificial Sequence
  chemically synthesized
aggttgtgattcttagatga

SEQ ID NO: 73798 - DNA, 20 bp, Artificial Sequence
  chemically synthesized
tcatgtgcattctctcatct

SEQ ID NO: 73799 - DNA, 20 bp, Artificial Sequence
  chemically synthesized
ttagatgagagaatgcacat

SEQ ID NO: 73800 - DNA, 20 bp, Artificial Sequence
  chemically synthesized
tagatgagagaatgcacatg

SEQ ID NO: 73801 - DNA, 20 bp, Artificial Sequence
  chemically synthesized
tcactccttgcagttagaaa

SEQ ID NO: 73802 - DNA, 20 bp, Artificial Sequence
  chemically synthesized
tgaggactttttctaactgc

SEQ ID NO: 73803 - DNA, 20 bp, Artificial Sequence
  chemically synthesized
gaggactttttctaactgca

SEQ ID NO: 73804 - DNA, 20 bp, Artificial Sequence
  chemically synthesized
aaaccatcactccttgcagt

SEQ ID NO: 73805 - DNA, 20 bp, Artificial Sequence
  chemically synthesized
ggactttttctaactgcaag

SEQ ID NO: 73806 - DNA, 20 bp, Artificial Sequence
  chemically synthesized
taggaaaccatcactccttg

SEQ ID NO: 73807 - DNA, 20 bp, Artificial Sequence
  chemically synthesized
tttctaactgcaaggagtga

SEQ ID NO: 73808 - DNA, 20 bp, Artificial Sequence
  chemically synthesized
catttgactttttgtggtgt

SEQ ID NO: 73809 - DNA, 20 bp, Artificial Sequence
  chemically synthesized
ccatttgactttttgtggtg

SEQ ID NO: 73810 - DNA, 20 bp, Artificial Sequence
  chemically synthesized
atggtttcctacaccacaaa

SEQ ID NO: 73811 - DNA, 20 bp, Artificial Sequence
  chemically synthesized
tttgaccatttgactttttg

SEQ ID NO: 73812 - DNA, 20 bp, Artificial Sequence
  chemically synthesized
ctacaccacaaaaagtcaaa

SEQ ID NO: 73813 - DNA, 20 bp, Artificial Sequence
  chemically synthesized
caaaaagtcaaatggtcaaa

SEQ ID NO: 73814 - DNA, 20 bp, Artificial Sequence
  chemically synthesized
cttcctcaaagtagacacat

SEQ ID NO: 73815 - DNA, 20 bp, Artificial Sequence
  chemically synthesized
cataccaatgtgtctacttt

SEQ ID NO: 73816 - DNA, 20 bp, Artificial Sequence
  chemically synthesized
ataccaatgtgtctactttg

SEQ ID NO: 73817 - DNA, 20 bp, Artificial Sequence
  chemically synthesized
tcctattttcttcctcaaag

SEQ ID NO: 73818 - DNA, 20 bp, Artificial Sequence
  chemically synthesized
ccaatgtgtctactttgagg

SEQ ID NO: 73819 - DNA, 20 bp, Artificial Sequence
  chemically synthesized
aagtcctattttcttcctca

SEQ ID NO: 73820 - DNA, 20 bp, Artificial Sequence
  chemically synthesized
gtctactttgaggaagaaaa

SEQ ID NO: 73821 - DNA, 20 bp, Artificial Sequence
  chemically synthesized
tctactttgaggaagaaaat

SEQ ID NO: 73822 - DNA, 20 bp, Artificial Sequence
  chemically synthesized
tgaaattttctgtgggaatg

SEQ ID NO: 73823 - DNA, 20 bp, Artificial Sequence
  chemically synthesized
aaaataggacttcattccca

SEQ ID NO: 73824 - DNA, 20 bp, Artificial Sequence
  chemically synthesized
gcctgtttgaaattttctgt

SEQ ID NO: 73825 - DNA, 20 bp, Artificial Sequence
  chemically synthesized
tgcctgtttgaaattttctg

SEQ ID NO: 73826 - DNA, 20 bp, Artificial Sequence
  chemically synthesized
ttcccacagaaaatttcaaa

SEQ ID NO: 73827 - DNA, 20 bp, Artificial Sequence
  chemically synthesized
tcccacagaaaatttcaaac

SEQ ID NO: 73828 - DNA, 20 bp, Artificial Sequence
  chemically synthesized
aatagaaatgtaagagacat

SEQ ID NO: 73829 - DNA, 20 bp, Artificial Sequence
  chemically synthesized
atcttctaatagaaatgtaa

SEQ ID NO: 73830 - DNA, 20 bp, Artificial Sequence
  chemically synthesized
gaatcttctaatagaaatgt

SEQ ID NO: 73831 - DNA, 20 bp, Artificial Sequence
  chemically synthesized
aatgtctcttacatttctat

SEQ ID NO: 73832 - DNA, 20 bp, Artificial Sequence
  chemically synthesized
gtctcttacatttctattag

SEQ ID NO: 73833 - DNA, 20 bp, Artificial Sequence
  chemically synthesized
actgactttgaatcttctaa

SEQ ID NO: 73834 - DNA, 20 bp, Artificial Sequence
  chemically synthesized
catttctattagaagattca

SEQ ID NO: 73835 - DNA, 20 bp, Artificial Sequence
  chemically synthesized
tctattagaagattcaaagt

SEQ ID NO: 73836 - DNA, 20 bp, Artificial Sequence
  chemically synthesized
tagaagattcaaagtcagtt

SEQ ID NO: 73837 - DNA, 20 bp, Artificial Sequence
  chemically synthesized
gtatagaatcataatgtata

SEQ ID NO: 73838 - DNA, 20 bp, Artificial Sequence
  chemically synthesized
atgtatagaatcataatgta

SEQ ID NO: 73839 - DNA, 20 bp, Artificial Sequence
  chemically synthesized
atacattatgattctataca

SEQ ID NO: 73840 - DNA, 20 bp, Artificial Sequence
  chemically synthesized
tacattatgattctatacat

SEQ ID NO: 73841 - DNA, 20 bp, Artificial Sequence
  chemically synthesized
agtcacaatttacctatgta

SEQ ID NO: 73842 - DNA, 20 bp, Artificial Sequence
  chemically synthesized
atacataggtaaattgtgac

SEQ ID NO: 73843 - DNA, 20 bp, Artificial Sequence
  chemically synthesized
tacataggtaaattgtgact

SEQ ID NO: 73844 - DNA, 20 bp, Artificial Sequence
  chemically synthesized
accaacaatacagtcaaacc

SEQ ID NO: 73845 - DNA, 20 bp, Artificial Sequence
  chemically synthesized
actgggtttgactgtattgt

SEQ ID NO: 73846 - DNA, 20 bp, Artificial Sequence
  chemically synthesized
ggatgtgagcaccaacaata

SEQ ID NO: 73847 - DNA, 20 bp, Artificial Sequence
  chemically synthesized
tgaaaccagttaagggatgt

SEQ ID NO: 73848 - DNA, 20 bp, Artificial Sequence
  chemically synthesized
tggtgctcacatcccttaac

SEQ ID NO: 73849 - DNA, 20 bp, Artificial Sequence
  chemically synthesized
aaaatggtgaaaccagttaa

SEQ ID NO: 73850 - DNA, 20 bp, Artificial Sequence
  chemically synthesized
caaaatggtgaaaccagtta

SEQ ID NO: 73851 - DNA, 20 bp, Artificial Sequence
  chemically synthesized
tcaaaatggtgaaaccagtt

SEQ ID NO: 73852 - DNA, 20 bp, Artificial Sequence
  chemically synthesized
atcagtcaaaatggtgaaac

SEQ ID NO: 73853 - DNA, 20 bp, Artificial Sequence
  chemically synthesized
gtctgtaatatcagtcaaaa

SEQ ID NO: 73854 - DNA, 20 bp, Artificial Sequence
  chemically synthesized
caccattttgactgatatta

SEQ ID NO: 73855 - DNA, 20 bp, Artificial Sequence
  chemically synthesized
tttttagctgtctgtaatat

SEQ ID NO: 73856 - DNA, 20 bp, Artificial Sequence
  chemically synthesized
attttgactgatattacaga

SEQ ID NO: 73857 - DNA, 20 bp, Artificial Sequence
  chemically synthesized
attacagacagctaaaaaac

SEQ ID NO: 73858 - DNA, 20 bp, Artificial Sequence
  chemically synthesized
ggaaagccatgctagttttt

SEQ ID NO: 73859 - DNA, 20 bp, Artificial Sequence
  chemically synthesized
agacagctaaaaaactagca

SEQ ID NO: 73860 - DNA, 20 bp, Artificial Sequence
  chemically synthesized
attttcaaggaaagccatgc

SEQ ID NO: 73861 - DNA, 20 bp, Artificial Sequence
  chemically synthesized
attcatttaattttcaagga

SEQ ID NO: 73862 - DNA, 20 bp, Artificial Sequence
  chemically synthesized
atccattcatttaattttca

SEQ ID NO: 73863 - DNA, 20 bp, Artificial Sequence
  chemically synthesized
tatccattcatttaattttc

SEQ ID NO: 73864 - DNA, 20 bp, Artificial Sequence
  chemically synthesized
ttccttgaaaattaaatgaa

SEQ ID NO: 73865 - DNA, 20 bp, Artificial Sequence
  chemically synthesized
ttaaatgaatggataatgca

SEQ ID NO: 73866 - DNA, 20 bp, Artificial Sequence
  chemically synthesized
aatggataatgcaaagaacc

SEQ ID NO: 73867 - DNA, 20 bp, Artificial Sequence
  chemically synthesized
atggataatgcaaagaaccc

SEQ ID NO: 73868 - DNA, 20 bp, Artificial Sequence
  chemically synthesized
acttgatatcagaatatcct

SEQ ID NO: 73869 - DNA, 20 bp, Artificial Sequence
  chemically synthesized
tacttgatatcagaatatcc

SEQ ID NO: 73870 - DNA, 20 bp, Artificial Sequence
  chemically synthesized
acccaggatattctgatatc

SEQ ID NO: 73871 - DNA, 20 bp, Artificial Sequence
  chemically synthesized
aggccgtgtctacttgatat

SEQ ID NO: 73872 - DNA, 20 bp, Artificial Sequence
  chemically synthesized
caggatattctgatatcaag

SEQ ID NO: 73873 - DNA, 20 bp, Artificial Sequence
  chemically synthesized
attctgatatcaagtagaca

SEQ ID NO: 73874 - DNA, 20 bp, Artificial Sequence
  chemically synthesized
atcaagtagacacggcctga

SEQ ID NO: 73875 - DNA, 20 bp, Artificial Sequence
  chemically synthesized
gattagagttacatactatc

SEQ ID NO: 73876 - DNA, 20 bp, Artificial Sequence
  chemically synthesized
agattagagttacatactat

SEQ ID NO: 73877 - DNA, 20 bp, Artificial Sequence
  chemically synthesized
atagtataatagaaagatta

SEQ ID NO: 73878 - DNA, 20 bp, Artificial Sequence
  chemically synthesized
aaatagtataatagaaagat

SEQ ID NO: 73879 - DNA, 20 bp, Artificial Sequence
  chemically synthesized
gggcaaaatagtataataga

SEQ ID NO: 73880 - DNA, 20 bp, Artificial Sequence
  chemically synthesized
atttgggcaaaatagtataa

SEQ ID NO: 73881 - DNA, 20 bp, Artificial Sequence
  chemically synthesized
agtcttaaatttgggcaaaa

SEQ ID NO: 73882 - DNA, 20 bp, Artificial Sequence
  chemically synthesized
atactattttgcccaaattt

SEQ ID NO: 73883 - DNA, 20 bp, Artificial Sequence
  chemically synthesized
agaagaagagtcttaaattt

SEQ ID NO: 73884 - DNA, 20 bp, Artificial Sequence
  chemically synthesized
aagaagaagagtcttaaatt

SEQ ID NO: 73885 - DNA, 20 bp, Artificial Sequence
  chemically synthesized
taaacctgagaaaagaagaa

SEQ ID NO: 73886 - DNA, 20 bp, Artificial Sequence
  chemically synthesized
tgtaaacctgagaaaagaag

SEQ ID NO: 73887 - DNA, 20 bp, Artificial Sequence
  chemically synthesized
taagactcttcttcttttct

SEQ ID NO: 73888 - DNA, 20 bp, Artificial Sequence
  chemically synthesized
agatgtaaacctgagaaaag

SEQ ID NO: 73889 - DNA, 20 bp, Artificial Sequence
  chemically synthesized
aagactcttcttcttttctc

SEQ ID NO: 73890 - DNA, 20 bp, Artificial Sequence
  chemically synthesized
ggcagatgtaaacctgagaa

SEQ ID NO: 73891 - DNA, 20 bp, Artificial Sequence
  chemically synthesized
agaaaggcagatgtaaacct

SEQ ID NO: 73892 - DNA, 20 bp, Artificial Sequence
  chemically synthesized
gaactggagtagtagaaagg

SEQ ID NO: 73893 - DNA, 20 bp, Artificial Sequence
  chemically synthesized
agagaactggagtagtagaa

SEQ ID NO: 73894 - DNA, 20 bp, Artificial Sequence
  chemically synthesized
tagagaactggagtagtaga

SEQ ID NO: 73895 - DNA, 20 bp, Artificial Sequence
  chemically synthesized
catctgcctttctactactc

SEQ ID NO: 73896 - DNA, 20 bp, Artificial Sequence
  chemically synthesized
aaaatagagaactggagtag

SEQ ID NO: 73897 - DNA, 20 bp, Artificial Sequence
  chemically synthesized
ataaaaatagagaactggag

SEQ ID NO: 73898 - DNA, 20 bp, Artificial Sequence
  chemically synthesized
aaaataaaaatagagaactg

SEQ ID NO: 73899 - DNA, 20 bp, Artificial Sequence
  chemically synthesized
ataaaataaaaatagagaac

SEQ ID NO: 73900 - DNA, 20 bp, Artificial Sequence
  chemically synthesized
aataaaataaaataaaaata

SEQ ID NO: 73901 - DNA, 20 bp, Artificial Sequence
  chemically synthesized
aaaataaaataaaataaaaa

SEQ ID NO: 73902 - DNA, 20 bp, Artificial Sequence
  chemically synthesized
ttttattttattttattttt

SEQ ID NO: 73903 - DNA, 20 bp, Artificial Sequence
  chemically synthesized
tttattttatttttgagacc

SEQ ID NO: 73904 - DNA, 20 bp, Artificial Sequence
  chemically synthesized
tttatttttgagaccgagtc

SEQ ID NO: 73905 - DNA, 20 bp, Artificial Sequence
  chemically synthesized
ctgggcgacagagccagact

SEQ ID NO: 73906 - DNA, 20 bp, Artificial Sequence
  chemically synthesized
tccagcctgggcgacagagc

SEQ ID NO: 73907 - DNA, 20 bp, Artificial Sequence
  chemically synthesized
ccgagtctggctctgtcgcc

SEQ ID NO: 73908 - DNA, 20 bp, Artificial Sequence
  chemically synthesized
gcactccagcctgggcgaca

SEQ ID NO: 73909 - DNA, 20 bp, Artificial Sequence
  chemically synthesized
cgagtctggctctgtcgccc

SEQ ID NO: 73910 - DNA, 20 bp, Artificial Sequence
  chemically synthesized
ctgcactccagcctgggcga

SEQ ID NO: 73911 - DNA, 20 bp, Artificial Sequence
  chemically synthesized
tctggctctgtcgcccaggc

SEQ ID NO: 73912 - DNA, 20 bp, Artificial Sequence
  chemically synthesized
tggctctgtcgcccaggctg

SEQ ID NO: 73913 - DNA, 20 bp, Artificial Sequence
  chemically synthesized
gtgccactgcactccagcct

SEQ ID NO: 73914 - DNA, 20 bp, Artificial Sequence
  chemically synthesized
cgtgccactgcactccagcc

SEQ ID NO: 73915 - DNA, 20 bp, Artificial Sequence
  chemically synthesized
ctgtcgcccaggctggagtg

SEQ ID NO: 73916 - DNA, 20 bp, Artificial Sequence
  chemically synthesized
gagatcgtgccactgcactc

SEQ ID NO: 73917 - DNA, 20 bp, Artificial Sequence
  chemically synthesized
tcgcccaggctggagtgcag

SEQ ID NO: 73918 - DNA, 20 bp, Artificial Sequence
  chemically synthesized
ggagtgcagtggcacgatct

SEQ ID NO: 73919 - DNA, 20 bp, Artificial Sequence
  chemically synthesized
ggcagaggttgcagtgagct

SEQ ID NO: 73920 - DNA, 20 bp, Artificial Sequence
  chemically synthesized
caggaggcagaggttgcagt

SEQ ID NO: 73921 - DNA, 20 bp, Artificial Sequence
  chemically synthesized
aaaccaggaggcagaggttg

SEQ ID NO: 73922 - DNA, 20 bp, Artificial Sequence
  chemically synthesized
tgcttgaaaccaggaggcag

SEQ ID NO: 73923 - DNA, 20 bp, Artificial Sequence
  chemically synthesized
tcactgcaacctctgcctcc

SEQ ID NO: 73924 - DNA, 20 bp, Artificial Sequence
  chemically synthesized
ttgcttgaaaccaggaggca

SEQ ID NO: 73925 - DNA, 20 bp, Artificial Sequence
  chemically synthesized
aattgcttgaaaccaggagg

SEQ ID NO: 73926 - DNA, 20 bp, Artificial Sequence
  chemically synthesized
gagaattgcttgaaaccagg

SEQ ID NO: 73927 - DNA, 20 bp, Artificial Sequence
  chemically synthesized
ggagaattgcttgaaaccag

SEQ ID NO: 73928 - DNA, 20 bp, Artificial Sequence
  chemically synthesized
aacctctgcctcctggtttc

SEQ ID NO: 73929 - DNA, 20 bp, Artificial Sequence
  chemically synthesized
caggagaattgcttgaaacc

SEQ ID NO: 73930 - DNA, 20 bp, Artificial Sequence
  chemically synthesized
gcaggagaattgcttgaaac

SEQ ID NO: 73931 - DNA, 20 bp, Artificial Sequence
  chemically synthesized
ttcaagcaattctcctgcct

SEQ ID NO: 73932 - DNA, 20 bp, Artificial Sequence
  chemically synthesized
tactctggaggctgaggcag

SEQ ID NO: 73933 - DNA, 20 bp, Artificial Sequence
  chemically synthesized
gctactctggaggctgaggc

SEQ ID NO: 73934 - DNA, 20 bp, Artificial Sequence
  chemically synthesized
agctactctggaggctgagg

SEQ ID NO: 73935 - DNA, 20 bp, Artificial Sequence
  chemically synthesized
aattctcctgcctcagcctc

SEQ ID NO: 73936 - DNA, 20 bp, Artificial Sequence
  chemically synthesized
cctagctactctggaggctg

SEQ ID NO: 73937 - DNA, 20 bp, Artificial Sequence
  chemically synthesized
tcctagctactctggaggct

SEQ ID NO: 73938 - DNA, 20 bp, Artificial Sequence
  chemically synthesized
ttctcctgcctcagcctcca

SEQ ID NO: 73939 - DNA, 20 bp, Artificial Sequence
  chemically synthesized
tcctgcctcagcctccagag

SEQ ID NO: 73940 - DNA, 20 bp, Artificial Sequence
  chemically synthesized
tgtaatcctagctactctgg

SEQ ID NO: 73941 - DNA, 20 bp, Artificial Sequence
  chemically synthesized
ctgtaatcctagctactctg

SEQ ID NO: 73942 - DNA, 20 bp, Artificial Sequence
  chemically synthesized
gcctcagcctccagagtagc

SEQ ID NO: 73943 - DNA, 20 bp, Artificial Sequence
  chemically synthesized
gcctgtaatcctagctactc

SEQ ID NO: 73944 - DNA, 20 bp, Artificial Sequence
  chemically synthesized
cctcagcctccagagtagct

SEQ ID NO: 73945 - DNA, 20 bp, Artificial Sequence
  chemically synthesized
ctccagagtagctaggatta

SEQ ID NO: 73946 - DNA, 20 bp, Artificial Sequence
  chemically synthesized
tccagagtagctaggattac

SEQ ID NO: 73947 - DNA, 20 bp, Artificial Sequence
  chemically synthesized
gtggtgcgtgcctgtaatcc

SEQ ID NO: 73948 - DNA, 20 bp, Artificial Sequence
  chemically synthesized
caggcacgcaccaccacacc

SEQ ID NO: 73949 - DNA, 20 bp, Artificial Sequence
  chemically synthesized
caaaacttacctgggtgtgg

SEQ ID NO: 73950 - DNA, 20 bp, Artificial Sequence
  chemically synthesized
aggcacgcaccaccacaccc

SEQ ID NO: 73951 - DNA, 20 bp, Artificial Sequence
  chemically synthesized
atacaaaacttacctgggtg

SEQ ID NO: 73952 - DNA, 20 bp, Artificial Sequence
  chemically synthesized
acgcaccaccacacccaggt

SEQ ID NO: 73953 - DNA, 20 bp, Artificial Sequence
  chemically synthesized
taaaaatacaaaacttacct

SEQ ID NO: 73954 - DNA, 20 bp, Artificial Sequence
  chemically synthesized
ctaaaaatacaaaacttacc

SEQ ID NO: 73955 - DNA, 20 bp, Artificial Sequence
  chemically synthesized
ccaggtaagttttgtatttt

SEQ ID NO: 73956 - DNA, 20 bp, Artificial Sequence
  chemically synthesized
ggtaagttttgtatttttag

SEQ ID NO: 73957 - DNA, 20 bp, Artificial Sequence
  chemically synthesized
taagttttgtatttttagta

SEQ ID NO: 73958 - DNA, 20 bp, Artificial Sequence
  chemically synthesized
tttgtatttttagtagagat

SEQ ID NO: 73959 - DNA, 20 bp, Artificial Sequence
  chemically synthesized
ttgtatttttagtagagatg

SEQ ID NO: 73960 - DNA, 20 bp, Artificial Sequence
  chemically synthesized
gagatgaggtttcaccatgc

SEQ ID NO: 73961 - DNA, 20 bp, Artificial Sequence
  chemically synthesized
tgaggtttcaccatgctggt

SEQ ID NO: 73962 - DNA, 20 bp, Artificial Sequence
  chemically synthesized
tgacaccagcctgaccagca

SEQ ID NO: 73963 - DNA, 20 bp, Artificial Sequence
  chemically synthesized
gaggtttcaccatgctggtc

SEQ ID NO: 73964 - DNA, 20 bp, Artificial Sequence
  chemically synthesized
tttcaccatgctggtcaggc

SEQ ID NO: 73965 - DNA, 20 bp, Artificial Sequence
  chemically synthesized
gagtttgacaccagcctgac

SEQ ID NO: 73966 - DNA, 20 bp, Artificial Sequence
  chemically synthesized
tgaggtcaggagtttgacac

SEQ ID NO: 73967 - DNA, 20 bp, Artificial Sequence
  chemically synthesized
ggcggatcacttgaggtcag

SEQ ID NO: 73968 - DNA, 20 bp, Artificial Sequence
  chemically synthesized
ggtgtcaaactcctgacctc

SEQ ID NO: 73969 - DNA, 20 bp, Artificial Sequence
  chemically synthesized
caggcggatcacttgaggtc

SEQ ID NO: 73970 - DNA, 20 bp, Artificial Sequence
  chemically synthesized
gcaggcggatcacttgaggt

SEQ ID NO: 73971 - DNA, 20 bp, Artificial Sequence
  chemically synthesized
cgaggcaggcggatcacttg

SEQ ID NO: 73972 - DNA, 20 bp, Artificial Sequence
  chemically synthesized
ccgaggcaggcggatcactt

SEQ ID NO: 73973 - DNA, 20 bp, Artificial Sequence
  chemically synthesized
ctcaagtgatccgcctgcct

SEQ ID NO: 73974 - DNA, 20 bp, Artificial Sequence
  chemically synthesized
ctttgggaggccgaggcagg

SEQ ID NO: 73975 - DNA, 20 bp, Artificial Sequence
  chemically synthesized
gcactttgggaggccgaggc

SEQ ID NO: 73976 - DNA, 20 bp, Artificial Sequence
  chemically synthesized
agcactttgggaggccgagg

SEQ ID NO: 73977 - DNA, 20 bp, Artificial Sequence
  chemically synthesized
cccagcactttgggaggccg

SEQ ID NO: 73978 - DNA, 20 bp, Artificial Sequence
  chemically synthesized
tcccagcactttgggaggcc

SEQ ID NO: 73979 - DNA, 20 bp, Artificial Sequence
  chemically synthesized
ccgcctgcctcggcctccca

SEQ ID NO: 73980 - DNA, 20 bp, Artificial Sequence
  chemically synthesized
tgtaatcccagcactttggg

SEQ ID NO: 73981 - DNA, 20 bp, Artificial Sequence
  chemically synthesized
ctgtaatcccagcactttgg

SEQ ID NO: 73982 - DNA, 20 bp, Artificial Sequence
  chemically synthesized
gcctcggcctcccaaagtgc

SEQ ID NO: 73983 - DNA, 20 bp, Artificial Sequence
  chemically synthesized
gcctgtaatcccagcacttt

SEQ ID NO: 73984 - DNA, 20 bp, Artificial Sequence
  chemically synthesized
cctcggcctcccaaagtgct

SEQ ID NO: 73985 - DNA, 20 bp, Artificial Sequence
  chemically synthesized
cgcctgtaatcccagcactt

SEQ ID NO: 73986 - DNA, 20 bp, Artificial Sequence
  chemically synthesized
ctcccaaagtgctgggatta

SEQ ID NO: 73987 - DNA, 20 bp, Artificial Sequence
  chemically synthesized
tcccaaagtgctgggattac

SEQ ID NO: 73988 - DNA, 20 bp, Artificial Sequence
  chemically synthesized
gtggctcacgcctgtaatcc

SEQ ID NO: 73989 - DNA, 20 bp, Artificial Sequence
  chemically synthesized
agtgctgggattacaggcgt

SEQ ID NO: 73990 - DNA, 20 bp, Artificial Sequence
  chemically synthesized
caggcgtgagccaccatgcc

SEQ ID NO: 73991 - DNA, 20 bp, Artificial Sequence
  chemically synthesized
aaagaactctctgggcatgg

SEQ ID NO: 73992 - DNA, 20 bp, Artificial Sequence
  chemically synthesized
ggcgtgagccaccatgccca

SEQ ID NO: 73993 - DNA, 20 bp, Artificial Sequence
  chemically synthesized
agtaaagaactctctgggca

SEQ ID NO: 73994 - DNA, 20 bp, Artificial Sequence
  chemically synthesized
cgtgagccaccatgcccaga

SEQ ID NO: 73995 - DNA, 20 bp, Artificial Sequence
  chemically synthesized
caaaaagtaaagaactctct

SEQ ID NO: 73996 - DNA, 20 bp, Artificial Sequence
  chemically synthesized
tcaaaaagtaaagaactctc

SEQ ID NO: 73997 - DNA, 20 bp, Artificial Sequence
  chemically synthesized
caaagaacaatcaaaaagta

SEQ ID NO: 73998 - DNA, 20 bp, Artificial Sequence
  chemically synthesized
taagacaaagaacaatcaaa

SEQ ID NO: 73999 - DNA, 20 bp, Artificial Sequence
  chemically synthesized
tttttgattgttctttgtct

SEQ ID NO: 74000 - DNA, 20 bp, Artificial Sequence
  chemically synthesized
tgcctctgtccactaagaca

SEQ ID NO: 74001 - DNA, 20 bp, Artificial Sequence
  chemically synthesized
ttgattgttctttgtcttag

SEQ ID NO: 74002 - DNA, 20 bp, Artificial Sequence
  chemically synthesized
ttgttctttgtcttagtgga

SEQ ID NO: 74003 - DNA, 20 bp, Artificial Sequence
  chemically synthesized
catctttgcctctgtccact

SEQ ID NO: 74004 - DNA, 20 bp, Artificial Sequence
  chemically synthesized
gttctttgtcttagtggaca

SEQ ID NO: 74005 - DNA, 20 bp, Artificial Sequence
  chemically synthesized
ttctttgtcttagtggacag

SEQ ID NO: 74006 - DNA, 20 bp, Artificial Sequence
  chemically synthesized
tgtcttagtggacagaggca

SEQ ID NO: 74007 - DNA, 20 bp, Artificial Sequence
  chemically synthesized
ggcaaagatgaacttgtact

SEQ ID NO: 74008 - DNA, 20 bp, Artificial Sequence
  chemically synthesized
tcgtgataaaaaccaagtac

SEQ ID NO: 74009 - DNA, 20 bp, Artificial Sequence
  chemically synthesized
tttaaatcgtgataaaaacc

SEQ ID NO: 74010 - DNA, 20 bp, Artificial Sequence
  chemically synthesized
ttggtttttatcacgattta

SEQ ID NO: 74011 - DNA, 20 bp, Artificial Sequence
  chemically synthesized
tcacgatttaaagattgaca

SEQ ID NO: 74012 - DNA, 20 bp, Artificial Sequence
  chemically synthesized
ttctatgaaaataaagaatt

SEQ ID NO: 74013 - DNA, 20 bp, Artificial Sequence
  chemically synthesized
gacatatttctatgaaaata

SEQ ID NO: 74014 - DNA, 20 bp, Artificial Sequence
  chemically synthesized
gactaaattctttattttca

SEQ ID NO: 74015 - DNA, 20 bp, Artificial Sequence
  chemically synthesized
ttaaatagtaaatgtcaaaa

SEQ ID NO: 74016 - DNA, 20 bp, Artificial Sequence
  chemically synthesized
tgacatcatatttttttaaa

SEQ ID NO: 74017 - DNA, 20 bp, Artificial Sequence
  chemically synthesized
aaaaaaatatgatgtcataa

SEQ ID NO: 74018 - DNA, 20 bp, Artificial Sequence
  chemically synthesized
aaaatatgatgtcataatgg

SEQ ID NO: 74019 - DNA, 20 bp, Artificial Sequence
  chemically synthesized
atatgatgtcataatggtgg

SEQ ID NO: 74020 - DNA, 20 bp, Artificial Sequence
  chemically synthesized
tatgatgtcataatggtggt

SEQ ID NO: 74021 - DNA, 20 bp, Artificial Sequence
  chemically synthesized
gtcataatggtggtgggctc

SEQ ID NO: 74022 - DNA, 20 bp, Artificial Sequence
  chemically synthesized
agttctatggcgggaagctt

SEQ ID NO: 74023 - DNA, 20 bp, Artificial Sequence
  chemically synthesized
tgggctcaagcttcccgcca

SEQ ID NO: 74024 - DNA, 20 bp, Artificial Sequence
  chemically synthesized
tatccaagttctatggcggg

SEQ ID NO: 74025 - DNA, 20 bp, Artificial Sequence
  chemically synthesized
cattatccaagttctatggc

SEQ ID NO: 74026 - DNA, 20 bp, Artificial Sequence
  chemically synthesized
gcattatccaagttctatgg

SEQ ID NO: 74027 - DNA, 20 bp, Artificial Sequence
  chemically synthesized
aagcttcccgccatagaact

SEQ ID NO: 74028 - DNA, 20 bp, Artificial Sequence
  chemically synthesized
aacgcattatccaagttcta

SEQ ID NO: 74029 - DNA, 20 bp, Artificial Sequence
  chemically synthesized
gtgaggctaacgcattatcc

SEQ ID NO: 74030 - DNA, 20 bp, Artificial Sequence
  chemically synthesized
atagaacttggataatgcgt

SEQ ID NO: 74031 - DNA, 20 bp, Artificial Sequence
  chemically synthesized
tatttagaacaatgtatgtg

SEQ ID NO: 74032 - DNA, 20 bp, Artificial Sequence
  chemically synthesized
atatttagaacaatgtatgt

SEQ ID NO: 74033 - DNA, 20 bp, Artificial Sequence
  chemically synthesized
tgttgagaatattttatatt

SEQ ID NO: 74034 - DNA, 20 bp, Artificial Sequence
  chemically synthesized
taaatataaaatattctcaa

SEQ ID NO: 74035 - DNA, 20 bp, Artificial Sequence
  chemically synthesized
aaatataaaatattctcaac

SEQ ID NO: 74036 - DNA, 20 bp, Artificial Sequence
  chemically synthesized
agcaattcatacatcctgtt

SEQ ID NO: 74037 - DNA, 20 bp, Artificial Sequence
  chemically synthesized
ggatgtatgaattgcttttc

SEQ ID NO: 74038 - DNA, 20 bp, Artificial Sequence
  chemically synthesized
tttttttcccattactggaa

SEQ ID NO: 74039 - DNA, 20 bp, Artificial Sequence
  chemically synthesized
atgaattgcttttccagtaa

SEQ ID NO: 74040 - DNA, 20 bp, Artificial Sequence
  chemically synthesized
tgaattgcttttccagtaat

SEQ ID NO: 74041 - DNA, 20 bp, Artificial Sequence
  chemically synthesized
agcaatttttttcccattac

SEQ ID NO: 74042 - DNA, 20 bp, Artificial Sequence
  chemically synthesized
caagaaatgaggttcacatc

SEQ ID NO: 74043 - DNA, 20 bp, Artificial Sequence
  chemically synthesized
agagaagaaagcaagaaatg

SEQ ID NO: 74044 - DNA, 20 bp, Artificial Sequence
  chemically synthesized
aagagaagaaagcaagaaat

SEQ ID NO: 74045 - DNA, 20 bp, Artificial Sequence
  chemically synthesized
gttcagaaagagaagaaagc

SEQ ID NO: 74046 - DNA, 20 bp, Artificial Sequence
  chemically synthesized
ccttgttcagaaagagaaga

SEQ ID NO: 74047 - DNA, 20 bp, Artificial Sequence
  chemically synthesized
gaggccttgttcagaaagag

SEQ ID NO: 74048 - DNA, 20 bp, Artificial Sequence
  chemically synthesized
tgtgaggccttgttcagaaa

SEQ ID NO: 74049 - DNA, 20 bp, Artificial Sequence
  chemically synthesized
gctttcttctctttctgaac

SEQ ID NO: 74050 - DNA, 20 bp, Artificial Sequence
  chemically synthesized
aatgtgaggccttgttcaga

SEQ ID NO: 74051 - DNA, 20 bp, Artificial Sequence
  chemically synthesized
ctttcttctctttctgaaca

SEQ ID NO: 74052 - DNA, 20 bp, Artificial Sequence
  chemically synthesized
tataaatgtgaggccttgtt

SEQ ID NO: 74053 - DNA, 20 bp, Artificial Sequence
  chemically synthesized
tctgctacattataaatgtg

SEQ ID NO: 74054 - DNA, 20 bp, Artificial Sequence
  chemically synthesized
ttctgctacattataaatgt

SEQ ID NO: 74055 - DNA, 20 bp, Artificial Sequence
  chemically synthesized
aaggcctcacatttataatg

SEQ ID NO: 74056 - DNA, 20 bp, Artificial Sequence
  chemically synthesized
gcctcacatttataatgtag

SEQ ID NO: 74057 - DNA, 20 bp, Artificial Sequence
  chemically synthesized
atgtagcagaattactatca

SEQ ID NO: 74058 - DNA, 20 bp, Artificial Sequence
  chemically synthesized
agttccattcttttctttga

SEQ ID NO: 74059 - DNA, 20 bp, Artificial Sequence
  chemically synthesized
gcagaattactatcaaagaa

SEQ ID NO: 74060 - DNA, 20 bp, Artificial Sequence
  chemically synthesized
attactatcaaagaaaagaa

SEQ ID NO: 74061 - DNA, 20 bp, Artificial Sequence
  chemically synthesized
tgcatataaccgagtcaagt

SEQ ID NO: 74062 - DNA, 20 bp, Artificial Sequence
  chemically synthesized
agaatggaactaacttgact

SEQ ID NO: 74063 - DNA, 20 bp, Artificial Sequence
  chemically synthesized
ggtttgcatataaccgagtc

SEQ ID NO: 74064 - DNA, 20 bp, Artificial Sequence
  chemically synthesized
gttttggtttgcatataacc

SEQ ID NO: 74065 - DNA, 20 bp, Artificial Sequence
  chemically synthesized
ttatatgcaaaccaaaacct

SEQ ID NO: 74066 - DNA, 20 bp, Artificial Sequence
  chemically synthesized
agctgataaatccaaggttt

SEQ ID NO: 74067 - DNA, 20 bp, Artificial Sequence
  chemically synthesized
gcagaaagctgataaatcca

SEQ ID NO: 74068 - DNA, 20 bp, Artificial Sequence
  chemically synthesized
agcagaaagctgataaatcc

SEQ ID NO: 74069 - DNA, 20 bp, Artificial Sequence
  chemically synthesized
aaccaaaaccttggatttat

SEQ ID NO: 74070 - DNA, 20 bp, Artificial Sequence
  chemically synthesized
taaaaagtgtttttagcaga

SEQ ID NO: 74071 - DNA, 20 bp, Artificial Sequence
  chemically synthesized
tgcttaaaaagtgtttttag

SEQ ID NO: 74072 - DNA, 20 bp, Artificial Sequence
  chemically synthesized
atatgcttaaaaagtgtttt

SEQ ID NO: 74073 - DNA, 20 bp, Artificial Sequence
  chemically synthesized
ttctgctaaaaacacttttt

SEQ ID NO: 74074 - DNA, 20 bp, Artificial Sequence
  chemically synthesized
accttaaagatatgcttaaa

SEQ ID NO: 74075 - DNA, 20 bp, Artificial Sequence
  chemically synthesized
cactttttaagcatatcttt

SEQ ID NO: 74076 - DNA, 20 bp, Artificial Sequence
  chemically synthesized
actttttaagcatatcttta

SEQ ID NO: 74077 - DNA, 20 bp, Artificial Sequence
  chemically synthesized
tatttttgaacatgacctta

SEQ ID NO: 74078 - DNA, 20 bp, Artificial Sequence
  chemically synthesized
tttaaggtcatgttcaaaaa

SEQ ID NO: 74079 - DNA, 20 bp, Artificial Sequence
  chemically synthesized
acatgaaatttgctacaata

SEQ ID NO: 74080 - DNA, 20 bp, Artificial Sequence
  chemically synthesized
atgaaatttgctacaatata

SEQ ID NO: 74081 - DNA, 20 bp, Artificial Sequence
  chemically synthesized
gtggtgtctgctctatattg

SEQ ID NO: 74082 - DNA, 20 bp, Artificial Sequence
  chemically synthesized
aaatttgctacaatatagag

SEQ ID NO: 74083 - DNA, 20 bp, Artificial Sequence
  chemically synthesized
ctattaaacagttcagtttg

SEQ ID NO: 74084 - DNA, 20 bp, Artificial Sequence
  chemically synthesized
ccttctcctattaaacagtt

SEQ ID NO: 74085 - DNA, 20 bp, Artificial Sequence
  chemically synthesized
ccacaaactgaactgtttaa

SEQ ID NO: 74086 - DNA, 20 bp, Artificial Sequence
  chemically synthesized
cacaaactgaactgtttaat

SEQ ID NO: 74087 - DNA, 20 bp, Artificial Sequence
  chemically synthesized
cacagccttctcctattaaa

SEQ ID NO: 74088 - DNA, 20 bp, Artificial Sequence
  chemically synthesized
caaactgaactgtttaatag

SEQ ID NO: 74089 - DNA, 20 bp, Artificial Sequence
  chemically synthesized
actgaactgtttaataggag

SEQ ID NO: 74090 - DNA, 20 bp, Artificial Sequence
  chemically synthesized
ctgaactgtttaataggaga

SEQ ID NO: 74091 - DNA, 20 bp, Artificial Sequence
  chemically synthesized
tccctaaacccacatataca

SEQ ID NO: 74092 - DNA, 20 bp, Artificial Sequence
  chemically synthesized
aggagaaggctgtgtatatg

SEQ ID NO: 74093 - DNA, 20 bp, Artificial Sequence
  chemically synthesized
ggagaaggctgtgtatatgt

SEQ ID NO: 74094 - DNA, 20 bp, Artificial Sequence
  chemically synthesized
aggctgtgtatatgtgggtt

SEQ ID NO: 74095 - DNA, 20 bp, Artificial Sequence
  chemically synthesized
ggctgtgtatatgtgggttt

SEQ ID NO: 74096 - DNA, 20 bp, Artificial Sequence
  chemically synthesized
gctgtgtatatgtgggttta

SEQ ID NO: 74097 - DNA, 20 bp, Artificial Sequence
  chemically synthesized
gtgtatatgtgggtttaggg

SEQ ID NO: 74098 - DNA, 20 bp, Artificial Sequence
  chemically synthesized
tatatgtgggtttagggaag

SEQ ID NO: 74099 - DNA, 20 bp, Artificial Sequence
  chemically synthesized
tatgtgggtttagggaagaa

SEQ ID NO: 74100 - DNA, 20 bp, Artificial Sequence
  chemically synthesized
tttagggaagaagagattaa

SEQ ID NO: 74101 - DNA, 20 bp, Artificial Sequence
  chemically synthesized
gggaagaagagattaaaagt

SEQ ID NO: 74102 - DNA, 20 bp, Artificial Sequence
  chemically synthesized
gaagaagagattaaaagtta

SEQ ID NO: 74103 - DNA, 20 bp, Artificial Sequence
  chemically synthesized
attaaaagttagagttatac

SEQ ID NO: 74104 - DNA, 20 bp, Artificial Sequence
  chemically synthesized
ttaaaagttagagttataca

SEQ ID NO: 74105 - DNA, 20 bp, Artificial Sequence
  chemically synthesized
aaaagttagagttatacaag

SEQ ID NO: 74106 - DNA, 20 bp, Artificial Sequence
  chemically synthesized
ctttattcataatacaaatg

SEQ ID NO: 74107 - DNA, 20 bp, Artificial Sequence
  chemically synthesized
ccacatttgtattatgaata

SEQ ID NO: 74108 - DNA, 20 bp, Artificial Sequence
  chemically synthesized
atttgtattatgaataaaga

SEQ ID NO: 74109 - DNA, 20 bp, Artificial Sequence
  chemically synthesized
tttgtattatgaataaagaa

SEQ ID NO: 74110 - DNA, 20 bp, Artificial Sequence
  chemically synthesized
aataaagaaaggaacttcat

SEQ ID NO: 74111 - DNA, 20 bp, Artificial Sequence
  chemically synthesized
aatttagtttaaaaccaatg

SEQ ID NO: 74112 - DNA, 20 bp, Artificial Sequence
  chemically synthesized
gatacacatttgacagaatt

SEQ ID NO: 74113 - DNA, 20 bp, Artificial Sequence
  chemically synthesized
tgggggagatacacatttga

SEQ ID NO: 74114 - DNA, 20 bp, Artificial Sequence
  chemically synthesized
tgtcaaatgtgtatctcccc

SEQ ID NO: 74115 - DNA, 20 bp, Artificial Sequence
  chemically synthesized
ctgtctctagatatctgggg

SEQ ID NO: 74116 - DNA, 20 bp, Artificial Sequence
  chemically synthesized
ttctgtctctagatatctgg

SEQ ID NO: 74117 - DNA, 20 bp, Artificial Sequence
  chemically synthesized
attctgtctctagatatctg

SEQ ID NO: 74118 - DNA, 20 bp, Artificial Sequence
  chemically synthesized
gtgtatctcccccagatatc

SEQ ID NO: 74119 - DNA, 20 bp, Artificial Sequence
  chemically synthesized
gattctgtctctagatatct

SEQ ID NO: 74120 - DNA, 20 bp, Artificial Sequence
  chemically synthesized
tgattctgtctctagatatc

SEQ ID NO: 74121 - DNA, 20 bp, Artificial Sequence
  chemically synthesized
gtatctcccccagatatcta

SEQ ID NO: 74122 - DNA, 20 bp, Artificial Sequence
  chemically synthesized
ctcccccagatatctagaga

SEQ ID NO: 74123 - DNA, 20 bp, Artificial Sequence
  chemically synthesized
caatcttatgattctgtctc

SEQ ID NO: 74124 - DNA, 20 bp, Artificial Sequence
  chemically synthesized
atatctagagacagaatcat

SEQ ID NO: 74125 - DNA, 20 bp, Artificial Sequence
  chemically synthesized
attttgtctaaggtcacata

SEQ ID NO: 74126 - DNA, 20 bp, Artificial Sequence
  chemically synthesized
gattgaactgtatgtgacct

SEQ ID NO: 74127 - DNA, 20 bp, Artificial Sequence
  chemically synthesized
gcagaaatctattttgtcta

SEQ ID NO: 74128 - DNA, 20 bp, Artificial Sequence
  chemically synthesized
tgcagaaatctattttgtct

SEQ ID NO: 74129 - DNA, 20 bp, Artificial Sequence
  chemically synthesized
gtatgtgaccttagacaaaa

SEQ ID NO: 74130 - DNA, 20 bp, Artificial Sequence
  chemically synthesized
ttctcctcatttttaaaatg

SEQ ID NO: 74131 - DNA, 20 bp, Artificial Sequence
  chemically synthesized
gatttctgcattttaaaaat

SEQ ID NO: 74132 - DNA, 20 bp, Artificial Sequence
  chemically synthesized
atttctgcattttaaaaatg

SEQ ID NO: 74133 - DNA, 20 bp, Artificial Sequence
  chemically synthesized
ttctgcattttaaaaatgag

SEQ ID NO: 74134 - DNA, 20 bp, Artificial Sequence
  chemically synthesized
tttaaaaatgaggagaatta

SEQ ID NO: 74135 - DNA, 20 bp, Artificial Sequence
  chemically synthesized
aaatgaggagaattaaagct

SEQ ID NO: 74136 - DNA, 20 bp, Artificial Sequence
  chemically synthesized
atgaggagaattaaagctga

SEQ ID NO: 74137 - DNA, 20 bp, Artificial Sequence
  chemically synthesized
gaggagaattaaagctgaga

SEQ ID NO: 74138 - DNA, 20 bp, Artificial Sequence
  chemically synthesized
aggagaattaaagctgagag

SEQ ID NO: 74139 - DNA, 20 bp, Artificial Sequence
  chemically synthesized
gaaagccatttaacctctct

SEQ ID NO: 74140 - DNA, 20 bp, Artificial Sequence
  chemically synthesized
taaagctgagagaggttaaa

SEQ ID NO: 74141 - DNA, 20 bp, Artificial Sequence
  chemically synthesized
ttgaccgtgttattgtgaga

SEQ ID NO: 74142 - DNA, 20 bp, Artificial Sequence
  chemically synthesized
ttatttgaccgtgttattgt

SEQ ID NO: 74143 - DNA, 20 bp, Artificial Sequence
  chemically synthesized
atggctttctcacaataaca

SEQ ID NO: 74144 - DNA, 20 bp, Artificial Sequence
  chemically synthesized
acaataacacggtcaaataa

SEQ ID NO: 74145 - DNA, 20 bp, Artificial Sequence
  chemically synthesized
aacacggtcaaataatggct

SEQ ID NO: 74146 - DNA, 20 bp, Artificial Sequence
  chemically synthesized
gtcaaataatggctgagctt

SEQ ID NO: 74147 - DNA, 20 bp, Artificial Sequence
  chemically synthesized
tctaacttcaaacttaagct

SEQ ID NO: 74148 - DNA, 20 bp, Artificial Sequence
  chemically synthesized
aatggctgagcttaagtttg

SEQ ID NO: 74149 - DNA, 20 bp, Artificial Sequence
  chemically synthesized
ggaggtctaacttcaaactt

SEQ ID NO: 74150 - DNA, 20 bp, Artificial Sequence
  chemically synthesized
gctgagcttaagtttgaagt

SEQ ID NO: 74151 - DNA, 20 bp, Artificial Sequence
  chemically synthesized
tttgaagttagacctcctaa

SEQ ID NO: 74152 - DNA, 20 bp, Artificial Sequence
  chemically synthesized
gcattggattgactattagg

SEQ ID NO: 74153 - DNA, 20 bp, Artificial Sequence
  chemically synthesized
agcattggattgactattag

SEQ ID NO: 74154 - DNA, 20 bp, Artificial Sequence
  chemically synthesized
agagcattggattgactatt

SEQ ID NO: 74155 - DNA, 20 bp, Artificial Sequence
  chemically synthesized
aagagcattggattgactat

SEQ ID NO: 74156 - DNA, 20 bp, Artificial Sequence
  chemically synthesized
tgatatagcgaaaagagcat

SEQ ID NO: 74157 - DNA, 20 bp, Artificial Sequence
  chemically synthesized
atagtatgatatagcgaaaa

SEQ ID NO: 74158 - DNA, 20 bp, Artificial Sequence
  chemically synthesized
agatagtatgatatagcgaa

SEQ ID NO: 74159 - DNA, 20 bp, Artificial Sequence
  chemically synthesized
tgtaaggagatagtatgata

SEQ ID NO: 74160 - DNA, 20 bp, Artificial Sequence
  chemically synthesized
ggaaaacacatgtaaggaga

SEQ ID NO: 74161 - DNA, 20 bp, Artificial Sequence
  chemically synthesized
tacaggaaaacacatgtaag

SEQ ID NO: 74162 - DNA, 20 bp, Artificial Sequence
  chemically synthesized
agtacaggaaaacacatgta

SEQ ID NO: 74163 - DNA, 20 bp, Artificial Sequence
  chemically synthesized
aagtacaggaaaacacatgt

SEQ ID NO: 74164 - DNA, 20 bp, Artificial Sequence
  chemically synthesized
aaaaacttggttataagtac

SEQ ID NO: 74165 - DNA, 20 bp, Artificial Sequence
  chemically synthesized
taaaaacttggttataagta

SEQ ID NO: 74166 - DNA, 20 bp, Artificial Sequence
  chemically synthesized
gttttcctgtacttataacc

SEQ ID NO: 74167 - DNA, 20 bp, Artificial Sequence
  chemically synthesized
atgagtaaaaacttggttat

SEQ ID NO: 74168 - DNA, 20 bp, Artificial Sequence
  chemically synthesized
ctttacaatgagtaaaaact

SEQ ID NO: 74169 - DNA, 20 bp, Artificial Sequence
  chemically synthesized
ccaagtttttactcattgta

SEQ ID NO: 74170 - DNA, 20 bp, Artificial Sequence
  chemically synthesized
atgtagccattctttacaat

SEQ ID NO: 74171 - DNA, 20 bp, Artificial Sequence
  chemically synthesized
tttttactcattgtaaagaa

SEQ ID NO: 74172 - DNA, 20 bp, Artificial Sequence
  chemically synthesized
cattgtaaagaatggctaca

SEQ ID NO: 74173 - DNA, 20 bp, Artificial Sequence
  chemically synthesized
gtaaagaatggctacatagt

SEQ ID NO: 74174 - DNA, 20 bp, Artificial Sequence
  chemically synthesized
acagtaaatagcttactatg

SEQ ID NO: 74175 - DNA, 20 bp, Artificial Sequence
  chemically synthesized
aaggtatcaaaaacagtaaa

SEQ ID NO: 74176 - DNA, 20 bp, Artificial Sequence
  chemically synthesized
tgcatttaaggtatcaaaaa

SEQ ID NO: 74177 - DNA, 20 bp, Artificial Sequence
  chemically synthesized
gcactatttatttgcattta

SEQ ID NO: 74178 - DNA, 20 bp, Artificial Sequence
  chemically synthesized
tgcactatttatttgcattt

SEQ ID NO: 74179 - DNA, 20 bp, Artificial Sequence
  chemically synthesized
ataccttaaatgcaaataaa

SEQ ID NO: 74180 - DNA, 20 bp, Artificial Sequence
  chemically synthesized
atgcaaataaatagtgcaac

SEQ ID NO: 74181 - DNA, 20 bp, Artificial Sequence
  chemically synthesized
aataaatagtgcaactagaa

SEQ ID NO: 74182 - DNA, 20 bp, Artificial Sequence
  chemically synthesized
caatgctaagtgatccattc

SEQ ID NO: 74183 - DNA, 20 bp, Artificial Sequence
  chemically synthesized
tgcaactagaatggatcact

SEQ ID NO: 74184 - DNA, 20 bp, Artificial Sequence
  chemically synthesized
ttttttttttaatcaatgct

SEQ ID NO: 74185 - DNA, 20 bp, Artificial Sequence
  chemically synthesized
aaaaaaaaaacttttcttac

SEQ ID NO: 74186 - DNA, 20 bp, Artificial Sequence
  chemically synthesized
aggattatgactagtaagaa

SEQ ID NO: 74187 - DNA, 20 bp, Artificial Sequence
  chemically synthesized
gtcaaaggattatgactagt

SEQ ID NO: 74188 - DNA, 20 bp, Artificial Sequence
  chemically synthesized
tgaggtcaaaggattatgac

SEQ ID NO: 74189 - DNA, 20 bp, Artificial Sequence
  chemically synthesized
agatttccaaatgaggtcaa

SEQ ID NO: 74190 - DNA, 20 bp, Artificial Sequence
  chemically synthesized
tagatttccaaatgaggtca

SEQ ID NO: 74191 - DNA, 20 bp, Artificial Sequence
  chemically synthesized
cataatcctttgacctcatt

SEQ ID NO: 74192 - DNA, 20 bp, Artificial Sequence
  chemically synthesized
ggcaggtagatttccaaatg

SEQ ID NO: 74193 - DNA, 20 bp, Artificial Sequence
  chemically synthesized
tggcaggtagatttccaaat

SEQ ID NO: 74194 - DNA, 20 bp, Artificial Sequence
  chemically synthesized
agatttgtgacagtggcagg

SEQ ID NO: 74195 - DNA, 20 bp, Artificial Sequence
  chemically synthesized
aaaagatttgtgacagtggc

SEQ ID NO: 74196 - DNA, 20 bp, Artificial Sequence
  chemically synthesized
taaaagatttgtgacagtgg

SEQ ID NO: 74197 - DNA, 20 bp, Artificial Sequence
  chemically synthesized
tggtaaaagatttgtgacag

SEQ ID NO: 74198 - DNA, 20 bp, Artificial Sequence
  chemically synthesized
acgtggtaaaagatttgtga

SEQ ID NO: 74199 - DNA, 20 bp, Artificial Sequence
  chemically synthesized
ttgctttcagaacgtggtaa

SEQ ID NO: 74200 - DNA, 20 bp, Artificial Sequence
  chemically synthesized
ccacgtttgctttcagaacg

SEQ ID NO: 74201 - DNA, 20 bp, Artificial Sequence
  chemically synthesized
aatcttttaccacgttctga

SEQ ID NO: 74202 - DNA, 20 bp, Artificial Sequence
  chemically synthesized
cagaatgccacgtttgcttt

SEQ ID NO: 74203 - DNA, 20 bp, Artificial Sequence
  chemically synthesized
ccacgttctgaaagcaaacg

SEQ ID NO: 74204 - DNA, 20 bp, Artificial Sequence
  chemically synthesized
ttataatttcttttagagag

SEQ ID NO: 74205 - DNA, 20 bp, Artificial Sequence
  chemically synthesized
cgtggcattctgctctctaa

SEQ ID NO: 74206 - DNA, 20 bp, Artificial Sequence
  chemically synthesized
attttataatttcttttaga

SEQ ID NO: 74207 - DNA, 20 bp, Artificial Sequence
  chemically synthesized
atattttataatttctttta

SEQ ID NO: 74208 - DNA, 20 bp, Artificial Sequence
  chemically synthesized
gtatattttataatttcttt

SEQ ID NO: 74209 - DNA, 20 bp, Artificial Sequence
  chemically synthesized
gaaattataaaatatacttc

SEQ ID NO: 74210 - DNA, 20 bp, Artificial Sequence
  chemically synthesized
gtcccatataagtgttctag

SEQ ID NO: 74211 - DNA, 20 bp, Artificial Sequence
  chemically synthesized
ttagtcccatataagtgttc

SEQ ID NO: 74212 - DNA, 20 bp, Artificial Sequence
  chemically synthesized
atacttctagaacacttata

SEQ ID NO: 74213 - DNA, 20 bp, Artificial Sequence
  chemically synthesized
tacttctagaacacttatat

SEQ ID NO: 74214 - DNA, 20 bp, Artificial Sequence
  chemically synthesized
tggccacattagtcccatat

SEQ ID NO: 74215 - DNA, 20 bp, Artificial Sequence
  chemically synthesized
acacttatatgggactaatg

SEQ ID NO: 74216 - DNA, 20 bp, Artificial Sequence
  chemically synthesized
aagaaaaccaatggccacat

SEQ ID NO: 74217 - DNA, 20 bp, Artificial Sequence
  chemically synthesized
tatgggactaatgtggccat

SEQ ID NO: 74218 - DNA, 20 bp, Artificial Sequence
  chemically synthesized
aaatgtccaaagaaaaccaa

SEQ ID NO: 74219 - DNA, 20 bp, Artificial Sequence
  chemically synthesized
atgtggccattggttttctt

SEQ ID NO: 74220 - DNA, 20 bp, Artificial Sequence
  chemically synthesized
aggaaagtaataaatgtcca

SEQ ID NO: 74221 - DNA, 20 bp, Artificial Sequence
  chemically synthesized
atcttaagtataaataagga

SEQ ID NO: 74222 - DNA, 20 bp, Artificial Sequence
  chemically synthesized
tttcatcttaagtataaata

SEQ ID NO: 74223 - DNA, 20 bp, Artificial Sequence
  chemically synthesized
ttttcatcttaagtataaat

SEQ ID NO: 74224 - DNA, 20 bp, Artificial Sequence
  chemically synthesized
tactttccttatttatactt

SEQ ID NO: 74225 - DNA, 20 bp, Artificial Sequence
  chemically synthesized
cttagtatgtttttcatctt

SEQ ID NO: 74226 - DNA, 20 bp, Artificial Sequence
  chemically synthesized
cttaagatgaaaaacatact

SEQ ID NO: 74227 - DNA, 20 bp, Artificial Sequence
  chemically synthesized
ttaagatgaaaaacatacta

SEQ ID NO: 74228 - DNA, 20 bp, Artificial Sequence
  chemically synthesized
gatgaaaaacatactaagga

SEQ ID NO: 74229 - DNA, 20 bp, Artificial Sequence
  chemically synthesized
aattttatctgttccatcct

SEQ ID NO: 74230 - DNA, 20 bp, Artificial Sequence
  chemically synthesized
aaaacatactaaggatggaa

SEQ ID NO: 74231 - DNA, 20 bp, Artificial Sequence
  chemically synthesized
tggaacagataaaattttaa

SEQ ID NO: 74232 - DNA, 20 bp, Artificial Sequence
  chemically synthesized
ctgtttgctccatagtagtt

SEQ ID NO: 74233 - DNA, 20 bp, Artificial Sequence
  chemically synthesized
ttaatagtactcaactacta

SEQ ID NO: 74234 - DNA, 20 bp, Artificial Sequence
  chemically synthesized
aatagtactcaactactatg

SEQ ID NO: 74235 - DNA, 20 bp, Artificial Sequence
  chemically synthesized
tttctctgtttgctccatag

SEQ ID NO: 74236 - DNA, 20 bp, Artificial Sequence
  chemically synthesized
gcctttctctgtttgctcca

SEQ ID NO: 74237 - DNA, 20 bp, Artificial Sequence
  chemically synthesized
ctcaactactatggagcaaa

SEQ ID NO: 74238 - DNA, 20 bp, Artificial Sequence
  chemically synthesized
caactactatggagcaaaca

SEQ ID NO: 74239 - DNA, 20 bp, Artificial Sequence
  chemically synthesized
tactatggagcaaacagaga

SEQ ID NO: 74240 - DNA, 20 bp, Artificial Sequence
  chemically synthesized
actatggagcaaacagagaa

SEQ ID NO: 74241 - DNA, 20 bp, Artificial Sequence
  chemically synthesized
gagaaaggcatataatcact

SEQ ID NO: 74242 - DNA, 20 bp, Artificial Sequence
  chemically synthesized
taaagcaaggcgatatagct

SEQ ID NO: 74243 - DNA, 20 bp, Artificial Sequence
  chemically synthesized
tcgactaaagcaaggcgata

SEQ ID NO: 74244 - DNA, 20 bp, Artificial Sequence
  chemically synthesized
ttagctatatcgccttgctt

SEQ ID NO: 74245 - DNA, 20 bp, Artificial Sequence
  chemically synthesized
aagtggcatcgactaaagca

SEQ ID NO: 74246 - DNA, 20 bp, Artificial Sequence
  chemically synthesized
taagtggcatcgactaaagc

SEQ ID NO: 74247 - DNA, 20 bp, Artificial Sequence
  chemically synthesized
gttataagtggcatcgacta

SEQ ID NO: 74248 - DNA, 20 bp, Artificial Sequence
  chemically synthesized
gtattctagattgttataag

SEQ ID NO: 74249 - DNA, 20 bp, Artificial Sequence
  chemically synthesized
tttgtattctagattgttat

SEQ ID NO: 74250 - DNA, 20 bp, Artificial Sequence
  chemically synthesized
cgatgccacttataacaatc

SEQ ID NO: 74251 - DNA, 20 bp, Artificial Sequence
  chemically synthesized
gtcctgaaagatttgtattc

SEQ ID NO: 74252 - DNA, 20 bp, Artificial Sequence
  chemically synthesized
aatctagaatacaaatcttt

SEQ ID NO: 74253 - DNA, 20 bp, Artificial Sequence
  chemically synthesized
atctagaatacaaatctttc

SEQ ID NO: 74254 - DNA, 20 bp, Artificial Sequence
  chemically synthesized
gttgtgatggatagtcctga

SEQ ID NO: 74255 - DNA, 20 bp, Artificial Sequence
  chemically synthesized
ttaattcttgttgtgatgga

SEQ ID NO: 74256 - DNA, 20 bp, Artificial Sequence
  chemically synthesized
tcaggactatccatcacaac

SEQ ID NO: 74257 - DNA, 20 bp, Artificial Sequence
  chemically synthesized
taatttaattcttgttgtga

SEQ ID NO: 74258 - DNA, 20 bp, Artificial Sequence
  chemically synthesized
caacaagaattaaattatgt

SEQ ID NO: 74259 - DNA, 20 bp, Artificial Sequence
  chemically synthesized
attaaattatgtgagatctc

SEQ ID NO: 74260 - DNA, 20 bp, Artificial Sequence
  chemically synthesized
taaattatgtgagatctcaa

SEQ ID NO: 74261 - DNA, 20 bp, Artificial Sequence
  chemically synthesized
aaattatgtgagatctcaag

SEQ ID NO: 74262 - DNA, 20 bp, Artificial Sequence
  chemically synthesized
ttgcaaatcccagacctctt

SEQ ID NO: 74263 - DNA, 20 bp, Artificial Sequence
  chemically synthesized
atgtgagatctcaagaggtc

SEQ ID NO: 74264 - DNA, 20 bp, Artificial Sequence
  chemically synthesized
tgtgagatctcaagaggtct

SEQ ID NO: 74265 - DNA, 20 bp, Artificial Sequence
  chemically synthesized
taaagataagttgcaaatcc

SEQ ID NO: 74266 - DNA, 20 bp, Artificial Sequence
  chemically synthesized
gctagatctttaataaagat

SEQ ID NO: 74267 - DNA, 20 bp, Artificial Sequence
  chemically synthesized
tttgcaacttatctttatta

SEQ ID NO: 74268 - DNA, 20 bp, Artificial Sequence
  chemically synthesized
gaattgctagatctttaata

SEQ ID NO: 74269 - DNA, 20 bp, Artificial Sequence
  chemically synthesized
acttatctttattaaagatc

SEQ ID NO: 74270 - DNA, 20 bp, Artificial Sequence
  chemically synthesized
gaggcctgttaaagaattgc

SEQ ID NO: 74271 - DNA, 20 bp, Artificial Sequence
  chemically synthesized
aagatctagcaattctttaa

SEQ ID NO: 74272 - DNA, 20 bp, Artificial Sequence
  chemically synthesized
agatctagcaattctttaac

SEQ ID NO: 74273 - DNA, 20 bp, Artificial Sequence
  chemically synthesized
tgtgattgagaggcctgtta

SEQ ID NO: 74274 - DNA, 20 bp, Artificial Sequence
  chemically synthesized
catttaggggtgtgattgag

SEQ ID NO: 74275 - DNA, 20 bp, Artificial Sequence
  chemically synthesized
ccatttaggggtgtgattga

SEQ ID NO: 74276 - DNA, 20 bp, Artificial Sequence
  chemically synthesized
gtccatttaggggtgtgatt

SEQ ID NO: 74277 - DNA, 20 bp, Artificial Sequence
  chemically synthesized
ctctcaatcacacccctaaa

SEQ ID NO: 74278 - DNA, 20 bp, Artificial Sequence
  chemically synthesized
cctattgtcagtccatttag

SEQ ID NO: 74279 - DNA, 20 bp, Artificial Sequence
  chemically synthesized
tcctattgtcagtccattta

SEQ ID NO: 74280 - DNA, 20 bp, Artificial Sequence
  chemically synthesized
ttcctattgtcagtccattt

SEQ ID NO: 74281 - DNA, 20 bp, Artificial Sequence
  chemically synthesized
tttcctattgtcagtccatt

SEQ ID NO: 74282 - DNA, 20 bp, Artificial Sequence
  chemically synthesized
acccctaaatggactgacaa

SEQ ID NO: 74283 - DNA, 20 bp, Artificial Sequence
  chemically synthesized
cccctaaatggactgacaat

SEQ ID NO: 74284 - DNA, 20 bp, Artificial Sequence
  chemically synthesized
ccaaatcactttcctattgt

SEQ ID NO: 74285 - DNA, 20 bp, Artificial Sequence
  chemically synthesized
taaatggactgacaatagga

SEQ ID NO: 74286 - DNA, 20 bp, Artificial Sequence
  chemically synthesized
ctgacaataggaaagtgatt

SEQ ID NO: 74287 - DNA, 20 bp, Artificial Sequence
  chemically synthesized
attatatttttcttattaaa

SEQ ID NO: 74288 - DNA, 20 bp, Artificial Sequence
  chemically synthesized
tttggttttaactttttaat

SEQ ID NO: 74289 - DNA, 20 bp, Artificial Sequence
  chemically synthesized
attaaaaagttaaaaccaaa

SEQ ID NO: 74290 - DNA, 20 bp, Artificial Sequence
  chemically synthesized
aaactgggtttaaaactatt

SEQ ID NO: 74291 - DNA, 20 bp, Artificial Sequence
  chemically synthesized
aaaccaaatagttttaaacc

SEQ ID NO: 74292 - DNA, 20 bp, Artificial Sequence
  chemically synthesized
ggtatgcctctgaggaaact

SEQ ID NO: 74293 - DNA, 20 bp, Artificial Sequence
  chemically synthesized
agttttaaacccagtttcct

SEQ ID NO: 74294 - DNA, 20 bp, Artificial Sequence
  chemically synthesized
aggtatgcctctgaggaaac

SEQ ID NO: 74295 - DNA, 20 bp, Artificial Sequence
  chemically synthesized
ttttaaacccagtttcctca

SEQ ID NO: 74296 - DNA, 20 bp, Artificial Sequence
  chemically synthesized
tttaaacccagtttcctcag

SEQ ID NO: 74297 - DNA, 20 bp, Artificial Sequence
  chemically synthesized
atgcagaaggtatgcctctg

SEQ ID NO: 74298 - DNA, 20 bp, Artificial Sequence
  chemically synthesized
gatgcagaaggtatgcctct

SEQ ID NO: 74299 - DNA, 20 bp, Artificial Sequence
  chemically synthesized
cctttccaacaggatgcaga

SEQ ID NO: 74300 - DNA, 20 bp, Artificial Sequence
  chemically synthesized
tcctttccaacaggatgcag

SEQ ID NO: 74301 - DNA, 20 bp, Artificial Sequence
  chemically synthesized
ttctcctttccaacaggatg

SEQ ID NO: 74302 - DNA, 20 bp, Artificial Sequence
  chemically synthesized
gcataccttctgcatcctgt

SEQ ID NO: 74303 - DNA, 20 bp, Artificial Sequence
  chemically synthesized
accttctgcatcctgttgga

SEQ ID NO: 74304 - DNA, 20 bp, Artificial Sequence
  chemically synthesized
ccttctgcatcctgttggaa

SEQ ID NO: 74305 - DNA, 20 bp, Artificial Sequence
  chemically synthesized
ccaattttctcctttccaac

SEQ ID NO: 74306 - DNA, 20 bp, Artificial Sequence
  chemically synthesized
tccaattttctcctttccaa

SEQ ID NO: 74307 - DNA, 20 bp, Artificial Sequence
  chemically synthesized
ttctgcatcctgttggaaag

SEQ ID NO: 74308 - DNA, 20 bp, Artificial Sequence
  chemically synthesized
cctgttggaaaggagaaaat

SEQ ID NO: 74309 - DNA, 20 bp, Artificial Sequence
  chemically synthesized
ttggaaaggagaaaattgga

SEQ ID NO: 74310 - DNA, 20 bp, Artificial Sequence
  chemically synthesized
tggaaaggagaaaattggaa

SEQ ID NO: 74311 - DNA, 20 bp, Artificial Sequence
  chemically synthesized
gaaaggagaaaattggaaag

SEQ ID NO: 74312 - DNA, 20 bp, Artificial Sequence
  chemically synthesized
aaggagaaaattggaaagga

SEQ ID NO: 74313 - DNA, 20 bp, Artificial Sequence
  chemically synthesized
ttagtttaaccgtagaatta

SEQ ID NO: 74314 - DNA, 20 bp, Artificial Sequence
  chemically synthesized
aaaatgattctctaattcta

SEQ ID NO: 74315 - DNA, 20 bp, Artificial Sequence
  chemically synthesized
aattagtttaaccgtagaat

SEQ ID NO: 74316 - DNA, 20 bp, Artificial Sequence
  chemically synthesized
ccctaaaattagtttaaccg

SEQ ID NO: 74317 - DNA, 20 bp, Artificial Sequence
  chemically synthesized
ttctacggttaaactaattt

SEQ ID NO: 74318 - DNA, 20 bp, Artificial Sequence
  chemically synthesized
tctacggttaaactaatttt

SEQ ID NO: 74319 - DNA, 20 bp, Artificial Sequence
  chemically synthesized
ctacggttaaactaatttta

SEQ ID NO: 74320 - DNA, 20 bp, Artificial Sequence
  chemically synthesized
ataccccaaaaccctaaaat

SEQ ID NO: 74321 - DNA, 20 bp, Artificial Sequence
  chemically synthesized
ttaaactaattttagggttt

SEQ ID NO: 74322 - DNA, 20 bp, Artificial Sequence
  chemically synthesized
taaactaattttagggtttt

SEQ ID NO: 74323 - DNA, 20 bp, Artificial Sequence
  chemically synthesized
aaactaattttagggttttg

SEQ ID NO: 74324 - DNA, 20 bp, Artificial Sequence
  chemically synthesized
tagggttttggggtataaca

SEQ ID NO: 74325 - DNA, 20 bp, Artificial Sequence
  chemically synthesized
aacatggtgtccttcacact

SEQ ID NO: 74326 - DNA, 20 bp, Artificial Sequence
  chemically synthesized
cgtctaccttctcagtgtga

SEQ ID NO: 74327 - DNA, 20 bp, Artificial Sequence
  chemically synthesized
gcgtctaccttctcagtgtg

SEQ ID NO: 74328 - DNA, 20 bp, Artificial Sequence
  chemically synthesized
atggtgtccttcacactgag

SEQ ID NO: 74329 - DNA, 20 bp, Artificial Sequence
  chemically synthesized
tggtgtccttcacactgaga

SEQ ID NO: 74330 - DNA, 20 bp, Artificial Sequence
  chemically synthesized
tgtccttcacactgagaagg

SEQ ID NO: 74331 - DNA, 20 bp, Artificial Sequence
  chemically synthesized
aagaggtgcgtctaccttct

SEQ ID NO: 74332 - DNA, 20 bp, Artificial Sequence
  chemically synthesized
aatggttgtagtggtggaag

SEQ ID NO: 74333 - DNA, 20 bp, Artificial Sequence
  chemically synthesized
taatggttgtagtggtggaa

SEQ ID NO: 74334 - DNA, 20 bp, Artificial Sequence
  chemically synthesized
agtaatggttgtagtggtgg

SEQ ID NO: 74335 - DNA, 20 bp, Artificial Sequence
  chemically synthesized
cagagtaatggttgtagtgg

SEQ ID NO: 74336 - DNA, 20 bp, Artificial Sequence
  chemically synthesized
atgcagagtaatggttgtag

SEQ ID NO: 74337 - DNA, 20 bp, Artificial Sequence
  chemically synthesized
ttcatgcagagtaatggttg

SEQ ID NO: 74338 - DNA, 20 bp, Artificial Sequence
  chemically synthesized
agttaattcatgcagagtaa

SEQ ID NO: 74339 - DNA, 20 bp, Artificial Sequence
  chemically synthesized
cgaatgagttaattcatgca

SEQ ID NO: 74340 - DNA, 20 bp, Artificial Sequence
  chemically synthesized
atcgaatgagttaattcatg

SEQ ID NO: 74341 - DNA, 20 bp, Artificial Sequence
  chemically synthesized
tggttactgtaacatcgaat

SEQ ID NO: 74342 - DNA, 20 bp, Artificial Sequence
  chemically synthesized
aattaactcattcgatgtta

SEQ ID NO: 74343 - DNA, 20 bp, Artificial Sequence
  chemically synthesized
cgatgttacagtaaccatgt

SEQ ID NO: 74344 - DNA, 20 bp, Artificial Sequence
  chemically synthesized
atgttacagtaaccatgtta

SEQ ID NO: 74345 - DNA, 20 bp, Artificial Sequence
  chemically synthesized
ccatttactcatctctaaca

SEQ ID NO: 74346 - DNA, 20 bp, Artificial Sequence
  chemically synthesized
acagtaaccatgttagagat

SEQ ID NO: 74347 - DNA, 20 bp, Artificial Sequence
  chemically synthesized
ccatgttagagatgagtaaa

SEQ ID NO: 74348 - DNA, 20 bp, Artificial Sequence
  chemically synthesized
gatgagtaaatggacaacca

SEQ ID NO: 74349 - DNA, 20 bp, Artificial Sequence
  chemically synthesized
tgagtaaatggacaaccaca

SEQ ID NO: 74350 - DNA, 20 bp, Artificial Sequence
  chemically synthesized
ttgaggccacttaatctctg

SEQ ID NO: 74351 - DNA, 20 bp, Artificial Sequence
  chemically synthesized
aatggacaaccacagagatt

SEQ ID NO: 74352 - DNA, 20 bp, Artificial Sequence
  chemically synthesized
ggacaaccacagagattaag

SEQ ID NO: 74353 - DNA, 20 bp, Artificial Sequence
  chemically synthesized
cacagagattaagtggcctc

SEQ ID NO: 74354 - DNA, 20 bp, Artificial Sequence
  chemically synthesized
acagagattaagtggcctca

SEQ ID NO: 74355 - DNA, 20 bp, Artificial Sequence
  chemically synthesized
atattagctgagtgaccttg

SEQ ID NO: 74356 - DNA, 20 bp, Artificial Sequence
  chemically synthesized
catattagctgagtgacctt

SEQ ID NO: 74357 - DNA, 20 bp, Artificial Sequence
  chemically synthesized
taagtggcctcaaggtcact

SEQ ID NO: 74358 - DNA, 20 bp, Artificial Sequence
  chemically synthesized
tggaatccaacatattagct

SEQ ID NO: 74359 - DNA, 20 bp, Artificial Sequence
  chemically synthesized
aggtcactcagctaatatgt

SEQ ID NO: 74360 - DNA, 20 bp, Artificial Sequence
  chemically synthesized
ggttttggaatccaacatat

SEQ ID NO: 74361 - DNA, 20 bp, Artificial Sequence
  chemically synthesized
ttattacagtacacaggttt

SEQ ID NO: 74362 - DNA, 20 bp, Artificial Sequence
  chemically synthesized
ttattattattacagtacac

SEQ ID NO: 74363 - DNA, 20 bp, Artificial Sequence
  chemically synthesized
attattattattacagtaca

SEQ ID NO: 74364 - DNA, 20 bp, Artificial Sequence
  chemically synthesized
tgttattattattattatta

SEQ ID NO: 74365 - DNA, 20 bp, Artificial Sequence
  chemically synthesized
ataataataataacaacatc

SEQ ID NO: 74366 - DNA, 20 bp, Artificial Sequence
  chemically synthesized
aataataataacaacatcaa

SEQ ID NO: 74367 - DNA, 20 bp, Artificial Sequence
  chemically synthesized
ataataacaacatcaagagc

SEQ ID NO: 74368 - DNA, 20 bp, Artificial Sequence
  chemically synthesized
acatcaagagctagaatttg

SEQ ID NO: 74369 - DNA, 20 bp, Artificial Sequence
  chemically synthesized
gataaacactctacaaattc

SEQ ID NO: 74370 - DNA, 20 bp, Artificial Sequence
  chemically synthesized
atcaagagctagaatttgta

SEQ ID NO: 74371 - DNA, 20 bp, Artificial Sequence
  chemically synthesized
tttgtagagtgtttatcatt

SEQ ID NO: 74372 - DNA, 20 bp, Artificial Sequence
  chemically synthesized
catttggcatgttcgctccc

SEQ ID NO: 74373 - DNA, 20 bp, Artificial Sequence
  chemically synthesized
aataaatggaaagtgctcgg

SEQ ID NO: 74374 - DNA, 20 bp, Artificial Sequence
  chemically synthesized
aaaataaatggaaagtgctc

SEQ ID NO: 74375 - DNA, 20 bp, Artificial Sequence
  chemically synthesized
caaaataaatggaaagtgct

SEQ ID NO: 74376 - DNA, 20 bp, Artificial Sequence
  chemically synthesized
aataagtcaaaataaatgga

SEQ ID NO: 74377 - DNA, 20 bp, Artificial Sequence
  chemically synthesized
gatgaataagtcaaaataaa

SEQ ID NO: 74378 - DNA, 20 bp, Artificial Sequence
  chemically synthesized
agtttattattaggatgaat

SEQ ID NO: 74379 - DNA, 20 bp, Artificial Sequence
  chemically synthesized
tgcaatatcagtttattatt

SEQ ID NO: 74380 - DNA, 20 bp, Artificial Sequence
  chemically synthesized
ctgcaatatcagtttattat

SEQ ID NO: 74381 - DNA, 20 bp, Artificial Sequence
  chemically synthesized
ctaataataaactgatattg

SEQ ID NO: 74382 - DNA, 20 bp, Artificial Sequence
  chemically synthesized
aataaaattctctgcaatat

SEQ ID NO: 74383 - DNA, 20 bp, Artificial Sequence
  chemically synthesized
aataataaactgatattgca

SEQ ID NO: 74384 - DNA, 20 bp, Artificial Sequence
  chemically synthesized
catttttttttttttgatga

SEQ ID NO: 74385 - DNA, 20 bp, Artificial Sequence
  chemically synthesized
tttttttttgatgaaagact

SEQ ID NO: 74386 - DNA, 20 bp, Artificial Sequence
  chemically synthesized
ttttttttgatgaaagactg

SEQ ID NO: 74387 - DNA, 20 bp, Artificial Sequence
  chemically synthesized
tttgatgaaagactgaggct

SEQ ID NO: 74388 - DNA, 20 bp, Artificial Sequence
  chemically synthesized
tacttaacctttctgagcct

SEQ ID NO: 74389 - DNA, 20 bp, Artificial Sequence
  chemically synthesized
atgaaagactgaggctcaga

SEQ ID NO: 74390 - DNA, 20 bp, Artificial Sequence
  chemically synthesized
tgaaagactgaggctcagaa

SEQ ID NO: 74391 - DNA, 20 bp, Artificial Sequence
  chemically synthesized
gcaaattacttaacctttct

SEQ ID NO: 74392 - DNA, 20 bp, Artificial Sequence
  chemically synthesized
gactgaggctcagaaaggtt

SEQ ID NO: 74393 - DNA, 20 bp, Artificial Sequence
  chemically synthesized
aaaggttaagtaatttgctc

SEQ ID NO: 74394 - DNA, 20 bp, Artificial Sequence
  chemically synthesized
aaggttaagtaatttgctcc

SEQ ID NO: 74395 - DNA, 20 bp, Artificial Sequence
  chemically synthesized
cttactagccatgggacctg

SEQ ID NO: 74396 - DNA, 20 bp, Artificial Sequence
  chemically synthesized
gtaatttgctccaggtccca

SEQ ID NO: 74397 - DNA, 20 bp, Artificial Sequence
  chemically synthesized
cacttactagccatgggacc

SEQ ID NO: 74398 - DNA, 20 bp, Artificial Sequence
  chemically synthesized
tttgctccaggtcccatggc

SEQ ID NO: 74399 - DNA, 20 bp, Artificial Sequence
  chemically synthesized
aggtcacacttactagccat

SEQ ID NO: 74400 - DNA, 20 bp, Artificial Sequence
  chemically synthesized
aaggtcacacttactagcca

SEQ ID NO: 74401 - DNA, 20 bp, Artificial Sequence
  chemically synthesized
ctccaggtcccatggctagt

SEQ ID NO: 74402 - DNA, 20 bp, Artificial Sequence
  chemically synthesized
ctgctcaaggtcacacttac

SEQ ID NO: 74403 - DNA, 20 bp, Artificial Sequence
  chemically synthesized
tggctagtaagtgtgacctt

SEQ ID NO: 74404 - DNA, 20 bp, Artificial Sequence
  chemically synthesized
ctagtaagtgtgaccttgag

SEQ ID NO: 74405 - DNA, 20 bp, Artificial Sequence
  chemically synthesized
caatgtaagtgtgctgctca

SEQ ID NO: 74406 - DNA, 20 bp, Artificial Sequence
  chemically synthesized
gcaatgtaagtgtgctgctc

SEQ ID NO: 74407 - DNA, 20 bp, Artificial Sequence
  chemically synthesized
gtaataaatacaggcaatgt

SEQ ID NO: 74408 - DNA, 20 bp, Artificial Sequence
  chemically synthesized
taggtttgcgtaataaatac

SEQ ID NO: 74409 - DNA, 20 bp, Artificial Sequence
  chemically synthesized
gtaggtttgcgtaataaata

SEQ ID NO: 74410 - DNA, 20 bp, Artificial Sequence
  chemically synthesized
tacatgtggaagtttttcgt

SEQ ID NO: 74411 - DNA, 20 bp, Artificial Sequence
  chemically synthesized
ttacatgtggaagtttttcg

SEQ ID NO: 74412 - DNA, 20 bp, Artificial Sequence
  chemically synthesized
tatcacaaacttacatgtgg

SEQ ID NO: 74413 - DNA, 20 bp, Artificial Sequence
  chemically synthesized
tacgaaaaacttccacatgt

SEQ ID NO: 74414 - DNA, 20 bp, Artificial Sequence
  chemically synthesized
tcctatcacaaacttacatg

SEQ ID NO: 74415 - DNA, 20 bp, Artificial Sequence
  chemically synthesized
ttccacatgtaagtttgtga

SEQ ID NO: 74416 - DNA, 20 bp, Artificial Sequence
  chemically synthesized
tccacatgtaagtttgtgat

SEQ ID NO: 74417 - DNA, 20 bp, Artificial Sequence
  chemically synthesized
ccaaaagtcatttaaagaaa

SEQ ID NO: 74418 - DNA, 20 bp, Artificial Sequence
  chemically synthesized
gtccaaaagtcatttaaaga

SEQ ID NO: 74419 - DNA, 20 bp, Artificial Sequence
  chemically synthesized
atgtgtccaaaagtcattta

SEQ ID NO: 74420 - DNA, 20 bp, Artificial Sequence
  chemically synthesized
ctctttctttaaatgacttt

SEQ ID NO: 74421 - DNA, 20 bp, Artificial Sequence
  chemically synthesized
caatagtaagatgtgtccaa

SEQ ID NO: 74422 - DNA, 20 bp, Artificial Sequence
  chemically synthesized
tttaaacaagagtcaatagt

SEQ ID NO: 74423 - DNA, 20 bp, Artificial Sequence
  chemically synthesized
ctaatttaaacaagagtcaa

SEQ ID NO: 74424 - DNA, 20 bp, Artificial Sequence
  chemically synthesized
tagaatcctaatttaaacaa

SEQ ID NO: 74425 - DNA, 20 bp, Artificial Sequence
  chemically synthesized
tttagaatcctaatttaaac

SEQ ID NO: 74426 - DNA, 20 bp, Artificial Sequence
  chemically synthesized
ctattgactcttgtttaaat

SEQ ID NO: 74427 - DNA, 20 bp, Artificial Sequence
  chemically synthesized
tattgactcttgtttaaatt

SEQ ID NO: 74428 - DNA, 20 bp, Artificial Sequence
  chemically synthesized
ttgtttaaattaggattcta

SEQ ID NO: 74429 - DNA, 20 bp, Artificial Sequence
  chemically synthesized
tgtttaaattaggattctaa

SEQ ID NO: 74430 - DNA, 20 bp, Artificial Sequence
  chemically synthesized
gtttaaattaggattctaaa

SEQ ID NO: 74431 - DNA, 20 bp, Artificial Sequence
  chemically synthesized
aaattaggattctaaaggga

SEQ ID NO: 74432 - DNA, 20 bp, Artificial Sequence
  chemically synthesized
ctcaaaaacatctttccctt

SEQ ID NO: 74433 - DNA, 20 bp, Artificial Sequence
  chemically synthesized
ctaaagggaaagatgttttt

SEQ ID NO: 74434 - DNA, 20 bp, Artificial Sequence
  chemically synthesized
aaagatgtttttgagaatcc

SEQ ID NO: 74435 - DNA, 20 bp, Artificial Sequence
  chemically synthesized
gatgtttttgagaatccaag

SEQ ID NO: 74436 - DNA, 20 bp, Artificial Sequence
  chemically synthesized
tttttgagaatccaagcagt

SEQ ID NO: 74437 - DNA, 20 bp, Artificial Sequence
  chemically synthesized
tcctttgtactcttactgct

SEQ ID NO: 74438 - DNA, 20 bp, Artificial Sequence
  chemically synthesized
tttgagaatccaagcagtaa

SEQ ID NO: 74439 - DNA, 20 bp, Artificial Sequence
  chemically synthesized
atccaagcagtaagagtaca

SEQ ID NO: 74440 - DNA, 20 bp, Artificial Sequence
  chemically synthesized
tccaagcagtaagagtacaa

SEQ ID NO: 74441 - DNA, 20 bp, Artificial Sequence
  chemically synthesized
aagagtacaaaggaactgca

SEQ ID NO: 74442 - DNA, 20 bp, Artificial Sequence
  chemically synthesized
agtacaaaggaactgcatgg

SEQ ID NO: 74443 - DNA, 20 bp, Artificial Sequence
  chemically synthesized
agatgtgaattgccaccatg

SEQ ID NO: 74444 - DNA, 20 bp, Artificial Sequence
  chemically synthesized
ataatgctgaatcatgatgg

SEQ ID NO: 74445 - DNA, 20 bp, Artificial Sequence
  chemically synthesized
aaaataatgctgaatcatga

SEQ ID NO: 74446 - DNA, 20 bp, Artificial Sequence
  chemically synthesized
tcacatcttccatcatgatt

SEQ ID NO: 74447 - DNA, 20 bp, Artificial Sequence
  chemically synthesized
agcagtattcttacgataaa

SEQ ID NO: 74448 - DNA, 20 bp, Artificial Sequence
  chemically synthesized
cattattttctgtttatcgt

SEQ ID NO: 74449 - DNA, 20 bp, Artificial Sequence
  chemically synthesized
atcgtaagaatactgctaca

SEQ ID NO: 74450 - DNA, 20 bp, Artificial Sequence
  chemically synthesized
cgtaagaatactgctacaca

SEQ ID NO: 74451 - DNA, 20 bp, Artificial Sequence
  chemically synthesized
aacatccaaactctgtgtag

SEQ ID NO: 74452 - DNA, 20 bp, Artificial Sequence
  chemically synthesized
gggaacatccaaactctgtg

SEQ ID NO: 74453 - DNA, 20 bp, Artificial Sequence
  chemically synthesized
gaatactgctacacagagtt

SEQ ID NO: 74454 - DNA, 20 bp, Artificial Sequence
  chemically synthesized
atttcaacacgcgagttaga

SEQ ID NO: 74455 - DNA, 20 bp, Artificial Sequence
  chemically synthesized
gatttcaacacgcgagttag

SEQ ID NO: 74456 - DNA, 20 bp, Artificial Sequence
  chemically synthesized
agatttcaacacgcgagtta

SEQ ID NO: 74457 - DNA, 20 bp, Artificial Sequence
  chemically synthesized
tcagatttcaacacgcgagt

SEQ ID NO: 74458 - DNA, 20 bp, Artificial Sequence
  chemically synthesized
gggatcagatttcaacacgc

SEQ ID NO: 74459 - DNA, 20 bp, Artificial Sequence
  chemically synthesized
tcaccaccaacacgggggat

SEQ ID NO: 74460 - DNA, 20 bp, Artificial Sequence
  chemically synthesized
tgaaatctgatcccccgtgt

SEQ ID NO: 74461 - DNA, 20 bp, Artificial Sequence
  chemically synthesized
aggcctcaccaccaacacgg

SEQ ID NO: 74462 - DNA, 20 bp, Artificial Sequence
  chemically synthesized
taggcctcaccaccaacacg

SEQ ID NO: 74463 - DNA, 20 bp, Artificial Sequence
  chemically synthesized
aatctgatcccccgtgttgg

SEQ ID NO: 74464 - DNA, 20 bp, Artificial Sequence
  chemically synthesized
ctaggcctcaccaccaacac

SEQ ID NO: 74465 - DNA, 20 bp, Artificial Sequence
  chemically synthesized
actaggcctcaccaccaaca

SEQ ID NO: 74466 - DNA, 20 bp, Artificial Sequence
  chemically synthesized
tgatcccccgtgttggtggt

SEQ ID NO: 74467 - DNA, 20 bp, Artificial Sequence
  chemically synthesized
gatcccccgtgttggtggtg

SEQ ID NO: 74468 - DNA, 20 bp, Artificial Sequence
  chemically synthesized
cccgtgttggtggtgaggcc

SEQ ID NO: 74469 - DNA, 20 bp, Artificial Sequence
  chemically synthesized
gtgttggtggtgaggcctag

SEQ ID NO: 74470 - DNA, 20 bp, Artificial Sequence
  chemically synthesized
ttggtggtgaggcctagtgg

SEQ ID NO: 74471 - DNA, 20 bp, Artificial Sequence
  chemically synthesized
tggtggtgaggcctagtgga

SEQ ID NO: 74472 - DNA, 20 bp, Artificial Sequence
  chemically synthesized
caacccagacaccttccact

SEQ ID NO: 74473 - DNA, 20 bp, Artificial Sequence
  chemically synthesized
acaacccagacaccttccac

SEQ ID NO: 74474 - DNA, 20 bp, Artificial Sequence
  chemically synthesized
gaggcctagtggaaggtgtc

SEQ ID NO: 74475 - DNA, 20 bp, Artificial Sequence
  chemically synthesized
aggcctagtggaaggtgtct

SEQ ID NO: 74476 - DNA, 20 bp, Artificial Sequence
  chemically synthesized
agtggaaggtgtctgggttg

SEQ ID NO: 74477 - DNA, 20 bp, Artificial Sequence
  chemically synthesized
gtggaaggtgtctgggttgt

SEQ ID NO: 74478 - DNA, 20 bp, Artificial Sequence
  chemically synthesized
agggattcactcctacaacc

SEQ ID NO: 74479 - DNA, 20 bp, Artificial Sequence
  chemically synthesized
ggaaggtgtctgggttgtag

SEQ ID NO: 74480 - DNA, 20 bp, Artificial Sequence
  chemically synthesized
aggagtgaatccctcatgaa

SEQ ID NO: 74481 - DNA, 20 bp, Artificial Sequence
  chemically synthesized
tggcaccaaaccattcatga

SEQ ID NO: 74482 - DNA, 20 bp, Artificial Sequence
  chemically synthesized
atggcaccaaaccattcatg

SEQ ID NO: 74483 - DNA, 20 bp, Artificial Sequence
  chemically synthesized
aatggcaccaaaccattcat

SEQ ID NO: 74484 - DNA, 20 bp, Artificial Sequence
  chemically synthesized
tgaatccctcatgaatggtt

SEQ ID NO: 74485 - DNA, 20 bp, Artificial Sequence
  chemically synthesized
atggtttggtgccattctca

SEQ ID NO: 74486 - DNA, 20 bp, Artificial Sequence
  chemically synthesized
ctcgctcactaccgtgagaa

SEQ ID NO: 74487 - DNA, 20 bp, Artificial Sequence
  chemically synthesized
gtttggtgccattctcacgg

SEQ ID NO: 74488 - DNA, 20 bp, Artificial Sequence
  chemically synthesized
aaaacctcgctcactaccgt

SEQ ID NO: 74489 - DNA, 20 bp, Artificial Sequence
  chemically synthesized
ggtgccattctcacggtagt

SEQ ID NO: 74490 - DNA, 20 bp, Artificial Sequence
  chemically synthesized
ccattctcacggtagtgagc

SEQ ID NO: 74491 - DNA, 20 bp, Artificial Sequence
  chemically synthesized
cattctcacggtagtgagcg

SEQ ID NO: 74492 - DNA, 20 bp, Artificial Sequence
  chemically synthesized
tagtgagcgaggttttgctc

SEQ ID NO: 74493 - DNA, 20 bp, Artificial Sequence
  chemically synthesized
tgagcgaggttttgctctag

SEQ ID NO: 74494 - DNA, 20 bp, Artificial Sequence
  chemically synthesized
agttctcatgaaaactgcta

SEQ ID NO: 74495 - DNA, 20 bp, Artificial Sequence
  chemically synthesized
ccagttctcatgaaaactgc

SEQ ID NO: 74496 - DNA, 20 bp, Artificial Sequence
  chemically synthesized
tttgctctagcagttttcat

SEQ ID NO: 74497 - DNA, 20 bp, Artificial Sequence
  chemically synthesized
ctagcagttttcatgagaac

SEQ ID NO: 74498 - DNA, 20 bp, Artificial Sequence
  chemically synthesized
aaaagagggaggggaggtgc

SEQ ID NO: 74499 - DNA, 20 bp, Artificial Sequence
  chemically synthesized
aggagaaaaagagggagggg

SEQ ID NO: 74500 - DNA, 20 bp, Artificial Sequence
  chemically synthesized
gaggagaaaaagagggaggg

SEQ ID NO: 74501 - DNA, 20 bp, Artificial Sequence
  chemically synthesized
aggaggagaaaaagagggag

SEQ ID NO: 74502 - DNA, 20 bp, Artificial Sequence
  chemically synthesized
gaggaggagaaaaagaggga

SEQ ID NO: 74503 - DNA, 20 bp, Artificial Sequence
  chemically synthesized
agaggaggagaaaaagaggg

SEQ ID NO: 74504 - DNA, 20 bp, Artificial Sequence
  chemically synthesized
gagaggaggagaaaaagagg

SEQ ID NO: 74505 - DNA, 20 bp, Artificial Sequence
  chemically synthesized
aagagaggaggagaaaaaga

SEQ ID NO: 74506 - DNA, 20 bp, Artificial Sequence
  chemically synthesized
caagagaggaggagaaaaag

SEQ ID NO: 74507 - DNA, 20 bp, Artificial Sequence
  chemically synthesized
gcaagagaggaggagaaaaa

SEQ ID NO: 74508 - DNA, 20 bp, Artificial Sequence
  chemically synthesized
cggcaagagaggaggagaaa

SEQ ID NO: 74509 - DNA, 20 bp, Artificial Sequence
  chemically synthesized
atcacacggcaagagaggag

SEQ ID NO: 74510 - DNA, 20 bp, Artificial Sequence
  chemically synthesized
agatcacacggcaagagagg

SEQ ID NO: 74511 - DNA, 20 bp, Artificial Sequence
  chemically synthesized
aagatcacacggcaagagag

SEQ ID NO: 74512 - DNA, 20 bp, Artificial Sequence
  chemically synthesized
caaagatcacacggcaagag

SEQ ID NO: 74513 - DNA, 20 bp, Artificial Sequence
  chemically synthesized
acaaagatcacacggcaaga

SEQ ID NO: 74514 - DNA, 20 bp, Artificial Sequence
  chemically synthesized
gtacaaagatcacacggcaa

SEQ ID NO: 74515 - DNA, 20 bp, Artificial Sequence
  chemically synthesized
gtgtacaaagatcacacggc

SEQ ID NO: 74516 - DNA, 20 bp, Artificial Sequence
  chemically synthesized
gctggtgtacaaagatcaca

SEQ ID NO: 74517 - DNA, 20 bp, Artificial Sequence
  chemically synthesized
gccgtgtgatctttgtacac

SEQ ID NO: 74518 - DNA, 20 bp, Artificial Sequence
  chemically synthesized
caaaggggagctggtgtaca

SEQ ID NO: 74519 - DNA, 20 bp, Artificial Sequence
  chemically synthesized
ggcagaaggcaaaggggagc

SEQ ID NO: 74520 - DNA, 20 bp, Artificial Sequence
  chemically synthesized
tcatggcagaaggcaaaggg

SEQ ID NO: 74521 - DNA, 20 bp, Artificial Sequence
  chemically synthesized
actcatggcagaaggcaaag

SEQ ID NO: 74522 - DNA, 20 bp, Artificial Sequence
  chemically synthesized
cactcatggcagaaggcaaa

SEQ ID NO: 74523 - DNA, 20 bp, Artificial Sequence
  chemically synthesized
ccactcatggcagaaggcaa

SEQ ID NO: 74524 - DNA, 20 bp, Artificial Sequence
  chemically synthesized
tccactcatggcagaaggca

SEQ ID NO: 74525 - DNA, 20 bp, Artificial Sequence
  chemically synthesized
ctgcttccactcatggcaga

SEQ ID NO: 74526 - DNA, 20 bp, Artificial Sequence
  chemically synthesized
tcccctttgccttctgccat

SEQ ID NO: 74527 - DNA, 20 bp, Artificial Sequence
  chemically synthesized
gctgcttccactcatggcag

SEQ ID NO: 74528 - DNA, 20 bp, Artificial Sequence
  chemically synthesized
cctttgccttctgccatgag

SEQ ID NO: 74529 - DNA, 20 bp, Artificial Sequence
  chemically synthesized
caggctgcttccactcatgg

SEQ ID NO: 74530 - DNA, 20 bp, Artificial Sequence
  chemically synthesized
ttgccttctgccatgagtgg

SEQ ID NO: 74531 - DNA, 20 bp, Artificial Sequence
  chemically synthesized
cgtcaggctgcttccactca

SEQ ID NO: 74532 - DNA, 20 bp, Artificial Sequence
  chemically synthesized
ccttctgccatgagtggaag

SEQ ID NO: 74533 - DNA, 20 bp, Artificial Sequence
  chemically synthesized
ctgcttctggcgagggcgtc

SEQ ID NO: 74534 - DNA, 20 bp, Artificial Sequence
  chemically synthesized
tctgcttctggcgagggcgt

SEQ ID NO: 74535 - DNA, 20 bp, Artificial Sequence
  chemically synthesized
aagcagcctgacgccctcgc

SEQ ID NO: 74536 - DNA, 20 bp, Artificial Sequence
  chemically synthesized
cagcctgacgccctcgccag

SEQ ID NO: 74537 - DNA, 20 bp, Artificial Sequence
  chemically synthesized
gaagcatctgcttctggcga

SEQ ID NO: 74538 - DNA, 20 bp, Artificial Sequence
  chemically synthesized
agaagcatctgcttctggcg

SEQ ID NO: 74539 - DNA, 20 bp, Artificial Sequence
  chemically synthesized
aagaagcatctgcttctggc

SEQ ID NO: 74540 - DNA, 20 bp, Artificial Sequence
  chemically synthesized
cctgacgccctcgccagaag

SEQ ID NO: 74541 - DNA, 20 bp, Artificial Sequence
  chemically synthesized
gtacaagaagcatctgcttc

SEQ ID NO: 74542 - DNA, 20 bp, Artificial Sequence
  chemically synthesized
agaagcagatgcttcttgta

SEQ ID NO: 74543 - DNA, 20 bp, Artificial Sequence
  chemically synthesized
agttctgcaggctgtacaag

SEQ ID NO: 74544 - DNA, 20 bp, Artificial Sequence
  chemically synthesized
ctcagttctgcaggctgtac

SEQ ID NO: 74545 - DNA, 20 bp, Artificial Sequence
  chemically synthesized
gatgcttcttgtacagcctg

SEQ ID NO: 74546 - DNA, 20 bp, Artificial Sequence
  chemically synthesized
tttatttggctcagttctgc

SEQ ID NO: 74547 - DNA, 20 bp, Artificial Sequence
  chemically synthesized
cttgtacagcctgcagaact

SEQ ID NO: 74548 - DNA, 20 bp, Artificial Sequence
  chemically synthesized
gtttatttggctcagttctg

SEQ ID NO: 74549 - DNA, 20 bp, Artificial Sequence
  chemically synthesized
gaacaggtgtttatttggct

SEQ ID NO: 74550 - DNA, 20 bp, Artificial Sequence
  chemically synthesized
ataaagaacaggtgtttatt

SEQ ID NO: 74551 - DNA, 20 bp, Artificial Sequence
  chemically synthesized
ctgggtaattcataaagaac

SEQ ID NO: 74552 - DNA, 20 bp, Artificial Sequence
  chemically synthesized
gctgggtaattcataaagaa

SEQ ID NO: 74553 - DNA, 20 bp, Artificial Sequence
  chemically synthesized
ttggggctgggtaattcata

SEQ ID NO: 74554 - DNA, 20 bp, Artificial Sequence
  chemically synthesized
cctgttctttatgaattacc

SEQ ID NO: 74555 - DNA, 20 bp, Artificial Sequence
  chemically synthesized
tttatgaattacccagcccc

SEQ ID NO: 74556 - DNA, 20 bp, Artificial Sequence
  chemically synthesized
ataaaagaatacttggggct

SEQ ID NO: 74557 - DNA, 20 bp, Artificial Sequence
  chemically synthesized
tataaaagaatacttggggc

SEQ ID NO: 74558 - DNA, 20 bp, Artificial Sequence
  chemically synthesized
ttgctataaaagaatacttg

SEQ ID NO: 74559 - DNA, 20 bp, Artificial Sequence
  chemically synthesized
gttgctataaaagaatactt

SEQ ID NO: 74560 - DNA, 20 bp, Artificial Sequence
  chemically synthesized
tgttgctataaaagaatact

SEQ ID NO: 74561 - DNA, 20 bp, Artificial Sequence
  chemically synthesized
cagccccaagtattctttta

SEQ ID NO: 74562 - DNA, 20 bp, Artificial Sequence
  chemically synthesized
tctgtttagtgttgctataa

SEQ ID NO: 74563 - DNA, 20 bp, Artificial Sequence
  chemically synthesized
tcttttatagcaacactaaa

SEQ ID NO: 74564 - DNA, 20 bp, Artificial Sequence
  chemically synthesized
agtatatgtcttagtctgtt

SEQ ID NO: 74565 - DNA, 20 bp, Artificial Sequence
  chemically synthesized
atagcaacactaaacagact

SEQ ID NO: 74566 - DNA, 20 bp, Artificial Sequence
  chemically synthesized
ctaagacttagtatatgtct

SEQ ID NO: 74567 - DNA, 20 bp, Artificial Sequence
  chemically synthesized
aacagactaagacatatact

SEQ ID NO: 74568 - DNA, 20 bp, Artificial Sequence
  chemically synthesized
ctaagacatatactaagtct

SEQ ID NO: 74569 - DNA, 20 bp, Artificial Sequence
  chemically synthesized
ttttggaagcaactaagact

SEQ ID NO: 74570 - DNA, 20 bp, Artificial Sequence
  chemically synthesized
tattaattttggaagcaact

SEQ ID NO: 74571 - DNA, 20 bp, Artificial Sequence
  chemically synthesized
attattaatattaattttgg

SEQ ID NO: 74572 - DNA, 20 bp, Artificial Sequence
  chemically synthesized
caaattattaatattaattt

SEQ ID NO: 74573 - DNA, 20 bp, Artificial Sequence
  chemically synthesized
attaataatttgaaaatgtt

SEQ ID NO: 74574 - DNA, 20 bp, Artificial Sequence
  chemically synthesized
ataatttgaaaatgtttaga

SEQ ID NO: 74575 - DNA, 20 bp, Artificial Sequence
  chemically synthesized
taatttgaaaatgtttagat

SEQ ID NO: 74576 - DNA, 20 bp, Artificial Sequence
  chemically synthesized
gaggataggatattttatat

SEQ ID NO: 74577 - DNA, 20 bp, Artificial Sequence
  chemically synthesized
atggtaatatttgtgaggat

SEQ ID NO: 74578 - DNA, 20 bp, Artificial Sequence
  chemically synthesized
catggtaatatttgtgagga

SEQ ID NO: 74579 - DNA, 20 bp, Artificial Sequence
  chemically synthesized
tgttcatggtaatatttgtg

SEQ ID NO: 74580 - DNA, 20 bp, Artificial Sequence
  chemically synthesized
atgttcatggtaatatttgt

SEQ ID NO: 74581 - DNA, 20 bp, Artificial Sequence
  chemically synthesized
cttttttcatgtaatgttca

SEQ ID NO: 74582 - DNA, 20 bp, Artificial Sequence
  chemically synthesized
ccatgaacattacatgaaaa

SEQ ID NO: 74583 - DNA, 20 bp, Artificial Sequence
  chemically synthesized
aaatttgtaaagaacaatga

SEQ ID NO: 74584 - DNA, 20 bp, Artificial Sequence
  chemically synthesized
atatacagataaaatttgta

SEQ ID NO: 74585 - DNA, 20 bp, Artificial Sequence
  chemically synthesized
tgttacagtaaaataatata

SEQ ID NO: 74586 - DNA, 20 bp, Artificial Sequence
  chemically synthesized
tatattattttactgtaaca

SEQ ID NO: 74587 - DNA, 20 bp, Artificial Sequence
  chemically synthesized
atattattttactgtaacaa

SEQ ID NO: 74588 - DNA, 20 bp, Artificial Sequence
  chemically synthesized
aacattgttgtcctttgtta

SEQ ID NO: 74589 - DNA, 20 bp, Artificial Sequence
  chemically synthesized
gtttacaatgtgcttacctg

SEQ ID NO: 74590 - DNA, 20 bp, Artificial Sequence
  chemically synthesized
agatggaagcttctgcaggt

SEQ ID NO: 74591 - DNA, 20 bp, Artificial Sequence
  chemically synthesized
tacaatgtgcttacctgcag

SEQ ID NO: 74592 - DNA, 20 bp, Artificial Sequence
  chemically synthesized
caccagatggaagcttctgc

SEQ ID NO: 74593 - DNA, 20 bp, Artificial Sequence
  chemically synthesized
acaccagatggaagcttctg

SEQ ID NO: 74594 - DNA, 20 bp, Artificial Sequence
  chemically synthesized
tacctgcagaagcttccatc

SEQ ID NO: 74595 - DNA, 20 bp, Artificial Sequence
  chemically synthesized
aagacctgaacaccagatgg

SEQ ID NO: 74596 - DNA, 20 bp, Artificial Sequence
  chemically synthesized
tggaagacctgaacaccaga

SEQ ID NO: 74597 - DNA, 20 bp, Artificial Sequence
  chemically synthesized
agaagcttccatctggtgtt

SEQ ID NO: 74598 - DNA, 20 bp, Artificial Sequence
  chemically synthesized
gaagcttccatctggtgttc

SEQ ID NO: 74599 - DNA, 20 bp, Artificial Sequence
  chemically synthesized
actctggaagacctgaacac

SEQ ID NO: 74600 - DNA, 20 bp, Artificial Sequence
  chemically synthesized
catctggtgttcaggtcttc

SEQ ID NO: 74601 - DNA, 20 bp, Artificial Sequence
  chemically synthesized
tctggtgttcaggtcttcca

SEQ ID NO: 74602 - DNA, 20 bp, Artificial Sequence
  chemically synthesized
gtataacctcagcactctgg

SEQ ID NO: 74603 - DNA, 20 bp, Artificial Sequence
  chemically synthesized
ttcaggtcttccagagtgct

SEQ ID NO: 74604 - DNA, 20 bp, Artificial Sequence
  chemically synthesized
accgtataacctcagcactc

SEQ ID NO: 74605 - DNA, 20 bp, Artificial Sequence
  chemically synthesized
tcaggtcttccagagtgctg

SEQ ID NO: 74606 - DNA, 20 bp, Artificial Sequence
  chemically synthesized
cagctctcaccgtataacct

SEQ ID NO: 74607 - DNA, 20 bp, Artificial Sequence
  chemically synthesized
tccagagtgctgaggttata

SEQ ID NO: 74608 - DNA, 20 bp, Artificial Sequence
  chemically synthesized
gagtgctgaggttatacggt

SEQ ID NO: 74609 - DNA, 20 bp, Artificial Sequence
  chemically synthesized
gtgctgaggttatacggtga

SEQ ID NO: 74610 - DNA, 20 bp, Artificial Sequence
  chemically synthesized
agcttaccactttgggcatt

SEQ ID NO: 74611 - DNA, 20 bp, Artificial Sequence
  chemically synthesized
cggtgagagctgaatgccca

SEQ ID NO: 74612 - DNA, 20 bp, Artificial Sequence
  chemically synthesized
tgagagctgaatgcccaaag

SEQ ID NO: 74613 - DNA, 20 bp, Artificial Sequence
  chemically synthesized
gctcgccagcttaccacttt

SEQ ID NO: 74614 - DNA, 20 bp, Artificial Sequence
  chemically synthesized
agctgaatgcccaaagtggt

SEQ ID NO: 74615 - DNA, 20 bp, Artificial Sequence
  chemically synthesized
tgctcgccagcttaccactt

SEQ ID NO: 74616 - DNA, 20 bp, Artificial Sequence
  chemically synthesized
gaatgcccaaagtggtaagc

SEQ ID NO: 74617 - DNA, 20 bp, Artificial Sequence
  chemically synthesized
gcccaaagtggtaagctggc

SEQ ID NO: 74618 - DNA, 20 bp, Artificial Sequence
  chemically synthesized
aaagtggtaagctggcgagc

SEQ ID NO: 74619 - DNA, 20 bp, Artificial Sequence
  chemically synthesized
aagtggtaagctggcgagca

SEQ ID NO: 74620 - DNA, 20 bp, Artificial Sequence
  chemically synthesized
acgtcaatgaccttgctcgc

SEQ ID NO: 74621 - DNA, 20 bp, Artificial Sequence
  chemically synthesized
ggcgagcaaggtcattgacg

SEQ ID NO: 74622 - DNA, 20 bp, Artificial Sequence
  chemically synthesized
gcgcctctgaaagagaacgt

SEQ ID NO: 74623 - DNA, 20 bp, Artificial Sequence
  chemically synthesized
acgtggctcacgttctcttt

SEQ ID NO: 74624 - DNA, 20 bp, Artificial Sequence
  chemically synthesized
gtggctcacgttctctttca

SEQ ID NO: 74625 - DNA, 20 bp, Artificial Sequence
  chemically synthesized
tggctcacgttctctttcag

SEQ ID NO: 74626 - DNA, 20 bp, Artificial Sequence
  chemically synthesized
gagaaattgcgcctctgaaa

SEQ ID NO: 74627 - DNA, 20 bp, Artificial Sequence
  chemically synthesized
aggagaaattgcgcctctga

SEQ ID NO: 74628 - DNA, 20 bp, Artificial Sequence
  chemically synthesized
agaggcgcaatttctcctcg

SEQ ID NO: 74629 - DNA, 20 bp, Artificial Sequence
  chemically synthesized
ttgcacacaggcacttcgag

SEQ ID NO: 74630 - DNA, 20 bp, Artificial Sequence
  chemically synthesized
tattgcacacaggcacttcg

SEQ ID NO: 74631 - DNA, 20 bp, Artificial Sequence
  chemically synthesized
ctattgcacacaggcacttc

SEQ ID NO: 74632 - DNA, 20 bp, Artificial Sequence
  chemically synthesized
tgcttttgactattgcacac

SEQ ID NO: 74633 - DNA, 20 bp, Artificial Sequence
  chemically synthesized
ctcgaagtgcctgtgtgcaa

SEQ ID NO: 74634 - DNA, 20 bp, Artificial Sequence
  chemically synthesized
ttgcttttgactattgcaca

SEQ ID NO: 74635 - DNA, 20 bp, Artificial Sequence
  chemically synthesized
tgcctgtgtgcaatagtcaa

SEQ ID NO: 74636 - DNA, 20 bp, Artificial Sequence
  chemically synthesized
tgcaatagtcaaaagcaaat

SEQ ID NO: 74637 - DNA, 20 bp, Artificial Sequence
  chemically synthesized
aatagtcaaaagcaaattgg

SEQ ID NO: 74638 - DNA, 20 bp, Artificial Sequence
  chemically synthesized
tcaaaagcaaattggaagat

SEQ ID NO: 74639 - DNA, 20 bp, Artificial Sequence
  chemically synthesized
aagatgagaatatttaaaac

SEQ ID NO: 74640 - DNA, 20 bp, Artificial Sequence
  chemically synthesized
atgagaatatttaaaacaag

SEQ ID NO: 74641 - DNA, 20 bp, Artificial Sequence
  chemically synthesized
aaacaagaagaactgatacc

SEQ ID NO: 74642 - DNA, 20 bp, Artificial Sequence
  chemically synthesized
aacaagaagaactgatacct

SEQ ID NO: 74643 - DNA, 20 bp, Artificial Sequence
  chemically synthesized
aagagaataagcccaggtat

SEQ ID NO: 74644 - DNA, 20 bp, Artificial Sequence
  chemically synthesized
accctaaagagaataagccc

SEQ ID NO: 74645 - DNA, 20 bp, Artificial Sequence
  chemically synthesized
caccctaaagagaataagcc

SEQ ID NO: 74646 - DNA, 20 bp, Artificial Sequence
  chemically synthesized
cactgcaccctaaagagaat

SEQ ID NO: 74647 - DNA, 20 bp, Artificial Sequence
  chemically synthesized
atacctgggcttattctctt

SEQ ID NO: 74648 - DNA, 20 bp, Artificial Sequence
  chemically synthesized
tacctgggcttattctcttt

SEQ ID NO: 74649 - DNA, 20 bp, Artificial Sequence
  chemically synthesized
acctgggcttattctcttta

SEQ ID NO: 74650 - DNA, 20 bp, Artificial Sequence
  chemically synthesized
tactggcactgcaccctaaa

SEQ ID NO: 74651 - DNA, 20 bp, Artificial Sequence
  chemically synthesized
ggcttattctctttagggtg

SEQ ID NO: 74652 - DNA, 20 bp, Artificial Sequence
  chemically synthesized
attactggcactgcacccta

SEQ ID NO: 74653 - DNA, 20 bp, Artificial Sequence
  chemically synthesized
ttctctttagggtgcagtgc

SEQ ID NO: 74654 - DNA, 20 bp, Artificial Sequence
  chemically synthesized
tagcatagagcaaacattac

SEQ ID NO: 74655 - DNA, 20 bp, Artificial Sequence
  chemically synthesized
gtaatgtttgctctatgcta

SEQ ID NO: 74656 - DNA, 20 bp, Artificial Sequence
  chemically synthesized
aacattcaaaccgtagcata

SEQ ID NO: 74657 - DNA, 20 bp, Artificial Sequence
  chemically synthesized
caaacattcaaaccgtagca

SEQ ID NO: 74658 - DNA, 20 bp, Artificial Sequence
  chemically synthesized
ggacacaaacattcaaaccg

SEQ ID NO: 74659 - DNA, 20 bp, Artificial Sequence
  chemically synthesized
tcaacataggaatttgaggg

SEQ ID NO: 74660 - DNA, 20 bp, Artificial Sequence
  chemically synthesized
ttcaacataggaatttgagg

SEQ ID NO: 74661 - DNA, 20 bp, Artificial Sequence
  chemically synthesized
tttcaacataggaatttgag

SEQ ID NO: 74662 - DNA, 20 bp, Artificial Sequence
  chemically synthesized
atttcaacataggaatttga

SEQ ID NO: 74663 - DNA, 20 bp, Artificial Sequence
  chemically synthesized
gatttcaacataggaatttg

SEQ ID NO: 74664 - DNA, 20 bp, Artificial Sequence
  chemically synthesized
ggatttcaacataggaattt

SEQ ID NO: 74665 - DNA, 20 bp, Artificial Sequence
  chemically synthesized
attttttaggatttcaacat

SEQ ID NO: 74666 - DNA, 20 bp, Artificial Sequence
  chemically synthesized
tattttttaggatttcaaca

SEQ ID NO: 74667 - DNA, 20 bp, Artificial Sequence
  chemically synthesized
tcgtttcctttttatttttt

SEQ ID NO: 74668 - DNA, 20 bp, Artificial Sequence
  chemically synthesized
ttcgtttcctttttattttt

SEQ ID NO: 74669 - DNA, 20 bp, Artificial Sequence
  chemically synthesized
ttgaaatcctaaaaaataaa

SEQ ID NO: 74670 - DNA, 20 bp, Artificial Sequence
  chemically synthesized
tgaaatcctaaaaaataaaa

SEQ ID NO: 74671 - DNA, 20 bp, Artificial Sequence
  chemically synthesized
gaaacgaaatcaaaacacct

SEQ ID NO: 74672 - DNA, 20 bp, Artificial Sequence
  chemically synthesized
aaacgaaatcaaaacaccta

SEQ ID NO: 74673 - DNA, 20 bp, Artificial Sequence
  chemically synthesized
aatcaaaacacctaaggcaa

SEQ ID NO: 74674 - DNA, 20 bp, Artificial Sequence
  chemically synthesized
tctcctaataccattgcctt

SEQ ID NO: 74675 - DNA, 20 bp, Artificial Sequence
  chemically synthesized
atctcctaataccattgcct

SEQ ID NO: 74676 - DNA, 20 bp, Artificial Sequence
  chemically synthesized
aacacctaaggcaatggtat

SEQ ID NO: 74677 - DNA, 20 bp, Artificial Sequence
  chemically synthesized
acacctaaggcaatggtatt

SEQ ID NO: 74678 - DNA, 20 bp, Artificial Sequence
  chemically synthesized
acctaaggcaatggtattag

SEQ ID NO: 74679 - DNA, 20 bp, Artificial Sequence
  chemically synthesized
aaggcaatggtattaggaga

SEQ ID NO: 74680 - DNA, 20 bp, Artificial Sequence
  chemically synthesized
aggcaatggtattaggagat

SEQ ID NO: 74681 - DNA, 20 bp, Artificial Sequence
  chemically synthesized
ggcaatggtattaggagatg

SEQ ID NO: 74682 - DNA, 20 bp, Artificial Sequence
  chemically synthesized
gtattaggagatggggcctt

SEQ ID NO: 74683 - DNA, 20 bp, Artificial Sequence
  chemically synthesized
tattaggagatggggccttt

SEQ ID NO: 74684 - DNA, 20 bp, Artificial Sequence
  chemically synthesized
attaggagatggggccttta

SEQ ID NO: 74685 - DNA, 20 bp, Artificial Sequence
  chemically synthesized
taggagatggggcctttagg

SEQ ID NO: 74686 - DNA, 20 bp, Artificial Sequence
  chemically synthesized
aggagatggggcctttaggg

SEQ ID NO: 74687 - DNA, 20 bp, Artificial Sequence
  chemically synthesized
cccaaaaatcacctccctaa

SEQ ID NO: 74688 - DNA, 20 bp, Artificial Sequence
  chemically synthesized
tcccaaaaatcacctcccta

SEQ ID NO: 74689 - DNA, 20 bp, Artificial Sequence
  chemically synthesized
gcctttagggaggtgatttt

SEQ ID NO: 74690 - DNA, 20 bp, Artificial Sequence
  chemically synthesized
cctttagggaggtgattttt

SEQ ID NO: 74691 - DNA, 20 bp, Artificial Sequence
  chemically synthesized
agggaggtgatttttgggat

SEQ ID NO: 74692 - DNA, 20 bp, Artificial Sequence
  chemically synthesized
tgggattagcgcccttataa

SEQ ID NO: 74693 - DNA, 20 bp, Artificial Sequence
  chemically synthesized
ctctgaggtctcttttataa

SEQ ID NO: 74694 - DNA, 20 bp, Artificial Sequence
  chemically synthesized
ggattagcgcccttataaaa

SEQ ID NO: 74695 - DNA, 20 bp, Artificial Sequence
  chemically synthesized
tctctgaggtctcttttata

SEQ ID NO: 74696 - DNA, 20 bp, Artificial Sequence
  chemically synthesized
ctctctgaggtctcttttat

SEQ ID NO: 74697 - DNA, 20 bp, Artificial Sequence
  chemically synthesized
cgcccttataaaagagacct

SEQ ID NO: 74698 - DNA, 20 bp, Artificial Sequence
  chemically synthesized
cccttataaaagagacctca

SEQ ID NO: 74699 - DNA, 20 bp, Artificial Sequence
  chemically synthesized
cttataaaagagacctcaga

SEQ ID NO: 74700 - DNA, 20 bp, Artificial Sequence
  chemically synthesized
aggagctagctagctctctg

SEQ ID NO: 74701 - DNA, 20 bp, Artificial Sequence
  chemically synthesized
taaaagagacctcagagagc

SEQ ID NO: 74702 - DNA, 20 bp, Artificial Sequence
  chemically synthesized
aaggagctagctagctctct

SEQ ID NO: 74703 - DNA, 20 bp, Artificial Sequence
  chemically synthesized
agagacctcagagagctagc

SEQ ID NO: 74704 - DNA, 20 bp, Artificial Sequence
  chemically synthesized
acatgctgaaaggagctagc

SEQ ID NO: 74705 - DNA, 20 bp, Artificial Sequence
  chemically synthesized
cctcacatgctgaaaggagc

SEQ ID NO: 74706 - DNA, 20 bp, Artificial Sequence
  chemically synthesized
gagagctagctagctccttt

SEQ ID NO: 74707 - DNA, 20 bp, Artificial Sequence
  chemically synthesized
gcaccctcacatgctgaaag

SEQ ID NO: 74708 - DNA, 20 bp, Artificial Sequence
  chemically synthesized
ctgcaccctcacatgctgaa

SEQ ID NO: 74709 - DNA, 20 bp, Artificial Sequence
  chemically synthesized
actgcaccctcacatgctga

SEQ ID NO: 74710 - DNA, 20 bp, Artificial Sequence
  chemically synthesized
gctagctcctttcagcatgt

SEQ ID NO: 74711 - DNA, 20 bp, Artificial Sequence
  chemically synthesized
ctagctcctttcagcatgtg

SEQ ID NO: 74712 - DNA, 20 bp, Artificial Sequence
  chemically synthesized
tagctcctttcagcatgtga

SEQ ID NO: 74713 - DNA, 20 bp, Artificial Sequence
  chemically synthesized
cctttcagcatgtgagggtg

SEQ ID NO: 74714 - DNA, 20 bp, Artificial Sequence
  chemically synthesized
tcagcatgtgagggtgcagt

SEQ ID NO: 74715 - DNA, 20 bp, Artificial Sequence
  chemically synthesized
gcatgtgagggtgcagtgag

SEQ ID NO: 74716 - DNA, 20 bp, Artificial Sequence
  chemically synthesized
catgtgagggtgcagtgaga

SEQ ID NO: 74717 - DNA, 20 bp, Artificial Sequence
  chemically synthesized
agtgagaaggtgctttgtat

SEQ ID NO: 74718 - DNA, 20 bp, Artificial Sequence
  chemically synthesized
gtgagaaggtgctttgtatg

SEQ ID NO: 74719 - DNA, 20 bp, Artificial Sequence
  chemically synthesized
gaaggcccattcctcataca

SEQ ID NO: 74720 - DNA, 20 bp, Artificial Sequence
  chemically synthesized
aaggtgctttgtatgaggaa

SEQ ID NO: 74721 - DNA, 20 bp, Artificial Sequence
  chemically synthesized
aggtgctttgtatgaggaat

SEQ ID NO: 74722 - DNA, 20 bp, Artificial Sequence
  chemically synthesized
tatgaggaatgggccttccc

SEQ ID NO: 74723 - DNA, 20 bp, Artificial Sequence
  chemically synthesized
gcagatttggtgtctgggga

SEQ ID NO: 74724 - DNA, 20 bp, Artificial Sequence
  chemically synthesized
agcagatttggtgtctgggg

SEQ ID NO: 74725 - DNA, 20 bp, Artificial Sequence
  chemically synthesized
accagcagatttggtgtctg

SEQ ID NO: 74726 - DNA, 20 bp, Artificial Sequence
  chemically synthesized
taccagcagatttggtgtct

SEQ ID NO: 74727 - DNA, 20 bp, Artificial Sequence
  chemically synthesized
ataccagcagatttggtgtc

SEQ ID NO: 74728 - DNA, 20 bp, Artificial Sequence
  chemically synthesized
tccccagacaccaaatctgc

SEQ ID NO: 74729 - DNA, 20 bp, Artificial Sequence
  chemically synthesized
gatcaaaataccagcagatt

SEQ ID NO: 74730 - DNA, 20 bp, Artificial Sequence
  chemically synthesized
gtccaagatcaaaataccag

SEQ ID NO: 74731 - DNA, 20 bp, Artificial Sequence
  chemically synthesized
gaagtccaagatcaaaatac

SEQ ID NO: 74732 - DNA, 20 bp, Artificial Sequence
  chemically synthesized
atctgctggtattttgatct

SEQ ID NO: 74733 - DNA, 20 bp, Artificial Sequence
  chemically synthesized
ttctggaggttgagaagtcc

SEQ ID NO: 74734 - DNA, 20 bp, Artificial Sequence
  chemically synthesized
tcactgttctggaggttgag

SEQ ID NO: 74735 - DNA, 20 bp, Artificial Sequence
  chemically synthesized
atcttggacttctcaacctc

SEQ ID NO: 74736 - DNA, 20 bp, Artificial Sequence
  chemically synthesized
ttctcactgttctggaggtt

SEQ ID NO: 74737 - DNA, 20 bp, Artificial Sequence
  chemically synthesized
ggacttctcaacctccagaa

SEQ ID NO: 74738 - DNA, 20 bp, Artificial Sequence
  chemically synthesized
cttatttctcactgttctgg

SEQ ID NO: 74739 - DNA, 20 bp, Artificial Sequence
  chemically synthesized
acttatttctcactgttctg

SEQ ID NO: 74740 - DNA, 20 bp, Artificial Sequence
  chemically synthesized
ttctcaacctccagaacagt

SEQ ID NO: 74741 - DNA, 20 bp, Artificial Sequence
  chemically synthesized
aaacttatttctcactgttc

SEQ ID NO: 74742 - DNA, 20 bp, Artificial Sequence
  chemically synthesized
cctccagaacagtgagaaat

SEQ ID NO: 74743 - DNA, 20 bp, Artificial Sequence
  chemically synthesized
ataagtttttgttgtttcac

SEQ ID NO: 74744 - DNA, 20 bp, Artificial Sequence
  chemically synthesized
tagaaatgccataaattgga

SEQ ID NO: 74745 - DNA, 20 bp, Artificial Sequence
  chemically synthesized
ttcacaagctatccaattta

SEQ ID NO: 74746 - DNA, 20 bp, Artificial Sequence
  chemically synthesized
ataatagaaatgccataaat

SEQ ID NO: 74747 - DNA, 20 bp, Artificial Sequence
  chemically synthesized
aatttatggcatttctatta

SEQ ID NO: 74748 - DNA, 20 bp, Artificial Sequence
  chemically synthesized
ttatggcatttctattatag

SEQ ID NO: 74749 - DNA, 20 bp, Artificial Sequence
  chemically synthesized
gtctgttccagctgctataa

SEQ ID NO: 74750 - DNA, 20 bp, Artificial Sequence
  chemically synthesized
ggcatttctattatagcagc

SEQ ID NO: 74751 - DNA, 20 bp, Artificial Sequence
  chemically synthesized
ttctattatagcagctggaa

SEQ ID NO: 74752 - DNA, 20 bp, Artificial Sequence
  chemically synthesized
gagactgtcttagtctgttc

SEQ ID NO: 74753 - DNA, 20 bp, Artificial Sequence
  chemically synthesized
tatagcagctggaacagact

SEQ ID NO: 74754 - DNA, 20 bp, Artificial Sequence
  chemically synthesized
gcagctggaacagactaaga

SEQ ID NO: 74755 - DNA, 20 bp, Artificial Sequence
  chemically synthesized
actaccacaagagactgtct

SEQ ID NO: 74756 - DNA, 20 bp, Artificial Sequence
  chemically synthesized
cagactaagacagtctcttg

SEQ ID NO: 74757 - DNA, 20 bp, Artificial Sequence
  chemically synthesized
actaagacagtctcttgtgg

SEQ ID NO: 74758 - DNA, 20 bp, Artificial Sequence
  chemically synthesized
ttgttataatactaccacaa

SEQ ID NO: 74759 - DNA, 20 bp, Artificial Sequence
  chemically synthesized
cattgttataatactaccac

SEQ ID NO: 74760 - DNA, 20 bp, Artificial Sequence
  chemically synthesized
ttgtggtagtattataacaa

SEQ ID NO: 74761 - DNA, 20 bp, Artificial Sequence
  chemically synthesized
taacaatggatatttgttaa

SEQ ID NO: 74762 - DNA, 20 bp, Artificial Sequence
  chemically synthesized
aacaatggatatttgttaat

SEQ ID NO: 74763 - DNA, 20 bp, Artificial Sequence
  chemically synthesized
acaatggatatttgttaatg

SEQ ID NO: 74764 - DNA, 20 bp, Artificial Sequence
  chemically synthesized
caatggatatttgttaatgg

SEQ ID NO: 74765 - DNA, 20 bp, Artificial Sequence
  chemically synthesized
aggaagtgctcaacaaatag

SEQ ID NO: 74766 - DNA, 20 bp, Artificial Sequence
  chemically synthesized
aatgataactactatttgtt

SEQ ID NO: 74767 - DNA, 20 bp, Artificial Sequence
  chemically synthesized
cctaggaagtgctcaacaaa

SEQ ID NO: 74768 - DNA, 20 bp, Artificial Sequence
  chemically synthesized
actatttgttgagcacttcc

SEQ ID NO: 74769 - DNA, 20 bp, Artificial Sequence
  chemically synthesized
ctatttgttgagcacttcct

SEQ ID NO: 74770 - DNA, 20 bp, Artificial Sequence
  chemically synthesized
catggcattaggcacctagg

SEQ ID NO: 74771 - DNA, 20 bp, Artificial Sequence
  chemically synthesized
catcatggcattaggcacct

SEQ ID NO: 74772 - DNA, 20 bp, Artificial Sequence
  chemically synthesized
tcatcatggcattaggcacc

SEQ ID NO: 74773 - DNA, 20 bp, Artificial Sequence
  chemically synthesized
atagagctcatcatggcatt

SEQ ID NO: 74774 - DNA, 20 bp, Artificial Sequence
  chemically synthesized
aatagagctcatcatggcat

SEQ ID NO: 74775 - DNA, 20 bp, Artificial Sequence
  chemically synthesized
taggtgcctaatgccatgat

SEQ ID NO: 74776 - DNA, 20 bp, Artificial Sequence
  chemically synthesized
tgtatgaatagagctcatca

SEQ ID NO: 74777 - DNA, 20 bp, Artificial Sequence
  chemically synthesized
aatcagtttatgtatgaata

SEQ ID NO: 74778 - DNA, 20 bp, Artificial Sequence
  chemically synthesized
aaaatcagtttatgtatgaa

SEQ ID NO: 74779 - DNA, 20 bp, Artificial Sequence
  chemically synthesized
ttgttgggtagaaataaaat

SEQ ID NO: 74780 - DNA, 20 bp, Artificial Sequence
  chemically synthesized
ggcctcataggattgttggg

SEQ ID NO: 74781 - DNA, 20 bp, Artificial Sequence
  chemically synthesized
actggcctcataggattgtt

SEQ ID NO: 74782 - DNA, 20 bp, Artificial Sequence
  chemically synthesized
tactggcctcataggattgt

SEQ ID NO: 74783 - DNA, 20 bp, Artificial Sequence
  chemically synthesized
tttctacccaacaatcctat

SEQ ID NO: 74784 - DNA, 20 bp, Artificial Sequence
  chemically synthesized
ttctacccaacaatcctatg

SEQ ID NO: 74785 - DNA, 20 bp, Artificial Sequence
  chemically synthesized
acccaacaatcctatgaggc

SEQ ID NO: 74786 - DNA, 20 bp, Artificial Sequence
  chemically synthesized
tctccaactactggcctcat

SEQ ID NO: 74787 - DNA, 20 bp, Artificial Sequence
  chemically synthesized
ttctccaactactggcctca

SEQ ID NO: 74788 - DNA, 20 bp, Artificial Sequence
  chemically synthesized
caacaatcctatgaggccag

SEQ ID NO: 74789 - DNA, 20 bp, Artificial Sequence
  chemically synthesized
aatcctatgaggccagtagt

SEQ ID NO: 74790 - DNA, 20 bp, Artificial Sequence
  chemically synthesized
tcctatgaggccagtagttg

SEQ ID NO: 74791 - DNA, 20 bp, Artificial Sequence
  chemically synthesized
aattagaattctccaactac

SEQ ID NO: 74792 - DNA, 20 bp, Artificial Sequence
  chemically synthesized
tgttttctcatgtataaaat

SEQ ID NO: 74793 - DNA, 20 bp, Artificial Sequence
  chemically synthesized
agaattctaattttatacat

SEQ ID NO: 74794 - DNA, 20 bp, Artificial Sequence
  chemically synthesized
tacatgagaaaacaaacttg

SEQ ID NO: 74795 - DNA, 20 bp, Artificial Sequence
  chemically synthesized
catgagaaaacaaacttgca

SEQ ID NO: 74796 - DNA, 20 bp, Artificial Sequence
  chemically synthesized
atgagaaaacaaacttgcag

SEQ ID NO: 74797 - DNA, 20 bp, Artificial Sequence
  chemically synthesized
ttttgaaaacaaacctctgc

SEQ ID NO: 74798 - DNA, 20 bp, Artificial Sequence
  chemically synthesized
caaaacaaacaaaccttgcc

SEQ ID NO: 74799 - DNA, 20 bp, Artificial Sequence
  chemically synthesized
ttacccatgagagcttggca

SEQ ID NO: 74800 - DNA, 20 bp, Artificial Sequence
  chemically synthesized
tttacccatgagagcttggc

SEQ ID NO: 74801 - DNA, 20 bp, Artificial Sequence
  chemically synthesized
aatttttacccatgagagct

SEQ ID NO: 74802 - DNA, 20 bp, Artificial Sequence
  chemically synthesized
caaaccttgccaagctctca

SEQ ID NO: 74803 - DNA, 20 bp, Artificial Sequence
  chemically synthesized
aaaccttgccaagctctcat

SEQ ID NO: 74804 - DNA, 20 bp, Artificial Sequence
  chemically synthesized
tcctcaatttttacccatga

SEQ ID NO: 74805 - DNA, 20 bp, Artificial Sequence
  chemically synthesized
gttcctcaatttttacccat

SEQ ID NO: 74806 - DNA, 20 bp, Artificial Sequence
  chemically synthesized
agctctcatgggtaaaaatt

SEQ ID NO: 74807 - DNA, 20 bp, Artificial Sequence
  chemically synthesized
gctctcatgggtaaaaattg

SEQ ID NO: 74808 - DNA, 20 bp, Artificial Sequence
  chemically synthesized
tgggtaaaaattgaggaacc

SEQ ID NO: 74809 - DNA, 20 bp, Artificial Sequence
  chemically synthesized
gggtaaaaattgaggaacct

SEQ ID NO: 74810 - DNA, 20 bp, Artificial Sequence
  chemically synthesized
aacctgcatataggtatccc

SEQ ID NO: 74811 - DNA, 20 bp, Artificial Sequence
  chemically synthesized
aaacctgcatataggtatcc

SEQ ID NO: 74812 - DNA, 20 bp, Artificial Sequence
  chemically synthesized
gaacctgggatacctatatg

SEQ ID NO: 74813 - DNA, 20 bp, Artificial Sequence
  chemically synthesized
aacctgggatacctatatgc

SEQ ID NO: 74814 - DNA, 20 bp, Artificial Sequence
  chemically synthesized
aggcaggcaaacctgcatat

SEQ ID NO: 74815 - DNA, 20 bp, Artificial Sequence
  chemically synthesized
gaggcaggcaaacctgcata

SEQ ID NO: 74816 - DNA, 20 bp, Artificial Sequence
  chemically synthesized
tatgcaggtttgcctgcctc

SEQ ID NO: 74817 - DNA, 20 bp, Artificial Sequence
  chemically synthesized
agaatatatattctagaggc

SEQ ID NO: 74818 - DNA, 20 bp, Artificial Sequence
  chemically synthesized
aagaatatatattctagagg

SEQ ID NO: 74819 - DNA, 20 bp, Artificial Sequence
  chemically synthesized
gttaagaatatatattctag

SEQ ID NO: 74820 - DNA, 20 bp, Artificial Sequence
  chemically synthesized
agttaagaatatatattcta

SEQ ID NO: 74821 - DNA, 20 bp, Artificial Sequence
  chemically synthesized
atagttaagaatatatattc

SEQ ID NO: 74822 - DNA, 20 bp, Artificial Sequence
  chemically synthesized
aagcatataacataatagtt

SEQ ID NO: 74823 - DNA, 20 bp, Artificial Sequence
  chemically synthesized
aggggaagcatataacataa

SEQ ID NO: 74824 - DNA, 20 bp, Artificial Sequence
  chemically synthesized
ttatgttatatgcttcccct

SEQ ID NO: 74825 - DNA, 20 bp, Artificial Sequence
  chemically synthesized
aatccagaatttcttagggg

SEQ ID NO: 74826 - DNA, 20 bp, Artificial Sequence
  chemically synthesized
gccaatccagaatttcttag

SEQ ID NO: 74827 - DNA, 20 bp, Artificial Sequence
  chemically synthesized
tgccaatccagaatttctta

SEQ ID NO: 74828 - DNA, 20 bp, Artificial Sequence
  chemically synthesized
ttgccaatccagaatttctt

SEQ ID NO: 74829 - DNA, 20 bp, Artificial Sequence
  chemically synthesized
tttgccaatccagaatttct

SEQ ID NO: 74830 - DNA, 20 bp, Artificial Sequence
  chemically synthesized
atgcttcccctaagaaattc

SEQ ID NO: 74831 - DNA, 20 bp, Artificial Sequence
  chemically synthesized
tcccctaagaaattctggat

SEQ ID NO: 74832 - DNA, 20 bp, Artificial Sequence
  chemically synthesized
ttcttgttactttgccaatc

SEQ ID NO: 74833 - DNA, 20 bp, Artificial Sequence
  chemically synthesized
taagaaattctggattggca

SEQ ID NO: 74834 - DNA, 20 bp, Artificial Sequence
  chemically synthesized
ttctggattggcaaagtaac

SEQ ID NO: 74835 - DNA, 20 bp, Artificial Sequence
  chemically synthesized
caagaaaaatatattgctgc

SEQ ID NO: 74836 - DNA, 20 bp, Artificial Sequence
  chemically synthesized
gagtagaatttagaatccag

SEQ ID NO: 74837 - DNA, 20 bp, Artificial Sequence
  chemically synthesized
catgagtagaatttagaatc

SEQ ID NO: 74838 - DNA, 20 bp, Artificial Sequence
  chemically synthesized
gttgtgacatgagtagaatt

SEQ ID NO: 74839 - DNA, 20 bp, Artificial Sequence
  chemically synthesized
atttctggttgtgacatgag

SEQ ID NO: 74840 - DNA, 20 bp, Artificial Sequence
  chemically synthesized
tccatttctggttgtgacat

SEQ ID NO: 74841 - DNA, 20 bp, Artificial Sequence
  chemically synthesized
aattctactcatgtcacaac

SEQ ID NO: 74842 - DNA, 20 bp, Artificial Sequence
  chemically synthesized
actcatgtcacaaccagaaa

SEQ ID NO: 74843 - DNA, 20 bp, Artificial Sequence
  chemically synthesized
aaaaaataaggatccatttc

SEQ ID NO: 74844 - DNA, 20 bp, Artificial Sequence
  chemically synthesized
tctttctattgtaaaaaata

SEQ ID NO: 74845 - DNA, 20 bp, Artificial Sequence
  chemically synthesized
atctttctattgtaaaaaat

SEQ ID NO: 74846 - DNA, 20 bp, Artificial Sequence
  chemically synthesized
tggatccttattttttacaa

SEQ ID NO: 74847 - DNA, 20 bp, Artificial Sequence
  chemically synthesized
tccttattttttacaataga

SEQ ID NO: 74848 - DNA, 20 bp, Artificial Sequence
  chemically synthesized
ttacaatagaaagatatatt

SEQ ID NO: 74849 - DNA, 20 bp, Artificial Sequence
  chemically synthesized
gttatgatgtggttggtgca

SEQ ID NO: 74850 - DNA, 20 bp, Artificial Sequence
  chemically synthesized
tgaaactgttatgatgtggt

SEQ ID NO: 74851 - DNA, 20 bp, Artificial Sequence
  chemically synthesized
taaatgaaactgttatgatg

SEQ ID NO: 74852 - DNA, 20 bp, Artificial Sequence
  chemically synthesized
ttgcaccaaccacatcataa

SEQ ID NO: 74853 - DNA, 20 bp, Artificial Sequence
  chemically synthesized
cacatcataacagtttcatt

SEQ ID NO: 74854 - DNA, 20 bp, Artificial Sequence
  chemically synthesized
acatcataacagtttcattt

SEQ ID NO: 74855 - DNA, 20 bp, Artificial Sequence
  chemically synthesized
catcataacagtttcattta

SEQ ID NO: 74856 - DNA, 20 bp, Artificial Sequence
  chemically synthesized
tcataacagtttcatttagg

SEQ ID NO: 74857 - DNA, 20 bp, Artificial Sequence
  chemically synthesized
taacagtttcatttagggag

SEQ ID NO: 74858 - DNA, 20 bp, Artificial Sequence
  chemically synthesized
aacagtttcatttagggagt

SEQ ID NO: 74859 - DNA, 20 bp, Artificial Sequence
  chemically synthesized
acagtttcatttagggagta

SEQ ID NO: 74860 - DNA, 20 bp, Artificial Sequence
  chemically synthesized
agggagtagggtattttgtc

SEQ ID NO: 74861 - DNA, 20 bp, Artificial Sequence
  chemically synthesized
agggtattttgtcaagtcct

SEQ ID NO: 74862 - DNA, 20 bp, Artificial Sequence
  chemically synthesized
gagatcaggaagtcattctg

SEQ ID NO: 74863 - DNA, 20 bp, Artificial Sequence
  chemically synthesized
ggagatcaggaagtcattct

SEQ ID NO: 74864 - DNA, 20 bp, Artificial Sequence
  chemically synthesized
taaaataccaggagatcagg

SEQ ID NO: 74865 - DNA, 20 bp, Artificial Sequence
  chemically synthesized
agaatgacttcctgatctcc

SEQ ID NO: 74866 - DNA, 20 bp, Artificial Sequence
  chemically synthesized
ggctaaaataccaggagatc

SEQ ID NO: 74867 - DNA, 20 bp, Artificial Sequence
  chemically synthesized
gggctaaaataccaggagat

SEQ ID NO: 74868 - DNA, 20 bp, Artificial Sequence
  chemically synthesized
tacaagggctaaaataccag

SEQ ID NO: 74869 - DNA, 20 bp, Artificial Sequence
  chemically synthesized
ttcctgatctcctggtattt

SEQ ID NO: 74870 - DNA, 20 bp, Artificial Sequence
  chemically synthesized
gctacaagggctaaaatacc

SEQ ID NO: 74871 - DNA, 20 bp, Artificial Sequence
  chemically synthesized
tgctacaagggctaaaatac

SEQ ID NO: 74872 - DNA, 20 bp, Artificial Sequence
  chemically synthesized
tcctggtattttagcccttg

SEQ ID NO: 74873 - DNA, 20 bp, Artificial Sequence
  chemically synthesized
ttctgaagtcattgctacaa

SEQ ID NO: 74874 - DNA, 20 bp, Artificial Sequence
  chemically synthesized
cttctgaagtcattgctaca

SEQ ID NO: 74875 - DNA, 20 bp, Artificial Sequence
  chemically synthesized
ccttctgaagtcattgctac

SEQ ID NO: 74876 - DNA, 20 bp, Artificial Sequence
  chemically synthesized
agcccttgtagcaatgactt

SEQ ID NO: 74877 - DNA, 20 bp, Artificial Sequence
  chemically synthesized
ccttgtagcaatgacttcag

SEQ ID NO: 74878 - DNA, 20 bp, Artificial Sequence
  chemically synthesized
cttgtagcaatgacttcaga

SEQ ID NO: 74879 - DNA, 20 bp, Artificial Sequence
  chemically synthesized
agccccacgggagccttctg

SEQ ID NO: 74880 - DNA, 20 bp, Artificial Sequence
  chemically synthesized
atgacttcagaaggctcccg

SEQ ID NO: 74881 - DNA, 20 bp, Artificial Sequence
  chemically synthesized
tgacttcagaaggctcccgt

SEQ ID NO: 74882 - DNA, 20 bp, Artificial Sequence
  chemically synthesized
gacttcagaaggctcccgtg

SEQ ID NO: 74883 - DNA, 20 bp, Artificial Sequence
  chemically synthesized
acagctgagaagccccacgg

SEQ ID NO: 74884 - DNA, 20 bp, Artificial Sequence
  chemically synthesized
agacagctgagaagccccac

SEQ ID NO: 74885 - DNA, 20 bp, Artificial Sequence
  chemically synthesized
aagacagctgagaagcccca

SEQ ID NO: 74886 - DNA, 20 bp, Artificial Sequence
  chemically synthesized
aaggctcccgtggggcttct

SEQ ID NO: 74887 - DNA, 20 bp, Artificial Sequence
  chemically synthesized
gtgcttcaaagacagctgag

SEQ ID NO: 74888 - DNA, 20 bp, Artificial Sequence
  chemically synthesized
ctagtgcttcaaagacagct

SEQ ID NO: 74889 - DNA, 20 bp, Artificial Sequence
  chemically synthesized
gggcttctcagctgtctttg

SEQ ID NO: 74890 - DNA, 20 bp, Artificial Sequence
  chemically synthesized
ctgctctagtgcttcaaaga

SEQ ID NO: 74891 - DNA, 20 bp, Artificial Sequence
  chemically synthesized
actcctgctctagtgcttca

SEQ ID NO: 74892 - DNA, 20 bp, Artificial Sequence
  chemically synthesized
ctcagctgtctttgaagcac

SEQ ID NO: 74893 - DNA, 20 bp, Artificial Sequence
  chemically synthesized
cagctgtctttgaagcacta

SEQ ID NO: 74894 - DNA, 20 bp, Artificial Sequence
  chemically synthesized
ctgtctttgaagcactagag

SEQ ID NO: 74895 - DNA, 20 bp, Artificial Sequence
  chemically synthesized
tgtctttgaagcactagagc

SEQ ID NO: 74896 - DNA, 20 bp, Artificial Sequence
  chemically synthesized
tctttgaagcactagagcag

SEQ ID NO: 74897 - DNA, 20 bp, Artificial Sequence
  chemically synthesized
tgcatcagagactcctgctc

SEQ ID NO: 74898 - DNA, 20 bp, Artificial Sequence
  chemically synthesized
tgctatgatgtattgcatca

SEQ ID NO: 74899 - DNA, 20 bp, Artificial Sequence
  chemically synthesized
attgctatgatgtattgcat

SEQ ID NO: 74900 - DNA, 20 bp, Artificial Sequence
  chemically synthesized
gtctctgatgcaatacatca

SEQ ID NO: 74901 - DNA, 20 bp, Artificial Sequence
  chemically synthesized
atacatcatagcaatccgtt

SEQ ID NO: 74902 - DNA, 20 bp, Artificial Sequence
  chemically synthesized
catcatagcaatccgttgag

SEQ ID NO: 74903 - DNA, 20 bp, Artificial Sequence
  chemically synthesized
catagggttcttctgctcaa

SEQ ID NO: 74904 - DNA, 20 bp, Artificial Sequence
  chemically synthesized
catagcaatccgttgagcag

SEQ ID NO: 74905 - DNA, 20 bp, Artificial Sequence
  chemically synthesized
ttgagcagaagaaccctatg

SEQ ID NO: 74906 - DNA, 20 bp, Artificial Sequence
  chemically synthesized
atcctccccatatctgcata

SEQ ID NO: 74907 - DNA, 20 bp, Artificial Sequence
  chemically synthesized
tatcctccccatatctgcat

SEQ ID NO: 74908 - DNA, 20 bp, Artificial Sequence
  chemically synthesized
atatcctccccatatctgca

SEQ ID NO: 74909 - DNA, 20 bp, Artificial Sequence
  chemically synthesized
agaagaaccctatgcagata

SEQ ID NO: 74910 - DNA, 20 bp, Artificial Sequence
  chemically synthesized
gaagaaccctatgcagatat

SEQ ID NO: 74911 - DNA, 20 bp, Artificial Sequence
  chemically synthesized
aagaaccctatgcagatatg

SEQ ID NO: 74912 - DNA, 20 bp, Artificial Sequence
  chemically synthesized
gaaccctatgcagatatggg

SEQ ID NO: 74913 - DNA, 20 bp, Artificial Sequence
  chemically synthesized
aaccctatgcagatatgggg

SEQ ID NO: 74914 - DNA, 20 bp, Artificial Sequence
  chemically synthesized
gatagggtagatatgaggcg

SEQ ID NO: 74915 - DNA, 20 bp, Artificial Sequence
  chemically synthesized
atctcgatagggtagatatg

SEQ ID NO: 74916 - DNA, 20 bp, Artificial Sequence
  chemically synthesized
catctcgatagggtagatat

SEQ ID NO: 74917 - DNA, 20 bp, Artificial Sequence
  chemically synthesized
cgcctcatatctaccctatc

SEQ ID NO: 74918 - DNA, 20 bp, Artificial Sequence
  chemically synthesized
taaatgccatctcgataggg

SEQ ID NO: 74919 - DNA, 20 bp, Artificial Sequence
  chemically synthesized
ccataaatgccatctcgata

SEQ ID NO: 74920 - DNA, 20 bp, Artificial Sequence
  chemically synthesized
tcatatctaccctatcgaga

SEQ ID NO: 74921 - DNA, 20 bp, Artificial Sequence
  chemically synthesized
tccataaatgccatctcgat

SEQ ID NO: 74922 - DNA, 20 bp, Artificial Sequence
  chemically synthesized
atccataaatgccatctcga

SEQ ID NO: 74923 - DNA, 20 bp, Artificial Sequence
  chemically synthesized
ccctatcgagatggcattta

SEQ ID NO: 74924 - DNA, 20 bp, Artificial Sequence
  chemically synthesized
ggacatcatgcatcatgtta

SEQ ID NO: 74925 - DNA, 20 bp, Artificial Sequence
  chemically synthesized
aaattgcttattggaacatt

SEQ ID NO: 74926 - DNA, 20 bp, Artificial Sequence
  chemically synthesized
tgatgtccaaatgttccaat

SEQ ID NO: 74927 - DNA, 20 bp, Artificial Sequence
  chemically synthesized
gtcccttagaaattgcttat

SEQ ID NO: 74928 - DNA, 20 bp, Artificial Sequence
  chemically synthesized
tgttccaataagcaatttct

SEQ ID NO: 74929 - DNA, 20 bp, Artificial Sequence
  chemically synthesized
gttccaataagcaatttcta

SEQ ID NO: 74930 - DNA, 20 bp, Artificial Sequence
  chemically synthesized
ttccaataagcaatttctaa

SEQ ID NO: 74931 - DNA, 20 bp, Artificial Sequence
  chemically synthesized
aagtgagggaatttgtccct

SEQ ID NO: 74932 - DNA, 20 bp, Artificial Sequence
  chemically synthesized
aagggacaaattccctcact

SEQ ID NO: 74933 - DNA, 20 bp, Artificial Sequence
  chemically synthesized
agggacaaattccctcactt

SEQ ID NO: 74934 - DNA, 20 bp, Artificial Sequence
  chemically synthesized
caaactgttctcctaagtga

SEQ ID NO: 74935 - DNA, 20 bp, Artificial Sequence
  chemically synthesized
ggacaaattccctcacttag

SEQ ID NO: 74936 - DNA, 20 bp, Artificial Sequence
  chemically synthesized
acaaactgttctcctaagtg

SEQ ID NO: 74937 - DNA, 20 bp, Artificial Sequence
  chemically synthesized
cacaaactgttctcctaagt

SEQ ID NO: 74938 - DNA, 20 bp, Artificial Sequence
  chemically synthesized
aattccctcacttaggagaa

SEQ ID NO: 74939 - DNA, 20 bp, Artificial Sequence
  chemically synthesized
attacacaaactgttctcct

SEQ ID NO: 74940 - DNA, 20 bp, Artificial Sequence
  chemically synthesized
gtaatgtaatgtctgtgtac

SEQ ID NO: 74941 - DNA, 20 bp, Artificial Sequence
  chemically synthesized
taatgtaatgtctgtgtaca

SEQ ID NO: 74942 - DNA, 20 bp, Artificial Sequence
  chemically synthesized
agtggtgctgtccttgtaca

SEQ ID NO: 74943 - DNA, 20 bp, Artificial Sequence
  chemically synthesized
gtaatgtctgtgtacaagga

SEQ ID NO: 74944 - DNA, 20 bp, Artificial Sequence
  chemically synthesized
aaacaacacgtatagtcaag

SEQ ID NO: 74945 - DNA, 20 bp, Artificial Sequence
  chemically synthesized
tcaaaacaacacgtatagtc

SEQ ID NO: 74946 - DNA, 20 bp, Artificial Sequence
  chemically synthesized
gcaagtcaaaacaacacgta

SEQ ID NO: 74947 - DNA, 20 bp, Artificial Sequence
  chemically synthesized
aacacctgcccagatcaagc

SEQ ID NO: 74948 - DNA, 20 bp, Artificial Sequence
  chemically synthesized
ttgttttgacttgcttgatc

SEQ ID NO: 74949 - DNA, 20 bp, Artificial Sequence
  chemically synthesized
tgttttgacttgcttgatct

SEQ ID NO: 74950 - DNA, 20 bp, Artificial Sequence
  chemically synthesized
aaataacacctgcccagatc

SEQ ID NO: 74951 - DNA, 20 bp, Artificial Sequence
  chemically synthesized
tttgacttgcttgatctggg

SEQ ID NO: 74952 - DNA, 20 bp, Artificial Sequence
  chemically synthesized
ttgacttgcttgatctgggc

SEQ ID NO: 74953 - DNA, 20 bp, Artificial Sequence
  chemically synthesized
acagagaaataacacctgcc

SEQ ID NO: 74954 - DNA, 20 bp, Artificial Sequence
  chemically synthesized
gcaggtgttatttctctgtc

SEQ ID NO: 74955 - DNA, 20 bp, Artificial Sequence
  chemically synthesized
tcaacatagtgaaccagaca

SEQ ID NO: 74956 - DNA, 20 bp, Artificial Sequence
  chemically synthesized
tatcaacatagtgaaccaga

SEQ ID NO: 74957 - DNA, 20 bp, Artificial Sequence
  chemically synthesized
gttttatcaacatagtgaac

SEQ ID NO: 74958 - DNA, 20 bp, Artificial Sequence
  chemically synthesized
aaccaatggttttatcaaca

SEQ ID NO: 74959 - DNA, 20 bp, Artificial Sequence
  chemically synthesized
cactatgttgataaaaccat

SEQ ID NO: 74960 - DNA, 20 bp, Artificial Sequence
  chemically synthesized
aatgaggtcagtgtaaccaa

SEQ ID NO: 74961 - DNA, 20 bp, Artificial Sequence
  chemically synthesized
gcaaggcttataaatgaggt

SEQ ID NO: 74962 - DNA, 20 bp, Artificial Sequence
  chemically synthesized
gttacactgacctcatttat

SEQ ID NO: 74963 - DNA, 20 bp, Artificial Sequence
  chemically synthesized
aaatgcaaggcttataaatg

SEQ ID NO: 74964 - DNA, 20 bp, Artificial Sequence
  chemically synthesized
gaaatgcaaggcttataaat

SEQ ID NO: 74965 - DNA, 20 bp, Artificial Sequence
  chemically synthesized
ttggagtgggaggaaatgca

SEQ ID NO: 74966 - DNA, 20 bp, Artificial Sequence
  chemically synthesized
tttggagtgggaggaaatgc

SEQ ID NO: 74967 - DNA, 20 bp, Artificial Sequence
  chemically synthesized
ctccttttatttggagtggg

SEQ ID NO: 74968 - DNA, 20 bp, Artificial Sequence
  chemically synthesized
gctccttttatttggagtgg

SEQ ID NO: 74969 - DNA, 20 bp, Artificial Sequence
  chemically synthesized
tggctccttttatttggagt

SEQ ID NO: 74970 - DNA, 20 bp, Artificial Sequence
  chemically synthesized
ctggctccttttatttggag

SEQ ID NO: 74971 - DNA, 20 bp, Artificial Sequence
  chemically synthesized
tttcctcccactccaaataa

SEQ ID NO: 74972 - DNA, 20 bp, Artificial Sequence
  chemically synthesized
atactggctccttttatttg

SEQ ID NO: 74973 - DNA, 20 bp, Artificial Sequence
  chemically synthesized
ttcctcccactccaaataaa

SEQ ID NO: 74974 - DNA, 20 bp, Artificial Sequence
  chemically synthesized
tcatactggctccttttatt

SEQ ID NO: 74975 - DNA, 20 bp, Artificial Sequence
  chemically synthesized
cctcccactccaaataaaag

SEQ ID NO: 74976 - DNA, 20 bp, Artificial Sequence
  chemically synthesized
ccactccaaataaaaggagc

SEQ ID NO: 74977 - DNA, 20 bp, Artificial Sequence
  chemically synthesized
cttattttgaatgttcatac

SEQ ID NO: 74978 - DNA, 20 bp, Artificial Sequence
  chemically synthesized
ccagtatgaacattcaaaat

SEQ ID NO: 74979 - DNA, 20 bp, Artificial Sequence
  chemically synthesized
agtattcaggttgatttgag

SEQ ID NO: 74980 - DNA, 20 bp, Artificial Sequence
  chemically synthesized
aagtattcaggttgatttga

SEQ ID NO: 74981 - DNA, 20 bp, Artificial Sequence
  chemically synthesized
tgaagtattcaggttgattt

SEQ ID NO: 74982 - DNA, 20 bp, Artificial Sequence
  chemically synthesized
ggtttactgatgaagtattc

SEQ ID NO: 74983 - DNA, 20 bp, Artificial Sequence
  chemically synthesized
cggtttactgatgaagtatt

SEQ ID NO: 74984 - DNA, 20 bp, Artificial Sequence
  chemically synthesized
aatcaacctgaatacttcat

SEQ ID NO: 74985 - DNA, 20 bp, Artificial Sequence
  chemically synthesized
agcaccacggtttactgatg

SEQ ID NO: 74986 - DNA, 20 bp, Artificial Sequence
  chemically synthesized
aatacttcatcagtaaaccg

SEQ ID NO: 74987 - DNA, 20 bp, Artificial Sequence
  chemically synthesized
ttatgctctatacagcacca

SEQ ID NO: 74988 - DNA, 20 bp, Artificial Sequence
  chemically synthesized
cagtaaaccgtggtgctgta

SEQ ID NO: 74989 - DNA, 20 bp, Artificial Sequence
  chemically synthesized
gtaaaccgtggtgctgtata

SEQ ID NO: 74990 - DNA, 20 bp, Artificial Sequence
  chemically synthesized
caacagtgttatgctctata

SEQ ID NO: 74991 - DNA, 20 bp, Artificial Sequence
  chemically synthesized
tagagcataacactgttgtg

SEQ ID NO: 74992 - DNA, 20 bp, Artificial Sequence
  chemically synthesized
attatctaagaactacacaa

SEQ ID NO: 74993 - DNA, 20 bp, Artificial Sequence
  chemically synthesized
taacactgttgtgtagttct

SEQ ID NO: 74994 - DNA, 20 bp, Artificial Sequence
  chemically synthesized
cacaatgttttgtattatct

SEQ ID NO: 74995 - DNA, 20 bp, Artificial Sequence
  chemically synthesized
ttaaaactttaagttcaaca

SEQ ID NO: 74996 - DNA, 20 bp, Artificial Sequence
  chemically synthesized
ttttaaaactttaagttcaa

SEQ ID NO: 74997 - DNA, 20 bp, Artificial Sequence
  chemically synthesized
taatcactctgttgaactta

SEQ ID NO: 74998 - DNA, 20 bp, Artificial Sequence
  chemically synthesized
tgaccactttttaaaacttt

SEQ ID NO: 74999 - DNA, 20 bp, Artificial Sequence
  chemically synthesized
gttgaacttaaagttttaaa

SEQ ID NO: 75000 - DNA, 20 bp, Artificial Sequence
  chemically synthesized
gaacttaaagttttaaaaag

SEQ ID NO: 75001 - DNA, 20 bp, Artificial Sequence
  chemically synthesized
gtcattaaaaacattacgtt

SEQ ID NO: 75002 - DNA, 20 bp, Artificial Sequence
  chemically synthesized
aaaacattacgttaagcaat

SEQ ID NO: 75003 - DNA, 20 bp, Artificial Sequence
  chemically synthesized
aaacattacgttaagcaatc

SEQ ID NO: 75004 - DNA, 20 bp, Artificial Sequence
  chemically synthesized
aacattacgttaagcaatca

SEQ ID NO: 75005 - DNA, 20 bp, Artificial Sequence
  chemically synthesized
acattacgttaagcaatcag

SEQ ID NO: 75006 - DNA, 20 bp, Artificial Sequence
  chemically synthesized
cattacgttaagcaatcagg

SEQ ID NO: 75007 - DNA, 20 bp, Artificial Sequence
  chemically synthesized
agcaatcagggggtttcttt

SEQ ID NO: 75008 - DNA, 20 bp, Artificial Sequence
  chemically synthesized
acattttcgttatcgtccaa

SEQ ID NO: 75009 - DNA, 20 bp, Artificial Sequence
  chemically synthesized
ggacgataacgaaaatgttc

SEQ ID NO: 75010 - DNA, 20 bp, Artificial Sequence
  chemically synthesized
ccatcaccattgtttaatac

SEQ ID NO: 75011 - DNA, 20 bp, Artificial Sequence
  chemically synthesized
aatgttctggtattaaacaa

SEQ ID NO: 75012 - DNA, 20 bp, Artificial Sequence
  chemically synthesized
ctggtattaaacaatggtga

SEQ ID NO: 75013 - DNA, 20 bp, Artificial Sequence
  chemically synthesized
gtattaaacaatggtgatgg

SEQ ID NO: 75014 - DNA, 20 bp, Artificial Sequence
  chemically synthesized
gtggtgtttagtatattcac

SEQ ID NO: 75015 - DNA, 20 bp, Artificial Sequence
  chemically synthesized
gtgtacaattcagtggtgtt

SEQ ID NO: 75016 - DNA, 20 bp, Artificial Sequence
  chemically synthesized
tttcaaagtgtacaattcag

SEQ ID NO: 75017 - DNA, 20 bp, Artificial Sequence
  chemically synthesized
ctctttcaaagtgtacaatt

SEQ ID NO: 75018 - DNA, 20 bp, Artificial Sequence
  chemically synthesized
cactgaattgtacactttga

SEQ ID NO: 75019 - DNA, 20 bp, Artificial Sequence
  chemically synthesized
ctgaattgtacactttgaaa

SEQ ID NO: 75020 - DNA, 20 bp, Artificial Sequence
  chemically synthesized
ctttaaaattcactctttca

SEQ ID NO: 75021 - DNA, 20 bp, Artificial Sequence
  chemically synthesized
ctttgaaagagtgaatttta

SEQ ID NO: 75022 - DNA, 20 bp, Artificial Sequence
  chemically synthesized
atattaataaaaacaaacaa

SEQ ID NO: 75023 - DNA, 20 bp, Artificial Sequence
  chemically synthesized
attaataaaaacaaacaaaa

SEQ ID NO: 75024 - DNA, 20 bp, Artificial Sequence
  chemically synthesized
taataaaaacaaacaaaaga

SEQ ID NO: 75025 - DNA, 20 bp, Artificial Sequence
  chemically synthesized
tgcatgtgtatggtcagaag

SEQ ID NO: 75026 - DNA, 20 bp, Artificial Sequence
  chemically synthesized
ttgcatgtgtatggtcagaa

SEQ ID NO: 75027 - DNA, 20 bp, Artificial Sequence
  chemically synthesized
tttgcatgtgtatggtcaga

SEQ ID NO: 75028 - DNA, 20 bp, Artificial Sequence
  chemically synthesized
ttttgcatgtgtatggtcag

SEQ ID NO: 75029 - DNA, 20 bp, Artificial Sequence
  chemically synthesized
tttttttgcatgtgtatggt

SEQ ID NO: 75030 - DNA, 20 bp, Artificial Sequence
  chemically synthesized
attttttttttgcatgtgta

SEQ ID NO: 75031 - DNA, 20 bp, Artificial Sequence
  chemically synthesized
cactaacacgaagttgaata

SEQ ID NO: 75032 - DNA, 20 bp, Artificial Sequence
  chemically synthesized
atctgtattcaacttcgtgt

SEQ ID NO: 75033 - DNA, 20 bp, Artificial Sequence
  chemically synthesized
agtgacattccactaacacg

SEQ ID NO: 75034 - DNA, 20 bp, Artificial Sequence
  chemically synthesized
tgtattcaacttcgtgttag

SEQ ID NO: 75035 - DNA, 20 bp, Artificial Sequence
  chemically synthesized
tcgtgttagtggaatgtcac

SEQ ID NO: 75036 - DNA, 20 bp, Artificial Sequence
  chemically synthesized
tagtggaatgtcactggaat

SEQ ID NO: 75037 - DNA, 20 bp, Artificial Sequence
  chemically synthesized
tctgaatttcacactgattc

SEQ ID NO: 75038 - DNA, 20 bp, Artificial Sequence
  chemically synthesized
actggaatcagtgtgaaatt

SEQ ID NO: 75039 - DNA, 20 bp, Artificial Sequence
  chemically synthesized
gaatcagtgtgaaattcaga

SEQ ID NO: 75040 - DNA, 20 bp, Artificial Sequence
  chemically synthesized
gtgaaattcagaaagtttta

SEQ ID NO: 75041 - DNA, 20 bp, Artificial Sequence
  chemically synthesized
tgaaattcagaaagttttat

SEQ ID NO: 75042 - DNA, 20 bp, Artificial Sequence
  chemically synthesized
gaaattcagaaagttttata

SEQ ID NO: 75043 - DNA, 20 bp, Artificial Sequence
  chemically synthesized
aaattcagaaagttttatag

SEQ ID NO: 75044 - DNA, 20 bp, Artificial Sequence
  chemically synthesized
ttcagaaagttttatagggg

SEQ ID NO: 75045 - DNA, 20 bp, Artificial Sequence
  chemically synthesized
gaaagttttataggggtgga

SEQ ID NO: 75046 - DNA, 20 bp, Artificial Sequence
  chemically synthesized
tgtatttattcataaggaaa

SEQ ID NO: 75047 - DNA, 20 bp, Artificial Sequence
  chemically synthesized
aatccatgtatttattcata

SEQ ID NO: 75048 - DNA, 20 bp, Artificial Sequence
  chemically synthesized
taatccatgtatttattcat

SEQ ID NO: 75049 - DNA, 20 bp, Artificial Sequence
  chemically synthesized
tttccttatgaataaataca

SEQ ID NO: 75050 - DNA, 20 bp, Artificial Sequence
  chemically synthesized
tgaataaatacatggattaa

SEQ ID NO: 75051 - DNA, 20 bp, Artificial Sequence
  chemically synthesized
aatacatggattaaaagtat

SEQ ID NO: 75052 - DNA, 20 bp, Artificial Sequence
  chemically synthesized
tggattaaaagtatcagaat

SEQ ID NO: 75053 - DNA, 20 bp, Artificial Sequence
  chemically synthesized
ggattaaaagtatcagaata

SEQ ID NO: 75054 - DNA, 20 bp, Artificial Sequence
  chemically synthesized
gattaaaagtatcagaataa

SEQ ID NO: 75055 - DNA, 20 bp, Artificial Sequence
  chemically synthesized
agtatcagaataagggccca

SEQ ID NO: 75056 - DNA, 20 bp, Artificial Sequence
  chemically synthesized
tatcagaataagggcccatg

SEQ ID NO: 75057 - DNA, 20 bp, Artificial Sequence
  chemically synthesized
agaataagggcccatggaga

SEQ ID NO: 75058 - DNA, 20 bp, Artificial Sequence
  chemically synthesized
tttaaaccacctttctccat

SEQ ID NO: 75059 - DNA, 20 bp, Artificial Sequence
  chemically synthesized
gaataagggcccatggagaa

SEQ ID NO: 75060 - DNA, 20 bp, Artificial Sequence
  chemically synthesized
atttaaaccacctttctcca

SEQ ID NO: 75061 - DNA, 20 bp, Artificial Sequence
  chemically synthesized
taagggcccatggagaaagg

SEQ ID NO: 75062 - DNA, 20 bp, Artificial Sequence
  chemically synthesized
gagataagtattcatatata

SEQ ID NO: 75063 - DNA, 20 bp, Artificial Sequence
  chemically synthesized
gatcatttccttttagagat

SEQ ID NO: 75064 - DNA, 20 bp, Artificial Sequence
  chemically synthesized
atatgaatacttatctctaa

SEQ ID NO: 75065 - DNA, 20 bp, Artificial Sequence
  chemically synthesized
tatgaatacttatctctaaa

SEQ ID NO: 75066 - DNA, 20 bp, Artificial Sequence
  chemically synthesized
atatggatcatttcctttta

SEQ ID NO: 75067 - DNA, 20 bp, Artificial Sequence
  chemically synthesized
taatatggatcatttccttt

SEQ ID NO: 75068 - DNA, 20 bp, Artificial Sequence
  chemically synthesized
tatgcaaaacaaaattaata

SEQ ID NO: 75069 - DNA, 20 bp, Artificial Sequence
  chemically synthesized
attaattttgttttgcataa

SEQ ID NO: 75070 - DNA, 20 bp, Artificial Sequence
  chemically synthesized
attttgttttgcataataga

SEQ ID NO: 75071 - DNA, 20 bp, Artificial Sequence
  chemically synthesized
ttttgttttgcataatagaa

SEQ ID NO: 75072 - DNA, 20 bp, Artificial Sequence
  chemically synthesized
gttttgcataatagaaaggt

SEQ ID NO: 75073 - DNA, 20 bp, Artificial Sequence
  chemically synthesized
ataatagaaaggttagaaaa

SEQ ID NO: 75074 - DNA, 20 bp, Artificial Sequence
  chemically synthesized
agtttcccccattgacattt

SEQ ID NO: 75075 - DNA, 20 bp, Artificial Sequence
  chemically synthesized
acagatttcttaaatgtcaa

SEQ ID NO: 75076 - DNA, 20 bp, Artificial Sequence
  chemically synthesized
cagatttcttaaatgtcaat

SEQ ID NO: 75077 - DNA, 20 bp, Artificial Sequence
  chemically synthesized
agatttcttaaatgtcaatg

SEQ ID NO: 75078 - DNA, 20 bp, Artificial Sequence
  chemically synthesized
gatttcttaaatgtcaatgg

SEQ ID NO: 75079 - DNA, 20 bp, Artificial Sequence
  chemically synthesized
aaatgtcaatgggggaaact

SEQ ID NO: 75080 - DNA, 20 bp, Artificial Sequence
  chemically synthesized
tcaatgggggaaacttggac

SEQ ID NO: 75081 - DNA, 20 bp, Artificial Sequence
  chemically synthesized
caatgggggaaacttggaca

SEQ ID NO: 75082 - DNA, 20 bp, Artificial Sequence
  chemically synthesized
tgtaaccgttgtccttgtcc

SEQ ID NO: 75083 - DNA, 20 bp, Artificial Sequence
  chemically synthesized
ggaaacttggacaaggacaa

SEQ ID NO: 75084 - DNA, 20 bp, Artificial Sequence
  chemically synthesized
aaaatgaaatcattctcttc

SEQ ID NO: 75085 - DNA, 20 bp, Artificial Sequence
  chemically synthesized
atgcacgttattatccagaa

SEQ ID NO: 75086 - DNA, 20 bp, Artificial Sequence
  chemically synthesized
aaatgcacgttattatccag

SEQ ID NO: 75087 - DNA, 20 bp, Artificial Sequence
  chemically synthesized
tagaaatgcacgttattatc

SEQ ID NO: 75088 - DNA, 20 bp, Artificial Sequence
  chemically synthesized
tggataataacgtgcatttc

SEQ ID NO: 75089 - DNA, 20 bp, Artificial Sequence
  chemically synthesized
ataataacgtgcatttctag

SEQ ID NO: 75090 - DNA, 20 bp, Artificial Sequence
  chemically synthesized
tgatatttatttgtggctac

SEQ ID NO: 75091 - DNA, 20 bp, Artificial Sequence
  chemically synthesized
cctcacatgatatttatttg

SEQ ID NO: 75092 - DNA, 20 bp, Artificial Sequence
  chemically synthesized
gccacaaataaatatcatgt

SEQ ID NO: 75093 - DNA, 20 bp, Artificial Sequence
  chemically synthesized
ccacaaataaatatcatgtg

SEQ ID NO: 75094 - DNA, 20 bp, Artificial Sequence
  chemically synthesized
cacaaataaatatcatgtga

SEQ ID NO: 75095 - DNA, 20 bp, Artificial Sequence
  chemically synthesized
acaaataaatatcatgtgag

SEQ ID NO: 75096 - DNA, 20 bp, Artificial Sequence
  chemically synthesized
atgtgaggggaaactgtaaa

SEQ ID NO: 75097 - DNA, 20 bp, Artificial Sequence
  chemically synthesized
tgtgaggggaaactgtaaac

SEQ ID NO: 75098 - DNA, 20 bp, Artificial Sequence
  chemically synthesized
tctgcagaggttcctgttta

SEQ ID NO: 75099 - DNA, 20 bp, Artificial Sequence
  chemically synthesized
actgtaaacaggaacctctg

SEQ ID NO: 75100 - DNA, 20 bp, Artificial Sequence
  chemically synthesized
tgtaaacaggaacctctgca

SEQ ID NO: 75101 - DNA, 20 bp, Artificial Sequence
  chemically synthesized
taaacaggaacctctgcaga

SEQ ID NO: 75102 - DNA, 20 bp, Artificial Sequence
  chemically synthesized
ctggcttgccctctctgcag

SEQ ID NO: 75103 - DNA, 20 bp, Artificial Sequence
  chemically synthesized
aaacaggaacctctgcagag

SEQ ID NO: 75104 - DNA, 20 bp, Artificial Sequence
  chemically synthesized
gctggcttgccctctctgca

SEQ ID NO: 75105 - DNA, 20 bp, Artificial Sequence
  chemically synthesized
aacaggaacctctgcagaga

SEQ ID NO: 75106 - DNA, 20 bp, Artificial Sequence
  chemically synthesized
ctgctggcttgccctctctg

SEQ ID NO: 75107 - DNA, 20 bp, Artificial Sequence
  chemically synthesized
ggaacctctgcagagagggc

SEQ ID NO: 75108 - DNA, 20 bp, Artificial Sequence
  chemically synthesized
cctctgcagagagggcaagc

SEQ ID NO: 75109 - DNA, 20 bp, Artificial Sequence
  chemically synthesized
ctgcagagagggcaagccag

SEQ ID NO: 75110 - DNA, 20 bp, Artificial Sequence
  chemically synthesized
tgcagagagggcaagccagc

SEQ ID NO: 75111 - DNA, 20 bp, Artificial Sequence
  chemically synthesized
agagagggcaagccagcagg

SEQ ID NO: 75112 - DNA, 20 bp, Artificial Sequence
  chemically synthesized
cactgaaagatgctgcctgc

SEQ ID NO: 75113 - DNA, 20 bp, Artificial Sequence
  chemically synthesized
agccagcaggcagcatcttt

SEQ ID NO: 75114 - DNA, 20 bp, Artificial Sequence
  chemically synthesized
ggactcacctgtatcactga

SEQ ID NO: 75115 - DNA, 20 bp, Artificial Sequence
  chemically synthesized
ggcagcatctttcagtgata

SEQ ID NO: 75116 - DNA, 20 bp, Artificial Sequence
  chemically synthesized
gcagcatctttcagtgatac

SEQ ID NO: 75117 - DNA, 20 bp, Artificial Sequence
  chemically synthesized
catctttcagtgatacaggt

SEQ ID NO: 75118 - DNA, 20 bp, Artificial Sequence
  chemically synthesized
aagagagatgattagcacaa

SEQ ID NO: 75119 - DNA, 20 bp, Artificial Sequence
  chemically synthesized
aaagagagatgattagcaca

SEQ ID NO: 75120 - DNA, 20 bp, Artificial Sequence
  chemically synthesized
tgcttgtaaagagagatgat

SEQ ID NO: 75121 - DNA, 20 bp, Artificial Sequence
  chemically synthesized
tgctaatcatctctctttac

SEQ ID NO: 75122 - DNA, 20 bp, Artificial Sequence
  chemically synthesized
gagagtcttgcttgtaaaga

SEQ ID NO: 75123 - DNA, 20 bp, Artificial Sequence
  chemically synthesized
ttgagagtcttgcttgtaaa

SEQ ID NO: 75124 - DNA, 20 bp, Artificial Sequence
  chemically synthesized
aatcatctctctttacaagc

SEQ ID NO: 75125 - DNA, 20 bp, Artificial Sequence
  chemically synthesized
gcttgagagtcttgcttgta

SEQ ID NO: 75126 - DNA, 20 bp, Artificial Sequence
  chemically synthesized
tctttacaagcaagactctc

SEQ ID NO: 75127 - DNA, 20 bp, Artificial Sequence
  chemically synthesized
taatcaacttaatggcttga

SEQ ID NO: 75128 - DNA, 20 bp, Artificial Sequence
  chemically synthesized
gataatcaacttaatggctt

SEQ ID NO: 75129 - DNA, 20 bp, Artificial Sequence
  chemically synthesized
agcaagactctcaagccatt

SEQ ID NO: 75130 - DNA, 20 bp, Artificial Sequence
  chemically synthesized
aggtaggataatcaacttaa

SEQ ID NO: 75131 - DNA, 20 bp, Artificial Sequence
  chemically synthesized
tagctatggcttaacgaggt

SEQ ID NO: 75132 - DNA, 20 bp, Artificial Sequence
  chemically synthesized
gttgattatcctacctcgtt

SEQ ID NO: 75133 - DNA, 20 bp, Artificial Sequence
  chemically synthesized
ctagctatggcttaacgagg

SEQ ID NO: 75134 - DNA, 20 bp, Artificial Sequence
  chemically synthesized
aatctagctatggcttaacg

SEQ ID NO: 75135 - DNA, 20 bp, Artificial Sequence
  chemically synthesized
aaatctagctatggcttaac

SEQ ID NO: 75136 - DNA, 20 bp, Artificial Sequence
  chemically synthesized
tatcctacctcgttaagcca

SEQ ID NO: 75137 - DNA, 20 bp, Artificial Sequence
  chemically synthesized
ctacctcgttaagccatagc

SEQ ID NO: 75138 - DNA, 20 bp, Artificial Sequence
  chemically synthesized
agggaactgaaatctagcta

SEQ ID NO: 75139 - DNA, 20 bp, Artificial Sequence
  chemically synthesized
gttaagccatagctagattt

SEQ ID NO: 75140 - DNA, 20 bp, Artificial Sequence
  chemically synthesized
acctaaagggaactgaaatc

SEQ ID NO: 75141 - DNA, 20 bp, Artificial Sequence
  chemically synthesized
agctagatttcagttccctt

SEQ ID NO: 75142 - DNA, 20 bp, Artificial Sequence
  chemically synthesized
gctagatttcagttcccttt

SEQ ID NO: 75143 - DNA, 20 bp, Artificial Sequence
  chemically synthesized
tgtacattgtgtcacctaaa

SEQ ID NO: 75144 - DNA, 20 bp, Artificial Sequence
  chemically synthesized
atgtacattgtgtcacctaa

SEQ ID NO: 75145 - DNA, 20 bp, Artificial Sequence
  chemically synthesized
aatgtacattgtgtcaccta

SEQ ID NO: 75146 - DNA, 20 bp, Artificial Sequence
  chemically synthesized
cattttcaaatgtctcttat

SEQ ID NO: 75147 - DNA, 20 bp, Artificial Sequence
  chemically synthesized
aaatcaaaatattctaataa

SEQ ID NO: 75148 - DNA, 20 bp, Artificial Sequence
  chemically synthesized
gaaaatcaaaatattctaat

SEQ ID NO: 75149 - DNA, 20 bp, Artificial Sequence
  chemically synthesized
gtgtgctcaggaatttggga

SEQ ID NO: 75150 - DNA, 20 bp, Artificial Sequence
  chemically synthesized
atgtgtgctcaggaatttgg

SEQ ID NO: 75151 - DNA, 20 bp, Artificial Sequence
  chemically synthesized
atatgtgtgctcaggaattt

SEQ ID NO: 75152 - DNA, 20 bp, Artificial Sequence
  chemically synthesized
attttctctcccaaattcct

SEQ ID NO: 75153 - DNA, 20 bp, Artificial Sequence
  chemically synthesized
aatatgtgtgctcaggaatt

SEQ ID NO: 75154 - DNA, 20 bp, Artificial Sequence
  chemically synthesized
caggattaatatgtgtgctc

SEQ ID NO: 75155 - DNA, 20 bp, Artificial Sequence
  chemically synthesized
gcaggattaatatgtgtgct

SEQ ID NO: 75156 - DNA, 20 bp, Artificial Sequence
  chemically synthesized
atcctccaaaacattgaagc

SEQ ID NO: 75157 - DNA, 20 bp, Artificial Sequence
  chemically synthesized
catcctccaaaacattgaag

SEQ ID NO: 75158 - DNA, 20 bp, Artificial Sequence
  chemically synthesized
cttcatcctccaaaacattg

SEQ ID NO: 75159 - DNA, 20 bp, Artificial Sequence
  chemically synthesized
ttaatcctgcttcaatgttt

SEQ ID NO: 75160 - DNA, 20 bp, Artificial Sequence
  chemically synthesized
aatcctgcttcaatgttttg

SEQ ID NO: 75161 - DNA, 20 bp, Artificial Sequence
  chemically synthesized
atcctgcttcaatgttttgg

SEQ ID NO: 75162 - DNA, 20 bp, Artificial Sequence
  chemically synthesized
cttcaatgttttggaggatg

SEQ ID NO: 75163 - DNA, 20 bp, Artificial Sequence
  chemically synthesized
ttcaatgttttggaggatga

SEQ ID NO: 75164 - DNA, 20 bp, Artificial Sequence
  chemically synthesized
tcaatgttttggaggatgaa

SEQ ID NO: 75165 - DNA, 20 bp, Artificial Sequence
  chemically synthesized
caatgttttggaggatgaag

SEQ ID NO: 75166 - DNA, 20 bp, Artificial Sequence
  chemically synthesized
gatgaaggggattcaaaaat

SEQ ID NO: 75167 - DNA, 20 bp, Artificial Sequence
  chemically synthesized
ggggattcaaaaataagttt

SEQ ID NO: 75168 - DNA, 20 bp, Artificial Sequence
  chemically synthesized
agagcattgcaattaattat

SEQ ID NO: 75169 - DNA, 20 bp, Artificial Sequence
  chemically synthesized
aaaaaaaagaggaaaaggga

SEQ ID NO: 75170 - DNA, 20 bp, Artificial Sequence
  chemically synthesized
gaaaaaaaaagaggaaaagg

SEQ ID NO: 75171 - DNA, 20 bp, Artificial Sequence
  chemically synthesized
aagaaaaaaaaagaggaaaa

SEQ ID NO: 75172 - DNA, 20 bp, Artificial Sequence
  chemically synthesized
aaagaaaaaaaaagaggaaa

SEQ ID NO: 75173 - DNA, 20 bp, Artificial Sequence
  chemically synthesized
aaaagaaaaaaaaagaggaa

SEQ ID NO: 75174 - DNA, 20 bp, Artificial Sequence
  chemically synthesized
ttttaaaaagaaaaaaaaag

SEQ ID NO: 75175 - DNA, 20 bp, Artificial Sequence
  chemically synthesized
attttaaaaagaaaaaaaaa

SEQ ID NO: 75176 - DNA, 20 bp, Artificial Sequence
  chemically synthesized
aaattttaaaaagaaaaaaa

SEQ ID NO: 75177 - DNA, 20 bp, Artificial Sequence
  chemically synthesized
gaagaaaagtaaattttaaa

SEQ ID NO: 75178 - DNA, 20 bp, Artificial Sequence
  chemically synthesized
tggtaaagtttaaagaagaa

SEQ ID NO: 75179 - DNA, 20 bp, Artificial Sequence
  chemically synthesized
tcttatggtaaagtttaaag

SEQ ID NO: 75180 - DNA, 20 bp, Artificial Sequence
  chemically synthesized
agatcttatggtaaagttta

SEQ ID NO: 75181 - DNA, 20 bp, Artificial Sequence
  chemically synthesized
tcttctttaaactttaccat

SEQ ID NO: 75182 - DNA, 20 bp, Artificial Sequence
  chemically synthesized
aatcccaagatcttatggta

SEQ ID NO: 75183 - DNA, 20 bp, Artificial Sequence
  chemically synthesized
aaaaaaatcccaagatctta

SEQ ID NO: 75184 - DNA, 20 bp, Artificial Sequence
  chemically synthesized
taaactttaccataagatct

SEQ ID NO: 75185 - DNA, 20 bp, Artificial Sequence
  chemically synthesized
aaactttaccataagatctt

SEQ ID NO: 75186 - DNA, 20 bp, Artificial Sequence
  chemically synthesized
aaaaaaaaaaaaaaaatccc

SEQ ID NO: 75187 - DNA, 20 bp, Artificial Sequence
  chemically synthesized
tttttttttttgcttctttc

SEQ ID NO: 75188 - DNA, 20 bp, Artificial Sequence
  chemically synthesized
ccactatcattgcttgaaag

SEQ ID NO: 75189 - DNA, 20 bp, Artificial Sequence
  chemically synthesized
cttccactatcattgcttga

SEQ ID NO: 75190 - DNA, 20 bp, Artificial Sequence
  chemically synthesized
ttgcttctttcaagcaatga

SEQ ID NO: 75191 - DNA, 20 bp, Artificial Sequence
  chemically synthesized
cttctttcaagcaatgatag

SEQ ID NO: 75192 - DNA, 20 bp, Artificial Sequence
  chemically synthesized
ctttcaagcaatgatagtgg

SEQ ID NO: 75193 - DNA, 20 bp, Artificial Sequence
  chemically synthesized
cttaagtggagattagttca

SEQ ID NO: 75194 - DNA, 20 bp, Artificial Sequence
  chemically synthesized
gtcttaagtggagattagtt

SEQ ID NO: 75195 - DNA, 20 bp, Artificial Sequence
  chemically synthesized
ggtgagtcttaagtggagat

SEQ ID NO: 75196 - DNA, 20 bp, Artificial Sequence
  chemically synthesized
ctctgaactaatctccactt

SEQ ID NO: 75197 - DNA, 20 bp, Artificial Sequence
  chemically synthesized
aatttggtgagtcttaagtg

SEQ ID NO: 75198 - DNA, 20 bp, Artificial Sequence
  chemically synthesized
ctaatttggtgagtcttaag

SEQ ID NO: 75199 - DNA, 20 bp, Artificial Sequence
  chemically synthesized
tggctaatttggtgagtctt

SEQ ID NO: 75200 - DNA, 20 bp, Artificial Sequence
  chemically synthesized
ccacttaagactcaccaaat

SEQ ID NO: 75201 - DNA, 20 bp, Artificial Sequence
  chemically synthesized
aagactttggctaatttggt

SEQ ID NO: 75202 - DNA, 20 bp, Artificial Sequence
  chemically synthesized
aatgaagactttggctaatt

SEQ ID NO: 75203 - DNA, 20 bp, Artificial Sequence
  chemically synthesized
aagactcaccaaattagcca

SEQ ID NO: 75204 - DNA, 20 bp, Artificial Sequence
  chemically synthesized
cacaaagagaatgaagactt

SEQ ID NO: 75205 - DNA, 20 bp, Artificial Sequence
  chemically synthesized
gctgtttcacaaagagaatg

SEQ ID NO: 75206 - DNA, 20 bp, Artificial Sequence
  chemically synthesized
catcactgctgtttcacaaa

SEQ ID NO: 75207 - DNA, 20 bp, Artificial Sequence
  chemically synthesized
tcttcattctctttgtgaaa

SEQ ID NO: 75208 - DNA, 20 bp, Artificial Sequence
  chemically synthesized
cccatcactgctgtttcaca

SEQ ID NO: 75209 - DNA, 20 bp, Artificial Sequence
  chemically synthesized
tcattctctttgtgaaacag

SEQ ID NO: 75210 - DNA, 20 bp, Artificial Sequence
  chemically synthesized
tctttgtgaaacagcagtga

SEQ ID NO: 75211 - DNA, 20 bp, Artificial Sequence
  chemically synthesized
ctttgtgaaacagcagtgat

SEQ ID NO: 75212 - DNA, 20 bp, Artificial Sequence
  chemically synthesized
gcagtgatgggaacctctca

SEQ ID NO: 75213 - DNA, 20 bp, Artificial Sequence
  chemically synthesized
cattttattgaggctgtgag

SEQ ID NO: 75214 - DNA, 20 bp, Artificial Sequence
  chemically synthesized
acattttattgaggctgtga

SEQ ID NO: 75215 - DNA, 20 bp, Artificial Sequence
  chemically synthesized
gaacattttattgaggctgt

SEQ ID NO: 75216 - DNA, 20 bp, Artificial Sequence
  chemically synthesized
gcacctcgaacattttattg

SEQ ID NO: 75217 - DNA, 20 bp, Artificial Sequence
  chemically synthesized
ggcacctcgaacattttatt

SEQ ID NO: 75218 - DNA, 20 bp, Artificial Sequence
  chemically synthesized
acagcctcaataaaatgttc

SEQ ID NO: 75219 - DNA, 20 bp, Artificial Sequence
  chemically synthesized
cagcctcaataaaatgttcg

SEQ ID NO: 75220 - DNA, 20 bp, Artificial Sequence
  chemically synthesized
aaaatgttcgaggtgcctgt

SEQ ID NO: 75221 - DNA, 20 bp, Artificial Sequence
  chemically synthesized
gaaggtccacacatactgac

SEQ ID NO: 75222 - DNA, 20 bp, Artificial Sequence
  chemically synthesized
agaaggtccacacatactga

SEQ ID NO: 75223 - DNA, 20 bp, Artificial Sequence
  chemically synthesized
gaggtgcctgtcagtatgtg

SEQ ID NO: 75224 - DNA, 20 bp, Artificial Sequence
  chemically synthesized
agtcaactgatgggagcaga

SEQ ID NO: 75225 - DNA, 20 bp, Artificial Sequence
  chemically synthesized
aagtcaactgatgggagcag

SEQ ID NO: 75226 - DNA, 20 bp, Artificial Sequence
  chemically synthesized
tgtggaccttctgctcccat

SEQ ID NO: 75227 - DNA, 20 bp, Artificial Sequence
  chemically synthesized
aacaagtcaactgatgggag

SEQ ID NO: 75228 - DNA, 20 bp, Artificial Sequence
  chemically synthesized
tgtaacaagtcaactgatgg

SEQ ID NO: 75229 - DNA, 20 bp, Artificial Sequence
  chemically synthesized
gttgtaacaagtcaactgat

SEQ ID NO: 75230 - DNA, 20 bp, Artificial Sequence
  chemically synthesized
ggttgtaacaagtcaactga

SEQ ID NO: 75231 - DNA, 20 bp, Artificial Sequence
  chemically synthesized
acacaactgacggttgtaac

SEQ ID NO: 75232 - DNA, 20 bp, Artificial Sequence
  chemically synthesized
agttgacttgttacaaccgt

SEQ ID NO: 75233 - DNA, 20 bp, Artificial Sequence
  chemically synthesized
gagaacatacacacaactga

SEQ ID NO: 75234 - DNA, 20 bp, Artificial Sequence
  chemically synthesized
ttactggcaaagataggttt

SEQ ID NO: 75235 - DNA, 20 bp, Artificial Sequence
  chemically synthesized
caacagttactggcaaagat

SEQ ID NO: 75236 - DNA, 20 bp, Artificial Sequence
  chemically synthesized
gttctcaaacctatctttgc

SEQ ID NO: 75237 - DNA, 20 bp, Artificial Sequence
  chemically synthesized
acaacagttactggcaaaga

SEQ ID NO: 75238 - DNA, 20 bp, Artificial Sequence
  chemically synthesized
aatcacaacagttactggca

SEQ ID NO: 75239 - DNA, 20 bp, Artificial Sequence
  chemically synthesized
tacataatcacaacagttac

SEQ ID NO: 75240 - DNA, 20 bp, Artificial Sequence
  chemically synthesized
attaaattacataatcacaa

SEQ ID NO: 75241 - DNA, 20 bp, Artificial Sequence
  chemically synthesized
tgtgattatgtaatttaata

SEQ ID NO: 75242 - DNA, 20 bp, Artificial Sequence
  chemically synthesized
attatgtaatttaataaaga

SEQ ID NO: 75243 - DNA, 20 bp, Artificial Sequence
  chemically synthesized
aactaatatttttatgattt

SEQ ID NO: 75244 - DNA, 20 bp, Artificial Sequence
  chemically synthesized
aaactaatatttttatgatt

SEQ ID NO: 75245 - DNA, 20 bp, Artificial Sequence
  chemically synthesized
ttcctaaatcataaaaatat

SEQ ID NO: 75246 - DNA, 20 bp, Artificial Sequence
  chemically synthesized
cataaaaatattagtttaaa

SEQ ID NO: 75247 - DNA, 20 bp, Artificial Sequence
  chemically synthesized
aaatattagtttaaaaagaa

SEQ ID NO: 75248 - DNA, 20 bp, Artificial Sequence
  chemically synthesized
agtttaaaaagaaaagaaaa

SEQ ID NO: 75249 - DNA, 20 bp, Artificial Sequence
  chemically synthesized
gttattatttctataaaaac

SEQ ID NO: 75250 - DNA, 20 bp, Artificial Sequence
  chemically synthesized
agtatttggcctggttttta

SEQ ID NO: 75251 - DNA, 20 bp, Artificial Sequence
  chemically synthesized
ttattatttctataaaaacc

SEQ ID NO: 75252 - DNA, 20 bp, Artificial Sequence
  chemically synthesized
actctccagagtatttggcc

SEQ ID NO: 75253 - DNA, 20 bp, Artificial Sequence
  chemically synthesized
aaaaaccaggccaaatactc

SEQ ID NO: 75254 - DNA, 20 bp, Artificial Sequence
  chemically synthesized
aagcaactctccagagtatt

SEQ ID NO: 75255 - DNA, 20 bp, Artificial Sequence
  chemically synthesized
aaaccaggccaaatactctg

SEQ ID NO: 75256 - DNA, 20 bp, Artificial Sequence
  chemically synthesized
accaggccaaatactctgga

SEQ ID NO: 75257 - DNA, 20 bp, Artificial Sequence
  chemically synthesized
ctttttgaagcaactctcca

SEQ ID NO: 75258 - DNA, 20 bp, Artificial Sequence
  chemically synthesized
ttctttttgaagcaactctc

SEQ ID NO: 75259 - DNA, 20 bp, Artificial Sequence
  chemically synthesized
ctctggagagttgcttcaaa

SEQ ID NO: 75260 - DNA, 20 bp, Artificial Sequence
  chemically synthesized
ttattttctttttctttttg

SEQ ID NO: 75261 - DNA, 20 bp, Artificial Sequence
  chemically synthesized
agagttgcttcaaaaagaaa

SEQ ID NO: 75262 - DNA, 20 bp, Artificial Sequence
  chemically synthesized
aaagaaaataaatattgttg

SEQ ID NO: 75263 - DNA, 20 bp, Artificial Sequence
  chemically synthesized
gaaaataaatattgttgaag

SEQ ID NO: 75264 - DNA, 20 bp, Artificial Sequence
  chemically synthesized
ttgttgaagtagttgtgaac

SEQ ID NO: 75265 - DNA, 20 bp, Artificial Sequence
  chemically synthesized
tgtgaacaagacaactgcta

SEQ ID NO: 75266 - DNA, 20 bp, Artificial Sequence
  chemically synthesized
gttgttttcttcatctttag

SEQ ID NO: 75267 - DNA, 20 bp, Artificial Sequence
  chemically synthesized
caagacaactgctaaagatg

SEQ ID NO: 75268 - DNA, 20 bp, Artificial Sequence
  chemically synthesized
tgggttgttttcttcatctt

SEQ ID NO: 75269 - DNA, 20 bp, Artificial Sequence
  chemically synthesized
taaagatgaagaaaacaacc

SEQ ID NO: 75270 - DNA, 20 bp, Artificial Sequence
  chemically synthesized
atgaagaaaacaacccagac

SEQ ID NO: 75271 - DNA, 20 bp, Artificial Sequence
  chemically synthesized
tgaagaaaacaacccagacc

SEQ ID NO: 75272 - DNA, 20 bp, Artificial Sequence
  chemically synthesized
tgagccaccccacctggtct

SEQ ID NO: 75273 - DNA, 20 bp, Artificial Sequence
  chemically synthesized
agaaaacaacccagaccagg

SEQ ID NO: 75274 - DNA, 20 bp, Artificial Sequence
  chemically synthesized
ttgagccaccccacctggtc

SEQ ID NO: 75275 - DNA, 20 bp, Artificial Sequence
  chemically synthesized
gaaaacaacccagaccaggt

SEQ ID NO: 75276 - DNA, 20 bp, Artificial Sequence
  chemically synthesized
aaaacaacccagaccaggtg

SEQ ID NO: 75277 - DNA, 20 bp, Artificial Sequence
  chemically synthesized
acaacccagaccaggtgggg

SEQ ID NO: 75278 - DNA, 20 bp, Artificial Sequence
  chemically synthesized
cagtcttgagccaccccacc

SEQ ID NO: 75279 - DNA, 20 bp, Artificial Sequence
  chemically synthesized
cagaccaggtggggtggctc

SEQ ID NO: 75280 - DNA, 20 bp, Artificial Sequence
  chemically synthesized
agtgctgggattacagtctt

SEQ ID NO: 75281 - DNA, 20 bp, Artificial Sequence
  chemically synthesized
gtggctcaagactgtaatcc

SEQ ID NO: 75282 - DNA, 20 bp, Artificial Sequence
  chemically synthesized
ctcccaaagtgctgggatta

SEQ ID NO: 75283 - DNA, 20 bp, Artificial Sequence
  chemically synthesized
agactgtaatcccagcactt

SEQ ID NO: 75284 - DNA, 20 bp, Artificial Sequence
  chemically synthesized
cctcagcctcccaaagtgct

SEQ ID NO: 75285 - DNA, 20 bp, Artificial Sequence
  chemically synthesized
gactgtaatcccagcacttt

SEQ ID NO: 75286 - DNA, 20 bp, Artificial Sequence
  chemically synthesized
acctcagcctcccaaagtgc

SEQ ID NO: 75287 - DNA, 20 bp, Artificial Sequence
  chemically synthesized
ctgtaatcccagcactttgg

SEQ ID NO: 75288 - DNA, 20 bp, Artificial Sequence
  chemically synthesized
tgtaatcccagcactttggg

SEQ ID NO: 75289 - DNA, 20 bp, Artificial Sequence
  chemically synthesized
ccacccacctcagcctccca

SEQ ID NO: 75290 - DNA, 20 bp, Artificial Sequence
  chemically synthesized
tcccagcactttgggaggct

SEQ ID NO: 75291 - DNA, 20 bp, Artificial Sequence
  chemically synthesized
cccagcactttgggaggctg

SEQ ID NO: 75292 - DNA, 20 bp, Artificial Sequence
  chemically synthesized
agcactttgggaggctgagg

SEQ ID NO: 75293 - DNA, 20 bp, Artificial Sequence
  chemically synthesized
gcactttgggaggctgaggt

SEQ ID NO: 75294 - DNA, 20 bp, Artificial Sequence
  chemically synthesized
ctttgggaggctgaggtggg

SEQ ID NO: 75295 - DNA, 20 bp, Artificial Sequence
  chemically synthesized
atccacccatccacccacct

SEQ ID NO: 75296 - DNA, 20 bp, Artificial Sequence
  chemically synthesized
gggaggctgaggtgggtgga

SEQ ID NO: 75297 - DNA, 20 bp, Artificial Sequence
  chemically synthesized
ggaggctgaggtgggtggat

SEQ ID NO: 75298 - DNA, 20 bp, Artificial Sequence
  chemically synthesized
ggctgaggtgggtggatggg

SEQ ID NO: 75299 - DNA, 20 bp, Artificial Sequence
  chemically synthesized
ggtggatgggtggatcactt

SEQ ID NO: 75300 - DNA, 20 bp, Artificial Sequence
  chemically synthesized
gtggatgggtggatcacttg

SEQ ID NO: 75301 - DNA, 20 bp, Artificial Sequence
  chemically synthesized
atgggtggatcacttgaggt

SEQ ID NO: 75302 - DNA, 20 bp, Artificial Sequence
  chemically synthesized
ggtctcgaactgctgacctc

SEQ ID NO: 75303 - DNA, 20 bp, Artificial Sequence
  chemically synthesized
ggtggatcacttgaggtcag

SEQ ID NO: 75304 - DNA, 20 bp, Artificial Sequence
  chemically synthesized
tcacttgaggtcagcagttc

SEQ ID NO: 75305 - DNA, 20 bp, Artificial Sequence
  chemically synthesized
tgaggtcagcagttcgagac

SEQ ID NO: 75306 - DNA, 20 bp, Artificial Sequence
  chemically synthesized
tcagcagttcgagaccagac

SEQ ID NO: 75307 - DNA, 20 bp, Artificial Sequence
  chemically synthesized
tttcaccatgttggccagtc

SEQ ID NO: 75308 - DNA, 20 bp, Artificial Sequence
  chemically synthesized
cgagaccagactggccaaca

SEQ ID NO: 75309 - DNA, 20 bp, Artificial Sequence
  chemically synthesized
cagggtttcaccatgttggc

SEQ ID NO: 75310 - DNA, 20 bp, Artificial Sequence
  chemically synthesized
gagacagggtttcaccatgt

SEQ ID NO: 75311 - DNA, 20 bp, Artificial Sequence
  chemically synthesized
ttgtatctttagtagagaca

SEQ ID NO: 75312 - DNA, 20 bp, Artificial Sequence
  chemically synthesized
tttgtatctttagtagagac

SEQ ID NO: 75313 - DNA, 20 bp, Artificial Sequence
  chemically synthesized
ttttgtatctttagtagaga

SEQ ID NO: 75314 - DNA, 20 bp, Artificial Sequence
  chemically synthesized
gtgaaaccctgtctctacta

SEQ ID NO: 75315 - DNA, 20 bp, Artificial Sequence
  chemically synthesized
taatttttgtatctttagta

SEQ ID NO: 75316 - DNA, 20 bp, Artificial Sequence
  chemically synthesized
aataatttttgtatctttag

SEQ ID NO: 75317 - DNA, 20 bp, Artificial Sequence
  chemically synthesized
ccgaataatttttgtatctt

SEQ ID NO: 75318 - DNA, 20 bp, Artificial Sequence
  chemically synthesized
ctaaagatacaaaaattatt

SEQ ID NO: 75319 - DNA, 20 bp, Artificial Sequence
  chemically synthesized
taaagatacaaaaattattc

SEQ ID NO: 75320 - DNA, 20 bp, Artificial Sequence
  chemically synthesized
atacaaaaattattcgggcg

SEQ ID NO: 75321 - DNA, 20 bp, Artificial Sequence
  chemically synthesized
caaaaattattcgggcgtgg

SEQ ID NO: 75322 - DNA, 20 bp, Artificial Sequence
  chemically synthesized
ggcgtggtggcacatgcctg

SEQ ID NO: 75323 - DNA, 20 bp, Artificial Sequence
  chemically synthesized
gtggcacatgcctgtagtac

SEQ ID NO: 75324 - DNA, 20 bp, Artificial Sequence
  chemically synthesized
ccctgagtagctggtactac

SEQ ID NO: 75325 - DNA, 20 bp, Artificial Sequence
  chemically synthesized
cccctgagtagctggtacta

SEQ ID NO: 75326 - DNA, 20 bp, Artificial Sequence
  chemically synthesized
tgcctgtagtaccagctact

SEQ ID NO: 75327 - DNA, 20 bp, Artificial Sequence
  chemically synthesized
gcctgtagtaccagctactc

SEQ ID NO: 75328 - DNA, 20 bp, Artificial Sequence
  chemically synthesized
gcctcagccccctgagtagc

SEQ ID NO: 75329 - DNA, 20 bp, Artificial Sequence
  chemically synthesized
cctgtagtaccagctactca

SEQ ID NO: 75330 - DNA, 20 bp, Artificial Sequence
  chemically synthesized
ctgtagtaccagctactcag

SEQ ID NO: 75331 - DNA, 20 bp, Artificial Sequence
  chemically synthesized
tgtagtaccagctactcagg

SEQ ID NO: 75332 - DNA, 20 bp, Artificial Sequence
  chemically synthesized
tcatgcctcagccccctgag

SEQ ID NO: 75333 - DNA, 20 bp, Artificial Sequence
  chemically synthesized
ttctcatgcctcagccccct

SEQ ID NO: 75334 - DNA, 20 bp, Artificial Sequence
  chemically synthesized
taccagctactcagggggct

SEQ ID NO: 75335 - DNA, 20 bp, Artificial Sequence
  chemically synthesized
accagctactcagggggctg

SEQ ID NO: 75336 - DNA, 20 bp, Artificial Sequence
  chemically synthesized
tactcagggggctgaggcat

SEQ ID NO: 75337 - DNA, 20 bp, Artificial Sequence
  chemically synthesized
ttcaagcgcttctcatgcct

SEQ ID NO: 75338 - DNA, 20 bp, Artificial Sequence
  chemically synthesized
tcagggggctgaggcatgag

SEQ ID NO: 75339 - DNA, 20 bp, Artificial Sequence
  chemically synthesized
gcatgagaagcgcttgaacc

SEQ ID NO: 75340 - DNA, 20 bp, Artificial Sequence
  chemically synthesized
catgagaagcgcttgaacct

SEQ ID NO: 75341 - DNA, 20 bp, Artificial Sequence
  chemically synthesized
aacctccacctcccaggttc

SEQ ID NO: 75342 - DNA, 20 bp, Artificial Sequence
  chemically synthesized
tgagaagcgcttgaacctgg

SEQ ID NO: 75343 - DNA, 20 bp, Artificial Sequence
  chemically synthesized
gagaagcgcttgaacctggg

SEQ ID NO: 75344 - DNA, 20 bp, Artificial Sequence
  chemically synthesized
aagcgcttgaacctgggagg

SEQ ID NO: 75345 - DNA, 20 bp, Artificial Sequence
  chemically synthesized
cactgcaacctccacctccc

SEQ ID NO: 75346 - DNA, 20 bp, Artificial Sequence
  chemically synthesized
gcgcttgaacctgggaggtg

SEQ ID NO: 75347 - DNA, 20 bp, Artificial Sequence
  chemically synthesized
tcactgcaacctccacctcc

SEQ ID NO: 75348 - DNA, 20 bp, Artificial Sequence
  chemically synthesized
cgcttgaacctgggaggtgg

SEQ ID NO: 75349 - DNA, 20 bp, Artificial Sequence
  chemically synthesized
aacctgggaggtggaggttg

SEQ ID NO: 75350 - DNA, 20 bp, Artificial Sequence
  chemically synthesized
tgggaggtggaggttgcagt

SEQ ID NO: 75351 - DNA, 20 bp, Artificial Sequence
  chemically synthesized
ggtggaggttgcagtgagcc

SEQ ID NO: 75352 - DNA, 20 bp, Artificial Sequence
  chemically synthesized
gaggttgcagtgagccaaga

SEQ ID NO: 75353 - DNA, 20 bp, Artificial Sequence
  chemically synthesized
tgagtgcagtggtgccatct

SEQ ID NO: 75354 - DNA, 20 bp, Artificial Sequence
  chemically synthesized
ccaggctggagtgagtgcag

SEQ ID NO: 75355 - DNA, 20 bp, Artificial Sequence
  chemically synthesized
cacccaggctggagtgagtg

SEQ ID NO: 75356 - DNA, 20 bp, Artificial Sequence
  chemically synthesized
tggcaccactgcactcactc

SEQ ID NO: 75357 - DNA, 20 bp, Artificial Sequence
  chemically synthesized
tgggtcacccaggctggagt

SEQ ID NO: 75358 - DNA, 20 bp, Artificial Sequence
  chemically synthesized
ccactgcactcactccagcc

SEQ ID NO: 75359 - DNA, 20 bp, Artificial Sequence
  chemically synthesized
cactgcactcactccagcct

SEQ ID NO: 75360 - DNA, 20 bp, Artificial Sequence
  chemically synthesized
ttgctgggtcacccaggctg

SEQ ID NO: 75361 - DNA, 20 bp, Artificial Sequence
  chemically synthesized
tcttgctgggtcacccaggc

SEQ ID NO: 75362 - DNA, 20 bp, Artificial Sequence
  chemically synthesized
agagtcttgctgggtcaccc

SEQ ID NO: 75363 - DNA, 20 bp, Artificial Sequence
  chemically synthesized
tcactccagcctgggtgacc

SEQ ID NO: 75364 - DNA, 20 bp, Artificial Sequence
  chemically synthesized
cagagtcttgctgggtcacc

SEQ ID NO: 75365 - DNA, 20 bp, Artificial Sequence
  chemically synthesized
tccagcctgggtgacccagc

SEQ ID NO: 75366 - DNA, 20 bp, Artificial Sequence
  chemically synthesized
tttggagacagagtcttgct

SEQ ID NO: 75367 - DNA, 20 bp, Artificial Sequence
  chemically synthesized
ttttggagacagagtcttgc

SEQ ID NO: 75368 - DNA, 20 bp, Artificial Sequence
  chemically synthesized
tttttttttttttggagaca

SEQ ID NO: 75369 - DNA, 20 bp, Artificial Sequence
  chemically synthesized
tttttttttttttttggaga

SEQ ID NO: 75370 - DNA, 20 bp, Artificial Sequence
  chemically synthesized
tttttttttttttttttttg

SEQ ID NO: 75371 - DNA, 20 bp, Artificial Sequence
  chemically synthesized
tttttttttttttttttttt

SEQ ID NO: 75372 - DNA, 20 bp, Artificial Sequence
  chemically synthesized
aaaaaaaaaaaaaaaaaaaa

SEQ ID NO: 75373 - DNA, 20 bp, Artificial Sequence
  chemically synthesized
aagaaaaaatgccaaatatt

SEQ ID NO: 75374 - DNA, 20 bp, Artificial Sequence
  chemically synthesized
ttcagattaaactgaatatt

SEQ ID NO: 75375 - DNA, 20 bp, Artificial Sequence
  chemically synthesized
ttaacagaaatttaggaatt

SEQ ID NO: 75376 - DNA, 20 bp, Artificial Sequence
  chemically synthesized
aaatattttaacagaaattt

SEQ ID NO: 75377 - DNA, 20 bp, Artificial Sequence
  chemically synthesized
caaatattttaacagaaatt

SEQ ID NO: 75378 - DNA, 20 bp, Artificial Sequence
  chemically synthesized
tccattgtcaaatattttaa

SEQ ID NO: 75379 - DNA, 20 bp, Artificial Sequence
  chemically synthesized
tctgttaaaatatttgacaa

SEQ ID NO: 75380 - DNA, 20 bp, Artificial Sequence
  chemically synthesized
gttaaaatatttgacaatgg

SEQ ID NO: 75381 - DNA, 20 bp, Artificial Sequence
  chemically synthesized
ttgacaatggaagctttgac

SEQ ID NO: 75382 - DNA, 20 bp, Artificial Sequence
  chemically synthesized
aactgacctcacaccagtca

SEQ ID NO: 75383 - DNA, 20 bp, Artificial Sequence
  chemically synthesized
atggaagctttgactggtgt

SEQ ID NO: 75384 - DNA, 20 bp, Artificial Sequence
  chemically synthesized
tggaagctttgactggtgtg

SEQ ID NO: 75385 - DNA, 20 bp, Artificial Sequence
  chemically synthesized
tttatcaactgacctcacac

SEQ ID NO: 75386 - DNA, 20 bp, Artificial Sequence
  chemically synthesized
agctttgactggtgtgaggt

SEQ ID NO: 75387 - DNA, 20 bp, Artificial Sequence
  chemically synthesized
gtgtgaggtcagttgataaa

SEQ ID NO: 75388 - DNA, 20 bp, Artificial Sequence
  chemically synthesized
tcagttgataaacagataac

SEQ ID NO: 75389 - DNA, 20 bp, Artificial Sequence
  chemically synthesized
cagttgataaacagataact

SEQ ID NO: 75390 - DNA, 20 bp, Artificial Sequence
  chemically synthesized
agttgataaacagataactg

SEQ ID NO: 75391 - DNA, 20 bp, Artificial Sequence
  chemically synthesized
gttgataaacagataactgg

SEQ ID NO: 75392 - DNA, 20 bp, Artificial Sequence
  chemically synthesized
taaacagataactgggggca

SEQ ID NO: 75393 - DNA, 20 bp, Artificial Sequence
  chemically synthesized
aaacagataactgggggcaa

SEQ ID NO: 75394 - DNA, 20 bp, Artificial Sequence
  chemically synthesized
ccaaagtgaacctttgcccc

SEQ ID NO: 75395 - DNA, 20 bp, Artificial Sequence
  chemically synthesized
ctgggggcaaaggttcactt

SEQ ID NO: 75396 - DNA, 20 bp, Artificial Sequence
  chemically synthesized
tgggggcaaaggttcacttt

SEQ ID NO: 75397 - DNA, 20 bp, Artificial Sequence
  chemically synthesized
gggggcaaaggttcactttg

SEQ ID NO: 75398 - DNA, 20 bp, Artificial Sequence
  chemically synthesized
ggcaaaggttcactttgggg

SEQ ID NO: 75399 - DNA, 20 bp, Artificial Sequence
  chemically synthesized
cccatctagagacttcccca

SEQ ID NO: 75400 - DNA, 20 bp, Artificial Sequence
  chemically synthesized
gttcactttggggaagtctc

SEQ ID NO: 75401 - DNA, 20 bp, Artificial Sequence
  chemically synthesized
actttggggaagtctctaga

SEQ ID NO: 75402 - DNA, 20 bp, Artificial Sequence
  chemically synthesized
ctttggggaagtctctagat

SEQ ID NO: 75403 - DNA, 20 bp, Artificial Sequence
  chemically synthesized
tttggggaagtctctagatg

SEQ ID NO: 75404 - DNA, 20 bp, Artificial Sequence
  chemically synthesized
agtctgctcaaccccatcta

SEQ ID NO: 75405 - DNA, 20 bp, Artificial Sequence
  chemically synthesized
ttagtctgctcaaccccatc

SEQ ID NO: 75406 - DNA, 20 bp, Artificial Sequence
  chemically synthesized
ggaagtctctagatggggtt

SEQ ID NO: 75407 - DNA, 20 bp, Artificial Sequence
  chemically synthesized
agtctctagatggggttgag

SEQ ID NO: 75408 - DNA, 20 bp, Artificial Sequence
  chemically synthesized
agatggggttgagcagacta

SEQ ID NO: 75409 - DNA, 20 bp, Artificial Sequence
  chemically synthesized
gatggggttgagcagactaa

SEQ ID NO: 75410 - DNA, 20 bp, Artificial Sequence
  chemically synthesized
tctagctgactgaagtcctt

SEQ ID NO: 75411 - DNA, 20 bp, Artificial Sequence
  chemically synthesized
ttgagcagactaaaggactt

SEQ ID NO: 75412 - DNA, 20 bp, Artificial Sequence
  chemically synthesized
gcagactaaaggacttcagt

SEQ ID NO: 75413 - DNA, 20 bp, Artificial Sequence
  chemically synthesized
tgatgatttctagctgactg

SEQ ID NO: 75414 - DNA, 20 bp, Artificial Sequence
  chemically synthesized
actaaaggacttcagtcagc

SEQ ID NO: 75415 - DNA, 20 bp, Artificial Sequence
  chemically synthesized
agtgccctcatgatgatttc

SEQ ID NO: 75416 - DNA, 20 bp, Artificial Sequence
  chemically synthesized
agtcagctagaaatcatcat

SEQ ID NO: 75417 - DNA, 20 bp, Artificial Sequence
  chemically synthesized
gtcagctagaaatcatcatg

SEQ ID NO: 75418 - DNA, 20 bp, Artificial Sequence
  chemically synthesized
tcagctagaaatcatcatga

SEQ ID NO: 75419 - DNA, 20 bp, Artificial Sequence
  chemically synthesized
ttcttccaccttcatgcgtt

SEQ ID NO: 75420 - DNA, 20 bp, Artificial Sequence
  chemically synthesized
atgagggcactcaacgcatg

SEQ ID NO: 75421 - DNA, 20 bp, Artificial Sequence
  chemically synthesized
tgagggcactcaacgcatga

SEQ ID NO: 75422 - DNA, 20 bp, Artificial Sequence
  chemically synthesized
gggcactcaacgcatgaagg

SEQ ID NO: 75423 - DNA, 20 bp, Artificial Sequence
  chemically synthesized
cactcaacgcatgaaggtgg

SEQ ID NO: 75424 - DNA, 20 bp, Artificial Sequence
  chemically synthesized
caacgcatgaaggtggaaga

SEQ ID NO: 75425 - DNA, 20 bp, Artificial Sequence
  chemically synthesized
aacgcatgaaggtggaagaa

SEQ ID NO: 75426 - DNA, 20 bp, Artificial Sequence
  chemically synthesized
cgcatgaaggtggaagaaag

SEQ ID NO: 75427 - DNA, 20 bp, Artificial Sequence
  chemically synthesized
aggtggaagaaaggagataa

SEQ ID NO: 75428 - DNA, 20 bp, Artificial Sequence
  chemically synthesized
ggaagaaaggagataacaga

SEQ ID NO: 75429 - DNA, 20 bp, Artificial Sequence
  chemically synthesized
agaaaggagataacagatgg

SEQ ID NO: 75430 - DNA, 20 bp, Artificial Sequence
  chemically synthesized
gaaaggagataacagatggt

SEQ ID NO: 75431 - DNA, 20 bp, Artificial Sequence
  chemically synthesized
ggagataacagatggtagga

SEQ ID NO: 75432 - DNA, 20 bp, Artificial Sequence
  chemically synthesized
cagatggtaggaaagataaa

SEQ ID NO: 75433 - DNA, 20 bp, Artificial Sequence
  chemically synthesized
agatggtaggaaagataaaa

SEQ ID NO: 75434 - DNA, 20 bp, Artificial Sequence
  chemically synthesized
gtaggaaagataaaaaggaa

SEQ ID NO: 75435 - DNA, 20 bp, Artificial Sequence
  chemically synthesized
taggaaagataaaaaggaaa

SEQ ID NO: 75436 - DNA, 20 bp, Artificial Sequence
  chemically synthesized
ggaaagataaaaaggaaaag

SEQ ID NO: 75437 - DNA, 20 bp, Artificial Sequence
  chemically synthesized
gaaagataaaaaggaaaagg

SEQ ID NO: 75438 - DNA, 20 bp, Artificial Sequence
  chemically synthesized
agataaaaaggaaaaggagg

SEQ ID NO: 75439 - DNA, 20 bp, Artificial Sequence
  chemically synthesized
gataaaaaggaaaaggaggc

SEQ ID NO: 75440 - DNA, 20 bp, Artificial Sequence
  chemically synthesized
taaaaaggaaaaggaggcag

SEQ ID NO: 75441 - DNA, 20 bp, Artificial Sequence
  chemically synthesized
aggcaggagaatgctcatgt

SEQ ID NO: 75442 - DNA, 20 bp, Artificial Sequence
  chemically synthesized
gccaaagtgaagactgacat

SEQ ID NO: 75443 - DNA, 20 bp, Artificial Sequence
  chemically synthesized
gctcatgtcagtcttcactt

SEQ ID NO: 75444 - DNA, 20 bp, Artificial Sequence
  chemically synthesized
ctaaatcaaatgccaaagtg

SEQ ID NO: 75445 - DNA, 20 bp, Artificial Sequence
  chemically synthesized
aaaacctaaatcaaatgcca

SEQ ID NO: 75446 - DNA, 20 bp, Artificial Sequence
  chemically synthesized
cttcactttggcatttgatt

SEQ ID NO: 75447 - DNA, 20 bp, Artificial Sequence
  chemically synthesized
ttcactttggcatttgattt

SEQ ID NO: 75448 - DNA, 20 bp, Artificial Sequence
  chemically synthesized
ttggcatttgatttaggttt

SEQ ID NO: 75449 - DNA, 20 bp, Artificial Sequence
  chemically synthesized
gcatttgatttaggttttgg

SEQ ID NO: 75450 - DNA, 20 bp, Artificial Sequence
  chemically synthesized
tttgatttaggttttggtag

SEQ ID NO: 75451 - DNA, 20 bp, Artificial Sequence
  chemically synthesized
gagccatccttgggtggtaa

SEQ ID NO: 75452 - DNA, 20 bp, Artificial Sequence
  chemically synthesized
ggtagcagcttttaccaccc

SEQ ID NO: 75453 - DNA, 20 bp, Artificial Sequence
  chemically synthesized
gtagcagcttttaccaccca

SEQ ID NO: 75454 - DNA, 20 bp, Artificial Sequence
  chemically synthesized
agtggtgagccatccttggg

SEQ ID NO: 75455 - DNA, 20 bp, Artificial Sequence
  chemically synthesized
cagcttttaccacccaagga

SEQ ID NO: 75456 - DNA, 20 bp, Artificial Sequence
  chemically synthesized
cacagtggtgagccatcctt

SEQ ID NO: 75457 - DNA, 20 bp, Artificial Sequence
  chemically synthesized
ccacagtggtgagccatcct

SEQ ID NO: 75458 - DNA, 20 bp, Artificial Sequence
  chemically synthesized
ccaaggatggctcaccactg

SEQ ID NO: 75459 - DNA, 20 bp, Artificial Sequence
  chemically synthesized
cactgagagcccacagtggt

SEQ ID NO: 75460 - DNA, 20 bp, Artificial Sequence
  chemically synthesized
caaggatggctcaccactgt

SEQ ID NO: 75461 - DNA, 20 bp, Artificial Sequence
  chemically synthesized
tgggcactgagagcccacag

SEQ ID NO: 75462 - DNA, 20 bp, Artificial Sequence
  chemically synthesized
tgctgggcactgagagccca

SEQ ID NO: 75463 - DNA, 20 bp, Artificial Sequence
  chemically synthesized
ggctcaccactgtgggctct

SEQ ID NO: 75464 - DNA, 20 bp, Artificial Sequence
  chemically synthesized
tgtatgctgctgggcactga

SEQ ID NO: 75465 - DNA, 20 bp, Artificial Sequence
  chemically synthesized
cactgtgggctctcagtgcc

SEQ ID NO: 75466 - DNA, 20 bp, Artificial Sequence
  chemically synthesized
tatgtatgctgctgggcact

SEQ ID NO: 75467 - DNA, 20 bp, Artificial Sequence
  chemically synthesized
tgtgggctctcagtgcccag

SEQ ID NO: 75468 - DNA, 20 bp, Artificial Sequence
  chemically synthesized
ttcttgttatgtatgctgct

SEQ ID NO: 75469 - DNA, 20 bp, Artificial Sequence
  chemically synthesized
cttcttgttatgtatgctgc

SEQ ID NO: 75470 - DNA, 20 bp, Artificial Sequence
  chemically synthesized
tgcccagcagcatacataac

SEQ ID NO: 75471 - DNA, 20 bp, Artificial Sequence
  chemically synthesized
ccagcagcatacataacaag

SEQ ID NO: 75472 - DNA, 20 bp, Artificial Sequence
  chemically synthesized
agcatacataacaagaagta

SEQ ID NO: 75473 - DNA, 20 bp, Artificial Sequence
  chemically synthesized
cttgtgactctgtgtttagg

SEQ ID NO: 75474 - DNA, 20 bp, Artificial Sequence
  chemically synthesized
gaagtatggccgcctaaaca

SEQ ID NO: 75475 - DNA, 20 bp, Artificial Sequence
  chemically synthesized
agtatggccgcctaaacaca

SEQ ID NO: 75476 - DNA, 20 bp, Artificial Sequence
  chemically synthesized
ggtcttgtgactctgtgttt

SEQ ID NO: 75477 - DNA, 20 bp, Artificial Sequence
  chemically synthesized
aggtcttgtgactctgtgtt

SEQ ID NO: 75478 - DNA, 20 bp, Artificial Sequence
  chemically synthesized
ccgcctaaacacagagtcac

SEQ ID NO: 75479 - DNA, 20 bp, Artificial Sequence
  chemically synthesized
gttcaccctttacagggtga

SEQ ID NO: 75480 - DNA, 20 bp, Artificial Sequence
  chemically synthesized
tgttcaccctttacagggtg

SEQ ID NO: 75481 - DNA, 20 bp, Artificial Sequence
  chemically synthesized
cacaagaccttcaccctgta

SEQ ID NO: 75482 - DNA, 20 bp, Artificial Sequence
  chemically synthesized
acaagaccttcaccctgtaa

SEQ ID NO: 75483 - DNA, 20 bp, Artificial Sequence
  chemically synthesized
caagaccttcaccctgtaaa

SEQ ID NO: 75484 - DNA, 20 bp, Artificial Sequence
  chemically synthesized
acctgtgttcaccctttaca

SEQ ID NO: 75485 - DNA, 20 bp, Artificial Sequence
  chemically synthesized
tacctgtgttcaccctttac

SEQ ID NO: 75486 - DNA, 20 bp, Artificial Sequence
  chemically synthesized
gtacctgtgttcacccttta

SEQ ID NO: 75487 - DNA, 20 bp, Artificial Sequence
  chemically synthesized
caccctgtaaagggtgaaca

SEQ ID NO: 75488 - DNA, 20 bp, Artificial Sequence
  chemically synthesized
accctgtaaagggtgaacac

SEQ ID NO: 75489 - DNA, 20 bp, Artificial Sequence
  chemically synthesized
tcacatctatttaaatagca

SEQ ID NO: 75490 - DNA, 20 bp, Artificial Sequence
  chemically synthesized
caggtactttgctatttaaa

SEQ ID NO: 75491 - DNA, 20 bp, Artificial Sequence
  chemically synthesized
caatgtcacatctatttaaa

SEQ ID NO: 75492 - DNA, 20 bp, Artificial Sequence
  chemically synthesized
tatttaaatagatgtgacat

SEQ ID NO: 75493 - DNA, 20 bp, Artificial Sequence
  chemically synthesized
aaatagatgtgacattggtt

SEQ ID NO: 75494 - DNA, 20 bp, Artificial Sequence
  chemically synthesized
attggtttggctatatttca

SEQ ID NO: 75495 - DNA, 20 bp, Artificial Sequence
  chemically synthesized
aagctctaatctgtgaaata

SEQ ID NO: 75496 - DNA, 20 bp, Artificial Sequence
  chemically synthesized
tttggctatatttcacagat

SEQ ID NO: 75497 - DNA, 20 bp, Artificial Sequence
  chemically synthesized
tggctatatttcacagatta

SEQ ID NO: 75498 - DNA, 20 bp, Artificial Sequence
  chemically synthesized
atttatgtgtgtcatattaa

SEQ ID NO: 75499 - DNA, 20 bp, Artificial Sequence
  chemically synthesized
gctttttgacattttaggtg

SEQ ID NO: 75500 - DNA, 20 bp, Artificial Sequence
  chemically synthesized
actgtgctttttgacatttt

SEQ ID NO: 75501 - DNA, 20 bp, Artificial Sequence
  chemically synthesized
aactgtgctttttgacattt

SEQ ID NO: 75502 - DNA, 20 bp, Artificial Sequence
  chemically synthesized
actacacctaaaatgtcaaa

SEQ ID NO: 75503 - DNA, 20 bp, Artificial Sequence
  chemically synthesized
acctaaaatgtcaaaaagca

SEQ ID NO: 75504 - DNA, 20 bp, Artificial Sequence
  chemically synthesized
caaaaagcacagttaacgct

SEQ ID NO: 75505 - DNA, 20 bp, Artificial Sequence
  chemically synthesized
aaatagcacctcgtattgct

SEQ ID NO: 75506 - DNA, 20 bp, Artificial Sequence
  chemically synthesized
cagttaacgctgagcaatac

SEQ ID NO: 75507 - DNA, 20 bp, Artificial Sequence
  chemically synthesized
agttaacgctgagcaatacg

SEQ ID NO: 75508 - DNA, 20 bp, Artificial Sequence
  chemically synthesized
agcaatacgaggtgctattt

SEQ ID NO: 75509 - DNA, 20 bp, Artificial Sequence
  chemically synthesized
caatcctgatatcacttaaa

SEQ ID NO: 75510 - DNA, 20 bp, Artificial Sequence
  chemically synthesized
aggtgctatttaagtgatat

SEQ ID NO: 75511 - DNA, 20 bp, Artificial Sequence
  chemically synthesized
ggtgctatttaagtgatatc

SEQ ID NO: 75512 - DNA, 20 bp, Artificial Sequence
  chemically synthesized
aagtgatatcaggattgcat

SEQ ID NO: 75513 - DNA, 20 bp, Artificial Sequence
  chemically synthesized
agtgatatcaggattgcatt

SEQ ID NO: 75514 - DNA, 20 bp, Artificial Sequence
  chemically synthesized
attgcattaggttttttttc

SEQ ID NO: 75515 - DNA, 20 bp, Artificial Sequence
  chemically synthesized
attaggttttttttctagtt

SEQ ID NO: 75516 - DNA, 20 bp, Artificial Sequence
  chemically synthesized
aggttttttttctagtttgg

SEQ ID NO: 75517 - DNA, 20 bp, Artificial Sequence
  chemically synthesized
ctcacttactgcttccaaac

SEQ ID NO: 75518 - DNA, 20 bp, Artificial Sequence
  chemically synthesized
ttttttttctagtttggaag

SEQ ID NO: 75519 - DNA, 20 bp, Artificial Sequence
  chemically synthesized
ttttctagtttggaagcagt

SEQ ID NO: 75520 - DNA, 20 bp, Artificial Sequence
  chemically synthesized
ctagtttggaagcagtaagt

SEQ ID NO: 75521 - DNA, 20 bp, Artificial Sequence
  chemically synthesized
cagtaagtgagaaaacattg

SEQ ID NO: 75522 - DNA, 20 bp, Artificial Sequence
  chemically synthesized
aagtgagaaaacattgaaga

SEQ ID NO: 75523 - DNA, 20 bp, Artificial Sequence
  chemically synthesized
aaagaaaacccacaatataa

SEQ ID NO: 75524 - DNA, 20 bp, Artificial Sequence
  chemically synthesized
tgaagaaagccattatattg

SEQ ID NO: 75525 - DNA, 20 bp, Artificial Sequence
  chemically synthesized
gaagaaagccattatattgt

SEQ ID NO: 75526 - DNA, 20 bp, Artificial Sequence
  chemically synthesized
ccagatgtttaagtgattca

SEQ ID NO: 75527 - DNA, 20 bp, Artificial Sequence
  chemically synthesized
ctttgaatcacttaaacatc

SEQ ID NO: 75528 - DNA, 20 bp, Artificial Sequence
  chemically synthesized
agaacatattccagatgttt

SEQ ID NO: 75529 - DNA, 20 bp, Artificial Sequence
  chemically synthesized
ctttcatggagaacatattc

SEQ ID NO: 75530 - DNA, 20 bp, Artificial Sequence
  chemically synthesized
ctggaatatgttctccatga

SEQ ID NO: 75531 - DNA, 20 bp, Artificial Sequence
  chemically synthesized
ggaatatgttctccatgaaa

SEQ ID NO: 75532 - DNA, 20 bp, Artificial Sequence
  chemically synthesized
acttggtttgctctttcatg

SEQ ID NO: 75533 - DNA, 20 bp, Artificial Sequence
  chemically synthesized
agacttggtttgctctttca

SEQ ID NO: 75534 - DNA, 20 bp, Artificial Sequence
  chemically synthesized
tctccatgaaagagcaaacc

SEQ ID NO: 75535 - DNA, 20 bp, Artificial Sequence
  chemically synthesized
agtcataataaaattagact

SEQ ID NO: 75536 - DNA, 20 bp, Artificial Sequence
  chemically synthesized
gaaactagtcataataaaat

SEQ ID NO: 75537 - DNA, 20 bp, Artificial Sequence
  chemically synthesized
aagtctaattttattatgac

SEQ ID NO: 75538 - DNA, 20 bp, Artificial Sequence
  chemically synthesized
aaattctgcctgtgagaaac

SEQ ID NO: 75539 - DNA, 20 bp, Artificial Sequence
  chemically synthesized
ttattatgactagtttctca

SEQ ID NO: 75540 - DNA, 20 bp, Artificial Sequence
  chemically synthesized
tattatgactagtttctcac

SEQ ID NO: 75541 - DNA, 20 bp, Artificial Sequence
  chemically synthesized
tatgactagtttctcacagg

SEQ ID NO: 75542 - DNA, 20 bp, Artificial Sequence
  chemically synthesized
gaactgaaaattctgcctgt

SEQ ID NO: 75543 - DNA, 20 bp, Artificial Sequence
  chemically synthesized
tttctcacaggcagaatttt

SEQ ID NO: 75544 - DNA, 20 bp, Artificial Sequence
  chemically synthesized
cattaaatgttgtctgatta

SEQ ID NO: 75545 - DNA, 20 bp, Artificial Sequence
  chemically synthesized
agtacttttgtatctataat

SEQ ID NO: 75546 - DNA, 20 bp, Artificial Sequence
  chemically synthesized
ttgtctgattatagatacaa

SEQ ID NO: 75547 - DNA, 20 bp, Artificial Sequence
  chemically synthesized
tagatacaaaagtactgatt

SEQ ID NO: 75548 - DNA, 20 bp, Artificial Sequence
  chemically synthesized
acttacctatcattctaaat

SEQ ID NO: 75549 - DNA, 20 bp, Artificial Sequence
  chemically synthesized
aaagtactgatttagaatga

SEQ ID NO: 75550 - DNA, 20 bp, Artificial Sequence
  chemically synthesized
aagtactgatttagaatgat

SEQ ID NO: 75551 - DNA, 20 bp, Artificial Sequence
  chemically synthesized
actgatttagaatgataggt

SEQ ID NO: 75552 - DNA, 20 bp, Artificial Sequence
  chemically synthesized
ataggtaagtctgatataat

SEQ ID NO: 75553 - DNA, 20 bp, Artificial Sequence
  chemically synthesized
tgaagaaaaacttattatat

SEQ ID NO: 75554 - DNA, 20 bp, Artificial Sequence
  chemically synthesized
aggcaatttaattttatatg

SEQ ID NO: 75555 - DNA, 20 bp, Artificial Sequence
  chemically synthesized
aagataagcaaagatatgac

SEQ ID NO: 75556 - DNA, 20 bp, Artificial Sequence
  chemically synthesized
aaagataagcaaagatatga

SEQ ID NO: 75557 - DNA, 20 bp, Artificial Sequence
  chemically synthesized
tagctacataaagataagca

SEQ ID NO: 75558 - DNA, 20 bp, Artificial Sequence
  chemically synthesized
atccttagctacataaagat

SEQ ID NO: 75559 - DNA, 20 bp, Artificial Sequence
  chemically synthesized
tatctttgcttatctttatg

SEQ ID NO: 75560 - DNA, 20 bp, Artificial Sequence
  chemically synthesized
aacaaatccttagctacata

SEQ ID NO: 75561 - DNA, 20 bp, Artificial Sequence
  chemically synthesized
ttgcttatctttatgtagct

SEQ ID NO: 75562 - DNA, 20 bp, Artificial Sequence
  chemically synthesized
tgcttatctttatgtagcta

SEQ ID NO: 75563 - DNA, 20 bp, Artificial Sequence
  chemically synthesized
tgtgtatttgaacaaatcct

SEQ ID NO: 75564 - DNA, 20 bp, Artificial Sequence
  chemically synthesized
caaatacacatttaaaatta

SEQ ID NO: 75565 - DNA, 20 bp, Artificial Sequence
  chemically synthesized
ttattttcttagaaaagtag

SEQ ID NO: 75566 - DNA, 20 bp, Artificial Sequence
  chemically synthesized
tagtcatctactacttttct

SEQ ID NO: 75567 - DNA, 20 bp, Artificial Sequence
  chemically synthesized
cctttattttcttagaaaag

SEQ ID NO: 75568 - DNA, 20 bp, Artificial Sequence
  chemically synthesized
attcctttattttcttagaa

SEQ ID NO: 75569 - DNA, 20 bp, Artificial Sequence
  chemically synthesized
agacaattcctttattttct

SEQ ID NO: 75570 - DNA, 20 bp, Artificial Sequence
  chemically synthesized
actacttttctaagaaaata

SEQ ID NO: 75571 - DNA, 20 bp, Artificial Sequence
  chemically synthesized
ctacttttctaagaaaataa

SEQ ID NO: 75572 - DNA, 20 bp, Artificial Sequence
  chemically synthesized
taaaggaattgtctattaac

SEQ ID NO: 75573 - DNA, 20 bp, Artificial Sequence
  chemically synthesized
aaaggaattgtctattaaca

SEQ ID NO: 75574 - DNA, 20 bp, Artificial Sequence
  chemically synthesized
aaggaattgtctattaacaa

SEQ ID NO: 75575 - DNA, 20 bp, Artificial Sequence
  chemically synthesized
aaataagattcccttgttaa

SEQ ID NO: 75576 - DNA, 20 bp, Artificial Sequence
  chemically synthesized
aacaagggaatcttattttt

SEQ ID NO: 75577 - DNA, 20 bp, Artificial Sequence
  chemically synthesized
acaagggaatcttatttttg

SEQ ID NO: 75578 - DNA, 20 bp, Artificial Sequence
  chemically synthesized
aaaattcctccctcaaaaat

SEQ ID NO: 75579 - DNA, 20 bp, Artificial Sequence
  chemically synthesized
caagggaatcttatttttga

SEQ ID NO: 75580 - DNA, 20 bp, Artificial Sequence
  chemically synthesized
agggaatcttatttttgagg

SEQ ID NO: 75581 - DNA, 20 bp, Artificial Sequence
  chemically synthesized
gggaatcttatttttgaggg

SEQ ID NO: 75582 - DNA, 20 bp, Artificial Sequence
  chemically synthesized
agggaggaattttgacttga

SEQ ID NO: 75583 - DNA, 20 bp, Artificial Sequence
  chemically synthesized
ggaattttgacttgacagtt

SEQ ID NO: 75584 - DNA, 20 bp, Artificial Sequence
  chemically synthesized
ggaatgttctcttaactgtc

SEQ ID NO: 75585 - DNA, 20 bp, Artificial Sequence
  chemically synthesized
aattttgacttgacagttaa

SEQ ID NO: 75586 - DNA, 20 bp, Artificial Sequence
  chemically synthesized
aagagaacattcctactgca

SEQ ID NO: 75587 - DNA, 20 bp, Artificial Sequence
  chemically synthesized
gaccttctgtgctttgcagt

SEQ ID NO: 75588 - DNA, 20 bp, Artificial Sequence
  chemically synthesized
tgaccttctgtgctttgcag

SEQ ID NO: 75589 - DNA, 20 bp, Artificial Sequence
  chemically synthesized
aacattcctactgcaaagca

SEQ ID NO: 75590 - DNA, 20 bp, Artificial Sequence
  chemically synthesized
aactgaccttctgtgctttg

SEQ ID NO: 75591 - DNA, 20 bp, Artificial Sequence
  chemically synthesized
attcctactgcaaagcacag

SEQ ID NO: 75592 - DNA, 20 bp, Artificial Sequence
  chemically synthesized
ttcctactgcaaagcacaga

SEQ ID NO: 75593 - DNA, 20 bp, Artificial Sequence
  chemically synthesized
tactgcaaagcacagaaggt

SEQ ID NO: 75594 - DNA, 20 bp, Artificial Sequence
  chemically synthesized
gcaaagcacagaaggtcagt

SEQ ID NO: 75595 - DNA, 20 bp, Artificial Sequence
  chemically synthesized
agcacagaaggtcagttgga

SEQ ID NO: 75596 - DNA, 20 bp, Artificial Sequence
  chemically synthesized
agaaggtcagttggaaagac

SEQ ID NO: 75597 - DNA, 20 bp, Artificial Sequence
  chemically synthesized
ggtcagttggaaagactaga

SEQ ID NO: 75598 - DNA, 20 bp, Artificial Sequence
  chemically synthesized
tcagttggaaagactagaaa

SEQ ID NO: 75599 - DNA, 20 bp, Artificial Sequence
  chemically synthesized
ttccctcaatttactctttc

SEQ ID NO: 75600 - DNA, 20 bp, Artificial Sequence
  chemically synthesized
aagactagaaagagtaaatt

SEQ ID NO: 75601 - DNA, 20 bp, Artificial Sequence
  chemically synthesized
agactagaaagagtaaattg

SEQ ID NO: 75602 - DNA, 20 bp, Artificial Sequence
  chemically synthesized
gactagaaagagtaaattga

SEQ ID NO: 75603 - DNA, 20 bp, Artificial Sequence
  chemically synthesized
taaattgagggaattctgct

SEQ ID NO: 75604 - DNA, 20 bp, Artificial Sequence
  chemically synthesized
aattgagggaattctgcttg

SEQ ID NO: 75605 - DNA, 20 bp, Artificial Sequence
  chemically synthesized
attgagggaattctgcttgg

SEQ ID NO: 75606 - DNA, 20 bp, Artificial Sequence
  chemically synthesized
ttgagggaattctgcttgga

SEQ ID NO: 75607 - DNA, 20 bp, Artificial Sequence
  chemically synthesized
tgagggaattctgcttggag

SEQ ID NO: 75608 - DNA, 20 bp, Artificial Sequence
  chemically synthesized
ggaaataaaacccctccaag

SEQ ID NO: 75609 - DNA, 20 bp, Artificial Sequence
  chemically synthesized
agaggaaataaaacccctcc

SEQ ID NO: 75610 - DNA, 20 bp, Artificial Sequence
  chemically synthesized
ggggttttatttcctctgtg

SEQ ID NO: 75611 - DNA, 20 bp, Artificial Sequence
  chemically synthesized
tgttgattcctacttcacag

SEQ ID NO: 75612 - DNA, 20 bp, Artificial Sequence
  chemically synthesized
gttttatttcctctgtgaag

SEQ ID NO: 75613 - DNA, 20 bp, Artificial Sequence
  chemically synthesized
ctgttgattcctacttcaca

SEQ ID NO: 75614 - DNA, 20 bp, Artificial Sequence
  chemically synthesized
ttttatttcctctgtgaagt

SEQ ID NO: 75615 - DNA, 20 bp, Artificial Sequence
  chemically synthesized
gtctgttgattcctacttca

SEQ ID NO: 75616 - DNA, 20 bp, Artificial Sequence
  chemically synthesized
ctctgtgaagtaggaatcaa

SEQ ID NO: 75617 - DNA, 20 bp, Artificial Sequence
  chemically synthesized
gaagtaggaatcaacagacc

SEQ ID NO: 75618 - DNA, 20 bp, Artificial Sequence
  chemically synthesized
aggaatcaacagacctggca

SEQ ID NO: 75619 - DNA, 20 bp, Artificial Sequence
  chemically synthesized
caggcactgcagactatgcc

SEQ ID NO: 75620 - DNA, 20 bp, Artificial Sequence
  chemically synthesized
ccaggcactgcagactatgc

SEQ ID NO: 75621 - DNA, 20 bp, Artificial Sequence
  chemically synthesized
aacagacctggcatagtctg

SEQ ID NO: 75622 - DNA, 20 bp, Artificial Sequence
  chemically synthesized
ctggcatagtctgcagtgcc

SEQ ID NO: 75623 - DNA, 20 bp, Artificial Sequence
  chemically synthesized
gcacgctatgccaggcactg

SEQ ID NO: 75624 - DNA, 20 bp, Artificial Sequence
  chemically synthesized
atagtctgcagtgcctggca

SEQ ID NO: 75625 - DNA, 20 bp, Artificial Sequence
  chemically synthesized
caggcactgcacgctatgcc

SEQ ID NO: 75626 - DNA, 20 bp, Artificial Sequence
  chemically synthesized
ccaggcactgcacgctatgc

SEQ ID NO: 75627 - DNA, 20 bp, Artificial Sequence
  chemically synthesized
gcagtgcctggcatagcgtg

SEQ ID NO: 75628 - DNA, 20 bp, Artificial Sequence
  chemically synthesized
ctggcatagcgtgcagtgcc

SEQ ID NO: 75629 - DNA, 20 bp, Artificial Sequence
  chemically synthesized
gtgactattcattgcacacc

SEQ ID NO: 75630 - DNA, 20 bp, Artificial Sequence
  chemically synthesized
agtgactattcattgcacac

SEQ ID NO: 75631 - DNA, 20 bp, Artificial Sequence
  chemically synthesized
agtgcctggtgtgcaatgaa

SEQ ID NO: 75632 - DNA, 20 bp, Artificial Sequence
  chemically synthesized
ccttaattcatgttttcatt

SEQ ID NO: 75633 - DNA, 20 bp, Artificial Sequence
  chemically synthesized
actgaatgaaaacatgaatt

SEQ ID NO: 75634 - DNA, 20 bp, Artificial Sequence
  chemically synthesized
ctgaatgaaaacatgaatta

SEQ ID NO: 75635 - DNA, 20 bp, Artificial Sequence
  chemically synthesized
tgaatgaaaacatgaattaa

SEQ ID NO: 75636 - DNA, 20 bp, Artificial Sequence
  chemically synthesized
tgaaaacatgaattaagggt

SEQ ID NO: 75637 - DNA, 20 bp, Artificial Sequence
  chemically synthesized
aaacatgaattaagggtaag

SEQ ID NO: 75638 - DNA, 20 bp, Artificial Sequence
  chemically synthesized
aacatgaattaagggtaagt

SEQ ID NO: 75639 - DNA, 20 bp, Artificial Sequence
  chemically synthesized
aacatttgaattaatcgtaa

SEQ ID NO: 75640 - DNA, 20 bp, Artificial Sequence
  chemically synthesized
catttgaattaatcgtaata

SEQ ID NO: 75641 - DNA, 20 bp, Artificial Sequence
  chemically synthesized
ttaatcgtaatagagactgt

SEQ ID NO: 75642 - DNA, 20 bp, Artificial Sequence
  chemically synthesized
aatcgtaatagagactgtga

SEQ ID NO: 75643 - DNA, 20 bp, Artificial Sequence
  chemically synthesized
atcgtaatagagactgtgag

SEQ ID NO: 75644 - DNA, 20 bp, Artificial Sequence
  chemically synthesized
tcgtaatagagactgtgaga

SEQ ID NO: 75645 - DNA, 20 bp, Artificial Sequence
  chemically synthesized
gtaatagagactgtgagagg

SEQ ID NO: 75646 - DNA, 20 bp, Artificial Sequence
  chemically synthesized
cttaggtcaactccctctca

SEQ ID NO: 75647 - DNA, 20 bp, Artificial Sequence
  chemically synthesized
ctgtgagagggagttgacct

SEQ ID NO: 75648 - DNA, 20 bp, Artificial Sequence
  chemically synthesized
gtgagagggagttgacctaa

SEQ ID NO: 75649 - DNA, 20 bp, Artificial Sequence
  chemically synthesized
ccaacctcattacatctctt

SEQ ID NO: 75650 - DNA, 20 bp, Artificial Sequence
  chemically synthesized
gccaacctcattacatctct

SEQ ID NO: 75651 - DNA, 20 bp, Artificial Sequence
  chemically synthesized
gttgacctaagagatgtaat

SEQ ID NO: 75652 - DNA, 20 bp, Artificial Sequence
  chemically synthesized
ttgacctaagagatgtaatg

SEQ ID NO: 75653 - DNA, 20 bp, Artificial Sequence
  chemically synthesized
cctaagagatgtaatgaggt

SEQ ID NO: 75654 - DNA, 20 bp, Artificial Sequence
  chemically synthesized
gatgtaatgaggttggcaaa

SEQ ID NO: 75655 - DNA, 20 bp, Artificial Sequence
  chemically synthesized
tgaggttggcaaacagtgtt

SEQ ID NO: 75656 - DNA, 20 bp, Artificial Sequence
  chemically synthesized
gaggttggcaaacagtgttg

SEQ ID NO: 75657 - DNA, 20 bp, Artificial Sequence
  chemically synthesized
aggttggcaaacagtgttga

SEQ ID NO: 75658 - DNA, 20 bp, Artificial Sequence
  chemically synthesized
acagtgttgagggcccactt

SEQ ID NO: 75659 - DNA, 20 bp, Artificial Sequence
  chemically synthesized
cagtgttgagggcccacttg

SEQ ID NO: 75660 - DNA, 20 bp, Artificial Sequence
  chemically synthesized
gttgaacctcatcctcaagt

SEQ ID NO: 75661 - DNA, 20 bp, Artificial Sequence
  chemically synthesized
tgttgaacctcatcctcaag

SEQ ID NO: 75662 - DNA, 20 bp, Artificial Sequence
  chemically synthesized
ttgagggcccacttgaggat

SEQ ID NO: 75663 - DNA, 20 bp, Artificial Sequence
  chemically synthesized
tgagggcccacttgaggatg

SEQ ID NO: 75664 - DNA, 20 bp, Artificial Sequence
  chemically synthesized
aaatgttgaacctcatcctc

SEQ ID NO: 75665 - DNA, 20 bp, Artificial Sequence
  chemically synthesized
ggatgaggttcaacattttt

SEQ ID NO: 75666 - DNA, 20 bp, Artificial Sequence
  chemically synthesized
tgaggttcaacattttttag

SEQ ID NO: 75667 - DNA, 20 bp, Artificial Sequence
  chemically synthesized
aatgagaaagtcaggcagat

SEQ ID NO: 75668 - DNA, 20 bp, Artificial Sequence
  chemically synthesized
gagaaaatgagaaagtcagg

SEQ ID NO: 75669 - DNA, 20 bp, Artificial Sequence
  chemically synthesized
ttggagaaaatgagaaagtc

SEQ ID NO: 75670 - DNA, 20 bp, Artificial Sequence
  chemically synthesized
gttggagaaaatgagaaagt

SEQ ID NO: 75671 - DNA, 20 bp, Artificial Sequence
  chemically synthesized
cactgttggagaaaatgaga

SEQ ID NO: 75672 - DNA, 20 bp, Artificial Sequence
  chemically synthesized
gcaacactgttggagaaaat

SEQ ID NO: 75673 - DNA, 20 bp, Artificial Sequence
  chemically synthesized
gactttctcattttctccaa

SEQ ID NO: 75674 - DNA, 20 bp, Artificial Sequence
  chemically synthesized
gcttacatgcaacactgttg

SEQ ID NO: 75675 - DNA, 20 bp, Artificial Sequence
  chemically synthesized
atgcttacatgcaacactgt

SEQ ID NO: 75676 - DNA, 20 bp, Artificial Sequence
  chemically synthesized
tctccaacagtgttgcatgt

SEQ ID NO: 75677 - DNA, 20 bp, Artificial Sequence
  chemically synthesized
aacagtgttgcatgtaagca

SEQ ID NO: 75678 - DNA, 20 bp, Artificial Sequence
  chemically synthesized
acagtgttgcatgtaagcat

SEQ ID NO: 75679 - DNA, 20 bp, Artificial Sequence
  chemically synthesized
cagtgttgcatgtaagcatg

SEQ ID NO: 75680 - DNA, 20 bp, Artificial Sequence
  chemically synthesized
gcatgtaagcatggggaaaa

SEQ ID NO: 75681 - DNA, 20 bp, Artificial Sequence
  chemically synthesized
catggggaaaacagttgatc

SEQ ID NO: 75682 - DNA, 20 bp, Artificial Sequence
  chemically synthesized
atggggaaaacagttgatcc

SEQ ID NO: 75683 - DNA, 20 bp, Artificial Sequence
  chemically synthesized
gaaaacagttgatccaggtt

SEQ ID NO: 75684 - DNA, 20 bp, Artificial Sequence
  chemically synthesized
aaaacagttgatccaggttt

SEQ ID NO: 75685 - DNA, 20 bp, Artificial Sequence
  chemically synthesized
aaacagttgatccaggtttg

SEQ ID NO: 75686 - DNA, 20 bp, Artificial Sequence
  chemically synthesized
atctgacgaaaccccaaacc

SEQ ID NO: 75687 - DNA, 20 bp, Artificial Sequence
  chemically synthesized
atccaggtttggggtttcgt

SEQ ID NO: 75688 - DNA, 20 bp, Artificial Sequence
  chemically synthesized
ggggtttcgtcagatgactg

SEQ ID NO: 75689 - DNA, 20 bp, Artificial Sequence
  chemically synthesized
atccctaaatgtgtgagcca

SEQ ID NO: 75690 - DNA, 20 bp, Artificial Sequence
  chemically synthesized
atgactgtggctcacacatt

SEQ ID NO: 75691 - DNA, 20 bp, Artificial Sequence
  chemically synthesized
tcccttatccctaaatgtgt

SEQ ID NO: 75692 - DNA, 20 bp, Artificial Sequence
  chemically synthesized
tgactgtggctcacacattt

SEQ ID NO: 75693 - DNA, 20 bp, Artificial Sequence
  chemically synthesized
gactgtggctcacacattta

SEQ ID NO: 75694 - DNA, 20 bp, Artificial Sequence
  chemically synthesized
tggctcacacatttagggat

SEQ ID NO: 75695 - DNA, 20 bp, Artificial Sequence
  chemically synthesized
ggctcacacatttagggata

SEQ ID NO: 75696 - DNA, 20 bp, Artificial Sequence
  chemically synthesized
gctcacacatttagggataa

SEQ ID NO: 75697 - DNA, 20 bp, Artificial Sequence
  chemically synthesized
tcacacatttagggataagg

SEQ ID NO: 75698 - DNA, 20 bp, Artificial Sequence
  chemically synthesized
ggataagggagtttcgatat

SEQ ID NO: 75699 - DNA, 20 bp, Artificial Sequence
  chemically synthesized
aagggagtttcgatattagc

SEQ ID NO: 75700 - DNA, 20 bp, Artificial Sequence
  chemically synthesized
agggagtttcgatattagcc

SEQ ID NO: 75701 - DNA, 20 bp, Artificial Sequence
  chemically synthesized
atattttttcaattacatcc

SEQ ID NO: 75702 - DNA, 20 bp, Artificial Sequence
  chemically synthesized
gtaattgaaaaaatatactg

SEQ ID NO: 75703 - DNA, 20 bp, Artificial Sequence
  chemically synthesized
ctaatccagtttagattcca

SEQ ID NO: 75704 - DNA, 20 bp, Artificial Sequence
  chemically synthesized
atatactgtggaatctaaac

SEQ ID NO: 75705 - DNA, 20 bp, Artificial Sequence
  chemically synthesized
gctttcctcctaatccagtt

SEQ ID NO: 75706 - DNA, 20 bp, Artificial Sequence
  chemically synthesized
ctgtggaatctaaactggat

SEQ ID NO: 75707 - DNA, 20 bp, Artificial Sequence
  chemically synthesized
tgtggaatctaaactggatt

SEQ ID NO: 75708 - DNA, 20 bp, Artificial Sequence
  chemically synthesized
tggaatctaaactggattag

SEQ ID NO: 75709 - DNA, 20 bp, Artificial Sequence
  chemically synthesized
ggaatctaaactggattagg

SEQ ID NO: 75710 - DNA, 20 bp, Artificial Sequence
  chemically synthesized
gctttgctttcctcctaatc

SEQ ID NO: 75711 - DNA, 20 bp, Artificial Sequence
  chemically synthesized
tctaaactggattaggagga

SEQ ID NO: 75712 - DNA, 20 bp, Artificial Sequence
  chemically synthesized
actggattaggaggaaagca

SEQ ID NO: 75713 - DNA, 20 bp, Artificial Sequence
  chemically synthesized
gaggaaagcaaagcaaaatg

SEQ ID NO: 75714 - DNA, 20 bp, Artificial Sequence
  chemically synthesized
gcaaagcaaaatgaagcttg

SEQ ID NO: 75715 - DNA, 20 bp, Artificial Sequence
  chemically synthesized
agcaaaatgaagcttgtaga

SEQ ID NO: 75716 - DNA, 20 bp, Artificial Sequence
  chemically synthesized
caaaatgaagcttgtagatg

SEQ ID NO: 75717 - DNA, 20 bp, Artificial Sequence
  chemically synthesized
tctactttctctccatctac

SEQ ID NO: 75718 - DNA, 20 bp, Artificial Sequence
  chemically synthesized
aaatgaagcttgtagatgga

SEQ ID NO: 75719 - DNA, 20 bp, Artificial Sequence
  chemically synthesized
gaagcttgtagatggagaga

SEQ ID NO: 75720 - DNA, 20 bp, Artificial Sequence
  chemically synthesized
gcttgtagatggagagaaag

SEQ ID NO: 75721 - DNA, 20 bp, Artificial Sequence
  chemically synthesized
ttgtagatggagagaaagta

SEQ ID NO: 75722 - DNA, 20 bp, Artificial Sequence
  chemically synthesized
tgtagatggagagaaagtag

SEQ ID NO: 75723 - DNA, 20 bp, Artificial Sequence
  chemically synthesized
gtagatggagagaaagtaga

SEQ ID NO: 75724 - DNA, 20 bp, Artificial Sequence
  chemically synthesized
tagatggagagaaagtagag

SEQ ID NO: 75725 - DNA, 20 bp, Artificial Sequence
  chemically synthesized
tggagagaaagtagaggggt

SEQ ID NO: 75726 - DNA, 20 bp, Artificial Sequence
  chemically synthesized
gaaagtagaggggtcagttg

SEQ ID NO: 75727 - DNA, 20 bp, Artificial Sequence
  chemically synthesized
agtagaggggtcagttgtag

SEQ ID NO: 75728 - DNA, 20 bp, Artificial Sequence
  chemically synthesized
aggggtcagttgtagaagtc

SEQ ID NO: 75729 - DNA, 20 bp, Artificial Sequence
  chemically synthesized
ggggtcagttgtagaagtcc

SEQ ID NO: 75730 - DNA, 20 bp, Artificial Sequence
  chemically synthesized
tggccttttatggattatcc

SEQ ID NO: 75731 - DNA, 20 bp, Artificial Sequence
  chemically synthesized
aagtccaggataatccataa

SEQ ID NO: 75732 - DNA, 20 bp, Artificial Sequence
  chemically synthesized
agtccaggataatccataaa

SEQ ID NO: 75733 - DNA, 20 bp, Artificial Sequence
  chemically synthesized
actcctgctgtggcctttta

SEQ ID NO: 75734 - DNA, 20 bp, Artificial Sequence
  chemically synthesized
ggataatccataaaaggcca

SEQ ID NO: 75735 - DNA, 20 bp, Artificial Sequence
  chemically synthesized
taatccataaaaggccacag

SEQ ID NO: 75736 - DNA, 20 bp, Artificial Sequence
  chemically synthesized
aatccataaaaggccacagc

SEQ ID NO: 75737 - DNA, 20 bp, Artificial Sequence
  chemically synthesized
tccataaaaggccacagcag

SEQ ID NO: 75738 - DNA, 20 bp, Artificial Sequence
  chemically synthesized
ttgtgcagctactcctgctg

SEQ ID NO: 75739 - DNA, 20 bp, Artificial Sequence
  chemically synthesized
ataaaaggccacagcaggag

SEQ ID NO: 75740 - DNA, 20 bp, Artificial Sequence
  chemically synthesized
gcaggagtagctgcacaaac

SEQ ID NO: 75741 - DNA, 20 bp, Artificial Sequence
  chemically synthesized
ctctctgtcgcttgtttgtg

SEQ ID NO: 75742 - DNA, 20 bp, Artificial Sequence
  chemically synthesized
gtagctgcacaaacaagcga

SEQ ID NO: 75743 - DNA, 20 bp, Artificial Sequence
  chemically synthesized
agctgcacaaacaagcgaca

SEQ ID NO: 75744 - DNA, 20 bp, Artificial Sequence
  chemically synthesized
ctgcacaaacaagcgacaga

SEQ ID NO: 75745 - DNA, 20 bp, Artificial Sequence
  chemically synthesized
tgcacaaacaagcgacagag

SEQ ID NO: 75746 - DNA, 20 bp, Artificial Sequence
  chemically synthesized
gcacaaacaagcgacagaga

SEQ ID NO: 75747 - DNA, 20 bp, Artificial Sequence
  chemically synthesized
cacaaacaagcgacagagag

SEQ ID NO: 75748 - DNA, 20 bp, Artificial Sequence
  chemically synthesized
caaacaagcgacagagaggg

SEQ ID NO: 75749 - DNA, 20 bp, Artificial Sequence
  chemically synthesized
gcgacagagaggggagactc

SEQ ID NO: 75750 - DNA, 20 bp, Artificial Sequence
  chemically synthesized
cgacagagaggggagactct

SEQ ID NO: 75751 - DNA, 20 bp, Artificial Sequence
  chemically synthesized
gagctaatctgagcatccca

SEQ ID NO: 75752 - DNA, 20 bp, Artificial Sequence
  chemically synthesized
aggggagactctgggatgct

SEQ ID NO: 75753 - DNA, 20 bp, Artificial Sequence
  chemically synthesized
tagagctaatctgagcatcc

SEQ ID NO: 75754 - DNA, 20 bp, Artificial Sequence
  chemically synthesized
agactctgggatgctcagat

SEQ ID NO: 75755 - DNA, 20 bp, Artificial Sequence
  chemically synthesized
aaatccagtagagctaatct

SEQ ID NO: 75756 - DNA, 20 bp, Artificial Sequence
  chemically synthesized
gatgctcagattagctctac

SEQ ID NO: 75757 - DNA, 20 bp, Artificial Sequence
  chemically synthesized
cataagtggcaaatccagta

SEQ ID NO: 75758 - DNA, 20 bp, Artificial Sequence
  chemically synthesized
ctcataagtggcaaatccag

SEQ ID NO: 75759 - DNA, 20 bp, Artificial Sequence
  chemically synthesized
aaactcataagtggcaaatc

SEQ ID NO: 75760 - DNA, 20 bp, Artificial Sequence
  chemically synthesized
ctactggatttgccacttat

SEQ ID NO: 75761 - DNA, 20 bp, Artificial Sequence
  chemically synthesized
tttataaataaactcataag

SEQ ID NO: 75762 - DNA, 20 bp, Artificial Sequence
  chemically synthesized
ccatttataaataaactcat

SEQ ID NO: 75763 - DNA, 20 bp, Artificial Sequence
  chemically synthesized
cttatgagtttatttataaa

SEQ ID NO: 75764 - DNA, 20 bp, Artificial Sequence
  chemically synthesized
tatatatatatatatatata

SEQ ID NO: 75765 - DNA, 20 bp, Artificial Sequence
  chemically synthesized
tatatatatatatatataga

SEQ ID NO: 75766 - DNA, 20 bp, Artificial Sequence
  chemically synthesized
tatatatatatatagataga

SEQ ID NO: 75767 - DNA, 20 bp, Artificial Sequence
  chemically synthesized
tatatatatagatagataga

SEQ ID NO: 75768 - DNA, 20 bp, Artificial Sequence
  chemically synthesized
tatatagatagatagataga

SEQ ID NO: 75769 - DNA, 20 bp, Artificial Sequence
  chemically synthesized
tagatagatagatagaaatc

SEQ ID NO: 75770 - DNA, 20 bp, Artificial Sequence
  chemically synthesized
tatatttatatatatatagc

SEQ ID NO: 75771 - DNA, 20 bp, Artificial Sequence
  chemically synthesized
tatatatatttatatatata

SEQ ID NO: 75772 - DNA, 20 bp, Artificial Sequence
  chemically synthesized
tatatatatataaatatata

SEQ ID NO: 75773 - DNA, 20 bp, Artificial Sequence
  chemically synthesized
taaatatatatagtgctact

SEQ ID NO: 75774 - DNA, 20 bp, Artificial Sequence
  chemically synthesized
gaagtttttcaaacactgag

SEQ ID NO: 75775 - DNA, 20 bp, Artificial Sequence
  chemically synthesized
agggaagtttttcaaacact

SEQ ID NO: 75776 - DNA, 20 bp, Artificial Sequence
  chemically synthesized
gtttgaaaaacttcccttct

SEQ ID NO: 75777 - DNA, 20 bp, Artificial Sequence
  chemically synthesized
tttaatatccctaagaaggg

SEQ ID NO: 75778 - DNA, 20 bp, Artificial Sequence
  chemically synthesized
tttgaaaaacttcccttctt

SEQ ID NO: 75779 - DNA, 20 bp, Artificial Sequence
  chemically synthesized
ttgaaaaacttcccttctta

SEQ ID NO: 75780 - DNA, 20 bp, Artificial Sequence
  chemically synthesized
atatttaatatccctaagaa

SEQ ID NO: 75781 - DNA, 20 bp, Artificial Sequence
  chemically synthesized
aatatttaatatccctaaga

SEQ ID NO: 75782 - DNA, 20 bp, Artificial Sequence
  chemically synthesized
gaatatttaatatccctaag

SEQ ID NO: 75783 - DNA, 20 bp, Artificial Sequence
  chemically synthesized
gaggaatatttaatatccct

SEQ ID NO: 75784 - DNA, 20 bp, Artificial Sequence
  chemically synthesized
tagcaggttaagattttagg

SEQ ID NO: 75785 - DNA, 20 bp, Artificial Sequence
  chemically synthesized
ttagcaggttaagattttag

SEQ ID NO: 75786 - DNA, 20 bp, Artificial Sequence
  chemically synthesized
agttagcaggttaagatttt

SEQ ID NO: 75787 - DNA, 20 bp, Artificial Sequence
  chemically synthesized
gagttagcaggttaagattt

SEQ ID NO: 75788 - DNA, 20 bp, Artificial Sequence
  chemically synthesized
cgtctatgagttagcaggtt

SEQ ID NO: 75789 - DNA, 20 bp, Artificial Sequence
  chemically synthesized
taggacgtctatgagttagc

SEQ ID NO: 75790 - DNA, 20 bp, Artificial Sequence
  chemically synthesized
ataggacgtctatgagttag

SEQ ID NO: 75791 - DNA, 20 bp, Artificial Sequence
  chemically synthesized
aatcttaacctgctaactca

SEQ ID NO: 75792 - DNA, 20 bp, Artificial Sequence
  chemically synthesized
gagataggacgtctatgagt

SEQ ID NO: 75793 - DNA, 20 bp, Artificial Sequence
  chemically synthesized
aagtgagataggacgtctat

SEQ ID NO: 75794 - DNA, 20 bp, Artificial Sequence
  chemically synthesized
gaattcctagtaagtgagat

SEQ ID NO: 75795 - DNA, 20 bp, Artificial Sequence
  chemically synthesized
tgaattcctagtaagtgaga

SEQ ID NO: 75796 - DNA, 20 bp, Artificial Sequence
  chemically synthesized
agacgtcctatctcacttac

SEQ ID NO: 75797 - DNA, 20 bp, Artificial Sequence
  chemically synthesized
gacgtcctatctcacttact

SEQ ID NO: 75798 - DNA, 20 bp, Artificial Sequence
  chemically synthesized
attttgaattcctagtaagt

SEQ ID NO: 75799 - DNA, 20 bp, Artificial Sequence
  chemically synthesized
agtaattttgaattcctagt

SEQ ID NO: 75800 - DNA, 20 bp, Artificial Sequence
  chemically synthesized
acctagtaattttgaattcc

SEQ ID NO: 75801 - DNA, 20 bp, Artificial Sequence
  chemically synthesized
tactaggaattcaaaattac

SEQ ID NO: 75802 - DNA, 20 bp, Artificial Sequence
  chemically synthesized
actaggaattcaaaattact

SEQ ID NO: 75803 - DNA, 20 bp, Artificial Sequence
  chemically synthesized
aacacttcatttttggaacc

SEQ ID NO: 75804 - DNA, 20 bp, Artificial Sequence
  chemically synthesized
attactaggttccaaaaatg

SEQ ID NO: 75805 - DNA, 20 bp, Artificial Sequence
  chemically synthesized
caagaataacacttcatttt

SEQ ID NO: 75806 - DNA, 20 bp, Artificial Sequence
  chemically synthesized
caaaaatgaagtgttattct

SEQ ID NO: 75807 - DNA, 20 bp, Artificial Sequence
  chemically synthesized
aaaaatgaagtgttattctt

SEQ ID NO: 75808 - DNA, 20 bp, Artificial Sequence
  chemically synthesized
tctgcacgtgtatgtagccc

SEQ ID NO: 75809 - DNA, 20 bp, Artificial Sequence
  chemically synthesized
aatttctctgcacgtgtatg

SEQ ID NO: 75810 - DNA, 20 bp, Artificial Sequence
  chemically synthesized
tcttgggctacatacacgtg

SEQ ID NO: 75811 - DNA, 20 bp, Artificial Sequence
  chemically synthesized
ttgggctacatacacgtgca

SEQ ID NO: 75812 - DNA, 20 bp, Artificial Sequence
  chemically synthesized
ttatgttacaaatattactt

SEQ ID NO: 75813 - DNA, 20 bp, Artificial Sequence
  chemically synthesized
tgttacaaatattacttaag

SEQ ID NO: 75814 - DNA, 20 bp, Artificial Sequence
  chemically synthesized
gttacaaatattacttaagt

SEQ ID NO: 75815 - DNA, 20 bp, Artificial Sequence
  chemically synthesized
ttacaaatattacttaagta

SEQ ID NO: 75816 - DNA, 20 bp, Artificial Sequence
  chemically synthesized
aatgccattagtccctactt

SEQ ID NO: 75817 - DNA, 20 bp, Artificial Sequence
  chemically synthesized
attacttaagtagggactaa

SEQ ID NO: 75818 - DNA, 20 bp, Artificial Sequence
  chemically synthesized
atggtagacagcaatgccat

SEQ ID NO: 75819 - DNA, 20 bp, Artificial Sequence
  chemically synthesized
tgacaaggattcatggtaga

SEQ ID NO: 75820 - DNA, 20 bp, Artificial Sequence
  chemically synthesized
tgtttgacaaggattcatgg

SEQ ID NO: 75821 - DNA, 20 bp, Artificial Sequence
  chemically synthesized
atttgtttgacaaggattca

SEQ ID NO: 75822 - DNA, 20 bp, Artificial Sequence
  chemically synthesized
taacaaacatttgtttgaca

SEQ ID NO: 75823 - DNA, 20 bp, Artificial Sequence
  chemically synthesized
ttaacaaacatttgtttgac

SEQ ID NO: 75824 - DNA, 20 bp, Artificial Sequence
  chemically synthesized
caaacaaatgtttgttaacc

SEQ ID NO: 75825 - DNA, 20 bp, Artificial Sequence
  chemically synthesized
tgtttgttaaccaagactct

SEQ ID NO: 75826 - DNA, 20 bp, Artificial Sequence
  chemically synthesized
aggctgttttccaagagtct

SEQ ID NO: 75827 - DNA, 20 bp, Artificial Sequence
  chemically synthesized
ctttttaggctgttttccaa

SEQ ID NO: 75828 - DNA, 20 bp, Artificial Sequence
  chemically synthesized
taaccaagactcttggaaaa

SEQ ID NO: 75829 - DNA, 20 bp, Artificial Sequence
  chemically synthesized
ctctttttaggctgttttcc

SEQ ID NO: 75830 - DNA, 20 bp, Artificial Sequence
  chemically synthesized
ctcttggaaaacagcctaaa

SEQ ID NO: 75831 - DNA, 20 bp, Artificial Sequence
  chemically synthesized
cttggaaaacagcctaaaaa

SEQ ID NO: 75832 - DNA, 20 bp, Artificial Sequence
  chemically synthesized
ttggaaaacagcctaaaaag

SEQ ID NO: 75833 - DNA, 20 bp, Artificial Sequence
  chemically synthesized
tcctagcacctcctcttttt

SEQ ID NO: 75834 - DNA, 20 bp, Artificial Sequence
  chemically synthesized
ggaaaacagcctaaaaagag

SEQ ID NO: 75835 - DNA, 20 bp, Artificial Sequence
  chemically synthesized
ttcctagcacctcctctttt

SEQ ID NO: 75836 - DNA, 20 bp, Artificial Sequence
  chemically synthesized
gaaaacagcctaaaaagagg

SEQ ID NO: 75837 - DNA, 20 bp, Artificial Sequence
  chemically synthesized
agcctaaaaagaggaggtgc

SEQ ID NO: 75838 - DNA, 20 bp, Artificial Sequence
  chemically synthesized
gcctaaaaagaggaggtgct

SEQ ID NO: 75839 - DNA, 20 bp, Artificial Sequence
  chemically synthesized
aaaaagaggaggtgctagga

SEQ ID NO: 75840 - DNA, 20 bp, Artificial Sequence
  chemically synthesized
atgctgggacttttctttcc

SEQ ID NO: 75841 - DNA, 20 bp, Artificial Sequence
  chemically synthesized
gaggaggtgctaggaaagaa

SEQ ID NO: 75842 - DNA, 20 bp, Artificial Sequence
  chemically synthesized
gtgctaggaaagaaaagtcc

SEQ ID NO: 75843 - DNA, 20 bp, Artificial Sequence
  chemically synthesized
agctcagcatgaagaatgct

SEQ ID NO: 75844 - DNA, 20 bp, Artificial Sequence
  chemically synthesized
tagctcagcatgaagaatgc

SEQ ID NO: 75845 - DNA, 20 bp, Artificial Sequence
  chemically synthesized
gtcccagcattcttcatgct

SEQ ID NO: 75846 - DNA, 20 bp, Artificial Sequence
  chemically synthesized
ctcatgactagctcagcatg

SEQ ID NO: 75847 - DNA, 20 bp, Artificial Sequence
  chemically synthesized
cagcattcttcatgctgagc

SEQ ID NO: 75848 - DNA, 20 bp, Artificial Sequence
  chemically synthesized
ttgccttctcatgactagct

SEQ ID NO: 75849 - DNA, 20 bp, Artificial Sequence
  chemically synthesized
cttcatgctgagctagtcat

SEQ ID NO: 75850 - DNA, 20 bp, Artificial Sequence
  chemically synthesized
catccttgccttctcatgac

SEQ ID NO: 75851 - DNA, 20 bp, Artificial Sequence
  chemically synthesized
catgctgagctagtcatgag

SEQ ID NO: 75852 - DNA, 20 bp, Artificial Sequence
  chemically synthesized
atgctgagctagtcatgaga

SEQ ID NO: 75853 - DNA, 20 bp, Artificial Sequence
  chemically synthesized
tgagctagtcatgagaaggc

SEQ ID NO: 75854 - DNA, 20 bp, Artificial Sequence
  chemically synthesized
gagctagtcatgagaaggca

SEQ ID NO: 75855 - DNA, 20 bp, Artificial Sequence
  chemically synthesized
agtcatgagaaggcaaggat

SEQ ID NO: 75856 - DNA, 20 bp, Artificial Sequence
  chemically synthesized
agaaggcaaggatgagcaat

SEQ ID NO: 75857 - DNA, 20 bp, Artificial Sequence
  chemically synthesized
tactaaacaccagtatttat

SEQ ID NO: 75858 - DNA, 20 bp, Artificial Sequence
  chemically synthesized
aaatcatgtcctataaatac

SEQ ID NO: 75859 - DNA, 20 bp, Artificial Sequence
  chemically synthesized
gtactaaacaccagtattta

SEQ ID NO: 75860 - DNA, 20 bp, Artificial Sequence
  chemically synthesized
gtcctataaatactggtgtt

SEQ ID NO: 75861 - DNA, 20 bp, Artificial Sequence
  chemically synthesized
ccggaataagtactaaacac

SEQ ID NO: 75862 - DNA, 20 bp, Artificial Sequence
  chemically synthesized
ctggtgtttagtacttattc

SEQ ID NO: 75863 - DNA, 20 bp, Artificial Sequence
  chemically synthesized
tggtgtttagtacttattcc

SEQ ID NO: 75864 - DNA, 20 bp, Artificial Sequence
  chemically synthesized
ggtgtttagtacttattccg

SEQ ID NO: 75865 - DNA, 20 bp, Artificial Sequence
  chemically synthesized
acgaggaagagccccggaat

SEQ ID NO: 75866 - DNA, 20 bp, Artificial Sequence
  chemically synthesized
tgaaccacgaggaagagccc

SEQ ID NO: 75867 - DNA, 20 bp, Artificial Sequence
  chemically synthesized
tattccggggctcttcctcg

SEQ ID NO: 75868 - DNA, 20 bp, Artificial Sequence
  chemically synthesized
cttccctgaaccacgaggaa

SEQ ID NO: 75869 - DNA, 20 bp, Artificial Sequence
  chemically synthesized
ggcttccctgaaccacgagg

SEQ ID NO: 75870 - DNA, 20 bp, Artificial Sequence
  chemically synthesized
cggggctcttcctcgtggtt

SEQ ID NO: 75871 - DNA, 20 bp, Artificial Sequence
  chemically synthesized
gagggcttccctgaaccacg

SEQ ID NO: 75872 - DNA, 20 bp, Artificial Sequence
  chemically synthesized
ggggctcttcctcgtggttc

SEQ ID NO: 75873 - DNA, 20 bp, Artificial Sequence
  chemically synthesized
tgagggcttccctgaaccac

SEQ ID NO: 75874 - DNA, 20 bp, Artificial Sequence
  chemically synthesized
gggctcttcctcgtggttca

SEQ ID NO: 75875 - DNA, 20 bp, Artificial Sequence
  chemically synthesized
ctcttcctcgtggttcaggg

SEQ ID NO: 75876 - DNA, 20 bp, Artificial Sequence
  chemically synthesized
gtggttcagggaagccctca

SEQ ID NO: 75877 - DNA, 20 bp, Artificial Sequence
  chemically synthesized
cgggtaattgcattctgtga

SEQ ID NO: 75878 - DNA, 20 bp, Artificial Sequence
  chemically synthesized
ccgggtaattgcattctgtg

SEQ ID NO: 75879 - DNA, 20 bp, Artificial Sequence
  chemically synthesized
cccgggtaattgcattctgt

SEQ ID NO: 75880 - DNA, 20 bp, Artificial Sequence
  chemically synthesized
cctcacagaatgcaattacc

SEQ ID NO: 75881 - DNA, 20 bp, Artificial Sequence
  chemically synthesized
ctcacagaatgcaattaccc

SEQ ID NO: 75882 - DNA, 20 bp, Artificial Sequence
  chemically synthesized
gaatgcaattacccgggaat

SEQ ID NO: 75883 - DNA, 20 bp, Artificial Sequence
  chemically synthesized
tgtacctgctgccaattccc

SEQ ID NO: 75884 - DNA, 20 bp, Artificial Sequence
  chemically synthesized
ctgtacctgctgccaattcc

SEQ ID NO: 75885 - DNA, 20 bp, Artificial Sequence
  chemically synthesized
tgcaattacccgggaattgg

SEQ ID NO: 75886 - DNA, 20 bp, Artificial Sequence
  chemically synthesized
aattacccgggaattggcag

SEQ ID NO: 75887 - DNA, 20 bp, Artificial Sequence
  chemically synthesized
attacccgggaattggcagc

SEQ ID NO: 75888 - DNA, 20 bp, Artificial Sequence
  chemically synthesized
ccgggaattggcagcaggta

SEQ ID NO: 75889 - DNA, 20 bp, Artificial Sequence
  chemically synthesized
aattggcagcaggtacagcc

SEQ ID NO: 75890 - DNA, 20 bp, Artificial Sequence
  chemically synthesized
aggagctgcaaaacatagct

SEQ ID NO: 75891 - DNA, 20 bp, Artificial Sequence
  chemically synthesized
caggagctgcaaaacatagc

SEQ ID NO: 75892 - DNA, 20 bp, Artificial Sequence
  chemically synthesized
tacagcccagctatgttttg

SEQ ID NO: 75893 - DNA, 20 bp, Artificial Sequence
  chemically synthesized
aatgcaggagctgcaaaaca

SEQ ID NO: 75894 - DNA, 20 bp, Artificial Sequence
  chemically synthesized
atatctgctgagaaatgcag

SEQ ID NO: 75895 - DNA, 20 bp, Artificial Sequence
  chemically synthesized
atatatctgctgagaaatgc

SEQ ID NO: 75896 - DNA, 20 bp, Artificial Sequence
  chemically synthesized
tttgcagctcctgcatttct

SEQ ID NO: 75897 - DNA, 20 bp, Artificial Sequence
  chemically synthesized
gatatatctgctgagaaatg

SEQ ID NO: 75898 - DNA, 20 bp, Artificial Sequence
  chemically synthesized
gcagctcctgcatttctcag

SEQ ID NO: 75899 - DNA, 20 bp, Artificial Sequence
  chemically synthesized
atgaggatgatatatctgct

SEQ ID NO: 75900 - DNA, 20 bp, Artificial Sequence
  chemically synthesized
cagcagatatatcatcctca

SEQ ID NO: 75901 - DNA, 20 bp, Artificial Sequence
  chemically synthesized
agcagatatatcatcctcat

SEQ ID NO: 75902 - DNA, 20 bp, Artificial Sequence
  chemically synthesized
gcagatatatcatcctcatg

SEQ ID NO: 75903 - DNA, 20 bp, Artificial Sequence
  chemically synthesized
ttgactctcttggccccatg

SEQ ID NO: 75904 - DNA, 20 bp, Artificial Sequence
  chemically synthesized
cttgactctcttggccccat

SEQ ID NO: 75905 - DNA, 20 bp, Artificial Sequence
  chemically synthesized
tatatcatcctcatggggcc

SEQ ID NO: 75906 - DNA, 20 bp, Artificial Sequence
  chemically synthesized
tatcatcctcatggggccaa

SEQ ID NO: 75907 - DNA, 20 bp, Artificial Sequence
  chemically synthesized
tcatcctcatggggccaaga

SEQ ID NO: 75908 - DNA, 20 bp, Artificial Sequence
  chemically synthesized
gatacagtccttgactctct

SEQ ID NO: 75909 - DNA, 20 bp, Artificial Sequence
  chemically synthesized
ctcatggggccaagagagtc

SEQ ID NO: 75910 - DNA, 20 bp, Artificial Sequence
  chemically synthesized
tcatggggccaagagagtca

SEQ ID NO: 75911 - DNA, 20 bp, Artificial Sequence
  chemically synthesized
cctctggaaaaagcaagata

SEQ ID NO: 75912 - DNA, 20 bp, Artificial Sequence
  chemically synthesized
tctgatcctctggaaaaagc

SEQ ID NO: 75913 - DNA, 20 bp, Artificial Sequence
  chemically synthesized
ggactgtatcttgctttttc

SEQ ID NO: 75914 - DNA, 20 bp, Artificial Sequence
  chemically synthesized
actgtatcttgctttttcca

SEQ ID NO: 75915 - DNA, 20 bp, Artificial Sequence
  chemically synthesized
ctgtatcttgctttttccag

SEQ ID NO: 75916 - DNA, 20 bp, Artificial Sequence
  chemically synthesized
ggcctctgatcctctggaaa

SEQ ID NO: 75917 - DNA, 20 bp, Artificial Sequence
  chemically synthesized
tcttgctttttccagaggat

SEQ ID NO: 75918 - DNA, 20 bp, Artificial Sequence
  chemically synthesized
ccagtaggcctctgatcctc

SEQ ID NO: 75919 - DNA, 20 bp, Artificial Sequence
  chemically synthesized
ttgctttttccagaggatca

SEQ ID NO: 75920 - DNA, 20 bp, Artificial Sequence
  chemically synthesized
tgctttttccagaggatcag

SEQ ID NO: 75921 - DNA, 20 bp, Artificial Sequence
  chemically synthesized
ccagaggatcagaggcctac

SEQ ID NO: 75922 - DNA, 20 bp, Artificial Sequence
  chemically synthesized
ggtatttgagagattccagt

SEQ ID NO: 75923 - DNA, 20 bp, Artificial Sequence
  chemically synthesized
aggtatttgagagattccag

SEQ ID NO: 75924 - DNA, 20 bp, Artificial Sequence
  chemically synthesized
cccaggtatttgagagattc

SEQ ID NO: 75925 - DNA, 20 bp, Artificial Sequence
  chemically synthesized
cattccgcccaggtatttga

SEQ ID NO: 75926 - DNA, 20 bp, Artificial Sequence
  chemically synthesized
actggaatctctcaaatacc

SEQ ID NO: 75927 - DNA, 20 bp, Artificial Sequence
  chemically synthesized
ctcattccgcccaggtattt

SEQ ID NO: 75928 - DNA, 20 bp, Artificial Sequence
  chemically synthesized
ctggaatctctcaaatacct

SEQ ID NO: 75929 - DNA, 20 bp, Artificial Sequence
  chemically synthesized
gaatctctcaaatacctggg

SEQ ID NO: 75930 - DNA, 20 bp, Artificial Sequence
  chemically synthesized
ttgagtagctcattccgccc

SEQ ID NO: 75931 - DNA, 20 bp, Artificial Sequence
  chemically synthesized
tttgagtagctcattccgcc

SEQ ID NO: 75932 - DNA, 20 bp, Artificial Sequence
  chemically synthesized
ctcaaatacctgggcggaat

SEQ ID NO: 75933 - DNA, 20 bp, Artificial Sequence
  chemically synthesized
ttgtttcaacagcatttgag

SEQ ID NO: 75934 - DNA, 20 bp, Artificial Sequence
  chemically synthesized
taattgtttcaacagcattt

SEQ ID NO: 75935 - DNA, 20 bp, Artificial Sequence
  chemically synthesized
tttctttttaattgtttcaa

SEQ ID NO: 75936 - DNA, 20 bp, Artificial Sequence
  chemically synthesized
atgctgttgaaacaattaaa

SEQ ID NO: 75937 - DNA, 20 bp, Artificial Sequence
  chemically synthesized
aaacaattaaaaagaaacac

SEQ ID NO: 75938 - DNA, 20 bp, Artificial Sequence
  chemically synthesized
attaaaaagaaacacaagtt

SEQ ID NO: 75939 - DNA, 20 bp, Artificial Sequence
  chemically synthesized
agaaacacaagttgagctgt

SEQ ID NO: 75940 - DNA, 20 bp, Artificial Sequence
  chemically synthesized
acacaagttgagctgtaagc

SEQ ID NO: 75941 - DNA, 20 bp, Artificial Sequence
  chemically synthesized
tttcatgaagggcttgctta

SEQ ID NO: 75942 - DNA, 20 bp, Artificial Sequence
  chemically synthesized
agcctgatacatttcatgaa

SEQ ID NO: 75943 - DNA, 20 bp, Artificial Sequence
  chemically synthesized
gagcctgatacatttcatga

SEQ ID NO: 75944 - DNA, 20 bp, Artificial Sequence
  chemically synthesized
tgagcctgatacatttcatg

SEQ ID NO: 75945 - DNA, 20 bp, Artificial Sequence
  chemically synthesized
aagcccttcatgaaatgtat

SEQ ID NO: 75946 - DNA, 20 bp, Artificial Sequence
  chemically synthesized
agcccttcatgaaatgtatc

SEQ ID NO: 75947 - DNA, 20 bp, Artificial Sequence
  chemically synthesized
ttcatgaaatgtatcaggct

SEQ ID NO: 75948 - DNA, 20 bp, Artificial Sequence
  chemically synthesized
catgaaatgtatcaggctca

SEQ ID NO: 75949 - DNA, 20 bp, Artificial Sequence
  chemically synthesized
agataatgatggaagtctct

SEQ ID NO: 75950 - DNA, 20 bp, Artificial Sequence
  chemically synthesized
aaaattacagataatgatgg

SEQ ID NO: 75951 - DNA, 20 bp, Artificial Sequence
  chemically synthesized
tcaaaaattacagataatga

SEQ ID NO: 75952 - DNA, 20 bp, Artificial Sequence
  chemically synthesized
gaatgaaaagtcaaaaatta

SEQ ID NO: 75953 - DNA, 20 bp, Artificial Sequence
  chemically synthesized
taatttttgacttttcattc

SEQ ID NO: 75954 - DNA, 20 bp, Artificial Sequence
  chemically synthesized
agggaaccaaccagaatgaa

SEQ ID NO: 75955 - DNA, 20 bp, Artificial Sequence
  chemically synthesized
ttttgacttttcattctggt

SEQ ID NO: 75956 - DNA, 20 bp, Artificial Sequence
  chemically synthesized
agagcagtcagggaaccaac

SEQ ID NO: 75957 - DNA, 20 bp, Artificial Sequence
  chemically synthesized
tctgggcatcagagcagtca

SEQ ID NO: 75958 - DNA, 20 bp, Artificial Sequence
  chemically synthesized
ttctgggcatcagagcagtc

SEQ ID NO: 75959 - DNA, 20 bp, Artificial Sequence
  chemically synthesized
attctgggcatcagagcagt

SEQ ID NO: 75960 - DNA, 20 bp, Artificial Sequence
  chemically synthesized
ctacattctgggcatcagag

SEQ ID NO: 75961 - DNA, 20 bp, Artificial Sequence
  chemically synthesized
tccctgactgctctgatgcc

SEQ ID NO: 75962 - DNA, 20 bp, Artificial Sequence
  chemically synthesized
tacctacattctgggcatca

SEQ ID NO: 75963 - DNA, 20 bp, Artificial Sequence
  chemically synthesized
tgtacctacattctgggcat

SEQ ID NO: 75964 - DNA, 20 bp, Artificial Sequence
  chemically synthesized
ctgctctgatgcccagaatg

SEQ ID NO: 75965 - DNA, 20 bp, Artificial Sequence
  chemically synthesized
tgctctgatgcccagaatgt

SEQ ID NO: 75966 - DNA, 20 bp, Artificial Sequence
  chemically synthesized
aaaagctgtacctacattct

SEQ ID NO: 75967 - DNA, 20 bp, Artificial Sequence
  chemically synthesized
gaaaagctgtacctacattc

SEQ ID NO: 75968 - DNA, 20 bp, Artificial Sequence
  chemically synthesized
tgatgcccagaatgtaggta

SEQ ID NO: 75969 - DNA, 20 bp, Artificial Sequence
  chemically synthesized
tgtaggtacagcttttcttt

SEQ ID NO: 75970 - DNA, 20 bp, Artificial Sequence
  chemically synthesized
gcagtaggtatctgaaagaa

SEQ ID NO: 75971 - DNA, 20 bp, Artificial Sequence
  chemically synthesized
tgaaggcagtaggtatctga

SEQ ID NO: 75972 - DNA, 20 bp, Artificial Sequence
  chemically synthesized
taaacctggctgaaggcagt

SEQ ID NO: 75973 - DNA, 20 bp, Artificial Sequence
  chemically synthesized
tttcagatacctactgcctt

SEQ ID NO: 75974 - DNA, 20 bp, Artificial Sequence
  chemically synthesized
ttaaacctggctgaaggcag

SEQ ID NO: 75975 - DNA, 20 bp, Artificial Sequence
  chemically synthesized
ctcttaaacctggctgaagg

SEQ ID NO: 75976 - DNA, 20 bp, Artificial Sequence
  chemically synthesized
agatacctactgccttcagc

SEQ ID NO: 75977 - DNA, 20 bp, Artificial Sequence
  chemically synthesized
gatacctactgccttcagcc

SEQ ID NO: 75978 - DNA, 20 bp, Artificial Sequence
  chemically synthesized
cttctcttaaacctggctga

SEQ ID NO: 75979 - DNA, 20 bp, Artificial Sequence
  chemically synthesized
gcttctcttaaacctggctg

SEQ ID NO: 75980 - DNA, 20 bp, Artificial Sequence
  chemically synthesized
tactgccttcagccaggttt

SEQ ID NO: 75981 - DNA, 20 bp, Artificial Sequence
  chemically synthesized
ctgccttcagccaggtttaa

SEQ ID NO: 75982 - DNA, 20 bp, Artificial Sequence
  chemically synthesized
gactctgcttctcttaaacc

SEQ ID NO: 75983 - DNA, 20 bp, Artificial Sequence
  chemically synthesized
ccttcagccaggtttaagag

SEQ ID NO: 75984 - DNA, 20 bp, Artificial Sequence
  chemically synthesized
tcagccaggtttaagagaag

SEQ ID NO: 75985 - DNA, 20 bp, Artificial Sequence
  chemically synthesized
agccaggtttaagagaagca

SEQ ID NO: 75986 - DNA, 20 bp, Artificial Sequence
  chemically synthesized
gtttaagagaagcagagtct

SEQ ID NO: 75987 - DNA, 20 bp, Artificial Sequence
  chemically synthesized
ccctttttcttaagagcact

SEQ ID NO: 75988 - DNA, 20 bp, Artificial Sequence
  chemically synthesized
agcagagtctgagtgctctt

SEQ ID NO: 75989 - DNA, 20 bp, Artificial Sequence
  chemically synthesized
tctcactccctttttcttaa

SEQ ID NO: 75990 - DNA, 20 bp, Artificial Sequence
  chemically synthesized
gtctgagtgctcttaagaaa

SEQ ID NO: 75991 - DNA, 20 bp, Artificial Sequence
  chemically synthesized
tctgagtgctcttaagaaaa

SEQ ID NO: 75992 - DNA, 20 bp, Artificial Sequence
  chemically synthesized
tctctcactccctttttctt

SEQ ID NO: 75993 - DNA, 20 bp, Artificial Sequence
  chemically synthesized
ctgagtgctcttaagaaaaa

SEQ ID NO: 75994 - DNA, 20 bp, Artificial Sequence
  chemically synthesized
gagtgctcttaagaaaaagg

SEQ ID NO: 75995 - DNA, 20 bp, Artificial Sequence
  chemically synthesized
gctcttaagaaaaagggagt

SEQ ID NO: 75996 - DNA, 20 bp, Artificial Sequence
  chemically synthesized
tcttaagaaaaagggagtga

SEQ ID NO: 75997 - DNA, 20 bp, Artificial Sequence
  chemically synthesized
taagaaaaagggagtgagag

SEQ ID NO: 75998 - DNA, 20 bp, Artificial Sequence
  chemically synthesized
gaaaaagggagtgagagaag

SEQ ID NO: 75999 - DNA, 20 bp, Artificial Sequence
  chemically synthesized
aaaaagggagtgagagaagc

SEQ ID NO: 76000 - DNA, 20 bp, Artificial Sequence
  chemically synthesized
aagggagtgagagaagcagg

SEQ ID NO: 76001 - DNA, 20 bp, Artificial Sequence
  chemically synthesized
gagtgagagaagcaggaaga

SEQ ID NO: 76002 - DNA, 20 bp, Artificial Sequence
  chemically synthesized
agtgagagaagcaggaagac

SEQ ID NO: 76003 - DNA, 20 bp, Artificial Sequence
  chemically synthesized
gtgagagaagcaggaagaca

SEQ ID NO: 76004 - DNA, 20 bp, Artificial Sequence
  chemically synthesized
gagaagcaggaagacagggc

SEQ ID NO: 76005 - DNA, 20 bp, Artificial Sequence
  chemically synthesized
agcaggaagacagggcaaga

SEQ ID NO: 76006 - DNA, 20 bp, Artificial Sequence
  chemically synthesized
gaagacagggcaagaaagtt

SEQ ID NO: 76007 - DNA, 20 bp, Artificial Sequence
  chemically synthesized
acagggcaagaaagttaagt

SEQ ID NO: 76008 - DNA, 20 bp, Artificial Sequence
  chemically synthesized
cagggcaagaaagttaagtt

SEQ ID NO: 76009 - DNA, 20 bp, Artificial Sequence
  chemically synthesized
aagaaagttaagttgggatg

SEQ ID NO: 76010 - DNA, 20 bp, Artificial Sequence
  chemically synthesized
agttaagttgggatgtggta

SEQ ID NO: 76011 - DNA, 20 bp, Artificial Sequence
  chemically synthesized
gttaagttgggatgtggtat

SEQ ID NO: 76012 - DNA, 20 bp, Artificial Sequence
  chemically synthesized
agttgggatgtggtatgggc

SEQ ID NO: 76013 - DNA, 20 bp, Artificial Sequence
  chemically synthesized
ttgggatgtggtatgggctg

SEQ ID NO: 76014 - DNA, 20 bp, Artificial Sequence
  chemically synthesized
atgtggtatgggctggagac

SEQ ID NO: 76015 - DNA, 20 bp, Artificial Sequence
  chemically synthesized
gccagattgatgctggtctc

SEQ ID NO: 76016 - DNA, 20 bp, Artificial Sequence
  chemically synthesized
ccatggggccagattgatgc

SEQ ID NO: 76017 - DNA, 20 bp, Artificial Sequence
  chemically synthesized
gctggagaccagcatcaatc

SEQ ID NO: 76018 - DNA, 20 bp, Artificial Sequence
  chemically synthesized
ccagcatcaatctggcccca

SEQ ID NO: 76019 - DNA, 20 bp, Artificial Sequence
  chemically synthesized
cagcatcaatctggccccat

SEQ ID NO: 76020 - DNA, 20 bp, Artificial Sequence
  chemically synthesized
tctgggaattcccatggggc

SEQ ID NO: 76021 - DNA, 20 bp, Artificial Sequence
  chemically synthesized
gtgatctgggaattcccatg

SEQ ID NO: 76022 - DNA, 20 bp, Artificial Sequence
  chemically synthesized
tgtgatctgggaattcccat

SEQ ID NO: 76023 - DNA, 20 bp, Artificial Sequence
  chemically synthesized
ttgtgatctgggaattccca

SEQ ID NO: 76024 - DNA, 20 bp, Artificial Sequence
  chemically synthesized
tctggccccatgggaattcc

SEQ ID NO: 76025 - DNA, 20 bp, Artificial Sequence
  chemically synthesized
tgttgtacaatttgtgatct

SEQ ID NO: 76026 - DNA, 20 bp, Artificial Sequence
  chemically synthesized
ctgttgtacaatttgtgatc

SEQ ID NO: 76027 - DNA, 20 bp, Artificial Sequence
  chemically synthesized
ccagatcacaaattgtacaa

SEQ ID NO: 76028 - DNA, 20 bp, Artificial Sequence
  chemically synthesized
gatcacaaattgtacaacag

SEQ ID NO: 76029 - DNA, 20 bp, Artificial Sequence
  chemically synthesized
atcacaaattgtacaacagc

SEQ ID NO: 76030 - DNA, 20 bp, Artificial Sequence
  chemically synthesized
acaacagcaggtgccatgat

SEQ ID NO: 76031 - DNA, 20 bp, Artificial Sequence
  chemically synthesized
caacagcaggtgccatgatg

SEQ ID NO: 76032 - DNA, 20 bp, Artificial Sequence
  chemically synthesized
aaaacccctttgcctcatca

SEQ ID NO: 76033 - DNA, 20 bp, Artificial Sequence
  chemically synthesized
gcaggtgccatgatgaggca

SEQ ID NO: 76034 - DNA, 20 bp, Artificial Sequence
  chemically synthesized
caggtgccatgatgaggcaa

SEQ ID NO: 76035 - DNA, 20 bp, Artificial Sequence
  chemically synthesized
aggtgccatgatgaggcaaa

SEQ ID NO: 76036 - DNA, 20 bp, Artificial Sequence
  chemically synthesized
ggtgccatgatgaggcaaag

SEQ ID NO: 76037 - DNA, 20 bp, Artificial Sequence
  chemically synthesized
aaaaccaccaggggtacaaa

SEQ ID NO: 76038 - DNA, 20 bp, Artificial Sequence
  chemically synthesized
taaaaccaccaggggtacaa

SEQ ID NO: 76039 - DNA, 20 bp, Artificial Sequence
  chemically synthesized
ttaaaaccaccaggggtaca

SEQ ID NO: 76040 - DNA, 20 bp, Artificial Sequence
  chemically synthesized
gggttttccctttgtacccc

SEQ ID NO: 76041 - DNA, 20 bp, Artificial Sequence
  chemically synthesized
ttttccctttgtacccctgg

SEQ ID NO: 76042 - DNA, 20 bp, Artificial Sequence
  chemically synthesized
ttctctcttaaaaccaccag

SEQ ID NO: 76043 - DNA, 20 bp, Artificial Sequence
  chemically synthesized
cttctctcttaaaaccacca

SEQ ID NO: 76044 - DNA, 20 bp, Artificial Sequence
  chemically synthesized
ccttctctcttaaaaccacc

SEQ ID NO: 76045 - DNA, 20 bp, Artificial Sequence
  chemically synthesized
accttctctcttaaaaccac

SEQ ID NO: 76046 - DNA, 20 bp, Artificial Sequence
  chemically synthesized
tttgtacccctggtggtttt

SEQ ID NO: 76047 - DNA, 20 bp, Artificial Sequence
  chemically synthesized
tgtacccctggtggttttaa

SEQ ID NO: 76048 - DNA, 20 bp, Artificial Sequence
  chemically synthesized
tacccctggtggttttaaga

SEQ ID NO: 76049 - DNA, 20 bp, Artificial Sequence
  chemically synthesized
ccctggtggttttaagagag

SEQ ID NO: 76050 - DNA, 20 bp, Artificial Sequence
  chemically synthesized
cctggtggttttaagagaga

SEQ ID NO: 76051 - DNA, 20 bp, Artificial Sequence
  chemically synthesized
tggttttaagagagaaggtg

SEQ ID NO: 76052 - DNA, 20 bp, Artificial Sequence
  chemically synthesized
ttttaagagagaaggtgtgg

SEQ ID NO: 76053 - DNA, 20 bp, Artificial Sequence
  chemically synthesized
tttaagagagaaggtgtggt

SEQ ID NO: 76054 - DNA, 20 bp, Artificial Sequence
  chemically synthesized
gaaggtgtggtgggacatgc

SEQ ID NO: 76055 - DNA, 20 bp, Artificial Sequence
  chemically synthesized
tgtggtgggacatgccagtc

SEQ ID NO: 76056 - DNA, 20 bp, Artificial Sequence
  chemically synthesized
gtggtgggacatgccagtca

SEQ ID NO: 76057 - DNA, 20 bp, Artificial Sequence
  chemically synthesized
gtgggacatgccagtcaagg

SEQ ID NO: 76058 - DNA, 20 bp, Artificial Sequence
  chemically synthesized
caaaaggaagccaccttgac

SEQ ID NO: 76059 - DNA, 20 bp, Artificial Sequence
  chemically synthesized
cagtcaaggtggcttccttt

SEQ ID NO: 76060 - DNA, 20 bp, Artificial Sequence
  chemically synthesized
aacctccctcagccaaaagg

SEQ ID NO: 76061 - DNA, 20 bp, Artificial Sequence
  chemically synthesized
aaggtggcttccttttggct

SEQ ID NO: 76062 - DNA, 20 bp, Artificial Sequence
  chemically synthesized
gagaacctccctcagccaaa

SEQ ID NO: 76063 - DNA, 20 bp, Artificial Sequence
  chemically synthesized
aggtggcttccttttggctg

SEQ ID NO: 76064 - DNA, 20 bp, Artificial Sequence
  chemically synthesized
agagaacctccctcagccaa

SEQ ID NO: 76065 - DNA, 20 bp, Artificial Sequence
  chemically synthesized
ggtggcttccttttggctga

SEQ ID NO: 76066 - DNA, 20 bp, Artificial Sequence
  chemically synthesized
tggcttccttttggctgagg

SEQ ID NO: 76067 - DNA, 20 bp, Artificial Sequence
  chemically synthesized
ggcttccttttggctgaggg

SEQ ID NO: 76068 - DNA, 20 bp, Artificial Sequence
  chemically synthesized
cctttccagagaacctccct

SEQ ID NO: 76069 - DNA, 20 bp, Artificial Sequence
  chemically synthesized
tttggctgagggaggttctc

SEQ ID NO: 76070 - DNA, 20 bp, Artificial Sequence
  chemically synthesized
gctgagggaggttctctgga

SEQ ID NO: 76071 - DNA, 20 bp, Artificial Sequence
  chemically synthesized
ctgagggaggttctctggaa

SEQ ID NO: 76072 - DNA, 20 bp, Artificial Sequence
  chemically synthesized
tgagggaggttctctggaaa

SEQ ID NO: 76073 - DNA, 20 bp, Artificial Sequence
  chemically synthesized
gagggaggttctctggaaag

SEQ ID NO: 76074 - DNA, 20 bp, Artificial Sequence
  chemically synthesized
catggtttcacccctttcca

SEQ ID NO: 76075 - DNA, 20 bp, Artificial Sequence
  chemically synthesized
ctcatggtttcacccctttc

SEQ ID NO: 76076 - DNA, 20 bp, Artificial Sequence
  chemically synthesized
ctggaaaggggtgaaaccat

SEQ ID NO: 76077 - DNA, 20 bp, Artificial Sequence
  chemically synthesized
tggaaaggggtgaaaccatg

SEQ ID NO: 76078 - DNA, 20 bp, Artificial Sequence
  chemically synthesized
tattagctgctaaagcctca

SEQ ID NO: 76079 - DNA, 20 bp, Artificial Sequence
  chemically synthesized
ggggtgaaaccatgaggctt

SEQ ID NO: 76080 - DNA, 20 bp, Artificial Sequence
  chemically synthesized
gtgaaaccatgaggctttag

SEQ ID NO: 76081 - DNA, 20 bp, Artificial Sequence
  chemically synthesized
actctgagtattagctgcta

SEQ ID NO: 76082 - DNA, 20 bp, Artificial Sequence
  chemically synthesized
aggctttagcagctaatact

SEQ ID NO: 76083 - DNA, 20 bp, Artificial Sequence
  chemically synthesized
gctttagcagctaatactca

SEQ ID NO: 76084 - DNA, 20 bp, Artificial Sequence
  chemically synthesized
tcctcagtgactctgagtat

SEQ ID NO: 76085 - DNA, 20 bp, Artificial Sequence
  chemically synthesized
acccattcctcagtgactct

SEQ ID NO: 76086 - DNA, 20 bp, Artificial Sequence
  chemically synthesized
agctaatactcagagtcact

SEQ ID NO: 76087 - DNA, 20 bp, Artificial Sequence
  chemically synthesized
gctaatactcagagtcactg

SEQ ID NO: 76088 - DNA, 20 bp, Artificial Sequence
  chemically synthesized
tactcagagtcactgaggaa

SEQ ID NO: 76089 - DNA, 20 bp, Artificial Sequence
  chemically synthesized
actcagagtcactgaggaat

SEQ ID NO: 76090 - DNA, 20 bp, Artificial Sequence
  chemically synthesized
gggttggtgcacccattcct

SEQ ID NO: 76091 - DNA, 20 bp, Artificial Sequence
  chemically synthesized
gaggaatgggtgcaccaacc

SEQ ID NO: 76092 - DNA, 20 bp, Artificial Sequence
  chemically synthesized
gtcagattcgttcactgggt

SEQ ID NO: 76093 - DNA, 20 bp, Artificial Sequence
  chemically synthesized
cccagtcagattcgttcact

SEQ ID NO: 76094 - DNA, 20 bp, Artificial Sequence
  chemically synthesized
ccccagtcagattcgttcac

SEQ ID NO: 76095 - DNA, 20 bp, Artificial Sequence
  chemically synthesized
acccagtgaacgaatctgac

SEQ ID NO: 76096 - DNA, 20 bp, Artificial Sequence
  chemically synthesized
cccagtgaacgaatctgact

SEQ ID NO: 76097 - DNA, 20 bp, Artificial Sequence
  chemically synthesized
ccagtgaacgaatctgactg

SEQ ID NO: 76098 - DNA, 20 bp, Artificial Sequence
  chemically synthesized
gatgctgttggtgccccagt

SEQ ID NO: 76099 - DNA, 20 bp, Artificial Sequence
  chemically synthesized
aatggatgctgttggtgccc

SEQ ID NO: 76100 - DNA, 20 bp, Artificial Sequence
  chemically synthesized
gaatctgactggggcaccaa

SEQ ID NO: 76101 - DNA, 20 bp, Artificial Sequence
  chemically synthesized
atctaagtaatggatgctgt

SEQ ID NO: 76102 - DNA, 20 bp, Artificial Sequence
  chemically synthesized
caccaacagcatccattact

SEQ ID NO: 76103 - DNA, 20 bp, Artificial Sequence
  chemically synthesized
gatgaagttaatctaagtaa

SEQ ID NO: 76104 - DNA, 20 bp, Artificial Sequence
  chemically synthesized
aaagcagatgaagttaatct

SEQ ID NO: 76105 - DNA, 20 bp, Artificial Sequence
  chemically synthesized
ggctattgggaaagcagatg

SEQ ID NO: 76106 - DNA, 20 bp, Artificial Sequence
  chemically synthesized
ggtaaaggctattgggaaag

SEQ ID NO: 76107 - DNA, 20 bp, Artificial Sequence
  chemically synthesized
aacttcatctgctttcccaa

SEQ ID NO: 76108 - DNA, 20 bp, Artificial Sequence
  chemically synthesized
aagggtaaaggctattggga

SEQ ID NO: 76109 - DNA, 20 bp, Artificial Sequence
  chemically synthesized
gttcaagggtaaaggctatt

SEQ ID NO: 76110 - DNA, 20 bp, Artificial Sequence
  chemically synthesized
agttcaagggtaaaggctat

SEQ ID NO: 76111 - DNA, 20 bp, Artificial Sequence
  chemically synthesized
caactgaagttcaagggtaa

SEQ ID NO: 76112 - DNA, 20 bp, Artificial Sequence
  chemically synthesized
acaactgaagttcaagggta

SEQ ID NO: 76113 - DNA, 20 bp, Artificial Sequence
  chemically synthesized
gcttgacaactgaagttcaa

SEQ ID NO: 76114 - DNA, 20 bp, Artificial Sequence
  chemically synthesized
tagcctttacccttgaactt

SEQ ID NO: 76115 - DNA, 20 bp, Artificial Sequence
  chemically synthesized
tgcttgacaactgaagttca

SEQ ID NO: 76116 - DNA, 20 bp, Artificial Sequence
  chemically synthesized
gtgcttgacaactgaagttc

SEQ ID NO: 76117 - DNA, 20 bp, Artificial Sequence
  chemically synthesized
atataagtgcttgacaactg

SEQ ID NO: 76118 - DNA, 20 bp, Artificial Sequence
  chemically synthesized
acccttgaacttcagttgtc

SEQ ID NO: 76119 - DNA, 20 bp, Artificial Sequence
  chemically synthesized
aaaaaaaaaaaacaaaatat

SEQ ID NO: 76120 - DNA, 20 bp, Artificial Sequence
  chemically synthesized
ttttgttttttttttttttt

SEQ ID NO: 76121 - DNA, 20 bp, Artificial Sequence
  chemically synthesized
tttgtttttttttttttttc

SEQ ID NO: 76122 - DNA, 20 bp, Artificial Sequence
  chemically synthesized
tgtttttttttttttttcag

SEQ ID NO: 76123 - DNA, 20 bp, Artificial Sequence
  chemically synthesized
gaaggaagaaaagaaaagaa

SEQ ID NO: 76124 - DNA, 20 bp, Artificial Sequence
  chemically synthesized
ggaaggaaggaagaaaagaa

SEQ ID NO: 76125 - DNA, 20 bp, Artificial Sequence
  chemically synthesized
aagaaggaaggaaggaagaa

SEQ ID NO: 76126 - DNA, 20 bp, Artificial Sequence
  chemically synthesized
aagaaaagaaggaaggaagg

SEQ ID NO: 76127 - DNA, 20 bp, Artificial Sequence
  chemically synthesized
agaaagaaaagaaggaagga

SEQ ID NO: 76128 - DNA, 20 bp, Artificial Sequence
  chemically synthesized
aagaaagaaaagaaggaagg

SEQ ID NO: 76129 - DNA, 20 bp, Artificial Sequence
  chemically synthesized
ggaaagaaagaaaagaagga

SEQ ID NO: 76130 - DNA, 20 bp, Artificial Sequence
  chemically synthesized
aggaaagaaagaaaagaagg

SEQ ID NO: 76131 - DNA, 20 bp, Artificial Sequence
  chemically synthesized
aaaaggaaagaaagaaaaga

SEQ ID NO: 76132 - DNA, 20 bp, Artificial Sequence
  chemically synthesized
aaaaaggaaagaaagaaaag

SEQ ID NO: 76133 - DNA, 20 bp, Artificial Sequence
  chemically synthesized
taaaaaaaggaaagaaagaa

SEQ ID NO: 76134 - DNA, 20 bp, Artificial Sequence
  chemically synthesized
ctgtataaaaaaaggaaaga

SEQ ID NO: 76135 - DNA, 20 bp, Artificial Sequence
  chemically synthesized
tctcctgtataaaaaaagga

SEQ ID NO: 76136 - DNA, 20 bp, Artificial Sequence
  chemically synthesized
gaagtctcctgtataaaaaa

SEQ ID NO: 76137 - DNA, 20 bp, Artificial Sequence
  chemically synthesized
agaagtctcctgtataaaaa

SEQ ID NO: 76138 - DNA, 20 bp, Artificial Sequence
  chemically synthesized
ctttctttcctttttttata

SEQ ID NO: 76139 - DNA, 20 bp, Artificial Sequence
  chemically synthesized
tttctttcctttttttatac

SEQ ID NO: 76140 - DNA, 20 bp, Artificial Sequence
  chemically synthesized
tctttcctttttttatacag

SEQ ID NO: 76141 - DNA, 20 bp, Artificial Sequence
  chemically synthesized
gaagaaagaaagaaagaaag

SEQ ID NO: 76142 - DNA, 20 bp, Artificial Sequence
  chemically synthesized
aaggaagaaagaaagaaaga

SEQ ID NO: 76143 - DNA, 20 bp, Artificial Sequence
  chemically synthesized
aagaaaggaagaaagaaaga

SEQ ID NO: 76144 - DNA, 20 bp, Artificial Sequence
  chemically synthesized
aaaaaagaaaggaagaaaga

SEQ ID NO: 76145 - DNA, 20 bp, Artificial Sequence
  chemically synthesized
ttgaaaaaaagaaaggaaga

SEQ ID NO: 76146 - DNA, 20 bp, Artificial Sequence
  chemically synthesized
tctcttgaaaaaaagaaagg

SEQ ID NO: 76147 - DNA, 20 bp, Artificial Sequence
  chemically synthesized
aagtctcttgaaaaaaagaa

SEQ ID NO: 76148 - DNA, 20 bp, Artificial Sequence
  chemically synthesized
gaagtctcttgaaaaaaaga

SEQ ID NO: 76149 - DNA, 20 bp, Artificial Sequence
  chemically synthesized
tttcttcctttctttttttc

SEQ ID NO: 76150 - DNA, 20 bp, Artificial Sequence
  chemically synthesized
gaaagaagtctcttgaaaaa

SEQ ID NO: 76151 - DNA, 20 bp, Artificial Sequence
  chemically synthesized
tcttcctttctttttttcaa

SEQ ID NO: 76152 - DNA, 20 bp, Artificial Sequence
  chemically synthesized
aggaaagaaaaaagagaaag

SEQ ID NO: 76153 - DNA, 20 bp, Artificial Sequence
  chemically synthesized
ggaaggaaagaaaaaagaga

SEQ ID NO: 76154 - DNA, 20 bp, Artificial Sequence
  chemically synthesized
ggaaggaaggaaagaaaaaa

SEQ ID NO: 76155 - DNA, 20 bp, Artificial Sequence
  chemically synthesized
aaggaaggaaggaaagaaaa

SEQ ID NO: 76156 - DNA, 20 bp, Artificial Sequence
  chemically synthesized
aggaaggaaggaaggaagga

SEQ ID NO: 76157 - DNA, 20 bp, Artificial Sequence
  chemically synthesized
ggaaaggaaggaaggaagga

SEQ ID NO: 76158 - DNA, 20 bp, Artificial Sequence
  chemically synthesized
aggaaaggaaggaaggaagg

SEQ ID NO: 76159 - DNA, 20 bp, Artificial Sequence
  chemically synthesized
ggaaggaaaggaaggaagga

SEQ ID NO: 76160 - DNA, 20 bp, Artificial Sequence
  chemically synthesized
aggaaggaaaggaaggaagg

SEQ ID NO: 76161 - DNA, 20 bp, Artificial Sequence
  chemically synthesized
gaaaggaaggaaaggaagga

SEQ ID NO: 76162 - DNA, 20 bp, Artificial Sequence
  chemically synthesized
agaaaggaaggaaaggaagg

SEQ ID NO: 76163 - DNA, 20 bp, Artificial Sequence
  chemically synthesized
gaaagaaaggaaggaaagga

SEQ ID NO: 76164 - DNA, 20 bp, Artificial Sequence
  chemically synthesized
ggaaagaaaggaaggaaagg

SEQ ID NO: 76165 - DNA, 20 bp, Artificial Sequence
  chemically synthesized
aaaggaaagaaaggaaggaa

SEQ ID NO: 76166 - DNA, 20 bp, Artificial Sequence
  chemically synthesized
aaaaggaaagaaaggaagga

SEQ ID NO: 76167 - DNA, 20 bp, Artificial Sequence
  chemically synthesized
aaaaaaaaggaaagaaagga

SEQ ID NO: 76168 - DNA, 20 bp, Artificial Sequence
  chemically synthesized
aaaaaaaaaggaaagaaagg

SEQ ID NO: 76169 - DNA, 20 bp, Artificial Sequence
  chemically synthesized
aaaaaaaaaaaaggaaagaa

SEQ ID NO: 76170 - DNA, 20 bp, Artificial Sequence
  chemically synthesized
aaaaaaaaaaaaaggaaaga

SEQ ID NO: 76171 - DNA, 20 bp, Artificial Sequence
  chemically synthesized
aaaaaaaaaaaaaaaaagga

SEQ ID NO: 76172 - DNA, 20 bp, Artificial Sequence
  chemically synthesized
ttggaaaaaaaaaaaaaaaa

SEQ ID NO: 76173 - DNA, 20 bp, Artificial Sequence
  chemically synthesized
cttggaaaaaaaaaaaaaaa

SEQ ID NO: 76174 - DNA, 20 bp, Artificial Sequence
  chemically synthesized
ctttttttttttttttttcc

SEQ ID NO: 76175 - DNA, 20 bp, Artificial Sequence
  chemically synthesized
tttttttttttttttttcca

SEQ ID NO: 76176 - DNA, 20 bp, Artificial Sequence
  chemically synthesized
ttttttttttttttccaagg

SEQ ID NO: 76177 - DNA, 20 bp, Artificial Sequence
  chemically synthesized
ttttttttttttccaaggtg

SEQ ID NO: 76178 - DNA, 20 bp, Artificial Sequence
  chemically synthesized
gcaagagtgaaactccacct

SEQ ID NO: 76179 - DNA, 20 bp, Artificial Sequence
  chemically synthesized
tactccagcctgggcagcaa

SEQ ID NO: 76180 - DNA, 20 bp, Artificial Sequence
  chemically synthesized
ggagtttcactcttgctgcc

SEQ ID NO: 76181 - DNA, 20 bp, Artificial Sequence
  chemically synthesized
gagtttcactcttgctgccc

SEQ ID NO: 76182 - DNA, 20 bp, Artificial Sequence
  chemically synthesized
tgtactccagcctgggcagc

SEQ ID NO: 76183 - DNA, 20 bp, Artificial Sequence
  chemically synthesized
ttcactcttgctgcccaggc

SEQ ID NO: 76184 - DNA, 20 bp, Artificial Sequence
  chemically synthesized
ccattgtactccagcctggg

SEQ ID NO: 76185 - DNA, 20 bp, Artificial Sequence
  chemically synthesized
cactcttgctgcccaggctg

SEQ ID NO: 76186 - DNA, 20 bp, Artificial Sequence
  chemically synthesized
gtgccattgtactccagcct

SEQ ID NO: 76187 - DNA, 20 bp, Artificial Sequence
  chemically synthesized
cgtgccattgtactccagcc

SEQ ID NO: 76188 - DNA, 20 bp, Artificial Sequence
  chemically synthesized
gagatcgtgccattgtactc

SEQ ID NO: 76189 - DNA, 20 bp, Artificial Sequence
  chemically synthesized
ctgcccaggctggagtacaa

SEQ ID NO: 76190 - DNA, 20 bp, Artificial Sequence
  chemically synthesized
ggagtacaatggcacgatct

SEQ ID NO: 76191 - DNA, 20 bp, Artificial Sequence
  chemically synthesized
ggtagaagttgcagtgagcc

SEQ ID NO: 76192 - DNA, 20 bp, Artificial Sequence
  chemically synthesized
caggaggtagaagttgcagt

SEQ ID NO: 76193 - DNA, 20 bp, Artificial Sequence
  chemically synthesized
aacccaggaggtagaagttg

SEQ ID NO: 76194 - DNA, 20 bp, Artificial Sequence
  chemically synthesized
cacttgaacccaggaggtag

SEQ ID NO: 76195 - DNA, 20 bp, Artificial Sequence
  chemically synthesized
tcactgcaacttctacctcc

SEQ ID NO: 76196 - DNA, 20 bp, Artificial Sequence
  chemically synthesized
cactgcaacttctacctcct

SEQ ID NO: 76197 - DNA, 20 bp, Artificial Sequence
  chemically synthesized
aatcacttgaacccaggagg

SEQ ID NO: 76198 - DNA, 20 bp, Artificial Sequence
  chemically synthesized
gagaatcacttgaacccagg

SEQ ID NO: 76199 - DNA, 20 bp, Artificial Sequence
  chemically synthesized
ggagaatcacttgaacccag

SEQ ID NO: 76200 - DNA, 20 bp, Artificial Sequence
  chemically synthesized
aacttctacctcctgggttc

SEQ ID NO: 76201 - DNA, 20 bp, Artificial Sequence
  chemically synthesized
caggagaatcacttgaaccc

SEQ ID NO: 76202 - DNA, 20 bp, Artificial Sequence
  chemically synthesized
gcaggagaatcacttgaacc

SEQ ID NO: 76203 - DNA, 20 bp, Artificial Sequence
  chemically synthesized
ttcaagtgattctcctgcct

SEQ ID NO: 76204 - DNA, 20 bp, Artificial Sequence
  chemically synthesized
tactcaggaggctgaggcag

SEQ ID NO: 76205 - DNA, 20 bp, Artificial Sequence
  chemically synthesized
gctactcaggaggctgaggc

SEQ ID NO: 76206 - DNA, 20 bp, Artificial Sequence
  chemically synthesized
agctactcaggaggctgagg

SEQ ID NO: 76207 - DNA, 20 bp, Artificial Sequence
  chemically synthesized
cccagctactcaggaggctg

SEQ ID NO: 76208 - DNA, 20 bp, Artificial Sequence
  chemically synthesized
tcccagctactcaggaggct

SEQ ID NO: 76209 - DNA, 20 bp, Artificial Sequence
  chemically synthesized
ttctcctgcctcagcctcct

SEQ ID NO: 76210 - DNA, 20 bp, Artificial Sequence
  chemically synthesized
tcctgcctcagcctcctgag

SEQ ID NO: 76211 - DNA, 20 bp, Artificial Sequence
  chemically synthesized
tgtaatcccagctactcagg

SEQ ID NO: 76212 - DNA, 20 bp, Artificial Sequence
  chemically synthesized
ctgtaatcccagctactcag

SEQ ID NO: 76213 - DNA, 20 bp, Artificial Sequence
  chemically synthesized
gcctcagcctcctgagtagc

SEQ ID NO: 76214 - DNA, 20 bp, Artificial Sequence
  chemically synthesized
acctgtaatcccagctactc

SEQ ID NO: 76215 - DNA, 20 bp, Artificial Sequence
  chemically synthesized
cctcagcctcctgagtagct

SEQ ID NO: 76216 - DNA, 20 bp, Artificial Sequence
  chemically synthesized
cacctgtaatcccagctact

SEQ ID NO: 76217 - DNA, 20 bp, Artificial Sequence
  chemically synthesized
ctcctgagtagctgggatta

SEQ ID NO: 76218 - DNA, 20 bp, Artificial Sequence
  chemically synthesized
tcctgagtagctgggattac

SEQ ID NO: 76219 - DNA, 20 bp, Artificial Sequence
  chemically synthesized
gtggcgggcacctgtaatcc

SEQ ID NO: 76220 - DNA, 20 bp, Artificial Sequence
  chemically synthesized
aattagccaggcgtggtggc

SEQ ID NO: 76221 - DNA, 20 bp, Artificial Sequence
  chemically synthesized
aaattagccaggcgtggtgg

SEQ ID NO: 76222 - DNA, 20 bp, Artificial Sequence
  chemically synthesized
caggtgcccgccaccacgcc

SEQ ID NO: 76223 - DNA, 20 bp, Artificial Sequence
  chemically synthesized
acaaaattagccaggcgtgg

SEQ ID NO: 76224 - DNA, 20 bp, Artificial Sequence
  chemically synthesized
aatacaaaattagccaggcg

SEQ ID NO: 76225 - DNA, 20 bp, Artificial Sequence
  chemically synthesized
ctaaaaatacaaaattagcc

SEQ ID NO: 76226 - DNA, 20 bp, Artificial Sequence
  chemically synthesized
tctaaaaatacaaaattagc

SEQ ID NO: 76227 - DNA, 20 bp, Artificial Sequence
  chemically synthesized
ctcttctaaaaatacaaaat

SEQ ID NO: 76228 - DNA, 20 bp, Artificial Sequence
  chemically synthesized
cctggctaattttgtatttt

SEQ ID NO: 76229 - DNA, 20 bp, Artificial Sequence
  chemically synthesized
ggctaattttgtatttttag

SEQ ID NO: 76230 - DNA, 20 bp, Artificial Sequence
  chemically synthesized
ctaattttgtatttttagaa

SEQ ID NO: 76231 - DNA, 20 bp, Artificial Sequence
  chemically synthesized
ttttgtatttttagaagaga

SEQ ID NO: 76232 - DNA, 20 bp, Artificial Sequence
  chemically synthesized
tttgtatttttagaagagat

SEQ ID NO: 76233 - DNA, 20 bp, Artificial Sequence
  chemically synthesized
ttgtatttttagaagagatg

SEQ ID NO: 76234 - DNA, 20 bp, Artificial Sequence
  chemically synthesized
gagatggggtttcaccatgt

SEQ ID NO: 76235 - DNA, 20 bp, Artificial Sequence
  chemically synthesized
tggggtttcaccatgttggc

SEQ ID NO: 76236 - DNA, 20 bp, Artificial Sequence
  chemically synthesized
caagaccagcctggccaaca

SEQ ID NO: 76237 - DNA, 20 bp, Artificial Sequence
  chemically synthesized
ggggtttcaccatgttggcc

SEQ ID NO: 76238 - DNA, 20 bp, Artificial Sequence
  chemically synthesized
tttcaccatgttggccaggc

SEQ ID NO: 76239 - DNA, 20 bp, Artificial Sequence
  chemically synthesized
tcaagagttcaagaccagcc

SEQ ID NO: 76240 - DNA, 20 bp, Artificial Sequence
  chemically synthesized
tgaggtcaagagttcaagac

SEQ ID NO: 76241 - DNA, 20 bp, Artificial Sequence
  chemically synthesized
tcacctgaggtcaagagttc

SEQ ID NO: 76242 - DNA, 20 bp, Artificial Sequence
  chemically synthesized
tggtcttgaactcttgacct

SEQ ID NO: 76243 - DNA, 20 bp, Artificial Sequence
  chemically synthesized
ggtggatcacctgaggtcaa

SEQ ID NO: 76244 - DNA, 20 bp, Artificial Sequence
  chemically synthesized
ggtcttgaactcttgacctc

SEQ ID NO: 76245 - DNA, 20 bp, Artificial Sequence
  chemically synthesized
tgggtggatcacctgaggtc

SEQ ID NO: 76246 - DNA, 20 bp, Artificial Sequence
  chemically synthesized
ctacgtgggtggatcacctg

SEQ ID NO: 76247 - DNA, 20 bp, Artificial Sequence
  chemically synthesized
cctacgtgggtggatcacct

SEQ ID NO: 76248 - DNA, 20 bp, Artificial Sequence
  chemically synthesized
cctcaggtgatccacccacg

SEQ ID NO: 76249 - DNA, 20 bp, Artificial Sequence
  chemically synthesized
ctcaggtgatccacccacgt

SEQ ID NO: 76250 - DNA, 20 bp, Artificial Sequence
  chemically synthesized
ctttgggaggcctacgtggg

SEQ ID NO: 76251 - DNA, 20 bp, Artificial Sequence
  chemically synthesized
gcactttgggaggcctacgt

SEQ ID NO: 76252 - DNA, 20 bp, Artificial Sequence
  chemically synthesized
agcactttgggaggcctacg

SEQ ID NO: 76253 - DNA, 20 bp, Artificial Sequence
  chemically synthesized
ccacccacgtaggcctccca

SEQ ID NO: 76254 - DNA, 20 bp, Artificial Sequence
  chemically synthesized
tgtaatcccagcactttggg

SEQ ID NO: 76255 - DNA, 20 bp, Artificial Sequence
  chemically synthesized
ctgtaatcccagcactttgg

SEQ ID NO: 76256 - DNA, 20 bp, Artificial Sequence
  chemically synthesized
acgtaggcctcccaaagtgc

SEQ ID NO: 76257 - DNA, 20 bp, Artificial Sequence
  chemically synthesized
gcctgtaatcccagcacttt

SEQ ID NO: 76258 - DNA, 20 bp, Artificial Sequence
  chemically synthesized
cgtaggcctcccaaagtgct

SEQ ID NO: 76259 - DNA, 20 bp, Artificial Sequence
  chemically synthesized
ggcctgtaatcccagcactt

SEQ ID NO: 76260 - DNA, 20 bp, Artificial Sequence
  chemically synthesized
ctcccaaagtgctgggatta

SEQ ID NO: 76261 - DNA, 20 bp, Artificial Sequence
  chemically synthesized
tcccaaagtgctgggattac

SEQ ID NO: 76262 - DNA, 20 bp, Artificial Sequence
  chemically synthesized
gtggctcaggcctgtaatcc

SEQ ID NO: 76263 - DNA, 20 bp, Artificial Sequence
  chemically synthesized
agtgctgggattacaggcct

SEQ ID NO: 76264 - DNA, 20 bp, Artificial Sequence
  chemically synthesized
caggcccggcacggtggctc

SEQ ID NO: 76265 - DNA, 20 bp, Artificial Sequence
  chemically synthesized
gcaggcccggcacggtggct

SEQ ID NO: 76266 - DNA, 20 bp, Artificial Sequence
  chemically synthesized
acaggcctgagccaccgtgc

SEQ ID NO: 76267 - DNA, 20 bp, Artificial Sequence
  chemically synthesized
caggcctgagccaccgtgcc

SEQ ID NO: 76268 - DNA, 20 bp, Artificial Sequence
  chemically synthesized
ctcctgcaggcccggcacgg

SEQ ID NO: 76269 - DNA, 20 bp, Artificial Sequence
  chemically synthesized
agtctcctgcaggcccggca

SEQ ID NO: 76270 - DNA, 20 bp, Artificial Sequence
  chemically synthesized
gagccaccgtgccgggcctg

SEQ ID NO: 76271 - DNA, 20 bp, Artificial Sequence
  chemically synthesized
agccaccgtgccgggcctgc

SEQ ID NO: 76272 - DNA, 20 bp, Artificial Sequence
  chemically synthesized
taagaagtctcctgcaggcc

SEQ ID NO: 76273 - DNA, 20 bp, Artificial Sequence
  chemically synthesized
ccaccgtgccgggcctgcag

SEQ ID NO: 76274 - DNA, 20 bp, Artificial Sequence
  chemically synthesized
tcacttaagaagtctcctgc

SEQ ID NO: 76275 - DNA, 20 bp, Artificial Sequence
  chemically synthesized
ttcacttaagaagtctcctg

SEQ ID NO: 76276 - DNA, 20 bp, Artificial Sequence
  chemically synthesized
gggcctgcaggagacttctt

SEQ ID NO: 76277 - DNA, 20 bp, Artificial Sequence
  chemically synthesized
gtaatgaaaattcacttaag

SEQ ID NO: 76278 - DNA, 20 bp, Artificial Sequence
  chemically synthesized
ttagtaatgaaaattcactt

SEQ ID NO: 76279 - DNA, 20 bp, Artificial Sequence
  chemically synthesized
aattttcattactaacacta

SEQ ID NO: 76280 - DNA, 20 bp, Artificial Sequence
  chemically synthesized
attttcattactaacactat

SEQ ID NO: 76281 - DNA, 20 bp, Artificial Sequence
  chemically synthesized
atgaaatagccccatagtgt

SEQ ID NO: 76282 - DNA, 20 bp, Artificial Sequence
  chemically synthesized
ttttcattactaacactatg

SEQ ID NO: 76283 - DNA, 20 bp, Artificial Sequence
  chemically synthesized
agagctatgaaatagcccca

SEQ ID NO: 76284 - DNA, 20 bp, Artificial Sequence
  chemically synthesized
aacactatggggctatttca

SEQ ID NO: 76285 - DNA, 20 bp, Artificial Sequence
  chemically synthesized
tttgttggagagctatgaaa

SEQ ID NO: 76286 - DNA, 20 bp, Artificial Sequence
  chemically synthesized
acaatcccagttttgttgga

SEQ ID NO: 76287 - DNA, 20 bp, Artificial Sequence
  chemically synthesized
tgacaatcccagttttgttg

SEQ ID NO: 76288 - DNA, 20 bp, Artificial Sequence
  chemically synthesized
tcatagctctccaacaaaac

SEQ ID NO: 76289 - DNA, 20 bp, Artificial Sequence
  chemically synthesized
ggtgacaatcccagttttgt

SEQ ID NO: 76290 - DNA, 20 bp, Artificial Sequence
  chemically synthesized
catagctctccaacaaaact

SEQ ID NO: 76291 - DNA, 20 bp, Artificial Sequence
  chemically synthesized
tcgagaaagggtgacaatcc

SEQ ID NO: 76292 - DNA, 20 bp, Artificial Sequence
  chemically synthesized
gggactcaactttcgagaaa

SEQ ID NO: 76293 - DNA, 20 bp, Artificial Sequence
  chemically synthesized
ggattgtcaccctttctcga

SEQ ID NO: 76294 - DNA, 20 bp, Artificial Sequence
  chemically synthesized
agggactcaactttcgagaa

SEQ ID NO: 76295 - DNA, 20 bp, Artificial Sequence
  chemically synthesized
gagggactcaactttcgaga

SEQ ID NO: 76296 - DNA, 20 bp, Artificial Sequence
  chemically synthesized
gtcaccctttctcgaaagtt

SEQ ID NO: 76297 - DNA, 20 bp, Artificial Sequence
  chemically synthesized
aaatgagggactcaactttc

SEQ ID NO: 76298 - DNA, 20 bp, Artificial Sequence
  chemically synthesized
tcagaatttggcagaaatga

SEQ ID NO: 76299 - DNA, 20 bp, Artificial Sequence
  chemically synthesized
ctcagaatttggcagaaatg

SEQ ID NO: 76300 - DNA, 20 bp, Artificial Sequence
  chemically synthesized
cctcagaatttggcagaaat

SEQ ID NO: 76301 - DNA, 20 bp, Artificial Sequence
  chemically synthesized
cacagtccctcagaatttgg

SEQ ID NO: 76302 - DNA, 20 bp, Artificial Sequence
  chemically synthesized
cctcatttctgccaaattct

SEQ ID NO: 76303 - DNA, 20 bp, Artificial Sequence
  chemically synthesized
ctcatttctgccaaattctg

SEQ ID NO: 76304 - DNA, 20 bp, Artificial Sequence
  chemically synthesized
ccacacagtccctcagaatt

SEQ ID NO: 76305 - DNA, 20 bp, Artificial Sequence
  chemically synthesized
tcatttctgccaaattctga

SEQ ID NO: 76306 - DNA, 20 bp, Artificial Sequence
  chemically synthesized
cttagctccacacagtccct

SEQ ID NO: 76307 - DNA, 20 bp, Artificial Sequence
  chemically synthesized
ccaaattctgagggactgtg

SEQ ID NO: 76308 - DNA, 20 bp, Artificial Sequence
  chemically synthesized
aaattctgagggactgtgtg

SEQ ID NO: 76309 - DNA, 20 bp, Artificial Sequence
  chemically synthesized
ccctttgtcttagctccaca

SEQ ID NO: 76310 - DNA, 20 bp, Artificial Sequence
  chemically synthesized
ctgagggactgtgtggagct

SEQ ID NO: 76311 - DNA, 20 bp, Artificial Sequence
  chemically synthesized
gactgtgtggagctaagaca

SEQ ID NO: 76312 - DNA, 20 bp, Artificial Sequence
  chemically synthesized
actgtgtggagctaagacaa

SEQ ID NO: 76313 - DNA, 20 bp, Artificial Sequence
  chemically synthesized
ctgtgtggagctaagacaaa

SEQ ID NO: 76314 - DNA, 20 bp, Artificial Sequence
  chemically synthesized
gcaaagtatcccctttgtct

SEQ ID NO: 76315 - DNA, 20 bp, Artificial Sequence
  chemically synthesized
tgtgtggagctaagacaaag

SEQ ID NO: 76316 - DNA, 20 bp, Artificial Sequence
  chemically synthesized
aagacaaaggggatactttg

SEQ ID NO: 76317 - DNA, 20 bp, Artificial Sequence
  chemically synthesized
ttgtattcgctcagtctgca

SEQ ID NO: 76318 - DNA, 20 bp, Artificial Sequence
  chemically synthesized
aaggggatactttgcagact

SEQ ID NO: 76319 - DNA, 20 bp, Artificial Sequence
  chemically synthesized
ggcagagggttgtattcgct

SEQ ID NO: 76320 - DNA, 20 bp, Artificial Sequence
  chemically synthesized
taagtgatactaaaggcaga

SEQ ID NO: 76321 - DNA, 20 bp, Artificial Sequence
  chemically synthesized
cgaatacaaccctctgcctt

SEQ ID NO: 76322 - DNA, 20 bp, Artificial Sequence
  chemically synthesized
ataagtgatactaaaggcag

SEQ ID NO: 76323 - DNA, 20 bp, Artificial Sequence
  chemically synthesized
cataagtgatactaaaggca

SEQ ID NO: 76324 - DNA, 20 bp, Artificial Sequence
  chemically synthesized
agcataagtgatactaaagg

SEQ ID NO: 76325 - DNA, 20 bp, Artificial Sequence
  chemically synthesized
agaagcataagtgatactaa

SEQ ID NO: 76326 - DNA, 20 bp, Artificial Sequence
  chemically synthesized
cagaagcataagtgatacta

SEQ ID NO: 76327 - DNA, 20 bp, Artificial Sequence
  chemically synthesized
tttagtatcacttatgcttc

SEQ ID NO: 76328 - DNA, 20 bp, Artificial Sequence
  chemically synthesized
aatgtctctaccagaagcat

SEQ ID NO: 76329 - DNA, 20 bp, Artificial Sequence
  chemically synthesized
agtatcacttatgcttctgg

SEQ ID NO: 76330 - DNA, 20 bp, Artificial Sequence
  chemically synthesized
tatcacttatgcttctggta

SEQ ID NO: 76331 - DNA, 20 bp, Artificial Sequence
  chemically synthesized
gtcgagaatgtctctaccag

SEQ ID NO: 76332 - DNA, 20 bp, Artificial Sequence
  chemically synthesized
attgtcgagaatgtctctac

SEQ ID NO: 76333 - DNA, 20 bp, Artificial Sequence
  chemically synthesized
caatggcataatttattgtc

SEQ ID NO: 76334 - DNA, 20 bp, Artificial Sequence
  chemically synthesized
ttttttaaagtacgtttcaa

SEQ ID NO: 76335 - DNA, 20 bp, Artificial Sequence
  chemically synthesized
acatccctttttttttttta

SEQ ID NO: 76336 - DNA, 20 bp, Artificial Sequence
  chemically synthesized
aacgtactttaaaaaaaaaa

SEQ ID NO: 76337 - DNA, 20 bp, Artificial Sequence
  chemically synthesized
acgtactttaaaaaaaaaaa

SEQ ID NO: 76338 - DNA, 20 bp, Artificial Sequence
  chemically synthesized
cgtactttaaaaaaaaaaaa

SEQ ID NO: 76339 - DNA, 20 bp, Artificial Sequence
  chemically synthesized
gatgtgattgcatttttttc

SEQ ID NO: 76340 - DNA, 20 bp, Artificial Sequence
  chemically synthesized
attgcatttttttccagcaa

SEQ ID NO: 76341 - DNA, 20 bp, Artificial Sequence
  chemically synthesized
atcacaataaaaactgttgc

SEQ ID NO: 76342 - DNA, 20 bp, Artificial Sequence
  chemically synthesized
agcaacagtttttattgtga

SEQ ID NO: 76343 - DNA, 20 bp, Artificial Sequence
  chemically synthesized
gtttttattgtgatagcctg

SEQ ID NO: 76344 - DNA, 20 bp, Artificial Sequence
  chemically synthesized
tttttattgtgatagcctga

SEQ ID NO: 76345 - DNA, 20 bp, Artificial Sequence
  chemically synthesized
ctgcataatattttgccttc

SEQ ID NO: 76346 - DNA, 20 bp, Artificial Sequence
  chemically synthesized
actgcataatattttgcctt

SEQ ID NO: 76347 - DNA, 20 bp, Artificial Sequence
  chemically synthesized
cctgaaggcaaaatattatg

SEQ ID NO: 76348 - DNA, 20 bp, Artificial Sequence
  chemically synthesized
gaacggaaggagacaacgaa

SEQ ID NO: 76349 - DNA, 20 bp, Artificial Sequence
  chemically synthesized
ccctgaaaactgaacggaag

SEQ ID NO: 76350 - DNA, 20 bp, Artificial Sequence
  chemically synthesized
tttcgttgtctccttccgtt

SEQ ID NO: 76351 - DNA, 20 bp, Artificial Sequence
  chemically synthesized
tgccctgaaaactgaacgga

SEQ ID NO: 76352 - DNA, 20 bp, Artificial Sequence
  chemically synthesized
ttgccctgaaaactgaacgg

SEQ ID NO: 76353 - DNA, 20 bp, Artificial Sequence
  chemically synthesized
gaattgccctgaaaactgaa

SEQ ID NO: 76354 - DNA, 20 bp, Artificial Sequence
  chemically synthesized
gtctccttccgttcagtttt

SEQ ID NO: 76355 - DNA, 20 bp, Artificial Sequence
  chemically synthesized
tctccttccgttcagttttc

SEQ ID NO: 76356 - DNA, 20 bp, Artificial Sequence
  chemically synthesized
ctccttccgttcagttttca

SEQ ID NO: 76357 - DNA, 20 bp, Artificial Sequence
  chemically synthesized
gcccaaatatgaaagtttac

SEQ ID NO: 76358 - DNA, 20 bp, Artificial Sequence
  chemically synthesized
ttcttgtaaactttcatatt

SEQ ID NO: 76359 - DNA, 20 bp, Artificial Sequence
  chemically synthesized
gtgatcatgcccaaatatga

SEQ ID NO: 76360 - DNA, 20 bp, Artificial Sequence
  chemically synthesized
tcttgtaaactttcatattt

SEQ ID NO: 76361 - DNA, 20 bp, Artificial Sequence
  chemically synthesized
tgggcatgatcacttttgac

SEQ ID NO: 76362 - DNA, 20 bp, Artificial Sequence
  chemically synthesized
ttattcagtttactcgtcaa

SEQ ID NO: 76363 - DNA, 20 bp, Artificial Sequence
  chemically synthesized
tcattatttatattgttatt

SEQ ID NO: 76364 - DNA, 20 bp, Artificial Sequence
  chemically synthesized
taacaatataaataatgaaa

SEQ ID NO: 76365 - DNA, 20 bp, Artificial Sequence
  chemically synthesized
tataaataatgaaacagact

SEQ ID NO: 76366 - DNA, 20 bp, Artificial Sequence
  chemically synthesized
aaatctaggccattagttct

SEQ ID NO: 76367 - DNA, 20 bp, Artificial Sequence
  chemically synthesized
tgaaacagactcagaactaa

SEQ ID NO: 76368 - DNA, 20 bp, Artificial Sequence
  chemically synthesized
cagactcagaactaatggcc

SEQ ID NO: 76369 - DNA, 20 bp, Artificial Sequence
  chemically synthesized
ttatgctaaatctaggccat

SEQ ID NO: 76370 - DNA, 20 bp, Artificial Sequence
  chemically synthesized
cagaactaatggcctagatt

SEQ ID NO: 76371 - DNA, 20 bp, Artificial Sequence
  chemically synthesized
tttctgattatgctaaatct

SEQ ID NO: 76372 - DNA, 20 bp, Artificial Sequence
  chemically synthesized
gtttctgattatgctaaatc

SEQ ID NO: 76373 - DNA, 20 bp, Artificial Sequence
  chemically synthesized
tggcctagatttagcataat

SEQ ID NO: 76374 - DNA, 20 bp, Artificial Sequence
  chemically synthesized
tagcataatcagaaacactt

SEQ ID NO: 76375 - DNA, 20 bp, Artificial Sequence
  chemically synthesized
ataatcagaaacacttaaga

SEQ ID NO: 76376 - DNA, 20 bp, Artificial Sequence
  chemically synthesized
taatcagaaacacttaagaa

SEQ ID NO: 76377 - DNA, 20 bp, Artificial Sequence
  chemically synthesized
ttttgactttaacctttctt

SEQ ID NO: 76378 - DNA, 20 bp, Artificial Sequence
  chemically synthesized
gaaacacttaagaaaggtta

SEQ ID NO: 76379 - DNA, 20 bp, Artificial Sequence
  chemically synthesized
gaaaggttaaagtcaaaaaa

SEQ ID NO: 76380 - DNA, 20 bp, Artificial Sequence
  chemically synthesized
taaagtcaaaaaaaagatct

SEQ ID NO: 76381 - DNA, 20 bp, Artificial Sequence
  chemically synthesized
aaagtcaaaaaaaagatctt

SEQ ID NO: 76382 - DNA, 20 bp, Artificial Sequence
  chemically synthesized
aaacttaatattgttttccc

SEQ ID NO: 76383 - DNA, 20 bp, Artificial Sequence
  chemically synthesized
gatcttgggaaaacaatatt

SEQ ID NO: 76384 - DNA, 20 bp, Artificial Sequence
  chemically synthesized
ggaaaacaatattaagtttg

SEQ ID NO: 76385 - DNA, 20 bp, Artificial Sequence
  chemically synthesized
gaaaacaatattaagtttgt

SEQ ID NO: 76386 - DNA, 20 bp, Artificial Sequence
  chemically synthesized
atattaagtttgtaggcatg

SEQ ID NO: 76387 - DNA, 20 bp, Artificial Sequence
  chemically synthesized
tttgtaggcatgaagaaatt

SEQ ID NO: 76388 - DNA, 20 bp, Artificial Sequence
  chemically synthesized
ttgtaggcatgaagaaattt

SEQ ID NO: 76389 - DNA, 20 bp, Artificial Sequence
  chemically synthesized
tgtaggcatgaagaaattta

SEQ ID NO: 76390 - DNA, 20 bp, Artificial Sequence
  chemically synthesized
gataatcgcttgggaaataa

SEQ ID NO: 76391 - DNA, 20 bp, Artificial Sequence
  chemically synthesized
atttagggcttttatttccc

SEQ ID NO: 76392 - DNA, 20 bp, Artificial Sequence
  chemically synthesized
ataattactgataatcgctt

SEQ ID NO: 76393 - DNA, 20 bp, Artificial Sequence
  chemically synthesized
tataattactgataatcgct

SEQ ID NO: 76394 - DNA, 20 bp, Artificial Sequence
  chemically synthesized
tttatttcccaagcgattat

SEQ ID NO: 76395 - DNA, 20 bp, Artificial Sequence
  chemically synthesized
cagtaattatattttaacta

SEQ ID NO: 76396 - DNA, 20 bp, Artificial Sequence
  chemically synthesized
ttgagtctgagaagaaacca

SEQ ID NO: 76397 - DNA, 20 bp, Artificial Sequence
  chemically synthesized
ttttaactatggtttcttct

SEQ ID NO: 76398 - DNA, 20 bp, Artificial Sequence
  chemically synthesized
ggaagcgtgttgagtctgag

SEQ ID NO: 76399 - DNA, 20 bp, Artificial Sequence
  chemically synthesized
tttggaagcgtgttgagtct

SEQ ID NO: 76400 - DNA, 20 bp, Artificial Sequence
  chemically synthesized
cacaaatttggaagcgtgtt

SEQ ID NO: 76401 - DNA, 20 bp, Artificial Sequence
  chemically synthesized
ttttaatgtcacaaatttgg

SEQ ID NO: 76402 - DNA, 20 bp, Artificial Sequence
  chemically synthesized
tttttttaatgtcacaaatt

SEQ ID NO: 76403 - DNA, 20 bp, Artificial Sequence
  chemically synthesized
aatttgtgacattaaaaaaa

SEQ ID NO: 76404 - DNA, 20 bp, Artificial Sequence
  chemically synthesized
tctttatggaaaacacagag

SEQ ID NO: 76405 - DNA, 20 bp, Artificial Sequence
  chemically synthesized
gattctttatggaaaacaca

SEQ ID NO: 76406 - DNA, 20 bp, Artificial Sequence
  chemically synthesized
tggattctttatggaaaaca

SEQ ID NO: 76407 - DNA, 20 bp, Artificial Sequence
  chemically synthesized
actgctctgtgttttccata

SEQ ID NO: 76408 - DNA, 20 bp, Artificial Sequence
  chemically synthesized
aaaaagatgtggattcttta

SEQ ID NO: 76409 - DNA, 20 bp, Artificial Sequence
  chemically synthesized
ttgttttttataaaaagatg

SEQ ID NO: 76410 - DNA, 20 bp, Artificial Sequence
  chemically synthesized
ttgagattgttttttataaa

SEQ ID NO: 76411 - DNA, 20 bp, Artificial Sequence
  chemically synthesized
ttataaaaaacaatctcaac

SEQ ID NO: 76412 - DNA, 20 bp, Artificial Sequence
  chemically synthesized
tataaaaaacaatctcaacc

SEQ ID NO: 76413 - DNA, 20 bp, Artificial Sequence
  chemically synthesized
gtgagccaccgcacctggtt

SEQ ID NO: 76414 - DNA, 20 bp, Artificial Sequence
  chemically synthesized
aaaacaatctcaaccaggtg

SEQ ID NO: 76415 - DNA, 20 bp, Artificial Sequence
  chemically synthesized
acaatctcaaccaggtgcgg

SEQ ID NO: 76416 - DNA, 20 bp, Artificial Sequence
  chemically synthesized
caggcgtgagccaccgcacc

SEQ ID NO: 76417 - DNA, 20 bp, Artificial Sequence
  chemically synthesized
agtgctaggattacaggcgt

SEQ ID NO: 76418 - DNA, 20 bp, Artificial Sequence
  chemically synthesized
gtggctcacgcctgtaatcc

SEQ ID NO: 76419 - DNA, 20 bp, Artificial Sequence
  chemically synthesized
tcccaaagtgctaggattac

SEQ ID NO: 76420 - DNA, 20 bp, Artificial Sequence
  chemically synthesized
ctcccaaagtgctaggatta

SEQ ID NO: 76421 - DNA, 20 bp, Artificial Sequence
  chemically synthesized
cgcctgtaatcctagcactt

SEQ ID NO: 76422 - DNA, 20 bp, Artificial Sequence
  chemically synthesized
cctcagcctcccaaagtgct

SEQ ID NO: 76423 - DNA, 20 bp, Artificial Sequence
  chemically synthesized
gcctgtaatcctagcacttt

SEQ ID NO: 76424 - DNA, 20 bp, Artificial Sequence
  chemically synthesized
acctcagcctcccaaagtgc

SEQ ID NO: 76425 - DNA, 20 bp, Artificial Sequence
  chemically synthesized
ctgtaatcctagcactttgg

SEQ ID NO: 76426 - DNA, 20 bp, Artificial Sequence
  chemically synthesized
tgtaatcctagcactttggg

SEQ ID NO: 76427 - DNA, 20 bp, Artificial Sequence
  chemically synthesized
ccacccacctcagcctccca

SEQ ID NO: 76428 - DNA, 20 bp, Artificial Sequence
  chemically synthesized
tcctagcactttgggaggct

SEQ ID NO: 76429 - DNA, 20 bp, Artificial Sequence
  chemically synthesized
cctagcactttgggaggctg

SEQ ID NO: 76430 - DNA, 20 bp, Artificial Sequence
  chemically synthesized
agcactttgggaggctgagg

SEQ ID NO: 76431 - DNA, 20 bp, Artificial Sequence
  chemically synthesized
gcactttgggaggctgaggt

SEQ ID NO: 76432 - DNA, 20 bp, Artificial Sequence
  chemically synthesized
ctttgggaggctgaggtggg

SEQ ID NO: 76433 - DNA, 20 bp, Artificial Sequence
  chemically synthesized
ctcaggtgatccacccacct

SEQ ID NO: 76434 - DNA, 20 bp, Artificial Sequence
  chemically synthesized
ctgaggtgggtggatcacct

SEQ ID NO: 76435 - DNA, 20 bp, Artificial Sequence
  chemically synthesized
tgaggtgggtggatcacctg

SEQ ID NO: 76436 - DNA, 20 bp, Artificial Sequence
  chemically synthesized
gtgggtggatcacctgaggt

SEQ ID NO: 76437 - DNA, 20 bp, Artificial Sequence
  chemically synthesized
tgggtggatcacctgaggtc

SEQ ID NO: 76438 - DNA, 20 bp, Artificial Sequence
  chemically synthesized
cgtctgtaactcctgacctc

SEQ ID NO: 76439 - DNA, 20 bp, Artificial Sequence
  chemically synthesized
ggtggatcacctgaggtcag

SEQ ID NO: 76440 - DNA, 20 bp, Artificial Sequence
  chemically synthesized
tcgtctgtaactcctgacct

SEQ ID NO: 76441 - DNA, 20 bp, Artificial Sequence
  chemically synthesized
tcacctgaggtcaggagtta

SEQ ID NO: 76442 - DNA, 20 bp, Artificial Sequence
  chemically synthesized
tgaggtcaggagttacagac

SEQ ID NO: 76443 - DNA, 20 bp, Artificial Sequence
  chemically synthesized
tcaggagttacagacgagcc

SEQ ID NO: 76444 - DNA, 20 bp, Artificial Sequence
  chemically synthesized
agggtttcactgtgttggcc

SEQ ID NO: 76445 - DNA, 20 bp, Artificial Sequence
  chemically synthesized
acagacgagcctggccaaca

SEQ ID NO: 76446 - DNA, 20 bp, Artificial Sequence
  chemically synthesized
cagggtttcactgtgttggc

SEQ ID NO: 76447 - DNA, 20 bp, Artificial Sequence
  chemically synthesized
gagacagggtttcactgtgt

SEQ ID NO: 76448 - DNA, 20 bp, Artificial Sequence
  chemically synthesized
ttctgtttttagtagagaca

SEQ ID NO: 76449 - DNA, 20 bp, Artificial Sequence
  chemically synthesized
tttctgtttttagtagagac

SEQ ID NO: 76450 - DNA, 20 bp, Artificial Sequence
  chemically synthesized
ttttctgtttttagtagaga

SEQ ID NO: 76451 - DNA, 20 bp, Artificial Sequence
  chemically synthesized
taatttttctgtttttagta

SEQ ID NO: 76452 - DNA, 20 bp, Artificial Sequence
  chemically synthesized
aaccctgtctctactaaaaa

SEQ ID NO: 76453 - DNA, 20 bp, Artificial Sequence
  chemically synthesized
gctaatttttctgtttttag

SEQ ID NO: 76454 - DNA, 20 bp, Artificial Sequence
  chemically synthesized
ccggctaatttttctgtttt

SEQ ID NO: 76455 - DNA, 20 bp, Artificial Sequence
  chemically synthesized
tctactaaaaacagaaaaat

SEQ ID NO: 76456 - DNA, 20 bp, Artificial Sequence
  chemically synthesized
ctaaaaacagaaaaattagc

SEQ ID NO: 76457 - DNA, 20 bp, Artificial Sequence
  chemically synthesized
taaaaacagaaaaattagcc

SEQ ID NO: 76458 - DNA, 20 bp, Artificial Sequence
  chemically synthesized
acagaaaaattagccgggca

SEQ ID NO: 76459 - DNA, 20 bp, Artificial Sequence
  chemically synthesized
gaaaaattagccgggcatgg

SEQ ID NO: 76460 - DNA, 20 bp, Artificial Sequence
  chemically synthesized
caggtgtgcaccaccatgcc

SEQ ID NO: 76461 - DNA, 20 bp, Artificial Sequence
  chemically synthesized
gtggtgcacacctgtaatcc

SEQ ID NO: 76462 - DNA, 20 bp, Artificial Sequence
  chemically synthesized
tccagagtggctgggattac

SEQ ID NO: 76463 - DNA, 20 bp, Artificial Sequence
  chemically synthesized
ctccagagtggctgggatta

SEQ ID NO: 76464 - DNA, 20 bp, Artificial Sequence
  chemically synthesized
cctcagcctccagagtggct

SEQ ID NO: 76465 - DNA, 20 bp, Artificial Sequence
  chemically synthesized
acctgtaatcccagccactc

SEQ ID NO: 76466 - DNA, 20 bp, Artificial Sequence
  chemically synthesized
gcctcagcctccagagtggc

SEQ ID NO: 76467 - DNA, 20 bp, Artificial Sequence
  chemically synthesized
ctgtaatcccagccactctg

SEQ ID NO: 76468 - DNA, 20 bp, Artificial Sequence
  chemically synthesized
tgtaatcccagccactctgg

SEQ ID NO: 76469 - DNA, 20 bp, Artificial Sequence
  chemically synthesized
tcctgcctcagcctccagag

SEQ ID NO: 76470 - DNA, 20 bp, Artificial Sequence
  chemically synthesized
ttctcctgcctcagcctcca

SEQ ID NO: 76471 - DNA, 20 bp, Artificial Sequence
  chemically synthesized
tcccagccactctggaggct

SEQ ID NO: 76472 - DNA, 20 bp, Artificial Sequence
  chemically synthesized
cccagccactctggaggctg

SEQ ID NO: 76473 - DNA, 20 bp, Artificial Sequence
  chemically synthesized
aattctcctgcctcagcctc

SEQ ID NO: 76474 - DNA, 20 bp, Artificial Sequence
  chemically synthesized
agccactctggaggctgagg

SEQ ID NO: 76475 - DNA, 20 bp, Artificial Sequence
  chemically synthesized
gccactctggaggctgaggc

SEQ ID NO: 76476 - DNA, 20 bp, Artificial Sequence
  chemically synthesized
cactctggaggctgaggcag

SEQ ID NO: 76477 - DNA, 20 bp, Artificial Sequence
  chemically synthesized
ttcaagcaattctcctgcct

SEQ ID NO: 76478 - DNA, 20 bp, Artificial Sequence
  chemically synthesized
gcaggagaattgcttgaacc

SEQ ID NO: 76479 - DNA, 20 bp, Artificial Sequence
  chemically synthesized
caggagaattgcttgaaccc

SEQ ID NO: 76480 - DNA, 20 bp, Artificial Sequence
  chemically synthesized
aacctccacctcccgggttc

SEQ ID NO: 76481 - DNA, 20 bp, Artificial Sequence
  chemically synthesized
ggagaattgcttgaacccgg

SEQ ID NO: 76482 - DNA, 20 bp, Artificial Sequence
  chemically synthesized
gagaattgcttgaacccggg

SEQ ID NO: 76483 - DNA, 20 bp, Artificial Sequence
  chemically synthesized
aattgcttgaacccgggagg

SEQ ID NO: 76484 - DNA, 20 bp, Artificial Sequence
  chemically synthesized
cactgcaacctccacctccc

SEQ ID NO: 76485 - DNA, 20 bp, Artificial Sequence
  chemically synthesized
ttgcttgaacccgggaggtg

SEQ ID NO: 76486 - DNA, 20 bp, Artificial Sequence
  chemically synthesized
tcactgcaacctccacctcc

SEQ ID NO: 76487 - DNA, 20 bp, Artificial Sequence
  chemically synthesized
tgcttgaacccgggaggtgg

SEQ ID NO: 76488 - DNA, 20 bp, Artificial Sequence
  chemically synthesized
aacccgggaggtggaggttg

SEQ ID NO: 76489 - DNA, 20 bp, Artificial Sequence
  chemically synthesized
cgggaggtggaggttgcagt

SEQ ID NO: 76490 - DNA, 20 bp, Artificial Sequence
  chemically synthesized
ggtggaggttgcagtgagct

SEQ ID NO: 76491 - DNA, 20 bp, Artificial Sequence
  chemically synthesized
ggagtgcaatgttgcaatct

SEQ ID NO: 76492 - DNA, 20 bp, Artificial Sequence
  chemically synthesized
gagattgcaacattgcactc

SEQ ID NO: 76493 - DNA, 20 bp, Artificial Sequence
  chemically synthesized
tgcaacattgcactccagcc

SEQ ID NO: 76494 - DNA, 20 bp, Artificial Sequence
  chemically synthesized
gcaacattgcactccagcct

SEQ ID NO: 76495 - DNA, 20 bp, Artificial Sequence
  chemically synthesized
tgctcttgttgcccaggctg

SEQ ID NO: 76496 - DNA, 20 bp, Artificial Sequence
  chemically synthesized
tttgctcttgttgcccaggc

SEQ ID NO: 76497 - DNA, 20 bp, Artificial Sequence
  chemically synthesized
tgcactccagcctgggcaac

SEQ ID NO: 76498 - DNA, 20 bp, Artificial Sequence
  chemically synthesized
gagttttgctcttgttgccc

SEQ ID NO: 76499 - DNA, 20 bp, Artificial Sequence
  chemically synthesized
agagttttgctcttgttgcc

SEQ ID NO: 76500 - DNA, 20 bp, Artificial Sequence
  chemically synthesized
cactccagcctgggcaacaa

SEQ ID NO: 76501 - DNA, 20 bp, Artificial Sequence
  chemically synthesized
ttgttcttgtttttgagaca

SEQ ID NO: 76502 - DNA, 20 bp, Artificial Sequence
  chemically synthesized
ttttgttcttgtttttgaga

SEQ ID NO: 76503 - DNA, 20 bp, Artificial Sequence
  chemically synthesized
caaaactctgtctcaaaaac

SEQ ID NO: 76504 - DNA, 20 bp, Artificial Sequence
  chemically synthesized
agttttttgttcttgttttt

SEQ ID NO: 76505 - DNA, 20 bp, Artificial Sequence
  chemically synthesized
aaaacaagaacaaaaaactc

SEQ ID NO: 76506 - DNA, 20 bp, Artificial Sequence
  chemically synthesized
gatattgtaaagagaaacta

SEQ ID NO: 76507 - DNA, 20 bp, Artificial Sequence
  chemically synthesized
tcgatattgtaaagagaaac

SEQ ID NO: 76508 - DNA, 20 bp, Artificial Sequence
  chemically synthesized
ttctttttcgatattgtaaa

SEQ ID NO: 76509 - DNA, 20 bp, Artificial Sequence
  chemically synthesized
tattctttttcgatattgta

SEQ ID NO: 76510 - DNA, 20 bp, Artificial Sequence
  chemically synthesized
ttctctttacaatatcgaaa

SEQ ID NO: 76511 - DNA, 20 bp, Artificial Sequence
  chemically synthesized
aaagttatccttttatgttt

SEQ ID NO: 76512 - DNA, 20 bp, Artificial Sequence
  chemically synthesized
gaatatatacccaaacataa

SEQ ID NO: 76513 - DNA, 20 bp, Artificial Sequence
  chemically synthesized
aaaagttatccttttatgtt

SEQ ID NO: 76514 - DNA, 20 bp, Artificial Sequence
  chemically synthesized
aatatatacccaaacataaa

SEQ ID NO: 76515 - DNA, 20 bp, Artificial Sequence
  chemically synthesized
gagaaaatgttaaaaagaaa

SEQ ID NO: 76516 - DNA, 20 bp, Artificial Sequence
  chemically synthesized
tgcaaagagaaaatgttaaa

SEQ ID NO: 76517 - DNA, 20 bp, Artificial Sequence
  chemically synthesized
agaattatgatcagtgcaaa

SEQ ID NO: 76518 - DNA, 20 bp, Artificial Sequence
  chemically synthesized
gaagaattatgatcagtgca

SEQ ID NO: 76519 - DNA, 20 bp, Artificial Sequence
  chemically synthesized
aaaagatgaagaattatgat

SEQ ID NO: 76520 - DNA, 20 bp, Artificial Sequence
  chemically synthesized
gatcataattcttcatcttt

SEQ ID NO: 76521 - DNA, 20 bp, Artificial Sequence
  chemically synthesized
aagccatgtcctaaaagatg

SEQ ID NO: 76522 - DNA, 20 bp, Artificial Sequence
  chemically synthesized
atcataattcttcatctttt

SEQ ID NO: 76523 - DNA, 20 bp, Artificial Sequence
  chemically synthesized
catagaaagccatgtcctaa

SEQ ID NO: 76524 - DNA, 20 bp, Artificial Sequence
  chemically synthesized
attcttcatcttttaggaca

SEQ ID NO: 76525 - DNA, 20 bp, Artificial Sequence
  chemically synthesized
ttaggacatggctttctatg

SEQ ID NO: 76526 - DNA, 20 bp, Artificial Sequence
  chemically synthesized
ggagttacaagcttcataga

SEQ ID NO: 76527 - DNA, 20 bp, Artificial Sequence
  chemically synthesized
cattggagttacaagcttca

SEQ ID NO: 76528 - DNA, 20 bp, Artificial Sequence
  chemically synthesized
tataagaacattggagttac

SEQ ID NO: 76529 - DNA, 20 bp, Artificial Sequence
  chemically synthesized
cttttattataagaacattg

SEQ ID NO: 76530 - DNA, 20 bp, Artificial Sequence
  chemically synthesized
ggcttttattataagaacat

SEQ ID NO: 76531 - DNA, 20 bp, Artificial Sequence
  chemically synthesized
ctccaatgttcttataataa

SEQ ID NO: 76532 - DNA, 20 bp, Artificial Sequence
  chemically synthesized
tataattcggcttttattat

SEQ ID NO: 76533 - DNA, 20 bp, Artificial Sequence
  chemically synthesized
aatatggccaagatataatt

SEQ ID NO: 76534 - DNA, 20 bp, Artificial Sequence
  chemically synthesized
ataaaagccgaattatatct

SEQ ID NO: 76535 - DNA, 20 bp, Artificial Sequence
  chemically synthesized
tagacactgttaatatggcc

SEQ ID NO: 76536 - DNA, 20 bp, Artificial Sequence
  chemically synthesized
ttatatcttggccatattaa

SEQ ID NO: 76537 - DNA, 20 bp, Artificial Sequence
  chemically synthesized
gaagatagacactgttaata

SEQ ID NO: 76538 - DNA, 20 bp, Artificial Sequence
  chemically synthesized
cacccagaaaagaaagaaga

SEQ ID NO: 76539 - DNA, 20 bp, Artificial Sequence
  chemically synthesized
tgagcacccagaaaagaaag

SEQ ID NO: 76540 - DNA, 20 bp, Artificial Sequence
  chemically synthesized
tgtctatcttctttcttttc

SEQ ID NO: 76541 - DNA, 20 bp, Artificial Sequence
  chemically synthesized
atgtgagcacccagaaaaga

SEQ ID NO: 76542 - DNA, 20 bp, Artificial Sequence
  chemically synthesized
gtctatcttctttcttttct

SEQ ID NO: 76543 - DNA, 20 bp, Artificial Sequence
  chemically synthesized
ggaaatgtgagcacccagaa

SEQ ID NO: 76544 - DNA, 20 bp, Artificial Sequence
  chemically synthesized
atgaaggaaatgtgagcacc

SEQ ID NO: 76545 - DNA, 20 bp, Artificial Sequence
  chemically synthesized
tttatacatgaaggaaatgt

SEQ ID NO: 76546 - DNA, 20 bp, Artificial Sequence
  chemically synthesized
tttccaaattttatacatga

SEQ ID NO: 76547 - DNA, 20 bp, Artificial Sequence
  chemically synthesized
atttccaaattttatacatg

SEQ ID NO: 76548 - DNA, 20 bp, Artificial Sequence
  chemically synthesized
tttccttcatgtataaaatt

SEQ ID NO: 76549 - DNA, 20 bp, Artificial Sequence
  chemically synthesized
catgtataaaatttggaaat

SEQ ID NO: 76550 - DNA, 20 bp, Artificial Sequence
  chemically synthesized
atgtataaaatttggaaatg

SEQ ID NO: 76551 - DNA, 20 bp, Artificial Sequence
  chemically synthesized
taaaatttggaaatgaggaa

SEQ ID NO: 76552 - DNA, 20 bp, Artificial Sequence
  chemically synthesized
aaaatttggaaatgaggaac

SEQ ID NO: 76553 - DNA, 20 bp, Artificial Sequence
  chemically synthesized
aaatttggaaatgaggaaca

SEQ ID NO: 76554 - DNA, 20 bp, Artificial Sequence
  chemically synthesized
tttggaaatgaggaacaggg

SEQ ID NO: 76555 - DNA, 20 bp, Artificial Sequence
  chemically synthesized
acagggaagtattgaccaca

SEQ ID NO: 76556 - DNA, 20 bp, Artificial Sequence
  chemically synthesized
cagggaagtattgaccacaa

SEQ ID NO: 76557 - DNA, 20 bp, Artificial Sequence
  chemically synthesized
aaataaaaacttttcctttg

SEQ ID NO: 76558 - DNA, 20 bp, Artificial Sequence
  chemically synthesized
aagtattgaccacaaaggaa

SEQ ID NO: 76559 - DNA, 20 bp, Artificial Sequence
  chemically synthesized
aaggaaaagtttttattttt

SEQ ID NO: 76560 - DNA, 20 bp, Artificial Sequence
  chemically synthesized
aagtttttatttttaagaac

SEQ ID NO: 76561 - DNA, 20 bp, Artificial Sequence
  chemically synthesized
ttttaagaacaagttgaaca

SEQ ID NO: 76562 - DNA, 20 bp, Artificial Sequence
  chemically synthesized
taagaacaagttgaacatag

SEQ ID NO: 76563 - DNA, 20 bp, Artificial Sequence
  chemically synthesized
aagaacaagttgaacatagc

SEQ ID NO: 76564 - DNA, 20 bp, Artificial Sequence
  chemically synthesized
gaacaagttgaacatagcag

SEQ ID NO: 76565 - DNA, 20 bp, Artificial Sequence
  chemically synthesized
tattttgcaaaccatacacc

SEQ ID NO: 76566 - DNA, 20 bp, Artificial Sequence
  chemically synthesized
ctgaccccttaccgggtgta

SEQ ID NO: 76567 - DNA, 20 bp, Artificial Sequence
  chemically synthesized
ttgcaaaccatacacccggt

SEQ ID NO: 76568 - DNA, 20 bp, Artificial Sequence
  chemically synthesized
tgcaaaccatacacccggta

SEQ ID NO: 76569 - DNA, 20 bp, Artificial Sequence
  chemically synthesized
gcaaaccatacacccggtaa

SEQ ID NO: 76570 - DNA, 20 bp, Artificial Sequence
  chemically synthesized
caaaccatacacccggtaag

SEQ ID NO: 76571 - DNA, 20 bp, Artificial Sequence
  chemically synthesized
ttgaatactgaccccttacc

SEQ ID NO: 76572 - DNA, 20 bp, Artificial Sequence
  chemically synthesized
tttgaatactgaccccttac

SEQ ID NO: 76573 - DNA, 20 bp, Artificial Sequence
  chemically synthesized
ccatacacccggtaaggggt

SEQ ID NO: 76574 - DNA, 20 bp, Artificial Sequence
  chemically synthesized
ggtcagtattcaaaatacac

SEQ ID NO: 76575 - DNA, 20 bp, Artificial Sequence
  chemically synthesized
gtcagtattcaaaatacaca

SEQ ID NO: 76576 - DNA, 20 bp, Artificial Sequence
  chemically synthesized
ttcttgctattgagttgtag

SEQ ID NO: 76577 - DNA, 20 bp, Artificial Sequence
  chemically synthesized
ttttcttgctattgagttgt

SEQ ID NO: 76578 - DNA, 20 bp, Artificial Sequence
  chemically synthesized
gttttcttgctattgagttg

SEQ ID NO: 76579 - DNA, 20 bp, Artificial Sequence
  chemically synthesized
aaggaactcctacaactcaa

SEQ ID NO: 76580 - DNA, 20 bp, Artificial Sequence
  chemically synthesized
aactcctacaactcaatagc

SEQ ID NO: 76581 - DNA, 20 bp, Artificial Sequence
  chemically synthesized
tgatttgttttcttgctatt

SEQ ID NO: 76582 - DNA, 20 bp, Artificial Sequence
  chemically synthesized
tacttgctcattttttagtc

SEQ ID NO: 76583 - DNA, 20 bp, Artificial Sequence
  chemically synthesized
ttacttgctcattttttagt

SEQ ID NO: 76584 - DNA, 20 bp, Artificial Sequence
  chemically synthesized
aaatcacctgactaaaaaat

SEQ ID NO: 76585 - DNA, 20 bp, Artificial Sequence
  chemically synthesized
caggttacttgctcattttt

SEQ ID NO: 76586 - DNA, 20 bp, Artificial Sequence
  chemically synthesized
cacctgactaaaaaatgagc

SEQ ID NO: 76587 - DNA, 20 bp, Artificial Sequence
  chemically synthesized
aaatgagcaagtaacctgaa

SEQ ID NO: 76588 - DNA, 20 bp, Artificial Sequence
  chemically synthesized
ctttggagaaatgtctattc

SEQ ID NO: 76589 - DNA, 20 bp, Artificial Sequence
  chemically synthesized
tctttggagaaatgtctatt

SEQ ID NO: 76590 - DNA, 20 bp, Artificial Sequence
  chemically synthesized
cctgaatagacatttctcca

SEQ ID NO: 76591 - DNA, 20 bp, Artificial Sequence
  chemically synthesized
gaatagacatttctccaaag

SEQ ID NO: 76592 - DNA, 20 bp, Artificial Sequence
  chemically synthesized
tcatttctatatcttctttg

SEQ ID NO: 76593 - DNA, 20 bp, Artificial Sequence
  chemically synthesized
actcatttctatatcttctt

SEQ ID NO: 76594 - DNA, 20 bp, Artificial Sequence
  chemically synthesized
acatttctccaaagaagata

SEQ ID NO: 76595 - DNA, 20 bp, Artificial Sequence
  chemically synthesized
tccaaagaagatatagaaat

SEQ ID NO: 76596 - DNA, 20 bp, Artificial Sequence
  chemically synthesized
aagatatagaaatgagtatt

SEQ ID NO: 76597 - DNA, 20 bp, Artificial Sequence
  chemically synthesized
gaaatgagtattcagattta

SEQ ID NO: 76598 - DNA, 20 bp, Artificial Sequence
  chemically synthesized
tgagtattcagatttataga

SEQ ID NO: 76599 - DNA, 20 bp, Artificial Sequence
  chemically synthesized
gagtattcagatttatagac

SEQ ID NO: 76600 - DNA, 20 bp, Artificial Sequence
  chemically synthesized
tcagatttatagacaggaaa

SEQ ID NO: 76601 - DNA, 20 bp, Artificial Sequence
  chemically synthesized
tttatagacaggaaatagaa

SEQ ID NO: 76602 - DNA, 20 bp, Artificial Sequence
  chemically synthesized
atagacaggaaatagaatgg

SEQ ID NO: 76603 - DNA, 20 bp, Artificial Sequence
  chemically synthesized
ggaaatagaatggtggtttc

SEQ ID NO: 76604 - DNA, 20 bp, Artificial Sequence
  chemically synthesized
gaaatagaatggtggtttcc

SEQ ID NO: 76605 - DNA, 20 bp, Artificial Sequence
  chemically synthesized
aaatagaatggtggtttcca

SEQ ID NO: 76606 - DNA, 20 bp, Artificial Sequence
  chemically synthesized
aatagaatggtggtttccag

SEQ ID NO: 76607 - DNA, 20 bp, Artificial Sequence
  chemically synthesized
gaatggtggtttccaggggc

SEQ ID NO: 76608 - DNA, 20 bp, Artificial Sequence
  chemically synthesized
aatggtggtttccaggggct

SEQ ID NO: 76609 - DNA, 20 bp, Artificial Sequence
  chemically synthesized
atggtggtttccaggggctg

SEQ ID NO: 76610 - DNA, 20 bp, Artificial Sequence
  chemically synthesized
tgcttcctgcccccagcccc

SEQ ID NO: 76611 - DNA, 20 bp, Artificial Sequence
  chemically synthesized
tggtggtttccaggggctgg

SEQ ID NO: 76612 - DNA, 20 bp, Artificial Sequence
  chemically synthesized
tggtttccaggggctggggg

SEQ ID NO: 76613 - DNA, 20 bp, Artificial Sequence
  chemically synthesized
ggtttccaggggctgggggc

SEQ ID NO: 76614 - DNA, 20 bp, Artificial Sequence
  chemically synthesized
tccccattgcttcctgcccc

SEQ ID NO: 76615 - DNA, 20 bp, Artificial Sequence
  chemically synthesized
ttccaggggctgggggcagg

SEQ ID NO: 76616 - DNA, 20 bp, Artificial Sequence
  chemically synthesized
gggctgggggcaggaagcaa

SEQ ID NO: 76617 - DNA, 20 bp, Artificial Sequence
  chemically synthesized
ggctgggggcaggaagcaat

SEQ ID NO: 76618 - DNA, 20 bp, Artificial Sequence
  chemically synthesized
gctgggggcaggaagcaatg

SEQ ID NO: 76619 - DNA, 20 bp, Artificial Sequence
  chemically synthesized
gaagcaatggggaattactg

SEQ ID NO: 76620 - DNA, 20 bp, Artificial Sequence
  chemically synthesized
gaacaaaaaagaaaaaacca

SEQ ID NO: 76621 - DNA, 20 bp, Artificial Sequence
  chemically synthesized
ccatctcaaaaggaacaaaa

SEQ ID NO: 76622 - DNA, 20 bp, Artificial Sequence
  chemically synthesized
ttttcttttttgttcctttt

SEQ ID NO: 76623 - DNA, 20 bp, Artificial Sequence
  chemically synthesized
cttttttgttccttttgaga

SEQ ID NO: 76624 - DNA, 20 bp, Artificial Sequence
  chemically synthesized
gagcgagactccatctcaaa

SEQ ID NO: 76625 - DNA, 20 bp, Artificial Sequence
  chemically synthesized
agagcgagactccatctcaa

SEQ ID NO: 76626 - DNA, 20 bp, Artificial Sequence
  chemically synthesized
tttttgttccttttgagatg

SEQ ID NO: 76627 - DNA, 20 bp, Artificial Sequence
  chemically synthesized
tccagcctgggcaacagagc

SEQ ID NO: 76628 - DNA, 20 bp, Artificial Sequence
  chemically synthesized
tggagtctcgctctgttgcc

SEQ ID NO: 76629 - DNA, 20 bp, Artificial Sequence
  chemically synthesized
gcactccagcctgggcaaca

SEQ ID NO: 76630 - DNA, 20 bp, Artificial Sequence
  chemically synthesized
ggagtctcgctctgttgccc

SEQ ID NO: 76631 - DNA, 20 bp, Artificial Sequence
  chemically synthesized
ctgcactccagcctgggcaa

SEQ ID NO: 76632 - DNA, 20 bp, Artificial Sequence
  chemically synthesized
tctcgctctgttgcccaggc

SEQ ID NO: 76633 - DNA, 20 bp, Artificial Sequence
  chemically synthesized
tcgctctgttgcccaggctg

SEQ ID NO: 76634 - DNA, 20 bp, Artificial Sequence
  chemically synthesized
acaccactgcactccagcct

SEQ ID NO: 76635 - DNA, 20 bp, Artificial Sequence
  chemically synthesized
cacaccactgcactccagcc

SEQ ID NO: 76636 - DNA, 20 bp, Artificial Sequence
  chemically synthesized
ctgttgcccaggctggagtg

SEQ ID NO: 76637 - DNA, 20 bp, Artificial Sequence
  chemically synthesized
gagatcacaccactgcactc

SEQ ID NO: 76638 - DNA, 20 bp, Artificial Sequence
  chemically synthesized
ttgcccaggctggagtgcag

SEQ ID NO: 76639 - DNA, 20 bp, Artificial Sequence
  chemically synthesized
cagtggtgtgatctcgatct

SEQ ID NO: 76640 - DNA, 20 bp, Artificial Sequence
  chemically synthesized
ggttgcagtgagctgagatc

SEQ ID NO: 76641 - DNA, 20 bp, Artificial Sequence
  chemically synthesized
ggcggaggttgcagtgagct

SEQ ID NO: 76642 - DNA, 20 bp, Artificial Sequence
  chemically synthesized
tgggaggcggaggttgcagt

SEQ ID NO: 76643 - DNA, 20 bp, Artificial Sequence
  chemically synthesized
aacctgggaggcggaggttg

SEQ ID NO: 76644 - DNA, 20 bp, Artificial Sequence
  chemically synthesized
tgcttgaacctgggaggcgg

SEQ ID NO: 76645 - DNA, 20 bp, Artificial Sequence
  chemically synthesized
tcactgcaacctccgcctcc

SEQ ID NO: 76646 - DNA, 20 bp, Artificial Sequence
  chemically synthesized
ttgcttgaacctgggaggcg

SEQ ID NO: 76647 - DNA, 20 bp, Artificial Sequence
  chemically synthesized
cactgcaacctccgcctccc

SEQ ID NO: 76648 - DNA, 20 bp, Artificial Sequence
  chemically synthesized
aattgcttgaacctgggagg

SEQ ID NO: 76649 - DNA, 20 bp, Artificial Sequence
  chemically synthesized
cagaattgcttgaacctggg

SEQ ID NO: 76650 - DNA, 20 bp, Artificial Sequence
  chemically synthesized
gcagaattgcttgaacctgg

SEQ ID NO: 76651 - DNA, 20 bp, Artificial Sequence
  chemically synthesized
aacctccgcctcccaggttc

SEQ ID NO: 76652 - DNA, 20 bp, Artificial Sequence
  chemically synthesized
cagcagaattgcttgaacct

SEQ ID NO: 76653 - DNA, 20 bp, Artificial Sequence
  chemically synthesized
gcagcagaattgcttgaacc

SEQ ID NO: 76654 - DNA, 20 bp, Artificial Sequence
  chemically synthesized
ttcaagcaattctgctgcct

SEQ ID NO: 76655 - DNA, 20 bp, Artificial Sequence
  chemically synthesized
tacttgggaggctgaggcag

SEQ ID NO: 76656 - DNA, 20 bp, Artificial Sequence
  chemically synthesized
agctacttgggaggctgagg

SEQ ID NO: 76657 - DNA, 20 bp, Artificial Sequence
  chemically synthesized
cccagctacttgggaggctg

SEQ ID NO: 76658 - DNA, 20 bp, Artificial Sequence
  chemically synthesized
tcccagctacttgggaggct

SEQ ID NO: 76659 - DNA, 20 bp, Artificial Sequence
  chemically synthesized
ttctgctgcctcagcctccc

SEQ ID NO: 76660 - DNA, 20 bp, Artificial Sequence
  chemically synthesized
tgctgcctcagcctcccaag

SEQ ID NO: 76661 - DNA, 20 bp, Artificial Sequence
  chemically synthesized
tgtaatcccagctacttggg

SEQ ID NO: 76662 - DNA, 20 bp, Artificial Sequence
  chemically synthesized
ctgtaatcccagctacttgg

SEQ ID NO: 76663 - DNA, 20 bp, Artificial Sequence
  chemically synthesized
gcctcagcctcccaagtagc

SEQ ID NO: 76664 - DNA, 20 bp, Artificial Sequence
  chemically synthesized
acctgtaatcccagctactt

SEQ ID NO: 76665 - DNA, 20 bp, Artificial Sequence
  chemically synthesized
cctcagcctcccaagtagct

SEQ ID NO: 76666 - DNA, 20 bp, Artificial Sequence
  chemically synthesized
cacctgtaatcccagctact

SEQ ID NO: 76667 - DNA, 20 bp, Artificial Sequence
  chemically synthesized
ctcccaagtagctgggatta

SEQ ID NO: 76668 - DNA, 20 bp, Artificial Sequence
  chemically synthesized
tcccaagtagctgggattac

SEQ ID NO: 76669 - DNA, 20 bp, Artificial Sequence
  chemically synthesized
gtggtgcacacctgtaatcc

SEQ ID NO: 76670 - DNA, 20 bp, Artificial Sequence
  chemically synthesized
caggtgtgcaccaccacgcc

SEQ ID NO: 76671 - DNA, 20 bp, Artificial Sequence
  chemically synthesized
caaaaattagctgggcgtgg

SEQ ID NO: 76672 - DNA, 20 bp, Artificial Sequence
  chemically synthesized
atacaaaaattagctgggcg

SEQ ID NO: 76673 - DNA, 20 bp, Artificial Sequence
  chemically synthesized
taaaaatacaaaaattagct

SEQ ID NO: 76674 - DNA, 20 bp, Artificial Sequence
  chemically synthesized
ctaaaaatacaaaaattagc

SEQ ID NO: 76675 - DNA, 20 bp, Artificial Sequence
  chemically synthesized
tctactaaaaatacaaaaat

SEQ ID NO: 76676 - DNA, 20 bp, Artificial Sequence
  chemically synthesized
ccagctaatttttgtatttt

SEQ ID NO: 76677 - DNA, 20 bp, Artificial Sequence
  chemically synthesized
gctaatttttgtatttttag

SEQ ID NO: 76678 - DNA, 20 bp, Artificial Sequence
  chemically synthesized
taatttttgtatttttagta

SEQ ID NO: 76679 - DNA, 20 bp, Artificial Sequence
  chemically synthesized
ttttgtatttttagtagaga

SEQ ID NO: 76680 - DNA, 20 bp, Artificial Sequence
  chemically synthesized
tttgtatttttagtagagat

SEQ ID NO: 76681 - DNA, 20 bp, Artificial Sequence
  chemically synthesized
ttgtatttttagtagagatg

SEQ ID NO: 76682 - DNA, 20 bp, Artificial Sequence
  chemically synthesized
gagatggggttttaccatgt

SEQ ID NO: 76683 - DNA, 20 bp, Artificial Sequence
  chemically synthesized
tggggttttaccatgttggc

SEQ ID NO: 76684 - DNA, 20 bp, Artificial Sequence
  chemically synthesized
cgagaccagcctggccaaca

SEQ ID NO: 76685 - DNA, 20 bp, Artificial Sequence
  chemically synthesized
ggggttttaccatgttggcc

SEQ ID NO: 76686 - DNA, 20 bp, Artificial Sequence
  chemically synthesized
ttttaccatgttggccaggc

SEQ ID NO: 76687 - DNA, 20 bp, Artificial Sequence
  chemically synthesized
ccaggagttcgagaccagcc

SEQ ID NO: 76688 - DNA, 20 bp, Artificial Sequence
  chemically synthesized
tgaggccaggagttcgagac

SEQ ID NO: 76689 - DNA, 20 bp, Artificial Sequence
  chemically synthesized
ccaggctggtctcgaactcc

SEQ ID NO: 76690 - DNA, 20 bp, Artificial Sequence
  chemically synthesized
tcacctgaggccaggagttc

SEQ ID NO: 76691 - DNA, 20 bp, Artificial Sequence
  chemically synthesized
tggtctcgaactcctggcct

SEQ ID NO: 76692 - DNA, 20 bp, Artificial Sequence
  chemically synthesized
ggcggatcacctgaggccag

SEQ ID NO: 76693 - DNA, 20 bp, Artificial Sequence
  chemically synthesized
ggtctcgaactcctggcctc

SEQ ID NO: 76694 - DNA, 20 bp, Artificial Sequence
  chemically synthesized
caggcggatcacctgaggcc

SEQ ID NO: 76695 - DNA, 20 bp, Artificial Sequence
  chemically synthesized
gcaggcggatcacctgaggc

SEQ ID NO: 76696 - DNA, 20 bp, Artificial Sequence
  chemically synthesized
caaggcaggcggatcacctg

SEQ ID NO: 76697 - DNA, 20 bp, Artificial Sequence
  chemically synthesized
ccaaggcaggcggatcacct

SEQ ID NO: 76698 - DNA, 20 bp, Artificial Sequence
  chemically synthesized
ctcaggtgatccgcctgcct

SEQ ID NO: 76699 - DNA, 20 bp, Artificial Sequence
  chemically synthesized
ctttgggaggccaaggcagg

SEQ ID NO: 76700 - DNA, 20 bp, Artificial Sequence
  chemically synthesized
acactttgggaggccaaggc

SEQ ID NO: 76701 - DNA, 20 bp, Artificial Sequence
  chemically synthesized
aacactttgggaggccaagg

SEQ ID NO: 76702 - DNA, 20 bp, Artificial Sequence
  chemically synthesized
ctcaacactttgggaggcca

SEQ ID NO: 76703 - DNA, 20 bp, Artificial Sequence
  chemically synthesized
tctcaacactttgggaggcc

SEQ ID NO: 76704 - DNA, 20 bp, Artificial Sequence
  chemically synthesized
ccgcctgccttggcctccca

SEQ ID NO: 76705 - DNA, 20 bp, Artificial Sequence
  chemically synthesized
tgtaatctcaacactttggg

SEQ ID NO: 76706 - DNA, 20 bp, Artificial Sequence
  chemically synthesized
ctgtaatctcaacactttgg

SEQ ID NO: 76707 - DNA, 20 bp, Artificial Sequence
  chemically synthesized
acctgtaatctcaacacttt

SEQ ID NO: 76708 - DNA, 20 bp, Artificial Sequence
  chemically synthesized
ccttggcctcccaaagtgtt

SEQ ID NO: 76709 - DNA, 20 bp, Artificial Sequence
  chemically synthesized
cacctgtaatctcaacactt

SEQ ID NO: 76710 - DNA, 20 bp, Artificial Sequence
  chemically synthesized
ctcccaaagtgttgagatta

SEQ ID NO: 76711 - DNA, 20 bp, Artificial Sequence
  chemically synthesized
tcccaaagtgttgagattac

SEQ ID NO: 76712 - DNA, 20 bp, Artificial Sequence
  chemically synthesized
agtgttgagattacaggtgt

SEQ ID NO: 76713 - DNA, 20 bp, Artificial Sequence
  chemically synthesized
caggtgtgagccaccatgcc

SEQ ID NO: 76714 - DNA, 20 bp, Artificial Sequence
  chemically synthesized
ataatccccaccaggcatgg

SEQ ID NO: 76715 - DNA, 20 bp, Artificial Sequence
  chemically synthesized
gtgtgagccaccatgcctgg

SEQ ID NO: 76716 - DNA, 20 bp, Artificial Sequence
  chemically synthesized
acgataatccccaccaggca

SEQ ID NO: 76717 - DNA, 20 bp, Artificial Sequence
  chemically synthesized
tgtgagccaccatgcctggt

SEQ ID NO: 76718 - DNA, 20 bp, Artificial Sequence
  chemically synthesized
gtgagccaccatgcctggtg

SEQ ID NO: 76719 - DNA, 20 bp, Artificial Sequence
  chemically synthesized
attcaacgataatccccacc

SEQ ID NO: 76720 - DNA, 20 bp, Artificial Sequence
  chemically synthesized
tattcaacgataatccccac

SEQ ID NO: 76721 - DNA, 20 bp, Artificial Sequence
  chemically synthesized
tggtggggattatcgttgaa

SEQ ID NO: 76722 - DNA, 20 bp, Artificial Sequence
  chemically synthesized
ggattatcgttgaatagaca

SEQ ID NO: 76723 - DNA, 20 bp, Artificial Sequence
  chemically synthesized
attatcgttgaatagacata

SEQ ID NO: 76724 - DNA, 20 bp, Artificial Sequence
  chemically synthesized
gttgaatagacatagagttt

SEQ ID NO: 76725 - DNA, 20 bp, Artificial Sequence
  chemically synthesized
acatagagtttcagttttgc

SEQ ID NO: 76726 - DNA, 20 bp, Artificial Sequence
  chemically synthesized
gagtttcagttttgcaagat

SEQ ID NO: 76727 - DNA, 20 bp, Artificial Sequence
  chemically synthesized
tttcagttttgcaagatgag

SEQ ID NO: 76728 - DNA, 20 bp, Artificial Sequence
  chemically synthesized
tcagttttgcaagatgagaa

SEQ ID NO: 76729 - DNA, 20 bp, Artificial Sequence
  chemically synthesized
ttgcaagatgagaagagttc

SEQ ID NO: 76730 - DNA, 20 bp, Artificial Sequence
  chemically synthesized
gcaagatgagaagagttctg

SEQ ID NO: 76731 - DNA, 20 bp, Artificial Sequence
  chemically synthesized
gatgagaagagttctggaga

SEQ ID NO: 76732 - DNA, 20 bp, Artificial Sequence
  chemically synthesized
ccatcaccaccatccatctc

SEQ ID NO: 76733 - DNA, 20 bp, Artificial Sequence
  chemically synthesized
agaagagttctggagatgga

SEQ ID NO: 76734 - DNA, 20 bp, Artificial Sequence
  chemically synthesized
agagttctggagatggatgg

SEQ ID NO: 76735 - DNA, 20 bp, Artificial Sequence
  chemically synthesized
ctggagatggatggtggtga

SEQ ID NO: 76736 - DNA, 20 bp, Artificial Sequence
  chemically synthesized
gagatggatggtggtgatgg

SEQ ID NO: 76737 - DNA, 20 bp, Artificial Sequence
  chemically synthesized
atggatggtggtgatggcag

SEQ ID NO: 76738 - DNA, 20 bp, Artificial Sequence
  chemically synthesized
cgtaaatgtatgtaatgcca

SEQ ID NO: 76739 - DNA, 20 bp, Artificial Sequence
  chemically synthesized
aaatgtatgtaatgccatgg

SEQ ID NO: 76740 - DNA, 20 bp, Artificial Sequence
  chemically synthesized
tatttaaatgtatacttcca

SEQ ID NO: 76741 - DNA, 20 bp, Artificial Sequence
  chemically synthesized
catggaagtatacatttaaa

SEQ ID NO: 76742 - DNA, 20 bp, Artificial Sequence
  chemically synthesized
tggaagtatacatttaaata

SEQ ID NO: 76743 - DNA, 20 bp, Artificial Sequence
  chemically synthesized
gtatacatttaaatagagcc

SEQ ID NO: 76744 - DNA, 20 bp, Artificial Sequence
  chemically synthesized
acatttaaatagagccaaga

SEQ ID NO: 76745 - DNA, 20 bp, Artificial Sequence
  chemically synthesized
ttacatgaagtttactatct

SEQ ID NO: 76746 - DNA, 20 bp, Artificial Sequence
  chemically synthesized
ggtaaaatacaaattacatg

SEQ ID NO: 76747 - DNA, 20 bp, Artificial Sequence
  chemically synthesized
atttttgattttttaaatag

SEQ ID NO: 76748 - DNA, 20 bp, Artificial Sequence
  chemically synthesized
cttatttttgattttttaaa

SEQ ID NO: 76749 - DNA, 20 bp, Artificial Sequence
  chemically synthesized
ctatttaaaaaatcaaaaat

SEQ ID NO: 76750 - DNA, 20 bp, Artificial Sequence
  chemically synthesized
aaaataagtacaatttgtaa

SEQ ID NO: 76751 - DNA, 20 bp, Artificial Sequence
  chemically synthesized
ataagtacaatttgtaaaag

SEQ ID NO: 76752 - DNA, 20 bp, Artificial Sequence
  chemically synthesized
gaaattaataaaatttgttc

SEQ ID NO: 76753 - DNA, 20 bp, Artificial Sequence
  chemically synthesized
acaaattttattaatttcct

SEQ ID NO: 76754 - DNA, 20 bp, Artificial Sequence
  chemically synthesized
caaattttattaatttcctt

SEQ ID NO: 76755 - DNA, 20 bp, Artificial Sequence
  chemically synthesized
attatagaaacattttccca

SEQ ID NO: 76756 - DNA, 20 bp, Artificial Sequence
  chemically synthesized
gattatagaaacattttccc

SEQ ID NO: 76757 - DNA, 20 bp, Artificial Sequence
  chemically synthesized
ggcagttgcagttaggatta

SEQ ID NO: 76758 - DNA, 20 bp, Artificial Sequence
  chemically synthesized
gataactggcagttgcagtt

SEQ ID NO: 76759 - DNA, 20 bp, Artificial Sequence
  chemically synthesized
agataactggcagttgcagt

SEQ ID NO: 76760 - DNA, 20 bp, Artificial Sequence
  chemically synthesized
ataatcctaactgcaactgc

SEQ ID NO: 76761 - DNA, 20 bp, Artificial Sequence
  chemically synthesized
ggggagataactggcagttg

SEQ ID NO: 76762 - DNA, 20 bp, Artificial Sequence
  chemically synthesized
tataaaggggagataactgg

SEQ ID NO: 76763 - DNA, 20 bp, Artificial Sequence
  chemically synthesized
gtctataaaggggagataac

SEQ ID NO: 76764 - DNA, 20 bp, Artificial Sequence
  chemically synthesized
tgccagttatctccccttta

SEQ ID NO: 76765 - DNA, 20 bp, Artificial Sequence
  chemically synthesized
tgttttttgtctataaaggg

SEQ ID NO: 76766 - DNA, 20 bp, Artificial Sequence
  chemically synthesized
cttgttttttgtctataaag

SEQ ID NO: 76767 - DNA, 20 bp, Artificial Sequence
  chemically synthesized
gcttgttttttgtctataaa

SEQ ID NO: 76768 - DNA, 20 bp, Artificial Sequence
  chemically synthesized
tgcttgttttttgtctataa

SEQ ID NO: 76769 - DNA, 20 bp, Artificial Sequence
  chemically synthesized
ttgcttgttttttgtctata

SEQ ID NO: 76770 - DNA, 20 bp, Artificial Sequence
  chemically synthesized
cccctttatagacaaaaaac

SEQ ID NO: 76771 - DNA, 20 bp, Artificial Sequence
  chemically synthesized
ggaaagcttgaagtattttg

SEQ ID NO: 76772 - DNA, 20 bp, Artificial Sequence
  chemically synthesized
aaaaaaccacaaaatacttc

SEQ ID NO: 76773 - DNA, 20 bp, Artificial Sequence
  chemically synthesized
ttgtgtcattggaaagcttg

SEQ ID NO: 76774 - DNA, 20 bp, Artificial Sequence
  chemically synthesized
gttttaattgtgtcattgga

SEQ ID NO: 76775 - DNA, 20 bp, Artificial Sequence
  chemically synthesized
atttgttttaattgtgtcat

SEQ ID NO: 76776 - DNA, 20 bp, Artificial Sequence
  chemically synthesized
acacaattaaaacaaataaa

SEQ ID NO: 76777 - DNA, 20 bp, Artificial Sequence
  chemically synthesized
aattaaaacaaataaaaaga

SEQ ID NO: 76778 - DNA, 20 bp, Artificial Sequence
  chemically synthesized
caaataaaaagatagttcat

SEQ ID NO: 76779 - DNA, 20 bp, Artificial Sequence
  chemically synthesized
gatagttcatgagtgtttca

SEQ ID NO: 76780 - DNA, 20 bp, Artificial Sequence
  chemically synthesized
tagttcatgagtgtttcaca

SEQ ID NO: 76781 - DNA, 20 bp, Artificial Sequence
  chemically synthesized
agttcatgagtgtttcacag

SEQ ID NO: 76782 - DNA, 20 bp, Artificial Sequence
  chemically synthesized
aattgtgtatattttgtatt

SEQ ID NO: 76783 - DNA, 20 bp, Artificial Sequence
  chemically synthesized
atatacacaattaacacaaa

SEQ ID NO: 76784 - DNA, 20 bp, Artificial Sequence
  chemically synthesized
tatacacaattaacacaaaa

SEQ ID NO: 76785 - DNA, 20 bp, Artificial Sequence
  chemically synthesized
aacacaaaaaggcttttaat

SEQ ID NO: 76786 - DNA, 20 bp, Artificial Sequence
  chemically synthesized
gacttatttgtgctcattaa

SEQ ID NO: 76787 - DNA, 20 bp, Artificial Sequence
  chemically synthesized
ggcttttaatgagcacaaat

SEQ ID NO: 76788 - DNA, 20 bp, Artificial Sequence
  chemically synthesized
tgagcacaaataagtcattt

SEQ ID NO: 76789 - DNA, 20 bp, Artificial Sequence
  chemically synthesized
gcacaaataagtcatttaag

SEQ ID NO: 76790 - DNA, 20 bp, Artificial Sequence
  chemically synthesized
cacaaataagtcatttaagc

SEQ ID NO: 76791 - DNA, 20 bp, Artificial Sequence
  chemically synthesized
catttaagcaggtcatgctt

SEQ ID NO: 76792 - DNA, 20 bp, Artificial Sequence
  chemically synthesized
atttaagcaggtcatgcttt

SEQ ID NO: 76793 - DNA, 20 bp, Artificial Sequence
  chemically synthesized
tctgtttccttagcaaccta

SEQ ID NO: 76794 - DNA, 20 bp, Artificial Sequence
  chemically synthesized
aggtcatgctttaggttgct

SEQ ID NO: 76795 - DNA, 20 bp, Artificial Sequence
  chemically synthesized
ggtcatgctttaggttgcta

SEQ ID NO: 76796 - DNA, 20 bp, Artificial Sequence
  chemically synthesized
gctttaggttgctaaggaaa

SEQ ID NO: 76797 - DNA, 20 bp, Artificial Sequence
  chemically synthesized
tggtattttttctgtttcct

SEQ ID NO: 76798 - DNA, 20 bp, Artificial Sequence
  chemically synthesized
atttttcagacagaaaatat

SEQ ID NO: 76799 - DNA, 20 bp, Artificial Sequence
  chemically synthesized
tataattaaaatttttcaga

SEQ ID NO: 76800 - DNA, 20 bp, Artificial Sequence
  chemically synthesized
cacatataattaaaattttt

SEQ ID NO: 76801 - DNA, 20 bp, Artificial Sequence
  chemically synthesized
taattatatgtgacaaaatg

SEQ ID NO: 76802 - DNA, 20 bp, Artificial Sequence
  chemically synthesized
tgtgacaaaatgaagcaaaa

SEQ ID NO: 76803 - DNA, 20 bp, Artificial Sequence
  chemically synthesized
gacaaaatgaagcaaaatgg

SEQ ID NO: 76804 - DNA, 20 bp, Artificial Sequence
  chemically synthesized
ttacttttaaggaagttaat

SEQ ID NO: 76805 - DNA, 20 bp, Artificial Sequence
  chemically synthesized
cttacttttaaggaagttaa

SEQ ID NO: 76806 - DNA, 20 bp, Artificial Sequence
  chemically synthesized
aaacctattaacttccttaa

SEQ ID NO: 76807 - DNA, 20 bp, Artificial Sequence
  chemically synthesized
attattacttacttttaagg

SEQ ID NO: 76808 - DNA, 20 bp, Artificial Sequence
  chemically synthesized
ctattaacttccttaaaagt

SEQ ID NO: 76809 - DNA, 20 bp, Artificial Sequence
  chemically synthesized
tggattattacttactttta

SEQ ID NO: 76810 - DNA, 20 bp, Artificial Sequence
  chemically synthesized
atggattattacttactttt

SEQ ID NO: 76811 - DNA, 20 bp, Artificial Sequence
  chemically synthesized
gttgatattttaatggttta

SEQ ID NO: 76812 - DNA, 20 bp, Artificial Sequence
  chemically synthesized
cctcatggttgatattttaa

SEQ ID NO: 76813 - DNA, 20 bp, Artificial Sequence
  chemically synthesized
accattaaaatatcaaccat

SEQ ID NO: 76814 - DNA, 20 bp, Artificial Sequence
  chemically synthesized
ccattaaaatatcaaccatg

SEQ ID NO: 76815 - DNA, 20 bp, Artificial Sequence
  chemically synthesized
tttgaagataaacatcctca

SEQ ID NO: 76816 - DNA, 20 bp, Artificial Sequence
  chemically synthesized
aggatgtttatcttcaaatt

SEQ ID NO: 76817 - DNA, 20 bp, Artificial Sequence
  chemically synthesized
tgaagtaacttctgaatttg

SEQ ID NO: 76818 - DNA, 20 bp, Artificial Sequence
  chemically synthesized
atgtttatcttcaaattcag

SEQ ID NO: 76819 - DNA, 20 bp, Artificial Sequence
  chemically synthesized
ttcaaattcagaagttactt

SEQ ID NO: 76820 - DNA, 20 bp, Artificial Sequence
  chemically synthesized
aattcagaagttacttcaga

SEQ ID NO: 76821 - DNA, 20 bp, Artificial Sequence
  chemically synthesized
agtaaaacttcatctgtctg

SEQ ID NO: 76822 - DNA, 20 bp, Artificial Sequence
  chemically synthesized
gaagttacttcagacagatg

SEQ ID NO: 76823 - DNA, 20 bp, Artificial Sequence
  chemically synthesized
tgaagttttacttttttttt

SEQ ID NO: 76824 - DNA, 20 bp, Artificial Sequence
  chemically synthesized
aaaactctatctcaaaaaaa

SEQ ID NO: 76825 - DNA, 20 bp, Artificial Sequence
  chemically synthesized
gttttactttttttttgaga

SEQ ID NO: 76826 - DNA, 20 bp, Artificial Sequence
  chemically synthesized
tttactttttttttgagata

SEQ ID NO: 76827 - DNA, 20 bp, Artificial Sequence
  chemically synthesized
cactccagccggggcgacaa

SEQ ID NO: 76828 - DNA, 20 bp, Artificial Sequence
  chemically synthesized
gagttttgctcttgtcgccc

SEQ ID NO: 76829 - DNA, 20 bp, Artificial Sequence
  chemically synthesized
tgcactccagccggggcgac

SEQ ID NO: 76830 - DNA, 20 bp, Artificial Sequence
  chemically synthesized
tttgctcttgtcgccccggc

SEQ ID NO: 76831 - DNA, 20 bp, Artificial Sequence
  chemically synthesized
tgctcttgtcgccccggctg

SEQ ID NO: 76832 - DNA, 20 bp, Artificial Sequence
  chemically synthesized
gcaccattgcactccagccg

SEQ ID NO: 76833 - DNA, 20 bp, Artificial Sequence
  chemically synthesized
cgcaccattgcactccagcc

SEQ ID NO: 76834 - DNA, 20 bp, Artificial Sequence
  chemically synthesized
tcgcaccattgcactccagc

SEQ ID NO: 76835 - DNA, 20 bp, Artificial Sequence
  chemically synthesized
cagatcgcaccattgcactc

SEQ ID NO: 76836 - DNA, 20 bp, Artificial Sequence
  chemically synthesized
tcgccccggctggagtgcaa

SEQ ID NO: 76837 - DNA, 20 bp, Artificial Sequence
  chemically synthesized
tggagtgcaatggtgcgatc

SEQ ID NO: 76838 - DNA, 20 bp, Artificial Sequence
  chemically synthesized
ggagtgcaatggtgcgatct

SEQ ID NO: 76839 - DNA, 20 bp, Artificial Sequence
  chemically synthesized
ggcggaggttgcagtgagcc

SEQ ID NO: 76840 - DNA, 20 bp, Artificial Sequence
  chemically synthesized
cacgaggcggaggttgcagt

SEQ ID NO: 76841 - DNA, 20 bp, Artificial Sequence
  chemically synthesized
aacccacgaggcggaggttg

SEQ ID NO: 76842 - DNA, 20 bp, Artificial Sequence
  chemically synthesized
cgcttgaacccacgaggcgg

SEQ ID NO: 76843 - DNA, 20 bp, Artificial Sequence
  chemically synthesized
tcactgcaacctccgcctcg

SEQ ID NO: 76844 - DNA, 20 bp, Artificial Sequence
  chemically synthesized
tcgcttgaacccacgaggcg

SEQ ID NO: 76845 - DNA, 20 bp, Artificial Sequence
  chemically synthesized
cactgcaacctccgcctcgt

SEQ ID NO: 76846 - DNA, 20 bp, Artificial Sequence
  chemically synthesized
aatcgcttgaacccacgagg

SEQ ID NO: 76847 - DNA, 20 bp, Artificial Sequence
  chemically synthesized
gagaatcgcttgaacccacg

SEQ ID NO: 76848 - DNA, 20 bp, Artificial Sequence
  chemically synthesized
ggagaatcgcttgaacccac

SEQ ID NO: 76849 - DNA, 20 bp, Artificial Sequence
  chemically synthesized
aacctccgcctcgtgggttc

SEQ ID NO: 76850 - DNA, 20 bp, Artificial Sequence
  chemically synthesized
tacttgggaggttgaagcag

SEQ ID NO: 76851 - DNA, 20 bp, Artificial Sequence
  chemically synthesized
gctacttgggaggttgaagc

SEQ ID NO: 76852 - DNA, 20 bp, Artificial Sequence
  chemically synthesized
agctacttgggaggttgaag

SEQ ID NO: 76853 - DNA, 20 bp, Artificial Sequence
  chemically synthesized
cccagctacttgggaggttg

SEQ ID NO: 76854 - DNA, 20 bp, Artificial Sequence
  chemically synthesized
ttctcctgcttcaacctccc

SEQ ID NO: 76855 - DNA, 20 bp, Artificial Sequence
  chemically synthesized
tcctgcttcaacctcccaag

SEQ ID NO: 76856 - DNA, 20 bp, Artificial Sequence
  chemically synthesized
tgtaatcccagctacttggg

SEQ ID NO: 76857 - DNA, 20 bp, Artificial Sequence
  chemically synthesized
ctgtaatcccagctacttgg

SEQ ID NO: 76858 - DNA, 20 bp, Artificial Sequence
  chemically synthesized
gcttcaacctcccaagtagc

SEQ ID NO: 76859 - DNA, 20 bp, Artificial Sequence
  chemically synthesized
gcctgtaatcccagctactt

SEQ ID NO: 76860 - DNA, 20 bp, Artificial Sequence
  chemically synthesized
cttcaacctcccaagtagct

SEQ ID NO: 76861 - DNA, 20 bp, Artificial Sequence
  chemically synthesized
cgcctgtaatcccagctact

SEQ ID NO: 76862 - DNA, 20 bp, Artificial Sequence
  chemically synthesized
ctcccaagtagctgggatta

SEQ ID NO: 76863 - DNA, 20 bp, Artificial Sequence
  chemically synthesized
tcccaagtagctgggattac

SEQ ID NO: 76864 - DNA, 20 bp, Artificial Sequence
  chemically synthesized
gtggtgtgcgcctgtaatcc

SEQ ID NO: 76865 - DNA, 20 bp, Artificial Sequence
  chemically synthesized
aaattagccaggcatggtgg

SEQ ID NO: 76866 - DNA, 20 bp, Artificial Sequence
  chemically synthesized
gcgcacaccaccaccatgcc

SEQ ID NO: 76867 - DNA, 20 bp, Artificial Sequence
  chemically synthesized
gaaaaattagccaggcatgg

SEQ ID NO: 76868 - DNA, 20 bp, Artificial Sequence
  chemically synthesized
atagaaaaattagccaggca

SEQ ID NO: 76869 - DNA, 20 bp, Artificial Sequence
  chemically synthesized
taaaaatagaaaaattagcc

SEQ ID NO: 76870 - DNA, 20 bp, Artificial Sequence
  chemically synthesized
gtaaaaatagaaaaattagc

SEQ ID NO: 76871 - DNA, 20 bp, Artificial Sequence
  chemically synthesized
tctagtaaaaatagaaaaat

SEQ ID NO: 76872 - DNA, 20 bp, Artificial Sequence
  chemically synthesized
gctaatttttctatttttac

SEQ ID NO: 76873 - DNA, 20 bp, Artificial Sequence
  chemically synthesized
aacccagtctctagtaaaaa

SEQ ID NO: 76874 - DNA, 20 bp, Artificial Sequence
  chemically synthesized
taatttttctatttttacta

SEQ ID NO: 76875 - DNA, 20 bp, Artificial Sequence
  chemically synthesized
tttctatttttactagagac

SEQ ID NO: 76876 - DNA, 20 bp, Artificial Sequence
  chemically synthesized
ttctatttttactagagact

SEQ ID NO: 76877 - DNA, 20 bp, Artificial Sequence
  chemically synthesized
acaaggtgaaacccagtctc

SEQ ID NO: 76878 - DNA, 20 bp, Artificial Sequence
  chemically synthesized
ctggccaacaaggtgaaacc

SEQ ID NO: 76879 - DNA, 20 bp, Artificial Sequence
  chemically synthesized
gagactgggtttcaccttgt

SEQ ID NO: 76880 - DNA, 20 bp, Artificial Sequence
  chemically synthesized
ctgggtttcaccttgttggc

SEQ ID NO: 76881 - DNA, 20 bp, Artificial Sequence
  chemically synthesized
caagaccagcctggccaaca

SEQ ID NO: 76882 - DNA, 20 bp, Artificial Sequence
  chemically synthesized
tgggtttcaccttgttggcc

SEQ ID NO: 76883 - DNA, 20 bp, Artificial Sequence
  chemically synthesized
tcaagaccagcctggccaac

SEQ ID NO: 76884 - DNA, 20 bp, Artificial Sequence
  chemically synthesized
tttcaccttgttggccaggc

SEQ ID NO: 76885 - DNA, 20 bp, Artificial Sequence
  chemically synthesized
tcaggagttcaagaccagcc

SEQ ID NO: 76886 - DNA, 20 bp, Artificial Sequence
  chemically synthesized
tgatgtcaggagttcaagac

SEQ ID NO: 76887 - DNA, 20 bp, Artificial Sequence
  chemically synthesized
tcatctgatgtcaggagttc

SEQ ID NO: 76888 - DNA, 20 bp, Artificial Sequence
  chemically synthesized
tggtcttgaactcctgacat

SEQ ID NO: 76889 - DNA, 20 bp, Artificial Sequence
  chemically synthesized
ggtggatcatctgatgtcag

SEQ ID NO: 76890 - DNA, 20 bp, Artificial Sequence
  chemically synthesized
cgggtggatcatctgatgtc

SEQ ID NO: 76891 - DNA, 20 bp, Artificial Sequence
  chemically synthesized
gcgggtggatcatctgatgt

SEQ ID NO: 76892 - DNA, 20 bp, Artificial Sequence
  chemically synthesized
atcagatgatccacccgcct

SEQ ID NO: 76893 - DNA, 20 bp, Artificial Sequence
  chemically synthesized
ctttgggaggccgaggcggg

SEQ ID NO: 76894 - DNA, 20 bp, Artificial Sequence
  chemically synthesized
gcactttgggaggccgaggc

SEQ ID NO: 76895 - DNA, 20 bp, Artificial Sequence
  chemically synthesized
agcactttgggaggccgagg

SEQ ID NO: 76896 - DNA, 20 bp, Artificial Sequence
  chemically synthesized
cccagcactttgggaggccg

SEQ ID NO: 76897 - DNA, 20 bp, Artificial Sequence
  chemically synthesized
tcccagcactttgggaggcc

SEQ ID NO: 76898 - DNA, 20 bp, Artificial Sequence
  chemically synthesized
ccacccgcctcggcctccca

SEQ ID NO: 76899 - DNA, 20 bp, Artificial Sequence
  chemically synthesized
tgtaatcccagcactttggg

SEQ ID NO: 76900 - DNA, 20 bp, Artificial Sequence
  chemically synthesized
ctgtaatcccagcactttgg

SEQ ID NO: 76901 - DNA, 20 bp, Artificial Sequence
  chemically synthesized
gcctcggcctcccaaagtgc

SEQ ID NO: 76902 - DNA, 20 bp, Artificial Sequence
  chemically synthesized
gcctgtaatcccagcacttt

SEQ ID NO: 76903 - DNA, 20 bp, Artificial Sequence
  chemically synthesized
cctcggcctcccaaagtgct

SEQ ID NO: 76904 - DNA, 20 bp, Artificial Sequence
  chemically synthesized
cgcctgtaatcccagcactt

SEQ ID NO: 76905 - DNA, 20 bp, Artificial Sequence
  chemically synthesized
ctcccaaagtgctgggatta

SEQ ID NO: 76906 - DNA, 20 bp, Artificial Sequence
  chemically synthesized
tcccaaagtgctgggattac

SEQ ID NO: 76907 - DNA, 20 bp, Artificial Sequence
  chemically synthesized
gtggctcacgcctgtaatcc

SEQ ID NO: 76908 - DNA, 20 bp, Artificial Sequence
  chemically synthesized
agtgctgggattacaggcgt

SEQ ID NO: 76909 - DNA, 20 bp, Artificial Sequence
  chemically synthesized
atgtaaaacttcaggcgcag

SEQ ID NO: 76910 - DNA, 20 bp, Artificial Sequence
  chemically synthesized
ggcgtgagccactgcgcctg

SEQ ID NO: 76911 - DNA, 20 bp, Artificial Sequence
  chemically synthesized
taaatgtaaaacttcaggcg

SEQ ID NO: 76912 - DNA, 20 bp, Artificial Sequence
  chemically synthesized
cttgttaaatgtaaaacttc

SEQ ID NO: 76913 - DNA, 20 bp, Artificial Sequence
  chemically synthesized
acttgttaaatgtaaaactt

SEQ ID NO: 76914 - DNA, 20 bp, Artificial Sequence
  chemically synthesized
cctgaagttttacatttaac

SEQ ID NO: 76915 - DNA, 20 bp, Artificial Sequence
  chemically synthesized
ttttacatttaacaagtttt

SEQ ID NO: 76916 - DNA, 20 bp, Artificial Sequence
  chemically synthesized
tttacatttaacaagttttt

SEQ ID NO: 76917 - DNA, 20 bp, Artificial Sequence
  chemically synthesized
tcagaccaagaaatgattgc

SEQ ID NO: 76918 - DNA, 20 bp, Artificial Sequence
  chemically synthesized
ttgggcttgcaatcatttct

SEQ ID NO: 76919 - DNA, 20 bp, Artificial Sequence
  chemically synthesized
ttgcaatcatttcttggtct

SEQ ID NO: 76920 - DNA, 20 bp, Artificial Sequence
  chemically synthesized
taacacatgtggctcagacc

SEQ ID NO: 76921 - DNA, 20 bp, Artificial Sequence
  chemically synthesized
ggtggttaacacatgtggct

SEQ ID NO: 76922 - DNA, 20 bp, Artificial Sequence
  chemically synthesized
acaatggtggttaacacatg

SEQ ID NO: 76923 - DNA, 20 bp, Artificial Sequence
  chemically synthesized
ggcccattcagggacaatgg

SEQ ID NO: 76924 - DNA, 20 bp, Artificial Sequence
  chemically synthesized
gagggcccattcagggacaa

SEQ ID NO: 76925 - DNA, 20 bp, Artificial Sequence
  chemically synthesized
taaccaccattgtccctgaa

SEQ ID NO: 76926 - DNA, 20 bp, Artificial Sequence
  chemically synthesized
aaccaccattgtccctgaat

SEQ ID NO: 76927 - DNA, 20 bp, Artificial Sequence
  chemically synthesized
ggagggagagggcccattca

SEQ ID NO: 76928 - DNA, 20 bp, Artificial Sequence
  chemically synthesized
gggagggagagggcccattc

SEQ ID NO: 76929 - DNA, 20 bp, Artificial Sequence
  chemically synthesized
ggggagggagagggcccatt

SEQ ID NO: 76930 - DNA, 20 bp, Artificial Sequence
  chemically synthesized
agctatttaggggagggaga

SEQ ID NO: 76931 - DNA, 20 bp, Artificial Sequence
  chemically synthesized
gagctatttaggggagggag

SEQ ID NO: 76932 - DNA, 20 bp, Artificial Sequence
  chemically synthesized
tgagctatttaggggaggga

SEQ ID NO: 76933 - DNA, 20 bp, Artificial Sequence
  chemically synthesized
tttgagctatttaggggagg

SEQ ID NO: 76934 - DNA, 20 bp, Artificial Sequence
  chemically synthesized
gttttgagctatttagggga

SEQ ID NO: 76935 - DNA, 20 bp, Artificial Sequence
  chemically synthesized
tgttttgagctatttagggg

SEQ ID NO: 76936 - DNA, 20 bp, Artificial Sequence
  chemically synthesized
ggccctctccctcccctaaa

SEQ ID NO: 76937 - DNA, 20 bp, Artificial Sequence
  chemically synthesized
atgttttgagctatttaggg

SEQ ID NO: 76938 - DNA, 20 bp, Artificial Sequence
  chemically synthesized
tgatgttttgagctatttag

SEQ ID NO: 76939 - DNA, 20 bp, Artificial Sequence
  chemically synthesized
ctgatgttttgagctattta

SEQ ID NO: 76940 - DNA, 20 bp, Artificial Sequence
  chemically synthesized
actgatgttttgagctattt

SEQ ID NO: 76941 - DNA, 20 bp, Artificial Sequence
  chemically synthesized
gactgatgttttgagctatt

SEQ ID NO: 76942 - DNA, 20 bp, Artificial Sequence
  chemically synthesized
ccctaaatagctcaaaacat

SEQ ID NO: 76943 - DNA, 20 bp, Artificial Sequence
  chemically synthesized
ctgccttagactgatgtttt

SEQ ID NO: 76944 - DNA, 20 bp, Artificial Sequence
  chemically synthesized
atagctcaaaacatcagtct

SEQ ID NO: 76945 - DNA, 20 bp, Artificial Sequence
  chemically synthesized
tagctcaaaacatcagtcta

SEQ ID NO: 76946 - DNA, 20 bp, Artificial Sequence
  chemically synthesized
ctcaaaacatcagtctaagg

SEQ ID NO: 76947 - DNA, 20 bp, Artificial Sequence
  chemically synthesized
ttgtgtgagaatcactgcct

SEQ ID NO: 76948 - DNA, 20 bp, Artificial Sequence
  chemically synthesized
aggcagtgattctcacacaa

SEQ ID NO: 76949 - DNA, 20 bp, Artificial Sequence
  chemically synthesized
tgagatgcacactattgtgt

SEQ ID NO: 76950 - DNA, 20 bp, Artificial Sequence
  chemically synthesized
caagccttccacatgacaat

SEQ ID NO: 76951 - DNA, 20 bp, Artificial Sequence
  chemically synthesized
gtgtgcatctcattgtcatg

SEQ ID NO: 76952 - DNA, 20 bp, Artificial Sequence
  chemically synthesized
tgcatctcattgtcatgtgg

SEQ ID NO: 76953 - DNA, 20 bp, Artificial Sequence
  chemically synthesized
gcatctcattgtcatgtgga

SEQ ID NO: 76954 - DNA, 20 bp, Artificial Sequence
  chemically synthesized
atgtggaaggcttgttaaca

SEQ ID NO: 76955 - DNA, 20 bp, Artificial Sequence
  chemically synthesized
tcagcagtctctgtgttaac

SEQ ID NO: 76956 - DNA, 20 bp, Artificial Sequence
  chemically synthesized
gtggaaggcttgttaacaca

SEQ ID NO: 76957 - DNA, 20 bp, Artificial Sequence
  chemically synthesized
ttgttaacacagagactgct

SEQ ID NO: 76958 - DNA, 20 bp, Artificial Sequence
  chemically synthesized
aagcactaagtgggactcag

SEQ ID NO: 76959 - DNA, 20 bp, Artificial Sequence
  chemically synthesized
caaaagcactaagtgggact

SEQ ID NO: 76960 - DNA, 20 bp, Artificial Sequence
  chemically synthesized
agagactgctgagtcccact

SEQ ID NO: 76961 - DNA, 20 bp, Artificial Sequence
  chemically synthesized
ctgaatcaaaagcactaagt

SEQ ID NO: 76962 - DNA, 20 bp, Artificial Sequence
  chemically synthesized
actgaatcaaaagcactaag

SEQ ID NO: 76963 - DNA, 20 bp, Artificial Sequence
  chemically synthesized
cccactgaatcaaaagcact

SEQ ID NO: 76964 - DNA, 20 bp, Artificial Sequence
  chemically synthesized
cccacttagtgcttttgatt

SEQ ID NO: 76965 - DNA, 20 bp, Artificial Sequence
  chemically synthesized
ccttacacccactgaatcaa

SEQ ID NO: 76966 - DNA, 20 bp, Artificial Sequence
  chemically synthesized
acttagtgcttttgattcag

SEQ ID NO: 76967 - DNA, 20 bp, Artificial Sequence
  chemically synthesized
cttagtgcttttgattcagt

SEQ ID NO: 76968 - DNA, 20 bp, Artificial Sequence
  chemically synthesized
gcttttgattcagtgggtgt

SEQ ID NO: 76969 - DNA, 20 bp, Artificial Sequence
  chemically synthesized
cttttgattcagtgggtgta

SEQ ID NO: 76970 - DNA, 20 bp, Artificial Sequence
  chemically synthesized
ttgattcagtgggtgtaagg

SEQ ID NO: 76971 - DNA, 20 bp, Artificial Sequence
  chemically synthesized
tgattcagtgggtgtaaggt

SEQ ID NO: 76972 - DNA, 20 bp, Artificial Sequence
  chemically synthesized
agtgggtgtaaggtgggcct

SEQ ID NO: 76973 - DNA, 20 bp, Artificial Sequence
  chemically synthesized
gtaaggtgggcctgagaatt

SEQ ID NO: 76974 - DNA, 20 bp, Artificial Sequence
  chemically synthesized
attagaaatgccaaattctc

SEQ ID NO: 76975 - DNA, 20 bp, Artificial Sequence
  chemically synthesized
tattagaaatgccaaattct

SEQ ID NO: 76976 - DNA, 20 bp, Artificial Sequence
  chemically synthesized
gagaatttggcatttctaat

SEQ ID NO: 76977 - DNA, 20 bp, Artificial Sequence
  chemically synthesized
aatttggcatttctaataag

SEQ ID NO: 76978 - DNA, 20 bp, Artificial Sequence
  chemically synthesized
aacattttctaacttcttat

SEQ ID NO: 76979 - DNA, 20 bp, Artificial Sequence
  chemically synthesized
tggcatttctaataagaagt

SEQ ID NO: 76980 - DNA, 20 bp, Artificial Sequence
  chemically synthesized
ataagaagttagaaaatgtt

SEQ ID NO: 76981 - DNA, 20 bp, Artificial Sequence
  chemically synthesized
gttagaaaatgttgagttcc

SEQ ID NO: 76982 - DNA, 20 bp, Artificial Sequence
  chemically synthesized
taaaaagcttgatgagttct

SEQ ID NO: 76983 - DNA, 20 bp, Artificial Sequence
  chemically synthesized
ataaaaagcttgatgagttc

SEQ ID NO: 76984 - DNA, 20 bp, Artificial Sequence
  chemically synthesized
ttgagttcctagaactcatc

SEQ ID NO: 76985 - DNA, 20 bp, Artificial Sequence
  chemically synthesized
aaagaaataaaaagcttgat

SEQ ID NO: 76986 - DNA, 20 bp, Artificial Sequence
  chemically synthesized
aaaataaataaagaaataaa

SEQ ID NO: 76987 - DNA, 20 bp, Artificial Sequence
  chemically synthesized
aaataaaataaaaataaata

SEQ ID NO: 76988 - DNA, 20 bp, Artificial Sequence
  chemically synthesized
tttatttttattttattttt

SEQ ID NO: 76989 - DNA, 20 bp, Artificial Sequence
  chemically synthesized
tttttattttatttttcaga

SEQ ID NO: 76990 - DNA, 20 bp, Artificial Sequence
  chemically synthesized
ttttattttatttttcagac

SEQ ID NO: 76991 - DNA, 20 bp, Artificial Sequence
  chemically synthesized
tttattttatttttcagaca

SEQ ID NO: 76992 - DNA, 20 bp, Artificial Sequence
  chemically synthesized
ccagcctgggcgacagaaag

SEQ ID NO: 76993 - DNA, 20 bp, Artificial Sequence
  chemically synthesized
tccagcctgggcgacagaaa

SEQ ID NO: 76994 - DNA, 20 bp, Artificial Sequence
  chemically synthesized
actccagcctgggcgacaga

SEQ ID NO: 76995 - DNA, 20 bp, Artificial Sequence
  chemically synthesized
cagggcctctttctgtcgcc

SEQ ID NO: 76996 - DNA, 20 bp, Artificial Sequence
  chemically synthesized
agggcctctttctgtcgccc

SEQ ID NO: 76997 - DNA, 20 bp, Artificial Sequence
  chemically synthesized
ctgcactccagcctgggcga

SEQ ID NO: 76998 - DNA, 20 bp, Artificial Sequence
  chemically synthesized
cctctttctgtcgcccaggc

SEQ ID NO: 76999 - DNA, 20 bp, Artificial Sequence
  chemically synthesized
tctttctgtcgcccaggctg

SEQ ID NO: 77000 - DNA, 20 bp, Artificial Sequence
  chemically synthesized
gcactgctgcactccagcct

SEQ ID NO: 77001 - DNA, 20 bp, Artificial Sequence
  chemically synthesized
cgcactgctgcactccagcc

SEQ ID NO: 77002 - DNA, 20 bp, Artificial Sequence
  chemically synthesized
ctgtcgcccaggctggagtg

SEQ ID NO: 77003 - DNA, 20 bp, Artificial Sequence
  chemically synthesized
atgatcgcactgctgcactc

SEQ ID NO: 77004 - DNA, 20 bp, Artificial Sequence
  chemically synthesized
tcgcccaggctggagtgcag

SEQ ID NO: 77005 - DNA, 20 bp, Artificial Sequence
  chemically synthesized
ggagtgcagcagtgcgatca

SEQ ID NO: 77006 - DNA, 20 bp, Artificial Sequence
  chemically synthesized
agtgcgatcatagctcactg

SEQ ID NO: 77007 - DNA, 20 bp, Artificial Sequence
  chemically synthesized
caggagtttgaggctgcagt

SEQ ID NO: 77008 - DNA, 20 bp, Artificial Sequence
  chemically synthesized
agcccaggagtttgaggctg

SEQ ID NO: 77009 - DNA, 20 bp, Artificial Sequence
  chemically synthesized
cgcttgagcccaggagtttg

SEQ ID NO: 77010 - DNA, 20 bp, Artificial Sequence
  chemically synthesized
tcactgcagcctcaaactcc

SEQ ID NO: 77011 - DNA, 20 bp, Artificial Sequence
  chemically synthesized
tcgcttgagcccaggagttt

SEQ ID NO: 77012 - DNA, 20 bp, Artificial Sequence
  chemically synthesized
cactgcagcctcaaactcct

SEQ ID NO: 77013 - DNA, 20 bp, Artificial Sequence
  chemically synthesized
ggaggatcgcttgagcccag

SEQ ID NO: 77014 - DNA, 20 bp, Artificial Sequence
  chemically synthesized
agcctcaaactcctgggctc

SEQ ID NO: 77015 - DNA, 20 bp, Artificial Sequence
  chemically synthesized
caggaggatcgcttgagccc

SEQ ID NO: 77016 - DNA, 20 bp, Artificial Sequence
  chemically synthesized
gcaggaggatcgcttgagcc

SEQ ID NO: 77017 - DNA, 20 bp, Artificial Sequence
  chemically synthesized
ctgaagcaggaggatcgctt

SEQ ID NO: 77018 - DNA, 20 bp, Artificial Sequence
  chemically synthesized
ctcaagcgatcctcctgctt

SEQ ID NO: 77019 - DNA, 20 bp, Artificial Sequence
  chemically synthesized
acttgggaggctgaagcagg

SEQ ID NO: 77020 - DNA, 20 bp, Artificial Sequence
  chemically synthesized
aacttgggaggctgaagcag

SEQ ID NO: 77021 - DNA, 20 bp, Artificial Sequence
  chemically synthesized
ctaacttgggaggctgaagc

SEQ ID NO: 77022 - DNA, 20 bp, Artificial Sequence
  chemically synthesized
gctaacttgggaggctgaag

SEQ ID NO: 77023 - DNA, 20 bp, Artificial Sequence
  chemically synthesized
ctggctaacttgggaggctg

SEQ ID NO: 77024 - DNA, 20 bp, Artificial Sequence
  chemically synthesized
tcctcctgcttcagcctccc

SEQ ID NO: 77025 - DNA, 20 bp, Artificial Sequence
  chemically synthesized
cctgcttcagcctcccaagt

SEQ ID NO: 77026 - DNA, 20 bp, Artificial Sequence
  chemically synthesized
gtagtcctggctaacttggg

SEQ ID NO: 77027 - DNA, 20 bp, Artificial Sequence
  chemically synthesized
tgtagtcctggctaacttgg

SEQ ID NO: 77028 - DNA, 20 bp, Artificial Sequence
  chemically synthesized
cttgtagtcctggctaactt

SEQ ID NO: 77029 - DNA, 20 bp, Artificial Sequence
  chemically synthesized
cttcagcctcccaagttagc

SEQ ID NO: 77030 - DNA, 20 bp, Artificial Sequence
  chemically synthesized
gcttgtagtcctggctaact

SEQ ID NO: 77031 - DNA, 20 bp, Artificial Sequence
  chemically synthesized
ttcagcctcccaagttagcc

SEQ ID NO: 77032 - DNA, 20 bp, Artificial Sequence
  chemically synthesized
cccaagttagccaggactac

SEQ ID NO: 77033 - DNA, 20 bp, Artificial Sequence
  chemically synthesized
gtggtgtgtgcttgtagtcc

SEQ ID NO: 77034 - DNA, 20 bp, Artificial Sequence
  chemically synthesized
atgccagtggtgtgtgcttg

SEQ ID NO: 77035 - DNA, 20 bp, Artificial Sequence
  chemically synthesized
ggactacaagcacacaccac

SEQ ID NO: 77036 - DNA, 20 bp, Artificial Sequence
  chemically synthesized
tatatatatatcaatgccag

SEQ ID NO: 77037 - DNA, 20 bp, Artificial Sequence
  chemically synthesized
aaatatatatatatcaatgc

SEQ ID NO: 77038 - DNA, 20 bp, Artificial Sequence
  chemically synthesized
attgatatatatatattttt

SEQ ID NO: 77039 - DNA, 20 bp, Artificial Sequence
  chemically synthesized
atatatatatatttttaagt

SEQ ID NO: 77040 - DNA, 20 bp, Artificial Sequence
  chemically synthesized
aaaaaaaaaaaaaaaagaaa

SEQ ID NO: 77041 - DNA, 20 bp, Artificial Sequence
  chemically synthesized
tcgcaaaaaaaaaaaaaaaa

SEQ ID NO: 77042 - DNA, 20 bp, Artificial Sequence
  chemically synthesized
ttttttttttttttttttgc

SEQ ID NO: 77043 - DNA, 20 bp, Artificial Sequence
  chemically synthesized
ttttttttttttttgcgaga

SEQ ID NO: 77044 - DNA, 20 bp, Artificial Sequence
  chemically synthesized
tttttttttttttgcgagat

SEQ ID NO: 77045 - DNA, 20 bp, Artificial Sequence
  chemically synthesized
accagcctggaaaacataga

SEQ ID NO: 77046 - DNA, 20 bp, Artificial Sequence
  chemically synthesized
agaccagcctggaaaacata

SEQ ID NO: 77047 - DNA, 20 bp, Artificial Sequence
  chemically synthesized
tgggatctctctatgttttc

SEQ ID NO: 77048 - DNA, 20 bp, Artificial Sequence
  chemically synthesized
tgagaccagcctggaaaaca

SEQ ID NO: 77049 - DNA, 20 bp, Artificial Sequence
  chemically synthesized
gggatctctctatgttttcc

SEQ ID NO: 77050 - DNA, 20 bp, Artificial Sequence
  chemically synthesized
tctctctatgttttccaggc

SEQ ID NO: 77051 - DNA, 20 bp, Artificial Sequence
  chemically synthesized
ccaggagtttgagaccagcc

SEQ ID NO: 77052 - DNA, 20 bp, Artificial Sequence
  chemically synthesized
tgagcccaggagtttgagac

SEQ ID NO: 77053 - DNA, 20 bp, Artificial Sequence
  chemically synthesized
ccaggctggtctcaaactcc

SEQ ID NO: 77054 - DNA, 20 bp, Artificial Sequence
  chemically synthesized
tcacttgagcccaggagttt

SEQ ID NO: 77055 - DNA, 20 bp, Artificial Sequence
  chemically synthesized
caggctggtctcaaactcct

SEQ ID NO: 77056 - DNA, 20 bp, Artificial Sequence
  chemically synthesized
ggaggatcacttgagcccag

SEQ ID NO: 77057 - DNA, 20 bp, Artificial Sequence
  chemically synthesized
ggtctcaaactcctgggctc

SEQ ID NO: 77058 - DNA, 20 bp, Artificial Sequence
  chemically synthesized
tgggaggatcacttgagccc

SEQ ID NO: 77059 - DNA, 20 bp, Artificial Sequence
  chemically synthesized
gtgggaggatcacttgagcc

SEQ ID NO: 77060 - DNA, 20 bp, Artificial Sequence
  chemically synthesized
ccgaagtgggaggatcactt

SEQ ID NO: 77061 - DNA, 20 bp, Artificial Sequence
  chemically synthesized
ctcaagtgatcctcccactt

SEQ ID NO: 77062 - DNA, 20 bp, Artificial Sequence
  chemically synthesized
ctttgggaggccgaagtggg

SEQ ID NO: 77063 - DNA, 20 bp, Artificial Sequence
  chemically synthesized
actttgggaggccgaagtgg

SEQ ID NO: 77064 - DNA, 20 bp, Artificial Sequence
  chemically synthesized
acactttgggaggccgaagt

SEQ ID NO: 77065 - DNA, 20 bp, Artificial Sequence
  chemically synthesized
aacactttgggaggccgaag

SEQ ID NO: 77066 - DNA, 20 bp, Artificial Sequence
  chemically synthesized
cccaacactttgggaggccg

SEQ ID NO: 77067 - DNA, 20 bp, Artificial Sequence
  chemically synthesized
cctcccacttcggcctccca

SEQ ID NO: 77068 - DNA, 20 bp, Artificial Sequence
  chemically synthesized
tgtaatcccaacactttggg

SEQ ID NO: 77069 - DNA, 20 bp, Artificial Sequence
  chemically synthesized
ttgtaatcccaacactttgg

SEQ ID NO: 77070 - DNA, 20 bp, Artificial Sequence
  chemically synthesized
acttcggcctcccaaagtgt

SEQ ID NO: 77071 - DNA, 20 bp, Artificial Sequence
  chemically synthesized
gcttgtaatcccaacacttt

SEQ ID NO: 77072 - DNA, 20 bp, Artificial Sequence
  chemically synthesized
cttcggcctcccaaagtgtt

SEQ ID NO: 77073 - DNA, 20 bp, Artificial Sequence
  chemically synthesized
tgcttgtaatcccaacactt

SEQ ID NO: 77074 - DNA, 20 bp, Artificial Sequence
  chemically synthesized
tcccaaagtgttgggattac

SEQ ID NO: 77075 - DNA, 20 bp, Artificial Sequence
  chemically synthesized
agtgttgggattacaagcat

SEQ ID NO: 77076 - DNA, 20 bp, Artificial Sequence
  chemically synthesized
caagcatgagccaccgtgcc

SEQ ID NO: 77077 - DNA, 20 bp, Artificial Sequence
  chemically synthesized
taagcttgggccaggcacgg

SEQ ID NO: 77078 - DNA, 20 bp, Artificial Sequence
  chemically synthesized
gagtaagcttgggccaggca

SEQ ID NO: 77079 - DNA, 20 bp, Artificial Sequence
  chemically synthesized
tgagccaccgtgcctggccc

SEQ ID NO: 77080 - DNA, 20 bp, Artificial Sequence
  chemically synthesized
gtcaagagtaagcttgggcc

SEQ ID NO: 77081 - DNA, 20 bp, Artificial Sequence
  chemically synthesized
agtcaagagtaagcttgggc

SEQ ID NO: 77082 - DNA, 20 bp, Artificial Sequence
  chemically synthesized
tctaagtcaagagtaagctt

SEQ ID NO: 77083 - DNA, 20 bp, Artificial Sequence
  chemically synthesized
ttctaagtcaagagtaagct

SEQ ID NO: 77084 - DNA, 20 bp, Artificial Sequence
  chemically synthesized
gaaggttctaagtcaagagt

SEQ ID NO: 77085 - DNA, 20 bp, Artificial Sequence
  chemically synthesized
gcccaagcttactcttgact

SEQ ID NO: 77086 - DNA, 20 bp, Artificial Sequence
  chemically synthesized
atctgaaggttctaagtcaa

SEQ ID NO: 77087 - DNA, 20 bp, Artificial Sequence
  chemically synthesized
gtatctgaaggttctaagtc

SEQ ID NO: 77088 - DNA, 20 bp, Artificial Sequence
  chemically synthesized
acagtgtatctgaaggttct

SEQ ID NO: 77089 - DNA, 20 bp, Artificial Sequence
  chemically synthesized
tactcttgacttagaacctt

SEQ ID NO: 77090 - DNA, 20 bp, Artificial Sequence
  chemically synthesized
agagggaacagtgtatctga

SEQ ID NO: 77091 - DNA, 20 bp, Artificial Sequence
  chemically synthesized
cagagggaacagtgtatctg

SEQ ID NO: 77092 - DNA, 20 bp, Artificial Sequence
  chemically synthesized
aaaactccaagcagagggaa

SEQ ID NO: 77093 - DNA, 20 bp, Artificial Sequence
  chemically synthesized
gatacactgttccctctgct

SEQ ID NO: 77094 - DNA, 20 bp, Artificial Sequence
  chemically synthesized
tatataaaactccaagcaga

SEQ ID NO: 77095 - DNA, 20 bp, Artificial Sequence
  chemically synthesized
tacactgttccctctgcttg

SEQ ID NO: 77096 - DNA, 20 bp, Artificial Sequence
  chemically synthesized
atatataaaactccaagcag

SEQ ID NO: 77097 - DNA, 20 bp, Artificial Sequence
  chemically synthesized
gatatataaaactccaagca

SEQ ID NO: 77098 - DNA, 20 bp, Artificial Sequence
  chemically synthesized
tggatatataaaactccaag

SEQ ID NO: 77099 - DNA, 20 bp, Artificial Sequence
  chemically synthesized
aagtggatatataaaactcc

SEQ ID NO: 77100 - DNA, 20 bp, Artificial Sequence
  chemically synthesized
agagccagctaggcataaag

SEQ ID NO: 77101 - DNA, 20 bp, Artificial Sequence
  chemically synthesized
ttatatatccactttatgcc

SEQ ID NO: 77102 - DNA, 20 bp, Artificial Sequence
  chemically synthesized
ataagagccagctaggcata

SEQ ID NO: 77103 - DNA, 20 bp, Artificial Sequence
  chemically synthesized
atatccactttatgcctagc

SEQ ID NO: 77104 - DNA, 20 bp, Artificial Sequence
  chemically synthesized
tatatgaataagagccagct

SEQ ID NO: 77105 - DNA, 20 bp, Artificial Sequence
  chemically synthesized
gtatatgaataagagccagc

SEQ ID NO: 77106 - DNA, 20 bp, Artificial Sequence
  chemically synthesized
agaagtatatgaataagagc

SEQ ID NO: 77107 - DNA, 20 bp, Artificial Sequence
  chemically synthesized
gatcagaagtatatgaataa

SEQ ID NO: 77108 - DNA, 20 bp, Artificial Sequence
  chemically synthesized
gagatcagaagtatatgaat

SEQ ID NO: 77109 - DNA, 20 bp, Artificial Sequence
  chemically synthesized
tattcatatacttctgatct

SEQ ID NO: 77110 - DNA, 20 bp, Artificial Sequence
  chemically synthesized
tcacatctaactgagatcag

SEQ ID NO: 77111 - DNA, 20 bp, Artificial Sequence
  chemically synthesized
aagtcacatctaactgagat

SEQ ID NO: 77112 - DNA, 20 bp, Artificial Sequence
  chemically synthesized
catatacttctgatctcagt

SEQ ID NO: 77113 - DNA, 20 bp, Artificial Sequence
  chemically synthesized
tttaaaagtcacatctaact

SEQ ID NO: 77114 - DNA, 20 bp, Artificial Sequence
  chemically synthesized
tcagttagatgtgactttta

SEQ ID NO: 77115 - DNA, 20 bp, Artificial Sequence
  chemically synthesized
ttagatgtgacttttaaaga

SEQ ID NO: 77116 - DNA, 20 bp, Artificial Sequence
  chemically synthesized
tgggaataggctatctttaa

SEQ ID NO: 77117 - DNA, 20 bp, Artificial Sequence
  chemically synthesized
ttttaaagatagcctattcc

SEQ ID NO: 77118 - DNA, 20 bp, Artificial Sequence
  chemically synthesized
tagggcaaccaactgggaat

SEQ ID NO: 77119 - DNA, 20 bp, Artificial Sequence
  chemically synthesized
gtagggcaaccaactgggaa

SEQ ID NO: 77120 - DNA, 20 bp, Artificial Sequence
  chemically synthesized
aaagatagcctattcccagt

SEQ ID NO: 77121 - DNA, 20 bp, Artificial Sequence
  chemically synthesized
tttacgtagggcaaccaact

SEQ ID NO: 77122 - DNA, 20 bp, Artificial Sequence
  chemically synthesized
ctttacgtagggcaaccaac

SEQ ID NO: 77123 - DNA, 20 bp, Artificial Sequence
  chemically synthesized
ccagttggttgccctacgta

SEQ ID NO: 77124 - DNA, 20 bp, Artificial Sequence
  chemically synthesized
aaaaggagacactttacgta

SEQ ID NO: 77125 - DNA, 20 bp, Artificial Sequence
  chemically synthesized
aaaaaggagacactttacgt

SEQ ID NO: 77126 - DNA, 20 bp, Artificial Sequence
  chemically synthesized
gaaaaaggagacactttacg

SEQ ID NO: 77127 - DNA, 20 bp, Artificial Sequence
  chemically synthesized
gttgagagtcaaggaaaaag

SEQ ID NO: 77128 - DNA, 20 bp, Artificial Sequence
  chemically synthesized
gtgttgagagtcaaggaaaa

SEQ ID NO: 77129 - DNA, 20 bp, Artificial Sequence
  chemically synthesized
ggtgttgagagtcaaggaaa

SEQ ID NO: 77130 - DNA, 20 bp, Artificial Sequence
  chemically synthesized
aaatagggtgttgagagtca

SEQ ID NO: 77131 - DNA, 20 bp, Artificial Sequence
  chemically synthesized
aaaatagggtgttgagagtc

SEQ ID NO: 77132 - DNA, 20 bp, Artificial Sequence
  chemically synthesized
gaaggaaaatagggtgttga

SEQ ID NO: 77133 - DNA, 20 bp, Artificial Sequence
  chemically synthesized
cagaaggaaaatagggtgtt

SEQ ID NO: 77134 - DNA, 20 bp, Artificial Sequence
  chemically synthesized
cagggttcagaaggaaaata

SEQ ID NO: 77135 - DNA, 20 bp, Artificial Sequence
  chemically synthesized
tcagggttcagaaggaaaat

SEQ ID NO: 77136 - DNA, 20 bp, Artificial Sequence
  chemically synthesized
atcagggttcagaaggaaaa

SEQ ID NO: 77137 - DNA, 20 bp, Artificial Sequence
  chemically synthesized
aattgtgatcagggttcaga

SEQ ID NO: 77138 - DNA, 20 bp, Artificial Sequence
  chemically synthesized
aaattgtgatcagggttcag

SEQ ID NO: 77139 - DNA, 20 bp, Artificial Sequence
  chemically synthesized
tgcaaattgtgatcagggtt

SEQ ID NO: 77140 - DNA, 20 bp, Artificial Sequence
  chemically synthesized
gtacttgcaaattgtgatca

SEQ ID NO: 77141 - DNA, 20 bp, Artificial Sequence
  chemically synthesized
tgtacttgcaaattgtgatc

SEQ ID NO: 77142 - DNA, 20 bp, Artificial Sequence
  chemically synthesized
atgtacttgcaaattgtgat

SEQ ID NO: 77143 - DNA, 20 bp, Artificial Sequence
  chemically synthesized
gaaccctgatcacaatttgc

SEQ ID NO: 77144 - DNA, 20 bp, Artificial Sequence
  chemically synthesized
cagacaatgaataaatgaat

SEQ ID NO: 77145 - DNA, 20 bp, Artificial Sequence
  chemically synthesized
acagacaatgaataaatgaa

SEQ ID NO: 77146 - DNA, 20 bp, Artificial Sequence
  chemically synthesized
tttctggtcttgggaaggaa

SEQ ID NO: 77147 - DNA, 20 bp, Artificial Sequence
  chemically synthesized
ttcattgtctgttccttccc

SEQ ID NO: 77148 - DNA, 20 bp, Artificial Sequence
  chemically synthesized
taaattttctggtcttggga

SEQ ID NO: 77149 - DNA, 20 bp, Artificial Sequence
  chemically synthesized
ataaattttctggtcttggg

SEQ ID NO: 77150 - DNA, 20 bp, Artificial Sequence
  chemically synthesized
tgtctgttccttcccaagac

SEQ ID NO: 77151 - DNA, 20 bp, Artificial Sequence
  chemically synthesized
ttaataaattttctggtctt

SEQ ID NO: 77152 - DNA, 20 bp, Artificial Sequence
  chemically synthesized
cttaataaattttctggtct

SEQ ID NO: 77153 - DNA, 20 bp, Artificial Sequence
  chemically synthesized
gattgccttaataaattttc

SEQ ID NO: 77154 - DNA, 20 bp, Artificial Sequence
  chemically synthesized
ccaagaccagaaaatttatt

SEQ ID NO: 77155 - DNA, 20 bp, Artificial Sequence
  chemically synthesized
caagaccagaaaatttatta

SEQ ID NO: 77156 - DNA, 20 bp, Artificial Sequence
  chemically synthesized
ctggtgaaaaacaataatgt

SEQ ID NO: 77157 - DNA, 20 bp, Artificial Sequence
  chemically synthesized
actggtgaaaaacaataatg

SEQ ID NO: 77158 - DNA, 20 bp, Artificial Sequence
  chemically synthesized
cctacattattgtttttcac

SEQ ID NO: 77159 - DNA, 20 bp, Artificial Sequence
  chemically synthesized
tactatggcttggcatatac

SEQ ID NO: 77160 - DNA, 20 bp, Artificial Sequence
  chemically synthesized
gtttttcaccagtatatgcc

SEQ ID NO: 77161 - DNA, 20 bp, Artificial Sequence
  chemically synthesized
caccagtatatgccaagcca

SEQ ID NO: 77162 - DNA, 20 bp, Artificial Sequence
  chemically synthesized
gattatcatgtactatggct

SEQ ID NO: 77163 - DNA, 20 bp, Artificial Sequence
  chemically synthesized
tgagggattatcatgtacta

SEQ ID NO: 77164 - DNA, 20 bp, Artificial Sequence
  chemically synthesized
ctttaataaaaatgtattga

SEQ ID NO: 77165 - DNA, 20 bp, Artificial Sequence
  chemically synthesized
tctttaataaaaatgtattg

SEQ ID NO: 77166 - DNA, 20 bp, Artificial Sequence
  chemically synthesized
ttctttaataaaaatgtatt

SEQ ID NO: 77167 - DNA, 20 bp, Artificial Sequence
  chemically synthesized
ccctcaatacatttttatta

SEQ ID NO: 77168 - DNA, 20 bp, Artificial Sequence
  chemically synthesized
atacatttttattaaagaac

SEQ ID NO: 77169 - DNA, 20 bp, Artificial Sequence
  chemically synthesized
catttttattaaagaacaag

SEQ ID NO: 77170 - DNA, 20 bp, Artificial Sequence
  chemically synthesized
ttattaaagaacaagcagtc

SEQ ID NO: 77171 - DNA, 20 bp, Artificial Sequence
  chemically synthesized
attaaagaacaagcagtcaa

SEQ ID NO: 77172 - DNA, 20 bp, Artificial Sequence
  chemically synthesized
gaacaagcagtcaagagaat

SEQ ID NO: 77173 - DNA, 20 bp, Artificial Sequence
  chemically synthesized
aacaagcagtcaagagaatt

SEQ ID NO: 77174 - DNA, 20 bp, Artificial Sequence
  chemically synthesized
agtattagtaattagtacag

SEQ ID NO: 77175 - DNA, 20 bp, Artificial Sequence
  chemically synthesized
tgaagtattagtaattagta

SEQ ID NO: 77176 - DNA, 20 bp, Artificial Sequence
  chemically synthesized
tggtctgaagtattagtaat

SEQ ID NO: 77177 - DNA, 20 bp, Artificial Sequence
  chemically synthesized
tgtactaattactaatactt

SEQ ID NO: 77178 - DNA, 20 bp, Artificial Sequence
  chemically synthesized
tagctattggtctgaagtat

SEQ ID NO: 77179 - DNA, 20 bp, Artificial Sequence
  chemically synthesized
tgacaatagctattggtctg

SEQ ID NO: 77180 - DNA, 20 bp, Artificial Sequence
  chemically synthesized
ttactaatacttcagaccaa

SEQ ID NO: 77181 - DNA, 20 bp, Artificial Sequence
  chemically synthesized
agcagtctgacaatagctat

SEQ ID NO: 77182 - DNA, 20 bp, Artificial Sequence
  chemically synthesized
ttcagaccaatagctattgt

SEQ ID NO: 77183 - DNA, 20 bp, Artificial Sequence
  chemically synthesized
tttacgaagcagtctgacaa

SEQ ID NO: 77184 - DNA, 20 bp, Artificial Sequence
  chemically synthesized
gtgagaaactgtttacgaag

SEQ ID NO: 77185 - DNA, 20 bp, Artificial Sequence
  chemically synthesized
ttgtcagactgcttcgtaaa

SEQ ID NO: 77186 - DNA, 20 bp, Artificial Sequence
  chemically synthesized
tctgtgagaaactgtttacg

SEQ ID NO: 77187 - DNA, 20 bp, Artificial Sequence
  chemically synthesized
gcttcgtaaacagtttctca

SEQ ID NO: 77188 - DNA, 20 bp, Artificial Sequence
  chemically synthesized
actctatgtcaggtttctgt

SEQ ID NO: 77189 - DNA, 20 bp, Artificial Sequence
  chemically synthesized
tttctcacagaaacctgaca

SEQ ID NO: 77190 - DNA, 20 bp, Artificial Sequence
  chemically synthesized
tctcacagaaacctgacata

SEQ ID NO: 77191 - DNA, 20 bp, Artificial Sequence
  chemically synthesized
ttatttaggaactctatgtc

SEQ ID NO: 77192 - DNA, 20 bp, Artificial Sequence
  chemically synthesized
cttatttaggaactctatgt

SEQ ID NO: 77193 - DNA, 20 bp, Artificial Sequence
  chemically synthesized
ctgacatagagttcctaaat

SEQ ID NO: 77194 - DNA, 20 bp, Artificial Sequence
  chemically synthesized
gacatagagttcctaaataa

SEQ ID NO: 77195 - DNA, 20 bp, Artificial Sequence
  chemically synthesized
tgggtagctttctcttattt

SEQ ID NO: 77196 - DNA, 20 bp, Artificial Sequence
  chemically synthesized
atgggtagctttctcttatt

SEQ ID NO: 77197 - DNA, 20 bp, Artificial Sequence
  chemically synthesized
tagagttcctaaataagaga

SEQ ID NO: 77198 - DNA, 20 bp, Artificial Sequence
  chemically synthesized
tatgggataaggaaaatggg

SEQ ID NO: 77199 - DNA, 20 bp, Artificial Sequence
  chemically synthesized
agatatgggataaggaaaat

SEQ ID NO: 77200 - DNA, 20 bp, Artificial Sequence
  chemically synthesized
cagatatgggataaggaaaa

SEQ ID NO: 77201 - DNA, 20 bp, Artificial Sequence
  chemically synthesized
aataattcagatatgggata

SEQ ID NO: 77202 - DNA, 20 bp, Artificial Sequence
  chemically synthesized
aaataattcagatatgggat

SEQ ID NO: 77203 - DNA, 20 bp, Artificial Sequence
  chemically synthesized
gatataaataattcagatat

SEQ ID NO: 77204 - DNA, 20 bp, Artificial Sequence
  chemically synthesized
agatataaataattcagata

SEQ ID NO: 77205 - DNA, 20 bp, Artificial Sequence
  chemically synthesized
agtgatagatataaataatt

SEQ ID NO: 77206 - DNA, 20 bp, Artificial Sequence
  chemically synthesized
ctccaatataaatcaagtga

SEQ ID NO: 77207 - DNA, 20 bp, Artificial Sequence
  chemically synthesized
caaatgctccaatataaatc

SEQ ID NO: 77208 - DNA, 20 bp, Artificial Sequence
  chemically synthesized
atctatcacttgatttatat

SEQ ID NO: 77209 - DNA, 20 bp, Artificial Sequence
  chemically synthesized
ctatcacttgatttatattg

SEQ ID NO: 77210 - DNA, 20 bp, Artificial Sequence
  chemically synthesized
ggagcatttgctaatttctg

SEQ ID NO: 77211 - DNA, 20 bp, Artificial Sequence
  chemically synthesized
atgagagatgcttcagaaat

SEQ ID NO: 77212 - DNA, 20 bp, Artificial Sequence
  chemically synthesized
ccaaagaatgagagatgctt

SEQ ID NO: 77213 - DNA, 20 bp, Artificial Sequence
  chemically synthesized
tattcttgcccaaagaatga

SEQ ID NO: 77214 - DNA, 20 bp, Artificial Sequence
  chemically synthesized
ctgaagcatctctcattctt

SEQ ID NO: 77215 - DNA, 20 bp, Artificial Sequence
  chemically synthesized
tgaagcatctctcattcttt

SEQ ID NO: 77216 - DNA, 20 bp, Artificial Sequence
  chemically synthesized
tatattcttgcccaaagaat

SEQ ID NO: 77217 - DNA, 20 bp, Artificial Sequence
  chemically synthesized
gcatctctcattctttgggc

SEQ ID NO: 77218 - DNA, 20 bp, Artificial Sequence
  chemically synthesized
aaatgttatattcttgccca

SEQ ID NO: 77219 - DNA, 20 bp, Artificial Sequence
  chemically synthesized
tgggcaagaatataacattt

SEQ ID NO: 77220 - DNA, 20 bp, Artificial Sequence
  chemically synthesized
gaatataacatttcagtttt

SEQ ID NO: 77221 - DNA, 20 bp, Artificial Sequence
  chemically synthesized
tttcagtttttggtctctac

SEQ ID NO: 77222 - DNA, 20 bp, Artificial Sequence
  chemically synthesized
ttcagtttttggtctctacc

SEQ ID NO: 77223 - DNA, 20 bp, Artificial Sequence
  chemically synthesized
tcagtttttggtctctacca

SEQ ID NO: 77224 - DNA, 20 bp, Artificial Sequence
  chemically synthesized
tattttaaaaatccctggta

SEQ ID NO: 77225 - DNA, 20 bp, Artificial Sequence
  chemically synthesized
tttattttaaaaatccctgg

SEQ ID NO: 77226 - DNA, 20 bp, Artificial Sequence
  chemically synthesized
atttttattttaaaaatccc

SEQ ID NO: 77227 - DNA, 20 bp, Artificial Sequence
  chemically synthesized
agggatttttaaaataaaaa

SEQ ID NO: 77228 - DNA, 20 bp, Artificial Sequence
  chemically synthesized
ggatttttaaaataaaaatg

SEQ ID NO: 77229 - DNA, 20 bp, Artificial Sequence
  chemically synthesized
ttttaaaataaaaatggagt

SEQ ID NO: 77230 - DNA, 20 bp, Artificial Sequence
  chemically synthesized
taaaataaaaatggagtgag

SEQ ID NO: 77231 - DNA, 20 bp, Artificial Sequence
  chemically synthesized
aaaataaaaatggagtgagt

SEQ ID NO: 77232 - DNA, 20 bp, Artificial Sequence
  chemically synthesized
aatggagtgagtgggaaaaa

SEQ ID NO: 77233 - DNA, 20 bp, Artificial Sequence
  chemically synthesized
tggagtgagtgggaaaaaaa

SEQ ID NO: 77234 - DNA, 20 bp, Artificial Sequence
  chemically synthesized
ggagtgagtgggaaaaaaag

SEQ ID NO: 77235 - DNA, 20 bp, Artificial Sequence
  chemically synthesized
gtgagtgggaaaaaaagagg

SEQ ID NO: 77236 - DNA, 20 bp, Artificial Sequence
  chemically synthesized
agtgggaaaaaaagaggaag

SEQ ID NO: 77237 - DNA, 20 bp, Artificial Sequence
  chemically synthesized
aaagaggaagtagcctattc

SEQ ID NO: 77238 - DNA, 20 bp, Artificial Sequence
  chemically synthesized
aagaggaagtagcctattca

SEQ ID NO: 77239 - DNA, 20 bp, Artificial Sequence
  chemically synthesized
agaatatattttccttgaat

SEQ ID NO: 77240 - DNA, 20 bp, Artificial Sequence
  chemically synthesized
cagaatatattttccttgaa

SEQ ID NO: 77241 - DNA, 20 bp, Artificial Sequence
  chemically synthesized
caaggaaaatatattctgct

SEQ ID NO: 77242 - DNA, 20 bp, Artificial Sequence
  chemically synthesized
ggaaaatatattctgcttgg

SEQ ID NO: 77243 - DNA, 20 bp, Artificial Sequence
  chemically synthesized
cttgtgccaccaccaccaag

SEQ ID NO: 77244 - DNA, 20 bp, Artificial Sequence
  chemically synthesized
aaatatattctgcttggtgg

SEQ ID NO: 77245 - DNA, 20 bp, Artificial Sequence
  chemically synthesized
taacttgtgccaccaccacc

SEQ ID NO: 77246 - DNA, 20 bp, Artificial Sequence
  chemically synthesized
tatattctgcttggtggtgg

SEQ ID NO: 77247 - DNA, 20 bp, Artificial Sequence
  chemically synthesized
ctgcttggtggtggtggcac

SEQ ID NO: 77248 - DNA, 20 bp, Artificial Sequence
  chemically synthesized
ttggtggtggtggcacaagt

SEQ ID NO: 77249 - DNA, 20 bp, Artificial Sequence
  chemically synthesized
gcacaagttagtgcatcttt

SEQ ID NO: 77250 - DNA, 20 bp, Artificial Sequence
  chemically synthesized
acaagttagtgcatcttttg

SEQ ID NO: 77251 - DNA, 20 bp, Artificial Sequence
  chemically synthesized
caagttagtgcatcttttgg

SEQ ID NO: 77252 - DNA, 20 bp, Artificial Sequence
  chemically synthesized
aagttagtgcatcttttgga

SEQ ID NO: 77253 - DNA, 20 bp, Artificial Sequence
  chemically synthesized
gttgttaaaatgccctccaa

SEQ ID NO: 77254 - DNA, 20 bp, Artificial Sequence
  chemically synthesized
attttaacaacactgaataa

SEQ ID NO: 77255 - DNA, 20 bp, Artificial Sequence
  chemically synthesized
atatttttaatgcttttatt

SEQ ID NO: 77256 - DNA, 20 bp, Artificial Sequence
  chemically synthesized
taaaaatatttacatatgaa

SEQ ID NO: 77257 - DNA, 20 bp, Artificial Sequence
  chemically synthesized
atatttacatatgaaaagac

SEQ ID NO: 77258 - DNA, 20 bp, Artificial Sequence
  chemically synthesized
tttacatatgaaaagactag

SEQ ID NO: 77259 - DNA, 20 bp, Artificial Sequence
  chemically synthesized
tcagttggtttgtagtcttc

SEQ ID NO: 77260 - DNA, 20 bp, Artificial Sequence
  chemically synthesized
gctggatttcagttggtttg

SEQ ID NO: 77261 - DNA, 20 bp, Artificial Sequence
  chemically synthesized
agcccaggctggatttcagt

SEQ ID NO: 77262 - DNA, 20 bp, Artificial Sequence
  chemically synthesized
actacaaaccaactgaaatc

SEQ ID NO: 77263 - DNA, 20 bp, Artificial Sequence
  chemically synthesized
gtagagcccaggctggattt

SEQ ID NO: 77264 - DNA, 20 bp, Artificial Sequence
  chemically synthesized
aaaccaactgaaatccagcc

SEQ ID NO: 77265 - DNA, 20 bp, Artificial Sequence
  chemically synthesized
aaccaactgaaatccagcct

SEQ ID NO: 77266 - DNA, 20 bp, Artificial Sequence
  chemically synthesized
tttggtagtagagcccaggc

SEQ ID NO: 77267 - DNA, 20 bp, Artificial Sequence
  chemically synthesized
ccaatttggtagtagagccc

SEQ ID NO: 77268 - DNA, 20 bp, Artificial Sequence
  chemically synthesized
accaatttggtagtagagcc

SEQ ID NO: 77269 - DNA, 20 bp, Artificial Sequence
  chemically synthesized
gcctaaccaatttggtagta

SEQ ID NO: 77270 - DNA, 20 bp, Artificial Sequence
  chemically synthesized
aagcctaaccaatttggtag

SEQ ID NO: 77271 - DNA, 20 bp, Artificial Sequence
  chemically synthesized
cctgggctctactaccaaat

SEQ ID NO: 77272 - DNA, 20 bp, Artificial Sequence
  chemically synthesized
gccaagcctaaccaatttgg

SEQ ID NO: 77273 - DNA, 20 bp, Artificial Sequence
  chemically synthesized
ggctctactaccaaattggt

SEQ ID NO: 77274 - DNA, 20 bp, Artificial Sequence
  chemically synthesized
tatgccaagcctaaccaatt

SEQ ID NO: 77275 - DNA, 20 bp, Artificial Sequence
  chemically synthesized
gctctactaccaaattggtt

SEQ ID NO: 77276 - DNA, 20 bp, Artificial Sequence
  chemically synthesized
actaccaaattggttaggct

SEQ ID NO: 77277 - DNA, 20 bp, Artificial Sequence
  chemically synthesized
caaattggttaggcttggca

SEQ ID NO: 77278 - DNA, 20 bp, Artificial Sequence
  chemically synthesized
aaattggttaggcttggcat

SEQ ID NO: 77279 - DNA, 20 bp, Artificial Sequence
  chemically synthesized
gagatccccggtcctatgcc

SEQ ID NO: 77280 - DNA, 20 bp, Artificial Sequence
  chemically synthesized
ggttaggcttggcataggac

SEQ ID NO: 77281 - DNA, 20 bp, Artificial Sequence
  chemically synthesized
gttaggcttggcataggacc

SEQ ID NO: 77282 - DNA, 20 bp, Artificial Sequence
  chemically synthesized
ttaggcttggcataggaccg

SEQ ID NO: 77283 - DNA, 20 bp, Artificial Sequence
  chemically synthesized
tgtgtttttgaagagatccc

SEQ ID NO: 77284 - DNA, 20 bp, Artificial Sequence
  chemically synthesized
aaaggcactgtgtttttgaa

SEQ ID NO: 77285 - DNA, 20 bp, Artificial Sequence
  chemically synthesized
aaaaaggcactgtgtttttg

SEQ ID NO: 77286 - DNA, 20 bp, Artificial Sequence
  chemically synthesized
cggggatctcttcaaaaaca

SEQ ID NO: 77287 - DNA, 20 bp, Artificial Sequence
  chemically synthesized
tctttgggcaaagaagaaaa

SEQ ID NO: 77288 - DNA, 20 bp, Artificial Sequence
  chemically synthesized
ctctttgggcaaagaagaaa

SEQ ID NO: 77289 - DNA, 20 bp, Artificial Sequence
  chemically synthesized
aagggcctctttgggcaaag

SEQ ID NO: 77290 - DNA, 20 bp, Artificial Sequence
  chemically synthesized
gcctttttcttctttgccca

SEQ ID NO: 77291 - DNA, 20 bp, Artificial Sequence
  chemically synthesized
tgcaagggcctctttgggca

SEQ ID NO: 77292 - DNA, 20 bp, Artificial Sequence
  chemically synthesized
ctttttcttctttgcccaaa

SEQ ID NO: 77293 - DNA, 20 bp, Artificial Sequence
  chemically synthesized
tttttcttctttgcccaaag

SEQ ID NO: 77294 - DNA, 20 bp, Artificial Sequence
  chemically synthesized
atccctgcaagggcctcttt

SEQ ID NO: 77295 - DNA, 20 bp, Artificial Sequence
  chemically synthesized
aatccctgcaagggcctctt

SEQ ID NO: 77296 - DNA, 20 bp, Artificial Sequence
  chemically synthesized
tttgcccaaagaggcccttg

SEQ ID NO: 77297 - DNA, 20 bp, Artificial Sequence
  chemically synthesized
ttgcccaaagaggcccttgc

SEQ ID NO: 77298 - DNA, 20 bp, Artificial Sequence
  chemically synthesized
tgcccaaagaggcccttgca

SEQ ID NO: 77299 - DNA, 20 bp, Artificial Sequence
  chemically synthesized
tataatcccaatccctgcaa

SEQ ID NO: 77300 - DNA, 20 bp, Artificial Sequence
  chemically synthesized
ctataatcccaatccctgca

SEQ ID NO: 77301 - DNA, 20 bp, Artificial Sequence
  chemically synthesized
tctataatcccaatccctgc

SEQ ID NO: 77302 - DNA, 20 bp, Artificial Sequence
  chemically synthesized
aaagaggcccttgcagggat

SEQ ID NO: 77303 - DNA, 20 bp, Artificial Sequence
  chemically synthesized
aagaggcccttgcagggatt

SEQ ID NO: 77304 - DNA, 20 bp, Artificial Sequence
  chemically synthesized
ccttgcagggattgggatta

SEQ ID NO: 77305 - DNA, 20 bp, Artificial Sequence
  chemically synthesized
gggattgggattatagatgc

SEQ ID NO: 77306 - DNA, 20 bp, Artificial Sequence
  chemically synthesized
ggattgggattatagatgct

SEQ ID NO: 77307 - DNA, 20 bp, Artificial Sequence
  chemically synthesized
gattgggattatagatgctg

SEQ ID NO: 77308 - DNA, 20 bp, Artificial Sequence
  chemically synthesized
ggattatagatgctggggct

SEQ ID NO: 77309 - DNA, 20 bp, Artificial Sequence
  chemically synthesized
atcatctgtaatctcagccc

SEQ ID NO: 77310 - DNA, 20 bp, Artificial Sequence
  chemically synthesized
agatgctggggctgagatta

SEQ ID NO: 77311 - DNA, 20 bp, Artificial Sequence
  chemically synthesized
agagggatcatctgtaatct

SEQ ID NO: 77312 - DNA, 20 bp, Artificial Sequence
  chemically synthesized
gagagagagagagagagaga

SEQ ID NO: 77313 - DNA, 20 bp, Artificial Sequence
  chemically synthesized
agagagagagagagagagag

SEQ ID NO: 77314 - DNA, 20 bp, Artificial Sequence
  chemically synthesized
gagagagagagagagagaga

SEQ ID NO: 77315 - DNA, 20 bp, Artificial Sequence
  chemically synthesized
gggagagagagagagagaga

SEQ ID NO: 77316 - DNA, 20 bp, Artificial Sequence
  chemically synthesized
cagggagagagagagagaga

SEQ ID NO: 77317 - DNA, 20 bp, Artificial Sequence
  chemically synthesized
ggcagggagagagagagaga

SEQ ID NO: 77318 - DNA, 20 bp, Artificial Sequence
  chemically synthesized
gaggcagggagagagagaga

SEQ ID NO: 77319 - DNA, 20 bp, Artificial Sequence
  chemically synthesized
gggaggcagggagagagaga

SEQ ID NO: 77320 - DNA, 20 bp, Artificial Sequence
  chemically synthesized
tagggaggcagggagagaga

SEQ ID NO: 77321 - DNA, 20 bp, Artificial Sequence
  chemically synthesized
attagggaggcagggagaga

SEQ ID NO: 77322 - DNA, 20 bp, Artificial Sequence
  chemically synthesized
aaattagggaggcagggaga

SEQ ID NO: 77323 - DNA, 20 bp, Artificial Sequence
  chemically synthesized
aaaaattagggaggcaggga

SEQ ID NO: 77324 - DNA, 20 bp, Artificial Sequence
  chemically synthesized
ccaaaaattagggaggcagg

SEQ ID NO: 77325 - DNA, 20 bp, Artificial Sequence
  chemically synthesized
gcccaaaaattagggaggca

SEQ ID NO: 77326 - DNA, 20 bp, Artificial Sequence
  chemically synthesized
agcccaaaaattagggaggc

SEQ ID NO: 77327 - DNA, 20 bp, Artificial Sequence
  chemically synthesized
aagcccaaaaattagggagg

SEQ ID NO: 77328 - DNA, 20 bp, Artificial Sequence
  chemically synthesized
gaaaagcccaaaaattaggg

SEQ ID NO: 77329 - DNA, 20 bp, Artificial Sequence
  chemically synthesized
ggaaaagcccaaaaattagg

SEQ ID NO: 77330 - DNA, 20 bp, Artificial Sequence
  chemically synthesized
ctccctgcctccctaatttt

SEQ ID NO: 77331 - DNA, 20 bp, Artificial Sequence
  chemically synthesized
gtggaaaagcccaaaaatta

SEQ ID NO: 77332 - DNA, 20 bp, Artificial Sequence
  chemically synthesized
tccctgcctccctaattttt

SEQ ID NO: 77333 - DNA, 20 bp, Artificial Sequence
  chemically synthesized
agtggaaaagcccaaaaatt

SEQ ID NO: 77334 - DNA, 20 bp, Artificial Sequence
  chemically synthesized
tagtggaaaagcccaaaaat

SEQ ID NO: 77335 - DNA, 20 bp, Artificial Sequence
  chemically synthesized
gtaacttttctttagtggaa

SEQ ID NO: 77336 - DNA, 20 bp, Artificial Sequence
  chemically synthesized
atttttgggcttttccacta

SEQ ID NO: 77337 - DNA, 20 bp, Artificial Sequence
  chemically synthesized
tttaagtaacttttctttag

SEQ ID NO: 77338 - DNA, 20 bp, Artificial Sequence
  chemically synthesized
tgggcttttccactaaagaa

SEQ ID NO: 77339 - DNA, 20 bp, Artificial Sequence
  chemically synthesized
ttatttaagtaacttttctt

SEQ ID NO: 77340 - DNA, 20 bp, Artificial Sequence
  chemically synthesized
cttagttcatatcattattt

SEQ ID NO: 77341 - DNA, 20 bp, Artificial Sequence
  chemically synthesized
cttaaataatgatatgaact

SEQ ID NO: 77342 - DNA, 20 bp, Artificial Sequence
  chemically synthesized
aaataatgatatgaactaag

SEQ ID NO: 77343 - DNA, 20 bp, Artificial Sequence
  chemically synthesized
tctaatatttgatgacttct

SEQ ID NO: 77344 - DNA, 20 bp, Artificial Sequence
  chemically synthesized
actaagaagtcatcaaatat

SEQ ID NO: 77345 - DNA, 20 bp, Artificial Sequence
  chemically synthesized
tcaaatattagactgtaacg

SEQ ID NO: 77346 - DNA, 20 bp, Artificial Sequence
  chemically synthesized
tttgtaaatgaacttcgtta

SEQ ID NO: 77347 - DNA, 20 bp, Artificial Sequence
  chemically synthesized
acaaatattttccacttgtg

SEQ ID NO: 77348 - DNA, 20 bp, Artificial Sequence
  chemically synthesized
ctatcccttttctacacaag

SEQ ID NO: 77349 - DNA, 20 bp, Artificial Sequence
  chemically synthesized
ttactatcccttttctacac

SEQ ID NO: 77350 - DNA, 20 bp, Artificial Sequence
  chemically synthesized
tattttccacttgtgtagaa

SEQ ID NO: 77351 - DNA, 20 bp, Artificial Sequence
  chemically synthesized
attttccacttgtgtagaaa

SEQ ID NO: 77352 - DNA, 20 bp, Artificial Sequence
  chemically synthesized
ttttccacttgtgtagaaaa

SEQ ID NO: 77353 - DNA, 20 bp, Artificial Sequence
  chemically synthesized
ccacttgtgtagaaaaggga

SEQ ID NO: 77354 - DNA, 20 bp, Artificial Sequence
  chemically synthesized
ggatagtaacatgcatactt

SEQ ID NO: 77355 - DNA, 20 bp, Artificial Sequence
  chemically synthesized
gatagtaacatgcatacttt

SEQ ID NO: 77356 - DNA, 20 bp, Artificial Sequence
  chemically synthesized
atagtaacatgcatacttta

SEQ ID NO: 77357 - DNA, 20 bp, Artificial Sequence
  chemically synthesized
ccatctttgtaacagcccta

SEQ ID NO: 77358 - DNA, 20 bp, Artificial Sequence
  chemically synthesized
catactttagggctgttaca

SEQ ID NO: 77359 - DNA, 20 bp, Artificial Sequence
  chemically synthesized
cttctcatccatctttgtaa

SEQ ID NO: 77360 - DNA, 20 bp, Artificial Sequence
  chemically synthesized
ctttagggctgttacaaaga

SEQ ID NO: 77361 - DNA, 20 bp, Artificial Sequence
  chemically synthesized
gggctgttacaaagatggat

SEQ ID NO: 77362 - DNA, 20 bp, Artificial Sequence
  chemically synthesized
ctgttacaaagatggatgag

SEQ ID NO: 77363 - DNA, 20 bp, Artificial Sequence
  chemically synthesized
acaaagatggatgagaagtt

SEQ ID NO: 77364 - DNA, 20 bp, Artificial Sequence
  chemically synthesized
caaagatggatgagaagttt

SEQ ID NO: 77365 - DNA, 20 bp, Artificial Sequence
  chemically synthesized
aggcatatttctccttcttt

SEQ ID NO: 77366 - DNA, 20 bp, Artificial Sequence
  chemically synthesized
tatatgtgaactaaaagaag

SEQ ID NO: 77367 - DNA, 20 bp, Artificial Sequence
  chemically synthesized
actatatgtgaactaaaaga

SEQ ID NO: 77368 - DNA, 20 bp, Artificial Sequence
  chemically synthesized
gactatatgtgaactaaaag

SEQ ID NO: 77369 - DNA, 20 bp, Artificial Sequence
  chemically synthesized
tgtgactatatgtgaactaa

SEQ ID NO: 77370 - DNA, 20 bp, Artificial Sequence
  chemically synthesized
tccttcttttagttcacata

SEQ ID NO: 77371 - DNA, 20 bp, Artificial Sequence
  chemically synthesized
tagttcacatatagtcacac

SEQ ID NO: 77372 - DNA, 20 bp, Artificial Sequence
  chemically synthesized
tagtcacacaagttcctatt

SEQ ID NO: 77373 - DNA, 20 bp, Artificial Sequence
  chemically synthesized
agtcacacaagttcctattc

SEQ ID NO: 77374 - DNA, 20 bp, Artificial Sequence
  chemically synthesized
ctccctggactagcctgaat

SEQ ID NO: 77375 - DNA, 20 bp, Artificial Sequence
  chemically synthesized
acacaagttcctattcaggc

SEQ ID NO: 77376 - DNA, 20 bp, Artificial Sequence
  chemically synthesized
tctccctggactagcctgaa

SEQ ID NO: 77377 - DNA, 20 bp, Artificial Sequence
  chemically synthesized
agttcctattcaggctagtc

SEQ ID NO: 77378 - DNA, 20 bp, Artificial Sequence
  chemically synthesized
gttcctattcaggctagtcc

SEQ ID NO: 77379 - DNA, 20 bp, Artificial Sequence
  chemically synthesized
ttcctattcaggctagtcca

SEQ ID NO: 77380 - DNA, 20 bp, Artificial Sequence
  chemically synthesized
cctattcaggctagtccagg

SEQ ID NO: 77381 - DNA, 20 bp, Artificial Sequence
  chemically synthesized
tttgcagagtctccctggac

SEQ ID NO: 77382 - DNA, 20 bp, Artificial Sequence
  chemically synthesized
actgctttgcagagtctccc

SEQ ID NO: 77383 - DNA, 20 bp, Artificial Sequence
  chemically synthesized
tagtccagggagactctgca

SEQ ID NO: 77384 - DNA, 20 bp, Artificial Sequence
  chemically synthesized
tccagggagactctgcaaag

SEQ ID NO: 77385 - DNA, 20 bp, Artificial Sequence
  chemically synthesized
ttattacctactgctttgca

SEQ ID NO: 77386 - DNA, 20 bp, Artificial Sequence
  chemically synthesized
acttattacctactgctttg

SEQ ID NO: 77387 - DNA, 20 bp, Artificial Sequence
  chemically synthesized
agggagactctgcaaagcag

SEQ ID NO: 77388 - DNA, 20 bp, Artificial Sequence
  chemically synthesized
gggagactctgcaaagcagt

SEQ ID NO: 77389 - DNA, 20 bp, Artificial Sequence
  chemically synthesized
tctgcaaagcagtaggtaat

SEQ ID NO: 77390 - DNA, 20 bp, Artificial Sequence
  chemically synthesized
taggtaataagttcatccat

SEQ ID NO: 77391 - DNA, 20 bp, Artificial Sequence
  chemically synthesized
ggtaataagttcatccatga

SEQ ID NO: 77392 - DNA, 20 bp, Artificial Sequence
  chemically synthesized
taataagttcatccatgaga

SEQ ID NO: 77393 - DNA, 20 bp, Artificial Sequence
  chemically synthesized
cttagtctgtgactctctca

SEQ ID NO: 77394 - DNA, 20 bp, Artificial Sequence
  chemically synthesized
gttcatccatgagagagtca

SEQ ID NO: 77395 - DNA, 20 bp, Artificial Sequence
  chemically synthesized
ccatgagagagtcacagact

SEQ ID NO: 77396 - DNA, 20 bp, Artificial Sequence
  chemically synthesized
agctacccggcaaaggatct

SEQ ID NO: 77397 - DNA, 20 bp, Artificial Sequence
  chemically synthesized
cacagactaagatcctttgc

SEQ ID NO: 77398 - DNA, 20 bp, Artificial Sequence
  chemically synthesized
acagactaagatcctttgcc

SEQ ID NO: 77399 - DNA, 20 bp, Artificial Sequence
  chemically synthesized
aaaaggtagctacccggcaa

SEQ ID NO: 77400 - DNA, 20 bp, Artificial Sequence
  chemically synthesized
gactaagatcctttgccggg

SEQ ID NO: 77401 - DNA, 20 bp, Artificial Sequence
  chemically synthesized
aaaaaggtagctacccggca

SEQ ID NO: 77402 - DNA, 20 bp, Artificial Sequence
  chemically synthesized
gctccaaaaaggtagctacc

SEQ ID NO: 77403 - DNA, 20 bp, Artificial Sequence
  chemically synthesized
ttgccgggtagctacctttt

SEQ ID NO: 77404 - DNA, 20 bp, Artificial Sequence
  chemically synthesized
agaaatcagctccaaaaagg

SEQ ID NO: 77405 - DNA, 20 bp, Artificial Sequence
  chemically synthesized
gccgggtagctacctttttg

SEQ ID NO: 77406 - DNA, 20 bp, Artificial Sequence
  chemically synthesized
gtgagaaatcagctccaaaa

SEQ ID NO: 77407 - DNA, 20 bp, Artificial Sequence
  chemically synthesized
tgtgagaaatcagctccaaa

SEQ ID NO: 77408 - DNA, 20 bp, Artificial Sequence
  chemically synthesized
cctggggcgatgtgagaaat

SEQ ID NO: 77409 - DNA, 20 bp, Artificial Sequence
  chemically synthesized
ggttgcccctggggcgatgt

SEQ ID NO: 77410 - DNA, 20 bp, Artificial Sequence
  chemically synthesized
gctgatttctcacatcgccc

SEQ ID NO: 77411 - DNA, 20 bp, Artificial Sequence
  chemically synthesized
ctgatttctcacatcgcccc

SEQ ID NO: 77412 - DNA, 20 bp, Artificial Sequence
  chemically synthesized
tgatttctcacatcgcccca

SEQ ID NO: 77413 - DNA, 20 bp, Artificial Sequence
  chemically synthesized
gatttctcacatcgccccag

SEQ ID NO: 77414 - DNA, 20 bp, Artificial Sequence
  chemically synthesized
catgatagaggttgcccctg

SEQ ID NO: 77415 - DNA, 20 bp, Artificial Sequence
  chemically synthesized
acatgatagaggttgcccct

SEQ ID NO: 77416 - DNA, 20 bp, Artificial Sequence
  chemically synthesized
tacatgatagaggttgcccc

SEQ ID NO: 77417 - DNA, 20 bp, Artificial Sequence
  chemically synthesized
tttataaggctacatgatag

SEQ ID NO: 77418 - DNA, 20 bp, Artificial Sequence
  chemically synthesized
caggggcaacctctatcatg

SEQ ID NO: 77419 - DNA, 20 bp, Artificial Sequence
  chemically synthesized
gtttataaggctacatgata

SEQ ID NO: 77420 - DNA, 20 bp, Artificial Sequence
  chemically synthesized
acgtttataaggctacatga

SEQ ID NO: 77421 - DNA, 20 bp, Artificial Sequence
  chemically synthesized
agttcgaggagacgtttata

SEQ ID NO: 77422 - DNA, 20 bp, Artificial Sequence
  chemically synthesized
tagttcgaggagacgtttat

SEQ ID NO: 77423 - DNA, 20 bp, Artificial Sequence
  chemically synthesized
ttataaacgtctcctcgaac

SEQ ID NO: 77424 - DNA, 20 bp, Artificial Sequence
  chemically synthesized
tttccaatgtctagttcgag

SEQ ID NO: 77425 - DNA, 20 bp, Artificial Sequence
  chemically synthesized
actttccaatgtctagttcg

SEQ ID NO: 77426 - DNA, 20 bp, Artificial Sequence
  chemically synthesized
tactttccaatgtctagttc

SEQ ID NO: 77427 - DNA, 20 bp, Artificial Sequence
  chemically synthesized
cgtctcctcgaactagacat

SEQ ID NO: 77428 - DNA, 20 bp, Artificial Sequence
  chemically synthesized
tgtacctactttccaatgtc

SEQ ID NO: 77429 - DNA, 20 bp, Artificial Sequence
  chemically synthesized
tcctcgaactagacattgga

SEQ ID NO: 77430 - DNA, 20 bp, Artificial Sequence
  chemically synthesized
tcgaactagacattggaaag

SEQ ID NO: 77431 - DNA, 20 bp, Artificial Sequence
  chemically synthesized
cgaactagacattggaaagt

SEQ ID NO: 77432 - DNA, 20 bp, Artificial Sequence
  chemically synthesized
gtaggtacatgaaactgata

SEQ ID NO: 77433 - DNA, 20 bp, Artificial Sequence
  chemically synthesized
aggtacatgaaactgataaa

SEQ ID NO: 77434 - DNA, 20 bp, Artificial Sequence
  chemically synthesized
ggtacatgaaactgataaag

SEQ ID NO: 77435 - DNA, 20 bp, Artificial Sequence
  chemically synthesized
acactatgcttcctctttat

SEQ ID NO: 77436 - DNA, 20 bp, Artificial Sequence
  chemically synthesized
acatgaaactgataaagagg

SEQ ID NO: 77437 - DNA, 20 bp, Artificial Sequence
  chemically synthesized
aaactgataaagaggaagca

SEQ ID NO: 77438 - DNA, 20 bp, Artificial Sequence
  chemically synthesized
gataaagaggaagcatagtg

SEQ ID NO: 77439 - DNA, 20 bp, Artificial Sequence
  chemically synthesized
ataaagaggaagcatagtgt

SEQ ID NO: 77440 - DNA, 20 bp, Artificial Sequence
  chemically synthesized
taaagaggaagcatagtgtg

SEQ ID NO: 77441 - DNA, 20 bp, Artificial Sequence
  chemically synthesized
agaggaagcatagtgtgggg

SEQ ID NO: 77442 - DNA, 20 bp, Artificial Sequence
  chemically synthesized
gaagcatagtgtggggaaga

SEQ ID NO: 77443 - DNA, 20 bp, Artificial Sequence
  chemically synthesized
ggggaagaaagatatgtgtt

SEQ ID NO: 77444 - DNA, 20 bp, Artificial Sequence
  chemically synthesized
atgtgttcagaacttgaaca

SEQ ID NO: 77445 - DNA, 20 bp, Artificial Sequence
  chemically synthesized
tgtgttcagaacttgaacaa

SEQ ID NO: 77446 - DNA, 20 bp, Artificial Sequence
  chemically synthesized
gtgttcagaacttgaacaaa

SEQ ID NO: 77447 - DNA, 20 bp, Artificial Sequence
  chemically synthesized
ctacctcttaccctttgttc

SEQ ID NO: 77448 - DNA, 20 bp, Artificial Sequence
  chemically synthesized
tcagaacttgaacaaagggt

SEQ ID NO: 77449 - DNA, 20 bp, Artificial Sequence
  chemically synthesized
agaacttgaacaaagggtaa

SEQ ID NO: 77450 - DNA, 20 bp, Artificial Sequence
  chemically synthesized
gaacttgaacaaagggtaag

SEQ ID NO: 77451 - DNA, 20 bp, Artificial Sequence
  chemically synthesized
cttgaacaaagggtaagagg

SEQ ID NO: 77452 - DNA, 20 bp, Artificial Sequence
  chemically synthesized
ttgaacaaagggtaagaggt

SEQ ID NO: 77453 - DNA, 20 bp, Artificial Sequence
  chemically synthesized
acaaagggtaagaggtagga

SEQ ID NO: 77454 - DNA, 20 bp, Artificial Sequence
  chemically synthesized
ggaaagtttaatgtgtgtct

SEQ ID NO: 77455 - DNA, 20 bp, Artificial Sequence
  chemically synthesized
gaaagtttaatgtgtgtctg

SEQ ID NO: 77456 - DNA, 20 bp, Artificial Sequence
  chemically synthesized
tttaatgtgtgtctgaggaa

SEQ ID NO: 77457 - DNA, 20 bp, Artificial Sequence
  chemically synthesized
aaaggctatttgcttttcct

SEQ ID NO: 77458 - DNA, 20 bp, Artificial Sequence
  chemically synthesized
tgtgtctgaggaaaagcaaa

SEQ ID NO: 77459 - DNA, 20 bp, Artificial Sequence
  chemically synthesized
ttcatattttaagttattaa

SEQ ID NO: 77460 - DNA, 20 bp, Artificial Sequence
  chemically synthesized
cttcatattttaagttatta

SEQ ID NO: 77461 - DNA, 20 bp, Artificial Sequence
  chemically synthesized
tgccctgtacttcatatttt

SEQ ID NO: 77462 - DNA, 20 bp, Artificial Sequence
  chemically synthesized
ctttaataacttaaaatatg

SEQ ID NO: 77463 - DNA, 20 bp, Artificial Sequence
  chemically synthesized
ataacttaaaatatgaagta

SEQ ID NO: 77464 - DNA, 20 bp, Artificial Sequence
  chemically synthesized
taacttaaaatatgaagtac

SEQ ID NO: 77465 - DNA, 20 bp, Artificial Sequence
  chemically synthesized
aacttaaaatatgaagtaca

SEQ ID NO: 77466 - DNA, 20 bp, Artificial Sequence
  chemically synthesized
ttaaaatatgaagtacaggg

SEQ ID NO: 77467 - DNA, 20 bp, Artificial Sequence
  chemically synthesized
gaagtacagggcagctgtaa

SEQ ID NO: 77468 - DNA, 20 bp, Artificial Sequence
  chemically synthesized
cacccatgattcatctttta

SEQ ID NO: 77469 - DNA, 20 bp, Artificial Sequence
  chemically synthesized
cagctgtaaaagatgaatca

SEQ ID NO: 77470 - DNA, 20 bp, Artificial Sequence
  chemically synthesized
agctgtaaaagatgaatcat

SEQ ID NO: 77471 - DNA, 20 bp, Artificial Sequence
  chemically synthesized
gatgaatcatgggtgttttc

SEQ ID NO: 77472 - DNA, 20 bp, Artificial Sequence
  chemically synthesized
atgaatcatgggtgttttct

SEQ ID NO: 77473 - DNA, 20 bp, Artificial Sequence
  chemically synthesized
catgggtgttttctgggatc

SEQ ID NO: 77474 - DNA, 20 bp, Artificial Sequence
  chemically synthesized
acccaccacaatcttgatcc

SEQ ID NO: 77475 - DNA, 20 bp, Artificial Sequence
  chemically synthesized
gttttctgggatcaagattg

SEQ ID NO: 77476 - DNA, 20 bp, Artificial Sequence
  chemically synthesized
ttctgggatcaagattgtgg

SEQ ID NO: 77477 - DNA, 20 bp, Artificial Sequence
  chemically synthesized
tctgggatcaagattgtggt

SEQ ID NO: 77478 - DNA, 20 bp, Artificial Sequence
  chemically synthesized
gattgtggtgggtcttgaat

SEQ ID NO: 77479 - DNA, 20 bp, Artificial Sequence
  chemically synthesized
attgtggtgggtcttgaatg

SEQ ID NO: 77480 - DNA, 20 bp, Artificial Sequence
  chemically synthesized
ttgtaaaggccacctcattc

SEQ ID NO: 77481 - DNA, 20 bp, Artificial Sequence
  chemically synthesized
gtggtgggtcttgaatgagg

SEQ ID NO: 77482 - DNA, 20 bp, Artificial Sequence
  chemically synthesized
atcttcattctacattgtaa

SEQ ID NO: 77483 - DNA, 20 bp, Artificial Sequence
  chemically synthesized
atgaggtggcctttacaatg

SEQ ID NO: 77484 - DNA, 20 bp, Artificial Sequence
  chemically synthesized
catcttcattctacattgta

SEQ ID NO: 77485 - DNA, 20 bp, Artificial Sequence
  chemically synthesized
ggcctttacaatgtagaatg

SEQ ID NO: 77486 - DNA, 20 bp, Artificial Sequence
  chemically synthesized
gaatgaagatgtccacaaaa

SEQ ID NO: 77487 - DNA, 20 bp, Artificial Sequence
  chemically synthesized
aatgaagatgtccacaaaac

SEQ ID NO: 77488 - DNA, 20 bp, Artificial Sequence
  chemically synthesized
aaaatgccattcccgttttg

SEQ ID NO: 77489 - DNA, 20 bp, Artificial Sequence
  chemically synthesized
agatgtccacaaaacgggaa

SEQ ID NO: 77490 - DNA, 20 bp, Artificial Sequence
  chemically synthesized
aaacgggaatggcattttct

SEQ ID NO: 77491 - DNA, 20 bp, Artificial Sequence
  chemically synthesized
aattaaatctaagagttgcc

SEQ ID NO: 77492 - DNA, 20 bp, Artificial Sequence
  chemically synthesized
ggcattttctcggcaactct

SEQ ID NO: 77493 - DNA, 20 bp, Artificial Sequence
  chemically synthesized
tgagtagtaattaaatctaa

SEQ ID NO: 77494 - DNA, 20 bp, Artificial Sequence
  chemically synthesized
agtgagtagtaattaaatct

SEQ ID NO: 77495 - DNA, 20 bp, Artificial Sequence
  chemically synthesized
agtaagtgttttcaagtgag

SEQ ID NO: 77496 - DNA, 20 bp, Artificial Sequence
  chemically synthesized
taaagtaagtgttttcaagt

SEQ ID NO: 77497 - DNA, 20 bp, Artificial Sequence
  chemically synthesized
gatataaagtaagtgttttc

SEQ ID NO: 77498 - DNA, 20 bp, Artificial Sequence
  chemically synthesized
gtatctagtggatataaagt

SEQ ID NO: 77499 - DNA, 20 bp, Artificial Sequence
  chemically synthesized
cacagtatctagtggatata

SEQ ID NO: 77500 - DNA, 20 bp, Artificial Sequence
  chemically synthesized
aacacttactttatatccac

SEQ ID NO: 77501 - DNA, 20 bp, Artificial Sequence
  chemically synthesized
tatgtgggcacagtatctag

SEQ ID NO: 77502 - DNA, 20 bp, Artificial Sequence
  chemically synthesized
atatatgtgggcacagtatc

SEQ ID NO: 77503 - DNA, 20 bp, Artificial Sequence
  chemically synthesized
cacacacatatatgtgggca

SEQ ID NO: 77504 - DNA, 20 bp, Artificial Sequence
  chemically synthesized
acacacacacacatatatgt

SEQ ID NO: 77505 - DNA, 20 bp, Artificial Sequence
  chemically synthesized
cacacacacacacatatatg

SEQ ID NO: 77506 - DNA, 20 bp, Artificial Sequence
  chemically synthesized
ccatttttccagtggatgat

SEQ ID NO: 77507 - DNA, 20 bp, Artificial Sequence
  chemically synthesized
tccatttttccagtggatga

SEQ ID NO: 77508 - DNA, 20 bp, Artificial Sequence
  chemically synthesized
attatatacctatcatccac

SEQ ID NO: 77509 - DNA, 20 bp, Artificial Sequence
  chemically synthesized
tgagacttccatttttccag

SEQ ID NO: 77510 - DNA, 20 bp, Artificial Sequence
  chemically synthesized
cctatcatccactggaaaaa

SEQ ID NO: 77511 - DNA, 20 bp, Artificial Sequence
  chemically synthesized
tgttgagacttccatttttc

SEQ ID NO: 77512 - DNA, 20 bp, Artificial Sequence
  chemically synthesized
atcatccactggaaaaatgg

SEQ ID NO: 77513 - DNA, 20 bp, Artificial Sequence
  chemically synthesized
ctaatgattgtgagtgtgtt

SEQ ID NO: 77514 - DNA, 20 bp, Artificial Sequence
  chemically synthesized
gtacctctgctaatgattgt

SEQ ID NO: 77515 - DNA, 20 bp, Artificial Sequence
  chemically synthesized
ctcaacacactcacaatcat

SEQ ID NO: 77516 - DNA, 20 bp, Artificial Sequence
  chemically synthesized
aacacactcacaatcattag

SEQ ID NO: 77517 - DNA, 20 bp, Artificial Sequence
  chemically synthesized
cacactcacaatcattagca

SEQ ID NO: 77518 - DNA, 20 bp, Artificial Sequence
  chemically synthesized
acactcacaatcattagcag

SEQ ID NO: 77519 - DNA, 20 bp, Artificial Sequence
  chemically synthesized
agcagaggtacacaatttaa

SEQ ID NO: 77520 - DNA, 20 bp, Artificial Sequence
  chemically synthesized
gcagaggtacacaatttaat

SEQ ID NO: 77521 - DNA, 20 bp, Artificial Sequence
  chemically synthesized
aaaaatgcaatccatattat

SEQ ID NO: 77522 - DNA, 20 bp, Artificial Sequence
  chemically synthesized
tgactcaacttctcataata

SEQ ID NO: 77523 - DNA, 20 bp, Artificial Sequence
  chemically synthesized
aatgcaatccatattatgag

SEQ ID NO: 77524 - DNA, 20 bp, Artificial Sequence
  chemically synthesized
aatccatattatgagaagtt

SEQ ID NO: 77525 - DNA, 20 bp, Artificial Sequence
  chemically synthesized
tattatgagaagttgagtca

SEQ ID NO: 77526 - DNA, 20 bp, Artificial Sequence
  chemically synthesized
attatgagaagttgagtcat

SEQ ID NO: 77527 - DNA, 20 bp, Artificial Sequence
  chemically synthesized
ttatgagaagttgagtcata

SEQ ID NO: 77528 - DNA, 20 bp, Artificial Sequence
  chemically synthesized
tatgagaagttgagtcatag

SEQ ID NO: 77529 - DNA, 20 bp, Artificial Sequence
  chemically synthesized
gaagttgagtcataggggtt

SEQ ID NO: 77530 - DNA, 20 bp, Artificial Sequence
  chemically synthesized
gttgagtcataggggtttgg

SEQ ID NO: 77531 - DNA, 20 bp, Artificial Sequence
  chemically synthesized
ttgagtcataggggtttgga

SEQ ID NO: 77532 - DNA, 20 bp, Artificial Sequence
  chemically synthesized
tcataggggtttggaaggtg

SEQ ID NO: 77533 - DNA, 20 bp, Artificial Sequence
  chemically synthesized
ataggggtttggaaggtgca

SEQ ID NO: 77534 - DNA, 20 bp, Artificial Sequence
  chemically synthesized
gggtttggaaggtgcagaga

SEQ ID NO: 77535 - DNA, 20 bp, Artificial Sequence
  chemically synthesized
ggtgcagagaaagatgctga

SEQ ID NO: 77536 - DNA, 20 bp, Artificial Sequence
  chemically synthesized
tgcagagaaagatgctgatg

SEQ ID NO: 77537 - DNA, 20 bp, Artificial Sequence
  chemically synthesized
gcagagaaagatgctgatgg

SEQ ID NO: 77538 - DNA, 20 bp, Artificial Sequence
  chemically synthesized
cagagaaagatgctgatgga

SEQ ID NO: 77539 - DNA, 20 bp, Artificial Sequence
  chemically synthesized
agagaaagatgctgatggag

SEQ ID NO: 77540 - DNA, 20 bp, Artificial Sequence
  chemically synthesized
aggtctctcttcccctccat

SEQ ID NO: 77541 - DNA, 20 bp, Artificial Sequence
  chemically synthesized
gaaagatgctgatggagggg

SEQ ID NO: 77542 - DNA, 20 bp, Artificial Sequence
  chemically synthesized
aagatgctgatggaggggaa

SEQ ID NO: 77543 - DNA, 20 bp, Artificial Sequence
  chemically synthesized
gatgctgatggaggggaaga

SEQ ID NO: 77544 - DNA, 20 bp, Artificial Sequence
  chemically synthesized
gaggggaagagagacctcct

SEQ ID NO: 77545 - DNA, 20 bp, Artificial Sequence
  chemically synthesized
gggaagagagacctcctgag

SEQ ID NO: 77546 - DNA, 20 bp, Artificial Sequence
  chemically synthesized
agtcaccttatctactcagg

SEQ ID NO: 77547 - DNA, 20 bp, Artificial Sequence
  chemically synthesized
cagtcaccttatctactcag

SEQ ID NO: 77548 - DNA, 20 bp, Artificial Sequence
  chemically synthesized
ttcagtcaccttatctactc

SEQ ID NO: 77549 - DNA, 20 bp, Artificial Sequence
  chemically synthesized
gagagacctcctgagtagat

SEQ ID NO: 77550 - DNA, 20 bp, Artificial Sequence
  chemically synthesized
tttcagtcaccttatctact

SEQ ID NO: 77551 - DNA, 20 bp, Artificial Sequence
  chemically synthesized
agagacctcctgagtagata

SEQ ID NO: 77552 - DNA, 20 bp, Artificial Sequence
  chemically synthesized
ttcccctctgtgaatgattt

SEQ ID NO: 77553 - DNA, 20 bp, Artificial Sequence
  chemically synthesized
aaggtgactgaaatcattca

SEQ ID NO: 77554 - DNA, 20 bp, Artificial Sequence
  chemically synthesized
ggtgactgaaatcattcaca

SEQ ID NO: 77555 - DNA, 20 bp, Artificial Sequence
  chemically synthesized
gtgactgaaatcattcacag

SEQ ID NO: 77556 - DNA, 20 bp, Artificial Sequence
  chemically synthesized
tgactgaaatcattcacaga

SEQ ID NO: 77557 - DNA, 20 bp, Artificial Sequence
  chemically synthesized
gactgaaatcattcacagag

SEQ ID NO: 77558 - DNA, 20 bp, Artificial Sequence
  chemically synthesized
tcattcacagaggggaacac

SEQ ID NO: 77559 - DNA, 20 bp, Artificial Sequence
  chemically synthesized
ttcacagaggggaacactag

SEQ ID NO: 77560 - DNA, 20 bp, Artificial Sequence
  chemically synthesized
cacagaggggaacactagaa

SEQ ID NO: 77561 - DNA, 20 bp, Artificial Sequence
  chemically synthesized
acagaggggaacactagaag

SEQ ID NO: 77562 - DNA, 20 bp, Artificial Sequence
  chemically synthesized
ccagaggaacatgcctcttc

SEQ ID NO: 77563 - DNA, 20 bp, Artificial Sequence
  chemically synthesized
ctagaagaggcatgttcctc

SEQ ID NO: 77564 - DNA, 20 bp, Artificial Sequence
  chemically synthesized
ggtgactatttcatgtccag

SEQ ID NO: 77565 - DNA, 20 bp, Artificial Sequence
  chemically synthesized
aggtgactatttcatgtcca

SEQ ID NO: 77566 - DNA, 20 bp, Artificial Sequence
  chemically synthesized
ccaggtgactatttcatgtc

SEQ ID NO: 77567 - DNA, 20 bp, Artificial Sequence
  chemically synthesized
atgttcctctggacatgaaa

SEQ ID NO: 77568 - DNA, 20 bp, Artificial Sequence
  chemically synthesized
ctggacatgaaatagtcacc

SEQ ID NO: 77569 - DNA, 20 bp, Artificial Sequence
  chemically synthesized
tgatctacttgagattttcc

SEQ ID NO: 77570 - DNA, 20 bp, Artificial Sequence
  chemically synthesized
ctgatctacttgagattttc

SEQ ID NO: 77571 - DNA, 20 bp, Artificial Sequence
  chemically synthesized
atagtcacctggaaaatctc

SEQ ID NO: 77572 - DNA, 20 bp, Artificial Sequence
  chemically synthesized
gtcacctggaaaatctcaag

SEQ ID NO: 77573 - DNA, 20 bp, Artificial Sequence
  chemically synthesized
caagttatactgatctactt

SEQ ID NO: 77574 - DNA, 20 bp, Artificial Sequence
  chemically synthesized
ctggaaaatctcaagtagat

SEQ ID NO: 77575 - DNA, 20 bp, Artificial Sequence
  chemically synthesized
aagtagatcagtataacttg

SEQ ID NO: 77576 - DNA, 20 bp, Artificial Sequence
  chemically synthesized
ctcctttccacaatgaccac

SEQ ID NO: 77577 - DNA, 20 bp, Artificial Sequence
  chemically synthesized
agtataacttgtggtcattg

SEQ ID NO: 77578 - DNA, 20 bp, Artificial Sequence
  chemically synthesized
taacttgtggtcattgtgga

SEQ ID NO: 77579 - DNA, 20 bp, Artificial Sequence
  chemically synthesized
aacttgtggtcattgtggaa

SEQ ID NO: 77580 - DNA, 20 bp, Artificial Sequence
  chemically synthesized
cttgtggtcattgtggaaag

SEQ ID NO: 77581 - DNA, 20 bp, Artificial Sequence
  chemically synthesized
gtggtcattgtggaaaggag

SEQ ID NO: 77582 - DNA, 20 bp, Artificial Sequence
  chemically synthesized
ggtcattgtggaaaggagaa

SEQ ID NO: 77583 - DNA, 20 bp, Artificial Sequence
  chemically synthesized
tgtggaaaggagaagagaca

SEQ ID NO: 77584 - DNA, 20 bp, Artificial Sequence
  chemically synthesized
tggaaaggagaagagacaca

SEQ ID NO: 77585 - DNA, 20 bp, Artificial Sequence
  chemically synthesized
agacacagagtgtttgtatg

SEQ ID NO: 77586 - DNA, 20 bp, Artificial Sequence
  chemically synthesized
acacagagtgtttgtatgca

SEQ ID NO: 77587 - DNA, 20 bp, Artificial Sequence
  chemically synthesized
gagtgtttgtatgcagagac

SEQ ID NO: 77588 - DNA, 20 bp, Artificial Sequence
  chemically synthesized
tgtttgtatgcagagacaag

SEQ ID NO: 77589 - DNA, 20 bp, Artificial Sequence
  chemically synthesized
gcagagacaagaagtaacaa

SEQ ID NO: 77590 - DNA, 20 bp, Artificial Sequence
  chemically synthesized
agacaagaagtaacaatggc

SEQ ID NO: 77591 - DNA, 20 bp, Artificial Sequence
  chemically synthesized
aagtaacaatggccagaaat

SEQ ID NO: 77592 - DNA, 20 bp, Artificial Sequence
  chemically synthesized
atttgccaccagcttatttc

SEQ ID NO: 77593 - DNA, 20 bp, Artificial Sequence
  chemically synthesized
aacaatggccagaaataagc

SEQ ID NO: 77594 - DNA, 20 bp, Artificial Sequence
  chemically synthesized
aatggccagaaataagctgg

SEQ ID NO: 77595 - DNA, 20 bp, Artificial Sequence
  chemically synthesized
taatttgctccatttgccac

SEQ ID NO: 77596 - DNA, 20 bp, Artificial Sequence
  chemically synthesized
agaaataagctggtggcaaa

SEQ ID NO: 77597 - DNA, 20 bp, Artificial Sequence
  chemically synthesized
aaataagctggtggcaaatg

SEQ ID NO: 77598 - DNA, 20 bp, Artificial Sequence
  chemically synthesized
ttatttgcaaaataattttt

SEQ ID NO: 77599 - DNA, 20 bp, Artificial Sequence
  chemically synthesized
tatttgcaaaataattttta

SEQ ID NO: 77600 - DNA, 20 bp, Artificial Sequence
  chemically synthesized
atttgcaaaataatttttaa

SEQ ID NO: 77601 - DNA, 20 bp, Artificial Sequence
  chemically synthesized
ttaagggtcacgctatctaa

SEQ ID NO: 77602 - DNA, 20 bp, Artificial Sequence
  chemically synthesized
gcaaaatgctatcttttaga

SEQ ID NO: 77603 - DNA, 20 bp, Artificial Sequence
  chemically synthesized
gggtcacgctatctaaaaga

SEQ ID NO: 77604 - DNA, 20 bp, Artificial Sequence
  chemically synthesized
tagggcaaaatgctatcttt

SEQ ID NO: 77605 - DNA, 20 bp, Artificial Sequence
  chemically synthesized
caaatttgtgcaaaagcata

SEQ ID NO: 77606 - DNA, 20 bp, Artificial Sequence
  chemically synthesized
acaaatttgtgcaaaagcat

SEQ ID NO: 77607 - DNA, 20 bp, Artificial Sequence
  chemically synthesized
aacaaatttgtgcaaaagca

SEQ ID NO: 77608 - DNA, 20 bp, Artificial Sequence
  chemically synthesized
gaataaacaaatttgtgcaa

SEQ ID NO: 77609 - DNA, 20 bp, Artificial Sequence
  chemically synthesized
aggtacccaataatagtttt

SEQ ID NO: 77610 - DNA, 20 bp, Artificial Sequence
  chemically synthesized
tttattccaaaaactattat

SEQ ID NO: 77611 - DNA, 20 bp, Artificial Sequence
  chemically synthesized
ttattccaaaaactattatt

SEQ ID NO: 77612 - DNA, 20 bp, Artificial Sequence
  chemically synthesized
atataataggtacccaataa

SEQ ID NO: 77613 - DNA, 20 bp, Artificial Sequence
  chemically synthesized
aacattccctggcatataat

SEQ ID NO: 77614 - DNA, 20 bp, Artificial Sequence
  chemically synthesized
gaacattccctggcatataa

SEQ ID NO: 77615 - DNA, 20 bp, Artificial Sequence
  chemically synthesized
attgggtacctattatatgc

SEQ ID NO: 77616 - DNA, 20 bp, Artificial Sequence
  chemically synthesized
ttgggtacctattatatgcc

SEQ ID NO: 77617 - DNA, 20 bp, Artificial Sequence
  chemically synthesized
tgggtacctattatatgcca

SEQ ID NO: 77618 - DNA, 20 bp, Artificial Sequence
  chemically synthesized
ccagtgcctagaacattccc

SEQ ID NO: 77619 - DNA, 20 bp, Artificial Sequence
  chemically synthesized
ttatatgccagggaatgttc

SEQ ID NO: 77620 - DNA, 20 bp, Artificial Sequence
  chemically synthesized
tatatgccagggaatgttct

SEQ ID NO: 77621 - DNA, 20 bp, Artificial Sequence
  chemically synthesized
ccagggaatgttctaggcac

SEQ ID NO: 77622 - DNA, 20 bp, Artificial Sequence
  chemically synthesized
tacgctgtatttccagtgcc

SEQ ID NO: 77623 - DNA, 20 bp, Artificial Sequence
  chemically synthesized
tgttctaggcactggaaata

SEQ ID NO: 77624 - DNA, 20 bp, Artificial Sequence
  chemically synthesized
tctatcttacgctgtatttc

SEQ ID NO: 77625 - DNA, 20 bp, Artificial Sequence
  chemically synthesized
aggcactggaaatacagcgt

SEQ ID NO: 77626 - DNA, 20 bp, Artificial Sequence
  chemically synthesized
actggaaatacagcgtaaga

SEQ ID NO: 77627 - DNA, 20 bp, Artificial Sequence
  chemically synthesized
aatacagcgtaagatagacc

SEQ ID NO: 77628 - DNA, 20 bp, Artificial Sequence
  chemically synthesized
gctgcatgattacagagact

SEQ ID NO: 77629 - DNA, 20 bp, Artificial Sequence
  chemically synthesized
ccttaagctgcatgattaca

SEQ ID NO: 77630 - DNA, 20 bp, Artificial Sequence
  chemically synthesized
agccttaagctgcatgatta

SEQ ID NO: 77631 - DNA, 20 bp, Artificial Sequence
  chemically synthesized
accaagtctctgtaatcatg

SEQ ID NO: 77632 - DNA, 20 bp, Artificial Sequence
  chemically synthesized
tctctgtaatcatgcagctt

SEQ ID NO: 77633 - DNA, 20 bp, Artificial Sequence
  chemically synthesized
ctctgtaatcatgcagctta

SEQ ID NO: 77634 - DNA, 20 bp, Artificial Sequence
  chemically synthesized
aaatgatatccattagcctt

SEQ ID NO: 77635 - DNA, 20 bp, Artificial Sequence
  chemically synthesized
atcatgcagcttaaggctaa

SEQ ID NO: 77636 - DNA, 20 bp, Artificial Sequence
  chemically synthesized
ttaaatgaaatgatatccat

SEQ ID NO: 77637 - DNA, 20 bp, Artificial Sequence
  chemically synthesized
tttataagcctagttattaa

SEQ ID NO: 77638 - DNA, 20 bp, Artificial Sequence
  chemically synthesized
aaatgatgactattaataac

SEQ ID NO: 77639 - DNA, 20 bp, Artificial Sequence
  chemically synthesized
aatgatgactattaataact

SEQ ID NO: 77640 - DNA, 20 bp, Artificial Sequence
  chemically synthesized
aatttgcttctttataagcc

SEQ ID NO: 77641 - DNA, 20 bp, Artificial Sequence
  chemically synthesized
tattaataactaggcttata

SEQ ID NO: 77642 - DNA, 20 bp, Artificial Sequence
  chemically synthesized
taataactaggcttataaag

SEQ ID NO: 77643 - DNA, 20 bp, Artificial Sequence
  chemically synthesized
cttggaatttgcttctttat

SEQ ID NO: 77644 - DNA, 20 bp, Artificial Sequence
  chemically synthesized
cttataaagaagcaaattcc

SEQ ID NO: 77645 - DNA, 20 bp, Artificial Sequence
  chemically synthesized
agccatgatatattttggct

SEQ ID NO: 77646 - DNA, 20 bp, Artificial Sequence
  chemically synthesized
tttatagccatgatatattt

SEQ ID NO: 77647 - DNA, 20 bp, Artificial Sequence
  chemically synthesized
ttccaagccaaaatatatca

SEQ ID NO: 77648 - DNA, 20 bp, Artificial Sequence
  chemically synthesized
tggtcaaaaattgtatttta

SEQ ID NO: 77649 - DNA, 20 bp, Artificial Sequence
  chemically synthesized
ataaaatacaatttttgacc

SEQ ID NO: 77650 - DNA, 20 bp, Artificial Sequence
  chemically synthesized
tactttgtcctgcattttct

SEQ ID NO: 77651 - DNA, 20 bp, Artificial Sequence
  chemically synthesized
aatttttgaccaagaaaatg

SEQ ID NO: 77652 - DNA, 20 bp, Artificial Sequence
  chemically synthesized
atttttgaccaagaaaatgc

SEQ ID NO: 77653 - DNA, 20 bp, Artificial Sequence
  chemically synthesized
gaccaagaaaatgcaggaca

SEQ ID NO: 77654 - DNA, 20 bp, Artificial Sequence
  chemically synthesized
caggacaaagtataatattg

SEQ ID NO: 77655 - DNA, 20 bp, Artificial Sequence
  chemically synthesized
acaaagtataatattgcaga

SEQ ID NO: 77656 - DNA, 20 bp, Artificial Sequence
  chemically synthesized
aagtataatattgcagatag

SEQ ID NO: 77657 - DNA, 20 bp, Artificial Sequence
  chemically synthesized
tattgcagatagcagtctca

SEQ ID NO: 77658 - DNA, 20 bp, Artificial Sequence
  chemically synthesized
ttgcagatagcagtctcaaa

SEQ ID NO: 77659 - DNA, 20 bp, Artificial Sequence
  chemically synthesized
agtgaaaacagaatctcttt

SEQ ID NO: 77660 - DNA, 20 bp, Artificial Sequence
  chemically synthesized
tttgctttaataagtgaaaa

SEQ ID NO: 77661 - DNA, 20 bp, Artificial Sequence
  chemically synthesized
gattctgttttcacttatta

SEQ ID NO: 77662 - DNA, 20 bp, Artificial Sequence
  chemically synthesized
gtagcttaatttgctttaat

SEQ ID NO: 77663 - DNA, 20 bp, Artificial Sequence
  chemically synthesized
ttcacttattaaagcaaatt

SEQ ID NO: 77664 - DNA, 20 bp, Artificial Sequence
  chemically synthesized
attattcagacatgcagagg

SEQ ID NO: 77665 - DNA, 20 bp, Artificial Sequence
  chemically synthesized
atcattattcagacatgcag

SEQ ID NO: 77666 - DNA, 20 bp, Artificial Sequence
  chemically synthesized
aatcattattcagacatgca

SEQ ID NO: 77667 - DNA, 20 bp, Artificial Sequence
  chemically synthesized
ttaatcattattcagacatg

SEQ ID NO: 77668 - DNA, 20 bp, Artificial Sequence
  chemically synthesized
ttcctctattaatcattatt

SEQ ID NO: 77669 - DNA, 20 bp, Artificial Sequence
  chemically synthesized
catgtctgaataatgattaa

SEQ ID NO: 77670 - DNA, 20 bp, Artificial Sequence
  chemically synthesized
tgtctgaataatgattaata

SEQ ID NO: 77671 - DNA, 20 bp, Artificial Sequence
  chemically synthesized
gtctgaataatgattaatag

SEQ ID NO: 77672 - DNA, 20 bp, Artificial Sequence
  chemically synthesized
taatgattaatagaggaatc

SEQ ID NO: 77673 - DNA, 20 bp, Artificial Sequence
  chemically synthesized
atagaggaatctagaattgt

SEQ ID NO: 77674 - DNA, 20 bp, Artificial Sequence
  chemically synthesized
gcacgggtaactcacaattc

SEQ ID NO: 77675 - DNA, 20 bp, Artificial Sequence
  chemically synthesized
ccaggtacagcatattgcac

SEQ ID NO: 77676 - DNA, 20 bp, Artificial Sequence
  chemically synthesized
accaggtacagcatattgca

SEQ ID NO: 77677 - DNA, 20 bp, Artificial Sequence
  chemically synthesized
cccgtgcaatatgctgtacc

SEQ ID NO: 77678 - DNA, 20 bp, Artificial Sequence
  chemically synthesized
catataaagcaaaccaggta

SEQ ID NO: 77679 - DNA, 20 bp, Artificial Sequence
  chemically synthesized
tgctccatataaagcaaacc

SEQ ID NO: 77680 - DNA, 20 bp, Artificial Sequence
  chemically synthesized
gtgctccatataaagcaaac

SEQ ID NO: 77681 - DNA, 20 bp, Artificial Sequence
  chemically synthesized
tgtacctggtttgctttata

SEQ ID NO: 77682 - DNA, 20 bp, Artificial Sequence
  chemically synthesized
tacctggtttgctttatatg

SEQ ID NO: 77683 - DNA, 20 bp, Artificial Sequence
  chemically synthesized
aaataaatgtgctccatata

SEQ ID NO: 77684 - DNA, 20 bp, Artificial Sequence
  chemically synthesized
ttatatggagcacatttatt

SEQ ID NO: 77685 - DNA, 20 bp, Artificial Sequence
  chemically synthesized
ggagcacatttatttagttt

SEQ ID NO: 77686 - DNA, 20 bp, Artificial Sequence
  chemically synthesized
catttatttagttttggttc

SEQ ID NO: 77687 - DNA, 20 bp, Artificial Sequence
  chemically synthesized
atttatttagttttggttct

SEQ ID NO: 77688 - DNA, 20 bp, Artificial Sequence
  chemically synthesized
tttatttagttttggttcta

SEQ ID NO: 77689 - DNA, 20 bp, Artificial Sequence
  chemically synthesized
ttatttagttttggttctag

SEQ ID NO: 77690 - DNA, 20 bp, Artificial Sequence
  chemically synthesized
tatttagttttggttctagg

SEQ ID NO: 77691 - DNA, 20 bp, Artificial Sequence
  chemically synthesized
ttagttttggttctaggggg

SEQ ID NO: 77692 - DNA, 20 bp, Artificial Sequence
  chemically synthesized
tagttttggttctaggggga

SEQ ID NO: 77693 - DNA, 20 bp, Artificial Sequence
  chemically synthesized
agtagtgagtgccttccccc

SEQ ID NO: 77694 - DNA, 20 bp, Artificial Sequence
  chemically synthesized
atccattttgtttcagtagt

SEQ ID NO: 77695 - DNA, 20 bp, Artificial Sequence
  chemically synthesized
aaaaatccattttgtttcag

SEQ ID NO: 77696 - DNA, 20 bp, Artificial Sequence
  chemically synthesized
agtaaaaatccattttgttt

SEQ ID NO: 77697 - DNA, 20 bp, Artificial Sequence
  chemically synthesized
cactcactactgaaacaaaa

SEQ ID NO: 77698 - DNA, 20 bp, Artificial Sequence
  chemically synthesized
tattgaatgaaaaatcaaat

SEQ ID NO: 77699 - DNA, 20 bp, Artificial Sequence
  chemically synthesized
cattcaatatattattaact

SEQ ID NO: 77700 - DNA, 20 bp, Artificial Sequence
  chemically synthesized
atttctgccttagtatttct

SEQ ID NO: 77701 - DNA, 20 bp, Artificial Sequence
  chemically synthesized
attattaacttagaaatact

SEQ ID NO: 77702 - DNA, 20 bp, Artificial Sequence
  chemically synthesized
ttattaacttagaaatacta

SEQ ID NO: 77703 - DNA, 20 bp, Artificial Sequence
  chemically synthesized
ttaacttagaaatactaagg

SEQ ID NO: 77704 - DNA, 20 bp, Artificial Sequence
  chemically synthesized
tctttggttcatttctgcct

SEQ ID NO: 77705 - DNA, 20 bp, Artificial Sequence
  chemically synthesized
actaaggcagaaatgaacca

SEQ ID NO: 77706 - DNA, 20 bp, Artificial Sequence
  chemically synthesized
taaaaatttgtattaatctt

SEQ ID NO: 77707 - DNA, 20 bp, Artificial Sequence
  chemically synthesized
aaagattaatacaaattttt

SEQ ID NO: 77708 - DNA, 20 bp, Artificial Sequence
  chemically synthesized
agattaatacaaatttttaa

SEQ ID NO: 77709 - DNA, 20 bp, Artificial Sequence
  chemically synthesized
ttaatacaaatttttaagag

SEQ ID NO: 77710 - DNA, 20 bp, Artificial Sequence
  chemically synthesized
gcagtgataaaaataataca

SEQ ID NO: 77711 - DNA, 20 bp, Artificial Sequence
  chemically synthesized
gtgataaaaataatacacag

SEQ ID NO: 77712 - DNA, 20 bp, Artificial Sequence
  chemically synthesized
gataaaaataatacacagaa

SEQ ID NO: 77713 - DNA, 20 bp, Artificial Sequence
  chemically synthesized
ataaaaataatacacagaag

SEQ ID NO: 77714 - DNA, 20 bp, Artificial Sequence
  chemically synthesized
taaaaataatacacagaaga

SEQ ID NO: 77715 - DNA, 20 bp, Artificial Sequence
  chemically synthesized
atacacagaagagggctaaa

SEQ ID NO: 77716 - DNA, 20 bp, Artificial Sequence
  chemically synthesized
tacacagaagagggctaaaa

SEQ ID NO: 77717 - DNA, 20 bp, Artificial Sequence
  chemically synthesized
gacgtttttgcaatcctttt

SEQ ID NO: 77718 - DNA, 20 bp, Artificial Sequence
  chemically synthesized
aaagtaaaattggatattaa

SEQ ID NO: 77719 - DNA, 20 bp, Artificial Sequence
  chemically synthesized
gaaagtaaaattggatatta

SEQ ID NO: 77720 - DNA, 20 bp, Artificial Sequence
  chemically synthesized
caataatctgaaagtaaaat

SEQ ID NO: 77721 - DNA, 20 bp, Artificial Sequence
  chemically synthesized
ttaatatccaattttacttt

SEQ ID NO: 77722 - DNA, 20 bp, Artificial Sequence
  chemically synthesized
taggaactacaataatctga

SEQ ID NO: 77723 - DNA, 20 bp, Artificial Sequence
  chemically synthesized
attttactttcagattattg

SEQ ID NO: 77724 - DNA, 20 bp, Artificial Sequence
  chemically synthesized
taaaaacattaattacattt

SEQ ID NO: 77725 - DNA, 20 bp, Artificial Sequence
  chemically synthesized
ctaaaaacattaattacatt

SEQ ID NO: 77726 - DNA, 20 bp, Artificial Sequence
  chemically synthesized
ctaaatgtaattaatgtttt

SEQ ID NO: 77727 - DNA, 20 bp, Artificial Sequence
  chemically synthesized
gaaataagaccattttagaa

SEQ ID NO: 77728 - DNA, 20 bp, Artificial Sequence
  chemically synthesized
tgtttttagcctttctaaaa

SEQ ID NO: 77729 - DNA, 20 bp, Artificial Sequence
  chemically synthesized
agaaataagaccattttaga

SEQ ID NO: 77730 - DNA, 20 bp, Artificial Sequence
  chemically synthesized
tgcaagaaataagaccattt

SEQ ID NO: 77731 - DNA, 20 bp, Artificial Sequence
  chemically synthesized
ttattttgtttgcaagaaat

SEQ ID NO: 77732 - DNA, 20 bp, Artificial Sequence
  chemically synthesized
tgcttttttattttgtttgc

SEQ ID NO: 77733 - DNA, 20 bp, Artificial Sequence
  chemically synthesized
ttcttgcaaacaaaataaaa

SEQ ID NO: 77734 - DNA, 20 bp, Artificial Sequence
  chemically synthesized
ttgcaaacaaaataaaaaag

SEQ ID NO: 77735 - DNA, 20 bp, Artificial Sequence
  chemically synthesized
tgcaaacaaaataaaaaagc

SEQ ID NO: 77736 - DNA, 20 bp, Artificial Sequence
  chemically synthesized
gcaggatgttcaactactta

SEQ ID NO: 77737 - DNA, 20 bp, Artificial Sequence
  chemically synthesized
tcctttcgtttgactttaag

SEQ ID NO: 77738 - DNA, 20 bp, Artificial Sequence
  chemically synthesized
tgttcctttcgtttgacttt

SEQ ID NO: 77739 - DNA, 20 bp, Artificial Sequence
  chemically synthesized
aactacttaaagtcaaacga

SEQ ID NO: 77740 - DNA, 20 bp, Artificial Sequence
  chemically synthesized
actacttaaagtcaaacgaa

SEQ ID NO: 77741 - DNA, 20 bp, Artificial Sequence
  chemically synthesized
ttaaagtcaaacgaaaggaa

SEQ ID NO: 77742 - DNA, 20 bp, Artificial Sequence
  chemically synthesized
atgttgcatagattttaatg

SEQ ID NO: 77743 - DNA, 20 bp, Artificial Sequence
  chemically synthesized
tgaaccattatgatgttgca

SEQ ID NO: 77744 - DNA, 20 bp, Artificial Sequence
  chemically synthesized
aaatctatgcaacatcataa

SEQ ID NO: 77745 - DNA, 20 bp, Artificial Sequence
  chemically synthesized
cctcagaatatgatgaaaag

SEQ ID NO: 77746 - DNA, 20 bp, Artificial Sequence
  chemically synthesized
cagcctcagaatatgatgaa

SEQ ID NO: 77747 - DNA, 20 bp, Artificial Sequence
  chemically synthesized
tcttcttttcatcatattct

SEQ ID NO: 77748 - DNA, 20 bp, Artificial Sequence
  chemically synthesized
cttcttttcatcatattctg

SEQ ID NO: 77749 - DNA, 20 bp, Artificial Sequence
  chemically synthesized
taagactttcttttcagcct

SEQ ID NO: 77750 - DNA, 20 bp, Artificial Sequence
  chemically synthesized
catcatattctgaggctgaa

SEQ ID NO: 77751 - DNA, 20 bp, Artificial Sequence
  chemically synthesized
atattctgaggctgaaaaga

SEQ ID NO: 77752 - DNA, 20 bp, Artificial Sequence
  chemically synthesized
aatacataagactttctttt

SEQ ID NO: 77753 - DNA, 20 bp, Artificial Sequence
  chemically synthesized
ttgctcagaaatgaatacat

SEQ ID NO: 77754 - DNA, 20 bp, Artificial Sequence
  chemically synthesized
agtcttatgtattcatttct

SEQ ID NO: 77755 - DNA, 20 bp, Artificial Sequence
  chemically synthesized
gtattcatttctgagcaatg

SEQ ID NO: 77756 - DNA, 20 bp, Artificial Sequence
  chemically synthesized
tccagagggcccacattgct

SEQ ID NO: 77757 - DNA, 20 bp, Artificial Sequence
  chemically synthesized
tattcatttctgagcaatgt

SEQ ID NO: 77758 - DNA, 20 bp, Artificial Sequence
  chemically synthesized
tctgagcaatgtgggccctc

SEQ ID NO: 77759 - DNA, 20 bp, Artificial Sequence
  chemically synthesized
caactaataatgtgtccaga

SEQ ID NO: 77760 - DNA, 20 bp, Artificial Sequence
  chemically synthesized
acaactaataatgtgtccag

SEQ ID NO: 77761 - DNA, 20 bp, Artificial Sequence
  chemically synthesized
aacaactaataatgtgtcca

SEQ ID NO: 77762 - DNA, 20 bp, Artificial Sequence
  chemically synthesized
ataacaactaataatgtgtc

SEQ ID NO: 77763 - DNA, 20 bp, Artificial Sequence
  chemically synthesized
gggccctctggacacattat

SEQ ID NO: 77764 - DNA, 20 bp, Artificial Sequence
  chemically synthesized
acaacctcatgtattcacag

SEQ ID NO: 77765 - DNA, 20 bp, Artificial Sequence
  chemically synthesized
ttcacaacctcatgtattca

SEQ ID NO: 77766 - DNA, 20 bp, Artificial Sequence
  chemically synthesized
ttttacttctgtgaatacat

SEQ ID NO: 77767 - DNA, 20 bp, Artificial Sequence
  chemically synthesized
tttacttctgtgaatacatg

SEQ ID NO: 77768 - DNA, 20 bp, Artificial Sequence
  chemically synthesized
tgaatacatgaggttgtgaa

SEQ ID NO: 77769 - DNA, 20 bp, Artificial Sequence
  chemically synthesized
acatgaggttgtgaaaagtc

SEQ ID NO: 77770 - DNA, 20 bp, Artificial Sequence
  chemically synthesized
tgtgaaaagtctagcttctt

SEQ ID NO: 77771 - DNA, 20 bp, Artificial Sequence
  chemically synthesized
aaactcttgactcaagaagc

SEQ ID NO: 77772 - DNA, 20 bp, Artificial Sequence
  chemically synthesized
gaataaactcttgactcaag

SEQ ID NO: 77773 - DNA, 20 bp, Artificial Sequence
  chemically synthesized
aaagtctagcttcttgagtc

SEQ ID NO: 77774 - DNA, 20 bp, Artificial Sequence
  chemically synthesized
agtctagcttcttgagtcaa

SEQ ID NO: 77775 - DNA, 20 bp, Artificial Sequence
  chemically synthesized
actgaataaactcttgactc

SEQ ID NO: 77776 - DNA, 20 bp, Artificial Sequence
  chemically synthesized
tcttgagtcaagagtttatt

SEQ ID NO: 77777 - DNA, 20 bp, Artificial Sequence
  chemically synthesized
gaaaatatcaattttatggt

SEQ ID NO: 77778 - DNA, 20 bp, Artificial Sequence
  chemically synthesized
tcttgaaaatatcaatttta

SEQ ID NO: 77779 - DNA, 20 bp, Artificial Sequence
  chemically synthesized
accataaaattgatattttc

SEQ ID NO: 77780 - DNA, 20 bp, Artificial Sequence
  chemically synthesized
taagatgtgatcataaaaat

SEQ ID NO: 77781 - DNA, 20 bp, Artificial Sequence
  chemically synthesized
gatttttatgatcacatctt

SEQ ID NO: 77782 - DNA, 20 bp, Artificial Sequence
  chemically synthesized
atttttatgatcacatctta

SEQ ID NO: 77783 - DNA, 20 bp, Artificial Sequence
  chemically synthesized
atgaatttagatattacctt

SEQ ID NO: 77784 - DNA, 20 bp, Artificial Sequence
  chemically synthesized
actattacaggatatgaatt

SEQ ID NO: 77785 - DNA, 20 bp, Artificial Sequence
  chemically synthesized
tctaaattcatatcctgtaa

SEQ ID NO: 77786 - DNA, 20 bp, Artificial Sequence
  chemically synthesized
ttgtcataacagactattac

SEQ ID NO: 77787 - DNA, 20 bp, Artificial Sequence
  chemically synthesized
gttgtcataacagactatta

SEQ ID NO: 77788 - DNA, 20 bp, Artificial Sequence
  chemically synthesized
catgatagcagttgtcataa

SEQ ID NO: 77789 - DNA, 20 bp, Artificial Sequence
  chemically synthesized
actggacattatcatgatag

SEQ ID NO: 77790 - DNA, 20 bp, Artificial Sequence
  chemically synthesized
ttaactggacattatcatga

SEQ ID NO: 77791 - DNA, 20 bp, Artificial Sequence
  chemically synthesized
actgctatcatgataatgtc

SEQ ID NO: 77792 - DNA, 20 bp, Artificial Sequence
  chemically synthesized
tatcatgataatgtccagtt

SEQ ID NO: 77793 - DNA, 20 bp, Artificial Sequence
  chemically synthesized
atcatttgcatgtacttaac

SEQ ID NO: 77794 - DNA, 20 bp, Artificial Sequence
  chemically synthesized
cttagactcatttgtgtaag

SEQ ID NO: 77795 - DNA, 20 bp, Artificial Sequence
  chemically synthesized
acacttagactcatttgtgt

SEQ ID NO: 77796 - DNA, 20 bp, Artificial Sequence
  chemically synthesized
aaattactacttacacaaat

SEQ ID NO: 77797 - DNA, 20 bp, Artificial Sequence
  chemically synthesized
ctacttacacaaatgagtct

SEQ ID NO: 77798 - DNA, 20 bp, Artificial Sequence
  chemically synthesized
cacaaatgagtctaagtgtc

SEQ ID NO: 77799 - DNA, 20 bp, Artificial Sequence
  chemically synthesized
tgtttagacagcttgacact

SEQ ID NO: 77800 - DNA, 20 bp, Artificial Sequence
  chemically synthesized
atctgagaacgttgtttaga

SEQ ID NO: 77801 - DNA, 20 bp, Artificial Sequence
  chemically synthesized
tcacatctgagaacgttgtt

SEQ ID NO: 77802 - DNA, 20 bp, Artificial Sequence
  chemically synthesized
agctgtctaaacaacgttct

SEQ ID NO: 77803 - DNA, 20 bp, Artificial Sequence
  chemically synthesized
tttttttggaaatcacatct

SEQ ID NO: 77804 - DNA, 20 bp, Artificial Sequence
  chemically synthesized
tttttttttttttttttttt

SEQ ID NO: 77805 - DNA, 20 bp, Artificial Sequence
  chemically synthesized
aaaaaaaaaaaatcactcat

SEQ ID NO: 77806 - DNA, 20 bp, Artificial Sequence
  chemically synthesized
aaagggtagatttggccaat

SEQ ID NO: 77807 - DNA, 20 bp, Artificial Sequence
  chemically synthesized
ctttttctaaagggtagatt

SEQ ID NO: 77808 - DNA, 20 bp, Artificial Sequence
  chemically synthesized
cattggccaaatctaccctt

SEQ ID NO: 77809 - DNA, 20 bp, Artificial Sequence
  chemically synthesized
caatcactttttctaaaggg

SEQ ID NO: 77810 - DNA, 20 bp, Artificial Sequence
  chemically synthesized
tatcaatcactttttctaaa

SEQ ID NO: 77811 - DNA, 20 bp, Artificial Sequence
  chemically synthesized
ccaaatctaccctttagaaa

SEQ ID NO: 77812 - DNA, 20 bp, Artificial Sequence
  chemically synthesized
atatcaatcactttttctaa

SEQ ID NO: 77813 - DNA, 20 bp, Artificial Sequence
  chemically synthesized
aatatcaatcactttttcta

SEQ ID NO: 77814 - DNA, 20 bp, Artificial Sequence
  chemically synthesized
agtgattgatattcaactaa

SEQ ID NO: 77815 - DNA, 20 bp, Artificial Sequence
  chemically synthesized
ttactattaaatatatctgt

SEQ ID NO: 77816 - DNA, 20 bp, Artificial Sequence
  chemically synthesized
caactaacagatatatttaa

SEQ ID NO: 77817 - DNA, 20 bp, Artificial Sequence
  chemically synthesized
acagatatatttaatagtaa

SEQ ID NO: 77818 - DNA, 20 bp, Artificial Sequence
  chemically synthesized
tcctattttgaaaaagaaaa

SEQ ID NO: 77819 - DNA, 20 bp, Artificial Sequence
  chemically synthesized
atcatactcctattttgaaa

SEQ ID NO: 77820 - DNA, 20 bp, Artificial Sequence
  chemically synthesized
gacttttttctttttcaaaa

SEQ ID NO: 77821 - DNA, 20 bp, Artificial Sequence
  chemically synthesized
acttttttctttttcaaaat

SEQ ID NO: 77822 - DNA, 20 bp, Artificial Sequence
  chemically synthesized
ttttttctttttcaaaatag

SEQ ID NO: 77823 - DNA, 20 bp, Artificial Sequence
  chemically synthesized
ttcaaaataggagtatgatt

SEQ ID NO: 77824 - DNA, 20 bp, Artificial Sequence
  chemically synthesized
tcacccccacagatttttga

SEQ ID NO: 77825 - DNA, 20 bp, Artificial Sequence
  chemically synthesized
atcacccccacagatttttg

SEQ ID NO: 77826 - DNA, 20 bp, Artificial Sequence
  chemically synthesized
catcacccccacagattttt

SEQ ID NO: 77827 - DNA, 20 bp, Artificial Sequence
  chemically synthesized
ttagtgccctcaaaaatctg

SEQ ID NO: 77828 - DNA, 20 bp, Artificial Sequence
  chemically synthesized
tagtgccctcaaaaatctgt

SEQ ID NO: 77829 - DNA, 20 bp, Artificial Sequence
  chemically synthesized
agtgccctcaaaaatctgtg

SEQ ID NO: 77830 - DNA, 20 bp, Artificial Sequence
  chemically synthesized
gtgccctcaaaaatctgtgg

SEQ ID NO: 77831 - DNA, 20 bp, Artificial Sequence
  chemically synthesized
tcaatgcagcatcaccccca

SEQ ID NO: 77832 - DNA, 20 bp, Artificial Sequence
  chemically synthesized
tctcctttagataatcaatg

SEQ ID NO: 77833 - DNA, 20 bp, Artificial Sequence
  chemically synthesized
gatgctgcattgattatcta

SEQ ID NO: 77834 - DNA, 20 bp, Artificial Sequence
  chemically synthesized
atgctgcattgattatctaa

SEQ ID NO: 77835 - DNA, 20 bp, Artificial Sequence
  chemically synthesized
gctgcattgattatctaaag

SEQ ID NO: 77836 - DNA, 20 bp, Artificial Sequence
  chemically synthesized
actgaaattgtattctcctt

SEQ ID NO: 77837 - DNA, 20 bp, Artificial Sequence
  chemically synthesized
tctaaaggagaatacaattt

SEQ ID NO: 77838 - DNA, 20 bp, Artificial Sequence
  chemically synthesized
aaaggagaatacaatttcag

SEQ ID NO: 77839 - DNA, 20 bp, Artificial Sequence
  chemically synthesized
aaggagaatacaatttcagt

SEQ ID NO: 77840 - DNA, 20 bp, Artificial Sequence
  chemically synthesized
aatacaatttcagtaggaaa

SEQ ID NO: 77841 - DNA, 20 bp, Artificial Sequence
  chemically synthesized
tacaatttcagtaggaaaaa

SEQ ID NO: 77842 - DNA, 20 bp, Artificial Sequence
  chemically synthesized
tgaaaagattattttaaaaa

SEQ ID NO: 77843 - DNA, 20 bp, Artificial Sequence
  chemically synthesized
agtgaaaagattattttaaa

SEQ ID NO: 77844 - DNA, 20 bp, Artificial Sequence
  chemically synthesized
attactgaattattagtgaa

SEQ ID NO: 77845 - DNA, 20 bp, Artificial Sequence
  chemically synthesized
taatcttttcactaataatt

SEQ ID NO: 77846 - DNA, 20 bp, Artificial Sequence
  chemically synthesized
atctaaaattactgaattat

SEQ ID NO: 77847 - DNA, 20 bp, Artificial Sequence
  chemically synthesized
cactaataattcagtaattt

SEQ ID NO: 77848 - DNA, 20 bp, Artificial Sequence
  chemically synthesized
attcagtaattttagattca

SEQ ID NO: 77849 - DNA, 20 bp, Artificial Sequence
  chemically synthesized
cagtaattttagattcaaag

SEQ ID NO: 77850 - DNA, 20 bp, Artificial Sequence
  chemically synthesized
agtaattttagattcaaagt

SEQ ID NO: 77851 - DNA, 20 bp, Artificial Sequence
  chemically synthesized
attttagattcaaagtgggt

SEQ ID NO: 77852 - DNA, 20 bp, Artificial Sequence
  chemically synthesized
aaagtgggtcagatttcacc

SEQ ID NO: 77853 - DNA, 20 bp, Artificial Sequence
  chemically synthesized
gttgtatgcaagaggggtct

SEQ ID NO: 77854 - DNA, 20 bp, Artificial Sequence
  chemically synthesized
ttgattgttgtatgcaagag

SEQ ID NO: 77855 - DNA, 20 bp, Artificial Sequence
  chemically synthesized
gttgattgttgtatgcaaga

SEQ ID NO: 77856 - DNA, 20 bp, Artificial Sequence
  chemically synthesized
ggttgattgttgtatgcaag

SEQ ID NO: 77857 - DNA, 20 bp, Artificial Sequence
  chemically synthesized
gggttgattgttgtatgcaa

SEQ ID NO: 77858 - DNA, 20 bp, Artificial Sequence
  chemically synthesized
tggggttgattgttgtatgc

SEQ ID NO: 77859 - DNA, 20 bp, Artificial Sequence
  chemically synthesized
caacaatcaaccccaaaccc

SEQ ID NO: 77860 - DNA, 20 bp, Artificial Sequence
  chemically synthesized
ataaaactgcctagggtttg

SEQ ID NO: 77861 - DNA, 20 bp, Artificial Sequence
  chemically synthesized
aacaatcaaccccaaaccct

SEQ ID NO: 77862 - DNA, 20 bp, Artificial Sequence
  chemically synthesized
tataaaactgcctagggttt

SEQ ID NO: 77863 - DNA, 20 bp, Artificial Sequence
  chemically synthesized
ctataaaactgcctagggtt

SEQ ID NO: 77864 - DNA, 20 bp, Artificial Sequence
  chemically synthesized
aatcaaccccaaaccctagg

SEQ ID NO: 77865 - DNA, 20 bp, Artificial Sequence
  chemically synthesized
ttctcctataaaactgccta

SEQ ID NO: 77866 - DNA, 20 bp, Artificial Sequence
  chemically synthesized
tttctcctataaaactgcct

SEQ ID NO: 77867 - DNA, 20 bp, Artificial Sequence
  chemically synthesized
gtttctcctataaaactgcc

SEQ ID NO: 77868 - DNA, 20 bp, Artificial Sequence
  chemically synthesized
ccaaaccctaggcagtttta

SEQ ID NO: 77869 - DNA, 20 bp, Artificial Sequence
  chemically synthesized
caaaccctaggcagttttat

SEQ ID NO: 77870 - DNA, 20 bp, Artificial Sequence
  chemically synthesized
aaccctaggcagttttatag

SEQ ID NO: 77871 - DNA, 20 bp, Artificial Sequence
  chemically synthesized
gttgaaggaagacatttgca

SEQ ID NO: 77872 - DNA, 20 bp, Artificial Sequence
  chemically synthesized
ttttgtataaaggttgaagg

SEQ ID NO: 77873 - DNA, 20 bp, Artificial Sequence
  chemically synthesized
tttttttgtataaaggttga

SEQ ID NO: 77874 - DNA, 20 bp, Artificial Sequence
  chemically synthesized
ttttttttgtataaaggttg

SEQ ID NO: 77875 - DNA, 20 bp, Artificial Sequence
  chemically synthesized
tcaattttttttttgtataa

SEQ ID NO: 77876 - DNA, 20 bp, Artificial Sequence
  chemically synthesized
ctcaattttttttttgtata

SEQ ID NO: 77877 - DNA, 20 bp, Artificial Sequence
  chemically synthesized
ctttatacaaaaaaaaaatt

SEQ ID NO: 77878 - DNA, 20 bp, Artificial Sequence
  chemically synthesized
atacaaaaaaaaaattgaga

SEQ ID NO: 77879 - DNA, 20 bp, Artificial Sequence
  chemically synthesized
aaaaaattgagatggttcca

SEQ ID NO: 77880 - DNA, 20 bp, Artificial Sequence
  chemically synthesized
aaaaattgagatggttccaa

SEQ ID NO: 77881 - DNA, 20 bp, Artificial Sequence
  chemically synthesized
tgtgaataaaatattacctt

SEQ ID NO: 77882 - DNA, 20 bp, Artificial Sequence
  chemically synthesized
caaaggtaatattttattca

SEQ ID NO: 77883 - DNA, 20 bp, Artificial Sequence
  chemically synthesized
taatattttattcacagcat

SEQ ID NO: 77884 - DNA, 20 bp, Artificial Sequence
  chemically synthesized
ttattcacagcataagccaa

SEQ ID NO: 77885 - DNA, 20 bp, Artificial Sequence
  chemically synthesized
attcacagcataagccaacg

SEQ ID NO: 77886 - DNA, 20 bp, Artificial Sequence
  chemically synthesized
atgagcataaattactccgt

SEQ ID NO: 77887 - DNA, 20 bp, Artificial Sequence
  chemically synthesized
gtaatttatgctcatttgtt

SEQ ID NO: 77888 - DNA, 20 bp, Artificial Sequence
  chemically synthesized
gaaatacaggctaaacaaat

SEQ ID NO: 77889 - DNA, 20 bp, Artificial Sequence
  chemically synthesized
cataaggttaaaagaaatac

SEQ ID NO: 77890 - DNA, 20 bp, Artificial Sequence
  chemically synthesized
gcataaggttaaaagaaata

SEQ ID NO: 77891 - DNA, 20 bp, Artificial Sequence
  chemically synthesized
ccaataaagcataaggttaa

SEQ ID NO: 77892 - DNA, 20 bp, Artificial Sequence
  chemically synthesized
tgtgcatccaataaagcata

SEQ ID NO: 77893 - DNA, 20 bp, Artificial Sequence
  chemically synthesized
ttgtgcatccaataaagcat

SEQ ID NO: 77894 - DNA, 20 bp, Artificial Sequence
  chemically synthesized
cttttaaccttatgctttat

SEQ ID NO: 77895 - DNA, 20 bp, Artificial Sequence
  chemically synthesized
tgacttttgtgcatccaata

SEQ ID NO: 77896 - DNA, 20 bp, Artificial Sequence
  chemically synthesized
atgctttattggatgcacaa

SEQ ID NO: 77897 - DNA, 20 bp, Artificial Sequence
  chemically synthesized
cacaaaagtcaccctgatat

SEQ ID NO: 77898 - DNA, 20 bp, Artificial Sequence
  chemically synthesized
acaaaggttatccaatatca

SEQ ID NO: 77899 - DNA, 20 bp, Artificial Sequence
  chemically synthesized
cacaaaggttatccaatatc

SEQ ID NO: 77900 - DNA, 20 bp, Artificial Sequence
  chemically synthesized
ccacaaaggttatccaatat

SEQ ID NO: 77901 - DNA, 20 bp, Artificial Sequence
  chemically synthesized
ctgatattggataacctttg

SEQ ID NO: 77902 - DNA, 20 bp, Artificial Sequence
  chemically synthesized
gatattggataacctttgtg

SEQ ID NO: 77903 - DNA, 20 bp, Artificial Sequence
  chemically synthesized
atatactagaatctccacaa

SEQ ID NO: 77904 - DNA, 20 bp, Artificial Sequence
  chemically synthesized
aatatactagaatctccaca

SEQ ID NO: 77905 - DNA, 20 bp, Artificial Sequence
  chemically synthesized
gataacctttgtggagattc

SEQ ID NO: 77906 - DNA, 20 bp, Artificial Sequence
  chemically synthesized
ttgtggagattctagtatat

SEQ ID NO: 77907 - DNA, 20 bp, Artificial Sequence
  chemically synthesized
tgtggagattctagtatatt

SEQ ID NO: 77908 - DNA, 20 bp, Artificial Sequence
  chemically synthesized
ctttcacaaacccaatatac

SEQ ID NO: 77909 - DNA, 20 bp, Artificial Sequence
  chemically synthesized
ctagtatattgggtttgtga

SEQ ID NO: 77910 - DNA, 20 bp, Artificial Sequence
  chemically synthesized
tttgtgaaagtctaaaacaa

SEQ ID NO: 77911 - DNA, 20 bp, Artificial Sequence
  chemically synthesized
gagagaatggtccattgttt

SEQ ID NO: 77912 - DNA, 20 bp, Artificial Sequence
  chemically synthesized
ggctaaagcaagggagagaa

SEQ ID NO: 77913 - DNA, 20 bp, Artificial Sequence
  chemically synthesized
gatggggctaaagcaaggga

SEQ ID NO: 77914 - DNA, 20 bp, Artificial Sequence
  chemically synthesized
gggatggggctaaagcaagg

SEQ ID NO: 77915 - DNA, 20 bp, Artificial Sequence
  chemically synthesized
gaccattctctcccttgctt

SEQ ID NO: 77916 - DNA, 20 bp, Artificial Sequence
  chemically synthesized
cagggatggggctaaagcaa

SEQ ID NO: 77917 - DNA, 20 bp, Artificial Sequence
  chemically synthesized
gcagggatggggctaaagca

SEQ ID NO: 77918 - DNA, 20 bp, Artificial Sequence
  chemically synthesized
agcagggatggggctaaagc

SEQ ID NO: 77919 - DNA, 20 bp, Artificial Sequence
  chemically synthesized
ttctagcagggatggggcta

SEQ ID NO: 77920 - DNA, 20 bp, Artificial Sequence
  chemically synthesized
acatgtttctagcagggatg

SEQ ID NO: 77921 - DNA, 20 bp, Artificial Sequence
  chemically synthesized
cacatgtttctagcagggat

SEQ ID NO: 77922 - DNA, 20 bp, Artificial Sequence
  chemically synthesized
tgctttagccccatccctgc

SEQ ID NO: 77923 - DNA, 20 bp, Artificial Sequence
  chemically synthesized
tcacatgtttctagcaggga

SEQ ID NO: 77924 - DNA, 20 bp, Artificial Sequence
  chemically synthesized
gtcttcacatgtttctagca

SEQ ID NO: 77925 - DNA, 20 bp, Artificial Sequence
  chemically synthesized
ggtcttcacatgtttctagc

SEQ ID NO: 77926 - DNA, 20 bp, Artificial Sequence
  chemically synthesized
tggtcttcacatgtttctag

SEQ ID NO: 77927 - DNA, 20 bp, Artificial Sequence
  chemically synthesized
ttttggtcttcacatgtttc

SEQ ID NO: 77928 - DNA, 20 bp, Artificial Sequence
  chemically synthesized
atccctgctagaaacatgtg

SEQ ID NO: 77929 - DNA, 20 bp, Artificial Sequence
  chemically synthesized
tctgcttgccagttggtttt

SEQ ID NO: 77930 - DNA, 20 bp, Artificial Sequence
  chemically synthesized
tgtgaagaccaaaaaccaac

SEQ ID NO: 77931 - DNA, 20 bp, Artificial Sequence
  chemically synthesized
aagaccaaaaaccaactggc

SEQ ID NO: 77932 - DNA, 20 bp, Artificial Sequence
  chemically synthesized
ttcaccttctgcttgccagt

SEQ ID NO: 77933 - DNA, 20 bp, Artificial Sequence
  chemically synthesized
accaaaaaccaactggcaag

SEQ ID NO: 77934 - DNA, 20 bp, Artificial Sequence
  chemically synthesized
ctgcttcaccttctgcttgc

SEQ ID NO: 77935 - DNA, 20 bp, Artificial Sequence
  chemically synthesized
aaaaaccaactggcaagcag

SEQ ID NO: 77936 - DNA, 20 bp, Artificial Sequence
  chemically synthesized
aaaaccaactggcaagcaga

SEQ ID NO: 77937 - DNA, 20 bp, Artificial Sequence
  chemically synthesized
caactggcaagcagaaggtg

SEQ ID NO: 77938 - DNA, 20 bp, Artificial Sequence
  chemically synthesized
ctggcaagcagaaggtgaag

SEQ ID NO: 77939 - DNA, 20 bp, Artificial Sequence
  chemically synthesized
tggcaagcagaaggtgaagc

SEQ ID NO: 77940 - DNA, 20 bp, Artificial Sequence
  chemically synthesized
aggtaaaatgccgttgcata

SEQ ID NO: 77941 - DNA, 20 bp, Artificial Sequence
  chemically synthesized
agcaagcagactgtatgcaa

SEQ ID NO: 77942 - DNA, 20 bp, Artificial Sequence
  chemically synthesized
ttgcatacagtctgcttgct

SEQ ID NO: 77943 - DNA, 20 bp, Artificial Sequence
  chemically synthesized
tgcatacagtctgcttgctt

SEQ ID NO: 77944 - DNA, 20 bp, Artificial Sequence
  chemically synthesized
cttatctgcccccaagcaag

SEQ ID NO: 77945 - DNA, 20 bp, Artificial Sequence
  chemically synthesized
gcatacagtctgcttgcttg

SEQ ID NO: 77946 - DNA, 20 bp, Artificial Sequence
  chemically synthesized
catacagtctgcttgcttgg

SEQ ID NO: 77947 - DNA, 20 bp, Artificial Sequence
  chemically synthesized
tttcttatctgcccccaagc

SEQ ID NO: 77948 - DNA, 20 bp, Artificial Sequence
  chemically synthesized
acagtctgcttgcttggggg

SEQ ID NO: 77949 - DNA, 20 bp, Artificial Sequence
  chemically synthesized
taagtttcttatctgccccc

SEQ ID NO: 77950 - DNA, 20 bp, Artificial Sequence
  chemically synthesized
ctgcttgcttgggggcagat

SEQ ID NO: 77951 - DNA, 20 bp, Artificial Sequence
  chemically synthesized
cagataagaaacttaaatca

SEQ ID NO: 77952 - DNA, 20 bp, Artificial Sequence
  chemically synthesized
agataagaaacttaaatcac

SEQ ID NO: 77953 - DNA, 20 bp, Artificial Sequence
  chemically synthesized
atttaactgacctgtgattt

SEQ ID NO: 77954 - DNA, 20 bp, Artificial Sequence
  chemically synthesized
aagaaacttaaatcacaggt

SEQ ID NO: 77955 - DNA, 20 bp, Artificial Sequence
  chemically synthesized
taaatcacaggtcagttaaa

SEQ ID NO: 77956 - DNA, 20 bp, Artificial Sequence
  chemically synthesized
aaatcacaggtcagttaaat

SEQ ID NO: 77957 - DNA, 20 bp, Artificial Sequence
  chemically synthesized
ttaaatgggtattatttaat

SEQ ID NO: 77958 - DNA, 20 bp, Artificial Sequence
  chemically synthesized
tattatttaataagacctaa

SEQ ID NO: 77959 - DNA, 20 bp, Artificial Sequence
  chemically synthesized
attatttaataagacctaat

SEQ ID NO: 77960 - DNA, 20 bp, Artificial Sequence
  chemically synthesized
ttgtgaacctaaagcctatt

SEQ ID NO: 77961 - DNA, 20 bp, Artificial Sequence
  chemically synthesized
gttgtgaacctaaagcctat

SEQ ID NO: 77962 - DNA, 20 bp, Artificial Sequence
  chemically synthesized
taataagacctaataggctt

SEQ ID NO: 77963 - DNA, 20 bp, Artificial Sequence
  chemically synthesized
aataagacctaataggcttt

SEQ ID NO: 77964 - DNA, 20 bp, Artificial Sequence
  chemically synthesized
tatccattgttgtgaaccta

SEQ ID NO: 77965 - DNA, 20 bp, Artificial Sequence
  chemically synthesized
aggctttaggttcacaacaa

SEQ ID NO: 77966 - DNA, 20 bp, Artificial Sequence
  chemically synthesized
tttaggttcacaacaatgga

SEQ ID NO: 77967 - DNA, 20 bp, Artificial Sequence
  chemically synthesized
acaatggatagatctcaaaa

SEQ ID NO: 77968 - DNA, 20 bp, Artificial Sequence
  chemically synthesized
caatggatagatctcaaaat

SEQ ID NO: 77969 - DNA, 20 bp, Artificial Sequence
  chemically synthesized
aaaacattgtaacccatttt

SEQ ID NO: 77970 - DNA, 20 bp, Artificial Sequence
  chemically synthesized
aaaatgggttacaatgtttt

SEQ ID NO: 77971 - DNA, 20 bp, Artificial Sequence
  chemically synthesized
aatgggttacaatgttttaa

SEQ ID NO: 77972 - DNA, 20 bp, Artificial Sequence
  chemically synthesized
gggttacaatgttttaagag

SEQ ID NO: 77973 - DNA, 20 bp, Artificial Sequence
  chemically synthesized
ggttacaatgttttaagagt

SEQ ID NO: 77974 - DNA, 20 bp, Artificial Sequence
  chemically synthesized
atgttttaagagtaggaaaa

SEQ ID NO: 77975 - DNA, 20 bp, Artificial Sequence
  chemically synthesized
agtaggaaaaaagtaaatga

SEQ ID NO: 77976 - DNA, 20 bp, Artificial Sequence
  chemically synthesized
gtaggaaaaaagtaaatgaa

SEQ ID NO: 77977 - DNA, 20 bp, Artificial Sequence
  chemically synthesized
aaagtaaatgaaaggaaact

SEQ ID NO: 77978 - DNA, 20 bp, Artificial Sequence
  chemically synthesized
gtaaatgaaaggaaactcag

SEQ ID NO: 77979 - DNA, 20 bp, Artificial Sequence
  chemically synthesized
aatgaaaggaaactcagcag

SEQ ID NO: 77980 - DNA, 20 bp, Artificial Sequence
  chemically synthesized
accaatgataaactactgct

SEQ ID NO: 77981 - DNA, 20 bp, Artificial Sequence
  chemically synthesized
actcagcagtagtttatcat

SEQ ID NO: 77982 - DNA, 20 bp, Artificial Sequence
  chemically synthesized
atacattgatgtgttttttt

SEQ ID NO: 77983 - DNA, 20 bp, Artificial Sequence
  chemically synthesized
aacacatcaatgtattgcca

SEQ ID NO: 77984 - DNA, 20 bp, Artificial Sequence
  chemically synthesized
caaaagtgaatgagagtctt

SEQ ID NO: 77985 - DNA, 20 bp, Artificial Sequence
  chemically synthesized
gtagaaacaaaagtgaatga

SEQ ID NO: 77986 - DNA, 20 bp, Artificial Sequence
  chemically synthesized
aagtagaaacaaaagtgaat

SEQ ID NO: 77987 - DNA, 20 bp, Artificial Sequence
  chemically synthesized
caggaattaagtagaaacaa

SEQ ID NO: 77988 - DNA, 20 bp, Artificial Sequence
  chemically synthesized
gccgaagtacaggaattaag

SEQ ID NO: 77989 - DNA, 20 bp, Artificial Sequence
  chemically synthesized
tatgccgaagtacaggaatt

SEQ ID NO: 77990 - DNA, 20 bp, Artificial Sequence
  chemically synthesized
tctacttaattcctgtactt

SEQ ID NO: 77991 - DNA, 20 bp, Artificial Sequence
  chemically synthesized
ggcaatatatgccgaagtac

SEQ ID NO: 77992 - DNA, 20 bp, Artificial Sequence
  chemically synthesized
tggcaatatatgccgaagta

SEQ ID NO: 77993 - DNA, 20 bp, Artificial Sequence
  chemically synthesized
tttattggcaatatatgccg

SEQ ID NO: 77994 - DNA, 20 bp, Artificial Sequence
  chemically synthesized
acagagtgaagtcaatttat

SEQ ID NO: 77995 - DNA, 20 bp, Artificial Sequence
  chemically synthesized
gcaagttagtgaacagagtg

SEQ ID NO: 77996 - DNA, 20 bp, Artificial Sequence
  chemically synthesized
cataagcaagttagtgaaca

SEQ ID NO: 77997 - DNA, 20 bp, Artificial Sequence
  chemically synthesized
ggcataagcaagttagtgaa

SEQ ID NO: 77998 - DNA, 20 bp, Artificial Sequence
  chemically synthesized
ttaacacggcataagcaagt

SEQ ID NO: 77999 - DNA, 20 bp, Artificial Sequence
  chemically synthesized
gatcttaacacggcataagc

SEQ ID NO: 78000 - DNA, 20 bp, Artificial Sequence
  chemically synthesized
tcatgatcttaacacggcat

SEQ ID NO: 78001 - DNA, 20 bp, Artificial Sequence
  chemically synthesized
taacttgcttatgccgtgtt

SEQ ID NO: 78002 - DNA, 20 bp, Artificial Sequence
  chemically synthesized
ctatcatcatgatcttaaca

SEQ ID NO: 78003 - DNA, 20 bp, Artificial Sequence
  chemically synthesized
ccgtgttaagatcatgatga

SEQ ID NO: 78004 - DNA, 20 bp, Artificial Sequence
  chemically synthesized
gatagaatgtgaatatttga

SEQ ID NO: 78005 - DNA, 20 bp, Artificial Sequence
  chemically synthesized
atagaatgtgaatatttgat

SEQ ID NO: 78006 - DNA, 20 bp, Artificial Sequence
  chemically synthesized
tagaatgtgaatatttgata

SEQ ID NO: 78007 - DNA, 20 bp, Artificial Sequence
  chemically synthesized
tgtgaatatttgatagggaa

SEQ ID NO: 78008 - DNA, 20 bp, Artificial Sequence
  chemically synthesized
gatagggaaaagttctaaat

SEQ ID NO: 78009 - DNA, 20 bp, Artificial Sequence
  chemically synthesized
atagactcaaatgactcatt

SEQ ID NO: 78010 - DNA, 20 bp, Artificial Sequence
  chemically synthesized
aagttctaaatgagtcattt

SEQ ID NO: 78011 - DNA, 20 bp, Artificial Sequence
  chemically synthesized
tccgggattatgcatcatta

SEQ ID NO: 78012 - DNA, 20 bp, Artificial Sequence
  chemically synthesized
tctataatgatgcataatcc

SEQ ID NO: 78013 - DNA, 20 bp, Artificial Sequence
  chemically synthesized
ttttagaagtttggttttcc

SEQ ID NO: 78014 - DNA, 20 bp, Artificial Sequence
  chemically synthesized
tttttagaagtttggttttc

SEQ ID NO: 78015 - DNA, 20 bp, Artificial Sequence
  chemically synthesized
cacacttatttttagaagtt

SEQ ID NO: 78016 - DNA, 20 bp, Artificial Sequence
  chemically synthesized
cgaaacacacttatttttag

SEQ ID NO: 78017 - DNA, 20 bp, Artificial Sequence
  chemically synthesized
aaaaccaaacttctaaaaat

SEQ ID NO: 78018 - DNA, 20 bp, Artificial Sequence
  chemically synthesized
tttcgaaacacacttatttt

SEQ ID NO: 78019 - DNA, 20 bp, Artificial Sequence
  chemically synthesized
aaaataagtgtgtttcgaaa

SEQ ID NO: 78020 - DNA, 20 bp, Artificial Sequence
  chemically synthesized
aaataagtgtgtttcgaaac

SEQ ID NO: 78021 - DNA, 20 bp, Artificial Sequence
  chemically synthesized
agtgtgtttcgaaacaggac

SEQ ID NO: 78022 - DNA, 20 bp, Artificial Sequence
  chemically synthesized
gtgtttcgaaacaggactgg

SEQ ID NO: 78023 - DNA, 20 bp, Artificial Sequence
  chemically synthesized
tgtttcgaaacaggactggc

SEQ ID NO: 78024 - DNA, 20 bp, Artificial Sequence
  chemically synthesized
tcataaagttaagaacctgc

SEQ ID NO: 78025 - DNA, 20 bp, Artificial Sequence
  chemically synthesized
ttttttttcttcataaagtt

SEQ ID NO: 78026 - DNA, 20 bp, Artificial Sequence
  chemically synthesized
ggcaggttcttaactttatg

SEQ ID NO: 78027 - DNA, 20 bp, Artificial Sequence
  chemically synthesized
ggtaattttttttcttcata

SEQ ID NO: 78028 - DNA, 20 bp, Artificial Sequence
  chemically synthesized
ttttaaggaattgattttta

SEQ ID NO: 78029 - DNA, 20 bp, Artificial Sequence
  chemically synthesized
cataaaaatcaattccttaa

SEQ ID NO: 78030 - DNA, 20 bp, Artificial Sequence
  chemically synthesized
cagatttctattttctttta

SEQ ID NO: 78031 - DNA, 20 bp, Artificial Sequence
  chemically synthesized
acagatttctattttctttt

SEQ ID NO: 78032 - DNA, 20 bp, Artificial Sequence
  chemically synthesized
atcaattccttaaaagaaaa

SEQ ID NO: 78033 - DNA, 20 bp, Artificial Sequence
  chemically synthesized
aagaaaatagaaatctgtct

SEQ ID NO: 78034 - DNA, 20 bp, Artificial Sequence
  chemically synthesized
tggaggatctaacactaaga

SEQ ID NO: 78035 - DNA, 20 bp, Artificial Sequence
  chemically synthesized
atagaaatctgtcttagtgt

SEQ ID NO: 78036 - DNA, 20 bp, Artificial Sequence
  chemically synthesized
aggctggaggatctaacact

SEQ ID NO: 78037 - DNA, 20 bp, Artificial Sequence
  chemically synthesized
tgtcttagtgttagatcctc

SEQ ID NO: 78038 - DNA, 20 bp, Artificial Sequence
  chemically synthesized
cttaaccagaatgaggctgg

SEQ ID NO: 78039 - DNA, 20 bp, Artificial Sequence
  chemically synthesized
tcttaaccagaatgaggctg

SEQ ID NO: 78040 - DNA, 20 bp, Artificial Sequence
  chemically synthesized
tctcttaaccagaatgaggc

SEQ ID NO: 78041 - DNA, 20 bp, Artificial Sequence
  chemically synthesized
tagatcctccagcctcattc

SEQ ID NO: 78042 - DNA, 20 bp, Artificial Sequence
  chemically synthesized
aaattctcttaaccagaatg

SEQ ID NO: 78043 - DNA, 20 bp, Artificial Sequence
  chemically synthesized
caaattctcttaaccagaat

SEQ ID NO: 78044 - DNA, 20 bp, Artificial Sequence
  chemically synthesized
cctccagcctcattctggtt

SEQ ID NO: 78045 - DNA, 20 bp, Artificial Sequence
  chemically synthesized
tccagcctcattctggttaa

SEQ ID NO: 78046 - DNA, 20 bp, Artificial Sequence
  chemically synthesized
aaacgccaaattctcttaac

SEQ ID NO: 78047 - DNA, 20 bp, Artificial Sequence
  chemically synthesized
tcattctggttaagagaatt

SEQ ID NO: 78048 - DNA, 20 bp, Artificial Sequence
  chemically synthesized
gttaagagaatttggcgttt

SEQ ID NO: 78049 - DNA, 20 bp, Artificial Sequence
  chemically synthesized
ttaagagaatttggcgtttc

SEQ ID NO: 78050 - DNA, 20 bp, Artificial Sequence
  chemically synthesized
taagagaatttggcgtttca

SEQ ID NO: 78051 - DNA, 20 bp, Artificial Sequence
  chemically synthesized
gaatttggcgtttcagggct

SEQ ID NO: 78052 - DNA, 20 bp, Artificial Sequence
  chemically synthesized
ttaagtttccacagtgtgct

SEQ ID NO: 78053 - DNA, 20 bp, Artificial Sequence
  chemically synthesized
tttcagggctgagcacactg

SEQ ID NO: 78054 - DNA, 20 bp, Artificial Sequence
  chemically synthesized
caatatttattaagtttcca

SEQ ID NO: 78055 - DNA, 20 bp, Artificial Sequence
  chemically synthesized
tgtaaacctcaatatttatt

SEQ ID NO: 78056 - DNA, 20 bp, Artificial Sequence
  chemically synthesized
gtggaaacttaataaatatt

SEQ ID NO: 78057 - DNA, 20 bp, Artificial Sequence
  chemically synthesized
tggaaacttaataaatattg

SEQ ID NO: 78058 - DNA, 20 bp, Artificial Sequence
  chemically synthesized
tattgaggtttacaaacaaa

SEQ ID NO: 78059 - DNA, 20 bp, Artificial Sequence
  chemically synthesized
aaaagcataacaatgatatg

SEQ ID NO: 78060 - DNA, 20 bp, Artificial Sequence
  chemically synthesized
ttttcagtgttgttgaaaat

SEQ ID NO: 78061 - DNA, 20 bp, Artificial Sequence
  chemically synthesized
agtaagggcacattgatttt

SEQ ID NO: 78062 - DNA, 20 bp, Artificial Sequence
  chemically synthesized
aactgaattaggcagagtaa

SEQ ID NO: 78063 - DNA, 20 bp, Artificial Sequence
  chemically synthesized
taactgaattaggcagagta

SEQ ID NO: 78064 - DNA, 20 bp, Artificial Sequence
  chemically synthesized
ttaactgaattaggcagagt

SEQ ID NO: 78065 - DNA, 20 bp, Artificial Sequence
  chemically synthesized
tgagttaactgaattaggca

SEQ ID NO: 78066 - DNA, 20 bp, Artificial Sequence
  chemically synthesized
tgcccttactctgcctaatt

SEQ ID NO: 78067 - DNA, 20 bp, Artificial Sequence
  chemically synthesized
attgagttaactgaattagg

SEQ ID NO: 78068 - DNA, 20 bp, Artificial Sequence
  chemically synthesized
ataattgagttaactgaatt

SEQ ID NO: 78069 - DNA, 20 bp, Artificial Sequence
  chemically synthesized
aataattgagttaactgaat

SEQ ID NO: 78070 - DNA, 20 bp, Artificial Sequence
  chemically synthesized
caagtgtacattaaataatt

SEQ ID NO: 78071 - DNA, 20 bp, Artificial Sequence
  chemically synthesized
atttaatgtacacttgattt

SEQ ID NO: 78072 - DNA, 20 bp, Artificial Sequence
  chemically synthesized
tggtcaaacccactcaaatc

SEQ ID NO: 78073 - DNA, 20 bp, Artificial Sequence
  chemically synthesized
taatgtacacttgatttgag

SEQ ID NO: 78074 - DNA, 20 bp, Artificial Sequence
  chemically synthesized
aatgtacacttgatttgagt

SEQ ID NO: 78075 - DNA, 20 bp, Artificial Sequence
  chemically synthesized
gatttgagtgggtttgacca

SEQ ID NO: 78076 - DNA, 20 bp, Artificial Sequence
  chemically synthesized
atggaaaatggaaatagcta

SEQ ID NO: 78077 - DNA, 20 bp, Artificial Sequence
  chemically synthesized
tgttcaatggaaaatggaaa

SEQ ID NO: 78078 - DNA, 20 bp, Artificial Sequence
  chemically synthesized
gattaatgttcaatggaaaa

SEQ ID NO: 78079 - DNA, 20 bp, Artificial Sequence
  chemically synthesized
gcaatttgattaatgttcaa

SEQ ID NO: 78080 - DNA, 20 bp, Artificial Sequence
  chemically synthesized
aaaatgaaattttacattag

SEQ ID NO: 78081 - DNA, 20 bp, Artificial Sequence
  chemically synthesized
gaaaaaatgaaattttacat

SEQ ID NO: 78082 - DNA, 20 bp, Artificial Sequence
  chemically synthesized
atctgggagaggagaaggat

SEQ ID NO: 78083 - DNA, 20 bp, Artificial Sequence
  chemically synthesized
ctagaatctgggagaggaga

SEQ ID NO: 78084 - DNA, 20 bp, Artificial Sequence
  chemically synthesized
cctagaatctgggagaggag

SEQ ID NO: 78085 - DNA, 20 bp, Artificial Sequence
  chemically synthesized
ttctcatccttctcctctcc

SEQ ID NO: 78086 - DNA, 20 bp, Artificial Sequence
  chemically synthesized
tatcctagaatctgggagag

SEQ ID NO: 78087 - DNA, 20 bp, Artificial Sequence
  chemically synthesized
cttatcctagaatctgggag

SEQ ID NO: 78088 - DNA, 20 bp, Artificial Sequence
  chemically synthesized
ccttatcctagaatctggga

SEQ ID NO: 78089 - DNA, 20 bp, Artificial Sequence
  chemically synthesized
tcccttatcctagaatctgg

SEQ ID NO: 78090 - DNA, 20 bp, Artificial Sequence
  chemically synthesized
ccttctcctctcccagattc

SEQ ID NO: 78091 - DNA, 20 bp, Artificial Sequence
  chemically synthesized
cttctcctctcccagattct

SEQ ID NO: 78092 - DNA, 20 bp, Artificial Sequence
  chemically synthesized
tttcccttatcctagaatct

SEQ ID NO: 78093 - DNA, 20 bp, Artificial Sequence
  chemically synthesized
ttttcccttatcctagaatc

SEQ ID NO: 78094 - DNA, 20 bp, Artificial Sequence
  chemically synthesized
cctctcccagattctaggat

SEQ ID NO: 78095 - DNA, 20 bp, Artificial Sequence
  chemically synthesized
ctctcccagattctaggata

SEQ ID NO: 78096 - DNA, 20 bp, Artificial Sequence
  chemically synthesized
tctcccagattctaggataa

SEQ ID NO: 78097 - DNA, 20 bp, Artificial Sequence
  chemically synthesized
cttaaacttttcccttatcc

SEQ ID NO: 78098 - DNA, 20 bp, Artificial Sequence
  chemically synthesized
cagattctaggataagggaa

SEQ ID NO: 78099 - DNA, 20 bp, Artificial Sequence
  chemically synthesized
ctaggataagggaaaagttt

SEQ ID NO: 78100 - DNA, 20 bp, Artificial Sequence
  chemically synthesized
agtttcatgtctcttgttta

SEQ ID NO: 78101 - DNA, 20 bp, Artificial Sequence
  chemically synthesized
ttgcttttaactttaaacaa

SEQ ID NO: 78102 - DNA, 20 bp, Artificial Sequence
  chemically synthesized
atttgcttttaactttaaac

SEQ ID NO: 78103 - DNA, 20 bp, Artificial Sequence
  chemically synthesized
tgtctcttgtttaaagttaa

SEQ ID NO: 78104 - DNA, 20 bp, Artificial Sequence
  chemically synthesized
taaagttaaaagcaaatttt

SEQ ID NO: 78105 - DNA, 20 bp, Artificial Sequence
  chemically synthesized
tttaagacatctgtttccat

SEQ ID NO: 78106 - DNA, 20 bp, Artificial Sequence
  chemically synthesized
atgggataaactaatggaaa

SEQ ID NO: 78107 - DNA, 20 bp, Artificial Sequence
  chemically synthesized
agaattatgggataaactaa

SEQ ID NO: 78108 - DNA, 20 bp, Artificial Sequence
  chemically synthesized
gtatatgaaaagagaattat

SEQ ID NO: 78109 - DNA, 20 bp, Artificial Sequence
  chemically synthesized
ggtatatgaaaagagaatta

SEQ ID NO: 78110 - DNA, 20 bp, Artificial Sequence
  chemically synthesized
gggtgagtggtatatgaaaa

SEQ ID NO: 78111 - DNA, 20 bp, Artificial Sequence
  chemically synthesized
tagggtgagtggtatatgaa

SEQ ID NO: 78112 - DNA, 20 bp, Artificial Sequence
  chemically synthesized
tggttgtggtatagggtgag

SEQ ID NO: 78113 - DNA, 20 bp, Artificial Sequence
  chemically synthesized
tcatggttgtggtatagggt

SEQ ID NO: 78114 - DNA, 20 bp, Artificial Sequence
  chemically synthesized
aagttcatggttgtggtata

SEQ ID NO: 78115 - DNA, 20 bp, Artificial Sequence
  chemically synthesized
aaagttcatggttgtggtat

SEQ ID NO: 78116 - DNA, 20 bp, Artificial Sequence
  chemically synthesized
aaaagttcatggttgtggta

SEQ ID NO: 78117 - DNA, 20 bp, Artificial Sequence
  chemically synthesized
tgtgaaaaagttcatggttg

SEQ ID NO: 78118 - DNA, 20 bp, Artificial Sequence
  chemically synthesized
aatatctgtgaaaaagttca

SEQ ID NO: 78119 - DNA, 20 bp, Artificial Sequence
  chemically synthesized
cacaaccatgaactttttca

SEQ ID NO: 78120 - DNA, 20 bp, Artificial Sequence
  chemically synthesized
tgtattaaatatctgtgaaa

SEQ ID NO: 78121 - DNA, 20 bp, Artificial Sequence
  chemically synthesized
cattgttttttgcaccattt

SEQ ID NO: 78122 - DNA, 20 bp, Artificial Sequence
  chemically synthesized
attgttttttgcaccatttt

SEQ ID NO: 78123 - DNA, 20 bp, Artificial Sequence
  chemically synthesized
aaggaggatttttcccaaaa

SEQ ID NO: 78124 - DNA, 20 bp, Artificial Sequence
  chemically synthesized
gctgaagtggttgaggaagg

SEQ ID NO: 78125 - DNA, 20 bp, Artificial Sequence
  chemically synthesized
agctgaagtggttgaggaag

SEQ ID NO: 78126 - DNA, 20 bp, Artificial Sequence
  chemically synthesized
ttagctgaagtggttgagga

SEQ ID NO: 78127 - DNA, 20 bp, Artificial Sequence
  chemically synthesized
cttagctgaagtggttgagg

SEQ ID NO: 78128 - DNA, 20 bp, Artificial Sequence
  chemically synthesized
agtcttagctgaagtggttg

SEQ ID NO: 78129 - DNA, 20 bp, Artificial Sequence
  chemically synthesized
gagtcttagctgaagtggtt

SEQ ID NO: 78130 - DNA, 20 bp, Artificial Sequence
  chemically synthesized
tcctccttcctcaaccactt

SEQ ID NO: 78131 - DNA, 20 bp, Artificial Sequence
  chemically synthesized
gaaaagagtcttagctgaag

SEQ ID NO: 78132 - DNA, 20 bp, Artificial Sequence
  chemically synthesized
cttcctcaaccacttcagct

SEQ ID NO: 78133 - DNA, 20 bp, Artificial Sequence
  chemically synthesized
gtagaaaagagtcttagctg

SEQ ID NO: 78134 - DNA, 20 bp, Artificial Sequence
  chemically synthesized
gagaaagtagaaaagagtct

SEQ ID NO: 78135 - DNA, 20 bp, Artificial Sequence
  chemically synthesized
aactgggagaaagtagaaaa

SEQ ID NO: 78136 - DNA, 20 bp, Artificial Sequence
  chemically synthesized
tcaactgggagaaagtagaa

SEQ ID NO: 78137 - DNA, 20 bp, Artificial Sequence
  chemically synthesized
tgggatcaactgggagaaag

SEQ ID NO: 78138 - DNA, 20 bp, Artificial Sequence
  chemically synthesized
gactcttttctactttctcc

SEQ ID NO: 78139 - DNA, 20 bp, Artificial Sequence
  chemically synthesized
atgtgggatcaactgggaga

SEQ ID NO: 78140 - DNA, 20 bp, Artificial Sequence
  chemically synthesized
gatgatgtgggatcaactgg

SEQ ID NO: 78141 - DNA, 20 bp, Artificial Sequence
  chemically synthesized
gagatgatgtgggatcaact

SEQ ID NO: 78142 - DNA, 20 bp, Artificial Sequence
  chemically synthesized
agagatgatgtgggatcaac

SEQ ID NO: 78143 - DNA, 20 bp, Artificial Sequence
  chemically synthesized
agatgaaatagagatgatgt

SEQ ID NO: 78144 - DNA, 20 bp, Artificial Sequence
  chemically synthesized
gagatgaaatagagatgatg

SEQ ID NO: 78145 - DNA, 20 bp, Artificial Sequence
  chemically synthesized
ggtgaaatagagatgaaata

SEQ ID NO: 78146 - DNA, 20 bp, Artificial Sequence
  chemically synthesized
gaggtgaaatagagatgaaa

SEQ ID NO: 78147 - DNA, 20 bp, Artificial Sequence
  chemically synthesized
aatagagatgaggtgaaata

SEQ ID NO: 78148 - DNA, 20 bp, Artificial Sequence
  chemically synthesized
gaaatagagatgaggtgaaa

SEQ ID NO: 78149 - DNA, 20 bp, Artificial Sequence
  chemically synthesized
tgtgtatagaaatagagatg

SEQ ID NO: 78150 - DNA, 20 bp, Artificial Sequence
  chemically synthesized
ttgtgtatagaaatagagat

SEQ ID NO: 78151 - DNA, 20 bp, Artificial Sequence
  chemically synthesized
tatttttgtgtatagaaata

SEQ ID NO: 78152 - DNA, 20 bp, Artificial Sequence
  chemically synthesized
tatatttttgtgtatagaaa

SEQ ID NO: 78153 - DNA, 20 bp, Artificial Sequence
  chemically synthesized
ggagggtatatttttgtgta

SEQ ID NO: 78154 - DNA, 20 bp, Artificial Sequence
  chemically synthesized
aggctctgtgttcaggggga

SEQ ID NO: 78155 - DNA, 20 bp, Artificial Sequence
  chemically synthesized
gaggctctgtgttcaggggg

SEQ ID NO: 78156 - DNA, 20 bp, Artificial Sequence
  chemically synthesized
tgaggctctgtgttcagggg

SEQ ID NO: 78157 - DNA, 20 bp, Artificial Sequence
  chemically synthesized
cttgaggctctgtgttcagg

SEQ ID NO: 78158 - DNA, 20 bp, Artificial Sequence
  chemically synthesized
atataccctccccctgaaca

SEQ ID NO: 78159 - DNA, 20 bp, Artificial Sequence
  chemically synthesized
ccttgaggctctgtgttcag

SEQ ID NO: 78160 - DNA, 20 bp, Artificial Sequence
  chemically synthesized
cccttgaggctctgtgttca

SEQ ID NO: 78161 - DNA, 20 bp, Artificial Sequence
  chemically synthesized
ataccctccccctgaacaca

SEQ ID NO: 78162 - DNA, 20 bp, Artificial Sequence
  chemically synthesized
ccccttgaggctctgtgttc

SEQ ID NO: 78163 - DNA, 20 bp, Artificial Sequence
  chemically synthesized
accccttgaggctctgtgtt

SEQ ID NO: 78164 - DNA, 20 bp, Artificial Sequence
  chemically synthesized
ccccctgaacacagagcctc

SEQ ID NO: 78165 - DNA, 20 bp, Artificial Sequence
  chemically synthesized
cccctgaacacagagcctca

SEQ ID NO: 78166 - DNA, 20 bp, Artificial Sequence
  chemically synthesized
ccctgaacacagagcctcaa

SEQ ID NO: 78167 - DNA, 20 bp, Artificial Sequence
  chemically synthesized
cctgaacacagagcctcaag

SEQ ID NO: 78168 - DNA, 20 bp, Artificial Sequence
  chemically synthesized
gaacacagagcctcaagggg

SEQ ID NO: 78169 - DNA, 20 bp, Artificial Sequence
  chemically synthesized
cttactttgtccaccccttg

SEQ ID NO: 78170 - DNA, 20 bp, Artificial Sequence
  chemically synthesized
acttactttgtccacccctt

SEQ ID NO: 78171 - DNA, 20 bp, Artificial Sequence
  chemically synthesized
agagcctcaaggggtggaca

SEQ ID NO: 78172 - DNA, 20 bp, Artificial Sequence
  chemically synthesized
cctcaaggggtggacaaagt

SEQ ID NO: 78173 - DNA, 20 bp, Artificial Sequence
  chemically synthesized
acaaagtaagttataaaatg

SEQ ID NO: 78174 - DNA, 20 bp, Artificial Sequence
  chemically synthesized
caaagtaagttataaaatgt

SEQ ID NO: 78175 - DNA, 20 bp, Artificial Sequence
  chemically synthesized
ttataaaatgtaggcactcc

SEQ ID NO: 78176 - DNA, 20 bp, Artificial Sequence
  chemically synthesized
ataaaatgtaggcactcctg

SEQ ID NO: 78177 - DNA, 20 bp, Artificial Sequence
  chemically synthesized
aaatgtaggcactcctggag

SEQ ID NO: 78178 - DNA, 20 bp, Artificial Sequence
  chemically synthesized
atagctaacagcttctccag

SEQ ID NO: 78179 - DNA, 20 bp, Artificial Sequence
  chemically synthesized
gaatagctaacagcttctcc

SEQ ID NO: 78180 - DNA, 20 bp, Artificial Sequence
  chemically synthesized
tgaatagctaacagcttctc

SEQ ID NO: 78181 - DNA, 20 bp, Artificial Sequence
  chemically synthesized
ggcactcctggagaagctgt

SEQ ID NO: 78182 - DNA, 20 bp, Artificial Sequence
  chemically synthesized
tgctagatatgaatagctaa

SEQ ID NO: 78183 - DNA, 20 bp, Artificial Sequence
  chemically synthesized
atctacttgctagatatgaa

SEQ ID NO: 78184 - DNA, 20 bp, Artificial Sequence
  chemically synthesized
agctgttagctattcatatc

SEQ ID NO: 78185 - DNA, 20 bp, Artificial Sequence
  chemically synthesized
gttagctattcatatctagc

SEQ ID NO: 78186 - DNA, 20 bp, Artificial Sequence
  chemically synthesized
agctattcatatctagcaag

SEQ ID NO: 78187 - DNA, 20 bp, Artificial Sequence
  chemically synthesized
tttaagtaaaatctacttgc

SEQ ID NO: 78188 - DNA, 20 bp, Artificial Sequence
  chemically synthesized
gcaagtagattttacttaaa

SEQ ID NO: 78189 - DNA, 20 bp, Artificial Sequence
  chemically synthesized
gggatcagtcaacacttttt

SEQ ID NO: 78190 - DNA, 20 bp, Artificial Sequence
  chemically synthesized
atattaaaaatagttgggat

SEQ ID NO: 78191 - DNA, 20 bp, Artificial Sequence
  chemically synthesized
ctaggatattaaaaatagtt

SEQ ID NO: 78192 - DNA, 20 bp, Artificial Sequence
  chemically synthesized
tctaggatattaaaaatagt

SEQ ID NO: 78193 - DNA, 20 bp, Artificial Sequence
  chemically synthesized
tgaatctaggatattaaaaa

SEQ ID NO: 78194 - DNA, 20 bp, Artificial Sequence
  chemically synthesized
cccaactatttttaatatcc

SEQ ID NO: 78195 - DNA, 20 bp, Artificial Sequence
  chemically synthesized
tatttttaatatcctagatt

SEQ ID NO: 78196 - DNA, 20 bp, Artificial Sequence
  chemically synthesized
tttatagagtttctgaatct

SEQ ID NO: 78197 - DNA, 20 bp, Artificial Sequence
  chemically synthesized
ctttatagagtttctgaatc

SEQ ID NO: 78198 - DNA, 20 bp, Artificial Sequence
  chemically synthesized
ctagattcagaaactctata

SEQ ID NO: 78199 - DNA, 20 bp, Artificial Sequence
  chemically synthesized
tgataaaatagtactttata

SEQ ID NO: 78200 - DNA, 20 bp, Artificial Sequence
  chemically synthesized
gatgataaaatagtacttta

SEQ ID NO: 78201 - DNA, 20 bp, Artificial Sequence
  chemically synthesized
caaacatactgatgataaaa

SEQ ID NO: 78202 - DNA, 20 bp, Artificial Sequence
  chemically synthesized
ataaagtactattttatcat

SEQ ID NO: 78203 - DNA, 20 bp, Artificial Sequence
  chemically synthesized
tattttatcatcagtatgtt

SEQ ID NO: 78204 - DNA, 20 bp, Artificial Sequence
  chemically synthesized
tttatcatcagtatgtttgg

SEQ ID NO: 78205 - DNA, 20 bp, Artificial Sequence
  chemically synthesized
catcagtatgtttggtagaa

SEQ ID NO: 78206 - DNA, 20 bp, Artificial Sequence
  chemically synthesized
tatgtttggtagaaaagtgt

SEQ ID NO: 78207 - DNA, 20 bp, Artificial Sequence
  chemically synthesized
atgtttggtagaaaagtgta

SEQ ID NO: 78208 - DNA, 20 bp, Artificial Sequence
  chemically synthesized
gtttggtagaaaagtgtaag

SEQ ID NO: 78209 - DNA, 20 bp, Artificial Sequence
  chemically synthesized
ttaaatgtaattgtttttat

SEQ ID NO: 78210 - DNA, 20 bp, Artificial Sequence
  chemically synthesized
atgcaaaaaatatttacaca

SEQ ID NO: 78211 - DNA, 20 bp, Artificial Sequence
  chemically synthesized
aaatatttacacaaagtgaa

SEQ ID NO: 78212 - DNA, 20 bp, Artificial Sequence
  chemically synthesized
tctcaaactatatatatatt

SEQ ID NO: 78213 - DNA, 20 bp, Artificial Sequence
  chemically synthesized
tatgtgactaaatatatata

SEQ ID NO: 78214 - DNA, 20 bp, Artificial Sequence
  chemically synthesized
actaaatatatatatagttt

SEQ ID NO: 78215 - DNA, 20 bp, Artificial Sequence
  chemically synthesized
atatatatatagtttgagac

SEQ ID NO: 78216 - DNA, 20 bp, Artificial Sequence
  chemically synthesized
tatatatatagtttgagaca

SEQ ID NO: 78217 - DNA, 20 bp, Artificial Sequence
  chemically synthesized
tccaggctgagtgacaaagc

SEQ ID NO: 78218 - DNA, 20 bp, Artificial Sequence
  chemically synthesized
caaggtcttgctttgtcact

SEQ ID NO: 78219 - DNA, 20 bp, Artificial Sequence
  chemically synthesized
gtactccaggctgagtgaca

SEQ ID NO: 78220 - DNA, 20 bp, Artificial Sequence
  chemically synthesized
tcttgctttgtcactcagcc

SEQ ID NO: 78221 - DNA, 20 bp, Artificial Sequence
  chemically synthesized
ttgctttgtcactcagcctg

SEQ ID NO: 78222 - DNA, 20 bp, Artificial Sequence
  chemically synthesized
actccactgtactccaggct

SEQ ID NO: 78223 - DNA, 20 bp, Artificial Sequence
  chemically synthesized
ttgtcactcagcctggagta

SEQ ID NO: 78224 - DNA, 20 bp, Artificial Sequence
  chemically synthesized
tgttcactccactgtactcc

SEQ ID NO: 78225 - DNA, 20 bp, Artificial Sequence
  chemically synthesized
ctgttcactccactgtactc

SEQ ID NO: 78226 - DNA, 20 bp, Artificial Sequence
  chemically synthesized
tcactcagcctggagtacag

SEQ ID NO: 78227 - DNA, 20 bp, Artificial Sequence
  chemically synthesized
actcagcctggagtacagtg

SEQ ID NO: 78228 - DNA, 20 bp, Artificial Sequence
  chemically synthesized
ctggagtacagtggagtgaa

SEQ ID NO: 78229 - DNA, 20 bp, Artificial Sequence
  chemically synthesized
tggagtacagtggagtgaac

SEQ ID NO: 78230 - DNA, 20 bp, Artificial Sequence
  chemically synthesized
ggagtacagtggagtgaaca

SEQ ID NO: 78231 - DNA, 20 bp, Artificial Sequence
  chemically synthesized
ggagtgaacagggcacactg

SEQ ID NO: 78232 - DNA, 20 bp, Artificial Sequence
  chemically synthesized
agcacaggaggttgaggctg

SEQ ID NO: 78233 - DNA, 20 bp, Artificial Sequence
  chemically synthesized
tgtttgagcacaggaggttg

SEQ ID NO: 78234 - DNA, 20 bp, Artificial Sequence
  chemically synthesized
ctgtttgagcacaggaggtt

SEQ ID NO: 78235 - DNA, 20 bp, Artificial Sequence
  chemically synthesized
gaggactgtttgagcacagg

SEQ ID NO: 78236 - DNA, 20 bp, Artificial Sequence
  chemically synthesized
ggaggactgtttgagcacag

SEQ ID NO: 78237 - DNA, 20 bp, Artificial Sequence
  chemically synthesized
caggaggactgtttgagcac

SEQ ID NO: 78238 - DNA, 20 bp, Artificial Sequence
  chemically synthesized
gcaggaggactgtttgagca

SEQ ID NO: 78239 - DNA, 20 bp, Artificial Sequence
  chemically synthesized
ctcaacctcctgtgctcaaa

SEQ ID NO: 78240 - DNA, 20 bp, Artificial Sequence
  chemically synthesized
ctggggcaggaggactgttt

SEQ ID NO: 78241 - DNA, 20 bp, Artificial Sequence
  chemically synthesized
ctcaaacagtcctcctgccc

SEQ ID NO: 78242 - DNA, 20 bp, Artificial Sequence
  chemically synthesized
acccgaaaggctggggcagg

SEQ ID NO: 78243 - DNA, 20 bp, Artificial Sequence
  chemically synthesized
tacccgaaaggctggggcag

SEQ ID NO: 78244 - DNA, 20 bp, Artificial Sequence
  chemically synthesized
gctacccgaaaggctggggc

SEQ ID NO: 78245 - DNA, 20 bp, Artificial Sequence
  chemically synthesized
agctacccgaaaggctgggg

SEQ ID NO: 78246 - DNA, 20 bp, Artificial Sequence
  chemically synthesized
cccagctacccgaaaggctg

SEQ ID NO: 78247 - DNA, 20 bp, Artificial Sequence
  chemically synthesized
gtcctcctgccccagccttt

SEQ ID NO: 78248 - DNA, 20 bp, Artificial Sequence
  chemically synthesized
tcccagctacccgaaaggct

SEQ ID NO: 78249 - DNA, 20 bp, Artificial Sequence
  chemically synthesized
tcctcctgccccagcctttc

SEQ ID NO: 78250 - DNA, 20 bp, Artificial Sequence
  chemically synthesized
gtcccagctacccgaaaggc

SEQ ID NO: 78251 - DNA, 20 bp, Artificial Sequence
  chemically synthesized
tcctgccccagcctttcggg

SEQ ID NO: 78252 - DNA, 20 bp, Artificial Sequence
  chemically synthesized
tgtagtcccagctacccgaa

SEQ ID NO: 78253 - DNA, 20 bp, Artificial Sequence
  chemically synthesized
ctgtagtcccagctacccga

SEQ ID NO: 78254 - DNA, 20 bp, Artificial Sequence
  chemically synthesized
gccccagcctttcgggtagc

SEQ ID NO: 78255 - DNA, 20 bp, Artificial Sequence
  chemically synthesized
ccccagcctttcgggtagct

SEQ ID NO: 78256 - DNA, 20 bp, Artificial Sequence
  chemically synthesized
ctttcgggtagctgggacta

SEQ ID NO: 78257 - DNA, 20 bp, Artificial Sequence
  chemically synthesized
gtggcatgtgtctgtagtcc

SEQ ID NO: 78258 - DNA, 20 bp, Artificial Sequence
  chemically synthesized
ggtgtggtggcatgtgtctg

SEQ ID NO: 78259 - DNA, 20 bp, Artificial Sequence
  chemically synthesized
cagacacatgccaccacacc

SEQ ID NO: 78260 - DNA, 20 bp, Artificial Sequence
  chemically synthesized
caaaaattaaccaggtgtgg

SEQ ID NO: 78261 - DNA, 20 bp, Artificial Sequence
  chemically synthesized
atacaaaaattaaccaggtg

SEQ ID NO: 78262 - DNA, 20 bp, Artificial Sequence
  chemically synthesized
aaaaaatacaaaaattaacc

SEQ ID NO: 78263 - DNA, 20 bp, Artificial Sequence
  chemically synthesized
caaaaaatacaaaaattaac

SEQ ID NO: 78264 - DNA, 20 bp, Artificial Sequence
  chemically synthesized
tttgtattttttgtccaaac

SEQ ID NO: 78265 - DNA, 20 bp, Artificial Sequence
  chemically synthesized
ttgtattttttgtccaaacg

SEQ ID NO: 78266 - DNA, 20 bp, Artificial Sequence
  chemically synthesized
caacatagtgaaacctcgtt

SEQ ID NO: 78267 - DNA, 20 bp, Artificial Sequence
  chemically synthesized
cgaggtttcactatgttgtc

SEQ ID NO: 78268 - DNA, 20 bp, Artificial Sequence
  chemically synthesized
taagaccagcctggacaaca

SEQ ID NO: 78269 - DNA, 20 bp, Artificial Sequence
  chemically synthesized
gaggtttcactatgttgtcc

SEQ ID NO: 78270 - DNA, 20 bp, Artificial Sequence
  chemically synthesized
tttcactatgttgtccaggc

SEQ ID NO: 78271 - DNA, 20 bp, Artificial Sequence
  chemically synthesized
tcaggagtttaagaccagcc

SEQ ID NO: 78272 - DNA, 20 bp, Artificial Sequence
  chemically synthesized
tgagctcaggagtttaagac

SEQ ID NO: 78273 - DNA, 20 bp, Artificial Sequence
  chemically synthesized
ttgcatgagctcaggagttt

SEQ ID NO: 78274 - DNA, 20 bp, Artificial Sequence
  chemically synthesized
caggctggtcttaaactcct

SEQ ID NO: 78275 - DNA, 20 bp, Artificial Sequence
  chemically synthesized
ggtgggttgcatgagctcag

SEQ ID NO: 78276 - DNA, 20 bp, Artificial Sequence
  chemically synthesized
tgggtgggttgcatgagctc

SEQ ID NO: 78277 - DNA, 20 bp, Artificial Sequence
  chemically synthesized
gtgggtgggttgcatgagct

SEQ ID NO: 78278 - DNA, 20 bp, Artificial Sequence
  chemically synthesized
ccgaggtgggtgggttgcat

SEQ ID NO: 78279 - DNA, 20 bp, Artificial Sequence
  chemically synthesized
tttgggaggccgaggtgggt

SEQ ID NO: 78280 - DNA, 20 bp, Artificial Sequence
  chemically synthesized
ctcatgcaacccacccacct

SEQ ID NO: 78281 - DNA, 20 bp, Artificial Sequence
  chemically synthesized
ctttgggaggccgaggtggg

SEQ ID NO: 78282 - DNA, 20 bp, Artificial Sequence
  chemically synthesized
gcactttgggaggccgaggt

SEQ ID NO: 78283 - DNA, 20 bp, Artificial Sequence
  chemically synthesized
agcactttgggaggccgagg

SEQ ID NO: 78284 - DNA, 20 bp, Artificial Sequence
  chemically synthesized
cccagcactttgggaggccg

SEQ ID NO: 78285 - DNA, 20 bp, Artificial Sequence
  chemically synthesized
tcccagcactttgggaggcc

SEQ ID NO: 78286 - DNA, 20 bp, Artificial Sequence
  chemically synthesized
ccacccacctcggcctccca

SEQ ID NO: 78287 - DNA, 20 bp, Artificial Sequence
  chemically synthesized
tgtaatcccagcactttggg

SEQ ID NO: 78288 - DNA, 20 bp, Artificial Sequence
  chemically synthesized
ctgtaatcccagcactttgg

SEQ ID NO: 78289 - DNA, 20 bp, Artificial Sequence
  chemically synthesized
acctcggcctcccaaagtgc

SEQ ID NO: 78290 - DNA, 20 bp, Artificial Sequence
  chemically synthesized
gcctgtaatcccagcacttt

SEQ ID NO: 78291 - DNA, 20 bp, Artificial Sequence
  chemically synthesized
cctcggcctcccaaagtgct

SEQ ID NO: 78292 - DNA, 20 bp, Artificial Sequence
  chemically synthesized
cgcctgtaatcccagcactt

SEQ ID NO: 78293 - DNA, 20 bp, Artificial Sequence
  chemically synthesized
ctcccaaagtgctgggatta

SEQ ID NO: 78294 - DNA, 20 bp, Artificial Sequence
  chemically synthesized
tcccaaagtgctgggattac

SEQ ID NO: 78295 - DNA, 20 bp, Artificial Sequence
  chemically synthesized
gtggctcacgcctgtaatcc

SEQ ID NO: 78296 - DNA, 20 bp, Artificial Sequence
  chemically synthesized
agtgctgggattacaggcgt

SEQ ID NO: 78297 - DNA, 20 bp, Artificial Sequence
  chemically synthesized
attacaggcgtgagccacca

SEQ ID NO: 78298 - DNA, 20 bp, Artificial Sequence
  chemically synthesized
caggcgtgagccaccacggc

SEQ ID NO: 78299 - DNA, 20 bp, Artificial Sequence
  chemically synthesized
ttagtcatggccggccgtgg

SEQ ID NO: 78300 - DNA, 20 bp, Artificial Sequence
  chemically synthesized
tatttagtcatggccggccg

SEQ ID NO: 78301 - DNA, 20 bp, Artificial Sequence
  chemically synthesized
taaaaatatttagtcatggc

SEQ ID NO: 78302 - DNA, 20 bp, Artificial Sequence
  chemically synthesized
acgttaaaaatatttagtca

SEQ ID NO: 78303 - DNA, 20 bp, Artificial Sequence
  chemically synthesized
tttttaacgttaaaaatatt

SEQ ID NO: 78304 - DNA, 20 bp, Artificial Sequence
  chemically synthesized
ttaacgttaaaaattaatac

SEQ ID NO: 78305 - DNA, 20 bp, Artificial Sequence
  chemically synthesized
taacgttaaaaattaatact

SEQ ID NO: 78306 - DNA, 20 bp, Artificial Sequence
  chemically synthesized
cgttaaaaattaatactggg

SEQ ID NO: 78307 - DNA, 20 bp, Artificial Sequence
  chemically synthesized
gttaaaaattaatactggga

SEQ ID NO: 78308 - DNA, 20 bp, Artificial Sequence
  chemically synthesized
aaaattaatactgggaaggc

SEQ ID NO: 78309 - DNA, 20 bp, Artificial Sequence
  chemically synthesized
aacagcataacttgccttcc

SEQ ID NO: 78310 - DNA, 20 bp, Artificial Sequence
  chemically synthesized
gggaaggcaagttatgctgt

SEQ ID NO: 78311 - DNA, 20 bp, Artificial Sequence
  chemically synthesized
gggttgcttcagatgaccaa

SEQ ID NO: 78312 - DNA, 20 bp, Artificial Sequence
  chemically synthesized
gttatgctgttggtcatctg

SEQ ID NO: 78313 - DNA, 20 bp, Artificial Sequence
  chemically synthesized
gtacaattttggggttgctt

SEQ ID NO: 78314 - DNA, 20 bp, Artificial Sequence
  chemically synthesized
atgacactggtacaattttg

SEQ ID NO: 78315 - DNA, 20 bp, Artificial Sequence
  chemically synthesized
aatgacactggtacaatttt

SEQ ID NO: 78316 - DNA, 20 bp, Artificial Sequence
  chemically synthesized
taatgacactggtacaattt

SEQ ID NO: 78317 - DNA, 20 bp, Artificial Sequence
  chemically synthesized
aagcaaccccaaaattgtac

SEQ ID NO: 78318 - DNA, 20 bp, Artificial Sequence
  chemically synthesized
tgttggtattttaatgacac

SEQ ID NO: 78319 - DNA, 20 bp, Artificial Sequence
  chemically synthesized
cagtgtcattaaaataccaa

SEQ ID NO: 78320 - DNA, 20 bp, Artificial Sequence
  chemically synthesized
agtgtcattaaaataccaac

SEQ ID NO: 78321 - DNA, 20 bp, Artificial Sequence
  chemically synthesized
tttatttcattttttcctgt

SEQ ID NO: 78322 - DNA, 20 bp, Artificial Sequence
  chemically synthesized
aatgaaataaaccaccgtca

SEQ ID NO: 78323 - DNA, 20 bp, Artificial Sequence
  chemically synthesized
cttgtggaagactttgacgg

SEQ ID NO: 78324 - DNA, 20 bp, Artificial Sequence
  chemically synthesized
tcacttgtggaagactttga

SEQ ID NO: 78325 - DNA, 20 bp, Artificial Sequence
  chemically synthesized
ccaccgtcaaagtcttccac

SEQ ID NO: 78326 - DNA, 20 bp, Artificial Sequence
  chemically synthesized
tttctaaatctcacttgtgg

SEQ ID NO: 78327 - DNA, 20 bp, Artificial Sequence
  chemically synthesized
cgtcaaagtcttccacaagt

SEQ ID NO: 78328 - DNA, 20 bp, Artificial Sequence
  chemically synthesized
tcttttctaaatctcacttg

SEQ ID NO: 78329 - DNA, 20 bp, Artificial Sequence
  chemically synthesized
agtcttccacaagtgagatt

SEQ ID NO: 78330 - DNA, 20 bp, Artificial Sequence
  chemically synthesized
tccacaagtgagatttagaa

SEQ ID NO: 78331 - DNA, 20 bp, Artificial Sequence
  chemically synthesized
acaagtgagatttagaaaag

SEQ ID NO: 78332 - DNA, 20 bp, Artificial Sequence
  chemically synthesized
ggaaccttgaaatgaataaa

SEQ ID NO: 78333 - DNA, 20 bp, Artificial Sequence
  chemically synthesized
agaagccatttattcatttc

SEQ ID NO: 78334 - DNA, 20 bp, Artificial Sequence
  chemically synthesized
gaagccatttattcatttca

SEQ ID NO: 78335 - DNA, 20 bp, Artificial Sequence
  chemically synthesized
ttattcatttcaaggttcct

SEQ ID NO: 78336 - DNA, 20 bp, Artificial Sequence
  chemically synthesized
tagggagcattgtttcgctt

SEQ ID NO: 78337 - DNA, 20 bp, Artificial Sequence
  chemically synthesized
atagggagcattgtttcgct

SEQ ID NO: 78338 - DNA, 20 bp, Artificial Sequence
  chemically synthesized
agatatgggagcatcatagg

SEQ ID NO: 78339 - DNA, 20 bp, Artificial Sequence
  chemically synthesized
ttagatatgggagcatcata

SEQ ID NO: 78340 - DNA, 20 bp, Artificial Sequence
  chemically synthesized
tttagatatgggagcatcat

SEQ ID NO: 78341 - DNA, 20 bp, Artificial Sequence
  chemically synthesized
gtttagatatgggagcatca

SEQ ID NO: 78342 - DNA, 20 bp, Artificial Sequence
  chemically synthesized
gattaatagtttagatatgg

SEQ ID NO: 78343 - DNA, 20 bp, Artificial Sequence
  chemically synthesized
ttgattaatagtttagatat

SEQ ID NO: 78344 - DNA, 20 bp, Artificial Sequence
  chemically synthesized
attgattaatagtttagata

SEQ ID NO: 78345 - DNA, 20 bp, Artificial Sequence
  chemically synthesized
tgttggattgattaatagtt

SEQ ID NO: 78346 - DNA, 20 bp, Artificial Sequence
  chemically synthesized
cctcttgttggattgattaa

SEQ ID NO: 78347 - DNA, 20 bp, Artificial Sequence
  chemically synthesized
aaactattaatcaatccaac

SEQ ID NO: 78348 - DNA, 20 bp, Artificial Sequence
  chemically synthesized
actattaatcaatccaacaa

SEQ ID NO: 78349 - DNA, 20 bp, Artificial Sequence
  chemically synthesized
ctattaatcaatccaacaag

SEQ ID NO: 78350 - DNA, 20 bp, Artificial Sequence
  chemically synthesized
gcaggcacacagcctcttgt

SEQ ID NO: 78351 - DNA, 20 bp, Artificial Sequence
  chemically synthesized
taaaaatgaatgcaggcaca

SEQ ID NO: 78352 - DNA, 20 bp, Artificial Sequence
  chemically synthesized
tttagtttaaaaatgaatgc

SEQ ID NO: 78353 - DNA, 20 bp, Artificial Sequence
  chemically synthesized
atttagtttaaaaatgaatg

SEQ ID NO: 78354 - DNA, 20 bp, Artificial Sequence
  chemically synthesized
catttttaaactaaatcttc

SEQ ID NO: 78355 - DNA, 20 bp, Artificial Sequence
  chemically synthesized
ttatcaatatccagaagatt

SEQ ID NO: 78356 - DNA, 20 bp, Artificial Sequence
  chemically synthesized
ttatatttatcaatatccag

SEQ ID NO: 78357 - DNA, 20 bp, Artificial Sequence
  chemically synthesized
cttttatatttatcaatatc

SEQ ID NO: 78358 - DNA, 20 bp, Artificial Sequence
  chemically synthesized
ctggatattgataaatataa

SEQ ID NO: 78359 - DNA, 20 bp, Artificial Sequence
  chemically synthesized
atatttattacttgtaattg

SEQ ID NO: 78360 - DNA, 20 bp, Artificial Sequence
  chemically synthesized
gttagcgtttcttcaattac

SEQ ID NO: 78361 - DNA, 20 bp, Artificial Sequence
  chemically synthesized
agacatattttgtgtagtgt

SEQ ID NO: 78362 - DNA, 20 bp, Artificial Sequence
  chemically synthesized
acctgaagacatattttgtg

SEQ ID NO: 78363 - DNA, 20 bp, Artificial Sequence
  chemically synthesized
cactacacaaaatatgtctt

SEQ ID NO: 78364 - DNA, 20 bp, Artificial Sequence
  chemically synthesized
actacacaaaatatgtcttc

SEQ ID NO: 78365 - DNA, 20 bp, Artificial Sequence
  chemically synthesized
agctactgtgtatgtacctg

SEQ ID NO: 78366 - DNA, 20 bp, Artificial Sequence
  chemically synthesized
tatgtcttcaggtacataca

SEQ ID NO: 78367 - DNA, 20 bp, Artificial Sequence
  chemically synthesized
gtcttcaggtacatacacag

SEQ ID NO: 78368 - DNA, 20 bp, Artificial Sequence
  chemically synthesized
catacacagtagctttacta

SEQ ID NO: 78369 - DNA, 20 bp, Artificial Sequence
  chemically synthesized
agaaccaatattccatagta

SEQ ID NO: 78370 - DNA, 20 bp, Artificial Sequence
  chemically synthesized
ttctgagaaccaatattcca

SEQ ID NO: 78371 - DNA, 20 bp, Artificial Sequence
  chemically synthesized
gtagctttactatggaatat

SEQ ID NO: 78372 - DNA, 20 bp, Artificial Sequence
  chemically synthesized
tactatggaatattggttct

SEQ ID NO: 78373 - DNA, 20 bp, Artificial Sequence
  chemically synthesized
ctggttcagagatacattct

SEQ ID NO: 78374 - DNA, 20 bp, Artificial Sequence
  chemically synthesized
ctcagaatgtatctctgaac

SEQ ID NO: 78375 - DNA, 20 bp, Artificial Sequence
  chemically synthesized
ttcatgatgctgctggttca

SEQ ID NO: 78376 - DNA, 20 bp, Artificial Sequence
  chemically synthesized
agaatgtatctctgaaccag

SEQ ID NO: 78377 - DNA, 20 bp, Artificial Sequence
  chemically synthesized
tgttcatgatgctgctggtt

SEQ ID NO: 78378 - DNA, 20 bp, Artificial Sequence
  chemically synthesized
ccaggtgttcatgatgctgc

SEQ ID NO: 78379 - DNA, 20 bp, Artificial Sequence
  chemically synthesized
ccagcagcatcatgaacacc

SEQ ID NO: 78380 - DNA, 20 bp, Artificial Sequence
  chemically synthesized
cagcagcatcatgaacacct

SEQ ID NO: 78381 - DNA, 20 bp, Artificial Sequence
  chemically synthesized
catcatgaacacctgggaac

SEQ ID NO: 78382 - DNA, 20 bp, Artificial Sequence
  chemically synthesized
agaagtcccaacttgttccc

SEQ ID NO: 78383 - DNA, 20 bp, Artificial Sequence
  chemically synthesized
aagaagtcccaacttgttcc

SEQ ID NO: 78384 - DNA, 20 bp, Artificial Sequence
  chemically synthesized
atgaacacctgggaacaagt

SEQ ID NO: 78385 - DNA, 20 bp, Artificial Sequence
  chemically synthesized
tgaacacctgggaacaagtt

SEQ ID NO: 78386 - DNA, 20 bp, Artificial Sequence
  chemically synthesized
gggaacaagttgggacttct

SEQ ID NO: 78387 - DNA, 20 bp, Artificial Sequence
  chemically synthesized
atgtctggggcaaggctaag

SEQ ID NO: 78388 - DNA, 20 bp, Artificial Sequence
  chemically synthesized
aaaatgtctggggcaaggct

SEQ ID NO: 78389 - DNA, 20 bp, Artificial Sequence
  chemically synthesized
gggacttcttagccttgccc

SEQ ID NO: 78390 - DNA, 20 bp, Artificial Sequence
  chemically synthesized
gattcaaaatgtctggggca

SEQ ID NO: 78391 - DNA, 20 bp, Artificial Sequence
  chemically synthesized
tgattcaaaatgtctggggc

SEQ ID NO: 78392 - DNA, 20 bp, Artificial Sequence
  chemically synthesized
ttcctgattcaaaatgtctg

SEQ ID NO: 78393 - DNA, 20 bp, Artificial Sequence
  chemically synthesized
gttcctgattcaaaatgtct

SEQ ID NO: 78394 - DNA, 20 bp, Artificial Sequence
  chemically synthesized
agttcctgattcaaaatgtc

SEQ ID NO: 78395 - DNA, 20 bp, Artificial Sequence
  chemically synthesized
ttgccccagacattttgaat

SEQ ID NO: 78396 - DNA, 20 bp, Artificial Sequence
  chemically synthesized
tgccccagacattttgaatc

SEQ ID NO: 78397 - DNA, 20 bp, Artificial Sequence
  chemically synthesized
acattttgaatcaggaactc

SEQ ID NO: 78398 - DNA, 20 bp, Artificial Sequence
  chemically synthesized
cattttgaatcaggaactct

SEQ ID NO: 78399 - DNA, 20 bp, Artificial Sequence
  chemically synthesized
attttgaatcaggaactctg

SEQ ID NO: 78400 - DNA, 20 bp, Artificial Sequence
  chemically synthesized
ttgaatcaggaactctgggg

SEQ ID NO: 78401 - DNA, 20 bp, Artificial Sequence
  chemically synthesized
tgaatcaggaactctgggga

SEQ ID NO: 78402 - DNA, 20 bp, Artificial Sequence
  chemically synthesized
gaatcaggaactctggggaa

SEQ ID NO: 78403 - DNA, 20 bp, Artificial Sequence
  chemically synthesized
gttggtgaaccccttcccca

SEQ ID NO: 78404 - DNA, 20 bp, Artificial Sequence
  chemically synthesized
aatcaggaactctggggaag

SEQ ID NO: 78405 - DNA, 20 bp, Artificial Sequence
  chemically synthesized
aggttggtgaaccccttccc

SEQ ID NO: 78406 - DNA, 20 bp, Artificial Sequence
  chemically synthesized
gggaaggggttcaccaacct

SEQ ID NO: 78407 - DNA, 20 bp, Artificial Sequence
  chemically synthesized
gggcttgtagaaactcaggt

SEQ ID NO: 78408 - DNA, 20 bp, Artificial Sequence
  chemically synthesized
tggagggcttgtagaaactc

SEQ ID NO: 78409 - DNA, 20 bp, Artificial Sequence
  chemically synthesized
ctggagggcttgtagaaact

SEQ ID NO: 78410 - DNA, 20 bp, Artificial Sequence
  chemically synthesized
tcaccaacctgagtttctac

SEQ ID NO: 78411 - DNA, 20 bp, Artificial Sequence
  chemically synthesized
agaatcacctggagggcttg

SEQ ID NO: 78412 - DNA, 20 bp, Artificial Sequence
  chemically synthesized
ctgagtttctacaagccctc

SEQ ID NO: 78413 - DNA, 20 bp, Artificial Sequence
  chemically synthesized
tgagtttctacaagccctcc

SEQ ID NO: 78414 - DNA, 20 bp, Artificial Sequence
  chemically synthesized
atacatcagaatcacctgga

SEQ ID NO: 78415 - DNA, 20 bp, Artificial Sequence
  chemically synthesized
catacatcagaatcacctgg

SEQ ID NO: 78416 - DNA, 20 bp, Artificial Sequence
  chemically synthesized
gcatacatcagaatcacctg

SEQ ID NO: 78417 - DNA, 20 bp, Artificial Sequence
  chemically synthesized
cagcatacatcagaatcacc

SEQ ID NO: 78418 - DNA, 20 bp, Artificial Sequence
  chemically synthesized
gttctcacctcagcatacat

SEQ ID NO: 78419 - DNA, 20 bp, Artificial Sequence
  chemically synthesized
aggtgattctgatgtatgct

SEQ ID NO: 78420 - DNA, 20 bp, Artificial Sequence
  chemically synthesized
ggtgattctgatgtatgctg

SEQ ID NO: 78421 - DNA, 20 bp, Artificial Sequence
  chemically synthesized
attctgatgtatgctgaggt

SEQ ID NO: 78422 - DNA, 20 bp, Artificial Sequence
  chemically synthesized
agtggcaatggttctcacct

SEQ ID NO: 78423 - DNA, 20 bp, Artificial Sequence
  chemically synthesized
tcaagaattttcagtggcaa

SEQ ID NO: 78424 - DNA, 20 bp, Artificial Sequence
  chemically synthesized
agaatgtcaagaattttcag

SEQ ID NO: 78425 - DNA, 20 bp, Artificial Sequence
  chemically synthesized
ttgagaatgtcaagaatttt

SEQ ID NO: 78426 - DNA, 20 bp, Artificial Sequence
  chemically synthesized
cagacatcattgagaatgtc

SEQ ID NO: 78427 - DNA, 20 bp, Artificial Sequence
  chemically synthesized
agacatgtccagacatcatt

SEQ ID NO: 78428 - DNA, 20 bp, Artificial Sequence
  chemically synthesized
ttgacattctcaatgatgtc

SEQ ID NO: 78429 - DNA, 20 bp, Artificial Sequence
  chemically synthesized
tctaggcattcagacatgtc

SEQ ID NO: 78430 - DNA, 20 bp, Artificial Sequence
  chemically synthesized
tctggacatgtctgaatgcc

SEQ ID NO: 78431 - DNA, 20 bp, Artificial Sequence
  chemically synthesized
tctgtaaatgtctaggcatt

SEQ ID NO: 78432 - DNA, 20 bp, Artificial Sequence
  chemically synthesized
tatggaatctgtaaatgtct

SEQ ID NO: 78433 - DNA, 20 bp, Artificial Sequence
  chemically synthesized
ttatggaatctgtaaatgtc

SEQ ID NO: 78434 - DNA, 20 bp, Artificial Sequence
  chemically synthesized
tctgaatgcctagacattta

SEQ ID NO: 78435 - DNA, 20 bp, Artificial Sequence
  chemically synthesized
tgagtttggctttatagtta

SEQ ID NO: 78436 - DNA, 20 bp, Artificial Sequence
  chemically synthesized
ttacagattccataactata

SEQ ID NO: 78437 - DNA, 20 bp, Artificial Sequence
  chemically synthesized
cataagtgagtttggcttta

SEQ ID NO: 78438 - DNA, 20 bp, Artificial Sequence
  chemically synthesized
aatggcctcataagtgagtt

SEQ ID NO: 78439 - DNA, 20 bp, Artificial Sequence
  chemically synthesized
ataaagccaaactcacttat

SEQ ID NO: 78440 - DNA, 20 bp, Artificial Sequence
  chemically synthesized
taaagccaaactcacttatg

SEQ ID NO: 78441 - DNA, 20 bp, Artificial Sequence
  chemically synthesized
aagaaaatggcctcataagt

SEQ ID NO: 78442 - DNA, 20 bp, Artificial Sequence
  chemically synthesized
tagtaagaaaatggcctcat

SEQ ID NO: 78443 - DNA, 20 bp, Artificial Sequence
  chemically synthesized
gatcactattagtaagaaaa

SEQ ID NO: 78444 - DNA, 20 bp, Artificial Sequence
  chemically synthesized
tgaggccattttcttactaa

SEQ ID NO: 78445 - DNA, 20 bp, Artificial Sequence
  chemically synthesized
agaaagtgatcactattagt

SEQ ID NO: 78446 - DNA, 20 bp, Artificial Sequence
  chemically synthesized
tctaagaaagtgatcactat

SEQ ID NO: 78447 - DNA, 20 bp, Artificial Sequence
  chemically synthesized
actaatagtgatcactttct

SEQ ID NO: 78448 - DNA, 20 bp, Artificial Sequence
  chemically synthesized
atgaatgaaaaagtctaaga

SEQ ID NO: 78449 - DNA, 20 bp, Artificial Sequence
  chemically synthesized
gttaatgaatgaaaaagtct

SEQ ID NO: 78450 - DNA, 20 bp, Artificial Sequence
  chemically synthesized
agaagagttaatgaatgaaa

SEQ ID NO: 78451 - DNA, 20 bp, Artificial Sequence
  chemically synthesized
gaattagtgatggaagagaa

SEQ ID NO: 78452 - DNA, 20 bp, Artificial Sequence
  chemically synthesized
cagaattagtgatggaagag

SEQ ID NO: 78453 - DNA, 20 bp, Artificial Sequence
  chemically synthesized
catcagaattagtgatggaa

SEQ ID NO: 78454 - DNA, 20 bp, Artificial Sequence
  chemically synthesized
ttcatcagaattagtgatgg

SEQ ID NO: 78455 - DNA, 20 bp, Artificial Sequence
  chemically synthesized
ctgttcatcagaattagtga

SEQ ID NO: 78456 - DNA, 20 bp, Artificial Sequence
  chemically synthesized
tgatagctgttcatcagaat

SEQ ID NO: 78457 - DNA, 20 bp, Artificial Sequence
  chemically synthesized
ccatcactaattctgatgaa

SEQ ID NO: 78458 - DNA, 20 bp, Artificial Sequence
  chemically synthesized
atagcttgatagctgttcat

SEQ ID NO: 78459 - DNA, 20 bp, Artificial Sequence
  chemically synthesized
aattctgatgaacagctatc

SEQ ID NO: 78460 - DNA, 20 bp, Artificial Sequence
  chemically synthesized
ccctaccatgaatagcttga

SEQ ID NO: 78461 - DNA, 20 bp, Artificial Sequence
  chemically synthesized
aacagctatcaagctattca

SEQ ID NO: 78462 - DNA, 20 bp, Artificial Sequence
  chemically synthesized
agctatcaagctattcatgg

SEQ ID NO: 78463 - DNA, 20 bp, Artificial Sequence
  chemically synthesized
accctccaccctaccatgaa

SEQ ID NO: 78464 - DNA, 20 bp, Artificial Sequence
  chemically synthesized
gctatcaagctattcatggt

SEQ ID NO: 78465 - DNA, 20 bp, Artificial Sequence
  chemically synthesized
ctatcaagctattcatggta

SEQ ID NO: 78466 - DNA, 20 bp, Artificial Sequence
  chemically synthesized
tcaagctattcatggtaggg

SEQ ID NO: 78467 - DNA, 20 bp, Artificial Sequence
  chemically synthesized
aagctattcatggtagggtg

SEQ ID NO: 78468 - DNA, 20 bp, Artificial Sequence
  chemically synthesized
agctattcatggtagggtgg

SEQ ID NO: 78469 - DNA, 20 bp, Artificial Sequence
  chemically synthesized
gctattcatggtagggtgga

SEQ ID NO: 78470 - DNA, 20 bp, Artificial Sequence
  chemically synthesized
attcatggtagggtggaggg

SEQ ID NO: 78471 - DNA, 20 bp, Artificial Sequence
  chemically synthesized
ttcatggtagggtggagggt

SEQ ID NO: 78472 - DNA, 20 bp, Artificial Sequence
  chemically synthesized
atggtagggtggagggtagg

SEQ ID NO: 78473 - DNA, 20 bp, Artificial Sequence
  chemically synthesized
gggtaggtggattttccata

SEQ ID NO: 78474 - DNA, 20 bp, Artificial Sequence
  chemically synthesized
atgagaattttgtttcttta

SEQ ID NO: 78475 - DNA, 20 bp, Artificial Sequence
  chemically synthesized
agtaattctttataaataat

SEQ ID NO: 78476 - DNA, 20 bp, Artificial Sequence
  chemically synthesized
caaaattctcattatttata

SEQ ID NO: 78477 - DNA, 20 bp, Artificial Sequence
  chemically synthesized
ctgttttgtttttgcatgta

SEQ ID NO: 78478 - DNA, 20 bp, Artificial Sequence
  chemically synthesized
ctgtacatgcaaaaacaaaa

SEQ ID NO: 78479 - DNA, 20 bp, Artificial Sequence
  chemically synthesized
aaacaaaacagcattaaaaa

SEQ ID NO: 78480 - DNA, 20 bp, Artificial Sequence
  chemically synthesized
aaacagcattaaaaaaagcc

SEQ ID NO: 78481 - DNA, 20 bp, Artificial Sequence
  chemically synthesized
ctcactcttcatattcaact

SEQ ID NO: 78482 - DNA, 20 bp, Artificial Sequence
  chemically synthesized
aaaaagccaagttgaatatg

SEQ ID NO: 78483 - DNA, 20 bp, Artificial Sequence
  chemically synthesized
aaagccaagttgaatatgaa

SEQ ID NO: 78484 - DNA, 20 bp, Artificial Sequence
  chemically synthesized
ccaagttgaatatgaagagt

SEQ ID NO: 78485 - DNA, 20 bp, Artificial Sequence
  chemically synthesized
agttgaatatgaagagtgag

SEQ ID NO: 78486 - DNA, 20 bp, Artificial Sequence
  chemically synthesized
atgaagagtgagtggattac

SEQ ID NO: 78487 - DNA, 20 bp, Artificial Sequence
  chemically synthesized
tgaagagtgagtggattact

SEQ ID NO: 78488 - DNA, 20 bp, Artificial Sequence
  chemically synthesized
ctgcaactaataagtaaacc

SEQ ID NO: 78489 - DNA, 20 bp, Artificial Sequence
  chemically synthesized
ggattactaggtttacttat

SEQ ID NO: 78490 - DNA, 20 bp, Artificial Sequence
  chemically synthesized
aagtgtcccctgcaactaat

SEQ ID NO: 78491 - DNA, 20 bp, Artificial Sequence
  chemically synthesized
ctaggtttacttattagttg

SEQ ID NO: 78492 - DNA, 20 bp, Artificial Sequence
  chemically synthesized
taggtttacttattagttgc

SEQ ID NO: 78493 - DNA, 20 bp, Artificial Sequence
  chemically synthesized
aggtttacttattagttgca

SEQ ID NO: 78494 - DNA, 20 bp, Artificial Sequence
  chemically synthesized
ggtttacttattagttgcag

SEQ ID NO: 78495 - DNA, 20 bp, Artificial Sequence
  chemically synthesized
atggatgcccaggttaggta

SEQ ID NO: 78496 - DNA, 20 bp, Artificial Sequence
  chemically synthesized
aggggacactttacctaacc

SEQ ID NO: 78497 - DNA, 20 bp, Artificial Sequence
  chemically synthesized
ggggacactttacctaacct

SEQ ID NO: 78498 - DNA, 20 bp, Artificial Sequence
  chemically synthesized
gaaggatggatgcccaggtt

SEQ ID NO: 78499 - DNA, 20 bp, Artificial Sequence
  chemically synthesized
tgaaggatggatgcccaggt

SEQ ID NO: 78500 - DNA, 20 bp, Artificial Sequence
  chemically synthesized
cagctgaaggatggatgccc

SEQ ID NO: 78501 - DNA, 20 bp, Artificial Sequence
  chemically synthesized
gcagctgaaggatggatgcc

SEQ ID NO: 78502 - DNA, 20 bp, Artificial Sequence
  chemically synthesized
taacctgggcatccatcctt

SEQ ID NO: 78503 - DNA, 20 bp, Artificial Sequence
  chemically synthesized
ccatcacagcagctgaagga

SEQ ID NO: 78504 - DNA, 20 bp, Artificial Sequence
  chemically synthesized
tcaaccatcacagcagctga

SEQ ID NO: 78505 - DNA, 20 bp, Artificial Sequence
  chemically synthesized
gtcaaccatcacagcagctg

SEQ ID NO: 78506 - DNA, 20 bp, Artificial Sequence
  chemically synthesized
ccatccttcagctgctgtga

SEQ ID NO: 78507 - DNA, 20 bp, Artificial Sequence
  chemically synthesized
ttaatagtcaaccatcacag

SEQ ID NO: 78508 - DNA, 20 bp, Artificial Sequence
  chemically synthesized
acattaatagtcaaccatca

SEQ ID NO: 78509 - DNA, 20 bp, Artificial Sequence
  chemically synthesized
aggtagctataagacattaa

SEQ ID NO: 78510 - DNA, 20 bp, Artificial Sequence
  chemically synthesized
ggttgactattaatgtctta

SEQ ID NO: 78511 - DNA, 20 bp, Artificial Sequence
  chemically synthesized
tggagaaggcaggtagctat

SEQ ID NO: 78512 - DNA, 20 bp, Artificial Sequence
  chemically synthesized
tcacatgtggagaaggcagg

SEQ ID NO: 78513 - DNA, 20 bp, Artificial Sequence
  chemically synthesized
aggtcacatgtggagaaggc

SEQ ID NO: 78514 - DNA, 20 bp, Artificial Sequence
  chemically synthesized
gaggtcacatgtggagaagg

SEQ ID NO: 78515 - DNA, 20 bp, Artificial Sequence
  chemically synthesized
gcagaggtcacatgtggaga

SEQ ID NO: 78516 - DNA, 20 bp, Artificial Sequence
  chemically synthesized
agcagaggtcacatgtggag

SEQ ID NO: 78517 - DNA, 20 bp, Artificial Sequence
  chemically synthesized
ataagcagaggtcacatgtg

SEQ ID NO: 78518 - DNA, 20 bp, Artificial Sequence
  chemically synthesized
ccataagcagaggtcacatg

SEQ ID NO: 78519 - DNA, 20 bp, Artificial Sequence
  chemically synthesized
ccacatgtgacctctgctta

SEQ ID NO: 78520 - DNA, 20 bp, Artificial Sequence
  chemically synthesized
tagggggctcccataagcag

SEQ ID NO: 78521 - DNA, 20 bp, Artificial Sequence
  chemically synthesized
cacatgtgacctctgcttat

SEQ ID NO: 78522 - DNA, 20 bp, Artificial Sequence
  chemically synthesized
ctagggggctcccataagca

SEQ ID NO: 78523 - DNA, 20 bp, Artificial Sequence
  chemically synthesized
catgtgacctctgcttatgg

SEQ ID NO: 78524 - DNA, 20 bp, Artificial Sequence
  chemically synthesized
ggctagggggctcccataag

SEQ ID NO: 78525 - DNA, 20 bp, Artificial Sequence
  chemically synthesized
ctgggctagggggctcccat

SEQ ID NO: 78526 - DNA, 20 bp, Artificial Sequence
  chemically synthesized
ctctgcttatgggagccccc

SEQ ID NO: 78527 - DNA, 20 bp, Artificial Sequence
  chemically synthesized
cttatgggagccccctagcc

SEQ ID NO: 78528 - DNA, 20 bp, Artificial Sequence
  chemically synthesized
gggttacttcctgggctagg

SEQ ID NO: 78529 - DNA, 20 bp, Artificial Sequence
  chemically synthesized
ttatgggagccccctagccc

SEQ ID NO: 78530 - DNA, 20 bp, Artificial Sequence
  chemically synthesized
tgggttacttcctgggctag

SEQ ID NO: 78531 - DNA, 20 bp, Artificial Sequence
  chemically synthesized
atgggttacttcctgggcta

SEQ ID NO: 78532 - DNA, 20 bp, Artificial Sequence
  chemically synthesized
tatgggttacttcctgggct

SEQ ID NO: 78533 - DNA, 20 bp, Artificial Sequence
  chemically synthesized
tgggagccccctagcccagg

SEQ ID NO: 78534 - DNA, 20 bp, Artificial Sequence
  chemically synthesized
atatgggttacttcctgggc

SEQ ID NO: 78535 - DNA, 20 bp, Artificial Sequence
  chemically synthesized
tgggatatgggttacttcct

SEQ ID NO: 78536 - DNA, 20 bp, Artificial Sequence
  chemically synthesized
ctgggatatgggttacttcc

SEQ ID NO: 78537 - DNA, 20 bp, Artificial Sequence
  chemically synthesized
ccaggaagtaacccatatcc

SEQ ID NO: 78538 - DNA, 20 bp, Artificial Sequence
  chemically synthesized
caggaagtaacccatatccc

SEQ ID NO: 78539 - DNA, 20 bp, Artificial Sequence
  chemically synthesized
gtggtccactcctgggatat

SEQ ID NO: 78540 - DNA, 20 bp, Artificial Sequence
  chemically synthesized
tgtggtccactcctgggata

SEQ ID NO: 78541 - DNA, 20 bp, Artificial Sequence
  chemically synthesized
ggaagtaacccatatcccag

SEQ ID NO: 78542 - DNA, 20 bp, Artificial Sequence
  chemically synthesized
agtaacccatatcccaggag

SEQ ID NO: 78543 - DNA, 20 bp, Artificial Sequence
  chemically synthesized
actggctgtggtccactcct

SEQ ID NO: 78544 - DNA, 20 bp, Artificial Sequence
  chemically synthesized
cactggctgtggtccactcc

SEQ ID NO: 78545 - DNA, 20 bp, Artificial Sequence
  chemically synthesized
catatcccaggagtggacca

SEQ ID NO: 78546 - DNA, 20 bp, Artificial Sequence
  chemically synthesized
tcccaggagtggaccacagc

SEQ ID NO: 78547 - DNA, 20 bp, Artificial Sequence
  chemically synthesized
caggagtggaccacagccag

SEQ ID NO: 78548 - DNA, 20 bp, Artificial Sequence
  chemically synthesized
ctgcagcacaccactggctg

SEQ ID NO: 78549 - DNA, 20 bp, Artificial Sequence
  chemically synthesized
gctctgctgcagcacaccac

SEQ ID NO: 78550 - DNA, 20 bp, Artificial Sequence
  chemically synthesized
ccacagccagtggtgtgctg

SEQ ID NO: 78551 - DNA, 20 bp, Artificial Sequence
  chemically synthesized
cagccagtggtgtgctgcag

SEQ ID NO: 78552 - DNA, 20 bp, Artificial Sequence
  chemically synthesized
gccagtggtgtgctgcagca

SEQ ID NO: 78553 - DNA, 20 bp, Artificial Sequence
  chemically synthesized
ttggctcttgggctctgctg

SEQ ID NO: 78554 - DNA, 20 bp, Artificial Sequence
  chemically synthesized
ggtgtgctgcagcagagccc

SEQ ID NO: 78555 - DNA, 20 bp, Artificial Sequence
  chemically synthesized
tgtgctgcagcagagcccaa

SEQ ID NO: 78556 - DNA, 20 bp, Artificial Sequence
  chemically synthesized
gatgcacacaattggctctt

SEQ ID NO: 78557 - DNA, 20 bp, Artificial Sequence
  chemically synthesized
agatgcacacaattggctct

SEQ ID NO: 78558 - DNA, 20 bp, Artificial Sequence
  chemically synthesized
tgggaggagatgcacacaat

SEQ ID NO: 78559 - DNA, 20 bp, Artificial Sequence
  chemically synthesized
actgagtatggaattgggag

SEQ ID NO: 78560 - DNA, 20 bp, Artificial Sequence
  chemically synthesized
ccactgagtatggaattggg

SEQ ID NO: 78561 - DNA, 20 bp, Artificial Sequence
  chemically synthesized
gccactgagtatggaattgg

SEQ ID NO: 78562 - DNA, 20 bp, Artificial Sequence
  chemically synthesized
atgccactgagtatggaatt

SEQ ID NO: 78563 - DNA, 20 bp, Artificial Sequence
  chemically synthesized
aatgccactgagtatggaat

SEQ ID NO: 78564 - DNA, 20 bp, Artificial Sequence
  chemically synthesized
tctcctcccaattccatact

SEQ ID NO: 78565 - DNA, 20 bp, Artificial Sequence
  chemically synthesized
cctcccaattccatactcag

SEQ ID NO: 78566 - DNA, 20 bp, Artificial Sequence
  chemically synthesized
cgacataatgccactgagta

SEQ ID NO: 78567 - DNA, 20 bp, Artificial Sequence
  chemically synthesized
gctaccgacataatgccact

SEQ ID NO: 78568 - DNA, 20 bp, Artificial Sequence
  chemically synthesized
catactcagtggcattatgt

SEQ ID NO: 78569 - DNA, 20 bp, Artificial Sequence
  chemically synthesized
actcagtggcattatgtcgg

SEQ ID NO: 78570 - DNA, 20 bp, Artificial Sequence
  chemically synthesized
agtggcattatgtcggtagc

SEQ ID NO: 78571 - DNA, 20 bp, Artificial Sequence
  chemically synthesized
tggcattatgtcggtagctg

SEQ ID NO: 78572 - DNA, 20 bp, Artificial Sequence
  chemically synthesized
ttatgtcggtagctggagat

SEQ ID NO: 78573 - DNA, 20 bp, Artificial Sequence
  chemically synthesized
ctccctctaccactgatctc

SEQ ID NO: 78574 - DNA, 20 bp, Artificial Sequence
  chemically synthesized
tgtcggtagctggagatcag

SEQ ID NO: 78575 - DNA, 20 bp, Artificial Sequence
  chemically synthesized
cggtagctggagatcagtgg

SEQ ID NO: 78576 - DNA, 20 bp, Artificial Sequence
  chemically synthesized
gtagctggagatcagtggta

SEQ ID NO: 78577 - DNA, 20 bp, Artificial Sequence
  chemically synthesized
tagctggagatcagtggtag

SEQ ID NO: 78578 - DNA, 20 bp, Artificial Sequence
  chemically synthesized
agctggagatcagtggtaga

SEQ ID NO: 78579 - DNA, 20 bp, Artificial Sequence
  chemically synthesized
ctggagatcagtggtagagg

SEQ ID NO: 78580 - DNA, 20 bp, Artificial Sequence
  chemically synthesized
agtatttacaccacgaaaac

SEQ ID NO: 78581 - DNA, 20 bp, Artificial Sequence
  chemically synthesized
tgtatcaaaaccagttttcg

SEQ ID NO: 78582 - DNA, 20 bp, Artificial Sequence
  chemically synthesized
atcctggtgtgtatcaaaac

SEQ ID NO: 78583 - DNA, 20 bp, Artificial Sequence
  chemically synthesized
aaactggttttgatacacac

SEQ ID NO: 78584 - DNA, 20 bp, Artificial Sequence
  chemically synthesized
aactggttttgatacacacc

SEQ ID NO: 78585 - DNA, 20 bp, Artificial Sequence
  chemically synthesized
ctctgaggtgggatgaatcc

SEQ ID NO: 78586 - DNA, 20 bp, Artificial Sequence
  chemically synthesized
caccaggattcatcccacct

SEQ ID NO: 78587 - DNA, 20 bp, Artificial Sequence
  chemically synthesized
ccaggattcatcccacctca

SEQ ID NO: 78588 - DNA, 20 bp, Artificial Sequence
  chemically synthesized
ttgtcgactagctctgaggt

SEQ ID NO: 78589 - DNA, 20 bp, Artificial Sequence
  chemically synthesized
tttgtcgactagctctgagg

SEQ ID NO: 78590 - DNA, 20 bp, Artificial Sequence
  chemically synthesized
gattcatcccacctcagagc

SEQ ID NO: 78591 - DNA, 20 bp, Artificial Sequence
  chemically synthesized
atatttgtcgactagctctg

SEQ ID NO: 78592 - DNA, 20 bp, Artificial Sequence
  chemically synthesized
aatatttgtcgactagctct

SEQ ID NO: 78593 - DNA, 20 bp, Artificial Sequence
  chemically synthesized
gctggcaaatatttgtcgac

SEQ ID NO: 78594 - DNA, 20 bp, Artificial Sequence
  chemically synthesized
gctagtcgacaaatatttgc

SEQ ID NO: 78595 - DNA, 20 bp, Artificial Sequence
  chemically synthesized
acaaatatttgccagcactt

SEQ ID NO: 78596 - DNA, 20 bp, Artificial Sequence
  chemically synthesized
tgtctgtgtcactgaagtgc

SEQ ID NO: 78597 - DNA, 20 bp, Artificial Sequence
  chemically synthesized
agtcattgtctgtgtcactg

SEQ ID NO: 78598 - DNA, 20 bp, Artificial Sequence
  chemically synthesized
ttgccagcacttcagtgaca

SEQ ID NO: 78599 - DNA, 20 bp, Artificial Sequence
  chemically synthesized
tcagtgacacagacaatgac

SEQ ID NO: 78600 - DNA, 20 bp, Artificial Sequence
  chemically synthesized
cacagacaatgactggtata

SEQ ID NO: 78601 - DNA, 20 bp, Artificial Sequence
  chemically synthesized
acagacaatgactggtataa

SEQ ID NO: 78602 - DNA, 20 bp, Artificial Sequence
  chemically synthesized
ccggagttgtgcctttatac

SEQ ID NO: 78603 - DNA, 20 bp, Artificial Sequence
  chemically synthesized
ctggtataaaggcacaactc

SEQ ID NO: 78604 - DNA, 20 bp, Artificial Sequence
  chemically synthesized
ataaaggcacaactccggct

SEQ ID NO: 78605 - DNA, 20 bp, Artificial Sequence
  chemically synthesized
taagccacaacaccgagccg

SEQ ID NO: 78606 - DNA, 20 bp, Artificial Sequence
  chemically synthesized
cgtaagccacaacaccgagc

SEQ ID NO: 78607 - DNA, 20 bp, Artificial Sequence
  chemically synthesized
acaactccggctcggtgttg

SEQ ID NO: 78608 - DNA, 20 bp, Artificial Sequence
  chemically synthesized
caggcgtaagccacaacacc

SEQ ID NO: 78609 - DNA, 20 bp, Artificial Sequence
  chemically synthesized
agtgctgggattacaggcgt

SEQ ID NO: 78610 - DNA, 20 bp, Artificial Sequence
  chemically synthesized
gtggcttacgcctgtaatcc

SEQ ID NO: 78611 - DNA, 20 bp, Artificial Sequence
  chemically synthesized
tcccaaagtgctgggattac

SEQ ID NO: 78612 - DNA, 20 bp, Artificial Sequence
  chemically synthesized
ctcccaaagtgctgggatta

SEQ ID NO: 78613 - DNA, 20 bp, Artificial Sequence
  chemically synthesized
cgcctgtaatcccagcactt

SEQ ID NO: 78614 - DNA, 20 bp, Artificial Sequence
  chemically synthesized
cctcagcctcccaaagtgct

SEQ ID NO: 78615 - DNA, 20 bp, Artificial Sequence
  chemically synthesized
gcctgtaatcccagcacttt

SEQ ID NO: 78616 - DNA, 20 bp, Artificial Sequence
  chemically synthesized
acctcagcctcccaaagtgc

SEQ ID NO: 78617 - DNA, 20 bp, Artificial Sequence
  chemically synthesized
ctgtaatcccagcactttgg

SEQ ID NO: 78618 - DNA, 20 bp, Artificial Sequence
  chemically synthesized
tgtaatcccagcactttggg

SEQ ID NO: 78619 - DNA, 20 bp, Artificial Sequence
  chemically synthesized
ctgcccacctcagcctccca

SEQ ID NO: 78620 - DNA, 20 bp, Artificial Sequence
  chemically synthesized
tcccagcactttgggaggct

SEQ ID NO: 78621 - DNA, 20 bp, Artificial Sequence
  chemically synthesized
cccagcactttgggaggctg

SEQ ID NO: 78622 - DNA, 20 bp, Artificial Sequence
  chemically synthesized
agcactttgggaggctgagg

SEQ ID NO: 78623 - DNA, 20 bp, Artificial Sequence
  chemically synthesized
gcactttgggaggctgaggt

SEQ ID NO: 78624 - DNA, 20 bp, Artificial Sequence
  chemically synthesized
ctttgggaggctgaggtggg

SEQ ID NO: 78625 - DNA, 20 bp, Artificial Sequence
  chemically synthesized
ctcaggtgatctgcccacct

SEQ ID NO: 78626 - DNA, 20 bp, Artificial Sequence
  chemically synthesized
ctgaggtgggcagatcacct

SEQ ID NO: 78627 - DNA, 20 bp, Artificial Sequence
  chemically synthesized
tgaggtgggcagatcacctg

SEQ ID NO: 78628 - DNA, 20 bp, Artificial Sequence
  chemically synthesized
gtgggcagatcacctgaggt

SEQ ID NO: 78629 - DNA, 20 bp, Artificial Sequence
  chemically synthesized
tgggcagatcacctgaggtc

SEQ ID NO: 78630 - DNA, 20 bp, Artificial Sequence
  chemically synthesized
ggtcttgaactcctgacctc

SEQ ID NO: 78631 - DNA, 20 bp, Artificial Sequence
  chemically synthesized
ggcagatcacctgaggtcag

SEQ ID NO: 78632 - DNA, 20 bp, Artificial Sequence
  chemically synthesized
tggtcttgaactcctgacct

SEQ ID NO: 78633 - DNA, 20 bp, Artificial Sequence
  chemically synthesized
tcacctgaggtcaggagttc

SEQ ID NO: 78634 - DNA, 20 bp, Artificial Sequence
  chemically synthesized
tgaggtcaggagttcaagac

SEQ ID NO: 78635 - DNA, 20 bp, Artificial Sequence
  chemically synthesized
tttcaccatgttagtcaggc

SEQ ID NO: 78636 - DNA, 20 bp, Artificial Sequence
  chemically synthesized
ggggtttcaccatgttagtc

SEQ ID NO: 78637 - DNA, 20 bp, Artificial Sequence
  chemically synthesized
caagaccagcctgactaaca

SEQ ID NO: 78638 - DNA, 20 bp, Artificial Sequence
  chemically synthesized
tggggtttcaccatgttagt

SEQ ID NO: 78639 - DNA, 20 bp, Artificial Sequence
  chemically synthesized
gagatggggtttcaccatgt

SEQ ID NO: 78640 - DNA, 20 bp, Artificial Sequence
  chemically synthesized
ttgtgtttttagtagagatg

SEQ ID NO: 78641 - DNA, 20 bp, Artificial Sequence
  chemically synthesized
tttgtgtttttagtagagat

SEQ ID NO: 78642 - DNA, 20 bp, Artificial Sequence
  chemically synthesized
ttttgtgtttttagtagaga

SEQ ID NO: 78643 - DNA, 20 bp, Artificial Sequence
  chemically synthesized
taatttttgtgtttttagta

SEQ ID NO: 78644 - DNA, 20 bp, Artificial Sequence
  chemically synthesized
gctaatttttgtgtttttag

SEQ ID NO: 78645 - DNA, 20 bp, Artificial Sequence
  chemically synthesized
ctggctaatttttgtgtttt

SEQ ID NO: 78646 - DNA, 20 bp, Artificial Sequence
  chemically synthesized
tctactaaaaacacaaaaat

SEQ ID NO: 78647 - DNA, 20 bp, Artificial Sequence
  chemically synthesized
ctaaaaacacaaaaattagc

SEQ ID NO: 78648 - DNA, 20 bp, Artificial Sequence
  chemically synthesized
taaaaacacaaaaattagcc

SEQ ID NO: 78649 - DNA, 20 bp, Artificial Sequence
  chemically synthesized
acacaaaaattagccaggcg

SEQ ID NO: 78650 - DNA, 20 bp, Artificial Sequence
  chemically synthesized
caaaaattagccaggcgtgg

SEQ ID NO: 78651 - DNA, 20 bp, Artificial Sequence
  chemically synthesized
caggcatgcaccgccacgcc

SEQ ID NO: 78652 - DNA, 20 bp, Artificial Sequence
  chemically synthesized
gcggtgcatgcctgtaatcc

SEQ ID NO: 78653 - DNA, 20 bp, Artificial Sequence
  chemically synthesized
tcctgagtagctgggattac

SEQ ID NO: 78654 - DNA, 20 bp, Artificial Sequence
  chemically synthesized
ctcctgagtagctgggatta

SEQ ID NO: 78655 - DNA, 20 bp, Artificial Sequence
  chemically synthesized
tgcctgtaatcccagctact

SEQ ID NO: 78656 - DNA, 20 bp, Artificial Sequence
  chemically synthesized
cctcagcctcctgagtagct

SEQ ID NO: 78657 - DNA, 20 bp, Artificial Sequence
  chemically synthesized
gcctgtaatcccagctactc

SEQ ID NO: 78658 - DNA, 20 bp, Artificial Sequence
  chemically synthesized
gcctcagcctcctgagtagc

SEQ ID NO: 78659 - DNA, 20 bp, Artificial Sequence
  chemically synthesized
ctgtaatcccagctactcag

SEQ ID NO: 78660 - DNA, 20 bp, Artificial Sequence
  chemically synthesized
tgtaatcccagctactcagg

SEQ ID NO: 78661 - DNA, 20 bp, Artificial Sequence
  chemically synthesized
tcctgcctcagcctcctgag

SEQ ID NO: 78662 - DNA, 20 bp, Artificial Sequence
  chemically synthesized
ttctcctgcctcagcctcct

SEQ ID NO: 78663 - DNA, 20 bp, Artificial Sequence
  chemically synthesized
tcccagctactcaggaggct

SEQ ID NO: 78664 - DNA, 20 bp, Artificial Sequence
  chemically synthesized
cccagctactcaggaggctg

SEQ ID NO: 78665 - DNA, 20 bp, Artificial Sequence
  chemically synthesized
agctactcaggaggctgagg

SEQ ID NO: 78666 - DNA, 20 bp, Artificial Sequence
  chemically synthesized
gctactcaggaggctgaggc

SEQ ID NO: 78667 - DNA, 20 bp, Artificial Sequence
  chemically synthesized
tactcaggaggctgaggcag

SEQ ID NO: 78668 - DNA, 20 bp, Artificial Sequence
  chemically synthesized
ttcaagtgattctcctgcct

SEQ ID NO: 78669 - DNA, 20 bp, Artificial Sequence
  chemically synthesized
gcaggagaatcacttgaacc

SEQ ID NO: 78670 - DNA, 20 bp, Artificial Sequence
  chemically synthesized
caggagaatcacttgaacct

SEQ ID NO: 78671 - DNA, 20 bp, Artificial Sequence
  chemically synthesized
aacctccgcctcccaggttc

SEQ ID NO: 78672 - DNA, 20 bp, Artificial Sequence
  chemically synthesized
ggagaatcacttgaacctgg

SEQ ID NO: 78673 - DNA, 20 bp, Artificial Sequence
  chemically synthesized
gagaatcacttgaacctggg

SEQ ID NO: 78674 - DNA, 20 bp, Artificial Sequence
  chemically synthesized
aatcacttgaacctgggagg

SEQ ID NO: 78675 - DNA, 20 bp, Artificial Sequence
  chemically synthesized
cactgcaacctccgcctccc

SEQ ID NO: 78676 - DNA, 20 bp, Artificial Sequence
  chemically synthesized
tcacttgaacctgggaggcg

SEQ ID NO: 78677 - DNA, 20 bp, Artificial Sequence
  chemically synthesized
tcactgcaacctccgcctcc

SEQ ID NO: 78678 - DNA, 20 bp, Artificial Sequence
  chemically synthesized
cacttgaacctgggaggcgg

SEQ ID NO: 78679 - DNA, 20 bp, Artificial Sequence
  chemically synthesized
aacctgggaggcggaggttg

SEQ ID NO: 78680 - DNA, 20 bp, Artificial Sequence
  chemically synthesized
tgggaggcggaggttgcagt

SEQ ID NO: 78681 - DNA, 20 bp, Artificial Sequence
  chemically synthesized
ggcggaggttgcagtgagct

SEQ ID NO: 78682 - DNA, 20 bp, Artificial Sequence
  chemically synthesized
cccaggctggagtgcaatct

SEQ ID NO: 78683 - DNA, 20 bp, Artificial Sequence
  chemically synthesized
agtgagctgagattgcactc

SEQ ID NO: 78684 - DNA, 20 bp, Artificial Sequence
  chemically synthesized
gctgagattgcactccagcc

SEQ ID NO: 78685 - DNA, 20 bp, Artificial Sequence
  chemically synthesized
ctgagattgcactccagcct

SEQ ID NO: 78686 - DNA, 20 bp, Artificial Sequence
  chemically synthesized
cgctcttgttgcccaggctg

SEQ ID NO: 78687 - DNA, 20 bp, Artificial Sequence
  chemically synthesized
ttcgctcttgttgcccaggc

SEQ ID NO: 78688 - DNA, 20 bp, Artificial Sequence
  chemically synthesized
tgcactccagcctgggcaac

SEQ ID NO: 78689 - DNA, 20 bp, Artificial Sequence
  chemically synthesized
gagtttcgctcttgttgccc

SEQ ID NO: 78690 - DNA, 20 bp, Artificial Sequence
  chemically synthesized
ggagtttcgctcttgttgcc

SEQ ID NO: 78691 - DNA, 20 bp, Artificial Sequence
  chemically synthesized
cactccagcctgggcaacaa

SEQ ID NO: 78692 - DNA, 20 bp, Artificial Sequence
  chemically synthesized
tattttatttttttgagatg

SEQ ID NO: 78693 - DNA, 20 bp, Artificial Sequence
  chemically synthesized
tttattttatttttttgaga

SEQ ID NO: 78694 - DNA, 20 bp, Artificial Sequence
  chemically synthesized
ttattttattttattttttt

SEQ ID NO: 78695 - DNA, 20 bp, Artificial Sequence
  chemically synthesized
caaaaaaataaaataaaata

SEQ ID NO: 78696 - DNA, 20 bp, Artificial Sequence
  chemically synthesized
aaaaaataaaataaaataaa

SEQ ID NO: 78697 - DNA, 20 bp, Artificial Sequence
  chemically synthesized
aaataaagagtacaactcca

SEQ ID NO: 78698 - DNA, 20 bp, Artificial Sequence
  chemically synthesized
aaagagtacaactccacagc

SEQ ID NO: 78699 - DNA, 20 bp, Artificial Sequence
  chemically synthesized
aagagtacaactccacagcg

SEQ ID NO: 78700 - DNA, 20 bp, Artificial Sequence
  chemically synthesized
cgagcagaaacctcgctgtg

SEQ ID NO: 78701 - DNA, 20 bp, Artificial Sequence
  chemically synthesized
ctcgagcagaaacctcgctg

SEQ ID NO: 78702 - DNA, 20 bp, Artificial Sequence
  chemically synthesized
ccacagcgaggtttctgctc

SEQ ID NO: 78703 - DNA, 20 bp, Artificial Sequence
  chemically synthesized
cacagcgaggtttctgctcg

SEQ ID NO: 78704 - DNA, 20 bp, Artificial Sequence
  chemically synthesized
acagcgaggtttctgctcga

SEQ ID NO: 78705 - DNA, 20 bp, Artificial Sequence
  chemically synthesized
agagagagcaagccctcgag

SEQ ID NO: 78706 - DNA, 20 bp, Artificial Sequence
  chemically synthesized
cagagagagagcaagccctc

SEQ ID NO: 78707 - DNA, 20 bp, Artificial Sequence
  chemically synthesized
gtctgatccagagagagagc

SEQ ID NO: 78708 - DNA, 20 bp, Artificial Sequence
  chemically synthesized
tcgagggcttgctctctctc

SEQ ID NO: 78709 - DNA, 20 bp, Artificial Sequence
  chemically synthesized
ttgtgtctgatccagagaga

SEQ ID NO: 78710 - DNA, 20 bp, Artificial Sequence
  chemically synthesized
cattgtgtctgatccagaga

SEQ ID NO: 78711 - DNA, 20 bp, Artificial Sequence
  chemically synthesized
ggcttgctctctctctggat

SEQ ID NO: 78712 - DNA, 20 bp, Artificial Sequence
  chemically synthesized
cacattgtgtctgatccaga

SEQ ID NO: 78713 - DNA, 20 bp, Artificial Sequence
  chemically synthesized
ctcacattgtgtctgatcca

SEQ ID NO: 78714 - DNA, 20 bp, Artificial Sequence
  chemically synthesized
acctcacattgtgtctgatc

SEQ ID NO: 78715 - DNA, 20 bp, Artificial Sequence
  chemically synthesized
ctctggatcagacacaatgt

SEQ ID NO: 78716 - DNA, 20 bp, Artificial Sequence
  chemically synthesized
tctggatcagacacaatgtg

SEQ ID NO: 78717 - DNA, 20 bp, Artificial Sequence
  chemically synthesized
atgtgaggtttcacctgaaa

SEQ ID NO: 78718 - DNA, 20 bp, Artificial Sequence
  chemically synthesized
cccagcaagtatgccatttc

SEQ ID NO: 78719 - DNA, 20 bp, Artificial Sequence
  chemically synthesized
gcccagcaagtatgccattt

SEQ ID NO: 78720 - DNA, 20 bp, Artificial Sequence
  chemically synthesized
acctgaaatggcatacttgc

SEQ ID NO: 78721 - DNA, 20 bp, Artificial Sequence
  chemically synthesized
cctgaaatggcatacttgct

SEQ ID NO: 78722 - DNA, 20 bp, Artificial Sequence
  chemically synthesized
aggagaagaaagagcccagc

SEQ ID NO: 78723 - DNA, 20 bp, Artificial Sequence
  chemically synthesized
atacaggagaagaaagagcc

SEQ ID NO: 78724 - DNA, 20 bp, Artificial Sequence
  chemically synthesized
aaacaatacaggagaagaaa

SEQ ID NO: 78725 - DNA, 20 bp, Artificial Sequence
  chemically synthesized
ggaaacaatacaggagaaga

SEQ ID NO: 78726 - DNA, 20 bp, Artificial Sequence
  chemically synthesized
ttagggaaacaatacaggag

SEQ ID NO: 78727 - DNA, 20 bp, Artificial Sequence
  chemically synthesized
gagttagggaaacaatacag

SEQ ID NO: 78728 - DNA, 20 bp, Artificial Sequence
  chemically synthesized
tggagttagggaaacaatac

SEQ ID NO: 78729 - DNA, 20 bp, Artificial Sequence
  chemically synthesized
ttggagttagggaaacaata

SEQ ID NO: 78730 - DNA, 20 bp, Artificial Sequence
  chemically synthesized
agaagcctgtattggagtta

SEQ ID NO: 78731 - DNA, 20 bp, Artificial Sequence
  chemically synthesized
gagaagcctgtattggagtt

SEQ ID NO: 78732 - DNA, 20 bp, Artificial Sequence
  chemically synthesized
ggagaagcctgtattggagt

SEQ ID NO: 78733 - DNA, 20 bp, Artificial Sequence
  chemically synthesized
ttgtttccctaactccaata

SEQ ID NO: 78734 - DNA, 20 bp, Artificial Sequence
  chemically synthesized
tgtttccctaactccaatac

SEQ ID NO: 78735 - DNA, 20 bp, Artificial Sequence
  chemically synthesized
ctcaggagaagcctgtattg

SEQ ID NO: 78736 - DNA, 20 bp, Artificial Sequence
  chemically synthesized
ctctcaggagaagcctgtat

SEQ ID NO: 78737 - DNA, 20 bp, Artificial Sequence
  chemically synthesized
ctccaatacaggcttctcct

SEQ ID NO: 78738 - DNA, 20 bp, Artificial Sequence
  chemically synthesized
ccaatacaggcttctcctga

SEQ ID NO: 78739 - DNA, 20 bp, Artificial Sequence
  chemically synthesized
agagggtctgctctcaggag

SEQ ID NO: 78740 - DNA, 20 bp, Artificial Sequence
  chemically synthesized
atacaggcttctcctgagag

SEQ ID NO: 78741 - DNA, 20 bp, Artificial Sequence
  chemically synthesized
tatagagggtctgctctcag

SEQ ID NO: 78742 - DNA, 20 bp, Artificial Sequence
  chemically synthesized
tttatagagggtctgctctc

SEQ ID NO: 78743 - DNA, 20 bp, Artificial Sequence
  chemically synthesized
atttatagagggtctgctct

SEQ ID NO: 78744 - DNA, 20 bp, Artificial Sequence
  chemically synthesized
aggtgcctgtgatttataga

SEQ ID NO: 78745 - DNA, 20 bp, Artificial Sequence
  chemically synthesized
taggtgcctgtgatttatag

SEQ ID NO: 78746 - DNA, 20 bp, Artificial Sequence
  chemically synthesized
ctaggtgcctgtgatttata

SEQ ID NO: 78747 - DNA, 20 bp, Artificial Sequence
  chemically synthesized
agcagaccctctataaatca

SEQ ID NO: 78748 - DNA, 20 bp, Artificial Sequence
  chemically synthesized
gtctaggtgcctgtgattta

SEQ ID NO: 78749 - DNA, 20 bp, Artificial Sequence
  chemically synthesized
gcagaccctctataaatcac

SEQ ID NO: 78750 - DNA, 20 bp, Artificial Sequence
  chemically synthesized
ctctataaatcacaggcacc

SEQ ID NO: 78751 - DNA, 20 bp, Artificial Sequence
  chemically synthesized
gaccctgagaacaggggtct

SEQ ID NO: 78752 - DNA, 20 bp, Artificial Sequence
  chemically synthesized
agaccctgagaacaggggtc

SEQ ID NO: 78753 - DNA, 20 bp, Artificial Sequence
  chemically synthesized
ggcacctagacccctgttct

SEQ ID NO: 78754 - DNA, 20 bp, Artificial Sequence
  chemically synthesized
aacgcagaccctgagaacag

SEQ ID NO: 78755 - DNA, 20 bp, Artificial Sequence
  chemically synthesized
gcacctagacccctgttctc

SEQ ID NO: 78756 - DNA, 20 bp, Artificial Sequence
  chemically synthesized
gaacgcagaccctgagaaca

SEQ ID NO: 78757 - DNA, 20 bp, Artificial Sequence
  chemically synthesized
cacctagacccctgttctca

SEQ ID NO: 78758 - DNA, 20 bp, Artificial Sequence
  chemically synthesized
tgaacgcagaccctgagaac

SEQ ID NO: 78759 - DNA, 20 bp, Artificial Sequence
  chemically synthesized
atgaacgcagaccctgagaa

SEQ ID NO: 78760 - DNA, 20 bp, Artificial Sequence
  chemically synthesized
gttccatgaacgcagaccct

SEQ ID NO: 78761 - DNA, 20 bp, Artificial Sequence
  chemically synthesized
gttctcagggtctgcgttca

SEQ ID NO: 78762 - DNA, 20 bp, Artificial Sequence
  chemically synthesized
taagtcaggttccatgaacg

SEQ ID NO: 78763 - DNA, 20 bp, Artificial Sequence
  chemically synthesized
gttaaatggcattttaagtc

SEQ ID NO: 78764 - DNA, 20 bp, Artificial Sequence
  chemically synthesized
agttaaatggcattttaagt

SEQ ID NO: 78765 - DNA, 20 bp, Artificial Sequence
  chemically synthesized
aatgagttaaatggcatttt

SEQ ID NO: 78766 - DNA, 20 bp, Artificial Sequence
  chemically synthesized
cacttaactaatgagttaaa

SEQ ID NO: 78767 - DNA, 20 bp, Artificial Sequence
  chemically synthesized
taaaatgccatttaactcat

SEQ ID NO: 78768 - DNA, 20 bp, Artificial Sequence
  chemically synthesized
tgccatttaactcattagtt

SEQ ID NO: 78769 - DNA, 20 bp, Artificial Sequence
  chemically synthesized
tgcatagtcacttaactaat

SEQ ID NO: 78770 - DNA, 20 bp, Artificial Sequence
  chemically synthesized
agttaagtgactatgcacaa

SEQ ID NO: 78771 - DNA, 20 bp, Artificial Sequence
  chemically synthesized
ttatttcaagcttttgtgca

SEQ ID NO: 78772 - DNA, 20 bp, Artificial Sequence
  chemically synthesized
ttttgaacatgtattatttc

SEQ ID NO: 78773 - DNA, 20 bp, Artificial Sequence
  chemically synthesized
aataatacatgttcaaaatt

SEQ ID NO: 78774 - DNA, 20 bp, Artificial Sequence
  chemically synthesized
taatacatgttcaaaattaa

SEQ ID NO: 78775 - DNA, 20 bp, Artificial Sequence
  chemically synthesized
tgttcaaaattaagagctgc

SEQ ID NO: 78776 - DNA, 20 bp, Artificial Sequence
  chemically synthesized
aaattaagagctgctagtca

SEQ ID NO: 78777 - DNA, 20 bp, Artificial Sequence
  chemically synthesized
atccaaagttccatgactag

SEQ ID NO: 78778 - DNA, 20 bp, Artificial Sequence
  chemically synthesized
gtgatccaaagttccatgac

SEQ ID NO: 78779 - DNA, 20 bp, Artificial Sequence
  chemically synthesized
agctgctagtcatggaactt

SEQ ID NO: 78780 - DNA, 20 bp, Artificial Sequence
  chemically synthesized
catctgattattgtgatcca

SEQ ID NO: 78781 - DNA, 20 bp, Artificial Sequence
  chemically synthesized
gaactttggatcacaataat

SEQ ID NO: 78782 - DNA, 20 bp, Artificial Sequence
  chemically synthesized
ataatcagatgaacctgcaa

SEQ ID NO: 78783 - DNA, 20 bp, Artificial Sequence
  chemically synthesized
atttcaaatttatcttttgc

SEQ ID NO: 78784 - DNA, 20 bp, Artificial Sequence
  chemically synthesized
tatttcaaatttatcttttg

SEQ ID NO: 78785 - DNA, 20 bp, Artificial Sequence
  chemically synthesized
tgcaaaagataaatttgaaa

SEQ ID NO: 78786 - DNA, 20 bp, Artificial Sequence
  chemically synthesized
aaagataaatttgaaatagc

SEQ ID NO: 78787 - DNA, 20 bp, Artificial Sequence
  chemically synthesized
aagataaatttgaaatagca

SEQ ID NO: 78788 - DNA, 20 bp, Artificial Sequence
  chemically synthesized
agataaatttgaaatagcaa

SEQ ID NO: 78789 - DNA, 20 bp, Artificial Sequence
  chemically synthesized
atgtacacagacaaaaagag

SEQ ID NO: 78790 - DNA, 20 bp, Artificial Sequence
  chemically synthesized
tttatgtacacagacaaaaa

SEQ ID NO: 78791 - DNA, 20 bp, Artificial Sequence
  chemically synthesized
cttttatgtacacagacaaa

SEQ ID NO: 78792 - DNA, 20 bp, Artificial Sequence
  chemically synthesized
acttctgtcttttatgtaca

SEQ ID NO: 78793 - DNA, 20 bp, Artificial Sequence
  chemically synthesized
ctttttgtctgtgtacataa

SEQ ID NO: 78794 - DNA, 20 bp, Artificial Sequence
  chemically synthesized
ttgtctgtgtacataaaaga

SEQ ID NO: 78795 - DNA, 20 bp, Artificial Sequence
  chemically synthesized
tctgtgtacataaaagacag

SEQ ID NO: 78796 - DNA, 20 bp, Artificial Sequence
  chemically synthesized
acataaaagacagaagttga

SEQ ID NO: 78797 - DNA, 20 bp, Artificial Sequence
  chemically synthesized
aagacagaagttgatggaaa

SEQ ID NO: 78798 - DNA, 20 bp, Artificial Sequence
  chemically synthesized
gaagttgatggaaaaagata

SEQ ID NO: 78799 - DNA, 20 bp, Artificial Sequence
  chemically synthesized
aaggattgcccagtttttgc

SEQ ID NO: 78800 - DNA, 20 bp, Artificial Sequence
  chemically synthesized
aagataaagcctgcaaaaac

SEQ ID NO: 78801 - DNA, 20 bp, Artificial Sequence
  chemically synthesized
aaaggattgcccagtttttg

SEQ ID NO: 78802 - DNA, 20 bp, Artificial Sequence
  chemically synthesized
agataaagcctgcaaaaact

SEQ ID NO: 78803 - DNA, 20 bp, Artificial Sequence
  chemically synthesized
tcacagtataaaggattgcc

SEQ ID NO: 78804 - DNA, 20 bp, Artificial Sequence
  chemically synthesized
agttgagaatcacagtataa

SEQ ID NO: 78805 - DNA, 20 bp, Artificial Sequence
  chemically synthesized
aagttgagaatcacagtata

SEQ ID NO: 78806 - DNA, 20 bp, Artificial Sequence
  chemically synthesized
aaagcgtaagttgagaatca

SEQ ID NO: 78807 - DNA, 20 bp, Artificial Sequence
  chemically synthesized
tggacatgaaagcgtaagtt

SEQ ID NO: 78808 - DNA, 20 bp, Artificial Sequence
  chemically synthesized
acctatggacatgaaagcgt

SEQ ID NO: 78809 - DNA, 20 bp, Artificial Sequence
  chemically synthesized
acattcacctatggacatga

SEQ ID NO: 78810 - DNA, 20 bp, Artificial Sequence
  chemically synthesized
aacttacgctttcatgtcca

SEQ ID NO: 78811 - DNA, 20 bp, Artificial Sequence
  chemically synthesized
acttacgctttcatgtccat

SEQ ID NO: 78812 - DNA, 20 bp, Artificial Sequence
  chemically synthesized
tctttcagcacattcaccta

SEQ ID NO: 78813 - DNA, 20 bp, Artificial Sequence
  chemically synthesized
tccataggtgaatgtgctga

SEQ ID NO: 78814 - DNA, 20 bp, Artificial Sequence
  chemically synthesized
ttctgaagtaaggaatcttt

SEQ ID NO: 78815 - DNA, 20 bp, Artificial Sequence
  chemically synthesized
tgctgaaagattccttactt

SEQ ID NO: 78816 - DNA, 20 bp, Artificial Sequence
  chemically synthesized
tttcttcaaattctgaagta

SEQ ID NO: 78817 - DNA, 20 bp, Artificial Sequence
  chemically synthesized
ttttcttcaaattctgaagt

SEQ ID NO: 78818 - DNA, 20 bp, Artificial Sequence
  chemically synthesized
tgctttttcttcaaattctg

SEQ ID NO: 78819 - DNA, 20 bp, Artificial Sequence
  chemically synthesized
attccttacttcagaatttg

SEQ ID NO: 78820 - DNA, 20 bp, Artificial Sequence
  chemically synthesized
tacttcagaatttgaagaaa

SEQ ID NO: 78821 - DNA, 20 bp, Artificial Sequence
  chemically synthesized
attcatcatgttttaatatg

SEQ ID NO: 78822 - DNA, 20 bp, Artificial Sequence
  chemically synthesized
aaaacatgatgaatccatta

SEQ ID NO: 78823 - DNA, 20 bp, Artificial Sequence
  chemically synthesized
ttttatggtattttccataa

SEQ ID NO: 78824 - DNA, 20 bp, Artificial Sequence
  chemically synthesized
taaatctcacatcaatttta

SEQ ID NO: 78825 - DNA, 20 bp, Artificial Sequence
  chemically synthesized
aaataccataaaattgatgt

SEQ ID NO: 78826 - DNA, 20 bp, Artificial Sequence
  chemically synthesized
tgagatttaaaaaataaaac

SEQ ID NO: 78827 - DNA, 20 bp, Artificial Sequence
  chemically synthesized
aaaataaaacaagaacatca

SEQ ID NO: 78828 - DNA, 20 bp, Artificial Sequence
  chemically synthesized
tcaaagaaatttcatgctca

SEQ ID NO: 78829 - DNA, 20 bp, Artificial Sequence
  chemically synthesized
aaatttcatgctcatggaaa

SEQ ID NO: 78830 - DNA, 20 bp, Artificial Sequence
  chemically synthesized
tacctatctcctttttccat

SEQ ID NO: 78831 - DNA, 20 bp, Artificial Sequence
  chemically synthesized
aatttcatgctcatggaaaa

SEQ ID NO: 78832 - DNA, 20 bp, Artificial Sequence
  chemically synthesized
tttcatgctcatggaaaaag

SEQ ID NO: 78833 - DNA, 20 bp, Artificial Sequence
  chemically synthesized
atgctcatggaaaaaggaga

SEQ ID NO: 78834 - DNA, 20 bp, Artificial Sequence
  chemically synthesized
tgctcatggaaaaaggagat

SEQ ID NO: 78835 - DNA, 20 bp, Artificial Sequence
  chemically synthesized
catggaaaaaggagataggt

SEQ ID NO: 78836 - DNA, 20 bp, Artificial Sequence
  chemically synthesized
ggaaaaaggagataggtaag

SEQ ID NO: 78837 - DNA, 20 bp, Artificial Sequence
  chemically synthesized
aaaaggagataggtaagtgg

SEQ ID NO: 78838 - DNA, 20 bp, Artificial Sequence
  chemically synthesized
aggagataggtaagtggaag

SEQ ID NO: 78839 - DNA, 20 bp, Artificial Sequence
  chemically synthesized
ggagataggtaagtggaagc

SEQ ID NO: 78840 - DNA, 20 bp, Artificial Sequence
  chemically synthesized
agataggtaagtggaagcgg

SEQ ID NO: 78841 - DNA, 20 bp, Artificial Sequence
  chemically synthesized
taagtggaagcgggagatgt

SEQ ID NO: 78842 - DNA, 20 bp, Artificial Sequence
  chemically synthesized
aagtggaagcgggagatgtc

SEQ ID NO: 78843 - DNA, 20 bp, Artificial Sequence
  chemically synthesized
tcttaacagcatagaagaca

SEQ ID NO: 78844 - DNA, 20 bp, Artificial Sequence
  chemically synthesized
cagttatcttaacagcatag

SEQ ID NO: 78845 - DNA, 20 bp, Artificial Sequence
  chemically synthesized
gctatgtcttctatgctgtt

SEQ ID NO: 78846 - DNA, 20 bp, Artificial Sequence
  chemically synthesized
cttcagttatcttaacagca

SEQ ID NO: 78847 - DNA, 20 bp, Artificial Sequence
  chemically synthesized
atttacttcagttatcttaa

SEQ ID NO: 78848 - DNA, 20 bp, Artificial Sequence
  chemically synthesized
ctatgctgttaagataactg

SEQ ID NO: 78849 - DNA, 20 bp, Artificial Sequence
  chemically synthesized
attcttaaacttatttactt

SEQ ID NO: 78850 - DNA, 20 bp, Artificial Sequence
  chemically synthesized
ttaagataactgaagtaaat

SEQ ID NO: 78851 - DNA, 20 bp, Artificial Sequence
  chemically synthesized
taactgaagtaaataagttt

SEQ ID NO: 78852 - DNA, 20 bp, Artificial Sequence
  chemically synthesized
agtttaagaatcactgctct

SEQ ID NO: 78853 - DNA, 20 bp, Artificial Sequence
  chemically synthesized
ttaagaatcactgctctcgg

SEQ ID NO: 78854 - DNA, 20 bp, Artificial Sequence
  chemically synthesized
ttaaaagcatcttccgagag

SEQ ID NO: 78855 - DNA, 20 bp, Artificial Sequence
  chemically synthesized
tatttaaaagcatcttccga

SEQ ID NO: 78856 - DNA, 20 bp, Artificial Sequence
  chemically synthesized
tctatttaaaagcatcttcc

SEQ ID NO: 78857 - DNA, 20 bp, Artificial Sequence
  chemically synthesized
tctcggaagatgcttttaaa

SEQ ID NO: 78858 - DNA, 20 bp, Artificial Sequence
  chemically synthesized
ctgcaggtttttctatttaa

SEQ ID NO: 78859 - DNA, 20 bp, Artificial Sequence
  chemically synthesized
cttttaaatagaaaaacctg

SEQ ID NO: 78860 - DNA, 20 bp, Artificial Sequence
  chemically synthesized
taaatagaaaaacctgcagt

SEQ ID NO: 78861 - DNA, 20 bp, Artificial Sequence
  chemically synthesized
ttatagtttacacttactgc

SEQ ID NO: 78862 - DNA, 20 bp, Artificial Sequence
  chemically synthesized
gttatagtttacacttactg

SEQ ID NO: 78863 - DNA, 20 bp, Artificial Sequence
  chemically synthesized
taaaataatatttttagtta

SEQ ID NO: 78864 - DNA, 20 bp, Artificial Sequence
  chemically synthesized
tcatgttaaaataatatttt

SEQ ID NO: 78865 - DNA, 20 bp, Artificial Sequence
  chemically synthesized
agaaagaactttttcataat

SEQ ID NO: 78866 - DNA, 20 bp, Artificial Sequence
  chemically synthesized
gaaaaaatcttattatgaaa

SEQ ID NO: 78867 - DNA, 20 bp, Artificial Sequence
  chemically synthesized
attatgaaaaagttctttct

SEQ ID NO: 78868 - DNA, 20 bp, Artificial Sequence
  chemically synthesized
ttatgaaaaagttctttctt

SEQ ID NO: 78869 - DNA, 20 bp, Artificial Sequence
  chemically synthesized
cattttaatggggcctaaga

SEQ ID NO: 78870 - DNA, 20 bp, Artificial Sequence
  chemically synthesized
ctctcattttaatggggcct

SEQ ID NO: 78871 - DNA, 20 bp, Artificial Sequence
  chemically synthesized
atgtctctctcattttaatg

SEQ ID NO: 78872 - DNA, 20 bp, Artificial Sequence
  chemically synthesized
aatgtctctctcattttaat

SEQ ID NO: 78873 - DNA, 20 bp, Artificial Sequence
  chemically synthesized
ttcttaggccccattaaaat

SEQ ID NO: 78874 - DNA, 20 bp, Artificial Sequence
  chemically synthesized
taatgtctctctcattttaa

SEQ ID NO: 78875 - DNA, 20 bp, Artificial Sequence
  chemically synthesized
cttaggccccattaaaatga

SEQ ID NO: 78876 - DNA, 20 bp, Artificial Sequence
  chemically synthesized
taggccccattaaaatgaga

SEQ ID NO: 78877 - DNA, 20 bp, Artificial Sequence
  chemically synthesized
cattaaaatgagagagacat

SEQ ID NO: 78878 - DNA, 20 bp, Artificial Sequence
  chemically synthesized
tgagagagacattagtatca

SEQ ID NO: 78879 - DNA, 20 bp, Artificial Sequence
  chemically synthesized
ttttctgggtattatgggaa

SEQ ID NO: 78880 - DNA, 20 bp, Artificial Sequence
  chemically synthesized
atcagttttctgggtattat

SEQ ID NO: 78881 - DNA, 20 bp, Artificial Sequence
  chemically synthesized
acaactgttcccataatacc

SEQ ID NO: 78882 - DNA, 20 bp, Artificial Sequence
  chemically synthesized
aatcagttttctgggtatta

SEQ ID NO: 78883 - DNA, 20 bp, Artificial Sequence
  chemically synthesized
tcttggtaaatcagttttct

SEQ ID NO: 78884 - DNA, 20 bp, Artificial Sequence
  chemically synthesized
ttcttggtaaatcagttttc

SEQ ID NO: 78885 - DNA, 20 bp, Artificial Sequence
  chemically synthesized
acccagaaaactgatttacc

SEQ ID NO: 78886 - DNA, 20 bp, Artificial Sequence
  chemically synthesized
aataatttttcttggtaaat

SEQ ID NO: 78887 - DNA, 20 bp, Artificial Sequence
  chemically synthesized
tggcattgaataatttttct

SEQ ID NO: 78888 - DNA, 20 bp, Artificial Sequence
  chemically synthesized
aaattaactaagttaagtaa

SEQ ID NO: 78889 - DNA, 20 bp, Artificial Sequence
  chemically synthesized
ttcaatgccattacttaact

SEQ ID NO: 78890 - DNA, 20 bp, Artificial Sequence
  chemically synthesized
aacctgaaattaactaagtt

SEQ ID NO: 78891 - DNA, 20 bp, Artificial Sequence
  chemically synthesized
tacacaacctgaaattaact

SEQ ID NO: 78892 - DNA, 20 bp, Artificial Sequence
  chemically synthesized
ttacttaacttagttaattt

SEQ ID NO: 78893 - DNA, 20 bp, Artificial Sequence
  chemically synthesized
tacttaacttagttaatttc

SEQ ID NO: 78894 - DNA, 20 bp, Artificial Sequence
  chemically synthesized
tagttaatttcaggttgtgt

SEQ ID NO: 78895 - DNA, 20 bp, Artificial Sequence
  chemically synthesized
agttaatttcaggttgtgta

SEQ ID NO: 78896 - DNA, 20 bp, Artificial Sequence
  chemically synthesized
ggttgtgtaaggcataatac

SEQ ID NO: 78897 - DNA, 20 bp, Artificial Sequence
  chemically synthesized
ttaacagttagcattgacac

SEQ ID NO: 78898 - DNA, 20 bp, Artificial Sequence
  chemically synthesized
aattttcaaaatttaacagt

SEQ ID NO: 78899 - DNA, 20 bp, Artificial Sequence
  chemically synthesized
ttacaattttcaaaatttaa

SEQ ID NO: 78900 - DNA, 20 bp, Artificial Sequence
  chemically synthesized
ttttgaaaattgtaattgtc

SEQ ID NO: 78901 - DNA, 20 bp, Artificial Sequence
  chemically synthesized
attgtaattgtcaagcatga

SEQ ID NO: 78902 - DNA, 20 bp, Artificial Sequence
  chemically synthesized
ttgtaattgtcaagcatgac

SEQ ID NO: 78903 - DNA, 20 bp, Artificial Sequence
  chemically synthesized
taattgtcaagcatgacagg

SEQ ID NO: 78904 - DNA, 20 bp, Artificial Sequence
  chemically synthesized
ttgtcaagcatgacaggaag

SEQ ID NO: 78905 - DNA, 20 bp, Artificial Sequence
  chemically synthesized
acaggaagaagcgaactcct

SEQ ID NO: 78906 - DNA, 20 bp, Artificial Sequence
  chemically synthesized
caggaagaagcgaactcctt

SEQ ID NO: 78907 - DNA, 20 bp, Artificial Sequence
  chemically synthesized
ttaagatcaaataacccaag

SEQ ID NO: 78908 - DNA, 20 bp, Artificial Sequence
  chemically synthesized
ctttaagatcaaataaccca

SEQ ID NO: 78909 - DNA, 20 bp, Artificial Sequence
  chemically synthesized
gctttaagatcaaataaccc

SEQ ID NO: 78910 - DNA, 20 bp, Artificial Sequence
  chemically synthesized
ccttgggttatttgatctta

SEQ ID NO: 78911 - DNA, 20 bp, Artificial Sequence
  chemically synthesized
agtaaaacaggaaatgcttt

SEQ ID NO: 78912 - DNA, 20 bp, Artificial Sequence
  chemically synthesized
ctcctaccgttcagtaaaac

SEQ ID NO: 78913 - DNA, 20 bp, Artificial Sequence
  chemically synthesized
tctcctaccgttcagtaaaa

SEQ ID NO: 78914 - DNA, 20 bp, Artificial Sequence
  chemically synthesized
gcatttcctgttttactgaa

SEQ ID NO: 78915 - DNA, 20 bp, Artificial Sequence
  chemically synthesized
tttcctgttttactgaacgg

SEQ ID NO: 78916 - DNA, 20 bp, Artificial Sequence
  chemically synthesized
ttcctgttttactgaacggt

SEQ ID NO: 78917 - DNA, 20 bp, Artificial Sequence
  chemically synthesized
tctgttactctcctaccgtt

SEQ ID NO: 78918 - DNA, 20 bp, Artificial Sequence
  chemically synthesized
cctgttttactgaacggtag

SEQ ID NO: 78919 - DNA, 20 bp, Artificial Sequence
  chemically synthesized
tgttttactgaacggtagga

SEQ ID NO: 78920 - DNA, 20 bp, Artificial Sequence
  chemically synthesized
actgaacggtaggagagtaa

SEQ ID NO: 78921 - DNA, 20 bp, Artificial Sequence
  chemically synthesized
ccaaagttgtgacaagaata

SEQ ID NO: 78922 - DNA, 20 bp, Artificial Sequence
  chemically synthesized
acatctaccaaagttgtgac

SEQ ID NO: 78923 - DNA, 20 bp, Artificial Sequence
  chemically synthesized
ctttattcttgtcacaactt

SEQ ID NO: 78924 - DNA, 20 bp, Artificial Sequence
  chemically synthesized
tattcttgtcacaactttgg

SEQ ID NO: 78925 - DNA, 20 bp, Artificial Sequence
  chemically synthesized
ttattttttgacatctacca

SEQ ID NO: 78926 - DNA, 20 bp, Artificial Sequence
  chemically synthesized
aaataattaaaaatatatat

SEQ ID NO: 78927 - DNA, 20 bp, Artificial Sequence
  chemically synthesized
cctaagaaaatggaatcaca

SEQ ID NO: 78928 - DNA, 20 bp, Artificial Sequence
  chemically synthesized
gctgtgtgattccattttct

SEQ ID NO: 78929 - DNA, 20 bp, Artificial Sequence
  chemically synthesized
ctgtgtgattccattttctt

SEQ ID NO: 78930 - DNA, 20 bp, Artificial Sequence
  chemically synthesized
ttccatatttcctaagaaaa

SEQ ID NO: 78931 - DNA, 20 bp, Artificial Sequence
  chemically synthesized
actgaaattccatatttcct

SEQ ID NO: 78932 - DNA, 20 bp, Artificial Sequence
  chemically synthesized
ttccattttcttaggaaata

SEQ ID NO: 78933 - DNA, 20 bp, Artificial Sequence
  chemically synthesized
tcttaggaaatatggaattt

SEQ ID NO: 78934 - DNA, 20 bp, Artificial Sequence
  chemically synthesized
taaataaataactcacattt

SEQ ID NO: 78935 - DNA, 20 bp, Artificial Sequence
  chemically synthesized
tagaaacagtgctaaaatgt

SEQ ID NO: 78936 - DNA, 20 bp, Artificial Sequence
  chemically synthesized
tcacattttagcactgtttc

SEQ ID NO: 78937 - DNA, 20 bp, Artificial Sequence
  chemically synthesized
tgtaccacattaactagaaa

SEQ ID NO: 78938 - DNA, 20 bp, Artificial Sequence
  chemically synthesized
agcactgtttctagttaatg

SEQ ID NO: 78939 - DNA, 20 bp, Artificial Sequence
  chemically synthesized
tgtgcatgtaccacattaac

SEQ ID NO: 78940 - DNA, 20 bp, Artificial Sequence
  chemically synthesized
gtacatgcacatgtatacac

SEQ ID NO: 78941 - DNA, 20 bp, Artificial Sequence
  chemically synthesized
gagggagcaagaatttgtat

SEQ ID NO: 78942 - DNA, 20 bp, Artificial Sequence
  chemically synthesized
aatacaaattcttgctccct

SEQ ID NO: 78943 - DNA, 20 bp, Artificial Sequence
  chemically synthesized
tagcaccaagctgagggagc

SEQ ID NO: 78944 - DNA, 20 bp, Artificial Sequence
  chemically synthesized
tatttagcaccaagctgagg

SEQ ID NO: 78945 - DNA, 20 bp, Artificial Sequence
  chemically synthesized
aaattcttgctccctcagct

SEQ ID NO: 78946 - DNA, 20 bp, Artificial Sequence
  chemically synthesized
attatttagcaccaagctga

SEQ ID NO: 78947 - DNA, 20 bp, Artificial Sequence
  chemically synthesized
tattatttagcaccaagctg

SEQ ID NO: 78948 - DNA, 20 bp, Artificial Sequence
  chemically synthesized
ttattatttagcaccaagct

SEQ ID NO: 78949 - DNA, 20 bp, Artificial Sequence
  chemically synthesized
gaatattattatttagcacc

SEQ ID NO: 78950 - DNA, 20 bp, Artificial Sequence
  chemically synthesized
ttcctgggaatattattatt

SEQ ID NO: 78951 - DNA, 20 bp, Artificial Sequence
  chemically synthesized
gtgctaaataataatattcc

SEQ ID NO: 78952 - DNA, 20 bp, Artificial Sequence
  chemically synthesized
tgctaaataataatattccc

SEQ ID NO: 78953 - DNA, 20 bp, Artificial Sequence
  chemically synthesized
gatggcatcttagttttcct

SEQ ID NO: 78954 - DNA, 20 bp, Artificial Sequence
  chemically synthesized
agatggcatcttagttttcc

SEQ ID NO: 78955 - DNA, 20 bp, Artificial Sequence
  chemically synthesized
ataatattcccaggaaaact

SEQ ID NO: 78956 - DNA, 20 bp, Artificial Sequence
  chemically synthesized
gagttgtatagatggcatct

SEQ ID NO: 78957 - DNA, 20 bp, Artificial Sequence
  chemically synthesized
tatattgagagttgtataga

SEQ ID NO: 78958 - DNA, 20 bp, Artificial Sequence
  chemically synthesized
aaattatattgagagttgta

SEQ ID NO: 78959 - DNA, 20 bp, Artificial Sequence
  chemically synthesized
aaaaacaaaaattatattga

SEQ ID NO: 78960 - DNA, 20 bp, Artificial Sequence
  chemically synthesized
tcaaaaacaaaaattatatt

SEQ ID NO: 78961 - DNA, 20 bp, Artificial Sequence
  chemically synthesized
aaatgttcacactctataat

SEQ ID NO: 78962 - DNA, 20 bp, Artificial Sequence
  chemically synthesized
agaagtctgatctcattata

SEQ ID NO: 78963 - DNA, 20 bp, Artificial Sequence
  chemically synthesized
agagaagtctgatctcatta

SEQ ID NO: 78964 - DNA, 20 bp, Artificial Sequence
  chemically synthesized
ttcacactctataatgagat

SEQ ID NO: 78965 - DNA, 20 bp, Artificial Sequence
  chemically synthesized
ataatgagatcagacttctc

SEQ ID NO: 78966 - DNA, 20 bp, Artificial Sequence
  chemically synthesized
taatgagatcagacttctct

SEQ ID NO: 78967 - DNA, 20 bp, Artificial Sequence
  chemically synthesized
attgaaacctatacccagag

SEQ ID NO: 78968 - DNA, 20 bp, Artificial Sequence
  chemically synthesized
agatcagacttctctgggta

SEQ ID NO: 78969 - DNA, 20 bp, Artificial Sequence
  chemically synthesized
gatcagacttctctgggtat

SEQ ID NO: 78970 - DNA, 20 bp, Artificial Sequence
  chemically synthesized
atgattgaaacctataccca

SEQ ID NO: 78971 - DNA, 20 bp, Artificial Sequence
  chemically synthesized
atatgattgaaacctatacc

SEQ ID NO: 78972 - DNA, 20 bp, Artificial Sequence
  chemically synthesized
catatcatgaattaatgaat

SEQ ID NO: 78973 - DNA, 20 bp, Artificial Sequence
  chemically synthesized
taatatactctcagtattag

SEQ ID NO: 78974 - DNA, 20 bp, Artificial Sequence
  chemically synthesized
tttgtatatcctctaatact

SEQ ID NO: 78975 - DNA, 20 bp, Artificial Sequence
  chemically synthesized
gtaatatactctcagtatta

SEQ ID NO: 78976 - DNA, 20 bp, Artificial Sequence
  chemically synthesized
tgtatatcctctaatactga

SEQ ID NO: 78977 - DNA, 20 bp, Artificial Sequence
  chemically synthesized
aagtaatatactctcagtat

SEQ ID NO: 78978 - DNA, 20 bp, Artificial Sequence
  chemically synthesized
aaacttaagtaatatactct

SEQ ID NO: 78979 - DNA, 20 bp, Artificial Sequence
  chemically synthesized
atactgagagtatattactt

SEQ ID NO: 78980 - DNA, 20 bp, Artificial Sequence
  chemically synthesized
aaagattattcaaaaaactt

SEQ ID NO: 78981 - DNA, 20 bp, Artificial Sequence
  chemically synthesized
tcaagagtctcgggtaataa

SEQ ID NO: 78982 - DNA, 20 bp, Artificial Sequence
  chemically synthesized
tgaataatcttttattaccc

SEQ ID NO: 78983 - DNA, 20 bp, Artificial Sequence
  chemically synthesized
tactattcctcaagagtctc

SEQ ID NO: 78984 - DNA, 20 bp, Artificial Sequence
  chemically synthesized
atactattcctcaagagtct

SEQ ID NO: 78985 - DNA, 20 bp, Artificial Sequence
  chemically synthesized
ttttattacccgagactctt

SEQ ID NO: 78986 - DNA, 20 bp, Artificial Sequence
  chemically synthesized
tttattacccgagactcttg

SEQ ID NO: 78987 - DNA, 20 bp, Artificial Sequence
  chemically synthesized
ctagaaatactattcctcaa

SEQ ID NO: 78988 - DNA, 20 bp, Artificial Sequence
  chemically synthesized
tacccgagactcttgaggaa

SEQ ID NO: 78989 - DNA, 20 bp, Artificial Sequence
  chemically synthesized
aactagaaatactattcctc

SEQ ID NO: 78990 - DNA, 20 bp, Artificial Sequence
  chemically synthesized
ctcttgaggaatagtatttc

SEQ ID NO: 78991 - DNA, 20 bp, Artificial Sequence
  chemically synthesized
tgtttgtggtgggtaataac

SEQ ID NO: 78992 - DNA, 20 bp, Artificial Sequence
  chemically synthesized
ctgaaagctttgtttgtggt

SEQ ID NO: 78993 - DNA, 20 bp, Artificial Sequence
  chemically synthesized
tctgaaagctttgtttgtgg

SEQ ID NO: 78994 - DNA, 20 bp, Artificial Sequence
  chemically synthesized
gttattacccaccacaaaca

SEQ ID NO: 78995 - DNA, 20 bp, Artificial Sequence
  chemically synthesized
ttttctgaaagctttgtttg

SEQ ID NO: 78996 - DNA, 20 bp, Artificial Sequence
  chemically synthesized
cccaccacaaacaaagcttt

SEQ ID NO: 78997 - DNA, 20 bp, Artificial Sequence
  chemically synthesized
tgtttgctaggattttctga

SEQ ID NO: 78998 - DNA, 20 bp, Artificial Sequence
  chemically synthesized
acaaagctttcagaaaatcc

SEQ ID NO: 78999 - DNA, 20 bp, Artificial Sequence
  chemically synthesized
tttcagaaaatcctagcaaa

SEQ ID NO: 79000 - DNA, 20 bp, Artificial Sequence
  chemically synthesized
ttcagaaaatcctagcaaac

SEQ ID NO: 79001 - DNA, 20 bp, Artificial Sequence
  chemically synthesized
atatgccaatcctgtttgct

SEQ ID NO: 79002 - DNA, 20 bp, Artificial Sequence
  chemically synthesized
aatatgccaatcctgtttgc

SEQ ID NO: 79003 - DNA, 20 bp, Artificial Sequence
  chemically synthesized
aaaatcctagcaaacaggat

SEQ ID NO: 79004 - DNA, 20 bp, Artificial Sequence
  chemically synthesized
caaacaggattggcatatta

SEQ ID NO: 79005 - DNA, 20 bp, Artificial Sequence
  chemically synthesized
aaacaggattggcatattat

SEQ ID NO: 79006 - DNA, 20 bp, Artificial Sequence
  chemically synthesized
ggattggcatattataggat

SEQ ID NO: 79007 - DNA, 20 bp, Artificial Sequence
  chemically synthesized
tataggatcagatgttgata

SEQ ID NO: 79008 - DNA, 20 bp, Artificial Sequence
  chemically synthesized
ttgatatggttgttttcaaa

SEQ ID NO: 79009 - DNA, 20 bp, Artificial Sequence
  chemically synthesized
atatggttgttttcaaatag

SEQ ID NO: 79010 - DNA, 20 bp, Artificial Sequence
  chemically synthesized
tatggttgttttcaaatagt

SEQ ID NO: 79011 - DNA, 20 bp, Artificial Sequence
  chemically synthesized
ggttgttttcaaatagtagg

SEQ ID NO: 79012 - DNA, 20 bp, Artificial Sequence
  chemically synthesized
gttgttttcaaatagtagga

SEQ ID NO: 79013 - DNA, 20 bp, Artificial Sequence
  chemically synthesized
ttttcaaatagtaggaagga

SEQ ID NO: 79014 - DNA, 20 bp, Artificial Sequence
  chemically synthesized
gtaggaaggatggtattatt

SEQ ID NO: 79015 - DNA, 20 bp, Artificial Sequence
  chemically synthesized
aggaaggatggtattatttg

SEQ ID NO: 79016 - DNA, 20 bp, Artificial Sequence
  chemically synthesized
ctactcaagaagtgtttaat

SEQ ID NO: 79017 - DNA, 20 bp, Artificial Sequence
  chemically synthesized
tatctgattaaacacttctt

SEQ ID NO: 79018 - DNA, 20 bp, Artificial Sequence
  chemically synthesized
ctgattaaacacttcttgag

SEQ ID NO: 79019 - DNA, 20 bp, Artificial Sequence
  chemically synthesized
ttcatctgattctactcaag

SEQ ID NO: 79020 - DNA, 20 bp, Artificial Sequence
  chemically synthesized
gagttcatctgattctactc

SEQ ID NO: 79021 - DNA, 20 bp, Artificial Sequence
  chemically synthesized
aaacacttcttgagtagaat

SEQ ID NO: 79022 - DNA, 20 bp, Artificial Sequence
  chemically synthesized
gtagaatcagatgaactcat

SEQ ID NO: 79023 - DNA, 20 bp, Artificial Sequence
  chemically synthesized
aatcaaaatgttcagctaat

SEQ ID NO: 79024 - DNA, 20 bp, Artificial Sequence
  chemically synthesized
acacgggtaatcaaaatgtt

SEQ ID NO: 79025 - DNA, 20 bp, Artificial Sequence
  chemically synthesized
tgggatatttaggagaacac

SEQ ID NO: 79026 - DNA, 20 bp, Artificial Sequence
  chemically synthesized
atgggatatttaggagaaca

SEQ ID NO: 79027 - DNA, 20 bp, Artificial Sequence
  chemically synthesized
tctggtcatgggatatttag

SEQ ID NO: 79028 - DNA, 20 bp, Artificial Sequence
  chemically synthesized
cttctggtcatgggatattt

SEQ ID NO: 79029 - DNA, 20 bp, Artificial Sequence
  chemically synthesized
tcttctggtcatgggatatt

SEQ ID NO: 79030 - DNA, 20 bp, Artificial Sequence
  chemically synthesized
tctcctaaatatcccatgac

SEQ ID NO: 79031 - DNA, 20 bp, Artificial Sequence
  chemically synthesized
acagctactcttctggtcat

SEQ ID NO: 79032 - DNA, 20 bp, Artificial Sequence
  chemically synthesized
cctaaatatcccatgaccag

SEQ ID NO: 79033 - DNA, 20 bp, Artificial Sequence
  chemically synthesized
tacagctactcttctggtca

SEQ ID NO: 79034 - DNA, 20 bp, Artificial Sequence
  chemically synthesized
taaatatcccatgaccagaa

SEQ ID NO: 79035 - DNA, 20 bp, Artificial Sequence
  chemically synthesized
atatcccatgaccagaagag

SEQ ID NO: 79036 - DNA, 20 bp, Artificial Sequence
  chemically synthesized
gagttgtacagctactcttc

SEQ ID NO: 79037 - DNA, 20 bp, Artificial Sequence
  chemically synthesized
tggattaaatcagagttgta

SEQ ID NO: 79038 - DNA, 20 bp, Artificial Sequence
  chemically synthesized
attgttattggattaaatca

SEQ ID NO: 79039 - DNA, 20 bp, Artificial Sequence
  chemically synthesized
ttattgttattggattaaat

SEQ ID NO: 79040 - DNA, 20 bp, Artificial Sequence
  chemically synthesized
gaattggttattattgttat

SEQ ID NO: 79041 - DNA, 20 bp, Artificial Sequence
  chemically synthesized
ataacaataataaccaattc

SEQ ID NO: 79042 - DNA, 20 bp, Artificial Sequence
  chemically synthesized
ataaaagaaggagctagaat

SEQ ID NO: 79043 - DNA, 20 bp, Artificial Sequence
  chemically synthesized
actgtgataaaagaaggagc

SEQ ID NO: 79044 - DNA, 20 bp, Artificial Sequence
  chemically synthesized
atggactgtgataaaagaag

SEQ ID NO: 79045 - DNA, 20 bp, Artificial Sequence
  chemically synthesized
tgatggactgtgataaaaga

SEQ ID NO: 79046 - DNA, 20 bp, Artificial Sequence
  chemically synthesized
ttgatggactgtgataaaag

SEQ ID NO: 79047 - DNA, 20 bp, Artificial Sequence
  chemically synthesized
tctagctccttcttttatca

SEQ ID NO: 79048 - DNA, 20 bp, Artificial Sequence
  chemically synthesized
attttgatggactgtgataa

SEQ ID NO: 79049 - DNA, 20 bp, Artificial Sequence
  chemically synthesized
acttctttgtgttattttga

SEQ ID NO: 79050 - DNA, 20 bp, Artificial Sequence
  chemically synthesized
cagtccatcaaaataacaca

SEQ ID NO: 79051 - DNA, 20 bp, Artificial Sequence
  chemically synthesized
tccatcaaaataacacaaag

SEQ ID NO: 79052 - DNA, 20 bp, Artificial Sequence
  chemically synthesized
tcattgaacttattttaatt

SEQ ID NO: 79053 - DNA, 20 bp, Artificial Sequence
  chemically synthesized
aaagaagtccaaattaaaat

SEQ ID NO: 79054 - DNA, 20 bp, Artificial Sequence
  chemically synthesized
aaaataagttcaatgacaaa

SEQ ID NO: 79055 - DNA, 20 bp, Artificial Sequence
  chemically synthesized
ggctttagaacagttggaaa

SEQ ID NO: 79056 - DNA, 20 bp, Artificial Sequence
  chemically synthesized
aggctttagaacagttggaa

SEQ ID NO: 79057 - DNA, 20 bp, Artificial Sequence
  chemically synthesized
ggaaaaggctttagaacagt

SEQ ID NO: 79058 - DNA, 20 bp, Artificial Sequence
  chemically synthesized
ttccttttccaactgttcta

SEQ ID NO: 79059 - DNA, 20 bp, Artificial Sequence
  chemically synthesized
gacaggaaaaggctttagaa

SEQ ID NO: 79060 - DNA, 20 bp, Artificial Sequence
  chemically synthesized
ttaaagacaggaaaaggctt

SEQ ID NO: 79061 - DNA, 20 bp, Artificial Sequence
  chemically synthesized
ctttgcttaaagacaggaaa

SEQ ID NO: 79062 - DNA, 20 bp, Artificial Sequence
  chemically synthesized
actttgcttaaagacaggaa

SEQ ID NO: 79063 - DNA, 20 bp, Artificial Sequence
  chemically synthesized
taaagccttttcctgtcttt

SEQ ID NO: 79064 - DNA, 20 bp, Artificial Sequence
  chemically synthesized
aatgaactttgcttaaagac

SEQ ID NO: 79065 - DNA, 20 bp, Artificial Sequence
  chemically synthesized
gaatgaactttgcttaaaga

SEQ ID NO: 79066 - DNA, 20 bp, Artificial Sequence
  chemically synthesized
ccttttcctgtctttaagca

SEQ ID NO: 79067 - DNA, 20 bp, Artificial Sequence
  chemically synthesized
gactgaatgaactttgctta

SEQ ID NO: 79068 - DNA, 20 bp, Artificial Sequence
  chemically synthesized
gtctttaagcaaagttcatt

SEQ ID NO: 79069 - DNA, 20 bp, Artificial Sequence
  chemically synthesized
ctgcttttactttcatagat

SEQ ID NO: 79070 - DNA, 20 bp, Artificial Sequence
  chemically synthesized
agtcattatctcatctatga

SEQ ID NO: 79071 - DNA, 20 bp, Artificial Sequence
  chemically synthesized
tccttctgcttttactttca

SEQ ID NO: 79072 - DNA, 20 bp, Artificial Sequence
  chemically synthesized
tatctcatctatgaaagtaa

SEQ ID NO: 79073 - DNA, 20 bp, Artificial Sequence
  chemically synthesized
ctcatctatgaaagtaaaag

SEQ ID NO: 79074 - DNA, 20 bp, Artificial Sequence
  chemically synthesized
atctatgaaagtaaaagcag

SEQ ID NO: 79075 - DNA, 20 bp, Artificial Sequence
  chemically synthesized
tctatgaaagtaaaagcaga

SEQ ID NO: 79076 - DNA, 20 bp, Artificial Sequence
  chemically synthesized
taaagccatttatttaataa

SEQ ID NO: 79077 - DNA, 20 bp, Artificial Sequence
  chemically synthesized
ataaagccatttatttaata

SEQ ID NO: 79078 - DNA, 20 bp, Artificial Sequence
  chemically synthesized
cataaagccatttatttaat

SEQ ID NO: 79079 - DNA, 20 bp, Artificial Sequence
  chemically synthesized
tgtttcccttattaaataaa

SEQ ID NO: 79080 - DNA, 20 bp, Artificial Sequence
  chemically synthesized
ccttccacatcgaaagcata

SEQ ID NO: 79081 - DNA, 20 bp, Artificial Sequence
  chemically synthesized
atggctttatgctttcgatg

SEQ ID NO: 79082 - DNA, 20 bp, Artificial Sequence
  chemically synthesized
tgaaatgccttccacatcga

SEQ ID NO: 79083 - DNA, 20 bp, Artificial Sequence
  chemically synthesized
gctttatgctttcgatgtgg

SEQ ID NO: 79084 - DNA, 20 bp, Artificial Sequence
  chemically synthesized
ctttatgctttcgatgtgga

SEQ ID NO: 79085 - DNA, 20 bp, Artificial Sequence
  chemically synthesized
atgtggaaggcatttcataa

SEQ ID NO: 79086 - DNA, 20 bp, Artificial Sequence
  chemically synthesized
gcatttcataacagtcaaaa

SEQ ID NO: 79087 - DNA, 20 bp, Artificial Sequence
  chemically synthesized
catttcataacagtcaaaaa

SEQ ID NO: 79088 - DNA, 20 bp, Artificial Sequence
  chemically synthesized
ttcataacagtcaaaaaagg

SEQ ID NO: 79089 - DNA, 20 bp, Artificial Sequence
  chemically synthesized
ggtgggaggaaatgagttga

SEQ ID NO: 79090 - DNA, 20 bp, Artificial Sequence
  chemically synthesized
aacagtgggtgggaggaaat

SEQ ID NO: 79091 - DNA, 20 bp, Artificial Sequence
  chemically synthesized
gatttaaaacagtgggtggg

SEQ ID NO: 79092 - DNA, 20 bp, Artificial Sequence
  chemically synthesized
cgatttaaaacagtgggtgg

SEQ ID NO: 79093 - DNA, 20 bp, Artificial Sequence
  chemically synthesized
aacgatttaaaacagtgggt

SEQ ID NO: 79094 - DNA, 20 bp, Artificial Sequence
  chemically synthesized
aaacgatttaaaacagtggg

SEQ ID NO: 79095 - DNA, 20 bp, Artificial Sequence
  chemically synthesized
aacaaacgatttaaaacagt

SEQ ID NO: 79096 - DNA, 20 bp, Artificial Sequence
  chemically synthesized
aaacaaacgatttaaaacag

SEQ ID NO: 79097 - DNA, 20 bp, Artificial Sequence
  chemically synthesized
accaaacaaacgatttaaaa

SEQ ID NO: 79098 - DNA, 20 bp, Artificial Sequence
  chemically synthesized
actgttttaaatcgtttgtt

SEQ ID NO: 79099 - DNA, 20 bp, Artificial Sequence
  chemically synthesized
tatgtaagtgtagtatacat

SEQ ID NO: 79100 - DNA, 20 bp, Artificial Sequence
  chemically synthesized
ataaacaacttatgtaagtg

SEQ ID NO: 79101 - DNA, 20 bp, Artificial Sequence
  chemically synthesized
aatgtatactacacttacat

SEQ ID NO: 79102 - DNA, 20 bp, Artificial Sequence
  chemically synthesized
tcttcataaacaacttatgt

SEQ ID NO: 79103 - DNA, 20 bp, Artificial Sequence
  chemically synthesized
acttacataagttgtttatg

SEQ ID NO: 79104 - DNA, 20 bp, Artificial Sequence
  chemically synthesized
ttacataagttgtttatgaa

SEQ ID NO: 79105 - DNA, 20 bp, Artificial Sequence
  chemically synthesized
tttatgaagagccaaattaa

SEQ ID NO: 79106 - DNA, 20 bp, Artificial Sequence
  chemically synthesized
aattgcaaagactattaatt

SEQ ID NO: 79107 - DNA, 20 bp, Artificial Sequence
  chemically synthesized
ttccaacaaaaacaattgca

SEQ ID NO: 79108 - DNA, 20 bp, Artificial Sequence
  chemically synthesized
gtctttgcaattgtttttgt

SEQ ID NO: 79109 - DNA, 20 bp, Artificial Sequence
  chemically synthesized
caattgtttttgttggaatt

SEQ ID NO: 79110 - DNA, 20 bp, Artificial Sequence
  chemically synthesized
attgtttttgttggaatttg

SEQ ID NO: 79111 - DNA, 20 bp, Artificial Sequence
  chemically synthesized
tgtttttgttggaatttgga

SEQ ID NO: 79112 - DNA, 20 bp, Artificial Sequence
  chemically synthesized
ttggaatttggagagctgac

SEQ ID NO: 79113 - DNA, 20 bp, Artificial Sequence
  chemically synthesized
ttttctactaattcacttgt

SEQ ID NO: 79114 - DNA, 20 bp, Artificial Sequence
  chemically synthesized
tggagagctgacaagtgaat

SEQ ID NO: 79115 - DNA, 20 bp, Artificial Sequence
  chemically synthesized
agagctgacaagtgaattag

SEQ ID NO: 79116 - DNA, 20 bp, Artificial Sequence
  chemically synthesized
acaagtgaattagtagaaaa

SEQ ID NO: 79117 - DNA, 20 bp, Artificial Sequence
  chemically synthesized
aatggcaattctacatgaat

SEQ ID NO: 79118 - DNA, 20 bp, Artificial Sequence
  chemically synthesized
gacttaaaagctaattcatg

SEQ ID NO: 79119 - DNA, 20 bp, Artificial Sequence
  chemically synthesized
ttctacatgaattagctttt

SEQ ID NO: 79120 - DNA, 20 bp, Artificial Sequence
  chemically synthesized
agcctcttagggagacttaa

SEQ ID NO: 79121 - DNA, 20 bp, Artificial Sequence
  chemically synthesized
attagcttttaagtctccct

SEQ ID NO: 79122 - DNA, 20 bp, Artificial Sequence
  chemically synthesized
tagcttttaagtctccctaa

SEQ ID NO: 79123 - DNA, 20 bp, Artificial Sequence
  chemically synthesized
agcttttaagtctccctaag

SEQ ID NO: 79124 - DNA, 20 bp, Artificial Sequence
  chemically synthesized
ttctgcatcagcctcttagg

SEQ ID NO: 79125 - DNA, 20 bp, Artificial Sequence
  chemically synthesized
agttctgcatcagcctctta

SEQ ID NO: 79126 - DNA, 20 bp, Artificial Sequence
  chemically synthesized
aagttctgcatcagcctctt

SEQ ID NO: 79127 - DNA, 20 bp, Artificial Sequence
  chemically synthesized
taagttctgcatcagcctct

SEQ ID NO: 79128 - DNA, 20 bp, Artificial Sequence
  chemically synthesized
gtctccctaagaggctgatg

SEQ ID NO: 79129 - DNA, 20 bp, Artificial Sequence
  chemically synthesized
tctcttattaagttctgcat

SEQ ID NO: 79130 - DNA, 20 bp, Artificial Sequence
  chemically synthesized
aggctgatgcagaacttaat

SEQ ID NO: 79131 - DNA, 20 bp, Artificial Sequence
  chemically synthesized
gctgatgcagaacttaataa

SEQ ID NO: 79132 - DNA, 20 bp, Artificial Sequence
  chemically synthesized
ctcctaataagtctcttatt

SEQ ID NO: 79133 - DNA, 20 bp, Artificial Sequence
  chemically synthesized
gaacttaataagagacttat

SEQ ID NO: 79134 - DNA, 20 bp, Artificial Sequence
  chemically synthesized
aacttaataagagacttatt

SEQ ID NO: 79135 - DNA, 20 bp, Artificial Sequence
  chemically synthesized
cttaataagagacttattag

SEQ ID NO: 79136 - DNA, 20 bp, Artificial Sequence
  chemically synthesized
gttgtcctacttctcctaat

SEQ ID NO: 79137 - DNA, 20 bp, Artificial Sequence
  chemically synthesized
aataagagacttattaggag

SEQ ID NO: 79138 - DNA, 20 bp, Artificial Sequence
  chemically synthesized
aagagacttattaggagaag

SEQ ID NO: 79139 - DNA, 20 bp, Artificial Sequence
  chemically synthesized
agagacttattaggagaagt

SEQ ID NO: 79140 - DNA, 20 bp, Artificial Sequence
  chemically synthesized
agaagtaggacaacttaatt

SEQ ID NO: 79141 - DNA, 20 bp, Artificial Sequence
  chemically synthesized
gtctataatcaatctgaatt

SEQ ID NO: 79142 - DNA, 20 bp, Artificial Sequence
  chemically synthesized
aacttaattcagattgatta

SEQ ID NO: 79143 - DNA, 20 bp, Artificial Sequence
  chemically synthesized
ttcagattgattatagactt

SEQ ID NO: 79144 - DNA, 20 bp, Artificial Sequence
  chemically synthesized
attgattatagacttcggtg

SEQ ID NO: 79145 - DNA, 20 bp, Artificial Sequence
  chemically synthesized
aaccccagctgtcttcaccg

SEQ ID NO: 79146 - DNA, 20 bp, Artificial Sequence
  chemically synthesized
attatagacttcggtgaaga

SEQ ID NO: 79147 - DNA, 20 bp, Artificial Sequence
  chemically synthesized
tagacttcggtgaagacagc

SEQ ID NO: 79148 - DNA, 20 bp, Artificial Sequence
  chemically synthesized
agacttcggtgaagacagct

SEQ ID NO: 79149 - DNA, 20 bp, Artificial Sequence
  chemically synthesized
gacttcggtgaagacagctg

SEQ ID NO: 79150 - DNA, 20 bp, Artificial Sequence
  chemically synthesized
tttcagtttcatttgaaccc

SEQ ID NO: 79151 - DNA, 20 bp, Artificial Sequence
  chemically synthesized
gggttcaaatgaaactgaaa

SEQ ID NO: 79152 - DNA, 20 bp, Artificial Sequence
  chemically synthesized
agtgcatataagttcttttt

SEQ ID NO: 79153 - DNA, 20 bp, Artificial Sequence
  chemically synthesized
gcatactttgaagtgcatat

SEQ ID NO: 79154 - DNA, 20 bp, Artificial Sequence
  chemically synthesized
aagaacttatatgcacttca

SEQ ID NO: 79155 - DNA, 20 bp, Artificial Sequence
  chemically synthesized
catctgcttagcatactttg

SEQ ID NO: 79156 - DNA, 20 bp, Artificial Sequence
  chemically synthesized
tatgcacttcaaagtatgct

SEQ ID NO: 79157 - DNA, 20 bp, Artificial Sequence
  chemically synthesized
gcacttcaaagtatgctaag

SEQ ID NO: 79158 - DNA, 20 bp, Artificial Sequence
  chemically synthesized
aattgtttcagacatctgct

SEQ ID NO: 79159 - DNA, 20 bp, Artificial Sequence
  chemically synthesized
gcagagcggagtaattgttt

SEQ ID NO: 79160 - DNA, 20 bp, Artificial Sequence
  chemically synthesized
acttctgaaaaggcagagcg

SEQ ID NO: 79161 - DNA, 20 bp, Artificial Sequence
  chemically synthesized
aaacttctgaaaaggcagag

SEQ ID NO: 79162 - DNA, 20 bp, Artificial Sequence
  chemically synthesized
ttgaaacttctgaaaaggca

SEQ ID NO: 79163 - DNA, 20 bp, Artificial Sequence
  chemically synthesized
attactccgctctgcctttt

SEQ ID NO: 79164 - DNA, 20 bp, Artificial Sequence
  chemically synthesized
ctttgaaacttctgaaaagg

SEQ ID NO: 79165 - DNA, 20 bp, Artificial Sequence
  chemically synthesized
actccgctctgccttttcag

SEQ ID NO: 79166 - DNA, 20 bp, Artificial Sequence
  chemically synthesized
cgcctttgaaacttctgaaa

SEQ ID NO: 79167 - DNA, 20 bp, Artificial Sequence
  chemically synthesized
ccgcctttgaaacttctgaa

SEQ ID NO: 79168 - DNA, 20 bp, Artificial Sequence
  chemically synthesized
ctgccttttcagaagtttca

SEQ ID NO: 79169 - DNA, 20 bp, Artificial Sequence
  chemically synthesized
tgccttttcagaagtttcaa

SEQ ID NO: 79170 - DNA, 20 bp, Artificial Sequence
  chemically synthesized
cttttcagaagtttcaaagg

SEQ ID NO: 79171 - DNA, 20 bp, Artificial Sequence
  chemically synthesized
ttttcagaagtttcaaaggc

SEQ ID NO: 79172 - DNA, 20 bp, Artificial Sequence
  chemically synthesized
cagaagtttcaaaggcggga

SEQ ID NO: 79173 - DNA, 20 bp, Artificial Sequence
  chemically synthesized
agaagtttcaaaggcgggat

SEQ ID NO: 79174 - DNA, 20 bp, Artificial Sequence
  chemically synthesized
tttcaaaggcgggatgggaa

SEQ ID NO: 79175 - DNA, 20 bp, Artificial Sequence
  chemically synthesized
aaggcgggatgggaatagca

SEQ ID NO: 79176 - DNA, 20 bp, Artificial Sequence
  chemically synthesized
tgggaatagcatggtaaacg

SEQ ID NO: 79177 - DNA, 20 bp, Artificial Sequence
  chemically synthesized
gggaatagcatggtaaacga

SEQ ID NO: 79178 - DNA, 20 bp, Artificial Sequence
  chemically synthesized
aacgaaggttctgtttgcct

SEQ ID NO: 79179 - DNA, 20 bp, Artificial Sequence
  chemically synthesized
cctacctcgacttaggcaaa

SEQ ID NO: 79180 - DNA, 20 bp, Artificial Sequence
  chemically synthesized
aggttctgtttgcctaagtc

SEQ ID NO: 79181 - DNA, 20 bp, Artificial Sequence
  chemically synthesized
ggttctgtttgcctaagtcg

SEQ ID NO: 79182 - DNA, 20 bp, Artificial Sequence
  chemically synthesized
aaaagcccctacctcgactt

SEQ ID NO: 79183 - DNA, 20 bp, Artificial Sequence
  chemically synthesized
taaaagcccctacctcgact

SEQ ID NO: 79184 - DNA, 20 bp, Artificial Sequence
  chemically synthesized
tctgtttgcctaagtcgagg

SEQ ID NO: 79185 - DNA, 20 bp, Artificial Sequence
  chemically synthesized
ctgtttgcctaagtcgaggt

SEQ ID NO: 79186 - DNA, 20 bp, Artificial Sequence
  chemically synthesized
tgtttgcctaagtcgaggta

SEQ ID NO: 79187 - DNA, 20 bp, Artificial Sequence
  chemically synthesized
gtttgcctaagtcgaggtag

SEQ ID NO: 79188 - DNA, 20 bp, Artificial Sequence
  chemically synthesized
tagcgctgtgtgtgttttaa

SEQ ID NO: 79189 - DNA, 20 bp, Artificial Sequence
  chemically synthesized
aggggcttttaaaacacaca

SEQ ID NO: 79190 - DNA, 20 bp, Artificial Sequence
  chemically synthesized
ccaaagcatctgattttaga

SEQ ID NO: 79191 - DNA, 20 bp, Artificial Sequence
  chemically synthesized
cacacagcgctatctaaaat

SEQ ID NO: 79192 - DNA, 20 bp, Artificial Sequence
  chemically synthesized
ttccccaaagcatctgattt

SEQ ID NO: 79193 - DNA, 20 bp, Artificial Sequence
  chemically synthesized
ctatctaaaatcagatgctt

SEQ ID NO: 79194 - DNA, 20 bp, Artificial Sequence
  chemically synthesized
tatctaaaatcagatgcttt

SEQ ID NO: 79195 - DNA, 20 bp, Artificial Sequence
  chemically synthesized
atctaaaatcagatgctttg

SEQ ID NO: 79196 - DNA, 20 bp, Artificial Sequence
  chemically synthesized
aaaatcagatgctttgggga

SEQ ID NO: 79197 - DNA, 20 bp, Artificial Sequence
  chemically synthesized
caaatcactttctttcccca

SEQ ID NO: 79198 - DNA, 20 bp, Artificial Sequence
  chemically synthesized
tcagatgctttggggaaaga

SEQ ID NO: 79199 - DNA, 20 bp, Artificial Sequence
  chemically synthesized
tgatttgacattgctgtcct

SEQ ID NO: 79200 - DNA, 20 bp, Artificial Sequence
  chemically synthesized
taaaagcaaattacttagga

SEQ ID NO: 79201 - DNA, 20 bp, Artificial Sequence
  chemically synthesized
aagctaaaagcaaattactt

SEQ ID NO: 79202 - DNA, 20 bp, Artificial Sequence
  chemically synthesized
aaagctaaaagcaaattact

SEQ ID NO: 79203 - DNA, 20 bp, Artificial Sequence
  chemically synthesized
tgtcctaagtaatttgcttt

SEQ ID NO: 79204 - DNA, 20 bp, Artificial Sequence
  chemically synthesized
tgctttgtttataaagctaa

SEQ ID NO: 79205 - DNA, 20 bp, Artificial Sequence
  chemically synthesized
catctcctgctttgtttata

SEQ ID NO: 79206 - DNA, 20 bp, Artificial Sequence
  chemically synthesized
tgcttttagctttataaaca

SEQ ID NO: 79207 - DNA, 20 bp, Artificial Sequence
  chemically synthesized
ttttagctttataaacaaag

SEQ ID NO: 79208 - DNA, 20 bp, Artificial Sequence
  chemically synthesized
tttagctttataaacaaagc

SEQ ID NO: 79209 - DNA, 20 bp, Artificial Sequence
  chemically synthesized
tagctttataaacaaagcag

SEQ ID NO: 79210 - DNA, 20 bp, Artificial Sequence
  chemically synthesized
ttataaacaaagcaggagat

SEQ ID NO: 79211 - DNA, 20 bp, Artificial Sequence
  chemically synthesized
ataaacaaagcaggagatga

SEQ ID NO: 79212 - DNA, 20 bp, Artificial Sequence
  chemically synthesized
taaacaaagcaggagatgag

SEQ ID NO: 79213 - DNA, 20 bp, Artificial Sequence
  chemically synthesized
aaacaaagcaggagatgaga

SEQ ID NO: 79214 - DNA, 20 bp, Artificial Sequence
  chemically synthesized
aggagatgagagggaataca

SEQ ID NO: 79215 - DNA, 20 bp, Artificial Sequence
  chemically synthesized
agagggaatacatggtaact

SEQ ID NO: 79216 - DNA, 20 bp, Artificial Sequence
  chemically synthesized
atacatggtaactaagtaat

SEQ ID NO: 79217 - DNA, 20 bp, Artificial Sequence
  chemically synthesized
tgccaggagagcttattact

SEQ ID NO: 79218 - DNA, 20 bp, Artificial Sequence
  chemically synthesized
aactaagtaataagctctcc

SEQ ID NO: 79219 - DNA, 20 bp, Artificial Sequence
  chemically synthesized
gtaagttagtgttgccagga

SEQ ID NO: 79220 - DNA, 20 bp, Artificial Sequence
  chemically synthesized
ttgtaagttagtgttgccag

SEQ ID NO: 79221 - DNA, 20 bp, Artificial Sequence
  chemically synthesized
aattgtaagttagtgttgcc

SEQ ID NO: 79222 - DNA, 20 bp, Artificial Sequence
  chemically synthesized
taattgtaagttagtgttgc

SEQ ID NO: 79223 - DNA, 20 bp, Artificial Sequence
  chemically synthesized
atgtgaaattaattgtaagt

SEQ ID NO: 79224 - DNA, 20 bp, Artificial Sequence
  chemically synthesized
ttcaatgtgaaattaattgt

SEQ ID NO: 79225 - DNA, 20 bp, Artificial Sequence
  chemically synthesized
ttcacattgaataaataatt

SEQ ID NO: 79226 - DNA, 20 bp, Artificial Sequence
  chemically synthesized
cattgaataaataatttggt

SEQ ID NO: 79227 - DNA, 20 bp, Artificial Sequence
  chemically synthesized
attgaataaataatttggtc

SEQ ID NO: 79228 - DNA, 20 bp, Artificial Sequence
  chemically synthesized
ttttattattattatacttt

SEQ ID NO: 79229 - DNA, 20 bp, Artificial Sequence
  chemically synthesized
tattattatactttaagttc

SEQ ID NO: 79230 - DNA, 20 bp, Artificial Sequence
  chemically synthesized
cacatgtatcccagaactta

SEQ ID NO: 79231 - DNA, 20 bp, Artificial Sequence
  chemically synthesized
attattatactttaagttct

SEQ ID NO: 79232 - DNA, 20 bp, Artificial Sequence
  chemically synthesized
cacgttctgcacatgtatcc

SEQ ID NO: 79233 - DNA, 20 bp, Artificial Sequence
  chemically synthesized
taagttctgggatacatgtg

SEQ ID NO: 79234 - DNA, 20 bp, Artificial Sequence
  chemically synthesized
ggatacatgtgcagaacgtg

SEQ ID NO: 79235 - DNA, 20 bp, Artificial Sequence
  chemically synthesized
gatacatgtgcagaacgtgc

SEQ ID NO: 79236 - DNA, 20 bp, Artificial Sequence
  chemically synthesized
gaacgtgcaggtttgttaca

SEQ ID NO: 79237 - DNA, 20 bp, Artificial Sequence
  chemically synthesized
aacgtgcaggtttgttacat

SEQ ID NO: 79238 - DNA, 20 bp, Artificial Sequence
  chemically synthesized
acataggtatacacatgcca

SEQ ID NO: 79239 - DNA, 20 bp, Artificial Sequence
  chemically synthesized
taggtatacacatgccatgg

SEQ ID NO: 79240 - DNA, 20 bp, Artificial Sequence
  chemically synthesized
atgggtgcagcaaaccacca

SEQ ID NO: 79241 - DNA, 20 bp, Artificial Sequence
  chemically synthesized
agatgacaggttgatgggtg

SEQ ID NO: 79242 - DNA, 20 bp, Artificial Sequence
  chemically synthesized
aatgtagatgacaggttgat

SEQ ID NO: 79243 - DNA, 20 bp, Artificial Sequence
  chemically synthesized
taatgtagatgacaggttga

SEQ ID NO: 79244 - DNA, 20 bp, Artificial Sequence
  chemically synthesized
aaatacctaatgtagatgac

SEQ ID NO: 79245 - DNA, 20 bp, Artificial Sequence
  chemically synthesized
gaaatacctaatgtagatga

SEQ ID NO: 79246 - DNA, 20 bp, Artificial Sequence
  chemically synthesized
catcaacctgtcatctacat

SEQ ID NO: 79247 - DNA, 20 bp, Artificial Sequence
  chemically synthesized
atcaacctgtcatctacatt

SEQ ID NO: 79248 - DNA, 20 bp, Artificial Sequence
  chemically synthesized
agtaagagaaatacctaatg

SEQ ID NO: 79249 - DNA, 20 bp, Artificial Sequence
  chemically synthesized
taggggagggatagcagtaa

SEQ ID NO: 79250 - DNA, 20 bp, Artificial Sequence
  chemically synthesized
gttaggggagggatagcagt

SEQ ID NO: 79251 - DNA, 20 bp, Artificial Sequence
  chemically synthesized
ggaggttaggggagggatag

SEQ ID NO: 79252 - DNA, 20 bp, Artificial Sequence
  chemically synthesized
gtgggaggttaggggaggga

SEQ ID NO: 79253 - DNA, 20 bp, Artificial Sequence
  chemically synthesized
aggggtgggaggttagggga

SEQ ID NO: 79254 - DNA, 20 bp, Artificial Sequence
  chemically synthesized
gaggggtgggaggttagggg

SEQ ID NO: 79255 - DNA, 20 bp, Artificial Sequence
  chemically synthesized
cgaggggtgggaggttaggg

SEQ ID NO: 79256 - DNA, 20 bp, Artificial Sequence
  chemically synthesized
gtcgaggggtgggaggttag

SEQ ID NO: 79257 - DNA, 20 bp, Artificial Sequence
  chemically synthesized
tgtcgaggggtgggaggtta

SEQ ID NO: 79258 - DNA, 20 bp, Artificial Sequence
  chemically synthesized
ctgtcgaggggtgggaggtt

SEQ ID NO: 79259 - DNA, 20 bp, Artificial Sequence
  chemically synthesized
cctgtcgaggggtgggaggt

SEQ ID NO: 79260 - DNA, 20 bp, Artificial Sequence
  chemically synthesized
ggggcctgtcgaggggtggg

SEQ ID NO: 79261 - DNA, 20 bp, Artificial Sequence
  chemically synthesized
cggggcctgtcgaggggtgg

SEQ ID NO: 79262 - DNA, 20 bp, Artificial Sequence
  chemically synthesized
accggggcctgtcgaggggt

SEQ ID NO: 79263 - DNA, 20 bp, Artificial Sequence
  chemically synthesized
caccggggcctgtcgagggg

SEQ ID NO: 79264 - DNA, 20 bp, Artificial Sequence
  chemically synthesized
cctaacctcccacccctcga

SEQ ID NO: 79265 - DNA, 20 bp, Artificial Sequence
  chemically synthesized
ctaacctcccacccctcgac

SEQ ID NO: 79266 - DNA, 20 bp, Artificial Sequence
  chemically synthesized
acacaccggggcctgtcgag

SEQ ID NO: 79267 - DNA, 20 bp, Artificial Sequence
  chemically synthesized
cacacaccggggcctgtcga

SEQ ID NO: 79268 - DNA, 20 bp, Artificial Sequence
  chemically synthesized
tcacacaccggggcctgtcg

SEQ ID NO: 79269 - DNA, 20 bp, Artificial Sequence
  chemically synthesized
atcacacaccggggcctgtc

SEQ ID NO: 79270 - DNA, 20 bp, Artificial Sequence
  chemically synthesized
tcccacccctcgacaggccc

SEQ ID NO: 79271 - DNA, 20 bp, Artificial Sequence
  chemically synthesized
gacgggaacatcacacaccg

SEQ ID NO: 79272 - DNA, 20 bp, Artificial Sequence
  chemically synthesized
ggacgggaacatcacacacc

SEQ ID NO: 79273 - DNA, 20 bp, Artificial Sequence
  chemically synthesized
gggacgggaacatcacacac

SEQ ID NO: 79274 - DNA, 20 bp, Artificial Sequence
  chemically synthesized
gagcccatggacacagggac

SEQ ID NO: 79275 - DNA, 20 bp, Artificial Sequence
  chemically synthesized
agagcccatggacacaggga

SEQ ID NO: 79276 - DNA, 20 bp, Artificial Sequence
  chemically synthesized
aacgagagcccatggacaca

SEQ ID NO: 79277 - DNA, 20 bp, Artificial Sequence
  chemically synthesized
tgttcccgtccctgtgtcca

SEQ ID NO: 79278 - DNA, 20 bp, Artificial Sequence
  chemically synthesized
caacgagagcccatggacac

SEQ ID NO: 79279 - DNA, 20 bp, Artificial Sequence
  chemically synthesized
gttcccgtccctgtgtccat

SEQ ID NO: 79280 - DNA, 20 bp, Artificial Sequence
  chemically synthesized
acaacgagagcccatggaca

SEQ ID NO: 79281 - DNA, 20 bp, Artificial Sequence
  chemically synthesized
agttgaacaacgagagccca

SEQ ID NO: 79282 - DNA, 20 bp, Artificial Sequence
  chemically synthesized
aagtgggagttgaacaacga

SEQ ID NO: 79283 - DNA, 20 bp, Artificial Sequence
  chemically synthesized
gtaagtgggagttgaacaac

SEQ ID NO: 79284 - DNA, 20 bp, Artificial Sequence
  chemically synthesized
atgttctcactcgtaagtgg

SEQ ID NO: 79285 - DNA, 20 bp, Artificial Sequence
  chemically synthesized
gttgttcaactcccacttac

SEQ ID NO: 79286 - DNA, 20 bp, Artificial Sequence
  chemically synthesized
gcatgttctcactcgtaagt

SEQ ID NO: 79287 - DNA, 20 bp, Artificial Sequence
  chemically synthesized
cgcatgttctcactcgtaag

SEQ ID NO: 79288 - DNA, 20 bp, Artificial Sequence
  chemically synthesized
ttcaactcccacttacgagt

SEQ ID NO: 79289 - DNA, 20 bp, Artificial Sequence
  chemically synthesized
caccgcatgttctcactcgt

SEQ ID NO: 79290 - DNA, 20 bp, Artificial Sequence
  chemically synthesized
cacttacgagtgagaacatg

SEQ ID NO: 79291 - DNA, 20 bp, Artificial Sequence
  chemically synthesized
gagtgagaacatgcggtgcc

SEQ ID NO: 79292 - DNA, 20 bp, Artificial Sequence
  chemically synthesized
taacacaggaacagaaaacc

SEQ ID NO: 79293 - DNA, 20 bp, Artificial Sequence
  chemically synthesized
ctaacacaggaacagaaaac

SEQ ID NO: 79294 - DNA, 20 bp, Artificial Sequence
  chemically synthesized
tcagcaaactaacacaggaa

SEQ ID NO: 79295 - DNA, 20 bp, Artificial Sequence
  chemically synthesized
ctggttttctgttcctgtgt

SEQ ID NO: 79296 - DNA, 20 bp, Artificial Sequence
  chemically synthesized
caatctcagcaaactaacac

SEQ ID NO: 79297 - DNA, 20 bp, Artificial Sequence
  chemically synthesized
tcaatctcagcaaactaaca

SEQ ID NO: 79298 - DNA, 20 bp, Artificial Sequence
  chemically synthesized
tgttcctgtgttagtttgct

SEQ ID NO: 79299 - DNA, 20 bp, Artificial Sequence
  chemically synthesized
tgttagtttgctgagattga

SEQ ID NO: 79300 - DNA, 20 bp, Artificial Sequence
  chemically synthesized
aagctggaagccatcaatct

SEQ ID NO: 79301 - DNA, 20 bp, Artificial Sequence
  chemically synthesized
ttgctgagattgatggcttc

SEQ ID NO: 79302 - DNA, 20 bp, Artificial Sequence
  chemically synthesized
agggacatggatgaagctgg

SEQ ID NO: 79303 - DNA, 20 bp, Artificial Sequence
  chemically synthesized
ggcagggacatggatgaagc

SEQ ID NO: 79304 - DNA, 20 bp, Artificial Sequence
  chemically synthesized
ccttggcagggacatggatg

SEQ ID NO: 79305 - DNA, 20 bp, Artificial Sequence
  chemically synthesized
tcatgtccttggcagggaca

SEQ ID NO: 79306 - DNA, 20 bp, Artificial Sequence
  chemically synthesized
gcttcatccatgtccctgcc

SEQ ID NO: 79307 - DNA, 20 bp, Artificial Sequence
  chemically synthesized
cttcatccatgtccctgcca

SEQ ID NO: 79308 - DNA, 20 bp, Artificial Sequence
  chemically synthesized
atgagttcatgtccttggca

SEQ ID NO: 79309 - DNA, 20 bp, Artificial Sequence
  chemically synthesized
gatgagttcatgtccttggc

SEQ ID NO: 79310 - DNA, 20 bp, Artificial Sequence
  chemically synthesized
ggatgagttcatgtccttgg

SEQ ID NO: 79311 - DNA, 20 bp, Artificial Sequence
  chemically synthesized
aaaggatgagttcatgtcct

SEQ ID NO: 79312 - DNA, 20 bp, Artificial Sequence
  chemically synthesized
atgcagccataagaaaggat

SEQ ID NO: 79313 - DNA, 20 bp, Artificial Sequence
  chemically synthesized
catgaactcatcctttctta

SEQ ID NO: 79314 - DNA, 20 bp, Artificial Sequence
  chemically synthesized
atactatgcagccataagaa

SEQ ID NO: 79315 - DNA, 20 bp, Artificial Sequence
  chemically synthesized
aatactatgcagccataaga

SEQ ID NO: 79316 - DNA, 20 bp, Artificial Sequence
  chemically synthesized
atggaatactatgcagccat

SEQ ID NO: 79317 - DNA, 20 bp, Artificial Sequence
  chemically synthesized
catcctttcttatggctgca

SEQ ID NO: 79318 - DNA, 20 bp, Artificial Sequence
  chemically synthesized
atacaccatggaatactatg

SEQ ID NO: 79319 - DNA, 20 bp, Artificial Sequence
  chemically synthesized
tatggctgcatagtattcca

SEQ ID NO: 79320 - DNA, 20 bp, Artificial Sequence
  chemically synthesized
aacgtggcacagatacacca

SEQ ID NO: 79321 - DNA, 20 bp, Artificial Sequence
  chemically synthesized
tggataaagaaaacgtggca

SEQ ID NO: 79322 - DNA, 20 bp, Artificial Sequence
  chemically synthesized
tagactggataaagaaaacg

SEQ ID NO: 79323 - DNA, 20 bp, Artificial Sequence
  chemically synthesized
tgtgccacgttttctttatc

SEQ ID NO: 79324 - DNA, 20 bp, Artificial Sequence
  chemically synthesized
catcaatgatagactggata

SEQ ID NO: 79325 - DNA, 20 bp, Artificial Sequence
  chemically synthesized
aatgctcatcaatgatagac

SEQ ID NO: 79326 - DNA, 20 bp, Artificial Sequence
  chemically synthesized
acccaaatgctcatcaatga

SEQ ID NO: 79327 - DNA, 20 bp, Artificial Sequence
  chemically synthesized
ttatccagtctatcattgat

SEQ ID NO: 79328 - DNA, 20 bp, Artificial Sequence
  chemically synthesized
gtctatcattgatgagcatt

SEQ ID NO: 79329 - DNA, 20 bp, Artificial Sequence
  chemically synthesized
tctatcattgatgagcattt

SEQ ID NO: 79330 - DNA, 20 bp, Artificial Sequence
  chemically synthesized
tcattgatgagcatttgggt

SEQ ID NO: 79331 - DNA, 20 bp, Artificial Sequence
  chemically synthesized
tgagcatttgggttggttcc

SEQ ID NO: 79332 - DNA, 20 bp, Artificial Sequence
  chemically synthesized
tgttcacaatagcaaagact

SEQ ID NO: 79333 - DNA, 20 bp, Artificial Sequence
  chemically synthesized
cagcactgttcacaatagca

SEQ ID NO: 79334 - DNA, 20 bp, Artificial Sequence
  chemically synthesized
caagtctttgctattgtgaa

SEQ ID NO: 79335 - DNA, 20 bp, Artificial Sequence
  chemically synthesized
tgttgcagcactgttcacaa

SEQ ID NO: 79336 - DNA, 20 bp, Artificial Sequence
  chemically synthesized
atgcacatgtatgtttgttg

SEQ ID NO: 79337 - DNA, 20 bp, Artificial Sequence
  chemically synthesized
tacatgtgcatgtgtcttta

SEQ ID NO: 79338 - DNA, 20 bp, Artificial Sequence
  chemically synthesized
atgtgcatgtgtctttatag

SEQ ID NO: 79339 - DNA, 20 bp, Artificial Sequence
  chemically synthesized
ttataaatcattctactata

SEQ ID NO: 79340 - DNA, 20 bp, Artificial Sequence
  chemically synthesized
tagaatgatttataatcctt

SEQ ID NO: 79341 - DNA, 20 bp, Artificial Sequence
  chemically synthesized
agaatgatttataatccttt

SEQ ID NO: 79342 - DNA, 20 bp, Artificial Sequence
  chemically synthesized
attactggttatatacccaa

SEQ ID NO: 79343 - DNA, 20 bp, Artificial Sequence
  chemically synthesized
cattactggttatataccca

SEQ ID NO: 79344 - DNA, 20 bp, Artificial Sequence
  chemically synthesized
taatcctttgggtatataac

SEQ ID NO: 79345 - DNA, 20 bp, Artificial Sequence
  chemically synthesized
tttgggtatataaccagtaa

SEQ ID NO: 79346 - DNA, 20 bp, Artificial Sequence
  chemically synthesized
ttgggtatataaccagtaat

SEQ ID NO: 79347 - DNA, 20 bp, Artificial Sequence
  chemically synthesized
tgatccagcaatcccattac

SEQ ID NO: 79348 - DNA, 20 bp, Artificial Sequence
  chemically synthesized
ataaccagtaatgggattgc

SEQ ID NO: 79349 - DNA, 20 bp, Artificial Sequence
  chemically synthesized
aatgggattgctggatcaaa

SEQ ID NO: 79350 - DNA, 20 bp, Artificial Sequence
  chemically synthesized
accagaagtaccatttgatc

SEQ ID NO: 79351 - DNA, 20 bp, Artificial Sequence
  chemically synthesized
gctggatcaaatggtacttc

SEQ ID NO: 79352 - DNA, 20 bp, Artificial Sequence
  chemically synthesized
tcaaatggtacttctggttc

SEQ ID NO: 79353 - DNA, 20 bp, Artificial Sequence
  chemically synthesized
cctcaaggatctagaaccag

SEQ ID NO: 79354 - DNA, 20 bp, Artificial Sequence
  chemically synthesized
attcctcaaggatctagaac

SEQ ID NO: 79355 - DNA, 20 bp, Artificial Sequence
  chemically synthesized
acttctggttctagatcctt

SEQ ID NO: 79356 - DNA, 20 bp, Artificial Sequence
  chemically synthesized
gtggcaattcctcaaggatc

SEQ ID NO: 79357 - DNA, 20 bp, Artificial Sequence
  chemically synthesized
cttctggttctagatccttg

SEQ ID NO: 79358 - DNA, 20 bp, Artificial Sequence
  chemically synthesized
gacagtgtggcaattcctca

SEQ ID NO: 79359 - DNA, 20 bp, Artificial Sequence
  chemically synthesized
agacagtgtggcaattcctc

SEQ ID NO: 79360 - DNA, 20 bp, Artificial Sequence
  chemically synthesized
aaccattgtggaagacagtg

SEQ ID NO: 79361 - DNA, 20 bp, Artificial Sequence
  chemically synthesized
agttcaaccattgtggaaga

SEQ ID NO: 79362 - DNA, 20 bp, Artificial Sequence
  chemically synthesized
tgccacactgtcttccacaa

SEQ ID NO: 79363 - DNA, 20 bp, Artificial Sequence
  chemically synthesized
aattagttcaaccattgtgg

SEQ ID NO: 79364 - DNA, 20 bp, Artificial Sequence
  chemically synthesized
gtaaattagttcaaccattg

SEQ ID NO: 79365 - DNA, 20 bp, Artificial Sequence
  chemically synthesized
ctgttggtgggagtgtaaat

SEQ ID NO: 79366 - DNA, 20 bp, Artificial Sequence
  chemically synthesized
ctaatttacactcccaccaa

SEQ ID NO: 79367 - DNA, 20 bp, Artificial Sequence
  chemically synthesized
tgcttttacactgttggtgg

SEQ ID NO: 79368 - DNA, 20 bp, Artificial Sequence
  chemically synthesized
tgtgcttttacactgttggt

SEQ ID NO: 79369 - DNA, 20 bp, Artificial Sequence
  chemically synthesized
gtgtgcttttacactgttgg

SEQ ID NO: 79370 - DNA, 20 bp, Artificial Sequence
  chemically synthesized
taggtgtgcttttacactgt

SEQ ID NO: 79371 - DNA, 20 bp, Artificial Sequence
  chemically synthesized
cactcccaccaacagtgtaa

SEQ ID NO: 79372 - DNA, 20 bp, Artificial Sequence
  chemically synthesized
tggggaagatgtggagaaat

SEQ ID NO: 79373 - DNA, 20 bp, Artificial Sequence
  chemically synthesized
ctggggaagatgtggagaaa

SEQ ID NO: 79374 - DNA, 20 bp, Artificial Sequence
  chemically synthesized
caggtgctggggaagatgtg

SEQ ID NO: 79375 - DNA, 20 bp, Artificial Sequence
  chemically synthesized
atcaggtgctggggaagatg

SEQ ID NO: 79376 - DNA, 20 bp, Artificial Sequence
  chemically synthesized
ctatttctccacatcttccc

SEQ ID NO: 79377 - DNA, 20 bp, Artificial Sequence
  chemically synthesized
ggaaacatcaggtgctgggg

SEQ ID NO: 79378 - DNA, 20 bp, Artificial Sequence
  chemically synthesized
tcaggaaacatcaggtgctg

SEQ ID NO: 79379 - DNA, 20 bp, Artificial Sequence
  chemically synthesized
gtcaggaaacatcaggtgct

SEQ ID NO: 79380 - DNA, 20 bp, Artificial Sequence
  chemically synthesized
agtcaggaaacatcaggtgc

SEQ ID NO: 79381 - DNA, 20 bp, Artificial Sequence
  chemically synthesized
ttaaaaagtcaggaaacatc

SEQ ID NO: 79382 - DNA, 20 bp, Artificial Sequence
  chemically synthesized
attaaaaagtcaggaaacat

SEQ ID NO: 79383 - DNA, 20 bp, Artificial Sequence
  chemically synthesized
atggcgatcattaaaaagtc

SEQ ID NO: 79384 - DNA, 20 bp, Artificial Sequence
  chemically synthesized
aatggcgatcattaaaaagt

SEQ ID NO: 79385 - DNA, 20 bp, Artificial Sequence
  chemically synthesized
ttacaatggcgatcattaaa

SEQ ID NO: 79386 - DNA, 20 bp, Artificial Sequence
  chemically synthesized
ttaatgatcgccattgtaac

SEQ ID NO: 79387 - DNA, 20 bp, Artificial Sequence
  chemically synthesized
tcaaaacacaccagttacaa

SEQ ID NO: 79388 - DNA, 20 bp, Artificial Sequence
  chemically synthesized
aaatgcaaatcaaaacacac

SEQ ID NO: 79389 - DNA, 20 bp, Artificial Sequence
  chemically synthesized
atttgcatttctctaatcac

SEQ ID NO: 79390 - DNA, 20 bp, Artificial Sequence
  chemically synthesized
ctcatcatcactggtgatta

SEQ ID NO: 79391 - DNA, 20 bp, Artificial Sequence
  chemically synthesized
agctcatcatcactggtgat

SEQ ID NO: 79392 - DNA, 20 bp, Artificial Sequence
  chemically synthesized
gaaaaaaagctcatcatcac

SEQ ID NO: 79393 - DNA, 20 bp, Artificial Sequence
  chemically synthesized
ctctaatcaccagtgatgat

SEQ ID NO: 79394 - DNA, 20 bp, Artificial Sequence
  chemically synthesized
cggccaacaaacatgaaaaa

SEQ ID NO: 79395 - DNA, 20 bp, Artificial Sequence
  chemically synthesized
gagctttttttcatgtttgt

SEQ ID NO: 79396 - DNA, 20 bp, Artificial Sequence
  chemically synthesized
ctcaaagtaagacatttatg

SEQ ID NO: 79397 - DNA, 20 bp, Artificial Sequence
  chemically synthesized
ccgcataaatgtcttacttt

SEQ ID NO: 79398 - DNA, 20 bp, Artificial Sequence
  chemically synthesized
gaacagacacttctcaaagt

SEQ ID NO: 79399 - DNA, 20 bp, Artificial Sequence
  chemically synthesized
cataaatgtcttactttgag

SEQ ID NO: 79400 - DNA, 20 bp, Artificial Sequence
  chemically synthesized
atatgaacagacacttctca

SEQ ID NO: 79401 - DNA, 20 bp, Artificial Sequence
  chemically synthesized
aattgggcaaaggatatgaa

SEQ ID NO: 79402 - DNA, 20 bp, Artificial Sequence
  chemically synthesized
cctaatcaaaaattgggcaa

SEQ ID NO: 79403 - DNA, 20 bp, Artificial Sequence
  chemically synthesized
acctaatcaaaaattgggca

SEQ ID NO: 79404 - DNA, 20 bp, Artificial Sequence
  chemically synthesized
aaaaaacctaatcaaaaatt

SEQ ID NO: 79405 - DNA, 20 bp, Artificial Sequence
  chemically synthesized
gaaaaaacctaatcaaaaat

SEQ ID NO: 79406 - DNA, 20 bp, Artificial Sequence
  chemically synthesized
tcctttgcccaatttttgat

SEQ ID NO: 79407 - DNA, 20 bp, Artificial Sequence
  chemically synthesized
cctttgcccaatttttgatt

SEQ ID NO: 79408 - DNA, 20 bp, Artificial Sequence
  chemically synthesized
aggaacttaaacaaatttac

SEQ ID NO: 79409 - DNA, 20 bp, Artificial Sequence
  chemically synthesized
tttttcttgtaaatttgttt

SEQ ID NO: 79410 - DNA, 20 bp, Artificial Sequence
  chemically synthesized
aaatttgtttaagttccttg

SEQ ID NO: 79411 - DNA, 20 bp, Artificial Sequence
  chemically synthesized
gctgatatccagaatctaca

SEQ ID NO: 79412 - DNA, 20 bp, Artificial Sequence
  chemically synthesized
ggctgatatccagaatctac

SEQ ID NO: 79413 - DNA, 20 bp, Artificial Sequence
  chemically synthesized
tttaagttccttgtagattc

SEQ ID NO: 79414 - DNA, 20 bp, Artificial Sequence
  chemically synthesized
tccttgtagattctggatat

SEQ ID NO: 79415 - DNA, 20 bp, Artificial Sequence
  chemically synthesized
tctgacaaagggctgatatc

SEQ ID NO: 79416 - DNA, 20 bp, Artificial Sequence
  chemically synthesized
tctggatatcagccctttgt

SEQ ID NO: 79417 - DNA, 20 bp, Artificial Sequence
  chemically synthesized
ccatctattcatctgacaaa

SEQ ID NO: 79418 - DNA, 20 bp, Artificial Sequence
  chemically synthesized
gccatctattcatctgacaa

SEQ ID NO: 79419 - DNA, 20 bp, Artificial Sequence
  chemically synthesized
tgccatctattcatctgaca

SEQ ID NO: 79420 - DNA, 20 bp, Artificial Sequence
  chemically synthesized
tcagccctttgtcagatgaa

SEQ ID NO: 79421 - DNA, 20 bp, Artificial Sequence
  chemically synthesized
ccctttgtcagatgaataga

SEQ ID NO: 79422 - DNA, 20 bp, Artificial Sequence
  chemically synthesized
acaagcaacctacagaatgg

SEQ ID NO: 79423 - DNA, 20 bp, Artificial Sequence
  chemically synthesized
aaacattttctcccattctg

SEQ ID NO: 79424 - DNA, 20 bp, Artificial Sequence
  chemically synthesized
aacattttctcccattctgt

SEQ ID NO: 79425 - DNA, 20 bp, Artificial Sequence
  chemically synthesized
gaacaagcaacctacagaat

SEQ ID NO: 79426 - DNA, 20 bp, Artificial Sequence
  chemically synthesized
tgaacaagcaacctacagaa

SEQ ID NO: 79427 - DNA, 20 bp, Artificial Sequence
  chemically synthesized
cagagtgaacaagcaaccta

SEQ ID NO: 79428 - DNA, 20 bp, Artificial Sequence
  chemically synthesized
aaactatcatcagagtgaac

SEQ ID NO: 79429 - DNA, 20 bp, Artificial Sequence
  chemically synthesized
ttgcttgttcactctgatga

SEQ ID NO: 79430 - DNA, 20 bp, Artificial Sequence
  chemically synthesized
agcaaaagaaactatcatca

SEQ ID NO: 79431 - DNA, 20 bp, Artificial Sequence
  chemically synthesized
acagcaaaagaaactatcat

SEQ ID NO: 79432 - DNA, 20 bp, Artificial Sequence
  chemically synthesized
aaagagcttctgcacagcaa

SEQ ID NO: 79433 - DNA, 20 bp, Artificial Sequence
  chemically synthesized
tgatagtttcttttgctgtg

SEQ ID NO: 79434 - DNA, 20 bp, Artificial Sequence
  chemically synthesized
tagtttcttttgctgtgcag

SEQ ID NO: 79435 - DNA, 20 bp, Artificial Sequence
  chemically synthesized
taaactaaagagcttctgca

SEQ ID NO: 79436 - DNA, 20 bp, Artificial Sequence
  chemically synthesized
tttgctgtgcagaagctctt

SEQ ID NO: 79437 - DNA, 20 bp, Artificial Sequence
  chemically synthesized
tggaatctaattaaactaaa

SEQ ID NO: 79438 - DNA, 20 bp, Artificial Sequence
  chemically synthesized
aatggaatctaattaaacta

SEQ ID NO: 79439 - DNA, 20 bp, Artificial Sequence
  chemically synthesized
cagaagctctttagtttaat

SEQ ID NO: 79440 - DNA, 20 bp, Artificial Sequence
  chemically synthesized
caaaagccaaaattgacaaa

SEQ ID NO: 79441 - DNA, 20 bp, Artificial Sequence
  chemically synthesized
tagattccatttgtcaattt

SEQ ID NO: 79442 - DNA, 20 bp, Artificial Sequence
  chemically synthesized
accaaaagcaatggcaacaa

SEQ ID NO: 79443 - DNA, 20 bp, Artificial Sequence
  chemically synthesized
gcttttgttgccattgcttt

SEQ ID NO: 79444 - DNA, 20 bp, Artificial Sequence
  chemically synthesized
gactaaaacaccaaaagcaa

SEQ ID NO: 79445 - DNA, 20 bp, Artificial Sequence
  chemically synthesized
cttcacgactaaaacaccaa

SEQ ID NO: 79446 - DNA, 20 bp, Artificial Sequence
  chemically synthesized
tgccattgcttttggtgttt

SEQ ID NO: 79447 - DNA, 20 bp, Artificial Sequence
  chemically synthesized
cttttggtgttttagtcgtg

SEQ ID NO: 79448 - DNA, 20 bp, Artificial Sequence
  chemically synthesized
tcaggatataggcatgggca

SEQ ID NO: 79449 - DNA, 20 bp, Artificial Sequence
  chemically synthesized
accattcaggatataggcat

SEQ ID NO: 79450 - DNA, 20 bp, Artificial Sequence
  chemically synthesized
taccattcaggatataggca

SEQ ID NO: 79451 - DNA, 20 bp, Artificial Sequence
  chemically synthesized
ggcaataccattcaggatat

SEQ ID NO: 79452 - DNA, 20 bp, Artificial Sequence
  chemically synthesized
aggcaataccattcaggata

SEQ ID NO: 79453 - DNA, 20 bp, Artificial Sequence
  chemically synthesized
gcccatgcctatatcctgaa

SEQ ID NO: 79454 - DNA, 20 bp, Artificial Sequence
  chemically synthesized
aaacctaggcaataccattc

SEQ ID NO: 79455 - DNA, 20 bp, Artificial Sequence
  chemically synthesized
aaaacctaggcaataccatt

SEQ ID NO: 79456 - DNA, 20 bp, Artificial Sequence
  chemically synthesized
atatcctgaatggtattgcc

SEQ ID NO: 79457 - DNA, 20 bp, Artificial Sequence
  chemically synthesized
tatcctgaatggtattgcct

SEQ ID NO: 79458 - DNA, 20 bp, Artificial Sequence
  chemically synthesized
aaaaccctagaagaaaacct

SEQ ID NO: 79459 - DNA, 20 bp, Artificial Sequence
  chemically synthesized
aaaaaccctagaagaaaacc

SEQ ID NO: 79460 - DNA, 20 bp, Artificial Sequence
  chemically synthesized
gtattgcctaggttttcttc

SEQ ID NO: 79461 - DNA, 20 bp, Artificial Sequence
  chemically synthesized
tattgcctaggttttcttct

SEQ ID NO: 79462 - DNA, 20 bp, Artificial Sequence
  chemically synthesized
attgcctaggttttcttcta

SEQ ID NO: 79463 - DNA, 20 bp, Artificial Sequence
  chemically synthesized
taaaaccataaaaaccctag

SEQ ID NO: 79464 - DNA, 20 bp, Artificial Sequence
  chemically synthesized
acctaaaaccataaaaaccc

SEQ ID NO: 79465 - DNA, 20 bp, Artificial Sequence
  chemically synthesized
gttttcttctagggttttta

SEQ ID NO: 79466 - DNA, 20 bp, Artificial Sequence
  chemically synthesized
ttctagggtttttatggttt

SEQ ID NO: 79467 - DNA, 20 bp, Artificial Sequence
  chemically synthesized
tctagggtttttatggtttt

SEQ ID NO: 79468 - DNA, 20 bp, Artificial Sequence
  chemically synthesized
tggttttaggttttatgttt

SEQ ID NO: 79469 - DNA, 20 bp, Artificial Sequence
  chemically synthesized
aggttttatgtttaagtctt

SEQ ID NO: 79470 - DNA, 20 bp, Artificial Sequence
  chemically synthesized
ccttatacaaaaattaactc

SEQ ID NO: 79471 - DNA, 20 bp, Artificial Sequence
  chemically synthesized
tcttgagttaatttttgtat

SEQ ID NO: 79472 - DNA, 20 bp, Artificial Sequence
  chemically synthesized
cttgagttaatttttgtata

SEQ ID NO: 79473 - DNA, 20 bp, Artificial Sequence
  chemically synthesized
ttaatttttgtataaggtgt

SEQ ID NO: 79474 - DNA, 20 bp, Artificial Sequence
  chemically synthesized
taatttttgtataaggtgta

SEQ ID NO: 79475 - DNA, 20 bp, Artificial Sequence
  chemically synthesized
tttttgtataaggtgtaagg

SEQ ID NO: 79476 - DNA, 20 bp, Artificial Sequence
  chemically synthesized
ttttgtataaggtgtaagga

SEQ ID NO: 79477 - DNA, 20 bp, Artificial Sequence
  chemically synthesized
tttgtataaggtgtaaggaa

SEQ ID NO: 79478 - DNA, 20 bp, Artificial Sequence
  chemically synthesized
ttgtataaggtgtaaggaag

SEQ ID NO: 79479 - DNA, 20 bp, Artificial Sequence
  chemically synthesized
taaggtgtaaggaaggggtc

SEQ ID NO: 79480 - DNA, 20 bp, Artificial Sequence
  chemically synthesized
gtaaggaaggggtccagttt

SEQ ID NO: 79481 - DNA, 20 bp, Artificial Sequence
  chemically synthesized
catctacagaaaactgaaac

SEQ ID NO: 79482 - DNA, 20 bp, Artificial Sequence
  chemically synthesized
ggtccagtttcagttttctg

SEQ ID NO: 79483 - DNA, 20 bp, Artificial Sequence
  chemically synthesized
cagtttcagttttctgtaga

SEQ ID NO: 79484 - DNA, 20 bp, Artificial Sequence
  chemically synthesized
gtaaaccggctagccatcta

SEQ ID NO: 79485 - DNA, 20 bp, Artificial Sequence
  chemically synthesized
ttcagttttctgtagatggc

SEQ ID NO: 79486 - DNA, 20 bp, Artificial Sequence
  chemically synthesized
gttttctgtagatggctagc

SEQ ID NO: 79487 - DNA, 20 bp, Artificial Sequence
  chemically synthesized
atggtgctgggtaaaccggc

SEQ ID NO: 79488 - DNA, 20 bp, Artificial Sequence
  chemically synthesized
agatggctagccggtttacc

SEQ ID NO: 79489 - DNA, 20 bp, Artificial Sequence
  chemically synthesized
gtaaatggtgctgggtaaac

SEQ ID NO: 79490 - DNA, 20 bp, Artificial Sequence
  chemically synthesized
cctattcagtaaatggtgct

SEQ ID NO: 79491 - DNA, 20 bp, Artificial Sequence
  chemically synthesized
ccctattcagtaaatggtgc

SEQ ID NO: 79492 - DNA, 20 bp, Artificial Sequence
  chemically synthesized
aggattccctattcagtaaa

SEQ ID NO: 79493 - DNA, 20 bp, Artificial Sequence
  chemically synthesized
acccagcaccatttactgaa

SEQ ID NO: 79494 - DNA, 20 bp, Artificial Sequence
  chemically synthesized
cccagcaccatttactgaat

SEQ ID NO: 79495 - DNA, 20 bp, Artificial Sequence
  chemically synthesized
ccagcaccatttactgaata

SEQ ID NO: 79496 - DNA, 20 bp, Artificial Sequence
  chemically synthesized
tggagaaaggattccctatt

SEQ ID NO: 79497 - DNA, 20 bp, Artificial Sequence
  chemically synthesized
caaaaacaagcaatggagaa

SEQ ID NO: 79498 - DNA, 20 bp, Artificial Sequence
  chemically synthesized
acaaaaacaagcaatggaga

SEQ ID NO: 79499 - DNA, 20 bp, Artificial Sequence
  chemically synthesized
cctgacaaaaacaagcaatg

SEQ ID NO: 79500 - DNA, 20 bp, Artificial Sequence
  chemically synthesized
aacctgacaaaaacaagcaa

SEQ ID NO: 79501 - DNA, 20 bp, Artificial Sequence
  chemically synthesized
ttgacaaacctgacaaaaac

SEQ ID NO: 79502 - DNA, 20 bp, Artificial Sequence
  chemically synthesized
tctccattgcttgtttttgt

SEQ ID NO: 79503 - DNA, 20 bp, Artificial Sequence
  chemically synthesized
ctccattgcttgtttttgtc

SEQ ID NO: 79504 - DNA, 20 bp, Artificial Sequence
  chemically synthesized
tgtttttgtcaggtttgtca

SEQ ID NO: 79505 - DNA, 20 bp, Artificial Sequence
  chemically synthesized
ttgtcaggtttgtcaaagat

SEQ ID NO: 79506 - DNA, 20 bp, Artificial Sequence
  chemically synthesized
caggtttgtcaaagatcaga

SEQ ID NO: 79507 - DNA, 20 bp, Artificial Sequence
  chemically synthesized
tgtcaaagatcagatggttg

SEQ ID NO: 79508 - DNA, 20 bp, Artificial Sequence
  chemically synthesized
atcagatggttgtagatgtg

SEQ ID NO: 79509 - DNA, 20 bp, Artificial Sequence
  chemically synthesized
agatgtgtggcattatttct

SEQ ID NO: 79510 - DNA, 20 bp, Artificial Sequence
  chemically synthesized
gatgtgtggcattatttctg

SEQ ID NO: 79511 - DNA, 20 bp, Artificial Sequence
  chemically synthesized
gaccaatggaacagaggcct

SEQ ID NO: 79512 - DNA, 20 bp, Artificial Sequence
  chemically synthesized
tatatagaccaatggaacag

SEQ ID NO: 79513 - DNA, 20 bp, Artificial Sequence
  chemically synthesized
atatatagaccaatggaaca

SEQ ID NO: 79514 - DNA, 20 bp, Artificial Sequence
  chemically synthesized
ttctgaggcctctgttccat

SEQ ID NO: 79515 - DNA, 20 bp, Artificial Sequence
  chemically synthesized
agatatatagaccaatggaa

SEQ ID NO: 79516 - DNA, 20 bp, Artificial Sequence
  chemically synthesized
aaaacagatatatagaccaa

SEQ ID NO: 79517 - DNA, 20 bp, Artificial Sequence
  chemically synthesized
ttggtaccaaaacagatata

SEQ ID NO: 79518 - DNA, 20 bp, Artificial Sequence
  chemically synthesized
attggtctatatatctgttt

SEQ ID NO: 79519 - DNA, 20 bp, Artificial Sequence
  chemically synthesized
gtatggtattggtaccaaaa

SEQ ID NO: 79520 - DNA, 20 bp, Artificial Sequence
  chemically synthesized
taaccaaaacagtatggtat

SEQ ID NO: 79521 - DNA, 20 bp, Artificial Sequence
  chemically synthesized
cttcagtaaccaaaacagta

SEQ ID NO: 79522 - DNA, 20 bp, Artificial Sequence
  chemically synthesized
gtaccaataccatactgttt

SEQ ID NO: 79523 - DNA, 20 bp, Artificial Sequence
  chemically synthesized
caaggcttcagtaaccaaaa

SEQ ID NO: 79524 - DNA, 20 bp, Artificial Sequence
  chemically synthesized
ccatactgttttggttactg

SEQ ID NO: 79525 - DNA, 20 bp, Artificial Sequence
  chemically synthesized
caaactatactacaaggctt

SEQ ID NO: 79526 - DNA, 20 bp, Artificial Sequence
  chemically synthesized
ttttggttactgaagccttg

SEQ ID NO: 79527 - DNA, 20 bp, Artificial Sequence
  chemically synthesized
gttactgaagccttgtagta

SEQ ID NO: 79528 - DNA, 20 bp, Artificial Sequence
  chemically synthesized
tgacttcaaactatactaca

SEQ ID NO: 79529 - DNA, 20 bp, Artificial Sequence
  chemically synthesized
ctgacttcaaactatactac

SEQ ID NO: 79530 - DNA, 20 bp, Artificial Sequence
  chemically synthesized
aagccttgtagtatagtttg

SEQ ID NO: 79531 - DNA, 20 bp, Artificial Sequence
  chemically synthesized
cttgtagtatagtttgaagt

SEQ ID NO: 79532 - DNA, 20 bp, Artificial Sequence
  chemically synthesized
ttgtagtatagtttgaagtc

SEQ ID NO: 79533 - DNA, 20 bp, Artificial Sequence
  chemically synthesized
tagtatagtttgaagtcagg

SEQ ID NO: 79534 - DNA, 20 bp, Artificial Sequence
  chemically synthesized
gtcaggtagcatgatgcctc

SEQ ID NO: 79535 - DNA, 20 bp, Artificial Sequence
  chemically synthesized
agcaaaaagaacaaagctgg

SEQ ID NO: 79536 - DNA, 20 bp, Artificial Sequence
  chemically synthesized
aagcaaaaagaacaaagctg

SEQ ID NO: 79537 - DNA, 20 bp, Artificial Sequence
  chemically synthesized
ctaagcaaaaagaacaaagc

SEQ ID NO: 79538 - DNA, 20 bp, Artificial Sequence
  chemically synthesized
aatcctaagcaaaaagaaca

SEQ ID NO: 79539 - DNA, 20 bp, Artificial Sequence
  chemically synthesized
ccagctttgttctttttgct

SEQ ID NO: 79540 - DNA, 20 bp, Artificial Sequence
  chemically synthesized
cagctttgttctttttgctt

SEQ ID NO: 79541 - DNA, 20 bp, Artificial Sequence
  chemically synthesized
ccaagtcaatcctaagcaaa

SEQ ID NO: 79542 - DNA, 20 bp, Artificial Sequence
  chemically synthesized
cacatagccaagtcaatcct

SEQ ID NO: 79543 - DNA, 20 bp, Artificial Sequence
  chemically synthesized
ctttttgcttaggattgact

SEQ ID NO: 79544 - DNA, 20 bp, Artificial Sequence
  chemically synthesized
ttaggattgacttggctatg

SEQ ID NO: 79545 - DNA, 20 bp, Artificial Sequence
  chemically synthesized
aaaaaagagcccacatagcc

SEQ ID NO: 79546 - DNA, 20 bp, Artificial Sequence
  chemically synthesized
taggattgacttggctatgt

SEQ ID NO: 79547 - DNA, 20 bp, Artificial Sequence
  chemically synthesized
gaaccaaaaaagagcccaca

SEQ ID NO: 79548 - DNA, 20 bp, Artificial Sequence
  chemically synthesized
tggctatgtgggctcttttt

SEQ ID NO: 79549 - DNA, 20 bp, Artificial Sequence
  chemically synthesized
tttcatatggaaccaaaaaa

SEQ ID NO: 79550 - DNA, 20 bp, Artificial Sequence
  chemically synthesized
aatttcatatggaaccaaaa

SEQ ID NO: 79551 - DNA, 20 bp, Artificial Sequence
  chemically synthesized
aaactactttaaatttcata

SEQ ID NO: 79552 - DNA, 20 bp, Artificial Sequence
  chemically synthesized
ttggttccatatgaaattta

SEQ ID NO: 79553 - DNA, 20 bp, Artificial Sequence
  chemically synthesized
gttccatatgaaatttaaag

SEQ ID NO: 79554 - DNA, 20 bp, Artificial Sequence
  chemically synthesized
attgactttcttcacataat

SEQ ID NO: 79555 - DNA, 20 bp, Artificial Sequence
  chemically synthesized
gtagtttttctaattatgtg

SEQ ID NO: 79556 - DNA, 20 bp, Artificial Sequence
  chemically synthesized
tttttctaattatgtgaaga

SEQ ID NO: 79557 - DNA, 20 bp, Artificial Sequence
  chemically synthesized
aattatgtgaagaaagtcaa

SEQ ID NO: 79558 - DNA, 20 bp, Artificial Sequence
  chemically synthesized
tatgtgaagaaagtcaatgg

SEQ ID NO: 79559 - DNA, 20 bp, Artificial Sequence
  chemically synthesized
gaaagtcaatggtagcttga

SEQ ID NO: 79560 - DNA, 20 bp, Artificial Sequence
  chemically synthesized
aagtcaatggtagcttgatg

SEQ ID NO: 79561 - DNA, 20 bp, Artificial Sequence
  chemically synthesized
gattcaatgcagtctccatc

SEQ ID NO: 79562 - DNA, 20 bp, Artificial Sequence
  chemically synthesized
agtaatttatagattcaatg

SEQ ID NO: 79563 - DNA, 20 bp, Artificial Sequence
  chemically synthesized
atactgtccaaagtaattta

SEQ ID NO: 79564 - DNA, 20 bp, Artificial Sequence
  chemically synthesized
attgaatctataaattactt

SEQ ID NO: 79565 - DNA, 20 bp, Artificial Sequence
  chemically synthesized
aatctataaattactttgga

SEQ ID NO: 79566 - DNA, 20 bp, Artificial Sequence
  chemically synthesized
gaaaatggccatactgtcca

SEQ ID NO: 79567 - DNA, 20 bp, Artificial Sequence
  chemically synthesized
ataaattactttggacagta

SEQ ID NO: 79568 - DNA, 20 bp, Artificial Sequence
  chemically synthesized
aagaatcaatatcgtgaaaa

SEQ ID NO: 79569 - DNA, 20 bp, Artificial Sequence
  chemically synthesized
attccatgctcatggatagg

SEQ ID NO: 79570 - DNA, 20 bp, Artificial Sequence
  chemically synthesized
tattgattcttcctatccat

SEQ ID NO: 79571 - DNA, 20 bp, Artificial Sequence
  chemically synthesized
aacattccatgctcatggat

SEQ ID NO: 79572 - DNA, 20 bp, Artificial Sequence
  chemically synthesized
gaacattccatgctcatgga

SEQ ID NO: 79573 - DNA, 20 bp, Artificial Sequence
  chemically synthesized
attcttcctatccatgagca

SEQ ID NO: 79574 - DNA, 20 bp, Artificial Sequence
  chemically synthesized
ggaagaacattccatgctca

SEQ ID NO: 79575 - DNA, 20 bp, Artificial Sequence
  chemically synthesized
aggacaccacaaacaaatgg

SEQ ID NO: 79576 - DNA, 20 bp, Artificial Sequence
  chemically synthesized
gagaggacaccacaaacaaa

SEQ ID NO: 79577 - DNA, 20 bp, Artificial Sequence
  chemically synthesized
aatgttcttccatttgtttg

SEQ ID NO: 79578 - DNA, 20 bp, Artificial Sequence
  chemically synthesized
actgctcaaggaaatgagag

SEQ ID NO: 79579 - DNA, 20 bp, Artificial Sequence
  chemically synthesized
cactgctcaaggaaatgaga

SEQ ID NO: 79580 - DNA, 20 bp, Artificial Sequence
  chemically synthesized
accactgctcaaggaaatga

SEQ ID NO: 79581 - DNA, 20 bp, Artificial Sequence
  chemically synthesized
aaaccactgctcaaggaaat

SEQ ID NO: 79582 - DNA, 20 bp, Artificial Sequence
  chemically synthesized
gtgtcctctctcatttcctt

SEQ ID NO: 79583 - DNA, 20 bp, Artificial Sequence
  chemically synthesized
tcctctctcatttccttgag

SEQ ID NO: 79584 - DNA, 20 bp, Artificial Sequence
  chemically synthesized
tctctcatttccttgagcag

SEQ ID NO: 79585 - DNA, 20 bp, Artificial Sequence
  chemically synthesized
gaactacaaaccactgctca

SEQ ID NO: 79586 - DNA, 20 bp, Artificial Sequence
  chemically synthesized
agaactacaaaccactgctc

SEQ ID NO: 79587 - DNA, 20 bp, Artificial Sequence
  chemically synthesized
tttccttgagcagtggtttg

SEQ ID NO: 79588 - DNA, 20 bp, Artificial Sequence
  chemically synthesized
gtggtttgtagttctccttg

SEQ ID NO: 79589 - DNA, 20 bp, Artificial Sequence
  chemically synthesized
ggtttgtagttctccttgaa

SEQ ID NO: 79590 - DNA, 20 bp, Artificial Sequence
  chemically synthesized
gtttgtagttctccttgaag

SEQ ID NO: 79591 - DNA, 20 bp, Artificial Sequence
  chemically synthesized
atgtgaaagacctcttcaag

SEQ ID NO: 79592 - DNA, 20 bp, Artificial Sequence
  chemically synthesized
ggatgtgaaagacctcttca

SEQ ID NO: 79593 - DNA, 20 bp, Artificial Sequence
  chemically synthesized
gggatgtgaaagacctcttc

SEQ ID NO: 79594 - DNA, 20 bp, Artificial Sequence
  chemically synthesized
acaacttagaagggatgtga

SEQ ID NO: 79595 - DNA, 20 bp, Artificial Sequence
  chemically synthesized
aggtctttcacatcccttct

SEQ ID NO: 79596 - DNA, 20 bp, Artificial Sequence
  chemically synthesized
cctaggaatacaacttagaa

SEQ ID NO: 79597 - DNA, 20 bp, Artificial Sequence
  chemically synthesized
acctaggaatacaacttaga

SEQ ID NO: 79598 - DNA, 20 bp, Artificial Sequence
  chemically synthesized
tacctaggaatacaacttag

SEQ ID NO: 79599 - DNA, 20 bp, Artificial Sequence
  chemically synthesized
aaatacctaggaatacaact

SEQ ID NO: 79600 - DNA, 20 bp, Artificial Sequence
  chemically synthesized
tcccttctaagttgtattcc

SEQ ID NO: 79601 - DNA, 20 bp, Artificial Sequence
  chemically synthesized
cccttctaagttgtattcct

SEQ ID NO: 79602 - DNA, 20 bp, Artificial Sequence
  chemically synthesized
tcaaagagaataaaatacct

SEQ ID NO: 79603 - DNA, 20 bp, Artificial Sequence
  chemically synthesized
ttcaaagagaataaaatacc

SEQ ID NO: 79604 - DNA, 20 bp, Artificial Sequence
  chemically synthesized
taggtattttattctctttg

SEQ ID NO: 79605 - DNA, 20 bp, Artificial Sequence
  chemically synthesized
ccattcacaattgcttcaaa

SEQ ID NO: 79606 - DNA, 20 bp, Artificial Sequence
  chemically synthesized
tcccattcacaattgcttca

SEQ ID NO: 79607 - DNA, 20 bp, Artificial Sequence
  chemically synthesized
ctctttgaagcaattgtgaa

SEQ ID NO: 79608 - DNA, 20 bp, Artificial Sequence
  chemically synthesized
tctttgaagcaattgtgaat

SEQ ID NO: 79609 - DNA, 20 bp, Artificial Sequence
  chemically synthesized
atgggaattcactcatgatt

SEQ ID NO: 79610 - DNA, 20 bp, Artificial Sequence
  chemically synthesized
caaagagagtgccaaatcat

SEQ ID NO: 79611 - DNA, 20 bp, Artificial Sequence
  chemically synthesized
acgccaataatagacaaaga

SEQ ID NO: 79612 - DNA, 20 bp, Artificial Sequence
  chemically synthesized
atacgccaataatagacaaa

SEQ ID NO: 79613 - DNA, 20 bp, Artificial Sequence
  chemically synthesized
ctatacgccaataatagaca

SEQ ID NO: 79614 - DNA, 20 bp, Artificial Sequence
  chemically synthesized
gcactctctttgtctattat

SEQ ID NO: 79615 - DNA, 20 bp, Artificial Sequence
  chemically synthesized
gcattcctatacgccaataa

SEQ ID NO: 79616 - DNA, 20 bp, Artificial Sequence
  chemically synthesized
ctttgtctattattggcgta

SEQ ID NO: 79617 - DNA, 20 bp, Artificial Sequence
  chemically synthesized
tttgtctattattggcgtat

SEQ ID NO: 79618 - DNA, 20 bp, Artificial Sequence
  chemically synthesized
aatcaatgtggaaaaatagt

SEQ ID NO: 79619 - DNA, 20 bp, Artificial Sequence
  chemically synthesized
acaaaatcaatgtggaaaaa

SEQ ID NO: 79620 - DNA, 20 bp, Artificial Sequence
  chemically synthesized
ctcaggatacaaaatcaatg

SEQ ID NO: 79621 - DNA, 20 bp, Artificial Sequence
  chemically synthesized
ccacattgattttgtatcct

SEQ ID NO: 79622 - DNA, 20 bp, Artificial Sequence
  chemically synthesized
agcaacttcagcaaagtctc

SEQ ID NO: 79623 - DNA, 20 bp, Artificial Sequence
  chemically synthesized
aagcaacttcagcaaagtct

SEQ ID NO: 79624 - DNA, 20 bp, Artificial Sequence
  chemically synthesized
tgtatcctgagactttgctg

SEQ ID NO: 79625 - DNA, 20 bp, Artificial Sequence
  chemically synthesized
gctgataagcaacttcagca

SEQ ID NO: 79626 - DNA, 20 bp, Artificial Sequence
  chemically synthesized
cttaagctgataagcaactt

SEQ ID NO: 79627 - DNA, 20 bp, Artificial Sequence
  chemically synthesized
actttgctgaagttgcttat

SEQ ID NO: 79628 - DNA, 20 bp, Artificial Sequence
  chemically synthesized
caaaatcttcttaagctgat

SEQ ID NO: 79629 - DNA, 20 bp, Artificial Sequence
  chemically synthesized
ctgaagttgcttatcagctt

SEQ ID NO: 79630 - DNA, 20 bp, Artificial Sequence
  chemically synthesized
aagttgcttatcagcttaag

SEQ ID NO: 79631 - DNA, 20 bp, Artificial Sequence
  chemically synthesized
tctcaacccaaaatcttctt

SEQ ID NO: 79632 - DNA, 20 bp, Artificial Sequence
  chemically synthesized
ttatcagcttaagaagattt

SEQ ID NO: 79633 - DNA, 20 bp, Artificial Sequence
  chemically synthesized
tatcagcttaagaagatttt

SEQ ID NO: 79634 - DNA, 20 bp, Artificial Sequence
  chemically synthesized
gcttaagaagattttgggtt

SEQ ID NO: 79635 - DNA, 20 bp, Artificial Sequence
  chemically synthesized
aagattttgggttgagacga

SEQ ID NO: 79636 - DNA, 20 bp, Artificial Sequence
  chemically synthesized
agattttgggttgagacgat

SEQ ID NO: 79637 - DNA, 20 bp, Artificial Sequence
  chemically synthesized
gattttgggttgagacgatg

SEQ ID NO: 79638 - DNA, 20 bp, Artificial Sequence
  chemically synthesized
agctgacatgattgtatatt

SEQ ID NO: 79639 - DNA, 20 bp, Artificial Sequence
  chemically synthesized
ttctaaatatacaatcatgt

SEQ ID NO: 79640 - DNA, 20 bp, Artificial Sequence
  chemically synthesized
acaatcatgtcagctgcaaa

SEQ ID NO: 79641 - DNA, 20 bp, Artificial Sequence
  chemically synthesized
aatcatgtcagctgcaaaca

SEQ ID NO: 79642 - DNA, 20 bp, Artificial Sequence
  chemically synthesized
agtcagattgtctctgtttg

SEQ ID NO: 79643 - DNA, 20 bp, Artificial Sequence
  chemically synthesized
caaataggaagagaggaagt

SEQ ID NO: 79644 - DNA, 20 bp, Artificial Sequence
  chemically synthesized
tattcaaataggaagagagg

SEQ ID NO: 79645 - DNA, 20 bp, Artificial Sequence
  chemically synthesized
gggtattcaaataggaagag

SEQ ID NO: 79646 - DNA, 20 bp, Artificial Sequence
  chemically synthesized
agggtattcaaataggaaga

SEQ ID NO: 79647 - DNA, 20 bp, Artificial Sequence
  chemically synthesized
aaagggtattcaaataggaa

SEQ ID NO: 79648 - DNA, 20 bp, Artificial Sequence
  chemically synthesized
ataaagggtattcaaatagg

SEQ ID NO: 79649 - DNA, 20 bp, Artificial Sequence
  chemically synthesized
gaaataaagggtattcaaat

SEQ ID NO: 79650 - DNA, 20 bp, Artificial Sequence
  chemically synthesized
agaaataaagggtattcaaa

SEQ ID NO: 79651 - DNA, 20 bp, Artificial Sequence
  chemically synthesized
aggcaagggaaagaaataaa

SEQ ID NO: 79652 - DNA, 20 bp, Artificial Sequence
  chemically synthesized
caggcaagggaaagaaataa

SEQ ID NO: 79653 - DNA, 20 bp, Artificial Sequence
  chemically synthesized
tcaggcaagggaaagaaata

SEQ ID NO: 79654 - DNA, 20 bp, Artificial Sequence
  chemically synthesized
caggacaatcaggcaaggga

SEQ ID NO: 79655 - DNA, 20 bp, Artificial Sequence
  chemically synthesized
tggccaggacaatcaggcaa

SEQ ID NO: 79656 - DNA, 20 bp, Artificial Sequence
  chemically synthesized
ttggccaggacaatcaggca

SEQ ID NO: 79657 - DNA, 20 bp, Artificial Sequence
  chemically synthesized
tttggccaggacaatcaggc

SEQ ID NO: 79658 - DNA, 20 bp, Artificial Sequence
  chemically synthesized
aagttttggccaggacaatc

SEQ ID NO: 79659 - DNA, 20 bp, Artificial Sequence
  chemically synthesized
tttcccttgcctgattgtcc

SEQ ID NO: 79660 - DNA, 20 bp, Artificial Sequence
  chemically synthesized
gaagttttggccaggacaat

SEQ ID NO: 79661 - DNA, 20 bp, Artificial Sequence
  chemically synthesized
taatattggaagttttggcc

SEQ ID NO: 79662 - DNA, 20 bp, Artificial Sequence
  chemically synthesized
ataatattggaagttttggc

SEQ ID NO: 79663 - DNA, 20 bp, Artificial Sequence
  chemically synthesized
caacataatattggaagttt

SEQ ID NO: 79664 - DNA, 20 bp, Artificial Sequence
  chemically synthesized
cgtattcaacataatattgg

SEQ ID NO: 79665 - DNA, 20 bp, Artificial Sequence
  chemically synthesized
actcgtattcaacataatat

SEQ ID NO: 79666 - DNA, 20 bp, Artificial Sequence
  chemically synthesized
tccaatattatgttgaatac

SEQ ID NO: 79667 - DNA, 20 bp, Artificial Sequence
  chemically synthesized
aatattatgttgaatacgag

SEQ ID NO: 79668 - DNA, 20 bp, Artificial Sequence
  chemically synthesized
attatgttgaatacgagtgg

SEQ ID NO: 79669 - DNA, 20 bp, Artificial Sequence
  chemically synthesized
ttatgttgaatacgagtggt

SEQ ID NO: 79670 - DNA, 20 bp, Artificial Sequence
  chemically synthesized
atgttgaatacgagtggtgg

SEQ ID NO: 79671 - DNA, 20 bp, Artificial Sequence
  chemically synthesized
gttgaatacgagtggtggga

SEQ ID NO: 79672 - DNA, 20 bp, Artificial Sequence
  chemically synthesized
ttgaatacgagtggtgggag

SEQ ID NO: 79673 - DNA, 20 bp, Artificial Sequence
  chemically synthesized
tgaatacgagtggtgggaga

SEQ ID NO: 79674 - DNA, 20 bp, Artificial Sequence
  chemically synthesized
ttaaaaaccggcacaagaca

SEQ ID NO: 79675 - DNA, 20 bp, Artificial Sequence
  chemically synthesized
tttaaaaaccggcacaagac

SEQ ID NO: 79676 - DNA, 20 bp, Artificial Sequence
  chemically synthesized
agggcatccttgtcttgtgc

SEQ ID NO: 79677 - DNA, 20 bp, Artificial Sequence
  chemically synthesized
ctccctttaaaaaccggcac

SEQ ID NO: 79678 - DNA, 20 bp, Artificial Sequence
  chemically synthesized
ttgtcttgtgccggttttta

SEQ ID NO: 79679 - DNA, 20 bp, Artificial Sequence
  chemically synthesized
gaagcactccctttaaaaac

SEQ ID NO: 79680 - DNA, 20 bp, Artificial Sequence
  chemically synthesized
tgtcttgtgccggtttttaa

SEQ ID NO: 79681 - DNA, 20 bp, Artificial Sequence
  chemically synthesized
gtcttgtgccggtttttaaa

SEQ ID NO: 79682 - DNA, 20 bp, Artificial Sequence
  chemically synthesized
cttgtgccggtttttaaagg

SEQ ID NO: 79683 - DNA, 20 bp, Artificial Sequence
  chemically synthesized
gtttttaaagggagtgcttc

SEQ ID NO: 79684 - DNA, 20 bp, Artificial Sequence
  chemically synthesized
actgaatgggcaaaagctgg

SEQ ID NO: 79685 - DNA, 20 bp, Artificial Sequence
  chemically synthesized
catactgaatgggcaaaagc

SEQ ID NO: 79686 - DNA, 20 bp, Artificial Sequence
  chemically synthesized
ttatcatactgaatgggcaa

SEQ ID NO: 79687 - DNA, 20 bp, Artificial Sequence
  chemically synthesized
gcttccagcttttgcccatt

SEQ ID NO: 79688 - DNA, 20 bp, Artificial Sequence
  chemically synthesized
cagccattatcatactgaat

SEQ ID NO: 79689 - DNA, 20 bp, Artificial Sequence
  chemically synthesized
acagccattatcatactgaa

SEQ ID NO: 79690 - DNA, 20 bp, Artificial Sequence
  chemically synthesized
ttgcccattcagtatgataa

SEQ ID NO: 79691 - DNA, 20 bp, Artificial Sequence
  chemically synthesized
attcagtatgataatggctg

SEQ ID NO: 79692 - DNA, 20 bp, Artificial Sequence
  chemically synthesized
ttcagtatgataatggctgt

SEQ ID NO: 79693 - DNA, 20 bp, Artificial Sequence
  chemically synthesized
agctacttatgacaaaccca

SEQ ID NO: 79694 - DNA, 20 bp, Artificial Sequence
  chemically synthesized
aatggctgtgggtttgtcat

SEQ ID NO: 79695 - DNA, 20 bp, Artificial Sequence
  chemically synthesized
ggctgtgggtttgtcataag

SEQ ID NO: 79696 - DNA, 20 bp, Artificial Sequence
  chemically synthesized
aacgtatctcaaaataataa

SEQ ID NO: 79697 - DNA, 20 bp, Artificial Sequence
  chemically synthesized
ggaacgtatctcaaaataat

SEQ ID NO: 79698 - DNA, 20 bp, Artificial Sequence
  chemically synthesized
taagtagctcttattatttt

SEQ ID NO: 79699 - DNA, 20 bp, Artificial Sequence
  chemically synthesized
tattttgagatacgttccat

SEQ ID NO: 79700 - DNA, 20 bp, Artificial Sequence
  chemically synthesized
ctcaataaattaggtactga

SEQ ID NO: 79701 - DNA, 20 bp, Artificial Sequence
  chemically synthesized
ctaaaaactctcaataaatt

SEQ ID NO: 79702 - DNA, 20 bp, Artificial Sequence
  chemically synthesized
ccatcagtacctaatttatt

SEQ ID NO: 79703 - DNA, 20 bp, Artificial Sequence
  chemically synthesized
gctaaaaactctcaataaat

SEQ ID NO: 79704 - DNA, 20 bp, Artificial Sequence
  chemically synthesized
atcagtacctaatttattga

SEQ ID NO: 79705 - DNA, 20 bp, Artificial Sequence
  chemically synthesized
cctaatttattgagagtttt

SEQ ID NO: 79706 - DNA, 20 bp, Artificial Sequence
  chemically synthesized
tattgagagtttttagcatg

SEQ ID NO: 79707 - DNA, 20 bp, Artificial Sequence
  chemically synthesized
attgagagtttttagcatga

SEQ ID NO: 79708 - DNA, 20 bp, Artificial Sequence
  chemically synthesized
ttgagagtttttagcatgaa

SEQ ID NO: 79709 - DNA, 20 bp, Artificial Sequence
  chemically synthesized
tgagagtttttagcatgaag

SEQ ID NO: 79710 - DNA, 20 bp, Artificial Sequence
  chemically synthesized
aggggtgttgaattttattg

SEQ ID NO: 79711 - DNA, 20 bp, Artificial Sequence
  chemically synthesized
ggggtgttgaattttattga

SEQ ID NO: 79712 - DNA, 20 bp, Artificial Sequence
  chemically synthesized
tatctcaatagaagcggaaa

SEQ ID NO: 79713 - DNA, 20 bp, Artificial Sequence
  chemically synthesized
ttatctcaatagaagcggaa

SEQ ID NO: 79714 - DNA, 20 bp, Artificial Sequence
  chemically synthesized
catgattatctcaatagaag

SEQ ID NO: 79715 - DNA, 20 bp, Artificial Sequence
  chemically synthesized
aggccttttccgcttctatt

SEQ ID NO: 79716 - DNA, 20 bp, Artificial Sequence
  chemically synthesized
ccacatgattatctcaatag

SEQ ID NO: 79717 - DNA, 20 bp, Artificial Sequence
  chemically synthesized
aaaccacatgattatctcaa

SEQ ID NO: 79718 - DNA, 20 bp, Artificial Sequence
  chemically synthesized
cttctattgagataatcatg

SEQ ID NO: 79719 - DNA, 20 bp, Artificial Sequence
  chemically synthesized
aatcatgtggtttttgtcat

SEQ ID NO: 79720 - DNA, 20 bp, Artificial Sequence
  chemically synthesized
ttttgtcattggttctgttt

SEQ ID NO: 79721 - DNA, 20 bp, Artificial Sequence
  chemically synthesized
aacataatccatcacttaaa

SEQ ID NO: 79722 - DNA, 20 bp, Artificial Sequence
  chemically synthesized
cattggttctgtttaagtga

SEQ ID NO: 79723 - DNA, 20 bp, Artificial Sequence
  chemically synthesized
tgccaggctggttcaacata

SEQ ID NO: 79724 - DNA, 20 bp, Artificial Sequence
  chemically synthesized
ttgatttctgtatgttgaac

SEQ ID NO: 79725 - DNA, 20 bp, Artificial Sequence
  chemically synthesized
ttctgtatgttgaaccagcc

SEQ ID NO: 79726 - DNA, 20 bp, Artificial Sequence
  chemically synthesized
tcatccctgggatgccaggc

SEQ ID NO: 79727 - DNA, 20 bp, Artificial Sequence
  chemically synthesized
gttgaaccagcctggcatcc

SEQ ID NO: 79728 - DNA, 20 bp, Artificial Sequence
  chemically synthesized
ggcttcatccctgggatgcc

SEQ ID NO: 79729 - DNA, 20 bp, Artificial Sequence
  chemically synthesized
ttgaaccagcctggcatccc

SEQ ID NO: 79730 - DNA, 20 bp, Artificial Sequence
  chemically synthesized
tggcttcatccctgggatgc

SEQ ID NO: 79731 - DNA, 20 bp, Artificial Sequence
  chemically synthesized
tgaaccagcctggcatccca

SEQ ID NO: 79732 - DNA, 20 bp, Artificial Sequence
  chemically synthesized
agcctggcatcccagggatg

SEQ ID NO: 79733 - DNA, 20 bp, Artificial Sequence
  chemically synthesized
atcaagttggcttcatccct

SEQ ID NO: 79734 - DNA, 20 bp, Artificial Sequence
  chemically synthesized
gatcaagttggcttcatccc

SEQ ID NO: 79735 - DNA, 20 bp, Artificial Sequence
  chemically synthesized
cttatccagcatgatcaagt

SEQ ID NO: 79736 - DNA, 20 bp, Artificial Sequence
  chemically synthesized
aaagcttatccagcatgatc

SEQ ID NO: 79737 - DNA, 20 bp, Artificial Sequence
  chemically synthesized
tgaagccaacttgatcatgc

SEQ ID NO: 79738 - DNA, 20 bp, Artificial Sequence
  chemically synthesized
ccaacttgatcatgctggat

SEQ ID NO: 79739 - DNA, 20 bp, Artificial Sequence
  chemically synthesized
agcacatgaaaaagcttatc

SEQ ID NO: 79740 - DNA, 20 bp, Artificial Sequence
  chemically synthesized
gaatccagcagcacatgaaa

SEQ ID NO: 79741 - DNA, 20 bp, Artificial Sequence
  chemically synthesized
taagctttttcatgtgctgc

SEQ ID NO: 79742 - DNA, 20 bp, Artificial Sequence
  chemically synthesized
ttttcatgtgctgctggatt

SEQ ID NO: 79743 - DNA, 20 bp, Artificial Sequence
  chemically synthesized
tactggcaaaccgaatccag

SEQ ID NO: 79744 - DNA, 20 bp, Artificial Sequence
  chemically synthesized
aaatactggcaaaccgaatc

SEQ ID NO: 79745 - DNA, 20 bp, Artificial Sequence
  chemically synthesized
tgctgctggattcggtttgc

SEQ ID NO: 79746 - DNA, 20 bp, Artificial Sequence
  chemically synthesized
gaaaatcctcaataaaatac

SEQ ID NO: 79747 - DNA, 20 bp, Artificial Sequence
  chemically synthesized
cggtttgccagtattttatt

SEQ ID NO: 79748 - DNA, 20 bp, Artificial Sequence
  chemically synthesized
ggtttgccagtattttattg

SEQ ID NO: 79749 - DNA, 20 bp, Artificial Sequence
  chemically synthesized
attttcgcattgatgttcat

SEQ ID NO: 79750 - DNA, 20 bp, Artificial Sequence
  chemically synthesized
ttttcgcattgatgttcatc

SEQ ID NO: 79751 - DNA, 20 bp, Artificial Sequence
  chemically synthesized
tttcgcattgatgttcatca

SEQ ID NO: 79752 - DNA, 20 bp, Artificial Sequence
  chemically synthesized
ttgatgttcatcagggatat

SEQ ID NO: 79753 - DNA, 20 bp, Artificial Sequence
  chemically synthesized
caacagacaaagaaaatttc

SEQ ID NO: 79754 - DNA, 20 bp, Artificial Sequence
  chemically synthesized
acaacagacaaagaaaattt

SEQ ID NO: 79755 - DNA, 20 bp, Artificial Sequence
  chemically synthesized
tggcagagacacaacagaca

SEQ ID NO: 79756 - DNA, 20 bp, Artificial Sequence
  chemically synthesized
aaaacctggcagagacacaa

SEQ ID NO: 79757 - DNA, 20 bp, Artificial Sequence
  chemically synthesized
tttgtctgttgtgtctctgc

SEQ ID NO: 79758 - DNA, 20 bp, Artificial Sequence
  chemically synthesized
ttgtctgttgtgtctctgcc

SEQ ID NO: 79759 - DNA, 20 bp, Artificial Sequence
  chemically synthesized
cctgataccaaaacctggca

SEQ ID NO: 79760 - DNA, 20 bp, Artificial Sequence
  chemically synthesized
atcctgataccaaaacctgg

SEQ ID NO: 79761 - DNA, 20 bp, Artificial Sequence
  chemically synthesized
gttgtgtctctgccaggttt

SEQ ID NO: 79762 - DNA, 20 bp, Artificial Sequence
  chemically synthesized
atcatcctgataccaaaacc

SEQ ID NO: 79763 - DNA, 20 bp, Artificial Sequence
  chemically synthesized
tctctgccaggttttggtat

SEQ ID NO: 79764 - DNA, 20 bp, Artificial Sequence
  chemically synthesized
ctctgccaggttttggtatc

SEQ ID NO: 79765 - DNA, 20 bp, Artificial Sequence
  chemically synthesized
ttttggtatcaggatgatgc

SEQ ID NO: 79766 - DNA, 20 bp, Artificial Sequence
  chemically synthesized
cctaactctttttatgaggc

SEQ ID NO: 79767 - DNA, 20 bp, Artificial Sequence
  chemically synthesized
gatgatgctggcctcataaa

SEQ ID NO: 79768 - DNA, 20 bp, Artificial Sequence
  chemically synthesized
cctccctaactctttttatg

SEQ ID NO: 79769 - DNA, 20 bp, Artificial Sequence
  chemically synthesized
tgatgctggcctcataaaaa

SEQ ID NO: 79770 - DNA, 20 bp, Artificial Sequence
  chemically synthesized
tcctccctaactctttttat

SEQ ID NO: 79771 - DNA, 20 bp, Artificial Sequence
  chemically synthesized
gctggcctcataaaaagagt

SEQ ID NO: 79772 - DNA, 20 bp, Artificial Sequence
  chemically synthesized
ctggcctcataaaaagagtt

SEQ ID NO: 79773 - DNA, 20 bp, Artificial Sequence
  chemically synthesized
tggcctcataaaaagagtta

SEQ ID NO: 79774 - DNA, 20 bp, Artificial Sequence
  chemically synthesized
gcctcataaaaagagttagg

SEQ ID NO: 79775 - DNA, 20 bp, Artificial Sequence
  chemically synthesized
cctcataaaaagagttaggg

SEQ ID NO: 79776 - DNA, 20 bp, Artificial Sequence
  chemically synthesized
tcataaaaagagttagggag

SEQ ID NO: 79777 - DNA, 20 bp, Artificial Sequence
  chemically synthesized
ttctaaacaataggaaaaga

SEQ ID NO: 79778 - DNA, 20 bp, Artificial Sequence
  chemically synthesized
attctaaacaataggaaaag

SEQ ID NO: 79779 - DNA, 20 bp, Artificial Sequence
  chemically synthesized
tattctaaacaataggaaaa

SEQ ID NO: 79780 - DNA, 20 bp, Artificial Sequence
  chemically synthesized
actattctaaacaataggaa

SEQ ID NO: 79781 - DNA, 20 bp, Artificial Sequence
  chemically synthesized
gtccctcttttcctattgtt

SEQ ID NO: 79782 - DNA, 20 bp, Artificial Sequence
  chemically synthesized
ctgaaactattctaaacaat

SEQ ID NO: 79783 - DNA, 20 bp, Artificial Sequence
  chemically synthesized
tctgaaactattctaaacaa

SEQ ID NO: 79784 - DNA, 20 bp, Artificial Sequence
  chemically synthesized
tcttttcctattgtttagaa

SEQ ID NO: 79785 - DNA, 20 bp, Artificial Sequence
  chemically synthesized
cctattgtttagaatagttt

SEQ ID NO: 79786 - DNA, 20 bp, Artificial Sequence
  chemically synthesized
attgtttagaatagtttcag

SEQ ID NO: 79787 - DNA, 20 bp, Artificial Sequence
  chemically synthesized
ttgtttagaatagtttcaga

SEQ ID NO: 79788 - DNA, 20 bp, Artificial Sequence
  chemically synthesized
tagaatagtttcagaaggaa

SEQ ID NO: 79789 - DNA, 20 bp, Artificial Sequence
  chemically synthesized
agtttcagaaggaatggtac

SEQ ID NO: 79790 - DNA, 20 bp, Artificial Sequence
  chemically synthesized
ccagaggtacaaagaggagc

SEQ ID NO: 79791 - DNA, 20 bp, Artificial Sequence
  chemically synthesized
tctaccagaggtacaaagag

SEQ ID NO: 79792 - DNA, 20 bp, Artificial Sequence
  chemically synthesized
attctaccagaggtacaaag

SEQ ID NO: 79793 - DNA, 20 bp, Artificial Sequence
  chemically synthesized
aattctaccagaggtacaaa

SEQ ID NO: 79794 - DNA, 20 bp, Artificial Sequence
  chemically synthesized
tgaattctaccagaggtaca

SEQ ID NO: 79795 - DNA, 20 bp, Artificial Sequence
  chemically synthesized
ccagctcctctttgtacctc

SEQ ID NO: 79796 - DNA, 20 bp, Artificial Sequence
  chemically synthesized
gctcctctttgtacctctgg

SEQ ID NO: 79797 - DNA, 20 bp, Artificial Sequence
  chemically synthesized
tcacagctgaattctaccag

SEQ ID NO: 79798 - DNA, 20 bp, Artificial Sequence
  chemically synthesized
ttcacagctgaattctacca

SEQ ID NO: 79799 - DNA, 20 bp, Artificial Sequence
  chemically synthesized
gattcacagctgaattctac

SEQ ID NO: 79800 - DNA, 20 bp, Artificial Sequence
  chemically synthesized
tttgtacctctggtagaatt

SEQ ID NO: 79801 - DNA, 20 bp, Artificial Sequence
  chemically synthesized
cccaggaacagatggattca

SEQ ID NO: 79802 - DNA, 20 bp, Artificial Sequence
  chemically synthesized
aaaaaaagcccaggaacaga

SEQ ID NO: 79803 - DNA, 20 bp, Artificial Sequence
  chemically synthesized
gctgtgaatccatctgttcc

SEQ ID NO: 79804 - DNA, 20 bp, Artificial Sequence
  chemically synthesized
ctgtgaatccatctgttcct

SEQ ID NO: 79805 - DNA, 20 bp, Artificial Sequence
  chemically synthesized
aaccaaaaaaagcccaggaa

SEQ ID NO: 79806 - DNA, 20 bp, Artificial Sequence
  chemically synthesized
ctaccaaccaaaaaaagccc

SEQ ID NO: 79807 - DNA, 20 bp, Artificial Sequence
  chemically synthesized
cctaccaaccaaaaaaagcc

SEQ ID NO: 79808 - DNA, 20 bp, Artificial Sequence
  chemically synthesized
atctgttcctgggctttttt

SEQ ID NO: 79809 - DNA, 20 bp, Artificial Sequence
  chemically synthesized
aatagcctaccaaccaaaaa

SEQ ID NO: 79810 - DNA, 20 bp, Artificial Sequence
  chemically synthesized
gttcctgggctttttttggt

SEQ ID NO: 79811 - DNA, 20 bp, Artificial Sequence
  chemically synthesized
cctgggctttttttggttgg

SEQ ID NO: 79812 - DNA, 20 bp, Artificial Sequence
  chemically synthesized
ctgggctttttttggttggt

SEQ ID NO: 79813 - DNA, 20 bp, Artificial Sequence
  chemically synthesized
gaaattgaggcagtaattaa

SEQ ID NO: 79814 - DNA, 20 bp, Artificial Sequence
  chemically synthesized
aacgagttctgaaattgagg

SEQ ID NO: 79815 - DNA, 20 bp, Artificial Sequence
  chemically synthesized
attaattactgcctcaattt

SEQ ID NO: 79816 - DNA, 20 bp, Artificial Sequence
  chemically synthesized
aataacgagttctgaaattg

SEQ ID NO: 79817 - DNA, 20 bp, Artificial Sequence
  chemically synthesized
caataacgagttctgaaatt

SEQ ID NO: 79818 - DNA, 20 bp, Artificial Sequence
  chemically synthesized
tcaatttcagaactcgttat

SEQ ID NO: 79819 - DNA, 20 bp, Artificial Sequence
  chemically synthesized
tccctgaatagaccaataac

SEQ ID NO: 79820 - DNA, 20 bp, Artificial Sequence
  chemically synthesized
gaactcgttattggtctatt

SEQ ID NO: 79821 - DNA, 20 bp, Artificial Sequence
  chemically synthesized
aactcgttattggtctattc

SEQ ID NO: 79822 - DNA, 20 bp, Artificial Sequence
  chemically synthesized
actcgttattggtctattca

SEQ ID NO: 79823 - DNA, 20 bp, Artificial Sequence
  chemically synthesized
gaagaaatcgaatccctgaa

SEQ ID NO: 79824 - DNA, 20 bp, Artificial Sequence
  chemically synthesized
tcagggattcgatttcttcc

SEQ ID NO: 79825 - DNA, 20 bp, Artificial Sequence
  chemically synthesized
gattcgatttcttcctggtt

SEQ ID NO: 79826 - DNA, 20 bp, Artificial Sequence
  chemically synthesized
cctcccaagactaaaccagg

SEQ ID NO: 79827 - DNA, 20 bp, Artificial Sequence
  chemically synthesized
caccctcccaagactaaacc

SEQ ID NO: 79828 - DNA, 20 bp, Artificial Sequence
  chemically synthesized
acaccctcccaagactaaac

SEQ ID NO: 79829 - DNA, 20 bp, Artificial Sequence
  chemically synthesized
atttcttcctggtttagtct

SEQ ID NO: 79830 - DNA, 20 bp, Artificial Sequence
  chemically synthesized
tttcttcctggtttagtctt

SEQ ID NO: 79831 - DNA, 20 bp, Artificial Sequence
  chemically synthesized
tcttcctggtttagtcttgg

SEQ ID NO: 79832 - DNA, 20 bp, Artificial Sequence
  chemically synthesized
cttcctggtttagtcttggg

SEQ ID NO: 79833 - DNA, 20 bp, Artificial Sequence
  chemically synthesized
ttcctggtttagtcttggga

SEQ ID NO: 79834 - DNA, 20 bp, Artificial Sequence
  chemically synthesized
ctggacacatacaccctccc

SEQ ID NO: 79835 - DNA, 20 bp, Artificial Sequence
  chemically synthesized
cttgggagggtgtatgtgtc

SEQ ID NO: 79836 - DNA, 20 bp, Artificial Sequence
  chemically synthesized
agaagaaattgattaatttc

SEQ ID NO: 79837 - DNA, 20 bp, Artificial Sequence
  chemically synthesized
agaaattaatcaatttcttc

SEQ ID NO: 79838 - DNA, 20 bp, Artificial Sequence
  chemically synthesized
aaataaactagaaaatctag

SEQ ID NO: 79839 - DNA, 20 bp, Artificial Sequence
  chemically synthesized
tcaatttcttctagattttc

SEQ ID NO: 79840 - DNA, 20 bp, Artificial Sequence
  chemically synthesized
cgcaaataaactagaaaatc

SEQ ID NO: 79841 - DNA, 20 bp, Artificial Sequence
  chemically synthesized
acacctctacgcaaataaac

SEQ ID NO: 79842 - DNA, 20 bp, Artificial Sequence
  chemically synthesized
gattttctagtttatttgcg

SEQ ID NO: 79843 - DNA, 20 bp, Artificial Sequence
  chemically synthesized
ttttctagtttatttgcgta

SEQ ID NO: 79844 - DNA, 20 bp, Artificial Sequence
  chemically synthesized
tttctagtttatttgcgtag

SEQ ID NO: 79845 - DNA, 20 bp, Artificial Sequence
  chemically synthesized
tatttgcgtagaggtgttta

SEQ ID NO: 79846 - DNA, 20 bp, Artificial Sequence
  chemically synthesized
gtgtttatagtattctctga

SEQ ID NO: 79847 - DNA, 20 bp, Artificial Sequence
  chemically synthesized
tttatagtattctctgatgg

SEQ ID NO: 79848 - DNA, 20 bp, Artificial Sequence
  chemically synthesized
agaaatacaaactaccatca

SEQ ID NO: 79849 - DNA, 20 bp, Artificial Sequence
  chemically synthesized
acagaaatacaaactaccat

SEQ ID NO: 79850 - DNA, 20 bp, Artificial Sequence
  chemically synthesized
gatggtagtttgtatttctg

SEQ ID NO: 79851 - DNA, 20 bp, Artificial Sequence
  chemically synthesized
atggtagtttgtatttctgt

SEQ ID NO: 79852 - DNA, 20 bp, Artificial Sequence
  chemically synthesized
agtttgtatttctgtgggat

SEQ ID NO: 79853 - DNA, 20 bp, Artificial Sequence
  chemically synthesized
ggatattagctctcatccca

SEQ ID NO: 79854 - DNA, 20 bp, Artificial Sequence
  chemically synthesized
tttgtatttctgtgggatga

SEQ ID NO: 79855 - DNA, 20 bp, Artificial Sequence
  chemically synthesized
aaaaatgataaaggggatat

SEQ ID NO: 79856 - DNA, 20 bp, Artificial Sequence
  chemically synthesized
cacaagaaaaaatgataaag

SEQ ID NO: 79857 - DNA, 20 bp, Artificial Sequence
  chemically synthesized
acacaagaaaaaatgataaa

SEQ ID NO: 79858 - DNA, 20 bp, Artificial Sequence
  chemically synthesized
gacacaagaaaaaatgataa

SEQ ID NO: 79859 - DNA, 20 bp, Artificial Sequence
  chemically synthesized
agacacaagaaaaaatgata

SEQ ID NO: 79860 - DNA, 20 bp, Artificial Sequence
  chemically synthesized
gagaagaatcagacagacac

SEQ ID NO: 79861 - DNA, 20 bp, Artificial Sequence
  chemically synthesized
gaaaagagagaagaatcaga

SEQ ID NO: 79862 - DNA, 20 bp, Artificial Sequence
  chemically synthesized
agaagaaaagagagaagaat

SEQ ID NO: 79863 - DNA, 20 bp, Artificial Sequence
  chemically synthesized
taataaagaagaaaagagag

SEQ ID NO: 79864 - DNA, 20 bp, Artificial Sequence
  chemically synthesized
gactaataaagaagaaaaga

SEQ ID NO: 79865 - DNA, 20 bp, Artificial Sequence
  chemically synthesized
cagactaataaagaagaaaa

SEQ ID NO: 79866 - DNA, 20 bp, Artificial Sequence
  chemically synthesized
gccagactaataaagaagaa

SEQ ID NO: 79867 - DNA, 20 bp, Artificial Sequence
  chemically synthesized
ttctctcttttcttctttat

SEQ ID NO: 79868 - DNA, 20 bp, Artificial Sequence
  chemically synthesized
tgctagccagactaataaag

SEQ ID NO: 79869 - DNA, 20 bp, Artificial Sequence
  chemically synthesized
gactgctagccagactaata

SEQ ID NO: 79870 - DNA, 20 bp, Artificial Sequence
  chemically synthesized
tcttttcttctttattagtc

SEQ ID NO: 79871 - DNA, 20 bp, Artificial Sequence
  chemically synthesized
ttcttctttattagtctggc

SEQ ID NO: 79872 - DNA, 20 bp, Artificial Sequence
  chemically synthesized
ttctttattagtctggctag

SEQ ID NO: 79873 - DNA, 20 bp, Artificial Sequence
  chemically synthesized
aaaatagatagactgctagc

SEQ ID NO: 79874 - DNA, 20 bp, Artificial Sequence
  chemically synthesized
taacaaaatagatagactgc

SEQ ID NO: 79875 - DNA, 20 bp, Artificial Sequence
  chemically synthesized
gaaaagattaacaaaataga

SEQ ID NO: 79876 - DNA, 20 bp, Artificial Sequence
  chemically synthesized
ttttgaaaagattaacaaaa

SEQ ID NO: 79877 - DNA, 20 bp, Artificial Sequence
  chemically synthesized
ccaggggctggttttttgaa

SEQ ID NO: 79878 - DNA, 20 bp, Artificial Sequence
  chemically synthesized
tgttaatcttttcaaaaaac

SEQ ID NO: 79879 - DNA, 20 bp, Artificial Sequence
  chemically synthesized
cttttcaaaaaaccagcccc

SEQ ID NO: 79880 - DNA, 20 bp, Artificial Sequence
  chemically synthesized
aaatcaatgaagccaggggc

SEQ ID NO: 79881 - DNA, 20 bp, Artificial Sequence
  chemically synthesized
caaaaaatcaatgaagccag

SEQ ID NO: 79882 - DNA, 20 bp, Artificial Sequence
  chemically synthesized
tcaaaaaatcaatgaagcca

SEQ ID NO: 79883 - DNA, 20 bp, Artificial Sequence
  chemically synthesized
ttcaaaaaatcaatgaagcc

SEQ ID NO: 79884 - DNA, 20 bp, Artificial Sequence
  chemically synthesized
cttcaaaaaatcaatgaagc

SEQ ID NO: 79885 - DNA, 20 bp, Artificial Sequence
  chemically synthesized
aatccttcaaaaaatcaatg

SEQ ID NO: 79886 - DNA, 20 bp, Artificial Sequence
  chemically synthesized
ctggcttcattgattttttg

SEQ ID NO: 79887 - DNA, 20 bp, Artificial Sequence
  chemically synthesized
tggcttcattgattttttga

SEQ ID NO: 79888 - DNA, 20 bp, Artificial Sequence
  chemically synthesized
actgaaggagatagagacat

SEQ ID NO: 79889 - DNA, 20 bp, Artificial Sequence
  chemically synthesized
gagcagaactgaaggagata

SEQ ID NO: 79890 - DNA, 20 bp, Artificial Sequence
  chemically synthesized
tctcatgtctctatctcctt

SEQ ID NO: 79891 - DNA, 20 bp, Artificial Sequence
  chemically synthesized
cagagcagaactgaaggaga

SEQ ID NO: 79892 - DNA, 20 bp, Artificial Sequence
  chemically synthesized
cgatcagagcagaactgaag

SEQ ID NO: 79893 - DNA, 20 bp, Artificial Sequence
  chemically synthesized
tacgatcagagcagaactga

SEQ ID NO: 79894 - DNA, 20 bp, Artificial Sequence
  chemically synthesized
ctacgatcagagcagaactg

SEQ ID NO: 79895 - DNA, 20 bp, Artificial Sequence
  chemically synthesized
agaaataactacgatcagag

SEQ ID NO: 79896 - DNA, 20 bp, Artificial Sequence
  chemically synthesized
cttcagttctgctctgatcg

SEQ ID NO: 79897 - DNA, 20 bp, Artificial Sequence
  chemically synthesized
agaagaaataactacgatca

SEQ ID NO: 79898 - DNA, 20 bp, Artificial Sequence
  chemically synthesized
agagaagaaataactacgat

SEQ ID NO: 79899 - DNA, 20 bp, Artificial Sequence
  chemically synthesized
ttccaaagctagcagaagag

SEQ ID NO: 79900 - DNA, 20 bp, Artificial Sequence
  chemically synthesized
agttatttcttctcttctgc

SEQ ID NO: 79901 - DNA, 20 bp, Artificial Sequence
  chemically synthesized
aaattccaaagctagcagaa

SEQ ID NO: 79902 - DNA, 20 bp, Artificial Sequence
  chemically synthesized
acaaattccaaagctagcag

SEQ ID NO: 79903 - DNA, 20 bp, Artificial Sequence
  chemically synthesized
ttcttctcttctgctagctt

SEQ ID NO: 79904 - DNA, 20 bp, Artificial Sequence
  chemically synthesized
caaacaaattccaaagctag

SEQ ID NO: 79905 - DNA, 20 bp, Artificial Sequence
  chemically synthesized
gagcaaacaaattccaaagc

SEQ ID NO: 79906 - DNA, 20 bp, Artificial Sequence
  chemically synthesized
gcaagagcaaacaaattcca

SEQ ID NO: 79907 - DNA, 20 bp, Artificial Sequence
  chemically synthesized
taaaagaagtagagaagcaa

SEQ ID NO: 79908 - DNA, 20 bp, Artificial Sequence
  chemically synthesized
attaaaagaagtagagaagc

SEQ ID NO: 79909 - DNA, 20 bp, Artificial Sequence
  chemically synthesized
cacaattaaaagaagtagag

SEQ ID NO: 79910 - DNA, 20 bp, Artificial Sequence
  chemically synthesized
catcacaattaaaagaagta

SEQ ID NO: 79911 - DNA, 20 bp, Artificial Sequence
  chemically synthesized
aacatcacaattaaaagaag

SEQ ID NO: 79912 - DNA, 20 bp, Artificial Sequence
  chemically synthesized
cttaacatcacaattaaaag

SEQ ID NO: 79913 - DNA, 20 bp, Artificial Sequence
  chemically synthesized
caccttaacatcacaattaa

SEQ ID NO: 79914 - DNA, 20 bp, Artificial Sequence
  chemically synthesized
cttcttttaattgtgatgtt

SEQ ID NO: 79915 - DNA, 20 bp, Artificial Sequence
  chemically synthesized
ttcttttaattgtgatgtta

SEQ ID NO: 79916 - DNA, 20 bp, Artificial Sequence
  chemically synthesized
tgatgttaaggtgtcaattt

SEQ ID NO: 79917 - DNA, 20 bp, Artificial Sequence
  chemically synthesized
aaatccccacaggagaaagc

SEQ ID NO: 79918 - DNA, 20 bp, Artificial Sequence
  chemically synthesized
aaaatccccacaggagaaag

SEQ ID NO: 79919 - DNA, 20 bp, Artificial Sequence
  chemically synthesized
atatttcctgctttctcctg

SEQ ID NO: 79920 - DNA, 20 bp, Artificial Sequence
  chemically synthesized
attaaaatccccacaggaga

SEQ ID NO: 79921 - DNA, 20 bp, Artificial Sequence
  chemically synthesized
tatttcctgctttctcctgt

SEQ ID NO: 79922 - DNA, 20 bp, Artificial Sequence
  chemically synthesized
atttcctgctttctcctgtg

SEQ ID NO: 79923 - DNA, 20 bp, Artificial Sequence
  chemically synthesized
cagcattaaaatccccacag

SEQ ID NO: 79924 - DNA, 20 bp, Artificial Sequence
  chemically synthesized
tacagcattaaaatccccac

SEQ ID NO: 79925 - DNA, 20 bp, Artificial Sequence
  chemically synthesized
ttacagcattaaaatcccca

SEQ ID NO: 79926 - DNA, 20 bp, Artificial Sequence
  chemically synthesized
agtatttagagggaaattta

SEQ ID NO: 79927 - DNA, 20 bp, Artificial Sequence
  chemically synthesized
cagctaaagcagtatttaga

SEQ ID NO: 79928 - DNA, 20 bp, Artificial Sequence
  chemically synthesized
acagctaaagcagtatttag

SEQ ID NO: 79929 - DNA, 20 bp, Artificial Sequence
  chemically synthesized
cacagctaaagcagtattta

SEQ ID NO: 79930 - DNA, 20 bp, Artificial Sequence
  chemically synthesized
gacacagctaaagcagtatt

SEQ ID NO: 79931 - DNA, 20 bp, Artificial Sequence
  chemically synthesized
tttccctctaaatactgctt

SEQ ID NO: 79932 - DNA, 20 bp, Artificial Sequence
  chemically synthesized
tctctgggacacagctaaag

SEQ ID NO: 79933 - DNA, 20 bp, Artificial Sequence
  chemically synthesized
gaatctctgggacacagcta

SEQ ID NO: 79934 - DNA, 20 bp, Artificial Sequence
  chemically synthesized
atactgctttagctgtgtcc

SEQ ID NO: 79935 - DNA, 20 bp, Artificial Sequence
  chemically synthesized
actgctttagctgtgtccca

SEQ ID NO: 79936 - DNA, 20 bp, Artificial Sequence
  chemically synthesized
ggaccagaatctctgggaca

SEQ ID NO: 79937 - DNA, 20 bp, Artificial Sequence
  chemically synthesized
cacaacggaccagaatctct

SEQ ID NO: 79938 - DNA, 20 bp, Artificial Sequence
  chemically synthesized
tagctgtgtcccagagattc

SEQ ID NO: 79939 - DNA, 20 bp, Artificial Sequence
  chemically synthesized
acacaacggaccagaatctc

SEQ ID NO: 79940 - DNA, 20 bp, Artificial Sequence
  chemically synthesized
agaataaatacacaacggac

SEQ ID NO: 79941 - DNA, 20 bp, Artificial Sequence
  chemically synthesized
caatgagaataaatacacaa

SEQ ID NO: 79942 - DNA, 20 bp, Artificial Sequence
  chemically synthesized
cgttgtgtatttattctcat

SEQ ID NO: 79943 - DNA, 20 bp, Artificial Sequence
  chemically synthesized
ataagttctttcaaaccaat

SEQ ID NO: 79944 - DNA, 20 bp, Artificial Sequence
  chemically synthesized
atttattctcattggtttga

SEQ ID NO: 79945 - DNA, 20 bp, Artificial Sequence
  chemically synthesized
aaattaaggcagaaatgaat

SEQ ID NO: 79946 - DNA, 20 bp, Artificial Sequence
  chemically synthesized
gataaataaggaaattaagg

SEQ ID NO: 79947 - DNA, 20 bp, Artificial Sequence
  chemically synthesized
ctggataaataaggaaatta

SEQ ID NO: 79948 - DNA, 20 bp, Artificial Sequence
  chemically synthesized
gctggataaataaggaaatt

SEQ ID NO: 79949 - DNA, 20 bp, Artificial Sequence
  chemically synthesized
gaatgactgctggataaata

SEQ ID NO: 79950 - DNA, 20 bp, Artificial Sequence
  chemically synthesized
ccttaatttccttatttatc

SEQ ID NO: 79951 - DNA, 20 bp, Artificial Sequence
  chemically synthesized
tgaatgactgctggataaat

SEQ ID NO: 79952 - DNA, 20 bp, Artificial Sequence
  chemically synthesized
taatttccttatttatccag

SEQ ID NO: 79953 - DNA, 20 bp, Artificial Sequence
  chemically synthesized
acctgctcctgaatgactgc

SEQ ID NO: 79954 - DNA, 20 bp, Artificial Sequence
  chemically synthesized
ttatttatccagcagtcatt

SEQ ID NO: 79955 - DNA, 20 bp, Artificial Sequence
  chemically synthesized
tatttatccagcagtcattc

SEQ ID NO: 79956 - DNA, 20 bp, Artificial Sequence
  chemically synthesized
tttatccagcagtcattcag

SEQ ID NO: 79957 - DNA, 20 bp, Artificial Sequence
  chemically synthesized
atccagcagtcattcaggag

SEQ ID NO: 79958 - DNA, 20 bp, Artificial Sequence
  chemically synthesized
tccagcagtcattcaggagc

SEQ ID NO: 79959 - DNA, 20 bp, Artificial Sequence
  chemically synthesized
tcattcaggagcaggttgct

SEQ ID NO: 79960 - DNA, 20 bp, Artificial Sequence
  chemically synthesized
cacacaactacatggaaact

SEQ ID NO: 79961 - DNA, 20 bp, Artificial Sequence
  chemically synthesized
caggttgctcagtttccatg

SEQ ID NO: 79962 - DNA, 20 bp, Artificial Sequence
  chemically synthesized
ctcaaaaccacacaactaca

SEQ ID NO: 79963 - DNA, 20 bp, Artificial Sequence
  chemically synthesized
tcagtttccatgtagttgtg

SEQ ID NO: 79964 - DNA, 20 bp, Artificial Sequence
  chemically synthesized
ccatgtagttgtgtggtttt

SEQ ID NO: 79965 - DNA, 20 bp, Artificial Sequence
  chemically synthesized
gtagttgtgtggttttgagt

SEQ ID NO: 79966 - DNA, 20 bp, Artificial Sequence
  chemically synthesized
tgagtgagtttcttaatcct

SEQ ID NO: 79967 - DNA, 20 bp, Artificial Sequence
  chemically synthesized
tcaaattagaactcaggatt

SEQ ID NO: 79968 - DNA, 20 bp, Artificial Sequence
  chemically synthesized
gtacaatcaaattagaactc

SEQ ID NO: 79969 - DNA, 20 bp, Artificial Sequence
  chemically synthesized
agtacaatcaaattagaact

SEQ ID NO: 79970 - DNA, 20 bp, Artificial Sequence
  chemically synthesized
agaccacagtacaatcaaat

SEQ ID NO: 79971 - DNA, 20 bp, Artificial Sequence
  chemically synthesized
gttctaatttgattgtactg

SEQ ID NO: 79972 - DNA, 20 bp, Artificial Sequence
  chemically synthesized
atttgattgtactgtggtct

SEQ ID NO: 79973 - DNA, 20 bp, Artificial Sequence
  chemically synthesized
cataagagtctctcagacca

SEQ ID NO: 79974 - DNA, 20 bp, Artificial Sequence
  chemically synthesized
ttgattgtactgtggtctga

SEQ ID NO: 79975 - DNA, 20 bp, Artificial Sequence
  chemically synthesized
cagaaatcataagagtctct

SEQ ID NO: 79976 - DNA, 20 bp, Artificial Sequence
  chemically synthesized
caaaaaaacagaaatcataa

SEQ ID NO: 79977 - DNA, 20 bp, Artificial Sequence
  chemically synthesized
tgcaaaaaaacagaaatcat

SEQ ID NO: 79978 - DNA, 20 bp, Artificial Sequence
  chemically synthesized
cctcagcaaatgcaaaaaaa

SEQ ID NO: 79979 - DNA, 20 bp, Artificial Sequence
  chemically synthesized
tctgtttttttgcatttgct

SEQ ID NO: 79980 - DNA, 20 bp, Artificial Sequence
  chemically synthesized
ctgtttttttgcatttgctg

SEQ ID NO: 79981 - DNA, 20 bp, Artificial Sequence
  chemically synthesized
gtttttttgcatttgctgag

SEQ ID NO: 79982 - DNA, 20 bp, Artificial Sequence
  chemically synthesized
attggaagtaaaacactcct

SEQ ID NO: 79983 - DNA, 20 bp, Artificial Sequence
  chemically synthesized
aaaattgaccacataattgg

SEQ ID NO: 79984 - DNA, 20 bp, Artificial Sequence
  chemically synthesized
gtgttttacttccaattatg

SEQ ID NO: 79985 - DNA, 20 bp, Artificial Sequence
  chemically synthesized
tataaaattgaccacataat

SEQ ID NO: 79986 - DNA, 20 bp, Artificial Sequence
  chemically synthesized
tatgtggtcaattttataat

SEQ ID NO: 79987 - DNA, 20 bp, Artificial Sequence
  chemically synthesized
attttataataagtgtgatg

SEQ ID NO: 79988 - DNA, 20 bp, Artificial Sequence
  chemically synthesized
aataagtgtgatgtggtgct

SEQ ID NO: 79989 - DNA, 20 bp, Artificial Sequence
  chemically synthesized
aacagaatatacattattct

SEQ ID NO: 79990 - DNA, 20 bp, Artificial Sequence
  chemically synthesized
taatgtatattctgttgatt

SEQ ID NO: 79991 - DNA, 20 bp, Artificial Sequence
  chemically synthesized
aatgtatattctgttgattt

SEQ ID NO: 79992 - DNA, 20 bp, Artificial Sequence
  chemically synthesized
aactccccaccccaaatcaa

SEQ ID NO: 79993 - DNA, 20 bp, Artificial Sequence
  chemically synthesized
atgtatattctgttgatttg

SEQ ID NO: 79994 - DNA, 20 bp, Artificial Sequence
  chemically synthesized
tatattctgttgatttgggg

SEQ ID NO: 79995 - DNA, 20 bp, Artificial Sequence
  chemically synthesized
atattctgttgatttggggt

SEQ ID NO: 79996 - DNA, 20 bp, Artificial Sequence
  chemically synthesized
tattctgttgatttggggtg

SEQ ID NO: 79997 - DNA, 20 bp, Artificial Sequence
  chemically synthesized
ttctgttgatttggggtggg

SEQ ID NO: 79998 - DNA, 20 bp, Artificial Sequence
  chemically synthesized
atttggggtggggagttctg

SEQ ID NO: 79999 - DNA, 20 bp, Artificial Sequence
  chemically synthesized
gtggacttaatagacatcta

SEQ ID NO: 80000 - DNA, 20 bp, Artificial Sequence
  chemically synthesized
gagttctgtagatgtctatt

SEQ ID NO: 80001 - DNA, 20 bp, Artificial Sequence
  chemically synthesized
tctggaccaagtggacttaa

SEQ ID NO: 80002 - DNA, 20 bp, Artificial Sequence
  chemically synthesized
agatgtctattaagtccact

SEQ ID NO: 80003 - DNA, 20 bp, Artificial Sequence
  chemically synthesized
tctattaagtccacttggtc

SEQ ID NO: 80004 - DNA, 20 bp, Artificial Sequence
  chemically synthesized
aaactcagctctggaccaag

SEQ ID NO: 80005 - DNA, 20 bp, Artificial Sequence
  chemically synthesized
tattaagtccacttggtcca

SEQ ID NO: 80006 - DNA, 20 bp, Artificial Sequence
  chemically synthesized
cttaaactcagctctggacc

SEQ ID NO: 80007 - DNA, 20 bp, Artificial Sequence
  chemically synthesized
agtccacttggtccagagct

SEQ ID NO: 80008 - DNA, 20 bp, Artificial Sequence
  chemically synthesized
tcaggacttaaactcagctc

SEQ ID NO: 80009 - DNA, 20 bp, Artificial Sequence
  chemically synthesized
cttggtccagagctgagttt

SEQ ID NO: 80010 - DNA, 20 bp, Artificial Sequence
  chemically synthesized
ggatattcaggacttaaact

SEQ ID NO: 80011 - DNA, 20 bp, Artificial Sequence
  chemically synthesized
gaaaattaacaaggatattc

SEQ ID NO: 80012 - DNA, 20 bp, Artificial Sequence
  chemically synthesized
agaaaattaacaaggatatt

SEQ ID NO: 80013 - DNA, 20 bp, Artificial Sequence
  chemically synthesized
aacgaaacagaaaattaaca

SEQ ID NO: 80014 - DNA, 20 bp, Artificial Sequence
  chemically synthesized
caacgaaacagaaaattaac

SEQ ID NO: 80015 - DNA, 20 bp, Artificial Sequence
  chemically synthesized
tattagacggatcaacgaaa

SEQ ID NO: 80016 - DNA, 20 bp, Artificial Sequence
  chemically synthesized
accccactgtcaatattaga

SEQ ID NO: 80017 - DNA, 20 bp, Artificial Sequence
  chemically synthesized
gttgatccgtctaatattga

SEQ ID NO: 80018 - DNA, 20 bp, Artificial Sequence
  chemically synthesized
taacaccccactgtcaatat

SEQ ID NO: 80019 - DNA, 20 bp, Artificial Sequence
  chemically synthesized
gatccgtctaatattgacag

SEQ ID NO: 80020 - DNA, 20 bp, Artificial Sequence
  chemically synthesized
atccgtctaatattgacagt

SEQ ID NO: 80021 - DNA, 20 bp, Artificial Sequence
  chemically synthesized
tccgtctaatattgacagtg

SEQ ID NO: 80022 - DNA, 20 bp, Artificial Sequence
  chemically synthesized
tgcccatacaataatagtgg

SEQ ID NO: 80023 - DNA, 20 bp, Artificial Sequence
  chemically synthesized
gatgcccatacaataatagt

SEQ ID NO: 80024 - DNA, 20 bp, Artificial Sequence
  chemically synthesized
agatgcccatacaataatag

SEQ ID NO: 80025 - DNA, 20 bp, Artificial Sequence
  chemically synthesized
catagatgcccatacaataa

SEQ ID NO: 80026 - DNA, 20 bp, Artificial Sequence
  chemically synthesized
aatctcccactattattgta

SEQ ID NO: 80027 - DNA, 20 bp, Artificial Sequence
  chemically synthesized
atctcccactattattgtat

SEQ ID NO: 80028 - DNA, 20 bp, Artificial Sequence
  chemically synthesized
tagagacctacaaagagaca

SEQ ID NO: 80029 - DNA, 20 bp, Artificial Sequence
  chemically synthesized
tgggcatctatgtctctttg

SEQ ID NO: 80030 - DNA, 20 bp, Artificial Sequence
  chemically synthesized
gggcatctatgtctctttgt

SEQ ID NO: 80031 - DNA, 20 bp, Artificial Sequence
  chemically synthesized
agttcttagagacctacaaa

SEQ ID NO: 80032 - DNA, 20 bp, Artificial Sequence
  chemically synthesized
taagttcttagagacctaca

SEQ ID NO: 80033 - DNA, 20 bp, Artificial Sequence
  chemically synthesized
atgtctctttgtaggtctct

SEQ ID NO: 80034 - DNA, 20 bp, Artificial Sequence
  chemically synthesized
attcataaagtaagttctta

SEQ ID NO: 80035 - DNA, 20 bp, Artificial Sequence
  chemically synthesized
ggattcataaagtaagttct

SEQ ID NO: 80036 - DNA, 20 bp, Artificial Sequence
  chemically synthesized
agcacccggattcataaagt

SEQ ID NO: 80037 - DNA, 20 bp, Artificial Sequence
  chemically synthesized
taggagcacccggattcata

SEQ ID NO: 80038 - DNA, 20 bp, Artificial Sequence
  chemically synthesized
aagaacttactttatgaatc

SEQ ID NO: 80039 - DNA, 20 bp, Artificial Sequence
  chemically synthesized
agaacttactttatgaatcc

SEQ ID NO: 80040 - DNA, 20 bp, Artificial Sequence
  chemically synthesized
gcacccaatataggagcacc

SEQ ID NO: 80041 - DNA, 20 bp, Artificial Sequence
  chemically synthesized
gaatccgggtgctcctatat

SEQ ID NO: 80042 - DNA, 20 bp, Artificial Sequence
  chemically synthesized
aatccgggtgctcctatatt

SEQ ID NO: 80043 - DNA, 20 bp, Artificial Sequence
  chemically synthesized
tatatatgcacccaatatag

SEQ ID NO: 80044 - DNA, 20 bp, Artificial Sequence
  chemically synthesized
aatatatatgcacccaatat

SEQ ID NO: 80045 - DNA, 20 bp, Artificial Sequence
  chemically synthesized
aaatatatatgcacccaata

SEQ ID NO: 80046 - DNA, 20 bp, Artificial Sequence
  chemically synthesized
atattgggtgcatatatatt

SEQ ID NO: 80047 - DNA, 20 bp, Artificial Sequence
  chemically synthesized
tattgggtgcatatatattt

SEQ ID NO: 80048 - DNA, 20 bp, Artificial Sequence
  chemically synthesized
gggtgcatatatatttagga

SEQ ID NO: 80049 - DNA, 20 bp, Artificial Sequence
  chemically synthesized
gcatatatatttaggatagt

SEQ ID NO: 80050 - DNA, 20 bp, Artificial Sequence
  chemically synthesized
agtgatcaatgcaacaagaa

SEQ ID NO: 80051 - DNA, 20 bp, Artificial Sequence
  chemically synthesized
aaagtgatcaatgcaacaag

SEQ ID NO: 80052 - DNA, 20 bp, Artificial Sequence
  chemically synthesized
ggtaaagtgatcaatgcaac

SEQ ID NO: 80053 - DNA, 20 bp, Artificial Sequence
  chemically synthesized
aatggtattacataatggta

SEQ ID NO: 80054 - DNA, 20 bp, Artificial Sequence
  chemically synthesized
aaaaaaatggtattacataa

SEQ ID NO: 80055 - DNA, 20 bp, Artificial Sequence
  chemically synthesized
atcaaaaaggacaaaaaaaa

SEQ ID NO: 80056 - DNA, 20 bp, Artificial Sequence
  chemically synthesized
taaaccaataaagatcaaaa

SEQ ID NO: 80057 - DNA, 20 bp, Artificial Sequence
  chemically synthesized
ttaaaccaataaagatcaaa

SEQ ID NO: 80058 - DNA, 20 bp, Artificial Sequence
  chemically synthesized
ttgtcctttttgatctttat

SEQ ID NO: 80059 - DNA, 20 bp, Artificial Sequence
  chemically synthesized
aaacagactttaaaccaata

SEQ ID NO: 80060 - DNA, 20 bp, Artificial Sequence
  chemically synthesized
ttttgatctttattggttta

SEQ ID NO: 80061 - DNA, 20 bp, Artificial Sequence
  chemically synthesized
aatcctagtctcagacaaaa

SEQ ID NO: 80062 - DNA, 20 bp, Artificial Sequence
  chemically synthesized
gtttaaagtctgttttgtct

SEQ ID NO: 80063 - DNA, 20 bp, Artificial Sequence
  chemically synthesized
aagtctgttttgtctgagac

SEQ ID NO: 80064 - DNA, 20 bp, Artificial Sequence
  chemically synthesized
agtctgttttgtctgagact

SEQ ID NO: 80065 - DNA, 20 bp, Artificial Sequence
  chemically synthesized
aggggttgcaatcctagtct

SEQ ID NO: 80066 - DNA, 20 bp, Artificial Sequence
  chemically synthesized
aaaagcaggggttgcaatcc

SEQ ID NO: 80067 - DNA, 20 bp, Artificial Sequence
  chemically synthesized
tggaaagaaaaaaaaagcag

SEQ ID NO: 80068 - DNA, 20 bp, Artificial Sequence
  chemically synthesized
atggaaagaaaaaaaaagca

SEQ ID NO: 80069 - DNA, 20 bp, Artificial Sequence
  chemically synthesized
aatggaaagaaaaaaaaagc

SEQ ID NO: 80070 - DNA, 20 bp, Artificial Sequence
  chemically synthesized
aaatggaaagaaaaaaaaag

SEQ ID NO: 80071 - DNA, 20 bp, Artificial Sequence
  chemically synthesized
agcaaatggaaagaaaaaaa

SEQ ID NO: 80072 - DNA, 20 bp, Artificial Sequence
  chemically synthesized
tttaccaagcagcaaatgga

SEQ ID NO: 80073 - DNA, 20 bp, Artificial Sequence
  chemically synthesized
aatatttaccaagcagcaaa

SEQ ID NO: 80074 - DNA, 20 bp, Artificial Sequence
  chemically synthesized
ttttctttccatttgctgct

SEQ ID NO: 80075 - DNA, 20 bp, Artificial Sequence
  chemically synthesized
atcgatgaatatttaccaag

SEQ ID NO: 80076 - DNA, 20 bp, Artificial Sequence
  chemically synthesized
gggatcgatgaatatttacc

SEQ ID NO: 80077 - DNA, 20 bp, Artificial Sequence
  chemically synthesized
acacataggctcaaaataaa

SEQ ID NO: 80078 - DNA, 20 bp, Artificial Sequence
  chemically synthesized
ttcatcgatccctttatttt

SEQ ID NO: 80079 - DNA, 20 bp, Artificial Sequence
  chemically synthesized
cacacataggctcaaaataa

SEQ ID NO: 80080 - DNA, 20 bp, Artificial Sequence
  chemically synthesized
acacacataggctcaaaata

SEQ ID NO: 80081 - DNA, 20 bp, Artificial Sequence
  chemically synthesized
tcatgtgcagagacacacat

SEQ ID NO: 80082 - DNA, 20 bp, Artificial Sequence
  chemically synthesized
ctcatgtgcagagacacaca

SEQ ID NO: 80083 - DNA, 20 bp, Artificial Sequence
  chemically synthesized
ctatgtgtgtctctgcacat

SEQ ID NO: 80084 - DNA, 20 bp, Artificial Sequence
  chemically synthesized
gaagacccacctcatgtgca

SEQ ID NO: 80085 - DNA, 20 bp, Artificial Sequence
  chemically synthesized
tatgtgtgtctctgcacatg

SEQ ID NO: 80086 - DNA, 20 bp, Artificial Sequence
  chemically synthesized
cagaagacccacctcatgtg

SEQ ID NO: 80087 - DNA, 20 bp, Artificial Sequence
  chemically synthesized
gtgtgtctctgcacatgagg

SEQ ID NO: 80088 - DNA, 20 bp, Artificial Sequence
  chemically synthesized
tgtgtctctgcacatgaggt

SEQ ID NO: 80089 - DNA, 20 bp, Artificial Sequence
  chemically synthesized
tgaggtgggtcttctgaata

SEQ ID NO: 80090 - DNA, 20 bp, Artificial Sequence
  chemically synthesized
catcagtgtgctgtattcag

SEQ ID NO: 80091 - DNA, 20 bp, Artificial Sequence
  chemically synthesized
acccatcagtgtgctgtatt

SEQ ID NO: 80092 - DNA, 20 bp, Artificial Sequence
  chemically synthesized
ttctgaatacagcacactga

SEQ ID NO: 80093 - DNA, 20 bp, Artificial Sequence
  chemically synthesized
tctgaatacagcacactgat

SEQ ID NO: 80094 - DNA, 20 bp, Artificial Sequence
  chemically synthesized
gataaagactcaagacccat

SEQ ID NO: 80095 - DNA, 20 bp, Artificial Sequence
  chemically synthesized
acagcacactgatgggtctt

SEQ ID NO: 80096 - DNA, 20 bp, Artificial Sequence
  chemically synthesized
ggcaaattggataaagactc

SEQ ID NO: 80097 - DNA, 20 bp, Artificial Sequence
  chemically synthesized
acagactggcaaattggata

SEQ ID NO: 80098 - DNA, 20 bp, Artificial Sequence
  chemically synthesized
tgagtctttatccaatttgc

SEQ ID NO: 80099 - DNA, 20 bp, Artificial Sequence
  chemically synthesized
aaagacacagactggcaaat

SEQ ID NO: 80100 - DNA, 20 bp, Artificial Sequence
  chemically synthesized
cccaattaaaagacacagac

SEQ ID NO: 80101 - DNA, 20 bp, Artificial Sequence
  chemically synthesized
aatgccccaattaaaagaca

SEQ ID NO: 80102 - DNA, 20 bp, Artificial Sequence
  chemically synthesized
gccagtctgtgtcttttaat

SEQ ID NO: 80103 - DNA, 20 bp, Artificial Sequence
  chemically synthesized
ccagtctgtgtcttttaatt

SEQ ID NO: 80104 - DNA, 20 bp, Artificial Sequence
  chemically synthesized
cagtctgtgtcttttaattg

SEQ ID NO: 80105 - DNA, 20 bp, Artificial Sequence
  chemically synthesized
aggctaaatgccccaattaa

SEQ ID NO: 80106 - DNA, 20 bp, Artificial Sequence
  chemically synthesized
tgtcttttaattggggcatt

SEQ ID NO: 80107 - DNA, 20 bp, Artificial Sequence
  chemically synthesized
tattaaccttaaatgtaaac

SEQ ID NO: 80108 - DNA, 20 bp, Artificial Sequence
  chemically synthesized
atattaaccttaaatgtaaa

SEQ ID NO: 80109 - DNA, 20 bp, Artificial Sequence
  chemically synthesized
catttagcctgtttacattt

SEQ ID NO: 80110 - DNA, 20 bp, Artificial Sequence
  chemically synthesized
atttagcctgtttacattta

SEQ ID NO: 80111 - DNA, 20 bp, Artificial Sequence
  chemically synthesized
ccagctagcatcataatgac

SEQ ID NO: 80112 - DNA, 20 bp, Artificial Sequence
  chemically synthesized
accagctagcatcataatga

SEQ ID NO: 80113 - DNA, 20 bp, Artificial Sequence
  chemically synthesized
tgatcctgtcattatgatgc

SEQ ID NO: 80114 - DNA, 20 bp, Artificial Sequence
  chemically synthesized
cctgtcattatgatgctagc

SEQ ID NO: 80115 - DNA, 20 bp, Artificial Sequence
  chemically synthesized
taacgggcaaagtaaccagc

SEQ ID NO: 80116 - DNA, 20 bp, Artificial Sequence
  chemically synthesized
caactaacgggcaaagtaac

SEQ ID NO: 80117 - DNA, 20 bp, Artificial Sequence
  chemically synthesized
tagctggttactttgcccgt

SEQ ID NO: 80118 - DNA, 20 bp, Artificial Sequence
  chemically synthesized
actgcatcaactaacgggca

SEQ ID NO: 80119 - DNA, 20 bp, Artificial Sequence
  chemically synthesized
aagaaactgcatcaactaac

SEQ ID NO: 80120 - DNA, 20 bp, Artificial Sequence
  chemically synthesized
gaagaaactgcatcaactaa

SEQ ID NO: 80121 - DNA, 20 bp, Artificial Sequence
  chemically synthesized
actttgcccgttagttgatg

SEQ ID NO: 80122 - DNA, 20 bp, Artificial Sequence
  chemically synthesized
tagttgatgcagtttcttca

SEQ ID NO: 80123 - DNA, 20 bp, Artificial Sequence
  chemically synthesized
gtaaagaccatcacactatg

SEQ ID NO: 80124 - DNA, 20 bp, Artificial Sequence
  chemically synthesized
gcagtttcttcatagtgtga

SEQ ID NO: 80125 - DNA, 20 bp, Artificial Sequence
  chemically synthesized
taaaaacataacaaattgta

SEQ ID NO: 80126 - DNA, 20 bp, Artificial Sequence
  chemically synthesized
aatttgttatgtttttacca

SEQ ID NO: 80127 - DNA, 20 bp, Artificial Sequence
  chemically synthesized
tgttatgtttttaccatggc

SEQ ID NO: 80128 - DNA, 20 bp, Artificial Sequence
  chemically synthesized
ggaaaaactggtaccagcca

SEQ ID NO: 80129 - DNA, 20 bp, Artificial Sequence
  chemically synthesized
gtttttaccatggctggtac

SEQ ID NO: 80130 - DNA, 20 bp, Artificial Sequence
  chemically synthesized
tggaaaggaaaaactggtac

SEQ ID NO: 80131 - DNA, 20 bp, Artificial Sequence
  chemically synthesized
taaatatggaaaggaaaaac

SEQ ID NO: 80132 - DNA, 20 bp, Artificial Sequence
  chemically synthesized
aggaagcactaaatatggaa

SEQ ID NO: 80133 - DNA, 20 bp, Artificial Sequence
  chemically synthesized
aaggaagcactaaatatgga

SEQ ID NO: 80134 - DNA, 20 bp, Artificial Sequence
  chemically synthesized
cagtttttcctttccatatt

SEQ ID NO: 80135 - DNA, 20 bp, Artificial Sequence
  chemically synthesized
aatgaaggaagcactaaata

SEQ ID NO: 80136 - DNA, 20 bp, Artificial Sequence
  chemically synthesized
atatttagtgcttccttcat

SEQ ID NO: 80137 - DNA, 20 bp, Artificial Sequence
  chemically synthesized
acaagagcttctaatgaagg

SEQ ID NO: 80138 - DNA, 20 bp, Artificial Sequence
  chemically synthesized
tttagtgcttccttcattag

SEQ ID NO: 80139 - DNA, 20 bp, Artificial Sequence
  chemically synthesized
cttacaagagcttctaatga

SEQ ID NO: 80140 - DNA, 20 bp, Artificial Sequence
  chemically synthesized
ccttacaagagcttctaatg

SEQ ID NO: 80141 - DNA, 20 bp, Artificial Sequence
  chemically synthesized
ccttcattagaagctcttgt

SEQ ID NO: 80142 - DNA, 20 bp, Artificial Sequence
  chemically synthesized
cttcattagaagctcttgta

SEQ ID NO: 80143 - DNA, 20 bp, Artificial Sequence
  chemically synthesized
ccaccaggcctgccttacaa

SEQ ID NO: 80144 - DNA, 20 bp, Artificial Sequence
  chemically synthesized
cattagaagctcttgtaagg

SEQ ID NO: 80145 - DNA, 20 bp, Artificial Sequence
  chemically synthesized
attagaagctcttgtaaggc

SEQ ID NO: 80146 - DNA, 20 bp, Artificial Sequence
  chemically synthesized
caccaccaggcctgccttac

SEQ ID NO: 80147 - DNA, 20 bp, Artificial Sequence
  chemically synthesized
aagctcttgtaaggcaggcc

SEQ ID NO: 80148 - DNA, 20 bp, Artificial Sequence
  chemically synthesized
ctcttgtaaggcaggcctgg

SEQ ID NO: 80149 - DNA, 20 bp, Artificial Sequence
  chemically synthesized
tgagagattttgtcaccacc

SEQ ID NO: 80150 - DNA, 20 bp, Artificial Sequence
  chemically synthesized
ctgagagattttgtcaccac

SEQ ID NO: 80151 - DNA, 20 bp, Artificial Sequence
  chemically synthesized
ctggtggtgacaaaatctct

SEQ ID NO: 80152 - DNA, 20 bp, Artificial Sequence
  chemically synthesized
tacagacaagcaaatgctga

SEQ ID NO: 80153 - DNA, 20 bp, Artificial Sequence
  chemically synthesized
tttacagacaagcaaatgct

SEQ ID NO: 80154 - DNA, 20 bp, Artificial Sequence
  chemically synthesized
tcagcatttgcttgtctgta

SEQ ID NO: 80155 - DNA, 20 bp, Artificial Sequence
  chemically synthesized
aaataaaatcctttacagac

SEQ ID NO: 80156 - DNA, 20 bp, Artificial Sequence
  chemically synthesized
cagcatttgcttgtctgtaa

SEQ ID NO: 80157 - DNA, 20 bp, Artificial Sequence
  chemically synthesized
agtagaaataaaatccttta

SEQ ID NO: 80158 - DNA, 20 bp, Artificial Sequence
  chemically synthesized
actaagcttcataagcaaag

SEQ ID NO: 80159 - DNA, 20 bp, Artificial Sequence
  chemically synthesized
caaactaagcttcataagca

SEQ ID NO: 80160 - DNA, 20 bp, Artificial Sequence
  chemically synthesized
ttatttctactttgcttatg

SEQ ID NO: 80161 - DNA, 20 bp, Artificial Sequence
  chemically synthesized
ccagccaaactaagcttcat

SEQ ID NO: 80162 - DNA, 20 bp, Artificial Sequence
  chemically synthesized
tctactttgcttatgaagct

SEQ ID NO: 80163 - DNA, 20 bp, Artificial Sequence
  chemically synthesized
tttgcttatgaagcttagtt

SEQ ID NO: 80164 - DNA, 20 bp, Artificial Sequence
  chemically synthesized
atttcatatccagccaaact

SEQ ID NO: 80165 - DNA, 20 bp, Artificial Sequence
  chemically synthesized
cttatgaagcttagtttggc

SEQ ID NO: 80166 - DNA, 20 bp, Artificial Sequence
  chemically synthesized
tcaacccagaatttcatatc

SEQ ID NO: 80167 - DNA, 20 bp, Artificial Sequence
  chemically synthesized
tttggctggatatgaaattc

SEQ ID NO: 80168 - DNA, 20 bp, Artificial Sequence
  chemically synthesized
ttggctggatatgaaattct

SEQ ID NO: 80169 - DNA, 20 bp, Artificial Sequence
  chemically synthesized
aaagaaaagaattttcaacc

SEQ ID NO: 80170 - DNA, 20 bp, Artificial Sequence
  chemically synthesized
ggttgaaaattcttttcttt

SEQ ID NO: 80171 - DNA, 20 bp, Artificial Sequence
  chemically synthesized
tattcaacattcttaaagaa

SEQ ID NO: 80172 - DNA, 20 bp, Artificial Sequence
  chemically synthesized
gccaatattcaacattctta

SEQ ID NO: 80173 - DNA, 20 bp, Artificial Sequence
  chemically synthesized
tctttaagaatgttgaatat

SEQ ID NO: 80174 - DNA, 20 bp, Artificial Sequence
  chemically synthesized
tacaagccagaagagagtgg

SEQ ID NO: 80175 - DNA, 20 bp, Artificial Sequence
  chemically synthesized
ctacaagccagaagagagtg

SEQ ID NO: 80176 - DNA, 20 bp, Artificial Sequence
  chemically synthesized
cctacaagccagaagagagt

SEQ ID NO: 80177 - DNA, 20 bp, Artificial Sequence
  chemically synthesized
ccctacaagccagaagagag

SEQ ID NO: 80178 - DNA, 20 bp, Artificial Sequence
  chemically synthesized
tattggcccccactctcttc

SEQ ID NO: 80179 - DNA, 20 bp, Artificial Sequence
  chemically synthesized
aaaccctacaagccagaaga

SEQ ID NO: 80180 - DNA, 20 bp, Artificial Sequence
  chemically synthesized
agaaaccctacaagccagaa

SEQ ID NO: 80181 - DNA, 20 bp, Artificial Sequence
  chemically synthesized
gcagaaaccctacaagccag

SEQ ID NO: 80182 - DNA, 20 bp, Artificial Sequence
  chemically synthesized
ccccactctcttctggcttg

SEQ ID NO: 80183 - DNA, 20 bp, Artificial Sequence
  chemically synthesized
cccactctcttctggcttgt

SEQ ID NO: 80184 - DNA, 20 bp, Artificial Sequence
  chemically synthesized
ccactctcttctggcttgta

SEQ ID NO: 80185 - DNA, 20 bp, Artificial Sequence
  chemically synthesized
ttggcagaaaccctacaagc

SEQ ID NO: 80186 - DNA, 20 bp, Artificial Sequence
  chemically synthesized
tcatttggcagaaaccctac

SEQ ID NO: 80187 - DNA, 20 bp, Artificial Sequence
  chemically synthesized
actaacagcggatcatttgg

SEQ ID NO: 80188 - DNA, 20 bp, Artificial Sequence
  chemically synthesized
cagactaacagcggatcatt

SEQ ID NO: 80189 - DNA, 20 bp, Artificial Sequence
  chemically synthesized
tctgccaaatgatccgctgt

SEQ ID NO: 80190 - DNA, 20 bp, Artificial Sequence
  chemically synthesized
aaagcccatcagactaacag

SEQ ID NO: 80191 - DNA, 20 bp, Artificial Sequence
  chemically synthesized
aggaaagcccatcagactaa

SEQ ID NO: 80192 - DNA, 20 bp, Artificial Sequence
  chemically synthesized
atgatccgctgttagtctga

SEQ ID NO: 80193 - DNA, 20 bp, Artificial Sequence
  chemically synthesized
tgatccgctgttagtctgat

SEQ ID NO: 80194 - DNA, 20 bp, Artificial Sequence
  chemically synthesized
taccccaaaggaaagcccat

SEQ ID NO: 80195 - DNA, 20 bp, Artificial Sequence
  chemically synthesized
tagtctgatgggctttcctt

SEQ ID NO: 80196 - DNA, 20 bp, Artificial Sequence
  chemically synthesized
agtctgatgggctttccttt

SEQ ID NO: 80197 - DNA, 20 bp, Artificial Sequence
  chemically synthesized
gtctgatgggctttcctttg

SEQ ID NO: 80198 - DNA, 20 bp, Artificial Sequence
  chemically synthesized
ggtcaggctaccccaaagga

SEQ ID NO: 80199 - DNA, 20 bp, Artificial Sequence
  chemically synthesized
tgatgggctttcctttgggg

SEQ ID NO: 80200 - DNA, 20 bp, Artificial Sequence
  chemically synthesized
gaaaggtcaggctaccccaa

SEQ ID NO: 80201 - DNA, 20 bp, Artificial Sequence
  chemically synthesized
agaaaggtcaggctacccca

SEQ ID NO: 80202 - DNA, 20 bp, Artificial Sequence
  chemically synthesized
ggcagccagagagaaaggtc

SEQ ID NO: 80203 - DNA, 20 bp, Artificial Sequence
  chemically synthesized
gggcagccagagagaaaggt

SEQ ID NO: 80204 - DNA, 20 bp, Artificial Sequence
  chemically synthesized
ggtagcctgacctttctctc

SEQ ID NO: 80205 - DNA, 20 bp, Artificial Sequence
  chemically synthesized
ttaagggcagccagagagaa

SEQ ID NO: 80206 - DNA, 20 bp, Artificial Sequence
  chemically synthesized
gttaagggcagccagagaga

SEQ ID NO: 80207 - DNA, 20 bp, Artificial Sequence
  chemically synthesized
aaatgttaagggcagccaga

SEQ ID NO: 80208 - DNA, 20 bp, Artificial Sequence
  chemically synthesized
aaaaatgttaagggcagcca

SEQ ID NO: 80209 - DNA, 20 bp, Artificial Sequence
  chemically synthesized
gaaaaaatgttaagggcagc

SEQ ID NO: 80210 - DNA, 20 bp, Artificial Sequence
  chemically synthesized
gaaggaaaaaatgttaaggg

SEQ ID NO: 80211 - DNA, 20 bp, Artificial Sequence
  chemically synthesized
aatgaaggaaaaaatgttaa

SEQ ID NO: 80212 - DNA, 20 bp, Artificial Sequence
  chemically synthesized
aaatgaaggaaaaaatgtta

SEQ ID NO: 80213 - DNA, 20 bp, Artificial Sequence
  chemically synthesized
gaaatgaaggaaaaaatgtt

SEQ ID NO: 80214 - DNA, 20 bp, Artificial Sequence
  chemically synthesized
attcaccaaggttgaaatga

SEQ ID NO: 80215 - DNA, 20 bp, Artificial Sequence
  chemically synthesized
gattcaccaaggttgaaatg

SEQ ID NO: 80216 - DNA, 20 bp, Artificial Sequence
  chemically synthesized
tttttccttcatttcaacct

SEQ ID NO: 80217 - DNA, 20 bp, Artificial Sequence
  chemically synthesized
cataataatcggattcacca

SEQ ID NO: 80218 - DNA, 20 bp, Artificial Sequence
  chemically synthesized
acataataatcggattcacc

SEQ ID NO: 80219 - DNA, 20 bp, Artificial Sequence
  chemically synthesized
aacccaagacacataataat

SEQ ID NO: 80220 - DNA, 20 bp, Artificial Sequence
  chemically synthesized
aatccgattattatgtgtct

SEQ ID NO: 80221 - DNA, 20 bp, Artificial Sequence
  chemically synthesized
atccgattattatgtgtctt

SEQ ID NO: 80222 - DNA, 20 bp, Artificial Sequence
  chemically synthesized
ctccttgagaagagcaaccc

SEQ ID NO: 80223 - DNA, 20 bp, Artificial Sequence
  chemically synthesized
tgtcttgggttgctcttctc

SEQ ID NO: 80224 - DNA, 20 bp, Artificial Sequence
  chemically synthesized
gtcttgggttgctcttctca

SEQ ID NO: 80225 - DNA, 20 bp, Artificial Sequence
  chemically synthesized
acaaagatactccttgagaa

SEQ ID NO: 80226 - DNA, 20 bp, Artificial Sequence
  chemically synthesized
cttgggttgctcttctcaag

SEQ ID NO: 80227 - DNA, 20 bp, Artificial Sequence
  chemically synthesized
ccacaaagatactccttgag

SEQ ID NO: 80228 - DNA, 20 bp, Artificial Sequence
  chemically synthesized
acaccacaaagatactcctt

SEQ ID NO: 80229 - DNA, 20 bp, Artificial Sequence
  chemically synthesized
cttctcaaggagtatctttg

SEQ ID NO: 80230 - DNA, 20 bp, Artificial Sequence
  chemically synthesized
gaaatatggagaacaccaca

SEQ ID NO: 80231 - DNA, 20 bp, Artificial Sequence
  chemically synthesized
attcaaattcaggaaatatg

SEQ ID NO: 80232 - DNA, 20 bp, Artificial Sequence
  chemically synthesized
acattcaaattcaggaaata

SEQ ID NO: 80233 - DNA, 20 bp, Artificial Sequence
  chemically synthesized
acaggccaacattcaaattc

SEQ ID NO: 80234 - DNA, 20 bp, Artificial Sequence
  chemically synthesized
gacaggccaacattcaaatt

SEQ ID NO: 80235 - DNA, 20 bp, Artificial Sequence
  chemically synthesized
tatttcctgaatttgaatgt

SEQ ID NO: 80236 - DNA, 20 bp, Artificial Sequence
  chemically synthesized
tgaatgttggcctgtcttgc

SEQ ID NO: 80237 - DNA, 20 bp, Artificial Sequence
  chemically synthesized
cttccccaacctagcaagac

SEQ ID NO: 80238 - DNA, 20 bp, Artificial Sequence
  chemically synthesized
gaatgttggcctgtcttgct

SEQ ID NO: 80239 - DNA, 20 bp, Artificial Sequence
  chemically synthesized
acttccccaacctagcaaga

SEQ ID NO: 80240 - DNA, 20 bp, Artificial Sequence
  chemically synthesized
gttggcctgtcttgctaggt

SEQ ID NO: 80241 - DNA, 20 bp, Artificial Sequence
  chemically synthesized
gagaacttccccaacctagc

SEQ ID NO: 80242 - DNA, 20 bp, Artificial Sequence
  chemically synthesized
ttggcctgtcttgctaggtt

SEQ ID NO: 80243 - DNA, 20 bp, Artificial Sequence
  chemically synthesized
tggcctgtcttgctaggttg

SEQ ID NO: 80244 - DNA, 20 bp, Artificial Sequence
  chemically synthesized
ccaggagaacttccccaacc

SEQ ID NO: 80245 - DNA, 20 bp, Artificial Sequence
  chemically synthesized
cctgtcttgctaggttgggg

SEQ ID NO: 80246 - DNA, 20 bp, Artificial Sequence
  chemically synthesized
ctaggttggggaagttctcc

SEQ ID NO: 80247 - DNA, 20 bp, Artificial Sequence
  chemically synthesized
ctcttcaggttattatccag

SEQ ID NO: 80248 - DNA, 20 bp, Artificial Sequence
  chemically synthesized
cactcttcaggttattatcc

SEQ ID NO: 80249 - DNA, 20 bp, Artificial Sequence
  chemically synthesized
acactcttcaggttattatc

SEQ ID NO: 80250 - DNA, 20 bp, Artificial Sequence
  chemically synthesized
ttctcctggataataacctg

SEQ ID NO: 80251 - DNA, 20 bp, Artificial Sequence
  chemically synthesized
ctcctggataataacctgaa

SEQ ID NO: 80252 - DNA, 20 bp, Artificial Sequence
  chemically synthesized
caagttggaaaacactcttc

SEQ ID NO: 80253 - DNA, 20 bp, Artificial Sequence
  chemically synthesized
ccaagttggaaaacactctt

SEQ ID NO: 80254 - DNA, 20 bp, Artificial Sequence
  chemically synthesized
ctgaagagtgttttccaact

SEQ ID NO: 80255 - DNA, 20 bp, Artificial Sequence
  chemically synthesized
tggggagaatggaaccaagt

SEQ ID NO: 80256 - DNA, 20 bp, Artificial Sequence
  chemically synthesized
gtgatggggagaatggaacc

SEQ ID NO: 80257 - DNA, 20 bp, Artificial Sequence
  chemically synthesized
cctgaaagtgatggggagaa

SEQ ID NO: 80258 - DNA, 20 bp, Artificial Sequence
  chemically synthesized
gtgtacctgaaagtgatggg

SEQ ID NO: 80259 - DNA, 20 bp, Artificial Sequence
  chemically synthesized
tggtgtacctgaaagtgatg

SEQ ID NO: 80260 - DNA, 20 bp, Artificial Sequence
  chemically synthesized
ttggtgtacctgaaagtgat

SEQ ID NO: 80261 - DNA, 20 bp, Artificial Sequence
  chemically synthesized
tccattctccccatcacttt

SEQ ID NO: 80262 - DNA, 20 bp, Artificial Sequence
  chemically synthesized
attggtgtacctgaaagtga

SEQ ID NO: 80263 - DNA, 20 bp, Artificial Sequence
  chemically synthesized
ccattctccccatcactttc

SEQ ID NO: 80264 - DNA, 20 bp, Artificial Sequence
  chemically synthesized
catttgattggtgtacctga

SEQ ID NO: 80265 - DNA, 20 bp, Artificial Sequence
  chemically synthesized
agaccaaacctacatttgat

SEQ ID NO: 80266 - DNA, 20 bp, Artificial Sequence
  chemically synthesized
tcaggtacaccaatcaaatg

SEQ ID NO: 80267 - DNA, 20 bp, Artificial Sequence
  chemically synthesized
caggtacaccaatcaaatgt

SEQ ID NO: 80268 - DNA, 20 bp, Artificial Sequence
  chemically synthesized
acaccaatcaaatgtaggtt

SEQ ID NO: 80269 - DNA, 20 bp, Artificial Sequence
  chemically synthesized
gaaatatgggacgatgtgaa

SEQ ID NO: 80270 - DNA, 20 bp, Artificial Sequence
  chemically synthesized
acaaagccttcaagaaatat

SEQ ID NO: 80271 - DNA, 20 bp, Artificial Sequence
  chemically synthesized
aacaaagccttcaagaaata

SEQ ID NO: 80272 - DNA, 20 bp, Artificial Sequence
  chemically synthesized
acatcgtcccatatttcttg

SEQ ID NO: 80273 - DNA, 20 bp, Artificial Sequence
  chemically synthesized
catcgtcccatatttcttga

SEQ ID NO: 80274 - DNA, 20 bp, Artificial Sequence
  chemically synthesized
aaggaacaaacaaagccttc

SEQ ID NO: 80275 - DNA, 20 bp, Artificial Sequence
  chemically synthesized
agaatgaaaaggaacaaaca

SEQ ID NO: 80276 - DNA, 20 bp, Artificial Sequence
  chemically synthesized
ttactgaaaaaagaatgaaa

SEQ ID NO: 80277 - DNA, 20 bp, Artificial Sequence
  chemically synthesized
attactgaaaaaagaatgaa

SEQ ID NO: 80278 - DNA, 20 bp, Artificial Sequence
  chemically synthesized
gttccttttcattctttttt

SEQ ID NO: 80279 - DNA, 20 bp, Artificial Sequence
  chemically synthesized
gaagagaagattactgaaaa

SEQ ID NO: 80280 - DNA, 20 bp, Artificial Sequence
  chemically synthesized
atgaaataaagcatgaagag

SEQ ID NO: 80281 - DNA, 20 bp, Artificial Sequence
  chemically synthesized
ttaatgaaataaagcatgaa

SEQ ID NO: 80282 - DNA, 20 bp, Artificial Sequence
  chemically synthesized
acttaatgaaataaagcatg

SEQ ID NO: 80283 - DNA, 20 bp, Artificial Sequence
  chemically synthesized
aagatcaacttaatgaaata

SEQ ID NO: 80284 - DNA, 20 bp, Artificial Sequence
  chemically synthesized
tcttcatgctttatttcatt

SEQ ID NO: 80285 - DNA, 20 bp, Artificial Sequence
  chemically synthesized
tatttcattaagttgatctt

SEQ ID NO: 80286 - DNA, 20 bp, Artificial Sequence
  chemically synthesized
agaaaggatatcagagactg

SEQ ID NO: 80287 - DNA, 20 bp, Artificial Sequence
  chemically synthesized
aagcaaaagaaaggatatca

SEQ ID NO: 80288 - DNA, 20 bp, Artificial Sequence
  chemically synthesized
ccaagcaaaagaaaggatat

SEQ ID NO: 80289 - DNA, 20 bp, Artificial Sequence
  chemically synthesized
aaatcgaccaagcaaaagaa

SEQ ID NO: 80290 - DNA, 20 bp, Artificial Sequence
  chemically synthesized
caaatcgaccaagcaaaaga

SEQ ID NO: 80291 - DNA, 20 bp, Artificial Sequence
  chemically synthesized
ctgatatcctttcttttgct

SEQ ID NO: 80292 - DNA, 20 bp, Artificial Sequence
  chemically synthesized
tagccaaatcgaccaagcaa

SEQ ID NO: 80293 - DNA, 20 bp, Artificial Sequence
  chemically synthesized
tatcaatagccaaatcgacc

SEQ ID NO: 80294 - DNA, 20 bp, Artificial Sequence
  chemically synthesized
tttcttttgcttggtcgatt

SEQ ID NO: 80295 - DNA, 20 bp, Artificial Sequence
  chemically synthesized
gaagcatacacaagtatcaa

SEQ ID NO: 80296 - DNA, 20 bp, Artificial Sequence
  chemically synthesized
gaactttgtgaagcatacac

SEQ ID NO: 80297 - DNA, 20 bp, Artificial Sequence
  chemically synthesized
atacttgtgtatgcttcaca

SEQ ID NO: 80298 - DNA, 20 bp, Artificial Sequence
  chemically synthesized
cacagcacgagaactttgtg

SEQ ID NO: 80299 - DNA, 20 bp, Artificial Sequence
  chemically synthesized
ggagctgagaaacacagcac

SEQ ID NO: 80300 - DNA, 20 bp, Artificial Sequence
  chemically synthesized
agttctcgtgctgtgtttct

SEQ ID NO: 80301 - DNA, 20 bp, Artificial Sequence
  chemically synthesized
cctgaaggagctgagaaaca

SEQ ID NO: 80302 - DNA, 20 bp, Artificial Sequence
  chemically synthesized
ataaatgacctgaaggagct

SEQ ID NO: 80303 - DNA, 20 bp, Artificial Sequence
  chemically synthesized
gctgtgtttctcagctcctt

SEQ ID NO: 80304 - DNA, 20 bp, Artificial Sequence
  chemically synthesized
ctgtgtttctcagctccttc

SEQ ID NO: 80305 - DNA, 20 bp, Artificial Sequence
  chemically synthesized
ggaacataaatgacctgaag

SEQ ID NO: 80306 - DNA, 20 bp, Artificial Sequence
  chemically synthesized
gaggaacataaatgacctga

SEQ ID NO: 80307 - DNA, 20 bp, Artificial Sequence
  chemically synthesized
agaggaacataaatgacctg

SEQ ID NO: 80308 - DNA, 20 bp, Artificial Sequence
  chemically synthesized
ctagaataaccagtttagag

SEQ ID NO: 80309 - DNA, 20 bp, Artificial Sequence
  chemically synthesized
atttatgttcctctctaaac

SEQ ID NO: 80310 - DNA, 20 bp, Artificial Sequence
  chemically synthesized
actagaataaccagtttaga

SEQ ID NO: 80311 - DNA, 20 bp, Artificial Sequence
  chemically synthesized
taactagaataaccagttta

SEQ ID NO: 80312 - DNA, 20 bp, Artificial Sequence
  chemically synthesized
gctaactagaataaccagtt

SEQ ID NO: 80313 - DNA, 20 bp, Artificial Sequence
  chemically synthesized
cctctctaaactggttattc

SEQ ID NO: 80314 - DNA, 20 bp, Artificial Sequence
  chemically synthesized
gaattgctaactagaataac

SEQ ID NO: 80315 - DNA, 20 bp, Artificial Sequence
  chemically synthesized
tctaaactggttattctagt

SEQ ID NO: 80316 - DNA, 20 bp, Artificial Sequence
  chemically synthesized
aggttagaggaattgctaac

SEQ ID NO: 80317 - DNA, 20 bp, Artificial Sequence
  chemically synthesized
aaccttaaaaaaaaggttag

SEQ ID NO: 80318 - DNA, 20 bp, Artificial Sequence
  chemically synthesized
gaaccttaaaaaaaaggtta

SEQ ID NO: 80319 - DNA, 20 bp, Artificial Sequence
  chemically synthesized
aagaaccttaaaaaaaaggt

SEQ ID NO: 80320 - DNA, 20 bp, Artificial Sequence
  chemically synthesized
attcctctaacctttttttt

SEQ ID NO: 80321 - DNA, 20 bp, Artificial Sequence
  chemically synthesized
agctaagaaccttaaaaaaa

SEQ ID NO: 80322 - DNA, 20 bp, Artificial Sequence
  chemically synthesized
ttcctctaacctttttttta

SEQ ID NO: 80323 - DNA, 20 bp, Artificial Sequence
  chemically synthesized
aagctaagaaccttaaaaaa

SEQ ID NO: 80324 - DNA, 20 bp, Artificial Sequence
  chemically synthesized
aaccttttttttaaggttct

SEQ ID NO: 80325 - DNA, 20 bp, Artificial Sequence
  chemically synthesized
taacccaatgcaaggaagct

SEQ ID NO: 80326 - DNA, 20 bp, Artificial Sequence
  chemically synthesized
tgttctaacccaatgcaagg

SEQ ID NO: 80327 - DNA, 20 bp, Artificial Sequence
  chemically synthesized
ggttcttagcttccttgcat

SEQ ID NO: 80328 - DNA, 20 bp, Artificial Sequence
  chemically synthesized
gttcttagcttccttgcatt

SEQ ID NO: 80329 - DNA, 20 bp, Artificial Sequence
  chemically synthesized
gcgtgttctaacccaatgca

SEQ ID NO: 80330 - DNA, 20 bp, Artificial Sequence
  chemically synthesized
agcgtgttctaacccaatgc

SEQ ID NO: 80331 - DNA, 20 bp, Artificial Sequence
  chemically synthesized
ttagcttccttgcattgggt

SEQ ID NO: 80332 - DNA, 20 bp, Artificial Sequence
  chemically synthesized
tgggttagaacacgctcctt

SEQ ID NO: 80333 - DNA, 20 bp, Artificial Sequence
  chemically synthesized
caaactcttacgagctaaag

SEQ ID NO: 80334 - DNA, 20 bp, Artificial Sequence
  chemically synthesized
aacaaactcttacgagctaa

SEQ ID NO: 80335 - DNA, 20 bp, Artificial Sequence
  chemically synthesized
taacaaactcttacgagcta

SEQ ID NO: 80336 - DNA, 20 bp, Artificial Sequence
  chemically synthesized
aacacgctcctttagctcgt

SEQ ID NO: 80337 - DNA, 20 bp, Artificial Sequence
  chemically synthesized
cacgctcctttagctcgtaa

SEQ ID NO: 80338 - DNA, 20 bp, Artificial Sequence
  chemically synthesized
gggtaataacaaactcttac

SEQ ID NO: 80339 - DNA, 20 bp, Artificial Sequence
  chemically synthesized
ggaagtaggcttcagaaggt

SEQ ID NO: 80340 - DNA, 20 bp, Artificial Sequence
  chemically synthesized
ttgttattacccaccttctg

SEQ ID NO: 80341 - DNA, 20 bp, Artificial Sequence
  chemically synthesized
cggaagtaggcttcagaagg

SEQ ID NO: 80342 - DNA, 20 bp, Artificial Sequence
  chemically synthesized
tgacggaagtaggcttcaga

SEQ ID NO: 80343 - DNA, 20 bp, Artificial Sequence
  chemically synthesized
ttgacggaagtaggcttcag

SEQ ID NO: 80344 - DNA, 20 bp, Artificial Sequence
  chemically synthesized
gaattgacggaagtaggctt

SEQ ID NO: 80345 - DNA, 20 bp, Artificial Sequence
  chemically synthesized
tttgacgaattgacggaagt

SEQ ID NO: 80346 - DNA, 20 bp, Artificial Sequence
  chemically synthesized
gtttgacgaattgacggaag

SEQ ID NO: 80347 - DNA, 20 bp, Artificial Sequence
  chemically synthesized
tgagtttgacgaattgacgg

SEQ ID NO: 80348 - DNA, 20 bp, Artificial Sequence
  chemically synthesized
gaatgagtttgacgaattga

SEQ ID NO: 80349 - DNA, 20 bp, Artificial Sequence
  chemically synthesized
aacaaaactggatggagaat

SEQ ID NO: 80350 - DNA, 20 bp, Artificial Sequence
  chemically synthesized
cgtcaaactcattctccatc

SEQ ID NO: 80351 - DNA, 20 bp, Artificial Sequence
  chemically synthesized
caagggaacaaaactggatg

SEQ ID NO: 80352 - DNA, 20 bp, Artificial Sequence
  chemically synthesized
agcaagggaacaaaactgga

SEQ ID NO: 80353 - DNA, 20 bp, Artificial Sequence
  chemically synthesized
ctccagcaagggaacaaaac

SEQ ID NO: 80354 - DNA, 20 bp, Artificial Sequence
  chemically synthesized
atccagttttgttcccttgc

SEQ ID NO: 80355 - DNA, 20 bp, Artificial Sequence
  chemically synthesized
ccagttttgttcccttgctg

SEQ ID NO: 80356 - DNA, 20 bp, Artificial Sequence
  chemically synthesized
tcacaactcctctccagcaa

SEQ ID NO: 80357 - DNA, 20 bp, Artificial Sequence
  chemically synthesized
agttttgttcccttgctgga

SEQ ID NO: 80358 - DNA, 20 bp, Artificial Sequence
  chemically synthesized
atcacaactcctctccagca

SEQ ID NO: 80359 - DNA, 20 bp, Artificial Sequence
  chemically synthesized
gttttgttcccttgctggag

SEQ ID NO: 80360 - DNA, 20 bp, Artificial Sequence
  chemically synthesized
gatcacaactcctctccagc

SEQ ID NO: 80361 - DNA, 20 bp, Artificial Sequence
  chemically synthesized
tttgttcccttgctggagag

SEQ ID NO: 80362 - DNA, 20 bp, Artificial Sequence
  chemically synthesized
aaatgatcacaactcctctc

SEQ ID NO: 80363 - DNA, 20 bp, Artificial Sequence
  chemically synthesized
ggagaggagttgtgatcatt

SEQ ID NO: 80364 - DNA, 20 bp, Artificial Sequence
  chemically synthesized
agaggagttgtgatcatttg

SEQ ID NO: 80365 - DNA, 20 bp, Artificial Sequence
  chemically synthesized
gaggagttgtgatcatttgg

SEQ ID NO: 80366 - DNA, 20 bp, Artificial Sequence
  chemically synthesized
ggagttgtgatcatttggag

SEQ ID NO: 80367 - DNA, 20 bp, Artificial Sequence
  chemically synthesized
gttgtgatcatttggaggag

SEQ ID NO: 80368 - DNA, 20 bp, Artificial Sequence
  chemically synthesized
tgtgatcatttggaggagaa

SEQ ID NO: 80369 - DNA, 20 bp, Artificial Sequence
  chemically synthesized
gtgatcatttggaggagaag

SEQ ID NO: 80370 - DNA, 20 bp, Artificial Sequence
  chemically synthesized
ttggaggagaagaggcgttc

SEQ ID NO: 80371 - DNA, 20 bp, Artificial Sequence
  chemically synthesized
agaagaggcgttccggtttt

SEQ ID NO: 80372 - DNA, 20 bp, Artificial Sequence
  chemically synthesized
agcctgaaaattccaaaaac

SEQ ID NO: 80373 - DNA, 20 bp, Artificial Sequence
  chemically synthesized
gttccggtttttggaatttt

SEQ ID NO: 80374 - DNA, 20 bp, Artificial Sequence
  chemically synthesized
ttccggtttttggaattttc

SEQ ID NO: 80375 - DNA, 20 bp, Artificial Sequence
  chemically synthesized
aattttcaggctttttgtgc

SEQ ID NO: 80376 - DNA, 20 bp, Artificial Sequence
  chemically synthesized
tgaggaaaaaccagcacaaa

SEQ ID NO: 80377 - DNA, 20 bp, Artificial Sequence
  chemically synthesized
ccacgaagatgaggaaaaac

SEQ ID NO: 80378 - DNA, 20 bp, Artificial Sequence
  chemically synthesized
tagataaatccacgaagatg

SEQ ID NO: 80379 - DNA, 20 bp, Artificial Sequence
  chemically synthesized
ctggtttttcctcatcttcg

SEQ ID NO: 80380 - DNA, 20 bp, Artificial Sequence
  chemically synthesized
gtagataaatccacgaagat

SEQ ID NO: 80381 - DNA, 20 bp, Artificial Sequence
  chemically synthesized
caaaggtagataaatccacg

SEQ ID NO: 80382 - DNA, 20 bp, Artificial Sequence
  chemically synthesized
ttcgtggatttatctacctt

SEQ ID NO: 80383 - DNA, 20 bp, Artificial Sequence
  chemically synthesized
ccaacatcaaagaccaaagg

SEQ ID NO: 80384 - DNA, 20 bp, Artificial Sequence
  chemically synthesized
tcaccaacatcaaagaccaa

SEQ ID NO: 80385 - DNA, 20 bp, Artificial Sequence
  chemically synthesized
gtcaccaacatcaaagacca

SEQ ID NO: 80386 - DNA, 20 bp, Artificial Sequence
  chemically synthesized
ctacctttggtctttgatgt

SEQ ID NO: 80387 - DNA, 20 bp, Artificial Sequence
  chemically synthesized
tctgaaggtcaccaacatca

SEQ ID NO: 80388 - DNA, 20 bp, Artificial Sequence
  chemically synthesized
tctttgatgttggtgacctt

SEQ ID NO: 80389 - DNA, 20 bp, Artificial Sequence
  chemically synthesized
tgatgttggtgaccttcaga

SEQ ID NO: 80390 - DNA, 20 bp, Artificial Sequence
  chemically synthesized
gatgttggtgaccttcagat

SEQ ID NO: 80391 - DNA, 20 bp, Artificial Sequence
  chemically synthesized
atgttggtgaccttcagatg

SEQ ID NO: 80392 - DNA, 20 bp, Artificial Sequence
  chemically synthesized
cacacaaaaaccccatctga

SEQ ID NO: 80393 - DNA, 20 bp, Artificial Sequence
  chemically synthesized
ccacacaaaaaccccatctg

SEQ ID NO: 80394 - DNA, 20 bp, Artificial Sequence
  chemically synthesized
cttcagatggggtttttgtg

SEQ ID NO: 80395 - DNA, 20 bp, Artificial Sequence
  chemically synthesized
tagcatcaacatcaacaaaa

SEQ ID NO: 80396 - DNA, 20 bp, Artificial Sequence
  chemically synthesized
ctagcatcaacatcaacaaa

SEQ ID NO: 80397 - DNA, 20 bp, Artificial Sequence
  chemically synthesized
ctttttgttgatgttgatgc

SEQ ID NO: 80398 - DNA, 20 bp, Artificial Sequence
  chemically synthesized
tttgttgatgttgatgctag

SEQ ID NO: 80399 - DNA, 20 bp, Artificial Sequence
  chemically synthesized
ttgatgttgatgctagcagt

SEQ ID NO: 80400 - DNA, 20 bp, Artificial Sequence
  chemically synthesized
tgatgttgatgctagcagtc

SEQ ID NO: 80401 - DNA, 20 bp, Artificial Sequence
  chemically synthesized
agcagagggttcctgactgc

SEQ ID NO: 80402 - DNA, 20 bp, Artificial Sequence
  chemically synthesized
cagtcaggaaccctctgctg

SEQ ID NO: 80403 - DNA, 20 bp, Artificial Sequence
  chemically synthesized
tccagcagacctgcagcaga

SEQ ID NO: 80404 - DNA, 20 bp, Artificial Sequence
  chemically synthesized
agtcaggaaccctctgctgc

SEQ ID NO: 80405 - DNA, 20 bp, Artificial Sequence
  chemically synthesized
ttccagcagacctgcagcag

SEQ ID NO: 80406 - DNA, 20 bp, Artificial Sequence
  chemically synthesized
attccagcagacctgcagca

SEQ ID NO: 80407 - DNA, 20 bp, Artificial Sequence
  chemically synthesized
aaattccagcagacctgcag

SEQ ID NO: 80408 - DNA, 20 bp, Artificial Sequence
  chemically synthesized
agcaaattccagcagacctg

SEQ ID NO: 80409 - DNA, 20 bp, Artificial Sequence
  chemically synthesized
accctctgctgcaggtctgc

SEQ ID NO: 80410 - DNA, 20 bp, Artificial Sequence
  chemically synthesized
ggacctccagcaaattccag

SEQ ID NO: 80411 - DNA, 20 bp, Artificial Sequence
  chemically synthesized
agtggacctccagcaaattc

SEQ ID NO: 80412 - DNA, 20 bp, Artificial Sequence
  chemically synthesized
gcaggtctgctggaatttgc

SEQ ID NO: 80413 - DNA, 20 bp, Artificial Sequence
  chemically synthesized
aggtctgctggaatttgctg

SEQ ID NO: 80414 - DNA, 20 bp, Artificial Sequence
  chemically synthesized
ggtctgctggaatttgctgg

SEQ ID NO: 80415 - DNA, 20 bp, Artificial Sequence
  chemically synthesized
cagggtctggagtggacctc

SEQ ID NO: 80416 - DNA, 20 bp, Artificial Sequence
  chemically synthesized
aatttgctggaggtccactc

SEQ ID NO: 80417 - DNA, 20 bp, Artificial Sequence
  chemically synthesized
caggcaaacagggtctggag

SEQ ID NO: 80418 - DNA, 20 bp, Artificial Sequence
  chemically synthesized
actcaggcaaacagggtctg

SEQ ID NO: 80419 - DNA, 20 bp, Artificial Sequence
  chemically synthesized
atactcaggcaaacagggtc

SEQ ID NO: 80420 - DNA, 20 bp, Artificial Sequence
  chemically synthesized
tggtgatactcaggcaaaca

SEQ ID NO: 80421 - DNA, 20 bp, Artificial Sequence
  chemically synthesized
ctggtgatactcaggcaaac

SEQ ID NO: 80422 - DNA, 20 bp, Artificial Sequence
  chemically synthesized
actccagaccctgtttgcct

SEQ ID NO: 80423 - DNA, 20 bp, Artificial Sequence
  chemically synthesized
gctggtgatactcaggcaaa

SEQ ID NO: 80424 - DNA, 20 bp, Artificial Sequence
  chemically synthesized
agcttctgctggtgatactc

SEQ ID NO: 80425 - DNA, 20 bp, Artificial Sequence
  chemically synthesized
cagcttctgctggtgatact

SEQ ID NO: 80426 - DNA, 20 bp, Artificial Sequence
  chemically synthesized
cctgtttgcctgagtatcac

SEQ ID NO: 80427 - DNA, 20 bp, Artificial Sequence
  chemically synthesized
gtttgcctgagtatcaccag

SEQ ID NO: 80428 - DNA, 20 bp, Artificial Sequence
  chemically synthesized
tgcctgagtatcaccagcag

SEQ ID NO: 80429 - DNA, 20 bp, Artificial Sequence
  chemically synthesized
tgctgttctgcagcttctgc

SEQ ID NO: 80430 - DNA, 20 bp, Artificial Sequence
  chemically synthesized
agtatcaccagcagaagctg

SEQ ID NO: 80431 - DNA, 20 bp, Artificial Sequence
  chemically synthesized
caccagcagaagctgcagaa

SEQ ID NO: 80432 - DNA, 20 bp, Artificial Sequence
  chemically synthesized
cagcaatctttgctgttctg

SEQ ID NO: 80433 - DNA, 20 bp, Artificial Sequence
  chemically synthesized
gcagaagctgcagaacagca

SEQ ID NO: 80434 - DNA, 20 bp, Artificial Sequence
  chemically synthesized
cttccagaggaaggaacaga

SEQ ID NO: 80435 - DNA, 20 bp, Artificial Sequence
  chemically synthesized
gaagcttccagaggaaggaa

SEQ ID NO: 80436 - DNA, 20 bp, Artificial Sequence
  chemically synthesized
ttgctgtctgttccttcctc

SEQ ID NO: 80437 - DNA, 20 bp, Artificial Sequence
  chemically synthesized
gggatgaagcttccagagga

SEQ ID NO: 80438 - DNA, 20 bp, Artificial Sequence
  chemically synthesized
ctgtctgttccttcctctgg

SEQ ID NO: 80439 - DNA, 20 bp, Artificial Sequence
  chemically synthesized
tgggatgaagcttccagagg

SEQ ID NO: 80440 - DNA, 20 bp, Artificial Sequence
  chemically synthesized
ctctgggatgaagcttccag

SEQ ID NO: 80441 - DNA, 20 bp, Artificial Sequence
  chemically synthesized
cctctgggatgaagcttcca

SEQ ID NO: 80442 - DNA, 20 bp, Artificial Sequence
  chemically synthesized
cccctctgggatgaagcttc

SEQ ID NO: 80443 - DNA, 20 bp, Artificial Sequence
  chemically synthesized
ttcctctggaagcttcatcc

SEQ ID NO: 80444 - DNA, 20 bp, Artificial Sequence
  chemically synthesized
cctctggaagcttcatccca

SEQ ID NO: 80445 - DNA, 20 bp, Artificial Sequence
  chemically synthesized
gcaggtgcccctctgggatg

SEQ ID NO: 80446 - DNA, 20 bp, Artificial Sequence
  chemically synthesized
ctctggaagcttcatcccag

SEQ ID NO: 80447 - DNA, 20 bp, Artificial Sequence
  chemically synthesized
tctggaagcttcatcccaga

SEQ ID NO: 80448 - DNA, 20 bp, Artificial Sequence
  chemically synthesized
ctggaagcttcatcccagag

SEQ ID NO: 80449 - DNA, 20 bp, Artificial Sequence
  chemically synthesized
catctggcaggtgcccctct

SEQ ID NO: 80450 - DNA, 20 bp, Artificial Sequence
  chemically synthesized
gcatctggcaggtgcccctc

SEQ ID NO: 80451 - DNA, 20 bp, Artificial Sequence
  chemically synthesized
catcccagaggggcacctgc

SEQ ID NO: 80452 - DNA, 20 bp, Artificial Sequence
  chemically synthesized
agctctggctggcatctggc

SEQ ID NO: 80453 - DNA, 20 bp, Artificial Sequence
  chemically synthesized
gagctctggctggcatctgg

SEQ ID NO: 80454 - DNA, 20 bp, Artificial Sequence
  chemically synthesized
gaggggcacctgccagatgc

SEQ ID NO: 80455 - DNA, 20 bp, Artificial Sequence
  chemically synthesized
ggagagctctggctggcatc

SEQ ID NO: 80456 - DNA, 20 bp, Artificial Sequence
  chemically synthesized
ggcacctgccagatgccagc

SEQ ID NO: 80457 - DNA, 20 bp, Artificial Sequence
  chemically synthesized
cacctgccagatgccagcca

SEQ ID NO: 80458 - DNA, 20 bp, Artificial Sequence
  chemically synthesized
tcatacaggagagctctggc

SEQ ID NO: 80459 - DNA, 20 bp, Artificial Sequence
  chemically synthesized
accctcatacaggagagctc

SEQ ID NO: 80460 - DNA, 20 bp, Artificial Sequence
  chemically synthesized
acagacaccctcatacagga

SEQ ID NO: 80461 - DNA, 20 bp, Artificial Sequence
  chemically synthesized
cagccagagctctcctgtat

SEQ ID NO: 80462 - DNA, 20 bp, Artificial Sequence
  chemically synthesized
agccagagctctcctgtatg

SEQ ID NO: 80463 - DNA, 20 bp, Artificial Sequence
  chemically synthesized
tgacagacaccctcatacag

SEQ ID NO: 80464 - DNA, 20 bp, Artificial Sequence
  chemically synthesized
gccagagctctcctgtatga

SEQ ID NO: 80465 - DNA, 20 bp, Artificial Sequence
  chemically synthesized
gttgacagacaccctcatac

SEQ ID NO: 80466 - DNA, 20 bp, Artificial Sequence
  chemically synthesized
ggttgacagacaccctcata

SEQ ID NO: 80467 - DNA, 20 bp, Artificial Sequence
  chemically synthesized
cacctcccagcaggggttga

SEQ ID NO: 80468 - DNA, 20 bp, Artificial Sequence
  chemically synthesized
gggtgtctgtcaacccctgc

SEQ ID NO: 80469 - DNA, 20 bp, Artificial Sequence
  chemically synthesized
ggtgtctgtcaacccctgct

SEQ ID NO: 80470 - DNA, 20 bp, Artificial Sequence
  chemically synthesized
tgtctgtcaacccctgctgg

SEQ ID NO: 80471 - DNA, 20 bp, Artificial Sequence
  chemically synthesized
tgggagacacctcccagcag

SEQ ID NO: 80472 - DNA, 20 bp, Artificial Sequence
  chemically synthesized
gtctgtcaacccctgctggg

SEQ ID NO: 80473 - DNA, 20 bp, Artificial Sequence
  chemically synthesized
ctgggagacacctcccagca

SEQ ID NO: 80474 - DNA, 20 bp, Artificial Sequence
  chemically synthesized
actgggagacacctcccagc

SEQ ID NO: 80475 - DNA, 20 bp, Artificial Sequence
  chemically synthesized
gactgggagacacctcccag

SEQ ID NO: 80476 - DNA, 20 bp, Artificial Sequence
  chemically synthesized
cctgactgggagacacctcc

SEQ ID NO: 80477 - DNA, 20 bp, Artificial Sequence
  chemically synthesized
ccctgctgggaggtgtctcc

SEQ ID NO: 80478 - DNA, 20 bp, Artificial Sequence
  chemically synthesized
gctgggaggtgtctcccagt

SEQ ID NO: 80479 - DNA, 20 bp, Artificial Sequence
  chemically synthesized
ctgggaggtgtctcccagtc

SEQ ID NO: 80480 - DNA, 20 bp, Artificial Sequence
  chemically synthesized
cccccgtgcctcctgactgg

SEQ ID NO: 80481 - DNA, 20 bp, Artificial Sequence
  chemically synthesized
gggaggtgtctcccagtcag

SEQ ID NO: 80482 - DNA, 20 bp, Artificial Sequence
  chemically synthesized
ggaggtgtctcccagtcagg

SEQ ID NO: 80483 - DNA, 20 bp, Artificial Sequence
  chemically synthesized
gacccccgtgcctcctgact

SEQ ID NO: 80484 - DNA, 20 bp, Artificial Sequence
  chemically synthesized
tgacccccgtgcctcctgac

SEQ ID NO: 80485 - DNA, 20 bp, Artificial Sequence
  chemically synthesized
tgtctcccagtcaggaggca

SEQ ID NO: 80486 - DNA, 20 bp, Artificial Sequence
  chemically synthesized
gtctcccagtcaggaggcac

SEQ ID NO: 80487 - DNA, 20 bp, Artificial Sequence
  chemically synthesized
tctcccagtcaggaggcacg

SEQ ID NO: 80488 - DNA, 20 bp, Artificial Sequence
  chemically synthesized
ctcccagtcaggaggcacgg

SEQ ID NO: 80489 - DNA, 20 bp, Artificial Sequence
  chemically synthesized
cagtcaggaggcacgggggt

SEQ ID NO: 80490 - DNA, 20 bp, Artificial Sequence
  chemically synthesized
agtcaggaggcacgggggtc

SEQ ID NO: 80491 - DNA, 20 bp, Artificial Sequence
  chemically synthesized
cgggggtcaggaccccactt

SEQ ID NO: 80492 - DNA, 20 bp, Artificial Sequence
  chemically synthesized
acagactgccttctcaagtg

SEQ ID NO: 80493 - DNA, 20 bp, Artificial Sequence
  chemically synthesized
gggtcaggaccccacttgag

SEQ ID NO: 80494 - DNA, 20 bp, Artificial Sequence
  chemically synthesized
gacagactgccttctcaagt

SEQ ID NO: 80495 - DNA, 20 bp, Artificial Sequence
  chemically synthesized
ggtcaggaccccacttgaga

SEQ ID NO: 80496 - DNA, 20 bp, Artificial Sequence
  chemically synthesized
ggacagactgccttctcaag

SEQ ID NO: 80497 - DNA, 20 bp, Artificial Sequence
  chemically synthesized
caggaccccacttgagaagg

SEQ ID NO: 80498 - DNA, 20 bp, Artificial Sequence
  chemically synthesized
aagggacagactgccttctc

SEQ ID NO: 80499 - DNA, 20 bp, Artificial Sequence
  chemically synthesized
tgagaaggcagtctgtccct

SEQ ID NO: 80500 - DNA, 20 bp, Artificial Sequence
  chemically synthesized
actcgagctctgctaaggga

SEQ ID NO: 80501 - DNA, 20 bp, Artificial Sequence
  chemically synthesized
gaaggcagtctgtcccttag

SEQ ID NO: 80502 - DNA, 20 bp, Artificial Sequence
  chemically synthesized
aggcagtctgtcccttagca

SEQ ID NO: 80503 - DNA, 20 bp, Artificial Sequence
  chemically synthesized
cagcactcgagctctgctaa

SEQ ID NO: 80504 - DNA, 20 bp, Artificial Sequence
  chemically synthesized
acagcactcgagctctgcta

SEQ ID NO: 80505 - DNA, 20 bp, Artificial Sequence
  chemically synthesized
cacagcactcgagctctgct

SEQ ID NO: 80506 - DNA, 20 bp, Artificial Sequence
  chemically synthesized
tctgtcccttagcagagctc

SEQ ID NO: 80507 - DNA, 20 bp, Artificial Sequence
  chemically synthesized
gatctcccagcacagcactc

SEQ ID NO: 80508 - DNA, 20 bp, Artificial Sequence
  chemically synthesized
gcagagctcgagtgctgtgc

SEQ ID NO: 80509 - DNA, 20 bp, Artificial Sequence
  chemically synthesized
cagagctcgagtgctgtgct

SEQ ID NO: 80510 - DNA, 20 bp, Artificial Sequence
  chemically synthesized
gagctcgagtgctgtgctgg

SEQ ID NO: 80511 - DNA, 20 bp, Artificial Sequence
  chemically synthesized
gagcagcagatctcccagca

SEQ ID NO: 80512 - DNA, 20 bp, Artificial Sequence
  chemically synthesized
gaagagagcagcagatctcc

SEQ ID NO: 80513 - DNA, 20 bp, Artificial Sequence
  chemically synthesized
gctggctctgaagagagcag

SEQ ID NO: 80514 - DNA, 20 bp, Artificial Sequence
  chemically synthesized
gggagatctgctgctctctt

SEQ ID NO: 80515 - DNA, 20 bp, Artificial Sequence
  chemically synthesized
cctgctggctctgaagagag

SEQ ID NO: 80516 - DNA, 20 bp, Artificial Sequence
  chemically synthesized
gagatctgctgctctcttca

SEQ ID NO: 80517 - DNA, 20 bp, Artificial Sequence
  chemically synthesized
ctgcctgctggctctgaaga

SEQ ID NO: 80518 - DNA, 20 bp, Artificial Sequence
  chemically synthesized
tcctgcctgctggctctgaa

SEQ ID NO: 80519 - DNA, 20 bp, Artificial Sequence
  chemically synthesized
tctgctgctctcttcagagc

SEQ ID NO: 80520 - DNA, 20 bp, Artificial Sequence
  chemically synthesized
gttcctgcctgctggctctg

SEQ ID NO: 80521 - DNA, 20 bp, Artificial Sequence
  chemically synthesized
gctgctctcttcagagccag

SEQ ID NO: 80522 - DNA, 20 bp, Artificial Sequence
  chemically synthesized
ctgctctcttcagagccagc

SEQ ID NO: 80523 - DNA, 20 bp, Artificial Sequence
  chemically synthesized
ctctcttcagagccagcagg

SEQ ID NO: 80524 - DNA, 20 bp, Artificial Sequence
  chemically synthesized
tctcttcagagccagcaggc

SEQ ID NO: 80525 - DNA, 20 bp, Artificial Sequence
  chemically synthesized
acttaaacgttcctgcctgc

SEQ ID NO: 80526 - DNA, 20 bp, Artificial Sequence
  chemically synthesized
gccagcaggcaggaacgttt

SEQ ID NO: 80527 - DNA, 20 bp, Artificial Sequence
  chemically synthesized
agctgtgggtgcagcatcag

SEQ ID NO: 80528 - DNA, 20 bp, Artificial Sequence
  chemically synthesized
ggcagctgtgggtgcagcat

SEQ ID NO: 80529 - DNA, 20 bp, Artificial Sequence
  chemically synthesized
gtctgctgatgctgcaccca

SEQ ID NO: 80530 - DNA, 20 bp, Artificial Sequence
  chemically synthesized
ggaaggggcagctgtgggtg

SEQ ID NO: 80531 - DNA, 20 bp, Artificial Sequence
  chemically synthesized
cacggggaaggggcagctgt

SEQ ID NO: 80532 - DNA, 20 bp, Artificial Sequence
  chemically synthesized
ccacggggaaggggcagctg

SEQ ID NO: 80533 - DNA, 20 bp, Artificial Sequence
  chemically synthesized
agagcaccacggggaagggg

SEQ ID NO: 80534 - DNA, 20 bp, Artificial Sequence
  chemically synthesized
gacagagcaccacggggaag

SEQ ID NO: 80535 - DNA, 20 bp, Artificial Sequence
  chemically synthesized
ccacagctgccccttccccg

SEQ ID NO: 80536 - DNA, 20 bp, Artificial Sequence
  chemically synthesized
ggacagagcaccacggggaa

SEQ ID NO: 80537 - DNA, 20 bp, Artificial Sequence
  chemically synthesized
gggacagagcaccacgggga

SEQ ID NO: 80538 - DNA, 20 bp, Artificial Sequence
  chemically synthesized
tgggacagagcaccacgggg

SEQ ID NO: 80539 - DNA, 20 bp, Artificial Sequence
  chemically synthesized
ccctgggacagagcaccacg

SEQ ID NO: 80540 - DNA, 20 bp, Artificial Sequence
  chemically synthesized
tccctgggacagagcaccac

SEQ ID NO: 80541 - DNA, 20 bp, Artificial Sequence
  chemically synthesized
ctccctgggacagagcacca

SEQ ID NO: 80542 - DNA, 20 bp, Artificial Sequence
  chemically synthesized
ttccccgtggtgctctgtcc

SEQ ID NO: 80543 - DNA, 20 bp, Artificial Sequence
  chemically synthesized
tccccgtggtgctctgtccc

SEQ ID NO: 80544 - DNA, 20 bp, Artificial Sequence
  chemically synthesized
ccccgtggtgctctgtccca

SEQ ID NO: 80545 - DNA, 20 bp, Artificial Sequence
  chemically synthesized
actcccatctccctgggaca

SEQ ID NO: 80546 - DNA, 20 bp, Artificial Sequence
  chemically synthesized
ccgtggtgctctgtcccagg

SEQ ID NO: 80547 - DNA, 20 bp, Artificial Sequence
  chemically synthesized
aaactcccatctccctggga

SEQ ID NO: 80548 - DNA, 20 bp, Artificial Sequence
  chemically synthesized
ggtgctctgtcccagggaga

SEQ ID NO: 80549 - DNA, 20 bp, Artificial Sequence
  chemically synthesized
gataaaactcccatctccct

SEQ ID NO: 80550 - DNA, 20 bp, Artificial Sequence
  chemically synthesized
gtgctctgtcccagggagat

SEQ ID NO: 80551 - DNA, 20 bp, Artificial Sequence
  chemically synthesized
agataaaactcccatctccc

SEQ ID NO: 80552 - DNA, 20 bp, Artificial Sequence
  chemically synthesized
gctctgtcccagggagatgg

SEQ ID NO: 80553 - DNA, 20 bp, Artificial Sequence
  chemically synthesized
gagatgggagttttatctat

SEQ ID NO: 80554 - DNA, 20 bp, Artificial Sequence
  chemically synthesized
cagccccagtcaggggctta

SEQ ID NO: 80555 - DNA, 20 bp, Artificial Sequence
  chemically synthesized
tttatctataagcccctgac

SEQ ID NO: 80556 - DNA, 20 bp, Artificial Sequence
  chemically synthesized
ttatctataagcccctgact

SEQ ID NO: 80557 - DNA, 20 bp, Artificial Sequence
  chemically synthesized
tatctataagcccctgactg

SEQ ID NO: 80558 - DNA, 20 bp, Artificial Sequence
  chemically synthesized
aaggcagcagccccagtcag

SEQ ID NO: 80559 - DNA, 20 bp, Artificial Sequence
  chemically synthesized
aaaggcagcagccccagtca

SEQ ID NO: 80560 - DNA, 20 bp, Artificial Sequence
  chemically synthesized
gaaaggcagcagccccagtc

SEQ ID NO: 80561 - DNA, 20 bp, Artificial Sequence
  chemically synthesized
agaaaggcagcagccccagt

SEQ ID NO: 80562 - DNA, 20 bp, Artificial Sequence
  chemically synthesized
tgaaagaaaggcagcagccc

SEQ ID NO: 80563 - DNA, 20 bp, Artificial Sequence
  chemically synthesized
catctctgaaagaaaggcag

SEQ ID NO: 80564 - DNA, 20 bp, Artificial Sequence
  chemically synthesized
gggcatctctgaaagaaagg

SEQ ID NO: 80565 - DNA, 20 bp, Artificial Sequence
  chemically synthesized
tggggctgctgcctttcttt

SEQ ID NO: 80566 - DNA, 20 bp, Artificial Sequence
  chemically synthesized
gcagggcatctctgaaagaa

SEQ ID NO: 80567 - DNA, 20 bp, Artificial Sequence
  chemically synthesized
gggctgctgcctttctttca

SEQ ID NO: 80568 - DNA, 20 bp, Artificial Sequence
  chemically synthesized
ggcagggcatctctgaaaga

SEQ ID NO: 80569 - DNA, 20 bp, Artificial Sequence
  chemically synthesized
tctgggcagggcatctctga

SEQ ID NO: 80570 - DNA, 20 bp, Artificial Sequence
  chemically synthesized
tctttcagagatgccctgcc

SEQ ID NO: 80571 - DNA, 20 bp, Artificial Sequence
  chemically synthesized
tttcagagatgccctgccca

SEQ ID NO: 80572 - DNA, 20 bp, Artificial Sequence
  chemically synthesized
agattccttctctctgggca

SEQ ID NO: 80573 - DNA, 20 bp, Artificial Sequence
  chemically synthesized
tcagagatgccctgcccaga

SEQ ID NO: 80574 - DNA, 20 bp, Artificial Sequence
  chemically synthesized
tagattccttctctctgggc

SEQ ID NO: 80575 - DNA, 20 bp, Artificial Sequence
  chemically synthesized
ctagattccttctctctggg

SEQ ID NO: 80576 - DNA, 20 bp, Artificial Sequence
  chemically synthesized
gagatgccctgcccagagag

SEQ ID NO: 80577 - DNA, 20 bp, Artificial Sequence
  chemically synthesized
agatgccctgcccagagaga

SEQ ID NO: 80578 - DNA, 20 bp, Artificial Sequence
  chemically synthesized
tctctagattccttctctct

SEQ ID NO: 80579 - DNA, 20 bp, Artificial Sequence
  chemically synthesized
ctctctagattccttctctc

SEQ ID NO: 80580 - DNA, 20 bp, Artificial Sequence
  chemically synthesized
ctgcccagagagaaggaatc

SEQ ID NO: 80581 - DNA, 20 bp, Artificial Sequence
  chemically synthesized
gcccagagagaaggaatcta

SEQ ID NO: 80582 - DNA, 20 bp, Artificial Sequence
  chemically synthesized
ccagagagaaggaatctaga

SEQ ID NO: 80583 - DNA, 20 bp, Artificial Sequence
  chemically synthesized
cagagagaaggaatctagag

SEQ ID NO: 80584 - DNA, 20 bp, Artificial Sequence
  chemically synthesized
ctgtagccagattgcctctc

SEQ ID NO: 80585 - DNA, 20 bp, Artificial Sequence
  chemically synthesized
aggaatctagagaggcaatc

SEQ ID NO: 80586 - DNA, 20 bp, Artificial Sequence
  chemically synthesized
ctagagaggcaatctggcta

SEQ ID NO: 80587 - DNA, 20 bp, Artificial Sequence
  chemically synthesized
gagaggcaatctggctacag

SEQ ID NO: 80588 - DNA, 20 bp, Artificial Sequence
  chemically synthesized
ctcggcaaagccactgtagc

SEQ ID NO: 80589 - DNA, 20 bp, Artificial Sequence
  chemically synthesized
gcagctcggcaaagccactg

SEQ ID NO: 80590 - DNA, 20 bp, Artificial Sequence
  chemically synthesized
ctggctacagtggctttgcc

SEQ ID NO: 80591 - DNA, 20 bp, Artificial Sequence
  chemically synthesized
gagctcaccgcagctcggca

SEQ ID NO: 80592 - DNA, 20 bp, Artificial Sequence
  chemically synthesized
acagtggctttgccgagctg

SEQ ID NO: 80593 - DNA, 20 bp, Artificial Sequence
  chemically synthesized
gggcggagctcaccgcagct

SEQ ID NO: 80594 - DNA, 20 bp, Artificial Sequence
  chemically synthesized
tggctttgccgagctgcggt

SEQ ID NO: 80595 - DNA, 20 bp, Artificial Sequence
  chemically synthesized
taactgggcggagctcaccg

SEQ ID NO: 80596 - DNA, 20 bp, Artificial Sequence
  chemically synthesized
gagctgcggtgagctccgcc

SEQ ID NO: 80597 - DNA, 20 bp, Artificial Sequence
  chemically synthesized
caagaagttctaactgggcg

SEQ ID NO: 80598 - DNA, 20 bp, Artificial Sequence
  chemically synthesized
tgcggtgagctccgcccagt

SEQ ID NO: 80599 - DNA, 20 bp, Artificial Sequence
  chemically synthesized
gtcaagaagttctaactggg

SEQ ID NO: 80600 - DNA, 20 bp, Artificial Sequence
  chemically synthesized
gccgtcaagaagttctaact

SEQ ID NO: 80601 - DNA, 20 bp, Artificial Sequence
  chemically synthesized
agccgtcaagaagttctaac

SEQ ID NO: 80602 - DNA, 20 bp, Artificial Sequence
  chemically synthesized
gcccagttagaacttcttga

SEQ ID NO: 80603 - DNA, 20 bp, Artificial Sequence
  chemically synthesized
gtgtaaacaaagccgtcaag

SEQ ID NO: 80604 - DNA, 20 bp, Artificial Sequence
  chemically synthesized
acagtgtaaacaaagccgtc

SEQ ID NO: 80605 - DNA, 20 bp, Artificial Sequence
  chemically synthesized
ttcccctcacagtgtaaaca

SEQ ID NO: 80606 - DNA, 20 bp, Artificial Sequence
  chemically synthesized
gacggctttgtttacactgt

SEQ ID NO: 80607 - DNA, 20 bp, Artificial Sequence
  chemically synthesized
acggctttgtttacactgtg

SEQ ID NO: 80608 - DNA, 20 bp, Artificial Sequence
  chemically synthesized
cggctttgtttacactgtga

SEQ ID NO: 80609 - DNA, 20 bp, Artificial Sequence
  chemically synthesized
ggctttgtttacactgtgag

SEQ ID NO: 80610 - DNA, 20 bp, Artificial Sequence
  chemically synthesized
agtaggcagttttcccctca

SEQ ID NO: 80611 - DNA, 20 bp, Artificial Sequence
  chemically synthesized
gaggggaaaactgcctactc

SEQ ID NO: 80612 - DNA, 20 bp, Artificial Sequence
  chemically synthesized
attactgaagcttgagtagg

SEQ ID NO: 80613 - DNA, 20 bp, Artificial Sequence
  chemically synthesized
gccattactgaagcttgagt

SEQ ID NO: 80614 - DNA, 20 bp, Artificial Sequence
  chemically synthesized
tgccattactgaagcttgag

SEQ ID NO: 80615 - DNA, 20 bp, Artificial Sequence
  chemically synthesized
aaaactgcctactcaagctt

SEQ ID NO: 80616 - DNA, 20 bp, Artificial Sequence
  chemically synthesized
acctgccattactgaagctt

SEQ ID NO: 80617 - DNA, 20 bp, Artificial Sequence
  chemically synthesized
gcctactcaagcttcagtaa

SEQ ID NO: 80618 - DNA, 20 bp, Artificial Sequence
  chemically synthesized
aggggcacctgccattactg

SEQ ID NO: 80619 - DNA, 20 bp, Artificial Sequence
  chemically synthesized
tactcaagcttcagtaatgg

SEQ ID NO: 80620 - DNA, 20 bp, Artificial Sequence
  chemically synthesized
actcaagcttcagtaatggc

SEQ ID NO: 80621 - DNA, 20 bp, Artificial Sequence
  chemically synthesized
ctcaagcttagtgtggggag

SEQ ID NO: 80622 - DNA, 20 bp, Artificial Sequence
  chemically synthesized
actcaagcttagtgtgggga

SEQ ID NO: 80623 - DNA, 20 bp, Artificial Sequence
  chemically synthesized
tactcaagcttagtgtgggg

SEQ ID NO: 80624 - DNA, 20 bp, Artificial Sequence
  chemically synthesized
atactcaagcttagtgtggg

SEQ ID NO: 80625 - DNA, 20 bp, Artificial Sequence
  chemically synthesized
caggtgcccctccccacact

SEQ ID NO: 80626 - DNA, 20 bp, Artificial Sequence
  chemically synthesized
ggatactcaagcttagtgtg

SEQ ID NO: 80627 - DNA, 20 bp, Artificial Sequence
  chemically synthesized
gggatactcaagcttagtgt

SEQ ID NO: 80628 - DNA, 20 bp, Artificial Sequence
  chemically synthesized
tgggatactcaagcttagtg

SEQ ID NO: 80629 - DNA, 20 bp, Artificial Sequence
  chemically synthesized
cccctccccacactaagctt

SEQ ID NO: 80630 - DNA, 20 bp, Artificial Sequence
  chemically synthesized
ggacctgggatactcaagct

SEQ ID NO: 80631 - DNA, 20 bp, Artificial Sequence
  chemically synthesized
gaagtggacctgggatactc

SEQ ID NO: 80632 - DNA, 20 bp, Artificial Sequence
  chemically synthesized
cacactaagcttgagtatcc

SEQ ID NO: 80633 - DNA, 20 bp, Artificial Sequence
  chemically synthesized
acactaagcttgagtatccc

SEQ ID NO: 80634 - DNA, 20 bp, Artificial Sequence
  chemically synthesized
cagcagtctgaagtggacct

SEQ ID NO: 80635 - DNA, 20 bp, Artificial Sequence
  chemically synthesized
acagcagtctgaagtggacc

SEQ ID NO: 80636 - DNA, 20 bp, Artificial Sequence
  chemically synthesized
tgagtatcccaggtccactt

SEQ ID NO: 80637 - DNA, 20 bp, Artificial Sequence
  chemically synthesized
gccagcacagcagtctgaag

SEQ ID NO: 80638 - DNA, 20 bp, Artificial Sequence
  chemically synthesized
gctgccagcacagcagtctg

SEQ ID NO: 80639 - DNA, 20 bp, Artificial Sequence
  chemically synthesized
tccacttcagactgctgtgc

SEQ ID NO: 80640 - DNA, 20 bp, Artificial Sequence
  chemically synthesized
aattctcgctgccagcacag

SEQ ID NO: 80641 - DNA, 20 bp, Artificial Sequence
  chemically synthesized
acttcagactgctgtgctgg

SEQ ID NO: 80642 - DNA, 20 bp, Artificial Sequence
  chemically synthesized
tgaaattctcgctgccagca

SEQ ID NO: 80643 - DNA, 20 bp, Artificial Sequence
  chemically synthesized
cagactgctgtgctggcagc

SEQ ID NO: 80644 - DNA, 20 bp, Artificial Sequence
  chemically synthesized
tggcttgaaattctcgctgc

SEQ ID NO: 80645 - DNA, 20 bp, Artificial Sequence
  chemically synthesized
gtgctggcagcgagaatttc

SEQ ID NO: 80646 - DNA, 20 bp, Artificial Sequence
  chemically synthesized
tggcagcgagaatttcaagc

SEQ ID NO: 80647 - DNA, 20 bp, Artificial Sequence
  chemically synthesized
cagcgagaatttcaagccag

SEQ ID NO: 80648 - DNA, 20 bp, Artificial Sequence
  chemically synthesized
cccagccagctaagatccac

SEQ ID NO: 80649 - DNA, 20 bp, Artificial Sequence
  chemically synthesized
aatttcaagccagtggatct

SEQ ID NO: 80650 - DNA, 20 bp, Artificial Sequence
  chemically synthesized
tcaagccagtggatcttagc

SEQ ID NO: 80651 - DNA, 20 bp, Artificial Sequence
  chemically synthesized
gccagtggatcttagctggc

SEQ ID NO: 80652 - DNA, 20 bp, Artificial Sequence
  chemically synthesized
ccaacggagcccagccagct

SEQ ID NO: 80653 - DNA, 20 bp, Artificial Sequence
  chemically synthesized
ccagtggatcttagctggct

SEQ ID NO: 80654 - DNA, 20 bp, Artificial Sequence
  chemically synthesized
cacccccaacggagcccagc

SEQ ID NO: 80655 - DNA, 20 bp, Artificial Sequence
  chemically synthesized
atcccacccccaacggagcc

SEQ ID NO: 80656 - DNA, 20 bp, Artificial Sequence
  chemically synthesized
cttagctggctgggctccgt

SEQ ID NO: 80657 - DNA, 20 bp, Artificial Sequence
  chemically synthesized
ttagctggctgggctccgtt

SEQ ID NO: 80658 - DNA, 20 bp, Artificial Sequence
  chemically synthesized
tagctggctgggctccgttg

SEQ ID NO: 80659 - DNA, 20 bp, Artificial Sequence
  chemically synthesized
agctggctgggctccgttgg

SEQ ID NO: 80660 - DNA, 20 bp, Artificial Sequence
  chemically synthesized
agtggatcccacccccaacg

SEQ ID NO: 80661 - DNA, 20 bp, Artificial Sequence
  chemically synthesized
tggctgggctccgttggggg

SEQ ID NO: 80662 - DNA, 20 bp, Artificial Sequence
  chemically synthesized
tcagtggatcccacccccaa

SEQ ID NO: 80663 - DNA, 20 bp, Artificial Sequence
  chemically synthesized
ggctgggctccgttgggggt

SEQ ID NO: 80664 - DNA, 20 bp, Artificial Sequence
  chemically synthesized
cgttgggggtgggatccact

SEQ ID NO: 80665 - DNA, 20 bp, Artificial Sequence
  chemically synthesized
gggggtgggatccactgagc

SEQ ID NO: 80666 - DNA, 20 bp, Artificial Sequence
  chemically synthesized
agccaagtggtctagctcag

SEQ ID NO: 80667 - DNA, 20 bp, Artificial Sequence
  chemically synthesized
gggagccaagtggtctagct

SEQ ID NO: 80668 - DNA, 20 bp, Artificial Sequence
  chemically synthesized
atccactgagctagaccact

SEQ ID NO: 80669 - DNA, 20 bp, Artificial Sequence
  chemically synthesized
agtcagggagccaagtggtc

SEQ ID NO: 80670 - DNA, 20 bp, Artificial Sequence
  chemically synthesized
actgaagtcagggagccaag

SEQ ID NO: 80671 - DNA, 20 bp, Artificial Sequence
  chemically synthesized
gggactgaagtcagggagcc

SEQ ID NO: 80672 - DNA, 20 bp, Artificial Sequence
  chemically synthesized
gaaaggggactgaagtcagg

SEQ ID NO: 80673 - DNA, 20 bp, Artificial Sequence
  chemically synthesized
accacttggctccctgactt

SEQ ID NO: 80674 - DNA, 20 bp, Artificial Sequence
  chemically synthesized
tggaaaggggactgaagtca

SEQ ID NO: 80675 - DNA, 20 bp, Artificial Sequence
  chemically synthesized
ctggaaaggggactgaagtc

SEQ ID NO: 80676 - DNA, 20 bp, Artificial Sequence
  chemically synthesized
cctggaaaggggactgaagt

SEQ ID NO: 80677 - DNA, 20 bp, Artificial Sequence
  chemically synthesized
ctcccctggaaaggggactg

SEQ ID NO: 80678 - DNA, 20 bp, Artificial Sequence
  chemically synthesized
cctgacttcagtcccctttc

SEQ ID NO: 80679 - DNA, 20 bp, Artificial Sequence
  chemically synthesized
ctgacttcagtcccctttcc

SEQ ID NO: 80680 - DNA, 20 bp, Artificial Sequence
  chemically synthesized
tgacttcagtcccctttcca

SEQ ID NO: 80681 - DNA, 20 bp, Artificial Sequence
  chemically synthesized
ccattcactcccctggaaag

SEQ ID NO: 80682 - DNA, 20 bp, Artificial Sequence
  chemically synthesized
gacttcagtcccctttccag

SEQ ID NO: 80683 - DNA, 20 bp, Artificial Sequence
  chemically synthesized
accattcactcccctggaaa

SEQ ID NO: 80684 - DNA, 20 bp, Artificial Sequence
  chemically synthesized
aaccattcactcccctggaa

SEQ ID NO: 80685 - DNA, 20 bp, Artificial Sequence
  chemically synthesized
cttcagtcccctttccaggg

SEQ ID NO: 80686 - DNA, 20 bp, Artificial Sequence
  chemically synthesized
gaaccattcactcccctgga

SEQ ID NO: 80687 - DNA, 20 bp, Artificial Sequence
  chemically synthesized
gatagaaccattcactcccc

SEQ ID NO: 80688 - DNA, 20 bp, Artificial Sequence
  chemically synthesized
cccctttccaggggagtgaa

SEQ ID NO: 80689 - DNA, 20 bp, Artificial Sequence
  chemically synthesized
agtgaatggttctatctcgc

SEQ ID NO: 80690 - DNA, 20 bp, Artificial Sequence
  chemically synthesized
cacctggaacaccagcgaga

SEQ ID NO: 80691 - DNA, 20 bp, Artificial Sequence
  chemically synthesized
gcgtcacctggaacaccagc

SEQ ID NO: 80692 - DNA, 20 bp, Artificial Sequence
  chemically synthesized
gttctatctcgctggtgttc

SEQ ID NO: 80693 - DNA, 20 bp, Artificial Sequence
  chemically synthesized
ttctatctcgctggtgttcc

SEQ ID NO: 80694 - DNA, 20 bp, Artificial Sequence
  chemically synthesized
cccagcgtcacctggaacac

SEQ ID NO: 80695 - DNA, 20 bp, Artificial Sequence
  chemically synthesized
tttcatatcccagcgtcacc

SEQ ID NO: 80696 - DNA, 20 bp, Artificial Sequence
  chemically synthesized
gctggtgttccaggtgacgc

SEQ ID NO: 80697 - DNA, 20 bp, Artificial Sequence
  chemically synthesized
ctggtgttccaggtgacgct

SEQ ID NO: 80698 - DNA, 20 bp, Artificial Sequence
  chemically synthesized
caggcgtttttttcatatcc

SEQ ID NO: 80699 - DNA, 20 bp, Artificial Sequence
  chemically synthesized
ggatatgaaaaaaacgcctg

SEQ ID NO: 80700 - DNA, 20 bp, Artificial Sequence
  chemically synthesized
atgaaaaaaacgcctgcagc

SEQ ID NO: 80701 - DNA, 20 bp, Artificial Sequence
  chemically synthesized
gcagacaccgagctagctgc

SEQ ID NO: 80702 - DNA, 20 bp, Artificial Sequence
  chemically synthesized
ggcagacaccgagctagctg

SEQ ID NO: 80703 - DNA, 20 bp, Artificial Sequence
  chemically synthesized
aaaaacgcctgcagctagct

SEQ ID NO: 80704 - DNA, 20 bp, Artificial Sequence
  chemically synthesized
tgtttgggcagacaccgagc

SEQ ID NO: 80705 - DNA, 20 bp, Artificial Sequence
  chemically synthesized
cagctgtttgggcagacacc

SEQ ID NO: 80706 - DNA, 20 bp, Artificial Sequence
  chemically synthesized
tagctcggtgtctgcccaaa

SEQ ID NO: 80707 - DNA, 20 bp, Artificial Sequence
  chemically synthesized
aaattgggcagctgtttggg

SEQ ID NO: 80708 - DNA, 20 bp, Artificial Sequence
  chemically synthesized
acaaaattgggcagctgttt

SEQ ID NO: 80709 - DNA, 20 bp, Artificial Sequence
  chemically synthesized
cacaaaattgggcagctgtt

SEQ ID NO: 80710 - DNA, 20 bp, Artificial Sequence
  chemically synthesized
gtttcaagcacaaaattggg

SEQ ID NO: 80711 - DNA, 20 bp, Artificial Sequence
  chemically synthesized
tgggtttcaagcacaaaatt

SEQ ID NO: 80712 - DNA, 20 bp, Artificial Sequence
  chemically synthesized
ctgggtttcaagcacaaaat

SEQ ID NO: 80713 - DNA, 20 bp, Artificial Sequence
  chemically synthesized
ccaattttgtgcttgaaacc

SEQ ID NO: 80714 - DNA, 20 bp, Artificial Sequence
  chemically synthesized
caattttgtgcttgaaaccc

SEQ ID NO: 80715 - DNA, 20 bp, Artificial Sequence
  chemically synthesized
ccaccagggccctgggtttc

SEQ ID NO: 80716 - DNA, 20 bp, Artificial Sequence
  chemically synthesized
aattttgtgcttgaaaccca

SEQ ID NO: 80717 - DNA, 20 bp, Artificial Sequence
  chemically synthesized
gtgcttgaaacccagggccc

SEQ ID NO: 80718 - DNA, 20 bp, Artificial Sequence
  chemically synthesized
gcctacgccaccagggccct

SEQ ID NO: 80719 - DNA, 20 bp, Artificial Sequence
  chemically synthesized
tgcctacgccaccagggccc

SEQ ID NO: 80720 - DNA, 20 bp, Artificial Sequence
  chemically synthesized
cttgaaacccagggccctgg

SEQ ID NO: 80721 - DNA, 20 bp, Artificial Sequence
  chemically synthesized
ctcgggtgcctacgccacca

SEQ ID NO: 80722 - DNA, 20 bp, Artificial Sequence
  chemically synthesized
aacccagggccctggtggcg

SEQ ID NO: 80723 - DNA, 20 bp, Artificial Sequence
  chemically synthesized
cctcgggtgcctacgccacc

SEQ ID NO: 80724 - DNA, 20 bp, Artificial Sequence
  chemically synthesized
acccagggccctggtggcgt

SEQ ID NO: 80725 - DNA, 20 bp, Artificial Sequence
  chemically synthesized
ccctcgggtgcctacgccac

SEQ ID NO: 80726 - DNA, 20 bp, Artificial Sequence
  chemically synthesized
ccctggtggcgtaggcaccc

SEQ ID NO: 80727 - DNA, 20 bp, Artificial Sequence
  chemically synthesized
cctggtggcgtaggcacccg

SEQ ID NO: 80728 - DNA, 20 bp, Artificial Sequence
  chemically synthesized
ctggtggcgtaggcacccga

SEQ ID NO: 80729 - DNA, 20 bp, Artificial Sequence
  chemically synthesized
gcagaccaggagattccctc

SEQ ID NO: 80730 - DNA, 20 bp, Artificial Sequence
  chemically synthesized
tgcagaccaggagattccct

SEQ ID NO: 80731 - DNA, 20 bp, Artificial Sequence
  chemically synthesized
aggcacccgagggaatctcc

SEQ ID NO: 80732 - DNA, 20 bp, Artificial Sequence
  chemically synthesized
ctccgcaacatgcagaccag

SEQ ID NO: 80733 - DNA, 20 bp, Artificial Sequence
  chemically synthesized
gcctccgcaacatgcagacc

SEQ ID NO: 80734 - DNA, 20 bp, Artificial Sequence
  chemically synthesized
agcctccgcaacatgcagac

SEQ ID NO: 80735 - DNA, 20 bp, Artificial Sequence
  chemically synthesized
atctcctggtctgcatgttg

SEQ ID NO: 80736 - DNA, 20 bp, Artificial Sequence
  chemically synthesized
cccacagcctccgcaacatg

SEQ ID NO: 80737 - DNA, 20 bp, Artificial Sequence
  chemically synthesized
ctcctggtctgcatgttgcg

SEQ ID NO: 80738 - DNA, 20 bp, Artificial Sequence
  chemically synthesized
tcctggtctgcatgttgcgg

SEQ ID NO: 80739 - DNA, 20 bp, Artificial Sequence
  chemically synthesized
tctgcatgttgcggaggctg

SEQ ID NO: 80740 - DNA, 20 bp, Artificial Sequence
  chemically synthesized
ctgcatgttgcggaggctgt

SEQ ID NO: 80741 - DNA, 20 bp, Artificial Sequence
  chemically synthesized
tgttgcggaggctgtgggaa

SEQ ID NO: 80742 - DNA, 20 bp, Artificial Sequence
  chemically synthesized
cagacactatgcttttccca

SEQ ID NO: 80743 - DNA, 20 bp, Artificial Sequence
  chemically synthesized
cggaggctgtgggaaaagca

SEQ ID NO: 80744 - DNA, 20 bp, Artificial Sequence
  chemically synthesized
tgtgggaaaagcatagtgtc

SEQ ID NO: 80745 - DNA, 20 bp, Artificial Sequence
  chemically synthesized
gtgggaaaagcatagtgtct

SEQ ID NO: 80746 - DNA, 20 bp, Artificial Sequence
  chemically synthesized
gaaaagcatagtgtctgggc

SEQ ID NO: 80747 - DNA, 20 bp, Artificial Sequence
  chemically synthesized
aggaacggagcattccagcc

SEQ ID NO: 80748 - DNA, 20 bp, Artificial Sequence
  chemically synthesized
ccctgaggaacggagcattc

SEQ ID NO: 80749 - DNA, 20 bp, Artificial Sequence
  chemically synthesized
ggctggaatgctccgttcct

SEQ ID NO: 80750 - DNA, 20 bp, Artificial Sequence
  chemically synthesized
ggactgtgccctgaggaacg

SEQ ID NO: 80751 - DNA, 20 bp, Artificial Sequence
  chemically synthesized
gctggaatgctccgttcctc

SEQ ID NO: 80752 - DNA, 20 bp, Artificial Sequence
  chemically synthesized
ctggaatgctccgttcctca

SEQ ID NO: 80753 - DNA, 20 bp, Artificial Sequence
  chemically synthesized
agggactgtgccctgaggaa

SEQ ID NO: 80754 - DNA, 20 bp, Artificial Sequence
  chemically synthesized
atgctccgttcctcagggca

SEQ ID NO: 80755 - DNA, 20 bp, Artificial Sequence
  chemically synthesized
ccgtgagggactgtgccctg

SEQ ID NO: 80756 - DNA, 20 bp, Artificial Sequence
  chemically synthesized
gccgtgagggactgtgccct

SEQ ID NO: 80757 - DNA, 20 bp, Artificial Sequence
  chemically synthesized
cctcagggcacagtccctca

SEQ ID NO: 80758 - DNA, 20 bp, Artificial Sequence
  chemically synthesized
ctagccaacagaagccgtga

SEQ ID NO: 80759 - DNA, 20 bp, Artificial Sequence
  chemically synthesized
cctagccaacagaagccgtg

SEQ ID NO: 80760 - DNA, 20 bp, Artificial Sequence
  chemically synthesized
ccctagccaacagaagccgt

SEQ ID NO: 80761 - DNA, 20 bp, Artificial Sequence
  chemically synthesized
cagtccctcacggcttctgt

SEQ ID NO: 80762 - DNA, 20 bp, Artificial Sequence
  chemically synthesized
ttccctcccctagccaacag

SEQ ID NO: 80763 - DNA, 20 bp, Artificial Sequence
  chemically synthesized
ccctcacggcttctgttggc

SEQ ID NO: 80764 - DNA, 20 bp, Artificial Sequence
  chemically synthesized
cctcacggcttctgttggct

SEQ ID NO: 80765 - DNA, 20 bp, Artificial Sequence
  chemically synthesized
ctcacggcttctgttggcta

SEQ ID NO: 80766 - DNA, 20 bp, Artificial Sequence
  chemically synthesized
gaattccctcccctagccaa

SEQ ID NO: 80767 - DNA, 20 bp, Artificial Sequence
  chemically synthesized
tcacggcttctgttggctag

SEQ ID NO: 80768 - DNA, 20 bp, Artificial Sequence
  chemically synthesized
acggcttctgttggctaggg

SEQ ID NO: 80769 - DNA, 20 bp, Artificial Sequence
  chemically synthesized
cggcttctgttggctagggg

SEQ ID NO: 80770 - DNA, 20 bp, Artificial Sequence
  chemically synthesized
ggcttctgttggctagggga

SEQ ID NO: 80771 - DNA, 20 bp, Artificial Sequence
  chemically synthesized
ggtcagggaattccctcccc

SEQ ID NO: 80772 - DNA, 20 bp, Artificial Sequence
  chemically synthesized
cccggaagcacaaggggtca

SEQ ID NO: 80773 - DNA, 20 bp, Artificial Sequence
  chemically synthesized
ccccggaagcacaaggggtc

SEQ ID NO: 80774 - DNA, 20 bp, Artificial Sequence
  chemically synthesized
accccggaagcacaaggggt

SEQ ID NO: 80775 - DNA, 20 bp, Artificial Sequence
  chemically synthesized
cctcaccccggaagcacaag

SEQ ID NO: 80776 - DNA, 20 bp, Artificial Sequence
  chemically synthesized
gcctcaccccggaagcacaa

SEQ ID NO: 80777 - DNA, 20 bp, Artificial Sequence
  chemically synthesized
cgcctcaccccggaagcaca

SEQ ID NO: 80778 - DNA, 20 bp, Artificial Sequence
  chemically synthesized
tccctgaccccttgtgcttc

SEQ ID NO: 80779 - DNA, 20 bp, Artificial Sequence
  chemically synthesized
tcgcctcaccccggaagcac

SEQ ID NO: 80780 - DNA, 20 bp, Artificial Sequence
  chemically synthesized
ccctgaccccttgtgcttcc

SEQ ID NO: 80781 - DNA, 20 bp, Artificial Sequence
  chemically synthesized
cctgaccccttgtgcttccg

SEQ ID NO: 80782 - DNA, 20 bp, Artificial Sequence
  chemically synthesized
accccttgtgcttccggggt

SEQ ID NO: 80783 - DNA, 20 bp, Artificial Sequence
  chemically synthesized
gggatgtcgcctcaccccgg

SEQ ID NO: 80784 - DNA, 20 bp, Artificial Sequence
  chemically synthesized
ccccttgtgcttccggggtg

SEQ ID NO: 80785 - DNA, 20 bp, Artificial Sequence
  chemically synthesized
ggtgggatgtcgcctcaccc

SEQ ID NO: 80786 - DNA, 20 bp, Artificial Sequence
  chemically synthesized
agagggcgcagaagcacggt

SEQ ID NO: 80787 - DNA, 20 bp, Artificial Sequence
  chemically synthesized
cagagggcgcagaagcacgg

SEQ ID NO: 80788 - DNA, 20 bp, Artificial Sequence
  chemically synthesized
ccacagagggcgcagaagca

SEQ ID NO: 80789 - DNA, 20 bp, Artificial Sequence
  chemically synthesized
gcagcccacagagggcgcag

SEQ ID NO: 80790 - DNA, 20 bp, Artificial Sequence
  chemically synthesized
ggtgcagcccacagagggcg

SEQ ID NO: 80791 - DNA, 20 bp, Artificial Sequence
  chemically synthesized
ccgtgcttctgcgccctctg

SEQ ID NO: 80792 - DNA, 20 bp, Artificial Sequence
  chemically synthesized
cgtgcttctgcgccctctgt

SEQ ID NO: 80793 - DNA, 20 bp, Artificial Sequence
  chemically synthesized
cagtgggtgcagcccacaga

SEQ ID NO: 80794 - DNA, 20 bp, Artificial Sequence
  chemically synthesized
acagtgggtgcagcccacag

SEQ ID NO: 80795 - DNA, 20 bp, Artificial Sequence
  chemically synthesized
gacagtgggtgcagcccaca

SEQ ID NO: 80796 - DNA, 20 bp, Artificial Sequence
  chemically synthesized
tagacagtgggtgcagccca

SEQ ID NO: 80797 - DNA, 20 bp, Artificial Sequence
  chemically synthesized
gactggttagacagtgggtg

SEQ ID NO: 80798 - DNA, 20 bp, Artificial Sequence
  chemically synthesized
actgggactggttagacagt

SEQ ID NO: 80799 - DNA, 20 bp, Artificial Sequence
  chemically synthesized
cactgggactggttagacag

SEQ ID NO: 80800 - DNA, 20 bp, Artificial Sequence
  chemically synthesized
ggctgcacccactgtctaac

SEQ ID NO: 80801 - DNA, 20 bp, Artificial Sequence
  chemically synthesized
tctcactgggactggttaga

SEQ ID NO: 80802 - DNA, 20 bp, Artificial Sequence
  chemically synthesized
ctcatctcactgggactggt

SEQ ID NO: 80803 - DNA, 20 bp, Artificial Sequence
  chemically synthesized
acccactgtctaaccagtcc

SEQ ID NO: 80804 - DNA, 20 bp, Artificial Sequence
  chemically synthesized
ccggctcatctcactgggac

SEQ ID NO: 80805 - DNA, 20 bp, Artificial Sequence
  chemically synthesized
actgtctaaccagtcccagt

SEQ ID NO: 80806 - DNA, 20 bp, Artificial Sequence
  chemically synthesized
agtacccggctcatctcact

SEQ ID NO: 80807 - DNA, 20 bp, Artificial Sequence
  chemically synthesized
ctaaccagtcccagtgagat

SEQ ID NO: 80808 - DNA, 20 bp, Artificial Sequence
  chemically synthesized
cagtacccggctcatctcac

SEQ ID NO: 80809 - DNA, 20 bp, Artificial Sequence
  chemically synthesized
ccagtcccagtgagatgagc

SEQ ID NO: 80810 - DNA, 20 bp, Artificial Sequence
  chemically synthesized
cagtcccagtgagatgagcc

SEQ ID NO: 80811 - DNA, 20 bp, Artificial Sequence
  chemically synthesized
gtgagatgagccgggtactg

SEQ ID NO: 80812 - DNA, 20 bp, Artificial Sequence
  chemically synthesized
gcatttccaactgcagtacc

SEQ ID NO: 80813 - DNA, 20 bp, Artificial Sequence
  chemically synthesized
gatgagccgggtactgcagt

SEQ ID NO: 80814 - DNA, 20 bp, Artificial Sequence
  chemically synthesized
gatttctgcatttccaactg

SEQ ID NO: 80815 - DNA, 20 bp, Artificial Sequence
  chemically synthesized
gggtactgcagttggaaatg

SEQ ID NO: 80816 - DNA, 20 bp, Artificial Sequence
  chemically synthesized
gtgagatcaacacagaaggt

SEQ ID NO: 80817 - DNA, 20 bp, Artificial Sequence
  chemically synthesized
agtgagatcaacacagaagg

SEQ ID NO: 80818 - DNA, 20 bp, Artificial Sequence
  chemically synthesized
cctagtgagatcaacacaga

SEQ ID NO: 80819 - DNA, 20 bp, Artificial Sequence
  chemically synthesized
ccctagtgagatcaacacag

SEQ ID NO: 80820 - DNA, 20 bp, Artificial Sequence
  chemically synthesized
agcccctagtgagatcaaca

SEQ ID NO: 80821 - DNA, 20 bp, Artificial Sequence
  chemically synthesized
accttctgtgttgatctcac

SEQ ID NO: 80822 - DNA, 20 bp, Artificial Sequence
  chemically synthesized
ccttctgtgttgatctcact

SEQ ID NO: 80823 - DNA, 20 bp, Artificial Sequence
  chemically synthesized
cttctgtgttgatctcacta

SEQ ID NO: 80824 - DNA, 20 bp, Artificial Sequence
  chemically synthesized
ttctgtgttgatctcactag

SEQ ID NO: 80825 - DNA, 20 bp, Artificial Sequence
  chemically synthesized
tcaggtgcgcagcccctagt

SEQ ID NO: 80826 - DNA, 20 bp, Artificial Sequence
  chemically synthesized
cagctcaggtgcgcagcccc

SEQ ID NO: 80827 - DNA, 20 bp, Artificial Sequence
  chemically synthesized
tcactaggggctgcgcacct

SEQ ID NO: 80828 - DNA, 20 bp, Artificial Sequence
  chemically synthesized
ataggaacagctcaggtgcg

SEQ ID NO: 80829 - DNA, 20 bp, Artificial Sequence
  chemically synthesized
tggctgaataggaacagctc

SEQ ID NO: 80830 - DNA, 20 bp, Artificial Sequence
  chemically synthesized
atggctgaataggaacagct

SEQ ID NO: 80831 - DNA, 20 bp, Artificial Sequence
  chemically synthesized
gcaagatggctgaataggaa

SEQ ID NO: 80832 - DNA, 20 bp, Artificial Sequence
  chemically synthesized
gcacctgagctgttcctatt

SEQ ID NO: 80833 - DNA, 20 bp, Artificial Sequence
  chemically synthesized
ggctggcaagatggctgaat

SEQ ID NO: 80834 - DNA, 20 bp, Artificial Sequence
  chemically synthesized
tggctggcaagatggctgaa

SEQ ID NO: 80835 - DNA, 20 bp, Artificial Sequence
  chemically synthesized
ttcctattcagccatcttgc

SEQ ID NO: 80836 - DNA, 20 bp, Artificial Sequence
  chemically synthesized
caaagaagtggctggcaaga

SEQ ID NO: 80837 - DNA, 20 bp, Artificial Sequence
  chemically synthesized
tgaccaaagaagtggctggc

SEQ ID NO: 80838 - DNA, 20 bp, Artificial Sequence
  chemically synthesized
atcctgaccaaagaagtggc

SEQ ID NO: 80839 - DNA, 20 bp, Artificial Sequence
  chemically synthesized
catcttgccagccacttctt

SEQ ID NO: 80840 - DNA, 20 bp, Artificial Sequence
  chemically synthesized
taaaatcctgaccaaagaag

SEQ ID NO: 80841 - DNA, 20 bp, Artificial Sequence
  chemically synthesized
ttgccagccacttctttggt

SEQ ID NO: 80842 - DNA, 20 bp, Artificial Sequence
  chemically synthesized
ctttaaaatcctgaccaaag

SEQ ID NO: 80843 - DNA, 20 bp, Artificial Sequence
  chemically synthesized
tgccagccacttctttggtc

SEQ ID NO: 80844 - DNA, 20 bp, Artificial Sequence
  chemically synthesized
catctttaaaatcctgacca

SEQ ID NO: 80845 - DNA, 20 bp, Artificial Sequence
  chemically synthesized
cttctttggtcaggatttta

SEQ ID NO: 80846 - DNA, 20 bp, Artificial Sequence
  chemically synthesized
aagatgaataattcctgctt

SEQ ID NO: 80847 - DNA, 20 bp, Artificial Sequence
  chemically synthesized
tacagcttagaaactaaagc

SEQ ID NO: 80848 - DNA, 20 bp, Artificial Sequence
  chemically synthesized
atacagcttagaaactaaag

SEQ ID NO: 80849 - DNA, 20 bp, Artificial Sequence
  chemically synthesized
ttaatacagcttagaaacta

SEQ ID NO: 80850 - DNA, 20 bp, Artificial Sequence
  chemically synthesized
taattcctgctttagtttct

SEQ ID NO: 80851 - DNA, 20 bp, Artificial Sequence
  chemically synthesized
atctagggtttaatacagct

SEQ ID NO: 80852 - DNA, 20 bp, Artificial Sequence
  chemically synthesized
agaatatctagggtttaata

SEQ ID NO: 80853 - DNA, 20 bp, Artificial Sequence
  chemically synthesized
ttctaagctgtattaaaccc

SEQ ID NO: 80854 - DNA, 20 bp, Artificial Sequence
  chemically synthesized
gcttttcaatagaatatcta

SEQ ID NO: 80855 - DNA, 20 bp, Artificial Sequence
  chemically synthesized
agcttttcaatagaatatct

SEQ ID NO: 80856 - DNA, 20 bp, Artificial Sequence
  chemically synthesized
tagcttttcaatagaatatc

SEQ ID NO: 80857 - DNA, 20 bp, Artificial Sequence
  chemically synthesized
accctagatattctattgaa

SEQ ID NO: 80858 - DNA, 20 bp, Artificial Sequence
  chemically synthesized
tactttcagtagcttttcaa

SEQ ID NO: 80859 - DNA, 20 bp, Artificial Sequence
  chemically synthesized
ttctattgaaaagctactga

SEQ ID NO: 80860 - DNA, 20 bp, Artificial Sequence
  chemically synthesized
atatattgatttactttcag

SEQ ID NO: 80861 - DNA, 20 bp, Artificial Sequence
  chemically synthesized
catatatattgatttacttt

SEQ ID NO: 80862 - DNA, 20 bp, Artificial Sequence
  chemically synthesized
tttatgctattgtaagatta

SEQ ID NO: 80863 - DNA, 20 bp, Artificial Sequence
  chemically synthesized
cataatccataatcttacaa

SEQ ID NO: 80864 - DNA, 20 bp, Artificial Sequence
  chemically synthesized
taaggattttatgctattgt

SEQ ID NO: 80865 - DNA, 20 bp, Artificial Sequence
  chemically synthesized
atagcataaaatccttaata

SEQ ID NO: 80866 - DNA, 20 bp, Artificial Sequence
  chemically synthesized
tctaaaccagtactgtatta

SEQ ID NO: 80867 - DNA, 20 bp, Artificial Sequence
  chemically synthesized
ttctaaaccagtactgtatt

SEQ ID NO: 80868 - DNA, 20 bp, Artificial Sequence
  chemically synthesized
taaaatccttaatacagtac

SEQ ID NO: 80869 - DNA, 20 bp, Artificial Sequence
  chemically synthesized
tccttaatacagtactggtt

SEQ ID NO: 80870 - DNA, 20 bp, Artificial Sequence
  chemically synthesized
atgttactgggtttctaaac

SEQ ID NO: 80871 - DNA, 20 bp, Artificial Sequence
  chemically synthesized
acagtactggtttagaaacc

SEQ ID NO: 80872 - DNA, 20 bp, Artificial Sequence
  chemically synthesized
tggtgataagagatgttact

SEQ ID NO: 80873 - DNA, 20 bp, Artificial Sequence
  chemically synthesized
ctggtgataagagatgttac

SEQ ID NO: 80874 - DNA, 20 bp, Artificial Sequence
  chemically synthesized
ccagtaacatctcttatcac

SEQ ID NO: 80875 - DNA, 20 bp, Artificial Sequence
  chemically synthesized
tgtttatgtactggtgataa

SEQ ID NO: 80876 - DNA, 20 bp, Artificial Sequence
  chemically synthesized
aatgtttatgtactggtgat

SEQ ID NO: 80877 - DNA, 20 bp, Artificial Sequence
  chemically synthesized
ttaatagaatgtttatgtac

SEQ ID NO: 80878 - DNA, 20 bp, Artificial Sequence
  chemically synthesized
taagtacggtatatttttaa

SEQ ID NO: 80879 - DNA, 20 bp, Artificial Sequence
  chemically synthesized
cactccatactttataagta

SEQ ID NO: 80880 - DNA, 20 bp, Artificial Sequence
  chemically synthesized
aaaaatataccgtacttata

SEQ ID NO: 80881 - DNA, 20 bp, Artificial Sequence
  chemically synthesized
agtgtcactccatactttat

SEQ ID NO: 80882 - DNA, 20 bp, Artificial Sequence
  chemically synthesized
tataccgtacttataaagta

SEQ ID NO: 80883 - DNA, 20 bp, Artificial Sequence
  chemically synthesized
taccgtacttataaagtatg

SEQ ID NO: 80884 - DNA, 20 bp, Artificial Sequence
  chemically synthesized
atcaaaggccatattatagc

SEQ ID NO: 80885 - DNA, 20 bp, Artificial Sequence
  chemically synthesized
gagtgacactcgctataata

SEQ ID NO: 80886 - DNA, 20 bp, Artificial Sequence
  chemically synthesized
gtctatcaaaggccatatta

SEQ ID NO: 80887 - DNA, 20 bp, Artificial Sequence
  chemically synthesized
cgctataatatggcctttga

SEQ ID NO: 80888 - DNA, 20 bp, Artificial Sequence
  chemically synthesized
tctgaaaatatgtctatcaa

SEQ ID NO: 80889 - DNA, 20 bp, Artificial Sequence
  chemically synthesized
atctgaaaatatgtctatca

SEQ ID NO: 80890 - DNA, 20 bp, Artificial Sequence
  chemically synthesized
gcctttgatagacatatttt

SEQ ID NO: 80891 - DNA, 20 bp, Artificial Sequence
  chemically synthesized
agacatattttcagatatta

SEQ ID NO: 80892 - DNA, 20 bp, Artificial Sequence
  chemically synthesized
gacatattttcagatattaa

SEQ ID NO: 80893 - DNA, 20 bp, Artificial Sequence
  chemically synthesized
atgtttaaaagcatatgatt

SEQ ID NO: 80894 - DNA, 20 bp, Artificial Sequence
  chemically synthesized
catgcaattgcaatgtttaa

SEQ ID NO: 80895 - DNA, 20 bp, Artificial Sequence
  chemically synthesized
caattgcatgctttgtaaac

SEQ ID NO: 80896 - DNA, 20 bp, Artificial Sequence
  chemically synthesized
agggttttatctagtttaca

SEQ ID NO: 80897 - DNA, 20 bp, Artificial Sequence
  chemically synthesized
ggagtaaccagggttttatc

SEQ ID NO: 80898 - DNA, 20 bp, Artificial Sequence
  chemically synthesized
ttgtaaactagataaaaccc

SEQ ID NO: 80899 - DNA, 20 bp, Artificial Sequence
  chemically synthesized
cctgttatttggagtaacca

SEQ ID NO: 80900 - DNA, 20 bp, Artificial Sequence
  chemically synthesized
tcctgttatttggagtaacc

SEQ ID NO: 80901 - DNA, 20 bp, Artificial Sequence
  chemically synthesized
ttcctgttatttggagtaac

SEQ ID NO: 80902 - DNA, 20 bp, Artificial Sequence
  chemically synthesized
accctggttactccaaataa

SEQ ID NO: 80903 - DNA, 20 bp, Artificial Sequence
  chemically synthesized
aagctaattcctgttatttg

SEQ ID NO: 80904 - DNA, 20 bp, Artificial Sequence
  chemically synthesized
ccctggttactccaaataac

SEQ ID NO: 80905 - DNA, 20 bp, Artificial Sequence
  chemically synthesized
tgaagctaattcctgttatt

SEQ ID NO: 80906 - DNA, 20 bp, Artificial Sequence
  chemically synthesized
ttactccaaataacaggaat

SEQ ID NO: 80907 - DNA, 20 bp, Artificial Sequence
  chemically synthesized
ataaatctgggttaaatatg

SEQ ID NO: 80908 - DNA, 20 bp, Artificial Sequence
  chemically synthesized
aattagcttcatatttaacc

SEQ ID NO: 80909 - DNA, 20 bp, Artificial Sequence
  chemically synthesized
atttaatccttcataaatct

SEQ ID NO: 80910 - DNA, 20 bp, Artificial Sequence
  chemically synthesized
tatttaatccttcataaatc

SEQ ID NO: 80911 - DNA, 20 bp, Artificial Sequence
  chemically synthesized
atatttaacccagatttatg

SEQ ID NO: 80912 - DNA, 20 bp, Artificial Sequence
  chemically synthesized
tatttaacccagatttatga

SEQ ID NO: 80913 - DNA, 20 bp, Artificial Sequence
  chemically synthesized
ttgatggagaagaaaaaaca

SEQ ID NO: 80914 - DNA, 20 bp, Artificial Sequence
  chemically synthesized
taagtaagcctttgatggag

SEQ ID NO: 80915 - DNA, 20 bp, Artificial Sequence
  chemically synthesized
ttgttttttcttctccatca

SEQ ID NO: 80916 - DNA, 20 bp, Artificial Sequence
  chemically synthesized
tgttttttcttctccatcaa

SEQ ID NO: 80917 - DNA, 20 bp, Artificial Sequence
  chemically synthesized
tattaagtaagcctttgatg

SEQ ID NO: 80918 - DNA, 20 bp, Artificial Sequence
  chemically synthesized
tgtattaagtaagcctttga

SEQ ID NO: 80919 - DNA, 20 bp, Artificial Sequence
  chemically synthesized
aaatgctatgtgtattaagt

SEQ ID NO: 80920 - DNA, 20 bp, Artificial Sequence
  chemically synthesized
gtaaaaatgctatgtgtatt

SEQ ID NO: 80921 - DNA, 20 bp, Artificial Sequence
  chemically synthesized
aaaggcttacttaatacaca

SEQ ID NO: 80922 - DNA, 20 bp, Artificial Sequence
  chemically synthesized
ttttacaacaacaacaatga

SEQ ID NO: 80923 - DNA, 20 bp, Artificial Sequence
  chemically synthesized
caacaatgaaagcctccaca

SEQ ID NO: 80924 - DNA, 20 bp, Artificial Sequence
  chemically synthesized
acaaatgaattgccgtgtgg

SEQ ID NO: 80925 - DNA, 20 bp, Artificial Sequence
  chemically synthesized
tacaaatgaattgccgtgtg

SEQ ID NO: 80926 - DNA, 20 bp, Artificial Sequence
  chemically synthesized
actacaaatgaattgccgtg

SEQ ID NO: 80927 - DNA, 20 bp, Artificial Sequence
  chemically synthesized
tccacacggcaattcatttg

SEQ ID NO: 80928 - DNA, 20 bp, Artificial Sequence
  chemically synthesized
taatgttttgtgcattgtta

SEQ ID NO: 80929 - DNA, 20 bp, Artificial Sequence
  chemically synthesized
atactgcctatagtaggaag

SEQ ID NO: 80930 - DNA, 20 bp, Artificial Sequence
  chemically synthesized
tatactgcctatagtaggaa

SEQ ID NO: 80931 - DNA, 20 bp, Artificial Sequence
  chemically synthesized
aaattttcctcttcctacta

SEQ ID NO: 80932 - DNA, 20 bp, Artificial Sequence
  chemically synthesized
ggtatactgcctatagtagg

SEQ ID NO: 80933 - DNA, 20 bp, Artificial Sequence
  chemically synthesized
aattttcctcttcctactat

SEQ ID NO: 80934 - DNA, 20 bp, Artificial Sequence
  chemically synthesized
taaggtatactgcctatagt

SEQ ID NO: 80935 - DNA, 20 bp, Artificial Sequence
  chemically synthesized
tttcctcttcctactatagg

SEQ ID NO: 80936 - DNA, 20 bp, Artificial Sequence
  chemically synthesized
ataaggtatactgcctatag

SEQ ID NO: 80937 - DNA, 20 bp, Artificial Sequence
  chemically synthesized
tgaataaggtatactgccta

SEQ ID NO: 80938 - DNA, 20 bp, Artificial Sequence
  chemically synthesized
tgatatcttcataatgaata

SEQ ID NO: 80939 - DNA, 20 bp, Artificial Sequence
  chemically synthesized
gtgatatcttcataatgaat

SEQ ID NO: 80940 - DNA, 20 bp, Artificial Sequence
  chemically synthesized
agtataccttattcattatg

SEQ ID NO: 80941 - DNA, 20 bp, Artificial Sequence
  chemically synthesized
attcattatgaagatatcac

SEQ ID NO: 80942 - DNA, 20 bp, Artificial Sequence
  chemically synthesized
gaagatatcacaagtttatt

SEQ ID NO: 80943 - DNA, 20 bp, Artificial Sequence
  chemically synthesized
agatatcacaagtttattca

SEQ ID NO: 80944 - DNA, 20 bp, Artificial Sequence
  chemically synthesized
atcacaagtttattcagagt

SEQ ID NO: 80945 - DNA, 20 bp, Artificial Sequence
  chemically synthesized
tcacaagtttattcagagtt

SEQ ID NO: 80946 - DNA, 20 bp, Artificial Sequence
  chemically synthesized
acaagtttattcagagttgg

SEQ ID NO: 80947 - DNA, 20 bp, Artificial Sequence
  chemically synthesized
aagtttattcagagttggga

SEQ ID NO: 80948 - DNA, 20 bp, Artificial Sequence
  chemically synthesized
aaaaatcattcaaaacatgt

SEQ ID NO: 80949 - DNA, 20 bp, Artificial Sequence
  chemically synthesized
tacatgttttgaatgatttt

SEQ ID NO: 80950 - DNA, 20 bp, Artificial Sequence
  chemically synthesized
acatgttttgaatgattttt

SEQ ID NO: 80951 - DNA, 20 bp, Artificial Sequence
  chemically synthesized
agatagaaccaacatgaaca

SEQ ID NO: 80952 - DNA, 20 bp, Artificial Sequence
  chemically synthesized
cagatagaaccaacatgaac

SEQ ID NO: 80953 - DNA, 20 bp, Artificial Sequence
  chemically synthesized
taggatcgccctgttcatgt

SEQ ID NO: 80954 - DNA, 20 bp, Artificial Sequence
  chemically synthesized
gcagatagaaccaacatgaa

SEQ ID NO: 80955 - DNA, 20 bp, Artificial Sequence
  chemically synthesized
ttaggggatgaatgagcaga

SEQ ID NO: 80956 - DNA, 20 bp, Artificial Sequence
  chemically synthesized
agaattaggggatgaatgag

SEQ ID NO: 80957 - DNA, 20 bp, Artificial Sequence
  chemically synthesized
tatagaattaggggatgaat

SEQ ID NO: 80958 - DNA, 20 bp, Artificial Sequence
  chemically synthesized
atcttttcttatagaattag

SEQ ID NO: 80959 - DNA, 20 bp, Artificial Sequence
  chemically synthesized
tatcttttcttatagaatta

SEQ ID NO: 80960 - DNA, 20 bp, Artificial Sequence
  chemically synthesized
ttatcttttcttatagaatt

SEQ ID NO: 80961 - DNA, 20 bp, Artificial Sequence
  chemically synthesized
cattcatcccctaattctat

SEQ ID NO: 80962 - DNA, 20 bp, Artificial Sequence
  chemically synthesized
cttatcttttcttatagaat

SEQ ID NO: 80963 - DNA, 20 bp, Artificial Sequence
  chemically synthesized
atcccctaattctataagaa

SEQ ID NO: 80964 - DNA, 20 bp, Artificial Sequence
  chemically synthesized
ggaaaacttatcttttctta

SEQ ID NO: 80965 - DNA, 20 bp, Artificial Sequence
  chemically synthesized
ctaattctataagaaaagat

SEQ ID NO: 80966 - DNA, 20 bp, Artificial Sequence
  chemically synthesized
tcttatatatgagttatgta

SEQ ID NO: 80967 - DNA, 20 bp, Artificial Sequence
  chemically synthesized
ttcttatatatgagttatgt

SEQ ID NO: 80968 - DNA, 20 bp, Artificial Sequence
  chemically synthesized
tccttacataactcatatat

SEQ ID NO: 80969 - DNA, 20 bp, Artificial Sequence
  chemically synthesized
ttacttgatttcttatatat

SEQ ID NO: 80970 - DNA, 20 bp, Artificial Sequence
  chemically synthesized
taactcatatataagaaatc

SEQ ID NO: 80971 - DNA, 20 bp, Artificial Sequence
  chemically synthesized
tcatatataagaaatcaagt

SEQ ID NO: 80972 - DNA, 20 bp, Artificial Sequence
  chemically synthesized
catatataagaaatcaagta

SEQ ID NO: 80973 - DNA, 20 bp, Artificial Sequence
  chemically synthesized
gcttcccatttatatgagtc

SEQ ID NO: 80974 - DNA, 20 bp, Artificial Sequence
  chemically synthesized
gttgacttgactcatataaa

SEQ ID NO: 80975 - DNA, 20 bp, Artificial Sequence
  chemically synthesized
gttatgcttcccatttatat

SEQ ID NO: 80976 - DNA, 20 bp, Artificial Sequence
  chemically synthesized
ttgacttgactcatataaat

SEQ ID NO: 80977 - DNA, 20 bp, Artificial Sequence
  chemically synthesized
acttgactcatataaatggg

SEQ ID NO: 80978 - DNA, 20 bp, Artificial Sequence
  chemically synthesized
cataacaaaattaatacaat

SEQ ID NO: 80979 - DNA, 20 bp, Artificial Sequence
  chemically synthesized
aacaaaattaatacaataag

SEQ ID NO: 80980 - DNA, 20 bp, Artificial Sequence
  chemically synthesized
atacaataagaagaaaactt

SEQ ID NO: 80981 - DNA, 20 bp, Artificial Sequence
  chemically synthesized
aagaagaaaactttagaacc

SEQ ID NO: 80982 - DNA, 20 bp, Artificial Sequence
  chemically synthesized
tcttcttaaccttggttcta

SEQ ID NO: 80983 - DNA, 20 bp, Artificial Sequence
  chemically synthesized
agaagaaaactttagaacca

SEQ ID NO: 80984 - DNA, 20 bp, Artificial Sequence
  chemically synthesized
aaaactttagaaccaaggtt

SEQ ID NO: 80985 - DNA, 20 bp, Artificial Sequence
  chemically synthesized
tgcttttctcttcttaacct

SEQ ID NO: 80986 - DNA, 20 bp, Artificial Sequence
  chemically synthesized
actttagaaccaaggttaag

SEQ ID NO: 80987 - DNA, 20 bp, Artificial Sequence
  chemically synthesized
tttagaaccaaggttaagaa

SEQ ID NO: 80988 - DNA, 20 bp, Artificial Sequence
  chemically synthesized
aaccaaggttaagaagagaa

SEQ ID NO: 80989 - DNA, 20 bp, Artificial Sequence
  chemically synthesized
gttaagaagagaaaagcaat

SEQ ID NO: 80990 - DNA, 20 bp, Artificial Sequence
  chemically synthesized
ttaagaagagaaaagcaata

SEQ ID NO: 80991 - DNA, 20 bp, Artificial Sequence
  chemically synthesized
taagaagagaaaagcaataa

SEQ ID NO: 80992 - DNA, 20 bp, Artificial Sequence
  chemically synthesized
gaagagaaaagcaataaggg

SEQ ID NO: 80993 - DNA, 20 bp, Artificial Sequence
  chemically synthesized
agaaaagcaataagggaaga

SEQ ID NO: 80994 - DNA, 20 bp, Artificial Sequence
  chemically synthesized
ggaagatagttgcatgaaca

SEQ ID NO: 80995 - DNA, 20 bp, Artificial Sequence
  chemically synthesized
agttgcatgaacatggttgc

SEQ ID NO: 80996 - DNA, 20 bp, Artificial Sequence
  chemically synthesized
tcatcttcactttggcaagc

SEQ ID NO: 80997 - DNA, 20 bp, Artificial Sequence
  chemically synthesized
tgcaagtatcttgcttgcca

SEQ ID NO: 80998 - DNA, 20 bp, Artificial Sequence
  chemically synthesized
aatttcatcttcactttggc

SEQ ID NO: 80999 - DNA, 20 bp, Artificial Sequence
  chemically synthesized
gtatcttgcttgccaaagtg

SEQ ID NO: 81000 - DNA, 20 bp, Artificial Sequence
  chemically synthesized
ttagaatttcatcttcactt

SEQ ID NO: 81001 - DNA, 20 bp, Artificial Sequence
  chemically synthesized
tgaaatgtgatataatgtat

SEQ ID NO: 81002 - DNA, 20 bp, Artificial Sequence
  chemically synthesized
cacatttcacattatctatt

SEQ ID NO: 81003 - DNA, 20 bp, Artificial Sequence
  chemically synthesized
catttcacattatctattca

SEQ ID NO: 81004 - DNA, 20 bp, Artificial Sequence
  chemically synthesized
atttcacattatctattcag

SEQ ID NO: 81005 - DNA, 20 bp, Artificial Sequence
  chemically synthesized
ccaagcatatttcctctgaa

SEQ ID NO: 81006 - DNA, 20 bp, Artificial Sequence
  chemically synthesized
ctattcagaggaaatatgct

SEQ ID NO: 81007 - DNA, 20 bp, Artificial Sequence
  chemically synthesized
aatttgacattgaggaagcc

SEQ ID NO: 81008 - DNA, 20 bp, Artificial Sequence
  chemically synthesized
gttagaatttgacattgagg

SEQ ID NO: 81009 - DNA, 20 bp, Artificial Sequence
  chemically synthesized
tatgttagaatttgacattg

SEQ ID NO: 81010 - DNA, 20 bp, Artificial Sequence
  chemically synthesized
ctatgttagaatttgacatt

SEQ ID NO: 81011 - DNA, 20 bp, Artificial Sequence
  chemically synthesized
ctcaatgtcaaattctaaca

SEQ ID NO: 81012 - DNA, 20 bp, Artificial Sequence
  chemically synthesized
ttgtcaaagaaacgctatgt

SEQ ID NO: 81013 - DNA, 20 bp, Artificial Sequence
  chemically synthesized
tttttttgagaaatttgtca

SEQ ID NO: 81014 - DNA, 20 bp, Artificial Sequence
  chemically synthesized
ctgtggctttgggttttttt

SEQ ID NO: 81015 - DNA, 20 bp, Artificial Sequence
  chemically synthesized
aaatttctcaaaaaaaccca

SEQ ID NO: 81016 - DNA, 20 bp, Artificial Sequence
  chemically synthesized
ctcaaaaaaacccaaagcca

SEQ ID NO: 81017 - DNA, 20 bp, Artificial Sequence
  chemically synthesized
tcctcagtccctgtggcttt

SEQ ID NO: 81018 - DNA, 20 bp, Artificial Sequence
  chemically synthesized
tcaaaaaaacccaaagccac

SEQ ID NO: 81019 - DNA, 20 bp, Artificial Sequence
  chemically synthesized
atcctcagtccctgtggctt

SEQ ID NO: 81020 - DNA, 20 bp, Artificial Sequence
  chemically synthesized
caaaaaaacccaaagccaca

SEQ ID NO: 81021 - DNA, 20 bp, Artificial Sequence
  chemically synthesized
cttaccatcctcagtccctg

SEQ ID NO: 81022 - DNA, 20 bp, Artificial Sequence
  chemically synthesized
aacccaaagccacagggact

SEQ ID NO: 81023 - DNA, 20 bp, Artificial Sequence
  chemically synthesized
acccaaagccacagggactg

SEQ ID NO: 81024 - DNA, 20 bp, Artificial Sequence
  chemically synthesized
aaagccacagggactgagga

SEQ ID NO: 81025 - DNA, 20 bp, Artificial Sequence
  chemically synthesized
ctttttaggcttaccatcct

SEQ ID NO: 81026 - DNA, 20 bp, Artificial Sequence
  chemically synthesized
ccacagggactgaggatggt

SEQ ID NO: 81027 - DNA, 20 bp, Artificial Sequence
  chemically synthesized
ctgaggatggtaagcctaaa

SEQ ID NO: 81028 - DNA, 20 bp, Artificial Sequence
  chemically synthesized
tgaggatggtaagcctaaaa

SEQ ID NO: 81029 - DNA, 20 bp, Artificial Sequence
  chemically synthesized
ggatggtaagcctaaaaagg

SEQ ID NO: 81030 - DNA, 20 bp, Artificial Sequence
  chemically synthesized
actggcaaatccaccttttt

SEQ ID NO: 81031 - DNA, 20 bp, Artificial Sequence
  chemically synthesized
aactggcaaatccacctttt

SEQ ID NO: 81032 - DNA, 20 bp, Artificial Sequence
  chemically synthesized
gcctaaaaaggtggatttgc

SEQ ID NO: 81033 - DNA, 20 bp, Artificial Sequence
  chemically synthesized
taaagttttaagaagaaaac

SEQ ID NO: 81034 - DNA, 20 bp, Artificial Sequence
  chemically synthesized
ttcacatctaaagttttaag

SEQ ID NO: 81035 - DNA, 20 bp, Artificial Sequence
  chemically synthesized
cagttttcttcttaaaactt

SEQ ID NO: 81036 - DNA, 20 bp, Artificial Sequence
  chemically synthesized
gcattcacatctaaagtttt

SEQ ID NO: 81037 - DNA, 20 bp, Artificial Sequence
  chemically synthesized
atcttcagcattcacatcta

SEQ ID NO: 81038 - DNA, 20 bp, Artificial Sequence
  chemically synthesized
aactttagatgtgaatgctg

SEQ ID NO: 81039 - DNA, 20 bp, Artificial Sequence
  chemically synthesized
atgccatccttatttatctt

SEQ ID NO: 81040 - DNA, 20 bp, Artificial Sequence
  chemically synthesized
tgtgaatgctgaagataaat

SEQ ID NO: 81041 - DNA, 20 bp, Artificial Sequence
  chemically synthesized
gtgaatgctgaagataaata

SEQ ID NO: 81042 - DNA, 20 bp, Artificial Sequence
  chemically synthesized
atgctgaagataaataagga

SEQ ID NO: 81043 - DNA, 20 bp, Artificial Sequence
  chemically synthesized
gtaggctagaaattatgatg

SEQ ID NO: 81044 - DNA, 20 bp, Artificial Sequence
  chemically synthesized
cgtcacttcatcataatttc

SEQ ID NO: 81045 - DNA, 20 bp, Artificial Sequence
  chemically synthesized
taatgatgtgtgtagtaggc

SEQ ID NO: 81046 - DNA, 20 bp, Artificial Sequence
  chemically synthesized
gatttaatgatgtgtgtagt

SEQ ID NO: 81047 - DNA, 20 bp, Artificial Sequence
  chemically synthesized
tgatttaatgatgtgtgtag

SEQ ID NO: 81048 - DNA, 20 bp, Artificial Sequence
  chemically synthesized
gattgatttaatgatgtgtg

SEQ ID NO: 81049 - DNA, 20 bp, Artificial Sequence
  chemically synthesized
ccttttttggcattcaaatt

SEQ ID NO: 81050 - DNA, 20 bp, Artificial Sequence
  chemically synthesized
tctcaatttgaatgccaaaa

SEQ ID NO: 81051 - DNA, 20 bp, Artificial Sequence
  chemically synthesized
ctcaatttgaatgccaaaaa

SEQ ID NO: 81052 - DNA, 20 bp, Artificial Sequence
  chemically synthesized
tgttttgattaaaccttttt

SEQ ID NO: 81053 - DNA, 20 bp, Artificial Sequence
  chemically synthesized
ttaatcaaaacatttcattg

SEQ ID NO: 81054 - DNA, 20 bp, Artificial Sequence
  chemically synthesized
taatcaaaacatttcattgt

SEQ ID NO: 81055 - DNA, 20 bp, Artificial Sequence
  chemically synthesized
atttcattgtaggaacttta

SEQ ID NO: 81056 - DNA, 20 bp, Artificial Sequence
  chemically synthesized
ttctatgagttttttcttta

SEQ ID NO: 81057 - DNA, 20 bp, Artificial Sequence
  chemically synthesized
aactttaaagaaaaaactca

SEQ ID NO: 81058 - DNA, 20 bp, Artificial Sequence
  chemically synthesized
agtcagggcagggattctat

SEQ ID NO: 81059 - DNA, 20 bp, Artificial Sequence
  chemically synthesized
tactgtgaaaagtcagggca

SEQ ID NO: 81060 - DNA, 20 bp, Artificial Sequence
  chemically synthesized
ttactgtgaaaagtcagggc

SEQ ID NO: 81061 - DNA, 20 bp, Artificial Sequence
  chemically synthesized
cttactgtgaaaagtcaggg

SEQ ID NO: 81062 - DNA, 20 bp, Artificial Sequence
  chemically synthesized
tttcttactgtgaaaagtca

SEQ ID NO: 81063 - DNA, 20 bp, Artificial Sequence
  chemically synthesized
atttcttactgtgaaaagtc

SEQ ID NO: 81064 - DNA, 20 bp, Artificial Sequence
  chemically synthesized
catttcttactgtgaaaagt

SEQ ID NO: 81065 - DNA, 20 bp, Artificial Sequence
  chemically synthesized
atccctgccctgacttttca

SEQ ID NO: 81066 - DNA, 20 bp, Artificial Sequence
  chemically synthesized
cttgcatttcttactgtgaa

SEQ ID NO: 81067 - DNA, 20 bp, Artificial Sequence
  chemically synthesized
ctgccctgacttttcacagt

SEQ ID NO: 81068 - DNA, 20 bp, Artificial Sequence
  chemically synthesized
cttttcacagtaagaaatgc

SEQ ID NO: 81069 - DNA, 20 bp, Artificial Sequence
  chemically synthesized
cagtaagaaatgcaagttaa

SEQ ID NO: 81070 - DNA, 20 bp, Artificial Sequence
  chemically synthesized
atgcgatatgcataactaca

SEQ ID NO: 81071 - DNA, 20 bp, Artificial Sequence
  chemically synthesized
gcaaatctgtcgcatctatg

SEQ ID NO: 81072 - DNA, 20 bp, Artificial Sequence
  chemically synthesized
gcataactacatagatgcga

SEQ ID NO: 81073 - DNA, 20 bp, Artificial Sequence
  chemically synthesized
gcgacagatttgcatattcc

SEQ ID NO: 81074 - DNA, 20 bp, Artificial Sequence
  chemically synthesized
cagatttgcatattccaaga

SEQ ID NO: 81075 - DNA, 20 bp, Artificial Sequence
  chemically synthesized
atttgcatattccaagatgg

SEQ ID NO: 81076 - DNA, 20 bp, Artificial Sequence
  chemically synthesized
actctcccaggctgccatct

SEQ ID NO: 81077 - DNA, 20 bp, Artificial Sequence
  chemically synthesized
catattccaagatggcagcc

SEQ ID NO: 81078 - DNA, 20 bp, Artificial Sequence
  chemically synthesized
atattccaagatggcagcct

SEQ ID NO: 81079 - DNA, 20 bp, Artificial Sequence
  chemically synthesized
attccaagatggcagcctgg

SEQ ID NO: 81080 - DNA, 20 bp, Artificial Sequence
  chemically synthesized
tccaagatggcagcctggga

SEQ ID NO: 81081 - DNA, 20 bp, Artificial Sequence
  chemically synthesized
acactgtaaataactctccc

SEQ ID NO: 81082 - DNA, 20 bp, Artificial Sequence
  chemically synthesized
tacactgtaaataactctcc

SEQ ID NO: 81083 - DNA, 20 bp, Artificial Sequence
  chemically synthesized
cagcctgggagagttattta

SEQ ID NO: 81084 - DNA, 20 bp, Artificial Sequence
  chemically synthesized
agtgtatgaaaaactgtgtt

SEQ ID NO: 81085 - DNA, 20 bp, Artificial Sequence
  chemically synthesized
tgtatgaaaaactgtgttca

SEQ ID NO: 81086 - DNA, 20 bp, Artificial Sequence
  chemically synthesized
ttacctgttgactctgaaca

SEQ ID NO: 81087 - DNA, 20 bp, Artificial Sequence
  chemically synthesized
aaaactgtgttcagagtcaa

SEQ ID NO: 81088 - DNA, 20 bp, Artificial Sequence
  chemically synthesized
aaactgtgttcagagtcaac

SEQ ID NO: 81089 - DNA, 20 bp, Artificial Sequence
  chemically synthesized
tcagagtcaacaggtaaact

SEQ ID NO: 81090 - DNA, 20 bp, Artificial Sequence
  chemically synthesized
gtcaacaggtaaactaagaa

SEQ ID NO: 81091 - DNA, 20 bp, Artificial Sequence
  chemically synthesized
caggaatatttcactgttct

SEQ ID NO: 81092 - DNA, 20 bp, Artificial Sequence
  chemically synthesized
taagaacagtgaaatattcc

SEQ ID NO: 81093 - DNA, 20 bp, Artificial Sequence
  chemically synthesized
cagtgaaatattcctggctc

SEQ ID NO: 81094 - DNA, 20 bp, Artificial Sequence
  chemically synthesized
tggtatgtccttcttgagcc

SEQ ID NO: 81095 - DNA, 20 bp, Artificial Sequence
  chemically synthesized
tgaaatattcctggctcaag

SEQ ID NO: 81096 - DNA, 20 bp, Artificial Sequence
  chemically synthesized
gtggtatgtccttcttgagc

SEQ ID NO: 81097 - DNA, 20 bp, Artificial Sequence
  chemically synthesized
gaaatattcctggctcaaga

SEQ ID NO: 81098 - DNA, 20 bp, Artificial Sequence
  chemically synthesized
aaaagtggtatgtccttctt

SEQ ID NO: 81099 - DNA, 20 bp, Artificial Sequence
  chemically synthesized
caagaaggacataccacttt

SEQ ID NO: 81100 - DNA, 20 bp, Artificial Sequence
  chemically synthesized
tagtttctctgtaccaaaag

SEQ ID NO: 81101 - DNA, 20 bp, Artificial Sequence
  chemically synthesized
aggacataccacttttggta

SEQ ID NO: 81102 - DNA, 20 bp, Artificial Sequence
  chemically synthesized
ccatagtttctctgtaccaa

SEQ ID NO: 81103 - DNA, 20 bp, Artificial Sequence
  chemically synthesized
gacataccacttttggtaca

SEQ ID NO: 81104 - DNA, 20 bp, Artificial Sequence
  chemically synthesized
cttttggtacagagaaacta

SEQ ID NO: 81105 - DNA, 20 bp, Artificial Sequence
  chemically synthesized
tacagagaaactatggttta

SEQ ID NO: 81106 - DNA, 20 bp, Artificial Sequence
  chemically synthesized
tgcgcccagactataaacca

SEQ ID NO: 81107 - DNA, 20 bp, Artificial Sequence
  chemically synthesized
agaaactatggtttatagtc

SEQ ID NO: 81108 - DNA, 20 bp, Artificial Sequence
  chemically synthesized
gaaactatggtttatagtct

SEQ ID NO: 81109 - DNA, 20 bp, Artificial Sequence
  chemically synthesized
tatggtttatagtctgggcg

SEQ ID NO: 81110 - DNA, 20 bp, Artificial Sequence
  chemically synthesized
ggtttatagtctgggcgcag

SEQ ID NO: 81111 - DNA, 20 bp, Artificial Sequence
  chemically synthesized
caggcgtgagccactgcgcc

SEQ ID NO: 81112 - DNA, 20 bp, Artificial Sequence
  chemically synthesized
agtgctgggattacaggcgt

SEQ ID NO: 81113 - DNA, 20 bp, Artificial Sequence
  chemically synthesized
gtggctcacgcctgtaatcc

SEQ ID NO: 81114 - DNA, 20 bp, Artificial Sequence
  chemically synthesized
tcccaaagtgctgggattac

SEQ ID NO: 81115 - DNA, 20 bp, Artificial Sequence
  chemically synthesized
ctcccaaagtgctgggatta

SEQ ID NO: 81116 - DNA, 20 bp, Artificial Sequence
  chemically synthesized
cgcctgtaatcccagcactt

SEQ ID NO: 81117 - DNA, 20 bp, Artificial Sequence
  chemically synthesized
ccttggcctcccaaagtgct

SEQ ID NO: 81118 - DNA, 20 bp, Artificial Sequence
  chemically synthesized
gcctgtaatcccagcacttt

SEQ ID NO: 81119 - DNA, 20 bp, Artificial Sequence
  chemically synthesized
accttggcctcccaaagtgc

SEQ ID NO: 81120 - DNA, 20 bp, Artificial Sequence
  chemically synthesized
ctgtaatcccagcactttgg

SEQ ID NO: 81121 - DNA, 20 bp, Artificial Sequence
  chemically synthesized
tgtaatcccagcactttggg

SEQ ID NO: 81122 - DNA, 20 bp, Artificial Sequence
  chemically synthesized
ccgttcaccttggcctccca

SEQ ID NO: 81123 - DNA, 20 bp, Artificial Sequence
  chemically synthesized
tcccagcactttgggaggcc

SEQ ID NO: 81124 - DNA, 20 bp, Artificial Sequence
  chemically synthesized
cccagcactttgggaggcca

SEQ ID NO: 81125 - DNA, 20 bp, Artificial Sequence
  chemically synthesized
ctttgggaggccaaggtgaa

SEQ ID NO: 81126 - DNA, 20 bp, Artificial Sequence
  chemically synthesized
ctcaggtgatccgttcacct

SEQ ID NO: 81127 - DNA, 20 bp, Artificial Sequence
  chemically synthesized
ccaaggtgaacggatcacct

SEQ ID NO: 81128 - DNA, 20 bp, Artificial Sequence
  chemically synthesized
caaggtgaacggatcacctg

SEQ ID NO: 81129 - DNA, 20 bp, Artificial Sequence
  chemically synthesized
gtgaacggatcacctgaggt

SEQ ID NO: 81130 - DNA, 20 bp, Artificial Sequence
  chemically synthesized
ggtctcgaacttctgacctc

SEQ ID NO: 81131 - DNA, 20 bp, Artificial Sequence
  chemically synthesized
aacggatcacctgaggtcag

SEQ ID NO: 81132 - DNA, 20 bp, Artificial Sequence
  chemically synthesized
tggtctcgaacttctgacct

SEQ ID NO: 81133 - DNA, 20 bp, Artificial Sequence
  chemically synthesized
tcacctgaggtcagaagttc

SEQ ID NO: 81134 - DNA, 20 bp, Artificial Sequence
  chemically synthesized
tgaggtcagaagttcgagac

SEQ ID NO: 81135 - DNA, 20 bp, Artificial Sequence
  chemically synthesized
tcagaagttcgagaccagcc

SEQ ID NO: 81136 - DNA, 20 bp, Artificial Sequence
  chemically synthesized
tttcaccacgttggccaggc

SEQ ID NO: 81137 - DNA, 20 bp, Artificial Sequence
  chemically synthesized
ggggtttcaccacgttggcc

SEQ ID NO: 81138 - DNA, 20 bp, Artificial Sequence
  chemically synthesized
cgagaccagcctggccaacg

SEQ ID NO: 81139 - DNA, 20 bp, Artificial Sequence
  chemically synthesized
tggggtttcaccacgttggc

SEQ ID NO: 81140 - DNA, 20 bp, Artificial Sequence
  chemically synthesized
gagatggggtttcaccacgt

SEQ ID NO: 81141 - DNA, 20 bp, Artificial Sequence
  chemically synthesized
tggattttttagtagagatg

SEQ ID NO: 81142 - DNA, 20 bp, Artificial Sequence
  chemically synthesized
ttggattttttagtagagat

SEQ ID NO: 81143 - DNA, 20 bp, Artificial Sequence
  chemically synthesized
tttggattttttagtagaga

SEQ ID NO: 81144 - DNA, 20 bp, Artificial Sequence
  chemically synthesized
tttttttggattttttagta

SEQ ID NO: 81145 - DNA, 20 bp, Artificial Sequence
  chemically synthesized
tttttttttggattttttag

SEQ ID NO: 81146 - DNA, 20 bp, Artificial Sequence
  chemically synthesized
ttttttttttttggattttt

SEQ ID NO: 81147 - DNA, 20 bp, Artificial Sequence
  chemically synthesized
gctaattttttttttttttt

SEQ ID NO: 81148 - DNA, 20 bp, Artificial Sequence
  chemically synthesized
tccaaaaaaaaaaaaaaaat

SEQ ID NO: 81149 - DNA, 20 bp, Artificial Sequence
  chemically synthesized
aaaaaaaaaaaaaaattagc

SEQ ID NO: 81150 - DNA, 20 bp, Artificial Sequence
  chemically synthesized
aaaaaaaaaaaaaattagcc

SEQ ID NO: 81151 - DNA, 20 bp, Artificial Sequence
  chemically synthesized
aaaaaaaaattagccaggcg

SEQ ID NO: 81152 - DNA, 20 bp, Artificial Sequence
  chemically synthesized
aaaaaattagccaggcgtgg

SEQ ID NO: 81153 - DNA, 20 bp, Artificial Sequence
  chemically synthesized
cagacatgtgccaccacgcc

SEQ ID NO: 81154 - DNA, 20 bp, Artificial Sequence
  chemically synthesized
gtggcacatgtctgtaatcc

SEQ ID NO: 81155 - DNA, 20 bp, Artificial Sequence
  chemically synthesized
ctcctgagtagctgggatta

SEQ ID NO: 81156 - DNA, 20 bp, Artificial Sequence
  chemically synthesized
tgtctgtaatcccagctact

SEQ ID NO: 81157 - DNA, 20 bp, Artificial Sequence
  chemically synthesized
cctcagcctcctgagtagct

SEQ ID NO: 81158 - DNA, 20 bp, Artificial Sequence
  chemically synthesized
gtctgtaatcccagctactc

SEQ ID NO: 81159 - DNA, 20 bp, Artificial Sequence
  chemically synthesized
gcctcagcctcctgagtagc

SEQ ID NO: 81160 - DNA, 20 bp, Artificial Sequence
  chemically synthesized
ctgtaatcccagctactcag

SEQ ID NO: 81161 - DNA, 20 bp, Artificial Sequence
  chemically synthesized
tgtaatcccagctactcagg

SEQ ID NO: 81162 - DNA, 20 bp, Artificial Sequence
  chemically synthesized
ctctgcctcagcctcctgag

SEQ ID NO: 81163 - DNA, 20 bp, Artificial Sequence
  chemically synthesized
attctctgcctcagcctcct

SEQ ID NO: 81164 - DNA, 20 bp, Artificial Sequence
  chemically synthesized
tcccagctactcaggaggct

SEQ ID NO: 81165 - DNA, 20 bp, Artificial Sequence
  chemically synthesized
cccagctactcaggaggctg

SEQ ID NO: 81166 - DNA, 20 bp, Artificial Sequence
  chemically synthesized
agctactcaggaggctgagg

SEQ ID NO: 81167 - DNA, 20 bp, Artificial Sequence
  chemically synthesized
ctactcaggaggctgaggca

SEQ ID NO: 81168 - DNA, 20 bp, Artificial Sequence
  chemically synthesized
gttcaagcaattctctgcct

SEQ ID NO: 81169 - DNA, 20 bp, Artificial Sequence
  chemically synthesized
ggcagagaattgcttgaacc

SEQ ID NO: 81170 - DNA, 20 bp, Artificial Sequence
  chemically synthesized
gcagagaattgcttgaaccc

SEQ ID NO: 81171 - DNA, 20 bp, Artificial Sequence
  chemically synthesized
aacctccgcctcctgggttc

SEQ ID NO: 81172 - DNA, 20 bp, Artificial Sequence
  chemically synthesized
agagaattgcttgaacccag

SEQ ID NO: 81173 - DNA, 20 bp, Artificial Sequence
  chemically synthesized
gagaattgcttgaacccagg

SEQ ID NO: 81174 - DNA, 20 bp, Artificial Sequence
  chemically synthesized
aattgcttgaacccaggagg

SEQ ID NO: 81175 - DNA, 20 bp, Artificial Sequence
  chemically synthesized
cactgcaacctccgcctcct

SEQ ID NO: 81176 - DNA, 20 bp, Artificial Sequence
  chemically synthesized
ttgcttgaacccaggaggcg

SEQ ID NO: 81177 - DNA, 20 bp, Artificial Sequence
  chemically synthesized
tcactgcaacctccgcctcc

SEQ ID NO: 81178 - DNA, 20 bp, Artificial Sequence
  chemically synthesized
tgcttgaacccaggaggcgg

SEQ ID NO: 81179 - DNA, 20 bp, Artificial Sequence
  chemically synthesized
aacccaggaggcggaggttg

SEQ ID NO: 81180 - DNA, 20 bp, Artificial Sequence
  chemically synthesized
caggaggcggaggttgcagt

SEQ ID NO: 81181 - DNA, 20 bp, Artificial Sequence
  chemically synthesized
ggcggaggttgcagtgagcc

SEQ ID NO: 81182 - DNA, 20 bp, Artificial Sequence
  chemically synthesized
gaggttgcagtgagccgaga

SEQ ID NO: 81183 - DNA, 20 bp, Artificial Sequence
  chemically synthesized
ggagtgcagtggtgctgtct

SEQ ID NO: 81184 - DNA, 20 bp, Artificial Sequence
  chemically synthesized
tcacccaggctggagtgcag

SEQ ID NO: 81185 - DNA, 20 bp, Artificial Sequence
  chemically synthesized
gagacagcaccactgcactc

SEQ ID NO: 81186 - DNA, 20 bp, Artificial Sequence
  chemically synthesized
ctgtcacccaggctggagtg

SEQ ID NO: 81187 - DNA, 20 bp, Artificial Sequence
  chemically synthesized
agcaccactgcactccagcc

SEQ ID NO: 81188 - DNA, 20 bp, Artificial Sequence
  chemically synthesized
gcaccactgcactccagcct

SEQ ID NO: 81189 - DNA, 20 bp, Artificial Sequence
  chemically synthesized
tcactctgtcacccaggctg

SEQ ID NO: 81190 - DNA, 20 bp, Artificial Sequence
  chemically synthesized
tctcactctgtcacccaggc

SEQ ID NO: 81191 - DNA, 20 bp, Artificial Sequence
  chemically synthesized
ctgcactccagcctgggtga

SEQ ID NO: 81192 - DNA, 20 bp, Artificial Sequence
  chemically synthesized
acagtctcactctgtcaccc

SEQ ID NO: 81193 - DNA, 20 bp, Artificial Sequence
  chemically synthesized
gcactccagcctgggtgaca

SEQ ID NO: 81194 - DNA, 20 bp, Artificial Sequence
  chemically synthesized
gacagtctcactctgtcacc

SEQ ID NO: 81195 - DNA, 20 bp, Artificial Sequence
  chemically synthesized
tccagcctgggtgacagagt

SEQ ID NO: 81196 - DNA, 20 bp, Artificial Sequence
  chemically synthesized
taatttttttttttttgaga

SEQ ID NO: 81197 - DNA, 20 bp, Artificial Sequence
  chemically synthesized
tttttaattttttttttttt

SEQ ID NO: 81198 - DNA, 20 bp, Artificial Sequence
  chemically synthesized
aaaaaaaaaaaaattaaaaa

SEQ ID NO: 81199 - DNA, 20 bp, Artificial Sequence
  chemically synthesized
aaaaaaaaaaattaaaaaaa

SEQ ID NO: 81200 - DNA, 20 bp, Artificial Sequence
  chemically synthesized
aattaaaaaaagagaaacca

SEQ ID NO: 81201 - DNA, 20 bp, Artificial Sequence
  chemically synthesized
gtttttgttttaataaacca

SEQ ID NO: 81202 - DNA, 20 bp, Artificial Sequence
  chemically synthesized
aaaaacaaaacattaaaaaa

SEQ ID NO: 81203 - DNA, 20 bp, Artificial Sequence
  chemically synthesized
aacattaaaaaacagcaatc

SEQ ID NO: 81204 - DNA, 20 bp, Artificial Sequence
  chemically synthesized
ttaaaaaacagcaatctggc

SEQ ID NO: 81205 - DNA, 20 bp, Artificial Sequence
  chemically synthesized
taaaaaacagcaatctggcc

SEQ ID NO: 81206 - DNA, 20 bp, Artificial Sequence
  chemically synthesized
aaaaacagcaatctggccgg

SEQ ID NO: 81207 - DNA, 20 bp, Artificial Sequence
  chemically synthesized
cgtgagccaccgctcccggc

SEQ ID NO: 81208 - DNA, 20 bp, Artificial Sequence
  chemically synthesized
aacagcaatctggccgggag

SEQ ID NO: 81209 - DNA, 20 bp, Artificial Sequence
  chemically synthesized
agcaatctggccgggagcgg

SEQ ID NO: 81210 - DNA, 20 bp, Artificial Sequence
  chemically synthesized
caggcgtgagccaccgctcc

SEQ ID NO: 81211 - DNA, 20 bp, Artificial Sequence
  chemically synthesized
agtgctgggattacaggcgt

SEQ ID NO: 81212 - DNA, 20 bp, Artificial Sequence
  chemically synthesized
gtggctcacgcctgtaatcc

SEQ ID NO: 81213 - DNA, 20 bp, Artificial Sequence
  chemically synthesized
tcccaaagtgctgggattac

SEQ ID NO: 81214 - DNA, 20 bp, Artificial Sequence
  chemically synthesized
ctcccaaagtgctgggatta

SEQ ID NO: 81215 - DNA, 20 bp, Artificial Sequence
  chemically synthesized
cgcctgtaatcccagcactt

SEQ ID NO: 81216 - DNA, 20 bp, Artificial Sequence
  chemically synthesized
ccttggcctcccaaagtgct

SEQ ID NO: 81217 - DNA, 20 bp, Artificial Sequence
  chemically synthesized
gcctgtaatcccagcacttt

SEQ ID NO: 81218 - DNA, 20 bp, Artificial Sequence
  chemically synthesized
accttggcctcccaaagtgc

SEQ ID NO: 81219 - DNA, 20 bp, Artificial Sequence
  chemically synthesized
ctgtaatcccagcactttgg

SEQ ID NO: 81220 - DNA, 20 bp, Artificial Sequence
  chemically synthesized
tgtaatcccagcactttggg

SEQ ID NO: 81221 - DNA, 20 bp, Artificial Sequence
  chemically synthesized
ccgcccaccttggcctccca

SEQ ID NO: 81222 - DNA, 20 bp, Artificial Sequence
  chemically synthesized
tcccagcactttgggaggcc

SEQ ID NO: 81223 - DNA, 20 bp, Artificial Sequence
  chemically synthesized
cccagcactttgggaggcca

SEQ ID NO: 81224 - DNA, 20 bp, Artificial Sequence
  chemically synthesized
agcactttgggaggccaagg

SEQ ID NO: 81225 - DNA, 20 bp, Artificial Sequence
  chemically synthesized
gcactttgggaggccaaggt

SEQ ID NO: 81226 - DNA, 20 bp, Artificial Sequence
  chemically synthesized
ctttgggaggccaaggtggg

SEQ ID NO: 81227 - DNA, 20 bp, Artificial Sequence
  chemically synthesized
atctcgtgatccgcccacct

SEQ ID NO: 81228 - DNA, 20 bp, Artificial Sequence
  chemically synthesized
ggccaaggtgggcggatcac

SEQ ID NO: 81229 - DNA, 20 bp, Artificial Sequence
  chemically synthesized
ggtgggcggatcacgagatc

SEQ ID NO: 81230 - DNA, 20 bp, Artificial Sequence
  chemically synthesized
tgggcggatcacgagatcaa

SEQ ID NO: 81231 - DNA, 20 bp, Artificial Sequence
  chemically synthesized
gatcacgagatcaagagatc

SEQ ID NO: 81232 - DNA, 20 bp, Artificial Sequence
  chemically synthesized
tcaagagatcaagaccatcc

SEQ ID NO: 81233 - DNA, 20 bp, Artificial Sequence
  chemically synthesized
tttcaccatgttggccagga

SEQ ID NO: 81234 - DNA, 20 bp, Artificial Sequence
  chemically synthesized
ggggtttcaccatgttggcc

SEQ ID NO: 81235 - DNA, 20 bp, Artificial Sequence
  chemically synthesized
caagaccatcctggccaaca

SEQ ID NO: 81236 - DNA, 20 bp, Artificial Sequence
  chemically synthesized
cggggtttcaccatgttggc

SEQ ID NO: 81237 - DNA, 20 bp, Artificial Sequence
  chemically synthesized
gagacggggtttcaccatgt

SEQ ID NO: 81238 - DNA, 20 bp, Artificial Sequence
  chemically synthesized
ttgtaattttagtagagacg

SEQ ID NO: 81239 - DNA, 20 bp, Artificial Sequence
  chemically synthesized
tttgtaattttagtagagac

SEQ ID NO: 81240 - DNA, 20 bp, Artificial Sequence
  chemically synthesized
ttttgtaattttagtagaga

SEQ ID NO: 81241 - DNA, 20 bp, Artificial Sequence
  chemically synthesized
tgatttttgtaattttagta

SEQ ID NO: 81242 - DNA, 20 bp, Artificial Sequence
  chemically synthesized
gctgatttttgtaattttag

SEQ ID NO: 81243 - DNA, 20 bp, Artificial Sequence
  chemically synthesized
ccagctgatttttgtaattt

SEQ ID NO: 81244 - DNA, 20 bp, Artificial Sequence
  chemically synthesized
tctactaaaattacaaaaat

SEQ ID NO: 81245 - DNA, 20 bp, Artificial Sequence
  chemically synthesized
ctaaaattacaaaaatcagc

SEQ ID NO: 81246 - DNA, 20 bp, Artificial Sequence
  chemically synthesized
taaaattacaaaaatcagct

SEQ ID NO: 81247 - DNA, 20 bp, Artificial Sequence
  chemically synthesized
ttacaaaaatcagctgggcg

SEQ ID NO: 81248 - DNA, 20 bp, Artificial Sequence
  chemically synthesized
caaaaatcagctgggcgtgg

SEQ ID NO: 81249 - DNA, 20 bp, Artificial Sequence
  chemically synthesized
caggcgcgcaccaccacgcc

SEQ ID NO: 81250 - DNA, 20 bp, Artificial Sequence
  chemically synthesized
ggcgtggtggtgcgcgcctg

SEQ ID NO: 81251 - DNA, 20 bp, Artificial Sequence
  chemically synthesized
gtggtgcgcgcctgtagtcc

SEQ ID NO: 81252 - DNA, 20 bp, Artificial Sequence
  chemically synthesized
tcctgagtagctgggactac

SEQ ID NO: 81253 - DNA, 20 bp, Artificial Sequence
  chemically synthesized
ctcctgagtagctgggacta

SEQ ID NO: 81254 - DNA, 20 bp, Artificial Sequence
  chemically synthesized
cgcctgtagtcccagctact

SEQ ID NO: 81255 - DNA, 20 bp, Artificial Sequence
  chemically synthesized
cctcagcctcctgagtagct

SEQ ID NO: 81256 - DNA, 20 bp, Artificial Sequence
  chemically synthesized
gcctgtagtcccagctactc

SEQ ID NO: 81257 - DNA, 20 bp, Artificial Sequence
  chemically synthesized
gcctcagcctcctgagtagc

SEQ ID NO: 81258 - DNA, 20 bp, Artificial Sequence
  chemically synthesized
ctgtagtcccagctactcag

SEQ ID NO: 81259 - DNA, 20 bp, Artificial Sequence
  chemically synthesized
tgtagtcccagctactcagg

SEQ ID NO: 81260 - DNA, 20 bp, Artificial Sequence
  chemically synthesized
tcctgcctcagcctcctgag

SEQ ID NO: 81261 - DNA, 20 bp, Artificial Sequence
  chemically synthesized
ttctcctgcctcagcctcct

SEQ ID NO: 81262 - DNA, 20 bp, Artificial Sequence
  chemically synthesized
tcccagctactcaggaggct

SEQ ID NO: 81263 - DNA, 20 bp, Artificial Sequence
  chemically synthesized
cccagctactcaggaggctg

SEQ ID NO: 81264 - DNA, 20 bp, Artificial Sequence
  chemically synthesized
agctactcaggaggctgagg

SEQ ID NO: 81265 - DNA, 20 bp, Artificial Sequence
  chemically synthesized
gctactcaggaggctgaggc

SEQ ID NO: 81266 - DNA, 20 bp, Artificial Sequence
  chemically synthesized
tactcaggaggctgaggcag

SEQ ID NO: 81267 - DNA, 20 bp, Artificial Sequence
  chemically synthesized
ttcaagcaattctcctgcct

SEQ ID NO: 81268 - DNA, 20 bp, Artificial Sequence
  chemically synthesized
gcaggagaattgcttgaacc

SEQ ID NO: 81269 - DNA, 20 bp, Artificial Sequence
  chemically synthesized
caggagaattgcttgaaccc

SEQ ID NO: 81270 - DNA, 20 bp, Artificial Sequence
  chemically synthesized
tcgctgaacctcctgggttc

SEQ ID NO: 81271 - DNA, 20 bp, Artificial Sequence
  chemically synthesized
ggagaattgcttgaacccag

SEQ ID NO: 81272 - DNA, 20 bp, Artificial Sequence
  chemically synthesized
gagaattgcttgaacccagg

SEQ ID NO: 81273 - DNA, 20 bp, Artificial Sequence
  chemically synthesized
ctcggctcgctgaacctcct

SEQ ID NO: 81274 - DNA, 20 bp, Artificial Sequence
  chemically synthesized
ttgcttgaacccaggaggtt

SEQ ID NO: 81275 - DNA, 20 bp, Artificial Sequence
  chemically synthesized
tctcggctcgctgaacctcc

SEQ ID NO: 81276 - DNA, 20 bp, Artificial Sequence
  chemically synthesized
ttgaacccaggaggttcagc

SEQ ID NO: 81277 - DNA, 20 bp, Artificial Sequence
  chemically synthesized
cccaggaggttcagcgagcc

SEQ ID NO: 81278 - DNA, 20 bp, Artificial Sequence
  chemically synthesized
ggagtgcagtggtgagatct

SEQ ID NO: 81279 - DNA, 20 bp, Artificial Sequence
  chemically synthesized
ccaggctggagtgcagtggt

SEQ ID NO: 81280 - DNA, 20 bp, Artificial Sequence
  chemically synthesized
gtcaccaggctggagtgcag

SEQ ID NO: 81281 - DNA, 20 bp, Artificial Sequence
  chemically synthesized
gagatctcaccactgcactc

SEQ ID NO: 81282 - DNA, 20 bp, Artificial Sequence
  chemically synthesized
tctgtcaccaggctggagtg

SEQ ID NO: 81283 - DNA, 20 bp, Artificial Sequence
  chemically synthesized
ctcaccactgcactccagcc

SEQ ID NO: 81284 - DNA, 20 bp, Artificial Sequence
  chemically synthesized
ctcactctgtcaccaggctg

SEQ ID NO: 81285 - DNA, 20 bp, Artificial Sequence
  chemically synthesized
gtctcactctgtcaccaggc

SEQ ID NO: 81286 - DNA, 20 bp, Artificial Sequence
  chemically synthesized
actgcactccagcctggtga

SEQ ID NO: 81287 - DNA, 20 bp, Artificial Sequence
  chemically synthesized
tgcactccagcctggtgaca

SEQ ID NO: 81288 - DNA, 20 bp, Artificial Sequence
  chemically synthesized
cagagtctcactctgtcacc

SEQ ID NO: 81289 - DNA, 20 bp, Artificial Sequence
  chemically synthesized
acagagtctcactctgtcac

SEQ ID NO: 81290 - DNA, 20 bp, Artificial Sequence
  chemically synthesized
ctccagcctggtgacagagt

SEQ ID NO: 81291 - DNA, 20 bp, Artificial Sequence
  chemically synthesized
ttttttttttttttgagaca

SEQ ID NO: 81292 - DNA, 20 bp, Artificial Sequence
  chemically synthesized
ttttttttttttttttgaga

SEQ ID NO: 81293 - DNA, 20 bp, Artificial Sequence
  chemically synthesized
ttcttttttttttttttttt

SEQ ID NO: 81294 - DNA, 20 bp, Artificial Sequence
  chemically synthesized
gtctcaaaaaaaaaaaaaaa

SEQ ID NO: 81295 - DNA, 20 bp, Artificial Sequence
  chemically synthesized
tcccaaggtgaaaaggtttg

SEQ ID NO: 81296 - DNA, 20 bp, Artificial Sequence
  chemically synthesized
aggacaatcccaaggtgaaa

SEQ ID NO: 81297 - DNA, 20 bp, Artificial Sequence
  chemically synthesized
atccacaaaccttttcacct

SEQ ID NO: 81298 - DNA, 20 bp, Artificial Sequence
  chemically synthesized
caggacaatcccaaggtgaa

SEQ ID NO: 81299 - DNA, 20 bp, Artificial Sequence
  chemically synthesized
tccacaaaccttttcacctt

SEQ ID NO: 81300 - DNA, 20 bp, Artificial Sequence
  chemically synthesized
tgttcttcaggacaatccca

SEQ ID NO: 81301 - DNA, 20 bp, Artificial Sequence
  chemically synthesized
ttgttcttcaggacaatccc

SEQ ID NO: 81302 - DNA, 20 bp, Artificial Sequence
  chemically synthesized
ttcaccttgggattgtcctg

SEQ ID NO: 81303 - DNA, 20 bp, Artificial Sequence
  chemically synthesized
atacaagatttttgttcttc

SEQ ID NO: 81304 - DNA, 20 bp, Artificial Sequence
  chemically synthesized
gatacaagatttttgttctt

SEQ ID NO: 81305 - DNA, 20 bp, Artificial Sequence
  chemically synthesized
aagaacaaaaatcttgtatc

SEQ ID NO: 81306 - DNA, 20 bp, Artificial Sequence
  chemically synthesized
taaacctgtagtctggatac

SEQ ID NO: 81307 - DNA, 20 bp, Artificial Sequence
  chemically synthesized
aaaatcttgtatccagacta

SEQ ID NO: 81308 - DNA, 20 bp, Artificial Sequence
  chemically synthesized
aaatcttgtatccagactac

SEQ ID NO: 81309 - DNA, 20 bp, Artificial Sequence
  chemically synthesized
taacttttaaacctgtagtc

SEQ ID NO: 81310 - DNA, 20 bp, Artificial Sequence
  chemically synthesized
tagaataacttttaaacctg

SEQ ID NO: 81311 - DNA, 20 bp, Artificial Sequence
  chemically synthesized
tatccagactacaggtttaa

SEQ ID NO: 81312 - DNA, 20 bp, Artificial Sequence
  chemically synthesized
atataaaggctttaataaag

SEQ ID NO: 81313 - DNA, 20 bp, Artificial Sequence
  chemically synthesized
aaagttattctactttatta

SEQ ID NO: 81314 - DNA, 20 bp, Artificial Sequence
  chemically synthesized
aatatataaaggctttaata

SEQ ID NO: 81315 - DNA, 20 bp, Artificial Sequence
  chemically synthesized
tctgtaagtggaatatataa

SEQ ID NO: 81316 - DNA, 20 bp, Artificial Sequence
  chemically synthesized
atctgtaagtggaatatata

SEQ ID NO: 81317 - DNA, 20 bp, Artificial Sequence
  chemically synthesized
gcctttatatattccactta

SEQ ID NO: 81318 - DNA, 20 bp, Artificial Sequence
  chemically synthesized
gttccacatagatctgtaag

SEQ ID NO: 81319 - DNA, 20 bp, Artificial Sequence
  chemically synthesized
ggtgttccacatagatctgt

SEQ ID NO: 81320 - DNA, 20 bp, Artificial Sequence
  chemically synthesized
attccacttacagatctatg

SEQ ID NO: 81321 - DNA, 20 bp, Artificial Sequence
  chemically synthesized
gaattactaggtgttccaca

SEQ ID NO: 81322 - DNA, 20 bp, Artificial Sequence
  chemically synthesized
acagatctatgtggaacacc

SEQ ID NO: 81323 - DNA, 20 bp, Artificial Sequence
  chemically synthesized
gaataactttttgaattact

SEQ ID NO: 81324 - DNA, 20 bp, Artificial Sequence
  chemically synthesized
ggaataactttttgaattac

SEQ ID NO: 81325 - DNA, 20 bp, Artificial Sequence
  chemically synthesized
ggaacacctagtaattcaaa

SEQ ID NO: 81326 - DNA, 20 bp, Artificial Sequence
  chemically synthesized
ccttccttgtaatggggaat

SEQ ID NO: 81327 - DNA, 20 bp, Artificial Sequence
  chemically synthesized
accttccttgtaatggggaa

SEQ ID NO: 81328 - DNA, 20 bp, Artificial Sequence
  chemically synthesized
ttattcctattccccattac

SEQ ID NO: 81329 - DNA, 20 bp, Artificial Sequence
  chemically synthesized
tattcctattccccattaca

SEQ ID NO: 81330 - DNA, 20 bp, Artificial Sequence
  chemically synthesized
attctaccttccttgtaatg

SEQ ID NO: 81331 - DNA, 20 bp, Artificial Sequence
  chemically synthesized
tattctaccttccttgtaat

SEQ ID NO: 81332 - DNA, 20 bp, Artificial Sequence
  chemically synthesized
atattctaccttccttgtaa

SEQ ID NO: 81333 - DNA, 20 bp, Artificial Sequence
  chemically synthesized
tcctattccccattacaagg

SEQ ID NO: 81334 - DNA, 20 bp, Artificial Sequence
  chemically synthesized
cctattccccattacaagga

SEQ ID NO: 81335 - DNA, 20 bp, Artificial Sequence
  chemically synthesized
attccccattacaaggaagg

SEQ ID NO: 81336 - DNA, 20 bp, Artificial Sequence
  chemically synthesized
aggaaggtagaatatttgtc

SEQ ID NO: 81337 - DNA, 20 bp, Artificial Sequence
  chemically synthesized
gaatatttgtctagtcaaat

SEQ ID NO: 81338 - DNA, 20 bp, Artificial Sequence
  chemically synthesized
agcaccagtgcttatttgac

SEQ ID NO: 81339 - DNA, 20 bp, Artificial Sequence
  chemically synthesized
ttgtctagtcaaataagcac

SEQ ID NO: 81340 - DNA, 20 bp, Artificial Sequence
  chemically synthesized
cactttactgaaaatagcac

SEQ ID NO: 81341 - DNA, 20 bp, Artificial Sequence
  chemically synthesized
ataagcactggtgctatttt

SEQ ID NO: 81342 - DNA, 20 bp, Artificial Sequence
  chemically synthesized
acttttcactttactgaaaa

SEQ ID NO: 81343 - DNA, 20 bp, Artificial Sequence
  chemically synthesized
cactggtgctattttcagta

SEQ ID NO: 81344 - DNA, 20 bp, Artificial Sequence
  chemically synthesized
gctattttcagtaaagtgaa

SEQ ID NO: 81345 - DNA, 20 bp, Artificial Sequence
  chemically synthesized
ttatcaaatattttaagggc

SEQ ID NO: 81346 - DNA, 20 bp, Artificial Sequence
  chemically synthesized
ctgcttatcaaatattttaa

SEQ ID NO: 81347 - DNA, 20 bp, Artificial Sequence
  chemically synthesized
actgcttatcaaatatttta

SEQ ID NO: 81348 - DNA, 20 bp, Artificial Sequence
  chemically synthesized
tactgcttatcaaatatttt

SEQ ID NO: 81349 - DNA, 20 bp, Artificial Sequence
  chemically synthesized
ttgcccttaaaatatttgat

SEQ ID NO: 81350 - DNA, 20 bp, Artificial Sequence
  chemically synthesized
cccttaaaatatttgataag

SEQ ID NO: 81351 - DNA, 20 bp, Artificial Sequence
  chemically synthesized
gtataaatcatgaattttaa

SEQ ID NO: 81352 - DNA, 20 bp, Artificial Sequence
  chemically synthesized
aatcatgaattttaaaagta

SEQ ID NO: 81353 - DNA, 20 bp, Artificial Sequence
  chemically synthesized
catgaattttaaaagtaaag

SEQ ID NO: 81354 - DNA, 20 bp, Artificial Sequence
  chemically synthesized
aaaacagtagaatcaaattt

SEQ ID NO: 81355 - DNA, 20 bp, Artificial Sequence
  chemically synthesized
gcttccataggaaaaaacag

SEQ ID NO: 81356 - DNA, 20 bp, Artificial Sequence
  chemically synthesized
atagcttccataggaaaaaa

SEQ ID NO: 81357 - DNA, 20 bp, Artificial Sequence
  chemically synthesized
gattctactgttttttccta

SEQ ID NO: 81358 - DNA, 20 bp, Artificial Sequence
  chemically synthesized
tctactgttttttcctatgg

SEQ ID NO: 81359 - DNA, 20 bp, Artificial Sequence
  chemically synthesized
cttccaaacatagcttccat

SEQ ID NO: 81360 - DNA, 20 bp, Artificial Sequence
  chemically synthesized
ccttccaaacatagcttcca

SEQ ID NO: 81361 - DNA, 20 bp, Artificial Sequence
  chemically synthesized
tttcctatggaagctatgtt

SEQ ID NO: 81362 - DNA, 20 bp, Artificial Sequence
  chemically synthesized
cctatggaagctatgtttgg

SEQ ID NO: 81363 - DNA, 20 bp, Artificial Sequence
  chemically synthesized
gaatctcagccttccaaaca

SEQ ID NO: 81364 - DNA, 20 bp, Artificial Sequence
  chemically synthesized
ctatggaagctatgtttgga

SEQ ID NO: 81365 - DNA, 20 bp, Artificial Sequence
  chemically synthesized
gaagctatgtttggaaggct

SEQ ID NO: 81366 - DNA, 20 bp, Artificial Sequence
  chemically synthesized
attgctcactaagagaatct

SEQ ID NO: 81367 - DNA, 20 bp, Artificial Sequence
  chemically synthesized
ttggaaggctgagattctct

SEQ ID NO: 81368 - DNA, 20 bp, Artificial Sequence
  chemically synthesized
aaggctgagattctcttagt

SEQ ID NO: 81369 - DNA, 20 bp, Artificial Sequence
  chemically synthesized
ttgactatattgctcactaa

SEQ ID NO: 81370 - DNA, 20 bp, Artificial Sequence
  chemically synthesized
tattgactatattgctcact

SEQ ID NO: 81371 - DNA, 20 bp, Artificial Sequence
  chemically synthesized
gattctcttagtgagcaata

SEQ ID NO: 81372 - DNA, 20 bp, Artificial Sequence
  chemically synthesized
gaacatggtaaattaataaa

SEQ ID NO: 81373 - DNA, 20 bp, Artificial Sequence
  chemically synthesized
tcatctgcgggtggtgaaca

SEQ ID NO: 81374 - DNA, 20 bp, Artificial Sequence
  chemically synthesized
tttaccatgttcaccacccg

SEQ ID NO: 81375 - DNA, 20 bp, Artificial Sequence
  chemically synthesized
gctagctgatcatctgcggg

SEQ ID NO: 81376 - DNA, 20 bp, Artificial Sequence
  chemically synthesized
attgctagctgatcatctgc

SEQ ID NO: 81377 - DNA, 20 bp, Artificial Sequence
  chemically synthesized
tattgctagctgatcatctg

SEQ ID NO: 81378 - DNA, 20 bp, Artificial Sequence
  chemically synthesized
gttcaccacccgcagatgat

SEQ ID NO: 81379 - DNA, 20 bp, Artificial Sequence
  chemically synthesized
accacccgcagatgatcagc

SEQ ID NO: 81380 - DNA, 20 bp, Artificial Sequence
  chemically synthesized
tatggaaatggcattattgc

SEQ ID NO: 81381 - DNA, 20 bp, Artificial Sequence
  chemically synthesized
gtccctggcctttatggaaa

SEQ ID NO: 81382 - DNA, 20 bp, Artificial Sequence
  chemically synthesized
gcaataatgccatttccata

SEQ ID NO: 81383 - DNA, 20 bp, Artificial Sequence
  chemically synthesized
caataatgccatttccataa

SEQ ID NO: 81384 - DNA, 20 bp, Artificial Sequence
  chemically synthesized
aatgccatttccataaaggc

SEQ ID NO: 81385 - DNA, 20 bp, Artificial Sequence
  chemically synthesized
gactaagtccctggccttta

SEQ ID NO: 81386 - DNA, 20 bp, Artificial Sequence
  chemically synthesized
atgccatttccataaaggcc

SEQ ID NO: 81387 - DNA, 20 bp, Artificial Sequence
  chemically synthesized
tgccatttccataaaggcca

SEQ ID NO: 81388 - DNA, 20 bp, Artificial Sequence
  chemically synthesized
ttccataaaggccagggact

SEQ ID NO: 81389 - DNA, 20 bp, Artificial Sequence
  chemically synthesized
aacaacaatgactaagtccc

SEQ ID NO: 81390 - DNA, 20 bp, Artificial Sequence
  chemically synthesized
tgggtgaaacaacaatgact

SEQ ID NO: 81391 - DNA, 20 bp, Artificial Sequence
  chemically synthesized
ggcttttggatttaaagaat

SEQ ID NO: 81392 - DNA, 20 bp, Artificial Sequence
  chemically synthesized
tggcttttggatttaaagaa

SEQ ID NO: 81393 - DNA, 20 bp, Artificial Sequence
  chemically synthesized
aaatgtggcttttggattta

SEQ ID NO: 81394 - DNA, 20 bp, Artificial Sequence
  chemically synthesized
cacccattctttaaatccaa

SEQ ID NO: 81395 - DNA, 20 bp, Artificial Sequence
  chemically synthesized
gtattagcaaatgtggcttt

SEQ ID NO: 81396 - DNA, 20 bp, Artificial Sequence
  chemically synthesized
tgtaattgtattagcaaatg

SEQ ID NO: 81397 - DNA, 20 bp, Artificial Sequence
  chemically synthesized
ttagcattctgtaattgtat

SEQ ID NO: 81398 - DNA, 20 bp, Artificial Sequence
  chemically synthesized
cacatttgctaatacaatta

SEQ ID NO: 81399 - DNA, 20 bp, Artificial Sequence
  chemically synthesized
ttacagaatgctaaatctca

SEQ ID NO: 81400 - DNA, 20 bp, Artificial Sequence
  chemically synthesized
atatgtgtttctgtgagatt

SEQ ID NO: 81401 - DNA, 20 bp, Artificial Sequence
  chemically synthesized
taagtaatatgtgtttctgt

SEQ ID NO: 81402 - DNA, 20 bp, Artificial Sequence
  chemically synthesized
tcacagaaacacatattact

SEQ ID NO: 81403 - DNA, 20 bp, Artificial Sequence
  chemically synthesized
aacttgttattcaagaaact

SEQ ID NO: 81404 - DNA, 20 bp, Artificial Sequence
  chemically synthesized
tacttagtttcttgaataac

SEQ ID NO: 81405 - DNA, 20 bp, Artificial Sequence
  chemically synthesized
tgttaaataacttgttattc

SEQ ID NO: 81406 - DNA, 20 bp, Artificial Sequence
  chemically synthesized
taacaagttatttaacacat

SEQ ID NO: 81407 - DNA, 20 bp, Artificial Sequence
  chemically synthesized
agttatttaacacataagat

SEQ ID NO: 81408 - DNA, 20 bp, Artificial Sequence
  chemically synthesized
tttaacacataagatcagaa

SEQ ID NO: 81409 - DNA, 20 bp, Artificial Sequence
  chemically synthesized
taacacataagatcagaatg

SEQ ID NO: 81410 - DNA, 20 bp, Artificial Sequence
  chemically synthesized
aacacataagatcagaatgg

SEQ ID NO: 81411 - DNA, 20 bp, Artificial Sequence
  chemically synthesized
acacataagatcagaatgga

SEQ ID NO: 81412 - DNA, 20 bp, Artificial Sequence
  chemically synthesized
cacataagatcagaatggag

SEQ ID NO: 81413 - DNA, 20 bp, Artificial Sequence
  chemically synthesized
acataagatcagaatggagg

SEQ ID NO: 81414 - DNA, 20 bp, Artificial Sequence
  chemically synthesized
cataagatcagaatggaggg

SEQ ID NO: 81415 - DNA, 20 bp, Artificial Sequence
  chemically synthesized
ataagatcagaatggagggg

SEQ ID NO: 81416 - DNA, 20 bp, Artificial Sequence
  chemically synthesized
atggagggggggtactatga

SEQ ID NO: 81417 - DNA, 20 bp, Artificial Sequence
  chemically synthesized
ggagggggggtactatgata

SEQ ID NO: 81418 - DNA, 20 bp, Artificial Sequence
  chemically synthesized
tacccctagacactctatca

SEQ ID NO: 81419 - DNA, 20 bp, Artificial Sequence
  chemically synthesized
gggtactatgatagagtgtc

SEQ ID NO: 81420 - DNA, 20 bp, Artificial Sequence
  chemically synthesized
ggtactatgatagagtgtct

SEQ ID NO: 81421 - DNA, 20 bp, Artificial Sequence
  chemically synthesized
gtactatgatagagtgtcta

SEQ ID NO: 81422 - DNA, 20 bp, Artificial Sequence
  chemically synthesized
tactatgatagagtgtctag

SEQ ID NO: 81423 - DNA, 20 bp, Artificial Sequence
  chemically synthesized
atgatagagtgtctaggggt

SEQ ID NO: 81424 - DNA, 20 bp, Artificial Sequence
  chemically synthesized
tgatagagtgtctaggggta

SEQ ID NO: 81425 - DNA, 20 bp, Artificial Sequence
  chemically synthesized
cagttcattttccttacccc

SEQ ID NO: 81426 - DNA, 20 bp, Artificial Sequence
  chemically synthesized
gtaaggaaaatgaactgata

SEQ ID NO: 81427 - DNA, 20 bp, Artificial Sequence
  chemically synthesized
aacattttatatatccatat

SEQ ID NO: 81428 - DNA, 20 bp, Artificial Sequence
  chemically synthesized
ggatatataaaatgttcttc

SEQ ID NO: 81429 - DNA, 20 bp, Artificial Sequence
  chemically synthesized
atataaaatgttcttctagc

SEQ ID NO: 81430 - DNA, 20 bp, Artificial Sequence
  chemically synthesized
ataactaggcagctagctag

SEQ ID NO: 81431 - DNA, 20 bp, Artificial Sequence
  chemically synthesized
ctgataactaggcagctagc

SEQ ID NO: 81432 - DNA, 20 bp, Artificial Sequence
  chemically synthesized
tgttcttctagctagctgcc

SEQ ID NO: 81433 - DNA, 20 bp, Artificial Sequence
  chemically synthesized
agcactgataactaggcagc

SEQ ID NO: 81434 - DNA, 20 bp, Artificial Sequence
  chemically synthesized
ttacagcactgataactagg

SEQ ID NO: 81435 - DNA, 20 bp, Artificial Sequence
  chemically synthesized
ctagctagctgcctagttat

SEQ ID NO: 81436 - DNA, 20 bp, Artificial Sequence
  chemically synthesized
ggattacagcactgataact

SEQ ID NO: 81437 - DNA, 20 bp, Artificial Sequence
  chemically synthesized
tggattacagcactgataac

SEQ ID NO: 81438 - DNA, 20 bp, Artificial Sequence
  chemically synthesized
tggcctcccaaagtggatta

SEQ ID NO: 81439 - DNA, 20 bp, Artificial Sequence
  chemically synthesized
atcagtgctgtaatccactt

SEQ ID NO: 81440 - DNA, 20 bp, Artificial Sequence
  chemically synthesized
tcagtgctgtaatccacttt

SEQ ID NO: 81441 - DNA, 20 bp, Artificial Sequence
  chemically synthesized
agtgctgtaatccactttgg

SEQ ID NO: 81442 - DNA, 20 bp, Artificial Sequence
  chemically synthesized
gtgctgtaatccactttggg

SEQ ID NO: 81443 - DNA, 20 bp, Artificial Sequence
  chemically synthesized
ctcaccttggcctcccaaag

SEQ ID NO: 81444 - DNA, 20 bp, Artificial Sequence
  chemically synthesized
ccactcaccttggcctccca

SEQ ID NO: 81445 - DNA, 20 bp, Artificial Sequence
  chemically synthesized
gtaatccactttgggaggcc

SEQ ID NO: 81446 - DNA, 20 bp, Artificial Sequence
  chemically synthesized
taatccactttgggaggcca

SEQ ID NO: 81447 - DNA, 20 bp, Artificial Sequence
  chemically synthesized
ccactttgggaggccaaggt

SEQ ID NO: 81448 - DNA, 20 bp, Artificial Sequence
  chemically synthesized
ctttgggaggccaaggtgag

SEQ ID NO: 81449 - DNA, 20 bp, Artificial Sequence
  chemically synthesized
ctcaggtgatccactcacct

SEQ ID NO: 81450 - DNA, 20 bp, Artificial Sequence
  chemically synthesized
ccaaggtgagtggatcacct

SEQ ID NO: 81451 - DNA, 20 bp, Artificial Sequence
  chemically synthesized
caaggtgagtggatcacctg

SEQ ID NO: 81452 - DNA, 20 bp, Artificial Sequence
  chemically synthesized
gtgagtggatcacctgaggt

SEQ ID NO: 81453 - DNA, 20 bp, Artificial Sequence
  chemically synthesized
agtctcgaacttctgacctc

SEQ ID NO: 81454 - DNA, 20 bp, Artificial Sequence
  chemically synthesized
agtggatcacctgaggtcag

SEQ ID NO: 81455 - DNA, 20 bp, Artificial Sequence
  chemically synthesized
tagtctcgaacttctgacct

SEQ ID NO: 81456 - DNA, 20 bp, Artificial Sequence
  chemically synthesized
tcacctgaggtcagaagttc

SEQ ID NO: 81457 - DNA, 20 bp, Artificial Sequence
  chemically synthesized
tgaggtcagaagttcgagac

SEQ ID NO: 81458 - DNA, 20 bp, Artificial Sequence
  chemically synthesized
tcagaagttcgagactagcc

SEQ ID NO: 81459 - DNA, 20 bp, Artificial Sequence
  chemically synthesized
tttcaccatgttggccaggc

SEQ ID NO: 81460 - DNA, 20 bp, Artificial Sequence
  chemically synthesized
ggggtttcaccatgttggcc

SEQ ID NO: 81461 - DNA, 20 bp, Artificial Sequence
  chemically synthesized
cgagactagcctggccaaca

SEQ ID NO: 81462 - DNA, 20 bp, Artificial Sequence
  chemically synthesized
tggggtttcaccatgttggc

SEQ ID NO: 81463 - DNA, 20 bp, Artificial Sequence
  chemically synthesized
gagatggggtttcaccatgt

SEQ ID NO: 81464 - DNA, 20 bp, Artificial Sequence
  chemically synthesized
tgtattttttagtagagatg

SEQ ID NO: 81465 - DNA, 20 bp, Artificial Sequence
  chemically synthesized
ttgtattttttagtagagat

SEQ ID NO: 81466 - DNA, 20 bp, Artificial Sequence
  chemically synthesized
tttgtattttttagtagaga

SEQ ID NO: 81467 - DNA, 20 bp, Artificial Sequence
  chemically synthesized
tttttttgtattttttagta

SEQ ID NO: 81468 - DNA, 20 bp, Artificial Sequence
  chemically synthesized
tttttttttgtattttttag

SEQ ID NO: 81469 - DNA, 20 bp, Artificial Sequence
  chemically synthesized
ttttttttttttgtattttt

SEQ ID NO: 81470 - DNA, 20 bp, Artificial Sequence
  chemically synthesized
aaaatacaaaaaaaaaaaaa

SEQ ID NO: 81471 - DNA, 20 bp, Artificial Sequence
  chemically synthesized
tacaaaaaaaaaaaaatagc

SEQ ID NO: 81472 - DNA, 20 bp, Artificial Sequence
  chemically synthesized
acaaaaaaaaaaaaatagct

SEQ ID NO: 81473 - DNA, 20 bp, Artificial Sequence
  chemically synthesized
aaaaaaaaaatagctgggca

SEQ ID NO: 81474 - DNA, 20 bp, Artificial Sequence
  chemically synthesized
aaaaaaatagctgggcatgg

SEQ ID NO: 81475 - DNA, 20 bp, Artificial Sequence
  chemically synthesized
caggcgcccaccaccatgcc

SEQ ID NO: 81476 - DNA, 20 bp, Artificial Sequence
  chemically synthesized
aaaatagctgggcatggtgg

SEQ ID NO: 81477 - DNA, 20 bp, Artificial Sequence
  chemically synthesized
aaatagctgggcatggtggt

SEQ ID NO: 81478 - DNA, 20 bp, Artificial Sequence
  chemically synthesized
ggcatggtggtgggcgcctg

SEQ ID NO: 81479 - DNA, 20 bp, Artificial Sequence
  chemically synthesized
gtggtgggcgcctgtagtcc

SEQ ID NO: 81480 - DNA, 20 bp, Artificial Sequence
  chemically synthesized
tcccaaatagctgggactac

SEQ ID NO: 81481 - DNA, 20 bp, Artificial Sequence
  chemically synthesized
ctcccaaatagctgggacta

SEQ ID NO: 81482 - DNA, 20 bp, Artificial Sequence
  chemically synthesized
cgcctgtagtcccagctatt

SEQ ID NO: 81483 - DNA, 20 bp, Artificial Sequence
  chemically synthesized
cctcagcctcccaaatagct

SEQ ID NO: 81484 - DNA, 20 bp, Artificial Sequence
  chemically synthesized
gcctgtagtcccagctattt

SEQ ID NO: 81485 - DNA, 20 bp, Artificial Sequence
  chemically synthesized
gcctcagcctcccaaatagc

SEQ ID NO: 81486 - DNA, 20 bp, Artificial Sequence
  chemically synthesized
ctgtagtcccagctatttgg

SEQ ID NO: 81487 - DNA, 20 bp, Artificial Sequence
  chemically synthesized
tgtagtcccagctatttggg

SEQ ID NO: 81488 - DNA, 20 bp, Artificial Sequence
  chemically synthesized
ctccgcctcagcctcccaaa

SEQ ID NO: 81489 - DNA, 20 bp, Artificial Sequence
  chemically synthesized
tcccagctatttgggaggct

SEQ ID NO: 81490 - DNA, 20 bp, Artificial Sequence
  chemically synthesized
cccagctatttgggaggctg

SEQ ID NO: 81491 - DNA, 20 bp, Artificial Sequence
  chemically synthesized
agctatttgggaggctgagg

SEQ ID NO: 81492 - DNA, 20 bp, Artificial Sequence
  chemically synthesized
ctatttgggaggctgaggcg

SEQ ID NO: 81493 - DNA, 20 bp, Artificial Sequence
  chemically synthesized
gctcaagcagttctccgcct

SEQ ID NO: 81494 - DNA, 20 bp, Artificial Sequence
  chemically synthesized
gctgaggcggagaactgctt

SEQ ID NO: 81495 - DNA, 20 bp, Artificial Sequence
  chemically synthesized
ctccacctcctgggctcaag

SEQ ID NO: 81496 - DNA, 20 bp, Artificial Sequence
  chemically synthesized
ggcggagaactgcttgagcc

SEQ ID NO: 81497 - DNA, 20 bp, Artificial Sequence
  chemically synthesized
gcggagaactgcttgagccc

SEQ ID NO: 81498 - DNA, 20 bp, Artificial Sequence
  chemically synthesized
aacctccacctcctgggctc

SEQ ID NO: 81499 - DNA, 20 bp, Artificial Sequence
  chemically synthesized
ggagaactgcttgagcccag

SEQ ID NO: 81500 - DNA, 20 bp, Artificial Sequence
  chemically synthesized
gagaactgcttgagcccagg

SEQ ID NO: 81501 - DNA, 20 bp, Artificial Sequence
  chemically synthesized
aactgcttgagcccaggagg

SEQ ID NO: 81502 - DNA, 20 bp, Artificial Sequence
  chemically synthesized
cactgcaacctccacctcct

SEQ ID NO: 81503 - DNA, 20 bp, Artificial Sequence
  chemically synthesized
ctgcttgagcccaggaggtg

SEQ ID NO: 81504 - DNA, 20 bp, Artificial Sequence
  chemically synthesized
tcactgcaacctccacctcc

SEQ ID NO: 81505 - DNA, 20 bp, Artificial Sequence
  chemically synthesized
tgcttgagcccaggaggtgg

SEQ ID NO: 81506 - DNA, 20 bp, Artificial Sequence
  chemically synthesized
agcccaggaggtggaggttg

SEQ ID NO: 81507 - DNA, 20 bp, Artificial Sequence
  chemically synthesized
caggaggtggaggttgcagt

SEQ ID NO: 81508 - DNA, 20 bp, Artificial Sequence
  chemically synthesized
ggtggaggttgcagtgagcc

SEQ ID NO: 81509 - DNA, 20 bp, Artificial Sequence
  chemically synthesized
gaggttgcagtgagccgaga

SEQ ID NO: 81510 - DNA, 20 bp, Artificial Sequence
  chemically synthesized
ggagtgcagtggtgctatct

SEQ ID NO: 81511 - DNA, 20 bp, Artificial Sequence
  chemically synthesized
tcacccaggctggagtgcag

SEQ ID NO: 81512 - DNA, 20 bp, Artificial Sequence
  chemically synthesized
gagatagcaccactgcactc

SEQ ID NO: 81513 - DNA, 20 bp, Artificial Sequence
  chemically synthesized
ctgtcacccaggctggagtg

SEQ ID NO: 81514 - DNA, 20 bp, Artificial Sequence
  chemically synthesized
agcaccactgcactccagcc

SEQ ID NO: 81515 - DNA, 20 bp, Artificial Sequence
  chemically synthesized
gcaccactgcactccagcct

SEQ ID NO: 81516 - DNA, 20 bp, Artificial Sequence
  chemically synthesized
tcgctctgtcacccaggctg

SEQ ID NO: 81517 - DNA, 20 bp, Artificial Sequence
  chemically synthesized
tctcgctctgtcacccaggc

SEQ ID NO: 81518 - DNA, 20 bp, Artificial Sequence
  chemically synthesized
ctgcactccagcctgggtga

SEQ ID NO: 81519 - DNA, 20 bp, Artificial Sequence
  chemically synthesized
acagtctcgctctgtcaccc

SEQ ID NO: 81520 - DNA, 20 bp, Artificial Sequence
  chemically synthesized
gcactccagcctgggtgaca

SEQ ID NO: 81521 - DNA, 20 bp, Artificial Sequence
  chemically synthesized
gacagtctcgctctgtcacc

SEQ ID NO: 81522 - DNA, 20 bp, Artificial Sequence
  chemically synthesized
tccagcctgggtgacagagc

SEQ ID NO: 81523 - DNA, 20 bp, Artificial Sequence
  chemically synthesized
attttattttttttttgcga

SEQ ID NO: 81524 - DNA, 20 bp, Artificial Sequence
  chemically synthesized
aaaataaaataaaataaaaa

SEQ ID NO: 81525 - DNA, 20 bp, Artificial Sequence
  chemically synthesized
aataaaataaaataaaaaaa

SEQ ID NO: 81526 - DNA, 20 bp, Artificial Sequence
  chemically synthesized
aaataaaaaaagagaaacca

SEQ ID NO: 81527 - DNA, 20 bp, Artificial Sequence
  chemically synthesized
ggaacttttctaataaacca

SEQ ID NO: 81528 - DNA, 20 bp, Artificial Sequence
  chemically synthesized
aaagagaaaccatggtttat

SEQ ID NO: 81529 - DNA, 20 bp, Artificial Sequence
  chemically synthesized
gaaaccatggtttattagaa

SEQ ID NO: 81530 - DNA, 20 bp, Artificial Sequence
  chemically synthesized
tttattagaaaagttcccta

SEQ ID NO: 81531 - DNA, 20 bp, Artificial Sequence
  chemically synthesized
ctcagaggattcatgctgta

SEQ ID NO: 81532 - DNA, 20 bp, Artificial Sequence
  chemically synthesized
cctcagaggattcatgctgt

SEQ ID NO: 81533 - DNA, 20 bp, Artificial Sequence
  chemically synthesized
ccctcagaggattcatgctg

SEQ ID NO: 81534 - DNA, 20 bp, Artificial Sequence
  chemically synthesized
ccctacagcatgaatcctct

SEQ ID NO: 81535 - DNA, 20 bp, Artificial Sequence
  chemically synthesized
cctacagcatgaatcctctg

SEQ ID NO: 81536 - DNA, 20 bp, Artificial Sequence
  chemically synthesized
ctacagcatgaatcctctga

SEQ ID NO: 81537 - DNA, 20 bp, Artificial Sequence
  chemically synthesized
tcagcaatttaagccctcag

SEQ ID NO: 81538 - DNA, 20 bp, Artificial Sequence
  chemically synthesized
ctcagcaatttaagccctca

SEQ ID NO: 81539 - DNA, 20 bp, Artificial Sequence
  chemically synthesized
cactcagcaatttaagccct

SEQ ID NO: 81540 - DNA, 20 bp, Artificial Sequence
  chemically synthesized
atttttccactcagcaattt

SEQ ID NO: 81541 - DNA, 20 bp, Artificial Sequence
  chemically synthesized
ctctgagggcttaaattgct

SEQ ID NO: 81542 - DNA, 20 bp, Artificial Sequence
  chemically synthesized
tgagggcttaaattgctgag

SEQ ID NO: 81543 - DNA, 20 bp, Artificial Sequence
  chemically synthesized
actcttcccatttttccact

SEQ ID NO: 81544 - DNA, 20 bp, Artificial Sequence
  chemically synthesized
taaattgctgagtggaaaaa

SEQ ID NO: 81545 - DNA, 20 bp, Artificial Sequence
  chemically synthesized
aaattgctgagtggaaaaat

SEQ ID NO: 81546 - DNA, 20 bp, Artificial Sequence
  chemically synthesized
ttgctgagtggaaaaatggg

SEQ ID NO: 81547 - DNA, 20 bp, Artificial Sequence
  chemically synthesized
gctgagtggaaaaatgggaa

SEQ ID NO: 81548 - DNA, 20 bp, Artificial Sequence
  chemically synthesized
gagtggaaaaatgggaagag

SEQ ID NO: 81549 - DNA, 20 bp, Artificial Sequence
  chemically synthesized
aaaatgggaagagtggtttc

SEQ ID NO: 81550 - DNA, 20 bp, Artificial Sequence
  chemically synthesized
ttatttcagaaaaaaagtag

SEQ ID NO: 81551 - DNA, 20 bp, Artificial Sequence
  chemically synthesized
aatttatttcagaaaaaaag

SEQ ID NO: 81552 - DNA, 20 bp, Artificial Sequence
  chemically synthesized
taaaatttatttcagaaaaa

SEQ ID NO: 81553 - DNA, 20 bp, Artificial Sequence
  chemically synthesized
ttattaactaaaatttattt

SEQ ID NO: 81554 - DNA, 20 bp, Artificial Sequence
  chemically synthesized
tttttttctgaaataaattt

SEQ ID NO: 81555 - DNA, 20 bp, Artificial Sequence
  chemically synthesized
ggtagtagtttacaaagaat

SEQ ID NO: 81556 - DNA, 20 bp, Artificial Sequence
  chemically synthesized
tttgggggtagtagtttaca

SEQ ID NO: 81557 - DNA, 20 bp, Artificial Sequence
  chemically synthesized
ctctgaagctttgggggtag

SEQ ID NO: 81558 - DNA, 20 bp, Artificial Sequence
  chemically synthesized
tttgtaaactactaccccca

SEQ ID NO: 81559 - DNA, 20 bp, Artificial Sequence
  chemically synthesized
aaactctgaagctttggggg

SEQ ID NO: 81560 - DNA, 20 bp, Artificial Sequence
  chemically synthesized
ttgaaactctgaagctttgg

SEQ ID NO: 81561 - DNA, 20 bp, Artificial Sequence
  chemically synthesized
tttgaaactctgaagctttg

SEQ ID NO: 81562 - DNA, 20 bp, Artificial Sequence
  chemically synthesized
aactactacccccaaagctt

SEQ ID NO: 81563 - DNA, 20 bp, Artificial Sequence
  chemically synthesized
gtttgaaactctgaagcttt

SEQ ID NO: 81564 - DNA, 20 bp, Artificial Sequence
  chemically synthesized
ggtttgaaactctgaagctt

SEQ ID NO: 81565 - DNA, 20 bp, Artificial Sequence
  chemically synthesized
ctactacccccaaagcttca

SEQ ID NO: 81566 - DNA, 20 bp, Artificial Sequence
  chemically synthesized
acactgggtttgaaactctg

SEQ ID NO: 81567 - DNA, 20 bp, Artificial Sequence
  chemically synthesized
aagcttcagagtttcaaacc

SEQ ID NO: 81568 - DNA, 20 bp, Artificial Sequence
  chemically synthesized
cactgcatcttattgacact

SEQ ID NO: 81569 - DNA, 20 bp, Artificial Sequence
  chemically synthesized
ccactgcatcttattgacac

SEQ ID NO: 81570 - DNA, 20 bp, Artificial Sequence
  chemically synthesized
gtttcaaacccagtgtcaat

SEQ ID NO: 81571 - DNA, 20 bp, Artificial Sequence
  chemically synthesized
aacccagtgtcaataagatg

SEQ ID NO: 81572 - DNA, 20 bp, Artificial Sequence
  chemically synthesized
ccagtgtcaataagatgcag

SEQ ID NO: 81573 - DNA, 20 bp, Artificial Sequence
  chemically synthesized
agtgtcaataagatgcagtg

SEQ ID NO: 81574 - DNA, 20 bp, Artificial Sequence
  chemically synthesized
gctcttctttaattttgcag

SEQ ID NO: 81575 - DNA, 20 bp, Artificial Sequence
  chemically synthesized
gtagctcttctttaattttg

SEQ ID NO: 81576 - DNA, 20 bp, Artificial Sequence
  chemically synthesized
ttatttccactgcaaaatta

SEQ ID NO: 81577 - DNA, 20 bp, Artificial Sequence
  chemically synthesized
tttccactgcaaaattaaag

SEQ ID NO: 81578 - DNA, 20 bp, Artificial Sequence
  chemically synthesized
tccactgcaaaattaaagaa

SEQ ID NO: 81579 - DNA, 20 bp, Artificial Sequence
  chemically synthesized
aaattaaagaagagctaccg

SEQ ID NO: 81580 - DNA, 20 bp, Artificial Sequence
  chemically synthesized
aattaaagaagagctaccga

SEQ ID NO: 81581 - DNA, 20 bp, Artificial Sequence
  chemically synthesized
attaaagaagagctaccgaa

SEQ ID NO: 81582 - DNA, 20 bp, Artificial Sequence
  chemically synthesized
taaagaagagctaccgaagg

SEQ ID NO: 81583 - DNA, 20 bp, Artificial Sequence
  chemically synthesized
atatatttatctcccttcgg

SEQ ID NO: 81584 - DNA, 20 bp, Artificial Sequence
  chemically synthesized
catatatatttatctccctt

SEQ ID NO: 81585 - DNA, 20 bp, Artificial Sequence
  chemically synthesized
atatgaattcatgtaattca

SEQ ID NO: 81586 - DNA, 20 bp, Artificial Sequence
  chemically synthesized
aacacgcataaaatacaaca

SEQ ID NO: 81587 - DNA, 20 bp, Artificial Sequence
  chemically synthesized
aaaatacaacacagattcaa

SEQ ID NO: 81588 - DNA, 20 bp, Artificial Sequence
  chemically synthesized
tggtaatagtagatgtgatt

SEQ ID NO: 81589 - DNA, 20 bp, Artificial Sequence
  chemically synthesized
ctggtaatagtagatgtgat

SEQ ID NO: 81590 - DNA, 20 bp, Artificial Sequence
  chemically synthesized
ccaatcacatctactattac

SEQ ID NO: 81591 - DNA, 20 bp, Artificial Sequence
  chemically synthesized
tttttatgtactggtaatag

SEQ ID NO: 81592 - DNA, 20 bp, Artificial Sequence
  chemically synthesized
gaatttttatgtactggtaa

SEQ ID NO: 81593 - DNA, 20 bp, Artificial Sequence
  chemically synthesized
ttatctgaatttttatgtac

SEQ ID NO: 81594 - DNA, 20 bp, Artificial Sequence
  chemically synthesized
attaccagtacataaaaatt

SEQ ID NO: 81595 - DNA, 20 bp, Artificial Sequence
  chemically synthesized
cagtacataaaaattcagat

SEQ ID NO: 81596 - DNA, 20 bp, Artificial Sequence
  chemically synthesized
tcagataagtaccataactt

SEQ ID NO: 81597 - DNA, 20 bp, Artificial Sequence
  chemically synthesized
acatatatacacttaagtta

SEQ ID NO: 81598 - DNA, 20 bp, Artificial Sequence
  chemically synthesized
tctcagacatatatacactt

SEQ ID NO: 81599 - DNA, 20 bp, Artificial Sequence
  chemically synthesized
acttaagtgtatatatgtct

SEQ ID NO: 81600 - DNA, 20 bp, Artificial Sequence
  chemically synthesized
aagtgtatatatgtctgaga

SEQ ID NO: 81601 - DNA, 20 bp, Artificial Sequence
  chemically synthesized
gtatatatgtctgagaaaga

SEQ ID NO: 81602 - DNA, 20 bp, Artificial Sequence
  chemically synthesized
cccagcacatctatctttct

SEQ ID NO: 81603 - DNA, 20 bp, Artificial Sequence
  chemically synthesized
tctgagaaagatagatgtgc

SEQ ID NO: 81604 - DNA, 20 bp, Artificial Sequence
  chemically synthesized
ctgagaaagatagatgtgct

SEQ ID NO: 81605 - DNA, 20 bp, Artificial Sequence
  chemically synthesized
gaaaaattatatttataacc

SEQ ID NO: 81606 - DNA, 20 bp, Artificial Sequence
  chemically synthesized
ttataaatataatttttcga

SEQ ID NO: 81607 - DNA, 20 bp, Artificial Sequence
  chemically synthesized
tataaatataatttttcgaa

SEQ ID NO: 81608 - DNA, 20 bp, Artificial Sequence
  chemically synthesized
tttatatgttttgctatcat

SEQ ID NO: 81609 - DNA, 20 bp, Artificial Sequence
  chemically synthesized
ttatatgttttgctatcatt

SEQ ID NO: 81610 - DNA, 20 bp, Artificial Sequence
  chemically synthesized
tctcattctgatcccaatga

SEQ ID NO: 81611 - DNA, 20 bp, Artificial Sequence
  chemically synthesized
tgttttgctatcattgggat

SEQ ID NO: 81612 - DNA, 20 bp, Artificial Sequence
  chemically synthesized
gctatcattgggatcagaat

SEQ ID NO: 81613 - DNA, 20 bp, Artificial Sequence
  chemically synthesized
tatcattgggatcagaatga

SEQ ID NO: 81614 - DNA, 20 bp, Artificial Sequence
  chemically synthesized
agaatgagagttttaccaat

SEQ ID NO: 81615 - DNA, 20 bp, Artificial Sequence
  chemically synthesized
gaatgagagttttaccaatc

SEQ ID NO: 81616 - DNA, 20 bp, Artificial Sequence
  chemically synthesized
aatgagagttttaccaatca

SEQ ID NO: 81617 - DNA, 20 bp, Artificial Sequence
  chemically synthesized
ttcattttccataccctgat

SEQ ID NO: 81618 - DNA, 20 bp, Artificial Sequence
  chemically synthesized
gagttttaccaatcagggta

SEQ ID NO: 81619 - DNA, 20 bp, Artificial Sequence
  chemically synthesized
caatcagggtatggaaaatg

SEQ ID NO: 81620 - DNA, 20 bp, Artificial Sequence
  chemically synthesized
tggaaaatgaagtttgtctt

SEQ ID NO: 81621 - DNA, 20 bp, Artificial Sequence
  chemically synthesized
atgaagtttgtcttaagacc

SEQ ID NO: 81622 - DNA, 20 bp, Artificial Sequence
  chemically synthesized
tcttatctgttcttggtctt

SEQ ID NO: 81623 - DNA, 20 bp, Artificial Sequence
  chemically synthesized
gtttgtcttaagaccaagaa

SEQ ID NO: 81624 - DNA, 20 bp, Artificial Sequence
  chemically synthesized
ttccctgtcttatctgttct

SEQ ID NO: 81625 - DNA, 20 bp, Artificial Sequence
  chemically synthesized
tcttaagaccaagaacagat

SEQ ID NO: 81626 - DNA, 20 bp, Artificial Sequence
  chemically synthesized
aagaccaagaacagataaga

SEQ ID NO: 81627 - DNA, 20 bp, Artificial Sequence
  chemically synthesized
agaccaagaacagataagac

SEQ ID NO: 81628 - DNA, 20 bp, Artificial Sequence
  chemically synthesized
gaccaagaacagataagaca

SEQ ID NO: 81629 - DNA, 20 bp, Artificial Sequence
  chemically synthesized
agataagacagggaaactaa

SEQ ID NO: 81630 - DNA, 20 bp, Artificial Sequence
  chemically synthesized
gataagacagggaaactaaa

SEQ ID NO: 81631 - DNA, 20 bp, Artificial Sequence
  chemically synthesized
cctatttgcggtattccttt

SEQ ID NO: 81632 - DNA, 20 bp, Artificial Sequence
  chemically synthesized
actaaaaggaataccgcaaa

SEQ ID NO: 81633 - DNA, 20 bp, Artificial Sequence
  chemically synthesized
ctaaaaggaataccgcaaat

SEQ ID NO: 81634 - DNA, 20 bp, Artificial Sequence
  chemically synthesized
taaaaggaataccgcaaata

SEQ ID NO: 81635 - DNA, 20 bp, Artificial Sequence
  chemically synthesized
ccttcacccaaccctatttg

SEQ ID NO: 81636 - DNA, 20 bp, Artificial Sequence
  chemically synthesized
aggaataccgcaaatagggt

SEQ ID NO: 81637 - DNA, 20 bp, Artificial Sequence
  chemically synthesized
ggaataccgcaaatagggtt

SEQ ID NO: 81638 - DNA, 20 bp, Artificial Sequence
  chemically synthesized
accgcaaatagggttgggtg

SEQ ID NO: 81639 - DNA, 20 bp, Artificial Sequence
  chemically synthesized
ccgcaaatagggttgggtga

SEQ ID NO: 81640 - DNA, 20 bp, Artificial Sequence
  chemically synthesized
aaatagggttgggtgaaggc

SEQ ID NO: 81641 - DNA, 20 bp, Artificial Sequence
  chemically synthesized
ataacagttcaagtatcagc

SEQ ID NO: 81642 - DNA, 20 bp, Artificial Sequence
  chemically synthesized
aagcataacagttcaagtat

SEQ ID NO: 81643 - DNA, 20 bp, Artificial Sequence
  chemically synthesized
aactaaaagcataacagttc

SEQ ID NO: 81644 - DNA, 20 bp, Artificial Sequence
  chemically synthesized
aaaaataactaaaagcataa

SEQ ID NO: 81645 - DNA, 20 bp, Artificial Sequence
  chemically synthesized
tacttgaactgttatgcttt

SEQ ID NO: 81646 - DNA, 20 bp, Artificial Sequence
  chemically synthesized
taataattaaaaataactaa

SEQ ID NO: 81647 - DNA, 20 bp, Artificial Sequence
  chemically synthesized
gatggagaagagaatgtgta

SEQ ID NO: 81648 - DNA, 20 bp, Artificial Sequence
  chemically synthesized
tactgagtatggatggagaa

SEQ ID NO: 81649 - DNA, 20 bp, Artificial Sequence
  chemically synthesized
gatactgagtatggatggag

SEQ ID NO: 81650 - DNA, 20 bp, Artificial Sequence
  chemically synthesized
taagatactgagtatggatg

SEQ ID NO: 81651 - DNA, 20 bp, Artificial Sequence
  chemically synthesized
tgtaagatactgagtatgga

SEQ ID NO: 81652 - DNA, 20 bp, Artificial Sequence
  chemically synthesized
ttctcttctccatccatact

SEQ ID NO: 81653 - DNA, 20 bp, Artificial Sequence
  chemically synthesized
catttgtaagatactgagta

SEQ ID NO: 81654 - DNA, 20 bp, Artificial Sequence
  chemically synthesized
aggtgcatttgtaagatact

SEQ ID NO: 81655 - DNA, 20 bp, Artificial Sequence
  chemically synthesized
tgtcacacaggtgcatttgt

SEQ ID NO: 81656 - DNA, 20 bp, Artificial Sequence
  chemically synthesized
tacaaatgcacctgtgtgac

SEQ ID NO: 81657 - DNA, 20 bp, Artificial Sequence
  chemically synthesized
tttagccatacttgtcacac

SEQ ID NO: 81658 - DNA, 20 bp, Artificial Sequence
  chemically synthesized
ttttagccatacttgtcaca

SEQ ID NO: 81659 - DNA, 20 bp, Artificial Sequence
  chemically synthesized
atgcacctgtgtgacaagta

SEQ ID NO: 81660 - DNA, 20 bp, Artificial Sequence
  chemically synthesized
agacataagggattcatttt

SEQ ID NO: 81661 - DNA, 20 bp, Artificial Sequence
  chemically synthesized
aggctgtagagcagacataa

SEQ ID NO: 81662 - DNA, 20 bp, Artificial Sequence
  chemically synthesized
taggctgtagagcagacata

SEQ ID NO: 81663 - DNA, 20 bp, Artificial Sequence
  chemically synthesized
ataggctgtagagcagacat

SEQ ID NO: 81664 - DNA, 20 bp, Artificial Sequence
  chemically synthesized
aatcccttatgtctgctcta

SEQ ID NO: 81665 - DNA, 20 bp, Artificial Sequence
  chemically synthesized
tcaatagataggctgtagag

SEQ ID NO: 81666 - DNA, 20 bp, Artificial Sequence
  chemically synthesized
tgctcaatagataggctgta

SEQ ID NO: 81667 - DNA, 20 bp, Artificial Sequence
  chemically synthesized
attgctcaatagataggctg

SEQ ID NO: 81668 - DNA, 20 bp, Artificial Sequence
  chemically synthesized
tgctctacagcctatctatt

SEQ ID NO: 81669 - DNA, 20 bp, Artificial Sequence
  chemically synthesized
aattaaattgctcaatagat

SEQ ID NO: 81670 - DNA, 20 bp, Artificial Sequence
  chemically synthesized
caattaaattgctcaataga

SEQ ID NO: 81671 - DNA, 20 bp, Artificial Sequence
  chemically synthesized
atgtcaattaaattgctcaa

SEQ ID NO: 81672 - DNA, 20 bp, Artificial Sequence
  chemically synthesized
aattgacatattaactaatt

SEQ ID NO: 81673 - DNA, 20 bp, Artificial Sequence
  chemically synthesized
atgtcccagtggaactaaat

SEQ ID NO: 81674 - DNA, 20 bp, Artificial Sequence
  chemically synthesized
attaactaatttagttccac

SEQ ID NO: 81675 - DNA, 20 bp, Artificial Sequence
  chemically synthesized
ttaactaatttagttccact

SEQ ID NO: 81676 - DNA, 20 bp, Artificial Sequence
  chemically synthesized
aagttaggaaaatgtcccag

SEQ ID NO: 81677 - DNA, 20 bp, Artificial Sequence
  chemically synthesized
aataagttaggaaaatgtcc

SEQ ID NO: 81678 - DNA, 20 bp, Artificial Sequence
  chemically synthesized
ccaaaaatgagaaataagtt

SEQ ID NO: 81679 - DNA, 20 bp, Artificial Sequence
  chemically synthesized
tccaaaaatgagaaataagt

SEQ ID NO: 81680 - DNA, 20 bp, Artificial Sequence
  chemically synthesized
cttctccaaaaatgagaaat

SEQ ID NO: 81681 - DNA, 20 bp, Artificial Sequence
  chemically synthesized
cctaacttatttctcatttt

SEQ ID NO: 81682 - DNA, 20 bp, Artificial Sequence
  chemically synthesized
taacttatttctcatttttg

SEQ ID NO: 81683 - DNA, 20 bp, Artificial Sequence
  chemically synthesized
tgacagacttctccaaaaat

SEQ ID NO: 81684 - DNA, 20 bp, Artificial Sequence
  chemically synthesized
cttatttctcatttttggag

SEQ ID NO: 81685 - DNA, 20 bp, Artificial Sequence
  chemically synthesized
tatagggactaattttttga

SEQ ID NO: 81686 - DNA, 20 bp, Artificial Sequence
  chemically synthesized
ggagaagtctgtcaaaaaat

SEQ ID NO: 81687 - DNA, 20 bp, Artificial Sequence
  chemically synthesized
tgattttattcaaaaatata

SEQ ID NO: 81688 - DNA, 20 bp, Artificial Sequence
  chemically synthesized
ttgattttattcaaaaatat

SEQ ID NO: 81689 - DNA, 20 bp, Artificial Sequence
  chemically synthesized
gttgattttattcaaaaata

SEQ ID NO: 81690 - DNA, 20 bp, Artificial Sequence
  chemically synthesized
tgtattacctagtattttaa

SEQ ID NO: 81691 - DNA, 20 bp, Artificial Sequence
  chemically synthesized
atttaatgcttttaaaatac

SEQ ID NO: 81692 - DNA, 20 bp, Artificial Sequence
  chemically synthesized
tttaatgcttttaaaatact

SEQ ID NO: 81693 - DNA, 20 bp, Artificial Sequence
  chemically synthesized
gggttttgaaatgtattacc

SEQ ID NO: 81694 - DNA, 20 bp, Artificial Sequence
  chemically synthesized
gtaatacatttcaaaaccct

SEQ ID NO: 81695 - DNA, 20 bp, Artificial Sequence
  chemically synthesized
gctgtgtactggaaaactaa

SEQ ID NO: 81696 - DNA, 20 bp, Artificial Sequence
  chemically synthesized
tgctgtgtactggaaaacta

SEQ ID NO: 81697 - DNA, 20 bp, Artificial Sequence
  chemically synthesized
tttcaaaacccttagttttc

SEQ ID NO: 81698 - DNA, 20 bp, Artificial Sequence
  chemically synthesized
ttgctgtgtactggaaaact

SEQ ID NO: 81699 - DNA, 20 bp, Artificial Sequence
  chemically synthesized
acccttagttttccagtaca

SEQ ID NO: 81700 - DNA, 20 bp, Artificial Sequence
  chemically synthesized
gggttaaccttgctgtgtac

SEQ ID NO: 81701 - DNA, 20 bp, Artificial Sequence
  chemically synthesized
ttagttttccagtacacagc

SEQ ID NO: 81702 - DNA, 20 bp, Artificial Sequence
  chemically synthesized
tagttttccagtacacagca

SEQ ID NO: 81703 - DNA, 20 bp, Artificial Sequence
  chemically synthesized
atgtctaacatttaaagtaa

SEQ ID NO: 81704 - DNA, 20 bp, Artificial Sequence
  chemically synthesized
catgtctaacatttaaagta

SEQ ID NO: 81705 - DNA, 20 bp, Artificial Sequence
  chemically synthesized
ccatgtctaacatttaaagt

SEQ ID NO: 81706 - DNA, 20 bp, Artificial Sequence
  chemically synthesized
ttaacccttactttaaatgt

SEQ ID NO: 81707 - DNA, 20 bp, Artificial Sequence
  chemically synthesized
gaccccatgtctaacattta

SEQ ID NO: 81708 - DNA, 20 bp, Artificial Sequence
  chemically synthesized
cttactttaaatgttagaca

SEQ ID NO: 81709 - DNA, 20 bp, Artificial Sequence
  chemically synthesized
ttactttaaatgttagacat

SEQ ID NO: 81710 - DNA, 20 bp, Artificial Sequence
  chemically synthesized
tactttaaatgttagacatg

SEQ ID NO: 81711 - DNA, 20 bp, Artificial Sequence
  chemically synthesized
gacatggggtcataaaacat

SEQ ID NO: 81712 - DNA, 20 bp, Artificial Sequence
  chemically synthesized
acatggggtcataaaacatt

SEQ ID NO: 81713 - DNA, 20 bp, Artificial Sequence
  chemically synthesized
catggggtcataaaacattg

SEQ ID NO: 81714 - DNA, 20 bp, Artificial Sequence
  chemically synthesized
ggggtcataaaacattgggg

SEQ ID NO: 81715 - DNA, 20 bp, Artificial Sequence
  chemically synthesized
gtcataaaacattggggtag

SEQ ID NO: 81716 - DNA, 20 bp, Artificial Sequence
  chemically synthesized
tcataaaacattggggtaga

SEQ ID NO: 81717 - DNA, 20 bp, Artificial Sequence
  chemically synthesized
cataaaacattggggtagaa

SEQ ID NO: 81718 - DNA, 20 bp, Artificial Sequence
  chemically synthesized
tggggtagaagggattttac

SEQ ID NO: 81719 - DNA, 20 bp, Artificial Sequence
  chemically synthesized
agaagggattttacaagtat

SEQ ID NO: 81720 - DNA, 20 bp, Artificial Sequence
  chemically synthesized
aagggattttacaagtatta

SEQ ID NO: 81721 - DNA, 20 bp, Artificial Sequence
  chemically synthesized
ggtaaaatttttaaaaagaa

SEQ ID NO: 81722 - DNA, 20 bp, Artificial Sequence
  chemically synthesized
tagtaggtaaaatttttaaa

SEQ ID NO: 81723 - DNA, 20 bp, Artificial Sequence
  chemically synthesized
tagctcttcattaaaatagt

SEQ ID NO: 81724 - DNA, 20 bp, Artificial Sequence
  chemically synthesized
atagctcttcattaaaatag

SEQ ID NO: 81725 - DNA, 20 bp, Artificial Sequence
  chemically synthesized
tgcatagctcttcattaaaa

SEQ ID NO: 81726 - DNA, 20 bp, Artificial Sequence
  chemically synthesized
ttttacctactattttaatg

SEQ ID NO: 81727 - DNA, 20 bp, Artificial Sequence
  chemically synthesized
ttacctactattttaatgaa

SEQ ID NO: 81728 - DNA, 20 bp, Artificial Sequence
  chemically synthesized
tggtctaatgttgaattgca

SEQ ID NO: 81729 - DNA, 20 bp, Artificial Sequence
  chemically synthesized
agagctatgcaattcaacat

SEQ ID NO: 81730 - DNA, 20 bp, Artificial Sequence
  chemically synthesized
tgcaattcaacattagacca

SEQ ID NO: 81731 - DNA, 20 bp, Artificial Sequence
  chemically synthesized
gcaattcaacattagaccat

SEQ ID NO: 81732 - DNA, 20 bp, Artificial Sequence
  chemically synthesized
cattgccttcatgaagccta

SEQ ID NO: 81733 - DNA, 20 bp, Artificial Sequence
  chemically synthesized
attagaccataggcttcatg

SEQ ID NO: 81734 - DNA, 20 bp, Artificial Sequence
  chemically synthesized
ttagaccataggcttcatga

SEQ ID NO: 81735 - DNA, 20 bp, Artificial Sequence
  chemically synthesized
acttgatcattgccttcatg

SEQ ID NO: 81736 - DNA, 20 bp, Artificial Sequence
  chemically synthesized
gcttcatgaaggcaatgatc

SEQ ID NO: 81737 - DNA, 20 bp, Artificial Sequence
  chemically synthesized
acaggtagttataaaagaaa

SEQ ID NO: 81738 - DNA, 20 bp, Artificial Sequence
  chemically synthesized
tgctggacaggtagttataa

SEQ ID NO: 81739 - DNA, 20 bp, Artificial Sequence
  chemically synthesized
ttcttttataactacctgtc

SEQ ID NO: 81740 - DNA, 20 bp, Artificial Sequence
  chemically synthesized
tatataatgtgctggacagg

SEQ ID NO: 81741 - DNA, 20 bp, Artificial Sequence
  chemically synthesized
cattatataatgtgctggac

SEQ ID NO: 81742 - DNA, 20 bp, Artificial Sequence
  chemically synthesized
tcattatataatgtgctgga

SEQ ID NO: 81743 - DNA, 20 bp, Artificial Sequence
  chemically synthesized
tgagtcattatataatgtgc

SEQ ID NO: 81744 - DNA, 20 bp, Artificial Sequence
  chemically synthesized
attatataatgactcataaa

SEQ ID NO: 81745 - DNA, 20 bp, Artificial Sequence
  chemically synthesized
ttcactcaacaactgtttat

SEQ ID NO: 81746 - DNA, 20 bp, Artificial Sequence
  chemically synthesized
atgactcataaacagttgtt

SEQ ID NO: 81747 - DNA, 20 bp, Artificial Sequence
  chemically synthesized
agttgttgagtgaataaatg

SEQ ID NO: 81748 - DNA, 20 bp, Artificial Sequence
  chemically synthesized
gttgttgagtgaataaatga

SEQ ID NO: 81749 - DNA, 20 bp, Artificial Sequence
  chemically synthesized
aataaatgaaggtacctaat

SEQ ID NO: 81750 - DNA, 20 bp, Artificial Sequence
  chemically synthesized
aacatatgaggaatctcatt

SEQ ID NO: 81751 - DNA, 20 bp, Artificial Sequence
  chemically synthesized
caacatatgaggaatctcat

SEQ ID NO: 81752 - DNA, 20 bp, Artificial Sequence
  chemically synthesized
cccagggccagcaacatatg

SEQ ID NO: 81753 - DNA, 20 bp, Artificial Sequence
  chemically synthesized
gcccagggccagcaacatat

SEQ ID NO: 81754 - DNA, 20 bp, Artificial Sequence
  chemically synthesized
tgagattcctcatatgttgc

SEQ ID NO: 81755 - DNA, 20 bp, Artificial Sequence
  chemically synthesized
tcctcatatgttgctggccc

SEQ ID NO: 81756 - DNA, 20 bp, Artificial Sequence
  chemically synthesized
cctcatatgttgctggccct

SEQ ID NO: 81757 - DNA, 20 bp, Artificial Sequence
  chemically synthesized
ttgggctgctagcccagggc

SEQ ID NO: 81758 - DNA, 20 bp, Artificial Sequence
  chemically synthesized
atatgttgctggccctgggc

SEQ ID NO: 81759 - DNA, 20 bp, Artificial Sequence
  chemically synthesized
atctttgggctgctagccca

SEQ ID NO: 81760 - DNA, 20 bp, Artificial Sequence
  chemically synthesized
tgttgctggccctgggctag

SEQ ID NO: 81761 - DNA, 20 bp, Artificial Sequence
  chemically synthesized
catctttgggctgctagccc

SEQ ID NO: 81762 - DNA, 20 bp, Artificial Sequence
  chemically synthesized
acatctttgggctgctagcc

SEQ ID NO: 81763 - DNA, 20 bp, Artificial Sequence
  chemically synthesized
gctgtacatctttgggctgc

SEQ ID NO: 81764 - DNA, 20 bp, Artificial Sequence
  chemically synthesized
ggccctgggctagcagccca

SEQ ID NO: 81765 - DNA, 20 bp, Artificial Sequence
  chemically synthesized
ggatcatgctgtacatcttt

SEQ ID NO: 81766 - DNA, 20 bp, Artificial Sequence
  chemically synthesized
aggatcatgctgtacatctt

SEQ ID NO: 81767 - DNA, 20 bp, Artificial Sequence
  chemically synthesized
gctagcagcccaaagatgta

SEQ ID NO: 81768 - DNA, 20 bp, Artificial Sequence
  chemically synthesized
tacagcatgatccttgctct

SEQ ID NO: 81769 - DNA, 20 bp, Artificial Sequence
  chemically synthesized
aagtgaagttgctaagagca

SEQ ID NO: 81770 - DNA, 20 bp, Artificial Sequence
  chemically synthesized
aaagtgaagttgctaagagc

SEQ ID NO: 81771 - DNA, 20 bp, Artificial Sequence
  chemically synthesized
agagaaagtgaagttgctaa

SEQ ID NO: 81772 - DNA, 20 bp, Artificial Sequence
  chemically synthesized
ccagagaaagtgaagttgct

SEQ ID NO: 81773 - DNA, 20 bp, Artificial Sequence
  chemically synthesized
tttttctcccagagaaagtg

SEQ ID NO: 81774 - DNA, 20 bp, Artificial Sequence
  chemically synthesized
cttagcaacttcactttctc

SEQ ID NO: 81775 - DNA, 20 bp, Artificial Sequence
  chemically synthesized
ttagcaacttcactttctct

SEQ ID NO: 81776 - DNA, 20 bp, Artificial Sequence
  chemically synthesized
agcaacttcactttctctgg

SEQ ID NO: 81777 - DNA, 20 bp, Artificial Sequence
  chemically synthesized
atttttttttctcccagaga

SEQ ID NO: 81778 - DNA, 20 bp, Artificial Sequence
  chemically synthesized
atgcatttttttttctccca

SEQ ID NO: 81779 - DNA, 20 bp, Artificial Sequence
  chemically synthesized
ttatgcatttttttttctcc

SEQ ID NO: 81780 - DNA, 20 bp, Artificial Sequence
  chemically synthesized
tgggagaaaaaaaaatgcat

SEQ ID NO: 81781 - DNA, 20 bp, Artificial Sequence
  chemically synthesized
agaaaaaaaaatgcataagc

SEQ ID NO: 81782 - DNA, 20 bp, Artificial Sequence
  chemically synthesized
cttaaatttcacatatattg

SEQ ID NO: 81783 - DNA, 20 bp, Artificial Sequence
  chemically synthesized
ctacaatatatgtgaaattt

SEQ ID NO: 81784 - DNA, 20 bp, Artificial Sequence
  chemically synthesized
gaaatttaagtgtgacaatt

SEQ ID NO: 81785 - DNA, 20 bp, Artificial Sequence
  chemically synthesized
gtgtgacaatttagcatgct

SEQ ID NO: 81786 - DNA, 20 bp, Artificial Sequence
  chemically synthesized
tggtactctcatagatcacc

SEQ ID NO: 81787 - DNA, 20 bp, Artificial Sequence
  chemically synthesized
tagcatgcttggtgatctat

SEQ ID NO: 81788 - DNA, 20 bp, Artificial Sequence
  chemically synthesized
gcatgcttggtgatctatga

SEQ ID NO: 81789 - DNA, 20 bp, Artificial Sequence
  chemically synthesized
gcttacagttggtactctca

SEQ ID NO: 81790 - DNA, 20 bp, Artificial Sequence
  chemically synthesized
tctatgagagtaccaactgt

SEQ ID NO: 81791 - DNA, 20 bp, Artificial Sequence
  chemically synthesized
cagaagaaactgcttacagt

SEQ ID NO: 81792 - DNA, 20 bp, Artificial Sequence
  chemically synthesized
atgagagtaccaactgtaag

SEQ ID NO: 81793 - DNA, 20 bp, Artificial Sequence
  chemically synthesized
caagcagaagaaactgctta

SEQ ID NO: 81794 - DNA, 20 bp, Artificial Sequence
  chemically synthesized
tgtaagcagtttcttctgct

SEQ ID NO: 81795 - DNA, 20 bp, Artificial Sequence
  chemically synthesized
ccccaactcccaccaagcag

SEQ ID NO: 81796 - DNA, 20 bp, Artificial Sequence
  chemically synthesized
aagcagtttcttctgcttgg

SEQ ID NO: 81797 - DNA, 20 bp, Artificial Sequence
  chemically synthesized
agcagtttcttctgcttggt

SEQ ID NO: 81798 - DNA, 20 bp, Artificial Sequence
  chemically synthesized
aacccccaactcccaccaag

SEQ ID NO: 81799 - DNA, 20 bp, Artificial Sequence
  chemically synthesized
cagtttcttctgcttggtgg

SEQ ID NO: 81800 - DNA, 20 bp, Artificial Sequence
  chemically synthesized
tacaacccccaactcccacc

SEQ ID NO: 81801 - DNA, 20 bp, Artificial Sequence
  chemically synthesized
ttcttctgcttggtgggagt

SEQ ID NO: 81802 - DNA, 20 bp, Artificial Sequence
  chemically synthesized
tcttctgcttggtgggagtt

SEQ ID NO: 81803 - DNA, 20 bp, Artificial Sequence
  chemically synthesized
cttctgcttggtgggagttg

SEQ ID NO: 81804 - DNA, 20 bp, Artificial Sequence
  chemically synthesized
ttctgcttggtgggagttgg

SEQ ID NO: 81805 - DNA, 20 bp, Artificial Sequence
  chemically synthesized
ttggtgggagttgggggttg

SEQ ID NO: 81806 - DNA, 20 bp, Artificial Sequence
  chemically synthesized
agttgggggttgtagacact

SEQ ID NO: 81807 - DNA, 20 bp, Artificial Sequence
  chemically synthesized
gttgggggttgtagacactc

SEQ ID NO: 81808 - DNA, 20 bp, Artificial Sequence
  chemically synthesized
ggggttgtagacactcagga

SEQ ID NO: 81809 - DNA, 20 bp, Artificial Sequence
  chemically synthesized
ctatctttgttgtctttcct

SEQ ID NO: 81810 - DNA, 20 bp, Artificial Sequence
  chemically synthesized
gacactcaggaaagacaaca

SEQ ID NO: 81811 - DNA, 20 bp, Artificial Sequence
  chemically synthesized
ctcaggaaagacaacaaaga

SEQ ID NO: 81812 - DNA, 20 bp, Artificial Sequence
  chemically synthesized
tcaggaaagacaacaaagat

SEQ ID NO: 81813 - DNA, 20 bp, Artificial Sequence
  chemically synthesized
aacaaagataggtaacattt

SEQ ID NO: 81814 - DNA, 20 bp, Artificial Sequence
  chemically synthesized
aagataggtaacattttggc

SEQ ID NO: 81815 - DNA, 20 bp, Artificial Sequence
  chemically synthesized
taacattttggctggtcctt

SEQ ID NO: 81816 - DNA, 20 bp, Artificial Sequence
  chemically synthesized
aacattttggctggtccttg

SEQ ID NO: 81817 - DNA, 20 bp, Artificial Sequence
  chemically synthesized
ctccttcagccctcaaggac

SEQ ID NO: 81818 - DNA, 20 bp, Artificial Sequence
  chemically synthesized
acattttggctggtccttga

SEQ ID NO: 81819 - DNA, 20 bp, Artificial Sequence
  chemically synthesized
gaattctccttcagccctca

SEQ ID NO: 81820 - DNA, 20 bp, Artificial Sequence
  chemically synthesized
cgaattctccttcagccctc

SEQ ID NO: 81821 - DNA, 20 bp, Artificial Sequence
  chemically synthesized
tggctggtccttgagggctg

SEQ ID NO: 81822 - DNA, 20 bp, Artificial Sequence
  chemically synthesized
ggctggtccttgagggctga

SEQ ID NO: 81823 - DNA, 20 bp, Artificial Sequence
  chemically synthesized
ctggtccttgagggctgaag

SEQ ID NO: 81824 - DNA, 20 bp, Artificial Sequence
  chemically synthesized
ctacttggcgaattctcctt

SEQ ID NO: 81825 - DNA, 20 bp, Artificial Sequence
  chemically synthesized
gggctgaaggagaattcgcc

SEQ ID NO: 81826 - DNA, 20 bp, Artificial Sequence
  chemically synthesized
ctgaaggagaattcgccaag

SEQ ID NO: 81827 - DNA, 20 bp, Artificial Sequence
  chemically synthesized
atccccctacgttgtctact

SEQ ID NO: 81828 - DNA, 20 bp, Artificial Sequence
  chemically synthesized
aattcgccaagtagacaacg

SEQ ID NO: 81829 - DNA, 20 bp, Artificial Sequence
  chemically synthesized
attcgccaagtagacaacgt

SEQ ID NO: 81830 - DNA, 20 bp, Artificial Sequence
  chemically synthesized
ttcgccaagtagacaacgta

SEQ ID NO: 81831 - DNA, 20 bp, Artificial Sequence
  chemically synthesized
tcgccaagtagacaacgtag

SEQ ID NO: 81832 - DNA, 20 bp, Artificial Sequence
  chemically synthesized
cgccaagtagacaacgtagg

SEQ ID NO: 81833 - DNA, 20 bp, Artificial Sequence
  chemically synthesized
gtagacaacgtagggggatc

SEQ ID NO: 81834 - DNA, 20 bp, Artificial Sequence
  chemically synthesized
acaacgtagggggatccaga

SEQ ID NO: 81835 - DNA, 20 bp, Artificial Sequence
  chemically synthesized
aacgtagggggatccagaca

SEQ ID NO: 81836 - DNA, 20 bp, Artificial Sequence
  chemically synthesized
cgtagggggatccagacaga

SEQ ID NO: 81837 - DNA, 20 bp, Artificial Sequence
  chemically synthesized
caaatgctgttctctctgtc

SEQ ID NO: 81838 - DNA, 20 bp, Artificial Sequence
  chemically synthesized
ggggatccagacagagagaa

SEQ ID NO: 81839 - DNA, 20 bp, Artificial Sequence
  chemically synthesized
cagagagaacagcatttgca

SEQ ID NO: 81840 - DNA, 20 bp, Artificial Sequence
  chemically synthesized
agagagaacagcatttgcaa

SEQ ID NO: 81841 - DNA, 20 bp, Artificial Sequence
  chemically synthesized
gagaacagcatttgcaaagg

SEQ ID NO: 81842 - DNA, 20 bp, Artificial Sequence
  chemically synthesized
tatacacatagatatagata

SEQ ID NO: 81843 - DNA, 20 bp, Artificial Sequence
  chemically synthesized
catatatatacacatagata

SEQ ID NO: 81844 - DNA, 20 bp, Artificial Sequence
  chemically synthesized
tatacacatatatatacaca

SEQ ID NO: 81845 - DNA, 20 bp, Artificial Sequence
  chemically synthesized
agtatatatacatatataca

SEQ ID NO: 81846 - DNA, 20 bp, Artificial Sequence
  chemically synthesized
tacatagttagatatataca

SEQ ID NO: 81847 - DNA, 20 bp, Artificial Sequence
  chemically synthesized
cacacacacacatacatagt

SEQ ID NO: 81848 - DNA, 20 bp, Artificial Sequence
  chemically synthesized
tatacacacacacacataca

SEQ ID NO: 81849 - DNA, 20 bp, Artificial Sequence
  chemically synthesized
acacacacacacatacttta

SEQ ID NO: 81850 - DNA, 20 bp, Artificial Sequence
  chemically synthesized
attgaatgtgtgtgtctgta

SEQ ID NO: 81851 - DNA, 20 bp, Artificial Sequence
  chemically synthesized
aaaaaggggtgatatgggca

SEQ ID NO: 81852 - DNA, 20 bp, Artificial Sequence
  chemically synthesized
ggaaaaaggggtgatatggg

SEQ ID NO: 81853 - DNA, 20 bp, Artificial Sequence
  chemically synthesized
ttgggaaaaaggggtgatat

SEQ ID NO: 81854 - DNA, 20 bp, Artificial Sequence
  chemically synthesized
tttgggaaaaaggggtgata

SEQ ID NO: 81855 - DNA, 20 bp, Artificial Sequence
  chemically synthesized
atggcatatttgggaaaaag

SEQ ID NO: 81856 - DNA, 20 bp, Artificial Sequence
  chemically synthesized
gatggcatatttgggaaaaa

SEQ ID NO: 81857 - DNA, 20 bp, Artificial Sequence
  chemically synthesized
tgatggcatatttgggaaaa

SEQ ID NO: 81858 - DNA, 20 bp, Artificial Sequence
  chemically synthesized
gtgatggcatatttgggaaa

SEQ ID NO: 81859 - DNA, 20 bp, Artificial Sequence
  chemically synthesized
atatatgtgatggcatattt

SEQ ID NO: 81860 - DNA, 20 bp, Artificial Sequence
  chemically synthesized
tatatatgtgatggcatatt

SEQ ID NO: 81861 - DNA, 20 bp, Artificial Sequence
  chemically synthesized
tgatatatatatatatgtga

SEQ ID NO: 81862 - DNA, 20 bp, Artificial Sequence
  chemically synthesized
acatatatatatatatcata

SEQ ID NO: 81863 - DNA, 20 bp, Artificial Sequence
  chemically synthesized
catatatatatatatcatat

SEQ ID NO: 81864 - DNA, 20 bp, Artificial Sequence
  chemically synthesized
atatatatatatcatatggg

SEQ ID NO: 81865 - DNA, 20 bp, Artificial Sequence
  chemically synthesized
atatatatatcatatgggca

SEQ ID NO: 81866 - DNA, 20 bp, Artificial Sequence
  chemically synthesized
tatgggcagagtgtattaaa

SEQ ID NO: 81867 - DNA, 20 bp, Artificial Sequence
  chemically synthesized
gcagagtgtattaaatggtc

SEQ ID NO: 81868 - DNA, 20 bp, Artificial Sequence
  chemically synthesized
agagtgtattaaatggtctg

SEQ ID NO: 81869 - DNA, 20 bp, Artificial Sequence
  chemically synthesized
gtattaaatggtctggagaa

SEQ ID NO: 81870 - DNA, 20 bp, Artificial Sequence
  chemically synthesized
tattaaatggtctggagaat

SEQ ID NO: 81871 - DNA, 20 bp, Artificial Sequence
  chemically synthesized
cagccatagctcctattctc

SEQ ID NO: 81872 - DNA, 20 bp, Artificial Sequence
  chemically synthesized
ttaaatggtctggagaatag

SEQ ID NO: 81873 - DNA, 20 bp, Artificial Sequence
  chemically synthesized
ggtctggagaataggagcta

SEQ ID NO: 81874 - DNA, 20 bp, Artificial Sequence
  chemically synthesized
ggagaataggagctatggct

SEQ ID NO: 81875 - DNA, 20 bp, Artificial Sequence
  chemically synthesized
ttgacttaccttctcagcca

SEQ ID NO: 81876 - DNA, 20 bp, Artificial Sequence
  chemically synthesized
gaataggagctatggctgag

SEQ ID NO: 81877 - DNA, 20 bp, Artificial Sequence
  chemically synthesized
aataggagctatggctgaga

SEQ ID NO: 81878 - DNA, 20 bp, Artificial Sequence
  chemically synthesized
ggagctatggctgagaaggt

SEQ ID NO: 81879 - DNA, 20 bp, Artificial Sequence
  chemically synthesized
ctagccttgacttaccttct

SEQ ID NO: 81880 - DNA, 20 bp, Artificial Sequence
  chemically synthesized
tatggctgagaaggtaagtc

SEQ ID NO: 81881 - DNA, 20 bp, Artificial Sequence
  chemically synthesized
atggctgagaaggtaagtca

SEQ ID NO: 81882 - DNA, 20 bp, Artificial Sequence
  chemically synthesized
ctgagaaggtaagtcaaggc

SEQ ID NO: 81883 - DNA, 20 bp, Artificial Sequence
  chemically synthesized
tgagaaggtaagtcaaggct

SEQ ID NO: 81884 - DNA, 20 bp, Artificial Sequence
  chemically synthesized
gaaggtaagtcaaggctagg

SEQ ID NO: 81885 - DNA, 20 bp, Artificial Sequence
  chemically synthesized
taagtcaaggctaggaagaa

SEQ ID NO: 81886 - DNA, 20 bp, Artificial Sequence
  chemically synthesized
ttacgtggcccttttcttcc

SEQ ID NO: 81887 - DNA, 20 bp, Artificial Sequence
  chemically synthesized
aagtcaaggctaggaagaaa

SEQ ID NO: 81888 - DNA, 20 bp, Artificial Sequence
  chemically synthesized
agtcaaggctaggaagaaaa

SEQ ID NO: 81889 - DNA, 20 bp, Artificial Sequence
  chemically synthesized
caatgaataaggagattacg

SEQ ID NO: 81890 - DNA, 20 bp, Artificial Sequence
  chemically synthesized
aatgaaatccaatgaataag

SEQ ID NO: 81891 - DNA, 20 bp, Artificial Sequence
  chemically synthesized
cacgtaatctccttattcat

SEQ ID NO: 81892 - DNA, 20 bp, Artificial Sequence
  chemically synthesized
agaatgaaatccaatgaata

SEQ ID NO: 81893 - DNA, 20 bp, Artificial Sequence
  chemically synthesized
gagaatgaaatccaatgaat

SEQ ID NO: 81894 - DNA, 20 bp, Artificial Sequence
  chemically synthesized
attcattggatttcattctc

SEQ ID NO: 81895 - DNA, 20 bp, Artificial Sequence
  chemically synthesized
ttcattggatttcattctct

SEQ ID NO: 81896 - DNA, 20 bp, Artificial Sequence
  chemically synthesized
ttggatttcattctctaggc

SEQ ID NO: 81897 - DNA, 20 bp, Artificial Sequence
  chemically synthesized
tgcgggagaatacttgccta

SEQ ID NO: 81898 - DNA, 20 bp, Artificial Sequence
  chemically synthesized
cttgcgggagaatacttgcc

SEQ ID NO: 81899 - DNA, 20 bp, Artificial Sequence
  chemically synthesized
ctaggcaagtattctcccgc

SEQ ID NO: 81900 - DNA, 20 bp, Artificial Sequence
  chemically synthesized
taggcaagtattctcccgca

SEQ ID NO: 81901 - DNA, 20 bp, Artificial Sequence
  chemically synthesized
ggcaagtattctcccgcaag

SEQ ID NO: 81902 - DNA, 20 bp, Artificial Sequence
  chemically synthesized
ccaatccaaactccttgcgg

SEQ ID NO: 81903 - DNA, 20 bp, Artificial Sequence
  chemically synthesized
ttccaatccaaactccttgc

SEQ ID NO: 81904 - DNA, 20 bp, Artificial Sequence
  chemically synthesized
attccaatccaaactccttg

SEQ ID NO: 81905 - DNA, 20 bp, Artificial Sequence
  chemically synthesized
gtattctcccgcaaggagtt

SEQ ID NO: 81906 - DNA, 20 bp, Artificial Sequence
  chemically synthesized
ctcccgcaaggagtttggat

SEQ ID NO: 81907 - DNA, 20 bp, Artificial Sequence
  chemically synthesized
caaggagtttggattggaat

SEQ ID NO: 81908 - DNA, 20 bp, Artificial Sequence
  chemically synthesized
ggagtttggattggaattgg

SEQ ID NO: 81909 - DNA, 20 bp, Artificial Sequence
  chemically synthesized
gtttggattggaattggaag

SEQ ID NO: 81910 - DNA, 20 bp, Artificial Sequence
  chemically synthesized
ggattggaattggaagaagc

SEQ ID NO: 81911 - DNA, 20 bp, Artificial Sequence
  chemically synthesized
gattggaattggaagaagct

SEQ ID NO: 81912 - DNA, 20 bp, Artificial Sequence
  chemically synthesized
ttggaagaagctgggtaatg

SEQ ID NO: 81913 - DNA, 20 bp, Artificial Sequence
  chemically synthesized
gctgatgttcctgcattacc

SEQ ID NO: 81914 - DNA, 20 bp, Artificial Sequence
  chemically synthesized
tggaagaagctgggtaatgc

SEQ ID NO: 81915 - DNA, 20 bp, Artificial Sequence
  chemically synthesized
gctgggtaatgcaggaacat

SEQ ID NO: 81916 - DNA, 20 bp, Artificial Sequence
  chemically synthesized
gtaatgcaggaacatcagca

SEQ ID NO: 81917 - DNA, 20 bp, Artificial Sequence
  chemically synthesized
tgaattaatggatggatgaa

SEQ ID NO: 81918 - DNA, 20 bp, Artificial Sequence
  chemically synthesized
acatttggtgaattaatgga

SEQ ID NO: 81919 - DNA, 20 bp, Artificial Sequence
  chemically synthesized
ttaaacatttggtgaattaa

SEQ ID NO: 81920 - DNA, 20 bp, Artificial Sequence
  chemically synthesized
gatactgcattttaaacatt

SEQ ID NO: 81921 - DNA, 20 bp, Artificial Sequence
  chemically synthesized
ttcaccaaatgtttaaaatg

SEQ ID NO: 81922 - DNA, 20 bp, Artificial Sequence
  chemically synthesized
atgtttaaaatgcagtatct

SEQ ID NO: 81923 - DNA, 20 bp, Artificial Sequence
  chemically synthesized
tctgtgtgcctggcatatct

SEQ ID NO: 81924 - DNA, 20 bp, Artificial Sequence
  chemically synthesized
atgcagtatctgagatatgc

SEQ ID NO: 81925 - DNA, 20 bp, Artificial Sequence
  chemically synthesized
tgcagtatctgagatatgcc

SEQ ID NO: 81926 - DNA, 20 bp, Artificial Sequence
  chemically synthesized
tctgagatatgccaggcaca

SEQ ID NO: 81927 - DNA, 20 bp, Artificial Sequence
  chemically synthesized
cattcacccctctgtgtgcc

SEQ ID NO: 81928 - DNA, 20 bp, Artificial Sequence
  chemically synthesized
tgagatatgccaggcacaca

SEQ ID NO: 81929 - DNA, 20 bp, Artificial Sequence
  chemically synthesized
gagatatgccaggcacacag

SEQ ID NO: 81930 - DNA, 20 bp, Artificial Sequence
  chemically synthesized
agatatgccaggcacacaga

SEQ ID NO: 81931 - DNA, 20 bp, Artificial Sequence
  chemically synthesized
gatatgccaggcacacagag

SEQ ID NO: 81932 - DNA, 20 bp, Artificial Sequence
  chemically synthesized
caggcacacagaggggtgaa

SEQ ID NO: 81933 - DNA, 20 bp, Artificial Sequence
  chemically synthesized
aggcacacagaggggtgaat

SEQ ID NO: 81934 - DNA, 20 bp, Artificial Sequence
  chemically synthesized
agaggggtgaatgggattta

SEQ ID NO: 81935 - DNA, 20 bp, Artificial Sequence
  chemically synthesized
atcttttacttagatgataa

SEQ ID NO: 81936 - DNA, 20 bp, Artificial Sequence
  chemically synthesized
gatgtatactgttatcatct

SEQ ID NO: 81937 - DNA, 20 bp, Artificial Sequence
  chemically synthesized
tactgttatcatctaagtaa

SEQ ID NO: 81938 - DNA, 20 bp, Artificial Sequence
  chemically synthesized
aatccccagcatcttttact

SEQ ID NO: 81939 - DNA, 20 bp, Artificial Sequence
  chemically synthesized
atcatctaagtaaaagatgc

SEQ ID NO: 81940 - DNA, 20 bp, Artificial Sequence
  chemically synthesized
tcatctaagtaaaagatgct

SEQ ID NO: 81941 - DNA, 20 bp, Artificial Sequence
  chemically synthesized
catctaagtaaaagatgctg

SEQ ID NO: 81942 - DNA, 20 bp, Artificial Sequence
  chemically synthesized
ccaatgtcctttttaatccc

SEQ ID NO: 81943 - DNA, 20 bp, Artificial Sequence
  chemically synthesized
aaaagatgctggggattaaa

SEQ ID NO: 81944 - DNA, 20 bp, Artificial Sequence
  chemically synthesized
aaagatgctggggattaaaa

SEQ ID NO: 81945 - DNA, 20 bp, Artificial Sequence
  chemically synthesized
ctggggattaaaaaggacat

SEQ ID NO: 81946 - DNA, 20 bp, Artificial Sequence
  chemically synthesized
ttaaaaaggacattggttaa

SEQ ID NO: 81947 - DNA, 20 bp, Artificial Sequence
  chemically synthesized
aaaaaggacattggttaaaa

SEQ ID NO: 81948 - DNA, 20 bp, Artificial Sequence
  chemically synthesized
aaaaggacattggttaaaag

SEQ ID NO: 81949 - DNA, 20 bp, Artificial Sequence
  chemically synthesized
aaggacattggttaaaagag

SEQ ID NO: 81950 - DNA, 20 bp, Artificial Sequence
  chemically synthesized
ggacattggttaaaagagga

SEQ ID NO: 81951 - DNA, 20 bp, Artificial Sequence
  chemically synthesized
aaagaggagagaaaacacaa

SEQ ID NO: 81952 - DNA, 20 bp, Artificial Sequence
  chemically synthesized
agaggagagaaaacacaaaa

SEQ ID NO: 81953 - DNA, 20 bp, Artificial Sequence
  chemically synthesized
aaacacaaaagagctattct

SEQ ID NO: 81954 - DNA, 20 bp, Artificial Sequence
  chemically synthesized
aacacaaaagagctattctg

SEQ ID NO: 81955 - DNA, 20 bp, Artificial Sequence
  chemically synthesized
tggctcatgttacctcagaa

SEQ ID NO: 81956 - DNA, 20 bp, Artificial Sequence
  chemically synthesized
catgatggctcatgttacct

SEQ ID NO: 81957 - DNA, 20 bp, Artificial Sequence
  chemically synthesized
gagctattctgaggtaacat

SEQ ID NO: 81958 - DNA, 20 bp, Artificial Sequence
  chemically synthesized
ttttcactgatggcacatga

SEQ ID NO: 81959 - DNA, 20 bp, Artificial Sequence
  chemically synthesized
catgagccatcatgtgccat

SEQ ID NO: 81960 - DNA, 20 bp, Artificial Sequence
  chemically synthesized
cccttctgcattttcactga

SEQ ID NO: 81961 - DNA, 20 bp, Artificial Sequence
  chemically synthesized
atgtgccatcagtgaaaatg

SEQ ID NO: 81962 - DNA, 20 bp, Artificial Sequence
  chemically synthesized
tgccatcagtgaaaatgcag

SEQ ID NO: 81963 - DNA, 20 bp, Artificial Sequence
  chemically synthesized
gccatcagtgaaaatgcaga

SEQ ID NO: 81964 - DNA, 20 bp, Artificial Sequence
  chemically synthesized
ccatcagtgaaaatgcagaa

SEQ ID NO: 81965 - DNA, 20 bp, Artificial Sequence
  chemically synthesized
gtgaaaatgcagaagggttt

SEQ ID NO: 81966 - DNA, 20 bp, Artificial Sequence
  chemically synthesized
tgaaaatgcagaagggttta

SEQ ID NO: 81967 - DNA, 20 bp, Artificial Sequence
  chemically synthesized
agggtttaaggatgaaccta

SEQ ID NO: 81968 - DNA, 20 bp, Artificial Sequence
  chemically synthesized
ttttccaggctagaaacttt

SEQ ID NO: 81969 - DNA, 20 bp, Artificial Sequence
  chemically synthesized
aaggatgaacctaaagtttc

SEQ ID NO: 81970 - DNA, 20 bp, Artificial Sequence
  chemically synthesized
attttccaggctagaaactt

SEQ ID NO: 81971 - DNA, 20 bp, Artificial Sequence
  chemically synthesized
tgaacctaaagtttctagcc

SEQ ID NO: 81972 - DNA, 20 bp, Artificial Sequence
  chemically synthesized
atccaacaaattttccaggc

SEQ ID NO: 81973 - DNA, 20 bp, Artificial Sequence
  chemically synthesized
catcatccaacaaattttcc

SEQ ID NO: 81974 - DNA, 20 bp, Artificial Sequence
  chemically synthesized
tcatcatccaacaaattttc

SEQ ID NO: 81975 - DNA, 20 bp, Artificial Sequence
  chemically synthesized
ttctagcctggaaaatttgt

SEQ ID NO: 81976 - DNA, 20 bp, Artificial Sequence
  chemically synthesized
tgatgattcattaactgaaa

SEQ ID NO: 81977 - DNA, 20 bp, Artificial Sequence
  chemically synthesized
gatgattcattaactgaaat

SEQ ID NO: 81978 - DNA, 20 bp, Artificial Sequence
  chemically synthesized
ttttttcctgtttcctattt

SEQ ID NO: 81979 - DNA, 20 bp, Artificial Sequence
  chemically synthesized
tcattaactgaaataggaaa

SEQ ID NO: 81980 - DNA, 20 bp, Artificial Sequence
  chemically synthesized
cattaactgaaataggaaac

SEQ ID NO: 81981 - DNA, 20 bp, Artificial Sequence
  chemically synthesized
aaataggaaacaggaaaaaa

SEQ ID NO: 81982 - DNA, 20 bp, Artificial Sequence
  chemically synthesized
aataggaaacaggaaaaaaa

SEQ ID NO: 81983 - DNA, 20 bp, Artificial Sequence
  chemically synthesized
ggaaacaggaaaaaaaaggt

SEQ ID NO: 81984 - DNA, 20 bp, Artificial Sequence
  chemically synthesized
caggaaaaaaaaggtcagat

SEQ ID NO: 81985 - DNA, 20 bp, Artificial Sequence
  chemically synthesized
ggaaaaaaaaggtcagataa

SEQ ID NO: 81986 - DNA, 20 bp, Artificial Sequence
  chemically synthesized
gaaaaaaaaggtcagataag

SEQ ID NO: 81987 - DNA, 20 bp, Artificial Sequence
  chemically synthesized
aaaaaaaaggtcagataaga

SEQ ID NO: 81988 - DNA, 20 bp, Artificial Sequence
  chemically synthesized
aaaaaaaggtcagataagag

SEQ ID NO: 81989 - DNA, 20 bp, Artificial Sequence
  chemically synthesized
aaaggtcagataagagggga

SEQ ID NO: 81990 - DNA, 20 bp, Artificial Sequence
  chemically synthesized
ggtcagataagaggggacag

SEQ ID NO: 81991 - DNA, 20 bp, Artificial Sequence
  chemically synthesized
cagataagaggggacagaag

SEQ ID NO: 81992 - DNA, 20 bp, Artificial Sequence
  chemically synthesized
agataagaggggacagaagt

SEQ ID NO: 81993 - DNA, 20 bp, Artificial Sequence
  chemically synthesized
gataagaggggacagaagta

SEQ ID NO: 81994 - DNA, 20 bp, Artificial Sequence
  chemically synthesized
aggggacagaagtagggaaa

SEQ ID NO: 81995 - DNA, 20 bp, Artificial Sequence
  chemically synthesized
agaagtagggaaatggaaaa

SEQ ID NO: 81996 - DNA, 20 bp, Artificial Sequence
  chemically synthesized
gaagtagggaaatggaaaac

SEQ ID NO: 81997 - DNA, 20 bp, Artificial Sequence
  chemically synthesized
agtagggaaatggaaaacag

SEQ ID NO: 81998 - DNA, 20 bp, Artificial Sequence
  chemically synthesized
aacaggagaacaaatgaact

SEQ ID NO: 81999 - DNA, 20 bp, Artificial Sequence
  chemically synthesized
agaacaaatgaacttggttt

SEQ ID NO: 82000 - DNA, 20 bp, Artificial Sequence
  chemically synthesized
aatgcaactattctgaaacc

SEQ ID NO: 82001 - DNA, 20 bp, Artificial Sequence
  chemically synthesized
aaatgaacttggtttcagaa

SEQ ID NO: 82002 - DNA, 20 bp, Artificial Sequence
  chemically synthesized
tttgtgatcgtaatgccaca

SEQ ID NO: 82003 - DNA, 20 bp, Artificial Sequence
  chemically synthesized
ttctgatctctgaatccatg

SEQ ID NO: 82004 - DNA, 20 bp, Artificial Sequence
  chemically synthesized
atcgtaatgccacatggatt

SEQ ID NO: 82005 - DNA, 20 bp, Artificial Sequence
  chemically synthesized
cgtaatgccacatggattca

SEQ ID NO: 82006 - DNA, 20 bp, Artificial Sequence
  chemically synthesized
tgccacatggattcagagat

SEQ ID NO: 82007 - DNA, 20 bp, Artificial Sequence
  chemically synthesized
cacatggattcagagatcag

SEQ ID NO: 82008 - DNA, 20 bp, Artificial Sequence
  chemically synthesized
catggattcagagatcagaa

SEQ ID NO: 82009 - DNA, 20 bp, Artificial Sequence
  chemically synthesized
tggattcagagatcagaaga

SEQ ID NO: 82010 - DNA, 20 bp, Artificial Sequence
  chemically synthesized
cagagatcagaagagagatg

SEQ ID NO: 82011 - DNA, 20 bp, Artificial Sequence
  chemically synthesized
atcagaagagagatgcggac

SEQ ID NO: 82012 - DNA, 20 bp, Artificial Sequence
  chemically synthesized
cagaagagagatgcggacta

SEQ ID NO: 82013 - DNA, 20 bp, Artificial Sequence
  chemically synthesized
agagatgcggactagagatg

SEQ ID NO: 82014 - DNA, 20 bp, Artificial Sequence
  chemically synthesized
tggtgatgtatctacatctc

SEQ ID NO: 82015 - DNA, 20 bp, Artificial Sequence
  chemically synthesized
gatgtagatacatcaccatc

SEQ ID NO: 82016 - DNA, 20 bp, Artificial Sequence
  chemically synthesized
atgtagatacatcaccatcc

SEQ ID NO: 82017 - DNA, 20 bp, Artificial Sequence
  chemically synthesized
cctgtttgagatggcctgga

SEQ ID NO: 82018 - DNA, 20 bp, Artificial Sequence
  chemically synthesized
cctccctgtttgagatggcc

SEQ ID NO: 82019 - DNA, 20 bp, Artificial Sequence
  chemically synthesized
accatccaggccatctcaaa

SEQ ID NO: 82020 - DNA, 20 bp, Artificial Sequence
  chemically synthesized
taaaccctccctgtttgaga

SEQ ID NO: 82021 - DNA, 20 bp, Artificial Sequence
  chemically synthesized
ccatccaggccatctcaaac

SEQ ID NO: 82022 - DNA, 20 bp, Artificial Sequence
  chemically synthesized
catccaggccatctcaaaca

SEQ ID NO: 82023 - DNA, 20 bp, Artificial Sequence
  chemically synthesized
tccaggccatctcaaacagg

SEQ ID NO: 82024 - DNA, 20 bp, Artificial Sequence
  chemically synthesized
tgtttaaaccctccctgttt

SEQ ID NO: 82025 - DNA, 20 bp, Artificial Sequence
  chemically synthesized
ccaggccatctcaaacaggg

SEQ ID NO: 82026 - DNA, 20 bp, Artificial Sequence
  chemically synthesized
caggccatctcaaacaggga

SEQ ID NO: 82027 - DNA, 20 bp, Artificial Sequence
  chemically synthesized
gggagggtttaaacaatcaa

SEQ ID NO: 82028 - DNA, 20 bp, Artificial Sequence
  chemically synthesized
gagggtttaaacaatcaaaa

SEQ ID NO: 82029 - DNA, 20 bp, Artificial Sequence
  chemically synthesized
ttaaacaatcaaaagagaat

SEQ ID NO: 82030 - DNA, 20 bp, Artificial Sequence
  chemically synthesized
taaacaatcaaaagagaatt

SEQ ID NO: 82031 - DNA, 20 bp, Artificial Sequence
  chemically synthesized
aatcaaaagagaattaggct

SEQ ID NO: 82032 - DNA, 20 bp, Artificial Sequence
  chemically synthesized
atcaaaagagaattaggcta

SEQ ID NO: 82033 - DNA, 20 bp, Artificial Sequence
  chemically synthesized
aaagagaattaggctaaggt

SEQ ID NO: 82034 - DNA, 20 bp, Artificial Sequence
  chemically synthesized
tgtgcccaagtttctaacct

SEQ ID NO: 82035 - DNA, 20 bp, Artificial Sequence
  chemically synthesized
ttaggctaaggttagaaact

SEQ ID NO: 82036 - DNA, 20 bp, Artificial Sequence
  chemically synthesized
taggctaaggttagaaactt

SEQ ID NO: 82037 - DNA, 20 bp, Artificial Sequence
  chemically synthesized
cctcaaatactgttgtgccc

SEQ ID NO: 82038 - DNA, 20 bp, Artificial Sequence
  chemically synthesized
ggttagaaacttgggcacaa

SEQ ID NO: 82039 - DNA, 20 bp, Artificial Sequence
  chemically synthesized
acttgggcacaacagtattt

SEQ ID NO: 82040 - DNA, 20 bp, Artificial Sequence
  chemically synthesized
cttgggcacaacagtatttg

SEQ ID NO: 82041 - DNA, 20 bp, Artificial Sequence
  chemically synthesized
ttgggcacaacagtatttga

SEQ ID NO: 82042 - DNA, 20 bp, Artificial Sequence
  chemically synthesized
tgggcacaacagtatttgag

SEQ ID NO: 82043 - DNA, 20 bp, Artificial Sequence
  chemically synthesized
gcacaacagtatttgagggg

SEQ ID NO: 82044 - DNA, 20 bp, Artificial Sequence
  chemically synthesized
aacagtatttgaggggtggc

SEQ ID NO: 82045 - DNA, 20 bp, Artificial Sequence
  chemically synthesized
acagtatttgaggggtggct

SEQ ID NO: 82046 - DNA, 20 bp, Artificial Sequence
  chemically synthesized
agtatttgaggggtggctag

SEQ ID NO: 82047 - DNA, 20 bp, Artificial Sequence
  chemically synthesized
atttgaggggtggctaggag

SEQ ID NO: 82048 - DNA, 20 bp, Artificial Sequence
  chemically synthesized
atttttctagattcttctcc

SEQ ID NO: 82049 - DNA, 20 bp, Artificial Sequence
  chemically synthesized
gggtggctaggagaagaatc

SEQ ID NO: 82050 - DNA, 20 bp, Artificial Sequence
  chemically synthesized
ttcttcttcctatatttttc

SEQ ID NO: 82051 - DNA, 20 bp, Artificial Sequence
  chemically synthesized
gagaagaatctagaaaaata

SEQ ID NO: 82052 - DNA, 20 bp, Artificial Sequence
  chemically synthesized
agaagaatctagaaaaatat

SEQ ID NO: 82053 - DNA, 20 bp, Artificial Sequence
  chemically synthesized
agaatctagaaaaatatagg

SEQ ID NO: 82054 - DNA, 20 bp, Artificial Sequence
  chemically synthesized
atctagaaaaatataggaag

SEQ ID NO: 82055 - DNA, 20 bp, Artificial Sequence
  chemically synthesized
aaaatataggaagaagaaca

SEQ ID NO: 82056 - DNA, 20 bp, Artificial Sequence
  chemically synthesized
tataggaagaagaacatgga

SEQ ID NO: 82057 - DNA, 20 bp, Artificial Sequence
  chemically synthesized
gaagaagaacatggatggaa

SEQ ID NO: 82058 - DNA, 20 bp, Artificial Sequence
  chemically synthesized
tggatggaacagttccatga

SEQ ID NO: 82059 - DNA, 20 bp, Artificial Sequence
  chemically synthesized
gtcctcttccttggctttca

SEQ ID NO: 82060 - DNA, 20 bp, Artificial Sequence
  chemically synthesized
ggaacagttccatgaaagcc

SEQ ID NO: 82061 - DNA, 20 bp, Artificial Sequence
  chemically synthesized
gaacagttccatgaaagcca

SEQ ID NO: 82062 - DNA, 20 bp, Artificial Sequence
  chemically synthesized
cagttccatgaaagccaagg

SEQ ID NO: 82063 - DNA, 20 bp, Artificial Sequence
  chemically synthesized
gttccatgaaagccaaggaa

SEQ ID NO: 82064 - DNA, 20 bp, Artificial Sequence
  chemically synthesized
ttccatgaaagccaaggaag

SEQ ID NO: 82065 - DNA, 20 bp, Artificial Sequence
  chemically synthesized
ctagaagttgtcctcttcct

SEQ ID NO: 82066 - DNA, 20 bp, Artificial Sequence
  chemically synthesized
ccaaggaagaggacaacttc

SEQ ID NO: 82067 - DNA, 20 bp, Artificial Sequence
  chemically synthesized
aagaggacaacttctagaat

SEQ ID NO: 82068 - DNA, 20 bp, Artificial Sequence
  chemically synthesized
tctcagcatcctcattctag

SEQ ID NO: 82069 - DNA, 20 bp, Artificial Sequence
  chemically synthesized
agaggacaacttctagaatg

SEQ ID NO: 82070 - DNA, 20 bp, Artificial Sequence
  chemically synthesized
gcatctcagcatcctcattc

SEQ ID NO: 82071 - DNA, 20 bp, Artificial Sequence
  chemically synthesized
acttctagaatgaggatgct

SEQ ID NO: 82072 - DNA, 20 bp, Artificial Sequence
  chemically synthesized
gaatgaggatgctgagatgc

SEQ ID NO: 82073 - DNA, 20 bp, Artificial Sequence
  chemically synthesized
cagcatgtttgccagcatct

SEQ ID NO: 82074 - DNA, 20 bp, Artificial Sequence
  chemically synthesized
catgcactcagcatgtttgc

SEQ ID NO: 82075 - DNA, 20 bp, Artificial Sequence
  chemically synthesized
gagatgctggcaaacatgct

SEQ ID NO: 82076 - DNA, 20 bp, Artificial Sequence
  chemically synthesized
ggcaaacatgctgagtgcat

SEQ ID NO: 82077 - DNA, 20 bp, Artificial Sequence
  chemically synthesized
gttaaattccctcatgcact

SEQ ID NO: 82078 - DNA, 20 bp, Artificial Sequence
  chemically synthesized
gcaaacatgctgagtgcatg

SEQ ID NO: 82079 - DNA, 20 bp, Artificial Sequence
  chemically synthesized
caaacatgctgagtgcatga

SEQ ID NO: 82080 - DNA, 20 bp, Artificial Sequence
  chemically synthesized
cctagattaaaattcaaaag

SEQ ID NO: 82081 - DNA, 20 bp, Artificial Sequence
  chemically synthesized
cctcctagattaaaattcaa

SEQ ID NO: 82082 - DNA, 20 bp, Artificial Sequence
  chemically synthesized
acttcttttgaattttaatc

SEQ ID NO: 82083 - DNA, 20 bp, Artificial Sequence
  chemically synthesized
cttcttttgaattttaatct

SEQ ID NO: 82084 - DNA, 20 bp, Artificial Sequence
  chemically synthesized
tcttttgaattttaatctag

SEQ ID NO: 82085 - DNA, 20 bp, Artificial Sequence
  chemically synthesized
cttttgaattttaatctagg

SEQ ID NO: 82086 - DNA, 20 bp, Artificial Sequence
  chemically synthesized
caaaatcacaaaaatcctcc

SEQ ID NO: 82087 - DNA, 20 bp, Artificial Sequence
  chemically synthesized
gatttttgtgattttgacaa

SEQ ID NO: 82088 - DNA, 20 bp, Artificial Sequence
  chemically synthesized
ttgtgattttgacaatagat

SEQ ID NO: 82089 - DNA, 20 bp, Artificial Sequence
  chemically synthesized
tgattttgacaatagatgag

SEQ ID NO: 82090 - DNA, 20 bp, Artificial Sequence
  chemically synthesized
taggagtatcattttgaaat

SEQ ID NO: 82091 - DNA, 20 bp, Artificial Sequence
  chemically synthesized
agaaaaaaatacatatttag

SEQ ID NO: 82092 - DNA, 20 bp, Artificial Sequence
  chemically synthesized
gtagaaaaaaatacatattt

SEQ ID NO: 82093 - DNA, 20 bp, Artificial Sequence
  chemically synthesized
tgtagaaaaaaatacatatt

SEQ ID NO: 82094 - DNA, 20 bp, Artificial Sequence
  chemically synthesized
taaatatgtatttttttcta

SEQ ID NO: 82095 - DNA, 20 bp, Artificial Sequence
  chemically synthesized
aagatggcaaatatattctg

SEQ ID NO: 82096 - DNA, 20 bp, Artificial Sequence
  chemically synthesized
attcccttgtggcacaaaga

SEQ ID NO: 82097 - DNA, 20 bp, Artificial Sequence
  chemically synthesized
ttaaattcccttgtggcaca

SEQ ID NO: 82098 - DNA, 20 bp, Artificial Sequence
  chemically synthesized
atttgccatctttgtgccac

SEQ ID NO: 82099 - DNA, 20 bp, Artificial Sequence
  chemically synthesized
tttgccatctttgtgccaca

SEQ ID NO: 82100 - DNA, 20 bp, Artificial Sequence
  chemically synthesized
ttgccatctttgtgccacaa

SEQ ID NO: 82101 - DNA, 20 bp, Artificial Sequence
  chemically synthesized
accaaagttaaattcccttg

SEQ ID NO: 82102 - DNA, 20 bp, Artificial Sequence
  chemically synthesized
gccacaagggaatttaactt

SEQ ID NO: 82103 - DNA, 20 bp, Artificial Sequence
  chemically synthesized
gaccactgtctataagacca

SEQ ID NO: 82104 - DNA, 20 bp, Artificial Sequence
  chemically synthesized
ggaatttaactttggtctta

SEQ ID NO: 82105 - DNA, 20 bp, Artificial Sequence
  chemically synthesized
tttaactttggtcttataga

SEQ ID NO: 82106 - DNA, 20 bp, Artificial Sequence
  chemically synthesized
tttggaagaccactgtctat

SEQ ID NO: 82107 - DNA, 20 bp, Artificial Sequence
  chemically synthesized
aactttggtcttatagacag

SEQ ID NO: 82108 - DNA, 20 bp, Artificial Sequence
  chemically synthesized
gaaaatcattatatatttgg

SEQ ID NO: 82109 - DNA, 20 bp, Artificial Sequence
  chemically synthesized
agggaaaatcattatatatt

SEQ ID NO: 82110 - DNA, 20 bp, Artificial Sequence
  chemically synthesized
ttggcccactgcagaaatga

SEQ ID NO: 82111 - DNA, 20 bp, Artificial Sequence
  chemically synthesized
attggcccactgcagaaatg

SEQ ID NO: 82112 - DNA, 20 bp, Artificial Sequence
  chemically synthesized
atgattttccctcatttctg

SEQ ID NO: 82113 - DNA, 20 bp, Artificial Sequence
  chemically synthesized
cattggcccactgcagaaat

SEQ ID NO: 82114 - DNA, 20 bp, Artificial Sequence
  chemically synthesized
attttccctcatttctgcag

SEQ ID NO: 82115 - DNA, 20 bp, Artificial Sequence
  chemically synthesized
ttttccctcatttctgcagt

SEQ ID NO: 82116 - DNA, 20 bp, Artificial Sequence
  chemically synthesized
caagtttcattggcccactg

SEQ ID NO: 82117 - DNA, 20 bp, Artificial Sequence
  chemically synthesized
aatacagtttcaagtttcat

SEQ ID NO: 82118 - DNA, 20 bp, Artificial Sequence
  chemically synthesized
aacatttgtaatacagtttc

SEQ ID NO: 82119 - DNA, 20 bp, Artificial Sequence
  chemically synthesized
ggaaggcaacatttgtaata

SEQ ID NO: 82120 - DNA, 20 bp, Artificial Sequence
  chemically synthesized
tattacaaatgttgccttcc

SEQ ID NO: 82121 - DNA, 20 bp, Artificial Sequence
  chemically synthesized
attacaaatgttgccttcca

SEQ ID NO: 82122 - DNA, 20 bp, Artificial Sequence
  chemically synthesized
ttacaaatgttgccttccaa

SEQ ID NO: 82123 - DNA, 20 bp, Artificial Sequence
  chemically synthesized
tgtgttgcccttcccttgga

SEQ ID NO: 82124 - DNA, 20 bp, Artificial Sequence
  chemically synthesized
caaatgttgccttccaaggg

SEQ ID NO: 82125 - DNA, 20 bp, Artificial Sequence
  chemically synthesized
atgtgttgcccttcccttgg

SEQ ID NO: 82126 - DNA, 20 bp, Artificial Sequence
  chemically synthesized
aaatgttgccttccaaggga

SEQ ID NO: 82127 - DNA, 20 bp, Artificial Sequence
  chemically synthesized
aatgttgccttccaagggaa

SEQ ID NO: 82128 - DNA, 20 bp, Artificial Sequence
  chemically synthesized
ttaatgtgttgcccttccct

SEQ ID NO: 82129 - DNA, 20 bp, Artificial Sequence
  chemically synthesized
agggaagggcaacacattaa

SEQ ID NO: 82130 - DNA, 20 bp, Artificial Sequence
  chemically synthesized
agttatggtttggtgaaata

SEQ ID NO: 82131 - DNA, 20 bp, Artificial Sequence
  chemically synthesized
aagttatggtttggtgaaat

SEQ ID NO: 82132 - DNA, 20 bp, Artificial Sequence
  chemically synthesized
gacttgggtaagttatggtt

SEQ ID NO: 82133 - DNA, 20 bp, Artificial Sequence
  chemically synthesized
tacatgacttgggtaagtta

SEQ ID NO: 82134 - DNA, 20 bp, Artificial Sequence
  chemically synthesized
caccaaaccataacttaccc

SEQ ID NO: 82135 - DNA, 20 bp, Artificial Sequence
  chemically synthesized
ccaaattacatgacttgggt

SEQ ID NO: 82136 - DNA, 20 bp, Artificial Sequence
  chemically synthesized
ctaaccaaattacatgactt

SEQ ID NO: 82137 - DNA, 20 bp, Artificial Sequence
  chemically synthesized
gctaaccaaattacatgact

SEQ ID NO: 82138 - DNA, 20 bp, Artificial Sequence
  chemically synthesized
cttacccaagtcatgtaatt

SEQ ID NO: 82139 - DNA, 20 bp, Artificial Sequence
  chemically synthesized
cccaagtcatgtaatttggt

SEQ ID NO: 82140 - DNA, 20 bp, Artificial Sequence
  chemically synthesized
tcatgtaatttggttagcaa

SEQ ID NO: 82141 - DNA, 20 bp, Artificial Sequence
  chemically synthesized
catgtaatttggttagcaaa

SEQ ID NO: 82142 - DNA, 20 bp, Artificial Sequence
  chemically synthesized
atgtaatttggttagcaaaa

SEQ ID NO: 82143 - DNA, 20 bp, Artificial Sequence
  chemically synthesized
ttagcaaaagggccaacacc

SEQ ID NO: 82144 - DNA, 20 bp, Artificial Sequence
  chemically synthesized
aaagccaggagtctaggtgt

SEQ ID NO: 82145 - DNA, 20 bp, Artificial Sequence
  chemically synthesized
agggccaacacctagactcc

SEQ ID NO: 82146 - DNA, 20 bp, Artificial Sequence
  chemically synthesized
taatcaaaagccaggagtct

SEQ ID NO: 82147 - DNA, 20 bp, Artificial Sequence
  chemically synthesized
ttaatcaaaagccaggagtc

SEQ ID NO: 82148 - DNA, 20 bp, Artificial Sequence
  chemically synthesized
aacacttaatcaaaagccag

SEQ ID NO: 82149 - DNA, 20 bp, Artificial Sequence
  chemically synthesized
aaaacacttaatcaaaagcc

SEQ ID NO: 82150 - DNA, 20 bp, Artificial Sequence
  chemically synthesized
taaaacacttaatcaaaagc

SEQ ID NO: 82151 - DNA, 20 bp, Artificial Sequence
  chemically synthesized
tagactcctggcttttgatt

SEQ ID NO: 82152 - DNA, 20 bp, Artificial Sequence
  chemically synthesized
aaaataaaacacttaatcaa

SEQ ID NO: 82153 - DNA, 20 bp, Artificial Sequence
  chemically synthesized
tgttacttagtatcagaata

SEQ ID NO: 82154 - DNA, 20 bp, Artificial Sequence
  chemically synthesized
tttttctgtattctgatact

SEQ ID NO: 82155 - DNA, 20 bp, Artificial Sequence
  chemically synthesized
ttgcttgtgttacttagtat

SEQ ID NO: 82156 - DNA, 20 bp, Artificial Sequence
  chemically synthesized
ggtgtattgcttgtgttact

SEQ ID NO: 82157 - DNA, 20 bp, Artificial Sequence
  chemically synthesized
attctgatactaagtaacac

SEQ ID NO: 82158 - DNA, 20 bp, Artificial Sequence
  chemically synthesized
gtgtgtgtgtgtgtgtgtat

SEQ ID NO: 82159 - DNA, 20 bp, Artificial Sequence
  chemically synthesized
acacacacacacacacacat

SEQ ID NO: 82160 - DNA, 20 bp, Artificial Sequence
  chemically synthesized
cacacacacacatcagactt

SEQ ID NO: 82161 - DNA, 20 bp, Artificial Sequence
  chemically synthesized
gatattaagtgattgtacta

SEQ ID NO: 82162 - DNA, 20 bp, Artificial Sequence
  chemically synthesized
agtacaatcacttaatatca

SEQ ID NO: 82163 - DNA, 20 bp, Artificial Sequence
  chemically synthesized
atcactttgactttgatatt

SEQ ID NO: 82164 - DNA, 20 bp, Artificial Sequence
  chemically synthesized
atcacttaatatcaaagtca

SEQ ID NO: 82165 - DNA, 20 bp, Artificial Sequence
  chemically synthesized
tattaaaacagttacagggc

SEQ ID NO: 82166 - DNA, 20 bp, Artificial Sequence
  chemically synthesized
gaaatattaaaacagttaca

SEQ ID NO: 82167 - DNA, 20 bp, Artificial Sequence
  chemically synthesized
tgaaatattaaaacagttac

SEQ ID NO: 82168 - DNA, 20 bp, Artificial Sequence
  chemically synthesized
atgaaatattaaaacagtta

SEQ ID NO: 82169 - DNA, 20 bp, Artificial Sequence
  chemically synthesized
tatgaaatgaaatattaaaa

SEQ ID NO: 82170 - DNA, 20 bp, Artificial Sequence
  chemically synthesized
tatttcatttcatataactg

SEQ ID NO: 82171 - DNA, 20 bp, Artificial Sequence
  chemically synthesized
tcatttcatataactgaaga

SEQ ID NO: 82172 - DNA, 20 bp, Artificial Sequence
  chemically synthesized
tctaattatttgtctgtctt

SEQ ID NO: 82173 - DNA, 20 bp, Artificial Sequence
  chemically synthesized
actgaagacagacaaataat

SEQ ID NO: 82174 - DNA, 20 bp, Artificial Sequence
  chemically synthesized
gtattttctccaagagaaga

SEQ ID NO: 82175 - DNA, 20 bp, Artificial Sequence
  chemically synthesized
attagatcactgtcttctct

SEQ ID NO: 82176 - DNA, 20 bp, Artificial Sequence
  chemically synthesized
tagatcactgtcttctcttg

SEQ ID NO: 82177 - DNA, 20 bp, Artificial Sequence
  chemically synthesized
catggtattttctccaagag

SEQ ID NO: 82178 - DNA, 20 bp, Artificial Sequence
  chemically synthesized
tcacatggtattttctccaa

SEQ ID NO: 82179 - DNA, 20 bp, Artificial Sequence
  chemically synthesized
attcacatggtattttctcc

SEQ ID NO: 82180 - DNA, 20 bp, Artificial Sequence
  chemically synthesized
aaattcagtcttcattcaca

SEQ ID NO: 82181 - DNA, 20 bp, Artificial Sequence
  chemically synthesized
gagaaaataccatgtgaatg

SEQ ID NO: 82182 - DNA, 20 bp, Artificial Sequence
  chemically synthesized
cagtccgtctttcacaaatt

SEQ ID NO: 82183 - DNA, 20 bp, Artificial Sequence
  chemically synthesized
aatgaagactgaatttgtga

SEQ ID NO: 82184 - DNA, 20 bp, Artificial Sequence
  chemically synthesized
aagactgaatttgtgaaaga

SEQ ID NO: 82185 - DNA, 20 bp, Artificial Sequence
  chemically synthesized
gaaagacggactgatttctc

SEQ ID NO: 82186 - DNA, 20 bp, Artificial Sequence
  chemically synthesized
aaagttaaagctagagaaat

SEQ ID NO: 82187 - DNA, 20 bp, Artificial Sequence
  chemically synthesized
ttcccacaaagttaaagcta

SEQ ID NO: 82188 - DNA, 20 bp, Artificial Sequence
  chemically synthesized
tcttcccacaaagttaaagc

SEQ ID NO: 82189 - DNA, 20 bp, Artificial Sequence
  chemically synthesized
gttatcttcccacaaagtta

SEQ ID NO: 82190 - DNA, 20 bp, Artificial Sequence
  chemically synthesized
tttctctagctttaactttg

SEQ ID NO: 82191 - DNA, 20 bp, Artificial Sequence
  chemically synthesized
ttctctagctttaactttgt

SEQ ID NO: 82192 - DNA, 20 bp, Artificial Sequence
  chemically synthesized
tctagctttaactttgtggg

SEQ ID NO: 82193 - DNA, 20 bp, Artificial Sequence
  chemically synthesized
tgcagtgttatcttcccaca

SEQ ID NO: 82194 - DNA, 20 bp, Artificial Sequence
  chemically synthesized
gggaagataacactgcactc

SEQ ID NO: 82195 - DNA, 20 bp, Artificial Sequence
  chemically synthesized
ttctaatctgaacttgagtg

SEQ ID NO: 82196 - DNA, 20 bp, Artificial Sequence
  chemically synthesized
gataacactgcactcaagtt

SEQ ID NO: 82197 - DNA, 20 bp, Artificial Sequence
  chemically synthesized
agagcttctaatctgaactt

SEQ ID NO: 82198 - DNA, 20 bp, Artificial Sequence
  chemically synthesized
cactgcactcaagttcagat

SEQ ID NO: 82199 - DNA, 20 bp, Artificial Sequence
  chemically synthesized
tgcactcaagttcagattag

SEQ ID NO: 82200 - DNA, 20 bp, Artificial Sequence
  chemically synthesized
ttcagattagaagctctttt

SEQ ID NO: 82201 - DNA, 20 bp, Artificial Sequence
  chemically synthesized
gccctttgagagactcaaaa

SEQ ID NO: 82202 - DNA, 20 bp, Artificial Sequence
  chemically synthesized
gggccctttgagagactcaa

SEQ ID NO: 82203 - DNA, 20 bp, Artificial Sequence
  chemically synthesized
aagctcttttgagtctctca

SEQ ID NO: 82204 - DNA, 20 bp, Artificial Sequence
  chemically synthesized
agctcttttgagtctctcaa

SEQ ID NO: 82205 - DNA, 20 bp, Artificial Sequence
  chemically synthesized
gctcttttgagtctctcaaa

SEQ ID NO: 82206 - DNA, 20 bp, Artificial Sequence
  chemically synthesized
tttgcttcagggccctttga

SEQ ID NO: 82207 - DNA, 20 bp, Artificial Sequence
  chemically synthesized
tctttgcttcagggcccttt

SEQ ID NO: 82208 - DNA, 20 bp, Artificial Sequence
  chemically synthesized
gagtctctcaaagggccctg

SEQ ID NO: 82209 - DNA, 20 bp, Artificial Sequence
  chemically synthesized
tctcaaagggccctgaagca

SEQ ID NO: 82210 - DNA, 20 bp, Artificial Sequence
  chemically synthesized
ccgtctacttctttgcttca

SEQ ID NO: 82211 - DNA, 20 bp, Artificial Sequence
  chemically synthesized
accgtctacttctttgcttc

SEQ ID NO: 82212 - DNA, 20 bp, Artificial Sequence
  chemically synthesized
taccgtctacttctttgctt

SEQ ID NO: 82213 - DNA, 20 bp, Artificial Sequence
  chemically synthesized
caaagggccctgaagcaaag

SEQ ID NO: 82214 - DNA, 20 bp, Artificial Sequence
  chemically synthesized
agggccctgaagcaaagaag

SEQ ID NO: 82215 - DNA, 20 bp, Artificial Sequence
  chemically synthesized
ccctgaagcaaagaagtaga

SEQ ID NO: 82216 - DNA, 20 bp, Artificial Sequence
  chemically synthesized
agatcacctcgagaaagtca

SEQ ID NO: 82217 - DNA, 20 bp, Artificial Sequence
  chemically synthesized
aagatcacctcgagaaagtc

SEQ ID NO: 82218 - DNA, 20 bp, Artificial Sequence
  chemically synthesized
gacggtaccttgactttctc

SEQ ID NO: 82219 - DNA, 20 bp, Artificial Sequence
  chemically synthesized
acggtaccttgactttctcg

SEQ ID NO: 82220 - DNA, 20 bp, Artificial Sequence
  chemically synthesized
tctccaagatcacctcgaga

SEQ ID NO: 82221 - DNA, 20 bp, Artificial Sequence
  chemically synthesized
actctctccaagatcacctc

SEQ ID NO: 82222 - DNA, 20 bp, Artificial Sequence
  chemically synthesized
tgactttctcgaggtgatct

SEQ ID NO: 82223 - DNA, 20 bp, Artificial Sequence
  chemically synthesized
actttctcgaggtgatcttg

SEQ ID NO: 82224 - DNA, 20 bp, Artificial Sequence
  chemically synthesized
tttctcgaggtgatcttgga

SEQ ID NO: 82225 - DNA, 20 bp, Artificial Sequence
  chemically synthesized
tctcgaggtgatcttggaga

SEQ ID NO: 82226 - DNA, 20 bp, Artificial Sequence
  chemically synthesized
tctcctcattgactctctcc

SEQ ID NO: 82227 - DNA, 20 bp, Artificial Sequence
  chemically synthesized
tgatcttggagagagtcaat

SEQ ID NO: 82228 - DNA, 20 bp, Artificial Sequence
  chemically synthesized
gatcttggagagagtcaatg

SEQ ID NO: 82229 - DNA, 20 bp, Artificial Sequence
  chemically synthesized
tcttggagagagtcaatgag

SEQ ID NO: 82230 - DNA, 20 bp, Artificial Sequence
  chemically synthesized
gtcaatgaggagatcgccca

SEQ ID NO: 82231 - DNA, 20 bp, Artificial Sequence
  chemically synthesized
tcaatgaggagatcgcccac

SEQ ID NO: 82232 - DNA, 20 bp, Artificial Sequence
  chemically synthesized
aagggatcctggcagcccgt

SEQ ID NO: 82233 - DNA, 20 bp, Artificial Sequence
  chemically synthesized
caagggatcctggcagcccg

SEQ ID NO: 82234 - DNA, 20 bp, Artificial Sequence
  chemically synthesized
ggagatcgcccacgggctgc

SEQ ID NO: 82235 - DNA, 20 bp, Artificial Sequence
  chemically synthesized
gagatcgcccacgggctgcc

SEQ ID NO: 82236 - DNA, 20 bp, Artificial Sequence
  chemically synthesized
aggtgatcaagggatcctgg

SEQ ID NO: 82237 - DNA, 20 bp, Artificial Sequence
  chemically synthesized
ctgaggtgatcaagggatcc

SEQ ID NO: 82238 - DNA, 20 bp, Artificial Sequence
  chemically synthesized
cgccaagctgaggtgatcaa

SEQ ID NO: 82239 - DNA, 20 bp, Artificial Sequence
  chemically synthesized
gcgccaagctgaggtgatca

SEQ ID NO: 82240 - DNA, 20 bp, Artificial Sequence
  chemically synthesized
tgcgccaagctgaggtgatc

SEQ ID NO: 82241 - DNA, 20 bp, Artificial Sequence
  chemically synthesized
ccaggatcccttgatcacct

SEQ ID NO: 82242 - DNA, 20 bp, Artificial Sequence
  chemically synthesized
atcccttgatcacctcagct

SEQ ID NO: 82243 - DNA, 20 bp, Artificial Sequence
  chemically synthesized
cctcaagctgcgccaagctg

SEQ ID NO: 82244 - DNA, 20 bp, Artificial Sequence
  chemically synthesized
acctcaagctgcgccaagct

SEQ ID NO: 82245 - DNA, 20 bp, Artificial Sequence
  chemically synthesized
ttgatcacctcagcttggcg

SEQ ID NO: 82246 - DNA, 20 bp, Artificial Sequence
  chemically synthesized
gctggacctcaagctgcgcc

SEQ ID NO: 82247 - DNA, 20 bp, Artificial Sequence
  chemically synthesized
acctcagcttggcgcagctt

SEQ ID NO: 82248 - DNA, 20 bp, Artificial Sequence
  chemically synthesized
cctcagcttggcgcagcttg

SEQ ID NO: 82249 - DNA, 20 bp, Artificial Sequence
  chemically synthesized
gcttggcgcagcttgaggtc

SEQ ID NO: 82250 - DNA, 20 bp, Artificial Sequence
  chemically synthesized
ccacggatgagctggacctc

SEQ ID NO: 82251 - DNA, 20 bp, Artificial Sequence
  chemically synthesized
tcaagaggccacggatgagc

SEQ ID NO: 82252 - DNA, 20 bp, Artificial Sequence
  chemically synthesized
cttgaggtccagctcatccg

SEQ ID NO: 82253 - DNA, 20 bp, Artificial Sequence
  chemically synthesized
aacttcaagaggccacggat

SEQ ID NO: 82254 - DNA, 20 bp, Artificial Sequence
  chemically synthesized
ccaggaacttcaagaggcca

SEQ ID NO: 82255 - DNA, 20 bp, Artificial Sequence
  chemically synthesized
agctcatccgtggcctcttg

SEQ ID NO: 82256 - DNA, 20 bp, Artificial Sequence
  chemically synthesized
aagactccaggaacttcaag

SEQ ID NO: 82257 - DNA, 20 bp, Artificial Sequence
  chemically synthesized
aaagactccaggaacttcaa

SEQ ID NO: 82258 - DNA, 20 bp, Artificial Sequence
  chemically synthesized
tgaaagactccaggaacttc

SEQ ID NO: 82259 - DNA, 20 bp, Artificial Sequence
  chemically synthesized
ccgtggcctcttgaagttcc

SEQ ID NO: 82260 - DNA, 20 bp, Artificial Sequence
  chemically synthesized
gtggcctcttgaagttcctg

SEQ ID NO: 82261 - DNA, 20 bp, Artificial Sequence
  chemically synthesized
tgagacccttgaaagactcc

SEQ ID NO: 82262 - DNA, 20 bp, Artificial Sequence
  chemically synthesized
atgagacccttgaaagactc

SEQ ID NO: 82263 - DNA, 20 bp, Artificial Sequence
  chemically synthesized
tgaagttcctggagtctttc

SEQ ID NO: 82264 - DNA, 20 bp, Artificial Sequence
  chemically synthesized
gaagttcctggagtctttca

SEQ ID NO: 82265 - DNA, 20 bp, Artificial Sequence
  chemically synthesized
aagttcctggagtctttcaa

SEQ ID NO: 82266 - DNA, 20 bp, Artificial Sequence
  chemically synthesized
aaaatagatgagacccttga

SEQ ID NO: 82267 - DNA, 20 bp, Artificial Sequence
  chemically synthesized
actggcagagaaaaatagat

SEQ ID NO: 82268 - DNA, 20 bp, Artificial Sequence
  chemically synthesized
cgctgactggcagagaaaaa

SEQ ID NO: 82269 - DNA, 20 bp, Artificial Sequence
  chemically synthesized
tctcatctatttttctctgc

SEQ ID NO: 82270 - DNA, 20 bp, Artificial Sequence
  chemically synthesized
atctatttttctctgccagt

SEQ ID NO: 82271 - DNA, 20 bp, Artificial Sequence
  chemically synthesized
ctgcactccgctgactggca

SEQ ID NO: 82272 - DNA, 20 bp, Artificial Sequence
  chemically synthesized
acctgcactccgctgactgg

SEQ ID NO: 82273 - DNA, 20 bp, Artificial Sequence
  chemically synthesized
tatttttctctgccagtcag

SEQ ID NO: 82274 - DNA, 20 bp, Artificial Sequence
  chemically synthesized
tttttctctgccagtcagcg

SEQ ID NO: 82275 - DNA, 20 bp, Artificial Sequence
  chemically synthesized
tgaacctgcactccgctgac

SEQ ID NO: 82276 - DNA, 20 bp, Artificial Sequence
  chemically synthesized
ctctgccagtcagcggagtg

SEQ ID NO: 82277 - DNA, 20 bp, Artificial Sequence
  chemically synthesized
tctgccagtcagcggagtgc

SEQ ID NO: 82278 - DNA, 20 bp, Artificial Sequence
  chemically synthesized
caggttcaatttttcccact

SEQ ID NO: 82279 - DNA, 20 bp, Artificial Sequence
  chemically synthesized
tgaggaggtcaatactgagt

SEQ ID NO: 82280 - DNA, 20 bp, Artificial Sequence
  chemically synthesized
ctgaggaggtcaatactgag

SEQ ID NO: 82281 - DNA, 20 bp, Artificial Sequence
  chemically synthesized
aggctgaggaggtcaatact

SEQ ID NO: 82282 - DNA, 20 bp, Artificial Sequence
  chemically synthesized
ccactcagtattgacctcct

SEQ ID NO: 82283 - DNA, 20 bp, Artificial Sequence
  chemically synthesized
tctacgaaagcaggctgagg

SEQ ID NO: 82284 - DNA, 20 bp, Artificial Sequence
  chemically synthesized
ttctacgaaagcaggctgag

SEQ ID NO: 82285 - DNA, 20 bp, Artificial Sequence
  chemically synthesized
gcttctacgaaagcaggctg

SEQ ID NO: 82286 - DNA, 20 bp, Artificial Sequence
  chemically synthesized
ggcttctacgaaagcaggct

SEQ ID NO: 82287 - DNA, 20 bp, Artificial Sequence
  chemically synthesized
acctcctcagcctgctttcg

SEQ ID NO: 82288 - DNA, 20 bp, Artificial Sequence
  chemically synthesized
cactcggcttctacgaaagc

SEQ ID NO: 82289 - DNA, 20 bp, Artificial Sequence
  chemically synthesized
tcactcggcttctacgaaag

SEQ ID NO: 82290 - DNA, 20 bp, Artificial Sequence
  chemically synthesized
tcctcagcctgctttcgtag

SEQ ID NO: 82291 - DNA, 20 bp, Artificial Sequence
  chemically synthesized
atgtcactcggcttctacga

SEQ ID NO: 82292 - DNA, 20 bp, Artificial Sequence
  chemically synthesized
agcctgctttcgtagaagcc

SEQ ID NO: 82293 - DNA, 20 bp, Artificial Sequence
  chemically synthesized
agagagcccagaatgtcact

SEQ ID NO: 82294 - DNA, 20 bp, Artificial Sequence
  chemically synthesized
gtagaagccgagtgacattc

SEQ ID NO: 82295 - DNA, 20 bp, Artificial Sequence
  chemically synthesized
tagaagccgagtgacattct

SEQ ID NO: 82296 - DNA, 20 bp, Artificial Sequence
  chemically synthesized
tgcctcctgaggagagagcc

SEQ ID NO: 82297 - DNA, 20 bp, Artificial Sequence
  chemically synthesized
gacattctgggctctctcct

SEQ ID NO: 82298 - DNA, 20 bp, Artificial Sequence
  chemically synthesized
acattctgggctctctcctc

SEQ ID NO: 82299 - DNA, 20 bp, Artificial Sequence
  chemically synthesized
agagctgcctcctgaggaga

SEQ ID NO: 82300 - DNA, 20 bp, Artificial Sequence
  chemically synthesized
attctgggctctctcctcag

SEQ ID NO: 82301 - DNA, 20 bp, Artificial Sequence
  chemically synthesized
ttagagctgcctcctgagga

SEQ ID NO: 82302 - DNA, 20 bp, Artificial Sequence
  chemically synthesized
ttctgggctctctcctcagg

SEQ ID NO: 82303 - DNA, 20 bp, Artificial Sequence
  chemically synthesized
atttagagctgcctcctgag

SEQ ID NO: 82304 - DNA, 20 bp, Artificial Sequence
  chemically synthesized
tgggctctctcctcaggagg

SEQ ID NO: 82305 - DNA, 20 bp, Artificial Sequence
  chemically synthesized
caatttagagctgcctcctg

SEQ ID NO: 82306 - DNA, 20 bp, Artificial Sequence
  chemically synthesized
ccaatttagagctgcctcct

SEQ ID NO: 82307 - DNA, 20 bp, Artificial Sequence
  chemically synthesized
ctcaggaggcagctctaaat

SEQ ID NO: 82308 - DNA, 20 bp, Artificial Sequence
  chemically synthesized
cttgtcatattgccaattta

SEQ ID NO: 82309 - DNA, 20 bp, Artificial Sequence
  chemically synthesized
accttgtcatattgccaatt

SEQ ID NO: 82310 - DNA, 20 bp, Artificial Sequence
  chemically synthesized
ctctaaattggcaatatgac

SEQ ID NO: 82311 - DNA, 20 bp, Artificial Sequence
  chemically synthesized
tctaaattggcaatatgaca

SEQ ID NO: 82312 - DNA, 20 bp, Artificial Sequence
  chemically synthesized
ttggcaatatgacaaggttt

SEQ ID NO: 82313 - DNA, 20 bp, Artificial Sequence
  chemically synthesized
tggcaatatgacaaggtttt

SEQ ID NO: 82314 - DNA, 20 bp, Artificial Sequence
  chemically synthesized
atgtttaaaaaaaaagaatg

SEQ ID NO: 82315 - DNA, 20 bp, Artificial Sequence
  chemically synthesized
tttgacaatgtttaaaaaaa

SEQ ID NO: 82316 - DNA, 20 bp, Artificial Sequence
  chemically synthesized
tttttttaaacattgtcaaa

SEQ ID NO: 82317 - DNA, 20 bp, Artificial Sequence
  chemically synthesized
ttttttaaacattgtcaaaa

SEQ ID NO: 82318 - DNA, 20 bp, Artificial Sequence
  chemically synthesized
cattgtcaaaaaggtcatac

SEQ ID NO: 82319 - DNA, 20 bp, Artificial Sequence
  chemically synthesized
tgtcaaaaaggtcatactgg

SEQ ID NO: 82320 - DNA, 20 bp, Artificial Sequence
  chemically synthesized
aaaaaggtcatactggaaga

SEQ ID NO: 82321 - DNA, 20 bp, Artificial Sequence
  chemically synthesized
actgtactctttctttcttc

SEQ ID NO: 82322 - DNA, 20 bp, Artificial Sequence
  chemically synthesized
aggtcatactggaagaaaga

SEQ ID NO: 82323 - DNA, 20 bp, Artificial Sequence
  chemically synthesized
gtcatactggaagaaagaaa

SEQ ID NO: 82324 - DNA, 20 bp, Artificial Sequence
  chemically synthesized
actggaagaaagaaagagta

SEQ ID NO: 82325 - DNA, 20 bp, Artificial Sequence
  chemically synthesized
aagaaagagtacagttgaac

SEQ ID NO: 82326 - DNA, 20 bp, Artificial Sequence
  chemically synthesized
gaaagagtacagttgaacaa

SEQ ID NO: 82327 - DNA, 20 bp, Artificial Sequence
  chemically synthesized
aaagagtacagttgaacaag

SEQ ID NO: 82328 - DNA, 20 bp, Artificial Sequence
  chemically synthesized
aagagtacagttgaacaaga

SEQ ID NO: 82329 - DNA, 20 bp, Artificial Sequence
  chemically synthesized
taaaaaagccgttaatcagt

SEQ ID NO: 82330 - DNA, 20 bp, Artificial Sequence
  chemically synthesized
ataaaaaagccgttaatcag

SEQ ID NO: 82331 - DNA, 20 bp, Artificial Sequence
  chemically synthesized
gagggtaacctactgattaa

SEQ ID NO: 82332 - DNA, 20 bp, Artificial Sequence
  chemically synthesized
agtataaaaaagccgttaat

SEQ ID NO: 82333 - DNA, 20 bp, Artificial Sequence
  chemically synthesized
atttatgccaaagtataaaa

SEQ ID NO: 82334 - DNA, 20 bp, Artificial Sequence
  chemically synthesized
ttaacggcttttttatactt

SEQ ID NO: 82335 - DNA, 20 bp, Artificial Sequence
  chemically synthesized
ctgtatcaaaatttatgcca

SEQ ID NO: 82336 - DNA, 20 bp, Artificial Sequence
  chemically synthesized
ctttggcataaattttgata

SEQ ID NO: 82337 - DNA, 20 bp, Artificial Sequence
  chemically synthesized
gcataaattttgatacagcc

SEQ ID NO: 82338 - DNA, 20 bp, Artificial Sequence
  chemically synthesized
agatatactttagatgttct

SEQ ID NO: 82339 - DNA, 20 bp, Artificial Sequence
  chemically synthesized
aagatatactttagatgttc

SEQ ID NO: 82340 - DNA, 20 bp, Artificial Sequence
  chemically synthesized
gatacagcccagaacatcta

SEQ ID NO: 82341 - DNA, 20 bp, Artificial Sequence
  chemically synthesized
aaactcaggaagatatactt

SEQ ID NO: 82342 - DNA, 20 bp, Artificial Sequence
  chemically synthesized
catctaaagtatatcttcct

SEQ ID NO: 82343 - DNA, 20 bp, Artificial Sequence
  chemically synthesized
atataaggtagaaactcagg

SEQ ID NO: 82344 - DNA, 20 bp, Artificial Sequence
  chemically synthesized
ttgatataaggtagaaactc

SEQ ID NO: 82345 - DNA, 20 bp, Artificial Sequence
  chemically synthesized
attgatataaggtagaaact

SEQ ID NO: 82346 - DNA, 20 bp, Artificial Sequence
  chemically synthesized
attgtcggattgatataagg

SEQ ID NO: 82347 - DNA, 20 bp, Artificial Sequence
  chemically synthesized
taaattgtcggattgatata

SEQ ID NO: 82348 - DNA, 20 bp, Artificial Sequence
  chemically synthesized
ttaaattgtcggattgatat

SEQ ID NO: 82349 - DNA, 20 bp, Artificial Sequence
  chemically synthesized
ttatatcaatccgacaattt

SEQ ID NO: 82350 - DNA, 20 bp, Artificial Sequence
  chemically synthesized
ttaagtgaatcttaaattgt

SEQ ID NO: 82351 - DNA, 20 bp, Artificial Sequence
  chemically synthesized
cgacaatttaagattcactt

SEQ ID NO: 82352 - DNA, 20 bp, Artificial Sequence
  chemically synthesized
gtttttctcctcaatagctt

SEQ ID NO: 82353 - DNA, 20 bp, Artificial Sequence
  chemically synthesized
taagattcacttaagctatt

SEQ ID NO: 82354 - DNA, 20 bp, Artificial Sequence
  chemically synthesized
aagattcacttaagctattg

SEQ ID NO: 82355 - DNA, 20 bp, Artificial Sequence
  chemically synthesized
gattcacttaagctattgag

SEQ ID NO: 82356 - DNA, 20 bp, Artificial Sequence
  chemically synthesized
cctaacgtttttctcctcaa

SEQ ID NO: 82357 - DNA, 20 bp, Artificial Sequence
  chemically synthesized
gctattgaggagaaaaacgt

SEQ ID NO: 82358 - DNA, 20 bp, Artificial Sequence
  chemically synthesized
ctattgaggagaaaaacgtt

SEQ ID NO: 82359 - DNA, 20 bp, Artificial Sequence
  chemically synthesized
aacgttaggatgcataccac

SEQ ID NO: 82360 - DNA, 20 bp, Artificial Sequence
  chemically synthesized
ctgaagtaaattagagcttg

SEQ ID NO: 82361 - DNA, 20 bp, Artificial Sequence
  chemically synthesized
agcctgcctgaagtaaatta

SEQ ID NO: 82362 - DNA, 20 bp, Artificial Sequence
  chemically synthesized
agagcctgcctgaagtaaat

SEQ ID NO: 82363 - DNA, 20 bp, Artificial Sequence
  chemically synthesized
ccacaagctctaatttactt

SEQ ID NO: 82364 - DNA, 20 bp, Artificial Sequence
  chemically synthesized
cacaagctctaatttacttc

SEQ ID NO: 82365 - DNA, 20 bp, Artificial Sequence
  chemically synthesized
aagctctaatttacttcagg

SEQ ID NO: 82366 - DNA, 20 bp, Artificial Sequence
  chemically synthesized
agctctaatttacttcaggc

SEQ ID NO: 82367 - DNA, 20 bp, Artificial Sequence
  chemically synthesized
tccatttaagagcctgcctg

SEQ ID NO: 82368 - DNA, 20 bp, Artificial Sequence
  chemically synthesized
acttcaggcaggctcttaaa

SEQ ID NO: 82369 - DNA, 20 bp, Artificial Sequence
  chemically synthesized
caagttaattttccatttaa

SEQ ID NO: 82370 - DNA, 20 bp, Artificial Sequence
  chemically synthesized
tacaagttaattttccattt

SEQ ID NO: 82371 - DNA, 20 bp, Artificial Sequence
  chemically synthesized
ttaaatggaaaattaacttg

SEQ ID NO: 82372 - DNA, 20 bp, Artificial Sequence
  chemically synthesized
tctattgttgcaaagactac

SEQ ID NO: 82373 - DNA, 20 bp, Artificial Sequence
  chemically synthesized
ggaggaattctattgttgca

SEQ ID NO: 82374 - DNA, 20 bp, Artificial Sequence
  chemically synthesized
acttgtagtctttgcaacaa

SEQ ID NO: 82375 - DNA, 20 bp, Artificial Sequence
  chemically synthesized
aacaatagaattcctcctca

SEQ ID NO: 82376 - DNA, 20 bp, Artificial Sequence
  chemically synthesized
aaagggagttatctgtgagg

SEQ ID NO: 82377 - DNA, 20 bp, Artificial Sequence
  chemically synthesized
caaagggagttatctgtgag

SEQ ID NO: 82378 - DNA, 20 bp, Artificial Sequence
  chemically synthesized
aacaaagggagttatctgtg

SEQ ID NO: 82379 - DNA, 20 bp, Artificial Sequence
  chemically synthesized
aaacaaagggagttatctgt

SEQ ID NO: 82380 - DNA, 20 bp, Artificial Sequence
  chemically synthesized
tagaaaataataaacaaagg

SEQ ID NO: 82381 - DNA, 20 bp, Artificial Sequence
  chemically synthesized
tttagaaaataataaacaaa

SEQ ID NO: 82382 - DNA, 20 bp, Artificial Sequence
  chemically synthesized
atttagaaaataataaacaa

SEQ ID NO: 82383 - DNA, 20 bp, Artificial Sequence
  chemically synthesized
catttagaaaataataaaca

SEQ ID NO: 82384 - DNA, 20 bp, Artificial Sequence
  chemically synthesized
caatcagttattggaacatt

SEQ ID NO: 82385 - DNA, 20 bp, Artificial Sequence
  chemically synthesized
agagattagcaatcagttat

SEQ ID NO: 82386 - DNA, 20 bp, Artificial Sequence
  chemically synthesized
catcaaaagagattagcaat

SEQ ID NO: 82387 - DNA, 20 bp, Artificial Sequence
  chemically synthesized
aaataaacatcaaaagagat

SEQ ID NO: 82388 - DNA, 20 bp, Artificial Sequence
  chemically synthesized
ttcataaataaacatcaaaa

SEQ ID NO: 82389 - DNA, 20 bp, Artificial Sequence
  chemically synthesized
cattcataaataaacatcaa

SEQ ID NO: 82390 - DNA, 20 bp, Artificial Sequence
  chemically synthesized
ataaactaccatgcataaat

SEQ ID NO: 82391 - DNA, 20 bp, Artificial Sequence
  chemically synthesized
tgcacaaactgatttatgca

SEQ ID NO: 82392 - DNA, 20 bp, Artificial Sequence
  chemically synthesized
acaaactgatttatgcatgg

SEQ ID NO: 82393 - DNA, 20 bp, Artificial Sequence
  chemically synthesized
atttatgcatggtagtttat

SEQ ID NO: 82394 - DNA, 20 bp, Artificial Sequence
  chemically synthesized
tagatgctgaaaaaaaaata

SEQ ID NO: 82395 - DNA, 20 bp, Artificial Sequence
  chemically synthesized
atagatgctgaaaaaaaaat

SEQ ID NO: 82396 - DNA, 20 bp, Artificial Sequence
  chemically synthesized
atgagtccttattttttttt

SEQ ID NO: 82397 - DNA, 20 bp, Artificial Sequence
  chemically synthesized
gaatcaattcaaattaaaca

SEQ ID NO: 82398 - DNA, 20 bp, Artificial Sequence
  chemically synthesized
tgaattgattctatttaacc

SEQ ID NO: 82399 - DNA, 20 bp, Artificial Sequence
  chemically synthesized
ctcatattttcttggttaaa

SEQ ID NO: 82400 - DNA, 20 bp, Artificial Sequence
  chemically synthesized
ggatagctctcatattttct

SEQ ID NO: 82401 - DNA, 20 bp, Artificial Sequence
  chemically synthesized
ctatttaaccaagaaaatat

SEQ ID NO: 82402 - DNA, 20 bp, Artificial Sequence
  chemically synthesized
atttaaccaagaaaatatga

SEQ ID NO: 82403 - DNA, 20 bp, Artificial Sequence
  chemically synthesized
aagaaaatatgagagctatc

SEQ ID NO: 82404 - DNA, 20 bp, Artificial Sequence
  chemically synthesized
tcttgctgccagggtctgga

SEQ ID NO: 82405 - DNA, 20 bp, Artificial Sequence
  chemically synthesized
tatgagagctatccagaccc

SEQ ID NO: 82406 - DNA, 20 bp, Artificial Sequence
  chemically synthesized
ccattcttgctgccagggtc

SEQ ID NO: 82407 - DNA, 20 bp, Artificial Sequence
  chemically synthesized
gagagctatccagaccctgg

SEQ ID NO: 82408 - DNA, 20 bp, Artificial Sequence
  chemically synthesized
gctatccagaccctggcagc

SEQ ID NO: 82409 - DNA, 20 bp, Artificial Sequence
  chemically synthesized
cccatccattcttgctgcca

SEQ ID NO: 82410 - DNA, 20 bp, Artificial Sequence
  chemically synthesized
gcccatccattcttgctgcc

SEQ ID NO: 82411 - DNA, 20 bp, Artificial Sequence
  chemically synthesized
agcccatccattcttgctgc

SEQ ID NO: 82412 - DNA, 20 bp, Artificial Sequence
  chemically synthesized
ccagaccctggcagcaagaa

SEQ ID NO: 82413 - DNA, 20 bp, Artificial Sequence
  chemically synthesized
accctggcagcaagaatgga

SEQ ID NO: 82414 - DNA, 20 bp, Artificial Sequence
  chemically synthesized
ccctggcagcaagaatggat

SEQ ID NO: 82415 - DNA, 20 bp, Artificial Sequence
  chemically synthesized
aaggatcagtggtgacggag

SEQ ID NO: 82416 - DNA, 20 bp, Artificial Sequence
  chemically synthesized
tagaaggatcagtggtgacg

SEQ ID NO: 82417 - DNA, 20 bp, Artificial Sequence
  chemically synthesized
gatagaaggatcagtggtga

SEQ ID NO: 82418 - DNA, 20 bp, Artificial Sequence
  chemically synthesized
catattgatagaaggatcag

SEQ ID NO: 82419 - DNA, 20 bp, Artificial Sequence
  chemically synthesized
taacatattgatagaaggat

SEQ ID NO: 82420 - DNA, 20 bp, Artificial Sequence
  chemically synthesized
tataataacatattgataga

SEQ ID NO: 82421 - DNA, 20 bp, Artificial Sequence
  chemically synthesized
ctataataacatattgatag

SEQ ID NO: 82422 - DNA, 20 bp, Artificial Sequence
  chemically synthesized
gaactataataacatattga

SEQ ID NO: 82423 - DNA, 20 bp, Artificial Sequence
  chemically synthesized
cttctatcaatatgttatta

SEQ ID NO: 82424 - DNA, 20 bp, Artificial Sequence
  chemically synthesized
agcccagaggtaattgaatg

SEQ ID NO: 82425 - DNA, 20 bp, Artificial Sequence
  chemically synthesized
gttccacattcaattacctc

SEQ ID NO: 82426 - DNA, 20 bp, Artificial Sequence
  chemically synthesized
ttccacattcaattacctct

SEQ ID NO: 82427 - DNA, 20 bp, Artificial Sequence
  chemically synthesized
aaactctaccaggagcccag

SEQ ID NO: 82428 - DNA, 20 bp, Artificial Sequence
  chemically synthesized
gaaactctaccaggagccca

SEQ ID NO: 82429 - DNA, 20 bp, Artificial Sequence
  chemically synthesized
ttcaattacctctgggctcc

SEQ ID NO: 82430 - DNA, 20 bp, Artificial Sequence
  chemically synthesized
gagaaactctaccaggagcc

SEQ ID NO: 82431 - DNA, 20 bp, Artificial Sequence
  chemically synthesized
aattacctctgggctcctgg

SEQ ID NO: 82432 - DNA, 20 bp, Artificial Sequence
  chemically synthesized
ttacctctgggctcctggta

SEQ ID NO: 82433 - DNA, 20 bp, Artificial Sequence
  chemically synthesized
gactagagaaactctaccag

SEQ ID NO: 82434 - DNA, 20 bp, Artificial Sequence
  chemically synthesized
aggactagagaaactctacc

SEQ ID NO: 82435 - DNA, 20 bp, Artificial Sequence
  chemically synthesized
aaggactagagaaactctac

SEQ ID NO: 82436 - DNA, 20 bp, Artificial Sequence
  chemically synthesized
ggctcctggtagagtttctc

SEQ ID NO: 82437 - DNA, 20 bp, Artificial Sequence
  chemically synthesized
agcagcctttggaaggacta

SEQ ID NO: 82438 - DNA, 20 bp, Artificial Sequence
  chemically synthesized
agagcagcctttggaaggac

SEQ ID NO: 82439 - DNA, 20 bp, Artificial Sequence
  chemically synthesized
gagtttctctagtccttcca

SEQ ID NO: 82440 - DNA, 20 bp, Artificial Sequence
  chemically synthesized
agtttctctagtccttccaa

SEQ ID NO: 82441 - DNA, 20 bp, Artificial Sequence
  chemically synthesized
ctgacagagcagcctttgga

SEQ ID NO: 82442 - DNA, 20 bp, Artificial Sequence
  chemically synthesized
tctgacagagcagcctttgg

SEQ ID NO: 82443 - DNA, 20 bp, Artificial Sequence
  chemically synthesized
atttctgacagagcagcctt

SEQ ID NO: 82444 - DNA, 20 bp, Artificial Sequence
  chemically synthesized
ccttccaaaggctgctctgt

SEQ ID NO: 82445 - DNA, 20 bp, Artificial Sequence
  chemically synthesized
tacgaatatttctgacagag

SEQ ID NO: 82446 - DNA, 20 bp, Artificial Sequence
  chemically synthesized
ctgtacgaatatttctgaca

SEQ ID NO: 82447 - DNA, 20 bp, Artificial Sequence
  chemically synthesized
gactgtacgaatatttctga

SEQ ID NO: 82448 - DNA, 20 bp, Artificial Sequence
  chemically synthesized
ctctgtcagaaatattcgta

SEQ ID NO: 82449 - DNA, 20 bp, Artificial Sequence
  chemically synthesized
agaaatattcgtacagtctc

SEQ ID NO: 82450 - DNA, 20 bp, Artificial Sequence
  chemically synthesized
aaatattcgtacagtctcaa

SEQ ID NO: 82451 - DNA, 20 bp, Artificial Sequence
  chemically synthesized
ctgtaatcatgagtactctt

SEQ ID NO: 82452 - DNA, 20 bp, Artificial Sequence
  chemically synthesized
ctcaagagtactcatgatta

SEQ ID NO: 82453 - DNA, 20 bp, Artificial Sequence
  chemically synthesized
actaaagaacctgtaatcat

SEQ ID NO: 82454 - DNA, 20 bp, Artificial Sequence
  chemically synthesized
tcaagagtactcatgattac

SEQ ID NO: 82455 - DNA, 20 bp, Artificial Sequence
  chemically synthesized
actcatgattacaggttctt

SEQ ID NO: 82456 - DNA, 20 bp, Artificial Sequence
  chemically synthesized
caagagggaattgaaaacta

SEQ ID NO: 82457 - DNA, 20 bp, Artificial Sequence
  chemically synthesized
tagttttcaattccctcttg

SEQ ID NO: 82458 - DNA, 20 bp, Artificial Sequence
  chemically synthesized
agttttcaattccctcttga

SEQ ID NO: 82459 - DNA, 20 bp, Artificial Sequence
  chemically synthesized
catttcacaggccttcaaga

SEQ ID NO: 82460 - DNA, 20 bp, Artificial Sequence
  chemically synthesized
tcatttcacaggccttcaag

SEQ ID NO: 82461 - DNA, 20 bp, Artificial Sequence
  chemically synthesized
ctcatttcacaggccttcaa

SEQ ID NO: 82462 - DNA, 20 bp, Artificial Sequence
  chemically synthesized
atctcatttcacaggccttc

SEQ ID NO: 82463 - DNA, 20 bp, Artificial Sequence
  chemically synthesized
ctcttgaaggcctgtgaaat

SEQ ID NO: 82464 - DNA, 20 bp, Artificial Sequence
  chemically synthesized
ttcttttcatctcatttcac

SEQ ID NO: 82465 - DNA, 20 bp, Artificial Sequence
  chemically synthesized
cttcttttcatctcatttca

SEQ ID NO: 82466 - DNA, 20 bp, Artificial Sequence
  chemically synthesized
ggcctgtgaaatgagatgaa

SEQ ID NO: 82467 - DNA, 20 bp, Artificial Sequence
  chemically synthesized
ctgtgaaatgagatgaaaag

SEQ ID NO: 82468 - DNA, 20 bp, Artificial Sequence
  chemically synthesized
gatgaaaagaagtgcttatt

SEQ ID NO: 82469 - DNA, 20 bp, Artificial Sequence
  chemically synthesized
aagaatgccacaagccaaat

SEQ ID NO: 82470 - DNA, 20 bp, Artificial Sequence
  chemically synthesized
agaagtgcttatttggcttg

SEQ ID NO: 82471 - DNA, 20 bp, Artificial Sequence
  chemically synthesized
aattttgagaagaatgccac

SEQ ID NO: 82472 - DNA, 20 bp, Artificial Sequence
  chemically synthesized
cacccaggattaattttgag

SEQ ID NO: 82473 - DNA, 20 bp, Artificial Sequence
  chemically synthesized
gagcacccaggattaatttt

SEQ ID NO: 82474 - DNA, 20 bp, Artificial Sequence
  chemically synthesized
attcttctcaaaattaatcc

SEQ ID NO: 82475 - DNA, 20 bp, Artificial Sequence
  chemically synthesized
ttcttctcaaaattaatcct

SEQ ID NO: 82476 - DNA, 20 bp, Artificial Sequence
  chemically synthesized
caaaattaatcctgggtgct

SEQ ID NO: 82477 - DNA, 20 bp, Artificial Sequence
  chemically synthesized
taaacaagttctgagcaccc

SEQ ID NO: 82478 - DNA, 20 bp, Artificial Sequence
  chemically synthesized
ataaacaagttctgagcacc

SEQ ID NO: 82479 - DNA, 20 bp, Artificial Sequence
  chemically synthesized
gagtttcataaacaagttct

SEQ ID NO: 82480 - DNA, 20 bp, Artificial Sequence
  chemically synthesized
gacctgggagtttcataaac

SEQ ID NO: 82481 - DNA, 20 bp, Artificial Sequence
  chemically synthesized
gaacttgtttatgaaactcc

SEQ ID NO: 82482 - DNA, 20 bp, Artificial Sequence
  chemically synthesized
aacttgtttatgaaactccc

SEQ ID NO: 82483 - DNA, 20 bp, Artificial Sequence
  chemically synthesized
agagatagaaattgacctgg

SEQ ID NO: 82484 - DNA, 20 bp, Artificial Sequence
  chemically synthesized
aaagagatagaaattgacct

SEQ ID NO: 82485 - DNA, 20 bp, Artificial Sequence
  chemically synthesized
aaaagagatagaaattgacc

SEQ ID NO: 82486 - DNA, 20 bp, Artificial Sequence
  chemically synthesized
cagtgtataaataaaagaga

SEQ ID NO: 82487 - DNA, 20 bp, Artificial Sequence
  chemically synthesized
ccatcagtgtataaataaaa

SEQ ID NO: 82488 - DNA, 20 bp, Artificial Sequence
  chemically synthesized
aaccatcagtgtataaataa

SEQ ID NO: 82489 - DNA, 20 bp, Artificial Sequence
  chemically synthesized
ctcttttatttatacactga

SEQ ID NO: 82490 - DNA, 20 bp, Artificial Sequence
  chemically synthesized
aaaaatcattttataaccat

SEQ ID NO: 82491 - DNA, 20 bp, Artificial Sequence
  chemically synthesized
ttataaaatgatttttttta

SEQ ID NO: 82492 - DNA, 20 bp, Artificial Sequence
  chemically synthesized
tataaaatgattttttttaa

SEQ ID NO: 82493 - DNA, 20 bp, Artificial Sequence
  chemically synthesized
gattttttttaaaggctata

SEQ ID NO: 82494 - DNA, 20 bp, Artificial Sequence
  chemically synthesized
attttttttaaaggctatat

SEQ ID NO: 82495 - DNA, 20 bp, Artificial Sequence
  chemically synthesized
cattaacagatagacccata

SEQ ID NO: 82496 - DNA, 20 bp, Artificial Sequence
  chemically synthesized
gcgctttcctcattaacaga

SEQ ID NO: 82497 - DNA, 20 bp, Artificial Sequence
  chemically synthesized
atatgggtctatctgttaat

SEQ ID NO: 82498 - DNA, 20 bp, Artificial Sequence
  chemically synthesized
tatgggtctatctgttaatg

SEQ ID NO: 82499 - DNA, 20 bp, Artificial Sequence
  chemically synthesized
cacagcgctttcctcattaa

SEQ ID NO: 82500 - DNA, 20 bp, Artificial Sequence
  chemically synthesized
ggtctatctgttaatgagga

SEQ ID NO: 82501 - DNA, 20 bp, Artificial Sequence
  chemically synthesized
ccagaatagctttacaaaca

SEQ ID NO: 82502 - DNA, 20 bp, Artificial Sequence
  chemically synthesized
aggaaagcgctgtgtttgta

SEQ ID NO: 82503 - DNA, 20 bp, Artificial Sequence
  chemically synthesized
ctgtgtttgtaaagctattc

SEQ ID NO: 82504 - DNA, 20 bp, Artificial Sequence
  chemically synthesized
tgtgtttgtaaagctattct

SEQ ID NO: 82505 - DNA, 20 bp, Artificial Sequence
  chemically synthesized
gtgtttgtaaagctattctg

SEQ ID NO: 82506 - DNA, 20 bp, Artificial Sequence
  chemically synthesized
gtttgtaaagctattctggg

SEQ ID NO: 82507 - DNA, 20 bp, Artificial Sequence
  chemically synthesized
ctccccccatctccccagaa

SEQ ID NO: 82508 - DNA, 20 bp, Artificial Sequence
  chemically synthesized
gtaaagctattctggggaga

SEQ ID NO: 82509 - DNA, 20 bp, Artificial Sequence
  chemically synthesized
taaagctattctggggagat

SEQ ID NO: 82510 - DNA, 20 bp, Artificial Sequence
  chemically synthesized
gaatgctccccccatctccc

SEQ ID NO: 82511 - DNA, 20 bp, Artificial Sequence
  chemically synthesized
aaagctattctggggagatg

SEQ ID NO: 82512 - DNA, 20 bp, Artificial Sequence
  chemically synthesized
aagctattctggggagatgg

SEQ ID NO: 82513 - DNA, 20 bp, Artificial Sequence
  chemically synthesized
agctattctggggagatggg

SEQ ID NO: 82514 - DNA, 20 bp, Artificial Sequence
  chemically synthesized
ctattctggggagatggggg

SEQ ID NO: 82515 - DNA, 20 bp, Artificial Sequence
  chemically synthesized
gggagatggggggagcattc

SEQ ID NO: 82516 - DNA, 20 bp, Artificial Sequence
  chemically synthesized
gatggggggagcattctgga

SEQ ID NO: 82517 - DNA, 20 bp, Artificial Sequence
  chemically synthesized
atgagagggcattaactatc

SEQ ID NO: 82518 - DNA, 20 bp, Artificial Sequence
  chemically synthesized
atagttaatgccctctcatt

SEQ ID NO: 82519 - DNA, 20 bp, Artificial Sequence
  chemically synthesized
gcactcttatctcaatgaga

SEQ ID NO: 82520 - DNA, 20 bp, Artificial Sequence
  chemically synthesized
agcactcttatctcaatgag

SEQ ID NO: 82521 - DNA, 20 bp, Artificial Sequence
  chemically synthesized
aagcactcttatctcaatga

SEQ ID NO: 82522 - DNA, 20 bp, Artificial Sequence
  chemically synthesized
caaagcactcttatctcaat

SEQ ID NO: 82523 - DNA, 20 bp, Artificial Sequence
  chemically synthesized
taatgccctctcattgagat

SEQ ID NO: 82524 - DNA, 20 bp, Artificial Sequence
  chemically synthesized
atgccctctcattgagataa

SEQ ID NO: 82525 - DNA, 20 bp, Artificial Sequence
  chemically synthesized
gctgtcaggttacataaaca

SEQ ID NO: 82526 - DNA, 20 bp, Artificial Sequence
  chemically synthesized
gctttgtttatgtaacctga

SEQ ID NO: 82527 - DNA, 20 bp, Artificial Sequence
  chemically synthesized
agatttgaagtatggctgtc

SEQ ID NO: 82528 - DNA, 20 bp, Artificial Sequence
  chemically synthesized
tagatttgaagtatggctgt

SEQ ID NO: 82529 - DNA, 20 bp, Artificial Sequence
  chemically synthesized
ttagctgtagatttgaagta

SEQ ID NO: 82530 - DNA, 20 bp, Artificial Sequence
  chemically synthesized
aaactttagctgtagatttg

SEQ ID NO: 82531 - DNA, 20 bp, Artificial Sequence
  chemically synthesized
acagccatacttcaaatcta

SEQ ID NO: 82532 - DNA, 20 bp, Artificial Sequence
  chemically synthesized
atacttcaaatctacagcta

SEQ ID NO: 82533 - DNA, 20 bp, Artificial Sequence
  chemically synthesized
ataccttgaaactttagctg

SEQ ID NO: 82534 - DNA, 20 bp, Artificial Sequence
  chemically synthesized
aaatctacagctaaagtttc

SEQ ID NO: 82535 - DNA, 20 bp, Artificial Sequence
  chemically synthesized
caatatataccttgaaactt

SEQ ID NO: 82536 - DNA, 20 bp, Artificial Sequence
  chemically synthesized
aatctacagctaaagtttca

SEQ ID NO: 82537 - DNA, 20 bp, Artificial Sequence
  chemically synthesized
aggtatatattgcaaaactc

SEQ ID NO: 82538 - DNA, 20 bp, Artificial Sequence
  chemically synthesized
tatattgcaaaactctagca

SEQ ID NO: 82539 - DNA, 20 bp, Artificial Sequence
  chemically synthesized
agtcctcattagccatgcta

SEQ ID NO: 82540 - DNA, 20 bp, Artificial Sequence
  chemically synthesized
taagtcctcattagccatgc

SEQ ID NO: 82541 - DNA, 20 bp, Artificial Sequence
  chemically synthesized
aaaactctagcatggctaat

SEQ ID NO: 82542 - DNA, 20 bp, Artificial Sequence
  chemically synthesized
aaactctagcatggctaatg

SEQ ID NO: 82543 - DNA, 20 bp, Artificial Sequence
  chemically synthesized
gggtatgtttaagtcctcat

SEQ ID NO: 82544 - DNA, 20 bp, Artificial Sequence
  chemically synthesized
ccactatttggggtatgttt

SEQ ID NO: 82545 - DNA, 20 bp, Artificial Sequence
  chemically synthesized
ggacttaaacataccccaaa

SEQ ID NO: 82546 - DNA, 20 bp, Artificial Sequence
  chemically synthesized
cttaaacataccccaaatag

SEQ ID NO: 82547 - DNA, 20 bp, Artificial Sequence
  chemically synthesized
ttctggatatccactatttg

SEQ ID NO: 82548 - DNA, 20 bp, Artificial Sequence
  chemically synthesized
gttctggatatccactattt

SEQ ID NO: 82549 - DNA, 20 bp, Artificial Sequence
  chemically synthesized
tgttctggatatccactatt

SEQ ID NO: 82550 - DNA, 20 bp, Artificial Sequence
  chemically synthesized
taccccaaatagtggatatc

SEQ ID NO: 82551 - DNA, 20 bp, Artificial Sequence
  chemically synthesized
taaggcttcccattatgttc

SEQ ID NO: 82552 - DNA, 20 bp, Artificial Sequence
  chemically synthesized
agtggatatccagaacataa

SEQ ID NO: 82553 - DNA, 20 bp, Artificial Sequence
  chemically synthesized
gtggatatccagaacataat

SEQ ID NO: 82554 - DNA, 20 bp, Artificial Sequence
  chemically synthesized
gatatccagaacataatggg

SEQ ID NO: 82555 - DNA, 20 bp, Artificial Sequence
  chemically synthesized
agaacataatgggaagcctt

SEQ ID NO: 82556 - DNA, 20 bp, Artificial Sequence
  chemically synthesized
gaacataatgggaagcctta

SEQ ID NO: 82557 - DNA, 20 bp, Artificial Sequence
  chemically synthesized
aacataatgggaagccttaa

SEQ ID NO: 82558 - DNA, 20 bp, Artificial Sequence
  chemically synthesized
ggtcctgcaaatggccctta

SEQ ID NO: 82559 - DNA, 20 bp, Artificial Sequence
  chemically synthesized
aggtcctgcaaatggccctt

SEQ ID NO: 82560 - DNA, 20 bp, Artificial Sequence
  chemically synthesized
gaagccttaagggccatttg

SEQ ID NO: 82561 - DNA, 20 bp, Artificial Sequence
  chemically synthesized
aagccttaagggccatttgc

SEQ ID NO: 82562 - DNA, 20 bp, Artificial Sequence
  chemically synthesized
atagcctaaggtcctgcaaa

SEQ ID NO: 82563 - DNA, 20 bp, Artificial Sequence
  chemically synthesized
aagggccatttgcaggacct

SEQ ID NO: 82564 - DNA, 20 bp, Artificial Sequence
  chemically synthesized
agggccatttgcaggacctt

SEQ ID NO: 82565 - DNA, 20 bp, Artificial Sequence
  chemically synthesized
gtatactttaatatagccta

SEQ ID NO: 82566 - DNA, 20 bp, Artificial Sequence
  chemically synthesized
tgtatactttaatatagcct

SEQ ID NO: 82567 - DNA, 20 bp, Artificial Sequence
  chemically synthesized
caggaccttaggctatatta

SEQ ID NO: 82568 - DNA, 20 bp, Artificial Sequence
  chemically synthesized
attcattgtatactttaata

SEQ ID NO: 82569 - DNA, 20 bp, Artificial Sequence
  chemically synthesized
attaactggtgattgtcagt

SEQ ID NO: 82570 - DNA, 20 bp, Artificial Sequence
  chemically synthesized
cagaattaactggtgattgt

SEQ ID NO: 82571 - DNA, 20 bp, Artificial Sequence
  chemically synthesized
tgaatccaactgacaatcac

SEQ ID NO: 82572 - DNA, 20 bp, Artificial Sequence
  chemically synthesized
gacattttgacagaattaac

SEQ ID NO: 82573 - DNA, 20 bp, Artificial Sequence
  chemically synthesized
taccttgtcagacattttga

SEQ ID NO: 82574 - DNA, 20 bp, Artificial Sequence
  chemically synthesized
attctgtcaaaatgtctgac

SEQ ID NO: 82575 - DNA, 20 bp, Artificial Sequence
  chemically synthesized
ttctgtcaaaatgtctgaca

SEQ ID NO: 82576 - DNA, 20 bp, Artificial Sequence
  chemically synthesized
ttacctattttataccttgt

SEQ ID NO: 82577 - DNA, 20 bp, Artificial Sequence
  chemically synthesized
atgtctgacaaggtataaaa

SEQ ID NO: 82578 - DNA, 20 bp, Artificial Sequence
  chemically synthesized
tgtctgacaaggtataaaat

SEQ ID NO: 82579 - DNA, 20 bp, Artificial Sequence
  chemically synthesized
tgacaaggtataaaataggt

SEQ ID NO: 82580 - DNA, 20 bp, Artificial Sequence
  chemically synthesized
aggtataaaataggtaagct

SEQ ID NO: 82581 - DNA, 20 bp, Artificial Sequence
  chemically synthesized
gtataaaataggtaagctaa

SEQ ID NO: 82582 - DNA, 20 bp, Artificial Sequence
  chemically synthesized
aaataggtaagctaagagaa

SEQ ID NO: 82583 - DNA, 20 bp, Artificial Sequence
  chemically synthesized
aagtattgagacttttctct

SEQ ID NO: 82584 - DNA, 20 bp, Artificial Sequence
  chemically synthesized
gactatttttcaaaagtatt

SEQ ID NO: 82585 - DNA, 20 bp, Artificial Sequence
  chemically synthesized
atgtaatgactatttttcaa

SEQ ID NO: 82586 - DNA, 20 bp, Artificial Sequence
  chemically synthesized
gtctcaatacttttgaaaaa

SEQ ID NO: 82587 - DNA, 20 bp, Artificial Sequence
  chemically synthesized
tattctcaaagaggtcacaa

SEQ ID NO: 82588 - DNA, 20 bp, Artificial Sequence
  chemically synthesized
tcatccattgtgacctcttt

SEQ ID NO: 82589 - DNA, 20 bp, Artificial Sequence
  chemically synthesized
catttctactattctcaaag

SEQ ID NO: 82590 - DNA, 20 bp, Artificial Sequence
  chemically synthesized
acatttctactattctcaaa

SEQ ID NO: 82591 - DNA, 20 bp, Artificial Sequence
  chemically synthesized
cattgtgacctctttgagaa

SEQ ID NO: 82592 - DNA, 20 bp, Artificial Sequence
  chemically synthesized
aaacatttctactattctca

SEQ ID NO: 82593 - DNA, 20 bp, Artificial Sequence
  chemically synthesized
tgtgacctctttgagaatag

SEQ ID NO: 82594 - DNA, 20 bp, Artificial Sequence
  chemically synthesized
gagaatagtagaaatgtttt

SEQ ID NO: 82595 - DNA, 20 bp, Artificial Sequence
  chemically synthesized
agaaatgttttgagctatta

SEQ ID NO: 82596 - DNA, 20 bp, Artificial Sequence
  chemically synthesized
cgcaattcctacatccataa

SEQ ID NO: 82597 - DNA, 20 bp, Artificial Sequence
  chemically synthesized
gttttgagctattatggatg

SEQ ID NO: 82598 - DNA, 20 bp, Artificial Sequence
  chemically synthesized
ttttgagctattatggatgt

SEQ ID NO: 82599 - DNA, 20 bp, Artificial Sequence
  chemically synthesized
tattatggatgtaggaattg

SEQ ID NO: 82600 - DNA, 20 bp, Artificial Sequence
  chemically synthesized
gatgtaggaattgcggacac

SEQ ID NO: 82601 - DNA, 20 bp, Artificial Sequence
  chemically synthesized
atctgttcatttatagaaac

SEQ ID NO: 82602 - DNA, 20 bp, Artificial Sequence
  chemically synthesized
attctagatctgttcattta

SEQ ID NO: 82603 - DNA, 20 bp, Artificial Sequence
  chemically synthesized
cactagtttctataaatgaa

SEQ ID NO: 82604 - DNA, 20 bp, Artificial Sequence
  chemically synthesized
tttctataaatgaacagatc

SEQ ID NO: 82605 - DNA, 20 bp, Artificial Sequence
  chemically synthesized
tacagattaaagattaattc

SEQ ID NO: 82606 - DNA, 20 bp, Artificial Sequence
  chemically synthesized
taaaggaagattacagatta

SEQ ID NO: 82607 - DNA, 20 bp, Artificial Sequence
  chemically synthesized
ccctggataaaggaagatta

SEQ ID NO: 82608 - DNA, 20 bp, Artificial Sequence
  chemically synthesized
cttgatcccctggataaagg

SEQ ID NO: 82609 - DNA, 20 bp, Artificial Sequence
  chemically synthesized
atctgtaatcttcctttatc

SEQ ID NO: 82610 - DNA, 20 bp, Artificial Sequence
  chemically synthesized
tctgtaatcttcctttatcc

SEQ ID NO: 82611 - DNA, 20 bp, Artificial Sequence
  chemically synthesized
ctgtaatcttcctttatcca

SEQ ID NO: 82612 - DNA, 20 bp, Artificial Sequence
  chemically synthesized
tctcttgatcccctggataa

SEQ ID NO: 82613 - DNA, 20 bp, Artificial Sequence
  chemically synthesized
tgtaatcttcctttatccag

SEQ ID NO: 82614 - DNA, 20 bp, Artificial Sequence
  chemically synthesized
ttctcttgatcccctggata

SEQ ID NO: 82615 - DNA, 20 bp, Artificial Sequence
  chemically synthesized
cttcctttatccaggggatc

SEQ ID NO: 82616 - DNA, 20 bp, Artificial Sequence
  chemically synthesized
ttgtttttctcttgatcccc

SEQ ID NO: 82617 - DNA, 20 bp, Artificial Sequence
  chemically synthesized
tcctttatccaggggatcaa

SEQ ID NO: 82618 - DNA, 20 bp, Artificial Sequence
  chemically synthesized
caagagaaaaacaaaatgaa

SEQ ID NO: 82619 - DNA, 20 bp, Artificial Sequence
  chemically synthesized
atctagaaactttttgaagg

SEQ ID NO: 82620 - DNA, 20 bp, Artificial Sequence
  chemically synthesized
gaatagtttctgccttcaaa

SEQ ID NO: 82621 - DNA, 20 bp, Artificial Sequence
  chemically synthesized
tggatctagaaactttttga

SEQ ID NO: 82622 - DNA, 20 bp, Artificial Sequence
  chemically synthesized
ttggatctagaaactttttg

SEQ ID NO: 82623 - DNA, 20 bp, Artificial Sequence
  chemically synthesized
ttctgccttcaaaaagtttc

SEQ ID NO: 82624 - DNA, 20 bp, Artificial Sequence
  chemically synthesized
tcaaaaagtttctagatcca

SEQ ID NO: 82625 - DNA, 20 bp, Artificial Sequence
  chemically synthesized
ttttctcccttctttggatc

SEQ ID NO: 82626 - DNA, 20 bp, Artificial Sequence
  chemically synthesized
aaaagtttctagatccaaag

SEQ ID NO: 82627 - DNA, 20 bp, Artificial Sequence
  chemically synthesized
aaagtttctagatccaaaga

SEQ ID NO: 82628 - DNA, 20 bp, Artificial Sequence
  chemically synthesized
aagtttctagatccaaagaa

SEQ ID NO: 82629 - DNA, 20 bp, Artificial Sequence
  chemically synthesized
gtttctagatccaaagaagg

SEQ ID NO: 82630 - DNA, 20 bp, Artificial Sequence
  chemically synthesized
tgttaattttctcccttctt

SEQ ID NO: 82631 - DNA, 20 bp, Artificial Sequence
  chemically synthesized
agaagggagaaaattaacac

SEQ ID NO: 82632 - DNA, 20 bp, Artificial Sequence
  chemically synthesized
agggagaaaattaacactag

SEQ ID NO: 82633 - DNA, 20 bp, Artificial Sequence
  chemically synthesized
gagaaaattaacactagaag

SEQ ID NO: 82634 - DNA, 20 bp, Artificial Sequence
  chemically synthesized
gaaaattaacactagaagca

SEQ ID NO: 82635 - DNA, 20 bp, Artificial Sequence
  chemically synthesized
tactgttttcactctgcttc

SEQ ID NO: 82636 - DNA, 20 bp, Artificial Sequence
  chemically synthesized
cactagaagcagagtgaaaa

SEQ ID NO: 82637 - DNA, 20 bp, Artificial Sequence
  chemically synthesized
agaagcagagtgaaaacagt

SEQ ID NO: 82638 - DNA, 20 bp, Artificial Sequence
  chemically synthesized
cagtaagttcacacataatc

SEQ ID NO: 82639 - DNA, 20 bp, Artificial Sequence
  chemically synthesized
cacacataatcgagtgctaa

SEQ ID NO: 82640 - DNA, 20 bp, Artificial Sequence
  chemically synthesized
acacataatcgagtgctaaa

SEQ ID NO: 82641 - DNA, 20 bp, Artificial Sequence
  chemically synthesized
ggtatacctcacgatccttt

SEQ ID NO: 82642 - DNA, 20 bp, Artificial Sequence
  chemically synthesized
tcgagtgctaaaaggatcgt

SEQ ID NO: 82643 - DNA, 20 bp, Artificial Sequence
  chemically synthesized
cgagtgctaaaaggatcgtg

SEQ ID NO: 82644 - DNA, 20 bp, Artificial Sequence
  chemically synthesized
aggatcgtgaggtataccgt

SEQ ID NO: 82645 - DNA, 20 bp, Artificial Sequence
  chemically synthesized
cgtgaggtataccgtgagcc

SEQ ID NO: 82646 - DNA, 20 bp, Artificial Sequence
  chemically synthesized
gttaggttattctaggctca

SEQ ID NO: 82647 - DNA, 20 bp, Artificial Sequence
  chemically synthesized
agtatccgttaggttattct

SEQ ID NO: 82648 - DNA, 20 bp, Artificial Sequence
  chemically synthesized
gagtatccgttaggttattc

SEQ ID NO: 82649 - DNA, 20 bp, Artificial Sequence
  chemically synthesized
gtgagcctagaataacctaa

SEQ ID NO: 82650 - DNA, 20 bp, Artificial Sequence
  chemically synthesized
atggtgtcagagtatccgtt

SEQ ID NO: 82651 - DNA, 20 bp, Artificial Sequence
  chemically synthesized
aatggtgtcagagtatccgt

SEQ ID NO: 82652 - DNA, 20 bp, Artificial Sequence
  chemically synthesized
aactctcttcaatggtgtca

SEQ ID NO: 82653 - DNA, 20 bp, Artificial Sequence
  chemically synthesized
ataactctcttcaatggtgt

SEQ ID NO: 82654 - DNA, 20 bp, Artificial Sequence
  chemically synthesized
cggatactctgacaccattg

SEQ ID NO: 82655 - DNA, 20 bp, Artificial Sequence
  chemically synthesized
gatactctgacaccattgaa

SEQ ID NO: 82656 - DNA, 20 bp, Artificial Sequence
  chemically synthesized
tactctgacaccattgaaga

SEQ ID NO: 82657 - DNA, 20 bp, Artificial Sequence
  chemically synthesized
gggtcaataactctcttcaa

SEQ ID NO: 82658 - DNA, 20 bp, Artificial Sequence
  chemically synthesized
attgaagagagttattgacc

SEQ ID NO: 82659 - DNA, 20 bp, Artificial Sequence
  chemically synthesized
cttctgagatcaaagaatct

SEQ ID NO: 82660 - DNA, 20 bp, Artificial Sequence
  chemically synthesized
acttctgagatcaaagaatc

SEQ ID NO: 82661 - DNA, 20 bp, Artificial Sequence
  chemically synthesized
tgacccagattctttgatct

SEQ ID NO: 82662 - DNA, 20 bp, Artificial Sequence
  chemically synthesized
taccctcacttctgagatca

SEQ ID NO: 82663 - DNA, 20 bp, Artificial Sequence
  chemically synthesized
cccagattctttgatctcag

SEQ ID NO: 82664 - DNA, 20 bp, Artificial Sequence
  chemically synthesized
gattctttgatctcagaagt

SEQ ID NO: 82665 - DNA, 20 bp, Artificial Sequence
  chemically synthesized
attctttgatctcagaagtg

SEQ ID NO: 82666 - DNA, 20 bp, Artificial Sequence
  chemically synthesized
ttattaataccctcacttct

SEQ ID NO: 82667 - DNA, 20 bp, Artificial Sequence
  chemically synthesized
ttctttgatctcagaagtga

SEQ ID NO: 82668 - DNA, 20 bp, Artificial Sequence
  chemically synthesized
agaagtgagggtattaataa

SEQ ID NO: 82669 - DNA, 20 bp, Artificial Sequence
  chemically synthesized
agggtattaataaaagtatt

SEQ ID NO: 82670 - DNA, 20 bp, Artificial Sequence
  chemically synthesized
cagttatattagcatttatg

SEQ ID NO: 82671 - DNA, 20 bp, Artificial Sequence
  chemically synthesized
ttattgttaaacagttatat

SEQ ID NO: 82672 - DNA, 20 bp, Artificial Sequence
  chemically synthesized
atattactgttattgttaaa

SEQ ID NO: 82673 - DNA, 20 bp, Artificial Sequence
  chemically synthesized
atataactgtttaacaataa

SEQ ID NO: 82674 - DNA, 20 bp, Artificial Sequence
  chemically synthesized
cagtaatatttgccctgatc

SEQ ID NO: 82675 - DNA, 20 bp, Artificial Sequence
  chemically synthesized
agtaatatttgccctgatct

SEQ ID NO: 82676 - DNA, 20 bp, Artificial Sequence
  chemically synthesized
gtaatatttgccctgatcta

SEQ ID NO: 82677 - DNA, 20 bp, Artificial Sequence
  chemically synthesized
aaaaattaagccctagatca

SEQ ID NO: 82678 - DNA, 20 bp, Artificial Sequence
  chemically synthesized
caaaaattaagccctagatc

SEQ ID NO: 82679 - DNA, 20 bp, Artificial Sequence
  chemically synthesized
acaaaaattaagccctagat

SEQ ID NO: 82680 - DNA, 20 bp, Artificial Sequence
  chemically synthesized
aagttacaaaaattaagccc

SEQ ID NO: 82681 - DNA, 20 bp, Artificial Sequence
  chemically synthesized
tgaaaaaagttacaaaaatt

SEQ ID NO: 82682 - DNA, 20 bp, Artificial Sequence
  chemically synthesized
ctaaaagacagagttgaaaa

SEQ ID NO: 82683 - DNA, 20 bp, Artificial Sequence
  chemically synthesized
cttttttcaactctgtcttt

SEQ ID NO: 82684 - DNA, 20 bp, Artificial Sequence
  chemically synthesized
ggcaacattgctaaaagaca

SEQ ID NO: 82685 - DNA, 20 bp, Artificial Sequence
  chemically synthesized
caggcaacattgctaaaaga

SEQ ID NO: 82686 - DNA, 20 bp, Artificial Sequence
  chemically synthesized
tcagcaggcaacattgctaa

SEQ ID NO: 82687 - DNA, 20 bp, Artificial Sequence
  chemically synthesized
gaacagggcttaaattcagc

SEQ ID NO: 82688 - DNA, 20 bp, Artificial Sequence
  chemically synthesized
agaacagggcttaaattcag

SEQ ID NO: 82689 - DNA, 20 bp, Artificial Sequence
  chemically synthesized
caatgttgcctgctgaattt

SEQ ID NO: 82690 - DNA, 20 bp, Artificial Sequence
  chemically synthesized
gaaagaacagggcttaaatt

SEQ ID NO: 82691 - DNA, 20 bp, Artificial Sequence
  chemically synthesized
ttttccccagtgaaagaaca

SEQ ID NO: 82692 - DNA, 20 bp, Artificial Sequence
  chemically synthesized
tttttccccagtgaaagaac

SEQ ID NO: 82693 - DNA, 20 bp, Artificial Sequence
  chemically synthesized
gtttttccccagtgaaagaa

SEQ ID NO: 82694 - DNA, 20 bp, Artificial Sequence
  chemically synthesized
tttaagccctgttctttcac

SEQ ID NO: 82695 - DNA, 20 bp, Artificial Sequence
  chemically synthesized
ttaagccctgttctttcact

SEQ ID NO: 82696 - DNA, 20 bp, Artificial Sequence
  chemically synthesized
taagccctgttctttcactg

SEQ ID NO: 82697 - DNA, 20 bp, Artificial Sequence
  chemically synthesized
aatttgtttttccccagtga

SEQ ID NO: 82698 - DNA, 20 bp, Artificial Sequence
  chemically synthesized
actgctaatttgtttttccc

SEQ ID NO: 82699 - DNA, 20 bp, Artificial Sequence
  chemically synthesized
ttcactggggaaaaacaaat

SEQ ID NO: 82700 - DNA, 20 bp, Artificial Sequence
  chemically synthesized
actggggaaaaacaaattag

SEQ ID NO: 82701 - DNA, 20 bp, Artificial Sequence
  chemically synthesized
ggcatatctgaaattcaagg

SEQ ID NO: 82702 - DNA, 20 bp, Artificial Sequence
  chemically synthesized
cagtattcttccttgaattt

SEQ ID NO: 82703 - DNA, 20 bp, Artificial Sequence
  chemically synthesized
aatggcatatctgaaattca

SEQ ID NO: 82704 - DNA, 20 bp, Artificial Sequence
  chemically synthesized
taatggcatatctgaaattc

SEQ ID NO: 82705 - DNA, 20 bp, Artificial Sequence
  chemically synthesized
ggaacacttctgtaacataa

SEQ ID NO: 82706 - DNA, 20 bp, Artificial Sequence
  chemically synthesized
tcagatatgccattatgtta

SEQ ID NO: 82707 - DNA, 20 bp, Artificial Sequence
  chemically synthesized
gatatgccattatgttacag

SEQ ID NO: 82708 - DNA, 20 bp, Artificial Sequence
  chemically synthesized
attatgttacagaagtgttc

SEQ ID NO: 82709 - DNA, 20 bp, Artificial Sequence
  chemically synthesized
tatgttacagaagtgttcca

SEQ ID NO: 82710 - DNA, 20 bp, Artificial Sequence
  chemically synthesized
tgtgtcatacaatacagctc

SEQ ID NO: 82711 - DNA, 20 bp, Artificial Sequence
  chemically synthesized
aataaatgtgtcatacaata

SEQ ID NO: 82712 - DNA, 20 bp, Artificial Sequence
  chemically synthesized
cacatttattaataaaatct

SEQ ID NO: 82713 - DNA, 20 bp, Artificial Sequence
  chemically synthesized
atttattaataaaatcttag

SEQ ID NO: 82714 - DNA, 20 bp, Artificial Sequence
  chemically synthesized
tttgaatggtgaacaccgct

SEQ ID NO: 82715 - DNA, 20 bp, Artificial Sequence
  chemically synthesized
tagcggtgttcaccattcaa

SEQ ID NO: 82716 - DNA, 20 bp, Artificial Sequence
  chemically synthesized
agactcaggattcttttgaa

SEQ ID NO: 82717 - DNA, 20 bp, Artificial Sequence
  chemically synthesized
tcaccattcaaaagaatcct

SEQ ID NO: 82718 - DNA, 20 bp, Artificial Sequence
  chemically synthesized
ttttgcaaagtatcagactc

SEQ ID NO: 82719 - DNA, 20 bp, Artificial Sequence
  chemically synthesized
attttgcaaagtatcagact

SEQ ID NO: 82720 - DNA, 20 bp, Artificial Sequence
  chemically synthesized
tgaatcattttgcaaagtat

SEQ ID NO: 82721 - DNA, 20 bp, Artificial Sequence
  chemically synthesized
ggatgatgaatcattttgca

SEQ ID NO: 82722 - DNA, 20 bp, Artificial Sequence
  chemically synthesized
gcaaaatgattcatcatcca

SEQ ID NO: 82723 - DNA, 20 bp, Artificial Sequence
  chemically synthesized
tattgaattgtaaatagctg

SEQ ID NO: 82724 - DNA, 20 bp, Artificial Sequence
  chemically synthesized
tttctctattgaattgtaaa

SEQ ID NO: 82725 - DNA, 20 bp, Artificial Sequence
  chemically synthesized
cacagctatttacaattcaa

SEQ ID NO: 82726 - DNA, 20 bp, Artificial Sequence
  chemically synthesized
cagctatttacaattcaata

SEQ ID NO: 82727 - DNA, 20 bp, Artificial Sequence
  chemically synthesized
tatttacaattcaatagaga

SEQ ID NO: 82728 - DNA, 20 bp, Artificial Sequence
  chemically synthesized
atttacaattcaatagagaa

SEQ ID NO: 82729 - DNA, 20 bp, Artificial Sequence
  chemically synthesized
tttacaattcaatagagaaa

SEQ ID NO: 82730 - DNA, 20 bp, Artificial Sequence
  chemically synthesized
acaattcaatagagaaaggg

SEQ ID NO: 82731 - DNA, 20 bp, Artificial Sequence
  chemically synthesized
caattcaatagagaaaggga

SEQ ID NO: 82732 - DNA, 20 bp, Artificial Sequence
  chemically synthesized
aggcgtttgaaccaaaatac

SEQ ID NO: 82733 - DNA, 20 bp, Artificial Sequence
  chemically synthesized
cttacagaactccagtattt

SEQ ID NO: 82734 - DNA, 20 bp, Artificial Sequence
  chemically synthesized
gcgtttgaaccaaaatactg

SEQ ID NO: 82735 - DNA, 20 bp, Artificial Sequence
  chemically synthesized
atattctacttacagaactc

SEQ ID NO: 82736 - DNA, 20 bp, Artificial Sequence
  chemically synthesized
ccaaaatactggagttctgt

SEQ ID NO: 82737 - DNA, 20 bp, Artificial Sequence
  chemically synthesized
aaatactggagttctgtaag

SEQ ID NO: 82738 - DNA, 20 bp, Artificial Sequence
  chemically synthesized
gaatcctaatattctactta

SEQ ID NO: 82739 - DNA, 20 bp, Artificial Sequence
  chemically synthesized
gagttctgtaagtagaatat

SEQ ID NO: 82740 - DNA, 20 bp, Artificial Sequence
  chemically synthesized
agttctgtaagtagaatatt

SEQ ID NO: 82741 - DNA, 20 bp, Artificial Sequence
  chemically synthesized
gtaagtagaatattaggatt

SEQ ID NO: 82742 - DNA, 20 bp, Artificial Sequence
  chemically synthesized
gaatattaggattcagccta

SEQ ID NO: 82743 - DNA, 20 bp, Artificial Sequence
  chemically synthesized
attaggattcagcctacaga

SEQ ID NO: 82744 - DNA, 20 bp, Artificial Sequence
  chemically synthesized
ttaggattcagcctacagat

SEQ ID NO: 82745 - DNA, 20 bp, Artificial Sequence
  chemically synthesized
taggattcagcctacagata

SEQ ID NO: 82746 - DNA, 20 bp, Artificial Sequence
  chemically synthesized
gaaagtacttccctatctgt

SEQ ID NO: 82747 - DNA, 20 bp, Artificial Sequence
  chemically synthesized
agaaagtacttccctatctg

SEQ ID NO: 82748 - DNA, 20 bp, Artificial Sequence
  chemically synthesized
gattcagcctacagataggg

SEQ ID NO: 82749 - DNA, 20 bp, Artificial Sequence
  chemically synthesized
gaaatatcccattattcaga

SEQ ID NO: 82750 - DNA, 20 bp, Artificial Sequence
  chemically synthesized
gggaagtactttctgaataa

SEQ ID NO: 82751 - DNA, 20 bp, Artificial Sequence
  chemically synthesized
ggaagtactttctgaataat

SEQ ID NO: 82752 - DNA, 20 bp, Artificial Sequence
  chemically synthesized
tacagaaatatcccattatt

SEQ ID NO: 82753 - DNA, 20 bp, Artificial Sequence
  chemically synthesized
tctagcatgattttagggta

SEQ ID NO: 82754 - DNA, 20 bp, Artificial Sequence
  chemically synthesized
acgtatctagcatgatttta

SEQ ID NO: 82755 - DNA, 20 bp, Artificial Sequence
  chemically synthesized
cacgtatctagcatgatttt

SEQ ID NO: 82756 - DNA, 20 bp, Artificial Sequence
  chemically synthesized
tcacgtatctagcatgattt

SEQ ID NO: 82757 - DNA, 20 bp, Artificial Sequence
  chemically synthesized
tctgtaccctaaaatcatgc

SEQ ID NO: 82758 - DNA, 20 bp, Artificial Sequence
  chemically synthesized
taaaatcatgctagatacgt

SEQ ID NO: 82759 - DNA, 20 bp, Artificial Sequence
  chemically synthesized
gagtaaataactcacgtatc

SEQ ID NO: 82760 - DNA, 20 bp, Artificial Sequence
  chemically synthesized
atcagctttatatgtaagca

SEQ ID NO: 82761 - DNA, 20 bp, Artificial Sequence
  chemically synthesized
gaatcagctttatatgtaag

SEQ ID NO: 82762 - DNA, 20 bp, Artificial Sequence
  chemically synthesized
atttactctgcttacatata

SEQ ID NO: 82763 - DNA, 20 bp, Artificial Sequence
  chemically synthesized
ggagaatcagctttatatgt

SEQ ID NO: 82764 - DNA, 20 bp, Artificial Sequence
  chemically synthesized
aagtgaaatatcaggagaat

SEQ ID NO: 82765 - DNA, 20 bp, Artificial Sequence
  chemically synthesized
gatttcaagtgaaatatcag

SEQ ID NO: 82766 - DNA, 20 bp, Artificial Sequence
  chemically synthesized
gagatttcaagtgaaatatc

SEQ ID NO: 82767 - DNA, 20 bp, Artificial Sequence
  chemically synthesized
ggagatttcaagtgaaatat

SEQ ID NO: 82768 - DNA, 20 bp, Artificial Sequence
  chemically synthesized
cacacaaacatggagatttc

SEQ ID NO: 82769 - DNA, 20 bp, Artificial Sequence
  chemically synthesized
cacacacacacacaaacatg

SEQ ID NO: 82770 - DNA, 20 bp, Artificial Sequence
  chemically synthesized
cacacacacacacacaaaca

SEQ ID NO: 82771 - DNA, 20 bp, Artificial Sequence
  chemically synthesized
tgtgtgtgtgtgtgtgtgtt

SEQ ID NO: 82772 - DNA, 20 bp, Artificial Sequence
  chemically synthesized
aattgtatgaaaaaaaacac

SEQ ID NO: 82773 - DNA, 20 bp, Artificial Sequence
  chemically synthesized
gtgttttttttcatacaatt

SEQ ID NO: 82774 - DNA, 20 bp, Artificial Sequence
  chemically synthesized
caattaagtttcccaaattc

SEQ ID NO: 82775 - DNA, 20 bp, Artificial Sequence
  chemically synthesized
atgataatttacttgaattt

SEQ ID NO: 82776 - DNA, 20 bp, Artificial Sequence
  chemically synthesized
aatgataatttacttgaatt

SEQ ID NO: 82777 - DNA, 20 bp, Artificial Sequence
  chemically synthesized
aagtaaattatcattttgcc

SEQ ID NO: 82778 - DNA, 20 bp, Artificial Sequence
  chemically synthesized
caggtccaaacagagaaact

SEQ ID NO: 82779 - DNA, 20 bp, Artificial Sequence
  chemically synthesized
tcaggtccaaacagagaaac

SEQ ID NO: 82780 - DNA, 20 bp, Artificial Sequence
  chemically synthesized
ttttgcctagtttctctgtt

SEQ ID NO: 82781 - DNA, 20 bp, Artificial Sequence
  chemically synthesized
cctcccttcaggtccaaaca

SEQ ID NO: 82782 - DNA, 20 bp, Artificial Sequence
  chemically synthesized
tgcctcccttcaggtccaaa

SEQ ID NO: 82783 - DNA, 20 bp, Artificial Sequence
  chemically synthesized
agtttctctgtttggacctg

SEQ ID NO: 82784 - DNA, 20 bp, Artificial Sequence
  chemically synthesized
gtttctctgtttggacctga

SEQ ID NO: 82785 - DNA, 20 bp, Artificial Sequence
  chemically synthesized
tttctctgtttggacctgaa

SEQ ID NO: 82786 - DNA, 20 bp, Artificial Sequence
  chemically synthesized
tctctgtttggacctgaagg

SEQ ID NO: 82787 - DNA, 20 bp, Artificial Sequence
  chemically synthesized
ctctgtttggacctgaaggg

SEQ ID NO: 82788 - DNA, 20 bp, Artificial Sequence
  chemically synthesized
agtattaattgcctcccttc

SEQ ID NO: 82789 - DNA, 20 bp, Artificial Sequence
  chemically synthesized
cagtattaattgcctccctt

SEQ ID NO: 82790 - DNA, 20 bp, Artificial Sequence
  chemically synthesized
atttttataattagtaatgt

SEQ ID NO: 82791 - DNA, 20 bp, Artificial Sequence
  chemically synthesized
gccattattatttttataat

SEQ ID NO: 82792 - DNA, 20 bp, Artificial Sequence
  chemically synthesized
actaattataaaaataataa

SEQ ID NO: 82793 - DNA, 20 bp, Artificial Sequence
  chemically synthesized
acatggtagttcaatagagg

SEQ ID NO: 82794 - DNA, 20 bp, Artificial Sequence
  chemically synthesized
acacatggtagttcaataga

SEQ ID NO: 82795 - DNA, 20 bp, Artificial Sequence
  chemically synthesized
gacacatggtagttcaatag

SEQ ID NO: 82796 - DNA, 20 bp, Artificial Sequence
  chemically synthesized
tgacacatggtagttcaata

SEQ ID NO: 82797 - DNA, 20 bp, Artificial Sequence
  chemically synthesized
actgacacatggtagttcaa

SEQ ID NO: 82798 - DNA, 20 bp, Artificial Sequence
  chemically synthesized
gtacaaccactgacacatgg

SEQ ID NO: 82799 - DNA, 20 bp, Artificial Sequence
  chemically synthesized
tctattgaactaccatgtgt

SEQ ID NO: 82800 - DNA, 20 bp, Artificial Sequence
  chemically synthesized
caggtacaaccactgacaca

SEQ ID NO: 82801 - DNA, 20 bp, Artificial Sequence
  chemically synthesized
attgaactaccatgtgtcag

SEQ ID NO: 82802 - DNA, 20 bp, Artificial Sequence
  chemically synthesized
tcagtggttgtacctgaaac

SEQ ID NO: 82803 - DNA, 20 bp, Artificial Sequence
  chemically synthesized
aactttgtatttccagtttc

SEQ ID NO: 82804 - DNA, 20 bp, Artificial Sequence
  chemically synthesized
caactttgtatttccagttt

SEQ ID NO: 82805 - DNA, 20 bp, Artificial Sequence
  chemically synthesized
tgcattcaactttgtatttc

SEQ ID NO: 82806 - DNA, 20 bp, Artificial Sequence
  chemically synthesized
tacctgaaactggaaataca

SEQ ID NO: 82807 - DNA, 20 bp, Artificial Sequence
  chemically synthesized
atacaaagttgaatgcaaaa

SEQ ID NO: 82808 - DNA, 20 bp, Artificial Sequence
  chemically synthesized
taaatattcctaaatagaaa

SEQ ID NO: 82809 - DNA, 20 bp, Artificial Sequence
  chemically synthesized
gcaaaacagccctttctatt

SEQ ID NO: 82810 - DNA, 20 bp, Artificial Sequence
  chemically synthesized
ttaaatattcctaaatagaa

SEQ ID NO: 82811 - DNA, 20 bp, Artificial Sequence
  chemically synthesized
caaaacagccctttctattt

SEQ ID NO: 82812 - DNA, 20 bp, Artificial Sequence
  chemically synthesized
gttaaatattcctaaataga

SEQ ID NO: 82813 - DNA, 20 bp, Artificial Sequence
  chemically synthesized
atatgttaaatattcctaaa

SEQ ID NO: 82814 - DNA, 20 bp, Artificial Sequence
  chemically synthesized
taggaatatttaacatataa

SEQ ID NO: 82815 - DNA, 20 bp, Artificial Sequence
  chemically synthesized
gaatatttaacatataatag

SEQ ID NO: 82816 - DNA, 20 bp, Artificial Sequence
  chemically synthesized
atatttaacatataatagaa

SEQ ID NO: 82817 - DNA, 20 bp, Artificial Sequence
  chemically synthesized
ttaacatataatagaagagt

SEQ ID NO: 82818 - DNA, 20 bp, Artificial Sequence
  chemically synthesized
taaataatttcaatacaatg

SEQ ID NO: 82819 - DNA, 20 bp, Artificial Sequence
  chemically synthesized
taatttcaatacaatgtaga

SEQ ID NO: 82820 - DNA, 20 bp, Artificial Sequence
  chemically synthesized
atacaatgtagacagtgcta

SEQ ID NO: 82821 - DNA, 20 bp, Artificial Sequence
  chemically synthesized
ccccatattgcgcaagtcta

SEQ ID NO: 82822 - DNA, 20 bp, Artificial Sequence
  chemically synthesized
ttttcttccccatattgcgc

SEQ ID NO: 82823 - DNA, 20 bp, Artificial Sequence
  chemically synthesized
tgctatagacttgcgcaata

SEQ ID NO: 82824 - DNA, 20 bp, Artificial Sequence
  chemically synthesized
gctatagacttgcgcaatat

SEQ ID NO: 82825 - DNA, 20 bp, Artificial Sequence
  chemically synthesized
ctatagacttgcgcaatatg

SEQ ID NO: 82826 - DNA, 20 bp, Artificial Sequence
  chemically synthesized
tagacttgcgcaatatgggg

SEQ ID NO: 82827 - DNA, 20 bp, Artificial Sequence
  chemically synthesized
cgcaatatggggaagaaaat

SEQ ID NO: 82828 - DNA, 20 bp, Artificial Sequence
  chemically synthesized
gcaatatggggaagaaaatc

SEQ ID NO: 82829 - DNA, 20 bp, Artificial Sequence
  chemically synthesized
atggggaagaaaatcgggaa

SEQ ID NO: 82830 - DNA, 20 bp, Artificial Sequence
  chemically synthesized
agaaaatcgggaaaagcttc

SEQ ID NO: 82831 - DNA, 20 bp, Artificial Sequence
  chemically synthesized
gaaaatcgggaaaagcttcc

SEQ ID NO: 82832 - DNA, 20 bp, Artificial Sequence
  chemically synthesized
aaatcgggaaaagcttccag

SEQ ID NO: 82833 - DNA, 20 bp, Artificial Sequence
  chemically synthesized
tcgggaaaagcttccaggag

SEQ ID NO: 82834 - DNA, 20 bp, Artificial Sequence
  chemically synthesized
tgattactagcttctcctgg

SEQ ID NO: 82835 - DNA, 20 bp, Artificial Sequence
  chemically synthesized
atgtgattactagcttctcc

SEQ ID NO: 82836 - DNA, 20 bp, Artificial Sequence
  chemically synthesized
gaaaagcttccaggagaagc

SEQ ID NO: 82837 - DNA, 20 bp, Artificial Sequence
  chemically synthesized
tttgaattctatgtgattac

SEQ ID NO: 82838 - DNA, 20 bp, Artificial Sequence
  chemically synthesized
aggagaagctagtaatcaca

SEQ ID NO: 82839 - DNA, 20 bp, Artificial Sequence
  chemically synthesized
agtaatcacatagaattcaa

SEQ ID NO: 82840 - DNA, 20 bp, Artificial Sequence
  chemically synthesized
agcatgaacatgacttattc

SEQ ID NO: 82841 - DNA, 20 bp, Artificial Sequence
  chemically synthesized
gcatgaacatgacttattca

SEQ ID NO: 82842 - DNA, 20 bp, Artificial Sequence
  chemically synthesized
tagcatactcttccttgaat

SEQ ID NO: 82843 - DNA, 20 bp, Artificial Sequence
  chemically synthesized
tgaacatgacttattcaagg

SEQ ID NO: 82844 - DNA, 20 bp, Artificial Sequence
  chemically synthesized
aacatgacttattcaaggaa

SEQ ID NO: 82845 - DNA, 20 bp, Artificial Sequence
  chemically synthesized
ttattcaaggaagagtatgc

SEQ ID NO: 82846 - DNA, 20 bp, Artificial Sequence
  chemically synthesized
attcaaggaagagtatgcta

SEQ ID NO: 82847 - DNA, 20 bp, Artificial Sequence
  chemically synthesized
cctcttcttggaatgttctc

SEQ ID NO: 82848 - DNA, 20 bp, Artificial Sequence
  chemically synthesized
agtatgctagagaacattcc

SEQ ID NO: 82849 - DNA, 20 bp, Artificial Sequence
  chemically synthesized
atgctagagaacattccaag

SEQ ID NO: 82850 - DNA, 20 bp, Artificial Sequence
  chemically synthesized
gctagagaacattccaagaa

SEQ ID NO: 82851 - DNA, 20 bp, Artificial Sequence
  chemically synthesized
ctagagaacattccaagaag

SEQ ID NO: 82852 - DNA, 20 bp, Artificial Sequence
  chemically synthesized
cacttgcattttcctcttct

SEQ ID NO: 82853 - DNA, 20 bp, Artificial Sequence
  chemically synthesized
ttccaagaagaggaaaatgc

SEQ ID NO: 82854 - DNA, 20 bp, Artificial Sequence
  chemically synthesized
agaagaggaaaatgcaagtg

SEQ ID NO: 82855 - DNA, 20 bp, Artificial Sequence
  chemically synthesized
aagaggaaaatgcaagtgca

SEQ ID NO: 82856 - DNA, 20 bp, Artificial Sequence
  chemically synthesized
aaaatgcaagtgcagagtca

SEQ ID NO: 82857 - DNA, 20 bp, Artificial Sequence
  chemically synthesized
aaatgcaagtgcagagtcat

SEQ ID NO: 82858 - DNA, 20 bp, Artificial Sequence
  chemically synthesized
aagtgcagagtcataggaca

SEQ ID NO: 82859 - DNA, 20 bp, Artificial Sequence
  chemically synthesized
cagagtcataggacatagtg

SEQ ID NO: 82860 - DNA, 20 bp, Artificial Sequence
  chemically synthesized
tcataggacatagtgcagta

SEQ ID NO: 82861 - DNA, 20 bp, Artificial Sequence
  chemically synthesized
tagtgcagtatggtatgtat

SEQ ID NO: 82862 - DNA, 20 bp, Artificial Sequence
  chemically synthesized
atggtatgtatcggaatctc

SEQ ID NO: 82863 - DNA, 20 bp, Artificial Sequence
  chemically synthesized
gtatgtatcggaatctcaag

SEQ ID NO: 82864 - DNA, 20 bp, Artificial Sequence
  chemically synthesized
tatgtatcggaatctcaagc

SEQ ID NO: 82865 - DNA, 20 bp, Artificial Sequence
  chemically synthesized
ctagaaacactggcctgctt

SEQ ID NO: 82866 - DNA, 20 bp, Artificial Sequence
  chemically synthesized
tatcggaatctcaagcaggc

SEQ ID NO: 82867 - DNA, 20 bp, Artificial Sequence
  chemically synthesized
ctcaagcaggccagtgtttc

SEQ ID NO: 82868 - DNA, 20 bp, Artificial Sequence
  chemically synthesized
tctttatgctctagaaacac

SEQ ID NO: 82869 - DNA, 20 bp, Artificial Sequence
  chemically synthesized
caagcaggccagtgtttcta

SEQ ID NO: 82870 - DNA, 20 bp, Artificial Sequence
  chemically synthesized
gccagtgtttctagagcata

SEQ ID NO: 82871 - DNA, 20 bp, Artificial Sequence
  chemically synthesized
tctccttgttctttatgctc

SEQ ID NO: 82872 - DNA, 20 bp, Artificial Sequence
  chemically synthesized
gtttctagagcataaagaac

SEQ ID NO: 82873 - DNA, 20 bp, Artificial Sequence
  chemically synthesized
tttctagagcataaagaaca

SEQ ID NO: 82874 - DNA, 20 bp, Artificial Sequence
  chemically synthesized
tctagagcataaagaacaag

SEQ ID NO: 82875 - DNA, 20 bp, Artificial Sequence
  chemically synthesized
tagagcataaagaacaagga

SEQ ID NO: 82876 - DNA, 20 bp, Artificial Sequence
  chemically synthesized
agagcataaagaacaaggag

SEQ ID NO: 82877 - DNA, 20 bp, Artificial Sequence
  chemically synthesized
gagcataaagaacaaggaga

SEQ ID NO: 82878 - DNA, 20 bp, Artificial Sequence
  chemically synthesized
acaaggagagggcatgtcca

SEQ ID NO: 82879 - DNA, 20 bp, Artificial Sequence
  chemically synthesized
aatagtgtctttttcatctt

SEQ ID NO: 82880 - DNA, 20 bp, Artificial Sequence
  chemically synthesized
gggcatgtccaaagatgaaa

SEQ ID NO: 82881 - DNA, 20 bp, Artificial Sequence
  chemically synthesized
aatgtatttccagatagcaa

SEQ ID NO: 82882 - DNA, 20 bp, Artificial Sequence
  chemically synthesized
aaaaagacactattgctatc

SEQ ID NO: 82883 - DNA, 20 bp, Artificial Sequence
  chemically synthesized
aaatctaatgtatttccaga

SEQ ID NO: 82884 - DNA, 20 bp, Artificial Sequence
  chemically synthesized
ttaaaaatctaatgtatttc

SEQ ID NO: 82885 - DNA, 20 bp, Artificial Sequence
  chemically synthesized
attgctatctggaaatacat

SEQ ID NO: 82886 - DNA, 20 bp, Artificial Sequence
  chemically synthesized
aatacattagatttttaaac

SEQ ID NO: 82887 - DNA, 20 bp, Artificial Sequence
  chemically synthesized
gatttttaaaccagaatttg

SEQ ID NO: 82888 - DNA, 20 bp, Artificial Sequence
  chemically synthesized
agaggcagagcttcaaattc

SEQ ID NO: 82889 - DNA, 20 bp, Artificial Sequence
  chemically synthesized
tatgtgatcatagagaggca

SEQ ID NO: 82890 - DNA, 20 bp, Artificial Sequence
  chemically synthesized
catatgtgatcatagagagg

SEQ ID NO: 82891 - DNA, 20 bp, Artificial Sequence
  chemically synthesized
gaccatatgtgatcatagag

SEQ ID NO: 82892 - DNA, 20 bp, Artificial Sequence
  chemically synthesized
ggaccatatgtgatcataga

SEQ ID NO: 82893 - DNA, 20 bp, Artificial Sequence
  chemically synthesized
gtggaccatatgtgatcata

SEQ ID NO: 82894 - DNA, 20 bp, Artificial Sequence
  chemically synthesized
tagtggaccatatgtgatca

SEQ ID NO: 82895 - DNA, 20 bp, Artificial Sequence
  chemically synthesized
tgcctctctatgatcacata

SEQ ID NO: 82896 - DNA, 20 bp, Artificial Sequence
  chemically synthesized
atgatcacatatggtccact

SEQ ID NO: 82897 - DNA, 20 bp, Artificial Sequence
  chemically synthesized
gatcacatatggtccactaa

SEQ ID NO: 82898 - DNA, 20 bp, Artificial Sequence
  chemically synthesized
atcacatatggtccactaag

SEQ ID NO: 82899 - DNA, 20 bp, Artificial Sequence
  chemically synthesized
gcaacacctaagcctcttag

SEQ ID NO: 82900 - DNA, 20 bp, Artificial Sequence
  chemically synthesized
atatggtccactaagaggct

SEQ ID NO: 82901 - DNA, 20 bp, Artificial Sequence
  chemically synthesized
aaggcaacacctaagcctct

SEQ ID NO: 82902 - DNA, 20 bp, Artificial Sequence
  chemically synthesized
tatggtccactaagaggctt

SEQ ID NO: 82903 - DNA, 20 bp, Artificial Sequence
  chemically synthesized
ttaccttcaaggcaacacct

SEQ ID NO: 82904 - DNA, 20 bp, Artificial Sequence
  chemically synthesized
gaggcttaggtgttgccttg

SEQ ID NO: 82905 - DNA, 20 bp, Artificial Sequence
  chemically synthesized
aggcttaggtgttgccttga

SEQ ID NO: 82906 - DNA, 20 bp, Artificial Sequence
  chemically synthesized
aaggttcctgattaccttca

SEQ ID NO: 82907 - DNA, 20 bp, Artificial Sequence
  chemically synthesized
aaaggttcctgattaccttc

SEQ ID NO: 82908 - DNA, 20 bp, Artificial Sequence
  chemically synthesized
ggtgttgccttgaaggtaat

SEQ ID NO: 82909 - DNA, 20 bp, Artificial Sequence
  chemically synthesized
gtgttgccttgaaggtaatc

SEQ ID NO: 82910 - DNA, 20 bp, Artificial Sequence
  chemically synthesized
ggtaatcaggaacctttgaa

SEQ ID NO: 82911 - DNA, 20 bp, Artificial Sequence
  chemically synthesized
ccttggttaaaaccgttcaa

SEQ ID NO: 82912 - DNA, 20 bp, Artificial Sequence
  chemically synthesized
cccttggttaaaaccgttca

SEQ ID NO: 82913 - DNA, 20 bp, Artificial Sequence
  chemically synthesized
acctttgaacggttttaacc

SEQ ID NO: 82914 - DNA, 20 bp, Artificial Sequence
  chemically synthesized
cctttgaacggttttaacca

SEQ ID NO: 82915 - DNA, 20 bp, Artificial Sequence
  chemically synthesized
ctttgaacggttttaaccaa

SEQ ID NO: 82916 - DNA, 20 bp, Artificial Sequence
  chemically synthesized
ttgaacggttttaaccaagg

SEQ ID NO: 82917 - DNA, 20 bp, Artificial Sequence
  chemically synthesized
aacggttttaaccaagggag

SEQ ID NO: 82918 - DNA, 20 bp, Artificial Sequence
  chemically synthesized
atattcctgtgccactccct

SEQ ID NO: 82919 - DNA, 20 bp, Artificial Sequence
  chemically synthesized
ttttaaccaagggagtggca

SEQ ID NO: 82920 - DNA, 20 bp, Artificial Sequence
  chemically synthesized
tttaaccaagggagtggcac

SEQ ID NO: 82921 - DNA, 20 bp, Artificial Sequence
  chemically synthesized
aggaatatgtgtgcttcaaa

SEQ ID NO: 82922 - DNA, 20 bp, Artificial Sequence
  chemically synthesized
atatcaggaagatctatttg

SEQ ID NO: 82923 - DNA, 20 bp, Artificial Sequence
  chemically synthesized
tactctgtatttatatcagg

SEQ ID NO: 82924 - DNA, 20 bp, Artificial Sequence
  chemically synthesized
acatactctgtatttatatc

SEQ ID NO: 82925 - DNA, 20 bp, Artificial Sequence
  chemically synthesized
tacatactctgtatttatat

SEQ ID NO: 82926 - DNA, 20 bp, Artificial Sequence
  chemically synthesized
agatcttcctgatataaata

SEQ ID NO: 82927 - DNA, 20 bp, Artificial Sequence
  chemically synthesized
atcttcctgatataaataca

SEQ ID NO: 82928 - DNA, 20 bp, Artificial Sequence
  chemically synthesized
taaatacagagtatgtattt

SEQ ID NO: 82929 - DNA, 20 bp, Artificial Sequence
  chemically synthesized
atacagagtatgtatttgag

SEQ ID NO: 82930 - DNA, 20 bp, Artificial Sequence
  chemically synthesized
gagtatgtatttgagaagaa

SEQ ID NO: 82931 - DNA, 20 bp, Artificial Sequence
  chemically synthesized
gtatttgagaagaacagaaa

SEQ ID NO: 82932 - DNA, 20 bp, Artificial Sequence
  chemically synthesized
gagaagaacagaaatggaat

SEQ ID NO: 82933 - DNA, 20 bp, Artificial Sequence
  chemically synthesized
gaagaacagaaatggaatca

SEQ ID NO: 82934 - DNA, 20 bp, Artificial Sequence
  chemically synthesized
agaacagaaatggaatcaga

SEQ ID NO: 82935 - DNA, 20 bp, Artificial Sequence
  chemically synthesized
aatggaatcagagagataat

SEQ ID NO: 82936 - DNA, 20 bp, Artificial Sequence
  chemically synthesized
atggaatcagagagataatg

SEQ ID NO: 82937 - DNA, 20 bp, Artificial Sequence
  chemically synthesized
agagataatgaggcaattgt

SEQ ID NO: 82938 - DNA, 20 bp, Artificial Sequence
  chemically synthesized
atgaggcaattgtaagaatt

SEQ ID NO: 82939 - DNA, 20 bp, Artificial Sequence
  chemically synthesized
caattgtaagaattcagtgc

SEQ ID NO: 82940 - DNA, 20 bp, Artificial Sequence
  chemically synthesized
agaattcagtgcaagattat

SEQ ID NO: 82941 - DNA, 20 bp, Artificial Sequence
  chemically synthesized
gaattcagtgcaagattatg

SEQ ID NO: 82942 - DNA, 20 bp, Artificial Sequence
  chemically synthesized
aagattatgaggatttgact

SEQ ID NO: 82943 - DNA, 20 bp, Artificial Sequence
  chemically synthesized
agattatgaggatttgactc

SEQ ID NO: 82944 - DNA, 20 bp, Artificial Sequence
  chemically synthesized
gattatgaggatttgactca

SEQ ID NO: 82945 - DNA, 20 bp, Artificial Sequence
  chemically synthesized
gaggatttgactcagggcaa

SEQ ID NO: 82946 - DNA, 20 bp, Artificial Sequence
  chemically synthesized
tttcctggtaccattgccct

SEQ ID NO: 82947 - DNA, 20 bp, Artificial Sequence
  chemically synthesized
ttgactcagggcaatggtac

SEQ ID NO: 82948 - DNA, 20 bp, Artificial Sequence
  chemically synthesized
tgactcagggcaatggtacc

SEQ ID NO: 82949 - DNA, 20 bp, Artificial Sequence
  chemically synthesized
cctatccctgtcatttttcc

SEQ ID NO: 82950 - DNA, 20 bp, Artificial Sequence
  chemically synthesized
aatggtaccaggaaaaatga

SEQ ID NO: 82951 - DNA, 20 bp, Artificial Sequence
  chemically synthesized
atggtaccaggaaaaatgac

SEQ ID NO: 82952 - DNA, 20 bp, Artificial Sequence
  chemically synthesized
tggtaccaggaaaaatgaca

SEQ ID NO: 82953 - DNA, 20 bp, Artificial Sequence
  chemically synthesized
accaggaaaaatgacaggga

SEQ ID NO: 82954 - DNA, 20 bp, Artificial Sequence
  chemically synthesized
ccaggaaaaatgacagggat

SEQ ID NO: 82955 - DNA, 20 bp, Artificial Sequence
  chemically synthesized
gaaaaatgacagggatagga

SEQ ID NO: 82956 - DNA, 20 bp, Artificial Sequence
  chemically synthesized
aaaaatgacagggataggat

SEQ ID NO: 82957 - DNA, 20 bp, Artificial Sequence
  chemically synthesized
aaaatgacagggataggata

SEQ ID NO: 82958 - DNA, 20 bp, Artificial Sequence
  chemically synthesized
attttcacacttcagatttt

SEQ ID NO: 82959 - DNA, 20 bp, Artificial Sequence
  chemically synthesized
gggaaatgtctaaaaatctg

SEQ ID NO: 82960 - DNA, 20 bp, Artificial Sequence
  chemically synthesized
gtcaccaaattttcacactt

SEQ ID NO: 82961 - DNA, 20 bp, Artificial Sequence
  chemically synthesized
aaatctgaagtgtgaaaatt

SEQ ID NO: 82962 - DNA, 20 bp, Artificial Sequence
  chemically synthesized
gtgaaaatttggtgactgaa

SEQ ID NO: 82963 - DNA, 20 bp, Artificial Sequence
  chemically synthesized
tcttctctccagcatctatt

SEQ ID NO: 82964 - DNA, 20 bp, Artificial Sequence
  chemically synthesized
tttggtgactgaatagatgc

SEQ ID NO: 82965 - DNA, 20 bp, Artificial Sequence
  chemically synthesized
tggtgactgaatagatgctg

SEQ ID NO: 82966 - DNA, 20 bp, Artificial Sequence
  chemically synthesized
gtgactgaatagatgctgga

SEQ ID NO: 82967 - DNA, 20 bp, Artificial Sequence
  chemically synthesized
actgaatagatgctggagag

SEQ ID NO: 82968 - DNA, 20 bp, Artificial Sequence
  chemically synthesized
tgaatagatgctggagagaa

SEQ ID NO: 82969 - DNA, 20 bp, Artificial Sequence
  chemically synthesized
ttctttttctctcttctctc

SEQ ID NO: 82970 - DNA, 20 bp, Artificial Sequence
  chemically synthesized
aatagatgctggagagaaga

SEQ ID NO: 82971 - DNA, 20 bp, Artificial Sequence
  chemically synthesized
tgctggagagaagagagaaa

SEQ ID NO: 82972 - DNA, 20 bp, Artificial Sequence
  chemically synthesized
gagaagagagaaaaagaaac

SEQ ID NO: 82973 - DNA, 20 bp, Artificial Sequence
  chemically synthesized
aaagaaacaagaatgacact

SEQ ID NO: 82974 - DNA, 20 bp, Artificial Sequence
  chemically synthesized
caagaatgacacttagtgtc

SEQ ID NO: 82975 - DNA, 20 bp, Artificial Sequence
  chemically synthesized
aagaatgacacttagtgtct

SEQ ID NO: 82976 - DNA, 20 bp, Artificial Sequence
  chemically synthesized
atctactcaacctagacact

SEQ ID NO: 82977 - DNA, 20 bp, Artificial Sequence
  chemically synthesized
tgacacttagtgtctaggtt

SEQ ID NO: 82978 - DNA, 20 bp, Artificial Sequence
  chemically synthesized
cacttagtgtctaggttgag

SEQ ID NO: 82979 - DNA, 20 bp, Artificial Sequence
  chemically synthesized
gtttgctcatctactcaacc

SEQ ID NO: 82980 - DNA, 20 bp, Artificial Sequence
  chemically synthesized
agtgtctaggttgagtagat

SEQ ID NO: 82981 - DNA, 20 bp, Artificial Sequence
  chemically synthesized
ttgagtagatgagcaaacgc

SEQ ID NO: 82982 - DNA, 20 bp, Artificial Sequence
  chemically synthesized
tgagtagatgagcaaacgct

SEQ ID NO: 82983 - DNA, 20 bp, Artificial Sequence
  chemically synthesized
atacttagttgaattgcacc

SEQ ID NO: 82984 - DNA, 20 bp, Artificial Sequence
  chemically synthesized
acgctgggtgcaattcaact

SEQ ID NO: 82985 - DNA, 20 bp, Artificial Sequence
  chemically synthesized
ggtgcaattcaactaagtat

SEQ ID NO: 82986 - DNA, 20 bp, Artificial Sequence
  chemically synthesized
gtgcaattcaactaagtatg

SEQ ID NO: 82987 - DNA, 20 bp, Artificial Sequence
  chemically synthesized
aaagtttatttcctcatact

SEQ ID NO: 82988 - DNA, 20 bp, Artificial Sequence
  chemically synthesized
tatgaggaaataaactttcc

SEQ ID NO: 82989 - DNA, 20 bp, Artificial Sequence
  chemically synthesized
gtgaactgagacatccagga

SEQ ID NO: 82990 - DNA, 20 bp, Artificial Sequence
  chemically synthesized
gtaggtgaactgagacatcc

SEQ ID NO: 82991 - DNA, 20 bp, Artificial Sequence
  chemically synthesized
ataaactttcctggatgtct

SEQ ID NO: 82992 - DNA, 20 bp, Artificial Sequence
  chemically synthesized
tgtaggtgaactgagacatc

SEQ ID NO: 82993 - DNA, 20 bp, Artificial Sequence
  chemically synthesized
gagctttctgtaggtgaact

SEQ ID NO: 82994 - DNA, 20 bp, Artificial Sequence
  chemically synthesized
tggatgtctcagttcaccta

SEQ ID NO: 82995 - DNA, 20 bp, Artificial Sequence
  chemically synthesized
tgtctcagttcacctacaga

SEQ ID NO: 82996 - DNA, 20 bp, Artificial Sequence
  chemically synthesized
aggaggctagagctttctgt

SEQ ID NO: 82997 - DNA, 20 bp, Artificial Sequence
  chemically synthesized
caggaggctagagctttctg

SEQ ID NO: 82998 - DNA, 20 bp, Artificial Sequence
  chemically synthesized
agttcacctacagaaagctc

SEQ ID NO: 82999 - DNA, 20 bp, Artificial Sequence
  chemically synthesized
ggaagtttctcaggaggcta

SEQ ID NO: 83000 - DNA, 20 bp, Artificial Sequence
  chemically synthesized
acagaaagctctagcctcct

SEQ ID NO: 83001 - DNA, 20 bp, Artificial Sequence
  chemically synthesized
tgggaagtttctcaggaggc

SEQ ID NO: 83002 - DNA, 20 bp, Artificial Sequence
  chemically synthesized
ggtgtgggaagtttctcagg

SEQ ID NO: 83003 - DNA, 20 bp, Artificial Sequence
  chemically synthesized
tggtgtgggaagtttctcag

SEQ ID NO: 83004 - DNA, 20 bp, Artificial Sequence
  chemically synthesized
catggtgtgggaagtttctc

SEQ ID NO: 83005 - DNA, 20 bp, Artificial Sequence
  chemically synthesized
ccatggtgtgggaagtttct

SEQ ID NO: 83006 - DNA, 20 bp, Artificial Sequence
  chemically synthesized
tctaatctccatggtgtggg

SEQ ID NO: 83007 - DNA, 20 bp, Artificial Sequence
  chemically synthesized
ctgagaaacttcccacacca

SEQ ID NO: 83008 - DNA, 20 bp, Artificial Sequence
  chemically synthesized
agatctaatctccatggtgt

SEQ ID NO: 83009 - DNA, 20 bp, Artificial Sequence
  chemically synthesized
gagaaacttcccacaccatg

SEQ ID NO: 83010 - DNA, 20 bp, Artificial Sequence
  chemically synthesized
cagatctaatctccatggtg

SEQ ID NO: 83011 - DNA, 20 bp, Artificial Sequence
  chemically synthesized
acttcccacaccatggagat

SEQ ID NO: 83012 - DNA, 20 bp, Artificial Sequence
  chemically synthesized
tgctacagatctaatctcca

SEQ ID NO: 83013 - DNA, 20 bp, Artificial Sequence
  chemically synthesized
caccatggagattagatctg

SEQ ID NO: 83014 - DNA, 20 bp, Artificial Sequence
  chemically synthesized
atgaactagacaaattgcta

SEQ ID NO: 83015 - DNA, 20 bp, Artificial Sequence
  chemically synthesized
tagatctgtagcaatttgtc

SEQ ID NO: 83016 - DNA, 20 bp, Artificial Sequence
  chemically synthesized
cttggatcagagaaatgaac

SEQ ID NO: 83017 - DNA, 20 bp, Artificial Sequence
  chemically synthesized
ctagttcatttctctgatcc

SEQ ID NO: 83018 - DNA, 20 bp, Artificial Sequence
  chemically synthesized
cgtttgaccctcttggatca

SEQ ID NO: 83019 - DNA, 20 bp, Artificial Sequence
  chemically synthesized
agttcatttctctgatccaa

SEQ ID NO: 83020 - DNA, 20 bp, Artificial Sequence
  chemically synthesized
gttcatttctctgatccaag

SEQ ID NO: 83021 - DNA, 20 bp, Artificial Sequence
  chemically synthesized
accgtttgaccctcttggat

SEQ ID NO: 83022 - DNA, 20 bp, Artificial Sequence
  chemically synthesized
ttcatttctctgatccaaga

SEQ ID NO: 83023 - DNA, 20 bp, Artificial Sequence
  chemically synthesized
ctataaccgtttgaccctct

SEQ ID NO: 83024 - DNA, 20 bp, Artificial Sequence
  chemically synthesized
tctgatccaagagggtcaaa

SEQ ID NO: 83025 - DNA, 20 bp, Artificial Sequence
  chemically synthesized
ccaagagggtcaaacggtta

SEQ ID NO: 83026 - DNA, 20 bp, Artificial Sequence
  chemically synthesized
agggtcaaacggttatagct

SEQ ID NO: 83027 - DNA, 20 bp, Artificial Sequence
  chemically synthesized
gggtcaaacggttatagctc

SEQ ID NO: 83028 - DNA, 20 bp, Artificial Sequence
  chemically synthesized
ggtcaaacggttatagctca

SEQ ID NO: 83029 - DNA, 20 bp, Artificial Sequence
  chemically synthesized
caaacggttatagctcaggg

SEQ ID NO: 83030 - DNA, 20 bp, Artificial Sequence
  chemically synthesized
aaacggttatagctcagggt

SEQ ID NO: 83031 - DNA, 20 bp, Artificial Sequence
  chemically synthesized
tcagcttaggaacctaccct

SEQ ID NO: 83032 - DNA, 20 bp, Artificial Sequence
  chemically synthesized
atagctcagggtaggttcct

SEQ ID NO: 83033 - DNA, 20 bp, Artificial Sequence
  chemically synthesized
aacaacatagagttcagctt

SEQ ID NO: 83034 - DNA, 20 bp, Artificial Sequence
  chemically synthesized
taacaacatagagttcagct

SEQ ID NO: 83035 - DNA, 20 bp, Artificial Sequence
  chemically synthesized
ctttctaacaacatagagtt

SEQ ID NO: 83036 - DNA, 20 bp, Artificial Sequence
  chemically synthesized
ccagtctttctaacaacata

SEQ ID NO: 83037 - DNA, 20 bp, Artificial Sequence
  chemically synthesized
taagctgaactctatgttgt

SEQ ID NO: 83038 - DNA, 20 bp, Artificial Sequence
  chemically synthesized
ctccagtctttctaacaaca

SEQ ID NO: 83039 - DNA, 20 bp, Artificial Sequence
  chemically synthesized
ctgaactctatgttgttaga

SEQ ID NO: 83040 - DNA, 20 bp, Artificial Sequence
  chemically synthesized
ctctatgttgttagaaagac

SEQ ID NO: 83041 - DNA, 20 bp, Artificial Sequence
  chemically synthesized
ctatgttgttagaaagactg

SEQ ID NO: 83042 - DNA, 20 bp, Artificial Sequence
  chemically synthesized
tgttgttagaaagactggag

SEQ ID NO: 83043 - DNA, 20 bp, Artificial Sequence
  chemically synthesized
gttgttagaaagactggagt

SEQ ID NO: 83044 - DNA, 20 bp, Artificial Sequence
  chemically synthesized
acctagaaagatacccactc

SEQ ID NO: 83045 - DNA, 20 bp, Artificial Sequence
  chemically synthesized
gactggagtgggtatctttc

SEQ ID NO: 83046 - DNA, 20 bp, Artificial Sequence
  chemically synthesized
actggagtgggtatctttct

SEQ ID NO: 83047 - DNA, 20 bp, Artificial Sequence
  chemically synthesized
ttgaaatgtaaatacctaga

SEQ ID NO: 83048 - DNA, 20 bp, Artificial Sequence
  chemically synthesized
ttttttgaaatgtaaatacc

SEQ ID NO: 83049 - DNA, 20 bp, Artificial Sequence
  chemically synthesized
tttacatttcaaaaaatatg

SEQ ID NO: 83050 - DNA, 20 bp, Artificial Sequence
  chemically synthesized
aaaatatgaagcccatacct

SEQ ID NO: 83051 - DNA, 20 bp, Artificial Sequence
  chemically synthesized
tggaaatgtctccaaggtat

SEQ ID NO: 83052 - DNA, 20 bp, Artificial Sequence
  chemically synthesized
aatatgaagcccataccttg

SEQ ID NO: 83053 - DNA, 20 bp, Artificial Sequence
  chemically synthesized
ctggaaatgtctccaaggta

SEQ ID NO: 83054 - DNA, 20 bp, Artificial Sequence
  chemically synthesized
acaatctggaaatgtctcca

SEQ ID NO: 83055 - DNA, 20 bp, Artificial Sequence
  chemically synthesized
tacaatctggaaatgtctcc

SEQ ID NO: 83056 - DNA, 20 bp, Artificial Sequence
  chemically synthesized
ccataccttggagacatttc

SEQ ID NO: 83057 - DNA, 20 bp, Artificial Sequence
  chemically synthesized
gtgtctcatgttttacaatc

SEQ ID NO: 83058 - DNA, 20 bp, Artificial Sequence
  chemically synthesized
atttccagattgtaaaacat

SEQ ID NO: 83059 - DNA, 20 bp, Artificial Sequence
  chemically synthesized
attgtaaaacatgagacaca

SEQ ID NO: 83060 - DNA, 20 bp, Artificial Sequence
  chemically synthesized
ttgtaaaacatgagacacac

SEQ ID NO: 83061 - DNA, 20 bp, Artificial Sequence
  chemically synthesized
tgtaaaacatgagacacaca

SEQ ID NO: 83062 - DNA, 20 bp, Artificial Sequence
  chemically synthesized
aaacatgagacacacagggc

SEQ ID NO: 83063 - DNA, 20 bp, Artificial Sequence
  chemically synthesized
atgagacacacagggctagc

SEQ ID NO: 83064 - DNA, 20 bp, Artificial Sequence
  chemically synthesized
cagcttctgcagaaaccagc

SEQ ID NO: 83065 - DNA, 20 bp, Artificial Sequence
  chemically synthesized
acagggctagctggtttctg

SEQ ID NO: 83066 - DNA, 20 bp, Artificial Sequence
  chemically synthesized
attccagcttctgcagaaac

SEQ ID NO: 83067 - DNA, 20 bp, Artificial Sequence
  chemically synthesized
gggctagctggtttctgcag

SEQ ID NO: 83068 - DNA, 20 bp, Artificial Sequence
  chemically synthesized
tagctggtttctgcagaagc

SEQ ID NO: 83069 - DNA, 20 bp, Artificial Sequence
  chemically synthesized
agtcctaattccagcttctg

SEQ ID NO: 83070 - DNA, 20 bp, Artificial Sequence
  chemically synthesized
gtttctgcagaagctggaat

SEQ ID NO: 83071 - DNA, 20 bp, Artificial Sequence
  chemically synthesized
tttctgcagaagctggaatt

SEQ ID NO: 83072 - DNA, 20 bp, Artificial Sequence
  chemically synthesized
acaggcctgagtcctaattc

SEQ ID NO: 83073 - DNA, 20 bp, Artificial Sequence
  chemically synthesized
cagaagctggaattaggact

SEQ ID NO: 83074 - DNA, 20 bp, Artificial Sequence
  chemically synthesized
agaagctggaattaggactc

SEQ ID NO: 83075 - DNA, 20 bp, Artificial Sequence
  chemically synthesized
tgtggaaacataacaggcct

SEQ ID NO: 83076 - DNA, 20 bp, Artificial Sequence
  chemically synthesized
gttctctgtggaaacataac

SEQ ID NO: 83077 - DNA, 20 bp, Artificial Sequence
  chemically synthesized
ggttctctgtggaaacataa

SEQ ID NO: 83078 - DNA, 20 bp, Artificial Sequence
  chemically synthesized
tcaggcctgttatgtttcca

SEQ ID NO: 83079 - DNA, 20 bp, Artificial Sequence
  chemically synthesized
aggcctgttatgtttccaca

SEQ ID NO: 83080 - DNA, 20 bp, Artificial Sequence
  chemically synthesized
tcattctgaaaggttctctg

SEQ ID NO: 83081 - DNA, 20 bp, Artificial Sequence
  chemically synthesized
tgtttccacagagaaccttt

SEQ ID NO: 83082 - DNA, 20 bp, Artificial Sequence
  chemically synthesized
tatccatctctcattctgaa

SEQ ID NO: 83083 - DNA, 20 bp, Artificial Sequence
  chemically synthesized
cacagagaacctttcagaat

SEQ ID NO: 83084 - DNA, 20 bp, Artificial Sequence
  chemically synthesized
ctatccatctctcattctga

SEQ ID NO: 83085 - DNA, 20 bp, Artificial Sequence
  chemically synthesized
cagagaacctttcagaatga

SEQ ID NO: 83086 - DNA, 20 bp, Artificial Sequence
  chemically synthesized
gaacctttcagaatgagaga

SEQ ID NO: 83087 - DNA, 20 bp, Artificial Sequence
  chemically synthesized
ctttcagaatgagagatgga

SEQ ID NO: 83088 - DNA, 20 bp, Artificial Sequence
  chemically synthesized
tcagaatgagagatggatag

SEQ ID NO: 83089 - DNA, 20 bp, Artificial Sequence
  chemically synthesized
tctgcttataaaggagaagg

SEQ ID NO: 83090 - DNA, 20 bp, Artificial Sequence
  chemically synthesized
ttctgcttataaaggagaag

SEQ ID NO: 83091 - DNA, 20 bp, Artificial Sequence
  chemically synthesized
ttttctgcttataaaggaga

SEQ ID NO: 83092 - DNA, 20 bp, Artificial Sequence
  chemically synthesized
tttttctgcttataaaggag

SEQ ID NO: 83093 - DNA, 20 bp, Artificial Sequence
  chemically synthesized
gcagcctccttctcctttat

SEQ ID NO: 83094 - DNA, 20 bp, Artificial Sequence
  chemically synthesized
cattttttctgcttataaag

SEQ ID NO: 83095 - DNA, 20 bp, Artificial Sequence
  chemically synthesized
gcctccttctcctttataag

SEQ ID NO: 83096 - DNA, 20 bp, Artificial Sequence
  chemically synthesized
atcattttttctgcttataa

SEQ ID NO: 83097 - DNA, 20 bp, Artificial Sequence
  chemically synthesized
aatcattttttctgcttata

SEQ ID NO: 83098 - DNA, 20 bp, Artificial Sequence
  chemically synthesized
gcagaaaaaatgatttttcc

SEQ ID NO: 83099 - DNA, 20 bp, Artificial Sequence
  chemically synthesized
tactccataagtgggagact

SEQ ID NO: 83100 - DNA, 20 bp, Artificial Sequence
  chemically synthesized
gtactccataagtgggagac

SEQ ID NO: 83101 - DNA, 20 bp, Artificial Sequence
  chemically synthesized
ttttcctagtctcccactta

SEQ ID NO: 83102 - DNA, 20 bp, Artificial Sequence
  chemically synthesized
gctgggtactccataagtgg

SEQ ID NO: 83103 - DNA, 20 bp, Artificial Sequence
  chemically synthesized
ttcctagtctcccacttatg

SEQ ID NO: 83104 - DNA, 20 bp, Artificial Sequence
  chemically synthesized
tggctgggtactccataagt

SEQ ID NO: 83105 - DNA, 20 bp, Artificial Sequence
  chemically synthesized
gtggctgggtactccataag

SEQ ID NO: 83106 - DNA, 20 bp, Artificial Sequence
  chemically synthesized
tgagtggctgggtactccat

SEQ ID NO: 83107 - DNA, 20 bp, Artificial Sequence
  chemically synthesized
tctcccacttatggagtacc

SEQ ID NO: 83108 - DNA, 20 bp, Artificial Sequence
  chemically synthesized
attttcctacttgagtggct

SEQ ID NO: 83109 - DNA, 20 bp, Artificial Sequence
  chemically synthesized
tatggagtacccagccactc

SEQ ID NO: 83110 - DNA, 20 bp, Artificial Sequence
  chemically synthesized
cattttcctacttgagtggc

SEQ ID NO: 83111 - DNA, 20 bp, Artificial Sequence
  chemically synthesized
ggagtacccagccactcaag

SEQ ID NO: 83112 - DNA, 20 bp, Artificial Sequence
  chemically synthesized
gagtacccagccactcaagt

SEQ ID NO: 83113 - DNA, 20 bp, Artificial Sequence
  chemically synthesized
gaaacattttcctacttgag

SEQ ID NO: 83114 - DNA, 20 bp, Artificial Sequence
  chemically synthesized
gatgaaacattttcctactt

SEQ ID NO: 83115 - DNA, 20 bp, Artificial Sequence
  chemically synthesized
caagtaggaaaatgtttcat

SEQ ID NO: 83116 - DNA, 20 bp, Artificial Sequence
  chemically synthesized
cagcgttcatcatgttgccc

SEQ ID NO: 83117 - DNA, 20 bp, Artificial Sequence
  chemically synthesized
agcgttcatcatgttgccct

SEQ ID NO: 83118 - DNA, 20 bp, Artificial Sequence
  chemically synthesized
gcgttcatcatgttgcccta

SEQ ID NO: 83119 - DNA, 20 bp, Artificial Sequence
  chemically synthesized
cgttcatcatgttgccctag

SEQ ID NO: 83120 - DNA, 20 bp, Artificial Sequence
  chemically synthesized
catcatgttgccctaggggt

SEQ ID NO: 83121 - DNA, 20 bp, Artificial Sequence
  chemically synthesized
tgcccaaagacttaccccta

SEQ ID NO: 83122 - DNA, 20 bp, Artificial Sequence
  chemically synthesized
ttgcccaaagacttacccct

SEQ ID NO: 83123 - DNA, 20 bp, Artificial Sequence
  chemically synthesized
tttgcccaaagacttacccc

SEQ ID NO: 83124 - DNA, 20 bp, Artificial Sequence
  chemically synthesized
ttgccctaggggtaagtctt

SEQ ID NO: 83125 - DNA, 20 bp, Artificial Sequence
  chemically synthesized
tgccctaggggtaagtcttt

SEQ ID NO: 83126 - DNA, 20 bp, Artificial Sequence
  chemically synthesized
taggggtaagtctttgggca

SEQ ID NO: 83127 - DNA, 20 bp, Artificial Sequence
  chemically synthesized
aggggtaagtctttgggcaa

SEQ ID NO: 83128 - DNA, 20 bp, Artificial Sequence
  chemically synthesized
ctgtgcccttcctttgccca

SEQ ID NO: 83129 - DNA, 20 bp, Artificial Sequence
  chemically synthesized
ggtaagtctttgggcaaagg

SEQ ID NO: 83130 - DNA, 20 bp, Artificial Sequence
  chemically synthesized
gtaagtctttgggcaaagga

SEQ ID NO: 83131 - DNA, 20 bp, Artificial Sequence
  chemically synthesized
taagtctttgggcaaaggaa

SEQ ID NO: 83132 - DNA, 20 bp, Artificial Sequence
  chemically synthesized
ctttgggcaaaggaagggca

SEQ ID NO: 83133 - DNA, 20 bp, Artificial Sequence
  chemically synthesized
acagcaacaatatttactgt

SEQ ID NO: 83134 - DNA, 20 bp, Artificial Sequence
  chemically synthesized
cagcaacaatatttactgta

SEQ ID NO: 83135 - DNA, 20 bp, Artificial Sequence
  chemically synthesized
gatttcatttaattacctta

SEQ ID NO: 83136 - DNA, 20 bp, Artificial Sequence
  chemically synthesized
gaggggttctgaatcagagg

SEQ ID NO: 83137 - DNA, 20 bp, Artificial Sequence
  chemically synthesized
aatgaaatctgcctctgatt

SEQ ID NO: 83138 - DNA, 20 bp, Artificial Sequence
  chemically synthesized
catgaggggttctgaatcag

SEQ ID NO: 83139 - DNA, 20 bp, Artificial Sequence
  chemically synthesized
gcatgaggggttctgaatca

SEQ ID NO: 83140 - DNA, 20 bp, Artificial Sequence
  chemically synthesized
gagcatgaggggttctgaat

SEQ ID NO: 83141 - DNA, 20 bp, Artificial Sequence
  chemically synthesized
ttatcctgaatgagcatgag

SEQ ID NO: 83142 - DNA, 20 bp, Artificial Sequence
  chemically synthesized
tttatcctgaatgagcatga

SEQ ID NO: 83143 - DNA, 20 bp, Artificial Sequence
  chemically synthesized
ttttatcctgaatgagcatg

SEQ ID NO: 83144 - DNA, 20 bp, Artificial Sequence
  chemically synthesized
attttatcctgaatgagcat

SEQ ID NO: 83145 - DNA, 20 bp, Artificial Sequence
  chemically synthesized
cagaacccctcatgctcatt

SEQ ID NO: 83146 - DNA, 20 bp, Artificial Sequence
  chemically synthesized
agaacccctcatgctcattc

SEQ ID NO: 83147 - DNA, 20 bp, Artificial Sequence
  chemically synthesized
tcaataattttatcctgaat

SEQ ID NO: 83148 - DNA, 20 bp, Artificial Sequence
  chemically synthesized
cattcaggataaaattattg

SEQ ID NO: 83149 - DNA, 20 bp, Artificial Sequence
  chemically synthesized
ttcaggataaaattattgaa

SEQ ID NO: 83150 - DNA, 20 bp, Artificial Sequence
  chemically synthesized
atattaaaaatgcaacatga

SEQ ID NO: 83151 - DNA, 20 bp, Artificial Sequence
  chemically synthesized
atggtgtgtgtgtgtgtgtg

SEQ ID NO: 83152 - DNA, 20 bp, Artificial Sequence
  chemically synthesized
tggtgtgtgtgtgtgtgtgt

SEQ ID NO: 83153 - DNA, 20 bp, Artificial Sequence
  chemically synthesized
ggtgtgtgtgtgtgtgtgtg

SEQ ID NO: 83154 - DNA, 20 bp, Artificial Sequence
  chemically synthesized
gtgtgtgtgtgtgtgtgtgg

SEQ ID NO: 83155 - DNA, 20 bp, Artificial Sequence
  chemically synthesized
tgtgtgtgtgtgtgtgtggg

SEQ ID NO: 83156 - DNA, 20 bp, Artificial Sequence
  chemically synthesized
gtgtgtgtgtgtgtgtgggg

SEQ ID NO: 83157 - DNA, 20 bp, Artificial Sequence
  chemically synthesized
tgtgtgtgtgtgtgtggggg

SEQ ID NO: 83158 - DNA, 20 bp, Artificial Sequence
  chemically synthesized
tggggggggtgttctgtgca

SEQ ID NO: 83159 - DNA, 20 bp, Artificial Sequence
  chemically synthesized
ggggggggtgttctgtgcat

SEQ ID NO: 83160 - DNA, 20 bp, Artificial Sequence
  chemically synthesized
gggggggtgttctgtgcatg

SEQ ID NO: 83161 - DNA, 20 bp, Artificial Sequence
  chemically synthesized
ggggggtgttctgtgcatgg

SEQ ID NO: 83162 - DNA, 20 bp, Artificial Sequence
  chemically synthesized
cttactctgtcccccatgca

SEQ ID NO: 83163 - DNA, 20 bp, Artificial Sequence
  chemically synthesized
ggtgttctgtgcatggggga

SEQ ID NO: 83164 - DNA, 20 bp, Artificial Sequence
  chemically synthesized
tgttctgtgcatgggggaca

SEQ ID NO: 83165 - DNA, 20 bp, Artificial Sequence
  chemically synthesized
ctgtgcatgggggacagagt

SEQ ID NO: 83166 - DNA, 20 bp, Artificial Sequence
  chemically synthesized
tgtgcatgggggacagagta

SEQ ID NO: 83167 - DNA, 20 bp, Artificial Sequence
  chemically synthesized
gtgcatgggggacagagtaa

SEQ ID NO: 83168 - DNA, 20 bp, Artificial Sequence
  chemically synthesized
tttccaagctgagcatatca

SEQ ID NO: 83169 - DNA, 20 bp, Artificial Sequence
  chemically synthesized
gtaagggactgtgatatgct

SEQ ID NO: 83170 - DNA, 20 bp, Artificial Sequence
  chemically synthesized
ggactgtgatatgctcagct

SEQ ID NO: 83171 - DNA, 20 bp, Artificial Sequence
  chemically synthesized
gaatgttagctttccaagct

SEQ ID NO: 83172 - DNA, 20 bp, Artificial Sequence
  chemically synthesized
tgtgatatgctcagcttgga

SEQ ID NO: 83173 - DNA, 20 bp, Artificial Sequence
  chemically synthesized
ggaaggaatgttagctttcc

SEQ ID NO: 83174 - DNA, 20 bp, Artificial Sequence
  chemically synthesized
tttccttgtggaaggaatgt

SEQ ID NO: 83175 - DNA, 20 bp, Artificial Sequence
  chemically synthesized
aaagctaacattccttccac

SEQ ID NO: 83176 - DNA, 20 bp, Artificial Sequence
  chemically synthesized
aagctaacattccttccaca

SEQ ID NO: 83177 - DNA, 20 bp, Artificial Sequence
  chemically synthesized
atttattatttccttgtgga

SEQ ID NO: 83178 - DNA, 20 bp, Artificial Sequence
  chemically synthesized
aatttattatttccttgtgg

SEQ ID NO: 83179 - DNA, 20 bp, Artificial Sequence
  chemically synthesized
cagaatttattatttccttg

SEQ ID NO: 83180 - DNA, 20 bp, Artificial Sequence
  chemically synthesized
acaaggaaataataaattct

SEQ ID NO: 83181 - DNA, 20 bp, Artificial Sequence
  chemically synthesized
caaggaaataataaattctg

SEQ ID NO: 83182 - DNA, 20 bp, Artificial Sequence
  chemically synthesized
aataataaattctgaggttt

SEQ ID NO: 83183 - DNA, 20 bp, Artificial Sequence
  chemically synthesized
ataataaattctgaggtttg

SEQ ID NO: 83184 - DNA, 20 bp, Artificial Sequence
  chemically synthesized
ttttttttctcctcaaacct

SEQ ID NO: 83185 - DNA, 20 bp, Artificial Sequence
  chemically synthesized
aataaattctgaggtttgag

SEQ ID NO: 83186 - DNA, 20 bp, Artificial Sequence
  chemically synthesized
ttgaggagaaaaaaaatact

SEQ ID NO: 83187 - DNA, 20 bp, Artificial Sequence
  chemically synthesized
tgaggagaaaaaaaatactt

SEQ ID NO: 83188 - DNA, 20 bp, Artificial Sequence
  chemically synthesized
aggagaaaaaaaatacttag

SEQ ID NO: 83189 - DNA, 20 bp, Artificial Sequence
  chemically synthesized
tgaatgagaaaataactcct

SEQ ID NO: 83190 - DNA, 20 bp, Artificial Sequence
  chemically synthesized
ttaggagttattttctcatt

SEQ ID NO: 83191 - DNA, 20 bp, Artificial Sequence
  chemically synthesized
tcaacgtatattagctgaat

SEQ ID NO: 83192 - DNA, 20 bp, Artificial Sequence
  chemically synthesized
tgtaggcactcaacgtatat

SEQ ID NO: 83193 - DNA, 20 bp, Artificial Sequence
  chemically synthesized
tcattcagctaatatacgtt

SEQ ID NO: 83194 - DNA, 20 bp, Artificial Sequence
  chemically synthesized
cccattaaactttgatatgt

SEQ ID NO: 83195 - DNA, 20 bp, Artificial Sequence
  chemically synthesized
cgttgagtgcctacatatca

SEQ ID NO: 83196 - DNA, 20 bp, Artificial Sequence
  chemically synthesized
gcccattaaactttgatatg

SEQ ID NO: 83197 - DNA, 20 bp, Artificial Sequence
  chemically synthesized
gcctacatatcaaagtttaa

SEQ ID NO: 83198 - DNA, 20 bp, Artificial Sequence
  chemically synthesized
cctacatatcaaagtttaat

SEQ ID NO: 83199 - DNA, 20 bp, Artificial Sequence
  chemically synthesized
atcaaagtttaatgggcaaa

SEQ ID NO: 83200 - DNA, 20 bp, Artificial Sequence
  chemically synthesized
caaagtttaatgggcaaaca

SEQ ID NO: 83201 - DNA, 20 bp, Artificial Sequence
  chemically synthesized
aaagtttaatgggcaaacag

SEQ ID NO: 83202 - DNA, 20 bp, Artificial Sequence
  chemically synthesized
ttaatgggcaaacagaggaa

SEQ ID NO: 83203 - DNA, 20 bp, Artificial Sequence
  chemically synthesized
taatgggcaaacagaggaac

SEQ ID NO: 83204 - DNA, 20 bp, Artificial Sequence
  chemically synthesized
acagaggaacaggatctctt

SEQ ID NO: 83205 - DNA, 20 bp, Artificial Sequence
  chemically synthesized
agaggaacaggatctcttga

SEQ ID NO: 83206 - DNA, 20 bp, Artificial Sequence
  chemically synthesized
gttccttttctatctctcaa

SEQ ID NO: 83207 - DNA, 20 bp, Artificial Sequence
  chemically synthesized
gaacaggatctcttgagaga

SEQ ID NO: 83208 - DNA, 20 bp, Artificial Sequence
  chemically synthesized
ttgttccttttctatctctc

SEQ ID NO: 83209 - DNA, 20 bp, Artificial Sequence
  chemically synthesized
ggatctcttgagagatagaa

SEQ ID NO: 83210 - DNA, 20 bp, Artificial Sequence
  chemically synthesized
gatctcttgagagatagaaa

SEQ ID NO: 83211 - DNA, 20 bp, Artificial Sequence
  chemically synthesized
agagatagaaaaggaacaaa

SEQ ID NO: 83212 - DNA, 20 bp, Artificial Sequence
  chemically synthesized
gagatagaaaaggaacaaat

SEQ ID NO: 83213 - DNA, 20 bp, Artificial Sequence
  chemically synthesized
atagaaaaggaacaaatagg

SEQ ID NO: 83214 - DNA, 20 bp, Artificial Sequence
  chemically synthesized
agaaaaggaacaaataggtg

SEQ ID NO: 83215 - DNA, 20 bp, Artificial Sequence
  chemically synthesized
aaaaggaacaaataggtgga

SEQ ID NO: 83216 - DNA, 20 bp, Artificial Sequence
  chemically synthesized
gaacaaataggtggagagat

SEQ ID NO: 83217 - DNA, 20 bp, Artificial Sequence
  chemically synthesized
aacaaataggtggagagatt

SEQ ID NO: 83218 - DNA, 20 bp, Artificial Sequence
  chemically synthesized
acaaataggtggagagatta

SEQ ID NO: 83219 - DNA, 20 bp, Artificial Sequence
  chemically synthesized
caaataggtggagagattag

SEQ ID NO: 83220 - DNA, 20 bp, Artificial Sequence
  chemically synthesized
gtggagagattaggggaaat

SEQ ID NO: 83221 - DNA, 20 bp, Artificial Sequence
  chemically synthesized
tggagagattaggggaaatg

SEQ ID NO: 83222 - DNA, 20 bp, Artificial Sequence
  chemically synthesized
gagagattaggggaaatgag

SEQ ID NO: 83223 - DNA, 20 bp, Artificial Sequence
  chemically synthesized
attaggggaaatgaggagtg

SEQ ID NO: 83224 - DNA, 20 bp, Artificial Sequence
  chemically synthesized
atgaggagtgtagaaatttc

SEQ ID NO: 83225 - DNA, 20 bp, Artificial Sequence
  chemically synthesized
tgaggagtgtagaaatttca

SEQ ID NO: 83226 - DNA, 20 bp, Artificial Sequence
  chemically synthesized
aggagtgtagaaatttcaag

SEQ ID NO: 83227 - DNA, 20 bp, Artificial Sequence
  chemically synthesized
gagtgtagaaatttcaagga

SEQ ID NO: 83228 - DNA, 20 bp, Artificial Sequence
  chemically synthesized
gtgtagaaatttcaaggaga

SEQ ID NO: 83229 - DNA, 20 bp, Artificial Sequence
  chemically synthesized
agaaatttcaaggagagagt

SEQ ID NO: 83230 - DNA, 20 bp, Artificial Sequence
  chemically synthesized
aaggagagagtgagaatttt

SEQ ID NO: 83231 - DNA, 20 bp, Artificial Sequence
  chemically synthesized
ggagagagtgagaattttga

SEQ ID NO: 83232 - DNA, 20 bp, Artificial Sequence
  chemically synthesized
gagagagtgagaattttgag

SEQ ID NO: 83233 - DNA, 20 bp, Artificial Sequence
  chemically synthesized
agagtgagaattttgagagg

SEQ ID NO: 83234 - DNA, 20 bp, Artificial Sequence
  chemically synthesized
agtgagaattttgagaggaa

SEQ ID NO: 83235 - DNA, 20 bp, Artificial Sequence
  chemically synthesized
gtgagaattttgagaggaag

SEQ ID NO: 83236 - DNA, 20 bp, Artificial Sequence
  chemically synthesized
tgagaattttgagaggaaga

SEQ ID NO: 83237 - DNA, 20 bp, Artificial Sequence
  chemically synthesized
ttgagaggaagagggtgacc

SEQ ID NO: 83238 - DNA, 20 bp, Artificial Sequence
  chemically synthesized
gaggaagagggtgaccaagt

SEQ ID NO: 83239 - DNA, 20 bp, Artificial Sequence
  chemically synthesized
tgtgtttcattggactcact

SEQ ID NO: 83240 - DNA, 20 bp, Artificial Sequence
  chemically synthesized
actttacttctgtgtttcat

SEQ ID NO: 83241 - DNA, 20 bp, Artificial Sequence
  chemically synthesized
caagtgagtccaatgaaaca

SEQ ID NO: 83242 - DNA, 20 bp, Artificial Sequence
  chemically synthesized
gtgagtccaatgaaacacag

SEQ ID NO: 83243 - DNA, 20 bp, Artificial Sequence
  chemically synthesized
tccaatgaaacacagaagta

SEQ ID NO: 83244 - DNA, 20 bp, Artificial Sequence
  chemically synthesized
atgaaacacagaagtaaagt

SEQ ID NO: 83245 - DNA, 20 bp, Artificial Sequence
  chemically synthesized
acacagaagtaaagtaagat

SEQ ID NO: 83246 - DNA, 20 bp, Artificial Sequence
  chemically synthesized
gtaaagtaagatcagcattg

SEQ ID NO: 83247 - DNA, 20 bp, Artificial Sequence
  chemically synthesized
aaagtaagatcagcattgca

SEQ ID NO: 83248 - DNA, 20 bp, Artificial Sequence
  chemically synthesized
cagcattgcagagtgttcac

SEQ ID NO: 83249 - DNA, 20 bp, Artificial Sequence
  chemically synthesized
gaaattgctctcagcacatc

SEQ ID NO: 83250 - DNA, 20 bp, Artificial Sequence
  chemically synthesized
gagtgttcactagatgtgct

SEQ ID NO: 83251 - DNA, 20 bp, Artificial Sequence
  chemically synthesized
gtgttcactagatgtgctga

SEQ ID NO: 83252 - DNA, 20 bp, Artificial Sequence
  chemically synthesized
ccctccactgaaattgctct

SEQ ID NO: 83253 - DNA, 20 bp, Artificial Sequence
  chemically synthesized
agatgtgctgagagcaattt

SEQ ID NO: 83254 - DNA, 20 bp, Artificial Sequence
  chemically synthesized
tgtgctgagagcaatttcag

SEQ ID NO: 83255 - DNA, 20 bp, Artificial Sequence
  chemically synthesized
tgctgagagcaatttcagtg

SEQ ID NO: 83256 - DNA, 20 bp, Artificial Sequence
  chemically synthesized
gctgagagcaatttcagtgg

SEQ ID NO: 83257 - DNA, 20 bp, Artificial Sequence
  chemically synthesized
ctgagagcaatttcagtgga

SEQ ID NO: 83258 - DNA, 20 bp, Artificial Sequence
  chemically synthesized
agagcaatttcagtggaggg

SEQ ID NO: 83259 - DNA, 20 bp, Artificial Sequence
  chemically synthesized
gcaatttcagtggagggcag

SEQ ID NO: 83260 - DNA, 20 bp, Artificial Sequence
  chemically synthesized
tcagtggagggcagaagcct

SEQ ID NO: 83261 - DNA, 20 bp, Artificial Sequence
  chemically synthesized
gtggagggcagaagcctcag

SEQ ID NO: 83262 - DNA, 20 bp, Artificial Sequence
  chemically synthesized
gagggcagaagcctcagaag

SEQ ID NO: 83263 - DNA, 20 bp, Artificial Sequence
  chemically synthesized
agggcagaagcctcagaagt

SEQ ID NO: 83264 - DNA, 20 bp, Artificial Sequence
  chemically synthesized
ctcagctatgcctacttctg

SEQ ID NO: 83265 - DNA, 20 bp, Artificial Sequence
  chemically synthesized
cctcagctatgcctacttct

SEQ ID NO: 83266 - DNA, 20 bp, Artificial Sequence
  chemically synthesized
agaagcctcagaagtaggca

SEQ ID NO: 83267 - DNA, 20 bp, Artificial Sequence
  chemically synthesized
cctcagaagtaggcatagct

SEQ ID NO: 83268 - DNA, 20 bp, Artificial Sequence
  chemically synthesized
ctcagaagtaggcatagctg

SEQ ID NO: 83269 - DNA, 20 bp, Artificial Sequence
  chemically synthesized
cagaagtaggcatagctgag

SEQ ID NO: 83270 - DNA, 20 bp, Artificial Sequence
  chemically synthesized
agtaggcatagctgaggagt

SEQ ID NO: 83271 - DNA, 20 bp, Artificial Sequence
  chemically synthesized
tccttcttccactcactcct

SEQ ID NO: 83272 - DNA, 20 bp, Artificial Sequence
  chemically synthesized
aggcatagctgaggagtgag

SEQ ID NO: 83273 - DNA, 20 bp, Artificial Sequence
  chemically synthesized
catagctgaggagtgagtgg

SEQ ID NO: 83274 - DNA, 20 bp, Artificial Sequence
  chemically synthesized
agctgaggagtgagtggaag

SEQ ID NO: 83275 - DNA, 20 bp, Artificial Sequence
  chemically synthesized
gctgaggagtgagtggaaga

SEQ ID NO: 83276 - DNA, 20 bp, Artificial Sequence
  chemically synthesized
tgaggagtgagtggaagaag

SEQ ID NO: 83277 - DNA, 20 bp, Artificial Sequence
  chemically synthesized
ggagtgagtggaagaaggag

SEQ ID NO: 83278 - DNA, 20 bp, Artificial Sequence
  chemically synthesized
gagtgagtggaagaaggagt

SEQ ID NO: 83279 - DNA, 20 bp, Artificial Sequence
  chemically synthesized
gaagaaggagtaggtatttc

SEQ ID NO: 83280 - DNA, 20 bp, Artificial Sequence
  chemically synthesized
atgttcaattttctttttct

SEQ ID NO: 83281 - DNA, 20 bp, Artificial Sequence
  chemically synthesized
cctcttttccttctcagaaa

SEQ ID NO: 83282 - DNA, 20 bp, Artificial Sequence
  chemically synthesized
ttcaattttctttttctgag

SEQ ID NO: 83283 - DNA, 20 bp, Artificial Sequence
  chemically synthesized
tcaattttctttttctgaga

SEQ ID NO: 83284 - DNA, 20 bp, Artificial Sequence
  chemically synthesized
tgtcttcctcttttccttct

SEQ ID NO: 83285 - DNA, 20 bp, Artificial Sequence
  chemically synthesized
tttctttttctgagaaggaa

SEQ ID NO: 83286 - DNA, 20 bp, Artificial Sequence
  chemically synthesized
tctttttctgagaaggaaaa

SEQ ID NO: 83287 - DNA, 20 bp, Artificial Sequence
  chemically synthesized
ctttttctgagaaggaaaag

SEQ ID NO: 83288 - DNA, 20 bp, Artificial Sequence
  chemically synthesized
tttctgagaaggaaaagagg

SEQ ID NO: 83289 - DNA, 20 bp, Artificial Sequence
  chemically synthesized
aggaaaagaggaagacacga

SEQ ID NO: 83290 - DNA, 20 bp, Artificial Sequence
  chemically synthesized
ggaaaagaggaagacacgac

SEQ ID NO: 83291 - DNA, 20 bp, Artificial Sequence
  chemically synthesized
aaaagaggaagacacgacag

SEQ ID NO: 83292 - DNA, 20 bp, Artificial Sequence
  chemically synthesized
aaagaggaagacacgacagg

SEQ ID NO: 83293 - DNA, 20 bp, Artificial Sequence
  chemically synthesized
aggaagacacgacaggagga

SEQ ID NO: 83294 - DNA, 20 bp, Artificial Sequence
  chemically synthesized
gaagacacgacaggaggaca

SEQ ID NO: 83295 - DNA, 20 bp, Artificial Sequence
  chemically synthesized
agacacgacaggaggacaga

SEQ ID NO: 83296 - DNA, 20 bp, Artificial Sequence
  chemically synthesized
gacacgacaggaggacagag

SEQ ID NO: 83297 - DNA, 20 bp, Artificial Sequence
  chemically synthesized
aggaggacagagaggataac

SEQ ID NO: 83298 - DNA, 20 bp, Artificial Sequence
  chemically synthesized
acagagaggataacaagaca

SEQ ID NO: 83299 - DNA, 20 bp, Artificial Sequence
  chemically synthesized
cagagaggataacaagacaa

SEQ ID NO: 83300 - DNA, 20 bp, Artificial Sequence
  chemically synthesized
agagaggataacaagacaaa

SEQ ID NO: 83301 - DNA, 20 bp, Artificial Sequence
  chemically synthesized
ggataacaagacaaagggat

SEQ ID NO: 83302 - DNA, 20 bp, Artificial Sequence
  chemically synthesized
taacaagacaaagggataag

SEQ ID NO: 83303 - DNA, 20 bp, Artificial Sequence
  chemically synthesized
aagggataagaagttctttt

SEQ ID NO: 83304 - DNA, 20 bp, Artificial Sequence
  chemically synthesized
ataagaagttctttttagca

SEQ ID NO: 83305 - DNA, 20 bp, Artificial Sequence
  chemically synthesized
caaatcattcctatgctaaa

SEQ ID NO: 83306 - DNA, 20 bp, Artificial Sequence
  chemically synthesized
taagaagttctttttagcat

SEQ ID NO: 83307 - DNA, 20 bp, Artificial Sequence
  chemically synthesized
gcataggaatgatttgaacc

SEQ ID NO: 83308 - DNA, 20 bp, Artificial Sequence
  chemically synthesized
ataggaatgatttgaaccta

SEQ ID NO: 83309 - DNA, 20 bp, Artificial Sequence
  chemically synthesized
atgatttgaacctagagtga

SEQ ID NO: 83310 - DNA, 20 bp, Artificial Sequence
  chemically synthesized
tagcttccgtctttcactct

SEQ ID NO: 83311 - DNA, 20 bp, Artificial Sequence
  chemically synthesized
ctagcttccgtctttcactc

SEQ ID NO: 83312 - DNA, 20 bp, Artificial Sequence
  chemically synthesized
tttgaacctagagtgaaaga

SEQ ID NO: 83313 - DNA, 20 bp, Artificial Sequence
  chemically synthesized
gaacctagagtgaaagacgg

SEQ ID NO: 83314 - DNA, 20 bp, Artificial Sequence
  chemically synthesized
ctagagtgaaagacggaagc

SEQ ID NO: 83315 - DNA, 20 bp, Artificial Sequence
  chemically synthesized
gagtgaaagacggaagctag

SEQ ID NO: 83316 - DNA, 20 bp, Artificial Sequence
  chemically synthesized
tgaaagacggaagctagcag

SEQ ID NO: 83317 - DNA, 20 bp, Artificial Sequence
  chemically synthesized
gaaagacggaagctagcagt

SEQ ID NO: 83318 - DNA, 20 bp, Artificial Sequence
  chemically synthesized
aaagacggaagctagcagta

SEQ ID NO: 83319 - DNA, 20 bp, Artificial Sequence
  chemically synthesized
atggttggttaccctactgc

SEQ ID NO: 83320 - DNA, 20 bp, Artificial Sequence
  chemically synthesized
agtagggtaaccaaccatct

SEQ ID NO: 83321 - DNA, 20 bp, Artificial Sequence
  chemically synthesized
gctggacaaaccaagatggt

SEQ ID NO: 83322 - DNA, 20 bp, Artificial Sequence
  chemically synthesized
caatgctggacaaaccaaga

SEQ ID NO: 83323 - DNA, 20 bp, Artificial Sequence
  chemically synthesized
aactcaatgctggacaaacc

SEQ ID NO: 83324 - DNA, 20 bp, Artificial Sequence
  chemically synthesized
accaaccatcttggtttgtc

SEQ ID NO: 83325 - DNA, 20 bp, Artificial Sequence
  chemically synthesized
atcttggtttgtccagcatt

SEQ ID NO: 83326 - DNA, 20 bp, Artificial Sequence
  chemically synthesized
catcctgaaaaactcaatgc

SEQ ID NO: 83327 - DNA, 20 bp, Artificial Sequence
  chemically synthesized
ttgtccagcattgagttttt

SEQ ID NO: 83328 - DNA, 20 bp, Artificial Sequence
  chemically synthesized
tgtccagcattgagtttttc

SEQ ID NO: 83329 - DNA, 20 bp, Artificial Sequence
  chemically synthesized
agcattgagtttttcaggat

SEQ ID NO: 83330 - DNA, 20 bp, Artificial Sequence
  chemically synthesized
cattgagtttttcaggatga

SEQ ID NO: 83331 - DNA, 20 bp, Artificial Sequence
  chemically synthesized
tattctggttttaacatcga

SEQ ID NO: 83332 - DNA, 20 bp, Artificial Sequence
  chemically synthesized
gagactttcgatgttaaaac

SEQ ID NO: 83333 - DNA, 20 bp, Artificial Sequence
  chemically synthesized
tttcgatgttaaaaccagaa

SEQ ID NO: 83334 - DNA, 20 bp, Artificial Sequence
  chemically synthesized
caattttcctgaaactattc

SEQ ID NO: 83335 - DNA, 20 bp, Artificial Sequence
  chemically synthesized
tgttaaaaccagaatagttt

SEQ ID NO: 83336 - DNA, 20 bp, Artificial Sequence
  chemically synthesized
gttaaaaccagaatagtttc

SEQ ID NO: 83337 - DNA, 20 bp, Artificial Sequence
  chemically synthesized
cagaatagtttcaggaaaat

SEQ ID NO: 83338 - DNA, 20 bp, Artificial Sequence
  chemically synthesized
atagtttcaggaaaattgga

SEQ ID NO: 83339 - DNA, 20 bp, Artificial Sequence
  chemically synthesized
tcaggaaaattggacagtct

SEQ ID NO: 83340 - DNA, 20 bp, Artificial Sequence
  chemically synthesized
caggaaaattggacagtctc

SEQ ID NO: 83341 - DNA, 20 bp, Artificial Sequence
  chemically synthesized
ccaactttcctcgttttcct

SEQ ID NO: 83342 - DNA, 20 bp, Artificial Sequence
  chemically synthesized
ttggacagtctcaggaaaac

SEQ ID NO: 83343 - DNA, 20 bp, Artificial Sequence
  chemically synthesized
tggacagtctcaggaaaacg

SEQ ID NO: 83344 - DNA, 20 bp, Artificial Sequence
  chemically synthesized
cagtctcaggaaaacgagga

SEQ ID NO: 83345 - DNA, 20 bp, Artificial Sequence
  chemically synthesized
ctcaggaaaacgaggaaagt

SEQ ID NO: 83346 - DNA, 20 bp, Artificial Sequence
  chemically synthesized
acgaggaaagttggtcaccc

SEQ ID NO: 83347 - DNA, 20 bp, Artificial Sequence
  chemically synthesized
aaggtcgtaacatatatcta

SEQ ID NO: 83348 - DNA, 20 bp, Artificial Sequence
  chemically synthesized
caaggtcgtaacatatatct

SEQ ID NO: 83349 - DNA, 20 bp, Artificial Sequence
  chemically synthesized
tcaaggtcgtaacatatatc

SEQ ID NO: 83350 - DNA, 20 bp, Artificial Sequence
  chemically synthesized
gatatatgttacgaccttga

SEQ ID NO: 83351 - DNA, 20 bp, Artificial Sequence
  chemically synthesized
atatgttacgaccttgacag

SEQ ID NO: 83352 - DNA, 20 bp, Artificial Sequence
  chemically synthesized
tatgttacgaccttgacaga

SEQ ID NO: 83353 - DNA, 20 bp, Artificial Sequence
  chemically synthesized
attatctccaccttctgtca

SEQ ID NO: 83354 - DNA, 20 bp, Artificial Sequence
  chemically synthesized
aattatctccaccttctgtc

SEQ ID NO: 83355 - DNA, 20 bp, Artificial Sequence
  chemically synthesized
gttacgaccttgacagaagg

SEQ ID NO: 83356 - DNA, 20 bp, Artificial Sequence
  chemically synthesized
tacgaccttgacagaaggtg

SEQ ID NO: 83357 - DNA, 20 bp, Artificial Sequence
  chemically synthesized
cagaaggtggagataattgt

SEQ ID NO: 83358 - DNA, 20 bp, Artificial Sequence
  chemically synthesized
gtggagataattgttggaac

SEQ ID NO: 83359 - DNA, 20 bp, Artificial Sequence
  chemically synthesized
tggagataattgttggaaca

SEQ ID NO: 83360 - DNA, 20 bp, Artificial Sequence
  chemically synthesized
tggaacaaggtctgtaaaat

SEQ ID NO: 83361 - DNA, 20 bp, Artificial Sequence
  chemically synthesized
ggaacaaggtctgtaaaata

SEQ ID NO: 83362 - DNA, 20 bp, Artificial Sequence
  chemically synthesized
agatccatttccttatttta

SEQ ID NO: 83363 - DNA, 20 bp, Artificial Sequence
  chemically synthesized
aggtctgtaaaataaggaaa

SEQ ID NO: 83364 - DNA, 20 bp, Artificial Sequence
  chemically synthesized
aaaaaaaaaaaaaaaaaaaa

SEQ ID NO: 83365 - DNA, 20 bp, Artificial Sequence
  chemically synthesized
tttttttttttttttttttt

SEQ ID NO: 83366 - DNA, 20 bp, Artificial Sequence
  chemically synthesized
ttttttttttttttttgaga

SEQ ID NO: 83367 - DNA, 20 bp, Artificial Sequence
  chemically synthesized
ttttttttttttttgagatg

SEQ ID NO: 83368 - DNA, 20 bp, Artificial Sequence
  chemically synthesized
tccagcctgggcgacagagc

SEQ ID NO: 83369 - DNA, 20 bp, Artificial Sequence
  chemically synthesized
tggagtctcgctctgtcgcc

SEQ ID NO: 83370 - DNA, 20 bp, Artificial Sequence
  chemically synthesized
gcactccagcctgggcgaca

SEQ ID NO: 83371 - DNA, 20 bp, Artificial Sequence
  chemically synthesized
ggagtctcgctctgtcgccc

SEQ ID NO: 83372 - DNA, 20 bp, Artificial Sequence
  chemically synthesized
ctgcactccagcctgggcga

SEQ ID NO: 83373 - DNA, 20 bp, Artificial Sequence
  chemically synthesized
tctcgctctgtcgcccaggc

SEQ ID NO: 83374 - DNA, 20 bp, Artificial Sequence
  chemically synthesized
tcgctctgtcgcccaggctg

SEQ ID NO: 83375 - DNA, 20 bp, Artificial Sequence
  chemically synthesized
gcgccactgcactccagcct

SEQ ID NO: 83376 - DNA, 20 bp, Artificial Sequence
  chemically synthesized
tgcgccactgcactccagcc

SEQ ID NO: 83377 - DNA, 20 bp, Artificial Sequence
  chemically synthesized
ctgtcgcccaggctggagtg

SEQ ID NO: 83378 - DNA, 20 bp, Artificial Sequence
  chemically synthesized
gagattgcgccactgcactc

SEQ ID NO: 83379 - DNA, 20 bp, Artificial Sequence
  chemically synthesized
tcgcccaggctggagtgcag

SEQ ID NO: 83380 - DNA, 20 bp, Artificial Sequence
  chemically synthesized
ggagtgcagtggcgcaatct

SEQ ID NO: 83381 - DNA, 20 bp, Artificial Sequence
  chemically synthesized
ggtggagcttgcagtgagcc

SEQ ID NO: 83382 - DNA, 20 bp, Artificial Sequence
  chemically synthesized
gcgcaatctcggctcactgc

SEQ ID NO: 83383 - DNA, 20 bp, Artificial Sequence
  chemically synthesized
tgggaggtggagcttgcagt

SEQ ID NO: 83384 - DNA, 20 bp, Artificial Sequence
  chemically synthesized
aacctgggaggtggagcttg

SEQ ID NO: 83385 - DNA, 20 bp, Artificial Sequence
  chemically synthesized
tcactgcaagctccacctcc

SEQ ID NO: 83386 - DNA, 20 bp, Artificial Sequence
  chemically synthesized
tggcatgaacctgggaggtg

SEQ ID NO: 83387 - DNA, 20 bp, Artificial Sequence
  chemically synthesized
cactgcaagctccacctccc

SEQ ID NO: 83388 - DNA, 20 bp, Artificial Sequence
  chemically synthesized
aatggcatgaacctgggagg

SEQ ID NO: 83389 - DNA, 20 bp, Artificial Sequence
  chemically synthesized
gagaatggcatgaacctggg

SEQ ID NO: 83390 - DNA, 20 bp, Artificial Sequence
  chemically synthesized
ggagaatggcatgaacctgg

SEQ ID NO: 83391 - DNA, 20 bp, Artificial Sequence
  chemically synthesized
caggagaatggcatgaacct

SEQ ID NO: 83392 - DNA, 20 bp, Artificial Sequence
  chemically synthesized
gcaggagaatggcatgaacc

SEQ ID NO: 83393 - DNA, 20 bp, Artificial Sequence
  chemically synthesized
gggaggctgaggcaggagaa

SEQ ID NO: 83394 - DNA, 20 bp, Artificial Sequence
  chemically synthesized
ttcatgccattctcctgcct

SEQ ID NO: 83395 - DNA, 20 bp, Artificial Sequence
  chemically synthesized
tactcgggaggctgaggcag

SEQ ID NO: 83396 - DNA, 20 bp, Artificial Sequence
  chemically synthesized
gctactcgggaggctgaggc

SEQ ID NO: 83397 - DNA, 20 bp, Artificial Sequence
  chemically synthesized
agctactcgggaggctgagg

SEQ ID NO: 83398 - DNA, 20 bp, Artificial Sequence
  chemically synthesized
cccagctactcgggaggctg

SEQ ID NO: 83399 - DNA, 20 bp, Artificial Sequence
  chemically synthesized
tcccagctactcgggaggct

SEQ ID NO: 83400 - DNA, 20 bp, Artificial Sequence
  chemically synthesized
ttctcctgcctcagcctccc

SEQ ID NO: 83401 - DNA, 20 bp, Artificial Sequence
  chemically synthesized
tcctgcctcagcctcccgag

SEQ ID NO: 83402 - DNA, 20 bp, Artificial Sequence
  chemically synthesized
tgtagtcccagctactcggg

SEQ ID NO: 83403 - DNA, 20 bp, Artificial Sequence
  chemically synthesized
ctgtagtcccagctactcgg

SEQ ID NO: 83404 - DNA, 20 bp, Artificial Sequence
  chemically synthesized
gcctcagcctcccgagtagc

SEQ ID NO: 83405 - DNA, 20 bp, Artificial Sequence
  chemically synthesized
gcctgtagtcccagctactc

SEQ ID NO: 83406 - DNA, 20 bp, Artificial Sequence
  chemically synthesized
cctcagcctcccgagtagct

SEQ ID NO: 83407 - DNA, 20 bp, Artificial Sequence
  chemically synthesized
cgcctgtagtcccagctact

SEQ ID NO: 83408 - DNA, 20 bp, Artificial Sequence
  chemically synthesized
ctcccgagtagctgggacta

SEQ ID NO: 83409 - DNA, 20 bp, Artificial Sequence
  chemically synthesized
tcccgagtagctgggactac

SEQ ID NO: 83410 - DNA, 20 bp, Artificial Sequence
  chemically synthesized
gtggcgggcgcctgtagtcc

SEQ ID NO: 83411 - DNA, 20 bp, Artificial Sequence
  chemically synthesized
ggcgtggtggcgggcgcctg

SEQ ID NO: 83412 - DNA, 20 bp, Artificial Sequence
  chemically synthesized
aattagctgggcgtggtggc

SEQ ID NO: 83413 - DNA, 20 bp, Artificial Sequence
  chemically synthesized
aaattagctgggcgtggtgg

SEQ ID NO: 83414 - DNA, 20 bp, Artificial Sequence
  chemically synthesized
caggcgcccgccaccacgcc

SEQ ID NO: 83415 - DNA, 20 bp, Artificial Sequence
  chemically synthesized
aaaaaattagctgggcgtgg

SEQ ID NO: 83416 - DNA, 20 bp, Artificial Sequence
  chemically synthesized
tacaaaaaattagctgggcg

SEQ ID NO: 83417 - DNA, 20 bp, Artificial Sequence
  chemically synthesized
aaaaatacaaaaaattagct

SEQ ID NO: 83418 - DNA, 20 bp, Artificial Sequence
  chemically synthesized
taaaaatacaaaaaattagc

SEQ ID NO: 83419 - DNA, 20 bp, Artificial Sequence
  chemically synthesized
ctactaaaaatacaaaaaat

SEQ ID NO: 83420 - DNA, 20 bp, Artificial Sequence
  chemically synthesized
cagctaattttttgtatttt

SEQ ID NO: 83421 - DNA, 20 bp, Artificial Sequence
  chemically synthesized
ctaattttttgtatttttag

SEQ ID NO: 83422 - DNA, 20 bp, Artificial Sequence
  chemically synthesized
aattttttgtatttttagta

SEQ ID NO: 83423 - DNA, 20 bp, Artificial Sequence
  chemically synthesized
ttttgtatttttagtagaga

SEQ ID NO: 83424 - DNA, 20 bp, Artificial Sequence
  chemically synthesized
tttgtatttttagtagagac

SEQ ID NO: 83425 - DNA, 20 bp, Artificial Sequence
  chemically synthesized
ttgtatttttagtagagacg

SEQ ID NO: 83426 - DNA, 20 bp, Artificial Sequence
  chemically synthesized
gagacggggtttcaccgtgt

SEQ ID NO: 83427 - DNA, 20 bp, Artificial Sequence
  chemically synthesized
cggggtttcaccgtgttagc

SEQ ID NO: 83428 - DNA, 20 bp, Artificial Sequence
  chemically synthesized
ggagaccatcctggctaaca

SEQ ID NO: 83429 - DNA, 20 bp, Artificial Sequence
  chemically synthesized
ggggtttcaccgtgttagcc

SEQ ID NO: 83430 - DNA, 20 bp, Artificial Sequence
  chemically synthesized
tttcaccgtgttagccagga

SEQ ID NO: 83431 - DNA, 20 bp, Artificial Sequence
  chemically synthesized
ttgggagatggagaccatcc

SEQ ID NO: 83432 - DNA, 20 bp, Artificial Sequence
  chemically synthesized
gatcacgaggttgggagatg

SEQ ID NO: 83433 - DNA, 20 bp, Artificial Sequence
  chemically synthesized
cagatcacgaggttgggaga

SEQ ID NO: 83434 - DNA, 20 bp, Artificial Sequence
  chemically synthesized
cgggcagatcacgaggttgg

SEQ ID NO: 83435 - DNA, 20 bp, Artificial Sequence
  chemically synthesized
ggcgggcagatcacgaggtt

SEQ ID NO: 83436 - DNA, 20 bp, Artificial Sequence
  chemically synthesized
aggcgggcagatcacgaggt

SEQ ID NO: 83437 - DNA, 20 bp, Artificial Sequence
  chemically synthesized
gccaaggcgggcagatcacg

SEQ ID NO: 83438 - DNA, 20 bp, Artificial Sequence
  chemically synthesized
ggccaaggcgggcagatcac

SEQ ID NO: 83439 - DNA, 20 bp, Artificial Sequence
  chemically synthesized
acctcgtgatctgcccgcct

SEQ ID NO: 83440 - DNA, 20 bp, Artificial Sequence
  chemically synthesized
ctttgggaggccaaggcggg

SEQ ID NO: 83441 - DNA, 20 bp, Artificial Sequence
  chemically synthesized
gcactttgggaggccaaggc

SEQ ID NO: 83442 - DNA, 20 bp, Artificial Sequence
  chemically synthesized
agcactttgggaggccaagg

SEQ ID NO: 83443 - DNA, 20 bp, Artificial Sequence
  chemically synthesized
cccagcactttgggaggcca

SEQ ID NO: 83444 - DNA, 20 bp, Artificial Sequence
  chemically synthesized
tcccagcactttgggaggcc

SEQ ID NO: 83445 - DNA, 20 bp, Artificial Sequence
  chemically synthesized
ctgcccgccttggcctccca

SEQ ID NO: 83446 - DNA, 20 bp, Artificial Sequence
  chemically synthesized
tgtaatcccagcactttggg

SEQ ID NO: 83447 - DNA, 20 bp, Artificial Sequence
  chemically synthesized
ctgtaatcccagcactttgg

SEQ ID NO: 83448 - DNA, 20 bp, Artificial Sequence
  chemically synthesized
gccttggcctcccaaagtgc

SEQ ID NO: 83449 - DNA, 20 bp, Artificial Sequence
  chemically synthesized
gcctgtaatcccagcacttt

SEQ ID NO: 83450 - DNA, 20 bp, Artificial Sequence
  chemically synthesized
ccttggcctcccaaagtgct

SEQ ID NO: 83451 - DNA, 20 bp, Artificial Sequence
  chemically synthesized
cgcctgtaatcccagcactt

SEQ ID NO: 83452 - DNA, 20 bp, Artificial Sequence
  chemically synthesized
ctcccaaagtgctgggatta

SEQ ID NO: 83453 - DNA, 20 bp, Artificial Sequence
  chemically synthesized
tcccaaagtgctgggattac

SEQ ID NO: 83454 - DNA, 20 bp, Artificial Sequence
  chemically synthesized
gtggctcacgcctgtaatcc

SEQ ID NO: 83455 - DNA, 20 bp, Artificial Sequence
  chemically synthesized
agtgctgggattacaggcgt

SEQ ID NO: 83456 - DNA, 20 bp, Artificial Sequence
  chemically synthesized
caggcgtgagccaccacgcc

SEQ ID NO: 83457 - DNA, 20 bp, Artificial Sequence
  chemically synthesized
ccatttccggccgggcgtgg

SEQ ID NO: 83458 - DNA, 20 bp, Artificial Sequence
  chemically synthesized
gatccatttccggccgggcg

SEQ ID NO: 83459 - DNA, 20 bp, Artificial Sequence
  chemically synthesized
cgtgagccaccacgcccggc

SEQ ID NO: 83460 - DNA, 20 bp, Artificial Sequence
  chemically synthesized
tttaagatccatttccggcc

SEQ ID NO: 83461 - DNA, 20 bp, Artificial Sequence
  chemically synthesized
ctttaagatccatttccggc

SEQ ID NO: 83462 - DNA, 20 bp, Artificial Sequence
  chemically synthesized
ccaccacgcccggccggaaa

SEQ ID NO: 83463 - DNA, 20 bp, Artificial Sequence
  chemically synthesized
agacctttaagatccatttc

SEQ ID NO: 83464 - DNA, 20 bp, Artificial Sequence
  chemically synthesized
ccggccggaaatggatctta

SEQ ID NO: 83465 - DNA, 20 bp, Artificial Sequence
  chemically synthesized
cggccggaaatggatcttaa

SEQ ID NO: 83466 - DNA, 20 bp, Artificial Sequence
  chemically synthesized
ttaagtttgatgagaccttt

SEQ ID NO: 83467 - DNA, 20 bp, Artificial Sequence
  chemically synthesized
cttaagtttttaagtttgat

SEQ ID NO: 83468 - DNA, 20 bp, Artificial Sequence
  chemically synthesized
ttttagtgccttaagttttt

SEQ ID NO: 83469 - DNA, 20 bp, Artificial Sequence
  chemically synthesized
ctcatcaaacttaaaaactt

SEQ ID NO: 83470 - DNA, 20 bp, Artificial Sequence
  chemically synthesized
tcatcaaacttaaaaactta

SEQ ID NO: 83471 - DNA, 20 bp, Artificial Sequence
  chemically synthesized
ttttaagtttttagtgcctt

SEQ ID NO: 83472 - DNA, 20 bp, Artificial Sequence
  chemically synthesized
ccttggactttttaagtttt

SEQ ID NO: 83473 - DNA, 20 bp, Artificial Sequence
  chemically synthesized
taaggcactaaaaacttaaa

SEQ ID NO: 83474 - DNA, 20 bp, Artificial Sequence
  chemically synthesized
aatagtgccttggacttttt

SEQ ID NO: 83475 - DNA, 20 bp, Artificial Sequence
  chemically synthesized
actaaaaacttaaaaagtcc

SEQ ID NO: 83476 - DNA, 20 bp, Artificial Sequence
  chemically synthesized
ctaaaaacttaaaaagtcca

SEQ ID NO: 83477 - DNA, 20 bp, Artificial Sequence
  chemically synthesized
tatatcatcaaatagtgcct

SEQ ID NO: 83478 - DNA, 20 bp, Artificial Sequence
  chemically synthesized
aatggaattatatcatcaaa

SEQ ID NO: 83479 - DNA, 20 bp, Artificial Sequence
  chemically synthesized
ttactgtccagttttaacaa

SEQ ID NO: 83480 - DNA, 20 bp, Artificial Sequence
  chemically synthesized
tataattccattgttaaaac

SEQ ID NO: 83481 - DNA, 20 bp, Artificial Sequence
  chemically synthesized
attccattgttaaaactgga

SEQ ID NO: 83482 - DNA, 20 bp, Artificial Sequence
  chemically synthesized
gctttgaattatttactgtc

SEQ ID NO: 83483 - DNA, 20 bp, Artificial Sequence
  chemically synthesized
actggacagtaaataattca

SEQ ID NO: 83484 - DNA, 20 bp, Artificial Sequence
  chemically synthesized
acagtaaataattcaaagct

SEQ ID NO: 83485 - DNA, 20 bp, Artificial Sequence
  chemically synthesized
cagtaaataattcaaagcta

SEQ ID NO: 83486 - DNA, 20 bp, Artificial Sequence
  chemically synthesized
gtaaataattcaaagctaag

SEQ ID NO: 83487 - DNA, 20 bp, Artificial Sequence
  chemically synthesized
ctctcacaatggatgctcct

SEQ ID NO: 83488 - DNA, 20 bp, Artificial Sequence
  chemically synthesized
agctaaggagcatccattgt

SEQ ID NO: 83489 - DNA, 20 bp, Artificial Sequence
  chemically synthesized
ctaaggagcatccattgtga

SEQ ID NO: 83490 - DNA, 20 bp, Artificial Sequence
  chemically synthesized
aaacacgtggtctctcacaa

SEQ ID NO: 83491 - DNA, 20 bp, Artificial Sequence
  chemically synthesized
caactcgatgggcaaacacg

SEQ ID NO: 83492 - DNA, 20 bp, Artificial Sequence
  chemically synthesized
agaccacgtgtttgcccatc

SEQ ID NO: 83493 - DNA, 20 bp, Artificial Sequence
  chemically synthesized
gtccttggcaacaactcgat

SEQ ID NO: 83494 - DNA, 20 bp, Artificial Sequence
  chemically synthesized
agtccttggcaacaactcga

SEQ ID NO: 83495 - DNA, 20 bp, Artificial Sequence
  chemically synthesized
ttgcccatcgagttgttgcc

SEQ ID NO: 83496 - DNA, 20 bp, Artificial Sequence
  chemically synthesized
tgcccatcgagttgttgcca

SEQ ID NO: 83497 - DNA, 20 bp, Artificial Sequence
  chemically synthesized
tcgagttgttgccaaggact

SEQ ID NO: 83498 - DNA, 20 bp, Artificial Sequence
  chemically synthesized
ctgtggtggatctaagtcct

SEQ ID NO: 83499 - DNA, 20 bp, Artificial Sequence
  chemically synthesized
tgtgcagctgtggtggatct

SEQ ID NO: 83500 - DNA, 20 bp, Artificial Sequence
  chemically synthesized
ccaaggacttagatccacca

SEQ ID NO: 83501 - DNA, 20 bp, Artificial Sequence
  chemically synthesized
aatgaactgtgcagctgtgg

SEQ ID NO: 83502 - DNA, 20 bp, Artificial Sequence
  chemically synthesized
agaaatgaactgtgcagctg

SEQ ID NO: 83503 - DNA, 20 bp, Artificial Sequence
  chemically synthesized
ttagatccaccacagctgca

SEQ ID NO: 83504 - DNA, 20 bp, Artificial Sequence
  chemically synthesized
tatttaagaaatgaactgtg

SEQ ID NO: 83505 - DNA, 20 bp, Artificial Sequence
  chemically synthesized
acagttcatttcttaaatat

SEQ ID NO: 83506 - DNA, 20 bp, Artificial Sequence
  chemically synthesized
atcttcaatgactcatattt

SEQ ID NO: 83507 - DNA, 20 bp, Artificial Sequence
  chemically synthesized
ttcttaaatatgagtcattg

SEQ ID NO: 83508 - DNA, 20 bp, Artificial Sequence
  chemically synthesized
gagtcattgaagattaaaat

SEQ ID NO: 83509 - DNA, 20 bp, Artificial Sequence
  chemically synthesized
agtcattgaagattaaaatg

SEQ ID NO: 83510 - DNA, 20 bp, Artificial Sequence
  chemically synthesized
tgaagattaaaatgaggcca

SEQ ID NO: 83511 - DNA, 20 bp, Artificial Sequence
  chemically synthesized
attaaaatgaggccaaagaa

SEQ ID NO: 83512 - DNA, 20 bp, Artificial Sequence
  chemically synthesized
aactttctttgtcttttctt

SEQ ID NO: 83513 - DNA, 20 bp, Artificial Sequence
  chemically synthesized
atgaggccaaagaaaagaca

SEQ ID NO: 83514 - DNA, 20 bp, Artificial Sequence
  chemically synthesized
ggccaaagaaaagacaaaga

SEQ ID NO: 83515 - DNA, 20 bp, Artificial Sequence
  chemically synthesized
tgcttatgtctttgtaataa

SEQ ID NO: 83516 - DNA, 20 bp, Artificial Sequence
  chemically synthesized
aagaaagttctgttattaca

SEQ ID NO: 83517 - DNA, 20 bp, Artificial Sequence
  chemically synthesized
ttctgttattacaaagacat

SEQ ID NO: 83518 - DNA, 20 bp, Artificial Sequence
  chemically synthesized
aggcaacaatgtgaaaataa

SEQ ID NO: 83519 - DNA, 20 bp, Artificial Sequence
  chemically synthesized
tcacattgttgcctgaaatt

SEQ ID NO: 83520 - DNA, 20 bp, Artificial Sequence
  chemically synthesized
cactttcttttcttaatttc

SEQ ID NO: 83521 - DNA, 20 bp, Artificial Sequence
  chemically synthesized
ccactttcttttcttaattt

SEQ ID NO: 83522 - DNA, 20 bp, Artificial Sequence
  chemically synthesized
ttgttgcctgaaattaagaa

SEQ ID NO: 83523 - DNA, 20 bp, Artificial Sequence
  chemically synthesized
tgcctgaaattaagaaaaga

SEQ ID NO: 83524 - DNA, 20 bp, Artificial Sequence
  chemically synthesized
ctgaaattaagaaaagaaag

SEQ ID NO: 83525 - DNA, 20 bp, Artificial Sequence
  chemically synthesized
aattaagaaaagaaagtgga

SEQ ID NO: 83526 - DNA, 20 bp, Artificial Sequence
  chemically synthesized
taagaaaagaaagtggatgg

SEQ ID NO: 83527 - DNA, 20 bp, Artificial Sequence
  chemically synthesized
agaaaagaaagtggatggaa

SEQ ID NO: 83528 - DNA, 20 bp, Artificial Sequence
  chemically synthesized
aaaagaaagtggatggaaga

SEQ ID NO: 83529 - DNA, 20 bp, Artificial Sequence
  chemically synthesized
aaagaaagtggatggaagag

SEQ ID NO: 83530 - DNA, 20 bp, Artificial Sequence
  chemically synthesized
aagaaagtggatggaagaga

SEQ ID NO: 83531 - DNA, 20 bp, Artificial Sequence
  chemically synthesized
agtggatggaagagagggtt

SEQ ID NO: 83532 - DNA, 20 bp, Artificial Sequence
  chemically synthesized
gggttaagtgattgtatctt

SEQ ID NO: 83533 - DNA, 20 bp, Artificial Sequence
  chemically synthesized
ctgaatcttttgaaattcta

SEQ ID NO: 83534 - DNA, 20 bp, Artificial Sequence
  chemically synthesized
ttgtatctttagaatttcaa

SEQ ID NO: 83535 - DNA, 20 bp, Artificial Sequence
  chemically synthesized
ctttagaatttcaaaagatt

SEQ ID NO: 83536 - DNA, 20 bp, Artificial Sequence
  chemically synthesized
aagattcagattaaatacaa

SEQ ID NO: 83537 - DNA, 20 bp, Artificial Sequence
  chemically synthesized
agattcagattaaatacaaa

SEQ ID NO: 83538 - DNA, 20 bp, Artificial Sequence
  chemically synthesized
aaggataaaactcccacaaa

SEQ ID NO: 83539 - DNA, 20 bp, Artificial Sequence
  chemically synthesized
ctatttctctctttttgtgg

SEQ ID NO: 83540 - DNA, 20 bp, Artificial Sequence
  chemically synthesized
ggataaaactcccacaaaaa

SEQ ID NO: 83541 - DNA, 20 bp, Artificial Sequence
  chemically synthesized
aactatttctctctttttgt

SEQ ID NO: 83542 - DNA, 20 bp, Artificial Sequence
  chemically synthesized
caactatttctctctttttg

SEQ ID NO: 83543 - DNA, 20 bp, Artificial Sequence
  chemically synthesized
ataaaactcccacaaaaaga

SEQ ID NO: 83544 - DNA, 20 bp, Artificial Sequence
  chemically synthesized
ctcccacaaaaagagagaaa

SEQ ID NO: 83545 - DNA, 20 bp, Artificial Sequence
  chemically synthesized
cacaaaaagagagaaatagt

SEQ ID NO: 83546 - DNA, 20 bp, Artificial Sequence
  chemically synthesized
aagagagaaatagttggttc

SEQ ID NO: 83547 - DNA, 20 bp, Artificial Sequence
  chemically synthesized
agagagaaatagttggttca

SEQ ID NO: 83548 - DNA, 20 bp, Artificial Sequence
  chemically synthesized
agagaaatagttggttcaag

SEQ ID NO: 83549 - DNA, 20 bp, Artificial Sequence
  chemically synthesized
gagaaatagttggttcaagg

SEQ ID NO: 83550 - DNA, 20 bp, Artificial Sequence
  chemically synthesized
aatagttggttcaaggaggt

SEQ ID NO: 83551 - DNA, 20 bp, Artificial Sequence
  chemically synthesized
tagttggttcaaggaggtca

SEQ ID NO: 83552 - DNA, 20 bp, Artificial Sequence
  chemically synthesized
agttggttcaaggaggtcag

SEQ ID NO: 83553 - DNA, 20 bp, Artificial Sequence
  chemically synthesized
ttcaaggaggtcagaggtta

SEQ ID NO: 83554 - DNA, 20 bp, Artificial Sequence
  chemically synthesized
aggtcagaggttaaagaaaa

SEQ ID NO: 83555 - DNA, 20 bp, Artificial Sequence
  chemically synthesized
tggcaataattcttatcatg

SEQ ID NO: 83556 - DNA, 20 bp, Artificial Sequence
  chemically synthesized
ggcaataattcttatcatgt

SEQ ID NO: 83557 - DNA, 20 bp, Artificial Sequence
  chemically synthesized
tatagtttttcccacatgat

SEQ ID NO: 83558 - DNA, 20 bp, Artificial Sequence
  chemically synthesized
aaattacatattgttattta

SEQ ID NO: 83559 - DNA, 20 bp, Artificial Sequence
  chemically synthesized
acaatatgtaattttaaaca

SEQ ID NO: 83560 - DNA, 20 bp, Artificial Sequence
  chemically synthesized
ttttaaacatggttatatgt

SEQ ID NO: 83561 - DNA, 20 bp, Artificial Sequence
  chemically synthesized
gttaagtgactaaattaaag

SEQ ID NO: 83562 - DNA, 20 bp, Artificial Sequence
  chemically synthesized
atgtaagatcctctttaatt

SEQ ID NO: 83563 - DNA, 20 bp, Artificial Sequence
  chemically synthesized
tgttaagtgactaaattaaa

SEQ ID NO: 83564 - DNA, 20 bp, Artificial Sequence
  chemically synthesized
tttgttaagtgactaaatta

SEQ ID NO: 83565 - DNA, 20 bp, Artificial Sequence
  chemically synthesized
gtagttgcttgaagtttgtt

SEQ ID NO: 83566 - DNA, 20 bp, Artificial Sequence
  chemically synthesized
ttagtcacttaacaaacttc

SEQ ID NO: 83567 - DNA, 20 bp, Artificial Sequence
  chemically synthesized
tgatacatagtagttgcttg

SEQ ID NO: 83568 - DNA, 20 bp, Artificial Sequence
  chemically synthesized
gaacagtgtctgatacatag

SEQ ID NO: 83569 - DNA, 20 bp, Artificial Sequence
  chemically synthesized
ttcaagcaactactatgtat

SEQ ID NO: 83570 - DNA, 20 bp, Artificial Sequence
  chemically synthesized
ctagaacagtgtctgataca

SEQ ID NO: 83571 - DNA, 20 bp, Artificial Sequence
  chemically synthesized
ctatgtatcagacactgttc

SEQ ID NO: 83572 - DNA, 20 bp, Artificial Sequence
  chemically synthesized
tatgtatcagacactgttct

SEQ ID NO: 83573 - DNA, 20 bp, Artificial Sequence
  chemically synthesized
cagatgttcattgcctagaa

SEQ ID NO: 83574 - DNA, 20 bp, Artificial Sequence
  chemically synthesized
gaccacagatgttcattgcc

SEQ ID NO: 83575 - DNA, 20 bp, Artificial Sequence
  chemically synthesized
ttctaggcaatgaacatctg

SEQ ID NO: 83576 - DNA, 20 bp, Artificial Sequence
  chemically synthesized
gctccatgctacaaagacca

SEQ ID NO: 83577 - DNA, 20 bp, Artificial Sequence
  chemically synthesized
atgaacatctgtggtctttg

SEQ ID NO: 83578 - DNA, 20 bp, Artificial Sequence
  chemically synthesized
catctgtggtctttgtagca

SEQ ID NO: 83579 - DNA, 20 bp, Artificial Sequence
  chemically synthesized
gttttaagctccatgctaca

SEQ ID NO: 83580 - DNA, 20 bp, Artificial Sequence
  chemically synthesized
tctgtggtctttgtagcatg

SEQ ID NO: 83581 - DNA, 20 bp, Artificial Sequence
  chemically synthesized
tacataaagccatttgtttt

SEQ ID NO: 83582 - DNA, 20 bp, Artificial Sequence
  chemically synthesized
agcatggagcttaaaacaaa

SEQ ID NO: 83583 - DNA, 20 bp, Artificial Sequence
  chemically synthesized
ttaaaacaaatggctttatg

SEQ ID NO: 83584 - DNA, 20 bp, Artificial Sequence
  chemically synthesized
tgctttttttttactacata

SEQ ID NO: 83585 - DNA, 20 bp, Artificial Sequence
  chemically synthesized
ggctttatgtagtaaaaaaa

SEQ ID NO: 83586 - DNA, 20 bp, Artificial Sequence
  chemically synthesized
gtagtaaaaaaaaagcaatg

SEQ ID NO: 83587 - DNA, 20 bp, Artificial Sequence
  chemically synthesized
ggctttccattattttaatg

SEQ ID NO: 83588 - DNA, 20 bp, Artificial Sequence
  chemically synthesized
tagaatctgcattaaaataa

SEQ ID NO: 83589 - DNA, 20 bp, Artificial Sequence
  chemically synthesized
atctgcattaaaataatgga

SEQ ID NO: 83590 - DNA, 20 bp, Artificial Sequence
  chemically synthesized
ataatggaaagccaattttt

SEQ ID NO: 83591 - DNA, 20 bp, Artificial Sequence
  chemically synthesized
gttattagatactgaaaaat

SEQ ID NO: 83592 - DNA, 20 bp, Artificial Sequence
  chemically synthesized
tgcagtttatggtgagttat

SEQ ID NO: 83593 - DNA, 20 bp, Artificial Sequence
  chemically synthesized
tacaacatgcagtttatggt

SEQ ID NO: 83594 - DNA, 20 bp, Artificial Sequence
  chemically synthesized
atactacaacatgcagttta

SEQ ID NO: 83595 - DNA, 20 bp, Artificial Sequence
  chemically synthesized
tcaccataaactgcatgttg

SEQ ID NO: 83596 - DNA, 20 bp, Artificial Sequence
  chemically synthesized
ataaattatactacaacatg

SEQ ID NO: 83597 - DNA, 20 bp, Artificial Sequence
  chemically synthesized
tataatttattgcattttaa

SEQ ID NO: 83598 - DNA, 20 bp, Artificial Sequence
  chemically synthesized
atttattgcattttaaaaga

SEQ ID NO: 83599 - DNA, 20 bp, Artificial Sequence
  chemically synthesized
ttttaaaagaaagaaaaatg

SEQ ID NO: 83600 - DNA, 20 bp, Artificial Sequence
  chemically synthesized
gtttgtctttttttaaaaaa

SEQ ID NO: 83601 - DNA, 20 bp, Artificial Sequence
  chemically synthesized
tgaagacttttttttaaaaa

SEQ ID NO: 83602 - DNA, 20 bp, Artificial Sequence
  chemically synthesized
ttttttaaaaaaagacaaac

SEQ ID NO: 83603 - DNA, 20 bp, Artificial Sequence
  chemically synthesized
aaacaagaatatttaatgtc

SEQ ID NO: 83604 - DNA, 20 bp, Artificial Sequence
  chemically synthesized
acaagaatatttaatgtcaa

SEQ ID NO: 83605 - DNA, 20 bp, Artificial Sequence
  chemically synthesized
caagacacttatcaaaatca

SEQ ID NO: 83606 - DNA, 20 bp, Artificial Sequence
  chemically synthesized
acaagacacttatcaaaatc

SEQ ID NO: 83607 - DNA, 20 bp, Artificial Sequence
  chemically synthesized
tcaagagccttgattttgat

SEQ ID NO: 83608 - DNA, 20 bp, Artificial Sequence
  chemically synthesized
aacaggcctttttgggagac

SEQ ID NO: 83609 - DNA, 20 bp, Artificial Sequence
  chemically synthesized
taagtgtcttgtctcccaaa

SEQ ID NO: 83610 - DNA, 20 bp, Artificial Sequence
  chemically synthesized
aagtgtcttgtctcccaaaa

SEQ ID NO: 83611 - DNA, 20 bp, Artificial Sequence
  chemically synthesized
tttcaaacaggcctttttgg

SEQ ID NO: 83612 - DNA, 20 bp, Artificial Sequence
  chemically synthesized
tctttcaaacaggccttttt

SEQ ID NO: 83613 - DNA, 20 bp, Artificial Sequence
  chemically synthesized
ctctttcaaacaggcctttt

SEQ ID NO: 83614 - DNA, 20 bp, Artificial Sequence
  chemically synthesized
tcccaaaaaggcctgtttga

SEQ ID NO: 83615 - DNA, 20 bp, Artificial Sequence
  chemically synthesized
ttctcaaacctctttcaaac

SEQ ID NO: 83616 - DNA, 20 bp, Artificial Sequence
  chemically synthesized
ccaaaaaggcctgtttgaaa

SEQ ID NO: 83617 - DNA, 20 bp, Artificial Sequence
  chemically synthesized
tttctcaaacctctttcaaa

SEQ ID NO: 83618 - DNA, 20 bp, Artificial Sequence
  chemically synthesized
caaaaaggcctgtttgaaag

SEQ ID NO: 83619 - DNA, 20 bp, Artificial Sequence
  chemically synthesized
ggcctgtttgaaagaggttt

SEQ ID NO: 83620 - DNA, 20 bp, Artificial Sequence
  chemically synthesized
atgacaaaatcagtatatat

SEQ ID NO: 83621 - DNA, 20 bp, Artificial Sequence
  chemically synthesized
caaaatttatatgacaaaat

SEQ ID NO: 83622 - DNA, 20 bp, Artificial Sequence
  chemically synthesized
tgattttgtcatataaattt

SEQ ID NO: 83623 - DNA, 20 bp, Artificial Sequence
  chemically synthesized
ttttggttaatattttaaac

SEQ ID NO: 83624 - DNA, 20 bp, Artificial Sequence
  chemically synthesized
ttggttaatattttaaacca

SEQ ID NO: 83625 - DNA, 20 bp, Artificial Sequence
  chemically synthesized
gttaatattttaaaccagag

SEQ ID NO: 83626 - DNA, 20 bp, Artificial Sequence
  chemically synthesized
atattttaaaccagagaagt

SEQ ID NO: 83627 - DNA, 20 bp, Artificial Sequence
  chemically synthesized
cataaaggaactgacttctc

SEQ ID NO: 83628 - DNA, 20 bp, Artificial Sequence
  chemically synthesized
ccttttctatcatcacataa

SEQ ID NO: 83629 - DNA, 20 bp, Artificial Sequence
  chemically synthesized
accttttctatcatcacata

SEQ ID NO: 83630 - DNA, 20 bp, Artificial Sequence
  chemically synthesized
tcagttcctttatgtgatga

SEQ ID NO: 83631 - DNA, 20 bp, Artificial Sequence
  chemically synthesized
tcctttatgtgatgatagaa

SEQ ID NO: 83632 - DNA, 20 bp, Artificial Sequence
  chemically synthesized
cctttatgtgatgatagaaa

SEQ ID NO: 83633 - DNA, 20 bp, Artificial Sequence
  chemically synthesized
tgtgatgatagaaaaggtat

SEQ ID NO: 83634 - DNA, 20 bp, Artificial Sequence
  chemically synthesized
gatagaaaaggtatcagata

SEQ ID NO: 83635 - DNA, 20 bp, Artificial Sequence
  chemically synthesized
cgtattctgtatgtacatgg

SEQ ID NO: 83636 - DNA, 20 bp, Artificial Sequence
  chemically synthesized
tacgtattctgtatgtacat

SEQ ID NO: 83637 - DNA, 20 bp, Artificial Sequence
  chemically synthesized
atacgtattctgtatgtaca

SEQ ID NO: 83638 - DNA, 20 bp, Artificial Sequence
  chemically synthesized
tattttctcccatgtacata

SEQ ID NO: 83639 - DNA, 20 bp, Artificial Sequence
  chemically synthesized
gaatacgtatttacaatatt

SEQ ID NO: 83640 - DNA, 20 bp, Artificial Sequence
  chemically synthesized
tatttacaatattcagatgt

SEQ ID NO: 83641 - DNA, 20 bp, Artificial Sequence
  chemically synthesized
aatattcagatgttagcatt

SEQ ID NO: 83642 - DNA, 20 bp, Artificial Sequence
  chemically synthesized
gatgttagcattcagatgtt

SEQ ID NO: 83643 - DNA, 20 bp, Artificial Sequence
  chemically synthesized
atctgttcaagggattcagg

SEQ ID NO: 83644 - DNA, 20 bp, Artificial Sequence
  chemically synthesized
tttatctgttcaagggattc

SEQ ID NO: 83645 - DNA, 20 bp, Artificial Sequence
  chemically synthesized
ttttatctgttcaagggatt

SEQ ID NO: 83646 - DNA, 20 bp, Artificial Sequence
  chemically synthesized
tacttcctgaatcccttgaa

SEQ ID NO: 83647 - DNA, 20 bp, Artificial Sequence
  chemically synthesized
agataattttatctgttcaa

SEQ ID NO: 83648 - DNA, 20 bp, Artificial Sequence
  chemically synthesized
aagataattttatctgttca

SEQ ID NO: 83649 - DNA, 20 bp, Artificial Sequence
  chemically synthesized
aaagataattttatctgttc

SEQ ID NO: 83650 - DNA, 20 bp, Artificial Sequence
  chemically synthesized
gaagaggatgtgttttaaca

SEQ ID NO: 83651 - DNA, 20 bp, Artificial Sequence
  chemically synthesized
aaaagaaaggtatggggaag

SEQ ID NO: 83652 - DNA, 20 bp, Artificial Sequence
  chemically synthesized
gaaaagaaaggtatggggaa

SEQ ID NO: 83653 - DNA, 20 bp, Artificial Sequence
  chemically synthesized
gtgaaaagaaaggtatgggg

SEQ ID NO: 83654 - DNA, 20 bp, Artificial Sequence
  chemically synthesized
aaggtgaaaagaaaggtatg

SEQ ID NO: 83655 - DNA, 20 bp, Artificial Sequence
  chemically synthesized
aaaggtgaaaagaaaggtat

SEQ ID NO: 83656 - DNA, 20 bp, Artificial Sequence
  chemically synthesized
gaaaggtgaaaagaaaggta

SEQ ID NO: 83657 - DNA, 20 bp, Artificial Sequence
  chemically synthesized
tcttggaaaggtgaaaagaa

SEQ ID NO: 83658 - DNA, 20 bp, Artificial Sequence
  chemically synthesized
gtcttggaaaggtgaaaaga

SEQ ID NO: 83659 - DNA, 20 bp, Artificial Sequence
  chemically synthesized
ggctgtcttggaaaggtgaa

SEQ ID NO: 83660 - DNA, 20 bp, Artificial Sequence
  chemically synthesized
acctttcttttcacctttcc

SEQ ID NO: 83661 - DNA, 20 bp, Artificial Sequence
  chemically synthesized
tgggtctggctgtcttggaa

SEQ ID NO: 83662 - DNA, 20 bp, Artificial Sequence
  chemically synthesized
ttcttttcacctttccaaga

SEQ ID NO: 83663 - DNA, 20 bp, Artificial Sequence
  chemically synthesized
ttgggtctggctgtcttgga

SEQ ID NO: 83664 - DNA, 20 bp, Artificial Sequence
  chemically synthesized
tttcacctttccaagacagc

SEQ ID NO: 83665 - DNA, 20 bp, Artificial Sequence
  chemically synthesized
acccttgggtctggctgtct

SEQ ID NO: 83666 - DNA, 20 bp, Artificial Sequence
  chemically synthesized
tttccaagacagccagaccc

SEQ ID NO: 83667 - DNA, 20 bp, Artificial Sequence
  chemically synthesized
ttccaagacagccagaccca

SEQ ID NO: 83668 - DNA, 20 bp, Artificial Sequence
  chemically synthesized
tccaagacagccagacccaa

SEQ ID NO: 83669 - DNA, 20 bp, Artificial Sequence
  chemically synthesized
ctattttggacccttgggtc

SEQ ID NO: 83670 - DNA, 20 bp, Artificial Sequence
  chemically synthesized
tatcactattttggaccctt

SEQ ID NO: 83671 - DNA, 20 bp, Artificial Sequence
  chemically synthesized
atatcactattttggaccct

SEQ ID NO: 83672 - DNA, 20 bp, Artificial Sequence
  chemically synthesized
ccagacccaagggtccaaaa

SEQ ID NO: 83673 - DNA, 20 bp, Artificial Sequence
  chemically synthesized
attctctcatatcactattt

SEQ ID NO: 83674 - DNA, 20 bp, Artificial Sequence
  chemically synthesized
agggtccaaaatagtgatat

SEQ ID NO: 83675 - DNA, 20 bp, Artificial Sequence
  chemically synthesized
ggtccaaaatagtgatatga

SEQ ID NO: 83676 - DNA, 20 bp, Artificial Sequence
  chemically synthesized
aaatagtgatatgagagaat

SEQ ID NO: 83677 - DNA, 20 bp, Artificial Sequence
  chemically synthesized
tagtgatatgagagaattag

SEQ ID NO: 83678 - DNA, 20 bp, Artificial Sequence
  chemically synthesized
gagaattagaagcaatacta

SEQ ID NO: 83679 - DNA, 20 bp, Artificial Sequence
  chemically synthesized
tagaagcaatactaaagacg

SEQ ID NO: 83680 - DNA, 20 bp, Artificial Sequence
  chemically synthesized
atagaggtgctctacgtctt

SEQ ID NO: 83681 - DNA, 20 bp, Artificial Sequence
  chemically synthesized
gaagcaatactaaagacgta

SEQ ID NO: 83682 - DNA, 20 bp, Artificial Sequence
  chemically synthesized
tgcatattttattttcatag

SEQ ID NO: 83683 - DNA, 20 bp, Artificial Sequence
  chemically synthesized
ttgcatattttattttcata

SEQ ID NO: 83684 - DNA, 20 bp, Artificial Sequence
  chemically synthesized
aattgcatattttattttca

SEQ ID NO: 83685 - DNA, 20 bp, Artificial Sequence
  chemically synthesized
tgaaaataaaatatgcaatt

SEQ ID NO: 83686 - DNA, 20 bp, Artificial Sequence
  chemically synthesized
atatgcaatttagaaaatgt

SEQ ID NO: 83687 - DNA, 20 bp, Artificial Sequence
  chemically synthesized
tatgcaatttagaaaatgtt

SEQ ID NO: 83688 - DNA, 20 bp, Artificial Sequence
  chemically synthesized
aaaatgttaggaatactaca

SEQ ID NO: 83689 - DNA, 20 bp, Artificial Sequence
  chemically synthesized
ctcaaggacaaacatctgtg

SEQ ID NO: 83690 - DNA, 20 bp, Artificial Sequence
  chemically synthesized
ctacacagatgtttgtcctt

SEQ ID NO: 83691 - DNA, 20 bp, Artificial Sequence
  chemically synthesized
tgtgaaccttaagaagctca

SEQ ID NO: 83692 - DNA, 20 bp, Artificial Sequence
  chemically synthesized
ttgtgaaccttaagaagctc

SEQ ID NO: 83693 - DNA, 20 bp, Artificial Sequence
  chemically synthesized
tgtttgtccttgagcttctt

SEQ ID NO: 83694 - DNA, 20 bp, Artificial Sequence
  chemically synthesized
gtttgtccttgagcttctta

SEQ ID NO: 83695 - DNA, 20 bp, Artificial Sequence
  chemically synthesized
tttattttgtgaaccttaag

SEQ ID NO: 83696 - DNA, 20 bp, Artificial Sequence
  chemically synthesized
aagtttattttgtgaacctt

SEQ ID NO: 83697 - DNA, 20 bp, Artificial Sequence
  chemically synthesized
tcacaaaataaacttatatg

SEQ ID NO: 83698 - DNA, 20 bp, Artificial Sequence
  chemically synthesized
tgtagtagcatacttcatat

SEQ ID NO: 83699 - DNA, 20 bp, Artificial Sequence
  chemically synthesized
tcattgctataatagtgtag

SEQ ID NO: 83700 - DNA, 20 bp, Artificial Sequence
  chemically synthesized
ttatcattgctataatagtg

SEQ ID NO: 83701 - DNA, 20 bp, Artificial Sequence
  chemically synthesized
agtatgctactacactatta

SEQ ID NO: 83702 - DNA, 20 bp, Artificial Sequence
  chemically synthesized
tgagattatcattgctataa

SEQ ID NO: 83703 - DNA, 20 bp, Artificial Sequence
  chemically synthesized
attatagcaatgataatctc

SEQ ID NO: 83704 - DNA, 20 bp, Artificial Sequence
  chemically synthesized
ataataaatagatttatctt

SEQ ID NO: 83705 - DNA, 20 bp, Artificial Sequence
  chemically synthesized
aattcaaccttcataataaa

SEQ ID NO: 83706 - DNA, 20 bp, Artificial Sequence
  chemically synthesized
agataaatctatttattatg

SEQ ID NO: 83707 - DNA, 20 bp, Artificial Sequence
  chemically synthesized
gataaatctatttattatga

SEQ ID NO: 83708 - DNA, 20 bp, Artificial Sequence
  chemically synthesized
attatgaaggttgaattatc

SEQ ID NO: 83709 - DNA, 20 bp, Artificial Sequence
  chemically synthesized
atgaaggttgaattatctgg

SEQ ID NO: 83710 - DNA, 20 bp, Artificial Sequence
  chemically synthesized
gtgttttaagtgcaatctac

SEQ ID NO: 83711 - DNA, 20 bp, Artificial Sequence
  chemically synthesized
gccagtacctatggtgtttt

SEQ ID NO: 83712 - DNA, 20 bp, Artificial Sequence
  chemically synthesized
agattgcacttaaaacacca

SEQ ID NO: 83713 - DNA, 20 bp, Artificial Sequence
  chemically synthesized
gattgcacttaaaacaccat

SEQ ID NO: 83714 - DNA, 20 bp, Artificial Sequence
  chemically synthesized
acttaaaacaccataggtac

SEQ ID NO: 83715 - DNA, 20 bp, Artificial Sequence
  chemically synthesized
acccggttggccagtaccta

SEQ ID NO: 83716 - DNA, 20 bp, Artificial Sequence
  chemically synthesized
caccataggtactggccaac

SEQ ID NO: 83717 - DNA, 20 bp, Artificial Sequence
  chemically synthesized
accataggtactggccaacc

SEQ ID NO: 83718 - DNA, 20 bp, Artificial Sequence
  chemically synthesized
caatcagtcacccggttggc

SEQ ID NO: 83719 - DNA, 20 bp, Artificial Sequence
  chemically synthesized
tcaacaatcagtcacccggt

SEQ ID NO: 83720 - DNA, 20 bp, Artificial Sequence
  chemically synthesized
tgagtcaacaatcagtcacc

SEQ ID NO: 83721 - DNA, 20 bp, Artificial Sequence
  chemically synthesized
caaattagtgagtcaacaat

SEQ ID NO: 83722 - DNA, 20 bp, Artificial Sequence
  chemically synthesized
ttttgaatgaacaaattagt

SEQ ID NO: 83723 - DNA, 20 bp, Artificial Sequence
  chemically synthesized
tattttttgaatgaacaaat

SEQ ID NO: 83724 - DNA, 20 bp, Artificial Sequence
  chemically synthesized
aatatttattttgaacctat

SEQ ID NO: 83725 - DNA, 20 bp, Artificial Sequence
  chemically synthesized
atatttattttgaacctatt

SEQ ID NO: 83726 - DNA, 20 bp, Artificial Sequence
  chemically synthesized
ttcctaactttgtacctaat

SEQ ID NO: 83727 - DNA, 20 bp, Artificial Sequence
  chemically synthesized
tttcctaactttgtacctaa

SEQ ID NO: 83728 - DNA, 20 bp, Artificial Sequence
  chemically synthesized
ttttgaacctattaggtaca

SEQ ID NO: 83729 - DNA, 20 bp, Artificial Sequence
  chemically synthesized
gaacctattaggtacaaagt

SEQ ID NO: 83730 - DNA, 20 bp, Artificial Sequence
  chemically synthesized
aacctattaggtacaaagtt

SEQ ID NO: 83731 - DNA, 20 bp, Artificial Sequence
  chemically synthesized
tattaggtacaaagttagga

SEQ ID NO: 83732 - DNA, 20 bp, Artificial Sequence
  chemically synthesized
gtacaaagttaggaaagata

SEQ ID NO: 83733 - DNA, 20 bp, Artificial Sequence
  chemically synthesized
acaaagttaggaaagatata

SEQ ID NO: 83734 - DNA, 20 bp, Artificial Sequence
  chemically synthesized
gctccttaatgacaaagatt

SEQ ID NO: 83735 - DNA, 20 bp, Artificial Sequence
  chemically synthesized
gagacttaatctttgtcatt

SEQ ID NO: 83736 - DNA, 20 bp, Artificial Sequence
  chemically synthesized
ctattggctccttaatgaca

SEQ ID NO: 83737 - DNA, 20 bp, Artificial Sequence
  chemically synthesized
agacttaatctttgtcatta

SEQ ID NO: 83738 - DNA, 20 bp, Artificial Sequence
  chemically synthesized
acttaatctttgtcattaag

SEQ ID NO: 83739 - DNA, 20 bp, Artificial Sequence
  chemically synthesized
ctttgtcattaaggagccaa

SEQ ID NO: 83740 - DNA, 20 bp, Artificial Sequence
  chemically synthesized
tcattaaggagccaatagtt

SEQ ID NO: 83741 - DNA, 20 bp, Artificial Sequence
  chemically synthesized
tacctactcaaccaaactat

SEQ ID NO: 83742 - DNA, 20 bp, Artificial Sequence
  chemically synthesized
aaggagccaatagtttggtt

SEQ ID NO: 83743 - DNA, 20 bp, Artificial Sequence
  chemically synthesized
gagccaatagtttggttgag

SEQ ID NO: 83744 - DNA, 20 bp, Artificial Sequence
  chemically synthesized
agccaatagtttggttgagt

SEQ ID NO: 83745 - DNA, 20 bp, Artificial Sequence
  chemically synthesized
tggttgagtaggtatatttg

SEQ ID NO: 83746 - DNA, 20 bp, Artificial Sequence
  chemically synthesized
atgaaacattcataatataa

SEQ ID NO: 83747 - DNA, 20 bp, Artificial Sequence
  chemically synthesized
tatctgtatctcaatttgca

SEQ ID NO: 83748 - DNA, 20 bp, Artificial Sequence
  chemically synthesized
atgtttcatccatgcaaatt

SEQ ID NO: 83749 - DNA, 20 bp, Artificial Sequence
  chemically synthesized
catccatgcaaattgagata

SEQ ID NO: 83750 - DNA, 20 bp, Artificial Sequence
  chemically synthesized
atgcaaattgagatacagat

SEQ ID NO: 83751 - DNA, 20 bp, Artificial Sequence
  chemically synthesized
aaattgagatacagataagt

SEQ ID NO: 83752 - DNA, 20 bp, Artificial Sequence
  chemically synthesized
aattgagatacagataagtt

SEQ ID NO: 83753 - DNA, 20 bp, Artificial Sequence
  chemically synthesized
attgagatacagataagtta

SEQ ID NO: 83754 - DNA, 20 bp, Artificial Sequence
  chemically synthesized
agataagttagggtttacct

SEQ ID NO: 83755 - DNA, 20 bp, Artificial Sequence
  chemically synthesized
gataagttagggtttaccta

SEQ ID NO: 83756 - DNA, 20 bp, Artificial Sequence
  chemically synthesized
tgtaattaactgatggcctt

SEQ ID NO: 83757 - DNA, 20 bp, Artificial Sequence
  chemically synthesized
tagggtttacctaaggccat

SEQ ID NO: 83758 - DNA, 20 bp, Artificial Sequence
  chemically synthesized
gtgtaattaactgatggcct

SEQ ID NO: 83759 - DNA, 20 bp, Artificial Sequence
  chemically synthesized
caaagtgtgtaattaactga

SEQ ID NO: 83760 - DNA, 20 bp, Artificial Sequence
  chemically synthesized
aattgcaagatttagattca

SEQ ID NO: 83761 - DNA, 20 bp, Artificial Sequence
  chemically synthesized
cactttagaattgcaagatt

SEQ ID NO: 83762 - DNA, 20 bp, Artificial Sequence
  chemically synthesized
cagcttcactttagaattgc

SEQ ID NO: 83763 - DNA, 20 bp, Artificial Sequence
  chemically synthesized
atctaaatcttgcaattcta

SEQ ID NO: 83764 - DNA, 20 bp, Artificial Sequence
  chemically synthesized
aatcttgcaattctaaagtg

SEQ ID NO: 83765 - DNA, 20 bp, Artificial Sequence
  chemically synthesized
actcactttcagcttcactt

SEQ ID NO: 83766 - DNA, 20 bp, Artificial Sequence
  chemically synthesized
caattctaaagtgaagctga

SEQ ID NO: 83767 - DNA, 20 bp, Artificial Sequence
  chemically synthesized
tctaaagtgaagctgaaagt

SEQ ID NO: 83768 - DNA, 20 bp, Artificial Sequence
  chemically synthesized
gttttgttatcactcacttt

SEQ ID NO: 83769 - DNA, 20 bp, Artificial Sequence
  chemically synthesized
aacataaaatctccctgact

SEQ ID NO: 83770 - DNA, 20 bp, Artificial Sequence
  chemically synthesized
ccaaattattctaagtcagg

SEQ ID NO: 83771 - DNA, 20 bp, Artificial Sequence
  chemically synthesized
ttccaaattattctaagtca

SEQ ID NO: 83772 - DNA, 20 bp, Artificial Sequence
  chemically synthesized
cttccaaattattctaagtc

SEQ ID NO: 83773 - DNA, 20 bp, Artificial Sequence
  chemically synthesized
gcttccaaattattctaagt

SEQ ID NO: 83774 - DNA, 20 bp, Artificial Sequence
  chemically synthesized
tgtggcttccaaattattct

SEQ ID NO: 83775 - DNA, 20 bp, Artificial Sequence
  chemically synthesized
ctccctgacttagaataatt

SEQ ID NO: 83776 - DNA, 20 bp, Artificial Sequence
  chemically synthesized
cctgacttagaataatttgg

SEQ ID NO: 83777 - DNA, 20 bp, Artificial Sequence
  chemically synthesized
gaataatttggaagccacat

SEQ ID NO: 83778 - DNA, 20 bp, Artificial Sequence
  chemically synthesized
taatttggaagccacataag

SEQ ID NO: 83779 - DNA, 20 bp, Artificial Sequence
  chemically synthesized
attaggattttccacttatg

SEQ ID NO: 83780 - DNA, 20 bp, Artificial Sequence
  chemically synthesized
acataagtggaaaatcctaa

SEQ ID NO: 83781 - DNA, 20 bp, Artificial Sequence
  chemically synthesized
tgatttcttccatggccatt

SEQ ID NO: 83782 - DNA, 20 bp, Artificial Sequence
  chemically synthesized
gtggaaaatcctaatggcca

SEQ ID NO: 83783 - DNA, 20 bp, Artificial Sequence
  chemically synthesized
ctgatttcttccatggccat

SEQ ID NO: 83784 - DNA, 20 bp, Artificial Sequence
  chemically synthesized
gaaaatcctaatggccatgg

SEQ ID NO: 83785 - DNA, 20 bp, Artificial Sequence
  chemically synthesized
taagtttctgatttcttcca

SEQ ID NO: 83786 - DNA, 20 bp, Artificial Sequence
  chemically synthesized
ctaatggccatggaagaaat

SEQ ID NO: 83787 - DNA, 20 bp, Artificial Sequence
  chemically synthesized
attactttcaggaatttttt

SEQ ID NO: 83788 - DNA, 20 bp, Artificial Sequence
  chemically synthesized
gaaacttaaaaaattcctga

SEQ ID NO: 83789 - DNA, 20 bp, Artificial Sequence
  chemically synthesized
ggttcttctctattactttc

SEQ ID NO: 83790 - DNA, 20 bp, Artificial Sequence
  chemically synthesized
taaaaaattcctgaaagtaa

SEQ ID NO: 83791 - DNA, 20 bp, Artificial Sequence
  chemically synthesized
tggttcttctctattacttt

SEQ ID NO: 83792 - DNA, 20 bp, Artificial Sequence
  chemically synthesized
aaaaattcctgaaagtaata

SEQ ID NO: 83793 - DNA, 20 bp, Artificial Sequence
  chemically synthesized
aattcctgaaagtaatagag

SEQ ID NO: 83794 - DNA, 20 bp, Artificial Sequence
  chemically synthesized
gaaagtaatagagaagaacc

SEQ ID NO: 83795 - DNA, 20 bp, Artificial Sequence
  chemically synthesized
aataataataatcaataact

SEQ ID NO: 83796 - DNA, 20 bp, Artificial Sequence
  chemically synthesized
ttatttatttatttattttt

SEQ ID NO: 83797 - DNA, 20 bp, Artificial Sequence
  chemically synthesized
ttatttatttatttttgaga

SEQ ID NO: 83798 - DNA, 20 bp, Artificial Sequence
  chemically synthesized
atttatttatttttgagacg

SEQ ID NO: 83799 - DNA, 20 bp, Artificial Sequence
  chemically synthesized
tccagactgggtgacagagc

SEQ ID NO: 83800 - DNA, 20 bp, Artificial Sequence
  chemically synthesized
cggagtctcgctctgtcacc

SEQ ID NO: 83801 - DNA, 20 bp, Artificial Sequence
  chemically synthesized
gcactccagactgggtgaca

SEQ ID NO: 83802 - DNA, 20 bp, Artificial Sequence
  chemically synthesized
ctgcactccagactgggtga

SEQ ID NO: 83803 - DNA, 20 bp, Artificial Sequence
  chemically synthesized
tctcgctctgtcacccagtc

SEQ ID NO: 83804 - DNA, 20 bp, Artificial Sequence
  chemically synthesized
tcgctctgtcacccagtctg

SEQ ID NO: 83805 - DNA, 20 bp, Artificial Sequence
  chemically synthesized
gtgccactgcactccagact

SEQ ID NO: 83806 - DNA, 20 bp, Artificial Sequence
  chemically synthesized
cgtgccactgcactccagac

SEQ ID NO: 83807 - DNA, 20 bp, Artificial Sequence
  chemically synthesized
ctgtcacccagtctggagtg

SEQ ID NO: 83808 - DNA, 20 bp, Artificial Sequence
  chemically synthesized
gagatcgtgccactgcactc

SEQ ID NO: 83809 - DNA, 20 bp, Artificial Sequence
  chemically synthesized
tcacccagtctggagtgcag

SEQ ID NO: 83810 - DNA, 20 bp, Artificial Sequence
  chemically synthesized
ggagtgcagtggcacgatct

SEQ ID NO: 83811 - DNA, 20 bp, Artificial Sequence
  chemically synthesized
ggcagaggttgcagtaagcc

SEQ ID NO: 83812 - DNA, 20 bp, Artificial Sequence
  chemically synthesized
caggaggcagaggttgcagt

SEQ ID NO: 83813 - DNA, 20 bp, Artificial Sequence
  chemically synthesized
aacccaggaggcagaggttg

SEQ ID NO: 83814 - DNA, 20 bp, Artificial Sequence
  chemically synthesized
cacttgaacccaggaggcag

SEQ ID NO: 83815 - DNA, 20 bp, Artificial Sequence
  chemically synthesized
ttactgcaacctctgcctcc

SEQ ID NO: 83816 - DNA, 20 bp, Artificial Sequence
  chemically synthesized
tcacttgaacccaggaggca

SEQ ID NO: 83817 - DNA, 20 bp, Artificial Sequence
  chemically synthesized
tactgcaacctctgcctcct

SEQ ID NO: 83818 - DNA, 20 bp, Artificial Sequence
  chemically synthesized
aatcacttgaacccaggagg

SEQ ID NO: 83819 - DNA, 20 bp, Artificial Sequence
  chemically synthesized
gagaatcacttgaacccagg

SEQ ID NO: 83820 - DNA, 20 bp, Artificial Sequence
  chemically synthesized
ggagaatcacttgaacccag

SEQ ID NO: 83821 - DNA, 20 bp, Artificial Sequence
  chemically synthesized
aacctctgcctcctgggttc

SEQ ID NO: 83822 - DNA, 20 bp, Artificial Sequence
  chemically synthesized
caggagaatcacttgaaccc

SEQ ID NO: 83823 - DNA, 20 bp, Artificial Sequence
  chemically synthesized
gcaggagaatcacttgaacc

SEQ ID NO: 83824 - DNA, 20 bp, Artificial Sequence
  chemically synthesized
ttcaagtgattctcctgcct

SEQ ID NO: 83825 - DNA, 20 bp, Artificial Sequence
  chemically synthesized
tactcaggaggctgaggcag

SEQ ID NO: 83826 - DNA, 20 bp, Artificial Sequence
  chemically synthesized
tctactcaggaggctgaggc

SEQ ID NO: 83827 - DNA, 20 bp, Artificial Sequence
  chemically synthesized
atctactcaggaggctgagg

SEQ ID NO: 83828 - DNA, 20 bp, Artificial Sequence
  chemically synthesized
cccatctactcaggaggctg

SEQ ID NO: 83829 - DNA, 20 bp, Artificial Sequence
  chemically synthesized
tcccatctactcaggaggct

SEQ ID NO: 83830 - DNA, 20 bp, Artificial Sequence
  chemically synthesized
ttctcctgcctcagcctcct

SEQ ID NO: 83831 - DNA, 20 bp, Artificial Sequence
  chemically synthesized
tcctgcctcagcctcctgag

SEQ ID NO: 83832 - DNA, 20 bp, Artificial Sequence
  chemically synthesized
tgtagtcccatctactcagg

SEQ ID NO: 83833 - DNA, 20 bp, Artificial Sequence
  chemically synthesized
ctgtagtcccatctactcag

SEQ ID NO: 83834 - DNA, 20 bp, Artificial Sequence
  chemically synthesized
gcctcagcctcctgagtaga

SEQ ID NO: 83835 - DNA, 20 bp, Artificial Sequence
  chemically synthesized
gcctgtagtcccatctactc

SEQ ID NO: 83836 - DNA, 20 bp, Artificial Sequence
  chemically synthesized
cctcagcctcctgagtagat

SEQ ID NO: 83837 - DNA, 20 bp, Artificial Sequence
  chemically synthesized
tgcctgtagtcccatctact

SEQ ID NO: 83838 - DNA, 20 bp, Artificial Sequence
  chemically synthesized
ctcctgagtagatgggacta

SEQ ID NO: 83839 - DNA, 20 bp, Artificial Sequence
  chemically synthesized
tcctgagtagatgggactac

SEQ ID NO: 83840 - DNA, 20 bp, Artificial Sequence
  chemically synthesized
ggtgtggtggcgcgtgcctg

SEQ ID NO: 83841 - DNA, 20 bp, Artificial Sequence
  chemically synthesized
aaaaaattagcagggtgtgg

SEQ ID NO: 83842 - DNA, 20 bp, Artificial Sequence
  chemically synthesized
tacaaaaaattagcagggtg

SEQ ID NO: 83843 - DNA, 20 bp, Artificial Sequence
  chemically synthesized
aaaaatacaaaaaattagca

SEQ ID NO: 83844 - DNA, 20 bp, Artificial Sequence
  chemically synthesized
taaaaatacaaaaaattagc

SEQ ID NO: 83845 - DNA, 20 bp, Artificial Sequence
  chemically synthesized
ctaaaaatacaaaaaattag

SEQ ID NO: 83846 - DNA, 20 bp, Artificial Sequence
  chemically synthesized
ctactaaaaatacaaaaaat

SEQ ID NO: 83847 - DNA, 20 bp, Artificial Sequence
  chemically synthesized
ctgctaattttttgtatttt

SEQ ID NO: 83848 - DNA, 20 bp, Artificial Sequence
  chemically synthesized
ctaattttttgtatttttag

SEQ ID NO: 83849 - DNA, 20 bp, Artificial Sequence
  chemically synthesized
aattttttgtatttttagta

SEQ ID NO: 83850 - DNA, 20 bp, Artificial Sequence
  chemically synthesized
ttttgtatttttagtagaga

SEQ ID NO: 83851 - DNA, 20 bp, Artificial Sequence
  chemically synthesized
tttgtatttttagtagagac

SEQ ID NO: 83852 - DNA, 20 bp, Artificial Sequence
  chemically synthesized
ttgtatttttagtagagacg

SEQ ID NO: 83853 - DNA, 20 bp, Artificial Sequence
  chemically synthesized
gagacggggtttcactatgt

SEQ ID NO: 83854 - DNA, 20 bp, Artificial Sequence
  chemically synthesized
agacggggtttcactatgtt

SEQ ID NO: 83855 - DNA, 20 bp, Artificial Sequence
  chemically synthesized
tgagaccagcttgcccaaca

SEQ ID NO: 83856 - DNA, 20 bp, Artificial Sequence
  chemically synthesized
ggggtttcactatgttgggc

SEQ ID NO: 83857 - DNA, 20 bp, Artificial Sequence
  chemically synthesized
tttcactatgttgggcaagc

SEQ ID NO: 83858 - DNA, 20 bp, Artificial Sequence
  chemically synthesized
tgaggtcaggagtttgagac

SEQ ID NO: 83859 - DNA, 20 bp, Artificial Sequence
  chemically synthesized
tcacctgaggtcaggagttt

SEQ ID NO: 83860 - DNA, 20 bp, Artificial Sequence
  chemically synthesized
tggtctcaaactcctgacct

SEQ ID NO: 83861 - DNA, 20 bp, Artificial Sequence
  chemically synthesized
aacggatcacctgaggtcag

SEQ ID NO: 83862 - DNA, 20 bp, Artificial Sequence
  chemically synthesized
ggtctcaaactcctgacctc

SEQ ID NO: 83863 - DNA, 20 bp, Artificial Sequence
  chemically synthesized
caaacggatcacctgaggtc

SEQ ID NO: 83864 - DNA, 20 bp, Artificial Sequence
  chemically synthesized
gcaaacggatcacctgaggt

SEQ ID NO: 83865 - DNA, 20 bp, Artificial Sequence
  chemically synthesized
cgaggcaaacggatcacctg

SEQ ID NO: 83866 - DNA, 20 bp, Artificial Sequence
  chemically synthesized
ccgaggcaaacggatcacct

SEQ ID NO: 83867 - DNA, 20 bp, Artificial Sequence
  chemically synthesized
ctcaggtgatccgtttgcct

SEQ ID NO: 83868 - DNA, 20 bp, Artificial Sequence
  chemically synthesized
ctttgcgaggccgaggcaaa

SEQ ID NO: 83869 - DNA, 20 bp, Artificial Sequence
  chemically synthesized
cccagcactttgcgaggccg

SEQ ID NO: 83870 - DNA, 20 bp, Artificial Sequence
  chemically synthesized
tcccagcactttgcgaggcc

SEQ ID NO: 83871 - DNA, 20 bp, Artificial Sequence
  chemically synthesized
ccgtttgcctcggcctcgca

SEQ ID NO: 83872 - DNA, 20 bp, Artificial Sequence
  chemically synthesized
tgtaatcccagcactttgcg

SEQ ID NO: 83873 - DNA, 20 bp, Artificial Sequence
  chemically synthesized
ttgtaatcccagcactttgc

SEQ ID NO: 83874 - DNA, 20 bp, Artificial Sequence
  chemically synthesized
gcctcggcctcgcaaagtgc

SEQ ID NO: 83875 - DNA, 20 bp, Artificial Sequence
  chemically synthesized
cctcggcctcgcaaagtgct

SEQ ID NO: 83876 - DNA, 20 bp, Artificial Sequence
  chemically synthesized
tcgcaaagtgctgggattac

SEQ ID NO: 83877 - DNA, 20 bp, Artificial Sequence
  chemically synthesized
gtggctcacacttgtaatcc

SEQ ID NO: 83878 - DNA, 20 bp, Artificial Sequence
  chemically synthesized
agtgctgggattacaagtgt

SEQ ID NO: 83879 - DNA, 20 bp, Artificial Sequence
  chemically synthesized
caagtgtgagccaccacacc

SEQ ID NO: 83880 - DNA, 20 bp, Artificial Sequence
  chemically synthesized
taatcagtggccaggtgtgg

SEQ ID NO: 83881 - DNA, 20 bp, Artificial Sequence
  chemically synthesized
aaataatcagtggccaggtg

SEQ ID NO: 83882 - DNA, 20 bp, Artificial Sequence
  chemically synthesized
gaaaaaaataatcagtggcc

SEQ ID NO: 83883 - DNA, 20 bp, Artificial Sequence
  chemically synthesized
agaaaaaaataatcagtggc

SEQ ID NO: 83884 - DNA, 20 bp, Artificial Sequence
  chemically synthesized
ggacagaaaaaaataatcag

SEQ ID NO: 83885 - DNA, 20 bp, Artificial Sequence
  chemically synthesized
gagggacagaaaaaaataat

SEQ ID NO: 83886 - DNA, 20 bp, Artificial Sequence
  chemically synthesized
taagcaggaagcaagaggga

SEQ ID NO: 83887 - DNA, 20 bp, Artificial Sequence
  chemically synthesized
aatataagcaggaagcaaga

SEQ ID NO: 83888 - DNA, 20 bp, Artificial Sequence
  chemically synthesized
taatataagcaggaagcaag

SEQ ID NO: 83889 - DNA, 20 bp, Artificial Sequence
  chemically synthesized
ataatataagcaggaagcaa

SEQ ID NO: 83890 - DNA, 20 bp, Artificial Sequence
  chemically synthesized
ttataatataagcaggaagc

SEQ ID NO: 83891 - DNA, 20 bp, Artificial Sequence
  chemically synthesized
atttttataatataagcagg

SEQ ID NO: 83892 - DNA, 20 bp, Artificial Sequence
  chemically synthesized
gatatttttataatataagc

SEQ ID NO: 83893 - DNA, 20 bp, Artificial Sequence
  chemically synthesized
agatatttttataatataag

SEQ ID NO: 83894 - DNA, 20 bp, Artificial Sequence
  chemically synthesized
tttagatatttttataatat

SEQ ID NO: 83895 - DNA, 20 bp, Artificial Sequence
  chemically synthesized
cttctatttatggcattatt

SEQ ID NO: 83896 - DNA, 20 bp, Artificial Sequence
  chemically synthesized
tatctaaataatgccataaa

SEQ ID NO: 83897 - DNA, 20 bp, Artificial Sequence
  chemically synthesized
ctaaataatgccataaatag

SEQ ID NO: 83898 - DNA, 20 bp, Artificial Sequence
  chemically synthesized
ttctgagctacttctattta

SEQ ID NO: 83899 - DNA, 20 bp, Artificial Sequence
  chemically synthesized
aataatgccataaatagaag

SEQ ID NO: 83900 - DNA, 20 bp, Artificial Sequence
  chemically synthesized
tgccataaatagaagtagct

SEQ ID NO: 83901 - DNA, 20 bp, Artificial Sequence
  chemically synthesized
tcccctccatacgtggttct

SEQ ID NO: 83902 - DNA, 20 bp, Artificial Sequence
  chemically synthesized
aagtagctcagaaccacgta

SEQ ID NO: 83903 - DNA, 20 bp, Artificial Sequence
  chemically synthesized
gtagctcagaaccacgtatg

SEQ ID NO: 83904 - DNA, 20 bp, Artificial Sequence
  chemically synthesized
tagctcagaaccacgtatgg

SEQ ID NO: 83905 - DNA, 20 bp, Artificial Sequence
  chemically synthesized
cctttcatcccctccatacg

SEQ ID NO: 83906 - DNA, 20 bp, Artificial Sequence
  chemically synthesized
agctcagaaccacgtatgga

SEQ ID NO: 83907 - DNA, 20 bp, Artificial Sequence
  chemically synthesized
gctcagaaccacgtatggag

SEQ ID NO: 83908 - DNA, 20 bp, Artificial Sequence
  chemically synthesized
accacgtatggaggggatga

SEQ ID NO: 83909 - DNA, 20 bp, Artificial Sequence
  chemically synthesized
ccacgtatggaggggatgaa

SEQ ID NO: 83910 - DNA, 20 bp, Artificial Sequence
  chemically synthesized
gtatggaggggatgaaaggt

SEQ ID NO: 83911 - DNA, 20 bp, Artificial Sequence
  chemically synthesized
gagatattgatttgcttcat

SEQ ID NO: 83912 - DNA, 20 bp, Artificial Sequence
  chemically synthesized
gatattgatttgcttcatga

SEQ ID NO: 83913 - DNA, 20 bp, Artificial Sequence
  chemically synthesized
atattgatttgcttcatgag

SEQ ID NO: 83914 - DNA, 20 bp, Artificial Sequence
  chemically synthesized
ctcctcttgttcctctcatg

SEQ ID NO: 83915 - DNA, 20 bp, Artificial Sequence
  chemically synthesized
atttgcttcatgagaggaac

SEQ ID NO: 83916 - DNA, 20 bp, Artificial Sequence
  chemically synthesized
ttgcttcatgagaggaacaa

SEQ ID NO: 83917 - DNA, 20 bp, Artificial Sequence
  chemically synthesized
tgcttcatgagaggaacaag

SEQ ID NO: 83918 - DNA, 20 bp, Artificial Sequence
  chemically synthesized
cttcatgagaggaacaagag

SEQ ID NO: 83919 - DNA, 20 bp, Artificial Sequence
  chemically synthesized
gaggaacaagaggagaactc

SEQ ID NO: 83920 - DNA, 20 bp, Artificial Sequence
  chemically synthesized
aggaacaagaggagaactct

SEQ ID NO: 83921 - DNA, 20 bp, Artificial Sequence
  chemically synthesized
caagaggagaactctgggca

SEQ ID NO: 83922 - DNA, 20 bp, Artificial Sequence
  chemically synthesized
aagaggagaactctgggcat

SEQ ID NO: 83923 - DNA, 20 bp, Artificial Sequence
  chemically synthesized
catgtcattacctatgccca

SEQ ID NO: 83924 - DNA, 20 bp, Artificial Sequence
  chemically synthesized
gtcatgtcattacctatgcc

SEQ ID NO: 83925 - DNA, 20 bp, Artificial Sequence
  chemically synthesized
gggcataggtaatgacatga

SEQ ID NO: 83926 - DNA, 20 bp, Artificial Sequence
  chemically synthesized
ggcataggtaatgacatgac

SEQ ID NO: 83927 - DNA, 20 bp, Artificial Sequence
  chemically synthesized
gcataggtaatgacatgaca

SEQ ID NO: 83928 - DNA, 20 bp, Artificial Sequence
  chemically synthesized
ataggtaatgacatgacagg

SEQ ID NO: 83929 - DNA, 20 bp, Artificial Sequence
  chemically synthesized
taatgacatgacagggagaa

SEQ ID NO: 83930 - DNA, 20 bp, Artificial Sequence
  chemically synthesized
gtccccaggagaaagcaaga

SEQ ID NO: 83931 - DNA, 20 bp, Artificial Sequence
  chemically synthesized
cactgtccccaggagaaagc

SEQ ID NO: 83932 - DNA, 20 bp, Artificial Sequence
  chemically synthesized
aaagctatcttgctttctcc

SEQ ID NO: 83933 - DNA, 20 bp, Artificial Sequence
  chemically synthesized
aagctatcttgctttctcct

SEQ ID NO: 83934 - DNA, 20 bp, Artificial Sequence
  chemically synthesized
agctatcttgctttctcctg

SEQ ID NO: 83935 - DNA, 20 bp, Artificial Sequence
  chemically synthesized
aatccactgtccccaggaga

SEQ ID NO: 83936 - DNA, 20 bp, Artificial Sequence
  chemically synthesized
atcttgctttctcctgggga

SEQ ID NO: 83937 - DNA, 20 bp, Artificial Sequence
  chemically synthesized
cctaaatccactgtccccag

SEQ ID NO: 83938 - DNA, 20 bp, Artificial Sequence
  chemically synthesized
atcctaaatccactgtcccc

SEQ ID NO: 83939 - DNA, 20 bp, Artificial Sequence
  chemically synthesized
ttgctttctcctggggacag

SEQ ID NO: 83940 - DNA, 20 bp, Artificial Sequence
  chemically synthesized
gatcctaaatccactgtccc

SEQ ID NO: 83941 - DNA, 20 bp, Artificial Sequence
  chemically synthesized
tctcctggggacagtggatt

SEQ ID NO: 83942 - DNA, 20 bp, Artificial Sequence
  chemically synthesized
ctcctggggacagtggattt

SEQ ID NO: 83943 - DNA, 20 bp, Artificial Sequence
  chemically synthesized
gatttaggatcatattacta

SEQ ID NO: 83944 - DNA, 20 bp, Artificial Sequence
  chemically synthesized
gatcatattactatggatgt

SEQ ID NO: 83945 - DNA, 20 bp, Artificial Sequence
  chemically synthesized
cgggcttttactcacatcca

SEQ ID NO: 83946 - DNA, 20 bp, Artificial Sequence
  chemically synthesized
attactatggatgtgagtaa

SEQ ID NO: 83947 - DNA, 20 bp, Artificial Sequence
  chemically synthesized
atctgtgttttgaaaagcac

SEQ ID NO: 83948 - DNA, 20 bp, Artificial Sequence
  chemically synthesized
catctgtgttttgaaaagca

SEQ ID NO: 83949 - DNA, 20 bp, Artificial Sequence
  chemically synthesized
aaagacatctgtgttttgaa

SEQ ID NO: 83950 - DNA, 20 bp, Artificial Sequence
  chemically synthesized
agcccgtgcttttcaaaaca

SEQ ID NO: 83951 - DNA, 20 bp, Artificial Sequence
  chemically synthesized
ggcaagctgtacatgattga

SEQ ID NO: 83952 - DNA, 20 bp, Artificial Sequence
  chemically synthesized
agatgtctttcaatcatgta

SEQ ID NO: 83953 - DNA, 20 bp, Artificial Sequence
  chemically synthesized
tcaatcatgtacagcttgcc

SEQ ID NO: 83954 - DNA, 20 bp, Artificial Sequence
  chemically synthesized
ggtaaaattcagcgccaggc

SEQ ID NO: 83955 - DNA, 20 bp, Artificial Sequence
  chemically synthesized
tacaggtaaaattcagcgcc

SEQ ID NO: 83956 - DNA, 20 bp, Artificial Sequence
  chemically synthesized
atacaggtaaaattcagcgc

SEQ ID NO: 83957 - DNA, 20 bp, Artificial Sequence
  chemically synthesized
atatgaatacaggtaaaatt

SEQ ID NO: 83958 - DNA, 20 bp, Artificial Sequence
  chemically synthesized
taccatttcaatatgaatac

SEQ ID NO: 83959 - DNA, 20 bp, Artificial Sequence
  chemically synthesized
ttaccatttcaatatgaata

SEQ ID NO: 83960 - DNA, 20 bp, Artificial Sequence
  chemically synthesized
tacctgtattcatattgaaa

SEQ ID NO: 83961 - DNA, 20 bp, Artificial Sequence
  chemically synthesized
aatggtaaatttgtgttttt

SEQ ID NO: 83962 - DNA, 20 bp, Artificial Sequence
  chemically synthesized
tttttcagaataaaatctga

SEQ ID NO: 83963 - DNA, 20 bp, Artificial Sequence
  chemically synthesized
agtatttctagtcattccat

SEQ ID NO: 83964 - DNA, 20 bp, Artificial Sequence
  chemically synthesized
ataaaatctgatggaatgac

SEQ ID NO: 83965 - DNA, 20 bp, Artificial Sequence
  chemically synthesized
acaaatatgggtagtatttc

SEQ ID NO: 83966 - DNA, 20 bp, Artificial Sequence
  chemically synthesized
gttctgcttacaaatatggg

SEQ ID NO: 83967 - DNA, 20 bp, Artificial Sequence
  chemically synthesized
gaagttctgcttacaaatat

SEQ ID NO: 83968 - DNA, 20 bp, Artificial Sequence
  chemically synthesized
gaaatactacccatatttgt

SEQ ID NO: 83969 - DNA, 20 bp, Artificial Sequence
  chemically synthesized
ggaagttctgcttacaaata

SEQ ID NO: 83970 - DNA, 20 bp, Artificial Sequence
  chemically synthesized
atactacccatatttgtaag

SEQ ID NO: 83971 - DNA, 20 bp, Artificial Sequence
  chemically synthesized
tatttgtaagcagaacttcc

SEQ ID NO: 83972 - DNA, 20 bp, Artificial Sequence
  chemically synthesized
cctcccaggatgattctagg

SEQ ID NO: 83973 - DNA, 20 bp, Artificial Sequence
  chemically synthesized
ctgcctcccaggatgattct

SEQ ID NO: 83974 - DNA, 20 bp, Artificial Sequence
  chemically synthesized
cctgcctcccaggatgattc

SEQ ID NO: 83975 - DNA, 20 bp, Artificial Sequence
  chemically synthesized
agaacttcctagaatcatcc

SEQ ID NO: 83976 - DNA, 20 bp, Artificial Sequence
  chemically synthesized
gaacttcctagaatcatcct

SEQ ID NO: 83977 - DNA, 20 bp, Artificial Sequence
  chemically synthesized
acttcctagaatcatcctgg

SEQ ID NO: 83978 - DNA, 20 bp, Artificial Sequence
  chemically synthesized
cttcctagaatcatcctggg

SEQ ID NO: 83979 - DNA, 20 bp, Artificial Sequence
  chemically synthesized
cctagaatcatcctgggagg

SEQ ID NO: 83980 - DNA, 20 bp, Artificial Sequence
  chemically synthesized
ctagaatcatcctgggaggc

SEQ ID NO: 83981 - DNA, 20 bp, Artificial Sequence
  chemically synthesized
accacttcagcctgcctccc

SEQ ID NO: 83982 - DNA, 20 bp, Artificial Sequence
  chemically synthesized
caccacttcagcctgcctcc

SEQ ID NO: 83983 - DNA, 20 bp, Artificial Sequence
  chemically synthesized
tcatcctgggaggcaggctg

SEQ ID NO: 83984 - DNA, 20 bp, Artificial Sequence
  chemically synthesized
tcctgggaggcaggctgaag

SEQ ID NO: 83985 - DNA, 20 bp, Artificial Sequence
  chemically synthesized
cagtgctcttttcaccactt

SEQ ID NO: 83986 - DNA, 20 bp, Artificial Sequence
  chemically synthesized
aggcaggctgaagtggtgaa

SEQ ID NO: 83987 - DNA, 20 bp, Artificial Sequence
  chemically synthesized
gcaggctgaagtggtgaaaa

SEQ ID NO: 83988 - DNA, 20 bp, Artificial Sequence
  chemically synthesized
ggtgaaaagagcactgttct

SEQ ID NO: 83989 - DNA, 20 bp, Artificial Sequence
  chemically synthesized
gaaaagagcactgttctgag

SEQ ID NO: 83990 - DNA, 20 bp, Artificial Sequence
  chemically synthesized
aaggcttctgccactcagaa

SEQ ID NO: 83991 - DNA, 20 bp, Artificial Sequence
  chemically synthesized
aagagcactgttctgagtgg

SEQ ID NO: 83992 - DNA, 20 bp, Artificial Sequence
  chemically synthesized
agcccaaggcttctgccact

SEQ ID NO: 83993 - DNA, 20 bp, Artificial Sequence
  chemically synthesized
agcactgttctgagtggcag

SEQ ID NO: 83994 - DNA, 20 bp, Artificial Sequence
  chemically synthesized
gttctgagtggcagaagcct

SEQ ID NO: 83995 - DNA, 20 bp, Artificial Sequence
  chemically synthesized
ttctgagtggcagaagcctt

SEQ ID NO: 83996 - DNA, 20 bp, Artificial Sequence
  chemically synthesized
cagcccaggcttgaagccca

SEQ ID NO: 83997 - DNA, 20 bp, Artificial Sequence
  chemically synthesized
tggcagaagccttgggcttc

SEQ ID NO: 83998 - DNA, 20 bp, Artificial Sequence
  chemically synthesized
ccagcccaggcttgaagccc

SEQ ID NO: 83999 - DNA, 20 bp, Artificial Sequence
  chemically synthesized
gaagccttgggcttcaagcc

SEQ ID NO: 84000 - DNA, 20 bp, Artificial Sequence
  chemically synthesized
aagccttgggcttcaagcct

SEQ ID NO: 84001 - DNA, 20 bp, Artificial Sequence
  chemically synthesized
tctggcccagcccaggcttg

SEQ ID NO: 84002 - DNA, 20 bp, Artificial Sequence
  chemically synthesized
cttgggcttcaagcctgggc

SEQ ID NO: 84003 - DNA, 20 bp, Artificial Sequence
  chemically synthesized
ttgggcttcaagcctgggct

SEQ ID NO: 84004 - DNA, 20 bp, Artificial Sequence
  chemically synthesized
gccaggttctggcccagccc

SEQ ID NO: 84005 - DNA, 20 bp, Artificial Sequence
  chemically synthesized
agccaggttctggcccagcc

SEQ ID NO: 84006 - DNA, 20 bp, Artificial Sequence
  chemically synthesized
gcttcaagcctgggctgggc

SEQ ID NO: 84007 - DNA, 20 bp, Artificial Sequence
  chemically synthesized
actgcagccaggttctggcc

SEQ ID NO: 84008 - DNA, 20 bp, Artificial Sequence
  chemically synthesized
gcctgggctgggccagaacc

SEQ ID NO: 84009 - DNA, 20 bp, Artificial Sequence
  chemically synthesized
ggatcactgcagccaggttc

SEQ ID NO: 84010 - DNA, 20 bp, Artificial Sequence
  chemically synthesized
gctgggccagaacctggctg

SEQ ID NO: 84011 - DNA, 20 bp, Artificial Sequence
  chemically synthesized
ttttctggatcactgcagcc

SEQ ID NO: 84012 - DNA, 20 bp, Artificial Sequence
  chemically synthesized
cttttctggatcactgcagc

SEQ ID NO: 84013 - DNA, 20 bp, Artificial Sequence
  chemically synthesized
tcaccttttctggatcactg

SEQ ID NO: 84014 - DNA, 20 bp, Artificial Sequence
  chemically synthesized
agaacctggctgcagtgatc

SEQ ID NO: 84015 - DNA, 20 bp, Artificial Sequence
  chemically synthesized
ctggctgcagtgatccagaa

SEQ ID NO: 84016 - DNA, 20 bp, Artificial Sequence
  chemically synthesized
tggctgcagtgatccagaaa

SEQ ID NO: 84017 - DNA, 20 bp, Artificial Sequence
  chemically synthesized
gaagagtttatcaccttttc

SEQ ID NO: 84018 - DNA, 20 bp, Artificial Sequence
  chemically synthesized
aggacacagaggagcaggaa

SEQ ID NO: 84019 - DNA, 20 bp, Artificial Sequence
  chemically synthesized
tgaggacacagaggagcagg

SEQ ID NO: 84020 - DNA, 20 bp, Artificial Sequence
  chemically synthesized
aaatgaggacacagaggagc

SEQ ID NO: 84021 - DNA, 20 bp, Artificial Sequence
  chemically synthesized
caaatgaggacacagaggag

SEQ ID NO: 84022 - DNA, 20 bp, Artificial Sequence
  chemically synthesized
ttacaaatgaggacacagag

SEQ ID NO: 84023 - DNA, 20 bp, Artificial Sequence
  chemically synthesized
ttttacaaatgaggacacag

SEQ ID NO: 84024 - DNA, 20 bp, Artificial Sequence
  chemically synthesized
attttacaaatgaggacaca

SEQ ID NO: 84025 - DNA, 20 bp, Artificial Sequence
  chemically synthesized
acattttacaaatgaggaca

SEQ ID NO: 84026 - DNA, 20 bp, Artificial Sequence
  chemically synthesized
atgcccacattttacaaatg

SEQ ID NO: 84027 - DNA, 20 bp, Artificial Sequence
  chemically synthesized
aatgcccacattttacaaat

SEQ ID NO: 84028 - DNA, 20 bp, Artificial Sequence
  chemically synthesized
gtgtcctcatttgtaaaatg

SEQ ID NO: 84029 - DNA, 20 bp, Artificial Sequence
  chemically synthesized
tgtcctcatttgtaaaatgt

SEQ ID NO: 84030 - DNA, 20 bp, Artificial Sequence
  chemically synthesized
ttagaacttagataaggttt

SEQ ID NO: 84031 - DNA, 20 bp, Artificial Sequence
  chemically synthesized
catttgctaaaaccttatct

SEQ ID NO: 84032 - DNA, 20 bp, Artificial Sequence
  chemically synthesized
tggatgttagaacttagata

SEQ ID NO: 84033 - DNA, 20 bp, Artificial Sequence
  chemically synthesized
ctggatgttagaacttagat

SEQ ID NO: 84034 - DNA, 20 bp, Artificial Sequence
  chemically synthesized
gagaactggatgttagaact

SEQ ID NO: 84035 - DNA, 20 bp, Artificial Sequence
  chemically synthesized
cttatctaagttctaacatc

SEQ ID NO: 84036 - DNA, 20 bp, Artificial Sequence
  chemically synthesized
agtatatgagaactggatgt

SEQ ID NO: 84037 - DNA, 20 bp, Artificial Sequence
  chemically synthesized
tgattatagtatatgagaac

SEQ ID NO: 84038 - DNA, 20 bp, Artificial Sequence
  chemically synthesized
acaaattgattatagtatat

SEQ ID NO: 84039 - DNA, 20 bp, Artificial Sequence
  chemically synthesized
tgatcttaacaaattgatta

SEQ ID NO: 84040 - DNA, 20 bp, Artificial Sequence
  chemically synthesized
tatactataatcaatttgtt

SEQ ID NO: 84041 - DNA, 20 bp, Artificial Sequence
  chemically synthesized
aatttgttaagatcattaat

SEQ ID NO: 84042 - DNA, 20 bp, Artificial Sequence
  chemically synthesized
ttaagatcattaatcggcca

SEQ ID NO: 84043 - DNA, 20 bp, Artificial Sequence
  chemically synthesized
taagatcattaatcggccac

SEQ ID NO: 84044 - DNA, 20 bp, Artificial Sequence
  chemically synthesized
gccaccatagagcaggcctg

SEQ ID NO: 84045 - DNA, 20 bp, Artificial Sequence
  chemically synthesized
tcggccacaggcctgctcta

SEQ ID NO: 84046 - DNA, 20 bp, Artificial Sequence
  chemically synthesized
tcaaactgccaccatagagc

SEQ ID NO: 84047 - DNA, 20 bp, Artificial Sequence
  chemically synthesized
ctcaaactgccaccatagag

SEQ ID NO: 84048 - DNA, 20 bp, Artificial Sequence
  chemically synthesized
gccacaggcctgctctatgg

SEQ ID NO: 84049 - DNA, 20 bp, Artificial Sequence
  chemically synthesized
actctcaaactgccaccata

SEQ ID NO: 84050 - DNA, 20 bp, Artificial Sequence
  chemically synthesized
acaggcctgctctatggtgg

SEQ ID NO: 84051 - DNA, 20 bp, Artificial Sequence
  chemically synthesized
agactctcaaactgccacca

SEQ ID NO: 84052 - DNA, 20 bp, Artificial Sequence
  chemically synthesized
ctgctctatggtggcagttt

SEQ ID NO: 84053 - DNA, 20 bp, Artificial Sequence
  chemically synthesized
gctctatggtggcagtttga

SEQ ID NO: 84054 - DNA, 20 bp, Artificial Sequence
  chemically synthesized
gcagtttgagagtctctgct

SEQ ID NO: 84055 - DNA, 20 bp, Artificial Sequence
  chemically synthesized
gataataacgatgcttagca

SEQ ID NO: 84056 - DNA, 20 bp, Artificial Sequence
  chemically synthesized
tcgataataacgatgcttag

SEQ ID NO: 84057 - DNA, 20 bp, Artificial Sequence
  chemically synthesized
gcatcgataataacgatgct

SEQ ID NO: 84058 - DNA, 20 bp, Artificial Sequence
  chemically synthesized
aagctatggctatggttttt

SEQ ID NO: 84059 - DNA, 20 bp, Artificial Sequence
  chemically synthesized
ttatcgatgcttaaaaacca

SEQ ID NO: 84060 - DNA, 20 bp, Artificial Sequence
  chemically synthesized
atgcttaaaaaccatagcca

SEQ ID NO: 84061 - DNA, 20 bp, Artificial Sequence
  chemically synthesized
tatatgccaagctatggcta

SEQ ID NO: 84062 - DNA, 20 bp, Artificial Sequence
  chemically synthesized
taaaaaccatagccatagct

SEQ ID NO: 84063 - DNA, 20 bp, Artificial Sequence
  chemically synthesized
atttactatatgccaagcta

SEQ ID NO: 84064 - DNA, 20 bp, Artificial Sequence
  chemically synthesized
catagccatagcttggcata

SEQ ID NO: 84065 - DNA, 20 bp, Artificial Sequence
  chemically synthesized
ctgagcatttactatatgcc

SEQ ID NO: 84066 - DNA, 20 bp, Artificial Sequence
  chemically synthesized
cttggcatatagtaaatgct

SEQ ID NO: 84067 - DNA, 20 bp, Artificial Sequence
  chemically synthesized
cttagtcaacaatgtttact

SEQ ID NO: 84068 - DNA, 20 bp, Artificial Sequence
  chemically synthesized
ctcagtaaacattgttgact

SEQ ID NO: 84069 - DNA, 20 bp, Artificial Sequence
  chemically synthesized
aaacattgttgactaagata

SEQ ID NO: 84070 - DNA, 20 bp, Artificial Sequence
  chemically synthesized
taactgggtgttctgtatct

SEQ ID NO: 84071 - DNA, 20 bp, Artificial Sequence
  chemically synthesized
tgactaagatacagaacacc

SEQ ID NO: 84072 - DNA, 20 bp, Artificial Sequence
  chemically synthesized
taagatacagaacacccagt

SEQ ID NO: 84073 - DNA, 20 bp, Artificial Sequence
  chemically synthesized
cacactctagtgttctaact

SEQ ID NO: 84074 - DNA, 20 bp, Artificial Sequence
  chemically synthesized
acacactctagtgttctaac

SEQ ID NO: 84075 - DNA, 20 bp, Artificial Sequence
  chemically synthesized
agaacacccagttagaacac

SEQ ID NO: 84076 - DNA, 20 bp, Artificial Sequence
  chemically synthesized
aacacccagttagaacacta

SEQ ID NO: 84077 - DNA, 20 bp, Artificial Sequence
  chemically synthesized
ggccttcatataacacactc

SEQ ID NO: 84078 - DNA, 20 bp, Artificial Sequence
  chemically synthesized
acactagagtgtgttatatg

SEQ ID NO: 84079 - DNA, 20 bp, Artificial Sequence
  chemically synthesized
cactagagtgtgttatatga

SEQ ID NO: 84080 - DNA, 20 bp, Artificial Sequence
  chemically synthesized
gagtgtgttatatgaaggcc

SEQ ID NO: 84081 - DNA, 20 bp, Artificial Sequence
  chemically synthesized
gttttgcatctaaatcaact

SEQ ID NO: 84082 - DNA, 20 bp, Artificial Sequence
  chemically synthesized
atatgaaggccaagttgatt

SEQ ID NO: 84083 - DNA, 20 bp, Artificial Sequence
  chemically synthesized
aagttgatttagatgcaaaa

SEQ ID NO: 84084 - DNA, 20 bp, Artificial Sequence
  chemically synthesized
agttgatttagatgcaaaac

SEQ ID NO: 84085 - DNA, 20 bp, Artificial Sequence
  chemically synthesized
ttagatgcaaaacaggcttg

SEQ ID NO: 84086 - DNA, 20 bp, Artificial Sequence
  chemically synthesized
tagatgcaaaacaggcttgc

SEQ ID NO: 84087 - DNA, 20 bp, Artificial Sequence
  chemically synthesized
agatgcaaaacaggcttgca

SEQ ID NO: 84088 - DNA, 20 bp, Artificial Sequence
  chemically synthesized
gatgcaaaacaggcttgcag

SEQ ID NO: 84089 - DNA, 20 bp, Artificial Sequence
  chemically synthesized
gagtccaggctttcccctgc

SEQ ID NO: 84090 - DNA, 20 bp, Artificial Sequence
  chemically synthesized
caaaacaggcttgcagggga

SEQ ID NO: 84091 - DNA, 20 bp, Artificial Sequence
  chemically synthesized
caggcttgcaggggaaagcc

SEQ ID NO: 84092 - DNA, 20 bp, Artificial Sequence
  chemically synthesized
cacttatgattcatgagtcc

SEQ ID NO: 84093 - DNA, 20 bp, Artificial Sequence
  chemically synthesized
tcacttatgattcatgagtc

SEQ ID NO: 84094 - DNA, 20 bp, Artificial Sequence
  chemically synthesized
ttttttcacttatgattcat

SEQ ID NO: 84095 - DNA, 20 bp, Artificial Sequence
  chemically synthesized
agcctggactcatgaatcat

SEQ ID NO: 84096 - DNA, 20 bp, Artificial Sequence
  chemically synthesized
aaaaaattaatgctgtaaat

SEQ ID NO: 84097 - DNA, 20 bp, Artificial Sequence
  chemically synthesized
aaaaattaatgctgtaaatt

SEQ ID NO: 84098 - DNA, 20 bp, Artificial Sequence
  chemically synthesized
tgtccatttttcccaattta

SEQ ID NO: 84099 - DNA, 20 bp, Artificial Sequence
  chemically synthesized
atgctgtaaattgggaaaaa

SEQ ID NO: 84100 - DNA, 20 bp, Artificial Sequence
  chemically synthesized
tgtaaattgggaaaaatgga

SEQ ID NO: 84101 - DNA, 20 bp, Artificial Sequence
  chemically synthesized
aaaatggacagatcttattc

SEQ ID NO: 84102 - DNA, 20 bp, Artificial Sequence
  chemically synthesized
aaatggacagatcttattct

SEQ ID NO: 84103 - DNA, 20 bp, Artificial Sequence
  chemically synthesized
aacatgagtagacctagaat

SEQ ID NO: 84104 - DNA, 20 bp, Artificial Sequence
  chemically synthesized
atctggaacatgagtagacc

SEQ ID NO: 84105 - DNA, 20 bp, Artificial Sequence
  chemically synthesized
ctttggatctggaacatgag

SEQ ID NO: 84106 - DNA, 20 bp, Artificial Sequence
  chemically synthesized
ttctaggtctactcatgttc

SEQ ID NO: 84107 - DNA, 20 bp, Artificial Sequence
  chemically synthesized
cagctttggatctggaacat

SEQ ID NO: 84108 - DNA, 20 bp, Artificial Sequence
  chemically synthesized
ctactcatgttccagatcca

SEQ ID NO: 84109 - DNA, 20 bp, Artificial Sequence
  chemically synthesized
gtgacactcagctttggatc

SEQ ID NO: 84110 - DNA, 20 bp, Artificial Sequence
  chemically synthesized
catgttccagatccaaagct

SEQ ID NO: 84111 - DNA, 20 bp, Artificial Sequence
  chemically synthesized
tcagcagtgacactcagctt

SEQ ID NO: 84112 - DNA, 20 bp, Artificial Sequence
  chemically synthesized
agtaactcagcagtgacact

SEQ ID NO: 84113 - DNA, 20 bp, Artificial Sequence
  chemically synthesized
caaagctgagtgtcactgct

SEQ ID NO: 84114 - DNA, 20 bp, Artificial Sequence
  chemically synthesized
aattccacccagtaactcag

SEQ ID NO: 84115 - DNA, 20 bp, Artificial Sequence
  chemically synthesized
gagtgtcactgctgagttac

SEQ ID NO: 84116 - DNA, 20 bp, Artificial Sequence
  chemically synthesized
agtgtcactgctgagttact

SEQ ID NO: 84117 - DNA, 20 bp, Artificial Sequence
  chemically synthesized
ggaaattccacccagtaact

SEQ ID NO: 84118 - DNA, 20 bp, Artificial Sequence
  chemically synthesized
gtcactgctgagttactggg

SEQ ID NO: 84119 - DNA, 20 bp, Artificial Sequence
  chemically synthesized
cttcttgaggaaattccacc

SEQ ID NO: 84120 - DNA, 20 bp, Artificial Sequence
  chemically synthesized
ttactgggtggaatttcctc

SEQ ID NO: 84121 - DNA, 20 bp, Artificial Sequence
  chemically synthesized
ctgggtggaatttcctcaag

SEQ ID NO: 84122 - DNA, 20 bp, Artificial Sequence
  chemically synthesized
ggtggaatttcctcaagaag

SEQ ID NO: 84123 - DNA, 20 bp, Artificial Sequence
  chemically synthesized
gctaatgggaccacttcttg

SEQ ID NO: 84124 - DNA, 20 bp, Artificial Sequence
  chemically synthesized
tgctaatgggaccacttctt

SEQ ID NO: 84125 - DNA, 20 bp, Artificial Sequence
  chemically synthesized
tcctcaagaagtggtcccat

SEQ ID NO: 84126 - DNA, 20 bp, Artificial Sequence
  chemically synthesized
ttgaagaaggcaatgctaat

SEQ ID NO: 84127 - DNA, 20 bp, Artificial Sequence
  chemically synthesized
gttgaagaaggcaatgctaa

SEQ ID NO: 84128 - DNA, 20 bp, Artificial Sequence
  chemically synthesized
agaaatcactaggttgaaga

SEQ ID NO: 84129 - DNA, 20 bp, Artificial Sequence
  chemically synthesized
aagaaatcactaggttgaag

SEQ ID NO: 84130 - DNA, 20 bp, Artificial Sequence
  chemically synthesized
tagcattgccttcttcaacc

SEQ ID NO: 84131 - DNA, 20 bp, Artificial Sequence
  chemically synthesized
tttaagaaatcactaggttg

SEQ ID NO: 84132 - DNA, 20 bp, Artificial Sequence
  chemically synthesized
atctcctttaagaaatcact

SEQ ID NO: 84133 - DNA, 20 bp, Artificial Sequence
  chemically synthesized
aatctcctttaagaaatcac

SEQ ID NO: 84134 - DNA, 20 bp, Artificial Sequence
  chemically synthesized
ttcaacctagtgatttctta

SEQ ID NO: 84135 - DNA, 20 bp, Artificial Sequence
  chemically synthesized
tcaacctagtgatttcttaa

SEQ ID NO: 84136 - DNA, 20 bp, Artificial Sequence
  chemically synthesized
aacctagtgatttcttaaag

SEQ ID NO: 84137 - DNA, 20 bp, Artificial Sequence
  chemically synthesized
tggacatgaaaatctccttt

SEQ ID NO: 84138 - DNA, 20 bp, Artificial Sequence
  chemically synthesized
gattttcatgtccaaacact

SEQ ID NO: 84139 - DNA, 20 bp, Artificial Sequence
  chemically synthesized
ccatggaacttctgagtgtt

SEQ ID NO: 84140 - DNA, 20 bp, Artificial Sequence
  chemically synthesized
tttcatgtccaaacactcag

SEQ ID NO: 84141 - DNA, 20 bp, Artificial Sequence
  chemically synthesized
gttcaaaccatggaacttct

SEQ ID NO: 84142 - DNA, 20 bp, Artificial Sequence
  chemically synthesized
ccaaacactcagaagttcca

SEQ ID NO: 84143 - DNA, 20 bp, Artificial Sequence
  chemically synthesized
ccaagcagcagttcaaacca

SEQ ID NO: 84144 - DNA, 20 bp, Artificial Sequence
  chemically synthesized
ccatggtttgaactgctgct

SEQ ID NO: 84145 - DNA, 20 bp, Artificial Sequence
  chemically synthesized
catggtttgaactgctgctt

SEQ ID NO: 84146 - DNA, 20 bp, Artificial Sequence
  chemically synthesized
atggtttgaactgctgcttg

SEQ ID NO: 84147 - DNA, 20 bp, Artificial Sequence
  chemically synthesized
acagaaaaagccccaagcag

SEQ ID NO: 84148 - DNA, 20 bp, Artificial Sequence
  chemically synthesized
actacagaaaaagccccaag

SEQ ID NO: 84149 - DNA, 20 bp, Artificial Sequence
  chemically synthesized
cagactacagaaaaagcccc

SEQ ID NO: 84150 - DNA, 20 bp, Artificial Sequence
  chemically synthesized
gctgcttggggctttttctg

SEQ ID NO: 84151 - DNA, 20 bp, Artificial Sequence
  chemically synthesized
aatcctgcagactacagaaa

SEQ ID NO: 84152 - DNA, 20 bp, Artificial Sequence
  chemically synthesized
ggggctttttctgtagtctg

SEQ ID NO: 84153 - DNA, 20 bp, Artificial Sequence
  chemically synthesized
ctacctaatcctgcagacta

SEQ ID NO: 84154 - DNA, 20 bp, Artificial Sequence
  chemically synthesized
gggctttttctgtagtctgc

SEQ ID NO: 84155 - DNA, 20 bp, Artificial Sequence
  chemically synthesized
ttttctgtagtctgcaggat

SEQ ID NO: 84156 - DNA, 20 bp, Artificial Sequence
  chemically synthesized
tttctgtagtctgcaggatt

SEQ ID NO: 84157 - DNA, 20 bp, Artificial Sequence
  chemically synthesized
tcatctcctacctaatcctg

SEQ ID NO: 84158 - DNA, 20 bp, Artificial Sequence
  chemically synthesized
ctgtagtctgcaggattagg

SEQ ID NO: 84159 - DNA, 20 bp, Artificial Sequence
  chemically synthesized
tgtagtctgcaggattaggt

SEQ ID NO: 84160 - DNA, 20 bp, Artificial Sequence
  chemically synthesized
tagtctgcaggattaggtag

SEQ ID NO: 84161 - DNA, 20 bp, Artificial Sequence
  chemically synthesized
tgcaggattaggtaggagat

SEQ ID NO: 84162 - DNA, 20 bp, Artificial Sequence
  chemically synthesized
caggattaggtaggagatga

SEQ ID NO: 84163 - DNA, 20 bp, Artificial Sequence
  chemically synthesized
aggattaggtaggagatgag

SEQ ID NO: 84164 - DNA, 20 bp, Artificial Sequence
  chemically synthesized
ggtaggagatgagaggacac

SEQ ID NO: 84165 - DNA, 20 bp, Artificial Sequence
  chemically synthesized
ggagatgagaggacactaga

SEQ ID NO: 84166 - DNA, 20 bp, Artificial Sequence
  chemically synthesized
gagatgagaggacactagac

SEQ ID NO: 84167 - DNA, 20 bp, Artificial Sequence
  chemically synthesized
cctacatttcagagcctgtc

SEQ ID NO: 84168 - DNA, 20 bp, Artificial Sequence
  chemically synthesized
actagacaggctctgaaatg

SEQ ID NO: 84169 - DNA, 20 bp, Artificial Sequence
  chemically synthesized
ttggatcatcctacatttca

SEQ ID NO: 84170 - DNA, 20 bp, Artificial Sequence
  chemically synthesized
ctagacaggctctgaaatgt

SEQ ID NO: 84171 - DNA, 20 bp, Artificial Sequence
  chemically synthesized
tgttggatcatcctacattt

SEQ ID NO: 84172 - DNA, 20 bp, Artificial Sequence
  chemically synthesized
tgaaatgtaggatgatccaa

SEQ ID NO: 84173 - DNA, 20 bp, Artificial Sequence
  chemically synthesized
tgttgaatgaacagaactgt

SEQ ID NO: 84174 - DNA, 20 bp, Artificial Sequence
  chemically synthesized
gtatccatttgttgaatgaa

SEQ ID NO: 84175 - DNA, 20 bp, Artificial Sequence
  chemically synthesized
agttctgttcattcaacaaa

SEQ ID NO: 84176 - DNA, 20 bp, Artificial Sequence
  chemically synthesized
tcattcaacaaatggatacc

SEQ ID NO: 84177 - DNA, 20 bp, Artificial Sequence
  chemically synthesized
ttcaacaaatggataccgag

SEQ ID NO: 84178 - DNA, 20 bp, Artificial Sequence
  chemically synthesized
tcaacaaatggataccgagc

SEQ ID NO: 84179 - DNA, 20 bp, Artificial Sequence
  chemically synthesized
catcttgttctatgcctgct

SEQ ID NO: 84180 - DNA, 20 bp, Artificial Sequence
  chemically synthesized
aaatggataccgagcaggca

SEQ ID NO: 84181 - DNA, 20 bp, Artificial Sequence
  chemically synthesized
ataccgagcaggcatagaac

SEQ ID NO: 84182 - DNA, 20 bp, Artificial Sequence
  chemically synthesized
ggcatagaacaagatgttaa

SEQ ID NO: 84183 - DNA, 20 bp, Artificial Sequence
  chemically synthesized
agtaaatacagatcaagtta

SEQ ID NO: 84184 - DNA, 20 bp, Artificial Sequence
  chemically synthesized
aaaactagtaaatacagatc

SEQ ID NO: 84185 - DNA, 20 bp, Artificial Sequence
  chemically synthesized
gtaacttgatctgtatttac

SEQ ID NO: 84186 - DNA, 20 bp, Artificial Sequence
  chemically synthesized
gatggcaaaactagtaaata

SEQ ID NO: 84187 - DNA, 20 bp, Artificial Sequence
  chemically synthesized
atgacgtaggatggcaaaac

SEQ ID NO: 84188 - DNA, 20 bp, Artificial Sequence
  chemically synthesized
acaagaatgatgacgtagga

SEQ ID NO: 84189 - DNA, 20 bp, Artificial Sequence
  chemically synthesized
aggaacaagaatgatgacgt

SEQ ID NO: 84190 - DNA, 20 bp, Artificial Sequence
  chemically synthesized
caggaacaagaatgatgacg

SEQ ID NO: 84191 - DNA, 20 bp, Artificial Sequence
  chemically synthesized
ggtagaaataacacaggaac

SEQ ID NO: 84192 - DNA, 20 bp, Artificial Sequence
  chemically synthesized
aaataaggtagaaataacac

SEQ ID NO: 84193 - DNA, 20 bp, Artificial Sequence
  chemically synthesized
aaaataaggtagaaataaca

SEQ ID NO: 84194 - DNA, 20 bp, Artificial Sequence
  chemically synthesized
aggagacataaaaaataagg

SEQ ID NO: 84195 - DNA, 20 bp, Artificial Sequence
  chemically synthesized
tacaggagacataaaaaata

SEQ ID NO: 84196 - DNA, 20 bp, Artificial Sequence
  chemically synthesized
atacaggagacataaaaaat

SEQ ID NO: 84197 - DNA, 20 bp, Artificial Sequence
  chemically synthesized
cagacatagaaacaatacag

SEQ ID NO: 84198 - DNA, 20 bp, Artificial Sequence
  chemically synthesized
gtcagacatagaaacaatac

SEQ ID NO: 84199 - DNA, 20 bp, Artificial Sequence
  chemically synthesized
tgtcagacatagaaacaata

SEQ ID NO: 84200 - DNA, 20 bp, Artificial Sequence
  chemically synthesized
agcaactttcttgtcagaca

SEQ ID NO: 84201 - DNA, 20 bp, Artificial Sequence
  chemically synthesized
gtattgtttctatgtctgac

SEQ ID NO: 84202 - DNA, 20 bp, Artificial Sequence
  chemically synthesized
tgtttctatgtctgacaaga

SEQ ID NO: 84203 - DNA, 20 bp, Artificial Sequence
  chemically synthesized
atattcagcaactttcttgt

SEQ ID NO: 84204 - DNA, 20 bp, Artificial Sequence
  chemically synthesized
ttttggtgacagaatatatt

SEQ ID NO: 84205 - DNA, 20 bp, Artificial Sequence
  chemically synthesized
tgaatatattctgtcaccaa

SEQ ID NO: 84206 - DNA, 20 bp, Artificial Sequence
  chemically synthesized
aaagaaggtccttttggtga

SEQ ID NO: 84207 - DNA, 20 bp, Artificial Sequence
  chemically synthesized
gaatatattctgtcaccaaa

SEQ ID NO: 84208 - DNA, 20 bp, Artificial Sequence
  chemically synthesized
ttaaataaagaaggtccttt

SEQ ID NO: 84209 - DNA, 20 bp, Artificial Sequence
  chemically synthesized
ggtggctctttaaataaaga

SEQ ID NO: 84210 - DNA, 20 bp, Artificial Sequence
  chemically synthesized
tggtggctctttaaataaag

SEQ ID NO: 84211 - DNA, 20 bp, Artificial Sequence
  chemically synthesized
aaaaggaccttctttattta

SEQ ID NO: 84212 - DNA, 20 bp, Artificial Sequence
  chemically synthesized
atatggtggctctttaaata

SEQ ID NO: 84213 - DNA, 20 bp, Artificial Sequence
  chemically synthesized
aaggaccttctttatttaaa

SEQ ID NO: 84214 - DNA, 20 bp, Artificial Sequence
  chemically synthesized
ttgagactcaataaatatgg

SEQ ID NO: 84215 - DNA, 20 bp, Artificial Sequence
  chemically synthesized
tgtttgagactcaataaata

SEQ ID NO: 84216 - DNA, 20 bp, Artificial Sequence
  chemically synthesized
aaagagccaccatatttatt

SEQ ID NO: 84217 - DNA, 20 bp, Artificial Sequence
  chemically synthesized
taaaatattcttatgtgttt

SEQ ID NO: 84218 - DNA, 20 bp, Artificial Sequence
  chemically synthesized
ttattgagtctcaaacacat

SEQ ID NO: 84219 - DNA, 20 bp, Artificial Sequence
  chemically synthesized
cttgtcccgaagtgagcatt

SEQ ID NO: 84220 - DNA, 20 bp, Artificial Sequence
  chemically synthesized
attttaccaaatgctcactt

SEQ ID NO: 84221 - DNA, 20 bp, Artificial Sequence
  chemically synthesized
ttttaccaaatgctcacttc

SEQ ID NO: 84222 - DNA, 20 bp, Artificial Sequence
  chemically synthesized
agcattgcttgtcccgaagt

SEQ ID NO: 84223 - DNA, 20 bp, Artificial Sequence
  chemically synthesized
ccaaatgctcacttcgggac

SEQ ID NO: 84224 - DNA, 20 bp, Artificial Sequence
  chemically synthesized
actgagcattgcttgtcccg

SEQ ID NO: 84225 - DNA, 20 bp, Artificial Sequence
  chemically synthesized
acttcgggacaagcaatgct

SEQ ID NO: 84226 - DNA, 20 bp, Artificial Sequence
  chemically synthesized
acctcgcttttaagttaact

SEQ ID NO: 84227 - DNA, 20 bp, Artificial Sequence
  chemically synthesized
gcaatgctcagttaacttaa

SEQ ID NO: 84228 - DNA, 20 bp, Artificial Sequence
  chemically synthesized
tgctcagttaacttaaaagc

SEQ ID NO: 84229 - DNA, 20 bp, Artificial Sequence
  chemically synthesized
gctcagttaacttaaaagcg

SEQ ID NO: 84230 - DNA, 20 bp, Artificial Sequence
  chemically synthesized
ttttccaagacctcgctttt

SEQ ID NO: 84231 - DNA, 20 bp, Artificial Sequence
  chemically synthesized
ttaacttaaaagcgaggtct

SEQ ID NO: 84232 - DNA, 20 bp, Artificial Sequence
  chemically synthesized
ttaaaagcgaggtcttggaa

SEQ ID NO: 84233 - DNA, 20 bp, Artificial Sequence
  chemically synthesized
taaaagcgaggtcttggaaa

SEQ ID NO: 84234 - DNA, 20 bp, Artificial Sequence
  chemically synthesized
aaaagcgaggtcttggaaaa

SEQ ID NO: 84235 - DNA, 20 bp, Artificial Sequence
  chemically synthesized
tggattgcttgcccttttcc

SEQ ID NO: 84236 - DNA, 20 bp, Artificial Sequence
  chemically synthesized
gcgaggtcttggaaaagggc

SEQ ID NO: 84237 - DNA, 20 bp, Artificial Sequence
  chemically synthesized
ttggaaaagggcaagcaatc

SEQ ID NO: 84238 - DNA, 20 bp, Artificial Sequence
  chemically synthesized
tggaaaagggcaagcaatcc

SEQ ID NO: 84239 - DNA, 20 bp, Artificial Sequence
  chemically synthesized
ccaccctgccatgtacatcc

SEQ ID NO: 84240 - DNA, 20 bp, Artificial Sequence
  chemically synthesized
caagcaatccaggatgtaca

SEQ ID NO: 84241 - DNA, 20 bp, Artificial Sequence
  chemically synthesized
gcaatccaggatgtacatgg

SEQ ID NO: 84242 - DNA, 20 bp, Artificial Sequence
  chemically synthesized
caatccaggatgtacatggc

SEQ ID NO: 84243 - DNA, 20 bp, Artificial Sequence
  chemically synthesized
aatccaggatgtacatggca

SEQ ID NO: 84244 - DNA, 20 bp, Artificial Sequence
  chemically synthesized
ccaggatgtacatggcaggg

SEQ ID NO: 84245 - DNA, 20 bp, Artificial Sequence
  chemically synthesized
gatgtacatggcagggtggc

SEQ ID NO: 84246 - DNA, 20 bp, Artificial Sequence
  chemically synthesized
ggtggcaagaatattgcccc

SEQ ID NO: 84247 - DNA, 20 bp, Artificial Sequence
  chemically synthesized
aatttgctttagattactgg

SEQ ID NO: 84248 - DNA, 20 bp, Artificial Sequence
  chemically synthesized
gaatttgctttagattactg

SEQ ID NO: 84249 - DNA, 20 bp, Artificial Sequence
  chemically synthesized
tgaatttgctttagattact

SEQ ID NO: 84250 - DNA, 20 bp, Artificial Sequence
  chemically synthesized
atgaatttgctttagattac

SEQ ID NO: 84251 - DNA, 20 bp, Artificial Sequence
  chemically synthesized
atattgcccccagtaatcta

SEQ ID NO: 84252 - DNA, 20 bp, Artificial Sequence
  chemically synthesized
gaacccctatgaatttgctt

SEQ ID NO: 84253 - DNA, 20 bp, Artificial Sequence
  chemically synthesized
agtaatctaaagcaaattca

SEQ ID NO: 84254 - DNA, 20 bp, Artificial Sequence
  chemically synthesized
gtaatctaaagcaaattcat

SEQ ID NO: 84255 - DNA, 20 bp, Artificial Sequence
  chemically synthesized
taatctaaagcaaattcata

SEQ ID NO: 84256 - DNA, 20 bp, Artificial Sequence
  chemically synthesized
aatctaaagcaaattcatag

SEQ ID NO: 84257 - DNA, 20 bp, Artificial Sequence
  chemically synthesized
agcaaattcataggggttca

SEQ ID NO: 84258 - DNA, 20 bp, Artificial Sequence
  chemically synthesized
aaattcataggggttcatgg

SEQ ID NO: 84259 - DNA, 20 bp, Artificial Sequence
  chemically synthesized
tcatggaagaaaaaaatttg

SEQ ID NO: 84260 - DNA, 20 bp, Artificial Sequence
  chemically synthesized
ggaagaaaaaaatttgaaga

SEQ ID NO: 84261 - DNA, 20 bp, Artificial Sequence
  chemically synthesized
aagaaaaaaatttgaagaaa

SEQ ID NO: 84262 - DNA, 20 bp, Artificial Sequence
  chemically synthesized
agaaaaaaatttgaagaaag

SEQ ID NO: 84263 - DNA, 20 bp, Artificial Sequence
  chemically synthesized
aaatttgaagaaagaggcaa

SEQ ID NO: 84264 - DNA, 20 bp, Artificial Sequence
  chemically synthesized
atttgaagaaagaggcaatg

SEQ ID NO: 84265 - DNA, 20 bp, Artificial Sequence
  chemically synthesized
agaggcaatggagcaaacaa

SEQ ID NO: 84266 - DNA, 20 bp, Artificial Sequence
  chemically synthesized
gcaatggagcaaacaacaga

SEQ ID NO: 84267 - DNA, 20 bp, Artificial Sequence
  chemically synthesized
aatggagcaaacaacagaaa

SEQ ID NO: 84268 - DNA, 20 bp, Artificial Sequence
  chemically synthesized
tggagcaaacaacagaaaga

SEQ ID NO: 84269 - DNA, 20 bp, Artificial Sequence
  chemically synthesized
ggagcaaacaacagaaagag

SEQ ID NO: 84270 - DNA, 20 bp, Artificial Sequence
  chemically synthesized
gaaagagaggtttcccttaa

SEQ ID NO: 84271 - DNA, 20 bp, Artificial Sequence
  chemically synthesized
ctgtctcaaatgactattaa

SEQ ID NO: 84272 - DNA, 20 bp, Artificial Sequence
  chemically synthesized
gctgtctcaaatgactatta

SEQ ID NO: 84273 - DNA, 20 bp, Artificial Sequence
  chemically synthesized
agctgtctcaaatgactatt

SEQ ID NO: 84274 - DNA, 20 bp, Artificial Sequence
  chemically synthesized
gtttcccttaatagtcattt

SEQ ID NO: 84275 - DNA, 20 bp, Artificial Sequence
  chemically synthesized
cccttaatagtcatttgaga

SEQ ID NO: 84276 - DNA, 20 bp, Artificial Sequence
  chemically synthesized
taatagtcatttgagacagc

SEQ ID NO: 84277 - DNA, 20 bp, Artificial Sequence
  chemically synthesized
atttgagacagctagtatta

SEQ ID NO: 84278 - DNA, 20 bp, Artificial Sequence
  chemically synthesized
gttcataacttctgtaatac

SEQ ID NO: 84279 - DNA, 20 bp, Artificial Sequence
  chemically synthesized
tgagacagctagtattacag

SEQ ID NO: 84280 - DNA, 20 bp, Artificial Sequence
  chemically synthesized
tattacagaagttatgaaca

SEQ ID NO: 84281 - DNA, 20 bp, Artificial Sequence
  chemically synthesized
attacagaagttatgaacat

SEQ ID NO: 84282 - DNA, 20 bp, Artificial Sequence
  chemically synthesized
aagttatgaacatgggtatc

SEQ ID NO: 84283 - DNA, 20 bp, Artificial Sequence
  chemically synthesized
agttatgaacatgggtatct

SEQ ID NO: 84284 - DNA, 20 bp, Artificial Sequence
  chemically synthesized
acatgggtatctgggctata

SEQ ID NO: 84285 - DNA, 20 bp, Artificial Sequence
  chemically synthesized
atggccttttctttatagcc

SEQ ID NO: 84286 - DNA, 20 bp, Artificial Sequence
  chemically synthesized
ggtatctgggctataaagaa

SEQ ID NO: 84287 - DNA, 20 bp, Artificial Sequence
  chemically synthesized
tgattatggccttttcttta

SEQ ID NO: 84288 - DNA, 20 bp, Artificial Sequence
  chemically synthesized
gtatctgggctataaagaaa

SEQ ID NO: 84289 - DNA, 20 bp, Artificial Sequence
  chemically synthesized
tcaataagaaaagatgatta

SEQ ID NO: 84290 - DNA, 20 bp, Artificial Sequence
  chemically synthesized
tgttcttatctcaataagaa

SEQ ID NO: 84291 - DNA, 20 bp, Artificial Sequence
  chemically synthesized
cataatcatcttttcttatt

SEQ ID NO: 84292 - DNA, 20 bp, Artificial Sequence
  chemically synthesized
ttaagtgttcttatctcaat

SEQ ID NO: 84293 - DNA, 20 bp, Artificial Sequence
  chemically synthesized
tcatcttttcttattgagat

SEQ ID NO: 84294 - DNA, 20 bp, Artificial Sequence
  chemically synthesized
aacagggtaaagttcatatt

SEQ ID NO: 84295 - DNA, 20 bp, Artificial Sequence
  chemically synthesized
aaaaatgtgttaacagggta

SEQ ID NO: 84296 - DNA, 20 bp, Artificial Sequence
  chemically synthesized
aaaaaaaaaatgtgttaaca

SEQ ID NO: 84297 - DNA, 20 bp, Artificial Sequence
  chemically synthesized
aaaaaaaaaaatgtgttaac

SEQ ID NO: 84298 - DNA, 20 bp, Artificial Sequence
  chemically synthesized
aaaaaaaaaaaatgtgttaa

SEQ ID NO: 84299 - DNA, 20 bp, Artificial Sequence
  chemically synthesized
acacattttttttttttttt

SEQ ID NO: 84300 - DNA, 20 bp, Artificial Sequence
  chemically synthesized
atttttttttttttttgaga

SEQ ID NO: 84301 - DNA, 20 bp, Artificial Sequence
  chemically synthesized
ttttttttttttttgagacg

SEQ ID NO: 84302 - DNA, 20 bp, Artificial Sequence
  chemically synthesized
tccagcctgagtgacagagc

SEQ ID NO: 84303 - DNA, 20 bp, Artificial Sequence
  chemically synthesized
cggagtctcgctctgtcact

SEQ ID NO: 84304 - DNA, 20 bp, Artificial Sequence
  chemically synthesized
gcactccagcctgagtgaca

SEQ ID NO: 84305 - DNA, 20 bp, Artificial Sequence
  chemically synthesized
ggagtctcgctctgtcactc

SEQ ID NO: 84306 - DNA, 20 bp, Artificial Sequence
  chemically synthesized
ctgcactccagcctgagtga

SEQ ID NO: 84307 - DNA, 20 bp, Artificial Sequence
  chemically synthesized
tctcgctctgtcactcaggc

SEQ ID NO: 84308 - DNA, 20 bp, Artificial Sequence
  chemically synthesized
tcgctctgtcactcaggctg

SEQ ID NO: 84309 - DNA, 20 bp, Artificial Sequence
  chemically synthesized
gcaccactgcactccagcct

SEQ ID NO: 84310 - DNA, 20 bp, Artificial Sequence
  chemically synthesized
ctgtcactcaggctggagtg

SEQ ID NO: 84311 - DNA, 20 bp, Artificial Sequence
  chemically synthesized
gatcgcgcaccactgcactc

SEQ ID NO: 84312 - DNA, 20 bp, Artificial Sequence
  chemically synthesized
tcactcaggctggagtgcag

SEQ ID NO: 84313 - DNA, 20 bp, Artificial Sequence
  chemically synthesized
agtgcagtggtgcgcgatct

SEQ ID NO: 84314 - DNA, 20 bp, Artificial Sequence
  chemically synthesized
gacggagcttgcagtgagcc

SEQ ID NO: 84315 - DNA, 20 bp, Artificial Sequence
  chemically synthesized
gcgcgatctcggctcactgc

SEQ ID NO: 84316 - DNA, 20 bp, Artificial Sequence
  chemically synthesized
tgggagacggagcttgcagt

SEQ ID NO: 84317 - DNA, 20 bp, Artificial Sequence
  chemically synthesized
aacctgggagacggagcttg

SEQ ID NO: 84318 - DNA, 20 bp, Artificial Sequence
  chemically synthesized
tcactgcaagctccgtctcc

SEQ ID NO: 84319 - DNA, 20 bp, Artificial Sequence
  chemically synthesized
tggcgtgaacctgggagacg

SEQ ID NO: 84320 - DNA, 20 bp, Artificial Sequence
  chemically synthesized
cactgcaagctccgtctccc

SEQ ID NO: 84321 - DNA, 20 bp, Artificial Sequence
  chemically synthesized
aatggcgtgaacctgggaga

SEQ ID NO: 84322 - DNA, 20 bp, Artificial Sequence
  chemically synthesized
ggagaatggcgtgaacctgg

SEQ ID NO: 84323 - DNA, 20 bp, Artificial Sequence
  chemically synthesized
caggagaatggcgtgaacct

SEQ ID NO: 84324 - DNA, 20 bp, Artificial Sequence
  chemically synthesized
gcaggagaatggcgtgaacc

SEQ ID NO: 84325 - DNA, 20 bp, Artificial Sequence
  chemically synthesized
gggaggctgaggcaggagaa

SEQ ID NO: 84326 - DNA, 20 bp, Artificial Sequence
  chemically synthesized
ttcacgccattctcctgcct

SEQ ID NO: 84327 - DNA, 20 bp, Artificial Sequence
  chemically synthesized
tactcgggaggctgaggcag

SEQ ID NO: 84328 - DNA, 20 bp, Artificial Sequence
  chemically synthesized
gctactcgggaggctgaggc

SEQ ID NO: 84329 - DNA, 20 bp, Artificial Sequence
  chemically synthesized
agctactcgggaggctgagg

SEQ ID NO: 84330 - DNA, 20 bp, Artificial Sequence
  chemically synthesized
cccagctactcgggaggctg

SEQ ID NO: 84331 - DNA, 20 bp, Artificial Sequence
  chemically synthesized
tcccagctactcgggaggct

SEQ ID NO: 84332 - DNA, 20 bp, Artificial Sequence
  chemically synthesized
ttctcctgcctcagcctccc

SEQ ID NO: 84333 - DNA, 20 bp, Artificial Sequence
  chemically synthesized
tcctgcctcagcctcccgag

SEQ ID NO: 84334 - DNA, 20 bp, Artificial Sequence
  chemically synthesized
tgtagtcccagctactcggg

SEQ ID NO: 84335 - DNA, 20 bp, Artificial Sequence
  chemically synthesized
ctgtagtcccagctactcgg

SEQ ID NO: 84336 - DNA, 20 bp, Artificial Sequence
  chemically synthesized
gcctcagcctcccgagtagc

SEQ ID NO: 84337 - DNA, 20 bp, Artificial Sequence
  chemically synthesized
acctgtagtcccagctactc

SEQ ID NO: 84338 - DNA, 20 bp, Artificial Sequence
  chemically synthesized
cctcagcctcccgagtagct

SEQ ID NO: 84339 - DNA, 20 bp, Artificial Sequence
  chemically synthesized
cacctgtagtcccagctact

SEQ ID NO: 84340 - DNA, 20 bp, Artificial Sequence
  chemically synthesized
ctcccgagtagctgggacta

SEQ ID NO: 84341 - DNA, 20 bp, Artificial Sequence
  chemically synthesized
tcccgagtagctgggactac

SEQ ID NO: 84342 - DNA, 20 bp, Artificial Sequence
  chemically synthesized
gtagcaggcacctgtagtcc

SEQ ID NO: 84343 - DNA, 20 bp, Artificial Sequence
  chemically synthesized
ggcatggtagcaggcacctg

SEQ ID NO: 84344 - DNA, 20 bp, Artificial Sequence
  chemically synthesized
aattagccgggcatggtagc

SEQ ID NO: 84345 - DNA, 20 bp, Artificial Sequence
  chemically synthesized
aaattagccgggcatggtag

SEQ ID NO: 84346 - DNA, 20 bp, Artificial Sequence
  chemically synthesized
caggtgcctgctaccatgcc

SEQ ID NO: 84347 - DNA, 20 bp, Artificial Sequence
  chemically synthesized
aaaaaattagccgggcatgg

SEQ ID NO: 84348 - DNA, 20 bp, Artificial Sequence
  chemically synthesized
aagaaaaaattagccgggca

SEQ ID NO: 84349 - DNA, 20 bp, Artificial Sequence
  chemically synthesized
aaaaaaagaaaaaattagcc

SEQ ID NO: 84350 - DNA, 20 bp, Artificial Sequence
  chemically synthesized
caaaaaaagaaaaaattagc

SEQ ID NO: 84351 - DNA, 20 bp, Artificial Sequence
  chemically synthesized
aatacaaaaaaagaaaaaat

SEQ ID NO: 84352 - DNA, 20 bp, Artificial Sequence
  chemically synthesized
ctctactaaaaatacaaaaa

SEQ ID NO: 84353 - DNA, 20 bp, Artificial Sequence
  chemically synthesized
tttttctttttttgtatttt

SEQ ID NO: 84354 - DNA, 20 bp, Artificial Sequence
  chemically synthesized
ttctttttttgtatttttag

SEQ ID NO: 84355 - DNA, 20 bp, Artificial Sequence
  chemically synthesized
ctttttttgtatttttagta

SEQ ID NO: 84356 - DNA, 20 bp, Artificial Sequence
  chemically synthesized
ttttgtatttttagtagaga

SEQ ID NO: 84357 - DNA, 20 bp, Artificial Sequence
  chemically synthesized
tttgtatttttagtagagat

SEQ ID NO: 84358 - DNA, 20 bp, Artificial Sequence
  chemically synthesized
ttgtatttttagtagagatg

SEQ ID NO: 84359 - DNA, 20 bp, Artificial Sequence
  chemically synthesized
gagatggggtttcaccgtgt

SEQ ID NO: 84360 - DNA, 20 bp, Artificial Sequence
  chemically synthesized
tggggtttcaccgtgttagc

SEQ ID NO: 84361 - DNA, 20 bp, Artificial Sequence
  chemically synthesized
caagaccatcctggctaaca

SEQ ID NO: 84362 - DNA, 20 bp, Artificial Sequence
  chemically synthesized
ggggtttcaccgtgttagcc

SEQ ID NO: 84363 - DNA, 20 bp, Artificial Sequence
  chemically synthesized
tttcaccgtgttagccagga

SEQ ID NO: 84364 - DNA, 20 bp, Artificial Sequence
  chemically synthesized
tccggagatcaagaccatcc

SEQ ID NO: 84365 - DNA, 20 bp, Artificial Sequence
  chemically synthesized
gccaggatggtcttgatctc

SEQ ID NO: 84366 - DNA, 20 bp, Artificial Sequence
  chemically synthesized
ttaaccgaggtccggagatc

SEQ ID NO: 84367 - DNA, 20 bp, Artificial Sequence
  chemically synthesized
tggtcttgatctccggacct

SEQ ID NO: 84368 - DNA, 20 bp, Artificial Sequence
  chemically synthesized
aatgtgttaaccgaggtccg

SEQ ID NO: 84369 - DNA, 20 bp, Artificial Sequence
  chemically synthesized
aaaatgtgttaaccgaggtc

SEQ ID NO: 84370 - DNA, 20 bp, Artificial Sequence
  chemically synthesized
acttaaaaatgtgttaaccg

SEQ ID NO: 84371 - DNA, 20 bp, Artificial Sequence
  chemically synthesized
cacttaaaaatgtgttaacc

SEQ ID NO: 84372 - DNA, 20 bp, Artificial Sequence
  chemically synthesized
acctcggttaacacattttt

SEQ ID NO: 84373 - DNA, 20 bp, Artificial Sequence
  chemically synthesized
acatttttaagtgcacaaat

SEQ ID NO: 84374 - DNA, 20 bp, Artificial Sequence
  chemically synthesized
caaatcggtattgttaacta

SEQ ID NO: 84375 - DNA, 20 bp, Artificial Sequence
  chemically synthesized
aaatcggtattgttaactat

SEQ ID NO: 84376 - DNA, 20 bp, Artificial Sequence
  chemically synthesized
gctgcataacattgtgccta

SEQ ID NO: 84377 - DNA, 20 bp, Artificial Sequence
  chemically synthesized
actataggcacaatgttatg

SEQ ID NO: 84378 - DNA, 20 bp, Artificial Sequence
  chemically synthesized
ataggcacaatgttatgcag

SEQ ID NO: 84379 - DNA, 20 bp, Artificial Sequence
  chemically synthesized
aatgttatgcagcagacctc

SEQ ID NO: 84380 - DNA, 20 bp, Artificial Sequence
  chemically synthesized
gcaagatgaaaaagttctag

SEQ ID NO: 84381 - DNA, 20 bp, Artificial Sequence
  chemically synthesized
tgcaagatgaaaaagttcta

SEQ ID NO: 84382 - DNA, 20 bp, Artificial Sequence
  chemically synthesized
tatgcaagatgaaaaagttc

SEQ ID NO: 84383 - DNA, 20 bp, Artificial Sequence
  chemically synthesized
ttcagttatgcaagatgaaa

SEQ ID NO: 84384 - DNA, 20 bp, Artificial Sequence
  chemically synthesized
atataaagtttcagttatgc

SEQ ID NO: 84385 - DNA, 20 bp, Artificial Sequence
  chemically synthesized
gctcaatggatataaagttt

SEQ ID NO: 84386 - DNA, 20 bp, Artificial Sequence
  chemically synthesized
gttgttgctcaatggatata

SEQ ID NO: 84387 - DNA, 20 bp, Artificial Sequence
  chemically synthesized
actgaaactttatatccatt

SEQ ID NO: 84388 - DNA, 20 bp, Artificial Sequence
  chemically synthesized
aagggcgagttgttgctcaa

SEQ ID NO: 84389 - DNA, 20 bp, Artificial Sequence
  chemically synthesized
ttgccatacattgtaagggc

SEQ ID NO: 84390 - DNA, 20 bp, Artificial Sequence
  chemically synthesized
atggttgccatacattgtaa

SEQ ID NO: 84391 - DNA, 20 bp, Artificial Sequence
  chemically synthesized
aatggttgccatacattgta

SEQ ID NO: 84392 - DNA, 20 bp, Artificial Sequence
  chemically synthesized
aaatggttgccatacattgt

SEQ ID NO: 84393 - DNA, 20 bp, Artificial Sequence
  chemically synthesized
caactcgcccttacaatgta

SEQ ID NO: 84394 - DNA, 20 bp, Artificial Sequence
  chemically synthesized
agaagcagagagtagaaaaa

SEQ ID NO: 84395 - DNA, 20 bp, Artificial Sequence
  chemically synthesized
aaactcatagaagcagagag

SEQ ID NO: 84396 - DNA, 20 bp, Artificial Sequence
  chemically synthesized
gtcaaactcatagaagcaga

SEQ ID NO: 84397 - DNA, 20 bp, Artificial Sequence
  chemically synthesized
tagtcaaactcatagaagca

SEQ ID NO: 84398 - DNA, 20 bp, Artificial Sequence
  chemically synthesized
tttctactctctgcttctat

SEQ ID NO: 84399 - DNA, 20 bp, Artificial Sequence
  chemically synthesized
tttagtcaaactcatagaag

SEQ ID NO: 84400 - DNA, 20 bp, Artificial Sequence
  chemically synthesized
ttatttagtcaaactcatag

SEQ ID NO: 84401 - DNA, 20 bp, Artificial Sequence
  chemically synthesized
tgattatttagtcaaactca

SEQ ID NO: 84402 - DNA, 20 bp, Artificial Sequence
  chemically synthesized
atcttatttagatgattatt

SEQ ID NO: 84403 - DNA, 20 bp, Artificial Sequence
  chemically synthesized
gactaaataatcatctaaat

SEQ ID NO: 84404 - DNA, 20 bp, Artificial Sequence
  chemically synthesized
gagctttttgtcatcttatt

SEQ ID NO: 84405 - DNA, 20 bp, Artificial Sequence
  chemically synthesized
catctaaataagatgacaaa

SEQ ID NO: 84406 - DNA, 20 bp, Artificial Sequence
  chemically synthesized
agtggagtgaaaataaggcg

SEQ ID NO: 84407 - DNA, 20 bp, Artificial Sequence
  chemically synthesized
gaagtggagtgaaaataagg

SEQ ID NO: 84408 - DNA, 20 bp, Artificial Sequence
  chemically synthesized
tcagaagtggagtgaaaata

SEQ ID NO: 84409 - DNA, 20 bp, Artificial Sequence
  chemically synthesized
ttcagaagtggagtgaaaat

SEQ ID NO: 84410 - DNA, 20 bp, Artificial Sequence
  chemically synthesized
ttcacttttattcagaagtg

SEQ ID NO: 84411 - DNA, 20 bp, Artificial Sequence
  chemically synthesized
tcttcacttttattcagaag

SEQ ID NO: 84412 - DNA, 20 bp, Artificial Sequence
  chemically synthesized
ttatcttcacttttattcag

SEQ ID NO: 84413 - DNA, 20 bp, Artificial Sequence
  chemically synthesized
ttcactccacttctgaataa

SEQ ID NO: 84414 - DNA, 20 bp, Artificial Sequence
  chemically synthesized
cccttatcttcacttttatt

SEQ ID NO: 84415 - DNA, 20 bp, Artificial Sequence
  chemically synthesized
tccacttctgaataaaagtg

SEQ ID NO: 84416 - DNA, 20 bp, Artificial Sequence
  chemically synthesized
ttctgaataaaagtgaagat

SEQ ID NO: 84417 - DNA, 20 bp, Artificial Sequence
  chemically synthesized
tctgaataaaagtgaagata

SEQ ID NO: 84418 - DNA, 20 bp, Artificial Sequence
  chemically synthesized
ctgaataaaagtgaagataa

SEQ ID NO: 84419 - DNA, 20 bp, Artificial Sequence
  chemically synthesized
aaagtgaagataagggattg

SEQ ID NO: 84420 - DNA, 20 bp, Artificial Sequence
  chemically synthesized
aagataagggattgaagtat

SEQ ID NO: 84421 - DNA, 20 bp, Artificial Sequence
  chemically synthesized
tgactatctgaaacaatgaa

SEQ ID NO: 84422 - DNA, 20 bp, Artificial Sequence
  chemically synthesized
gatacatccattcattgttt

SEQ ID NO: 84423 - DNA, 20 bp, Artificial Sequence
  chemically synthesized
catccattcattgtttcaga

SEQ ID NO: 84424 - DNA, 20 bp, Artificial Sequence
  chemically synthesized
aacaatattaatttataaat

SEQ ID NO: 84425 - DNA, 20 bp, Artificial Sequence
  chemically synthesized
aaatttgatgtaaaattgaa

SEQ ID NO: 84426 - DNA, 20 bp, Artificial Sequence
  chemically synthesized
aaaagtaaatgaacatattt

SEQ ID NO: 84427 - DNA, 20 bp, Artificial Sequence
  chemically synthesized
aaagtaaatgaacatatttc

SEQ ID NO: 84428 - DNA, 20 bp, Artificial Sequence
  chemically synthesized
taaaaaaaaaacataatttc

SEQ ID NO: 84429 - DNA, 20 bp, Artificial Sequence
  chemically synthesized
ttaaaaaaaaaacataattt

SEQ ID NO: 84430 - DNA, 20 bp, Artificial Sequence
  chemically synthesized
tttttttaaaaatctaatta

SEQ ID NO: 84431 - DNA, 20 bp, Artificial Sequence
  chemically synthesized
gttttttcattgactataat

SEQ ID NO: 84432 - DNA, 20 bp, Artificial Sequence
  chemically synthesized
gtcaatgaaaaaacattttt

SEQ ID NO: 84433 - DNA, 20 bp, Artificial Sequence
  chemically synthesized
aaaaacatttttgagtgtat

SEQ ID NO: 84434 - DNA, 20 bp, Artificial Sequence
  chemically synthesized
aaaacatttttgagtgtata

SEQ ID NO: 84435 - DNA, 20 bp, Artificial Sequence
  chemically synthesized
aaacatttttgagtgtataa

SEQ ID NO: 84436 - DNA, 20 bp, Artificial Sequence
  chemically synthesized
aacatttttgagtgtataag

SEQ ID NO: 84437 - DNA, 20 bp, Artificial Sequence
  chemically synthesized
tgtttaacaaactctgtgtt

SEQ ID NO: 84438 - DNA, 20 bp, Artificial Sequence
  chemically synthesized
gaaaaataaatctcaacaca

SEQ ID NO: 84439 - DNA, 20 bp, Artificial Sequence
  chemically synthesized
cagaaaaataaatctcaaca

SEQ ID NO: 84440 - DNA, 20 bp, Artificial Sequence
  chemically synthesized
tgtgttgagatttatttttc

SEQ ID NO: 84441 - DNA, 20 bp, Artificial Sequence
  chemically synthesized
gttgagatttatttttctgg

SEQ ID NO: 84442 - DNA, 20 bp, Artificial Sequence
  chemically synthesized
tctttgttttcaaagacttc

SEQ ID NO: 84443 - DNA, 20 bp, Artificial Sequence
  chemically synthesized
gaatacaatctttgttttca

SEQ ID NO: 84444 - DNA, 20 bp, Artificial Sequence
  chemically synthesized
tctggaagtctttgaaaaca

SEQ ID NO: 84445 - DNA, 20 bp, Artificial Sequence
  chemically synthesized
aaacaaagattgtattctct

SEQ ID NO: 84446 - DNA, 20 bp, Artificial Sequence
  chemically synthesized
agattgtattctctgagatc

SEQ ID NO: 84447 - DNA, 20 bp, Artificial Sequence
  chemically synthesized
agcccgtgcccttgatctca

SEQ ID NO: 84448 - DNA, 20 bp, Artificial Sequence
  chemically synthesized
gattgtattctctgagatca

SEQ ID NO: 84449 - DNA, 20 bp, Artificial Sequence
  chemically synthesized
attgtattctctgagatcaa

SEQ ID NO: 84450 - DNA, 20 bp, Artificial Sequence
  chemically synthesized
ctagcccgtgcccttgatct

SEQ ID NO: 84451 - DNA, 20 bp, Artificial Sequence
  chemically synthesized
attctctgagatcaagggca

SEQ ID NO: 84452 - DNA, 20 bp, Artificial Sequence
  chemically synthesized
ttctctgagatcaagggcac

SEQ ID NO: 84453 - DNA, 20 bp, Artificial Sequence
  chemically synthesized
ctgagatcaagggcacgggc

SEQ ID NO: 84454 - DNA, 20 bp, Artificial Sequence
  chemically synthesized
atcaagggcacgggctagaa

SEQ ID NO: 84455 - DNA, 20 bp, Artificial Sequence
  chemically synthesized
gcaagcaggctggactattc

SEQ ID NO: 84456 - DNA, 20 bp, Artificial Sequence
  chemically synthesized
gggcacgggctagaatagtc

SEQ ID NO: 84457 - DNA, 20 bp, Artificial Sequence
  chemically synthesized
tcacagacctgcaagcaggc

SEQ ID NO: 84458 - DNA, 20 bp, Artificial Sequence
  chemically synthesized
agaatagtccagcctgcttg

SEQ ID NO: 84459 - DNA, 20 bp, Artificial Sequence
  chemically synthesized
gaatagtccagcctgcttgc

SEQ ID NO: 84460 - DNA, 20 bp, Artificial Sequence
  chemically synthesized
agtatcacagacctgcaagc

SEQ ID NO: 84461 - DNA, 20 bp, Artificial Sequence
  chemically synthesized
tagtatcacagacctgcaag

SEQ ID NO: 84462 - DNA, 20 bp, Artificial Sequence
  chemically synthesized
ccatagtatcacagacctgc

SEQ ID NO: 84463 - DNA, 20 bp, Artificial Sequence
  chemically synthesized
actattcctccatagtatca

SEQ ID NO: 84464 - DNA, 20 bp, Artificial Sequence
  chemically synthesized
cttgcaggtctgtgatacta

SEQ ID NO: 84465 - DNA, 20 bp, Artificial Sequence
  chemically synthesized
tgcaggtctgtgatactatg

SEQ ID NO: 84466 - DNA, 20 bp, Artificial Sequence
  chemically synthesized
gcaggtctgtgatactatgg

SEQ ID NO: 84467 - DNA, 20 bp, Artificial Sequence
  chemically synthesized
cgcagtaaactattcctcca

SEQ ID NO: 84468 - DNA, 20 bp, Artificial Sequence
  chemically synthesized
tctgtgatactatggaggaa

SEQ ID NO: 84469 - DNA, 20 bp, Artificial Sequence
  chemically synthesized
ggaatagtttactgcgcaca

SEQ ID NO: 84470 - DNA, 20 bp, Artificial Sequence
  chemically synthesized
tgttcaagatgctgtgtgcg

SEQ ID NO: 84471 - DNA, 20 bp, Artificial Sequence
  chemically synthesized
tgcgcacacagcatcttgaa

SEQ ID NO: 84472 - DNA, 20 bp, Artificial Sequence
  chemically synthesized
taagagtcaaacagctgttc

SEQ ID NO: 84473 - DNA, 20 bp, Artificial Sequence
  chemically synthesized
ccttagaattaagagtcaaa

SEQ ID NO: 84474 - DNA, 20 bp, Artificial Sequence
  chemically synthesized
cagcccagccttagaattaa

SEQ ID NO: 84475 - DNA, 20 bp, Artificial Sequence
  chemically synthesized
gctgtttgactcttaattct

SEQ ID NO: 84476 - DNA, 20 bp, Artificial Sequence
  chemically synthesized
ctgtttgactcttaattcta

SEQ ID NO: 84477 - DNA, 20 bp, Artificial Sequence
  chemically synthesized
agcagcccagccttagaatt

SEQ ID NO: 84478 - DNA, 20 bp, Artificial Sequence
  chemically synthesized
ttgactcttaattctaaggc

SEQ ID NO: 84479 - DNA, 20 bp, Artificial Sequence
  chemically synthesized
tgactcttaattctaaggct

SEQ ID NO: 84480 - DNA, 20 bp, Artificial Sequence
  chemically synthesized
tgttggaagcagcccagcct

SEQ ID NO: 84481 - DNA, 20 bp, Artificial Sequence
  chemically synthesized
agtgattgttggaagcagcc

SEQ ID NO: 84482 - DNA, 20 bp, Artificial Sequence
  chemically synthesized
tccccagtgattgttggaag

SEQ ID NO: 84483 - DNA, 20 bp, Artificial Sequence
  chemically synthesized
acttccccagtgattgttgg

SEQ ID NO: 84484 - DNA, 20 bp, Artificial Sequence
  chemically synthesized
gtaacttccccagtgattgt

SEQ ID NO: 84485 - DNA, 20 bp, Artificial Sequence
  chemically synthesized
gggctgcttccaacaatcac

SEQ ID NO: 84486 - DNA, 20 bp, Artificial Sequence
  chemically synthesized
ggctgcttccaacaatcact

SEQ ID NO: 84487 - DNA, 20 bp, Artificial Sequence
  chemically synthesized
gctgcttccaacaatcactg

SEQ ID NO: 84488 - DNA, 20 bp, Artificial Sequence
  chemically synthesized
gcttccaacaatcactgggg

SEQ ID NO: 84489 - DNA, 20 bp, Artificial Sequence
  chemically synthesized
tcagtaggaagtaacttccc

SEQ ID NO: 84490 - DNA, 20 bp, Artificial Sequence
  chemically synthesized
acaacattattgtcagtagg

SEQ ID NO: 84491 - DNA, 20 bp, Artificial Sequence
  chemically synthesized
ttaacaacattattgtcagt

SEQ ID NO: 84492 - DNA, 20 bp, Artificial Sequence
  chemically synthesized
cttaacaacattattgtcag

SEQ ID NO: 84493 - DNA, 20 bp, Artificial Sequence
  chemically synthesized
gaacttaacaacattattgt

SEQ ID NO: 84494 - DNA, 20 bp, Artificial Sequence
  chemically synthesized
ctactgacaataatgttgtt

SEQ ID NO: 84495 - DNA, 20 bp, Artificial Sequence
  chemically synthesized
caataatgttgttaagttct

SEQ ID NO: 84496 - DNA, 20 bp, Artificial Sequence
  chemically synthesized
gtgatctctcaaggtcagct

SEQ ID NO: 84497 - DNA, 20 bp, Artificial Sequence
  chemically synthesized
ttaagttctgagctgacctt

SEQ ID NO: 84498 - DNA, 20 bp, Artificial Sequence
  chemically synthesized
aagttctgagctgaccttga

SEQ ID NO: 84499 - DNA, 20 bp, Artificial Sequence
  chemically synthesized
caccagtgatctctcaaggt

SEQ ID NO: 84500 - DNA, 20 bp, Artificial Sequence
  chemically synthesized
ttttcaccagtgatctctca

SEQ ID NO: 84501 - DNA, 20 bp, Artificial Sequence
  chemically synthesized
gttttcaccagtgatctctc

SEQ ID NO: 84502 - DNA, 20 bp, Artificial Sequence
  chemically synthesized
agctgaccttgagagatcac

SEQ ID NO: 84503 - DNA, 20 bp, Artificial Sequence
  chemically synthesized
gaactagattgagttttcac

SEQ ID NO: 84504 - DNA, 20 bp, Artificial Sequence
  chemically synthesized
tcactggtgaaaactcaatc

SEQ ID NO: 84505 - DNA, 20 bp, Artificial Sequence
  chemically synthesized
atggccacgggaactagatt

SEQ ID NO: 84506 - DNA, 20 bp, Artificial Sequence
  chemically synthesized
aaaactcaatctagttcccg

SEQ ID NO: 84507 - DNA, 20 bp, Artificial Sequence
  chemically synthesized
ccctaaatggccacgggaac

SEQ ID NO: 84508 - DNA, 20 bp, Artificial Sequence
  chemically synthesized
ctaattccctaaatggccac

SEQ ID NO: 84509 - DNA, 20 bp, Artificial Sequence
  chemically synthesized
cctaattccctaaatggcca

SEQ ID NO: 84510 - DNA, 20 bp, Artificial Sequence
  chemically synthesized
atctagttcccgtggccatt

SEQ ID NO: 84511 - DNA, 20 bp, Artificial Sequence
  chemically synthesized
tctagttcccgtggccattt

SEQ ID NO: 84512 - DNA, 20 bp, Artificial Sequence
  chemically synthesized
ctagttcccgtggccattta

SEQ ID NO: 84513 - DNA, 20 bp, Artificial Sequence
  chemically synthesized
ctaagacctaattccctaaa

SEQ ID NO: 84514 - DNA, 20 bp, Artificial Sequence
  chemically synthesized
cccgtggccatttagggaat

SEQ ID NO: 84515 - DNA, 20 bp, Artificial Sequence
  chemically synthesized
ccgtggccatttagggaatt

SEQ ID NO: 84516 - DNA, 20 bp, Artificial Sequence
  chemically synthesized
ccatttagggaattaggtct

SEQ ID NO: 84517 - DNA, 20 bp, Artificial Sequence
  chemically synthesized
catttagggaattaggtctt

SEQ ID NO: 84518 - DNA, 20 bp, Artificial Sequence
  chemically synthesized
aagtttaggcttaatgacct

SEQ ID NO: 84519 - DNA, 20 bp, Artificial Sequence
  chemically synthesized
gaattaggtcttaggtcatt

SEQ ID NO: 84520 - DNA, 20 bp, Artificial Sequence
  chemically synthesized
ggtcattaagcctaaacttt

SEQ ID NO: 84521 - DNA, 20 bp, Artificial Sequence
  chemically synthesized
atttccaaatcttaaagttt

SEQ ID NO: 84522 - DNA, 20 bp, Artificial Sequence
  chemically synthesized
aatttccaaatcttaaagtt

SEQ ID NO: 84523 - DNA, 20 bp, Artificial Sequence
  chemically synthesized
taagcctaaactttaagatt

SEQ ID NO: 84524 - DNA, 20 bp, Artificial Sequence
  chemically synthesized
gaagtaatttccaaatctta

SEQ ID NO: 84525 - DNA, 20 bp, Artificial Sequence
  chemically synthesized
catttctactaacatttcag

SEQ ID NO: 84526 - DNA, 20 bp, Artificial Sequence
  chemically synthesized
ggaaattacttctgaaatgt

SEQ ID NO: 84527 - DNA, 20 bp, Artificial Sequence
  chemically synthesized
attcatttctactaacattt

SEQ ID NO: 84528 - DNA, 20 bp, Artificial Sequence
  chemically synthesized
aattacttctgaaatgttag

SEQ ID NO: 84529 - DNA, 20 bp, Artificial Sequence
  chemically synthesized
gaaatgttagtagaaatgaa

SEQ ID NO: 84530 - DNA, 20 bp, Artificial Sequence
  chemically synthesized
agtagaaatgaatggattat

SEQ ID NO: 84531 - DNA, 20 bp, Artificial Sequence
  chemically synthesized
acacaaattaatttgtcaca

SEQ ID NO: 84532 - DNA, 20 bp, Artificial Sequence
  chemically synthesized
tacacaaattaatttgtcac

SEQ ID NO: 84533 - DNA, 20 bp, Artificial Sequence
  chemically synthesized
atacacaaattaatttgtca

SEQ ID NO: 84534 - DNA, 20 bp, Artificial Sequence
  chemically synthesized
attaatttgtgtatgttctc

SEQ ID NO: 84535 - DNA, 20 bp, Artificial Sequence
  chemically synthesized
aaattttggctcagtatctt

SEQ ID NO: 84536 - DNA, 20 bp, Artificial Sequence
  chemically synthesized
gtgtatgttctcaagatact

SEQ ID NO: 84537 - DNA, 20 bp, Artificial Sequence
  chemically synthesized
gacaatctcaaattttggct

SEQ ID NO: 84538 - DNA, 20 bp, Artificial Sequence
  chemically synthesized
aagatactgagccaaaattt

SEQ ID NO: 84539 - DNA, 20 bp, Artificial Sequence
  chemically synthesized
tacttgacaatctcaaattt

SEQ ID NO: 84540 - DNA, 20 bp, Artificial Sequence
  chemically synthesized
agccaaaatttgagattgtc

SEQ ID NO: 84541 - DNA, 20 bp, Artificial Sequence
  chemically synthesized
aatttgagattgtcaagtat

SEQ ID NO: 84542 - DNA, 20 bp, Artificial Sequence
  chemically synthesized
ttgagattgtcaagtataag

SEQ ID NO: 84543 - DNA, 20 bp, Artificial Sequence
  chemically synthesized
cagacacaaagggtatgatt

SEQ ID NO: 84544 - DNA, 20 bp, Artificial Sequence
  chemically synthesized
tgttgatagacagacacaaa

SEQ ID NO: 84545 - DNA, 20 bp, Artificial Sequence
  chemically synthesized
atgttgatagacagacacaa

SEQ ID NO: 84546 - DNA, 20 bp, Artificial Sequence
  chemically synthesized
tatgttgatagacagacaca

SEQ ID NO: 84547 - DNA, 20 bp, Artificial Sequence
  chemically synthesized
ttttggattatgttgataga

SEQ ID NO: 84548 - DNA, 20 bp, Artificial Sequence
  chemically synthesized
ccatttttggattatgttga

SEQ ID NO: 84549 - DNA, 20 bp, Artificial Sequence
  chemically synthesized
ctatcaacataatccaaaaa

SEQ ID NO: 84550 - DNA, 20 bp, Artificial Sequence
  chemically synthesized
atgaaccagggttccatttt

SEQ ID NO: 84551 - DNA, 20 bp, Artificial Sequence
  chemically synthesized
ataatccaaaaatggaaccc

SEQ ID NO: 84552 - DNA, 20 bp, Artificial Sequence
  chemically synthesized
tatgtgcttagaatgaacca

SEQ ID NO: 84553 - DNA, 20 bp, Artificial Sequence
  chemically synthesized
gtatgtgcttagaatgaacc

SEQ ID NO: 84554 - DNA, 20 bp, Artificial Sequence
  chemically synthesized
tgtatgtgcttagaatgaac

SEQ ID NO: 84555 - DNA, 20 bp, Artificial Sequence
  chemically synthesized
atggaaccctggttcattct

SEQ ID NO: 84556 - DNA, 20 bp, Artificial Sequence
  chemically synthesized
cacgtttgagtgtatgtgct

SEQ ID NO: 84557 - DNA, 20 bp, Artificial Sequence
  chemically synthesized
acttgggaatgatcacgttt

SEQ ID NO: 84558 - DNA, 20 bp, Artificial Sequence
  chemically synthesized
actcaaacgtgatcattccc

SEQ ID NO: 84559 - DNA, 20 bp, Artificial Sequence
  chemically synthesized
ttgccatctgagaaagactt

SEQ ID NO: 84560 - DNA, 20 bp, Artificial Sequence
  chemically synthesized
gttgccatctgagaaagact

SEQ ID NO: 84561 - DNA, 20 bp, Artificial Sequence
  chemically synthesized
gatcattcccaagtctttct

SEQ ID NO: 84562 - DNA, 20 bp, Artificial Sequence
  chemically synthesized
attcccaagtctttctcaga

SEQ ID NO: 84563 - DNA, 20 bp, Artificial Sequence
  chemically synthesized
aatgatgttgccatctgaga

SEQ ID NO: 84564 - DNA, 20 bp, Artificial Sequence
  chemically synthesized
aaataatgatgttgccatct

SEQ ID NO: 84565 - DNA, 20 bp, Artificial Sequence
  chemically synthesized
catcattattttatttgttc

SEQ ID NO: 84566 - DNA, 20 bp, Artificial Sequence
  chemically synthesized
tttgttcaagccattgacct

SEQ ID NO: 84567 - DNA, 20 bp, Artificial Sequence
  chemically synthesized
aaggaaaattctgaggtcaa

SEQ ID NO: 84568 - DNA, 20 bp, Artificial Sequence
  chemically synthesized
aagagtcaaggaaaattctg

SEQ ID NO: 84569 - DNA, 20 bp, Artificial Sequence
  chemically synthesized
aaagagtcaaggaaaattct

SEQ ID NO: 84570 - DNA, 20 bp, Artificial Sequence
  chemically synthesized
tgagaggaagcaaagagtca

SEQ ID NO: 84571 - DNA, 20 bp, Artificial Sequence
  chemically synthesized
ttgagaggaagcaaagagtc

SEQ ID NO: 84572 - DNA, 20 bp, Artificial Sequence
  chemically synthesized
ggagtttgagaggaagcaaa

SEQ ID NO: 84573 - DNA, 20 bp, Artificial Sequence
  chemically synthesized
gtggagtttgagaggaagca

SEQ ID NO: 84574 - DNA, 20 bp, Artificial Sequence
  chemically synthesized
agaatgtggagtttgagagg

SEQ ID NO: 84575 - DNA, 20 bp, Artificial Sequence
  chemically synthesized
gatagaatgtggagtttgag

SEQ ID NO: 84576 - DNA, 20 bp, Artificial Sequence
  chemically synthesized
agatagaatgtggagtttga

SEQ ID NO: 84577 - DNA, 20 bp, Artificial Sequence
  chemically synthesized
atagatagaatgtggagttt

SEQ ID NO: 84578 - DNA, 20 bp, Artificial Sequence
  chemically synthesized
cttaagatagatagaatgtg

SEQ ID NO: 84579 - DNA, 20 bp, Artificial Sequence
  chemically synthesized
aacttaagatagatagaatg

SEQ ID NO: 84580 - DNA, 20 bp, Artificial Sequence
  chemically synthesized
ttgatagaacttaagataga

SEQ ID NO: 84581 - DNA, 20 bp, Artificial Sequence
  chemically synthesized
ctccacattctatctatctt

SEQ ID NO: 84582 - DNA, 20 bp, Artificial Sequence
  chemically synthesized
agaattgatagaacttaaga

SEQ ID NO: 84583 - DNA, 20 bp, Artificial Sequence
  chemically synthesized
gggtagaattgatagaactt

SEQ ID NO: 84584 - DNA, 20 bp, Artificial Sequence
  chemically synthesized
tatttggagggtagaattga

SEQ ID NO: 84585 - DNA, 20 bp, Artificial Sequence
  chemically synthesized
tcgaagatatatttggaggg

SEQ ID NO: 84586 - DNA, 20 bp, Artificial Sequence
  chemically synthesized
tgatcgaagatatatttgga

SEQ ID NO: 84587 - DNA, 20 bp, Artificial Sequence
  chemically synthesized
ttgatcgaagatatatttgg

SEQ ID NO: 84588 - DNA, 20 bp, Artificial Sequence
  chemically synthesized
tttgatcgaagatatatttg

SEQ ID NO: 84589 - DNA, 20 bp, Artificial Sequence
  chemically synthesized
tatttgatcgaagatatatt

SEQ ID NO: 84590 - DNA, 20 bp, Artificial Sequence
  chemically synthesized
ggtgaataattatttgatcg

SEQ ID NO: 84591 - DNA, 20 bp, Artificial Sequence
  chemically synthesized
tagagtggaaatgataggta

SEQ ID NO: 84592 - DNA, 20 bp, Artificial Sequence
  chemically synthesized
tggactagagtggaaatgat

SEQ ID NO: 84593 - DNA, 20 bp, Artificial Sequence
  chemically synthesized
ttggactagagtggaaatga

SEQ ID NO: 84594 - DNA, 20 bp, Artificial Sequence
  chemically synthesized
catacctatcatttccactc

SEQ ID NO: 84595 - DNA, 20 bp, Artificial Sequence
  chemically synthesized
aatgattacttggactagag

SEQ ID NO: 84596 - DNA, 20 bp, Artificial Sequence
  chemically synthesized
tatcatttccactctagtcc

SEQ ID NO: 84597 - DNA, 20 bp, Artificial Sequence
  chemically synthesized
ggaaatgattacttggacta

SEQ ID NO: 84598 - DNA, 20 bp, Artificial Sequence
  chemically synthesized
aaggaaatgattacttggac

SEQ ID NO: 84599 - DNA, 20 bp, Artificial Sequence
  chemically synthesized
ctcagaaggaaatgattact

SEQ ID NO: 84600 - DNA, 20 bp, Artificial Sequence
  chemically synthesized
ccaagtaatcatttccttct

SEQ ID NO: 84601 - DNA, 20 bp, Artificial Sequence
  chemically synthesized
ggtggtggagtcatctcaga

SEQ ID NO: 84602 - DNA, 20 bp, Artificial Sequence
  chemically synthesized
gggtggtggagtcatctcag

SEQ ID NO: 84603 - DNA, 20 bp, Artificial Sequence
  chemically synthesized
ggagggtggtggagtcatct

SEQ ID NO: 84604 - DNA, 20 bp, Artificial Sequence
  chemically synthesized
cacagaaaaggagggtggtg

SEQ ID NO: 84605 - DNA, 20 bp, Artificial Sequence
  chemically synthesized
gacacagaaaaggagggtgg

SEQ ID NO: 84606 - DNA, 20 bp, Artificial Sequence
  chemically synthesized
gaagacacagaaaaggaggg

SEQ ID NO: 84607 - DNA, 20 bp, Artificial Sequence
  chemically synthesized
actgaagacacagaaaagga

SEQ ID NO: 84608 - DNA, 20 bp, Artificial Sequence
  chemically synthesized
aactgaagacacagaaaagg

SEQ ID NO: 84609 - DNA, 20 bp, Artificial Sequence
  chemically synthesized
aaactgaagacacagaaaag

SEQ ID NO: 84610 - DNA, 20 bp, Artificial Sequence
  chemically synthesized
cgaaactgaagacacagaaa

SEQ ID NO: 84611 - DNA, 20 bp, Artificial Sequence
  chemically synthesized
gcgaaactgaagacacagaa

SEQ ID NO: 84612 - DNA, 20 bp, Artificial Sequence
  chemically synthesized
accctccttttctgtgtctt

SEQ ID NO: 84613 - DNA, 20 bp, Artificial Sequence
  chemically synthesized
aaagagcgaaactgaagaca

SEQ ID NO: 84614 - DNA, 20 bp, Artificial Sequence
  chemically synthesized
ctataaaaagagcgaaactg

SEQ ID NO: 84615 - DNA, 20 bp, Artificial Sequence
  chemically synthesized
cttcagtttcgctcttttta

SEQ ID NO: 84616 - DNA, 20 bp, Artificial Sequence
  chemically synthesized
tggagaattgactataaaaa

SEQ ID NO: 84617 - DNA, 20 bp, Artificial Sequence
  chemically synthesized
tatggagaattgactataaa

SEQ ID NO: 84618 - DNA, 20 bp, Artificial Sequence
  chemically synthesized
tttttatagtcaattctcca

SEQ ID NO: 84619 - DNA, 20 bp, Artificial Sequence
  chemically synthesized
ttatagtcaattctccatag

SEQ ID NO: 84620 - DNA, 20 bp, Artificial Sequence
  chemically synthesized
agttgactcttgctgctatg

SEQ ID NO: 84621 - DNA, 20 bp, Artificial Sequence
  chemically synthesized
agtcaattctccatagcagc

SEQ ID NO: 84622 - DNA, 20 bp, Artificial Sequence
  chemically synthesized
gaagttgactcttgctgcta

SEQ ID NO: 84623 - DNA, 20 bp, Artificial Sequence
  chemically synthesized
tcaattctccatagcagcaa

SEQ ID NO: 84624 - DNA, 20 bp, Artificial Sequence
  chemically synthesized
gatctgatttatgtgtttag

SEQ ID NO: 84625 - DNA, 20 bp, Artificial Sequence
  chemically synthesized
tgtgatctgatttatgtgtt

SEQ ID NO: 84626 - DNA, 20 bp, Artificial Sequence
  chemically synthesized
caacttctaaacacataaat

SEQ ID NO: 84627 - DNA, 20 bp, Artificial Sequence
  chemically synthesized
cagatcacatcatccctgct

SEQ ID NO: 84628 - DNA, 20 bp, Artificial Sequence
  chemically synthesized
gatcacatcatccctgctga

SEQ ID NO: 84629 - DNA, 20 bp, Artificial Sequence
  chemically synthesized
tcactggaaggctctcagca

SEQ ID NO: 84630 - DNA, 20 bp, Artificial Sequence
  chemically synthesized
atcactggaaggctctcagc

SEQ ID NO: 84631 - DNA, 20 bp, Artificial Sequence
  chemically synthesized
catcactggaaggctctcag

SEQ ID NO: 84632 - DNA, 20 bp, Artificial Sequence
  chemically synthesized
aaacatcactggaaggctct

SEQ ID NO: 84633 - DNA, 20 bp, Artificial Sequence
  chemically synthesized
catccctgctgagagccttc

SEQ ID NO: 84634 - DNA, 20 bp, Artificial Sequence
  chemically synthesized
agtaaggaaacatcactgga

SEQ ID NO: 84635 - DNA, 20 bp, Artificial Sequence
  chemically synthesized
aagtaaggaaacatcactgg

SEQ ID NO: 84636 - DNA, 20 bp, Artificial Sequence
  chemically synthesized
tggaagtaaggaaacatcac

SEQ ID NO: 84637 - DNA, 20 bp, Artificial Sequence
  chemically synthesized
cagtgatgtttccttacttc

SEQ ID NO: 84638 - DNA, 20 bp, Artificial Sequence
  chemically synthesized
aagagacatcactggaagta

SEQ ID NO: 84639 - DNA, 20 bp, Artificial Sequence
  chemically synthesized
aaagagacatcactggaagt

SEQ ID NO: 84640 - DNA, 20 bp, Artificial Sequence
  chemically synthesized
gagtaaagagacatcactgg

SEQ ID NO: 84641 - DNA, 20 bp, Artificial Sequence
  chemically synthesized
tgtgagtaaagagacatcac

SEQ ID NO: 84642 - DNA, 20 bp, Artificial Sequence
  chemically synthesized
gattttattctgtgagtaaa

SEQ ID NO: 84643 - DNA, 20 bp, Artificial Sequence
  chemically synthesized
cagtgatgtctctttactca

SEQ ID NO: 84644 - DNA, 20 bp, Artificial Sequence
  chemically synthesized
tggattttattctgtgagta

SEQ ID NO: 84645 - DNA, 20 bp, Artificial Sequence
  chemically synthesized
ggaggtggattttattctgt

SEQ ID NO: 84646 - DNA, 20 bp, Artificial Sequence
  chemically synthesized
tgcaggccatagtttggagg

SEQ ID NO: 84647 - DNA, 20 bp, Artificial Sequence
  chemically synthesized
tcttgcaggccatagtttgg

SEQ ID NO: 84648 - DNA, 20 bp, Artificial Sequence
  chemically synthesized
taaaatccacctccaaacta

SEQ ID NO: 84649 - DNA, 20 bp, Artificial Sequence
  chemically synthesized
gtcttgcaggccatagtttg

SEQ ID NO: 84650 - DNA, 20 bp, Artificial Sequence
  chemically synthesized
tggtcttgcaggccatagtt

SEQ ID NO: 84651 - DNA, 20 bp, Artificial Sequence
  chemically synthesized
atgaatggtcttgcaggcca

SEQ ID NO: 84652 - DNA, 20 bp, Artificial Sequence
  chemically synthesized
acctccaaactatggcctgc

SEQ ID NO: 84653 - DNA, 20 bp, Artificial Sequence
  chemically synthesized
cagataatgaatggtcttgc

SEQ ID NO: 84654 - DNA, 20 bp, Artificial Sequence
  chemically synthesized
ccagataatgaatggtcttg

SEQ ID NO: 84655 - DNA, 20 bp, Artificial Sequence
  chemically synthesized
gggaaaggccagataatgaa

SEQ ID NO: 84656 - DNA, 20 bp, Artificial Sequence
  chemically synthesized
ctgcaagaccattcattatc

SEQ ID NO: 84657 - DNA, 20 bp, Artificial Sequence
  chemically synthesized
ttctagaaagagggaaaggc

SEQ ID NO: 84658 - DNA, 20 bp, Artificial Sequence
  chemically synthesized
taggttctagaaagagggaa

SEQ ID NO: 84659 - DNA, 20 bp, Artificial Sequence
  chemically synthesized
ataggttctagaaagaggga

SEQ ID NO: 84660 - DNA, 20 bp, Artificial Sequence
  chemically synthesized
atctggcctttccctctttc

SEQ ID NO: 84661 - DNA, 20 bp, Artificial Sequence
  chemically synthesized
agtgataggttctagaaaga

SEQ ID NO: 84662 - DNA, 20 bp, Artificial Sequence
  chemically synthesized
cagtgataggttctagaaag

SEQ ID NO: 84663 - DNA, 20 bp, Artificial Sequence
  chemically synthesized
acagtgataggttctagaaa

SEQ ID NO: 84664 - DNA, 20 bp, Artificial Sequence
  chemically synthesized
agacagtgataggttctaga

SEQ ID NO: 84665 - DNA, 20 bp, Artificial Sequence
  chemically synthesized
cagtagacagtgataggttc

SEQ ID NO: 84666 - DNA, 20 bp, Artificial Sequence
  chemically synthesized
taagatcagtagacagtgat

SEQ ID NO: 84667 - DNA, 20 bp, Artificial Sequence
  chemically synthesized
ataagatcagtagacagtga

SEQ ID NO: 84668 - DNA, 20 bp, Artificial Sequence
  chemically synthesized
agggaaataagatcagtaga

SEQ ID NO: 84669 - DNA, 20 bp, Artificial Sequence
  chemically synthesized
ctcaagggaaataagatcag

SEQ ID NO: 84670 - DNA, 20 bp, Artificial Sequence
  chemically synthesized
tatctcaagggaaataagat

SEQ ID NO: 84671 - DNA, 20 bp, Artificial Sequence
  chemically synthesized
ctgtgtatctcaagggaaat

SEQ ID NO: 84672 - DNA, 20 bp, Artificial Sequence
  chemically synthesized
ctactgatcttatttccctt

SEQ ID NO: 84673 - DNA, 20 bp, Artificial Sequence
  chemically synthesized
agatgagctgtgtatctcaa

SEQ ID NO: 84674 - DNA, 20 bp, Artificial Sequence
  chemically synthesized
aagatgagctgtgtatctca

SEQ ID NO: 84675 - DNA, 20 bp, Artificial Sequence
  chemically synthesized
caagatgagctgtgtatctc

SEQ ID NO: 84676 - DNA, 20 bp, Artificial Sequence
  chemically synthesized
cttatttcccttgagataca

SEQ ID NO: 84677 - DNA, 20 bp, Artificial Sequence
  chemically synthesized
tgttgtagaaatagcaagat

SEQ ID NO: 84678 - DNA, 20 bp, Artificial Sequence
  chemically synthesized
ttgagtgttgtagaaatagc

SEQ ID NO: 84679 - DNA, 20 bp, Artificial Sequence
  chemically synthesized
ggttttgagtgttgtagaaa

SEQ ID NO: 84680 - DNA, 20 bp, Artificial Sequence
  chemically synthesized
agaacaggttttgagtgttg

SEQ ID NO: 84681 - DNA, 20 bp, Artificial Sequence
  chemically synthesized
caatggtaagaacaggtttt

SEQ ID NO: 84682 - DNA, 20 bp, Artificial Sequence
  chemically synthesized
aaaagcccaatggtaagaac

SEQ ID NO: 84683 - DNA, 20 bp, Artificial Sequence
  chemically synthesized
caaaagcccaatggtaagaa

SEQ ID NO: 84684 - DNA, 20 bp, Artificial Sequence
  chemically synthesized
tcaaaacctgttcttaccat

SEQ ID NO: 84685 - DNA, 20 bp, Artificial Sequence
  chemically synthesized
caaaacctgttcttaccatt

SEQ ID NO: 84686 - DNA, 20 bp, Artificial Sequence
  chemically synthesized
aaattcaaaagcccaatggt

SEQ ID NO: 84687 - DNA, 20 bp, Artificial Sequence
  chemically synthesized
caccaaattcaaaagcccaa

SEQ ID NO: 84688 - DNA, 20 bp, Artificial Sequence
  chemically synthesized
taccattgggcttttgaatt

SEQ ID NO: 84689 - DNA, 20 bp, Artificial Sequence
  chemically synthesized
agaagaagcaccaaattcaa

SEQ ID NO: 84690 - DNA, 20 bp, Artificial Sequence
  chemically synthesized
aagaggattctaggcagaag

SEQ ID NO: 84691 - DNA, 20 bp, Artificial Sequence
  chemically synthesized
aatttggtgcttcttctgcc

SEQ ID NO: 84692 - DNA, 20 bp, Artificial Sequence
  chemically synthesized
atgaagaggattctaggcag

SEQ ID NO: 84693 - DNA, 20 bp, Artificial Sequence
  chemically synthesized
tgaatgaagaggattctagg

SEQ ID NO: 84694 - DNA, 20 bp, Artificial Sequence
  chemically synthesized
ccttgaatgaagaggattct

SEQ ID NO: 84695 - DNA, 20 bp, Artificial Sequence
  chemically synthesized
accttgaatgaagaggattc

SEQ ID NO: 84696 - DNA, 20 bp, Artificial Sequence
  chemically synthesized
tgcaaaaaccttgaatgaag

SEQ ID NO: 84697 - DNA, 20 bp, Artificial Sequence
  chemically synthesized
gcctagaatcctcttcattc

SEQ ID NO: 84698 - DNA, 20 bp, Artificial Sequence
  chemically synthesized
atgcaaaaaccttgaatgaa

SEQ ID NO: 84699 - DNA, 20 bp, Artificial Sequence
  chemically synthesized
cctagaatcctcttcattca

SEQ ID NO: 84700 - DNA, 20 bp, Artificial Sequence
  chemically synthesized
ccatgcaaaaaccttgaatg

SEQ ID NO: 84701 - DNA, 20 bp, Artificial Sequence
  chemically synthesized
cttcattcaaggtttttgca

SEQ ID NO: 84702 - DNA, 20 bp, Artificial Sequence
  chemically synthesized
gcatggtttactcactcaca

SEQ ID NO: 84703 - DNA, 20 bp, Artificial Sequence
  chemically synthesized
caaacaaaacctgtgtgagt

SEQ ID NO: 84704 - DNA, 20 bp, Artificial Sequence
  chemically synthesized
catggtttactcactcacac

SEQ ID NO: 84705 - DNA, 20 bp, Artificial Sequence
  chemically synthesized
caaacaaacaaaacctgtgt

SEQ ID NO: 84706 - DNA, 20 bp, Artificial Sequence
  chemically synthesized
ttttgtttgtttgttttttt

SEQ ID NO: 84707 - DNA, 20 bp, Artificial Sequence
  chemically synthesized
gtttgtttgtttttttgaga

SEQ ID NO: 84708 - DNA, 20 bp, Artificial Sequence
  chemically synthesized
tttgtttgtttttttgagac

SEQ ID NO: 84709 - DNA, 20 bp, Artificial Sequence
  chemically synthesized
ttgtttgtttttttgagaca

SEQ ID NO: 84710 - DNA, 20 bp, Artificial Sequence
  chemically synthesized
tctagcctgggtggcagagt

SEQ ID NO: 84711 - DNA, 20 bp, Artificial Sequence
  chemically synthesized
cagggtctcactctgccacc

SEQ ID NO: 84712 - DNA, 20 bp, Artificial Sequence
  chemically synthesized
gcactctagcctgggtggca

SEQ ID NO: 84713 - DNA, 20 bp, Artificial Sequence
  chemically synthesized
agggtctcactctgccaccc

SEQ ID NO: 84714 - DNA, 20 bp, Artificial Sequence
  chemically synthesized
ctgcactctagcctgggtgg

SEQ ID NO: 84715 - DNA, 20 bp, Artificial Sequence
  chemically synthesized
tctcactctgccacccaggc

SEQ ID NO: 84716 - DNA, 20 bp, Artificial Sequence
  chemically synthesized
ccactgcactctagcctggg

SEQ ID NO: 84717 - DNA, 20 bp, Artificial Sequence
  chemically synthesized
tcactctgccacccaggcta

SEQ ID NO: 84718 - DNA, 20 bp, Artificial Sequence
  chemically synthesized
gtgccactgcactctagcct

SEQ ID NO: 84719 - DNA, 20 bp, Artificial Sequence
  chemically synthesized
tgtgccactgcactctagcc

SEQ ID NO: 84720 - DNA, 20 bp, Artificial Sequence
  chemically synthesized
ctgccacccaggctagagtg

SEQ ID NO: 84721 - DNA, 20 bp, Artificial Sequence
  chemically synthesized
aagattgtgccactgcactc

SEQ ID NO: 84722 - DNA, 20 bp, Artificial Sequence
  chemically synthesized
ccacccaggctagagtgcag

SEQ ID NO: 84723 - DNA, 20 bp, Artificial Sequence
  chemically synthesized
agagtgcagtggcacaatct

SEQ ID NO: 84724 - DNA, 20 bp, Artificial Sequence
  chemically synthesized
ggcggaggttgaagtgaacc

SEQ ID NO: 84725 - DNA, 20 bp, Artificial Sequence
  chemically synthesized
aacttgggaggcggaggttg

SEQ ID NO: 84726 - DNA, 20 bp, Artificial Sequence
  chemically synthesized
cgcttgaacttgggaggcgg

SEQ ID NO: 84727 - DNA, 20 bp, Artificial Sequence
  chemically synthesized
tcgcttgaacttgggaggcg

SEQ ID NO: 84728 - DNA, 20 bp, Artificial Sequence
  chemically synthesized
cacttcaacctccgcctccc

SEQ ID NO: 84729 - DNA, 20 bp, Artificial Sequence
  chemically synthesized
aatcgcttgaacttgggagg

SEQ ID NO: 84730 - DNA, 20 bp, Artificial Sequence
  chemically synthesized
cagaatcgcttgaacttggg

SEQ ID NO: 84731 - DNA, 20 bp, Artificial Sequence
  chemically synthesized
ccagaatcgcttgaacttgg

SEQ ID NO: 84732 - DNA, 20 bp, Artificial Sequence
  chemically synthesized
aacctccgcctcccaagttc

SEQ ID NO: 84733 - DNA, 20 bp, Artificial Sequence
  chemically synthesized
taccagaatcgcttgaactt

SEQ ID NO: 84734 - DNA, 20 bp, Artificial Sequence
  chemically synthesized
gtaccagaatcgcttgaact

SEQ ID NO: 84735 - DNA, 20 bp, Artificial Sequence
  chemically synthesized
ctcccaagttcaagcgattc

SEQ ID NO: 84736 - DNA, 20 bp, Artificial Sequence
  chemically synthesized
ttcaagcgattctggtacct

SEQ ID NO: 84737 - DNA, 20 bp, Artificial Sequence
  chemically synthesized
tacccaggaggctgaggtac

SEQ ID NO: 84738 - DNA, 20 bp, Artificial Sequence
  chemically synthesized
cccagctacccaggaggctg

SEQ ID NO: 84739 - DNA, 20 bp, Artificial Sequence
  chemically synthesized
attctggtacctcagcctcc

SEQ ID NO: 84740 - DNA, 20 bp, Artificial Sequence
  chemically synthesized
tcccagctacccaggaggct

SEQ ID NO: 84741 - DNA, 20 bp, Artificial Sequence
  chemically synthesized
ttctggtacctcagcctcct

SEQ ID NO: 84742 - DNA, 20 bp, Artificial Sequence
  chemically synthesized
tggtacctcagcctcctggg

SEQ ID NO: 84743 - DNA, 20 bp, Artificial Sequence
  chemically synthesized
tgtagtcccagctacccagg

SEQ ID NO: 84744 - DNA, 20 bp, Artificial Sequence
  chemically synthesized
ctgtagtcccagctacccag

SEQ ID NO: 84745 - DNA, 20 bp, Artificial Sequence
  chemically synthesized
acctcagcctcctgggtagc

SEQ ID NO: 84746 - DNA, 20 bp, Artificial Sequence
  chemically synthesized
gcctgtagtcccagctaccc

SEQ ID NO: 84747 - DNA, 20 bp, Artificial Sequence
  chemically synthesized
cctcagcctcctgggtagct

SEQ ID NO: 84748 - DNA, 20 bp, Artificial Sequence
  chemically synthesized
tgcctgtagtcccagctacc

SEQ ID NO: 84749 - DNA, 20 bp, Artificial Sequence
  chemically synthesized
ctcctgggtagctgggacta

SEQ ID NO: 84750 - DNA, 20 bp, Artificial Sequence
  chemically synthesized
tcctgggtagctgggactac

SEQ ID NO: 84751 - DNA, 20 bp, Artificial Sequence
  chemically synthesized
gtgacacgtgcctgtagtcc

SEQ ID NO: 84752 - DNA, 20 bp, Artificial Sequence
  chemically synthesized
ggcgtggtgacacgtgcctg

SEQ ID NO: 84753 - DNA, 20 bp, Artificial Sequence
  chemically synthesized
caggcacgtgtcaccacgcc

SEQ ID NO: 84754 - DNA, 20 bp, Artificial Sequence
  chemically synthesized
taccaaaaactagctgggcg

SEQ ID NO: 84755 - DNA, 20 bp, Artificial Sequence
  chemically synthesized
cacgtgtcaccacgcccagc

SEQ ID NO: 84756 - DNA, 20 bp, Artificial Sequence
  chemically synthesized
gtttctaccaaaaactagct

SEQ ID NO: 84757 - DNA, 20 bp, Artificial Sequence
  chemically synthesized
cgtttctaccaaaaactagc

SEQ ID NO: 84758 - DNA, 20 bp, Artificial Sequence
  chemically synthesized
caccacgcccagctagtttt

SEQ ID NO: 84759 - DNA, 20 bp, Artificial Sequence
  chemically synthesized
actacgtttctaccaaaaac

SEQ ID NO: 84760 - DNA, 20 bp, Artificial Sequence
  chemically synthesized
cacgcccagctagtttttgg

SEQ ID NO: 84761 - DNA, 20 bp, Artificial Sequence
  chemically synthesized
gctagtttttggtagaaacg

SEQ ID NO: 84762 - DNA, 20 bp, Artificial Sequence
  chemically synthesized
gaaacgtagtttcactatgt

SEQ ID NO: 84763 - DNA, 20 bp, Artificial Sequence
  chemically synthesized
cgtagtttcactatgttggc

SEQ ID NO: 84764 - DNA, 20 bp, Artificial Sequence
  chemically synthesized
cgaaaccagcctggccaaca

SEQ ID NO: 84765 - DNA, 20 bp, Artificial Sequence
  chemically synthesized
gtagtttcactatgttggcc

SEQ ID NO: 84766 - DNA, 20 bp, Artificial Sequence
  chemically synthesized
tttcactatgttggccaggc

SEQ ID NO: 84767 - DNA, 20 bp, Artificial Sequence
  chemically synthesized
tcaagagttcgaaaccagcc

SEQ ID NO: 84768 - DNA, 20 bp, Artificial Sequence
  chemically synthesized
ggacgtcaagagttcgaaac

SEQ ID NO: 84769 - DNA, 20 bp, Artificial Sequence
  chemically synthesized
ggcagatccctggacgtcaa

SEQ ID NO: 84770 - DNA, 20 bp, Artificial Sequence
  chemically synthesized
ggtttcgaactcttgacgtc

SEQ ID NO: 84771 - DNA, 20 bp, Artificial Sequence
  chemically synthesized
gtttcgaactcttgacgtcc

SEQ ID NO: 84772 - DNA, 20 bp, Artificial Sequence
  chemically synthesized
caggcagatccctggacgtc

SEQ ID NO: 84773 - DNA, 20 bp, Artificial Sequence
  chemically synthesized
tttcgaactcttgacgtcca

SEQ ID NO: 84774 - DNA, 20 bp, Artificial Sequence
  chemically synthesized
ggctgaaacaggcagatccc

SEQ ID NO: 84775 - DNA, 20 bp, Artificial Sequence
  chemically synthesized
gtccagggatctgcctgttt

SEQ ID NO: 84776 - DNA, 20 bp, Artificial Sequence
  chemically synthesized
ctttgggtggctgaaacagg

SEQ ID NO: 84777 - DNA, 20 bp, Artificial Sequence
  chemically synthesized
gcactttgggtggctgaaac

SEQ ID NO: 84778 - DNA, 20 bp, Artificial Sequence
  chemically synthesized
agcactttgggtggctgaaa

SEQ ID NO: 84779 - DNA, 20 bp, Artificial Sequence
  chemically synthesized
ctgcctgtttcagccaccca

SEQ ID NO: 84780 - DNA, 20 bp, Artificial Sequence
  chemically synthesized
tgtaatcccagcactttggg

SEQ ID NO: 84781 - DNA, 20 bp, Artificial Sequence
  chemically synthesized
gtttcagccacccaaagtgc

SEQ ID NO: 84782 - DNA, 20 bp, Artificial Sequence
  chemically synthesized
gcctgtaatcccagcacttt

SEQ ID NO: 84783 - DNA, 20 bp, Artificial Sequence
  chemically synthesized
tttcagccacccaaagtgct

SEQ ID NO: 84784 - DNA, 20 bp, Artificial Sequence
  chemically synthesized
tgcctgtaatcccagcactt

SEQ ID NO: 84785 - DNA, 20 bp, Artificial Sequence
  chemically synthesized
cacccaaagtgctgggatta

SEQ ID NO: 84786 - DNA, 20 bp, Artificial Sequence
  chemically synthesized
acccaaagtgctgggattac

SEQ ID NO: 84787 - DNA, 20 bp, Artificial Sequence
  chemically synthesized
gtggctcatgcctgtaatcc

SEQ ID NO: 84788 - DNA, 20 bp, Artificial Sequence
  chemically synthesized
agtgctgggattacaggcat

SEQ ID NO: 84789 - DNA, 20 bp, Artificial Sequence
  chemically synthesized
caggcatgagccactgcacc

SEQ ID NO: 84790 - DNA, 20 bp, Artificial Sequence
  chemically synthesized
ttgtgtgaggccgggtgcag

SEQ ID NO: 84791 - DNA, 20 bp, Artificial Sequence
  chemically synthesized
gacttgtgtgaggccgggtg

SEQ ID NO: 84792 - DNA, 20 bp, Artificial Sequence
  chemically synthesized
gtaaagacttgtgtgaggcc

SEQ ID NO: 84793 - DNA, 20 bp, Artificial Sequence
  chemically synthesized
ggtaaagacttgtgtgaggc

SEQ ID NO: 84794 - DNA, 20 bp, Artificial Sequence
  chemically synthesized
cactgcacccggcctcacac

SEQ ID NO: 84795 - DNA, 20 bp, Artificial Sequence
  chemically synthesized
ttggggtaaagacttgtgtg

SEQ ID NO: 84796 - DNA, 20 bp, Artificial Sequence
  chemically synthesized
tttggggtaaagacttgtgt

SEQ ID NO: 84797 - DNA, 20 bp, Artificial Sequence
  chemically synthesized
gaggaggttattttggggta

SEQ ID NO: 84798 - DNA, 20 bp, Artificial Sequence
  chemically synthesized
tatgtgaggaggttattttg

SEQ ID NO: 84799 - DNA, 20 bp, Artificial Sequence
  chemically synthesized
ctatgtgaggaggttatttt

SEQ ID NO: 84800 - DNA, 20 bp, Artificial Sequence
  chemically synthesized
cctatgtgaggaggttattt

SEQ ID NO: 84801 - DNA, 20 bp, Artificial Sequence
  chemically synthesized
cccaaaataacctcctcaca

SEQ ID NO: 84802 - DNA, 20 bp, Artificial Sequence
  chemically synthesized
gagtactggcctatgtgagg

SEQ ID NO: 84803 - DNA, 20 bp, Artificial Sequence
  chemically synthesized
ccaaaataacctcctcacat

SEQ ID NO: 84804 - DNA, 20 bp, Artificial Sequence
  chemically synthesized
ggagtactggcctatgtgag

SEQ ID NO: 84805 - DNA, 20 bp, Artificial Sequence
  chemically synthesized
gaggagtactggcctatgtg

SEQ ID NO: 84806 - DNA, 20 bp, Artificial Sequence
  chemically synthesized
tgaggagtactggcctatgt

SEQ ID NO: 84807 - DNA, 20 bp, Artificial Sequence
  chemically synthesized
aataacctcctcacataggc

SEQ ID NO: 84808 - DNA, 20 bp, Artificial Sequence
  chemically synthesized
agagaaagattgaggagtac

SEQ ID NO: 84809 - DNA, 20 bp, Artificial Sequence
  chemically synthesized
atgaatagagaaagattgag

SEQ ID NO: 84810 - DNA, 20 bp, Artificial Sequence
  chemically synthesized
gcatgaatagagaaagattg

SEQ ID NO: 84811 - DNA, 20 bp, Artificial Sequence
  chemically synthesized
agcatgaatagagaaagatt

SEQ ID NO: 84812 - DNA, 20 bp, Artificial Sequence
  chemically synthesized
aaacaaagcatgaatagaga

SEQ ID NO: 84813 - DNA, 20 bp, Artificial Sequence
  chemically synthesized
aaataaacaaagcatgaata

SEQ ID NO: 84814 - DNA, 20 bp, Artificial Sequence
  chemically synthesized
gaaaataaacaaagcatgaa

SEQ ID NO: 84815 - DNA, 20 bp, Artificial Sequence
  chemically synthesized
ctatgaagagaaaataaaca

SEQ ID NO: 84816 - DNA, 20 bp, Artificial Sequence
  chemically synthesized
ctttgtttattttctcttca

SEQ ID NO: 84817 - DNA, 20 bp, Artificial Sequence
  chemically synthesized
tgggtagtaagtgctatgaa

SEQ ID NO: 84818 - DNA, 20 bp, Artificial Sequence
  chemically synthesized
gttgggtagtaagtgctatg

SEQ ID NO: 84819 - DNA, 20 bp, Artificial Sequence
  chemically synthesized
atgaaattatgttgggtagt

SEQ ID NO: 84820 - DNA, 20 bp, Artificial Sequence
  chemically synthesized
atatatgaaattatgttggg

SEQ ID NO: 84821 - DNA, 20 bp, Artificial Sequence
  chemically synthesized
ttaatatatgaaattatgtt

SEQ ID NO: 84822 - DNA, 20 bp, Artificial Sequence
  chemically synthesized
attaatatatgaaattatgt

SEQ ID NO: 84823 - DNA, 20 bp, Artificial Sequence
  chemically synthesized
taatttcatatattaattta

SEQ ID NO: 84824 - DNA, 20 bp, Artificial Sequence
  chemically synthesized
aatttcatatattaatttat

SEQ ID NO: 84825 - DNA, 20 bp, Artificial Sequence
  chemically synthesized
attttagtgacagaaataca

SEQ ID NO: 84826 - DNA, 20 bp, Artificial Sequence
  chemically synthesized
ggatgtttagattttagtga

SEQ ID NO: 84827 - DNA, 20 bp, Artificial Sequence
  chemically synthesized
ccctatggatgtttagattt

SEQ ID NO: 84828 - DNA, 20 bp, Artificial Sequence
  chemically synthesized
tctctgcccctatggatgtt

SEQ ID NO: 84829 - DNA, 20 bp, Artificial Sequence
  chemically synthesized
cactaaaatctaaacatcca

SEQ ID NO: 84830 - DNA, 20 bp, Artificial Sequence
  chemically synthesized
actaaaatctaaacatccat

SEQ ID NO: 84831 - DNA, 20 bp, Artificial Sequence
  chemically synthesized
ctaaaatctaaacatccata

SEQ ID NO: 84832 - DNA, 20 bp, Artificial Sequence
  chemically synthesized
taaaatctaaacatccatag

SEQ ID NO: 84833 - DNA, 20 bp, Artificial Sequence
  chemically synthesized
aatctaaacatccatagggg

SEQ ID NO: 84834 - DNA, 20 bp, Artificial Sequence
  chemically synthesized
aaaatgagtctctgccccta

SEQ ID NO: 84835 - DNA, 20 bp, Artificial Sequence
  chemically synthesized
tctaaacatccataggggca

SEQ ID NO: 84836 - DNA, 20 bp, Artificial Sequence
  chemically synthesized
catatgttagggaacaaaat

SEQ ID NO: 84837 - DNA, 20 bp, Artificial Sequence
  chemically synthesized
tctatgttaagcatatgtta

SEQ ID NO: 84838 - DNA, 20 bp, Artificial Sequence
  chemically synthesized
ctctatgttaagcatatgtt

SEQ ID NO: 84839 - DNA, 20 bp, Artificial Sequence
  chemically synthesized
actctatgttaagcatatgt

SEQ ID NO: 84840 - DNA, 20 bp, Artificial Sequence
  chemically synthesized
tccctaacatatgcttaaca

SEQ ID NO: 84841 - DNA, 20 bp, Artificial Sequence
  chemically synthesized
cctaacatatgcttaacata

SEQ ID NO: 84842 - DNA, 20 bp, Artificial Sequence
  chemically synthesized
tgaagagcctactctatgtt

SEQ ID NO: 84843 - DNA, 20 bp, Artificial Sequence
  chemically synthesized
aacatatgcttaacatagag

SEQ ID NO: 84844 - DNA, 20 bp, Artificial Sequence
  chemically synthesized
acatatgcttaacatagagt

SEQ ID NO: 84845 - DNA, 20 bp, Artificial Sequence
  chemically synthesized
tcaagaactttttttatgaa

SEQ ID NO: 84846 - DNA, 20 bp, Artificial Sequence
  chemically synthesized
tttcaagaactttttttatg

SEQ ID NO: 84847 - DNA, 20 bp, Artificial Sequence
  chemically synthesized
gagtaggctcttcataaaaa

SEQ ID NO: 84848 - DNA, 20 bp, Artificial Sequence
  chemically synthesized
ttcataaaaaaagttcttga

SEQ ID NO: 84849 - DNA, 20 bp, Artificial Sequence
  chemically synthesized
tagaatttattggttctttc

SEQ ID NO: 84850 - DNA, 20 bp, Artificial Sequence
  chemically synthesized
ctcagattcctagaatttat

SEQ ID NO: 84851 - DNA, 20 bp, Artificial Sequence
  chemically synthesized
ttgaaagaaccaataaattc

SEQ ID NO: 84852 - DNA, 20 bp, Artificial Sequence
  chemically synthesized
tgaaagaaccaataaattct

SEQ ID NO: 84853 - DNA, 20 bp, Artificial Sequence
  chemically synthesized
ccaataaattctaggaatct

SEQ ID NO: 84854 - DNA, 20 bp, Artificial Sequence
  chemically synthesized
tataccataactcagattcc

SEQ ID NO: 84855 - DNA, 20 bp, Artificial Sequence
  chemically synthesized
aattctaggaatctgagtta

SEQ ID NO: 84856 - DNA, 20 bp, Artificial Sequence
  chemically synthesized
ggaaaaattataccataact

SEQ ID NO: 84857 - DNA, 20 bp, Artificial Sequence
  chemically synthesized
tcccccaaaaacattatttt

SEQ ID NO: 84858 - DNA, 20 bp, Artificial Sequence
  chemically synthesized
gtcccccaaaaacattattt

SEQ ID NO: 84859 - DNA, 20 bp, Artificial Sequence
  chemically synthesized
ttttcctaaaataatgtttt

SEQ ID NO: 84860 - DNA, 20 bp, Artificial Sequence
  chemically synthesized
tttcctaaaataatgttttt

SEQ ID NO: 84861 - DNA, 20 bp, Artificial Sequence
  chemically synthesized
ttcctaaaataatgtttttg

SEQ ID NO: 84862 - DNA, 20 bp, Artificial Sequence
  chemically synthesized
tcctaaaataatgtttttgg

SEQ ID NO: 84863 - DNA, 20 bp, Artificial Sequence
  chemically synthesized
ataatgtttttgggggacaa

SEQ ID NO: 84864 - DNA, 20 bp, Artificial Sequence
  chemically synthesized
taatgtttttgggggacaaa

SEQ ID NO: 84865 - DNA, 20 bp, Artificial Sequence
  chemically synthesized
tgtttttgggggacaaaagg

SEQ ID NO: 84866 - DNA, 20 bp, Artificial Sequence
  chemically synthesized
tttttgggggacaaaaggaa

SEQ ID NO: 84867 - DNA, 20 bp, Artificial Sequence
  chemically synthesized
gggggacaaaaggaagagca

SEQ ID NO: 84868 - DNA, 20 bp, Artificial Sequence
  chemically synthesized
gaagagcacagaaaaaaatc

SEQ ID NO: 84869 - DNA, 20 bp, Artificial Sequence
  chemically synthesized
aagagcacagaaaaaaatca

SEQ ID NO: 84870 - DNA, 20 bp, Artificial Sequence
  chemically synthesized
agagcacagaaaaaaatcaa

SEQ ID NO: 84871 - DNA, 20 bp, Artificial Sequence
  chemically synthesized
gagcacagaaaaaaatcaag

SEQ ID NO: 84872 - DNA, 20 bp, Artificial Sequence
  chemically synthesized
taaatgaataatgtgtgtaa

SEQ ID NO: 84873 - DNA, 20 bp, Artificial Sequence
  chemically synthesized
gtgtgtaaaagtgctttgtc

SEQ ID NO: 84874 - DNA, 20 bp, Artificial Sequence
  chemically synthesized
tgtgtaaaagtgctttgtca

SEQ ID NO: 84875 - DNA, 20 bp, Artificial Sequence
  chemically synthesized
catagtgttttgccttgaca

SEQ ID NO: 84876 - DNA, 20 bp, Artificial Sequence
  chemically synthesized
tgtcaaggcaaaacactatg

SEQ ID NO: 84877 - DNA, 20 bp, Artificial Sequence
  chemically synthesized
tctttaaaacagtatctgca

SEQ ID NO: 84878 - DNA, 20 bp, Artificial Sequence
  chemically synthesized
actatgcagatactgtttta

SEQ ID NO: 84879 - DNA, 20 bp, Artificial Sequence
  chemically synthesized
tatgcagatactgttttaaa

SEQ ID NO: 84880 - DNA, 20 bp, Artificial Sequence
  chemically synthesized
ctgacaaatactctttaaaa

SEQ ID NO: 84881 - DNA, 20 bp, Artificial Sequence
  chemically synthesized
ctgttttaaagagtatttgt

SEQ ID NO: 84882 - DNA, 20 bp, Artificial Sequence
  chemically synthesized
tgttttaaagagtatttgtc

SEQ ID NO: 84883 - DNA, 20 bp, Artificial Sequence
  chemically synthesized
gacatcaaaatattttgaca

SEQ ID NO: 84884 - DNA, 20 bp, Artificial Sequence
  chemically synthesized
tcaaaatattttgacaaagt

SEQ ID NO: 84885 - DNA, 20 bp, Artificial Sequence
  chemically synthesized
aaaatattttgacaaagtga

SEQ ID NO: 84886 - DNA, 20 bp, Artificial Sequence
  chemically synthesized
aatattttgacaaagtgaga

SEQ ID NO: 84887 - DNA, 20 bp, Artificial Sequence
  chemically synthesized
attttgacaaagtgagagag

SEQ ID NO: 84888 - DNA, 20 bp, Artificial Sequence
  chemically synthesized
gacaaagtgagagagaagac

SEQ ID NO: 84889 - DNA, 20 bp, Artificial Sequence
  chemically synthesized
aaagtgagagagaagactgg

SEQ ID NO: 84890 - DNA, 20 bp, Artificial Sequence
  chemically synthesized
agtgagagagaagactggta

SEQ ID NO: 84891 - DNA, 20 bp, Artificial Sequence
  chemically synthesized
gagagagaagactggtagag

SEQ ID NO: 84892 - DNA, 20 bp, Artificial Sequence
  chemically synthesized
ttacaaactgacttctctac

SEQ ID NO: 84893 - DNA, 20 bp, Artificial Sequence
  chemically synthesized
gagaagactggtagagaagt

SEQ ID NO: 84894 - DNA, 20 bp, Artificial Sequence
  chemically synthesized
tttaatgactgtaacaagat

SEQ ID NO: 84895 - DNA, 20 bp, Artificial Sequence
  chemically synthesized
attcacatctcatcttgtta

SEQ ID NO: 84896 - DNA, 20 bp, Artificial Sequence
  chemically synthesized
tttgctttaatgactgtaac

SEQ ID NO: 84897 - DNA, 20 bp, Artificial Sequence
  chemically synthesized
tcatcttgttacagtcatta

SEQ ID NO: 84898 - DNA, 20 bp, Artificial Sequence
  chemically synthesized
ttgttacagtcattaaagca

SEQ ID NO: 84899 - DNA, 20 bp, Artificial Sequence
  chemically synthesized
ttacagtcattaaagcaaag

SEQ ID NO: 84900 - DNA, 20 bp, Artificial Sequence
  chemically synthesized
taaagcaaagcagcaattcc

SEQ ID NO: 84901 - DNA, 20 bp, Artificial Sequence
  chemically synthesized
actgaagaactgagtcatct

SEQ ID NO: 84902 - DNA, 20 bp, Artificial Sequence
  chemically synthesized
gcagcaattcctagatgact

SEQ ID NO: 84903 - DNA, 20 bp, Artificial Sequence
  chemically synthesized
aactgaagaactgagtcatc

SEQ ID NO: 84904 - DNA, 20 bp, Artificial Sequence
  chemically synthesized
tcctagatgactcagttctt

SEQ ID NO: 84905 - DNA, 20 bp, Artificial Sequence
  chemically synthesized
atcatcaaaactgaagaact

SEQ ID NO: 84906 - DNA, 20 bp, Artificial Sequence
  chemically synthesized
tagctttatcatcaaaactg

SEQ ID NO: 84907 - DNA, 20 bp, Artificial Sequence
  chemically synthesized
gttcttcagttttgatgata

SEQ ID NO: 84908 - DNA, 20 bp, Artificial Sequence
  chemically synthesized
ttcagttttgatgataaagc

SEQ ID NO: 84909 - DNA, 20 bp, Artificial Sequence
  chemically synthesized
ttgatgataaagctagtttt

SEQ ID NO: 84910 - DNA, 20 bp, Artificial Sequence
  chemically synthesized
agtctaagtcttctgaaaac

SEQ ID NO: 84911 - DNA, 20 bp, Artificial Sequence
  chemically synthesized
atgataaagctagttttcag

SEQ ID NO: 84912 - DNA, 20 bp, Artificial Sequence
  chemically synthesized
aagctagttttcagaagact

SEQ ID NO: 84913 - DNA, 20 bp, Artificial Sequence
  chemically synthesized
gttttcagaagacttagact

SEQ ID NO: 84914 - DNA, 20 bp, Artificial Sequence
  chemically synthesized
gtcttctgaaaactaagtct

SEQ ID NO: 84915 - DNA, 20 bp, Artificial Sequence
  chemically synthesized
gaagacttagacttagtttt

SEQ ID NO: 84916 - DNA, 20 bp, Artificial Sequence
  chemically synthesized
atttgagtcttctgaaaact

SEQ ID NO: 84917 - DNA, 20 bp, Artificial Sequence
  chemically synthesized
gacttagacttagttttcag

SEQ ID NO: 84918 - DNA, 20 bp, Artificial Sequence
  chemically synthesized
tttcagaagactcaaatgcc

SEQ ID NO: 84919 - DNA, 20 bp, Artificial Sequence
  chemically synthesized
aactgcatttctaggcattt

SEQ ID NO: 84920 - DNA, 20 bp, Artificial Sequence
  chemically synthesized
gactcaaatgcctagaaatg

SEQ ID NO: 84921 - DNA, 20 bp, Artificial Sequence
  chemically synthesized
atttttagaactgcatttct

SEQ ID NO: 84922 - DNA, 20 bp, Artificial Sequence
  chemically synthesized
tatttttagaactgcatttc

SEQ ID NO: 84923 - DNA, 20 bp, Artificial Sequence
  chemically synthesized
aatgacttaaaaattatttt

SEQ ID NO: 84924 - DNA, 20 bp, Artificial Sequence
  chemically synthesized
cagttctaaaaataattttt

SEQ ID NO: 84925 - DNA, 20 bp, Artificial Sequence
  chemically synthesized
atttttaagtcatttctatt

SEQ ID NO: 84926 - DNA, 20 bp, Artificial Sequence
  chemically synthesized
tcatatttagggatgctgaa

SEQ ID NO: 84927 - DNA, 20 bp, Artificial Sequence
  chemically synthesized
atcctatgcagtcatattta

SEQ ID NO: 84928 - DNA, 20 bp, Artificial Sequence
  chemically synthesized
tatcctatgcagtcatattt

SEQ ID NO: 84929 - DNA, 20 bp, Artificial Sequence
  chemically synthesized
atatcctatgcagtcatatt

SEQ ID NO: 84930 - DNA, 20 bp, Artificial Sequence
  chemically synthesized
catccctaaatatgactgca

SEQ ID NO: 84931 - DNA, 20 bp, Artificial Sequence
  chemically synthesized
atccctaaatatgactgcat

SEQ ID NO: 84932 - DNA, 20 bp, Artificial Sequence
  chemically synthesized
tataagtttgatatcctatg

SEQ ID NO: 84933 - DNA, 20 bp, Artificial Sequence
  chemically synthesized
attcttcatcatttttgtat

SEQ ID NO: 84934 - DNA, 20 bp, Artificial Sequence
  chemically synthesized
aaacttatacaaaaatgatg

SEQ ID NO: 84935 - DNA, 20 bp, Artificial Sequence
  chemically synthesized
tatacaaaaatgatgaagaa

SEQ ID NO: 84936 - DNA, 20 bp, Artificial Sequence
  chemically synthesized
atgatgaagaatagatcaaa

SEQ ID NO: 84937 - DNA, 20 bp, Artificial Sequence
  chemically synthesized
tttagccgcgttggaggaaa

SEQ ID NO: 84938 - DNA, 20 bp, Artificial Sequence
  chemically synthesized
gacgtctatttcctccaacg

SEQ ID NO: 84939 - DNA, 20 bp, Artificial Sequence
  chemically synthesized
tgtctttttagccgcgttgg

SEQ ID NO: 84940 - DNA, 20 bp, Artificial Sequence
  chemically synthesized
gtgtctttttagccgcgttg

SEQ ID NO: 84941 - DNA, 20 bp, Artificial Sequence
  chemically synthesized
aggtgtctttttagccgcgt

SEQ ID NO: 84942 - DNA, 20 bp, Artificial Sequence
  chemically synthesized
tttcctccaacgcggctaaa

SEQ ID NO: 84943 - DNA, 20 bp, Artificial Sequence
  chemically synthesized
tctactctaaggtgtctttt

SEQ ID NO: 84944 - DNA, 20 bp, Artificial Sequence
  chemically synthesized
acgcggctaaaaagacacct

SEQ ID NO: 84945 - DNA, 20 bp, Artificial Sequence
  chemically synthesized
gcggctaaaaagacacctta

SEQ ID NO: 84946 - DNA, 20 bp, Artificial Sequence
  chemically synthesized
gctaaaaagacaccttagag

SEQ ID NO: 84947 - DNA, 20 bp, Artificial Sequence
  chemically synthesized
tgttagttatatctactcta

SEQ ID NO: 84948 - DNA, 20 bp, Artificial Sequence
  chemically synthesized
ctgttagttatatctactct

SEQ ID NO: 84949 - DNA, 20 bp, Artificial Sequence
  chemically synthesized
cttagagtagatataactaa

SEQ ID NO: 84950 - DNA, 20 bp, Artificial Sequence
  chemically synthesized
agtagatataactaacagtc

SEQ ID NO: 84951 - DNA, 20 bp, Artificial Sequence
  chemically synthesized
tttctaaaccacttgactgt

SEQ ID NO: 84952 - DNA, 20 bp, Artificial Sequence
  chemically synthesized
agatataactaacagtcaag

SEQ ID NO: 84953 - DNA, 20 bp, Artificial Sequence
  chemically synthesized
taactaacagtcaagtggtt

SEQ ID NO: 84954 - DNA, 20 bp, Artificial Sequence
  chemically synthesized
tcaagtggtttagaaactct

SEQ ID NO: 84955 - DNA, 20 bp, Artificial Sequence
  chemically synthesized
aagtggtttagaaactctaa

SEQ ID NO: 84956 - DNA, 20 bp, Artificial Sequence
  chemically synthesized
agtggtttagaaactctaag

SEQ ID NO: 84957 - DNA, 20 bp, Artificial Sequence
  chemically synthesized
ttcaatgacctggcctctta

SEQ ID NO: 84958 - DNA, 20 bp, Artificial Sequence
  chemically synthesized
gtttagaaactctaagaggc

SEQ ID NO: 84959 - DNA, 20 bp, Artificial Sequence
  chemically synthesized
tttagaaactctaagaggcc

SEQ ID NO: 84960 - DNA, 20 bp, Artificial Sequence
  chemically synthesized
cattcaatgacctggcctct

SEQ ID NO: 84961 - DNA, 20 bp, Artificial Sequence
  chemically synthesized
cattctaacattcaatgacc

SEQ ID NO: 84962 - DNA, 20 bp, Artificial Sequence
  chemically synthesized
gaggccaggtcattgaatgt

SEQ ID NO: 84963 - DNA, 20 bp, Artificial Sequence
  chemically synthesized
aatgttagaatgaatcactc

SEQ ID NO: 84964 - DNA, 20 bp, Artificial Sequence
  chemically synthesized
ttagaatgaatcactctggc

SEQ ID NO: 84965 - DNA, 20 bp, Artificial Sequence
  chemically synthesized
tagaatgaatcactctggcc

SEQ ID NO: 84966 - DNA, 20 bp, Artificial Sequence
  chemically synthesized
tgagccaccgcgcccggcca

SEQ ID NO: 84967 - DNA, 20 bp, Artificial Sequence
  chemically synthesized
cgtgagccaccgcgcccggc

SEQ ID NO: 84968 - DNA, 20 bp, Artificial Sequence
  chemically synthesized
tgaatcactctggccgggcg

SEQ ID NO: 84969 - DNA, 20 bp, Artificial Sequence
  chemically synthesized
atcactctggccgggcgcgg

SEQ ID NO: 84970 - DNA, 20 bp, Artificial Sequence
  chemically synthesized
caggcgtgagccaccgcgcc

SEQ ID NO: 84971 - DNA, 20 bp, Artificial Sequence
  chemically synthesized
agtgctgggattacaggcgt

SEQ ID NO: 84972 - DNA, 20 bp, Artificial Sequence
  chemically synthesized
gtggctcacgcctgtaatcc

SEQ ID NO: 84973 - DNA, 20 bp, Artificial Sequence
  chemically synthesized
tcccaaagtgctgggattac

SEQ ID NO: 84974 - DNA, 20 bp, Artificial Sequence
  chemically synthesized
ctcccaaagtgctgggatta

SEQ ID NO: 84975 - DNA, 20 bp, Artificial Sequence
  chemically synthesized
cgcctgtaatcccagcactt

SEQ ID NO: 84976 - DNA, 20 bp, Artificial Sequence
  chemically synthesized
cctcagcctcccaaagtgct

SEQ ID NO: 84977 - DNA, 20 bp, Artificial Sequence
  chemically synthesized
gcctgtaatcccagcacttt

SEQ ID NO: 84978 - DNA, 20 bp, Artificial Sequence
  chemically synthesized
gcctcagcctcccaaagtgc

SEQ ID NO: 84979 - DNA, 20 bp, Artificial Sequence
  chemically synthesized
ctgtaatcccagcactttgg

SEQ ID NO: 84980 - DNA, 20 bp, Artificial Sequence
  chemically synthesized
tgtaatcccagcactttggg

SEQ ID NO: 84981 - DNA, 20 bp, Artificial Sequence
  chemically synthesized
ccacccgcctcagcctccca

SEQ ID NO: 84982 - DNA, 20 bp, Artificial Sequence
  chemically synthesized
tcccagcactttgggaggct

SEQ ID NO: 84983 - DNA, 20 bp, Artificial Sequence
  chemically synthesized
cccagcactttgggaggctg

SEQ ID NO: 84984 - DNA, 20 bp, Artificial Sequence
  chemically synthesized
agcactttgggaggctgagg

SEQ ID NO: 84985 - DNA, 20 bp, Artificial Sequence
  chemically synthesized
gcactttgggaggctgaggc

SEQ ID NO: 84986 - DNA, 20 bp, Artificial Sequence
  chemically synthesized
ctttgggaggctgaggcggg

SEQ ID NO: 84987 - DNA, 20 bp, Artificial Sequence
  chemically synthesized
acctcgtgatccacccgcct

SEQ ID NO: 84988 - DNA, 20 bp, Artificial Sequence
  chemically synthesized
ggctgaggcgggtggatcac

SEQ ID NO: 84989 - DNA, 20 bp, Artificial Sequence
  chemically synthesized
gctgaggcgggtggatcacg

SEQ ID NO: 84990 - DNA, 20 bp, Artificial Sequence
  chemically synthesized
aggcgggtggatcacgaggt

SEQ ID NO: 84991 - DNA, 20 bp, Artificial Sequence
  chemically synthesized
ggcgggtggatcacgaggtc

SEQ ID NO: 84992 - DNA, 20 bp, Artificial Sequence
  chemically synthesized
cgggtggatcacgaggtcag

SEQ ID NO: 84993 - DNA, 20 bp, Artificial Sequence
  chemically synthesized
gatcacgaggtcaggagatc

SEQ ID NO: 84994 - DNA, 20 bp, Artificial Sequence
  chemically synthesized
tcaggagatcgagaccatcc

SEQ ID NO: 84995 - DNA, 20 bp, Artificial Sequence
  chemically synthesized
tttcaccgtgttagccagga

SEQ ID NO: 84996 - DNA, 20 bp, Artificial Sequence
  chemically synthesized
ggggtttcaccgtgttagcc

SEQ ID NO: 84997 - DNA, 20 bp, Artificial Sequence
  chemically synthesized
cgagaccatcctggctaaca

SEQ ID NO: 84998 - DNA, 20 bp, Artificial Sequence
  chemically synthesized
cggggtttcaccgtgttagc

SEQ ID NO: 84999 - DNA, 20 bp, Artificial Sequence
  chemically synthesized
gagacggggtttcaccgtgt

SEQ ID NO: 85000 - DNA, 20 bp, Artificial Sequence
  chemically synthesized
ttgtatttttagtagagacg

SEQ ID NO: 85001 - DNA, 20 bp, Artificial Sequence
  chemically synthesized
tttgtatttttagtagagac

SEQ ID NO: 85002 - DNA, 20 bp, Artificial Sequence
  chemically synthesized
ttttgtatttttagtagaga

SEQ ID NO: 85003 - DNA, 20 bp, Artificial Sequence
  chemically synthesized
aatgttttgtatttttagta

SEQ ID NO: 85004 - DNA, 20 bp, Artificial Sequence
  chemically synthesized
ctaatgttttgtatttttag

SEQ ID NO: 85005 - DNA, 20 bp, Artificial Sequence
  chemically synthesized
tggctaatgttttgtatttt

SEQ ID NO: 85006 - DNA, 20 bp, Artificial Sequence
  chemically synthesized
ctactaaaaatacaaaacat

SEQ ID NO: 85007 - DNA, 20 bp, Artificial Sequence
  chemically synthesized
taaaaatacaaaacattagc

SEQ ID NO: 85008 - DNA, 20 bp, Artificial Sequence
  chemically synthesized
aaaaatacaaaacattagcc

SEQ ID NO: 85009 - DNA, 20 bp, Artificial Sequence
  chemically synthesized
tacaaaacattagccaggtg

SEQ ID NO: 85010 - DNA, 20 bp, Artificial Sequence
  chemically synthesized
aaaacattagccaggtgtgg

SEQ ID NO: 85011 - DNA, 20 bp, Artificial Sequence
  chemically synthesized
caggcacccaccaccacacc

SEQ ID NO: 85012 - DNA, 20 bp, Artificial Sequence
  chemically synthesized
acattagccaggtgtggtgg

SEQ ID NO: 85013 - DNA, 20 bp, Artificial Sequence
  chemically synthesized
cattagccaggtgtggtggt

SEQ ID NO: 85014 - DNA, 20 bp, Artificial Sequence
  chemically synthesized
ggtgtggtggtgggtgcctg

SEQ ID NO: 85015 - DNA, 20 bp, Artificial Sequence
  chemically synthesized
gtggtgggtgcctgtagtcc

SEQ ID NO: 85016 - DNA, 20 bp, Artificial Sequence
  chemically synthesized
cctgcctcagctgggactac

SEQ ID NO: 85017 - DNA, 20 bp, Artificial Sequence
  chemically synthesized
tcctgcctcagctgggacta

SEQ ID NO: 85018 - DNA, 20 bp, Artificial Sequence
  chemically synthesized
gggtgcctgtagtcccagct

SEQ ID NO: 85019 - DNA, 20 bp, Artificial Sequence
  chemically synthesized
ggtgcctgtagtcccagctg

SEQ ID NO: 85020 - DNA, 20 bp, Artificial Sequence
  chemically synthesized
ctccttctcctgcctcagct

SEQ ID NO: 85021 - DNA, 20 bp, Artificial Sequence
  chemically synthesized
gcctgtagtcccagctgagg

SEQ ID NO: 85022 - DNA, 20 bp, Artificial Sequence
  chemically synthesized
tctccttctcctgcctcagc

SEQ ID NO: 85023 - DNA, 20 bp, Artificial Sequence
  chemically synthesized
cctgtagtcccagctgaggc

SEQ ID NO: 85024 - DNA, 20 bp, Artificial Sequence
  chemically synthesized
tgtagtcccagctgaggcag

SEQ ID NO: 85025 - DNA, 20 bp, Artificial Sequence
  chemically synthesized
ccattctccttctcctgcct

SEQ ID NO: 85026 - DNA, 20 bp, Artificial Sequence
  chemically synthesized
agtcccagctgaggcaggag

SEQ ID NO: 85027 - DNA, 20 bp, Artificial Sequence
  chemically synthesized
gtcccagctgaggcaggaga

SEQ ID NO: 85028 - DNA, 20 bp, Artificial Sequence
  chemically synthesized
cccagctgaggcaggagaag

SEQ ID NO: 85029 - DNA, 20 bp, Artificial Sequence
  chemically synthesized
ctgaggcaggagaaggagaa

SEQ ID NO: 85030 - DNA, 20 bp, Artificial Sequence
  chemically synthesized
gaaggagaatggcgtgaacc

SEQ ID NO: 85031 - DNA, 20 bp, Artificial Sequence
  chemically synthesized
aaggagaatggcgtgaaccc

SEQ ID NO: 85032 - DNA, 20 bp, Artificial Sequence
  chemically synthesized
ggagaatggcgtgaacccag

SEQ ID NO: 85033 - DNA, 20 bp, Artificial Sequence
  chemically synthesized
gagaatggcgtgaacccagg

SEQ ID NO: 85034 - DNA, 20 bp, Artificial Sequence
  chemically synthesized
aatggcgtgaacccaggagg

SEQ ID NO: 85035 - DNA, 20 bp, Artificial Sequence
  chemically synthesized
caccgcaagctccacctcct

SEQ ID NO: 85036 - DNA, 20 bp, Artificial Sequence
  chemically synthesized
tggcgtgaacccaggaggtg

SEQ ID NO: 85037 - DNA, 20 bp, Artificial Sequence
  chemically synthesized
tcaccgcaagctccacctcc

SEQ ID NO: 85038 - DNA, 20 bp, Artificial Sequence
  chemically synthesized
aacccaggaggtggagcttg

SEQ ID NO: 85039 - DNA, 20 bp, Artificial Sequence
  chemically synthesized
caggaggtggagcttgcggt

SEQ ID NO: 85040 - DNA, 20 bp, Artificial Sequence
  chemically synthesized
gtgcgatctcggctcaccgc

SEQ ID NO: 85041 - DNA, 20 bp, Artificial Sequence
  chemically synthesized
ggtggagcttgcggtgagcc

SEQ ID NO: 85042 - DNA, 20 bp, Artificial Sequence
  chemically synthesized
ggagtgcagcggtgcgatct

SEQ ID NO: 85043 - DNA, 20 bp, Artificial Sequence
  chemically synthesized
cagcccaggctggagtgcag

SEQ ID NO: 85044 - DNA, 20 bp, Artificial Sequence
  chemically synthesized
gagatcgcaccgctgcactc

SEQ ID NO: 85045 - DNA, 20 bp, Artificial Sequence
  chemically synthesized
ctgcagcccaggctggagtg

SEQ ID NO: 85046 - DNA, 20 bp, Artificial Sequence
  chemically synthesized
cgcaccgctgcactccagcc

SEQ ID NO: 85047 - DNA, 20 bp, Artificial Sequence
  chemically synthesized
gcaccgctgcactccagcct

SEQ ID NO: 85048 - DNA, 20 bp, Artificial Sequence
  chemically synthesized
ctcgcctgcagcccaggctg

SEQ ID NO: 85049 - DNA, 20 bp, Artificial Sequence
  chemically synthesized
gtctcgcctgcagcccaggc

SEQ ID NO: 85050 - DNA, 20 bp, Artificial Sequence
  chemically synthesized
ctgcactccagcctgggctg

SEQ ID NO: 85051 - DNA, 20 bp, Artificial Sequence
  chemically synthesized
tgcactccagcctgggctgc

SEQ ID NO: 85052 - DNA, 20 bp, Artificial Sequence
  chemically synthesized
tggagtctcgcctgcagccc

SEQ ID NO: 85053 - DNA, 20 bp, Artificial Sequence
  chemically synthesized
atggagtctcgcctgcagcc

SEQ ID NO: 85054 - DNA, 20 bp, Artificial Sequence
  chemically synthesized
ctccagcctgggctgcaggc

SEQ ID NO: 85055 - DNA, 20 bp, Artificial Sequence
  chemically synthesized
ttgagatggagtctcgcctg

SEQ ID NO: 85056 - DNA, 20 bp, Artificial Sequence
  chemically synthesized
tttaatttttttttgagatg

SEQ ID NO: 85057 - DNA, 20 bp, Artificial Sequence
  chemically synthesized
tctttaatttttttttgaga

SEQ ID NO: 85058 - DNA, 20 bp, Artificial Sequence
  chemically synthesized
tttttctttaattttttttt

SEQ ID NO: 85059 - DNA, 20 bp, Artificial Sequence
  chemically synthesized
tccatctcaaaaaaaaatta

SEQ ID NO: 85060 - DNA, 20 bp, Artificial Sequence
  chemically synthesized
ttaaagaaaaaataaataaa

SEQ ID NO: 85061 - DNA, 20 bp, Artificial Sequence
  chemically synthesized
gaaaaaataaataaaaagaa

SEQ ID NO: 85062 - DNA, 20 bp, Artificial Sequence
  chemically synthesized
taaataaaaagaaaagaaaa

SEQ ID NO: 85063 - DNA, 20 bp, Artificial Sequence
  chemically synthesized
aacaaccaaaagttgcgata

SEQ ID NO: 85064 - DNA, 20 bp, Artificial Sequence
  chemically synthesized
aaaacaaccaaaagttgcga

SEQ ID NO: 85065 - DNA, 20 bp, Artificial Sequence
  chemically synthesized
aatcactctatcgcaacttt

SEQ ID NO: 85066 - DNA, 20 bp, Artificial Sequence
  chemically synthesized
cacctctgaaaaacaaccaa

SEQ ID NO: 85067 - DNA, 20 bp, Artificial Sequence
  chemically synthesized
cgcaacttttggttgttttt

SEQ ID NO: 85068 - DNA, 20 bp, Artificial Sequence
  chemically synthesized
caacttttggttgtttttca

SEQ ID NO: 85069 - DNA, 20 bp, Artificial Sequence
  chemically synthesized
aacttttggttgtttttcag

SEQ ID NO: 85070 - DNA, 20 bp, Artificial Sequence
  chemically synthesized
tggttgtttttcagaggtga

SEQ ID NO: 85071 - DNA, 20 bp, Artificial Sequence
  chemically synthesized
ggttgtttttcagaggtgat

SEQ ID NO: 85072 - DNA, 20 bp, Artificial Sequence
  chemically synthesized
gttgtttttcagaggtgata

SEQ ID NO: 85073 - DNA, 20 bp, Artificial Sequence
  chemically synthesized
acaacgcatttttcttaaca

SEQ ID NO: 85074 - DNA, 20 bp, Artificial Sequence
  chemically synthesized
aacgcatttttcttaacaca

SEQ ID NO: 85075 - DNA, 20 bp, Artificial Sequence
  chemically synthesized
atttaagtcagctctgtgtt

SEQ ID NO: 85076 - DNA, 20 bp, Artificial Sequence
  chemically synthesized
gtgaatgttaagatttaagt

SEQ ID NO: 85077 - DNA, 20 bp, Artificial Sequence
  chemically synthesized
atttgtgaatgttaagattt

SEQ ID NO: 85078 - DNA, 20 bp, Artificial Sequence
  chemically synthesized
ggatgtcatttgtgaatgtt

SEQ ID NO: 85079 - DNA, 20 bp, Artificial Sequence
  chemically synthesized
acattcacaaatgacatcca

SEQ ID NO: 85080 - DNA, 20 bp, Artificial Sequence
  chemically synthesized
acagaaagagaaaatatctt

SEQ ID NO: 85081 - DNA, 20 bp, Artificial Sequence
  chemically synthesized
gtgttttctttttacagaaa

SEQ ID NO: 85082 - DNA, 20 bp, Artificial Sequence
  chemically synthesized
ctgtgttttctttttacaga

SEQ ID NO: 85083 - DNA, 20 bp, Artificial Sequence
  chemically synthesized
atattttctctttctgtaaa

SEQ ID NO: 85084 - DNA, 20 bp, Artificial Sequence
  chemically synthesized
ttttctgtgttttcttttta

SEQ ID NO: 85085 - DNA, 20 bp, Artificial Sequence
  chemically synthesized
ctttctgtaaaaagaaaaca

SEQ ID NO: 85086 - DNA, 20 bp, Artificial Sequence
  chemically synthesized
gaaaacacagaaaactcgtc

SEQ ID NO: 85087 - DNA, 20 bp, Artificial Sequence
  chemically synthesized
agtatgtatgttagcttgac

SEQ ID NO: 85088 - DNA, 20 bp, Artificial Sequence
  chemically synthesized
atacattttagtatgtatgt

SEQ ID NO: 85089 - DNA, 20 bp, Artificial Sequence
  chemically synthesized
tgcttacgtgggatacattt

SEQ ID NO: 85090 - DNA, 20 bp, Artificial Sequence
  chemically synthesized
tactaaaatgtatcccacgt

SEQ ID NO: 85091 - DNA, 20 bp, Artificial Sequence
  chemically synthesized
taaaatgtatcccacgtaag

SEQ ID NO: 85092 - DNA, 20 bp, Artificial Sequence
  chemically synthesized
cagtgctggcctgcttacgt

SEQ ID NO: 85093 - DNA, 20 bp, Artificial Sequence
  chemically synthesized
aaaatgtatcccacgtaagc

SEQ ID NO: 85094 - DNA, 20 bp, Artificial Sequence
  chemically synthesized
tcagtgctggcctgcttacg

SEQ ID NO: 85095 - DNA, 20 bp, Artificial Sequence
  chemically synthesized
tgtatcccacgtaagcaggc

SEQ ID NO: 85096 - DNA, 20 bp, Artificial Sequence
  chemically synthesized
gctcattctgttatcagtgc

SEQ ID NO: 85097 - DNA, 20 bp, Artificial Sequence
  chemically synthesized
aagcaggccagcactgataa

SEQ ID NO: 85098 - DNA, 20 bp, Artificial Sequence
  chemically synthesized
atttaggctcattctgttat

SEQ ID NO: 85099 - DNA, 20 bp, Artificial Sequence
  chemically synthesized
gccagcactgataacagaat

SEQ ID NO: 85100 - DNA, 20 bp, Artificial Sequence
  chemically synthesized
tgtagattatacatttattt

SEQ ID NO: 85101 - DNA, 20 bp, Artificial Sequence
  chemically synthesized
ttgtagattatacatttatt

SEQ ID NO: 85102 - DNA, 20 bp, Artificial Sequence
  chemically synthesized
attatcctgaaatcatgttg

SEQ ID NO: 85103 - DNA, 20 bp, Artificial Sequence
  chemically synthesized
tataatctacaacatgattt

SEQ ID NO: 85104 - DNA, 20 bp, Artificial Sequence
  chemically synthesized
ataatctacaacatgatttc

SEQ ID NO: 85105 - DNA, 20 bp, Artificial Sequence
  chemically synthesized
gataattttattgaatttct

SEQ ID NO: 85106 - DNA, 20 bp, Artificial Sequence
  chemically synthesized
cacaaagtgagagacaggct

SEQ ID NO: 85107 - DNA, 20 bp, Artificial Sequence
  chemically synthesized
gtcaccacaaagtgagagac

SEQ ID NO: 85108 - DNA, 20 bp, Artificial Sequence
  chemically synthesized
agtcaccacaaagtgagaga

SEQ ID NO: 85109 - DNA, 20 bp, Artificial Sequence
  chemically synthesized
cagaagtcaccacaaagtga

SEQ ID NO: 85110 - DNA, 20 bp, Artificial Sequence
  chemically synthesized
tcagcctgtctctcactttg

SEQ ID NO: 85111 - DNA, 20 bp, Artificial Sequence
  chemically synthesized
ttcagaagtcaccacaaagt

SEQ ID NO: 85112 - DNA, 20 bp, Artificial Sequence
  chemically synthesized
tttcttcagaagtcaccaca

SEQ ID NO: 85113 - DNA, 20 bp, Artificial Sequence
  chemically synthesized
tcactttgtggtgacttctg

SEQ ID NO: 85114 - DNA, 20 bp, Artificial Sequence
  chemically synthesized
tgcatgttcgatttcttcag

SEQ ID NO: 85115 - DNA, 20 bp, Artificial Sequence
  chemically synthesized
ttatgcatgttcgatttctt

SEQ ID NO: 85116 - DNA, 20 bp, Artificial Sequence
  chemically synthesized
agtttacttgttcatttgtc

SEQ ID NO: 85117 - DNA, 20 bp, Artificial Sequence
  chemically synthesized
tagtttacttgttcatttgt

SEQ ID NO: 85118 - DNA, 20 bp, Artificial Sequence
  chemically synthesized
atatgacctgacaaatgaac

SEQ ID NO: 85119 - DNA, 20 bp, Artificial Sequence
  chemically synthesized
atgaaaaggcttgaataaag

SEQ ID NO: 85120 - DNA, 20 bp, Artificial Sequence
  chemically synthesized
acaagtaaactactttattc

SEQ ID NO: 85121 - DNA, 20 bp, Artificial Sequence
  chemically synthesized
caaatgaaaaggcttgaata

SEQ ID NO: 85122 - DNA, 20 bp, Artificial Sequence
  chemically synthesized
gatgctgttgacaaatgaaa

SEQ ID NO: 85123 - DNA, 20 bp, Artificial Sequence
  chemically synthesized
ggatgctgttgacaaatgaa

SEQ ID NO: 85124 - DNA, 20 bp, Artificial Sequence
  chemically synthesized
caagccttttcatttgtcaa

SEQ ID NO: 85125 - DNA, 20 bp, Artificial Sequence
  chemically synthesized
ttcatttgtcaacagcatcc

SEQ ID NO: 85126 - DNA, 20 bp, Artificial Sequence
  chemically synthesized
gacagaaagccattattgct

SEQ ID NO: 85127 - DNA, 20 bp, Artificial Sequence
  chemically synthesized
caacagcatccaagcaataa

SEQ ID NO: 85128 - DNA, 20 bp, Artificial Sequence
  chemically synthesized
ttattaaaagagtggacaga

SEQ ID NO: 85129 - DNA, 20 bp, Artificial Sequence
  chemically synthesized
tacattattaaaagagtgga

SEQ ID NO: 85130 - DNA, 20 bp, Artificial Sequence
  chemically synthesized
tacatacattattaaaagag

SEQ ID NO: 85131 - DNA, 20 bp, Artificial Sequence
  chemically synthesized
caatacatacattattaaaa

SEQ ID NO: 85132 - DNA, 20 bp, Artificial Sequence
  chemically synthesized
atcaatacatacattattaa

SEQ ID NO: 85133 - DNA, 20 bp, Artificial Sequence
  chemically synthesized
tctggttaagatttagatgg

SEQ ID NO: 85134 - DNA, 20 bp, Artificial Sequence
  chemically synthesized
ttttctggttaagatttaga

SEQ ID NO: 85135 - DNA, 20 bp, Artificial Sequence
  chemically synthesized
gagattttctggttaagatt

SEQ ID NO: 85136 - DNA, 20 bp, Artificial Sequence
  chemically synthesized
acttccatctaaatcttaac

SEQ ID NO: 85137 - DNA, 20 bp, Artificial Sequence
  chemically synthesized
cttcccgagattttctggtt

SEQ ID NO: 85138 - DNA, 20 bp, Artificial Sequence
  chemically synthesized
caaagcttcccgagattttc

SEQ ID NO: 85139 - DNA, 20 bp, Artificial Sequence
  chemically synthesized
aaatcttaaccagaaaatct

SEQ ID NO: 85140 - DNA, 20 bp, Artificial Sequence
  chemically synthesized
aatcttaaccagaaaatctc

SEQ ID NO: 85141 - DNA, 20 bp, Artificial Sequence
  chemically synthesized
cttaaccagaaaatctcggg

SEQ ID NO: 85142 - DNA, 20 bp, Artificial Sequence
  chemically synthesized
ggataccttcaaagcttccc

SEQ ID NO: 85143 - DNA, 20 bp, Artificial Sequence
  chemically synthesized
gaaaatctcgggaagctttg

SEQ ID NO: 85144 - DNA, 20 bp, Artificial Sequence
  chemically synthesized
aaaatctcgggaagctttga

SEQ ID NO: 85145 - DNA, 20 bp, Artificial Sequence
  chemically synthesized
gatcattaaggataccttca

SEQ ID NO: 85146 - DNA, 20 bp, Artificial Sequence
  chemically synthesized
cccttccctagagatcatta

SEQ ID NO: 85147 - DNA, 20 bp, Artificial Sequence
  chemically synthesized
tcccttccctagagatcatt

SEQ ID NO: 85148 - DNA, 20 bp, Artificial Sequence
  chemically synthesized
aaggtatccttaatgatctc

SEQ ID NO: 85149 - DNA, 20 bp, Artificial Sequence
  chemically synthesized
aggtatccttaatgatctct

SEQ ID NO: 85150 - DNA, 20 bp, Artificial Sequence
  chemically synthesized
ggtatccttaatgatctcta

SEQ ID NO: 85151 - DNA, 20 bp, Artificial Sequence
  chemically synthesized
atccttaatgatctctaggg

SEQ ID NO: 85152 - DNA, 20 bp, Artificial Sequence
  chemically synthesized
tccttaatgatctctaggga

SEQ ID NO: 85153 - DNA, 20 bp, Artificial Sequence
  chemically synthesized
ccttaatgatctctagggaa

SEQ ID NO: 85154 - DNA, 20 bp, Artificial Sequence
  chemically synthesized
tctctataatcccttcccta

SEQ ID NO: 85155 - DNA, 20 bp, Artificial Sequence
  chemically synthesized
aatctctataatcccttccc

SEQ ID NO: 85156 - DNA, 20 bp, Artificial Sequence
  chemically synthesized
gatctctagggaagggatta

SEQ ID NO: 85157 - DNA, 20 bp, Artificial Sequence
  chemically synthesized
tctctagggaagggattata

SEQ ID NO: 85158 - DNA, 20 bp, Artificial Sequence
  chemically synthesized
atagagatttttttaattga

SEQ ID NO: 85159 - DNA, 20 bp, Artificial Sequence
  chemically synthesized
ttaattgaaagatgaaaacc

SEQ ID NO: 85160 - DNA, 20 bp, Artificial Sequence
  chemically synthesized
taatgaaattgtttgtcact

SEQ ID NO: 85161 - DNA, 20 bp, Artificial Sequence
  chemically synthesized
ctaatgaaattgtttgtcac

SEQ ID NO: 85162 - DNA, 20 bp, Artificial Sequence
  chemically synthesized
ctagtgacaaacaatttcat

SEQ ID NO: 85163 - DNA, 20 bp, Artificial Sequence
  chemically synthesized
caaacaatttcattagtaaa

SEQ ID NO: 85164 - DNA, 20 bp, Artificial Sequence
  chemically synthesized
aaacaatttcattagtaaaa

SEQ ID NO: 85165 - DNA, 20 bp, Artificial Sequence
  chemically synthesized
ttagtaaaaaggcaaacaaa

SEQ ID NO: 85166 - DNA, 20 bp, Artificial Sequence
  chemically synthesized
cttgattgtaacaacagtgt

SEQ ID NO: 85167 - DNA, 20 bp, Artificial Sequence
  chemically synthesized
tcttgattgtaacaacagtg

SEQ ID NO: 85168 - DNA, 20 bp, Artificial Sequence
  chemically synthesized
ttagatcttgattgtaacaa

SEQ ID NO: 85169 - DNA, 20 bp, Artificial Sequence
  chemically synthesized
cctacactgttgttacaatc

SEQ ID NO: 85170 - DNA, 20 bp, Artificial Sequence
  chemically synthesized
ccccaaatccaaatggagat

SEQ ID NO: 85171 - DNA, 20 bp, Artificial Sequence
  chemically synthesized
atcaagatctaatctccatt

SEQ ID NO: 85172 - DNA, 20 bp, Artificial Sequence
  chemically synthesized
tcctaccccaaatccaaatg

SEQ ID NO: 85173 - DNA, 20 bp, Artificial Sequence
  chemically synthesized
cctcctaccccaaatccaaa

SEQ ID NO: 85174 - DNA, 20 bp, Artificial Sequence
  chemically synthesized
atctaatctccatttggatt

SEQ ID NO: 85175 - DNA, 20 bp, Artificial Sequence
  chemically synthesized
tctaatctccatttggattt

SEQ ID NO: 85176 - DNA, 20 bp, Artificial Sequence
  chemically synthesized
ctaatctccatttggatttg

SEQ ID NO: 85177 - DNA, 20 bp, Artificial Sequence
  chemically synthesized
atctccatttggatttgggg

SEQ ID NO: 85178 - DNA, 20 bp, Artificial Sequence
  chemically synthesized
tctccatttggatttggggt

SEQ ID NO: 85179 - DNA, 20 bp, Artificial Sequence
  chemically synthesized
tccatttggatttggggtag

SEQ ID NO: 85180 - DNA, 20 bp, Artificial Sequence
  chemically synthesized
ccatttggatttggggtagg

SEQ ID NO: 85181 - DNA, 20 bp, Artificial Sequence
  chemically synthesized
tttggatttggggtaggagg

SEQ ID NO: 85182 - DNA, 20 bp, Artificial Sequence
  chemically synthesized
ttggatttggggtaggagga

SEQ ID NO: 85183 - DNA, 20 bp, Artificial Sequence
  chemically synthesized
tggatttggggtaggaggaa

SEQ ID NO: 85184 - DNA, 20 bp, Artificial Sequence
  chemically synthesized
gatttggggtaggaggaagg

SEQ ID NO: 85185 - DNA, 20 bp, Artificial Sequence
  chemically synthesized
taggaggaagggagttgaat

SEQ ID NO: 85186 - DNA, 20 bp, Artificial Sequence
  chemically synthesized
ggagaactgcaataaaacat

SEQ ID NO: 85187 - DNA, 20 bp, Artificial Sequence
  chemically synthesized
aataagctgatgttttattg

SEQ ID NO: 85188 - DNA, 20 bp, Artificial Sequence
  chemically synthesized
tgttttattgcagttctcct

SEQ ID NO: 85189 - DNA, 20 bp, Artificial Sequence
  chemically synthesized
catagtggggaatttctaag

SEQ ID NO: 85190 - DNA, 20 bp, Artificial Sequence
  chemically synthesized
atcatagtggggaatttcta

SEQ ID NO: 85191 - DNA, 20 bp, Artificial Sequence
  chemically synthesized
aatcatagtggggaatttct

SEQ ID NO: 85192 - DNA, 20 bp, Artificial Sequence
  chemically synthesized
taaaggagcaaatcatagtg

SEQ ID NO: 85193 - DNA, 20 bp, Artificial Sequence
  chemically synthesized
ttaaaggagcaaatcatagt

SEQ ID NO: 85194 - DNA, 20 bp, Artificial Sequence
  chemically synthesized
tttaaaggagcaaatcatag

SEQ ID NO: 85195 - DNA, 20 bp, Artificial Sequence
  chemically synthesized
agttttaaaggagcaaatca

SEQ ID NO: 85196 - DNA, 20 bp, Artificial Sequence
  chemically synthesized
acctagagagagttttaaag

SEQ ID NO: 85197 - DNA, 20 bp, Artificial Sequence
  chemically synthesized
taacctagagagagttttaa

SEQ ID NO: 85198 - DNA, 20 bp, Artificial Sequence
  chemically synthesized
ttaacctagagagagtttta

SEQ ID NO: 85199 - DNA, 20 bp, Artificial Sequence
  chemically synthesized
tgctcctttaaaactctctc

SEQ ID NO: 85200 - DNA, 20 bp, Artificial Sequence
  chemically synthesized
gctcctttaaaactctctct

SEQ ID NO: 85201 - DNA, 20 bp, Artificial Sequence
  chemically synthesized
ttctgtgattaacctagaga

SEQ ID NO: 85202 - DNA, 20 bp, Artificial Sequence
  chemically synthesized
acttctgtgattaacctaga

SEQ ID NO: 85203 - DNA, 20 bp, Artificial Sequence
  chemically synthesized
ctacttctgtgattaaccta

SEQ ID NO: 85204 - DNA, 20 bp, Artificial Sequence
  chemically synthesized
gtctacttctgtgattaacc

SEQ ID NO: 85205 - DNA, 20 bp, Artificial Sequence
  chemically synthesized
aactctctctaggttaatca

SEQ ID NO: 85206 - DNA, 20 bp, Artificial Sequence
  chemically synthesized
tctctctaggttaatcacag

SEQ ID NO: 85207 - DNA, 20 bp, Artificial Sequence
  chemically synthesized
ctctaggttaatcacagaag

SEQ ID NO: 85208 - DNA, 20 bp, Artificial Sequence
  chemically synthesized
ggttaatcacagaagtagac

SEQ ID NO: 85209 - DNA, 20 bp, Artificial Sequence
  chemically synthesized
acaagtaataaatatcactt

SEQ ID NO: 85210 - DNA, 20 bp, Artificial Sequence
  chemically synthesized
ttttacttgagcagtcacta

SEQ ID NO: 85211 - DNA, 20 bp, Artificial Sequence
  chemically synthesized
tatcactttagtgactgctc

SEQ ID NO: 85212 - DNA, 20 bp, Artificial Sequence
  chemically synthesized
cttcctttgttttacttgag

SEQ ID NO: 85213 - DNA, 20 bp, Artificial Sequence
  chemically synthesized
tgacttcctttgttttactt

SEQ ID NO: 85214 - DNA, 20 bp, Artificial Sequence
  chemically synthesized
gtgactgctcaagtaaaaca

SEQ ID NO: 85215 - DNA, 20 bp, Artificial Sequence
  chemically synthesized
tgactgctcaagtaaaacaa

SEQ ID NO: 85216 - DNA, 20 bp, Artificial Sequence
  chemically synthesized
ctgctcaagtaaaacaaagg

SEQ ID NO: 85217 - DNA, 20 bp, Artificial Sequence
  chemically synthesized
tcaagtaaaacaaaggaagt

SEQ ID NO: 85218 - DNA, 20 bp, Artificial Sequence
  chemically synthesized
gtcagtttttaaaatatatc

SEQ ID NO: 85219 - DNA, 20 bp, Artificial Sequence
  chemically synthesized
tttttaaaatatatctggac

SEQ ID NO: 85220 - DNA, 20 bp, Artificial Sequence
  chemically synthesized
tagtgggtgttattctggtc

SEQ ID NO: 85221 - DNA, 20 bp, Artificial Sequence
  chemically synthesized
tcaattagtgggtgttattc

SEQ ID NO: 85222 - DNA, 20 bp, Artificial Sequence
  chemically synthesized
ctgactcgttttcaattagt

SEQ ID NO: 85223 - DNA, 20 bp, Artificial Sequence
  chemically synthesized
actgactcgttttcaattag

SEQ ID NO: 85224 - DNA, 20 bp, Artificial Sequence
  chemically synthesized
tagactgactcgttttcaat

SEQ ID NO: 85225 - DNA, 20 bp, Artificial Sequence
  chemically synthesized
aacacccactaattgaaaac

SEQ ID NO: 85226 - DNA, 20 bp, Artificial Sequence
  chemically synthesized
cccactaattgaaaacgagt

SEQ ID NO: 85227 - DNA, 20 bp, Artificial Sequence
  chemically synthesized
taattgaaaacgagtcagtc

SEQ ID NO: 85228 - DNA, 20 bp, Artificial Sequence
  chemically synthesized
tgaaaacgagtcagtctagt

SEQ ID NO: 85229 - DNA, 20 bp, Artificial Sequence
  chemically synthesized
gaaaacgagtcagtctagtg

SEQ ID NO: 85230 - DNA, 20 bp, Artificial Sequence
  chemically synthesized
acgagtcagtctagtgaggc

SEQ ID NO: 85231 - DNA, 20 bp, Artificial Sequence
  chemically synthesized
ttcctcattacttgcctcac

SEQ ID NO: 85232 - DNA, 20 bp, Artificial Sequence
  chemically synthesized
agtctagtgaggcaagtaat

SEQ ID NO: 85233 - DNA, 20 bp, Artificial Sequence
  chemically synthesized
gtctagtgaggcaagtaatg

SEQ ID NO: 85234 - DNA, 20 bp, Artificial Sequence
  chemically synthesized
caagtaatgaggaactgtaa

SEQ ID NO: 85235 - DNA, 20 bp, Artificial Sequence
  chemically synthesized
taatgaggaactgtaaaagc

SEQ ID NO: 85236 - DNA, 20 bp, Artificial Sequence
  chemically synthesized
atacattatcctggctttta

SEQ ID NO: 85237 - DNA, 20 bp, Artificial Sequence
  chemically synthesized
aatgaggaactgtaaaagcc

SEQ ID NO: 85238 - DNA, 20 bp, Artificial Sequence
  chemically synthesized
gtcttttgaatacattatcc

SEQ ID NO: 85239 - DNA, 20 bp, Artificial Sequence
  chemically synthesized
agccaggataatgtattcaa

SEQ ID NO: 85240 - DNA, 20 bp, Artificial Sequence
  chemically synthesized
tattcaaaagacataaaaat

SEQ ID NO: 85241 - DNA, 20 bp, Artificial Sequence
  chemically synthesized
caaaagacataaaaattggt

SEQ ID NO: 85242 - DNA, 20 bp, Artificial Sequence
  chemically synthesized
ttggtcagtttatatttgct

SEQ ID NO: 85243 - DNA, 20 bp, Artificial Sequence
  chemically synthesized
tggtcagtttatatttgcta

SEQ ID NO: 85244 - DNA, 20 bp, Artificial Sequence
  chemically synthesized
attaaagctcaaatatgcct

SEQ ID NO: 85245 - DNA, 20 bp, Artificial Sequence
  chemically synthesized
atatttgctaaggcatattt

SEQ ID NO: 85246 - DNA, 20 bp, Artificial Sequence
  chemically synthesized
tgaagtgttataaataatta

SEQ ID NO: 85247 - DNA, 20 bp, Artificial Sequence
  chemically synthesized
ataatgctccagatgcggtg

SEQ ID NO: 85248 - DNA, 20 bp, Artificial Sequence
  chemically synthesized
ttataacacttcaccgcatc

SEQ ID NO: 85249 - DNA, 20 bp, Artificial Sequence
  chemically synthesized
ataacacttcaccgcatctg

SEQ ID NO: 85250 - DNA, 20 bp, Artificial Sequence
  chemically synthesized
ataaaataatgctccagatg

SEQ ID NO: 85251 - DNA, 20 bp, Artificial Sequence
  chemically synthesized
taattaataaaataatgctc

SEQ ID NO: 85252 - DNA, 20 bp, Artificial Sequence
  chemically synthesized
tggagcattattttattaat

SEQ ID NO: 85253 - DNA, 20 bp, Artificial Sequence
  chemically synthesized
ttattttattaattagtctt

SEQ ID NO: 85254 - DNA, 20 bp, Artificial Sequence
  chemically synthesized
attttattaattagtcttga

SEQ ID NO: 85255 - DNA, 20 bp, Artificial Sequence
  chemically synthesized
actgcaactgaatggctctc

SEQ ID NO: 85256 - DNA, 20 bp, Artificial Sequence
  chemically synthesized
aattagtcttgagagccatt

SEQ ID NO: 85257 - DNA, 20 bp, Artificial Sequence
  chemically synthesized
gcataacaactgcaactgaa

SEQ ID NO: 85258 - DNA, 20 bp, Artificial Sequence
  chemically synthesized
tcttgagagccattcagttg

SEQ ID NO: 85259 - DNA, 20 bp, Artificial Sequence
  chemically synthesized
gttgcagttgttatgctgcc

SEQ ID NO: 85260 - DNA, 20 bp, Artificial Sequence
  chemically synthesized
cagttgttatgctgcccagc

SEQ ID NO: 85261 - DNA, 20 bp, Artificial Sequence
  chemically synthesized
tgctccccaaaccagctggg

SEQ ID NO: 85262 - DNA, 20 bp, Artificial Sequence
  chemically synthesized
ctgtgctccccaaaccagct

SEQ ID NO: 85263 - DNA, 20 bp, Artificial Sequence
  chemically synthesized
gttatgctgcccagctggtt

SEQ ID NO: 85264 - DNA, 20 bp, Artificial Sequence
  chemically synthesized
tctgtgctccccaaaccagc

SEQ ID NO: 85265 - DNA, 20 bp, Artificial Sequence
  chemically synthesized
ttatgctgcccagctggttt

SEQ ID NO: 85266 - DNA, 20 bp, Artificial Sequence
  chemically synthesized
tatgctgcccagctggtttg

SEQ ID NO: 85267 - DNA, 20 bp, Artificial Sequence
  chemically synthesized
tgctgcccagctggtttggg

SEQ ID NO: 85268 - DNA, 20 bp, Artificial Sequence
  chemically synthesized
tagatctgtgctccccaaac

SEQ ID NO: 85269 - DNA, 20 bp, Artificial Sequence
  chemically synthesized
cccagctggtttggggagca

SEQ ID NO: 85270 - DNA, 20 bp, Artificial Sequence
  chemically synthesized
ggagcacagatctactccca

SEQ ID NO: 85271 - DNA, 20 bp, Artificial Sequence
  chemically synthesized
gagcacagatctactcccat

SEQ ID NO: 85272 - DNA, 20 bp, Artificial Sequence
  chemically synthesized
aattttcacacccatgggag

SEQ ID NO: 85273 - DNA, 20 bp, Artificial Sequence
  chemically synthesized
agcaattttcacacccatgg

SEQ ID NO: 85274 - DNA, 20 bp, Artificial Sequence
  chemically synthesized
aaagcaattttcacacccat

SEQ ID NO: 85275 - DNA, 20 bp, Artificial Sequence
  chemically synthesized
caaagcaattttcacaccca

SEQ ID NO: 85276 - DNA, 20 bp, Artificial Sequence
  chemically synthesized
atgggtgtgaaaattgcttt

SEQ ID NO: 85277 - DNA, 20 bp, Artificial Sequence
  chemically synthesized
tgggtgtgaaaattgctttg

SEQ ID NO: 85278 - DNA, 20 bp, Artificial Sequence
  chemically synthesized
ggtgtgaaaattgctttgag

SEQ ID NO: 85279 - DNA, 20 bp, Artificial Sequence
  chemically synthesized
gaccatagtctcactcctca

SEQ ID NO: 85280 - DNA, 20 bp, Artificial Sequence
  chemically synthesized
tgaaaattgctttgaggagt

SEQ ID NO: 85281 - DNA, 20 bp, Artificial Sequence
  chemically synthesized
tgctttgaggagtgagacta

SEQ ID NO: 85282 - DNA, 20 bp, Artificial Sequence
  chemically synthesized
acagacatatttggggacca

SEQ ID NO: 85283 - DNA, 20 bp, Artificial Sequence
  chemically synthesized
atactccacagacatatttg

SEQ ID NO: 85284 - DNA, 20 bp, Artificial Sequence
  chemically synthesized
gatactccacagacatattt

SEQ ID NO: 85285 - DNA, 20 bp, Artificial Sequence
  chemically synthesized
agatactccacagacatatt

SEQ ID NO: 85286 - DNA, 20 bp, Artificial Sequence
  chemically synthesized
atggtccccaaatatgtctg

SEQ ID NO: 85287 - DNA, 20 bp, Artificial Sequence
  chemically synthesized
ggtccccaaatatgtctgtg

SEQ ID NO: 85288 - DNA, 20 bp, Artificial Sequence
  chemically synthesized
taaaattccaagatactcca

SEQ ID NO: 85289 - DNA, 20 bp, Artificial Sequence
  chemically synthesized
aatatgtctgtggagtatct

SEQ ID NO: 85290 - DNA, 20 bp, Artificial Sequence
  chemically synthesized
tcttctgtaggtaaaattcc

SEQ ID NO: 85291 - DNA, 20 bp, Artificial Sequence
  chemically synthesized
gtatcttggaattttaccta

SEQ ID NO: 85292 - DNA, 20 bp, Artificial Sequence
  chemically synthesized
tcttggaattttacctacag

SEQ ID NO: 85293 - DNA, 20 bp, Artificial Sequence
  chemically synthesized
gagatatatggttcttctgt

SEQ ID NO: 85294 - DNA, 20 bp, Artificial Sequence
  chemically synthesized
agagatatatggttcttctg

SEQ ID NO: 85295 - DNA, 20 bp, Artificial Sequence
  chemically synthesized
tgctgtcatggagagatata

SEQ ID NO: 85296 - DNA, 20 bp, Artificial Sequence
  chemically synthesized
aaccatatatctctccatga

SEQ ID NO: 85297 - DNA, 20 bp, Artificial Sequence
  chemically synthesized
atatcaattgctgtcatgga

SEQ ID NO: 85298 - DNA, 20 bp, Artificial Sequence
  chemically synthesized
caatatcaattgctgtcatg

SEQ ID NO: 85299 - DNA, 20 bp, Artificial Sequence
  chemically synthesized
gtcaatatcaattgctgtca

SEQ ID NO: 85300 - DNA, 20 bp, Artificial Sequence
  chemically synthesized
tttcttgtagagaaaatata

SEQ ID NO: 85301 - DNA, 20 bp, Artificial Sequence
  chemically synthesized
tgactgtatattttctctac

SEQ ID NO: 85302 - DNA, 20 bp, Artificial Sequence
  chemically synthesized
tcttgtactcttttcttgta

SEQ ID NO: 85303 - DNA, 20 bp, Artificial Sequence
  chemically synthesized
gtatattttctctacaagaa

SEQ ID NO: 85304 - DNA, 20 bp, Artificial Sequence
  chemically synthesized
tatcttgtactcttttcttg

SEQ ID NO: 85305 - DNA, 20 bp, Artificial Sequence
  chemically synthesized
atattttctctacaagaaaa

SEQ ID NO: 85306 - DNA, 20 bp, Artificial Sequence
  chemically synthesized
tctctacaagaaaagagtac

SEQ ID NO: 85307 - DNA, 20 bp, Artificial Sequence
  chemically synthesized
agattagtgataatattttg

SEQ ID NO: 85308 - DNA, 20 bp, Artificial Sequence
  chemically synthesized
ctttgtataccatttcagat

SEQ ID NO: 85309 - DNA, 20 bp, Artificial Sequence
  chemically synthesized
atattatcactaatctgaaa

SEQ ID NO: 85310 - DNA, 20 bp, Artificial Sequence
  chemically synthesized
tttttctttgtataccattt

SEQ ID NO: 85311 - DNA, 20 bp, Artificial Sequence
  chemically synthesized
ctaatctgaaatggtataca

SEQ ID NO: 85312 - DNA, 20 bp, Artificial Sequence
  chemically synthesized
aatcaggatgtttacaaaac

SEQ ID NO: 85313 - DNA, 20 bp, Artificial Sequence
  chemically synthesized
aaatcaggatgtttacaaaa

SEQ ID NO: 85314 - DNA, 20 bp, Artificial Sequence
  chemically synthesized
tttgtaaacatcctgattta

SEQ ID NO: 85315 - DNA, 20 bp, Artificial Sequence
  chemically synthesized
actttcattttctataaatc

SEQ ID NO: 85316 - DNA, 20 bp, Artificial Sequence
  chemically synthesized
cactttcattttctataaat

SEQ ID NO: 85317 - DNA, 20 bp, Artificial Sequence
  chemically synthesized
tcctgatttatagaaaatga

SEQ ID NO: 85318 - DNA, 20 bp, Artificial Sequence
  chemically synthesized
aaatgaacaacatttgattt

SEQ ID NO: 85319 - DNA, 20 bp, Artificial Sequence
  chemically synthesized
aaatcccattaaaatgtcaa

SEQ ID NO: 85320 - DNA, 20 bp, Artificial Sequence
  chemically synthesized
ttcaactattgacattttaa

SEQ ID NO: 85321 - DNA, 20 bp, Artificial Sequence
  chemically synthesized
tcaactattgacattttaat

SEQ ID NO: 85322 - DNA, 20 bp, Artificial Sequence
  chemically synthesized
gggatttgtatccccataaa

SEQ ID NO: 85323 - DNA, 20 bp, Artificial Sequence
  chemically synthesized
ctttgctgatgctttttatg

SEQ ID NO: 85324 - DNA, 20 bp, Artificial Sequence
  chemically synthesized
cctttgctgatgctttttat

SEQ ID NO: 85325 - DNA, 20 bp, Artificial Sequence
  chemically synthesized
tcctttgctgatgcttttta

SEQ ID NO: 85326 - DNA, 20 bp, Artificial Sequence
  chemically synthesized
tgtatccccataaaaagcat

SEQ ID NO: 85327 - DNA, 20 bp, Artificial Sequence
  chemically synthesized
ccccataaaaagcatcagca

SEQ ID NO: 85328 - DNA, 20 bp, Artificial Sequence
  chemically synthesized
cccataaaaagcatcagcaa

SEQ ID NO: 85329 - DNA, 20 bp, Artificial Sequence
  chemically synthesized
agcaaaggatattaataatt

SEQ ID NO: 85330 - DNA, 20 bp, Artificial Sequence
  chemically synthesized
aggatattaataatttagaa

SEQ ID NO: 85331 - DNA, 20 bp, Artificial Sequence
  chemically synthesized
gatattaataatttagaata

SEQ ID NO: 85332 - DNA, 20 bp, Artificial Sequence
  chemically synthesized
tattaataatttagaataga

SEQ ID NO: 85333 - DNA, 20 bp, Artificial Sequence
  chemically synthesized
aataatttagaatagagagt

SEQ ID NO: 85334 - DNA, 20 bp, Artificial Sequence
  chemically synthesized
aatttagaatagagagtaag

SEQ ID NO: 85335 - DNA, 20 bp, Artificial Sequence
  chemically synthesized
aagcagatgactttttaaaa

SEQ ID NO: 85336 - DNA, 20 bp, Artificial Sequence
  chemically synthesized
tagagtgccacttttttaaa

SEQ ID NO: 85337 - DNA, 20 bp, Artificial Sequence
  chemically synthesized
cagatgactttttaaaaaag

SEQ ID NO: 85338 - DNA, 20 bp, Artificial Sequence
  chemically synthesized
acttattccgcaagtattta

SEQ ID NO: 85339 - DNA, 20 bp, Artificial Sequence
  chemically synthesized
aaacttattccgcaagtatt

SEQ ID NO: 85340 - DNA, 20 bp, Artificial Sequence
  chemically synthesized
agtggcactctaaatacttg

SEQ ID NO: 85341 - DNA, 20 bp, Artificial Sequence
  chemically synthesized
actctaaatacttgcggaat

SEQ ID NO: 85342 - DNA, 20 bp, Artificial Sequence
  chemically synthesized
taattgtaaacttattccgc

SEQ ID NO: 85343 - DNA, 20 bp, Artificial Sequence
  chemically synthesized
gcggaataagtttacaatta

SEQ ID NO: 85344 - DNA, 20 bp, Artificial Sequence
  chemically synthesized
agaatccttggtatcaagat

SEQ ID NO: 85345 - DNA, 20 bp, Artificial Sequence
  chemically synthesized
tagaatccttggtatcaaga

SEQ ID NO: 85346 - DNA, 20 bp, Artificial Sequence
  chemically synthesized
cagtgacccatcttgatacc

SEQ ID NO: 85347 - DNA, 20 bp, Artificial Sequence
  chemically synthesized
agtgacccatcttgatacca

SEQ ID NO: 85348 - DNA, 20 bp, Artificial Sequence
  chemically synthesized
tgtatagaatccttggtatc

SEQ ID NO: 85349 - DNA, 20 bp, Artificial Sequence
  chemically synthesized
tgttgtttgtatagaatcct

SEQ ID NO: 85350 - DNA, 20 bp, Artificial Sequence
  chemically synthesized
tgatttaattgttgtttgta

SEQ ID NO: 85351 - DNA, 20 bp, Artificial Sequence
  chemically synthesized
atacaaacaacaattaaatc

SEQ ID NO: 85352 - DNA, 20 bp, Artificial Sequence
  chemically synthesized
attaaatcaagaaacccata

SEQ ID NO: 85353 - DNA, 20 bp, Artificial Sequence
  chemically synthesized
taaatcaagaaacccataaa

SEQ ID NO: 85354 - DNA, 20 bp, Artificial Sequence
  chemically synthesized
tacattgtattgctctttat

SEQ ID NO: 85355 - DNA, 20 bp, Artificial Sequence
  chemically synthesized
gtacattgtattgctcttta

SEQ ID NO: 85356 - DNA, 20 bp, Artificial Sequence
  chemically synthesized
agcaatacaatgtacaattc

SEQ ID NO: 85357 - DNA, 20 bp, Artificial Sequence
  chemically synthesized
aatgtacaattctggaaaca

SEQ ID NO: 85358 - DNA, 20 bp, Artificial Sequence
  chemically synthesized
gttttactttgccatgtttc

SEQ ID NO: 85359 - DNA, 20 bp, Artificial Sequence
  chemically synthesized
acaattctggaaacatggca

SEQ ID NO: 85360 - DNA, 20 bp, Artificial Sequence
  chemically synthesized
aacatggcaaagtaaaacaa

SEQ ID NO: 85361 - DNA, 20 bp, Artificial Sequence
  chemically synthesized
aaacaaaagtccacaaatat

SEQ ID NO: 85362 - DNA, 20 bp, Artificial Sequence
  chemically synthesized
gttgacagatcttatatttg

SEQ ID NO: 85363 - DNA, 20 bp, Artificial Sequence
  chemically synthesized
catcaagatctaatagttga

SEQ ID NO: 85364 - DNA, 20 bp, Artificial Sequence
  chemically synthesized
atataagatctgtcaactat

SEQ ID NO: 85365 - DNA, 20 bp, Artificial Sequence
  chemically synthesized
aaaattccatcaagatctaa

SEQ ID NO: 85366 - DNA, 20 bp, Artificial Sequence
  chemically synthesized
tgtcaactattagatcttga

SEQ ID NO: 85367 - DNA, 20 bp, Artificial Sequence
  chemically synthesized
aatcagtacaaaattccatc

SEQ ID NO: 85368 - DNA, 20 bp, Artificial Sequence
  chemically synthesized
aaagagaaaaagaacagaat

SEQ ID NO: 85369 - DNA, 20 bp, Artificial Sequence
  chemically synthesized
ttagaaaaagagaaaaagaa

SEQ ID NO: 85370 - DNA, 20 bp, Artificial Sequence
  chemically synthesized
ctcagttagaaaaagagaaa

SEQ ID NO: 85371 - DNA, 20 bp, Artificial Sequence
  chemically synthesized
cctgaactcagttagaaaaa

SEQ ID NO: 85372 - DNA, 20 bp, Artificial Sequence
  chemically synthesized
ctcctgaactcagttagaaa

SEQ ID NO: 85373 - DNA, 20 bp, Artificial Sequence
  chemically synthesized
ctttttctctttttctaact

SEQ ID NO: 85374 - DNA, 20 bp, Artificial Sequence
  chemically synthesized
tcagatctcctgaactcagt

SEQ ID NO: 85375 - DNA, 20 bp, Artificial Sequence
  chemically synthesized
tctctttttctaactgagtt

SEQ ID NO: 85376 - DNA, 20 bp, Artificial Sequence
  chemically synthesized
ctctttttctaactgagttc

SEQ ID NO: 85377 - DNA, 20 bp, Artificial Sequence
  chemically synthesized
ctttttctaactgagttcag

SEQ ID NO: 85378 - DNA, 20 bp, Artificial Sequence
  chemically synthesized
cgtatcagatctcctgaact

SEQ ID NO: 85379 - DNA, 20 bp, Artificial Sequence
  chemically synthesized
agttcaggagatctgatacg

SEQ ID NO: 85380 - DNA, 20 bp, Artificial Sequence
  chemically synthesized
ttgaaactggatctgcgtat

SEQ ID NO: 85381 - DNA, 20 bp, Artificial Sequence
  chemically synthesized
ggagatctgatacgcagatc

SEQ ID NO: 85382 - DNA, 20 bp, Artificial Sequence
  chemically synthesized
tgatacgcagatccagtttc

SEQ ID NO: 85383 - DNA, 20 bp, Artificial Sequence
  chemically synthesized
gatacgcagatccagtttca

SEQ ID NO: 85384 - DNA, 20 bp, Artificial Sequence
  chemically synthesized
caatggaaaatccttgaaac

SEQ ID NO: 85385 - DNA, 20 bp, Artificial Sequence
  chemically synthesized
gcctatgggcaaaagaacaa

SEQ ID NO: 85386 - DNA, 20 bp, Artificial Sequence
  chemically synthesized
ttccattgttcttttgccca

SEQ ID NO: 85387 - DNA, 20 bp, Artificial Sequence
  chemically synthesized
ctcttgaagcctatgggcaa

SEQ ID NO: 85388 - DNA, 20 bp, Artificial Sequence
  chemically synthesized
tccattgttcttttgcccat

SEQ ID NO: 85389 - DNA, 20 bp, Artificial Sequence
  chemically synthesized
gtgatgctcttgaagcctat

SEQ ID NO: 85390 - DNA, 20 bp, Artificial Sequence
  chemically synthesized
agtgatgctcttgaagccta

SEQ ID NO: 85391 - DNA, 20 bp, Artificial Sequence
  chemically synthesized
ttcttttgcccataggcttc

SEQ ID NO: 85392 - DNA, 20 bp, Artificial Sequence
  chemically synthesized
cttttgcccataggcttcaa

SEQ ID NO: 85393 - DNA, 20 bp, Artificial Sequence
  chemically synthesized
tctagttagtgatgctcttg

SEQ ID NO: 85394 - DNA, 20 bp, Artificial Sequence
  chemically synthesized
gcttcaagagcatcactaac

SEQ ID NO: 85395 - DNA, 20 bp, Artificial Sequence
  chemically synthesized
caagagcatcactaactaga

SEQ ID NO: 85396 - DNA, 20 bp, Artificial Sequence
  chemically synthesized
tcatatatggactgtctagt

SEQ ID NO: 85397 - DNA, 20 bp, Artificial Sequence
  chemically synthesized
cctttcatatatggactgtc

SEQ ID NO: 85398 - DNA, 20 bp, Artificial Sequence
  chemically synthesized
actagacagtccatatatga

SEQ ID NO: 85399 - DNA, 20 bp, Artificial Sequence
  chemically synthesized
tgtggtagccctttcatata

SEQ ID NO: 85400 - DNA, 20 bp, Artificial Sequence
  chemically synthesized
ctagacagtccatatatgaa

SEQ ID NO: 85401 - DNA, 20 bp, Artificial Sequence
  chemically synthesized
tagacagtccatatatgaaa

SEQ ID NO: 85402 - DNA, 20 bp, Artificial Sequence
  chemically synthesized
gttttgtcacatgtatgtgg

SEQ ID NO: 85403 - DNA, 20 bp, Artificial Sequence
  chemically synthesized
aaagttttgtcacatgtatg

SEQ ID NO: 85404 - DNA, 20 bp, Artificial Sequence
  chemically synthesized
catacatgtgacaaaacttt

SEQ ID NO: 85405 - DNA, 20 bp, Artificial Sequence
  chemically synthesized
ttagtagcctgtttgactca

SEQ ID NO: 85406 - DNA, 20 bp, Artificial Sequence
  chemically synthesized
tgacaaaactttgagtcaaa

SEQ ID NO: 85407 - DNA, 20 bp, Artificial Sequence
  chemically synthesized
gacaaaactttgagtcaaac

SEQ ID NO: 85408 - DNA, 20 bp, Artificial Sequence
  chemically synthesized
ctgatgagagaacagtttag

SEQ ID NO: 85409 - DNA, 20 bp, Artificial Sequence
  chemically synthesized
gtgctgatgagagaacagtt

SEQ ID NO: 85410 - DNA, 20 bp, Artificial Sequence
  chemically synthesized
cctgagtgctgatgagagaa

SEQ ID NO: 85411 - DNA, 20 bp, Artificial Sequence
  chemically synthesized
ctactaaactgttctctcat

SEQ ID NO: 85412 - DNA, 20 bp, Artificial Sequence
  chemically synthesized
tcgctcctgagtgctgatga

SEQ ID NO: 85413 - DNA, 20 bp, Artificial Sequence
  chemically synthesized
catcgctcctgagtgctgat

SEQ ID NO: 85414 - DNA, 20 bp, Artificial Sequence
  chemically synthesized
actgttctctcatcagcact

SEQ ID NO: 85415 - DNA, 20 bp, Artificial Sequence
  chemically synthesized
ctgttctctcatcagcactc

SEQ ID NO: 85416 - DNA, 20 bp, Artificial Sequence
  chemically synthesized
gttctctcatcagcactcag

SEQ ID NO: 85417 - DNA, 20 bp, Artificial Sequence
  chemically synthesized
caaacaacatcatcgctcct

SEQ ID NO: 85418 - DNA, 20 bp, Artificial Sequence
  chemically synthesized
caggagcgatgatgttgttt

SEQ ID NO: 85419 - DNA, 20 bp, Artificial Sequence
  chemically synthesized
aggagcgatgatgttgtttg

SEQ ID NO: 85420 - DNA, 20 bp, Artificial Sequence
  chemically synthesized
agcgatgatgttgtttgagg

SEQ ID NO: 85421 - DNA, 20 bp, Artificial Sequence
  chemically synthesized
gcgatgatgttgtttgagga

SEQ ID NO: 85422 - DNA, 20 bp, Artificial Sequence
  chemically synthesized
gatgatgttgtttgaggaag

SEQ ID NO: 85423 - DNA, 20 bp, Artificial Sequence
  chemically synthesized
tgatgttgtttgaggaagga

SEQ ID NO: 85424 - DNA, 20 bp, Artificial Sequence
  chemically synthesized
gaaggagagtgttttgtgtc

SEQ ID NO: 85425 - DNA, 20 bp, Artificial Sequence
  chemically synthesized
tgtgtcaagaatttttctta

SEQ ID NO: 85426 - DNA, 20 bp, Artificial Sequence
  chemically synthesized
aagcttctcttggtatcttt

SEQ ID NO: 85427 - DNA, 20 bp, Artificial Sequence
  chemically synthesized
gaatttttcttaaagatacc

SEQ ID NO: 85428 - DNA, 20 bp, Artificial Sequence
  chemically synthesized
atttttcttaaagataccaa

SEQ ID NO: 85429 - DNA, 20 bp, Artificial Sequence
  chemically synthesized
tttcttaaagataccaagag

SEQ ID NO: 85430 - DNA, 20 bp, Artificial Sequence
  chemically synthesized
atgctttttcaagcttctct

SEQ ID NO: 85431 - DNA, 20 bp, Artificial Sequence
  chemically synthesized
ataccaagagaagcttgaaa

SEQ ID NO: 85432 - DNA, 20 bp, Artificial Sequence
  chemically synthesized
gtttggcgcaatgctttttc

SEQ ID NO: 85433 - DNA, 20 bp, Artificial Sequence
  chemically synthesized
aaagcattgcgccaaactac

SEQ ID NO: 85434 - DNA, 20 bp, Artificial Sequence
  chemically synthesized
tacagcttttacttgtagtt

SEQ ID NO: 85435 - DNA, 20 bp, Artificial Sequence
  chemically synthesized
ttgcgccaaactacaagtaa

SEQ ID NO: 85436 - DNA, 20 bp, Artificial Sequence
  chemically synthesized
cgacatacagcttttacttg

SEQ ID NO: 85437 - DNA, 20 bp, Artificial Sequence
  chemically synthesized
ttcaataaacatacgacata

SEQ ID NO: 85438 - DNA, 20 bp, Artificial Sequence
  chemically synthesized
tgtatgtcgtatgtttattg

SEQ ID NO: 85439 - DNA, 20 bp, Artificial Sequence
  chemically synthesized
tattgaagcaccattcacaa

SEQ ID NO: 85440 - DNA, 20 bp, Artificial Sequence
  chemically synthesized
cacgcctttgctattgtgaa

SEQ ID NO: 85441 - DNA, 20 bp, Artificial Sequence
  chemically synthesized
aagcaccattcacaatagca

SEQ ID NO: 85442 - DNA, 20 bp, Artificial Sequence
  chemically synthesized
agcaccattcacaatagcaa

SEQ ID NO: 85443 - DNA, 20 bp, Artificial Sequence
  chemically synthesized
cattcacaatagcaaaggcg

SEQ ID NO: 85444 - DNA, 20 bp, Artificial Sequence
  chemically synthesized
tcattgatgggcatttgggt

SEQ ID NO: 85445 - DNA, 20 bp, Artificial Sequence
  chemically synthesized
tatatcattgatgggcattt

SEQ ID NO: 85446 - DNA, 20 bp, Artificial Sequence
  chemically synthesized
gtatatcattgatgggcatt

SEQ ID NO: 85447 - DNA, 20 bp, Artificial Sequence
  chemically synthesized
taatccagtatatcattgat

SEQ ID NO: 85448 - DNA, 20 bp, Artificial Sequence
  chemically synthesized
ttaatccagtatatcattga

SEQ ID NO: 85449 - DNA, 20 bp, Artificial Sequence
  chemically synthesized
aatgcccatcaatgatatac

SEQ ID NO: 85450 - DNA, 20 bp, Artificial Sequence
  chemically synthesized
catcaatgatatactggatt

SEQ ID NO: 85451 - DNA, 20 bp, Artificial Sequence
  chemically synthesized
tgtgccacattttcttaatc

SEQ ID NO: 85452 - DNA, 20 bp, Artificial Sequence
  chemically synthesized
tatactggattaagaaaatg

SEQ ID NO: 85453 - DNA, 20 bp, Artificial Sequence
  chemically synthesized
aatgtggcacatgtacacca

SEQ ID NO: 85454 - DNA, 20 bp, Artificial Sequence
  chemically synthesized
tatggcttcacagtattcca

SEQ ID NO: 85455 - DNA, 20 bp, Artificial Sequence
  chemically synthesized
gtacaccatggaatactgtg

SEQ ID NO: 85456 - DNA, 20 bp, Artificial Sequence
  chemically synthesized
catccttttttatggcttca

SEQ ID NO: 85457 - DNA, 20 bp, Artificial Sequence
  chemically synthesized
aatactgtgaagccataaaa

SEQ ID NO: 85458 - DNA, 20 bp, Artificial Sequence
  chemically synthesized
atactgtgaagccataaaaa

SEQ ID NO: 85459 - DNA, 20 bp, Artificial Sequence
  chemically synthesized
catgatctcatcctttttta

SEQ ID NO: 85460 - DNA, 20 bp, Artificial Sequence
  chemically synthesized
gtgaagccataaaaaaggat

SEQ ID NO: 85461 - DNA, 20 bp, Artificial Sequence
  chemically synthesized
ggatgagatcatgtcctttg

SEQ ID NO: 85462 - DNA, 20 bp, Artificial Sequence
  chemically synthesized
gatgagatcatgtcctttgc

SEQ ID NO: 85463 - DNA, 20 bp, Artificial Sequence
  chemically synthesized
atgagatcatgtcctttgca

SEQ ID NO: 85464 - DNA, 20 bp, Artificial Sequence
  chemically synthesized
cttcatccatgtccctgcaa

SEQ ID NO: 85465 - DNA, 20 bp, Artificial Sequence
  chemically synthesized
gcttcatccatgtccctgca

SEQ ID NO: 85466 - DNA, 20 bp, Artificial Sequence
  chemically synthesized
tcatgtcctttgcagggaca

SEQ ID NO: 85467 - DNA, 20 bp, Artificial Sequence
  chemically synthesized
cctttgcagggacatggatg

SEQ ID NO: 85468 - DNA, 20 bp, Artificial Sequence
  chemically synthesized
tgcagggacatggatgaagc

SEQ ID NO: 85469 - DNA, 20 bp, Artificial Sequence
  chemically synthesized
ttgctgagaatgatggtttc

SEQ ID NO: 85470 - DNA, 20 bp, Artificial Sequence
  chemically synthesized
aagctggaaaccatcattct

SEQ ID NO: 85471 - DNA, 20 bp, Artificial Sequence
  chemically synthesized
tgttagtttgctgagaatga

SEQ ID NO: 85472 - DNA, 20 bp, Artificial Sequence
  chemically synthesized
ggttcctctgttagtttgct

SEQ ID NO: 85473 - DNA, 20 bp, Artificial Sequence
  chemically synthesized
catcattctcagcaaactaa

SEQ ID NO: 85474 - DNA, 20 bp, Artificial Sequence
  chemically synthesized
tcattctcagcaaactaaca

SEQ ID NO: 85475 - DNA, 20 bp, Artificial Sequence
  chemically synthesized
cattctcagcaaactaacag

SEQ ID NO: 85476 - DNA, 20 bp, Artificial Sequence
  chemically synthesized
ttggttttcggttcctctgt

SEQ ID NO: 85477 - DNA, 20 bp, Artificial Sequence
  chemically synthesized
accatgcagtgtttggtttt

SEQ ID NO: 85478 - DNA, 20 bp, Artificial Sequence
  chemically synthesized
gagtgagaccatgcagtgtt

SEQ ID NO: 85479 - DNA, 20 bp, Artificial Sequence
  chemically synthesized
accgaaaaccaaacactgca

SEQ ID NO: 85480 - DNA, 20 bp, Artificial Sequence
  chemically synthesized
cacttatgagtgagaccatg

SEQ ID NO: 85481 - DNA, 20 bp, Artificial Sequence
  chemically synthesized
cactgcatggtctcactcat

SEQ ID NO: 85482 - DNA, 20 bp, Artificial Sequence
  chemically synthesized
tttatctcccacttatgagt

SEQ ID NO: 85483 - DNA, 20 bp, Artificial Sequence
  chemically synthesized
tgcatggtctcactcataag

SEQ ID NO: 85484 - DNA, 20 bp, Artificial Sequence
  chemically synthesized
gcatggtctcactcataagt

SEQ ID NO: 85485 - DNA, 20 bp, Artificial Sequence
  chemically synthesized
attgtttatctcccacttat

SEQ ID NO: 85486 - DNA, 20 bp, Artificial Sequence
  chemically synthesized
atggtctcactcataagtgg

SEQ ID NO: 85487 - DNA, 20 bp, Artificial Sequence
  chemically synthesized
agataaacaatgaaaacata

SEQ ID NO: 85488 - DNA, 20 bp, Artificial Sequence
  chemically synthesized
acaatgaaaacatatggaca

SEQ ID NO: 85489 - DNA, 20 bp, Artificial Sequence
  chemically synthesized
caatgaaaacatatggacac

SEQ ID NO: 85490 - DNA, 20 bp, Artificial Sequence
  chemically synthesized
aatgaaaacatatggacaca

SEQ ID NO: 85491 - DNA, 20 bp, Artificial Sequence
  chemically synthesized
tgaaaacatatggacacagg

SEQ ID NO: 85492 - DNA, 20 bp, Artificial Sequence
  chemically synthesized
gaaaacatatggacacaggg

SEQ ID NO: 85493 - DNA, 20 bp, Artificial Sequence
  chemically synthesized
aaaacatatggacacaggga

SEQ ID NO: 85494 - DNA, 20 bp, Artificial Sequence
  chemically synthesized
aaacatatggacacagggag

SEQ ID NO: 85495 - DNA, 20 bp, Artificial Sequence
  chemically synthesized
gggaggggaacatcacacac

SEQ ID NO: 85496 - DNA, 20 bp, Artificial Sequence
  chemically synthesized
ggaggggaacatcacacact

SEQ ID NO: 85497 - DNA, 20 bp, Artificial Sequence
  chemically synthesized
gaggggaacatcacacactg

SEQ ID NO: 85498 - DNA, 20 bp, Artificial Sequence
  chemically synthesized
ccccaccccctgacaggccc

SEQ ID NO: 85499 - DNA, 20 bp, Artificial Sequence
  chemically synthesized
catcacacactggggcctgt

SEQ ID NO: 85500 - DNA, 20 bp, Artificial Sequence
  chemically synthesized
atcacacactggggcctgtc

SEQ ID NO: 85501 - DNA, 20 bp, Artificial Sequence
  chemically synthesized
tcacacactggggcctgtca

SEQ ID NO: 85502 - DNA, 20 bp, Artificial Sequence
  chemically synthesized
cacacactggggcctgtcag

SEQ ID NO: 85503 - DNA, 20 bp, Artificial Sequence
  chemically synthesized
acacactggggcctgtcagg

SEQ ID NO: 85504 - DNA, 20 bp, Artificial Sequence
  chemically synthesized
ctagccccccaccccctgac

SEQ ID NO: 85505 - DNA, 20 bp, Artificial Sequence
  chemically synthesized
cctagccccccaccccctga

SEQ ID NO: 85506 - DNA, 20 bp, Artificial Sequence
  chemically synthesized
cactggggcctgtcaggggg

SEQ ID NO: 85507 - DNA, 20 bp, Artificial Sequence
  chemically synthesized
actggggcctgtcagggggt

SEQ ID NO: 85508 - DNA, 20 bp, Artificial Sequence
  chemically synthesized
ctggggcctgtcagggggtg

SEQ ID NO: 85509 - DNA, 20 bp, Artificial Sequence
  chemically synthesized
tggggcctgtcagggggtgg

SEQ ID NO: 85510 - DNA, 20 bp, Artificial Sequence
  chemically synthesized
ggggcctgtcagggggtggg

SEQ ID NO: 85511 - DNA, 20 bp, Artificial Sequence
  chemically synthesized
cctgtcagggggtggggggc

SEQ ID NO: 85512 - DNA, 20 bp, Artificial Sequence
  chemically synthesized
ctgtcagggggtggggggct

SEQ ID NO: 85513 - DNA, 20 bp, Artificial Sequence
  chemically synthesized
tgtcagggggtggggggcta

SEQ ID NO: 85514 - DNA, 20 bp, Artificial Sequence
  chemically synthesized
gtcagggggtggggggctag

SEQ ID NO: 85515 - DNA, 20 bp, Artificial Sequence
  chemically synthesized
cagggggtggggggctaggg

SEQ ID NO: 85516 - DNA, 20 bp, Artificial Sequence
  chemically synthesized
agggggtggggggctagggg

SEQ ID NO: 85517 - DNA, 20 bp, Artificial Sequence
  chemically synthesized
gggggtggggggctagggga

SEQ ID NO: 85518 - DNA, 20 bp, Artificial Sequence
  chemically synthesized
tcctaatgctatccctcccc

SEQ ID NO: 85519 - DNA, 20 bp, Artificial Sequence
  chemically synthesized
gtggggggctaggggaggga

SEQ ID NO: 85520 - DNA, 20 bp, Artificial Sequence
  chemically synthesized
ggctaggggagggatagcat

SEQ ID NO: 85521 - DNA, 20 bp, Artificial Sequence
  chemically synthesized
gctaggggagggatagcatt

SEQ ID NO: 85522 - DNA, 20 bp, Artificial Sequence
  chemically synthesized
taggggagggatagcattag

SEQ ID NO: 85523 - DNA, 20 bp, Artificial Sequence
  chemically synthesized
attaggagaaatacctaatg

SEQ ID NO: 85524 - DNA, 20 bp, Artificial Sequence
  chemically synthesized
atcaacccgtcatctacatt

SEQ ID NO: 85525 - DNA, 20 bp, Artificial Sequence
  chemically synthesized
catcaacccgtcatctacat

SEQ ID NO: 85526 - DNA, 20 bp, Artificial Sequence
  chemically synthesized
gaaatacctaatgtagatga

SEQ ID NO: 85527 - DNA, 20 bp, Artificial Sequence
  chemically synthesized
aaatacctaatgtagatgac

SEQ ID NO: 85528 - DNA, 20 bp, Artificial Sequence
  chemically synthesized
taatgtagatgacgggttga

SEQ ID NO: 85529 - DNA, 20 bp, Artificial Sequence
  chemically synthesized
aatgtagatgacgggttgat

SEQ ID NO: 85530 - DNA, 20 bp, Artificial Sequence
  chemically synthesized
agatgacgggttgatgggtg

SEQ ID NO: 85531 - DNA, 20 bp, Artificial Sequence
  chemically synthesized
atgggtgtggcaaaccacca

SEQ ID NO: 85532 - DNA, 20 bp, Artificial Sequence
  chemically synthesized
taggtatacatgtgccatgg

SEQ ID NO: 85533 - DNA, 20 bp, Artificial Sequence
  chemically synthesized
acataggtatacatgtgcca

SEQ ID NO: 85534 - DNA, 20 bp, Artificial Sequence
  chemically synthesized
aaagtgcaggtttgttacat

SEQ ID NO: 85535 - DNA, 20 bp, Artificial Sequence
  chemically synthesized
gaaagtgcaggtttgttaca

SEQ ID NO: 85536 - DNA, 20 bp, Artificial Sequence
  chemically synthesized
gatacatgtgcagaaagtgc

SEQ ID NO: 85537 - DNA, 20 bp, Artificial Sequence
  chemically synthesized
ggatacatgtgcagaaagtg

SEQ ID NO: 85538 - DNA, 20 bp, Artificial Sequence
  chemically synthesized
ttctgggatacatgtgcaga

SEQ ID NO: 85539 - DNA, 20 bp, Artificial Sequence
  chemically synthesized
tacattctgggatacatgtg

SEQ ID NO: 85540 - DNA, 20 bp, Artificial Sequence
  chemically synthesized
cactttctgcacatgtatcc

SEQ ID NO: 85541 - DNA, 20 bp, Artificial Sequence
  chemically synthesized
attattatactttacattct

SEQ ID NO: 85542 - DNA, 20 bp, Artificial Sequence
  chemically synthesized
cacatgtatcccagaatgta

SEQ ID NO: 85543 - DNA, 20 bp, Artificial Sequence
  chemically synthesized
tattattatactttacattc

SEQ ID NO: 85544 - DNA, 20 bp, Artificial Sequence
  chemically synthesized
gtagagctactttgatgcac

SEQ ID NO: 85545 - DNA, 20 bp, Artificial Sequence
  chemically synthesized
aaaaaaaaacctgtgcatca

SEQ ID NO: 85546 - DNA, 20 bp, Artificial Sequence
  chemically synthesized
tgtagagctactttgatgca

SEQ ID NO: 85547 - DNA, 20 bp, Artificial Sequence
  chemically synthesized
aaaaaacctgtgcatcaaag

SEQ ID NO: 85548 - DNA, 20 bp, Artificial Sequence
  chemically synthesized
atctttttgtaaagtgtgta

SEQ ID NO: 85549 - DNA, 20 bp, Artificial Sequence
  chemically synthesized
gcatctttttgtaaagtgtg

SEQ ID NO: 85550 - DNA, 20 bp, Artificial Sequence
  chemically synthesized
agctctacacactttacaaa

SEQ ID NO: 85551 - DNA, 20 bp, Artificial Sequence
  chemically synthesized
taattaagcatctttttgta

SEQ ID NO: 85552 - DNA, 20 bp, Artificial Sequence
  chemically synthesized
tttacaaaaagatgcttaat

SEQ ID NO: 85553 - DNA, 20 bp, Artificial Sequence
  chemically synthesized
ttttctgtttatttctaatt

SEQ ID NO: 85554 - DNA, 20 bp, Artificial Sequence
  chemically synthesized
gatgcttaattagaaataaa

SEQ ID NO: 85555 - DNA, 20 bp, Artificial Sequence
  chemically synthesized
tattcccttcttatttacag

SEQ ID NO: 85556 - DNA, 20 bp, Artificial Sequence
  chemically synthesized
aacagaaaactcctgtaaat

SEQ ID NO: 85557 - DNA, 20 bp, Artificial Sequence
  chemically synthesized
ggtattcccttcttatttac

SEQ ID NO: 85558 - DNA, 20 bp, Artificial Sequence
  chemically synthesized
tggtattcccttcttattta

SEQ ID NO: 85559 - DNA, 20 bp, Artificial Sequence
  chemically synthesized
agaaaactcctgtaaataag

SEQ ID NO: 85560 - DNA, 20 bp, Artificial Sequence
  chemically synthesized
gaaaactcctgtaaataaga

SEQ ID NO: 85561 - DNA, 20 bp, Artificial Sequence
  chemically synthesized
aaaactcctgtaaataagaa

SEQ ID NO: 85562 - DNA, 20 bp, Artificial Sequence
  chemically synthesized
cagggaaagaaagaatagag

SEQ ID NO: 85563 - DNA, 20 bp, Artificial Sequence
  chemically synthesized
gagcagggaaagaaagaata

SEQ ID NO: 85564 - DNA, 20 bp, Artificial Sequence
  chemically synthesized
aagagcagggaaagaaagaa

SEQ ID NO: 85565 - DNA, 20 bp, Artificial Sequence
  chemically synthesized
agaccaagagcagggaaaga

SEQ ID NO: 85566 - DNA, 20 bp, Artificial Sequence
  chemically synthesized
attgagaccaagagcaggga

SEQ ID NO: 85567 - DNA, 20 bp, Artificial Sequence
  chemically synthesized
attctttctttccctgctct

SEQ ID NO: 85568 - DNA, 20 bp, Artificial Sequence
  chemically synthesized
ggctattgagaccaagagca

SEQ ID NO: 85569 - DNA, 20 bp, Artificial Sequence
  chemically synthesized
aggctattgagaccaagagc

SEQ ID NO: 85570 - DNA, 20 bp, Artificial Sequence
  chemically synthesized
aaggctattgagaccaagag

SEQ ID NO: 85571 - DNA, 20 bp, Artificial Sequence
  chemically synthesized
aggaaggctattgagaccaa

SEQ ID NO: 85572 - DNA, 20 bp, Artificial Sequence
  chemically synthesized
aaaggaaggctattgagacc

SEQ ID NO: 85573 - DNA, 20 bp, Artificial Sequence
  chemically synthesized
ttccctgctcttggtctcaa

SEQ ID NO: 85574 - DNA, 20 bp, Artificial Sequence
  chemically synthesized
ttagataaaggaaggctatt

SEQ ID NO: 85575 - DNA, 20 bp, Artificial Sequence
  chemically synthesized
gacactggttagataaagga

SEQ ID NO: 85576 - DNA, 20 bp, Artificial Sequence
  chemically synthesized
agacactggttagataaagg

SEQ ID NO: 85577 - DNA, 20 bp, Artificial Sequence
  chemically synthesized
agtagacactggttagataa

SEQ ID NO: 85578 - DNA, 20 bp, Artificial Sequence
  chemically synthesized
cagtagacactggttagata

SEQ ID NO: 85579 - DNA, 20 bp, Artificial Sequence
  chemically synthesized
atagccttcctttatctaac

SEQ ID NO: 85580 - DNA, 20 bp, Artificial Sequence
  chemically synthesized
agtatacagtagacactggt

SEQ ID NO: 85581 - DNA, 20 bp, Artificial Sequence
  chemically synthesized
gcctagtatacagtagacac

SEQ ID NO: 85582 - DNA, 20 bp, Artificial Sequence
  chemically synthesized
ccaaagtgcctagtatacag

SEQ ID NO: 85583 - DNA, 20 bp, Artificial Sequence
  chemically synthesized
aaccagtgtctactgtatac

SEQ ID NO: 85584 - DNA, 20 bp, Artificial Sequence
  chemically synthesized
accagtgtctactgtatact

SEQ ID NO: 85585 - DNA, 20 bp, Artificial Sequence
  chemically synthesized
attccaaagtgcctagtata

SEQ ID NO: 85586 - DNA, 20 bp, Artificial Sequence
  chemically synthesized
ctactgtatactaggcactt

SEQ ID NO: 85587 - DNA, 20 bp, Artificial Sequence
  chemically synthesized
tcagcacattccaaagtgcc

SEQ ID NO: 85588 - DNA, 20 bp, Artificial Sequence
  chemically synthesized
tttctactcagcacattcca

SEQ ID NO: 85589 - DNA, 20 bp, Artificial Sequence
  chemically synthesized
taggcactttggaatgtgct

SEQ ID NO: 85590 - DNA, 20 bp, Artificial Sequence
  chemically synthesized
gcactttggaatgtgctgag

SEQ ID NO: 85591 - DNA, 20 bp, Artificial Sequence
  chemically synthesized
aaagctgtcatttttctact

SEQ ID NO: 85592 - DNA, 20 bp, Artificial Sequence
  chemically synthesized
tgtgctgagtagaaaaatga

SEQ ID NO: 85593 - DNA, 20 bp, Artificial Sequence
  chemically synthesized
gaagatttttgggaggggga

SEQ ID NO: 85594 - DNA, 20 bp, Artificial Sequence
  chemically synthesized
tcaagaagatttttgggagg

SEQ ID NO: 85595 - DNA, 20 bp, Artificial Sequence
  chemically synthesized
ttcaagaagatttttgggag

SEQ ID NO: 85596 - DNA, 20 bp, Artificial Sequence
  chemically synthesized
cttcaagaagatttttggga

SEQ ID NO: 85597 - DNA, 20 bp, Artificial Sequence
  chemically synthesized
ccttcaagaagatttttggg

SEQ ID NO: 85598 - DNA, 20 bp, Artificial Sequence
  chemically synthesized
tccttcaagaagatttttgg

SEQ ID NO: 85599 - DNA, 20 bp, Artificial Sequence
  chemically synthesized
tgtccttcaagaagattttt

SEQ ID NO: 85600 - DNA, 20 bp, Artificial Sequence
  chemically synthesized
atgtccttcaagaagatttt

SEQ ID NO: 85601 - DNA, 20 bp, Artificial Sequence
  chemically synthesized
ccctcccaaaaatcttcttg

SEQ ID NO: 85602 - DNA, 20 bp, Artificial Sequence
  chemically synthesized
cctcccaaaaatcttcttga

SEQ ID NO: 85603 - DNA, 20 bp, Artificial Sequence
  chemically synthesized
gctaaaccatgtccttcaag

SEQ ID NO: 85604 - DNA, 20 bp, Artificial Sequence
  chemically synthesized
cttgctaaaccatgtccttc

SEQ ID NO: 85605 - DNA, 20 bp, Artificial Sequence
  chemically synthesized
aaaaatcttcttgaaggaca

SEQ ID NO: 85606 - DNA, 20 bp, Artificial Sequence
  chemically synthesized
tcttcttgaaggacatggtt

SEQ ID NO: 85607 - DNA, 20 bp, Artificial Sequence
  chemically synthesized
cttgaaggacatggtttagc

SEQ ID NO: 85608 - DNA, 20 bp, Artificial Sequence
  chemically synthesized
tgaaggacatggtttagcaa

SEQ ID NO: 85609 - DNA, 20 bp, Artificial Sequence
  chemically synthesized
aggacatggtttagcaagag

SEQ ID NO: 85610 - DNA, 20 bp, Artificial Sequence
  chemically synthesized
agtagtcgatatttatcaaa

SEQ ID NO: 85611 - DNA, 20 bp, Artificial Sequence
  chemically synthesized
tgacaaacaacgctatgtta

SEQ ID NO: 85612 - DNA, 20 bp, Artificial Sequence
  chemically synthesized
ttgtctacttttctataaca

SEQ ID NO: 85613 - DNA, 20 bp, Artificial Sequence
  chemically synthesized
aacaacgctatgttatagaa

SEQ ID NO: 85614 - DNA, 20 bp, Artificial Sequence
  chemically synthesized
aacgctatgttatagaaaag

SEQ ID NO: 85615 - DNA, 20 bp, Artificial Sequence
  chemically synthesized
tatagaaaagtagacaattt

SEQ ID NO: 85616 - DNA, 20 bp, Artificial Sequence
  chemically synthesized
agaaaagtagacaattttag

SEQ ID NO: 85617 - DNA, 20 bp, Artificial Sequence
  chemically synthesized
gacaattttagaagtgtgta

SEQ ID NO: 85618 - DNA, 20 bp, Artificial Sequence
  chemically synthesized
attttagaagtgtgtaaaga

SEQ ID NO: 85619 - DNA, 20 bp, Artificial Sequence
  chemically synthesized
gaagtgtgtaaagaaagatc

SEQ ID NO: 85620 - DNA, 20 bp, Artificial Sequence
  chemically synthesized
ccctgttgtctacatttgac

SEQ ID NO: 85621 - DNA, 20 bp, Artificial Sequence
  chemically synthesized
aagaaagatctggtcaaatg

SEQ ID NO: 85622 - DNA, 20 bp, Artificial Sequence
  chemically synthesized
atctggtcaaatgtagacaa

SEQ ID NO: 85623 - DNA, 20 bp, Artificial Sequence
  chemically synthesized
tctggtcaaatgtagacaac

SEQ ID NO: 85624 - DNA, 20 bp, Artificial Sequence
  chemically synthesized
ctggtcaaatgtagacaaca

SEQ ID NO: 85625 - DNA, 20 bp, Artificial Sequence
  chemically synthesized
caaatgtagacaacagggaa

SEQ ID NO: 85626 - DNA, 20 bp, Artificial Sequence
  chemically synthesized
gaaaagtttgcacaatgtcc

SEQ ID NO: 85627 - DNA, 20 bp, Artificial Sequence
  chemically synthesized
gtttgcacaatgtccgagcc

SEQ ID NO: 85628 - DNA, 20 bp, Artificial Sequence
  chemically synthesized
taatcctttacatcttggct

SEQ ID NO: 85629 - DNA, 20 bp, Artificial Sequence
  chemically synthesized
aatgtccgagccaagatgta

SEQ ID NO: 85630 - DNA, 20 bp, Artificial Sequence
  chemically synthesized
tctaataatcctttacatct

SEQ ID NO: 85631 - DNA, 20 bp, Artificial Sequence
  chemically synthesized
atgtccgagccaagatgtaa

SEQ ID NO: 85632 - DNA, 20 bp, Artificial Sequence
  chemically synthesized
gccaagatgtaaaggattat

SEQ ID NO: 85633 - DNA, 20 bp, Artificial Sequence
  chemically synthesized
aaggattattagatgataac

SEQ ID NO: 85634 - DNA, 20 bp, Artificial Sequence
  chemically synthesized
aggattattagatgataacc

SEQ ID NO: 85635 - DNA, 20 bp, Artificial Sequence
  chemically synthesized
cccacccactcataatatcc

SEQ ID NO: 85636 - DNA, 20 bp, Artificial Sequence
  chemically synthesized
gatgataaccaggatattat

SEQ ID NO: 85637 - DNA, 20 bp, Artificial Sequence
  chemically synthesized
gataaccaggatattatgag

SEQ ID NO: 85638 - DNA, 20 bp, Artificial Sequence
  chemically synthesized
ataaccaggatattatgagt

SEQ ID NO: 85639 - DNA, 20 bp, Artificial Sequence
  chemically synthesized
accaggatattatgagtggg

SEQ ID NO: 85640 - DNA, 20 bp, Artificial Sequence
  chemically synthesized
ccaggatattatgagtgggt

SEQ ID NO: 85641 - DNA, 20 bp, Artificial Sequence
  chemically synthesized
atattatgagtgggtgggta

SEQ ID NO: 85642 - DNA, 20 bp, Artificial Sequence
  chemically synthesized
tattatgagtgggtgggtat

SEQ ID NO: 85643 - DNA, 20 bp, Artificial Sequence
  chemically synthesized
gagtgggtgggtataggtaa

SEQ ID NO: 85644 - DNA, 20 bp, Artificial Sequence
  chemically synthesized
agtgggtgggtataggtaaa

SEQ ID NO: 85645 - DNA, 20 bp, Artificial Sequence
  chemically synthesized
gtgggtgggtataggtaaaa

SEQ ID NO: 85646 - DNA, 20 bp, Artificial Sequence
  chemically synthesized
gggtataggtaaaagggttt

SEQ ID NO: 85647 - DNA, 20 bp, Artificial Sequence
  chemically synthesized
ataggtaaaagggtttgaga

SEQ ID NO: 85648 - DNA, 20 bp, Artificial Sequence
  chemically synthesized
aggtaaaagggtttgagaca

SEQ ID NO: 85649 - DNA, 20 bp, Artificial Sequence
  chemically synthesized
ggtaaaagggtttgagacag

SEQ ID NO: 85650 - DNA, 20 bp, Artificial Sequence
  chemically synthesized
atgtggggctttaaatatgt

SEQ ID NO: 85651 - DNA, 20 bp, Artificial Sequence
  chemically synthesized
acagaggaccaacatattta

SEQ ID NO: 85652 - DNA, 20 bp, Artificial Sequence
  chemically synthesized
acatatttaaagccccacat

SEQ ID NO: 85653 - DNA, 20 bp, Artificial Sequence
  chemically synthesized
atatttaaagccccacataa

SEQ ID NO: 85654 - DNA, 20 bp, Artificial Sequence
  chemically synthesized
ctgcgtgtccctcttatgtg

SEQ ID NO: 85655 - DNA, 20 bp, Artificial Sequence
  chemically synthesized
tatttaaagccccacataag

SEQ ID NO: 85656 - DNA, 20 bp, Artificial Sequence
  chemically synthesized
tctgcgtgtccctcttatgt

SEQ ID NO: 85657 - DNA, 20 bp, Artificial Sequence
  chemically synthesized
atttaaagccccacataaga

SEQ ID NO: 85658 - DNA, 20 bp, Artificial Sequence
  chemically synthesized
ttctgcgtgtccctcttatg

SEQ ID NO: 85659 - DNA, 20 bp, Artificial Sequence
  chemically synthesized
ccccacataagagggacacg

SEQ ID NO: 85660 - DNA, 20 bp, Artificial Sequence
  chemically synthesized
ataagagggacacgcagaat

SEQ ID NO: 85661 - DNA, 20 bp, Artificial Sequence
  chemically synthesized
gggacacgcagaattggaaa

SEQ ID NO: 85662 - DNA, 20 bp, Artificial Sequence
  chemically synthesized
gcagaattggaaaaagtaaa

SEQ ID NO: 85663 - DNA, 20 bp, Artificial Sequence
  chemically synthesized
agaattggaaaaagtaaatg

SEQ ID NO: 85664 - DNA, 20 bp, Artificial Sequence
  chemically synthesized
gaattggaaaaagtaaatgg

SEQ ID NO: 85665 - DNA, 20 bp, Artificial Sequence
  chemically synthesized
ttggaaaaagtaaatggagg

SEQ ID NO: 85666 - DNA, 20 bp, Artificial Sequence
  chemically synthesized
aaaagtaaatggaggcagta

SEQ ID NO: 85667 - DNA, 20 bp, Artificial Sequence
  chemically synthesized
gtaaatggaggcagtatggc

SEQ ID NO: 85668 - DNA, 20 bp, Artificial Sequence
  chemically synthesized
ttcccttgctgtttggatgc

SEQ ID NO: 85669 - DNA, 20 bp, Artificial Sequence
  chemically synthesized
cagtatggctggcatccaaa

SEQ ID NO: 85670 - DNA, 20 bp, Artificial Sequence
  chemically synthesized
atggctggcatccaaacagc

SEQ ID NO: 85671 - DNA, 20 bp, Artificial Sequence
  chemically synthesized
tggctggcatccaaacagca

SEQ ID NO: 85672 - DNA, 20 bp, Artificial Sequence
  chemically synthesized
gatgctcttcccttgctgtt

SEQ ID NO: 85673 - DNA, 20 bp, Artificial Sequence
  chemically synthesized
ggctggcatccaaacagcaa

SEQ ID NO: 85674 - DNA, 20 bp, Artificial Sequence
  chemically synthesized
tggcatccaaacagcaaggg

SEQ ID NO: 85675 - DNA, 20 bp, Artificial Sequence
  chemically synthesized
gcatccaaacagcaagggaa

SEQ ID NO: 85676 - DNA, 20 bp, Artificial Sequence
  chemically synthesized
aacagcaagggaagagcatc

SEQ ID NO: 85677 - DNA, 20 bp, Artificial Sequence
  chemically synthesized
acagcaagggaagagcatct

SEQ ID NO: 85678 - DNA, 20 bp, Artificial Sequence
  chemically synthesized
caagggaagagcatctagga

SEQ ID NO: 85679 - DNA, 20 bp, Artificial Sequence
  chemically synthesized
agggaagagcatctaggaaa

SEQ ID NO: 85680 - DNA, 20 bp, Artificial Sequence
  chemically synthesized
gggaagagcatctaggaaag

SEQ ID NO: 85681 - DNA, 20 bp, Artificial Sequence
  chemically synthesized
ggcctcagcctcctctttcc

SEQ ID NO: 85682 - DNA, 20 bp, Artificial Sequence
  chemically synthesized
gaagagcatctaggaaagag

SEQ ID NO: 85683 - DNA, 20 bp, Artificial Sequence
  chemically synthesized
aagagcatctaggaaagagg

SEQ ID NO: 85684 - DNA, 20 bp, Artificial Sequence
  chemically synthesized
catctaggaaagaggaggct

SEQ ID NO: 85685 - DNA, 20 bp, Artificial Sequence
  chemically synthesized
atctaggaaagaggaggctg

SEQ ID NO: 85686 - DNA, 20 bp, Artificial Sequence
  chemically synthesized
aggaaagaggaggctgaggc

SEQ ID NO: 85687 - DNA, 20 bp, Artificial Sequence
  chemically synthesized
ctatctggcttgtctggcct

SEQ ID NO: 85688 - DNA, 20 bp, Artificial Sequence
  chemically synthesized
agaggaggctgaggccagac

SEQ ID NO: 85689 - DNA, 20 bp, Artificial Sequence
  chemically synthesized
gaggctgaggccagacaagc

SEQ ID NO: 85690 - DNA, 20 bp, Artificial Sequence
  chemically synthesized
aaggcactatctggcttgtc

SEQ ID NO: 85691 - DNA, 20 bp, Artificial Sequence
  chemically synthesized
ctgaggccagacaagccaga

SEQ ID NO: 85692 - DNA, 20 bp, Artificial Sequence
  chemically synthesized
aagggtgacaaggcactatc

SEQ ID NO: 85693 - DNA, 20 bp, Artificial Sequence
  chemically synthesized
aatcctcaacaagggtgaca

SEQ ID NO: 85694 - DNA, 20 bp, Artificial Sequence
  chemically synthesized
aaatcctcaacaagggtgac

SEQ ID NO: 85695 - DNA, 20 bp, Artificial Sequence
  chemically synthesized
agtgccttgtcacccttgtt

SEQ ID NO: 85696 - DNA, 20 bp, Artificial Sequence
  chemically synthesized
gtgccttgtcacccttgttg

SEQ ID NO: 85697 - DNA, 20 bp, Artificial Sequence
  chemically synthesized
aagaccaaaatcctcaacaa

SEQ ID NO: 85698 - DNA, 20 bp, Artificial Sequence
  chemically synthesized
aaagaccaaaatcctcaaca

SEQ ID NO: 85699 - DNA, 20 bp, Artificial Sequence
  chemically synthesized
aaaagaccaaaatcctcaac

SEQ ID NO: 85700 - DNA, 20 bp, Artificial Sequence
  chemically synthesized
gtcacccttgttgaggattt

SEQ ID NO: 85701 - DNA, 20 bp, Artificial Sequence
  chemically synthesized
gaggattttggtctttttcc

SEQ ID NO: 85702 - DNA, 20 bp, Artificial Sequence
  chemically synthesized
ggattttggtctttttccaa

SEQ ID NO: 85703 - DNA, 20 bp, Artificial Sequence
  chemically synthesized
cttctcagtgctcttggaaa

SEQ ID NO: 85704 - DNA, 20 bp, Artificial Sequence
  chemically synthesized
agtagtcttctcagtgctct

SEQ ID NO: 85705 - DNA, 20 bp, Artificial Sequence
  chemically synthesized
ggtctttttccaagagcact

SEQ ID NO: 85706 - DNA, 20 bp, Artificial Sequence
  chemically synthesized
ctttttccaagagcactgag

SEQ ID NO: 85707 - DNA, 20 bp, Artificial Sequence
  chemically synthesized
taacactatagtagtcttct

SEQ ID NO: 85708 - DNA, 20 bp, Artificial Sequence
  chemically synthesized
gagcactgagaagactacta

SEQ ID NO: 85709 - DNA, 20 bp, Artificial Sequence
  chemically synthesized
tccttatcttaacactatag

SEQ ID NO: 85710 - DNA, 20 bp, Artificial Sequence
  chemically synthesized
gagaagactactatagtgtt

SEQ ID NO: 85711 - DNA, 20 bp, Artificial Sequence
  chemically synthesized
cagtccttatcttaacacta

SEQ ID NO: 85712 - DNA, 20 bp, Artificial Sequence
  chemically synthesized
gactactatagtgttaagat

SEQ ID NO: 85713 - DNA, 20 bp, Artificial Sequence
  chemically synthesized
actactatagtgttaagata

SEQ ID NO: 85714 - DNA, 20 bp, Artificial Sequence
  chemically synthesized
aagataaggactgatataat

SEQ ID NO: 85715 - DNA, 20 bp, Artificial Sequence
  chemically synthesized
aaacataaatccaattatat

SEQ ID NO: 85716 - DNA, 20 bp, Artificial Sequence
  chemically synthesized
ttggatttatgttttttaca

SEQ ID NO: 85717 - DNA, 20 bp, Artificial Sequence
  chemically synthesized
tgcaatctctacatttcagt

SEQ ID NO: 85718 - DNA, 20 bp, Artificial Sequence
  chemically synthesized
agattattctgactgaaatg

SEQ ID NO: 85719 - DNA, 20 bp, Artificial Sequence
  chemically synthesized
attattctgactgaaatgta

SEQ ID NO: 85720 - DNA, 20 bp, Artificial Sequence
  chemically synthesized
acaatgcaatctctacattt

SEQ ID NO: 85721 - DNA, 20 bp, Artificial Sequence
  chemically synthesized
gaaatgtagagattgcattg

SEQ ID NO: 85722 - DNA, 20 bp, Artificial Sequence
  chemically synthesized
aaatgtagagattgcattgt

SEQ ID NO: 85723 - DNA, 20 bp, Artificial Sequence
  chemically synthesized
aatgtagagattgcattgta

SEQ ID NO: 85724 - DNA, 20 bp, Artificial Sequence
  chemically synthesized
gtagagattgcattgtaggg

SEQ ID NO: 85725 - DNA, 20 bp, Artificial Sequence
  chemically synthesized
agattgcattgtagggtggc

SEQ ID NO: 85726 - DNA, 20 bp, Artificial Sequence
  chemically synthesized
attgcattgtagggtggcaa

SEQ ID NO: 85727 - DNA, 20 bp, Artificial Sequence
  chemically synthesized
gcattgtagggtggcaagag

SEQ ID NO: 85728 - DNA, 20 bp, Artificial Sequence
  chemically synthesized
tagggtggcaagagtagatg

SEQ ID NO: 85729 - DNA, 20 bp, Artificial Sequence
  chemically synthesized
gtggcaagagtagatgcaga

SEQ ID NO: 85730 - DNA, 20 bp, Artificial Sequence
  chemically synthesized
tggcaagagtagatgcagaa

SEQ ID NO: 85731 - DNA, 20 bp, Artificial Sequence
  chemically synthesized
aagagtagatgcagaaaggt

SEQ ID NO: 85732 - DNA, 20 bp, Artificial Sequence
  chemically synthesized
agagtagatgcagaaaggtt

SEQ ID NO: 85733 - DNA, 20 bp, Artificial Sequence
  chemically synthesized
agtagatgcagaaaggttag

SEQ ID NO: 85734 - DNA, 20 bp, Artificial Sequence
  chemically synthesized
tgcagaaaggttaggagaaa

SEQ ID NO: 85735 - DNA, 20 bp, Artificial Sequence
  chemically synthesized
tgttatcatcataattatag

SEQ ID NO: 85736 - DNA, 20 bp, Artificial Sequence
  chemically synthesized
tattgttatcatcataatta

SEQ ID NO: 85737 - DNA, 20 bp, Artificial Sequence
  chemically synthesized
tataattatgatgataacaa

SEQ ID NO: 85738 - DNA, 20 bp, Artificial Sequence
  chemically synthesized
aattatgatgataacaatag

SEQ ID NO: 85739 - DNA, 20 bp, Artificial Sequence
  chemically synthesized
atgatgataacaatagtaga

SEQ ID NO: 85740 - DNA, 20 bp, Artificial Sequence
  chemically synthesized
gacagtcaaaaacaattttg

SEQ ID NO: 85741 - DNA, 20 bp, Artificial Sequence
  chemically synthesized
acagtcaaaaacaattttga

SEQ ID NO: 85742 - DNA, 20 bp, Artificial Sequence
  chemically synthesized
aaacaattttgaaggtaaat

SEQ ID NO: 85743 - DNA, 20 bp, Artificial Sequence
  chemically synthesized
aattttgaaggtaaattggc

SEQ ID NO: 85744 - DNA, 20 bp, Artificial Sequence
  chemically synthesized
attttgaaggtaaattggcc

SEQ ID NO: 85745 - DNA, 20 bp, Artificial Sequence
  chemically synthesized
gaaggtaaattggccaggtg

SEQ ID NO: 85746 - DNA, 20 bp, Artificial Sequence
  chemically synthesized
ggtaaattggccaggtgcgg

SEQ ID NO: 85747 - DNA, 20 bp, Artificial Sequence
  chemically synthesized
caggcgtgagccaccgcacc

SEQ ID NO: 85748 - DNA, 20 bp, Artificial Sequence
  chemically synthesized
agtgctgggattacaggcgt

SEQ ID NO: 85749 - DNA, 20 bp, Artificial Sequence
  chemically synthesized
gtggctcacgcctgtaatcc

SEQ ID NO: 85750 - DNA, 20 bp, Artificial Sequence
  chemically synthesized
tcccaaagtgctgggattac

SEQ ID NO: 85751 - DNA, 20 bp, Artificial Sequence
  chemically synthesized
ctcccaaagtgctgggatta

SEQ ID NO: 85752 - DNA, 20 bp, Artificial Sequence
  chemically synthesized
cgcctgtaatcccagcactt

SEQ ID NO: 85753 - DNA, 20 bp, Artificial Sequence
  chemically synthesized
tcttggcctcccaaagtgct

SEQ ID NO: 85754 - DNA, 20 bp, Artificial Sequence
  chemically synthesized
gcctgtaatcccagcacttt

SEQ ID NO: 85755 - DNA, 20 bp, Artificial Sequence
  chemically synthesized
gtcttggcctcccaaagtgc

SEQ ID NO: 85756 - DNA, 20 bp, Artificial Sequence
  chemically synthesized
ctgtaatcccagcactttgg

SEQ ID NO: 85757 - DNA, 20 bp, Artificial Sequence
  chemically synthesized
tgtaatcccagcactttggg

SEQ ID NO: 85758 - DNA, 20 bp, Artificial Sequence
  chemically synthesized
ctgcctgtcttggcctccca

SEQ ID NO: 85759 - DNA, 20 bp, Artificial Sequence
  chemically synthesized
tcccagcactttgggaggcc

SEQ ID NO: 85760 - DNA, 20 bp, Artificial Sequence
  chemically synthesized
agcactttgggaggccaaga

SEQ ID NO: 85761 - DNA, 20 bp, Artificial Sequence
  chemically synthesized
gcactttgggaggccaagac

SEQ ID NO: 85762 - DNA, 20 bp, Artificial Sequence
  chemically synthesized
ctttgggaggccaagacagg

SEQ ID NO: 85763 - DNA, 20 bp, Artificial Sequence
  chemically synthesized
acctcgtgatctgcctgtct

SEQ ID NO: 85764 - DNA, 20 bp, Artificial Sequence
  chemically synthesized
ggccaagacaggcagatcac

SEQ ID NO: 85765 - DNA, 20 bp, Artificial Sequence
  chemically synthesized
gccaagacaggcagatcacg

SEQ ID NO: 85766 - DNA, 20 bp, Artificial Sequence
  chemically synthesized
gacaggcagatcacgaggtc

SEQ ID NO: 85767 - DNA, 20 bp, Artificial Sequence
  chemically synthesized
caggcagatcacgaggtcaa

SEQ ID NO: 85768 - DNA, 20 bp, Artificial Sequence
  chemically synthesized
gatcacgaggtcaagagatc

SEQ ID NO: 85769 - DNA, 20 bp, Artificial Sequence
  chemically synthesized
gtcaagagatcgagaccatc

SEQ ID NO: 85770 - DNA, 20 bp, Artificial Sequence
  chemically synthesized
gtttcaccgtgttggccaga

SEQ ID NO: 85771 - DNA, 20 bp, Artificial Sequence
  chemically synthesized
tcgagaccatctggccaaca

SEQ ID NO: 85772 - DNA, 20 bp, Artificial Sequence
  chemically synthesized
cagggtttcaccgtgttggc

SEQ ID NO: 85773 - DNA, 20 bp, Artificial Sequence
  chemically synthesized
gagacagggtttcaccgtgt

SEQ ID NO: 85774 - DNA, 20 bp, Artificial Sequence
  chemically synthesized
ttgtatttttagtagagaca

SEQ ID NO: 85775 - DNA, 20 bp, Artificial Sequence
  chemically synthesized
tttgtatttttagtagagac

SEQ ID NO: 85776 - DNA, 20 bp, Artificial Sequence
  chemically synthesized
gtttgtatttttagtagaga

SEQ ID NO: 85777 - DNA, 20 bp, Artificial Sequence
  chemically synthesized
taatgtttgtatttttagta

SEQ ID NO: 85778 - DNA, 20 bp, Artificial Sequence
  chemically synthesized
cctaatgtttgtatttttag

SEQ ID NO: 85779 - DNA, 20 bp, Artificial Sequence
  chemically synthesized
ccacctaatgtttgtatttt

SEQ ID NO: 85780 - DNA, 20 bp, Artificial Sequence
  chemically synthesized
tctactaaaaatacaaacat

SEQ ID NO: 85781 - DNA, 20 bp, Artificial Sequence
  chemically synthesized
ctactaaaaatacaaacatt

SEQ ID NO: 85782 - DNA, 20 bp, Artificial Sequence
  chemically synthesized
ctaaaaatacaaacattagg

SEQ ID NO: 85783 - DNA, 20 bp, Artificial Sequence
  chemically synthesized
taaaaatacaaacattaggt

SEQ ID NO: 85784 - DNA, 20 bp, Artificial Sequence
  chemically synthesized
atacaaacattaggtgggca

SEQ ID NO: 85785 - DNA, 20 bp, Artificial Sequence
  chemically synthesized
caaacattaggtgggcatgg

SEQ ID NO: 85786 - DNA, 20 bp, Artificial Sequence
  chemically synthesized
ggcatggtggcgcgtgcctg

SEQ ID NO: 85787 - DNA, 20 bp, Artificial Sequence
  chemically synthesized
gtggcgcgtgcctgtagtcc

SEQ ID NO: 85788 - DNA, 20 bp, Artificial Sequence
  chemically synthesized
tcccgagtagctgggactac

SEQ ID NO: 85789 - DNA, 20 bp, Artificial Sequence
  chemically synthesized
ctcccgagtagctgggacta

SEQ ID NO: 85790 - DNA, 20 bp, Artificial Sequence
  chemically synthesized
tgcctgtagtcccagctact

SEQ ID NO: 85791 - DNA, 20 bp, Artificial Sequence
  chemically synthesized
cctcagcctcccgagtagct

SEQ ID NO: 85792 - DNA, 20 bp, Artificial Sequence
  chemically synthesized
gcctgtagtcccagctactc

SEQ ID NO: 85793 - DNA, 20 bp, Artificial Sequence
  chemically synthesized
gcctcagcctcccgagtagc

SEQ ID NO: 85794 - DNA, 20 bp, Artificial Sequence
  chemically synthesized
ctgtagtcccagctactcgg

SEQ ID NO: 85795 - DNA, 20 bp, Artificial Sequence
  chemically synthesized
tgtagtcccagctactcggg

SEQ ID NO: 85796 - DNA, 20 bp, Artificial Sequence
  chemically synthesized
tcccgcctcagcctcccgag

SEQ ID NO: 85797 - DNA, 20 bp, Artificial Sequence
  chemically synthesized
ttctcccgcctcagcctccc

SEQ ID NO: 85798 - DNA, 20 bp, Artificial Sequence
  chemically synthesized
tcccagctactcgggaggct

SEQ ID NO: 85799 - DNA, 20 bp, Artificial Sequence
  chemically synthesized
cccagctactcgggaggctg

SEQ ID NO: 85800 - DNA, 20 bp, Artificial Sequence
  chemically synthesized
agctactcgggaggctgagg

SEQ ID NO: 85801 - DNA, 20 bp, Artificial Sequence
  chemically synthesized
gctactcgggaggctgaggc

SEQ ID NO: 85802 - DNA, 20 bp, Artificial Sequence
  chemically synthesized
tactcgggaggctgaggcgg

SEQ ID NO: 85803 - DNA, 20 bp, Artificial Sequence
  chemically synthesized
ttcaagcaattctcccgcct

SEQ ID NO: 85804 - DNA, 20 bp, Artificial Sequence
  chemically synthesized
ggcgggagaattgcttgaac

SEQ ID NO: 85805 - DNA, 20 bp, Artificial Sequence
  chemically synthesized
gcgggagaattgcttgaacc

SEQ ID NO: 85806 - DNA, 20 bp, Artificial Sequence
  chemically synthesized
gggagaattgcttgaaccag

SEQ ID NO: 85807 - DNA, 20 bp, Artificial Sequence
  chemically synthesized
caacctccgcctcctggttc

SEQ ID NO: 85808 - DNA, 20 bp, Artificial Sequence
  chemically synthesized
ggagaattgcttgaaccagg

SEQ ID NO: 85809 - DNA, 20 bp, Artificial Sequence
  chemically synthesized
gaattgcttgaaccaggagg

SEQ ID NO: 85810 - DNA, 20 bp, Artificial Sequence
  chemically synthesized
attgcttgaaccaggaggcg

SEQ ID NO: 85811 - DNA, 20 bp, Artificial Sequence
  chemically synthesized
tcactgcaacctccgcctcc

SEQ ID NO: 85812 - DNA, 20 bp, Artificial Sequence
  chemically synthesized
ttgcttgaaccaggaggcgg

SEQ ID NO: 85813 - DNA, 20 bp, Artificial Sequence
  chemically synthesized
gaaccaggaggcggaggttg

SEQ ID NO: 85814 - DNA, 20 bp, Artificial Sequence
  chemically synthesized
caggaggcggaggttgcagt

SEQ ID NO: 85815 - DNA, 20 bp, Artificial Sequence
  chemically synthesized
ggcggaggttgcagtgagcc

SEQ ID NO: 85816 - DNA, 20 bp, Artificial Sequence
  chemically synthesized
gagttgcaatggcacaatct

SEQ ID NO: 85817 - DNA, 20 bp, Artificial Sequence
  chemically synthesized
tcaccaggctggagttgcaa

SEQ ID NO: 85818 - DNA, 20 bp, Artificial Sequence
  chemically synthesized
agattgtgccattgcaactc

SEQ ID NO: 85819 - DNA, 20 bp, Artificial Sequence
  chemically synthesized
gtgccattgcaactccagcc

SEQ ID NO: 85820 - DNA, 20 bp, Artificial Sequence
  chemically synthesized
cttgctctgtcaccaggctg

SEQ ID NO: 85821 - DNA, 20 bp, Artificial Sequence
  chemically synthesized
gtcttgctctgtcaccaggc

SEQ ID NO: 85822 - DNA, 20 bp, Artificial Sequence
  chemically synthesized
ttgcaactccagcctggtga

SEQ ID NO: 85823 - DNA, 20 bp, Artificial Sequence
  chemically synthesized
gcaactccagcctggtgaca

SEQ ID NO: 85824 - DNA, 20 bp, Artificial Sequence
  chemically synthesized
ctgggtcttgctctgtcacc

SEQ ID NO: 85825 - DNA, 20 bp, Artificial Sequence
  chemically synthesized
actgggtcttgctctgtcac

SEQ ID NO: 85826 - DNA, 20 bp, Artificial Sequence
  chemically synthesized
ctccagcctggtgacagagc

SEQ ID NO: 85827 - DNA, 20 bp, Artificial Sequence
  chemically synthesized
cctggtgacagagcaagacc

SEQ ID NO: 85828 - DNA, 20 bp, Artificial Sequence
  chemically synthesized
ttttttttttttttgagact

SEQ ID NO: 85829 - DNA, 20 bp, Artificial Sequence
  chemically synthesized
tttttttttttttttgagac

SEQ ID NO: 85830 - DNA, 20 bp, Artificial Sequence
  chemically synthesized
tttttttttttttttttttt

SEQ ID NO: 85831 - DNA, 20 bp, Artificial Sequence
  chemically synthesized
aaaaaaaaaaaaaattgacc

SEQ ID NO: 85832 - DNA, 20 bp, Artificial Sequence
  chemically synthesized
tccactaccaagacatcact

SEQ ID NO: 85833 - DNA, 20 bp, Artificial Sequence
  chemically synthesized
ttccactaccaagacatcac

SEQ ID NO: 85834 - DNA, 20 bp, Artificial Sequence
  chemically synthesized
aaattgacccagtgatgtct

SEQ ID NO: 85835 - DNA, 20 bp, Artificial Sequence
  chemically synthesized
ttgacccagtgatgtcttgg

SEQ ID NO: 85836 - DNA, 20 bp, Artificial Sequence
  chemically synthesized
acccagtgatgtcttggtag

SEQ ID NO: 85837 - DNA, 20 bp, Artificial Sequence
  chemically synthesized
gccttcagccttccactacc

SEQ ID NO: 85838 - DNA, 20 bp, Artificial Sequence
  chemically synthesized
cagtgatgtcttggtagtgg

SEQ ID NO: 85839 - DNA, 20 bp, Artificial Sequence
  chemically synthesized
agtgatgtcttggtagtgga

SEQ ID NO: 85840 - DNA, 20 bp, Artificial Sequence
  chemically synthesized
gtcttggtagtggaaggctg

SEQ ID NO: 85841 - DNA, 20 bp, Artificial Sequence
  chemically synthesized
tcttggtagtggaaggctga

SEQ ID NO: 85842 - DNA, 20 bp, Artificial Sequence
  chemically synthesized
ggtagtggaaggctgaaggc

SEQ ID NO: 85843 - DNA, 20 bp, Artificial Sequence
  chemically synthesized
ttttccggatgaccagcctt

SEQ ID NO: 85844 - DNA, 20 bp, Artificial Sequence
  chemically synthesized
aaggctgaaggctggtcatc

SEQ ID NO: 85845 - DNA, 20 bp, Artificial Sequence
  chemically synthesized
cagtaccttttccggatgac

SEQ ID NO: 85846 - DNA, 20 bp, Artificial Sequence
  chemically synthesized
tgaaggctggtcatccggaa

SEQ ID NO: 85847 - DNA, 20 bp, Artificial Sequence
  chemically synthesized
gaaggctggtcatccggaaa

SEQ ID NO: 85848 - DNA, 20 bp, Artificial Sequence
  chemically synthesized
gtctggtacagtaccttttc

SEQ ID NO: 85849 - DNA, 20 bp, Artificial Sequence
  chemically synthesized
atccggaaaaggtactgtac

SEQ ID NO: 85850 - DNA, 20 bp, Artificial Sequence
  chemically synthesized
aacaatgtagttgtctggta

SEQ ID NO: 85851 - DNA, 20 bp, Artificial Sequence
  chemically synthesized
cagacaacaatgtagttgtc

SEQ ID NO: 85852 - DNA, 20 bp, Artificial Sequence
  chemically synthesized
tctcataccagacaacaatg

SEQ ID NO: 85853 - DNA, 20 bp, Artificial Sequence
  chemically synthesized
cagacaactacattgttgtc

SEQ ID NO: 85854 - DNA, 20 bp, Artificial Sequence
  chemically synthesized
actacattgttgtctggtat

SEQ ID NO: 85855 - DNA, 20 bp, Artificial Sequence
  chemically synthesized
aactaaatattttctcatac

SEQ ID NO: 85856 - DNA, 20 bp, Artificial Sequence
  chemically synthesized
gtctggtatgagaaaatatt

SEQ ID NO: 85857 - DNA, 20 bp, Artificial Sequence
  chemically synthesized
ggtatgagaaaatatttagt

SEQ ID NO: 85858 - DNA, 20 bp, Artificial Sequence
  chemically synthesized
tatgagaaaatatttagtta

SEQ ID NO: 85859 - DNA, 20 bp, Artificial Sequence
  chemically synthesized
aaaatatttagttagagtct

SEQ ID NO: 85860 - DNA, 20 bp, Artificial Sequence
  chemically synthesized
aaactctagctaaatattcc

SEQ ID NO: 85861 - DNA, 20 bp, Artificial Sequence
  chemically synthesized
agttagagtctcggaatatt

SEQ ID NO: 85862 - DNA, 20 bp, Artificial Sequence
  chemically synthesized
agagtctcggaatatttagc

SEQ ID NO: 85863 - DNA, 20 bp, Artificial Sequence
  chemically synthesized
agtctcggaatatttagcta

SEQ ID NO: 85864 - DNA, 20 bp, Artificial Sequence
  chemically synthesized
ggaatatttagctagagttt

SEQ ID NO: 85865 - DNA, 20 bp, Artificial Sequence
  chemically synthesized
tctacaaaactccaaaactc

SEQ ID NO: 85866 - DNA, 20 bp, Artificial Sequence
  chemically synthesized
aatatttagctagagttttg

SEQ ID NO: 85867 - DNA, 20 bp, Artificial Sequence
  chemically synthesized
gctagagttttggagttttg

SEQ ID NO: 85868 - DNA, 20 bp, Artificial Sequence
  chemically synthesized
ttttggagttttgtagattg

SEQ ID NO: 85869 - DNA, 20 bp, Artificial Sequence
  chemically synthesized
ttgtagattgcagcaacaaa

SEQ ID NO: 85870 - DNA, 20 bp, Artificial Sequence
  chemically synthesized
attgcagcaacaaaaagata

SEQ ID NO: 85871 - DNA, 20 bp, Artificial Sequence
  chemically synthesized
gcagcaacaaaaagataaag

SEQ ID NO: 85872 - DNA, 20 bp, Artificial Sequence
  chemically synthesized
aacaaaaagataaagaagca

SEQ ID NO: 85873 - DNA, 20 bp, Artificial Sequence
  chemically synthesized
acaaaaagataaagaagcaa

SEQ ID NO: 85874 - DNA, 20 bp, Artificial Sequence
  chemically synthesized
caaaaagataaagaagcaaa

SEQ ID NO: 85875 - DNA, 20 bp, Artificial Sequence
  chemically synthesized
gataaagaagcaaagggttt

SEQ ID NO: 85876 - DNA, 20 bp, Artificial Sequence
  chemically synthesized
ttttaataacttgttttcaa

SEQ ID NO: 85877 - DNA, 20 bp, Artificial Sequence
  chemically synthesized
ggtttcagacttttgaaaac

SEQ ID NO: 85878 - DNA, 20 bp, Artificial Sequence
  chemically synthesized
gaaaacaagttattaaaatt

SEQ ID NO: 85879 - DNA, 20 bp, Artificial Sequence
  chemically synthesized
aaatttagatgattgaatct

SEQ ID NO: 85880 - DNA, 20 bp, Artificial Sequence
  chemically synthesized
acctccttccaaatacaact

SEQ ID NO: 85881 - DNA, 20 bp, Artificial Sequence
  chemically synthesized
gattgaatctaagttgtatt

SEQ ID NO: 85882 - DNA, 20 bp, Artificial Sequence
  chemically synthesized
tgaatctaagttgtatttgg

SEQ ID NO: 85883 - DNA, 20 bp, Artificial Sequence
  chemically synthesized
gaatctaagttgtatttgga

SEQ ID NO: 85884 - DNA, 20 bp, Artificial Sequence
  chemically synthesized
atctaagttgtatttggaag

SEQ ID NO: 85885 - DNA, 20 bp, Artificial Sequence
  chemically synthesized
tctaagttgtatttggaagg

SEQ ID NO: 85886 - DNA, 20 bp, Artificial Sequence
  chemically synthesized
tatttggaaggaggtaaata

SEQ ID NO: 85887 - DNA, 20 bp, Artificial Sequence
  chemically synthesized
ttggaaggaggtaaatatgg

SEQ ID NO: 85888 - DNA, 20 bp, Artificial Sequence
  chemically synthesized
tggaaggaggtaaatatgga

SEQ ID NO: 85889 - DNA, 20 bp, Artificial Sequence
  chemically synthesized
ggaaggaggtaaatatggaa

SEQ ID NO: 85890 - DNA, 20 bp, Artificial Sequence
  chemically synthesized
aggaggtaaatatggaaggg

SEQ ID NO: 85891 - DNA, 20 bp, Artificial Sequence
  chemically synthesized
gaggtaaatatggaagggca

SEQ ID NO: 85892 - DNA, 20 bp, Artificial Sequence
  chemically synthesized
aggtaaatatggaagggcag

SEQ ID NO: 85893 - DNA, 20 bp, Artificial Sequence
  chemically synthesized
ttactctgtgttttatacat

SEQ ID NO: 85894 - DNA, 20 bp, Artificial Sequence
  chemically synthesized
aggaactaatgtataaaaca

SEQ ID NO: 85895 - DNA, 20 bp, Artificial Sequence
  chemically synthesized
gaactaatgtataaaacaca

SEQ ID NO: 85896 - DNA, 20 bp, Artificial Sequence
  chemically synthesized
ataaaacacagagtaatcaa

SEQ ID NO: 85897 - DNA, 20 bp, Artificial Sequence
  chemically synthesized
taaaacacagagtaatcaat

SEQ ID NO: 85898 - DNA, 20 bp, Artificial Sequence
  chemically synthesized
acacagagtaatcaatgggc

SEQ ID NO: 85899 - DNA, 20 bp, Artificial Sequence
  chemically synthesized
cagagtaatcaatgggctgg

SEQ ID NO: 85900 - DNA, 20 bp, Artificial Sequence
  chemically synthesized
cgtgaatttcacaggacttc

SEQ ID NO: 85901 - DNA, 20 bp, Artificial Sequence
  chemically synthesized
taacctttcgtgaatttcac

SEQ ID NO: 85902 - DNA, 20 bp, Artificial Sequence
  chemically synthesized
ttaacctttcgtgaatttca

SEQ ID NO: 85903 - DNA, 20 bp, Artificial Sequence
  chemically synthesized
aagtcctgtgaaattcacga

SEQ ID NO: 85904 - DNA, 20 bp, Artificial Sequence
  chemically synthesized
agtcctgtgaaattcacgaa

SEQ ID NO: 85905 - DNA, 20 bp, Artificial Sequence
  chemically synthesized
tgaaattcacgaaaggttaa

SEQ ID NO: 85906 - DNA, 20 bp, Artificial Sequence
  chemically synthesized
gaaattcacgaaaggttaac

SEQ ID NO: 85907 - DNA, 20 bp, Artificial Sequence
  chemically synthesized
attcacgaaaggttaacagg

SEQ ID NO: 85908 - DNA, 20 bp, Artificial Sequence
  chemically synthesized
aggttaacaggtagctatct

SEQ ID NO: 85909 - DNA, 20 bp, Artificial Sequence
  chemically synthesized
taacaggtagctatctgagc

SEQ ID NO: 85910 - DNA, 20 bp, Artificial Sequence
  chemically synthesized
ggttagtgtgcttgctcaga

SEQ ID NO: 85911 - DNA, 20 bp, Artificial Sequence
  chemically synthesized
acttggttagtgtgcttgct

SEQ ID NO: 85912 - DNA, 20 bp, Artificial Sequence
  chemically synthesized
tctgagcaagcacactaacc

SEQ ID NO: 85913 - DNA, 20 bp, Artificial Sequence
  chemically synthesized
gagcaagcacactaaccaag

SEQ ID NO: 85914 - DNA, 20 bp, Artificial Sequence
  chemically synthesized
agcaagcacactaaccaagt

SEQ ID NO: 85915 - DNA, 20 bp, Artificial Sequence
  chemically synthesized
ttaatccgtccccacttggt

SEQ ID NO: 85916 - DNA, 20 bp, Artificial Sequence
  chemically synthesized
gcaagcacactaaccaagtg

SEQ ID NO: 85917 - DNA, 20 bp, Artificial Sequence
  chemically synthesized
gaagttaatccgtccccact

SEQ ID NO: 85918 - DNA, 20 bp, Artificial Sequence
  chemically synthesized
gcacactaaccaagtgggga

SEQ ID NO: 85919 - DNA, 20 bp, Artificial Sequence
  chemically synthesized
gggacggattaacttcattc

SEQ ID NO: 85920 - DNA, 20 bp, Artificial Sequence
  chemically synthesized
gagtgatactcaccagaatg

SEQ ID NO: 85921 - DNA, 20 bp, Artificial Sequence
  chemically synthesized
cggattaacttcattctggt

SEQ ID NO: 85922 - DNA, 20 bp, Artificial Sequence
  chemically synthesized
gagttatgagtgatactcac

SEQ ID NO: 85923 - DNA, 20 bp, Artificial Sequence
  chemically synthesized
gtgagtatcactcataactc

SEQ ID NO: 85924 - DNA, 20 bp, Artificial Sequence
  chemically synthesized
gatggtgatgctagagttat

SEQ ID NO: 85925 - DNA, 20 bp, Artificial Sequence
  chemically synthesized
ttggggagatggtgatgcta

SEQ ID NO: 85926 - DNA, 20 bp, Artificial Sequence
  chemically synthesized
acttggggagatggtgatgc

SEQ ID NO: 85927 - DNA, 20 bp, Artificial Sequence
  chemically synthesized
tctagcatcaccatctcccc

SEQ ID NO: 85928 - DNA, 20 bp, Artificial Sequence
  chemically synthesized
aagaacatgacttggggaga

SEQ ID NO: 85929 - DNA, 20 bp, Artificial Sequence
  chemically synthesized
gacaaagaacatgacttggg

SEQ ID NO: 85930 - DNA, 20 bp, Artificial Sequence
  chemically synthesized
atgacaaagaacatgacttg

SEQ ID NO: 85931 - DNA, 20 bp, Artificial Sequence
  chemically synthesized
catgacaaagaacatgactt

SEQ ID NO: 85932 - DNA, 20 bp, Artificial Sequence
  chemically synthesized
tcatgacaaagaacatgact

SEQ ID NO: 85933 - DNA, 20 bp, Artificial Sequence
  chemically synthesized
caagtcatgttctttgtcat

SEQ ID NO: 85934 - DNA, 20 bp, Artificial Sequence
  chemically synthesized
tactcaggaatctcatgaca

SEQ ID NO: 85935 - DNA, 20 bp, Artificial Sequence
  chemically synthesized
ttctttgtcatgagattcct

SEQ ID NO: 85936 - DNA, 20 bp, Artificial Sequence
  chemically synthesized
ttgtcatgagattcctgagt

SEQ ID NO: 85937 - DNA, 20 bp, Artificial Sequence
  chemically synthesized
tgtcatgagattcctgagta

SEQ ID NO: 85938 - DNA, 20 bp, Artificial Sequence
  chemically synthesized
acttaacgcagtccttactc

SEQ ID NO: 85939 - DNA, 20 bp, Artificial Sequence
  chemically synthesized
tacttaacgcagtccttact

SEQ ID NO: 85940 - DNA, 20 bp, Artificial Sequence
  chemically synthesized
tcctgagtaaggactgcgtt

SEQ ID NO: 85941 - DNA, 20 bp, Artificial Sequence
  chemically synthesized
taaaatgtctgtacttaacg

SEQ ID NO: 85942 - DNA, 20 bp, Artificial Sequence
  chemically synthesized
agtaaggactgcgttaagta

SEQ ID NO: 85943 - DNA, 20 bp, Artificial Sequence
  chemically synthesized
ttttggttgcttgttaagag

SEQ ID NO: 85944 - DNA, 20 bp, Artificial Sequence
  chemically synthesized
gacattttaccactcttaac

SEQ ID NO: 85945 - DNA, 20 bp, Artificial Sequence
  chemically synthesized
tagttttggttgcttgttaa

SEQ ID NO: 85946 - DNA, 20 bp, Artificial Sequence
  chemically synthesized
attagttttggttgcttgtt

SEQ ID NO: 85947 - DNA, 20 bp, Artificial Sequence
  chemically synthesized
ctattcctggttattagttt

SEQ ID NO: 85948 - DNA, 20 bp, Artificial Sequence
  chemically synthesized
aagcaaccaaaactaataac

SEQ ID NO: 85949 - DNA, 20 bp, Artificial Sequence
  chemically synthesized
agcaaccaaaactaataacc

SEQ ID NO: 85950 - DNA, 20 bp, Artificial Sequence
  chemically synthesized
gcttcactattcctggttat

SEQ ID NO: 85951 - DNA, 20 bp, Artificial Sequence
  chemically synthesized
ccaaaactaataaccaggaa

SEQ ID NO: 85952 - DNA, 20 bp, Artificial Sequence
  chemically synthesized
aaatactgcttcactattcc

SEQ ID NO: 85953 - DNA, 20 bp, Artificial Sequence
  chemically synthesized
actaataaccaggaatagtg

SEQ ID NO: 85954 - DNA, 20 bp, Artificial Sequence
  chemically synthesized
aataaccaggaatagtgaag

SEQ ID NO: 85955 - DNA, 20 bp, Artificial Sequence
  chemically synthesized
cagtatttataacaaaatac

SEQ ID NO: 85956 - DNA, 20 bp, Artificial Sequence
  chemically synthesized
atttataacaaaatactggc

SEQ ID NO: 85957 - DNA, 20 bp, Artificial Sequence
  chemically synthesized
tataacaaaatactggctgg

SEQ ID NO: 85958 - DNA, 20 bp, Artificial Sequence
  chemically synthesized
ttgctgtggtttcttccagc

SEQ ID NO: 85959 - DNA, 20 bp, Artificial Sequence
  chemically synthesized
ataattgctgtggtttcttc

SEQ ID NO: 85960 - DNA, 20 bp, Artificial Sequence
  chemically synthesized
atactggctggaagaaacca

SEQ ID NO: 85961 - DNA, 20 bp, Artificial Sequence
  chemically synthesized
attggtccaaataattgctg

SEQ ID NO: 85962 - DNA, 20 bp, Artificial Sequence
  chemically synthesized
aagaaaccacagcaattatt

SEQ ID NO: 85963 - DNA, 20 bp, Artificial Sequence
  chemically synthesized
caactgtaatatgaggaaat

SEQ ID NO: 85964 - DNA, 20 bp, Artificial Sequence
  chemically synthesized
ggaccaatttcctcatatta

SEQ ID NO: 85965 - DNA, 20 bp, Artificial Sequence
  chemically synthesized
tgttcttcaactgtaatatg

SEQ ID NO: 85966 - DNA, 20 bp, Artificial Sequence
  chemically synthesized
ttgttcttcaactgtaatat

SEQ ID NO: 85967 - DNA, 20 bp, Artificial Sequence
  chemically synthesized
atttcctcatattacagttg

SEQ ID NO: 85968 - DNA, 20 bp, Artificial Sequence
  chemically synthesized
attacagttgaagaacaaaa

SEQ ID NO: 85969 - DNA, 20 bp, Artificial Sequence
  chemically synthesized
ttgaagaacaaaatagcaat

SEQ ID NO: 85970 - DNA, 20 bp, Artificial Sequence
  chemically synthesized
caatcagaatccatcttatg

SEQ ID NO: 85971 - DNA, 20 bp, Artificial Sequence
  chemically synthesized
agtcatatttcttcataaga

SEQ ID NO: 85972 - DNA, 20 bp, Artificial Sequence
  chemically synthesized
ttctagtcatatttcttcat

SEQ ID NO: 85973 - DNA, 20 bp, Artificial Sequence
  chemically synthesized
atcttatgaagaaatatgac

SEQ ID NO: 85974 - DNA, 20 bp, Artificial Sequence
  chemically synthesized
aagaaatatgactagaatct

SEQ ID NO: 85975 - DNA, 20 bp, Artificial Sequence
  chemically synthesized
gagtcaggagactgagattc

SEQ ID NO: 85976 - DNA, 20 bp, Artificial Sequence
  chemically synthesized
gcactaggagtcaggagact

SEQ ID NO: 85977 - DNA, 20 bp, Artificial Sequence
  chemically synthesized
acatgtgcactaggagtcag

SEQ ID NO: 85978 - DNA, 20 bp, Artificial Sequence
  chemically synthesized
aatctcagtctcctgactcc

SEQ ID NO: 85979 - DNA, 20 bp, Artificial Sequence
  chemically synthesized
ggacatgtgcactaggagtc

SEQ ID NO: 85980 - DNA, 20 bp, Artificial Sequence
  chemically synthesized
tggacatgtgcactaggagt

SEQ ID NO: 85981 - DNA, 20 bp, Artificial Sequence
  chemically synthesized
tcactggacatgtgcactag

SEQ ID NO: 85982 - DNA, 20 bp, Artificial Sequence
  chemically synthesized
aatcactggacatgtgcact

SEQ ID NO: 85983 - DNA, 20 bp, Artificial Sequence
  chemically synthesized
gaatcactggacatgtgcac

SEQ ID NO: 85984 - DNA, 20 bp, Artificial Sequence
  chemically synthesized
tgactcctagtgcacatgtc

SEQ ID NO: 85985 - DNA, 20 bp, Artificial Sequence
  chemically synthesized
aaccaaagaaaatgaatcac

SEQ ID NO: 85986 - DNA, 20 bp, Artificial Sequence
  chemically synthesized
gtccagtgattcattttctt

SEQ ID NO: 85987 - DNA, 20 bp, Artificial Sequence
  chemically synthesized
gattcattttctttggtttc

SEQ ID NO: 85988 - DNA, 20 bp, Artificial Sequence
  chemically synthesized
tatgctagttccagaaacca

SEQ ID NO: 85989 - DNA, 20 bp, Artificial Sequence
  chemically synthesized
ttttctttggtttctggaac

SEQ ID NO: 85990 - DNA, 20 bp, Artificial Sequence
  chemically synthesized
gatgaattttatgctagttc

SEQ ID NO: 85991 - DNA, 20 bp, Artificial Sequence
  chemically synthesized
acaaaagatgaattttatgc

SEQ ID NO: 85992 - DNA, 20 bp, Artificial Sequence
  chemically synthesized
agcataaaattcatcttttg

SEQ ID NO: 85993 - DNA, 20 bp, Artificial Sequence
  chemically synthesized
atgagacagaatttctacaa

SEQ ID NO: 85994 - DNA, 20 bp, Artificial Sequence
  chemically synthesized
tgcgatatagtgaaatgaga

SEQ ID NO: 85995 - DNA, 20 bp, Artificial Sequence
  chemically synthesized
attatgcgatatagtgaaat

SEQ ID NO: 85996 - DNA, 20 bp, Artificial Sequence
  chemically synthesized
aaaaaatgcattatgcgata

SEQ ID NO: 85997 - DNA, 20 bp, Artificial Sequence
  chemically synthesized
gcataatgcattttttaaaa

SEQ ID NO: 85998 - DNA, 20 bp, Artificial Sequence
  chemically synthesized
cataatgcattttttaaaaa

SEQ ID NO: 85999 - DNA, 20 bp, Artificial Sequence
  chemically synthesized
aagcactcattgagaaggat

SEQ ID NO: 86000 - DNA, 20 bp, Artificial Sequence
  chemically synthesized
aaagcactcattgagaagga

SEQ ID NO: 86001 - DNA, 20 bp, Artificial Sequence
  chemically synthesized
aaaggcccatccttctcaat

SEQ ID NO: 86002 - DNA, 20 bp, Artificial Sequence
  chemically synthesized
tagaaaagcactcattgaga

SEQ ID NO: 86003 - DNA, 20 bp, Artificial Sequence
  chemically synthesized
atagaaaagcactcattgag

SEQ ID NO: 86004 - DNA, 20 bp, Artificial Sequence
  chemically synthesized
catatagaaaagcactcatt

SEQ ID NO: 86005 - DNA, 20 bp, Artificial Sequence
  chemically synthesized
actctggtgtacatatagaa

SEQ ID NO: 86006 - DNA, 20 bp, Artificial Sequence
  chemically synthesized
aaaacactctggtgtacata

SEQ ID NO: 86007 - DNA, 20 bp, Artificial Sequence
  chemically synthesized
gtgcttttctatatgtacac

SEQ ID NO: 86008 - DNA, 20 bp, Artificial Sequence
  chemically synthesized
gcttttctatatgtacacca

SEQ ID NO: 86009 - DNA, 20 bp, Artificial Sequence
  chemically synthesized
aataaacagccaaaacactc

SEQ ID NO: 86010 - DNA, 20 bp, Artificial Sequence
  chemically synthesized
atatgtacaccagagtgttt

SEQ ID NO: 86011 - DNA, 20 bp, Artificial Sequence
  chemically synthesized
atgttctgactttgaataaa

SEQ ID NO: 86012 - DNA, 20 bp, Artificial Sequence
  chemically synthesized
gtgttttggctgtttattca

SEQ ID NO: 86013 - DNA, 20 bp, Artificial Sequence
  chemically synthesized
tttggctgtttattcaaagt

SEQ ID NO: 86014 - DNA, 20 bp, Artificial Sequence
  chemically synthesized
gtcagaacatttaaaacaca

SEQ ID NO: 86015 - DNA, 20 bp, Artificial Sequence
  chemically synthesized
tgtggtagggtgaaatgtaa

SEQ ID NO: 86016 - DNA, 20 bp, Artificial Sequence
  chemically synthesized
ttaaattagcttttgtggta

SEQ ID NO: 86017 - DNA, 20 bp, Artificial Sequence
  chemically synthesized
tacatttcaccctaccacaa

SEQ ID NO: 86018 - DNA, 20 bp, Artificial Sequence
  chemically synthesized
attaaattagcttttgtggt

SEQ ID NO: 86019 - DNA, 20 bp, Artificial Sequence
  chemically synthesized
tattaaattagcttttgtgg

SEQ ID NO: 86020 - DNA, 20 bp, Artificial Sequence
  chemically synthesized
gaatattaaattagcttttg

SEQ ID NO: 86021 - DNA, 20 bp, Artificial Sequence
  chemically synthesized
tatatttctgaatattaaat

SEQ ID NO: 86022 - DNA, 20 bp, Artificial Sequence
  chemically synthesized
acaaaagctaatttaatatt

SEQ ID NO: 86023 - DNA, 20 bp, Artificial Sequence
  chemically synthesized
ttaatattcagaaatatatg

SEQ ID NO: 86024 - DNA, 20 bp, Artificial Sequence
  chemically synthesized
taatattcagaaatatatga

SEQ ID NO: 86025 - DNA, 20 bp, Artificial Sequence
  chemically synthesized
cagaaatatatgaaggcaaa

SEQ ID NO: 86026 - DNA, 20 bp, Artificial Sequence
  chemically synthesized
tatatgaaggcaaatggcta

SEQ ID NO: 86027 - DNA, 20 bp, Artificial Sequence
  chemically synthesized
atatgaaggcaaatggctaa

SEQ ID NO: 86028 - DNA, 20 bp, Artificial Sequence
  chemically synthesized
atgaaggcaaatggctaaag

SEQ ID NO: 86029 - DNA, 20 bp, Artificial Sequence
  chemically synthesized
gaaactgccagtttctcctt

SEQ ID NO: 86030 - DNA, 20 bp, Artificial Sequence
  chemically synthesized
caaatggctaaaggagaaac

SEQ ID NO: 86031 - DNA, 20 bp, Artificial Sequence
  chemically synthesized
atggctaaaggagaaactgg

SEQ ID NO: 86032 - DNA, 20 bp, Artificial Sequence
  chemically synthesized
aaaaatgccagggaaactgc

SEQ ID NO: 86033 - DNA, 20 bp, Artificial Sequence
  chemically synthesized
ggagaaactggcagtttccc

SEQ ID NO: 86034 - DNA, 20 bp, Artificial Sequence
  chemically synthesized
aaaaaaaaaaaaaaatgcca

SEQ ID NO: 86035 - DNA, 20 bp, Artificial Sequence
  chemically synthesized
caaaaaaaaaaaaaaatgcc

SEQ ID NO: 86036 - DNA, 20 bp, Artificial Sequence
  chemically synthesized
gcaaaaaaaaaaaaaaatgc

SEQ ID NO: 86037 - DNA, 20 bp, Artificial Sequence
  chemically synthesized
catttttttttttttttgca

SEQ ID NO: 86038 - DNA, 20 bp, Artificial Sequence
  chemically synthesized
tttttttttgcaaagatccc

SEQ ID NO: 86039 - DNA, 20 bp, Artificial Sequence
  chemically synthesized
ttttttttgcaaagatccct

SEQ ID NO: 86040 - DNA, 20 bp, Artificial Sequence
  chemically synthesized
agaacatgaaagaagaccca

SEQ ID NO: 86041 - DNA, 20 bp, Artificial Sequence
  chemically synthesized
gagaacatgaaagaagaccc

SEQ ID NO: 86042 - DNA, 20 bp, Artificial Sequence
  chemically synthesized
agagaacatgaaagaagacc

SEQ ID NO: 86043 - DNA, 20 bp, Artificial Sequence
  chemically synthesized
aagggaagagaacatgaaag

SEQ ID NO: 86044 - DNA, 20 bp, Artificial Sequence
  chemically synthesized
aaaaagggaagagaacatga

SEQ ID NO: 86045 - DNA, 20 bp, Artificial Sequence
  chemically synthesized
aggaaattataaaaagggaa

SEQ ID NO: 86046 - DNA, 20 bp, Artificial Sequence
  chemically synthesized
ataggaaattataaaaaggg

SEQ ID NO: 86047 - DNA, 20 bp, Artificial Sequence
  chemically synthesized
gatataggaaattataaaaa

SEQ ID NO: 86048 - DNA, 20 bp, Artificial Sequence
  chemically synthesized
ggatataggaaattataaaa

SEQ ID NO: 86049 - DNA, 20 bp, Artificial Sequence
  chemically synthesized
aggatataggaaattataaa

SEQ ID NO: 86050 - DNA, 20 bp, Artificial Sequence
  chemically synthesized
tattctggagaagaggatat

SEQ ID NO: 86051 - DNA, 20 bp, Artificial Sequence
  chemically synthesized
ttattctggagaagaggata

SEQ ID NO: 86052 - DNA, 20 bp, Artificial Sequence
  chemically synthesized
atttcctatatcctcttctc

SEQ ID NO: 86053 - DNA, 20 bp, Artificial Sequence
  chemically synthesized
tttatattattctggagaag

SEQ ID NO: 86054 - DNA, 20 bp, Artificial Sequence
  chemically synthesized
gtttatattattctggagaa

SEQ ID NO: 86055 - DNA, 20 bp, Artificial Sequence
  chemically synthesized
gggtttatattattctggag

SEQ ID NO: 86056 - DNA, 20 bp, Artificial Sequence
  chemically synthesized
caagggtttatattattctg

SEQ ID NO: 86057 - DNA, 20 bp, Artificial Sequence
  chemically synthesized
gtcaagggtttatattattc

SEQ ID NO: 86058 - DNA, 20 bp, Artificial Sequence
  chemically synthesized
gcatcttgaggaaaggtcaa

SEQ ID NO: 86059 - DNA, 20 bp, Artificial Sequence
  chemically synthesized
ggcatcttgaggaaaggtca

SEQ ID NO: 86060 - DNA, 20 bp, Artificial Sequence
  chemically synthesized
tggcatcttgaggaaaggtc

SEQ ID NO: 86061 - DNA, 20 bp, Artificial Sequence
  chemically synthesized
taaacccttgacctttcctc

SEQ ID NO: 86062 - DNA, 20 bp, Artificial Sequence
  chemically synthesized
aaaggtggcatcttgaggaa

SEQ ID NO: 86063 - DNA, 20 bp, Artificial Sequence
  chemically synthesized
caaaggtggcatcttgagga

SEQ ID NO: 86064 - DNA, 20 bp, Artificial Sequence
  chemically synthesized
cagccaaaggtggcatcttg

SEQ ID NO: 86065 - DNA, 20 bp, Artificial Sequence
  chemically synthesized
acagccaaaggtggcatctt

SEQ ID NO: 86066 - DNA, 20 bp, Artificial Sequence
  chemically synthesized
tttcctcaagatgccacctt

SEQ ID NO: 86067 - DNA, 20 bp, Artificial Sequence
  chemically synthesized
tgtggagatacagccaaagg

SEQ ID NO: 86068 - DNA, 20 bp, Artificial Sequence
  chemically synthesized
ctctgtggagatacagccaa

SEQ ID NO: 86069 - DNA, 20 bp, Artificial Sequence
  chemically synthesized
tctctgtggagatacagcca

SEQ ID NO: 86070 - DNA, 20 bp, Artificial Sequence
  chemically synthesized
gaaagatctctgtggagata

SEQ ID NO: 86071 - DNA, 20 bp, Artificial Sequence
  chemically synthesized
cacctttggctgtatctcca

SEQ ID NO: 86072 - DNA, 20 bp, Artificial Sequence
  chemically synthesized
cctttggctgtatctccaca

SEQ ID NO: 86073 - DNA, 20 bp, Artificial Sequence
  chemically synthesized
gtaaaggaaagatctctgtg

SEQ ID NO: 86074 - DNA, 20 bp, Artificial Sequence
  chemically synthesized
atgtaaaggaaagatctctg

SEQ ID NO: 86075 - DNA, 20 bp, Artificial Sequence
  chemically synthesized
tatgttgagcatgtaaagga

SEQ ID NO: 86076 - DNA, 20 bp, Artificial Sequence
  chemically synthesized
tttgtatgttgagcatgtaa

SEQ ID NO: 86077 - DNA, 20 bp, Artificial Sequence
  chemically synthesized
ttttgtatgttgagcatgta

SEQ ID NO: 86078 - DNA, 20 bp, Artificial Sequence
  chemically synthesized
tggtaccacttttgtatgtt

SEQ ID NO: 86079 - DNA, 20 bp, Artificial Sequence
  chemically synthesized
tttacatgctcaacatacaa

SEQ ID NO: 86080 - DNA, 20 bp, Artificial Sequence
  chemically synthesized
acatgctcaacatacaaaag

SEQ ID NO: 86081 - DNA, 20 bp, Artificial Sequence
  chemically synthesized
aaaagtggtaccattttatc

SEQ ID NO: 86082 - DNA, 20 bp, Artificial Sequence
  chemically synthesized
ataataaaaacttgataaaa

SEQ ID NO: 86083 - DNA, 20 bp, Artificial Sequence
  chemically synthesized
tttatcaagtttttattatt

SEQ ID NO: 86084 - DNA, 20 bp, Artificial Sequence
  chemically synthesized
atcaagtttttattatttgg

SEQ ID NO: 86085 - DNA, 20 bp, Artificial Sequence
  chemically synthesized
ttatttggtagtaatttgtt

SEQ ID NO: 86086 - DNA, 20 bp, Artificial Sequence
  chemically synthesized
gatacaagaacagaaatgaa

SEQ ID NO: 86087 - DNA, 20 bp, Artificial Sequence
  chemically synthesized
gagaataaaagatacaagaa

SEQ ID NO: 86088 - DNA, 20 bp, Artificial Sequence
  chemically synthesized
gaaatgagaataaaagatac

SEQ ID NO: 86089 - DNA, 20 bp, Artificial Sequence
  chemically synthesized
tgttttggaaatgagaataa

SEQ ID NO: 86090 - DNA, 20 bp, Artificial Sequence
  chemically synthesized
ctgataagtgttttggaaat

SEQ ID NO: 86091 - DNA, 20 bp, Artificial Sequence
  chemically synthesized
gtggatactgataagtgttt

SEQ ID NO: 86092 - DNA, 20 bp, Artificial Sequence
  chemically synthesized
ctcatttccaaaacacttat

SEQ ID NO: 86093 - DNA, 20 bp, Artificial Sequence
  chemically synthesized
ggtgtagagtggatactgat

SEQ ID NO: 86094 - DNA, 20 bp, Artificial Sequence
  chemically synthesized
gtaaagtgtctggtgtagag

SEQ ID NO: 86095 - DNA, 20 bp, Artificial Sequence
  chemically synthesized
tatcagtatccactctacac

SEQ ID NO: 86096 - DNA, 20 bp, Artificial Sequence
  chemically synthesized
ctagtaaagtgtctggtgta

SEQ ID NO: 86097 - DNA, 20 bp, Artificial Sequence
  chemically synthesized
gtctagtaaagtgtctggtg

SEQ ID NO: 86098 - DNA, 20 bp, Artificial Sequence
  chemically synthesized
ctagagtctagtaaagtgtc

SEQ ID NO: 86099 - DNA, 20 bp, Artificial Sequence
  chemically synthesized
ctctacaccagacactttac

SEQ ID NO: 86100 - DNA, 20 bp, Artificial Sequence
  chemically synthesized
caagaccctagagtctagta

SEQ ID NO: 86101 - DNA, 20 bp, Artificial Sequence
  chemically synthesized
ccagacactttactagactc

SEQ ID NO: 86102 - DNA, 20 bp, Artificial Sequence
  chemically synthesized
cagacactttactagactct

SEQ ID NO: 86103 - DNA, 20 bp, Artificial Sequence
  chemically synthesized
agacactttactagactcta

SEQ ID NO: 86104 - DNA, 20 bp, Artificial Sequence
  chemically synthesized
acctccaagaccctagagtc

SEQ ID NO: 86105 - DNA, 20 bp, Artificial Sequence
  chemically synthesized
tgttcacctccaagacccta

SEQ ID NO: 86106 - DNA, 20 bp, Artificial Sequence
  chemically synthesized
tttactagactctagggtct

SEQ ID NO: 86107 - DNA, 20 bp, Artificial Sequence
  chemically synthesized
cttgttcacctccaagaccc

SEQ ID NO: 86108 - DNA, 20 bp, Artificial Sequence
  chemically synthesized
tactagactctagggtcttg

SEQ ID NO: 86109 - DNA, 20 bp, Artificial Sequence
  chemically synthesized
actagactctagggtcttgg

SEQ ID NO: 86110 - DNA, 20 bp, Artificial Sequence
  chemically synthesized
attttgtcttgttcacctcc

SEQ ID NO: 86111 - DNA, 20 bp, Artificial Sequence
  chemically synthesized
ctagggtcttggaggtgaac

SEQ ID NO: 86112 - DNA, 20 bp, Artificial Sequence
  chemically synthesized
agctctgagtgaaaaaggca

SEQ ID NO: 86113 - DNA, 20 bp, Artificial Sequence
  chemically synthesized
taagctctgagtgaaaaagg

SEQ ID NO: 86114 - DNA, 20 bp, Artificial Sequence
  chemically synthesized
tactaagctctgagtgaaaa

SEQ ID NO: 86115 - DNA, 20 bp, Artificial Sequence
  chemically synthesized
aaatctctgcctttttcact

SEQ ID NO: 86116 - DNA, 20 bp, Artificial Sequence
  chemically synthesized
ctactaagctctgagtgaaa

SEQ ID NO: 86117 - DNA, 20 bp, Artificial Sequence
  chemically synthesized
atctctgcctttttcactca

SEQ ID NO: 86118 - DNA, 20 bp, Artificial Sequence
  chemically synthesized
tgcctttttcactcagagct

SEQ ID NO: 86119 - DNA, 20 bp, Artificial Sequence
  chemically synthesized
tatcttctctactaagctct

SEQ ID NO: 86120 - DNA, 20 bp, Artificial Sequence
  chemically synthesized
ctttttcactcagagcttag

SEQ ID NO: 86121 - DNA, 20 bp, Artificial Sequence
  chemically synthesized
ttttcactcagagcttagta

SEQ ID NO: 86122 - DNA, 20 bp, Artificial Sequence
  chemically synthesized
tcactcagagcttagtagag

SEQ ID NO: 86123 - DNA, 20 bp, Artificial Sequence
  chemically synthesized
acatttctatcttctctact

SEQ ID NO: 86124 - DNA, 20 bp, Artificial Sequence
  chemically synthesized
tcagagcttagtagagaaga

SEQ ID NO: 86125 - DNA, 20 bp, Artificial Sequence
  chemically synthesized
aaaaataaaacaaacaaaca

SEQ ID NO: 86126 - DNA, 20 bp, Artificial Sequence
  chemically synthesized
caaacaaacaaagaaataat

SEQ ID NO: 86127 - DNA, 20 bp, Artificial Sequence
  chemically synthesized
aagaaataattggtcatcgt

SEQ ID NO: 86128 - DNA, 20 bp, Artificial Sequence
  chemically synthesized
gaaataattggtcatcgttg

SEQ ID NO: 86129 - DNA, 20 bp, Artificial Sequence
  chemically synthesized
aaataattggtcatcgttgg

SEQ ID NO: 86130 - DNA, 20 bp, Artificial Sequence
  chemically synthesized
tggtcatcgttggaggatgc

SEQ ID NO: 86131 - DNA, 20 bp, Artificial Sequence
  chemically synthesized
gttggaggatgctagtgaac

SEQ ID NO: 86132 - DNA, 20 bp, Artificial Sequence
  chemically synthesized
tataataacaacttgttcac

SEQ ID NO: 86133 - DNA, 20 bp, Artificial Sequence
  chemically synthesized
caagttgttattataaaaat

SEQ ID NO: 86134 - DNA, 20 bp, Artificial Sequence
  chemically synthesized
tgaaacgtattttgcttgtt

SEQ ID NO: 86135 - DNA, 20 bp, Artificial Sequence
  chemically synthesized
gtatacctttcataccgaac

SEQ ID NO: 86136 - DNA, 20 bp, Artificial Sequence
  chemically synthesized
attttgcttgttcggtatga

SEQ ID NO: 86137 - DNA, 20 bp, Artificial Sequence
  chemically synthesized
ttttgcttgttcggtatgaa

SEQ ID NO: 86138 - DNA, 20 bp, Artificial Sequence
  chemically synthesized
ttcggtatgaaaggtatact

SEQ ID NO: 86139 - DNA, 20 bp, Artificial Sequence
  chemically synthesized
ttgtctcctattttggtact

SEQ ID NO: 86140 - DNA, 20 bp, Artificial Sequence
  chemically synthesized
aggtatactgagtaccaaaa

SEQ ID NO: 86141 - DNA, 20 bp, Artificial Sequence
  chemically synthesized
ggtatactgagtaccaaaat

SEQ ID NO: 86142 - DNA, 20 bp, Artificial Sequence
  chemically synthesized
tatactgagtaccaaaatag

SEQ ID NO: 86143 - DNA, 20 bp, Artificial Sequence
  chemically synthesized
tttgcacttgtctcctattt

SEQ ID NO: 86144 - DNA, 20 bp, Artificial Sequence
  chemically synthesized
tgagtaccaaaataggagac

SEQ ID NO: 86145 - DNA, 20 bp, Artificial Sequence
  chemically synthesized
agtgcaaaacatttttttca

SEQ ID NO: 86146 - DNA, 20 bp, Artificial Sequence
  chemically synthesized
tttttttcatagacctaccc

SEQ ID NO: 86147 - DNA, 20 bp, Artificial Sequence
  chemically synthesized
cttcatttattcactggggt

SEQ ID NO: 86148 - DNA, 20 bp, Artificial Sequence
  chemically synthesized
tcttcatttattcactgggg

SEQ ID NO: 86149 - DNA, 20 bp, Artificial Sequence
  chemically synthesized
ccttcttcatttattcactg

SEQ ID NO: 86150 - DNA, 20 bp, Artificial Sequence
  chemically synthesized
tccttcttcatttattcact

SEQ ID NO: 86151 - DNA, 20 bp, Artificial Sequence
  chemically synthesized
ttccttcttcatttattcac

SEQ ID NO: 86152 - DNA, 20 bp, Artificial Sequence
  chemically synthesized
cctaccccagtgaataaatg

SEQ ID NO: 86153 - DNA, 20 bp, Artificial Sequence
  chemically synthesized
accccagtgaataaatgaag

SEQ ID NO: 86154 - DNA, 20 bp, Artificial Sequence
  chemically synthesized
ccccagtgaataaatgaaga

SEQ ID NO: 86155 - DNA, 20 bp, Artificial Sequence
  chemically synthesized
gtgaataaatgaagaaggaa

SEQ ID NO: 86156 - DNA, 20 bp, Artificial Sequence
  chemically synthesized
aataaatgaagaaggaatgg

SEQ ID NO: 86157 - DNA, 20 bp, Artificial Sequence
  chemically synthesized
taaatgaagaaggaatggta

SEQ ID NO: 86158 - DNA, 20 bp, Artificial Sequence
  chemically synthesized
tgaagaaggaatggtagaga

SEQ ID NO: 86159 - DNA, 20 bp, Artificial Sequence
  chemically synthesized
gaagaaggaatggtagagat

SEQ ID NO: 86160 - DNA, 20 bp, Artificial Sequence
  chemically synthesized
aattatcacactgcaacccc

SEQ ID NO: 86161 - DNA, 20 bp, Artificial Sequence
  chemically synthesized
cgatcagtggctaggggttg

SEQ ID NO: 86162 - DNA, 20 bp, Artificial Sequence
  chemically synthesized
tgttcacgatcagtggctag

SEQ ID NO: 86163 - DNA, 20 bp, Artificial Sequence
  chemically synthesized
ctgttcacgatcagtggcta

SEQ ID NO: 86164 - DNA, 20 bp, Artificial Sequence
  chemically synthesized
gctgttcacgatcagtggct

SEQ ID NO: 86165 - DNA, 20 bp, Artificial Sequence
  chemically synthesized
agctgttcacgatcagtggc

SEQ ID NO: 86166 - DNA, 20 bp, Artificial Sequence
  chemically synthesized
taatagctgttcacgatcag

SEQ ID NO: 86167 - DNA, 20 bp, Artificial Sequence
  chemically synthesized
gtttaatagctgttcacgat

SEQ ID NO: 86168 - DNA, 20 bp, Artificial Sequence
  chemically synthesized
ccctagccactgatcgtgaa

SEQ ID NO: 86169 - DNA, 20 bp, Artificial Sequence
  chemically synthesized
tctttttgtgtgatgtttaa

SEQ ID NO: 86170 - DNA, 20 bp, Artificial Sequence
  chemically synthesized
gctattaaacatcacacaaa

SEQ ID NO: 86171 - DNA, 20 bp, Artificial Sequence
  chemically synthesized
tattaaacatcacacaaaaa

SEQ ID NO: 86172 - DNA, 20 bp, Artificial Sequence
  chemically synthesized
atcacacaaaaagagaaaac

SEQ ID NO: 86173 - DNA, 20 bp, Artificial Sequence
  chemically synthesized
tcacacaaaaagagaaaaca

SEQ ID NO: 86174 - DNA, 20 bp, Artificial Sequence
  chemically synthesized
attcttccatcatcaggagg

SEQ ID NO: 86175 - DNA, 20 bp, Artificial Sequence
  chemically synthesized
tgtattcttccatcatcagg

SEQ ID NO: 86176 - DNA, 20 bp, Artificial Sequence
  chemically synthesized
tatataccacctcctgatga

SEQ ID NO: 86177 - DNA, 20 bp, Artificial Sequence
  chemically synthesized
gtgtattcttccatcatcag

SEQ ID NO: 86178 - DNA, 20 bp, Artificial Sequence
  chemically synthesized
tcgtgtattcttccatcatc

SEQ ID NO: 86179 - DNA, 20 bp, Artificial Sequence
  chemically synthesized
ataccacctcctgatgatgg

SEQ ID NO: 86180 - DNA, 20 bp, Artificial Sequence
  chemically synthesized
ttcgtgtattcttccatcat

SEQ ID NO: 86181 - DNA, 20 bp, Artificial Sequence
  chemically synthesized
agaatacacgaacacctgtg

SEQ ID NO: 86182 - DNA, 20 bp, Artificial Sequence
  chemically synthesized
atacacgaacacctgtgaag

SEQ ID NO: 86183 - DNA, 20 bp, Artificial Sequence
  chemically synthesized
ttttggcaagactgcttcac

SEQ ID NO: 86184 - DNA, 20 bp, Artificial Sequence
  chemically synthesized
tttttggcaagactgcttca

SEQ ID NO: 86185 - DNA, 20 bp, Artificial Sequence
  chemically synthesized
tgggtttggctttttttggc

SEQ ID NO: 86186 - DNA, 20 bp, Artificial Sequence
  chemically synthesized
tgaagcagtcttgccaaaaa

SEQ ID NO: 86187 - DNA, 20 bp, Artificial Sequence
  chemically synthesized
tatttgggtttggctttttt

SEQ ID NO: 86188 - DNA, 20 bp, Artificial Sequence
  chemically synthesized
agtttgattgtatttgggtt

SEQ ID NO: 86189 - DNA, 20 bp, Artificial Sequence
  chemically synthesized
tctatagtttgattgtattt

SEQ ID NO: 86190 - DNA, 20 bp, Artificial Sequence
  chemically synthesized
ttctatagtttgattgtatt

SEQ ID NO: 86191 - DNA, 20 bp, Artificial Sequence
  chemically synthesized
acccaaatacaatcaaacta

SEQ ID NO: 86192 - DNA, 20 bp, Artificial Sequence
  chemically synthesized
gattgaacagtgcagttcta

SEQ ID NO: 86193 - DNA, 20 bp, Artificial Sequence
  chemically synthesized
tagctaccgattgaacagtg

SEQ ID NO: 86194 - DNA, 20 bp, Artificial Sequence
  chemically synthesized
atagaactgcactgttcaat

SEQ ID NO: 86195 - DNA, 20 bp, Artificial Sequence
  chemically synthesized
gccagtagctaccgattgaa

SEQ ID NO: 86196 - DNA, 20 bp, Artificial Sequence
  chemically synthesized
gaactgcactgttcaatcgg

SEQ ID NO: 86197 - DNA, 20 bp, Artificial Sequence
  chemically synthesized
actgttcaatcggtagctac

SEQ ID NO: 86198 - DNA, 20 bp, Artificial Sequence
  chemically synthesized
cagtagccagatgttgccag

SEQ ID NO: 86199 - DNA, 20 bp, Artificial Sequence
  chemically synthesized
actcagtagccagatgttgc

SEQ ID NO: 86200 - DNA, 20 bp, Artificial Sequence
  chemically synthesized
cggtagctactggcaacatc

SEQ ID NO: 86201 - DNA, 20 bp, Artificial Sequence
  chemically synthesized
actggcaacatctggctact

SEQ ID NO: 86202 - DNA, 20 bp, Artificial Sequence
  chemically synthesized
cattccaagtactcagtagc

SEQ ID NO: 86203 - DNA, 20 bp, Artificial Sequence
  chemically synthesized
attacattccaagtactcag

SEQ ID NO: 86204 - DNA, 20 bp, Artificial Sequence
  chemically synthesized
acatctggctactgagtact

SEQ ID NO: 86205 - DNA, 20 bp, Artificial Sequence
  chemically synthesized
ctcattacattccaagtact

SEQ ID NO: 86206 - DNA, 20 bp, Artificial Sequence
  chemically synthesized
attcaggctcattacattcc

SEQ ID NO: 86207 - DNA, 20 bp, Artificial Sequence
  chemically synthesized
ctgagtacttggaatgtaat

SEQ ID NO: 86208 - DNA, 20 bp, Artificial Sequence
  chemically synthesized
gaatgtaatgagcctgaatt

SEQ ID NO: 86209 - DNA, 20 bp, Artificial Sequence
  chemically synthesized
tttacagcacatctcaattc

SEQ ID NO: 86210 - DNA, 20 bp, Artificial Sequence
  chemically synthesized
atttacagcacatctcaatt

SEQ ID NO: 86211 - DNA, 20 bp, Artificial Sequence
  chemically synthesized
atagaaaaaatgtacattta

SEQ ID NO: 86212 - DNA, 20 bp, Artificial Sequence
  chemically synthesized
tcatttcaacatgcaatcaa

SEQ ID NO: 86213 - DNA, 20 bp, Artificial Sequence
  chemically synthesized
ttgcatgttgaaatgacaat

SEQ ID NO: 86214 - DNA, 20 bp, Artificial Sequence
  chemically synthesized
tgacaataagaattgtacta

SEQ ID NO: 86215 - DNA, 20 bp, Artificial Sequence
  chemically synthesized
cattatatgtcatgcaactg

SEQ ID NO: 86216 - DNA, 20 bp, Artificial Sequence
  chemically synthesized
gcatgacatataatgatgaa

SEQ ID NO: 86217 - DNA, 20 bp, Artificial Sequence
  chemically synthesized
catataatgatgaaaagaaa

SEQ ID NO: 86218 - DNA, 20 bp, Artificial Sequence
  chemically synthesized
atataatgatgaaaagaaac

SEQ ID NO: 86219 - DNA, 20 bp, Artificial Sequence
  chemically synthesized
tataatgatgaaaagaaaca

SEQ ID NO: 86220 - DNA, 20 bp, Artificial Sequence
  chemically synthesized
gatgaaaagaaacagggtga

SEQ ID NO: 86221 - DNA, 20 bp, Artificial Sequence
  chemically synthesized
aagaaacagggtgaaagata

SEQ ID NO: 86222 - DNA, 20 bp, Artificial Sequence
  chemically synthesized
agaaacagggtgaaagatac

SEQ ID NO: 86223 - DNA, 20 bp, Artificial Sequence
  chemically synthesized
gaaacagggtgaaagataca

SEQ ID NO: 86224 - DNA, 20 bp, Artificial Sequence
  chemically synthesized
agtaagtttctaaaatagaa

SEQ ID NO: 86225 - DNA, 20 bp, Artificial Sequence
  chemically synthesized
acagggaaactattctattt

SEQ ID NO: 86226 - DNA, 20 bp, Artificial Sequence
  chemically synthesized
ttcacagtaagtttctaaaa

SEQ ID NO: 86227 - DNA, 20 bp, Artificial Sequence
  chemically synthesized
agtaattacagattcacagt

SEQ ID NO: 86228 - DNA, 20 bp, Artificial Sequence
  chemically synthesized
tggaagtaattacagattca

SEQ ID NO: 86229 - DNA, 20 bp, Artificial Sequence
  chemically synthesized
tttttgtttggaagtaatta

SEQ ID NO: 86230 - DNA, 20 bp, Artificial Sequence
  chemically synthesized
ttttattactttttgtttgg

SEQ ID NO: 86231 - DNA, 20 bp, Artificial Sequence
  chemically synthesized
tgtaattacttccaaacaaa

SEQ ID NO: 86232 - DNA, 20 bp, Artificial Sequence
  chemically synthesized
tctttttattactttttgtt

SEQ ID NO: 86233 - DNA, 20 bp, Artificial Sequence
  chemically synthesized
tccaaacaaaaagtaataaa

SEQ ID NO: 86234 - DNA, 20 bp, Artificial Sequence
  chemically synthesized
cacaccttactttggttagt

SEQ ID NO: 86235 - DNA, 20 bp, Artificial Sequence
  chemically synthesized
ataaaaagaccaactaacca

SEQ ID NO: 86236 - DNA, 20 bp, Artificial Sequence
  chemically synthesized
gacccacaccttactttggt

SEQ ID NO: 86237 - DNA, 20 bp, Artificial Sequence
  chemically synthesized
aaagaccaactaaccaaagt

SEQ ID NO: 86238 - DNA, 20 bp, Artificial Sequence
  chemically synthesized
aagaccaactaaccaaagta

SEQ ID NO: 86239 - DNA, 20 bp, Artificial Sequence
  chemically synthesized
atcagacccacaccttactt

SEQ ID NO: 86240 - DNA, 20 bp, Artificial Sequence
  chemically synthesized
caactaaccaaagtaaggtg

SEQ ID NO: 86241 - DNA, 20 bp, Artificial Sequence
  chemically synthesized
aactaaccaaagtaaggtgt

SEQ ID NO: 86242 - DNA, 20 bp, Artificial Sequence
  chemically synthesized
gtttaaataaaaattgaaat

SEQ ID NO: 86243 - DNA, 20 bp, Artificial Sequence
  chemically synthesized
atttttatttaaaccaaaac

SEQ ID NO: 86244 - DNA, 20 bp, Artificial Sequence
  chemically synthesized
ttttaaactttttctggttt

SEQ ID NO: 86245 - DNA, 20 bp, Artificial Sequence
  chemically synthesized
atttaaaccaaaaccagaaa

SEQ ID NO: 86246 - DNA, 20 bp, Artificial Sequence
  chemically synthesized
tgcattttttaaactttttc

SEQ ID NO: 86247 - DNA, 20 bp, Artificial Sequence
  chemically synthesized
aaaaaatgcataatatgtat

SEQ ID NO: 86248 - DNA, 20 bp, Artificial Sequence
  chemically synthesized
cataatatgtatgagaaaaa

SEQ ID NO: 86249 - DNA, 20 bp, Artificial Sequence
  chemically synthesized
gaaaaatggaaatttgaata

SEQ ID NO: 86250 - DNA, 20 bp, Artificial Sequence
  chemically synthesized
atggaaatttgaatatggac

SEQ ID NO: 86251 - DNA, 20 bp, Artificial Sequence
  chemically synthesized
atttcatcatatcaaatatc

SEQ ID NO: 86252 - DNA, 20 bp, Artificial Sequence
  chemically synthesized
tgaaattattgatatttcaa

SEQ ID NO: 86253 - DNA, 20 bp, Artificial Sequence
  chemically synthesized
ttgatatttcaaaagcatta

SEQ ID NO: 86254 - DNA, 20 bp, Artificial Sequence
  chemically synthesized
atatttcaaaagcattatag

SEQ ID NO: 86255 - DNA, 20 bp, Artificial Sequence
  chemically synthesized
ttcaaaagcattatagtagc

SEQ ID NO: 86256 - DNA, 20 bp, Artificial Sequence
  chemically synthesized
tcaaaagcattatagtagca

SEQ ID NO: 86257 - DNA, 20 bp, Artificial Sequence
  chemically synthesized
tagcaaggtgattaccttaa

SEQ ID NO: 86258 - DNA, 20 bp, Artificial Sequence
  chemically synthesized
gcaaggtgattaccttaaaa

SEQ ID NO: 86259 - DNA, 20 bp, Artificial Sequence
  chemically synthesized
agataggattcactctttta

SEQ ID NO: 86260 - DNA, 20 bp, Artificial Sequence
  chemically synthesized
aagataggattcactctttt

SEQ ID NO: 86261 - DNA, 20 bp, Artificial Sequence
  chemically synthesized
atttcaaaaggttaaaagat

SEQ ID NO: 86262 - DNA, 20 bp, Artificial Sequence
  chemically synthesized
tatttcaaaaggttaaaaga

SEQ ID NO: 86263 - DNA, 20 bp, Artificial Sequence
  chemically synthesized
ttaatatttcaaaaggttaa

SEQ ID NO: 86264 - DNA, 20 bp, Artificial Sequence
  chemically synthesized
tttattgttaatatttcaaa

SEQ ID NO: 86265 - DNA, 20 bp, Artificial Sequence
  chemically synthesized
ttttattgttaatatttcaa

SEQ ID NO: 86266 - DNA, 20 bp, Artificial Sequence
  chemically synthesized
attgttttaaaacaaatatc

SEQ ID NO: 86267 - DNA, 20 bp, Artificial Sequence
  chemically synthesized
gattgttttaaaacaaatat

SEQ ID NO: 86268 - DNA, 20 bp, Artificial Sequence
  chemically synthesized
atatttgttttaaaacaatc

SEQ ID NO: 86269 - DNA, 20 bp, Artificial Sequence
  chemically synthesized
tatttgttttaaaacaatct

SEQ ID NO: 86270 - DNA, 20 bp, Artificial Sequence
  chemically synthesized
ttgttttaaaacaatctggg

SEQ ID NO: 86271 - DNA, 20 bp, Artificial Sequence
  chemically synthesized
gttttaaaacaatctgggaa

SEQ ID NO: 86272 - DNA, 20 bp, Artificial Sequence
  chemically synthesized
atttattctatagctcttcc

SEQ ID NO: 86273 - DNA, 20 bp, Artificial Sequence
  chemically synthesized
aaacaatctgggaagagcta

SEQ ID NO: 86274 - DNA, 20 bp, Artificial Sequence
  chemically synthesized
gtcagatcttatttattcta

SEQ ID NO: 86275 - DNA, 20 bp, Artificial Sequence
  chemically synthesized
ggaagagctatagaataaat

SEQ ID NO: 86276 - DNA, 20 bp, Artificial Sequence
  chemically synthesized
caacaattatcaaatcacgt

SEQ ID NO: 86277 - DNA, 20 bp, Artificial Sequence
  chemically synthesized
ataattgttgatgtcttgat

SEQ ID NO: 86278 - DNA, 20 bp, Artificial Sequence
  chemically synthesized
taataaaactcgtactcatc

SEQ ID NO: 86279 - DNA, 20 bp, Artificial Sequence
  chemically synthesized
gttgatgtcttgatgagtac

SEQ ID NO: 86280 - DNA, 20 bp, Artificial Sequence
  chemically synthesized
gatgagtacgagttttatta

SEQ ID NO: 86281 - DNA, 20 bp, Artificial Sequence
  chemically synthesized
tgaacatatacaaaagtaga

SEQ ID NO: 86282 - DNA, 20 bp, Artificial Sequence
  chemically synthesized
atattgaacatatacaaaag

SEQ ID NO: 86283 - DNA, 20 bp, Artificial Sequence
  chemically synthesized
aaaatattgaacatatacaa

SEQ ID NO: 86284 - DNA, 20 bp, Artificial Sequence
  chemically synthesized
tcaatatttttcatcatgaa

SEQ ID NO: 86285 - DNA, 20 bp, Artificial Sequence
  chemically synthesized
tcttttggctatataaaaaa

SEQ ID NO: 86286 - DNA, 20 bp, Artificial Sequence
  chemically synthesized
atgaaaagcttttttttata

SEQ ID NO: 86287 - DNA, 20 bp, Artificial Sequence
  chemically synthesized
gcttttttttatatagccaa

SEQ ID NO: 86288 - DNA, 20 bp, Artificial Sequence
  chemically synthesized
ttttttttatatagccaaaa

SEQ ID NO: 86289 - DNA, 20 bp, Artificial Sequence
  chemically synthesized
ttttatatagccaaaagaga

SEQ ID NO: 86290 - DNA, 20 bp, Artificial Sequence
  chemically synthesized
aagaaatcgtccatctcttt

SEQ ID NO: 86291 - DNA, 20 bp, Artificial Sequence
  chemically synthesized
aagagatggacgatttctta

SEQ ID NO: 86292 - DNA, 20 bp, Artificial Sequence
  chemically synthesized
agagatggacgatttcttaa

SEQ ID NO: 86293 - DNA, 20 bp, Artificial Sequence
  chemically synthesized
gagatggacgatttcttaaa

SEQ ID NO: 86294 - DNA, 20 bp, Artificial Sequence
  chemically synthesized
ttgtgttaataatacccttt

SEQ ID NO: 86295 - DNA, 20 bp, Artificial Sequence
  chemically synthesized
acaaatgtgtttgacattta

SEQ ID NO: 86296 - DNA, 20 bp, Artificial Sequence
  chemically synthesized
gtttgacatttacagtgtaa

SEQ ID NO: 86297 - DNA, 20 bp, Artificial Sequence
  chemically synthesized
acatttacagtgtaatggct

SEQ ID NO: 86298 - DNA, 20 bp, Artificial Sequence
  chemically synthesized
gggtcaattataaataatct

SEQ ID NO: 86299 - DNA, 20 bp, Artificial Sequence
  chemically synthesized
gattatttataattgaccct

SEQ ID NO: 86300 - DNA, 20 bp, Artificial Sequence
  chemically synthesized
attatttataattgaccctt

SEQ ID NO: 86301 - DNA, 20 bp, Artificial Sequence
  chemically synthesized
tttataattgacccttgggt

SEQ ID NO: 86302 - DNA, 20 bp, Artificial Sequence
  chemically synthesized
tttttactcttctcacccaa

SEQ ID NO: 86303 - DNA, 20 bp, Artificial Sequence
  chemically synthesized
ttttttactcttctcaccca

SEQ ID NO: 86304 - DNA, 20 bp, Artificial Sequence
  chemically synthesized
ataattgacccttgggtgag

SEQ ID NO: 86305 - DNA, 20 bp, Artificial Sequence
  chemically synthesized
cttttttactcttctcaccc

SEQ ID NO: 86306 - DNA, 20 bp, Artificial Sequence
  chemically synthesized
aattgacccttgggtgagaa

SEQ ID NO: 86307 - DNA, 20 bp, Artificial Sequence
  chemically synthesized
cttgggtgagaagagtaaaa

SEQ ID NO: 86308 - DNA, 20 bp, Artificial Sequence
  chemically synthesized
ttgtttgaaattaagttgaa

SEQ ID NO: 86309 - DNA, 20 bp, Artificial Sequence
  chemically synthesized
aattaattttgtttgaaatt

SEQ ID NO: 86310 - DNA, 20 bp, Artificial Sequence
  chemically synthesized
aaacaaaattaattttaaaa

SEQ ID NO: 86311 - DNA, 20 bp, Artificial Sequence
  chemically synthesized
attaattttaaaatagtcac

SEQ ID NO: 86312 - DNA, 20 bp, Artificial Sequence
  chemically synthesized
atgttaagcacatagtaatc

SEQ ID NO: 86313 - DNA, 20 bp, Artificial Sequence
  chemically synthesized
ccttgcacatgttaagcaca

SEQ ID NO: 86314 - DNA, 20 bp, Artificial Sequence
  chemically synthesized
cctcgtgccttgcacatgtt

SEQ ID NO: 86315 - DNA, 20 bp, Artificial Sequence
  chemically synthesized
actatgtgcttaacatgtgc

SEQ ID NO: 86316 - DNA, 20 bp, Artificial Sequence
  chemically synthesized
ctatgtgcttaacatgtgca

SEQ ID NO: 86317 - DNA, 20 bp, Artificial Sequence
  chemically synthesized
gcttaacatgtgcaaggcac

SEQ ID NO: 86318 - DNA, 20 bp, Artificial Sequence
  chemically synthesized
cttaacatgtgcaaggcacg

SEQ ID NO: 86319 - DNA, 20 bp, Artificial Sequence
  chemically synthesized
acatagggtaggacattttt

SEQ ID NO: 86320 - DNA, 20 bp, Artificial Sequence
  chemically synthesized
cagaacgatgtacatagggt

SEQ ID NO: 86321 - DNA, 20 bp, Artificial Sequence
  chemically synthesized
gcagaacgatgtacataggg

SEQ ID NO: 86322 - DNA, 20 bp, Artificial Sequence
  chemically synthesized
gaagcagaacgatgtacata

SEQ ID NO: 86323 - DNA, 20 bp, Artificial Sequence
  chemically synthesized
agaagcagaacgatgtacat

SEQ ID NO: 86324 - DNA, 20 bp, Artificial Sequence
  chemically synthesized
cagaagcagaacgatgtaca

SEQ ID NO: 86325 - DNA, 20 bp, Artificial Sequence
  chemically synthesized
actttccagcagttcagaag

SEQ ID NO: 86326 - DNA, 20 bp, Artificial Sequence
  chemically synthesized
gcgactttccagcagttcag

SEQ ID NO: 86327 - DNA, 20 bp, Artificial Sequence
  chemically synthesized
tcgttctgcttctgaactgc

SEQ ID NO: 86328 - DNA, 20 bp, Artificial Sequence
  chemically synthesized
gaggcgactttccagcagtt

SEQ ID NO: 86329 - DNA, 20 bp, Artificial Sequence
  chemically synthesized
tctgcttctgaactgctgga

SEQ ID NO: 86330 - DNA, 20 bp, Artificial Sequence
  chemically synthesized
tattggaggcgactttccag

SEQ ID NO: 86331 - DNA, 20 bp, Artificial Sequence
  chemically synthesized
acctattggaggcgactttc

SEQ ID NO: 86332 - DNA, 20 bp, Artificial Sequence
  chemically synthesized
tgctggaaagtcgcctccaa

SEQ ID NO: 86333 - DNA, 20 bp, Artificial Sequence
  chemically synthesized
gctggaaagtcgcctccaat

SEQ ID NO: 86334 - DNA, 20 bp, Artificial Sequence
  chemically synthesized
agccggcaggcacctattgg

SEQ ID NO: 86335 - DNA, 20 bp, Artificial Sequence
  chemically synthesized
aagccggcaggcacctattg

SEQ ID NO: 86336 - DNA, 20 bp, Artificial Sequence
  chemically synthesized
ttaagccggcaggcacctat

SEQ ID NO: 86337 - DNA, 20 bp, Artificial Sequence
  chemically synthesized
cgcctccaataggtgcctgc

SEQ ID NO: 86338 - DNA, 20 bp, Artificial Sequence
  chemically synthesized
agatgatgaattaagccggc

SEQ ID NO: 86339 - DNA, 20 bp, Artificial Sequence
  chemically synthesized
aagatgatgaattaagccgg

SEQ ID NO: 86340 - DNA, 20 bp, Artificial Sequence
  chemically synthesized
tgaaagatgatgaattaagc

SEQ ID NO: 86341 - DNA, 20 bp, Artificial Sequence
  chemically synthesized
cagctgaaagatgatgaatt

SEQ ID NO: 86342 - DNA, 20 bp, Artificial Sequence
  chemically synthesized
cggcttaattcatcatcttt

SEQ ID NO: 86343 - DNA, 20 bp, Artificial Sequence
  chemically synthesized
aattcatcatctttcagctg

SEQ ID NO: 86344 - DNA, 20 bp, Artificial Sequence
  chemically synthesized
tctggtgtggctacagctga

SEQ ID NO: 86345 - DNA, 20 bp, Artificial Sequence
  chemically synthesized
aggaacttctggtgtggcta

SEQ ID NO: 86346 - DNA, 20 bp, Artificial Sequence
  chemically synthesized
tctttcagctgtagccacac

SEQ ID NO: 86347 - DNA, 20 bp, Artificial Sequence
  chemically synthesized
ttcagctgtagccacaccag

SEQ ID NO: 86348 - DNA, 20 bp, Artificial Sequence
  chemically synthesized
ctctgcaggaacttctggtg

SEQ ID NO: 86349 - DNA, 20 bp, Artificial Sequence
  chemically synthesized
cctttctctgcaggaacttc

SEQ ID NO: 86350 - DNA, 20 bp, Artificial Sequence
  chemically synthesized
agccacaccagaagttcctg

SEQ ID NO: 86351 - DNA, 20 bp, Artificial Sequence
  chemically synthesized
ccacaccagaagttcctgca

SEQ ID NO: 86352 - DNA, 20 bp, Artificial Sequence
  chemically synthesized
accagaagttcctgcagaga

SEQ ID NO: 86353 - DNA, 20 bp, Artificial Sequence
  chemically synthesized
gcgtctgcacctttctctgc

SEQ ID NO: 86354 - DNA, 20 bp, Artificial Sequence
  chemically synthesized
ccagaagttcctgcagagaa

SEQ ID NO: 86355 - DNA, 20 bp, Artificial Sequence
  chemically synthesized
agcgtctgcacctttctctg

SEQ ID NO: 86356 - DNA, 20 bp, Artificial Sequence
  chemically synthesized
agttcctgcagagaaaggtg

SEQ ID NO: 86357 - DNA, 20 bp, Artificial Sequence
  chemically synthesized
aaaggtgcagacgcttccac

SEQ ID NO: 86358 - DNA, 20 bp, Artificial Sequence
  chemically synthesized
aagccagttctgaccagtgg

SEQ ID NO: 86359 - DNA, 20 bp, Artificial Sequence
  chemically synthesized
gtgcagacgcttccactggt

SEQ ID NO: 86360 - DNA, 20 bp, Artificial Sequence
  chemically synthesized
tggaagccagttctgaccag

SEQ ID NO: 86361 - DNA, 20 bp, Artificial Sequence
  chemically synthesized
atttggaagccagttctgac

SEQ ID NO: 86362 - DNA, 20 bp, Artificial Sequence
  chemically synthesized
acgcttccactggtcagaac

SEQ ID NO: 86363 - DNA, 20 bp, Artificial Sequence
  chemically synthesized
ttcaggtcccatttggaagc

SEQ ID NO: 86364 - DNA, 20 bp, Artificial Sequence
  chemically synthesized
ggtcagaactggcttccaaa

SEQ ID NO: 86365 - DNA, 20 bp, Artificial Sequence
  chemically synthesized
gtcagaactggcttccaaat

SEQ ID NO: 86366 - DNA, 20 bp, Artificial Sequence
  chemically synthesized
ctttttcaggtcccatttgg

SEQ ID NO: 86367 - DNA, 20 bp, Artificial Sequence
  chemically synthesized
gttctttttcaggtcccatt

SEQ ID NO: 86368 - DNA, 20 bp, Artificial Sequence
  chemically synthesized
cttccaaatgggacctgaaa

SEQ ID NO: 86369 - DNA, 20 bp, Artificial Sequence
  chemically synthesized
gtacgctgctgttctttttc

SEQ ID NO: 86370 - DNA, 20 bp, Artificial Sequence
  chemically synthesized
ggtacgctgctgttcttttt

SEQ ID NO: 86371 - DNA, 20 bp, Artificial Sequence
  chemically synthesized
aaatgggacctgaaaaagaa

SEQ ID NO: 86372 - DNA, 20 bp, Artificial Sequence
  chemically synthesized
tgggacctgaaaaagaacag

SEQ ID NO: 86373 - DNA, 20 bp, Artificial Sequence
  chemically synthesized
agaacagcagcgtaccatgt

SEQ ID NO: 86374 - DNA, 20 bp, Artificial Sequence
  chemically synthesized
cacttctagatattctgaca

SEQ ID NO: 86375 - DNA, 20 bp, Artificial Sequence
  chemically synthesized
gcgtaccatgtcagaatatc

SEQ ID NO: 86376 - DNA, 20 bp, Artificial Sequence
  chemically synthesized
taccatgtcagaatatctag

SEQ ID NO: 86377 - DNA, 20 bp, Artificial Sequence
  chemically synthesized
agaatcatcaattacacttc

SEQ ID NO: 86378 - DNA, 20 bp, Artificial Sequence
  chemically synthesized
tactttttcaatggaattgt

SEQ ID NO: 86379 - DNA, 20 bp, Artificial Sequence
  chemically synthesized
ttctaacaattccattgaaa

SEQ ID NO: 86380 - DNA, 20 bp, Artificial Sequence
  chemically synthesized
ggtttattgtactttttcaa

SEQ ID NO: 86381 - DNA, 20 bp, Artificial Sequence
  chemically synthesized
actgctttgtagttcacaat

SEQ ID NO: 86382 - DNA, 20 bp, Artificial Sequence
  chemically synthesized
gactgctttgtagttcacaa

SEQ ID NO: 86383 - DNA, 20 bp, Artificial Sequence
  chemically synthesized
taaacctattgtgaactaca

SEQ ID NO: 86384 - DNA, 20 bp, Artificial Sequence
  chemically synthesized
acctattgtgaactacaaag

SEQ ID NO: 86385 - DNA, 20 bp, Artificial Sequence
  chemically synthesized
ttttattcaagactgctttg

SEQ ID NO: 86386 - DNA, 20 bp, Artificial Sequence
  chemically synthesized
aagtagccagatttttattc

SEQ ID NO: 86387 - DNA, 20 bp, Artificial Sequence
  chemically synthesized
agcagtcttgaataaaaatc

SEQ ID NO: 86388 - DNA, 20 bp, Artificial Sequence
  chemically synthesized
ggctctcaaaagtaagtagc

SEQ ID NO: 86389 - DNA, 20 bp, Artificial Sequence
  chemically synthesized
ttgtggctctcaaaagtaag

SEQ ID NO: 86390 - DNA, 20 bp, Artificial Sequence
  chemically synthesized
aaatctggctacttactttt

SEQ ID NO: 86391 - DNA, 20 bp, Artificial Sequence
  chemically synthesized
gttttgtggctctcaaaagt

SEQ ID NO: 86392 - DNA, 20 bp, Artificial Sequence
  chemically synthesized
atctggctacttacttttga

SEQ ID NO: 86393 - DNA, 20 bp, Artificial Sequence
  chemically synthesized
ctctgttttgtggctctcaa

SEQ ID NO: 86394 - DNA, 20 bp, Artificial Sequence
  chemically synthesized
tacttttgagagccacaaaa

SEQ ID NO: 86395 - DNA, 20 bp, Artificial Sequence
  chemically synthesized
cttttgagagccacaaaaca

SEQ ID NO: 86396 - DNA, 20 bp, Artificial Sequence
  chemically synthesized
tcaaactatcctctgttttg

SEQ ID NO: 86397 - DNA, 20 bp, Artificial Sequence
  chemically synthesized
ttttgagagccacaaaacag

SEQ ID NO: 86398 - DNA, 20 bp, Artificial Sequence
  chemically synthesized
gagagccacaaaacagagga

SEQ ID NO: 86399 - DNA, 20 bp, Artificial Sequence
  chemically synthesized
caaaacagaggatagtttga

SEQ ID NO: 86400 - DNA, 20 bp, Artificial Sequence
  chemically synthesized
gatagtttgatggcaatttt

SEQ ID NO: 86401 - DNA, 20 bp, Artificial Sequence
  chemically synthesized
tttgatggcaattttgagaa

SEQ ID NO: 86402 - DNA, 20 bp, Artificial Sequence
  chemically synthesized
ttgatggcaattttgagaaa

SEQ ID NO: 86403 - DNA, 20 bp, Artificial Sequence
  chemically synthesized
atggcaattttgagaaaagg

SEQ ID NO: 86404 - DNA, 20 bp, Artificial Sequence
  chemically synthesized
ttttgagaaaaggcagtgtt

SEQ ID NO: 86405 - DNA, 20 bp, Artificial Sequence
  chemically synthesized
tgcatgtggaaataaacata

SEQ ID NO: 86406 - DNA, 20 bp, Artificial Sequence
  chemically synthesized
catatgtttatttccacatg

SEQ ID NO: 86407 - DNA, 20 bp, Artificial Sequence
  chemically synthesized
aagtctcagcattctgcatg

SEQ ID NO: 86408 - DNA, 20 bp, Artificial Sequence
  chemically synthesized
atttccacatgcagaatgct

SEQ ID NO: 86409 - DNA, 20 bp, Artificial Sequence
  chemically synthesized
atgcagaatgctgagacttt

SEQ ID NO: 86410 - DNA, 20 bp, Artificial Sequence
  chemically synthesized
gtatttcatgccaaaagtct

SEQ ID NO: 86411 - DNA, 20 bp, Artificial Sequence
  chemically synthesized
cagtgtgtatttcatgccaa

SEQ ID NO: 86412 - DNA, 20 bp, Artificial Sequence
  chemically synthesized
ttttggcatgaaatacacac

SEQ ID NO: 86413 - DNA, 20 bp, Artificial Sequence
  chemically synthesized
tatggaaaagcaatagattc

SEQ ID NO: 86414 - DNA, 20 bp, Artificial Sequence
  chemically synthesized
acaacagtatggaaaagcaa

SEQ ID NO: 86415 - DNA, 20 bp, Artificial Sequence
  chemically synthesized
ttgactacaacagtatggaa

SEQ ID NO: 86416 - DNA, 20 bp, Artificial Sequence
  chemically synthesized
aattgttgactacaacagta

SEQ ID NO: 86417 - DNA, 20 bp, Artificial Sequence
  chemically synthesized
attgcttttccatactgttg

SEQ ID NO: 86418 - DNA, 20 bp, Artificial Sequence
  chemically synthesized
ttaagaattgttgactacaa

SEQ ID NO: 86419 - DNA, 20 bp, Artificial Sequence
  chemically synthesized
ttttttctaccagaaatatt

SEQ ID NO: 86420 - DNA, 20 bp, Artificial Sequence
  chemically synthesized
tcaacaattcttaatatttc

SEQ ID NO: 86421 - DNA, 20 bp, Artificial Sequence
  chemically synthesized
acaattcttaatatttctgg

SEQ ID NO: 86422 - DNA, 20 bp, Artificial Sequence
  chemically synthesized
ctgcatccaattttttctac

SEQ ID NO: 86423 - DNA, 20 bp, Artificial Sequence
  chemically synthesized
atatttctggtagaaaaaat

SEQ ID NO: 86424 - DNA, 20 bp, Artificial Sequence
  chemically synthesized
ctggtagaaaaaattggatg

SEQ ID NO: 86425 - DNA, 20 bp, Artificial Sequence
  chemically synthesized
gaaaacgaagtgtttttcat

SEQ ID NO: 86426 - DNA, 20 bp, Artificial Sequence
  chemically synthesized
gcatgagtcacatgaaaacg

SEQ ID NO: 86427 - DNA, 20 bp, Artificial Sequence
  chemically synthesized
cgttttcatgtgactcatgc

SEQ ID NO: 86428 - DNA, 20 bp, Artificial Sequence
  chemically synthesized
aagaattccagtactagcat

SEQ ID NO: 86429 - DNA, 20 bp, Artificial Sequence
  chemically synthesized
catgtgactcatgctagtac

SEQ ID NO: 86430 - DNA, 20 bp, Artificial Sequence
  chemically synthesized
ggcaaaaagaattccagtac

SEQ ID NO: 86431 - DNA, 20 bp, Artificial Sequence
  chemically synthesized
tctcaaggcaaaaagaattc

SEQ ID NO: 86432 - DNA, 20 bp, Artificial Sequence
  chemically synthesized
tttccatttctcaaggcaaa

SEQ ID NO: 86433 - DNA, 20 bp, Artificial Sequence
  chemically synthesized
actggaattctttttgcctt

SEQ ID NO: 86434 - DNA, 20 bp, Artificial Sequence
  chemically synthesized
attctttttgccttgagaaa

SEQ ID NO: 86435 - DNA, 20 bp, Artificial Sequence
  chemically synthesized
agagacctttccatttctca

SEQ ID NO: 86436 - DNA, 20 bp, Artificial Sequence
  chemically synthesized
gagagacctttccatttctc

SEQ ID NO: 86437 - DNA, 20 bp, Artificial Sequence
  chemically synthesized
tttttgccttgagaaatgga

SEQ ID NO: 86438 - DNA, 20 bp, Artificial Sequence
  chemically synthesized
ttttgccttgagaaatggaa

SEQ ID NO: 86439 - DNA, 20 bp, Artificial Sequence
  chemically synthesized
gaaaagtcaaaatgtgggga

SEQ ID NO: 86440 - DNA, 20 bp, Artificial Sequence
  chemically synthesized
tggaaaagtcaaaatgtggg

SEQ ID NO: 86441 - DNA, 20 bp, Artificial Sequence
  chemically synthesized
aatggaaaagtcaaaatgtg

SEQ ID NO: 86442 - DNA, 20 bp, Artificial Sequence
  chemically synthesized
aaatggaaaagtcaaaatgt

SEQ ID NO: 86443 - DNA, 20 bp, Artificial Sequence
  chemically synthesized
gaaatggaaaagtcaaaatg

SEQ ID NO: 86444 - DNA, 20 bp, Artificial Sequence
  chemically synthesized
cctagggtgtagaaatggaa

SEQ ID NO: 86445 - DNA, 20 bp, Artificial Sequence
  chemically synthesized
ggctgcctagggtgtagaaa

SEQ ID NO: 86446 - DNA, 20 bp, Artificial Sequence
  chemically synthesized
acttttccatttctacaccc

SEQ ID NO: 86447 - DNA, 20 bp, Artificial Sequence
  chemically synthesized
cttttccatttctacaccct

SEQ ID NO: 86448 - DNA, 20 bp, Artificial Sequence
  chemically synthesized
ggaaaaggctgcctagggtg

SEQ ID NO: 86449 - DNA, 20 bp, Artificial Sequence
  chemically synthesized
ttccatttctacaccctagg

SEQ ID NO: 86450 - DNA, 20 bp, Artificial Sequence
  chemically synthesized
tcaatggaaaaggctgccta

SEQ ID NO: 86451 - DNA, 20 bp, Artificial Sequence
  chemically synthesized
ctcaatggaaaaggctgcct

SEQ ID NO: 86452 - DNA, 20 bp, Artificial Sequence
  chemically synthesized
actcaatggaaaaggctgcc

SEQ ID NO: 86453 - DNA, 20 bp, Artificial Sequence
  chemically synthesized
atggaagaactcaatggaaa

SEQ ID NO: 86454 - DNA, 20 bp, Artificial Sequence
  chemically synthesized
cctaggcagccttttccatt

SEQ ID NO: 86455 - DNA, 20 bp, Artificial Sequence
  chemically synthesized
gatggaagaactcaatggaa

SEQ ID NO: 86456 - DNA, 20 bp, Artificial Sequence
  chemically synthesized
cgccagatggaagaactcaa

SEQ ID NO: 86457 - DNA, 20 bp, Artificial Sequence
  chemically synthesized
ttccattgagttcttccatc

SEQ ID NO: 86458 - DNA, 20 bp, Artificial Sequence
  chemically synthesized
aaggaacagacgccagatgg

SEQ ID NO: 86459 - DNA, 20 bp, Artificial Sequence
  chemically synthesized
agaaaggaacagacgccaga

SEQ ID NO: 86460 - DNA, 20 bp, Artificial Sequence
  chemically synthesized
gagcagaaaggaacagacgc

SEQ ID NO: 86461 - DNA, 20 bp, Artificial Sequence
  chemically synthesized
ggaagaggagcagaaaggaa

SEQ ID NO: 86462 - DNA, 20 bp, Artificial Sequence
  chemically synthesized
atttgggaagaggagcagaa

SEQ ID NO: 86463 - DNA, 20 bp, Artificial Sequence
  chemically synthesized
catttgggaagaggagcaga

SEQ ID NO: 86464 - DNA, 20 bp, Artificial Sequence
  chemically synthesized
gacgcatttgggaagaggag

SEQ ID NO: 86465 - DNA, 20 bp, Artificial Sequence
  chemically synthesized
ggagacgcatttgggaagag

SEQ ID NO: 86466 - DNA, 20 bp, Artificial Sequence
  chemically synthesized
aaggagacgcatttgggaag

SEQ ID NO: 86467 - DNA, 20 bp, Artificial Sequence
  chemically synthesized
aaaggagacgcatttgggaa

SEQ ID NO: 86468 - DNA, 20 bp, Artificial Sequence
  chemically synthesized
ggaaaggagacgcatttggg

SEQ ID NO: 86469 - DNA, 20 bp, Artificial Sequence
  chemically synthesized
gggggaaaggagacgcattt

SEQ ID NO: 86470 - DNA, 20 bp, Artificial Sequence
  chemically synthesized
agggggaaaggagacgcatt

SEQ ID NO: 86471 - DNA, 20 bp, Artificial Sequence
  chemically synthesized
aaagaagggtagggggaaag

SEQ ID NO: 86472 - DNA, 20 bp, Artificial Sequence
  chemically synthesized
ataaagaagggtagggggaa

SEQ ID NO: 86473 - DNA, 20 bp, Artificial Sequence
  chemically synthesized
aataaagaagggtaggggga

SEQ ID NO: 86474 - DNA, 20 bp, Artificial Sequence
  chemically synthesized
cacaaataaagaagggtagg

SEQ ID NO: 86475 - DNA, 20 bp, Artificial Sequence
  chemically synthesized
acacaaataaagaagggtag

SEQ ID NO: 86476 - DNA, 20 bp, Artificial Sequence
  chemically synthesized
cacacaaataaagaagggta

SEQ ID NO: 86477 - DNA, 20 bp, Artificial Sequence
  chemically synthesized
gcacacaaataaagaagggt

SEQ ID NO: 86478 - DNA, 20 bp, Artificial Sequence
  chemically synthesized
tgcacacaaataaagaaggg

SEQ ID NO: 86479 - DNA, 20 bp, Artificial Sequence
  chemically synthesized
aggtgcacacaaataaagaa

SEQ ID NO: 86480 - DNA, 20 bp, Artificial Sequence
  chemically synthesized
caggtgcacacaaataaaga

SEQ ID NO: 86481 - DNA, 20 bp, Artificial Sequence
  chemically synthesized
ccaggtgcacacaaataaag

SEQ ID NO: 86482 - DNA, 20 bp, Artificial Sequence
  chemically synthesized
atcccaggtgcacacaaata

SEQ ID NO: 86483 - DNA, 20 bp, Artificial Sequence
  chemically synthesized
cttctttatttgtgtgcacc

SEQ ID NO: 86484 - DNA, 20 bp, Artificial Sequence
  chemically synthesized
ttctttatttgtgtgcacct

SEQ ID NO: 86485 - DNA, 20 bp, Artificial Sequence
  chemically synthesized
acttggtgaagacaaatccc

SEQ ID NO: 86486 - DNA, 20 bp, Artificial Sequence
  chemically synthesized
aacttggtgaagacaaatcc

SEQ ID NO: 86487 - DNA, 20 bp, Artificial Sequence
  chemically synthesized
acctgggatttgtcttcacc

SEQ ID NO: 86488 - DNA, 20 bp, Artificial Sequence
  chemically synthesized
gaaaatgttgaaacttggtg

SEQ ID NO: 86489 - DNA, 20 bp, Artificial Sequence
  chemically synthesized
aagcagaaaatgttgaaact

SEQ ID NO: 86490 - DNA, 20 bp, Artificial Sequence
  chemically synthesized
tttacacaaaggaaacaaag

SEQ ID NO: 86491 - DNA, 20 bp, Artificial Sequence
  chemically synthesized
ctttttacacaaaggaaaca

SEQ ID NO: 86492 - DNA, 20 bp, Artificial Sequence
  chemically synthesized
tcttagtactttttacacaa

SEQ ID NO: 86493 - DNA, 20 bp, Artificial Sequence
  chemically synthesized
gtcttagtactttttacaca

SEQ ID NO: 86494 - DNA, 20 bp, Artificial Sequence
  chemically synthesized
ctttgtttcctttgtgtaaa

SEQ ID NO: 86495 - DNA, 20 bp, Artificial Sequence
  chemically synthesized
tcctttgtgtaaaaagtact

SEQ ID NO: 86496 - DNA, 20 bp, Artificial Sequence
  chemically synthesized
ttccatgtgagttgttgtct

SEQ ID NO: 86497 - DNA, 20 bp, Artificial Sequence
  chemically synthesized
tactaagacaacaactcaca

SEQ ID NO: 86498 - DNA, 20 bp, Artificial Sequence
  chemically synthesized
taagacaacaactcacatgg

SEQ ID NO: 86499 - DNA, 20 bp, Artificial Sequence
  chemically synthesized
ctgattttactcttccatgt

SEQ ID NO: 86500 - DNA, 20 bp, Artificial Sequence
  chemically synthesized
agacaacaactcacatggaa

SEQ ID NO: 86501 - DNA, 20 bp, Artificial Sequence
  chemically synthesized
ctcacatggaagagtaaaat

SEQ ID NO: 86502 - DNA, 20 bp, Artificial Sequence
  chemically synthesized
aaaatcagacatttatctga

SEQ ID NO: 86503 - DNA, 20 bp, Artificial Sequence
  chemically synthesized
tcatgttcgggggaagcttt

SEQ ID NO: 86504 - DNA, 20 bp, Artificial Sequence
  chemically synthesized
aaattattcatgttcggggg

SEQ ID NO: 86505 - DNA, 20 bp, Artificial Sequence
  chemically synthesized
cctaaattattcatgttcgg

SEQ ID NO: 86506 - DNA, 20 bp, Artificial Sequence
  chemically synthesized
gcctaaattattcatgttcg

SEQ ID NO: 86507 - DNA, 20 bp, Artificial Sequence
  chemically synthesized
tgcctaaattattcatgttc

SEQ ID NO: 86508 - DNA, 20 bp, Artificial Sequence
  chemically synthesized
ctgcctaaattattcatgtt

SEQ ID NO: 86509 - DNA, 20 bp, Artificial Sequence
  chemically synthesized
tcccccgaacatgaataatt

SEQ ID NO: 86510 - DNA, 20 bp, Artificial Sequence
  chemically synthesized
cccccgaacatgaataattt

SEQ ID NO: 86511 - DNA, 20 bp, Artificial Sequence
  chemically synthesized
ccgaacatgaataatttagg

SEQ ID NO: 86512 - DNA, 20 bp, Artificial Sequence
  chemically synthesized
cgaacatgaataatttaggc

SEQ ID NO: 86513 - DNA, 20 bp, Artificial Sequence
  chemically synthesized
aacatgaataatttaggcag

SEQ ID NO: 86514 - DNA, 20 bp, Artificial Sequence
  chemically synthesized
aataatttaggcaggagact

SEQ ID NO: 86515 - DNA, 20 bp, Artificial Sequence
  chemically synthesized
acagttgacggtaaagcact

SEQ ID NO: 86516 - DNA, 20 bp, Artificial Sequence
  chemically synthesized
tctaaatacagttgacggta

SEQ ID NO: 86517 - DNA, 20 bp, Artificial Sequence
  chemically synthesized
cgtgttctaaatacagttga

SEQ ID NO: 86518 - DNA, 20 bp, Artificial Sequence
  chemically synthesized
gctttaccgtcaactgtatt

SEQ ID NO: 86519 - DNA, 20 bp, Artificial Sequence
  chemically synthesized
ggattaacgtgttctaaata

SEQ ID NO: 86520 - DNA, 20 bp, Artificial Sequence
  chemically synthesized
atttagaacacgttaatcct

SEQ ID NO: 86521 - DNA, 20 bp, Artificial Sequence
  chemically synthesized
tagaacacgttaatccttag

SEQ ID NO: 86522 - DNA, 20 bp, Artificial Sequence
  chemically synthesized
gtattcttaaatggcttcta

SEQ ID NO: 86523 - DNA, 20 bp, Artificial Sequence
  chemically synthesized
tgtattcttaaatggcttct

SEQ ID NO: 86524 - DNA, 20 bp, Artificial Sequence
  chemically synthesized
ttaatccttagaagccattt

SEQ ID NO: 86525 - DNA, 20 bp, Artificial Sequence
  chemically synthesized
ttcatttgtgtattcttaaa

SEQ ID NO: 86526 - DNA, 20 bp, Artificial Sequence
  chemically synthesized
gaaatgtggattttatagca

SEQ ID NO: 86527 - DNA, 20 bp, Artificial Sequence
  chemically synthesized
caagtgaaatgtggatttta

SEQ ID NO: 86528 - DNA, 20 bp, Artificial Sequence
  chemically synthesized
tctcatcttcaagtgaaatg

SEQ ID NO: 86529 - DNA, 20 bp, Artificial Sequence
  chemically synthesized
taaaatccacatttcacttg

SEQ ID NO: 86530 - DNA, 20 bp, Artificial Sequence
  chemically synthesized
tccacatttcacttgaagat

SEQ ID NO: 86531 - DNA, 20 bp, Artificial Sequence
  chemically synthesized
taatttagcttctcatcttc

SEQ ID NO: 86532 - DNA, 20 bp, Artificial Sequence
  chemically synthesized
acatttcacttgaagatgag

SEQ ID NO: 86533 - DNA, 20 bp, Artificial Sequence
  chemically synthesized
gatgatttattttattaatt

SEQ ID NO: 86534 - DNA, 20 bp, Artificial Sequence
  chemically synthesized
taataaaataaatcatcatc

SEQ ID NO: 86535 - DNA, 20 bp, Artificial Sequence
  chemically synthesized
aaatcatcatccagaaaaca

SEQ ID NO: 86536 - DNA, 20 bp, Artificial Sequence
  chemically synthesized
tgcgtttcctctttgttttc

SEQ ID NO: 86537 - DNA, 20 bp, Artificial Sequence
  chemically synthesized
atcatcatccagaaaacaaa

SEQ ID NO: 86538 - DNA, 20 bp, Artificial Sequence
  chemically synthesized
tcatcatccagaaaacaaag

SEQ ID NO: 86539 - DNA, 20 bp, Artificial Sequence
  chemically synthesized
cagaaaacaaagaggaaacg

SEQ ID NO: 86540 - DNA, 20 bp, Artificial Sequence
  chemically synthesized
acaaagaggaaacgcagtgt

SEQ ID NO: 86541 - DNA, 20 bp, Artificial Sequence
  chemically synthesized
gaggaaacgcagtgttagca

SEQ ID NO: 86542 - DNA, 20 bp, Artificial Sequence
  chemically synthesized
tgttagcaaagctttatctt

SEQ ID NO: 86543 - DNA, 20 bp, Artificial Sequence
  chemically synthesized
gttagcaaagctttatcttc

SEQ ID NO: 86544 - DNA, 20 bp, Artificial Sequence
  chemically synthesized
ttctaatttacctgaagata

SEQ ID NO: 86545 - DNA, 20 bp, Artificial Sequence
  chemically synthesized
cataatttctaatttacctg

SEQ ID NO: 86546 - DNA, 20 bp, Artificial Sequence
  chemically synthesized
agctttatcttcaggtaaat

SEQ ID NO: 86547 - DNA, 20 bp, Artificial Sequence
  chemically synthesized
agaaattatgctcaatcact

SEQ ID NO: 86548 - DNA, 20 bp, Artificial Sequence
  chemically synthesized
ctgataatagctgagtgatt

SEQ ID NO: 86549 - DNA, 20 bp, Artificial Sequence
  chemically synthesized
agtaattgctgataatagct

SEQ ID NO: 86550 - DNA, 20 bp, Artificial Sequence
  chemically synthesized
ctcaatcactcagctattat

SEQ ID NO: 86551 - DNA, 20 bp, Artificial Sequence
  chemically synthesized
taattagtaattgctgataa

SEQ ID NO: 86552 - DNA, 20 bp, Artificial Sequence
  chemically synthesized
tagcgttattatgaattaat

SEQ ID NO: 86553 - DNA, 20 bp, Artificial Sequence
  chemically synthesized
tattatatttatgttatagg

SEQ ID NO: 86554 - DNA, 20 bp, Artificial Sequence
  chemically synthesized
ctttattatatttatgttat

SEQ ID NO: 86555 - DNA, 20 bp, Artificial Sequence
  chemically synthesized
tctttattatatttatgtta

SEQ ID NO: 86556 - DNA, 20 bp, Artificial Sequence
  chemically synthesized
cctataacataaatataata

SEQ ID NO: 86557 - DNA, 20 bp, Artificial Sequence
  chemically synthesized
tttcaatctttgcagcgtta

SEQ ID NO: 86558 - DNA, 20 bp, Artificial Sequence
  chemically synthesized
ataaagactttaacgctgca

SEQ ID NO: 86559 - DNA, 20 bp, Artificial Sequence
  chemically synthesized
gctttacatttcaatctttg

SEQ ID NO: 86560 - DNA, 20 bp, Artificial Sequence
  chemically synthesized
gctgcaaagattgaaatgta

SEQ ID NO: 86561 - DNA, 20 bp, Artificial Sequence
  chemically synthesized
aaagattgaaatgtaaagca

SEQ ID NO: 86562 - DNA, 20 bp, Artificial Sequence
  chemically synthesized
gaaatgtaaagcaaagcaac

SEQ ID NO: 86563 - DNA, 20 bp, Artificial Sequence
  chemically synthesized
aaatgtaaagcaaagcaacc

SEQ ID NO: 86564 - DNA, 20 bp, Artificial Sequence
  chemically synthesized
tgtaaagcaaagcaaccagg

SEQ ID NO: 86565 - DNA, 20 bp, Artificial Sequence
  chemically synthesized
taaagcaaagcaaccaggtg

SEQ ID NO: 86566 - DNA, 20 bp, Artificial Sequence
  chemically synthesized
aagggaaatgttgctccacc

SEQ ID NO: 86567 - DNA, 20 bp, Artificial Sequence
  chemically synthesized
aggtggagcaacatttccct

SEQ ID NO: 86568 - DNA, 20 bp, Artificial Sequence
  chemically synthesized
ctaagttaccaaatggctaa

SEQ ID NO: 86569 - DNA, 20 bp, Artificial Sequence
  chemically synthesized
gctaagttaccaaatggcta

SEQ ID NO: 86570 - DNA, 20 bp, Artificial Sequence
  chemically synthesized
caacatttcccttagccatt

SEQ ID NO: 86571 - DNA, 20 bp, Artificial Sequence
  chemically synthesized
agctaagttaccaaatggct

SEQ ID NO: 86572 - DNA, 20 bp, Artificial Sequence
  chemically synthesized
tgtcaagctaagttaccaaa

SEQ ID NO: 86573 - DNA, 20 bp, Artificial Sequence
  chemically synthesized
cccttagccatttggtaact

SEQ ID NO: 86574 - DNA, 20 bp, Artificial Sequence
  chemically synthesized
tgtatttgtaatgtcaagct

SEQ ID NO: 86575 - DNA, 20 bp, Artificial Sequence
  chemically synthesized
agaattgtatttgtaatgtc

SEQ ID NO: 86576 - DNA, 20 bp, Artificial Sequence
  chemically synthesized
tacaaatacaattctccttt

SEQ ID NO: 86577 - DNA, 20 bp, Artificial Sequence
  chemically synthesized
tgtttgactaaggccaaaag

SEQ ID NO: 86578 - DNA, 20 bp, Artificial Sequence
  chemically synthesized
tctgtttgactaaggccaaa

SEQ ID NO: 86579 - DNA, 20 bp, Artificial Sequence
  chemically synthesized
tacaattctccttttggcct

SEQ ID NO: 86580 - DNA, 20 bp, Artificial Sequence
  chemically synthesized
ttctgtttgactaaggccaa

SEQ ID NO: 86581 - DNA, 20 bp, Artificial Sequence
  chemically synthesized
ttggtgattctgtttgacta

SEQ ID NO: 86582 - DNA, 20 bp, Artificial Sequence
  chemically synthesized
tccttttggccttagtcaaa

SEQ ID NO: 86583 - DNA, 20 bp, Artificial Sequence
  chemically synthesized
tttggtgattctgtttgact

SEQ ID NO: 86584 - DNA, 20 bp, Artificial Sequence
  chemically synthesized
ttagtcaaacagaatcacca

SEQ ID NO: 86585 - DNA, 20 bp, Artificial Sequence
  chemically synthesized
ttcagtagataagtattctt

SEQ ID NO: 86586 - DNA, 20 bp, Artificial Sequence
  chemically synthesized
acaatttaatttcagtagat

SEQ ID NO: 86587 - DNA, 20 bp, Artificial Sequence
  chemically synthesized
ttggaacaatttaatttcag

SEQ ID NO: 86588 - DNA, 20 bp, Artificial Sequence
  chemically synthesized
agtttggaacaatttaattt

SEQ ID NO: 86589 - DNA, 20 bp, Artificial Sequence
  chemically synthesized
aaattatccttcagaaagtt

SEQ ID NO: 86590 - DNA, 20 bp, Artificial Sequence
  chemically synthesized
aaattgttccaaactttctg

SEQ ID NO: 86591 - DNA, 20 bp, Artificial Sequence
  chemically synthesized
aattgttccaaactttctga

SEQ ID NO: 86592 - DNA, 20 bp, Artificial Sequence
  chemically synthesized
ttgtcaaattatccttcaga

SEQ ID NO: 86593 - DNA, 20 bp, Artificial Sequence
  chemically synthesized
tgtattgtcaaattatcctt

SEQ ID NO: 86594 - DNA, 20 bp, Artificial Sequence
  chemically synthesized
gataatttgacaatacataa

SEQ ID NO: 86595 - DNA, 20 bp, Artificial Sequence
  chemically synthesized
cattgtctttgcacatttta

SEQ ID NO: 86596 - DNA, 20 bp, Artificial Sequence
  chemically synthesized
aaaagtctttaaaatgtgca

SEQ ID NO: 86597 - DNA, 20 bp, Artificial Sequence
  chemically synthesized
tgtgcaaagacaatgaccca

SEQ ID NO: 86598 - DNA, 20 bp, Artificial Sequence
  chemically synthesized
gtgcaaagacaatgacccac

SEQ ID NO: 86599 - DNA, 20 bp, Artificial Sequence
  chemically synthesized
ttccttgaatttaagcctgt

SEQ ID NO: 86600 - DNA, 20 bp, Artificial Sequence
  chemically synthesized
tttccttgaatttaagcctg

SEQ ID NO: 86601 - DNA, 20 bp, Artificial Sequence
  chemically synthesized
tgacccacaggcttaaattc

SEQ ID NO: 86602 - DNA, 20 bp, Artificial Sequence
  chemically synthesized
gacccacaggcttaaattca

SEQ ID NO: 86603 - DNA, 20 bp, Artificial Sequence
  chemically synthesized
agtataatttccttgaattt

SEQ ID NO: 86604 - DNA, 20 bp, Artificial Sequence
  chemically synthesized
tcaaggaaattatactaaca

SEQ ID NO: 86605 - DNA, 20 bp, Artificial Sequence
  chemically synthesized
tctttttccaatttctttgt

SEQ ID NO: 86606 - DNA, 20 bp, Artificial Sequence
  chemically synthesized
aattatactaacaaagaaat

SEQ ID NO: 86607 - DNA, 20 bp, Artificial Sequence
  chemically synthesized
actaacaaagaaattggaaa

SEQ ID NO: 86608 - DNA, 20 bp, Artificial Sequence
  chemically synthesized
agaaattggaaaaagataca

SEQ ID NO: 86609 - DNA, 20 bp, Artificial Sequence
  chemically synthesized
tggaaaaagatacaaagata

SEQ ID NO: 86610 - DNA, 20 bp, Artificial Sequence
  chemically synthesized
ggaaaaagatacaaagatat

SEQ ID NO: 86611 - DNA, 20 bp, Artificial Sequence
  chemically synthesized
aaaagatacaaagatatagg

SEQ ID NO: 86612 - DNA, 20 bp, Artificial Sequence
  chemically synthesized
aggtggaaaaatgttatata

SEQ ID NO: 86613 - DNA, 20 bp, Artificial Sequence
  chemically synthesized
ttatgattgataaaacaaaa

SEQ ID NO: 86614 - DNA, 20 bp, Artificial Sequence
  chemically synthesized
ttccctcatattgaatattt

SEQ ID NO: 86615 - DNA, 20 bp, Artificial Sequence
  chemically synthesized
acaacttaaatattcaatat

SEQ ID NO: 86616 - DNA, 20 bp, Artificial Sequence
  chemically synthesized
caacttaaatattcaatatg

SEQ ID NO: 86617 - DNA, 20 bp, Artificial Sequence
  chemically synthesized
aacttaaatattcaatatga

SEQ ID NO: 86618 - DNA, 20 bp, Artificial Sequence
  chemically synthesized
tcaatatgagggaattgctt

SEQ ID NO: 86619 - DNA, 20 bp, Artificial Sequence
  chemically synthesized
gttggggttttgcatttctc

SEQ ID NO: 86620 - DNA, 20 bp, Artificial Sequence
  chemically synthesized
tgaaaacaatcagtaggttg

SEQ ID NO: 86621 - DNA, 20 bp, Artificial Sequence
  chemically synthesized
ttgaaaacaatcagtaggtt

SEQ ID NO: 86622 - DNA, 20 bp, Artificial Sequence
  chemically synthesized
tttgaaaacaatcagtaggt

SEQ ID NO: 86623 - DNA, 20 bp, Artificial Sequence
  chemically synthesized
tacatttgaaaacaatcagt

SEQ ID NO: 86624 - DNA, 20 bp, Artificial Sequence
  chemically synthesized
ttacatttgaaaacaatcag

SEQ ID NO: 86625 - DNA, 20 bp, Artificial Sequence
  chemically synthesized
tcattacatttgaaaacaat

SEQ ID NO: 86626 - DNA, 20 bp, Artificial Sequence
  chemically synthesized
tctaaatttaaagcatatac

SEQ ID NO: 86627 - DNA, 20 bp, Artificial Sequence
  chemically synthesized
acttgtatatgctttaaatt

SEQ ID NO: 86628 - DNA, 20 bp, Artificial Sequence
  chemically synthesized
ttcattaatttctaaattta

SEQ ID NO: 86629 - DNA, 20 bp, Artificial Sequence
  chemically synthesized
tatatatgaatttaattaaa

SEQ ID NO: 86630 - DNA, 20 bp, Artificial Sequence
  chemically synthesized
ataattcccttttaaattaa

SEQ ID NO: 86631 - DNA, 20 bp, Artificial Sequence
  chemically synthesized
ttaaatagctcttaatttaa

SEQ ID NO: 86632 - DNA, 20 bp, Artificial Sequence
  chemically synthesized
taataattcccttttaaatt

SEQ ID NO: 86633 - DNA, 20 bp, Artificial Sequence
  chemically synthesized
taaatagctcttaatttaaa

SEQ ID NO: 86634 - DNA, 20 bp, Artificial Sequence
  chemically synthesized
aaatagctcttaatttaaaa

SEQ ID NO: 86635 - DNA, 20 bp, Artificial Sequence
  chemically synthesized
gggaattattacatatataa

SEQ ID NO: 86636 - DNA, 20 bp, Artificial Sequence
  chemically synthesized
tatataatggtgcattcata

SEQ ID NO: 86637 - DNA, 20 bp, Artificial Sequence
  chemically synthesized
catacagtaaaatcctttgc

SEQ ID NO: 86638 - DNA, 20 bp, Artificial Sequence
  chemically synthesized
atacagtaaaatcctttgca

SEQ ID NO: 86639 - DNA, 20 bp, Artificial Sequence
  chemically synthesized
catcatattgaaccttgcaa

SEQ ID NO: 86640 - DNA, 20 bp, Artificial Sequence
  chemically synthesized
tcatcatattgaaccttgca

SEQ ID NO: 86641 - DNA, 20 bp, Artificial Sequence
  chemically synthesized
caaggttcaatatgatgaca

SEQ ID NO: 86642 - DNA, 20 bp, Artificial Sequence
  chemically synthesized
tttccatatccataaatatt

SEQ ID NO: 86643 - DNA, 20 bp, Artificial Sequence
  chemically synthesized
atgacatagccaaatattta

SEQ ID NO: 86644 - DNA, 20 bp, Artificial Sequence
  chemically synthesized
tagccaaatatttatggata

SEQ ID NO: 86645 - DNA, 20 bp, Artificial Sequence
  chemically synthesized
aaatatttatggatatggaa

SEQ ID NO: 86646 - DNA, 20 bp, Artificial Sequence
  chemically synthesized
aatatttatggatatggaaa

SEQ ID NO: 86647 - DNA, 20 bp, Artificial Sequence
  chemically synthesized
tatggaaaaggtcatcatcc

SEQ ID NO: 86648 - DNA, 20 bp, Artificial Sequence
  chemically synthesized
tgttttctcatttagtaact

SEQ ID NO: 86649 - DNA, 20 bp, Artificial Sequence
  chemically synthesized
ctgttttctcatttagtaac

SEQ ID NO: 86650 - DNA, 20 bp, Artificial Sequence
  chemically synthesized
catcatcccagttactaaat

SEQ ID NO: 86651 - DNA, 20 bp, Artificial Sequence
  chemically synthesized
ttgtaacctgttttctcatt

SEQ ID NO: 86652 - DNA, 20 bp, Artificial Sequence
  chemically synthesized
ccagttactaaatgagaaaa

SEQ ID NO: 86653 - DNA, 20 bp, Artificial Sequence
  chemically synthesized
cagttactaaatgagaaaac

SEQ ID NO: 86654 - DNA, 20 bp, Artificial Sequence
  chemically synthesized
atacacatacacaaatgttt

SEQ ID NO: 86655 - DNA, 20 bp, Artificial Sequence
  chemically synthesized
tttgtatgcacatgcttgac

SEQ ID NO: 86656 - DNA, 20 bp, Artificial Sequence
  chemically synthesized
ttgtatgcacatgcttgact

SEQ ID NO: 86657 - DNA, 20 bp, Artificial Sequence
  chemically synthesized
tacaaaattttttcctagtc

SEQ ID NO: 86658 - DNA, 20 bp, Artificial Sequence
  chemically synthesized
gtcattacaaaattttttcc

SEQ ID NO: 86659 - DNA, 20 bp, Artificial Sequence
  chemically synthesized
aaaaattttgtaatgacaac

SEQ ID NO: 86660 - DNA, 20 bp, Artificial Sequence
  chemically synthesized
aaaattttgtaatgacaacc

SEQ ID NO: 86661 - DNA, 20 bp, Artificial Sequence
  chemically synthesized
tctacctctgagggataacc

SEQ ID NO: 86662 - DNA, 20 bp, Artificial Sequence
  chemically synthesized
atgacaaccaggttatccct

SEQ ID NO: 86663 - DNA, 20 bp, Artificial Sequence
  chemically synthesized
gacaaccaggttatccctca

SEQ ID NO: 86664 - DNA, 20 bp, Artificial Sequence
  chemically synthesized
acaaccaggttatccctcag

SEQ ID NO: 86665 - DNA, 20 bp, Artificial Sequence
  chemically synthesized
accaggttatccctcagagg

SEQ ID NO: 86666 - DNA, 20 bp, Artificial Sequence
  chemically synthesized
acctgtaaatctacctctga

SEQ ID NO: 86667 - DNA, 20 bp, Artificial Sequence
  chemically synthesized
cacctgtaaatctacctctg

SEQ ID NO: 86668 - DNA, 20 bp, Artificial Sequence
  chemically synthesized
tcacctgtaaatctacctct

SEQ ID NO: 86669 - DNA, 20 bp, Artificial Sequence
  chemically synthesized
atccctcagaggtagattta

SEQ ID NO: 86670 - DNA, 20 bp, Artificial Sequence
  chemically synthesized
tccctcagaggtagatttac

SEQ ID NO: 86671 - DNA, 20 bp, Artificial Sequence
  chemically synthesized
tttggaaaagtagaaagatt

SEQ ID NO: 86672 - DNA, 20 bp, Artificial Sequence
  chemically synthesized
tgacaatttggaaaagtaga

SEQ ID NO: 86673 - DNA, 20 bp, Artificial Sequence
  chemically synthesized
atcttgacaatttggaaaag

SEQ ID NO: 86674 - DNA, 20 bp, Artificial Sequence
  chemically synthesized
aaaatcttgacaatttggaa

SEQ ID NO: 86675 - DNA, 20 bp, Artificial Sequence
  chemically synthesized
ttctacttttccaaattgtc

SEQ ID NO: 86676 - DNA, 20 bp, Artificial Sequence
  chemically synthesized
gaaagaaaatcttgacaatt

SEQ ID NO: 86677 - DNA, 20 bp, Artificial Sequence
  chemically synthesized
gtttatactgcaattataga

SEQ ID NO: 86678 - DNA, 20 bp, Artificial Sequence
  chemically synthesized
agattttctttctataattg

SEQ ID NO: 86679 - DNA, 20 bp, Artificial Sequence
  chemically synthesized
tattgtttatactgcaatta

SEQ ID NO: 86680 - DNA, 20 bp, Artificial Sequence
  chemically synthesized
tgcagtataaacaatatgtc

SEQ ID NO: 86681 - DNA, 20 bp, Artificial Sequence
  chemically synthesized
gcagtataaacaatatgtcc

SEQ ID NO: 86682 - DNA, 20 bp, Artificial Sequence
  chemically synthesized
ggaaatgccttcatttttcc

SEQ ID NO: 86683 - DNA, 20 bp, Artificial Sequence
  chemically synthesized
caatatgtccaggaaaaatg

SEQ ID NO: 86684 - DNA, 20 bp, Artificial Sequence
  chemically synthesized
aatatgtccaggaaaaatga

SEQ ID NO: 86685 - DNA, 20 bp, Artificial Sequence
  chemically synthesized
tgaaggcatttccatcaaat

SEQ ID NO: 86686 - DNA, 20 bp, Artificial Sequence
  chemically synthesized
atttaatttatcttatttga

SEQ ID NO: 86687 - DNA, 20 bp, Artificial Sequence
  chemically synthesized
taagataaattaaattgttc

SEQ ID NO: 86688 - DNA, 20 bp, Artificial Sequence
  chemically synthesized
attaaattgttccagactct

SEQ ID NO: 86689 - DNA, 20 bp, Artificial Sequence
  chemically synthesized
ttaaattgttccagactcta

SEQ ID NO: 86690 - DNA, 20 bp, Artificial Sequence
  chemically synthesized
gaaataatacccttagagtc

SEQ ID NO: 86691 - DNA, 20 bp, Artificial Sequence
  chemically synthesized
taaattgttccagactctaa

SEQ ID NO: 86692 - DNA, 20 bp, Artificial Sequence
  chemically synthesized
cttgggaaataataccctta

SEQ ID NO: 86693 - DNA, 20 bp, Artificial Sequence
  chemically synthesized
ttcttgggaaataataccct

SEQ ID NO: 86694 - DNA, 20 bp, Artificial Sequence
  chemically synthesized
ctctaagggtattatttccc

SEQ ID NO: 86695 - DNA, 20 bp, Artificial Sequence
  chemically synthesized
tatttcacgattcagttctt

SEQ ID NO: 86696 - DNA, 20 bp, Artificial Sequence
  chemically synthesized
gtatttcacgattcagttct

SEQ ID NO: 86697 - DNA, 20 bp, Artificial Sequence
  chemically synthesized
atttatggtatttcacgatt

SEQ ID NO: 86698 - DNA, 20 bp, Artificial Sequence
  chemically synthesized
tattcaattcatgacattta

SEQ ID NO: 86699 - DNA, 20 bp, Artificial Sequence
  chemically synthesized
atgtcatgaattgaatataa

SEQ ID NO: 86700 - DNA, 20 bp, Artificial Sequence
  chemically synthesized
attgaatataatagtgcatg

SEQ ID NO: 86701 - DNA, 20 bp, Artificial Sequence
  chemically synthesized
gcatgcagattgcatacaat

SEQ ID NO: 86702 - DNA, 20 bp, Artificial Sequence
  chemically synthesized
atgcagattgcatacaatta

SEQ ID NO: 86703 - DNA, 20 bp, Artificial Sequence
  chemically synthesized
tgcagattgcatacaattag

SEQ ID NO: 86704 - DNA, 20 bp, Artificial Sequence
  chemically synthesized
gattgcatacaattagaggt

SEQ ID NO: 86705 - DNA, 20 bp, Artificial Sequence
  chemically synthesized
aggatggtacagaaacataa

SEQ ID NO: 86706 - DNA, 20 bp, Artificial Sequence
  chemically synthesized
tggtaactgaaaggatggta

SEQ ID NO: 86707 - DNA, 20 bp, Artificial Sequence
  chemically synthesized
atgtttctgtaccatccttt

SEQ ID NO: 86708 - DNA, 20 bp, Artificial Sequence
  chemically synthesized
aaaagtggtaactgaaagga

SEQ ID NO: 86709 - DNA, 20 bp, Artificial Sequence
  chemically synthesized
atggaaaagtggtaactgaa

SEQ ID NO: 86710 - DNA, 20 bp, Artificial Sequence
  chemically synthesized
catggaaaagtggtaactga

SEQ ID NO: 86711 - DNA, 20 bp, Artificial Sequence
  chemically synthesized
ttaggcttatcatggaaaag

SEQ ID NO: 86712 - DNA, 20 bp, Artificial Sequence
  chemically synthesized
cgcttaggcttatcatggaa

SEQ ID NO: 86713 - DNA, 20 bp, Artificial Sequence
  chemically synthesized
agttaccacttttccatgat

SEQ ID NO: 86714 - DNA, 20 bp, Artificial Sequence
  chemically synthesized
attgtcgcttaggcttatca

SEQ ID NO: 86715 - DNA, 20 bp, Artificial Sequence
  chemically synthesized
cacttttccatgataagcct

SEQ ID NO: 86716 - DNA, 20 bp, Artificial Sequence
  chemically synthesized
tgcatggggaattgtcgctt

SEQ ID NO: 86717 - DNA, 20 bp, Artificial Sequence
  chemically synthesized
ttgcatggggaattgtcgct

SEQ ID NO: 86718 - DNA, 20 bp, Artificial Sequence
  chemically synthesized
taagcgacaattccccatgc

SEQ ID NO: 86719 - DNA, 20 bp, Artificial Sequence
  chemically synthesized
aacagctaaaatcttgcatg

SEQ ID NO: 86720 - DNA, 20 bp, Artificial Sequence
  chemically synthesized
aaacagctaaaatcttgcat

SEQ ID NO: 86721 - DNA, 20 bp, Artificial Sequence
  chemically synthesized
taaacagctaaaatcttgca

SEQ ID NO: 86722 - DNA, 20 bp, Artificial Sequence
  chemically synthesized
caattccccatgcaagattt

SEQ ID NO: 86723 - DNA, 20 bp, Artificial Sequence
  chemically synthesized
gcaagattttagctgtttaa

SEQ ID NO: 86724 - DNA, 20 bp, Artificial Sequence
  chemically synthesized
acacattacatgctattaaa

SEQ ID NO: 86725 - DNA, 20 bp, Artificial Sequence
  chemically synthesized
taatagcatgtaatgtgtaa

SEQ ID NO: 86726 - DNA, 20 bp, Artificial Sequence
  chemically synthesized
taatggttaaacgaattcct

SEQ ID NO: 86727 - DNA, 20 bp, Artificial Sequence
  chemically synthesized
aatggttaaacgaattcctt

SEQ ID NO: 86728 - DNA, 20 bp, Artificial Sequence
  chemically synthesized
atggttaaacgaattccttg

SEQ ID NO: 86729 - DNA, 20 bp, Artificial Sequence
  chemically synthesized
tgtgaattccagacacccca

SEQ ID NO: 86730 - DNA, 20 bp, Artificial Sequence
  chemically synthesized
ctgtgaattccagacacccc

SEQ ID NO: 86731 - DNA, 20 bp, Artificial Sequence
  chemically synthesized
aacgaattccttggggtgtc

SEQ ID NO: 86732 - DNA, 20 bp, Artificial Sequence
  chemically synthesized
cttggggtgtctggaattca

SEQ ID NO: 86733 - DNA, 20 bp, Artificial Sequence
  chemically synthesized
agggaccaagctgtgaattc

SEQ ID NO: 86734 - DNA, 20 bp, Artificial Sequence
  chemically synthesized
ggtgtctggaattcacagct

SEQ ID NO: 86735 - DNA, 20 bp, Artificial Sequence
  chemically synthesized
ttttcactctcaaagggacc

SEQ ID NO: 86736 - DNA, 20 bp, Artificial Sequence
  chemically synthesized
attcacagcttggtcccttt

SEQ ID NO: 86737 - DNA, 20 bp, Artificial Sequence
  chemically synthesized
tcacagcttggtccctttga

SEQ ID NO: 86738 - DNA, 20 bp, Artificial Sequence
  chemically synthesized
agcctcttttcactctcaaa

SEQ ID NO: 86739 - DNA, 20 bp, Artificial Sequence
  chemically synthesized
cagcctcttttcactctcaa

SEQ ID NO: 86740 - DNA, 20 bp, Artificial Sequence
  chemically synthesized
acagcctcttttcactctca

SEQ ID NO: 86741 - DNA, 20 bp, Artificial Sequence
  chemically synthesized
ttggtccctttgagagtgaa

SEQ ID NO: 86742 - DNA, 20 bp, Artificial Sequence
  chemically synthesized
ggtccctttgagagtgaaaa

SEQ ID NO: 86743 - DNA, 20 bp, Artificial Sequence
  chemically synthesized
gtccctttgagagtgaaaag

SEQ ID NO: 86744 - DNA, 20 bp, Artificial Sequence
  chemically synthesized
gagagtgaaaagaggctgtc

SEQ ID NO: 86745 - DNA, 20 bp, Artificial Sequence
  chemically synthesized
agtgaaaagaggctgtcaag

SEQ ID NO: 86746 - DNA, 20 bp, Artificial Sequence
  chemically synthesized
gtgaaaagaggctgtcaagc

SEQ ID NO: 86747 - DNA, 20 bp, Artificial Sequence
  chemically synthesized
tttcaatatgtcctgcttga

SEQ ID NO: 86748 - DNA, 20 bp, Artificial Sequence
  chemically synthesized
gtcaagcaggacatattgaa

SEQ ID NO: 86749 - DNA, 20 bp, Artificial Sequence
  chemically synthesized
aagcaggacatattgaaaag

SEQ ID NO: 86750 - DNA, 20 bp, Artificial Sequence
  chemically synthesized
agcaggacatattgaaaagt

SEQ ID NO: 86751 - DNA, 20 bp, Artificial Sequence
  chemically synthesized
aggacatattgaaaagtagg

SEQ ID NO: 86752 - DNA, 20 bp, Artificial Sequence
  chemically synthesized
gacatattgaaaagtaggtg

SEQ ID NO: 86753 - DNA, 20 bp, Artificial Sequence
  chemically synthesized
catattgaaaagtaggtgga

SEQ ID NO: 86754 - DNA, 20 bp, Artificial Sequence
  chemically synthesized
tattgaaaagtaggtggaga

SEQ ID NO: 86755 - DNA, 20 bp, Artificial Sequence
  chemically synthesized
attgaaaagtaggtggagag

SEQ ID NO: 86756 - DNA, 20 bp, Artificial Sequence
  chemically synthesized
gaaaagtaggtggagagagg

SEQ ID NO: 86757 - DNA, 20 bp, Artificial Sequence
  chemically synthesized
aaaagtaggtggagagaggt

SEQ ID NO: 86758 - DNA, 20 bp, Artificial Sequence
  chemically synthesized
aaagtaggtggagagaggta

SEQ ID NO: 86759 - DNA, 20 bp, Artificial Sequence
  chemically synthesized
aggtggagagaggtagggct

SEQ ID NO: 86760 - DNA, 20 bp, Artificial Sequence
  chemically synthesized
agagaggtagggctcagaca

SEQ ID NO: 86761 - DNA, 20 bp, Artificial Sequence
  chemically synthesized
tttgctgcttttccatgtct

SEQ ID NO: 86762 - DNA, 20 bp, Artificial Sequence
  chemically synthesized
ggtagggctcagacatggaa

SEQ ID NO: 86763 - DNA, 20 bp, Artificial Sequence
  chemically synthesized
agggctcagacatggaaaag

SEQ ID NO: 86764 - DNA, 20 bp, Artificial Sequence
  chemically synthesized
agacatggaaaagcagcaaa

SEQ ID NO: 86765 - DNA, 20 bp, Artificial Sequence
  chemically synthesized
catggaaaagcagcaaatgg

SEQ ID NO: 86766 - DNA, 20 bp, Artificial Sequence
  chemically synthesized
aaaagcagcaaatggtagaa

SEQ ID NO: 86767 - DNA, 20 bp, Artificial Sequence
  chemically synthesized
tcaataaatatttatttaat

SEQ ID NO: 86768 - DNA, 20 bp, Artificial Sequence
  chemically synthesized
aatatttattgactgcccct

SEQ ID NO: 86769 - DNA, 20 bp, Artificial Sequence
  chemically synthesized
gtatcctagagacttagggg

SEQ ID NO: 86770 - DNA, 20 bp, Artificial Sequence
  chemically synthesized
aatgtatcctagagacttag

SEQ ID NO: 86771 - DNA, 20 bp, Artificial Sequence
  chemically synthesized
caatgtatcctagagactta

SEQ ID NO: 86772 - DNA, 20 bp, Artificial Sequence
  chemically synthesized
attgactgcccctaagtctc

SEQ ID NO: 86773 - DNA, 20 bp, Artificial Sequence
  chemically synthesized
ccaatgtatcctagagactt

SEQ ID NO: 86774 - DNA, 20 bp, Artificial Sequence
  chemically synthesized
ttgactgcccctaagtctct

SEQ ID NO: 86775 - DNA, 20 bp, Artificial Sequence
  chemically synthesized
cccaatgtatcctagagact

SEQ ID NO: 86776 - DNA, 20 bp, Artificial Sequence
  chemically synthesized
ctactccccaatgtatccta

SEQ ID NO: 86777 - DNA, 20 bp, Artificial Sequence
  chemically synthesized
ccctactccccaatgtatcc

SEQ ID NO: 86778 - DNA, 20 bp, Artificial Sequence
  chemically synthesized
cctaagtctctaggatacat

SEQ ID NO: 86779 - DNA, 20 bp, Artificial Sequence
  chemically synthesized
ctaagtctctaggatacatt

SEQ ID NO: 86780 - DNA, 20 bp, Artificial Sequence
  chemically synthesized
taagtctctaggatacattg

SEQ ID NO: 86781 - DNA, 20 bp, Artificial Sequence
  chemically synthesized
agtctctaggatacattggg

SEQ ID NO: 86782 - DNA, 20 bp, Artificial Sequence
  chemically synthesized
ctctaggatacattggggag

SEQ ID NO: 86783 - DNA, 20 bp, Artificial Sequence
  chemically synthesized
tctaggatacattggggagt

SEQ ID NO: 86784 - DNA, 20 bp, Artificial Sequence
  chemically synthesized
ctaggatacattggggagta

SEQ ID NO: 86785 - DNA, 20 bp, Artificial Sequence
  chemically synthesized
aggatacattggggagtagg

SEQ ID NO: 86786 - DNA, 20 bp, Artificial Sequence
  chemically synthesized
gatacattggggagtaggga

SEQ ID NO: 86787 - DNA, 20 bp, Artificial Sequence
  chemically synthesized
tacattggggagtagggaga

SEQ ID NO: 86788 - DNA, 20 bp, Artificial Sequence
  chemically synthesized
acattggggagtagggagag

SEQ ID NO: 86789 - DNA, 20 bp, Artificial Sequence
  chemically synthesized
ttggggagtagggagagagg

SEQ ID NO: 86790 - DNA, 20 bp, Artificial Sequence
  chemically synthesized
tggggagtagggagagagga

SEQ ID NO: 86791 - DNA, 20 bp, Artificial Sequence
  chemically synthesized
ggggagtagggagagaggaa

SEQ ID NO: 86792 - DNA, 20 bp, Artificial Sequence
  chemically synthesized
gagtagggagagaggaaggg

SEQ ID NO: 86793 - DNA, 20 bp, Artificial Sequence
  chemically synthesized
gtagggagagaggaagggaa

SEQ ID NO: 86794 - DNA, 20 bp, Artificial Sequence
  chemically synthesized
agggagagaggaagggaaga

SEQ ID NO: 86795 - DNA, 20 bp, Artificial Sequence
  chemically synthesized
atataacgatgactaatgtt

SEQ ID NO: 86796 - DNA, 20 bp, Artificial Sequence
  chemically synthesized
ggcagacagaggccaaacat

SEQ ID NO: 86797 - DNA, 20 bp, Artificial Sequence
  chemically synthesized
ttcctctaccaggcagacag

SEQ ID NO: 86798 - DNA, 20 bp, Artificial Sequence
  chemically synthesized
tttcctctaccaggcagaca

SEQ ID NO: 86799 - DNA, 20 bp, Artificial Sequence
  chemically synthesized
atgtttggcctctgtctgcc

SEQ ID NO: 86800 - DNA, 20 bp, Artificial Sequence
  chemically synthesized
tgtttcctctaccaggcaga

SEQ ID NO: 86801 - DNA, 20 bp, Artificial Sequence
  chemically synthesized
tttggcctctgtctgcctgg

SEQ ID NO: 86802 - DNA, 20 bp, Artificial Sequence
  chemically synthesized
tggcctctgtctgcctggta

SEQ ID NO: 86803 - DNA, 20 bp, Artificial Sequence
  chemically synthesized
attttgtttcctctaccagg

SEQ ID NO: 86804 - DNA, 20 bp, Artificial Sequence
  chemically synthesized
ggcctctgtctgcctggtag

SEQ ID NO: 86805 - DNA, 20 bp, Artificial Sequence
  chemically synthesized
gatattttgtttcctctacc

SEQ ID NO: 86806 - DNA, 20 bp, Artificial Sequence
  chemically synthesized
ggatattttgtttcctctac

SEQ ID NO: 86807 - DNA, 20 bp, Artificial Sequence
  chemically synthesized
gaggaaacaaaatatccttg

SEQ ID NO: 86808 - DNA, 20 bp, Artificial Sequence
  chemically synthesized
gaaacaaaatatccttgtgg

SEQ ID NO: 86809 - DNA, 20 bp, Artificial Sequence
  chemically synthesized
aacaaaatatccttgtggca

SEQ ID NO: 86810 - DNA, 20 bp, Artificial Sequence
  chemically synthesized
ctctagacctctctgccaca

SEQ ID NO: 86811 - DNA, 20 bp, Artificial Sequence
  chemically synthesized
cctctagacctctctgccac

SEQ ID NO: 86812 - DNA, 20 bp, Artificial Sequence
  chemically synthesized
caaaatatccttgtggcaga

SEQ ID NO: 86813 - DNA, 20 bp, Artificial Sequence
  chemically synthesized
aaaatatccttgtggcagag

SEQ ID NO: 86814 - DNA, 20 bp, Artificial Sequence
  chemically synthesized
atccttgtggcagagaggtc

SEQ ID NO: 86815 - DNA, 20 bp, Artificial Sequence
  chemically synthesized
ccttgtggcagagaggtcta

SEQ ID NO: 86816 - DNA, 20 bp, Artificial Sequence
  chemically synthesized
cttgtggcagagaggtctag

SEQ ID NO: 86817 - DNA, 20 bp, Artificial Sequence
  chemically synthesized
tgtggcagagaggtctagag

SEQ ID NO: 86818 - DNA, 20 bp, Artificial Sequence
  chemically synthesized
gtggcagagaggtctagagg

SEQ ID NO: 86819 - DNA, 20 bp, Artificial Sequence
  chemically synthesized
cccttcactatatcctcctc

SEQ ID NO: 86820 - DNA, 20 bp, Artificial Sequence
  chemically synthesized
gagaggtctagaggaggata

SEQ ID NO: 86821 - DNA, 20 bp, Artificial Sequence
  chemically synthesized
gtctagaggaggatatagtg

SEQ ID NO: 86822 - DNA, 20 bp, Artificial Sequence
  chemically synthesized
tctagaggaggatatagtga

SEQ ID NO: 86823 - DNA, 20 bp, Artificial Sequence
  chemically synthesized
ctagaggaggatatagtgaa

SEQ ID NO: 86824 - DNA, 20 bp, Artificial Sequence
  chemically synthesized
gaggaggatatagtgaaggg

SEQ ID NO: 86825 - DNA, 20 bp, Artificial Sequence
  chemically synthesized
aggaggatatagtgaagggc

SEQ ID NO: 86826 - DNA, 20 bp, Artificial Sequence
  chemically synthesized
gcttgaggtcttaacatagg

SEQ ID NO: 86827 - DNA, 20 bp, Artificial Sequence
  chemically synthesized
aagggcaggctgcctatgtt

SEQ ID NO: 86828 - DNA, 20 bp, Artificial Sequence
  chemically synthesized
gcagcttgaggtcttaacat

SEQ ID NO: 86829 - DNA, 20 bp, Artificial Sequence
  chemically synthesized
cgcagcttgaggtcttaaca

SEQ ID NO: 86830 - DNA, 20 bp, Artificial Sequence
  chemically synthesized
gctgcctatgttaagacctc

SEQ ID NO: 86831 - DNA, 20 bp, Artificial Sequence
  chemically synthesized
tatgttaagacctcaagctg

SEQ ID NO: 86832 - DNA, 20 bp, Artificial Sequence
  chemically synthesized
ataaacaaagccgcagcttg

SEQ ID NO: 86833 - DNA, 20 bp, Artificial Sequence
  chemically synthesized
cataaacaaagccgcagctt

SEQ ID NO: 86834 - DNA, 20 bp, Artificial Sequence
  chemically synthesized
tccttacataaacaaagccg

SEQ ID NO: 86835 - DNA, 20 bp, Artificial Sequence
  chemically synthesized
agcacttccttacataaaca

SEQ ID NO: 86836 - DNA, 20 bp, Artificial Sequence
  chemically synthesized
agctgcggctttgtttatgt

SEQ ID NO: 86837 - DNA, 20 bp, Artificial Sequence
  chemically synthesized
gctgcggctttgtttatgta

SEQ ID NO: 86838 - DNA, 20 bp, Artificial Sequence
  chemically synthesized
gcggctttgtttatgtaagg

SEQ ID NO: 86839 - DNA, 20 bp, Artificial Sequence
  chemically synthesized
gtaaggaagtgctaaaattc

SEQ ID NO: 86840 - DNA, 20 bp, Artificial Sequence
  chemically synthesized
ttaacctagaactggaattt

SEQ ID NO: 86841 - DNA, 20 bp, Artificial Sequence
  chemically synthesized
aagtgctaaaattccagttc

SEQ ID NO: 86842 - DNA, 20 bp, Artificial Sequence
  chemically synthesized
agtgctaaaattccagttct

SEQ ID NO: 86843 - DNA, 20 bp, Artificial Sequence
  chemically synthesized
agcaccatttaacctagaac

SEQ ID NO: 86844 - DNA, 20 bp, Artificial Sequence
  chemically synthesized
aattccagttctaggttaaa

SEQ ID NO: 86845 - DNA, 20 bp, Artificial Sequence
  chemically synthesized
tgagtcagcaccatttaacc

SEQ ID NO: 86846 - DNA, 20 bp, Artificial Sequence
  chemically synthesized
ttgacccactaataatgagt

SEQ ID NO: 86847 - DNA, 20 bp, Artificial Sequence
  chemically synthesized
aaatggtgctgactcattat

SEQ ID NO: 86848 - DNA, 20 bp, Artificial Sequence
  chemically synthesized
ttcattgacccactaataat

SEQ ID NO: 86849 - DNA, 20 bp, Artificial Sequence
  chemically synthesized
tggtgctgactcattattag

SEQ ID NO: 86850 - DNA, 20 bp, Artificial Sequence
  chemically synthesized
ggtgctgactcattattagt

SEQ ID NO: 86851 - DNA, 20 bp, Artificial Sequence
  chemically synthesized
agtgggtcaatgaacccctt

SEQ ID NO: 86852 - DNA, 20 bp, Artificial Sequence
  chemically synthesized
gtgggtcaatgaaccccttt

SEQ ID NO: 86853 - DNA, 20 bp, Artificial Sequence
  chemically synthesized
ctctcttaggggacctaaag

SEQ ID NO: 86854 - DNA, 20 bp, Artificial Sequence
  chemically synthesized
tctctcttaggggacctaaa

SEQ ID NO: 86855 - DNA, 20 bp, Artificial Sequence
  chemically synthesized
ctctctcttaggggacctaa

SEQ ID NO: 86856 - DNA, 20 bp, Artificial Sequence
  chemically synthesized
gctctctcttaggggaccta

SEQ ID NO: 86857 - DNA, 20 bp, Artificial Sequence
  chemically synthesized
tgaacccctttaggtcccct

SEQ ID NO: 86858 - DNA, 20 bp, Artificial Sequence
  chemically synthesized
aacccctttaggtcccctaa

SEQ ID NO: 86859 - DNA, 20 bp, Artificial Sequence
  chemically synthesized
cccctttaggtcccctaaga

SEQ ID NO: 86860 - DNA, 20 bp, Artificial Sequence
  chemically synthesized
gttattttgctctctcttag

SEQ ID NO: 86861 - DNA, 20 bp, Artificial Sequence
  chemically synthesized
cctttaggtcccctaagaga

SEQ ID NO: 86862 - DNA, 20 bp, Artificial Sequence
  chemically synthesized
agttattttgctctctctta

SEQ ID NO: 86863 - DNA, 20 bp, Artificial Sequence
  chemically synthesized
cagttattttgctctctctt

SEQ ID NO: 86864 - DNA, 20 bp, Artificial Sequence
  chemically synthesized
tcagttattttgctctctct

SEQ ID NO: 86865 - DNA, 20 bp, Artificial Sequence
  chemically synthesized
taagagagagcaaaataact

SEQ ID NO: 86866 - DNA, 20 bp, Artificial Sequence
  chemically synthesized
agagcaaaataactgagacc

SEQ ID NO: 86867 - DNA, 20 bp, Artificial Sequence
  chemically synthesized
gagcaaaataactgagacct

SEQ ID NO: 86868 - DNA, 20 bp, Artificial Sequence
  chemically synthesized
agcaaaataactgagaccta

SEQ ID NO: 86869 - DNA, 20 bp, Artificial Sequence
  chemically synthesized
gaactgaattccctaggtct

SEQ ID NO: 86870 - DNA, 20 bp, Artificial Sequence
  chemically synthesized
aaaaaagaactgaattccct

SEQ ID NO: 86871 - DNA, 20 bp, Artificial Sequence
  chemically synthesized
taactgagacctagggaatt

SEQ ID NO: 86872 - DNA, 20 bp, Artificial Sequence
  chemically synthesized
aaaaaaagaactgaattccc

SEQ ID NO: 86873 - DNA, 20 bp, Artificial Sequence
  chemically synthesized
caccaaaaaaaaaaaaaaaa

SEQ ID NO: 86874 - DNA, 20 bp, Artificial Sequence
  chemically synthesized
ttcttttttttttttttttt

SEQ ID NO: 86875 - DNA, 20 bp, Artificial Sequence
  chemically synthesized
tttttttttttttttttggt

SEQ ID NO: 86876 - DNA, 20 bp, Artificial Sequence
  chemically synthesized
tttttttttttttggtgaga

SEQ ID NO: 86877 - DNA, 20 bp, Artificial Sequence
  chemically synthesized
tttttttttttggtgagaca

SEQ ID NO: 86878 - DNA, 20 bp, Artificial Sequence
  chemically synthesized
tccagcctgggtgatagatc

SEQ ID NO: 86879 - DNA, 20 bp, Artificial Sequence
  chemically synthesized
cagagtcttgatctatcacc

SEQ ID NO: 86880 - DNA, 20 bp, Artificial Sequence
  chemically synthesized
agagtcttgatctatcaccc

SEQ ID NO: 86881 - DNA, 20 bp, Artificial Sequence
  chemically synthesized
ttgcactccagcctgggtga

SEQ ID NO: 86882 - DNA, 20 bp, Artificial Sequence
  chemically synthesized
tcttgatctatcacccaggc

SEQ ID NO: 86883 - DNA, 20 bp, Artificial Sequence
  chemically synthesized
ttgatctatcacccaggctg

SEQ ID NO: 86884 - DNA, 20 bp, Artificial Sequence
  chemically synthesized
gtgccattgcactccagcct

SEQ ID NO: 86885 - DNA, 20 bp, Artificial Sequence
  chemically synthesized
cgtgccattgcactccagcc

SEQ ID NO: 86886 - DNA, 20 bp, Artificial Sequence
  chemically synthesized
aagatcgtgccattgcactc

SEQ ID NO: 86887 - DNA, 20 bp, Artificial Sequence
  chemically synthesized
tcacccaggctggagtgcaa

SEQ ID NO: 86888 - DNA, 20 bp, Artificial Sequence
  chemically synthesized
ggagtgcaatggcacgatct

SEQ ID NO: 86889 - DNA, 20 bp, Artificial Sequence
  chemically synthesized
aggtggaggtgcagtgagcc

SEQ ID NO: 86890 - DNA, 20 bp, Artificial Sequence
  chemically synthesized
ccgggaggtggaggtgcagt

SEQ ID NO: 86891 - DNA, 20 bp, Artificial Sequence
  chemically synthesized
gaacccgggaggtggaggtg

SEQ ID NO: 86892 - DNA, 20 bp, Artificial Sequence
  chemically synthesized
tgcttgaacccgggaggtgg

SEQ ID NO: 86893 - DNA, 20 bp, Artificial Sequence
  chemically synthesized
ctcactgcacctccacctcc

SEQ ID NO: 86894 - DNA, 20 bp, Artificial Sequence
  chemically synthesized
ttgcttgaacccgggaggtg

SEQ ID NO: 86895 - DNA, 20 bp, Artificial Sequence
  chemically synthesized
tcactgcacctccacctccc

SEQ ID NO: 86896 - DNA, 20 bp, Artificial Sequence
  chemically synthesized
aattgcttgaacccgggagg

SEQ ID NO: 86897 - DNA, 20 bp, Artificial Sequence
  chemically synthesized
gagaattgcttgaacccggg

SEQ ID NO: 86898 - DNA, 20 bp, Artificial Sequence
  chemically synthesized
ggagaattgcttgaacccgg

SEQ ID NO: 86899 - DNA, 20 bp, Artificial Sequence
  chemically synthesized
cacctccacctcccgggttc

SEQ ID NO: 86900 - DNA, 20 bp, Artificial Sequence
  chemically synthesized
caggagaattgcttgaaccc

SEQ ID NO: 86901 - DNA, 20 bp, Artificial Sequence
  chemically synthesized
gcaggagaattgcttgaacc

SEQ ID NO: 86902 - DNA, 20 bp, Artificial Sequence
  chemically synthesized
ttcaagcaattctcctgcat

SEQ ID NO: 86903 - DNA, 20 bp, Artificial Sequence
  chemically synthesized
cacttgggaggctgatgcag

SEQ ID NO: 86904 - DNA, 20 bp, Artificial Sequence
  chemically synthesized
gccacttgggaggctgatgc

SEQ ID NO: 86905 - DNA, 20 bp, Artificial Sequence
  chemically synthesized
agccacttgggaggctgatg

SEQ ID NO: 86906 - DNA, 20 bp, Artificial Sequence
  chemically synthesized
ttctcctgcatcagcctccc

SEQ ID NO: 86907 - DNA, 20 bp, Artificial Sequence
  chemically synthesized
tcctgcatcagcctcccaag

SEQ ID NO: 86908 - DNA, 20 bp, Artificial Sequence
  chemically synthesized
tgtaatcccagccacttggg

SEQ ID NO: 86909 - DNA, 20 bp, Artificial Sequence
  chemically synthesized
ctgtaatcccagccacttgg

SEQ ID NO: 86910 - DNA, 20 bp, Artificial Sequence
  chemically synthesized
gcatcagcctcccaagtggc

SEQ ID NO: 86911 - DNA, 20 bp, Artificial Sequence
  chemically synthesized
gcctgtaatcccagccactt

SEQ ID NO: 86912 - DNA, 20 bp, Artificial Sequence
  chemically synthesized
catcagcctcccaagtggct

SEQ ID NO: 86913 - DNA, 20 bp, Artificial Sequence
  chemically synthesized
cgcctgtaatcccagccact

SEQ ID NO: 86914 - DNA, 20 bp, Artificial Sequence
  chemically synthesized
ctcccaagtggctgggatta

SEQ ID NO: 86915 - DNA, 20 bp, Artificial Sequence
  chemically synthesized
tcccaagtggctgggattac

SEQ ID NO: 86916 - DNA, 20 bp, Artificial Sequence
  chemically synthesized
gtggtgggcgcctgtaatcc

SEQ ID NO: 86917 - DNA, 20 bp, Artificial Sequence
  chemically synthesized
aattagctgggtgtggtggt

SEQ ID NO: 86918 - DNA, 20 bp, Artificial Sequence
  chemically synthesized
aaattagctgggtgtggtgg

SEQ ID NO: 86919 - DNA, 20 bp, Artificial Sequence
  chemically synthesized
caggcgcccaccaccacacc

SEQ ID NO: 86920 - DNA, 20 bp, Artificial Sequence
  chemically synthesized
caaaaattagctgggtgtgg

SEQ ID NO: 86921 - DNA, 20 bp, Artificial Sequence
  chemically synthesized
taccaaaaattagctgggtg

SEQ ID NO: 86922 - DNA, 20 bp, Artificial Sequence
  chemically synthesized
aaaaataccaaaaattagct

SEQ ID NO: 86923 - DNA, 20 bp, Artificial Sequence
  chemically synthesized
taaaaataccaaaaattagc

SEQ ID NO: 86924 - DNA, 20 bp, Artificial Sequence
  chemically synthesized
caccacacccagctaatttt

SEQ ID NO: 86925 - DNA, 20 bp, Artificial Sequence
  chemically synthesized
ctactaaaaataccaaaaat

SEQ ID NO: 86926 - DNA, 20 bp, Artificial Sequence
  chemically synthesized
cagctaatttttggtatttt

SEQ ID NO: 86927 - DNA, 20 bp, Artificial Sequence
  chemically synthesized
ctaatttttggtatttttag

SEQ ID NO: 86928 - DNA, 20 bp, Artificial Sequence
  chemically synthesized
aatttttggtatttttagta

SEQ ID NO: 86929 - DNA, 20 bp, Artificial Sequence
  chemically synthesized
tttggtatttttagtagaga

SEQ ID NO: 86930 - DNA, 20 bp, Artificial Sequence
  chemically synthesized
ttggtatttttagtagagat

SEQ ID NO: 86931 - DNA, 20 bp, Artificial Sequence
  chemically synthesized
tggtatttttagtagagatg

SEQ ID NO: 86932 - DNA, 20 bp, Artificial Sequence
  chemically synthesized
gagatggggtttcgccatgc

SEQ ID NO: 86933 - DNA, 20 bp, Artificial Sequence
  chemically synthesized
tggggtttcgccatgctggc

SEQ ID NO: 86934 - DNA, 20 bp, Artificial Sequence
  chemically synthesized
caagaccagcctggccagca

SEQ ID NO: 86935 - DNA, 20 bp, Artificial Sequence
  chemically synthesized
ggggtttcgccatgctggcc

SEQ ID NO: 86936 - DNA, 20 bp, Artificial Sequence
  chemically synthesized
tttcgccatgctggccaggc

SEQ ID NO: 86937 - DNA, 20 bp, Artificial Sequence
  chemically synthesized
gagttcaagaccagcctggc

SEQ ID NO: 86938 - DNA, 20 bp, Artificial Sequence
  chemically synthesized
tcaagagttcaagaccagcc

SEQ ID NO: 86939 - DNA, 20 bp, Artificial Sequence
  chemically synthesized
tgaggtcaagagttcaagac

SEQ ID NO: 86940 - DNA, 20 bp, Artificial Sequence
  chemically synthesized
tcacctgaggtcaagagttc

SEQ ID NO: 86941 - DNA, 20 bp, Artificial Sequence
  chemically synthesized
tggtcttgaactcttgacct

SEQ ID NO: 86942 - DNA, 20 bp, Artificial Sequence
  chemically synthesized
ggtggatcacctgaggtcaa

SEQ ID NO: 86943 - DNA, 20 bp, Artificial Sequence
  chemically synthesized
ggtcttgaactcttgacctc

SEQ ID NO: 86944 - DNA, 20 bp, Artificial Sequence
  chemically synthesized
caggtggatcacctgaggtc

SEQ ID NO: 86945 - DNA, 20 bp, Artificial Sequence
  chemically synthesized
tgaggcaggtggatcacctg

SEQ ID NO: 86946 - DNA, 20 bp, Artificial Sequence
  chemically synthesized
ctgaggcaggtggatcacct

SEQ ID NO: 86947 - DNA, 20 bp, Artificial Sequence
  chemically synthesized
ctcaggtgatccacctgcct

SEQ ID NO: 86948 - DNA, 20 bp, Artificial Sequence
  chemically synthesized
ctttgggaggctgaggcagg

SEQ ID NO: 86949 - DNA, 20 bp, Artificial Sequence
  chemically synthesized
acactttgggaggctgaggc

SEQ ID NO: 86950 - DNA, 20 bp, Artificial Sequence
  chemically synthesized
aacactttgggaggctgagg

SEQ ID NO: 86951 - DNA, 20 bp, Artificial Sequence
  chemically synthesized
cccaacactttgggaggctg

SEQ ID NO: 86952 - DNA, 20 bp, Artificial Sequence
  chemically synthesized
tcccaacactttgggaggct

SEQ ID NO: 86953 - DNA, 20 bp, Artificial Sequence
  chemically synthesized
ccacctgcctcagcctccca

SEQ ID NO: 86954 - DNA, 20 bp, Artificial Sequence
  chemically synthesized
tctactcccaacactttggg

SEQ ID NO: 86955 - DNA, 20 bp, Artificial Sequence
  chemically synthesized
ctctactcccaacactttgg

SEQ ID NO: 86956 - DNA, 20 bp, Artificial Sequence
  chemically synthesized
gcctcagcctcccaaagtgt

SEQ ID NO: 86957 - DNA, 20 bp, Artificial Sequence
  chemically synthesized
gcctctactcccaacacttt

SEQ ID NO: 86958 - DNA, 20 bp, Artificial Sequence
  chemically synthesized
cctcagcctcccaaagtgtt

SEQ ID NO: 86959 - DNA, 20 bp, Artificial Sequence
  chemically synthesized
cgcctctactcccaacactt

SEQ ID NO: 86960 - DNA, 20 bp, Artificial Sequence
  chemically synthesized
tcagcctcccaaagtgttgg

SEQ ID NO: 86961 - DNA, 20 bp, Artificial Sequence
  chemically synthesized
gcctcccaaagtgttgggag

SEQ ID NO: 86962 - DNA, 20 bp, Artificial Sequence
  chemically synthesized
ctcccaaagtgttgggagta

SEQ ID NO: 86963 - DNA, 20 bp, Artificial Sequence
  chemically synthesized
tcccaaagtgttgggagtag

SEQ ID NO: 86964 - DNA, 20 bp, Artificial Sequence
  chemically synthesized
agtgttgggagtagaggcgt

SEQ ID NO: 86965 - DNA, 20 bp, Artificial Sequence
  chemically synthesized
gaggcgtaagctaccacacc

SEQ ID NO: 86966 - DNA, 20 bp, Artificial Sequence
  chemically synthesized
gaattcccggctgggtgtgg

SEQ ID NO: 86967 - DNA, 20 bp, Artificial Sequence
  chemically synthesized
actgaattcccggctgggtg

SEQ ID NO: 86968 - DNA, 20 bp, Artificial Sequence
  chemically synthesized
cgtaagctaccacacccagc

SEQ ID NO: 86969 - DNA, 20 bp, Artificial Sequence
  chemically synthesized
gtaagctaccacacccagcc

SEQ ID NO: 86970 - DNA, 20 bp, Artificial Sequence
  chemically synthesized
ttagaactgaattcccggct

SEQ ID NO: 86971 - DNA, 20 bp, Artificial Sequence
  chemically synthesized
tttagaactgaattcccggc

SEQ ID NO: 86972 - DNA, 20 bp, Artificial Sequence
  chemically synthesized
accacacccagccgggaatt

SEQ ID NO: 86973 - DNA, 20 bp, Artificial Sequence
  chemically synthesized
atcctttagaactgaattcc

SEQ ID NO: 86974 - DNA, 20 bp, Artificial Sequence
  chemically synthesized
cagccgggaattcagttcta

SEQ ID NO: 86975 - DNA, 20 bp, Artificial Sequence
  chemically synthesized
agccgggaattcagttctaa

SEQ ID NO: 86976 - DNA, 20 bp, Artificial Sequence
  chemically synthesized
taagtttctcttagatcctt

SEQ ID NO: 86977 - DNA, 20 bp, Artificial Sequence
  chemically synthesized
aattcagttctaaaggatct

SEQ ID NO: 86978 - DNA, 20 bp, Artificial Sequence
  chemically synthesized
ttcagttctaaaggatctaa

SEQ ID NO: 86979 - DNA, 20 bp, Artificial Sequence
  chemically synthesized
tcatgctattaagtttctct

SEQ ID NO: 86980 - DNA, 20 bp, Artificial Sequence
  chemically synthesized
aggatctaagagaaacttaa

SEQ ID NO: 86981 - DNA, 20 bp, Artificial Sequence
  chemically synthesized
cttccctatttcatgctatt

SEQ ID NO: 86982 - DNA, 20 bp, Artificial Sequence
  chemically synthesized
agaaacttaatagcatgaaa

SEQ ID NO: 86983 - DNA, 20 bp, Artificial Sequence
  chemically synthesized
gaaacttaatagcatgaaat

SEQ ID NO: 86984 - DNA, 20 bp, Artificial Sequence
  chemically synthesized
aaacttaatagcatgaaata

SEQ ID NO: 86985 - DNA, 20 bp, Artificial Sequence
  chemically synthesized
cttaatagcatgaaataggg

SEQ ID NO: 86986 - DNA, 20 bp, Artificial Sequence
  chemically synthesized
gcatgaaatagggaagttgt

SEQ ID NO: 86987 - DNA, 20 bp, Artificial Sequence
  chemically synthesized
tgaaatagggaagttgttag

SEQ ID NO: 86988 - DNA, 20 bp, Artificial Sequence
  chemically synthesized
atagggaagttgttagaagc

SEQ ID NO: 86989 - DNA, 20 bp, Artificial Sequence
  chemically synthesized
tagggaagttgttagaagcc

SEQ ID NO: 86990 - DNA, 20 bp, Artificial Sequence
  chemically synthesized
agggaagttgttagaagcca

SEQ ID NO: 86991 - DNA, 20 bp, Artificial Sequence
  chemically synthesized
aagttgttagaagccaggga

SEQ ID NO: 86992 - DNA, 20 bp, Artificial Sequence
  chemically synthesized
gttgttagaagccagggaca

SEQ ID NO: 86993 - DNA, 20 bp, Artificial Sequence
  chemically synthesized
ttgttagaagccagggacag

SEQ ID NO: 86994 - DNA, 20 bp, Artificial Sequence
  chemically synthesized
tcttgactgtcctctgtccc

SEQ ID NO: 86995 - DNA, 20 bp, Artificial Sequence
  chemically synthesized
tagaagccagggacagagga

SEQ ID NO: 86996 - DNA, 20 bp, Artificial Sequence
  chemically synthesized
gccagggacagaggacagtc

SEQ ID NO: 86997 - DNA, 20 bp, Artificial Sequence
  chemically synthesized
cagggacagaggacagtcaa

SEQ ID NO: 86998 - DNA, 20 bp, Artificial Sequence
  chemically synthesized
gggacagaggacagtcaaga

SEQ ID NO: 86999 - DNA, 20 bp, Artificial Sequence
  chemically synthesized
gacagtcaagagagctaata

SEQ ID NO: 87000 - DNA, 20 bp, Artificial Sequence
  chemically synthesized
agtcaagagagctaatacag

SEQ ID NO: 87001 - DNA, 20 bp, Artificial Sequence
  chemically synthesized
tccgtcttctgctgctgtat

SEQ ID NO: 87002 - DNA, 20 bp, Artificial Sequence
  chemically synthesized
caagagagctaatacagcag

SEQ ID NO: 87003 - DNA, 20 bp, Artificial Sequence
  chemically synthesized
gagagctaatacagcagcag

SEQ ID NO: 87004 - DNA, 20 bp, Artificial Sequence
  chemically synthesized
gctaatacagcagcagaaga

SEQ ID NO: 87005 - DNA, 20 bp, Artificial Sequence
  chemically synthesized
acagcagcagaagacggacc

SEQ ID NO: 87006 - DNA, 20 bp, Artificial Sequence
  chemically synthesized
ttttcgtcttttgaggttcc

SEQ ID NO: 87007 - DNA, 20 bp, Artificial Sequence
  chemically synthesized
cttttcgtcttttgaggttc

SEQ ID NO: 87008 - DNA, 20 bp, Artificial Sequence
  chemically synthesized
agacggacctggaacctcaa

SEQ ID NO: 87009 - DNA, 20 bp, Artificial Sequence
  chemically synthesized
tgagagcttttcgtcttttg

SEQ ID NO: 87010 - DNA, 20 bp, Artificial Sequence
  chemically synthesized
gtgagagcttttcgtctttt

SEQ ID NO: 87011 - DNA, 20 bp, Artificial Sequence
  chemically synthesized
ctggaacctcaaaagacgaa

SEQ ID NO: 87012 - DNA, 20 bp, Artificial Sequence
  chemically synthesized
ccccttacccagatatgtga

SEQ ID NO: 87013 - DNA, 20 bp, Artificial Sequence
  chemically synthesized
acgaaaagctctcacatatc

SEQ ID NO: 87014 - DNA, 20 bp, Artificial Sequence
  chemically synthesized
gtccccttacccagatatgt

SEQ ID NO: 87015 - DNA, 20 bp, Artificial Sequence
  chemically synthesized
cgaaaagctctcacatatct

SEQ ID NO: 87016 - DNA, 20 bp, Artificial Sequence
  chemically synthesized
aagctctcacatatctgggt

SEQ ID NO: 87017 - DNA, 20 bp, Artificial Sequence
  chemically synthesized
agctctcacatatctgggta

SEQ ID NO: 87018 - DNA, 20 bp, Artificial Sequence
  chemically synthesized
gctctcacatatctgggtaa

SEQ ID NO: 87019 - DNA, 20 bp, Artificial Sequence
  chemically synthesized
ctctcacatatctgggtaag

SEQ ID NO: 87020 - DNA, 20 bp, Artificial Sequence
  chemically synthesized
ttaaaggaagtccccttacc

SEQ ID NO: 87021 - DNA, 20 bp, Artificial Sequence
  chemically synthesized
gcttagaaaaaaattaaagg

SEQ ID NO: 87022 - DNA, 20 bp, Artificial Sequence
  chemically synthesized
acagcttagaaaaaaattaa

SEQ ID NO: 87023 - DNA, 20 bp, Artificial Sequence
  chemically synthesized
cacagcttagaaaaaaatta

SEQ ID NO: 87024 - DNA, 20 bp, Artificial Sequence
  chemically synthesized
acttcctttaatttttttct

SEQ ID NO: 87025 - DNA, 20 bp, Artificial Sequence
  chemically synthesized
tttaatttttttctaagctg

SEQ ID NO: 87026 - DNA, 20 bp, Artificial Sequence
  chemically synthesized
taatttttttctaagctgtg

SEQ ID NO: 87027 - DNA, 20 bp, Artificial Sequence
  chemically synthesized
ttttatctaactccacagct

SEQ ID NO: 87028 - DNA, 20 bp, Artificial Sequence
  chemically synthesized
ttttttctaagctgtggagt

SEQ ID NO: 87029 - DNA, 20 bp, Artificial Sequence
  chemically synthesized
tgaaattttatctaactcca

SEQ ID NO: 87030 - DNA, 20 bp, Artificial Sequence
  chemically synthesized
tgtggagttagataaaattt

SEQ ID NO: 87031 - DNA, 20 bp, Artificial Sequence
  chemically synthesized
aagcaatttgatatgtagtt

SEQ ID NO: 87032 - DNA, 20 bp, Artificial Sequence
  chemically synthesized
gaagcaatttgatatgtagt

SEQ ID NO: 87033 - DNA, 20 bp, Artificial Sequence
  chemically synthesized
aaatgaagcaatttgatatg

SEQ ID NO: 87034 - DNA, 20 bp, Artificial Sequence
  chemically synthesized
tttaggagaggaaaaaaatg

SEQ ID NO: 87035 - DNA, 20 bp, Artificial Sequence
  chemically synthesized
ttcatttttttcctctccta

SEQ ID NO: 87036 - DNA, 20 bp, Artificial Sequence
  chemically synthesized
tcactcttgagctttaggag

SEQ ID NO: 87037 - DNA, 20 bp, Artificial Sequence
  chemically synthesized
ttcactcttgagctttagga

SEQ ID NO: 87038 - DNA, 20 bp, Artificial Sequence
  chemically synthesized
ctttcactcttgagctttag

SEQ ID NO: 87039 - DNA, 20 bp, Artificial Sequence
  chemically synthesized
tttttcctctcctaaagctc

SEQ ID NO: 87040 - DNA, 20 bp, Artificial Sequence
  chemically synthesized
tcctttcactcttgagcttt

SEQ ID NO: 87041 - DNA, 20 bp, Artificial Sequence
  chemically synthesized
ttcctttcactcttgagctt

SEQ ID NO: 87042 - DNA, 20 bp, Artificial Sequence
  chemically synthesized
tttcctctcctaaagctcaa

SEQ ID NO: 87043 - DNA, 20 bp, Artificial Sequence
  chemically synthesized
acatttttcctttcactctt

SEQ ID NO: 87044 - DNA, 20 bp, Artificial Sequence
  chemically synthesized
ctcctaaagctcaagagtga

SEQ ID NO: 87045 - DNA, 20 bp, Artificial Sequence
  chemically synthesized
tcctaaagctcaagagtgaa

SEQ ID NO: 87046 - DNA, 20 bp, Artificial Sequence
  chemically synthesized
gagtgaaaggaaaaatgtga

SEQ ID NO: 87047 - DNA, 20 bp, Artificial Sequence
  chemically synthesized
agtgaaaggaaaaatgtgat

SEQ ID NO: 87048 - DNA, 20 bp, Artificial Sequence
  chemically synthesized
tgaaaggaaaaatgtgatag

SEQ ID NO: 87049 - DNA, 20 bp, Artificial Sequence
  chemically synthesized
gaaaggaaaaatgtgatagg

SEQ ID NO: 87050 - DNA, 20 bp, Artificial Sequence
  chemically synthesized
tgataggaggacaaaaactg

SEQ ID NO: 87051 - DNA, 20 bp, Artificial Sequence
  chemically synthesized
cctttgtaagtttttcgctt

SEQ ID NO: 87052 - DNA, 20 bp, Artificial Sequence
  chemically synthesized
actgaagcgaaaaacttaca

SEQ ID NO: 87053 - DNA, 20 bp, Artificial Sequence
  chemically synthesized
ctgaagcgaaaaacttacaa

SEQ ID NO: 87054 - DNA, 20 bp, Artificial Sequence
  chemically synthesized
cagtgttctctgtcctttgt

SEQ ID NO: 87055 - DNA, 20 bp, Artificial Sequence
  chemically synthesized
agcgaaaaacttacaaagga

SEQ ID NO: 87056 - DNA, 20 bp, Artificial Sequence
  chemically synthesized
cgaaaaacttacaaaggaca

SEQ ID NO: 87057 - DNA, 20 bp, Artificial Sequence
  chemically synthesized
tacaaaggacagagaacact

SEQ ID NO: 87058 - DNA, 20 bp, Artificial Sequence
  chemically synthesized
aaggacagagaacactgagt

SEQ ID NO: 87059 - DNA, 20 bp, Artificial Sequence
  chemically synthesized
tcacctcttcagttcttact

SEQ ID NO: 87060 - DNA, 20 bp, Artificial Sequence
  chemically synthesized
agaacactgagtaagaactg

SEQ ID NO: 87061 - DNA, 20 bp, Artificial Sequence
  chemically synthesized
aacactgagtaagaactgaa

SEQ ID NO: 87062 - DNA, 20 bp, Artificial Sequence
  chemically synthesized
acactgagtaagaactgaag

SEQ ID NO: 87063 - DNA, 20 bp, Artificial Sequence
  chemically synthesized
ctggctgcctttcacctctt

SEQ ID NO: 87064 - DNA, 20 bp, Artificial Sequence
  chemically synthesized
agtaagaactgaagaggtga

SEQ ID NO: 87065 - DNA, 20 bp, Artificial Sequence
  chemically synthesized
gtaagaactgaagaggtgaa

SEQ ID NO: 87066 - DNA, 20 bp, Artificial Sequence
  chemically synthesized
agaactgaagaggtgaaagg

SEQ ID NO: 87067 - DNA, 20 bp, Artificial Sequence
  chemically synthesized
ctgaagaggtgaaaggcagc

SEQ ID NO: 87068 - DNA, 20 bp, Artificial Sequence
  chemically synthesized
gaagaggtgaaaggcagcca

SEQ ID NO: 87069 - DNA, 20 bp, Artificial Sequence
  chemically synthesized
tgctgttttaattcattctc

SEQ ID NO: 87070 - DNA, 20 bp, Artificial Sequence
  chemically synthesized
agccagagaatgaattaaaa

SEQ ID NO: 87071 - DNA, 20 bp, Artificial Sequence
  chemically synthesized
atacaaatgtattcaaccta

SEQ ID NO: 87072 - DNA, 20 bp, Artificial Sequence
  chemically synthesized
atgtattcaacctaaagctc

SEQ ID NO: 87073 - DNA, 20 bp, Artificial Sequence
  chemically synthesized
agtttgagacccagagcttt

SEQ ID NO: 87074 - DNA, 20 bp, Artificial Sequence
  chemically synthesized
tgtattcaacctaaagctct

SEQ ID NO: 87075 - DNA, 20 bp, Artificial Sequence
  chemically synthesized
tagtttgagacccagagctt

SEQ ID NO: 87076 - DNA, 20 bp, Artificial Sequence
  chemically synthesized
acactatagtttgagaccca

SEQ ID NO: 87077 - DNA, 20 bp, Artificial Sequence
  chemically synthesized
acacactatagtttgagacc

SEQ ID NO: 87078 - DNA, 20 bp, Artificial Sequence
  chemically synthesized
aagctctgggtctcaaacta

SEQ ID NO: 87079 - DNA, 20 bp, Artificial Sequence
  chemically synthesized
tcttatacacactatagttt

SEQ ID NO: 87080 - DNA, 20 bp, Artificial Sequence
  chemically synthesized
aatgtttcttatacacacta

SEQ ID NO: 87081 - DNA, 20 bp, Artificial Sequence
  chemically synthesized
tctcaaactatagtgtgtat

SEQ ID NO: 87082 - DNA, 20 bp, Artificial Sequence
  chemically synthesized
agtgtgtataagaaacattt

SEQ ID NO: 87083 - DNA, 20 bp, Artificial Sequence
  chemically synthesized
gtgtataagaaacatttgag

SEQ ID NO: 87084 - DNA, 20 bp, Artificial Sequence
  chemically synthesized
tagcaatctcaattttaaac

SEQ ID NO: 87085 - DNA, 20 bp, Artificial Sequence
  chemically synthesized
tgagtagcttgtttaaaatt

SEQ ID NO: 87086 - DNA, 20 bp, Artificial Sequence
  chemically synthesized
ttgtttaaaattgagattgc

SEQ ID NO: 87087 - DNA, 20 bp, Artificial Sequence
  chemically synthesized
tgtttaaaattgagattgct

SEQ ID NO: 87088 - DNA, 20 bp, Artificial Sequence
  chemically synthesized
gaaagtctggaggtggcacc

SEQ ID NO: 87089 - DNA, 20 bp, Artificial Sequence
  chemically synthesized
agattgctaggtgccacctc

SEQ ID NO: 87090 - DNA, 20 bp, Artificial Sequence
  chemically synthesized
aattatagaaagtctggagg

SEQ ID NO: 87091 - DNA, 20 bp, Artificial Sequence
  chemically synthesized
tagaattatagaaagtctgg

SEQ ID NO: 87092 - DNA, 20 bp, Artificial Sequence
  chemically synthesized
atagaattatagaaagtctg

SEQ ID NO: 87093 - DNA, 20 bp, Artificial Sequence
  chemically synthesized
tgatagaattatagaaagtc

SEQ ID NO: 87094 - DNA, 20 bp, Artificial Sequence
  chemically synthesized
attgttgatagaattataga

SEQ ID NO: 87095 - DNA, 20 bp, Artificial Sequence
  chemically synthesized
agagattgttgatagaatta

SEQ ID NO: 87096 - DNA, 20 bp, Artificial Sequence
  chemically synthesized
ttgaaagcagagattgttga

SEQ ID NO: 87097 - DNA, 20 bp, Artificial Sequence
  chemically synthesized
gaaggttcttgttgaaagca

SEQ ID NO: 87098 - DNA, 20 bp, Artificial Sequence
  chemically synthesized
gtgaaggttcttgttgaaag

SEQ ID NO: 87099 - DNA, 20 bp, Artificial Sequence
  chemically synthesized
caacaatctctgctttcaac

SEQ ID NO: 87100 - DNA, 20 bp, Artificial Sequence
  chemically synthesized
attgtgaaggttcttgttga

SEQ ID NO: 87101 - DNA, 20 bp, Artificial Sequence
  chemically synthesized
gcttacctgtggaattgtga

SEQ ID NO: 87102 - DNA, 20 bp, Artificial Sequence
  chemically synthesized
agcttacctgtggaattgtg

SEQ ID NO: 87103 - DNA, 20 bp, Artificial Sequence
  chemically synthesized
caagaaccttcacaattcca

SEQ ID NO: 87104 - DNA, 20 bp, Artificial Sequence
  chemically synthesized
aagaaccttcacaattccac

SEQ ID NO: 87105 - DNA, 20 bp, Artificial Sequence
  chemically synthesized
accttcacaattccacaggt

SEQ ID NO: 87106 - DNA, 20 bp, Artificial Sequence
  chemically synthesized
atggttctggagcttacctg

SEQ ID NO: 87107 - DNA, 20 bp, Artificial Sequence
  chemically synthesized
acaattccacaggtaagctc

SEQ ID NO: 87108 - DNA, 20 bp, Artificial Sequence
  chemically synthesized
tttatcaaagaatggttctg

SEQ ID NO: 87109 - DNA, 20 bp, Artificial Sequence
  chemically synthesized
gctttatcaaagaatggttc

SEQ ID NO: 87110 - DNA, 20 bp, Artificial Sequence
  chemically synthesized
ataaatgctttatcaaagaa

SEQ ID NO: 87111 - DNA, 20 bp, Artificial Sequence
  chemically synthesized
tccagaaccattctttgata

SEQ ID NO: 87112 - DNA, 20 bp, Artificial Sequence
  chemically synthesized
ctttaataaatgctttatca

SEQ ID NO: 87113 - DNA, 20 bp, Artificial Sequence
  chemically synthesized
ctttgataaagcatttatta

SEQ ID NO: 87114 - DNA, 20 bp, Artificial Sequence
  chemically synthesized
aagtaatgtttggggcatat

SEQ ID NO: 87115 - DNA, 20 bp, Artificial Sequence
  chemically synthesized
agaccaagaagtaatgtttg

SEQ ID NO: 87116 - DNA, 20 bp, Artificial Sequence
  chemically synthesized
gagaccaagaagtaatgttt

SEQ ID NO: 87117 - DNA, 20 bp, Artificial Sequence
  chemically synthesized
ggagaccaagaagtaatgtt

SEQ ID NO: 87118 - DNA, 20 bp, Artificial Sequence
  chemically synthesized
atgccccaaacattacttct

SEQ ID NO: 87119 - DNA, 20 bp, Artificial Sequence
  chemically synthesized
tttgccctgtggagaccaag

SEQ ID NO: 87120 - DNA, 20 bp, Artificial Sequence
  chemically synthesized
acctttgccctgtggagacc

SEQ ID NO: 87121 - DNA, 20 bp, Artificial Sequence
  chemically synthesized
acattacttcttggtctcca

SEQ ID NO: 87122 - DNA, 20 bp, Artificial Sequence
  chemically synthesized
cattacttcttggtctccac

SEQ ID NO: 87123 - DNA, 20 bp, Artificial Sequence
  chemically synthesized
attacttcttggtctccaca

SEQ ID NO: 87124 - DNA, 20 bp, Artificial Sequence
  chemically synthesized
aatgccacctttgccctgtg

SEQ ID NO: 87125 - DNA, 20 bp, Artificial Sequence
  chemically synthesized
ttcttggtctccacagggca

SEQ ID NO: 87126 - DNA, 20 bp, Artificial Sequence
  chemically synthesized
caaatgccacctttgccctg

SEQ ID NO: 87127 - DNA, 20 bp, Artificial Sequence
  chemically synthesized
tcttggtctccacagggcaa

SEQ ID NO: 87128 - DNA, 20 bp, Artificial Sequence
  chemically synthesized
tggtctccacagggcaaagg

SEQ ID NO: 87129 - DNA, 20 bp, Artificial Sequence
  chemically synthesized
agggcaaaggtggcatttgt

SEQ ID NO: 87130 - DNA, 20 bp, Artificial Sequence
  chemically synthesized
ttgtcagtgacttgattttg

SEQ ID NO: 87131 - DNA, 20 bp, Artificial Sequence
  chemically synthesized
acatttagatcttcaaaatc

SEQ ID NO: 87132 - DNA, 20 bp, Artificial Sequence
  chemically synthesized
gattttgaagatctaaatgt

SEQ ID NO: 87133 - DNA, 20 bp, Artificial Sequence
  chemically synthesized
attttgaagatctaaatgta

SEQ ID NO: 87134 - DNA, 20 bp, Artificial Sequence
  chemically synthesized
ctcacaatgttccttacatt

SEQ ID NO: 87135 - DNA, 20 bp, Artificial Sequence
  chemically synthesized
ctaaatgtaaggaacattgt

SEQ ID NO: 87136 - DNA, 20 bp, Artificial Sequence
  chemically synthesized
atggtcaaagaaaatgtttt

SEQ ID NO: 87137 - DNA, 20 bp, Artificial Sequence
  chemically synthesized
tcacgggcttaacatggtca

SEQ ID NO: 87138 - DNA, 20 bp, Artificial Sequence
  chemically synthesized
acattttctttgaccatgtt

SEQ ID NO: 87139 - DNA, 20 bp, Artificial Sequence
  chemically synthesized
aacatttcacgggcttaaca

SEQ ID NO: 87140 - DNA, 20 bp, Artificial Sequence
  chemically synthesized
gtgacttgaaaacatttcac

SEQ ID NO: 87141 - DNA, 20 bp, Artificial Sequence
  chemically synthesized
tgtgacttgaaaacatttca

SEQ ID NO: 87142 - DNA, 20 bp, Artificial Sequence
  chemically synthesized
taagcccgtgaaatgttttc

SEQ ID NO: 87143 - DNA, 20 bp, Artificial Sequence
  chemically synthesized
actgcttccgataaatgtat

SEQ ID NO: 87144 - DNA, 20 bp, Artificial Sequence
  chemically synthesized
cacatttctaatacatttat

SEQ ID NO: 87145 - DNA, 20 bp, Artificial Sequence
  chemically synthesized
atttctaatacatttatcgg

SEQ ID NO: 87146 - DNA, 20 bp, Artificial Sequence
  chemically synthesized
tctaatacatttatcggaag

SEQ ID NO: 87147 - DNA, 20 bp, Artificial Sequence
  chemically synthesized
cactcatgaaaataaaaata

SEQ ID NO: 87148 - DNA, 20 bp, Artificial Sequence
  chemically synthesized
acactcatgaaaataaaaat

SEQ ID NO: 87149 - DNA, 20 bp, Artificial Sequence
  chemically synthesized
tacactcatgaaaataaaaa

SEQ ID NO: 87150 - DNA, 20 bp, Artificial Sequence
  chemically synthesized
tgccctatttttattttcat

SEQ ID NO: 87151 - DNA, 20 bp, Artificial Sequence
  chemically synthesized
attttcatgagtgtatatac

SEQ ID NO: 87152 - DNA, 20 bp, Artificial Sequence
  chemically synthesized
gttaatcatttcaaaatatc

SEQ ID NO: 87153 - DNA, 20 bp, Artificial Sequence
  chemically synthesized
gatattccacatgcaaacat

SEQ ID NO: 87154 - DNA, 20 bp, Artificial Sequence
  chemically synthesized
agatattccacatgcaaaca

SEQ ID NO: 87155 - DNA, 20 bp, Artificial Sequence
  chemically synthesized
gattaacctatgtttgcatg

SEQ ID NO: 87156 - DNA, 20 bp, Artificial Sequence
  chemically synthesized
caaagaaacattttcaggag

SEQ ID NO: 87157 - DNA, 20 bp, Artificial Sequence
  chemically synthesized
tacaaagaaacattttcagg

SEQ ID NO: 87158 - DNA, 20 bp, Artificial Sequence
  chemically synthesized
atacaaagaaacattttcag

SEQ ID NO: 87159 - DNA, 20 bp, Artificial Sequence
  chemically synthesized
aaatacaaagaaacattttc

SEQ ID NO: 87160 - DNA, 20 bp, Artificial Sequence
  chemically synthesized
caaatacaaagaaacatttt

SEQ ID NO: 87161 - DNA, 20 bp, Artificial Sequence
  chemically synthesized
aaaaagtcattacaaataca

SEQ ID NO: 87162 - DNA, 20 bp, Artificial Sequence
  chemically synthesized
tttgtaatgacttttttttc

SEQ ID NO: 87163 - DNA, 20 bp, Artificial Sequence
  chemically synthesized
tatgatataaccagaaaaaa

SEQ ID NO: 87164 - DNA, 20 bp, Artificial Sequence
  chemically synthesized
cagcctatgtatgatataac

SEQ ID NO: 87165 - DNA, 20 bp, Artificial Sequence
  chemically synthesized
ttttctggttatatcataca

SEQ ID NO: 87166 - DNA, 20 bp, Artificial Sequence
  chemically synthesized
tttctggttatatcatacat

SEQ ID NO: 87167 - DNA, 20 bp, Artificial Sequence
  chemically synthesized
ttatatcatacataggctgt

SEQ ID NO: 87168 - DNA, 20 bp, Artificial Sequence
  chemically synthesized
tatatcatacataggctgtt

SEQ ID NO: 87169 - DNA, 20 bp, Artificial Sequence
  chemically synthesized
atatcatacataggctgttg

SEQ ID NO: 87170 - DNA, 20 bp, Artificial Sequence
  chemically synthesized
catacataggctgttggggt

SEQ ID NO: 87171 - DNA, 20 bp, Artificial Sequence
  chemically synthesized
caggttccttccaaccccaa

SEQ ID NO: 87172 - DNA, 20 bp, Artificial Sequence
  chemically synthesized
acataggctgttggggttgg

SEQ ID NO: 87173 - DNA, 20 bp, Artificial Sequence
  chemically synthesized
cataggctgttggggttgga

SEQ ID NO: 87174 - DNA, 20 bp, Artificial Sequence
  chemically synthesized
gttggggttggaaggaacct

SEQ ID NO: 87175 - DNA, 20 bp, Artificial Sequence
  chemically synthesized
tggggttggaaggaacctga

SEQ ID NO: 87176 - DNA, 20 bp, Artificial Sequence
  chemically synthesized
aggttgaactataatctctc

SEQ ID NO: 87177 - DNA, 20 bp, Artificial Sequence
  chemically synthesized
aaggttgaactataatctct

SEQ ID NO: 87178 - DNA, 20 bp, Artificial Sequence
  chemically synthesized
ggaaggaacctgagagatta

SEQ ID NO: 87179 - DNA, 20 bp, Artificial Sequence
  chemically synthesized
tctacatatgcaaaacaaga

SEQ ID NO: 87180 - DNA, 20 bp, Artificial Sequence
  chemically synthesized
ttctacatatgcaaaacaag

SEQ ID NO: 87181 - DNA, 20 bp, Artificial Sequence
  chemically synthesized
gatttctacatatgcaaaac

SEQ ID NO: 87182 - DNA, 20 bp, Artificial Sequence
  chemically synthesized
accttcttgttttgcatatg

SEQ ID NO: 87183 - DNA, 20 bp, Artificial Sequence
  chemically synthesized
gttttgcatatgtagaaatc

SEQ ID NO: 87184 - DNA, 20 bp, Artificial Sequence
  chemically synthesized
atgtagaaatcaagattgca

SEQ ID NO: 87185 - DNA, 20 bp, Artificial Sequence
  chemically synthesized
tgtagaaatcaagattgcaa

SEQ ID NO: 87186 - DNA, 20 bp, Artificial Sequence
  chemically synthesized
aagattgcaaaggtataaaa

SEQ ID NO: 87187 - DNA, 20 bp, Artificial Sequence
  chemically synthesized
gctcaagttatgtttttcag

SEQ ID NO: 87188 - DNA, 20 bp, Artificial Sequence
  chemically synthesized
acagctcaagttatgttttt

SEQ ID NO: 87189 - DNA, 20 bp, Artificial Sequence
  chemically synthesized
gctgctgaaaaacataactt

SEQ ID NO: 87190 - DNA, 20 bp, Artificial Sequence
  chemically synthesized
atatctaaataggacagctc

SEQ ID NO: 87191 - DNA, 20 bp, Artificial Sequence
  chemically synthesized
ataacttgagctgtcctatt

SEQ ID NO: 87192 - DNA, 20 bp, Artificial Sequence
  chemically synthesized
tttcccatatctaaatagga

SEQ ID NO: 87193 - DNA, 20 bp, Artificial Sequence
  chemically synthesized
tctatttcccatatctaaat

SEQ ID NO: 87194 - DNA, 20 bp, Artificial Sequence
  chemically synthesized
ttctatttcccatatctaaa

SEQ ID NO: 87195 - DNA, 20 bp, Artificial Sequence
  chemically synthesized
tgagctgtcctatttagata

SEQ ID NO: 87196 - DNA, 20 bp, Artificial Sequence
  chemically synthesized
gagctgtcctatttagatat

SEQ ID NO: 87197 - DNA, 20 bp, Artificial Sequence
  chemically synthesized
tcctatttagatatgggaaa

SEQ ID NO: 87198 - DNA, 20 bp, Artificial Sequence
  chemically synthesized
tagaaattacaaacctttgt

SEQ ID NO: 87199 - DNA, 20 bp, Artificial Sequence
  chemically synthesized
aggattttctcatctaacaa

SEQ ID NO: 87200 - DNA, 20 bp, Artificial Sequence
  chemically synthesized
aaggattttctcatctaaca

SEQ ID NO: 87201 - DNA, 20 bp, Artificial Sequence
  chemically synthesized
attacaaacctttgttagat

SEQ ID NO: 87202 - DNA, 20 bp, Artificial Sequence
  chemically synthesized
atgagaaaatccttaaacct

SEQ ID NO: 87203 - DNA, 20 bp, Artificial Sequence
  chemically synthesized
gttaaaaccactaaggttta

SEQ ID NO: 87204 - DNA, 20 bp, Artificial Sequence
  chemically synthesized
ggttaaaaccactaaggttt

SEQ ID NO: 87205 - DNA, 20 bp, Artificial Sequence
  chemically synthesized
agaaaatccttaaaccttag

SEQ ID NO: 87206 - DNA, 20 bp, Artificial Sequence
  chemically synthesized
acatttggttaaaaccacta

SEQ ID NO: 87207 - DNA, 20 bp, Artificial Sequence
  chemically synthesized
aacatttggttaaaaccact

SEQ ID NO: 87208 - DNA, 20 bp, Artificial Sequence
  chemically synthesized
gttcagagatcaaaaacatt

SEQ ID NO: 87209 - DNA, 20 bp, Artificial Sequence
  chemically synthesized
gcaacaagcctttttgttca

SEQ ID NO: 87210 - DNA, 20 bp, Artificial Sequence
  chemically synthesized
gtttttgatctctgaacaaa

SEQ ID NO: 87211 - DNA, 20 bp, Artificial Sequence
  chemically synthesized
tttttgatctctgaacaaaa

SEQ ID NO: 87212 - DNA, 20 bp, Artificial Sequence
  chemically synthesized
cagcaacaagcctttttgtt

SEQ ID NO: 87213 - DNA, 20 bp, Artificial Sequence
  chemically synthesized
taatttaatttaacagcaac

SEQ ID NO: 87214 - DNA, 20 bp, Artificial Sequence
  chemically synthesized
cccaatttaatttaatttaa

SEQ ID NO: 87215 - DNA, 20 bp, Artificial Sequence
  chemically synthesized
gctgttaaattaaattaaat

SEQ ID NO: 87216 - DNA, 20 bp, Artificial Sequence
  chemically synthesized
ctgttaaattaaattaaatt

SEQ ID NO: 87217 - DNA, 20 bp, Artificial Sequence
  chemically synthesized
attaaattaaattgggccta

SEQ ID NO: 87218 - DNA, 20 bp, Artificial Sequence
  chemically synthesized
ctatgtacagagtcagcttt

SEQ ID NO: 87219 - DNA, 20 bp, Artificial Sequence
  chemically synthesized
gctatgtacagagtcagctt

SEQ ID NO: 87220 - DNA, 20 bp, Artificial Sequence
  chemically synthesized
cagtttgctatgtacagagt

SEQ ID NO: 87221 - DNA, 20 bp, Artificial Sequence
  chemically synthesized
cctaaagctgactctgtaca

SEQ ID NO: 87222 - DNA, 20 bp, Artificial Sequence
  chemically synthesized
gttgcagtttgctatgtaca

SEQ ID NO: 87223 - DNA, 20 bp, Artificial Sequence
  chemically synthesized
gggttgcagtttgctatgta

SEQ ID NO: 87224 - DNA, 20 bp, Artificial Sequence
  chemically synthesized
gtacatagcaaactgcaacc

SEQ ID NO: 87225 - DNA, 20 bp, Artificial Sequence
  chemically synthesized
ttacatgccaagctgggttg

SEQ ID NO: 87226 - DNA, 20 bp, Artificial Sequence
  chemically synthesized
tagcaaactgcaacccagct

SEQ ID NO: 87227 - DNA, 20 bp, Artificial Sequence
  chemically synthesized
tattgcttacatgccaagct

SEQ ID NO: 87228 - DNA, 20 bp, Artificial Sequence
  chemically synthesized
atattgcttacatgccaagc

SEQ ID NO: 87229 - DNA, 20 bp, Artificial Sequence
  chemically synthesized
tgcaacccagcttggcatgt

SEQ ID NO: 87230 - DNA, 20 bp, Artificial Sequence
  chemically synthesized
ttgcatattgcttacatgcc

SEQ ID NO: 87231 - DNA, 20 bp, Artificial Sequence
  chemically synthesized
atgtaagcaatatgcaactt

SEQ ID NO: 87232 - DNA, 20 bp, Artificial Sequence
  chemically synthesized
gtaagcaatatgcaacttaa

SEQ ID NO: 87233 - DNA, 20 bp, Artificial Sequence
  chemically synthesized
tgttacaagaatgtactctt

SEQ ID NO: 87234 - DNA, 20 bp, Artificial Sequence
  chemically synthesized
gaggctcagctatttgttac

SEQ ID NO: 87235 - DNA, 20 bp, Artificial Sequence
  chemically synthesized
gagtacattcttgtaacaaa

SEQ ID NO: 87236 - DNA, 20 bp, Artificial Sequence
  chemically synthesized
cattcttgtaacaaatagct

SEQ ID NO: 87237 - DNA, 20 bp, Artificial Sequence
  chemically synthesized
tgtaacaaatagctgagcct

SEQ ID NO: 87238 - DNA, 20 bp, Artificial Sequence
  chemically synthesized
tgctgggattggctgaggct

SEQ ID NO: 87239 - DNA, 20 bp, Artificial Sequence
  chemically synthesized
ttgactgctgggattggctg

SEQ ID NO: 87240 - DNA, 20 bp, Artificial Sequence
  chemically synthesized
cttgactgctgggattggct

SEQ ID NO: 87241 - DNA, 20 bp, Artificial Sequence
  chemically synthesized
agctgagcctcagccaatcc

SEQ ID NO: 87242 - DNA, 20 bp, Artificial Sequence
  chemically synthesized
tgagcctcagccaatcccag

SEQ ID NO: 87243 - DNA, 20 bp, Artificial Sequence
  chemically synthesized
tgaaacttgactgctgggat

SEQ ID NO: 87244 - DNA, 20 bp, Artificial Sequence
  chemically synthesized
ctcagccaatcccagcagtc

SEQ ID NO: 87245 - DNA, 20 bp, Artificial Sequence
  chemically synthesized
ttagctgaaacttgactgct

SEQ ID NO: 87246 - DNA, 20 bp, Artificial Sequence
  chemically synthesized
attagctgaaacttgactgc

SEQ ID NO: 87247 - DNA, 20 bp, Artificial Sequence
  chemically synthesized
caatcccagcagtcaagttt

SEQ ID NO: 87248 - DNA, 20 bp, Artificial Sequence
  chemically synthesized
agtcaagtttcagctaatca

SEQ ID NO: 87249 - DNA, 20 bp, Artificial Sequence
  chemically synthesized
gtcaagtttcagctaatcac

SEQ ID NO: 87250 - DNA, 20 bp, Artificial Sequence
  chemically synthesized
atcagtttacagcctgtgat

SEQ ID NO: 87251 - DNA, 20 bp, Artificial Sequence
  chemically synthesized
gacatgagctgatcagttta

SEQ ID NO: 87252 - DNA, 20 bp, Artificial Sequence
  chemically synthesized
atcacaggctgtaaactgat

SEQ ID NO: 87253 - DNA, 20 bp, Artificial Sequence
  chemically synthesized
ttatatggacatgagctgat

SEQ ID NO: 87254 - DNA, 20 bp, Artificial Sequence
  chemically synthesized
catttgccttatatggacat

SEQ ID NO: 87255 - DNA, 20 bp, Artificial Sequence
  chemically synthesized
tgatcagctcatgtccatat

SEQ ID NO: 87256 - DNA, 20 bp, Artificial Sequence
  chemically synthesized
gatcagctcatgtccatata

SEQ ID NO: 87257 - DNA, 20 bp, Artificial Sequence
  chemically synthesized
aaataggcatttgccttata

SEQ ID NO: 87258 - DNA, 20 bp, Artificial Sequence
  chemically synthesized
tacttgggcatagtgtaaat

SEQ ID NO: 87259 - DNA, 20 bp, Artificial Sequence
  chemically synthesized
ttacttgggcatagtgtaaa

SEQ ID NO: 87260 - DNA, 20 bp, Artificial Sequence
  chemically synthesized
tgcctatttacactatgccc

SEQ ID NO: 87261 - DNA, 20 bp, Artificial Sequence
  chemically synthesized
gaatttgccttacttgggca

SEQ ID NO: 87262 - DNA, 20 bp, Artificial Sequence
  chemically synthesized
tatttacactatgcccaagt

SEQ ID NO: 87263 - DNA, 20 bp, Artificial Sequence
  chemically synthesized
atttacactatgcccaagta

SEQ ID NO: 87264 - DNA, 20 bp, Artificial Sequence
  chemically synthesized
gcttagaatttgccttactt

SEQ ID NO: 87265 - DNA, 20 bp, Artificial Sequence
  chemically synthesized
agcttagaatttgccttact

SEQ ID NO: 87266 - DNA, 20 bp, Artificial Sequence
  chemically synthesized
gcccaagtaaggcaaattct

SEQ ID NO: 87267 - DNA, 20 bp, Artificial Sequence
  chemically synthesized
cagcttgactggttacagct

SEQ ID NO: 87268 - DNA, 20 bp, Artificial Sequence
  chemically synthesized
ggcaaattctaagctgtaac

SEQ ID NO: 87269 - DNA, 20 bp, Artificial Sequence
  chemically synthesized
agaaacagcttgactggtta

SEQ ID NO: 87270 - DNA, 20 bp, Artificial Sequence
  chemically synthesized
attctaagctgtaaccagtc

SEQ ID NO: 87271 - DNA, 20 bp, Artificial Sequence
  chemically synthesized
acatacagaaacagcttgac

SEQ ID NO: 87272 - DNA, 20 bp, Artificial Sequence
  chemically synthesized
aaggaagtgacatacagaaa

SEQ ID NO: 87273 - DNA, 20 bp, Artificial Sequence
  chemically synthesized
tagaaaaaggaagtgacata

SEQ ID NO: 87274 - DNA, 20 bp, Artificial Sequence
  chemically synthesized
tatttatagatagaaaaagg

SEQ ID NO: 87275 - DNA, 20 bp, Artificial Sequence
  chemically synthesized
cagtatttatagatagaaaa

SEQ ID NO: 87276 - DNA, 20 bp, Artificial Sequence
  chemically synthesized
gcagtatttatagatagaaa

SEQ ID NO: 87277 - DNA, 20 bp, Artificial Sequence
  chemically synthesized
gggcaggcagtatttataga

SEQ ID NO: 87278 - DNA, 20 bp, Artificial Sequence
  chemically synthesized
aggtgggcaggcagtattta

SEQ ID NO: 87279 - DNA, 20 bp, Artificial Sequence
  chemically synthesized
cacccagcaaggtgggcagg

SEQ ID NO: 87280 - DNA, 20 bp, Artificial Sequence
  chemically synthesized
ctccacccagcaaggtgggc

SEQ ID NO: 87281 - DNA, 20 bp, Artificial Sequence
  chemically synthesized
gctccacccagcaaggtggg

SEQ ID NO: 87282 - DNA, 20 bp, Artificial Sequence
  chemically synthesized
atactgcctgcccaccttgc

SEQ ID NO: 87283 - DNA, 20 bp, Artificial Sequence
  chemically synthesized
aaagctccacccagcaaggt

SEQ ID NO: 87284 - DNA, 20 bp, Artificial Sequence
  chemically synthesized
tactgcctgcccaccttgct

SEQ ID NO: 87285 - DNA, 20 bp, Artificial Sequence
  chemically synthesized
gaaagctccacccagcaagg

SEQ ID NO: 87286 - DNA, 20 bp, Artificial Sequence
  chemically synthesized
tgcctgcccaccttgctggg

SEQ ID NO: 87287 - DNA, 20 bp, Artificial Sequence
  chemically synthesized
tcagaaagctccacccagca

SEQ ID NO: 87288 - DNA, 20 bp, Artificial Sequence
  chemically synthesized
ttcagaaagctccacccagc

SEQ ID NO: 87289 - DNA, 20 bp, Artificial Sequence
  chemically synthesized
cctgcccaccttgctgggtg

SEQ ID NO: 87290 - DNA, 20 bp, Artificial Sequence
  chemically synthesized
gaagttcagaaagctccacc

SEQ ID NO: 87291 - DNA, 20 bp, Artificial Sequence
  chemically synthesized
ctcagaattagaagttcaga

SEQ ID NO: 87292 - DNA, 20 bp, Artificial Sequence
  chemically synthesized
agtactcagaattagaagtt

SEQ ID NO: 87293 - DNA, 20 bp, Artificial Sequence
  chemically synthesized
cagacagtactcagaattag

SEQ ID NO: 87294 - DNA, 20 bp, Artificial Sequence
  chemically synthesized
ctttctgaacttctaattct

SEQ ID NO: 87295 - DNA, 20 bp, Artificial Sequence
  chemically synthesized
aatcagacagtactcagaat

SEQ ID NO: 87296 - DNA, 20 bp, Artificial Sequence
  chemically synthesized
ttcatgaatcagacagtact

SEQ ID NO: 87297 - DNA, 20 bp, Artificial Sequence
  chemically synthesized
aaaacaattcatgaatcaga

SEQ ID NO: 87298 - DNA, 20 bp, Artificial Sequence
  chemically synthesized
gcaaaaaacaattcatgaat

SEQ ID NO: 87299 - DNA, 20 bp, Artificial Sequence
  chemically synthesized
ccgttttgcagagtttattt

SEQ ID NO: 87300 - DNA, 20 bp, Artificial Sequence
  chemically synthesized
ctcaaataaactctgcaaaa

SEQ ID NO: 87301 - DNA, 20 bp, Artificial Sequence
  chemically synthesized
tagacaaattccgttttgca

SEQ ID NO: 87302 - DNA, 20 bp, Artificial Sequence
  chemically synthesized
tttagacaaattccgttttg

SEQ ID NO: 87303 - DNA, 20 bp, Artificial Sequence
  chemically synthesized
tgcaaaacggaatttgtcta

SEQ ID NO: 87304 - DNA, 20 bp, Artificial Sequence
  chemically synthesized
caatgttaaaagacaaactt

SEQ ID NO: 87305 - DNA, 20 bp, Artificial Sequence
  chemically synthesized
ttgacaattagcaatgttaa

SEQ ID NO: 87306 - DNA, 20 bp, Artificial Sequence
  chemically synthesized
agcagaatatatttgacaat

SEQ ID NO: 87307 - DNA, 20 bp, Artificial Sequence
  chemically synthesized
gttgagtgggtaggagtaag

SEQ ID NO: 87308 - DNA, 20 bp, Artificial Sequence
  chemically synthesized
tccgttgagtgggtaggagt

SEQ ID NO: 87309 - DNA, 20 bp, Artificial Sequence
  chemically synthesized
attttccgttgagtgggtag

SEQ ID NO: 87310 - DNA, 20 bp, Artificial Sequence
  chemically synthesized
ttattttccgttgagtgggt

SEQ ID NO: 87311 - DNA, 20 bp, Artificial Sequence
  chemically synthesized
tttattttccgttgagtggg

SEQ ID NO: 87312 - DNA, 20 bp, Artificial Sequence
  chemically synthesized
gcttactcctacccactcaa

SEQ ID NO: 87313 - DNA, 20 bp, Artificial Sequence
  chemically synthesized
tcttttattttccgttgagt

SEQ ID NO: 87314 - DNA, 20 bp, Artificial Sequence
  chemically synthesized
ctcttttattttccgttgag

SEQ ID NO: 87315 - DNA, 20 bp, Artificial Sequence
  chemically synthesized
cacctcttttattttccgtt

SEQ ID NO: 87316 - DNA, 20 bp, Artificial Sequence
  chemically synthesized
acccactcaacggaaaataa

SEQ ID NO: 87317 - DNA, 20 bp, Artificial Sequence
  chemically synthesized
ccactcaacggaaaataaaa

SEQ ID NO: 87318 - DNA, 20 bp, Artificial Sequence
  chemically synthesized
cactcaacggaaaataaaag

SEQ ID NO: 87319 - DNA, 20 bp, Artificial Sequence
  chemically synthesized
tcaacggaaaataaaagagg

SEQ ID NO: 87320 - DNA, 20 bp, Artificial Sequence
  chemically synthesized
aaaataaaagaggtggttca

SEQ ID NO: 87321 - DNA, 20 bp, Artificial Sequence
  chemically synthesized
aaataaaagaggtggttcaa

SEQ ID NO: 87322 - DNA, 20 bp, Artificial Sequence
  chemically synthesized
aataaaagaggtggttcaaa

SEQ ID NO: 87323 - DNA, 20 bp, Artificial Sequence
  chemically synthesized
ataaaagaggtggttcaaag

SEQ ID NO: 87324 - DNA, 20 bp, Artificial Sequence
  chemically synthesized
gtggttcaaaggggcatgct

SEQ ID NO: 87325 - DNA, 20 bp, Artificial Sequence
  chemically synthesized
aatagacatagatagaagct

SEQ ID NO: 87326 - DNA, 20 bp, Artificial Sequence
  chemically synthesized
agattaatagacatagatag

SEQ ID NO: 87327 - DNA, 20 bp, Artificial Sequence
  chemically synthesized
taaagattaatagacataga

SEQ ID NO: 87328 - DNA, 20 bp, Artificial Sequence
  chemically synthesized
ctaataaagattaatagaca

SEQ ID NO: 87329 - DNA, 20 bp, Artificial Sequence
  chemically synthesized
tcttcactaataaagattaa

SEQ ID NO: 87330 - DNA, 20 bp, Artificial Sequence
  chemically synthesized
ctatgtctattaatctttat

SEQ ID NO: 87331 - DNA, 20 bp, Artificial Sequence
  chemically synthesized
agctcttgtcttcactaata

SEQ ID NO: 87332 - DNA, 20 bp, Artificial Sequence
  chemically synthesized
tctattaatctttattagtg

SEQ ID NO: 87333 - DNA, 20 bp, Artificial Sequence
  chemically synthesized
taatctttattagtgaagac

SEQ ID NO: 87334 - DNA, 20 bp, Artificial Sequence
  chemically synthesized
atctttattagtgaagacaa

SEQ ID NO: 87335 - DNA, 20 bp, Artificial Sequence
  chemically synthesized
tattagtgaagacaagagct

SEQ ID NO: 87336 - DNA, 20 bp, Artificial Sequence
  chemically synthesized
attagtgaagacaagagctt

SEQ ID NO: 87337 - DNA, 20 bp, Artificial Sequence
  chemically synthesized
ttagtgaagacaagagctta

SEQ ID NO: 87338 - DNA, 20 bp, Artificial Sequence
  chemically synthesized
tagtgaagacaagagcttag

SEQ ID NO: 87339 - DNA, 20 bp, Artificial Sequence
  chemically synthesized
gttaaacggtagtaacccct

SEQ ID NO: 87340 - DNA, 20 bp, Artificial Sequence
  chemically synthesized
gcacttgccttgttaaacgg

SEQ ID NO: 87341 - DNA, 20 bp, Artificial Sequence
  chemically synthesized
aggggttactaccgtttaac

SEQ ID NO: 87342 - DNA, 20 bp, Artificial Sequence
  chemically synthesized
ggggttactaccgtttaaca

SEQ ID NO: 87343 - DNA, 20 bp, Artificial Sequence
  chemically synthesized
ttagcacttgccttgttaaa

SEQ ID NO: 87344 - DNA, 20 bp, Artificial Sequence
  chemically synthesized
ttactaccgtttaacaaggc

SEQ ID NO: 87345 - DNA, 20 bp, Artificial Sequence
  chemically synthesized
attatcagctttttagagat

SEQ ID NO: 87346 - DNA, 20 bp, Artificial Sequence
  chemically synthesized
ggcaagtgctaatctctaaa

SEQ ID NO: 87347 - DNA, 20 bp, Artificial Sequence
  chemically synthesized
tggaaattatcagcttttta

SEQ ID NO: 87348 - DNA, 20 bp, Artificial Sequence
  chemically synthesized
tgtggaaattatcagctttt

SEQ ID NO: 87349 - DNA, 20 bp, Artificial Sequence
  chemically synthesized
ttacaaattgtggaaattat

SEQ ID NO: 87350 - DNA, 20 bp, Artificial Sequence
  chemically synthesized
tacctaaaccttacaaattg

SEQ ID NO: 87351 - DNA, 20 bp, Artificial Sequence
  chemically synthesized
tgataatttccacaatttgt

SEQ ID NO: 87352 - DNA, 20 bp, Artificial Sequence
  chemically synthesized
gataatttccacaatttgta

SEQ ID NO: 87353 - DNA, 20 bp, Artificial Sequence
  chemically synthesized
tttccacaatttgtaaggtt

SEQ ID NO: 87354 - DNA, 20 bp, Artificial Sequence
  chemically synthesized
ttccacaatttgtaaggttt

SEQ ID NO: 87355 - DNA, 20 bp, Artificial Sequence
  chemically synthesized
tgtaaggtttaggtaaaacg

SEQ ID NO: 87356 - DNA, 20 bp, Artificial Sequence
  chemically synthesized
taaggtttaggtaaaacgca

SEQ ID NO: 87357 - DNA, 20 bp, Artificial Sequence
  chemically synthesized
taggtaaaacgcagagcctt

SEQ ID NO: 87358 - DNA, 20 bp, Artificial Sequence
  chemically synthesized
atatactccagcacatctaa

SEQ ID NO: 87359 - DNA, 20 bp, Artificial Sequence
  chemically synthesized
aatatactccagcacatcta

SEQ ID NO: 87360 - DNA, 20 bp, Artificial Sequence
  chemically synthesized
cgcagagcctttagatgtgc

SEQ ID NO: 87361 - DNA, 20 bp, Artificial Sequence
  chemically synthesized
cagagcctttagatgtgctg

SEQ ID NO: 87362 - DNA, 20 bp, Artificial Sequence
  chemically synthesized
aaagaccaagcaatatactc

SEQ ID NO: 87363 - DNA, 20 bp, Artificial Sequence
  chemically synthesized
atgtgctggagtatattgct

SEQ ID NO: 87364 - DNA, 20 bp, Artificial Sequence
  chemically synthesized
gagtatattgcttggtcttt

SEQ ID NO: 87365 - DNA, 20 bp, Artificial Sequence
  chemically synthesized
tgaggagttccttaaagacc

SEQ ID NO: 87366 - DNA, 20 bp, Artificial Sequence
  chemically synthesized
agtatattgcttggtcttta

SEQ ID NO: 87367 - DNA, 20 bp, Artificial Sequence
  chemically synthesized
tgacactgaggagttcctta

SEQ ID NO: 87368 - DNA, 20 bp, Artificial Sequence
  chemically synthesized
ttggtctttaaggaactcct

SEQ ID NO: 87369 - DNA, 20 bp, Artificial Sequence
  chemically synthesized
cttagtgtcctgacactgag

SEQ ID NO: 87370 - DNA, 20 bp, Artificial Sequence
  chemically synthesized
tttaaggaactcctcagtgt

SEQ ID NO: 87371 - DNA, 20 bp, Artificial Sequence
  chemically synthesized
ttaaggaactcctcagtgtc

SEQ ID NO: 87372 - DNA, 20 bp, Artificial Sequence
  chemically synthesized
ttcttagtgtcctgacactg

SEQ ID NO: 87373 - DNA, 20 bp, Artificial Sequence
  chemically synthesized
attcttagtgtcctgacact

SEQ ID NO: 87374 - DNA, 20 bp, Artificial Sequence
  chemically synthesized
ctcctcagtgtcaggacact

SEQ ID NO: 87375 - DNA, 20 bp, Artificial Sequence
  chemically synthesized
tgtcaggacactaagaatta

SEQ ID NO: 87376 - DNA, 20 bp, Artificial Sequence
  chemically synthesized
ttatcagcccctataattct

SEQ ID NO: 87377 - DNA, 20 bp, Artificial Sequence
  chemically synthesized
gtcaggacactaagaattat

SEQ ID NO: 87378 - DNA, 20 bp, Artificial Sequence
  chemically synthesized
tcaggacactaagaattata

SEQ ID NO: 87379 - DNA, 20 bp, Artificial Sequence
  chemically synthesized
caggacactaagaattatag

SEQ ID NO: 87380 - DNA, 20 bp, Artificial Sequence
  chemically synthesized
aagaattataggggctgata

SEQ ID NO: 87381 - DNA, 20 bp, Artificial Sequence
  chemically synthesized
agaaataacaatcactttat

SEQ ID NO: 87382 - DNA, 20 bp, Artificial Sequence
  chemically synthesized
taaagtgattgttatttctc

SEQ ID NO: 87383 - DNA, 20 bp, Artificial Sequence
  chemically synthesized
gattgttatttctctagaca

SEQ ID NO: 87384 - DNA, 20 bp, Artificial Sequence
  chemically synthesized
agttgaaatatctgtgtcta

SEQ ID NO: 87385 - DNA, 20 bp, Artificial Sequence
  chemically synthesized
acagttgaaatatctgtgtc

SEQ ID NO: 87386 - DNA, 20 bp, Artificial Sequence
  chemically synthesized
cagatatttcaactgtgatt

SEQ ID NO: 87387 - DNA, 20 bp, Artificial Sequence
  chemically synthesized
actaggcattaaccaaatca

SEQ ID NO: 87388 - DNA, 20 bp, Artificial Sequence
  chemically synthesized
actgtgatttggttaatgcc

SEQ ID NO: 87389 - DNA, 20 bp, Artificial Sequence
  chemically synthesized
tttattaaggatttcaaact

SEQ ID NO: 87390 - DNA, 20 bp, Artificial Sequence
  chemically synthesized
ttttattaaggatttcaaac

SEQ ID NO: 87391 - DNA, 20 bp, Artificial Sequence
  chemically synthesized
ttcagagtaaagttttatta

SEQ ID NO: 87392 - DNA, 20 bp, Artificial Sequence
  chemically synthesized
tttcagagtaaagttttatt

SEQ ID NO: 87393 - DNA, 20 bp, Artificial Sequence
  chemically synthesized
aatgcatgcctttcagagta

SEQ ID NO: 87394 - DNA, 20 bp, Artificial Sequence
  chemically synthesized
ttaataaaactttactctga

SEQ ID NO: 87395 - DNA, 20 bp, Artificial Sequence
  chemically synthesized
taataaaactttactctgaa

SEQ ID NO: 87396 - DNA, 20 bp, Artificial Sequence
  chemically synthesized
ttaagaatgcatgcctttca

SEQ ID NO: 87397 - DNA, 20 bp, Artificial Sequence
  chemically synthesized
ctttaagaatgcatgccttt

SEQ ID NO: 87398 - DNA, 20 bp, Artificial Sequence
  chemically synthesized
ctgaaaggcatgcattctta

SEQ ID NO: 87399 - DNA, 20 bp, Artificial Sequence
  chemically synthesized
aatataacacatttcacttt

SEQ ID NO: 87400 - DNA, 20 bp, Artificial Sequence
  chemically synthesized
tagttttataaaggaagtca

SEQ ID NO: 87401 - DNA, 20 bp, Artificial Sequence
  chemically synthesized
tatcattagttttataaagg

SEQ ID NO: 87402 - DNA, 20 bp, Artificial Sequence
  chemically synthesized
atatatcattagttttataa

SEQ ID NO: 87403 - DNA, 20 bp, Artificial Sequence
  chemically synthesized
gatatatcattagttttata

SEQ ID NO: 87404 - DNA, 20 bp, Artificial Sequence
  chemically synthesized
gatttatagggatatatcat

SEQ ID NO: 87405 - DNA, 20 bp, Artificial Sequence
  chemically synthesized
gagggtactaaagatttata

SEQ ID NO: 87406 - DNA, 20 bp, Artificial Sequence
  chemically synthesized
tgagggtactaaagatttat

SEQ ID NO: 87407 - DNA, 20 bp, Artificial Sequence
  chemically synthesized
atgagggtactaaagattta

SEQ ID NO: 87408 - DNA, 20 bp, Artificial Sequence
  chemically synthesized
gatatatccctataaatctt

SEQ ID NO: 87409 - DNA, 20 bp, Artificial Sequence
  chemically synthesized
tttattacatgagggtacta

SEQ ID NO: 87410 - DNA, 20 bp, Artificial Sequence
  chemically synthesized
agtgctattttattacatga

SEQ ID NO: 87411 - DNA, 20 bp, Artificial Sequence
  chemically synthesized
aagtgctattttattacatg

SEQ ID NO: 87412 - DNA, 20 bp, Artificial Sequence
  chemically synthesized
taagtgctattttattacat

SEQ ID NO: 87413 - DNA, 20 bp, Artificial Sequence
  chemically synthesized
agtaccctcatgtaataaaa

SEQ ID NO: 87414 - DNA, 20 bp, Artificial Sequence
  chemically synthesized
taaaatagcacttaaacatg

SEQ ID NO: 87415 - DNA, 20 bp, Artificial Sequence
  chemically synthesized
ccttttctttctgcatgttt

SEQ ID NO: 87416 - DNA, 20 bp, Artificial Sequence
  chemically synthesized
atagcacttaaacatgcaga

SEQ ID NO: 87417 - DNA, 20 bp, Artificial Sequence
  chemically synthesized
acttaaacatgcagaaagaa

SEQ ID NO: 87418 - DNA, 20 bp, Artificial Sequence
  chemically synthesized
cttaaacatgcagaaagaaa

SEQ ID NO: 87419 - DNA, 20 bp, Artificial Sequence
  chemically synthesized
ttaaacatgcagaaagaaaa

SEQ ID NO: 87420 - DNA, 20 bp, Artificial Sequence
  chemically synthesized
aaacatgcagaaagaaaagg

SEQ ID NO: 87421 - DNA, 20 bp, Artificial Sequence
  chemically synthesized
aacatgcagaaagaaaaggg

SEQ ID NO: 87422 - DNA, 20 bp, Artificial Sequence
  chemically synthesized
agaaagaaaagggaggaatg

SEQ ID NO: 87423 - DNA, 20 bp, Artificial Sequence
  chemically synthesized
ggaggaatgcagaaataata

SEQ ID NO: 87424 - DNA, 20 bp, Artificial Sequence
  chemically synthesized
ctgtttttatggcagtattg

SEQ ID NO: 87425 - DNA, 20 bp, Artificial Sequence
  chemically synthesized
ctttgtgtctgtttttatgg

SEQ ID NO: 87426 - DNA, 20 bp, Artificial Sequence
  chemically synthesized
ccacaatactgccataaaaa

SEQ ID NO: 87427 - DNA, 20 bp, Artificial Sequence
  chemically synthesized
ggtctttgtgtctgttttta

SEQ ID NO: 87428 - DNA, 20 bp, Artificial Sequence
  chemically synthesized
ctgccataaaaacagacaca

SEQ ID NO: 87429 - DNA, 20 bp, Artificial Sequence
  chemically synthesized
aaaacagacacaaagaccca

SEQ ID NO: 87430 - DNA, 20 bp, Artificial Sequence
  chemically synthesized
agacacaaagacccatggaa

SEQ ID NO: 87431 - DNA, 20 bp, Artificial Sequence
  chemically synthesized
ggttctctagtcttttccat

SEQ ID NO: 87432 - DNA, 20 bp, Artificial Sequence
  chemically synthesized
gggttctctagtcttttcca

SEQ ID NO: 87433 - DNA, 20 bp, Artificial Sequence
  chemically synthesized
caaagacccatggaaaagac

SEQ ID NO: 87434 - DNA, 20 bp, Artificial Sequence
  chemically synthesized
aagacccatggaaaagacta

SEQ ID NO: 87435 - DNA, 20 bp, Artificial Sequence
  chemically synthesized
ggattcgtttttgggttctc

SEQ ID NO: 87436 - DNA, 20 bp, Artificial Sequence
  chemically synthesized
aggtgtgtggattcgttttt

SEQ ID NO: 87437 - DNA, 20 bp, Artificial Sequence
  chemically synthesized
taggtgtgtggattcgtttt

SEQ ID NO: 87438 - DNA, 20 bp, Artificial Sequence
  chemically synthesized
atgagttaactgtaggtgtg

SEQ ID NO: 87439 - DNA, 20 bp, Artificial Sequence
  chemically synthesized
aaaacgaatccacacaccta

SEQ ID NO: 87440 - DNA, 20 bp, Artificial Sequence
  chemically synthesized
gtcaaaaatgagttaactgt

SEQ ID NO: 87441 - DNA, 20 bp, Artificial Sequence
  chemically synthesized
tgtcaaaaatgagttaactg

SEQ ID NO: 87442 - DNA, 20 bp, Artificial Sequence
  chemically synthesized
ttggcacctttgtcaaaaat

SEQ ID NO: 87443 - DNA, 20 bp, Artificial Sequence
  chemically synthesized
cagttaactcatttttgaca

SEQ ID NO: 87444 - DNA, 20 bp, Artificial Sequence
  chemically synthesized
agttaactcatttttgacaa

SEQ ID NO: 87445 - DNA, 20 bp, Artificial Sequence
  chemically synthesized
tcatttttgacaaaggtgcc

SEQ ID NO: 87446 - DNA, 20 bp, Artificial Sequence
  chemically synthesized
ttttccccactgtatgttct

SEQ ID NO: 87447 - DNA, 20 bp, Artificial Sequence
  chemically synthesized
acaaaggtgccaagaacata

SEQ ID NO: 87448 - DNA, 20 bp, Artificial Sequence
  chemically synthesized
aaggtgccaagaacatacag

SEQ ID NO: 87449 - DNA, 20 bp, Artificial Sequence
  chemically synthesized
aggtgccaagaacatacagt

SEQ ID NO: 87450 - DNA, 20 bp, Artificial Sequence
  chemically synthesized
ggtgccaagaacatacagtg

SEQ ID NO: 87451 - DNA, 20 bp, Artificial Sequence
  chemically synthesized
caagaacatacagtggggaa

SEQ ID NO: 87452 - DNA, 20 bp, Artificial Sequence
  chemically synthesized
aacatacagtggggaaaaga

SEQ ID NO: 87453 - DNA, 20 bp, Artificial Sequence
  chemically synthesized
tttccgcaccatttgttgaa

SEQ ID NO: 87454 - DNA, 20 bp, Artificial Sequence
  chemically synthesized
aagacagtctcttcaacaaa

SEQ ID NO: 87455 - DNA, 20 bp, Artificial Sequence
  chemically synthesized
tttttccgcaccatttgttg

SEQ ID NO: 87456 - DNA, 20 bp, Artificial Sequence
  chemically synthesized
agtctcttcaacaaatggtg

SEQ ID NO: 87457 - DNA, 20 bp, Artificial Sequence
  chemically synthesized
aacaaatggtgcggaaaaac

SEQ ID NO: 87458 - DNA, 20 bp, Artificial Sequence
  chemically synthesized
tcattctgcatatggatatc

SEQ ID NO: 87459 - DNA, 20 bp, Artificial Sequence
  chemically synthesized
aaaaactggatatccatatg

SEQ ID NO: 87460 - DNA, 20 bp, Artificial Sequence
  chemically synthesized
gtctagattcattctgcata

SEQ ID NO: 87461 - DNA, 20 bp, Artificial Sequence
  chemically synthesized
atccatatgcagaatgaatc

SEQ ID NO: 87462 - DNA, 20 bp, Artificial Sequence
  chemically synthesized
tatggtgagagataggggtc

SEQ ID NO: 87463 - DNA, 20 bp, Artificial Sequence
  chemically synthesized
ttgtatatggtgagagatag

SEQ ID NO: 87464 - DNA, 20 bp, Artificial Sequence
  chemically synthesized
tttgtatatggtgagagata

SEQ ID NO: 87465 - DNA, 20 bp, Artificial Sequence
  chemically synthesized
ttttgtatatggtgagagat

SEQ ID NO: 87466 - DNA, 20 bp, Artificial Sequence
  chemically synthesized
tttttgtatatggtgagaga

SEQ ID NO: 87467 - DNA, 20 bp, Artificial Sequence
  chemically synthesized
ttgatttttgtatatggtga

SEQ ID NO: 87468 - DNA, 20 bp, Artificial Sequence
  chemically synthesized
atttgatttttgtatatggt

SEQ ID NO: 87469 - DNA, 20 bp, Artificial Sequence
  chemically synthesized
tttgatttgatttttgtata

SEQ ID NO: 87470 - DNA, 20 bp, Artificial Sequence
  chemically synthesized
catatacaaaaatcaaatca

SEQ ID NO: 87471 - DNA, 20 bp, Artificial Sequence
  chemically synthesized
atacaaaaatcaaatcaaag

SEQ ID NO: 87472 - DNA, 20 bp, Artificial Sequence
  chemically synthesized
aatcaaatcaaagtagatta

SEQ ID NO: 87473 - DNA, 20 bp, Artificial Sequence
  chemically synthesized
tagattaaagacttaaatgt

SEQ ID NO: 87474 - DNA, 20 bp, Artificial Sequence
  chemically synthesized
tggtttgaggtcttacattt

SEQ ID NO: 87475 - DNA, 20 bp, Artificial Sequence
  chemically synthesized
tgtagtagtttcatggtttg

SEQ ID NO: 87476 - DNA, 20 bp, Artificial Sequence
  chemically synthesized
ttgtagtagtttcatggttt

SEQ ID NO: 87477 - DNA, 20 bp, Artificial Sequence
  chemically synthesized
gttctcttgtagtagtttca

SEQ ID NO: 87478 - DNA, 20 bp, Artificial Sequence
  chemically synthesized
tcaaaccatgaaactactac

SEQ ID NO: 87479 - DNA, 20 bp, Artificial Sequence
  chemically synthesized
aaaccatgaaactactacaa

SEQ ID NO: 87480 - DNA, 20 bp, Artificial Sequence
  chemically synthesized
ttctcagtgttctcttgtag

SEQ ID NO: 87481 - DNA, 20 bp, Artificial Sequence
  chemically synthesized
tttttctcagtgttctcttg

SEQ ID NO: 87482 - DNA, 20 bp, Artificial Sequence
  chemically synthesized
aactactacaagagaacact

SEQ ID NO: 87483 - DNA, 20 bp, Artificial Sequence
  chemically synthesized
gacaccctggagatttttct

SEQ ID NO: 87484 - DNA, 20 bp, Artificial Sequence
  chemically synthesized
agaacactgagaaaaatctc

SEQ ID NO: 87485 - DNA, 20 bp, Artificial Sequence
  chemically synthesized
gaacactgagaaaaatctcc

SEQ ID NO: 87486 - DNA, 20 bp, Artificial Sequence
  chemically synthesized
aacactgagaaaaatctcca

SEQ ID NO: 87487 - DNA, 20 bp, Artificial Sequence
  chemically synthesized
catctgttgatgacaccctg

SEQ ID NO: 87488 - DNA, 20 bp, Artificial Sequence
  chemically synthesized
ttcatctgttgatgacaccc

SEQ ID NO: 87489 - DNA, 20 bp, Artificial Sequence
  chemically synthesized
aatctccagggtgtcatcaa

SEQ ID NO: 87490 - DNA, 20 bp, Artificial Sequence
  chemically synthesized
aataatttgaatttgtactt

SEQ ID NO: 87491 - DNA, 20 bp, Artificial Sequence
  chemically synthesized
tttaattttttttgtttctg

SEQ ID NO: 87492 - DNA, 20 bp, Artificial Sequence
  chemically synthesized
ttcagaaacaaaaaaaatta

SEQ ID NO: 87493 - DNA, 20 bp, Artificial Sequence
  chemically synthesized
caaaaaaaattaaagaacca

SEQ ID NO: 87494 - DNA, 20 bp, Artificial Sequence
  chemically synthesized
tagctcccattttaattctg

SEQ ID NO: 87495 - DNA, 20 bp, Artificial Sequence
  chemically synthesized
aaagaaccacagaattaaaa

SEQ ID NO: 87496 - DNA, 20 bp, Artificial Sequence
  chemically synthesized
aagaaccacagaattaaaat

SEQ ID NO: 87497 - DNA, 20 bp, Artificial Sequence
  chemically synthesized
gaaccacagaattaaaatgg

SEQ ID NO: 87498 - DNA, 20 bp, Artificial Sequence
  chemically synthesized
attctctctatttaaagaga

SEQ ID NO: 87499 - DNA, 20 bp, Artificial Sequence
  chemically synthesized
atgggagctatctctttaaa

SEQ ID NO: 87500 - DNA, 20 bp, Artificial Sequence
  chemically synthesized
tgggattctctctatttaaa

SEQ ID NO: 87501 - DNA, 20 bp, Artificial Sequence
  chemically synthesized
gggagctatctctttaaata

SEQ ID NO: 87502 - DNA, 20 bp, Artificial Sequence
  chemically synthesized
tttgggattctctctattta

SEQ ID NO: 87503 - DNA, 20 bp, Artificial Sequence
  chemically synthesized
gagctatctctttaaataga

SEQ ID NO: 87504 - DNA, 20 bp, Artificial Sequence
  chemically synthesized
tttaaatagagagaatccca

SEQ ID NO: 87505 - DNA, 20 bp, Artificial Sequence
  chemically synthesized
taaatagagagaatcccaaa

SEQ ID NO: 87506 - DNA, 20 bp, Artificial Sequence
  chemically synthesized
atagagagaatcccaaagag

SEQ ID NO: 87507 - DNA, 20 bp, Artificial Sequence
  chemically synthesized
aaaaatgttgacttctcttt

SEQ ID NO: 87508 - DNA, 20 bp, Artificial Sequence
  chemically synthesized
aaaaaatgttgacttctctt

SEQ ID NO: 87509 - DNA, 20 bp, Artificial Sequence
  chemically synthesized
aagtcaacattttttttttc

SEQ ID NO: 87510 - DNA, 20 bp, Artificial Sequence
  chemically synthesized
caacattttttttttctaga

SEQ ID NO: 87511 - DNA, 20 bp, Artificial Sequence
  chemically synthesized
aacattttttttttctagac

SEQ ID NO: 87512 - DNA, 20 bp, Artificial Sequence
  chemically synthesized
gttggagttcaagacctgtc

SEQ ID NO: 87513 - DNA, 20 bp, Artificial Sequence
  chemically synthesized
atgtttggatgttggagttc

SEQ ID NO: 87514 - DNA, 20 bp, Artificial Sequence
  chemically synthesized
ttaattatgtttggatgttg

SEQ ID NO: 87515 - DNA, 20 bp, Artificial Sequence
  chemically synthesized
tgttaattatgtttggatgt

SEQ ID NO: 87516 - DNA, 20 bp, Artificial Sequence
  chemically synthesized
tttagaatgttaattatgtt

SEQ ID NO: 87517 - DNA, 20 bp, Artificial Sequence
  chemically synthesized
aaacataattaacattctaa

SEQ ID NO: 87518 - DNA, 20 bp, Artificial Sequence
  chemically synthesized
acataattaacattctaaaa

SEQ ID NO: 87519 - DNA, 20 bp, Artificial Sequence
  chemically synthesized
ataattaacattctaaaaga

SEQ ID NO: 87520 - DNA, 20 bp, Artificial Sequence
  chemically synthesized
aattaacattctaaaagaga

SEQ ID NO: 87521 - DNA, 20 bp, Artificial Sequence
  chemically synthesized
gaccttctttctctctcttt

SEQ ID NO: 87522 - DNA, 20 bp, Artificial Sequence
  chemically synthesized
aacattctaaaagagagaga

SEQ ID NO: 87523 - DNA, 20 bp, Artificial Sequence
  chemically synthesized
attctaaaagagagagaaag

SEQ ID NO: 87524 - DNA, 20 bp, Artificial Sequence
  chemically synthesized
ttctaaaagagagagaaaga

SEQ ID NO: 87525 - DNA, 20 bp, Artificial Sequence
  chemically synthesized
aaaagagagagaaagaaggt

SEQ ID NO: 87526 - DNA, 20 bp, Artificial Sequence
  chemically synthesized
aagagagagaaagaaggtca

SEQ ID NO: 87527 - DNA, 20 bp, Artificial Sequence
  chemically synthesized
gtcagagatattcaatgtcc

SEQ ID NO: 87528 - DNA, 20 bp, Artificial Sequence
  chemically synthesized
gatattcaatgtccaagttg

SEQ ID NO: 87529 - DNA, 20 bp, Artificial Sequence
  chemically synthesized
tttgagagaaaactgcaact

SEQ ID NO: 87530 - DNA, 20 bp, Artificial Sequence
  chemically synthesized
caagttgcagttttctctca

SEQ ID NO: 87531 - DNA, 20 bp, Artificial Sequence
  chemically synthesized
aagttgcagttttctctcaa

SEQ ID NO: 87532 - DNA, 20 bp, Artificial Sequence
  chemically synthesized
ttgcagttttctctcaaagg

SEQ ID NO: 87533 - DNA, 20 bp, Artificial Sequence
  chemically synthesized
gaggtggggtctacctttga

SEQ ID NO: 87534 - DNA, 20 bp, Artificial Sequence
  chemically synthesized
aagaggtggggtctaccttt

SEQ ID NO: 87535 - DNA, 20 bp, Artificial Sequence
  chemically synthesized
aagaagggcaaaaagaggtg

SEQ ID NO: 87536 - DNA, 20 bp, Artificial Sequence
  chemically synthesized
aaagaagggcaaaaagaggt

SEQ ID NO: 87537 - DNA, 20 bp, Artificial Sequence
  chemically synthesized
aaaagaagggcaaaaagagg

SEQ ID NO: 87538 - DNA, 20 bp, Artificial Sequence
  chemically synthesized
aacaaaagaagggcaaaaag

SEQ ID NO: 87539 - DNA, 20 bp, Artificial Sequence
  chemically synthesized
gaacaaaagaagggcaaaaa

SEQ ID NO: 87540 - DNA, 20 bp, Artificial Sequence
  chemically synthesized
gagaacaaaagaagggcaaa

SEQ ID NO: 87541 - DNA, 20 bp, Artificial Sequence
  chemically synthesized
tataatggagaacaaaagaa

SEQ ID NO: 87542 - DNA, 20 bp, Artificial Sequence
  chemically synthesized
gtataatggagaacaaaaga

SEQ ID NO: 87543 - DNA, 20 bp, Artificial Sequence
  chemically synthesized
tgtataatggagaacaaaag

SEQ ID NO: 87544 - DNA, 20 bp, Artificial Sequence
  chemically synthesized
ctttgtataatggagaacaa

SEQ ID NO: 87545 - DNA, 20 bp, Artificial Sequence
  chemically synthesized
gttagtgtctttgtataatg

SEQ ID NO: 87546 - DNA, 20 bp, Artificial Sequence
  chemically synthesized
cttttgttctccattataca

SEQ ID NO: 87547 - DNA, 20 bp, Artificial Sequence
  chemically synthesized
tagttagtgtctttgtataa

SEQ ID NO: 87548 - DNA, 20 bp, Artificial Sequence
  chemically synthesized
ctattagaggttagaatagt

SEQ ID NO: 87549 - DNA, 20 bp, Artificial Sequence
  chemically synthesized
cttgctattagaggttagaa

SEQ ID NO: 87550 - DNA, 20 bp, Artificial Sequence
  chemically synthesized
gagtgcttgctattagaggt

SEQ ID NO: 87551 - DNA, 20 bp, Artificial Sequence
  chemically synthesized
ctaactattctaacctctaa

SEQ ID NO: 87552 - DNA, 20 bp, Artificial Sequence
  chemically synthesized
tggggagtgcttgctattag

SEQ ID NO: 87553 - DNA, 20 bp, Artificial Sequence
  chemically synthesized
ctattctaacctctaatagc

SEQ ID NO: 87554 - DNA, 20 bp, Artificial Sequence
  chemically synthesized
ttggggagtgcttgctatta

SEQ ID NO: 87555 - DNA, 20 bp, Artificial Sequence
  chemically synthesized
tattggggagtgcttgctat

SEQ ID NO: 87556 - DNA, 20 bp, Artificial Sequence
  chemically synthesized
taatagcaagcactccccaa

SEQ ID NO: 87557 - DNA, 20 bp, Artificial Sequence
  chemically synthesized
gaagccataaatctattggg

SEQ ID NO: 87558 - DNA, 20 bp, Artificial Sequence
  chemically synthesized
tagaagccataaatctattg

SEQ ID NO: 87559 - DNA, 20 bp, Artificial Sequence
  chemically synthesized
gtagaagccataaatctatt

SEQ ID NO: 87560 - DNA, 20 bp, Artificial Sequence
  chemically synthesized
tgtagaagccataaatctat

SEQ ID NO: 87561 - DNA, 20 bp, Artificial Sequence
  chemically synthesized
agcactccccaatagattta

SEQ ID NO: 87562 - DNA, 20 bp, Artificial Sequence
  chemically synthesized
caatagatttatggcttcta

SEQ ID NO: 87563 - DNA, 20 bp, Artificial Sequence
  chemically synthesized
tgacattatatagtctgtag

SEQ ID NO: 87564 - DNA, 20 bp, Artificial Sequence
  chemically synthesized
cactgacattatatagtctg

SEQ ID NO: 87565 - DNA, 20 bp, Artificial Sequence
  chemically synthesized
gcaaggacactgacattata

SEQ ID NO: 87566 - DNA, 20 bp, Artificial Sequence
  chemically synthesized
ttctacagactatataatgt

SEQ ID NO: 87567 - DNA, 20 bp, Artificial Sequence
  chemically synthesized
attgtgaacattaagaggca

SEQ ID NO: 87568 - DNA, 20 bp, Artificial Sequence
  chemically synthesized
aattgtgaacattaagaggc

SEQ ID NO: 87569 - DNA, 20 bp, Artificial Sequence
  chemically synthesized
atacaattgtgaacattaag

SEQ ID NO: 87570 - DNA, 20 bp, Artificial Sequence
  chemically synthesized
tatacaattgtgaacattaa

SEQ ID NO: 87571 - DNA, 20 bp, Artificial Sequence
  chemically synthesized
tttatacaattgtgaacatt

SEQ ID NO: 87572 - DNA, 20 bp, Artificial Sequence
  chemically synthesized
tgtgagatttttatatttgg

SEQ ID NO: 87573 - DNA, 20 bp, Artificial Sequence
  chemically synthesized
ttatgtgagatttttatatt

SEQ ID NO: 87574 - DNA, 20 bp, Artificial Sequence
  chemically synthesized
cagcagaatttacattatgt

SEQ ID NO: 87575 - DNA, 20 bp, Artificial Sequence
  chemically synthesized
tgttatcaacataatttcag

SEQ ID NO: 87576 - DNA, 20 bp, Artificial Sequence
  chemically synthesized
atatgttatcaacataattt

SEQ ID NO: 87577 - DNA, 20 bp, Artificial Sequence
  chemically synthesized
aacatattatgtgattttca

SEQ ID NO: 87578 - DNA, 20 bp, Artificial Sequence
  chemically synthesized
tatgtgattttcatagttaa

SEQ ID NO: 87579 - DNA, 20 bp, Artificial Sequence
  chemically synthesized
taatagtatatacaatgatc

SEQ ID NO: 87580 - DNA, 20 bp, Artificial Sequence
  chemically synthesized
ctactactagattatttttc

SEQ ID NO: 87581 - DNA, 20 bp, Artificial Sequence
  chemically synthesized
aatgatctggaaaaataatc

SEQ ID NO: 87582 - DNA, 20 bp, Artificial Sequence
  chemically synthesized
gatctggaaaaataatctag

SEQ ID NO: 87583 - DNA, 20 bp, Artificial Sequence
  chemically synthesized
ctggaaaaataatctagtag

SEQ ID NO: 87584 - DNA, 20 bp, Artificial Sequence
  chemically synthesized
atttcaatttagtctactac

SEQ ID NO: 87585 - DNA, 20 bp, Artificial Sequence
  chemically synthesized
tatatatgaagatttcaatt

SEQ ID NO: 87586 - DNA, 20 bp, Artificial Sequence
  chemically synthesized
ttacataagaaatatatatg

SEQ ID NO: 87587 - DNA, 20 bp, Artificial Sequence
  chemically synthesized
tcaagtcaattgttttacat

SEQ ID NO: 87588 - DNA, 20 bp, Artificial Sequence
  chemically synthesized
taataacttgagaagtggtc

SEQ ID NO: 87589 - DNA, 20 bp, Artificial Sequence
  chemically synthesized
aattgacttgaccacttctc

SEQ ID NO: 87590 - DNA, 20 bp, Artificial Sequence
  chemically synthesized
aatattaataacttgagaag

SEQ ID NO: 87591 - DNA, 20 bp, Artificial Sequence
  chemically synthesized
tagaatattaataacttgag

SEQ ID NO: 87592 - DNA, 20 bp, Artificial Sequence
  chemically synthesized
ttttagaatattaataactt

SEQ ID NO: 87593 - DNA, 20 bp, Artificial Sequence
  chemically synthesized
aatccttgcatttttaattt

SEQ ID NO: 87594 - DNA, 20 bp, Artificial Sequence
  chemically synthesized
tattctaaaattaaaaatgc

SEQ ID NO: 87595 - DNA, 20 bp, Artificial Sequence
  chemically synthesized
attctaaaattaaaaatgca

SEQ ID NO: 87596 - DNA, 20 bp, Artificial Sequence
  chemically synthesized
aattaaaaatgcaaggattg

SEQ ID NO: 87597 - DNA, 20 bp, Artificial Sequence
  chemically synthesized
aaatgcaaggattgtggata

SEQ ID NO: 87598 - DNA, 20 bp, Artificial Sequence
  chemically synthesized
ggattgtggatatggaattt

SEQ ID NO: 87599 - DNA, 20 bp, Artificial Sequence
  chemically synthesized
agatggtaattagtcaaaga

SEQ ID NO: 87600 - DNA, 20 bp, Artificial Sequence
  chemically synthesized
attaagatggtaattagtca

SEQ ID NO: 87601 - DNA, 20 bp, Artificial Sequence
  chemically synthesized
tccaatattaagatggtaat

SEQ ID NO: 87602 - DNA, 20 bp, Artificial Sequence
  chemically synthesized
gacgttatccaatattaaga

SEQ ID NO: 87603 - DNA, 20 bp, Artificial Sequence
  chemically synthesized
actaattaccatcttaatat

SEQ ID NO: 87604 - DNA, 20 bp, Artificial Sequence
  chemically synthesized
tgatgacgttatccaatatt

SEQ ID NO: 87605 - DNA, 20 bp, Artificial Sequence
  chemically synthesized
ttaatattggataacgtcat

SEQ ID NO: 87606 - DNA, 20 bp, Artificial Sequence
  chemically synthesized
cacacacatgcatacacaca

SEQ ID NO: 87607 - DNA, 20 bp, Artificial Sequence
  chemically synthesized
atgcatgtgtgtgtacattt

SEQ ID NO: 87608 - DNA, 20 bp, Artificial Sequence
  chemically synthesized
tgctttaagtgggagaaaaa

SEQ ID NO: 87609 - DNA, 20 bp, Artificial Sequence
  chemically synthesized
actgctttaagtgggagaaa

SEQ ID NO: 87610 - DNA, 20 bp, Artificial Sequence
  chemically synthesized
ttctctttttctcccactta

SEQ ID NO: 87611 - DNA, 20 bp, Artificial Sequence
  chemically synthesized
acattaactgctttaagtgg

SEQ ID NO: 87612 - DNA, 20 bp, Artificial Sequence
  chemically synthesized
aaacattaactgctttaagt

SEQ ID NO: 87613 - DNA, 20 bp, Artificial Sequence
  chemically synthesized
tctttttctcccacttaaag

SEQ ID NO: 87614 - DNA, 20 bp, Artificial Sequence
  chemically synthesized
aaaacattaactgctttaag

SEQ ID NO: 87615 - DNA, 20 bp, Artificial Sequence
  chemically synthesized
acgaaaacattaactgcttt

SEQ ID NO: 87616 - DNA, 20 bp, Artificial Sequence
  chemically synthesized
aatgttttcgttttgtttga

SEQ ID NO: 87617 - DNA, 20 bp, Artificial Sequence
  chemically synthesized
taagtagtcagtgataattt

SEQ ID NO: 87618 - DNA, 20 bp, Artificial Sequence
  chemically synthesized
aaggaagaaaagtaagtagt

SEQ ID NO: 87619 - DNA, 20 bp, Artificial Sequence
  chemically synthesized
gtataaggaagaaaagtaag

SEQ ID NO: 87620 - DNA, 20 bp, Artificial Sequence
  chemically synthesized
gaggtataaggaagaaaagt

SEQ ID NO: 87621 - DNA, 20 bp, Artificial Sequence
  chemically synthesized
ccaagaggtataaggaagaa

SEQ ID NO: 87622 - DNA, 20 bp, Artificial Sequence
  chemically synthesized
gttggccaagaggtataagg

SEQ ID NO: 87623 - DNA, 20 bp, Artificial Sequence
  chemically synthesized
catgttggccaagaggtata

SEQ ID NO: 87624 - DNA, 20 bp, Artificial Sequence
  chemically synthesized
acatgttggccaagaggtat

SEQ ID NO: 87625 - DNA, 20 bp, Artificial Sequence
  chemically synthesized
cttttcttccttatacctct

SEQ ID NO: 87626 - DNA, 20 bp, Artificial Sequence
  chemically synthesized
tacatcacatgttggccaag

SEQ ID NO: 87627 - DNA, 20 bp, Artificial Sequence
  chemically synthesized
ttacatcacatgttggccaa

SEQ ID NO: 87628 - DNA, 20 bp, Artificial Sequence
  chemically synthesized
tattacatcacatgttggcc

SEQ ID NO: 87629 - DNA, 20 bp, Artificial Sequence
  chemically synthesized
tgcattattacatcacatgt

SEQ ID NO: 87630 - DNA, 20 bp, Artificial Sequence
  chemically synthesized
atgtgatgtaataatgcatg

SEQ ID NO: 87631 - DNA, 20 bp, Artificial Sequence
  chemically synthesized
taataatgcatgtggaatga

SEQ ID NO: 87632 - DNA, 20 bp, Artificial Sequence
  chemically synthesized
ctcataatttaattcaagaa

SEQ ID NO: 87633 - DNA, 20 bp, Artificial Sequence
  chemically synthesized
cctatctcataatttaattc

SEQ ID NO: 87634 - DNA, 20 bp, Artificial Sequence
  chemically synthesized
cttttcttgaattaaattat

SEQ ID NO: 87635 - DNA, 20 bp, Artificial Sequence
  chemically synthesized
tcttgaattaaattatgaga

SEQ ID NO: 87636 - DNA, 20 bp, Artificial Sequence
  chemically synthesized
cttgaattaaattatgagat

SEQ ID NO: 87637 - DNA, 20 bp, Artificial Sequence
  chemically synthesized
ttaagatgtctttgagagaa

SEQ ID NO: 87638 - DNA, 20 bp, Artificial Sequence
  chemically synthesized
attaaatttcttttctctca

SEQ ID NO: 87639 - DNA, 20 bp, Artificial Sequence
  chemically synthesized
agtaattaagatgtctttga

SEQ ID NO: 87640 - DNA, 20 bp, Artificial Sequence
  chemically synthesized
aaagtaattaagatgtcttt

SEQ ID NO: 87641 - DNA, 20 bp, Artificial Sequence
  chemically synthesized
aggcattatataaagtaatt

SEQ ID NO: 87642 - DNA, 20 bp, Artificial Sequence
  chemically synthesized
gatttaaaaggcattatata

SEQ ID NO: 87643 - DNA, 20 bp, Artificial Sequence
  chemically synthesized
atagaactgattgatttaaa

SEQ ID NO: 87644 - DNA, 20 bp, Artificial Sequence
  chemically synthesized
aatagaactgattgatttaa

SEQ ID NO: 87645 - DNA, 20 bp, Artificial Sequence
  chemically synthesized
ataatgccttttaaatcaat

SEQ ID NO: 87646 - DNA, 20 bp, Artificial Sequence
  chemically synthesized
cttggttttcttaattaaaa

SEQ ID NO: 87647 - DNA, 20 bp, Artificial Sequence
  chemically synthesized
caatcagttctattttaatt

SEQ ID NO: 87648 - DNA, 20 bp, Artificial Sequence
  chemically synthesized
ctattttaattaagaaaacc

SEQ ID NO: 87649 - DNA, 20 bp, Artificial Sequence
  chemically synthesized
tattttaattaagaaaacca

SEQ ID NO: 87650 - DNA, 20 bp, Artificial Sequence
  chemically synthesized
tttaattaagaaaaccaagg

SEQ ID NO: 87651 - DNA, 20 bp, Artificial Sequence
  chemically synthesized
attgtttaatttttctacct

SEQ ID NO: 87652 - DNA, 20 bp, Artificial Sequence
  chemically synthesized
agaaaaattaaacaattttc

SEQ ID NO: 87653 - DNA, 20 bp, Artificial Sequence
  chemically synthesized
gaaaaattaaacaattttcc

SEQ ID NO: 87654 - DNA, 20 bp, Artificial Sequence
  chemically synthesized
gcaatcacactttatgaacc

SEQ ID NO: 87655 - DNA, 20 bp, Artificial Sequence
  chemically synthesized
aacaattttccaggttcata

SEQ ID NO: 87656 - DNA, 20 bp, Artificial Sequence
  chemically synthesized
aggttcataaagtgtgattg

SEQ ID NO: 87657 - DNA, 20 bp, Artificial Sequence
  chemically synthesized
aagtgtgattgcagaactaa

SEQ ID NO: 87658 - DNA, 20 bp, Artificial Sequence
  chemically synthesized
atcgtacaattttattcttt

SEQ ID NO: 87659 - DNA, 20 bp, Artificial Sequence
  chemically synthesized
gaataaaattgtacgattgc

SEQ ID NO: 87660 - DNA, 20 bp, Artificial Sequence
  chemically synthesized
ataaaattgtacgattgcaa

SEQ ID NO: 87661 - DNA, 20 bp, Artificial Sequence
  chemically synthesized
ttgtacgattgcaagagaac

SEQ ID NO: 87662 - DNA, 20 bp, Artificial Sequence
  chemically synthesized
tacgattgcaagagaactgg

SEQ ID NO: 87663 - DNA, 20 bp, Artificial Sequence
  chemically synthesized
cgattgcaagagaactggaa

SEQ ID NO: 87664 - DNA, 20 bp, Artificial Sequence
  chemically synthesized
gaaatatggacagtctcttc

SEQ ID NO: 87665 - DNA, 20 bp, Artificial Sequence
  chemically synthesized
agtttgaccagaaatatgga

SEQ ID NO: 87666 - DNA, 20 bp, Artificial Sequence
  chemically synthesized
gaagagactgtccatatttc

SEQ ID NO: 87667 - DNA, 20 bp, Artificial Sequence
  chemically synthesized
gaagagtttgaccagaaata

SEQ ID NO: 87668 - DNA, 20 bp, Artificial Sequence
  chemically synthesized
actgaaatgaagagtttgac

SEQ ID NO: 87669 - DNA, 20 bp, Artificial Sequence
  chemically synthesized
tctggtcaaactcttcattt

SEQ ID NO: 87670 - DNA, 20 bp, Artificial Sequence
  chemically synthesized
ttctccttcactgaaatgaa

SEQ ID NO: 87671 - DNA, 20 bp, Artificial Sequence
  chemically synthesized
ttttctccttcactgaaatg

SEQ ID NO: 87672 - DNA, 20 bp, Artificial Sequence
  chemically synthesized
tcaaactcttcatttcagtg

SEQ ID NO: 87673 - DNA, 20 bp, Artificial Sequence
  chemically synthesized
caaactcttcatttcagtga

SEQ ID NO: 87674 - DNA, 20 bp, Artificial Sequence
  chemically synthesized
aactcttcatttcagtgaag

SEQ ID NO: 87675 - DNA, 20 bp, Artificial Sequence
  chemically synthesized
ttcagtgaaggagaaaattg

SEQ ID NO: 87676 - DNA, 20 bp, Artificial Sequence
  chemically synthesized
aaggagaaaattgaagtctg

SEQ ID NO: 87677 - DNA, 20 bp, Artificial Sequence
  chemically synthesized
gagaaaattgaagtctgaag

SEQ ID NO: 87678 - DNA, 20 bp, Artificial Sequence
  chemically synthesized
atcaagtcacttaactgctt

SEQ ID NO: 87679 - DNA, 20 bp, Artificial Sequence
  chemically synthesized
aattgaagtctgaagcagtt

SEQ ID NO: 87680 - DNA, 20 bp, Artificial Sequence
  chemically synthesized
agcagttaagtgacttgatc

SEQ ID NO: 87681 - DNA, 20 bp, Artificial Sequence
  chemically synthesized
cttagcatataatcttgatc

SEQ ID NO: 87682 - DNA, 20 bp, Artificial Sequence
  chemically synthesized
cttgatcaagattatatgct

SEQ ID NO: 87683 - DNA, 20 bp, Artificial Sequence
  chemically synthesized
atcaagattatatgctaaga

SEQ ID NO: 87684 - DNA, 20 bp, Artificial Sequence
  chemically synthesized
agattatatgctaagacagt

SEQ ID NO: 87685 - DNA, 20 bp, Artificial Sequence
  chemically synthesized
tattctgtcactaactgtct

SEQ ID NO: 87686 - DNA, 20 bp, Artificial Sequence
  chemically synthesized
tatgctaagacagttagtga

SEQ ID NO: 87687 - DNA, 20 bp, Artificial Sequence
  chemically synthesized
taagacagttagtgacagaa

SEQ ID NO: 87688 - DNA, 20 bp, Artificial Sequence
  chemically synthesized
cagttagtgacagaatagaa

SEQ ID NO: 87689 - DNA, 20 bp, Artificial Sequence
  chemically synthesized
ttagtgacagaatagaacag

SEQ ID NO: 87690 - DNA, 20 bp, Artificial Sequence
  chemically synthesized
tagtgacagaatagaacaga

SEQ ID NO: 87691 - DNA, 20 bp, Artificial Sequence
  chemically synthesized
agtgacagaatagaacagaa

SEQ ID NO: 87692 - DNA, 20 bp, Artificial Sequence
  chemically synthesized
gaatagaacagaagggaaac

SEQ ID NO: 87693 - DNA, 20 bp, Artificial Sequence
  chemically synthesized
aatagaacagaagggaaact

SEQ ID NO: 87694 - DNA, 20 bp, Artificial Sequence
  chemically synthesized
agaagggaaactgggttgcc

SEQ ID NO: 87695 - DNA, 20 bp, Artificial Sequence
  chemically synthesized
gggccagcagctgggcaacc

SEQ ID NO: 87696 - DNA, 20 bp, Artificial Sequence
  chemically synthesized
aaactgggttgcccagctgc

SEQ ID NO: 87697 - DNA, 20 bp, Artificial Sequence
  chemically synthesized
aaagacatgggccagcagct

SEQ ID NO: 87698 - DNA, 20 bp, Artificial Sequence
  chemically synthesized
gaaagacatgggccagcagc

SEQ ID NO: 87699 - DNA, 20 bp, Artificial Sequence
  chemically synthesized
agtagaaagacatgggccag

SEQ ID NO: 87700 - DNA, 20 bp, Artificial Sequence
  chemically synthesized
tagagtagaaagacatgggc

SEQ ID NO: 87701 - DNA, 20 bp, Artificial Sequence
  chemically synthesized
atggtagagtagaaagacat

SEQ ID NO: 87702 - DNA, 20 bp, Artificial Sequence
  chemically synthesized
tatggtagagtagaaagaca

SEQ ID NO: 87703 - DNA, 20 bp, Artificial Sequence
  chemically synthesized
tgtgagtatggtagagtaga

SEQ ID NO: 87704 - DNA, 20 bp, Artificial Sequence
  chemically synthesized
aatatgtgagtatggtagag

SEQ ID NO: 87705 - DNA, 20 bp, Artificial Sequence
  chemically synthesized
cgaaatatgtgagtatggta

SEQ ID NO: 87706 - DNA, 20 bp, Artificial Sequence
  chemically synthesized
ctcgaaatatgtgagtatgg

SEQ ID NO: 87707 - DNA, 20 bp, Artificial Sequence
  chemically synthesized
aaactcgaaatatgtgagta

SEQ ID NO: 87708 - DNA, 20 bp, Artificial Sequence
  chemically synthesized
atttcaaactcgaaatatgt

SEQ ID NO: 87709 - DNA, 20 bp, Artificial Sequence
  chemically synthesized
ctaccatactcacatatttc

SEQ ID NO: 87710 - DNA, 20 bp, Artificial Sequence
  chemically synthesized
tgaaatttttgtattcatat

SEQ ID NO: 87711 - DNA, 20 bp, Artificial Sequence
  chemically synthesized
atttttgtattcatataagt

SEQ ID NO: 87712 - DNA, 20 bp, Artificial Sequence
  chemically synthesized
ttgtattcatataagttagc

SEQ ID NO: 87713 - DNA, 20 bp, Artificial Sequence
  chemically synthesized
gtattcatataagttagctg

SEQ ID NO: 87714 - DNA, 20 bp, Artificial Sequence
  chemically synthesized
tattcatataagttagctgg

SEQ ID NO: 87715 - DNA, 20 bp, Artificial Sequence
  chemically synthesized
tcatataagttagctggagg

SEQ ID NO: 87716 - DNA, 20 bp, Artificial Sequence
  chemically synthesized
agggctatgcttactgcctc

SEQ ID NO: 87717 - DNA, 20 bp, Artificial Sequence
  chemically synthesized
ataagttagctggaggcagt

SEQ ID NO: 87718 - DNA, 20 bp, Artificial Sequence
  chemically synthesized
ttagctggaggcagtaagca

SEQ ID NO: 87719 - DNA, 20 bp, Artificial Sequence
  chemically synthesized
gcagtaagcatagccctata

SEQ ID NO: 87720 - DNA, 20 bp, Artificial Sequence
  chemically synthesized
tgttcaagagttgctttata

SEQ ID NO: 87721 - DNA, 20 bp, Artificial Sequence
  chemically synthesized
gtgttcaagagttgctttat

SEQ ID NO: 87722 - DNA, 20 bp, Artificial Sequence
  chemically synthesized
agtgttcaagagttgcttta

SEQ ID NO: 87723 - DNA, 20 bp, Artificial Sequence
  chemically synthesized
atgtttcttcaagtgttcaa

SEQ ID NO: 87724 - DNA, 20 bp, Artificial Sequence
  chemically synthesized
acatgtttcttcaagtgttc

SEQ ID NO: 87725 - DNA, 20 bp, Artificial Sequence
  chemically synthesized
aagcaactcttgaacacttg

SEQ ID NO: 87726 - DNA, 20 bp, Artificial Sequence
  chemically synthesized
acttgataacatgtttcttc

SEQ ID NO: 87727 - DNA, 20 bp, Artificial Sequence
  chemically synthesized
acttgaagaaacatgttatc

SEQ ID NO: 87728 - DNA, 20 bp, Artificial Sequence
  chemically synthesized
acatgttatcaagtgtaaat

SEQ ID NO: 87729 - DNA, 20 bp, Artificial Sequence
  chemically synthesized
ttatcaagtgtaaattagaa

SEQ ID NO: 87730 - DNA, 20 bp, Artificial Sequence
  chemically synthesized
agtgtaaattagaatagtat

SEQ ID NO: 87731 - DNA, 20 bp, Artificial Sequence
  chemically synthesized
gtgtaaattagaatagtatt

SEQ ID NO: 87732 - DNA, 20 bp, Artificial Sequence
  chemically synthesized
taaattagaatagtattggg

SEQ ID NO: 87733 - DNA, 20 bp, Artificial Sequence
  chemically synthesized
agaatagtattgggaagacc

SEQ ID NO: 87734 - DNA, 20 bp, Artificial Sequence
  chemically synthesized
tagtattgggaagacctagt

SEQ ID NO: 87735 - DNA, 20 bp, Artificial Sequence
  chemically synthesized
agtattgggaagacctagtg

SEQ ID NO: 87736 - DNA, 20 bp, Artificial Sequence
  chemically synthesized
tttctggctgtttcctcact

SEQ ID NO: 87737 - DNA, 20 bp, Artificial Sequence
  chemically synthesized
ttttctggctgtttcctcac

SEQ ID NO: 87738 - DNA, 20 bp, Artificial Sequence
  chemically synthesized
gggaagacctagtgaggaaa

SEQ ID NO: 87739 - DNA, 20 bp, Artificial Sequence
  chemically synthesized
agacctagtgaggaaacagc

SEQ ID NO: 87740 - DNA, 20 bp, Artificial Sequence
  chemically synthesized
tagtgaggaaacagccagaa

SEQ ID NO: 87741 - DNA, 20 bp, Artificial Sequence
  chemically synthesized
ataacaaatcttttcttttc

SEQ ID NO: 87742 - DNA, 20 bp, Artificial Sequence
  chemically synthesized
aggaaacagccagaaaagaa

SEQ ID NO: 87743 - DNA, 20 bp, Artificial Sequence
  chemically synthesized
agaaaagaaaagatttgtta

SEQ ID NO: 87744 - DNA, 20 bp, Artificial Sequence
  chemically synthesized
atggaatatgaatcaaaatt

SEQ ID NO: 87745 - DNA, 20 bp, Artificial Sequence
  chemically synthesized
ggaatatgaatcaaaatttg

SEQ ID NO: 87746 - DNA, 20 bp, Artificial Sequence
  chemically synthesized
tgaatcaaaatttggagaat

SEQ ID NO: 87747 - DNA, 20 bp, Artificial Sequence
  chemically synthesized
aatcaaaatttggagaataa

SEQ ID NO: 87748 - DNA, 20 bp, Artificial Sequence
  chemically synthesized
atcaaaatttggagaataag

SEQ ID NO: 87749 - DNA, 20 bp, Artificial Sequence
  chemically synthesized
aaatttggagaataagagga

SEQ ID NO: 87750 - DNA, 20 bp, Artificial Sequence
  chemically synthesized
atttggagaataagaggaaa

SEQ ID NO: 87751 - DNA, 20 bp, Artificial Sequence
  chemically synthesized
aagaggaaagagaatgttgc

SEQ ID NO: 87752 - DNA, 20 bp, Artificial Sequence
  chemically synthesized
aaagagaatgttgcaagtgt

SEQ ID NO: 87753 - DNA, 20 bp, Artificial Sequence
  chemically synthesized
aatgttgcaagtgtgagaac

SEQ ID NO: 87754 - DNA, 20 bp, Artificial Sequence
  chemically synthesized
ttgcaagtgtgagaaccagc

SEQ ID NO: 87755 - DNA, 20 bp, Artificial Sequence
  chemically synthesized
tgcaagtgtgagaaccagca

SEQ ID NO: 87756 - DNA, 20 bp, Artificial Sequence
  chemically synthesized
gcaagtgtgagaaccagcaa

SEQ ID NO: 87757 - DNA, 20 bp, Artificial Sequence
  chemically synthesized
atatgagtatgtacccttgc

SEQ ID NO: 87758 - DNA, 20 bp, Artificial Sequence
  chemically synthesized
agcaagggtacatactcata

SEQ ID NO: 87759 - DNA, 20 bp, Artificial Sequence
  chemically synthesized
gcaagggtacatactcatat

SEQ ID NO: 87760 - DNA, 20 bp, Artificial Sequence
  chemically synthesized
aagggtacatactcatatgg

SEQ ID NO: 87761 - DNA, 20 bp, Artificial Sequence
  chemically synthesized
atttcctcactctcccatat

SEQ ID NO: 87762 - DNA, 20 bp, Artificial Sequence
  chemically synthesized
gggtacatactcatatggga

SEQ ID NO: 87763 - DNA, 20 bp, Artificial Sequence
  chemically synthesized
acatactcatatgggagagt

SEQ ID NO: 87764 - DNA, 20 bp, Artificial Sequence
  chemically synthesized
catactcatatgggagagtg

SEQ ID NO: 87765 - DNA, 20 bp, Artificial Sequence
  chemically synthesized
tgggagagtgaggaaattgt

SEQ ID NO: 87766 - DNA, 20 bp, Artificial Sequence
  chemically synthesized
ggagagtgaggaaattgttg

SEQ ID NO: 87767 - DNA, 20 bp, Artificial Sequence
  chemically synthesized
agagtgaggaaattgttgga

SEQ ID NO: 87768 - DNA, 20 bp, Artificial Sequence
  chemically synthesized
gtgaggaaattgttggagag

SEQ ID NO: 87769 - DNA, 20 bp, Artificial Sequence
  chemically synthesized
tgaggaaattgttggagagt

SEQ ID NO: 87770 - DNA, 20 bp, Artificial Sequence
  chemically synthesized
aaattgttggagagtaggaa

SEQ ID NO: 87771 - DNA, 20 bp, Artificial Sequence
  chemically synthesized
aattgttggagagtaggaat

SEQ ID NO: 87772 - DNA, 20 bp, Artificial Sequence
  chemically synthesized
attgttggagagtaggaatg

SEQ ID NO: 87773 - DNA, 20 bp, Artificial Sequence
  chemically synthesized
ttggagagtaggaatggggt

SEQ ID NO: 87774 - DNA, 20 bp, Artificial Sequence
  chemically synthesized
gtaggaatggggttagaaaa

SEQ ID NO: 87775 - DNA, 20 bp, Artificial Sequence
  chemically synthesized
atagaatttattgattctct

SEQ ID NO: 87776 - DNA, 20 bp, Artificial Sequence
  chemically synthesized
atttattgattctcttggct

SEQ ID NO: 87777 - DNA, 20 bp, Artificial Sequence
  chemically synthesized
acatagattctctgagccaa

SEQ ID NO: 87778 - DNA, 20 bp, Artificial Sequence
  chemically synthesized
ttattgattctcttggctca

SEQ ID NO: 87779 - DNA, 20 bp, Artificial Sequence
  chemically synthesized
caacatagattctctgagcc

SEQ ID NO: 87780 - DNA, 20 bp, Artificial Sequence
  chemically synthesized
ctccccaacatagattctct

SEQ ID NO: 87781 - DNA, 20 bp, Artificial Sequence
  chemically synthesized
ttggctcagagaatctatgt

SEQ ID NO: 87782 - DNA, 20 bp, Artificial Sequence
  chemically synthesized
tggctcagagaatctatgtt

SEQ ID NO: 87783 - DNA, 20 bp, Artificial Sequence
  chemically synthesized
ggctcagagaatctatgttg

SEQ ID NO: 87784 - DNA, 20 bp, Artificial Sequence
  chemically synthesized
ctcagagaatctatgttggg

SEQ ID NO: 87785 - DNA, 20 bp, Artificial Sequence
  chemically synthesized
cattctgttactccccaaca

SEQ ID NO: 87786 - DNA, 20 bp, Artificial Sequence
  chemically synthesized
gaatctatgttggggagtaa

SEQ ID NO: 87787 - DNA, 20 bp, Artificial Sequence
  chemically synthesized
gggagtaacagaatgatgct

SEQ ID NO: 87788 - DNA, 20 bp, Artificial Sequence
  chemically synthesized
gtaacagaatgatgcttggt

SEQ ID NO: 87789 - DNA, 20 bp, Artificial Sequence
  chemically synthesized
cagaatgatgcttggtgaga

SEQ ID NO: 87790 - DNA, 20 bp, Artificial Sequence
  chemically synthesized
cctccagttcctttctcacc

SEQ ID NO: 87791 - DNA, 20 bp, Artificial Sequence
  chemically synthesized
agaatgatgcttggtgagaa

SEQ ID NO: 87792 - DNA, 20 bp, Artificial Sequence
  chemically synthesized
atgcttggtgagaaaggaac

SEQ ID NO: 87793 - DNA, 20 bp, Artificial Sequence
  chemically synthesized
gcttggtgagaaaggaactg

SEQ ID NO: 87794 - DNA, 20 bp, Artificial Sequence
  chemically synthesized
cttggtgagaaaggaactgg

SEQ ID NO: 87795 - DNA, 20 bp, Artificial Sequence
  chemically synthesized
ggtgagaaaggaactggagg

SEQ ID NO: 87796 - DNA, 20 bp, Artificial Sequence
  chemically synthesized
ctcttttctttttctgcctc

SEQ ID NO: 87797 - DNA, 20 bp, Artificial Sequence
  chemically synthesized
aaaggaactggaggcagaaa

SEQ ID NO: 87798 - DNA, 20 bp, Artificial Sequence
  chemically synthesized
aactggaggcagaaaaagaa

SEQ ID NO: 87799 - DNA, 20 bp, Artificial Sequence
  chemically synthesized
ctggaggcagaaaaagaaaa

SEQ ID NO: 87800 - DNA, 20 bp, Artificial Sequence
  chemically synthesized
gaggcagaaaaagaaaagag

SEQ ID NO: 87801 - DNA, 20 bp, Artificial Sequence
  chemically synthesized
aggcagaaaaagaaaagaga

SEQ ID NO: 87802 - DNA, 20 bp, Artificial Sequence
  chemically synthesized
ggcagaaaaagaaaagagaa

SEQ ID NO: 87803 - DNA, 20 bp, Artificial Sequence
  chemically synthesized
agaaaaagaaaagagaaggg

SEQ ID NO: 87804 - DNA, 20 bp, Artificial Sequence
  chemically synthesized
gaaaaagaaaagagaaggga

SEQ ID NO: 87805 - DNA, 20 bp, Artificial Sequence
  chemically synthesized
aaaagaaaagagaagggaag

SEQ ID NO: 87806 - DNA, 20 bp, Artificial Sequence
  chemically synthesized
gaaaagagaagggaaggagt

SEQ ID NO: 87807 - DNA, 20 bp, Artificial Sequence
  chemically synthesized
agagaagggaaggagttagc

SEQ ID NO: 87808 - DNA, 20 bp, Artificial Sequence
  chemically synthesized
gagaagggaaggagttagca

SEQ ID NO: 87809 - DNA, 20 bp, Artificial Sequence
  chemically synthesized
aggagttagcaaggacttat

SEQ ID NO: 87810 - DNA, 20 bp, Artificial Sequence
  chemically synthesized
ggagttagcaaggacttatt

SEQ ID NO: 87811 - DNA, 20 bp, Artificial Sequence
  chemically synthesized
ctctgccaactgtgcctaat

SEQ ID NO: 87812 - DNA, 20 bp, Artificial Sequence
  chemically synthesized
tagcaaggacttattaggca

SEQ ID NO: 87813 - DNA, 20 bp, Artificial Sequence
  chemically synthesized
aaggacttattaggcacagt

SEQ ID NO: 87814 - DNA, 20 bp, Artificial Sequence
  chemically synthesized
gacttattaggcacagttgg

SEQ ID NO: 87815 - DNA, 20 bp, Artificial Sequence
  chemically synthesized
cttattaggcacagttggca

SEQ ID NO: 87816 - DNA, 20 bp, Artificial Sequence
  chemically synthesized
tattaggcacagttggcaga

SEQ ID NO: 87817 - DNA, 20 bp, Artificial Sequence
  chemically synthesized
ttaggcacagttggcagaga

SEQ ID NO: 87818 - DNA, 20 bp, Artificial Sequence
  chemically synthesized
ggcacagttggcagagagag

SEQ ID NO: 87819 - DNA, 20 bp, Artificial Sequence
  chemically synthesized
gcacagttggcagagagaga

SEQ ID NO: 87820 - DNA, 20 bp, Artificial Sequence
  chemically synthesized
gcagagagagaaggttctac

SEQ ID NO: 87821 - DNA, 20 bp, Artificial Sequence
  chemically synthesized
atttaatcattagaatctag

SEQ ID NO: 87822 - DNA, 20 bp, Artificial Sequence
  chemically synthesized
tatatttaatcattagaatc

SEQ ID NO: 87823 - DNA, 20 bp, Artificial Sequence
  chemically synthesized
atgaagttatatttaatcat

SEQ ID NO: 87824 - DNA, 20 bp, Artificial Sequence
  chemically synthesized
atgattaaatataacttcat

SEQ ID NO: 87825 - DNA, 20 bp, Artificial Sequence
  chemically synthesized
gattaaatataacttcatta

SEQ ID NO: 87826 - DNA, 20 bp, Artificial Sequence
  chemically synthesized
aaaaaatcactgctctaatg

SEQ ID NO: 87827 - DNA, 20 bp, Artificial Sequence
  chemically synthesized
taaatataacttcattagag

SEQ ID NO: 87828 - DNA, 20 bp, Artificial Sequence
  chemically synthesized
attagagcagtgattttttt

SEQ ID NO: 87829 - DNA, 20 bp, Artificial Sequence
  chemically synthesized
tttttggtatgttttattca

SEQ ID NO: 87830 - DNA, 20 bp, Artificial Sequence
  chemically synthesized
atggttgcatcctccgtgcc

SEQ ID NO: 87831 - DNA, 20 bp, Artificial Sequence
  chemically synthesized
aggcactcttctgggcacgg

SEQ ID NO: 87832 - DNA, 20 bp, Artificial Sequence
  chemically synthesized
taggcactcttctgggcacg

SEQ ID NO: 87833 - DNA, 20 bp, Artificial Sequence
  chemically synthesized
gttgcatcctccgtgcccag

SEQ ID NO: 87834 - DNA, 20 bp, Artificial Sequence
  chemically synthesized
actaggcactcttctgggca

SEQ ID NO: 87835 - DNA, 20 bp, Artificial Sequence
  chemically synthesized
tgcatcctccgtgcccagaa

SEQ ID NO: 87836 - DNA, 20 bp, Artificial Sequence
  chemically synthesized
tatgtactaggcactcttct

SEQ ID NO: 87837 - DNA, 20 bp, Artificial Sequence
  chemically synthesized
ctatgtactaggcactcttc

SEQ ID NO: 87838 - DNA, 20 bp, Artificial Sequence
  chemically synthesized
tccgtgcccagaagagtgcc

SEQ ID NO: 87839 - DNA, 20 bp, Artificial Sequence
  chemically synthesized
ccagaagagtgcctagtaca

SEQ ID NO: 87840 - DNA, 20 bp, Artificial Sequence
  chemically synthesized
atgaatgcctactatgtact

SEQ ID NO: 87841 - DNA, 20 bp, Artificial Sequence
  chemically synthesized
aatgaatgcctactatgtac

SEQ ID NO: 87842 - DNA, 20 bp, Artificial Sequence
  chemically synthesized
gaagagtgcctagtacatag

SEQ ID NO: 87843 - DNA, 20 bp, Artificial Sequence
  chemically synthesized
aagagtgcctagtacatagt

SEQ ID NO: 87844 - DNA, 20 bp, Artificial Sequence
  chemically synthesized
gaatgaacaaataaatgaat

SEQ ID NO: 87845 - DNA, 20 bp, Artificial Sequence
  chemically synthesized
aatgaacaaataaatgaatg

SEQ ID NO: 87846 - DNA, 20 bp, Artificial Sequence
  chemically synthesized
atgaacaaataaatgaatga

SEQ ID NO: 87847 - DNA, 20 bp, Artificial Sequence
  chemically synthesized
gaacaaataaatgaatgagg

SEQ ID NO: 87848 - DNA, 20 bp, Artificial Sequence
  chemically synthesized
ataaatgaatgagggagata

SEQ ID NO: 87849 - DNA, 20 bp, Artificial Sequence
  chemically synthesized
aaatgaatgagggagatatg

SEQ ID NO: 87850 - DNA, 20 bp, Artificial Sequence
  chemically synthesized
agggagatatggagacctac

SEQ ID NO: 87851 - DNA, 20 bp, Artificial Sequence
  chemically synthesized
gttcaaagcttcaatcttgt

SEQ ID NO: 87852 - DNA, 20 bp, Artificial Sequence
  chemically synthesized
tgttcaaagcttcaatcttg

SEQ ID NO: 87853 - DNA, 20 bp, Artificial Sequence
  chemically synthesized
tatggagacctacaagattg

SEQ ID NO: 87854 - DNA, 20 bp, Artificial Sequence
  chemically synthesized
aagattgaagctttgaacaa

SEQ ID NO: 87855 - DNA, 20 bp, Artificial Sequence
  chemically synthesized
tcatattactcttttgttca

SEQ ID NO: 87856 - DNA, 20 bp, Artificial Sequence
  chemically synthesized
gattgaagctttgaacaaaa

SEQ ID NO: 87857 - DNA, 20 bp, Artificial Sequence
  chemically synthesized
aaagagtaatatgatataaa

SEQ ID NO: 87858 - DNA, 20 bp, Artificial Sequence
  chemically synthesized
atatgatataaacagcgtcc

SEQ ID NO: 87859 - DNA, 20 bp, Artificial Sequence
  chemically synthesized
tatgatataaacagcgtcca

SEQ ID NO: 87860 - DNA, 20 bp, Artificial Sequence
  chemically synthesized
gatataaacagcgtccaagg

SEQ ID NO: 87861 - DNA, 20 bp, Artificial Sequence
  chemically synthesized
tataaacagcgtccaaggta

SEQ ID NO: 87862 - DNA, 20 bp, Artificial Sequence
  chemically synthesized
tttgcaagaatactctacct

SEQ ID NO: 87863 - DNA, 20 bp, Artificial Sequence
  chemically synthesized
tgccatattgatacatttgc

SEQ ID NO: 87864 - DNA, 20 bp, Artificial Sequence
  chemically synthesized
ttcttgcaaatgtatcaata

SEQ ID NO: 87865 - DNA, 20 bp, Artificial Sequence
  chemically synthesized
cataacatgatgacttaaat

SEQ ID NO: 87866 - DNA, 20 bp, Artificial Sequence
  chemically synthesized
tgtgattaagattcttattt

SEQ ID NO: 87867 - DNA, 20 bp, Artificial Sequence
  chemically synthesized
ttaaataagaatcttaatca

SEQ ID NO: 87868 - DNA, 20 bp, Artificial Sequence
  chemically synthesized
taaataagaatcttaatcac

SEQ ID NO: 87869 - DNA, 20 bp, Artificial Sequence
  chemically synthesized
tcttttctcttcctgtgatt

SEQ ID NO: 87870 - DNA, 20 bp, Artificial Sequence
  chemically synthesized
ataagaatcttaatcacagg

SEQ ID NO: 87871 - DNA, 20 bp, Artificial Sequence
  chemically synthesized
aagaatcttaatcacaggaa

SEQ ID NO: 87872 - DNA, 20 bp, Artificial Sequence
  chemically synthesized
tcttaatcacaggaagagaa

SEQ ID NO: 87873 - DNA, 20 bp, Artificial Sequence
  chemically synthesized
acaggaagagaaaagatgta

SEQ ID NO: 87874 - DNA, 20 bp, Artificial Sequence
  chemically synthesized
ggaagagaaaagatgtatgg

SEQ ID NO: 87875 - DNA, 20 bp, Artificial Sequence
  chemically synthesized
agagaaaagatgtatggcag

SEQ ID NO: 87876 - DNA, 20 bp, Artificial Sequence
  chemically synthesized
tatggcagaagaaaaataaa

SEQ ID NO: 87877 - DNA, 20 bp, Artificial Sequence
  chemically synthesized
ggcagaagaaaaataaatgg

SEQ ID NO: 87878 - DNA, 20 bp, Artificial Sequence
  chemically synthesized
gcagaagaaaaataaatgga

SEQ ID NO: 87879 - DNA, 20 bp, Artificial Sequence
  chemically synthesized
ggaaggaaaacgatacaata

SEQ ID NO: 87880 - DNA, 20 bp, Artificial Sequence
  chemically synthesized
atacaatatggacttgtatt

SEQ ID NO: 87881 - DNA, 20 bp, Artificial Sequence
  chemically synthesized
atccttgtgcttccaaatac

SEQ ID NO: 87882 - DNA, 20 bp, Artificial Sequence
  chemically synthesized
caatatggacttgtatttgg

SEQ ID NO: 87883 - DNA, 20 bp, Artificial Sequence
  chemically synthesized
ggacttgtatttggaagcac

SEQ ID NO: 87884 - DNA, 20 bp, Artificial Sequence
  chemically synthesized
gacttgtatttggaagcaca

SEQ ID NO: 87885 - DNA, 20 bp, Artificial Sequence
  chemically synthesized
agcacaaggatatctcttat

SEQ ID NO: 87886 - DNA, 20 bp, Artificial Sequence
  chemically synthesized
tgtattccattggctcataa

SEQ ID NO: 87887 - DNA, 20 bp, Artificial Sequence
  chemically synthesized
tttgtattccattggctcat

SEQ ID NO: 87888 - DNA, 20 bp, Artificial Sequence
  chemically synthesized
ggatatctcttatgagccaa

SEQ ID NO: 87889 - DNA, 20 bp, Artificial Sequence
  chemically synthesized
agtttccctttgtattccat

SEQ ID NO: 87890 - DNA, 20 bp, Artificial Sequence
  chemically synthesized
ttatgagccaatggaataca

SEQ ID NO: 87891 - DNA, 20 bp, Artificial Sequence
  chemically synthesized
tatgagccaatggaatacaa

SEQ ID NO: 87892 - DNA, 20 bp, Artificial Sequence
  chemically synthesized
atgagccaatggaatacaaa

SEQ ID NO: 87893 - DNA, 20 bp, Artificial Sequence
  chemically synthesized
tttaaatccaaatgatttcg

SEQ ID NO: 87894 - DNA, 20 bp, Artificial Sequence
  chemically synthesized
agggaaacttcgaaatcatt

SEQ ID NO: 87895 - DNA, 20 bp, Artificial Sequence
  chemically synthesized
caattttgtttctttaaaaa

SEQ ID NO: 87896 - DNA, 20 bp, Artificial Sequence
  chemically synthesized
cattaatgtgtccattttta

SEQ ID NO: 87897 - DNA, 20 bp, Artificial Sequence
  chemically synthesized
tttaaaaatggacacattaa

SEQ ID NO: 87898 - DNA, 20 bp, Artificial Sequence
  chemically synthesized
gttttatttttttgaaatat

SEQ ID NO: 87899 - DNA, 20 bp, Artificial Sequence
  chemically synthesized
tttatttttttgaaatataa

SEQ ID NO: 87900 - DNA, 20 bp, Artificial Sequence
  chemically synthesized
atttttttgaaatataagag

SEQ ID NO: 87901 - DNA, 20 bp, Artificial Sequence
  chemically synthesized
ttgaaatataagagcagttt

SEQ ID NO: 87902 - DNA, 20 bp, Artificial Sequence
  chemically synthesized
cagttggcccattgtttggt

SEQ ID NO: 87903 - DNA, 20 bp, Artificial Sequence
  chemically synthesized
cagaatcgctcaccaaacaa

SEQ ID NO: 87904 - DNA, 20 bp, Artificial Sequence
  chemically synthesized
agaatcgctcaccaaacaat

SEQ ID NO: 87905 - DNA, 20 bp, Artificial Sequence
  chemically synthesized
attacagttggcccattgtt

SEQ ID NO: 87906 - DNA, 20 bp, Artificial Sequence
  chemically synthesized
atattataaaaaattacagt

SEQ ID NO: 87907 - DNA, 20 bp, Artificial Sequence
  chemically synthesized
taacatattataaaaaatta

SEQ ID NO: 87908 - DNA, 20 bp, Artificial Sequence
  chemically synthesized
ttttataatatgttataact

SEQ ID NO: 87909 - DNA, 20 bp, Artificial Sequence
  chemically synthesized
tttataatatgttataactt

SEQ ID NO: 87910 - DNA, 20 bp, Artificial Sequence
  chemically synthesized
aaataggcctgtgtttgccc

SEQ ID NO: 87911 - DNA, 20 bp, Artificial Sequence
  chemically synthesized
tgttataacttgggcaaaca

SEQ ID NO: 87912 - DNA, 20 bp, Artificial Sequence
  chemically synthesized
gttataacttgggcaaacac

SEQ ID NO: 87913 - DNA, 20 bp, Artificial Sequence
  chemically synthesized
caaacacaggcctatttttc

SEQ ID NO: 87914 - DNA, 20 bp, Artificial Sequence
  chemically synthesized
caatgatatactggaaaaat

SEQ ID NO: 87915 - DNA, 20 bp, Artificial Sequence
  chemically synthesized
tcaatgatatactggaaaaa

SEQ ID NO: 87916 - DNA, 20 bp, Artificial Sequence
  chemically synthesized
aaatagtttcaatgatatac

SEQ ID NO: 87917 - DNA, 20 bp, Artificial Sequence
  chemically synthesized
aagttgccacaattaaaaaa

SEQ ID NO: 87918 - DNA, 20 bp, Artificial Sequence
  chemically synthesized
ttgaaactattttttaattg

SEQ ID NO: 87919 - DNA, 20 bp, Artificial Sequence
  chemically synthesized
gggggttattttaaaatgaa

SEQ ID NO: 87920 - DNA, 20 bp, Artificial Sequence
  chemically synthesized
tcattttaaaataaccccca

SEQ ID NO: 87921 - DNA, 20 bp, Artificial Sequence
  chemically synthesized
ttttaaaataacccccatgg

SEQ ID NO: 87922 - DNA, 20 bp, Artificial Sequence
  chemically synthesized
tcttgtcacttcttccatgg

SEQ ID NO: 87923 - DNA, 20 bp, Artificial Sequence
  chemically synthesized
atcttgtcacttcttccatg

SEQ ID NO: 87924 - DNA, 20 bp, Artificial Sequence
  chemically synthesized
taaaataacccccatggaag

SEQ ID NO: 87925 - DNA, 20 bp, Artificial Sequence
  chemically synthesized
aatcttgtcacttcttccat

SEQ ID NO: 87926 - DNA, 20 bp, Artificial Sequence
  chemically synthesized
gaatcttgtcacttcttcca

SEQ ID NO: 87927 - DNA, 20 bp, Artificial Sequence
  chemically synthesized
acccccatggaagaagtgac

SEQ ID NO: 87928 - DNA, 20 bp, Artificial Sequence
  chemically synthesized
aagtgacaagattcataatg

SEQ ID NO: 87929 - DNA, 20 bp, Artificial Sequence
  chemically synthesized
agtgacaagattcataatgc

SEQ ID NO: 87930 - DNA, 20 bp, Artificial Sequence
  chemically synthesized
gattcataatgcaggtttat

SEQ ID NO: 87931 - DNA, 20 bp, Artificial Sequence
  chemically synthesized
aggtttatcagtgccactaa

SEQ ID NO: 87932 - DNA, 20 bp, Artificial Sequence
  chemically synthesized
gttagatatagaaccattag

SEQ ID NO: 87933 - DNA, 20 bp, Artificial Sequence
  chemically synthesized
agagttagatatagaaccat

SEQ ID NO: 87934 - DNA, 20 bp, Artificial Sequence
  chemically synthesized
aacactggaagagttagata

SEQ ID NO: 87935 - DNA, 20 bp, Artificial Sequence
  chemically synthesized
ggttctatatctaactcttc

SEQ ID NO: 87936 - DNA, 20 bp, Artificial Sequence
  chemically synthesized
tagaataacactggaagagt

SEQ ID NO: 87937 - DNA, 20 bp, Artificial Sequence
  chemically synthesized
agaatagaataacactggaa

SEQ ID NO: 87938 - DNA, 20 bp, Artificial Sequence
  chemically synthesized
atagaatagaataacactgg

SEQ ID NO: 87939 - DNA, 20 bp, Artificial Sequence
  chemically synthesized
gaaatagaatagaataacac

SEQ ID NO: 87940 - DNA, 20 bp, Artificial Sequence
  chemically synthesized
gggatgattatgaaatagaa

SEQ ID NO: 87941 - DNA, 20 bp, Artificial Sequence
  chemically synthesized
aattagggatgattatgaaa

SEQ ID NO: 87942 - DNA, 20 bp, Artificial Sequence
  chemically synthesized
tacagtataggcagtaatta

SEQ ID NO: 87943 - DNA, 20 bp, Artificial Sequence
  chemically synthesized
gtacagtataggcagtaatt

SEQ ID NO: 87944 - DNA, 20 bp, Artificial Sequence
  chemically synthesized
agtacagtataggcagtaat

SEQ ID NO: 87945 - DNA, 20 bp, Artificial Sequence
  chemically synthesized
tgagagaagtacagtatagg

SEQ ID NO: 87946 - DNA, 20 bp, Artificial Sequence
  chemically synthesized
aattgagagaagtacagtat

SEQ ID NO: 87947 - DNA, 20 bp, Artificial Sequence
  chemically synthesized
caattgagagaagtacagta

SEQ ID NO: 87948 - DNA, 20 bp, Artificial Sequence
  chemically synthesized
gggttcaattgagagaagta

SEQ ID NO: 87949 - DNA, 20 bp, Artificial Sequence
  chemically synthesized
tggcagggttcaattgagag

SEQ ID NO: 87950 - DNA, 20 bp, Artificial Sequence
  chemically synthesized
aaatggcagggttcaattga

SEQ ID NO: 87951 - DNA, 20 bp, Artificial Sequence
  chemically synthesized
gcaaatggcagggttcaatt

SEQ ID NO: 87952 - DNA, 20 bp, Artificial Sequence
  chemically synthesized
tcaatctacagcaaatggca

SEQ ID NO: 87953 - DNA, 20 bp, Artificial Sequence
  chemically synthesized
atcaatctacagcaaatggc

SEQ ID NO: 87954 - DNA, 20 bp, Artificial Sequence
  chemically synthesized
gatcaatctacagcaaatgg

SEQ ID NO: 87955 - DNA, 20 bp, Artificial Sequence
  chemically synthesized
ttgaaccctgccatttgctg

SEQ ID NO: 87956 - DNA, 20 bp, Artificial Sequence
  chemically synthesized
attgatcaatctacagcaaa

SEQ ID NO: 87957 - DNA, 20 bp, Artificial Sequence
  chemically synthesized
ttagggtattgatcaatcta

SEQ ID NO: 87958 - DNA, 20 bp, Artificial Sequence
  chemically synthesized
ctgacacttgattgaaatta

SEQ ID NO: 87959 - DNA, 20 bp, Artificial Sequence
  chemically synthesized
cctgacacttgattgaaatt

SEQ ID NO: 87960 - DNA, 20 bp, Artificial Sequence
  chemically synthesized
tcctgacacttgattgaaat

SEQ ID NO: 87961 - DNA, 20 bp, Artificial Sequence
  chemically synthesized
tcaataccctaatttcaatc

SEQ ID NO: 87962 - DNA, 20 bp, Artificial Sequence
  chemically synthesized
ccctaatttcaatcaagtgt

SEQ ID NO: 87963 - DNA, 20 bp, Artificial Sequence
  chemically synthesized
cctaatttcaatcaagtgtc

SEQ ID NO: 87964 - DNA, 20 bp, Artificial Sequence
  chemically synthesized
tcaatcaagtgtcaggaaat

SEQ ID NO: 87965 - DNA, 20 bp, Artificial Sequence
  chemically synthesized
ttctccacatcaaagcaatt

SEQ ID NO: 87966 - DNA, 20 bp, Artificial Sequence
  chemically synthesized
taagctaaattgctttgatg

SEQ ID NO: 87967 - DNA, 20 bp, Artificial Sequence
  chemically synthesized
agctaaattgctttgatgtg

SEQ ID NO: 87968 - DNA, 20 bp, Artificial Sequence
  chemically synthesized
agaagtaattctccacatca

SEQ ID NO: 87969 - DNA, 20 bp, Artificial Sequence
  chemically synthesized
agcactcataaaaagcaaag

SEQ ID NO: 87970 - DNA, 20 bp, Artificial Sequence
  chemically synthesized
ataagcactcataaaaagca

SEQ ID NO: 87971 - DNA, 20 bp, Artificial Sequence
  chemically synthesized
attacttctttgctttttat

SEQ ID NO: 87972 - DNA, 20 bp, Artificial Sequence
  chemically synthesized
atgttataagcactcataaa

SEQ ID NO: 87973 - DNA, 20 bp, Artificial Sequence
  chemically synthesized
aataatacaggatatgttat

SEQ ID NO: 87974 - DNA, 20 bp, Artificial Sequence
  chemically synthesized
ataggcctatgtaataatac

SEQ ID NO: 87975 - DNA, 20 bp, Artificial Sequence
  chemically synthesized
tataggcctatgtaataata

SEQ ID NO: 87976 - DNA, 20 bp, Artificial Sequence
  chemically synthesized
acatatcctgtattattaca

SEQ ID NO: 87977 - DNA, 20 bp, Artificial Sequence
  chemically synthesized
catatcctgtattattacat

SEQ ID NO: 87978 - DNA, 20 bp, Artificial Sequence
  chemically synthesized
tattacataggcctatataa

SEQ ID NO: 87979 - DNA, 20 bp, Artificial Sequence
  chemically synthesized
aatggttttggcttttatat

SEQ ID NO: 87980 - DNA, 20 bp, Artificial Sequence
  chemically synthesized
caatggttttggcttttata

SEQ ID NO: 87981 - DNA, 20 bp, Artificial Sequence
  chemically synthesized
aatattcagatcaatggttt

SEQ ID NO: 87982 - DNA, 20 bp, Artificial Sequence
  chemically synthesized
aatttaaatattcagatcaa

SEQ ID NO: 87983 - DNA, 20 bp, Artificial Sequence
  chemically synthesized
aattctagaatttaaatatt

SEQ ID NO: 87984 - DNA, 20 bp, Artificial Sequence
  chemically synthesized
tgatctgaatatttaaattc

SEQ ID NO: 87985 - DNA, 20 bp, Artificial Sequence
  chemically synthesized
gaatatttaaattctagaat

SEQ ID NO: 87986 - DNA, 20 bp, Artificial Sequence
  chemically synthesized
tatttaaattctagaattgg

SEQ ID NO: 87987 - DNA, 20 bp, Artificial Sequence
  chemically synthesized
atctaaggtgctgccaattc

SEQ ID NO: 87988 - DNA, 20 bp, Artificial Sequence
  chemically synthesized
ttctagaattggcagcacct

SEQ ID NO: 87989 - DNA, 20 bp, Artificial Sequence
  chemically synthesized
gaattggcagcaccttagat

SEQ ID NO: 87990 - DNA, 20 bp, Artificial Sequence
  chemically synthesized
gaaaacagttagcttatcta

SEQ ID NO: 87991 - DNA, 20 bp, Artificial Sequence
  chemically synthesized
agaaaacagttagcttatct

SEQ ID NO: 87992 - DNA, 20 bp, Artificial Sequence
  chemically synthesized
ttaatcaggtagaaaacagt

SEQ ID NO: 87993 - DNA, 20 bp, Artificial Sequence
  chemically synthesized
gtcattaatcaggtagaaaa

SEQ ID NO: 87994 - DNA, 20 bp, Artificial Sequence
  chemically synthesized
tcttgctgtcattaatcagg

SEQ ID NO: 87995 - DNA, 20 bp, Artificial Sequence
  chemically synthesized
gattcttgctgtcattaatc

SEQ ID NO: 87996 - DNA, 20 bp, Artificial Sequence
  chemically synthesized
tgattcttgctgtcattaat

SEQ ID NO: 87997 - DNA, 20 bp, Artificial Sequence
  chemically synthesized
gttttctacctgattaatga

SEQ ID NO: 87998 - DNA, 20 bp, Artificial Sequence
  chemically synthesized
tctacctgattaatgacagc

SEQ ID NO: 87999 - DNA, 20 bp, Artificial Sequence
  chemically synthesized
tgacagcaagaatcaaactg

SEQ ID NO: 88000 - DNA, 20 bp, Artificial Sequence
  chemically synthesized
cagcaagaatcaaactgcgg

SEQ ID NO: 88001 - DNA, 20 bp, Artificial Sequence
  chemically synthesized
gtttcccatgtcagctaccg

SEQ ID NO: 88002 - DNA, 20 bp, Artificial Sequence
  chemically synthesized
tcaaactgcggtagctgaca

SEQ ID NO: 88003 - DNA, 20 bp, Artificial Sequence
  chemically synthesized
caaactgcggtagctgacat

SEQ ID NO: 88004 - DNA, 20 bp, Artificial Sequence
  chemically synthesized
ttctcagcagtttcccatgt

SEQ ID NO: 88005 - DNA, 20 bp, Artificial Sequence
  chemically synthesized
agctgacatgggaaactgct

SEQ ID NO: 88006 - DNA, 20 bp, Artificial Sequence
  chemically synthesized
tatggactcttcattctcag

SEQ ID NO: 88007 - DNA, 20 bp, Artificial Sequence
  chemically synthesized
atgggaaactgctgagaatg

SEQ ID NO: 88008 - DNA, 20 bp, Artificial Sequence
  chemically synthesized
aaatatggactcttcattct

SEQ ID NO: 88009 - DNA, 20 bp, Artificial Sequence
  chemically synthesized
gggaaactgctgagaatgaa

SEQ ID NO: 88010 - DNA, 20 bp, Artificial Sequence
  chemically synthesized
agaatgaagagtccatattt

SEQ ID NO: 88011 - DNA, 20 bp, Artificial Sequence
  chemically synthesized
atagcatgtcagccaaaata

SEQ ID NO: 88012 - DNA, 20 bp, Artificial Sequence
  chemically synthesized
gaaagtggcaaatagcatgt

SEQ ID NO: 88013 - DNA, 20 bp, Artificial Sequence
  chemically synthesized
ggagaattgaaagtggcaaa

SEQ ID NO: 88014 - DNA, 20 bp, Artificial Sequence
  chemically synthesized
aataaaaggagaattgaaag

SEQ ID NO: 88015 - DNA, 20 bp, Artificial Sequence
  chemically synthesized
taaaataaaaggagaattga

SEQ ID NO: 88016 - DNA, 20 bp, Artificial Sequence
  chemically synthesized
tgaacttgataaaataaaag

SEQ ID NO: 88017 - DNA, 20 bp, Artificial Sequence
  chemically synthesized
tgtgaacttgataaaataaa

SEQ ID NO: 88018 - DNA, 20 bp, Artificial Sequence
  chemically synthesized
atgtgaacttgataaaataa

SEQ ID NO: 88019 - DNA, 20 bp, Artificial Sequence
  chemically synthesized
aattctccttttattttatc

SEQ ID NO: 88020 - DNA, 20 bp, Artificial Sequence
  chemically synthesized
ttattttatcaagttcacat

SEQ ID NO: 88021 - DNA, 20 bp, Artificial Sequence
  chemically synthesized
tattttatcaagttcacatg

SEQ ID NO: 88022 - DNA, 20 bp, Artificial Sequence
  chemically synthesized
tttatcaagttcacatgagg

SEQ ID NO: 88023 - DNA, 20 bp, Artificial Sequence
  chemically synthesized
tatcaagttcacatgaggca

SEQ ID NO: 88024 - DNA, 20 bp, Artificial Sequence
  chemically synthesized
agttcacatgaggcagagaa

SEQ ID NO: 88025 - DNA, 20 bp, Artificial Sequence
  chemically synthesized
gttcacatgaggcagagaaa

SEQ ID NO: 88026 - DNA, 20 bp, Artificial Sequence
  chemically synthesized
tgaggcagagaaaaggcact

SEQ ID NO: 88027 - DNA, 20 bp, Artificial Sequence
  chemically synthesized
taattgttccgagtatcact

SEQ ID NO: 88028 - DNA, 20 bp, Artificial Sequence
  chemically synthesized
aaaaggcactaagtgatact

SEQ ID NO: 88029 - DNA, 20 bp, Artificial Sequence
  chemically synthesized
aaagatgctataattgttcc

SEQ ID NO: 88030 - DNA, 20 bp, Artificial Sequence
  chemically synthesized
agtgatactcggaacaatta

SEQ ID NO: 88031 - DNA, 20 bp, Artificial Sequence
  chemically synthesized
ttctgcacaaaagaaaaaga

SEQ ID NO: 88032 - DNA, 20 bp, Artificial Sequence
  chemically synthesized
tcttttctgcacaaaagaaa

SEQ ID NO: 88033 - DNA, 20 bp, Artificial Sequence
  chemically synthesized
atctttctttttcttttgtg

SEQ ID NO: 88034 - DNA, 20 bp, Artificial Sequence
  chemically synthesized
agttattcttttctgcacaa

SEQ ID NO: 88035 - DNA, 20 bp, Artificial Sequence
  chemically synthesized
tctttttcttttgtgcagaa

SEQ ID NO: 88036 - DNA, 20 bp, Artificial Sequence
  chemically synthesized
aaatattggcaggtcaagtt

SEQ ID NO: 88037 - DNA, 20 bp, Artificial Sequence
  chemically synthesized
ggaaaaaatattggcaggtc

SEQ ID NO: 88038 - DNA, 20 bp, Artificial Sequence
  chemically synthesized
gagatggaaaaaatattggc

SEQ ID NO: 88039 - DNA, 20 bp, Artificial Sequence
  chemically synthesized
tgagatggaaaaaatattgg

SEQ ID NO: 88040 - DNA, 20 bp, Artificial Sequence
  chemically synthesized
atgtgagatggaaaaaatat

SEQ ID NO: 88041 - DNA, 20 bp, Artificial Sequence
  chemically synthesized
aaaagaatgaaaatgtgaga

SEQ ID NO: 88042 - DNA, 20 bp, Artificial Sequence
  chemically synthesized
ttaaaaaagaatgaaaatgt

SEQ ID NO: 88043 - DNA, 20 bp, Artificial Sequence
  chemically synthesized
gataaccttcgtcattaaaa

SEQ ID NO: 88044 - DNA, 20 bp, Artificial Sequence
  chemically synthesized
ttcattcttttttaatgacg

SEQ ID NO: 88045 - DNA, 20 bp, Artificial Sequence
  chemically synthesized
tcattcttttttaatgacga

SEQ ID NO: 88046 - DNA, 20 bp, Artificial Sequence
  chemically synthesized
tttaatgacgaaggttatca

SEQ ID NO: 88047 - DNA, 20 bp, Artificial Sequence
  chemically synthesized
aatgacgaaggttatcaaag

SEQ ID NO: 88048 - DNA, 20 bp, Artificial Sequence
  chemically synthesized
gtcagtatgtgtgatgacgt

SEQ ID NO: 88049 - DNA, 20 bp, Artificial Sequence
  chemically synthesized
ggtcagtatgtgtgatgacg

SEQ ID NO: 88050 - DNA, 20 bp, Artificial Sequence
  chemically synthesized
cttaaactcttaagagaggt

SEQ ID NO: 88051 - DNA, 20 bp, Artificial Sequence
  chemically synthesized
cacacatactgacctctctt

SEQ ID NO: 88052 - DNA, 20 bp, Artificial Sequence
  chemically synthesized
cacatactgacctctcttaa

SEQ ID NO: 88053 - DNA, 20 bp, Artificial Sequence
  chemically synthesized
acagcttaaactcttaagag

SEQ ID NO: 88054 - DNA, 20 bp, Artificial Sequence
  chemically synthesized
tacagcttaaactcttaaga

SEQ ID NO: 88055 - DNA, 20 bp, Artificial Sequence
  chemically synthesized
tctacagcttaaactcttaa

SEQ ID NO: 88056 - DNA, 20 bp, Artificial Sequence
  chemically synthesized
tttctacagcttaaactctt

SEQ ID NO: 88057 - DNA, 20 bp, Artificial Sequence
  chemically synthesized
ctgacctctcttaagagttt

SEQ ID NO: 88058 - DNA, 20 bp, Artificial Sequence
  chemically synthesized
tctcttaagagtttaagctg

SEQ ID NO: 88059 - DNA, 20 bp, Artificial Sequence
  chemically synthesized
ttaagagtttaagctgtaga

SEQ ID NO: 88060 - DNA, 20 bp, Artificial Sequence
  chemically synthesized
gaggctctattagctttcta

SEQ ID NO: 88061 - DNA, 20 bp, Artificial Sequence
  chemically synthesized
tttaagctgtagaaagctaa

SEQ ID NO: 88062 - DNA, 20 bp, Artificial Sequence
  chemically synthesized
taagctgtagaaagctaata

SEQ ID NO: 88063 - DNA, 20 bp, Artificial Sequence
  chemically synthesized
caaagatagggaggctctat

SEQ ID NO: 88064 - DNA, 20 bp, Artificial Sequence
  chemically synthesized
tagcattttcaaagataggg

SEQ ID NO: 88065 - DNA, 20 bp, Artificial Sequence
  chemically synthesized
atagcattttcaaagatagg

SEQ ID NO: 88066 - DNA, 20 bp, Artificial Sequence
  chemically synthesized
caatagcattttcaaagata

SEQ ID NO: 88067 - DNA, 20 bp, Artificial Sequence
  chemically synthesized
gcaatagcattttcaaagat

SEQ ID NO: 88068 - DNA, 20 bp, Artificial Sequence
  chemically synthesized
ggcaatagcattttcaaaga

SEQ ID NO: 88069 - DNA, 20 bp, Artificial Sequence
  chemically synthesized
caatggcaatagcattttca

SEQ ID NO: 88070 - DNA, 20 bp, Artificial Sequence
  chemically synthesized
actgggagcaacaatggcaa

SEQ ID NO: 88071 - DNA, 20 bp, Artificial Sequence
  chemically synthesized
tggtacactgggagcaacaa

SEQ ID NO: 88072 - DNA, 20 bp, Artificial Sequence
  chemically synthesized
gctattgccattgttgctcc

SEQ ID NO: 88073 - DNA, 20 bp, Artificial Sequence
  chemically synthesized
acttggtggtggtacactgg

SEQ ID NO: 88074 - DNA, 20 bp, Artificial Sequence
  chemically synthesized
caacttggtggtggtacact

SEQ ID NO: 88075 - DNA, 20 bp, Artificial Sequence
  chemically synthesized
tcaacttggtggtggtacac

SEQ ID NO: 88076 - DNA, 20 bp, Artificial Sequence
  chemically synthesized
gctcccagtgtaccaccacc

SEQ ID NO: 88077 - DNA, 20 bp, Artificial Sequence
  chemically synthesized
attttgtgtcaacttggtgg

SEQ ID NO: 88078 - DNA, 20 bp, Artificial Sequence
  chemically synthesized
tgaattttgtgtcaacttgg

SEQ ID NO: 88079 - DNA, 20 bp, Artificial Sequence
  chemically synthesized
atatgaattttgtgtcaact

SEQ ID NO: 88080 - DNA, 20 bp, Artificial Sequence
  chemically synthesized
cacaaaattcatatacaaaa

SEQ ID NO: 88081 - DNA, 20 bp, Artificial Sequence
  chemically synthesized
acaaaattcatatacaaaat

SEQ ID NO: 88082 - DNA, 20 bp, Artificial Sequence
  chemically synthesized
caaaattcatatacaaaata

SEQ ID NO: 88083 - DNA, 20 bp, Artificial Sequence
  chemically synthesized
aaattcatatacaaaatagg

SEQ ID NO: 88084 - DNA, 20 bp, Artificial Sequence
  chemically synthesized
catatacaaaatagggagat

SEQ ID NO: 88085 - DNA, 20 bp, Artificial Sequence
  chemically synthesized
atatacaaaatagggagata

SEQ ID NO: 88086 - DNA, 20 bp, Artificial Sequence
  chemically synthesized
gggagataaggaacaatgtc

SEQ ID NO: 88087 - DNA, 20 bp, Artificial Sequence
  chemically synthesized
ggagataaggaacaatgtct

SEQ ID NO: 88088 - DNA, 20 bp, Artificial Sequence
  chemically synthesized
gataaggaacaatgtctggg

SEQ ID NO: 88089 - DNA, 20 bp, Artificial Sequence
  chemically synthesized
aggaacaatgtctgggaagc

SEQ ID NO: 88090 - DNA, 20 bp, Artificial Sequence
  chemically synthesized
ggaacaatgtctgggaagcc

SEQ ID NO: 88091 - DNA, 20 bp, Artificial Sequence
  chemically synthesized
aagtttgcaccctggcttcc

SEQ ID NO: 88092 - DNA, 20 bp, Artificial Sequence
  chemically synthesized
gaacaatgtctgggaagcca

SEQ ID NO: 88093 - DNA, 20 bp, Artificial Sequence
  chemically synthesized
tttttcacaagtttgcaccc

SEQ ID NO: 88094 - DNA, 20 bp, Artificial Sequence
  chemically synthesized
tgttttgttttgtttttcac

SEQ ID NO: 88095 - DNA, 20 bp, Artificial Sequence
  chemically synthesized
caggtttatttttatgtata

SEQ ID NO: 88096 - DNA, 20 bp, Artificial Sequence
  chemically synthesized
acaggtttatttttatgtat

SEQ ID NO: 88097 - DNA, 20 bp, Artificial Sequence
  chemically synthesized
tagattgctaggagtagaac

SEQ ID NO: 88098 - DNA, 20 bp, Artificial Sequence
  chemically synthesized
gtagattgctaggagtagaa

SEQ ID NO: 88099 - DNA, 20 bp, Artificial Sequence
  chemically synthesized
aaataaacctgttctactcc

SEQ ID NO: 88100 - DNA, 20 bp, Artificial Sequence
  chemically synthesized
gagaagtagattgctaggag

SEQ ID NO: 88101 - DNA, 20 bp, Artificial Sequence
  chemically synthesized
tatgagaagtagattgctag

SEQ ID NO: 88102 - DNA, 20 bp, Artificial Sequence
  chemically synthesized
tttatgagaagtagattgct

SEQ ID NO: 88103 - DNA, 20 bp, Artificial Sequence
  chemically synthesized
ttttatgagaagtagattgc

SEQ ID NO: 88104 - DNA, 20 bp, Artificial Sequence
  chemically synthesized
ggatttgtttttatgagaag

SEQ ID NO: 88105 - DNA, 20 bp, Artificial Sequence
  chemically synthesized
aaaggatttgtttttatgag

SEQ ID NO: 88106 - DNA, 20 bp, Artificial Sequence
  chemically synthesized
agaaaaggatttgtttttat

SEQ ID NO: 88107 - DNA, 20 bp, Artificial Sequence
  chemically synthesized
attttttctaggagtagaaa

SEQ ID NO: 88108 - DNA, 20 bp, Artificial Sequence
  chemically synthesized
gattttttctaggagtagaa

SEQ ID NO: 88109 - DNA, 20 bp, Artificial Sequence
  chemically synthesized
aacaaatccttttctactcc

SEQ ID NO: 88110 - DNA, 20 bp, Artificial Sequence
  chemically synthesized
gagtagattttttctaggag

SEQ ID NO: 88111 - DNA, 20 bp, Artificial Sequence
  chemically synthesized
agagagtagattttttctag

SEQ ID NO: 88112 - DNA, 20 bp, Artificial Sequence
  chemically synthesized
atagagagtagattttttct

SEQ ID NO: 88113 - DNA, 20 bp, Artificial Sequence
  chemically synthesized
aatagagagtagattttttc

SEQ ID NO: 88114 - DNA, 20 bp, Artificial Sequence
  chemically synthesized
tgaaaggatgaaatagagag

SEQ ID NO: 88115 - DNA, 20 bp, Artificial Sequence
  chemically synthesized
aattgaaaggatgaaataga

SEQ ID NO: 88116 - DNA, 20 bp, Artificial Sequence
  chemically synthesized
ctaattgaaaggatgaaata

SEQ ID NO: 88117 - DNA, 20 bp, Artificial Sequence
  chemically synthesized
tactaattgaaaggatgaaa

SEQ ID NO: 88118 - DNA, 20 bp, Artificial Sequence
  chemically synthesized
ctctatttcatcctttcaat

SEQ ID NO: 88119 - DNA, 20 bp, Artificial Sequence
  chemically synthesized
agaaatgcatactaattgaa

SEQ ID NO: 88120 - DNA, 20 bp, Artificial Sequence
  chemically synthesized
aagaaatgcatactaattga

SEQ ID NO: 88121 - DNA, 20 bp, Artificial Sequence
  chemically synthesized
aattagtatgcatttctttg

SEQ ID NO: 88122 - DNA, 20 bp, Artificial Sequence
  chemically synthesized
tagtatgcatttctttgtag

SEQ ID NO: 88123 - DNA, 20 bp, Artificial Sequence
  chemically synthesized
gaaagaaggaaacttctaca

SEQ ID NO: 88124 - DNA, 20 bp, Artificial Sequence
  chemically synthesized
ccgtagcatataaagaaaga

SEQ ID NO: 88125 - DNA, 20 bp, Artificial Sequence
  chemically synthesized
accgtagcatataaagaaag

SEQ ID NO: 88126 - DNA, 20 bp, Artificial Sequence
  chemically synthesized
gataccgtagcatataaaga

SEQ ID NO: 88127 - DNA, 20 bp, Artificial Sequence
  chemically synthesized
atatgataccgtagcatata

SEQ ID NO: 88128 - DNA, 20 bp, Artificial Sequence
  chemically synthesized
ccttctttctttatatgcta

SEQ ID NO: 88129 - DNA, 20 bp, Artificial Sequence
  chemically synthesized
ttaaccaccatatgataccg

SEQ ID NO: 88130 - DNA, 20 bp, Artificial Sequence
  chemically synthesized
ttatatgctacggtatcata

SEQ ID NO: 88131 - DNA, 20 bp, Artificial Sequence
  chemically synthesized
tatgctacggtatcatatgg

SEQ ID NO: 88132 - DNA, 20 bp, Artificial Sequence
  chemically synthesized
cggtatcatatggtggttaa

SEQ ID NO: 88133 - DNA, 20 bp, Artificial Sequence
  chemically synthesized
tcatatggtggttaaaagtt

SEQ ID NO: 88134 - DNA, 20 bp, Artificial Sequence
  chemically synthesized
ggttaaaagttcagactctg

SEQ ID NO: 88135 - DNA, 20 bp, Artificial Sequence
  chemically synthesized
aaaagttcagactctgaagt

SEQ ID NO: 88136 - DNA, 20 bp, Artificial Sequence
  chemically synthesized
aatcagggagtctgacttca

SEQ ID NO: 88137 - DNA, 20 bp, Artificial Sequence
  chemically synthesized
gaaatcagggagtctgactt

SEQ ID NO: 88138 - DNA, 20 bp, Artificial Sequence
  chemically synthesized
taaaagaaaaagaaatcagg

SEQ ID NO: 88139 - DNA, 20 bp, Artificial Sequence
  chemically synthesized
agtaaaagaaaaagaaatca

SEQ ID NO: 88140 - DNA, 20 bp, Artificial Sequence
  chemically synthesized
aagtaaaagaaaaagaaatc

SEQ ID NO: 88141 - DNA, 20 bp, Artificial Sequence
  chemically synthesized
aaagtaaaagaaaaagaaat

SEQ ID NO: 88142 - DNA, 20 bp, Artificial Sequence
  chemically synthesized
aaagaaaaaagtaaaagaaa

SEQ ID NO: 88143 - DNA, 20 bp, Artificial Sequence
  chemically synthesized
aagaaaaaagaaaaaagtaa

SEQ ID NO: 88144 - DNA, 20 bp, Artificial Sequence
  chemically synthesized
tctcaaaagaaaaaagaaaa

SEQ ID NO: 88145 - DNA, 20 bp, Artificial Sequence
  chemically synthesized
gactctgtctcaaaagaaaa

SEQ ID NO: 88146 - DNA, 20 bp, Artificial Sequence
  chemically synthesized
acttttttcttttttctttt

SEQ ID NO: 88147 - DNA, 20 bp, Artificial Sequence
  chemically synthesized
ttttcttttttcttttgaga

SEQ ID NO: 88148 - DNA, 20 bp, Artificial Sequence
  chemically synthesized
agagtgagactctgtctcaa

SEQ ID NO: 88149 - DNA, 20 bp, Artificial Sequence
  chemically synthesized
ttcttttttcttttgagaca

SEQ ID NO: 88150 - DNA, 20 bp, Artificial Sequence
  chemically synthesized
tccagcctaggggacagagt

SEQ ID NO: 88151 - DNA, 20 bp, Artificial Sequence
  chemically synthesized
cagagtctcactctgtcccc

SEQ ID NO: 88152 - DNA, 20 bp, Artificial Sequence
  chemically synthesized
tcactccagcctaggggaca

SEQ ID NO: 88153 - DNA, 20 bp, Artificial Sequence
  chemically synthesized
agagtctcactctgtcccct

SEQ ID NO: 88154 - DNA, 20 bp, Artificial Sequence
  chemically synthesized
cttcactccagcctagggga

SEQ ID NO: 88155 - DNA, 20 bp, Artificial Sequence
  chemically synthesized
tctcactctgtcccctaggc

SEQ ID NO: 88156 - DNA, 20 bp, Artificial Sequence
  chemically synthesized
accacttcactccagcctag

SEQ ID NO: 88157 - DNA, 20 bp, Artificial Sequence
  chemically synthesized
tcactctgtcccctaggctg

SEQ ID NO: 88158 - DNA, 20 bp, Artificial Sequence
  chemically synthesized
caccacttcactccagccta

SEQ ID NO: 88159 - DNA, 20 bp, Artificial Sequence
  chemically synthesized
gcaccacttcactccagcct

SEQ ID NO: 88160 - DNA, 20 bp, Artificial Sequence
  chemically synthesized
cgcaccacttcactccagcc

SEQ ID NO: 88161 - DNA, 20 bp, Artificial Sequence
  chemically synthesized
ctgtcccctaggctggagtg

SEQ ID NO: 88162 - DNA, 20 bp, Artificial Sequence
  chemically synthesized
gagatcgcaccacttcactc

SEQ ID NO: 88163 - DNA, 20 bp, Artificial Sequence
  chemically synthesized
tcccctaggctggagtgaag

SEQ ID NO: 88164 - DNA, 20 bp, Artificial Sequence
  chemically synthesized
ggagtgaagtggtgcgatct

SEQ ID NO: 88165 - DNA, 20 bp, Artificial Sequence
  chemically synthesized
ggtggaggttgcagtgagcc

SEQ ID NO: 88166 - DNA, 20 bp, Artificial Sequence
  chemically synthesized
cgggaggtggaggttgcagt

SEQ ID NO: 88167 - DNA, 20 bp, Artificial Sequence
  chemically synthesized
aacccgggaggtggaggttg

SEQ ID NO: 88168 - DNA, 20 bp, Artificial Sequence
  chemically synthesized
cgcttgaacccgggaggtgg

SEQ ID NO: 88169 - DNA, 20 bp, Artificial Sequence
  chemically synthesized
tcactgcaacctccacctcc

SEQ ID NO: 88170 - DNA, 20 bp, Artificial Sequence
  chemically synthesized
tcgcttgaacccgggaggtg

SEQ ID NO: 88171 - DNA, 20 bp, Artificial Sequence
  chemically synthesized
cactgcaacctccacctccc

SEQ ID NO: 88172 - DNA, 20 bp, Artificial Sequence
  chemically synthesized
aatcgcttgaacccgggagg

SEQ ID NO: 88173 - DNA, 20 bp, Artificial Sequence
  chemically synthesized
gagaatcgcttgaacccggg

SEQ ID NO: 88174 - DNA, 20 bp, Artificial Sequence
  chemically synthesized
ggagaatcgcttgaacccgg

SEQ ID NO: 88175 - DNA, 20 bp, Artificial Sequence
  chemically synthesized
aacctccacctcccgggttc

SEQ ID NO: 88176 - DNA, 20 bp, Artificial Sequence
  chemically synthesized
caggagaatcgcttgaaccc

SEQ ID NO: 88177 - DNA, 20 bp, Artificial Sequence
  chemically synthesized
gcaggagaatcgcttgaacc

SEQ ID NO: 88178 - DNA, 20 bp, Artificial Sequence
  chemically synthesized
ttcaagcgattctcctgcct

SEQ ID NO: 88179 - DNA, 20 bp, Artificial Sequence
  chemically synthesized
tactcaggaggctgaggcag

SEQ ID NO: 88180 - DNA, 20 bp, Artificial Sequence
  chemically synthesized
gctactcaggaggctgaggc

SEQ ID NO: 88181 - DNA, 20 bp, Artificial Sequence
  chemically synthesized
agctactcaggaggctgagg

SEQ ID NO: 88182 - DNA, 20 bp, Artificial Sequence
  chemically synthesized
cccagctactcaggaggctg

SEQ ID NO: 88183 - DNA, 20 bp, Artificial Sequence
  chemically synthesized
tcccagctactcaggaggct

SEQ ID NO: 88184 - DNA, 20 bp, Artificial Sequence
  chemically synthesized
ttctcctgcctcagcctcct

SEQ ID NO: 88185 - DNA, 20 bp, Artificial Sequence
  chemically synthesized
tcctgcctcagcctcctgag

SEQ ID NO: 88186 - DNA, 20 bp, Artificial Sequence
  chemically synthesized
tgtagtcccagctactcagg

SEQ ID NO: 88187 - DNA, 20 bp, Artificial Sequence
  chemically synthesized
ctgtagtcccagctactcag

SEQ ID NO: 88188 - DNA, 20 bp, Artificial Sequence
  chemically synthesized
gcctcagcctcctgagtagc

SEQ ID NO: 88189 - DNA, 20 bp, Artificial Sequence
  chemically synthesized
gcctgtagtcccagctactc

SEQ ID NO: 88190 - DNA, 20 bp, Artificial Sequence
  chemically synthesized
cctcagcctcctgagtagct

SEQ ID NO: 88191 - DNA, 20 bp, Artificial Sequence
  chemically synthesized
cgcctgtagtcccagctact

SEQ ID NO: 88192 - DNA, 20 bp, Artificial Sequence
  chemically synthesized
ctcctgagtagctgggacta

SEQ ID NO: 88193 - DNA, 20 bp, Artificial Sequence
  chemically synthesized
tcctgagtagctgggactac

SEQ ID NO: 88194 - DNA, 20 bp, Artificial Sequence
  chemically synthesized
gtggcacgcgcctgtagtcc

SEQ ID NO: 88195 - DNA, 20 bp, Artificial Sequence
  chemically synthesized
ggcatggtggcacgcgcctg

SEQ ID NO: 88196 - DNA, 20 bp, Artificial Sequence
  chemically synthesized
caggcgcgtgccaccatgcc

SEQ ID NO: 88197 - DNA, 20 bp, Artificial Sequence
  chemically synthesized
caaaaattagctgggcatgg

SEQ ID NO: 88198 - DNA, 20 bp, Artificial Sequence
  chemically synthesized
atacaaaaattagctgggca

SEQ ID NO: 88199 - DNA, 20 bp, Artificial Sequence
  chemically synthesized
caaaaatacaaaaattagct

SEQ ID NO: 88200 - DNA, 20 bp, Artificial Sequence
  chemically synthesized
ccaaaaatacaaaaattagc

SEQ ID NO: 88201 - DNA, 20 bp, Artificial Sequence
  chemically synthesized
tctaccaaaaatacaaaaat

SEQ ID NO: 88202 - DNA, 20 bp, Artificial Sequence
  chemically synthesized
ccagctaatttttgtatttt

SEQ ID NO: 88203 - DNA, 20 bp, Artificial Sequence
  chemically synthesized
gctaatttttgtatttttgg

SEQ ID NO: 88204 - DNA, 20 bp, Artificial Sequence
  chemically synthesized
taatttttgtatttttggta

SEQ ID NO: 88205 - DNA, 20 bp, Artificial Sequence
  chemically synthesized
ttttgtatttttggtagaga

SEQ ID NO: 88206 - DNA, 20 bp, Artificial Sequence
  chemically synthesized
tttgtatttttggtagagac

SEQ ID NO: 88207 - DNA, 20 bp, Artificial Sequence
  chemically synthesized
gagacgggatttcaccatgt

SEQ ID NO: 88208 - DNA, 20 bp, Artificial Sequence
  chemically synthesized
cgggatttcaccatgttggc

SEQ ID NO: 88209 - DNA, 20 bp, Artificial Sequence
  chemically synthesized
cgagaccatcctggccaaca

SEQ ID NO: 88210 - DNA, 20 bp, Artificial Sequence
  chemically synthesized
gggatttcaccatgttggcc

SEQ ID NO: 88211 - DNA, 20 bp, Artificial Sequence
  chemically synthesized
tttcaccatgttggccagga

SEQ ID NO: 88212 - DNA, 20 bp, Artificial Sequence
  chemically synthesized
tcaagagatcgagaccatcc

SEQ ID NO: 88213 - DNA, 20 bp, Artificial Sequence
  chemically synthesized
gatcacgaggtcaagagatc

SEQ ID NO: 88214 - DNA, 20 bp, Artificial Sequence
  chemically synthesized
caggtggatcacgaggtcaa

SEQ ID NO: 88215 - DNA, 20 bp, Artificial Sequence
  chemically synthesized
ggcaggtggatcacgaggtc

SEQ ID NO: 88216 - DNA, 20 bp, Artificial Sequence
  chemically synthesized
gccgaggcaggtggatcacg

SEQ ID NO: 88217 - DNA, 20 bp, Artificial Sequence
  chemically synthesized
ggccgaggcaggtggatcac

SEQ ID NO: 88218 - DNA, 20 bp, Artificial Sequence
  chemically synthesized
acctcgtgatccacctgcct

SEQ ID NO: 88219 - DNA, 20 bp, Artificial Sequence
  chemically synthesized
ctttgggaggccgaggcagg

SEQ ID NO: 88220 - DNA, 20 bp, Artificial Sequence
  chemically synthesized
gcactttgggaggccgaggc

SEQ ID NO: 88221 - DNA, 20 bp, Artificial Sequence
  chemically synthesized
agcactttgggaggccgagg

SEQ ID NO: 88222 - DNA, 20 bp, Artificial Sequence
  chemically synthesized
cccagcactttgggaggccg

SEQ ID NO: 88223 - DNA, 20 bp, Artificial Sequence
  chemically synthesized
tcccagcactttgggaggcc

SEQ ID NO: 88224 - DNA, 20 bp, Artificial Sequence
  chemically synthesized
ccacctgcctcggcctccca

SEQ ID NO: 88225 - DNA, 20 bp, Artificial Sequence
  chemically synthesized
tgtaatcccagcactttggg

SEQ ID NO: 88226 - DNA, 20 bp, Artificial Sequence
  chemically synthesized
ctgtaatcccagcactttgg

SEQ ID NO: 88227 - DNA, 20 bp, Artificial Sequence
  chemically synthesized
gcctcggcctcccaaagtgc

SEQ ID NO: 88228 - DNA, 20 bp, Artificial Sequence
  chemically synthesized
gcctgtaatcccagcacttt

SEQ ID NO: 88229 - DNA, 20 bp, Artificial Sequence
  chemically synthesized
cctcggcctcccaaagtgct

SEQ ID NO: 88230 - DNA, 20 bp, Artificial Sequence
  chemically synthesized
cgcctgtaatcccagcactt

SEQ ID NO: 88231 - DNA, 20 bp, Artificial Sequence
  chemically synthesized
ctcccaaagtgctgggatta

SEQ ID NO: 88232 - DNA, 20 bp, Artificial Sequence
  chemically synthesized
tcccaaagtgctgggattac

SEQ ID NO: 88233 - DNA, 20 bp, Artificial Sequence
  chemically synthesized
gtggctcacgcctgtaatcc

SEQ ID NO: 88234 - DNA, 20 bp, Artificial Sequence
  chemically synthesized
agtgctgggattacaggcgt

SEQ ID NO: 88235 - DNA, 20 bp, Artificial Sequence
  chemically synthesized
caggcgtgagccactacgcc

SEQ ID NO: 88236 - DNA, 20 bp, Artificial Sequence
  chemically synthesized
tctgggtgggccaggcgtag

SEQ ID NO: 88237 - DNA, 20 bp, Artificial Sequence
  chemically synthesized
gagtctgggtgggccaggcg

SEQ ID NO: 88238 - DNA, 20 bp, Artificial Sequence
  chemically synthesized
acagggagtctgggtgggcc

SEQ ID NO: 88239 - DNA, 20 bp, Artificial Sequence
  chemically synthesized
gccactacgcctggcccacc

SEQ ID NO: 88240 - DNA, 20 bp, Artificial Sequence
  chemically synthesized
aacagggagtctgggtgggc

SEQ ID NO: 88241 - DNA, 20 bp, Artificial Sequence
  chemically synthesized
tgaaaacagggagtctgggt

SEQ ID NO: 88242 - DNA, 20 bp, Artificial Sequence
  chemically synthesized
atgaaaacagggagtctggg

SEQ ID NO: 88243 - DNA, 20 bp, Artificial Sequence
  chemically synthesized
aagatgaaaacagggagtct

SEQ ID NO: 88244 - DNA, 20 bp, Artificial Sequence
  chemically synthesized
caagatgaaaacagggagtc

SEQ ID NO: 88245 - DNA, 20 bp, Artificial Sequence
  chemically synthesized
agatacaagatgaaaacagg

SEQ ID NO: 88246 - DNA, 20 bp, Artificial Sequence
  chemically synthesized
gaagatacaagatgaaaaca

SEQ ID NO: 88247 - DNA, 20 bp, Artificial Sequence
  chemically synthesized
ggaagatacaagatgaaaac

SEQ ID NO: 88248 - DNA, 20 bp, Artificial Sequence
  chemically synthesized
tggaagatacaagatgaaaa

SEQ ID NO: 88249 - DNA, 20 bp, Artificial Sequence
  chemically synthesized
acttagcaagtggaagatac

SEQ ID NO: 88250 - DNA, 20 bp, Artificial Sequence
  chemically synthesized
tagggtcacttagcaagtgg

SEQ ID NO: 88251 - DNA, 20 bp, Artificial Sequence
  chemically synthesized
tcttgtatcttccacttgct

SEQ ID NO: 88252 - DNA, 20 bp, Artificial Sequence
  chemically synthesized
ccttagggtcacttagcaag

SEQ ID NO: 88253 - DNA, 20 bp, Artificial Sequence
  chemically synthesized
tttccttagggtcacttagc

SEQ ID NO: 88254 - DNA, 20 bp, Artificial Sequence
  chemically synthesized
ataatttccttagggtcact

SEQ ID NO: 88255 - DNA, 20 bp, Artificial Sequence
  chemically synthesized
tccacttgctaagtgaccct

SEQ ID NO: 88256 - DNA, 20 bp, Artificial Sequence
  chemically synthesized
ccacttgctaagtgacccta

SEQ ID NO: 88257 - DNA, 20 bp, Artificial Sequence
  chemically synthesized
gaggctaaataatttcctta

SEQ ID NO: 88258 - DNA, 20 bp, Artificial Sequence
  chemically synthesized
agaggctaaataatttcctt

SEQ ID NO: 88259 - DNA, 20 bp, Artificial Sequence
  chemically synthesized
gagaggctaaataatttcct

SEQ ID NO: 88260 - DNA, 20 bp, Artificial Sequence
  chemically synthesized
gtgaccctaaggaaattatt

SEQ ID NO: 88261 - DNA, 20 bp, Artificial Sequence
  chemically synthesized
gaagaaagtgaggcacagag

SEQ ID NO: 88262 - DNA, 20 bp, Artificial Sequence
  chemically synthesized
tgaagaaagtgaggcacaga

SEQ ID NO: 88263 - DNA, 20 bp, Artificial Sequence
  chemically synthesized
tttgaagaaagtgaggcaca

SEQ ID NO: 88264 - DNA, 20 bp, Artificial Sequence
  chemically synthesized
catttgaagaaagtgaggca

SEQ ID NO: 88265 - DNA, 20 bp, Artificial Sequence
  chemically synthesized
ttttacatttgaagaaagtg

SEQ ID NO: 88266 - DNA, 20 bp, Artificial Sequence
  chemically synthesized
tttttacatttgaagaaagt

SEQ ID NO: 88267 - DNA, 20 bp, Artificial Sequence
  chemically synthesized
attctttttacatttgaaga

SEQ ID NO: 88268 - DNA, 20 bp, Artificial Sequence
  chemically synthesized
ttgaattctttttacatttg

SEQ ID NO: 88269 - DNA, 20 bp, Artificial Sequence
  chemically synthesized
tcactttcttcaaatgtaaa

SEQ ID NO: 88270 - DNA, 20 bp, Artificial Sequence
  chemically synthesized
caataataaaatctacctct

SEQ ID NO: 88271 - DNA, 20 bp, Artificial Sequence
  chemically synthesized
aataataaaatctacctctt

SEQ ID NO: 88272 - DNA, 20 bp, Artificial Sequence
  chemically synthesized
ataataaaatctacctctta

SEQ ID NO: 88273 - DNA, 20 bp, Artificial Sequence
  chemically synthesized
ctctcagcaaccctaagagg

SEQ ID NO: 88274 - DNA, 20 bp, Artificial Sequence
  chemically synthesized
atgctctcagcaaccctaag

SEQ ID NO: 88275 - DNA, 20 bp, Artificial Sequence
  chemically synthesized
aatgctctcagcaaccctaa

SEQ ID NO: 88276 - DNA, 20 bp, Artificial Sequence
  chemically synthesized
ttaatgctctcagcaaccct

SEQ ID NO: 88277 - DNA, 20 bp, Artificial Sequence
  chemically synthesized
atctacctcttagggttgct

SEQ ID NO: 88278 - DNA, 20 bp, Artificial Sequence
  chemically synthesized
ctacctcttagggttgctga

SEQ ID NO: 88279 - DNA, 20 bp, Artificial Sequence
  chemically synthesized
attgaccggtttaatgctct

SEQ ID NO: 88280 - DNA, 20 bp, Artificial Sequence
  chemically synthesized
ggttgctgagagcattaaac

SEQ ID NO: 88281 - DNA, 20 bp, Artificial Sequence
  chemically synthesized
agcactttccattcattgac

SEQ ID NO: 88282 - DNA, 20 bp, Artificial Sequence
  chemically synthesized
gcattaaaccggtcaatgaa

SEQ ID NO: 88283 - DNA, 20 bp, Artificial Sequence
  chemically synthesized
taaaccggtcaatgaatgga

SEQ ID NO: 88284 - DNA, 20 bp, Artificial Sequence
  chemically synthesized
caatgaatggaaagtgctta

SEQ ID NO: 88285 - DNA, 20 bp, Artificial Sequence
  chemically synthesized
tacataccacgcaatgccat

SEQ ID NO: 88286 - DNA, 20 bp, Artificial Sequence
  chemically synthesized
aaagtgcttatggcattgcg

SEQ ID NO: 88287 - DNA, 20 bp, Artificial Sequence
  chemically synthesized
ttatggcattgcgtggtatg

SEQ ID NO: 88288 - DNA, 20 bp, Artificial Sequence
  chemically synthesized
tatggcattgcgtggtatgt

SEQ ID NO: 88289 - DNA, 20 bp, Artificial Sequence
  chemically synthesized
taggtacatcatgtaaatat

SEQ ID NO: 88290 - DNA, 20 bp, Artificial Sequence
  chemically synthesized
catcaagtatgaaataatga

SEQ ID NO: 88291 - DNA, 20 bp, Artificial Sequence
  chemically synthesized
tcattatttcatacttgatg

SEQ ID NO: 88292 - DNA, 20 bp, Artificial Sequence
  chemically synthesized
ctattgtaaatgtctgcatc

SEQ ID NO: 88293 - DNA, 20 bp, Artificial Sequence
  chemically synthesized
cttgatgcagacatttacaa

SEQ ID NO: 88294 - DNA, 20 bp, Artificial Sequence
  chemically synthesized
ctgcatttttagtaattcag

SEQ ID NO: 88295 - DNA, 20 bp, Artificial Sequence
  chemically synthesized
aatctgcatttttagtaatt

SEQ ID NO: 88296 - DNA, 20 bp, Artificial Sequence
  chemically synthesized
cttctgaattactaaaaatg

SEQ ID NO: 88297 - DNA, 20 bp, Artificial Sequence
  chemically synthesized
aggaggaaaatctgcatttt

SEQ ID NO: 88298 - DNA, 20 bp, Artificial Sequence
  chemically synthesized
aatgcagattttcctcctta

SEQ ID NO: 88299 - DNA, 20 bp, Artificial Sequence
  chemically synthesized
acatatatacttctataagg

SEQ ID NO: 88300 - DNA, 20 bp, Artificial Sequence
  chemically synthesized
gcagattttcctccttatag

SEQ ID NO: 88301 - DNA, 20 bp, Artificial Sequence
  chemically synthesized
aacatatatacttctataag

SEQ ID NO: 88302 - DNA, 20 bp, Artificial Sequence
  chemically synthesized
ttaacatatatacttctata

SEQ ID NO: 88303 - DNA, 20 bp, Artificial Sequence
  chemically synthesized
tttaacatatatacttctat

SEQ ID NO: 88304 - DNA, 20 bp, Artificial Sequence
  chemically synthesized
aagtatatatgttaaaattt

SEQ ID NO: 88305 - DNA, 20 bp, Artificial Sequence
  chemically synthesized
tatatgttaaaattttggac

SEQ ID NO: 88306 - DNA, 20 bp, Artificial Sequence
  chemically synthesized
tgttaaaattttggacaagt

SEQ ID NO: 88307 - DNA, 20 bp, Artificial Sequence
  chemically synthesized
taaaattttggacaagttag

SEQ ID NO: 88308 - DNA, 20 bp, Artificial Sequence
  chemically synthesized
gacaagttagaagaactata

SEQ ID NO: 88309 - DNA, 20 bp, Artificial Sequence
  chemically synthesized
aagttagaagaactataaag

SEQ ID NO: 88310 - DNA, 20 bp, Artificial Sequence
  chemically synthesized
gagattttttttcttcttta

SEQ ID NO: 88311 - DNA, 20 bp, Artificial Sequence
  chemically synthesized
ggtagaaagattacagaagg

SEQ ID NO: 88312 - DNA, 20 bp, Artificial Sequence
  chemically synthesized
taggtagaaagattacagaa

SEQ ID NO: 88313 - DNA, 20 bp, Artificial Sequence
  chemically synthesized
ctaggtagaaagattacaga

SEQ ID NO: 88314 - DNA, 20 bp, Artificial Sequence
  chemically synthesized
tctaggtagaaagattacag

SEQ ID NO: 88315 - DNA, 20 bp, Artificial Sequence
  chemically synthesized
acctctaggtagaaagatta

SEQ ID NO: 88316 - DNA, 20 bp, Artificial Sequence
  chemically synthesized
ccttctgtaatctttctacc

SEQ ID NO: 88317 - DNA, 20 bp, Artificial Sequence
  chemically synthesized
agttactacctctaggtaga

SEQ ID NO: 88318 - DNA, 20 bp, Artificial Sequence
  chemically synthesized
ttctgtaatctttctaccta

SEQ ID NO: 88319 - DNA, 20 bp, Artificial Sequence
  chemically synthesized
tctgtaatctttctacctag

SEQ ID NO: 88320 - DNA, 20 bp, Artificial Sequence
  chemically synthesized
gagtagttactacctctagg

SEQ ID NO: 88321 - DNA, 20 bp, Artificial Sequence
  chemically synthesized
gtaatctttctacctagagg

SEQ ID NO: 88322 - DNA, 20 bp, Artificial Sequence
  chemically synthesized
cgggagtagttactacctct

SEQ ID NO: 88323 - DNA, 20 bp, Artificial Sequence
  chemically synthesized
acgggagtagttactacctc

SEQ ID NO: 88324 - DNA, 20 bp, Artificial Sequence
  chemically synthesized
tatacactaaatgacgggag

SEQ ID NO: 88325 - DNA, 20 bp, Artificial Sequence
  chemically synthesized
gagtatacactaaatgacgg

SEQ ID NO: 88326 - DNA, 20 bp, Artificial Sequence
  chemically synthesized
tagtaactactcccgtcatt

SEQ ID NO: 88327 - DNA, 20 bp, Artificial Sequence
  chemically synthesized
gggagtatacactaaatgac

SEQ ID NO: 88328 - DNA, 20 bp, Artificial Sequence
  chemically synthesized
tgggagtatacactaaatga

SEQ ID NO: 88329 - DNA, 20 bp, Artificial Sequence
  chemically synthesized
ggacttaataatagttatgg

SEQ ID NO: 88330 - DNA, 20 bp, Artificial Sequence
  chemically synthesized
atggacttaataatagttat

SEQ ID NO: 88331 - DNA, 20 bp, Artificial Sequence
  chemically synthesized
aatggacttaataatagtta

SEQ ID NO: 88332 - DNA, 20 bp, Artificial Sequence
  chemically synthesized
atactcccataactattatt

SEQ ID NO: 88333 - DNA, 20 bp, Artificial Sequence
  chemically synthesized
tgaccaaatggacttaataa

SEQ ID NO: 88334 - DNA, 20 bp, Artificial Sequence
  chemically synthesized
taactattattaagtccatt

SEQ ID NO: 88335 - DNA, 20 bp, Artificial Sequence
  chemically synthesized
ggaggtagaagatgaccaaa

SEQ ID NO: 88336 - DNA, 20 bp, Artificial Sequence
  chemically synthesized
gtgataatgaagggaggtag

SEQ ID NO: 88337 - DNA, 20 bp, Artificial Sequence
  chemically synthesized
aaagtgataatgaagggagg

SEQ ID NO: 88338 - DNA, 20 bp, Artificial Sequence
  chemically synthesized
gaaaaagtgataatgaaggg

SEQ ID NO: 88339 - DNA, 20 bp, Artificial Sequence
  chemically synthesized
agaaaaagtgataatgaagg

SEQ ID NO: 88340 - DNA, 20 bp, Artificial Sequence
  chemically synthesized
agagaaaaagtgataatgaa

SEQ ID NO: 88341 - DNA, 20 bp, Artificial Sequence
  chemically synthesized
tagagaaaaagtgataatga

SEQ ID NO: 88342 - DNA, 20 bp, Artificial Sequence
  chemically synthesized
ctagagaaaaagtgataatg

SEQ ID NO: 88343 - DNA, 20 bp, Artificial Sequence
  chemically synthesized
cttcattatcactttttctc

SEQ ID NO: 88344 - DNA, 20 bp, Artificial Sequence
  chemically synthesized
ttcttctgtgtctagagaaa

SEQ ID NO: 88345 - DNA, 20 bp, Artificial Sequence
  chemically synthesized
tatcactttttctctagaca

SEQ ID NO: 88346 - DNA, 20 bp, Artificial Sequence
  chemically synthesized
tgtgctttcttctgtgtcta

SEQ ID NO: 88347 - DNA, 20 bp, Artificial Sequence
  chemically synthesized
cactttttctctagacacag

SEQ ID NO: 88348 - DNA, 20 bp, Artificial Sequence
  chemically synthesized
tttgtgctttcttctgtgtc

SEQ ID NO: 88349 - DNA, 20 bp, Artificial Sequence
  chemically synthesized
ttttctctagacacagaaga

SEQ ID NO: 88350 - DNA, 20 bp, Artificial Sequence
  chemically synthesized
agcacaaaatatttttaata

SEQ ID NO: 88351 - DNA, 20 bp, Artificial Sequence
  chemically synthesized
cacaaaatatttttaataaa

SEQ ID NO: 88352 - DNA, 20 bp, Artificial Sequence
  chemically synthesized
ttaataaagagaaatgaatt

SEQ ID NO: 88353 - DNA, 20 bp, Artificial Sequence
  chemically synthesized
taaagagaaatgaattaaga

SEQ ID NO: 88354 - DNA, 20 bp, Artificial Sequence
  chemically synthesized
aaagagaaatgaattaagaa

SEQ ID NO: 88355 - DNA, 20 bp, Artificial Sequence
  chemically synthesized
aattaagaaaggcaactgct

SEQ ID NO: 88356 - DNA, 20 bp, Artificial Sequence
  chemically synthesized
aagaaaggcaactgcttaga

SEQ ID NO: 88357 - DNA, 20 bp, Artificial Sequence
  chemically synthesized
caggcttcctgctttctaag

SEQ ID NO: 88358 - DNA, 20 bp, Artificial Sequence
  chemically synthesized
aaaggcaactgcttagaaag

SEQ ID NO: 88359 - DNA, 20 bp, Artificial Sequence
  chemically synthesized
aaggcaactgcttagaaagc

SEQ ID NO: 88360 - DNA, 20 bp, Artificial Sequence
  chemically synthesized
agccaggcttcctgctttct

SEQ ID NO: 88361 - DNA, 20 bp, Artificial Sequence
  chemically synthesized
gcaactgcttagaaagcagg

SEQ ID NO: 88362 - DNA, 20 bp, Artificial Sequence
  chemically synthesized
tgcttagaaagcaggaagcc

SEQ ID NO: 88363 - DNA, 20 bp, Artificial Sequence
  chemically synthesized
aagggcggggaatgaaagcc

SEQ ID NO: 88364 - DNA, 20 bp, Artificial Sequence
  chemically synthesized
caagggcggggaatgaaagc

SEQ ID NO: 88365 - DNA, 20 bp, Artificial Sequence
  chemically synthesized
ctagcaagggcggggaatga

SEQ ID NO: 88366 - DNA, 20 bp, Artificial Sequence
  chemically synthesized
taaatgatctagcaagggcg

SEQ ID NO: 88367 - DNA, 20 bp, Artificial Sequence
  chemically synthesized
ttaaatgatctagcaagggc

SEQ ID NO: 88368 - DNA, 20 bp, Artificial Sequence
  chemically synthesized
ctttcattccccgcccttgc

SEQ ID NO: 88369 - DNA, 20 bp, Artificial Sequence
  chemically synthesized
cttaaatgatctagcaaggg

SEQ ID NO: 88370 - DNA, 20 bp, Artificial Sequence
  chemically synthesized
taacttaaatgatctagcaa

SEQ ID NO: 88371 - DNA, 20 bp, Artificial Sequence
  chemically synthesized
gtaacttaaatgatctagca

SEQ ID NO: 88372 - DNA, 20 bp, Artificial Sequence
  chemically synthesized
tgtaacttaaatgatctagc

SEQ ID NO: 88373 - DNA, 20 bp, Artificial Sequence
  chemically synthesized
ccattgtaacttaaatgatc

SEQ ID NO: 88374 - DNA, 20 bp, Artificial Sequence
  chemically synthesized
ccgcccttgctagatcattt

SEQ ID NO: 88375 - DNA, 20 bp, Artificial Sequence
  chemically synthesized
ctagatcatttaagttacaa

SEQ ID NO: 88376 - DNA, 20 bp, Artificial Sequence
  chemically synthesized
tagatcatttaagttacaat

SEQ ID NO: 88377 - DNA, 20 bp, Artificial Sequence
  chemically synthesized
aacaaaaggatagagatagt

SEQ ID NO: 88378 - DNA, 20 bp, Artificial Sequence
  chemically synthesized
gaggaacaaaaggatagaga

SEQ ID NO: 88379 - DNA, 20 bp, Artificial Sequence
  chemically synthesized
cgtggaggaacaaaaggata

SEQ ID NO: 88380 - DNA, 20 bp, Artificial Sequence
  chemically synthesized
tccgtggaggaacaaaagga

SEQ ID NO: 88381 - DNA, 20 bp, Artificial Sequence
  chemically synthesized
tagttccgtggaggaacaaa

SEQ ID NO: 88382 - DNA, 20 bp, Artificial Sequence
  chemically synthesized
atagttccgtggaggaacaa

SEQ ID NO: 88383 - DNA, 20 bp, Artificial Sequence
  chemically synthesized
tctatccttttgttcctcca

SEQ ID NO: 88384 - DNA, 20 bp, Artificial Sequence
  chemically synthesized
gttttgcaatagttccgtgg

SEQ ID NO: 88385 - DNA, 20 bp, Artificial Sequence
  chemically synthesized
agttttgcaatagttccgtg

SEQ ID NO: 88386 - DNA, 20 bp, Artificial Sequence
  chemically synthesized
ccagttttgcaatagttccg

SEQ ID NO: 88387 - DNA, 20 bp, Artificial Sequence
  chemically synthesized
ttgttataccagttttgcaa

SEQ ID NO: 88388 - DNA, 20 bp, Artificial Sequence
  chemically synthesized
ccacggaactattgcaaaac

SEQ ID NO: 88389 - DNA, 20 bp, Artificial Sequence
  chemically synthesized
tattgcaaaactggtataac

SEQ ID NO: 88390 - DNA, 20 bp, Artificial Sequence
  chemically synthesized
gagggaagttcttgttatac

SEQ ID NO: 88391 - DNA, 20 bp, Artificial Sequence
  chemically synthesized
tttgtaaaaagggcagaggg

SEQ ID NO: 88392 - DNA, 20 bp, Artificial Sequence
  chemically synthesized
atctttgtaaaaagggcaga

SEQ ID NO: 88393 - DNA, 20 bp, Artificial Sequence
  chemically synthesized
catctttgtaaaaagggcag

SEQ ID NO: 88394 - DNA, 20 bp, Artificial Sequence
  chemically synthesized
gcatctttgtaaaaagggca

SEQ ID NO: 88395 - DNA, 20 bp, Artificial Sequence
  chemically synthesized
tagcatctttgtaaaaaggg

SEQ ID NO: 88396 - DNA, 20 bp, Artificial Sequence
  chemically synthesized
tcatagcatctttgtaaaaa

SEQ ID NO: 88397 - DNA, 20 bp, Artificial Sequence
  chemically synthesized
ttccctctgccctttttaca

SEQ ID NO: 88398 - DNA, 20 bp, Artificial Sequence
  chemically synthesized
atcatagcatctttgtaaaa

SEQ ID NO: 88399 - DNA, 20 bp, Artificial Sequence
  chemically synthesized
catcatagcatctttgtaaa

SEQ ID NO: 88400 - DNA, 20 bp, Artificial Sequence
  chemically synthesized
gttagttaatggatgcatca

SEQ ID NO: 88401 - DNA, 20 bp, Artificial Sequence
  chemically synthesized
tctttggagaagttagttaa

SEQ ID NO: 88402 - DNA, 20 bp, Artificial Sequence
  chemically synthesized
ccagctttctttggagaagt

SEQ ID NO: 88403 - DNA, 20 bp, Artificial Sequence
  chemically synthesized
tccattaactaacttctcca

SEQ ID NO: 88404 - DNA, 20 bp, Artificial Sequence
  chemically synthesized
tgtgccagctttctttggag

SEQ ID NO: 88405 - DNA, 20 bp, Artificial Sequence
  chemically synthesized
ttaactaacttctccaaaga

SEQ ID NO: 88406 - DNA, 20 bp, Artificial Sequence
  chemically synthesized
ctatgtgccagctttctttg

SEQ ID NO: 88407 - DNA, 20 bp, Artificial Sequence
  chemically synthesized
ttctatgtgccagctttctt

SEQ ID NO: 88408 - DNA, 20 bp, Artificial Sequence
  chemically synthesized
ctaacttctccaaagaaagc

SEQ ID NO: 88409 - DNA, 20 bp, Artificial Sequence
  chemically synthesized
ctccaaagaaagctggcaca

SEQ ID NO: 88410 - DNA, 20 bp, Artificial Sequence
  chemically synthesized
ttttgcccccttctatgtgc

SEQ ID NO: 88411 - DNA, 20 bp, Artificial Sequence
  chemically synthesized
caaagaaagctggcacatag

SEQ ID NO: 88412 - DNA, 20 bp, Artificial Sequence
  chemically synthesized
aaagaaagctggcacataga

SEQ ID NO: 88413 - DNA, 20 bp, Artificial Sequence
  chemically synthesized
aagaaagctggcacatagaa

SEQ ID NO: 88414 - DNA, 20 bp, Artificial Sequence
  chemically synthesized
agaaagctggcacatagaag

SEQ ID NO: 88415 - DNA, 20 bp, Artificial Sequence
  chemically synthesized
gaaagctggcacatagaagg

SEQ ID NO: 88416 - DNA, 20 bp, Artificial Sequence
  chemically synthesized
atagaagggggcaaaatata

SEQ ID NO: 88417 - DNA, 20 bp, Artificial Sequence
  chemically synthesized
gggcaaaatataaagtatgt

SEQ ID NO: 88418 - DNA, 20 bp, Artificial Sequence
  chemically synthesized
tgtgagtatactacaactaa

SEQ ID NO: 88419 - DNA, 20 bp, Artificial Sequence
  chemically synthesized
gtaaactaagcttttagttg

SEQ ID NO: 88420 - DNA, 20 bp, Artificial Sequence
  chemically synthesized
gtatactacaactaaaagct

SEQ ID NO: 88421 - DNA, 20 bp, Artificial Sequence
  chemically synthesized
tcctctgtaaactaagcttt

SEQ ID NO: 88422 - DNA, 20 bp, Artificial Sequence
  chemically synthesized
acaactaaaagcttagttta

SEQ ID NO: 88423 - DNA, 20 bp, Artificial Sequence
  chemically synthesized
aaacacatcctctgtaaact

SEQ ID NO: 88424 - DNA, 20 bp, Artificial Sequence
  chemically synthesized
aactaaaagcttagtttaca

SEQ ID NO: 88425 - DNA, 20 bp, Artificial Sequence
  chemically synthesized
actaaaagcttagtttacag

SEQ ID NO: 88426 - DNA, 20 bp, Artificial Sequence
  chemically synthesized
gatgtgttttaacaaaatct

SEQ ID NO: 88427 - DNA, 20 bp, Artificial Sequence
  chemically synthesized
tgtgttttaacaaaatctga

SEQ ID NO: 88428 - DNA, 20 bp, Artificial Sequence
  chemically synthesized
gtgttttaacaaaatctgag

SEQ ID NO: 88429 - DNA, 20 bp, Artificial Sequence
  chemically synthesized
ttttaacaaaatctgagagg

SEQ ID NO: 88430 - DNA, 20 bp, Artificial Sequence
  chemically synthesized
tcctgtcttttgcttcctct

SEQ ID NO: 88431 - DNA, 20 bp, Artificial Sequence
  chemically synthesized
caaaatctgagaggaagcaa

SEQ ID NO: 88432 - DNA, 20 bp, Artificial Sequence
  chemically synthesized
atctgagaggaagcaaaaga

SEQ ID NO: 88433 - DNA, 20 bp, Artificial Sequence
  chemically synthesized
tctgagaggaagcaaaagac

SEQ ID NO: 88434 - DNA, 20 bp, Artificial Sequence
  chemically synthesized
gagaggaagcaaaagacagg

SEQ ID NO: 88435 - DNA, 20 bp, Artificial Sequence
  chemically synthesized
caaaagacaggaagttgcta

SEQ ID NO: 88436 - DNA, 20 bp, Artificial Sequence
  chemically synthesized
ctacagttaaagagagacta

SEQ ID NO: 88437 - DNA, 20 bp, Artificial Sequence
  chemically synthesized
atagctcctacagttaaaga

SEQ ID NO: 88438 - DNA, 20 bp, Artificial Sequence
  chemically synthesized
agatagctcctacagttaaa

SEQ ID NO: 88439 - DNA, 20 bp, Artificial Sequence
  chemically synthesized
ctatagtctctctttaactg

SEQ ID NO: 88440 - DNA, 20 bp, Artificial Sequence
  chemically synthesized
tatagtctctctttaactgt

SEQ ID NO: 88441 - DNA, 20 bp, Artificial Sequence
  chemically synthesized
ggagatagctcctacagtta

SEQ ID NO: 88442 - DNA, 20 bp, Artificial Sequence
  chemically synthesized
tagtctctctttaactgtag

SEQ ID NO: 88443 - DNA, 20 bp, Artificial Sequence
  chemically synthesized
tttagaggagatagctccta

SEQ ID NO: 88444 - DNA, 20 bp, Artificial Sequence
  chemically synthesized
aattaacagtttagaggaga

SEQ ID NO: 88445 - DNA, 20 bp, Artificial Sequence
  chemically synthesized
ttataattaacagtttagag

SEQ ID NO: 88446 - DNA, 20 bp, Artificial Sequence
  chemically synthesized
cattataattaacagtttag

SEQ ID NO: 88447 - DNA, 20 bp, Artificial Sequence
  chemically synthesized
acattataattaacagttta

SEQ ID NO: 88448 - DNA, 20 bp, Artificial Sequence
  chemically synthesized
acacattataattaacagtt

SEQ ID NO: 88449 - DNA, 20 bp, Artificial Sequence
  chemically synthesized
ctgtaacacattataattaa

SEQ ID NO: 88450 - DNA, 20 bp, Artificial Sequence
  chemically synthesized
ctgttaattataatgtgtta

SEQ ID NO: 88451 - DNA, 20 bp, Artificial Sequence
  chemically synthesized
tgttaattataatgtgttac

SEQ ID NO: 88452 - DNA, 20 bp, Artificial Sequence
  chemically synthesized
tataattgtaatgtgttata

SEQ ID NO: 88453 - DNA, 20 bp, Artificial Sequence
  chemically synthesized
ataattgtaatgtgttataa

SEQ ID NO: 88454 - DNA, 20 bp, Artificial Sequence
  chemically synthesized
taattgtaatgtgttataaa

SEQ ID NO: 88455 - DNA, 20 bp, Artificial Sequence
  chemically synthesized
atgtgttataaagggtttta

SEQ ID NO: 88456 - DNA, 20 bp, Artificial Sequence
  chemically synthesized
gggttttaaagactgtcctc

SEQ ID NO: 88457 - DNA, 20 bp, Artificial Sequence
  chemically synthesized
tctaaatgcataccagagga

SEQ ID NO: 88458 - DNA, 20 bp, Artificial Sequence
  chemically synthesized
ttagtctaaatgcataccag

SEQ ID NO: 88459 - DNA, 20 bp, Artificial Sequence
  chemically synthesized
attagtctaaatgcatacca

SEQ ID NO: 88460 - DNA, 20 bp, Artificial Sequence
  chemically synthesized
gcattagtctaaatgcatac

SEQ ID NO: 88461 - DNA, 20 bp, Artificial Sequence
  chemically synthesized
actgtcctctggtatgcatt

SEQ ID NO: 88462 - DNA, 20 bp, Artificial Sequence
  chemically synthesized
tatggaattatttttggcat

SEQ ID NO: 88463 - DNA, 20 bp, Artificial Sequence
  chemically synthesized
atgtattatggaattatttt

SEQ ID NO: 88464 - DNA, 20 bp, Artificial Sequence
  chemically synthesized
aaattaacggatatgtatta

SEQ ID NO: 88465 - DNA, 20 bp, Artificial Sequence
  chemically synthesized
aaaaagtgataaaaaattaa

SEQ ID NO: 88466 - DNA, 20 bp, Artificial Sequence
  chemically synthesized
atatcacagggttatacaaa

SEQ ID NO: 88467 - DNA, 20 bp, Artificial Sequence
  chemically synthesized
ttctctcttggcatatcaca

SEQ ID NO: 88468 - DNA, 20 bp, Artificial Sequence
  chemically synthesized
tttctctcttggcatatcac

SEQ ID NO: 88469 - DNA, 20 bp, Artificial Sequence
  chemically synthesized
atttctctcttggcatatca

SEQ ID NO: 88470 - DNA, 20 bp, Artificial Sequence
  chemically synthesized
gtataaccctgtgatatgcc

SEQ ID NO: 88471 - DNA, 20 bp, Artificial Sequence
  chemically synthesized
ataaccctgtgatatgccaa

SEQ ID NO: 88472 - DNA, 20 bp, Artificial Sequence
  chemically synthesized
aaccctgtgatatgccaaga

SEQ ID NO: 88473 - DNA, 20 bp, Artificial Sequence
  chemically synthesized
agtttcataaatttctctct

SEQ ID NO: 88474 - DNA, 20 bp, Artificial Sequence
  chemically synthesized
aagagagaaatttatgaaac

SEQ ID NO: 88475 - DNA, 20 bp, Artificial Sequence
  chemically synthesized
agaaatttatgaaactagaa

SEQ ID NO: 88476 - DNA, 20 bp, Artificial Sequence
  chemically synthesized
aatgaggagtgcagctattc

SEQ ID NO: 88477 - DNA, 20 bp, Artificial Sequence
  chemically synthesized
gtgaatttaaatgaggagtg

SEQ ID NO: 88478 - DNA, 20 bp, Artificial Sequence
  chemically synthesized
tcagagtgaatttaaatgag

SEQ ID NO: 88479 - DNA, 20 bp, Artificial Sequence
  chemically synthesized
catcagagtgaatttaaatg

SEQ ID NO: 88480 - DNA, 20 bp, Artificial Sequence
  chemically synthesized
acatcagagtgaatttaaat

SEQ ID NO: 88481 - DNA, 20 bp, Artificial Sequence
  chemically synthesized
acatgcatattaagacatca

SEQ ID NO: 88482 - DNA, 20 bp, Artificial Sequence
  chemically synthesized
agacatgcatattaagacat

SEQ ID NO: 88483 - DNA, 20 bp, Artificial Sequence
  chemically synthesized
acataggagacatgcatatt

SEQ ID NO: 88484 - DNA, 20 bp, Artificial Sequence
  chemically synthesized
gtaatgttttataaacatag

SEQ ID NO: 88485 - DNA, 20 bp, Artificial Sequence
  chemically synthesized
tggtaatgttttataaacat

SEQ ID NO: 88486 - DNA, 20 bp, Artificial Sequence
  chemically synthesized
gtggtaatgttttataaaca

SEQ ID NO: 88487 - DNA, 20 bp, Artificial Sequence
  chemically synthesized
ggattcagattagattaaag

SEQ ID NO: 88488 - DNA, 20 bp, Artificial Sequence
  chemically synthesized
tgaggattcagattagatta

SEQ ID NO: 88489 - DNA, 20 bp, Artificial Sequence
  chemically synthesized
tgatacttgaggattcagat

SEQ ID NO: 88490 - DNA, 20 bp, Artificial Sequence
  chemically synthesized
ttaatctaatctgaatcctc

SEQ ID NO: 88491 - DNA, 20 bp, Artificial Sequence
  chemically synthesized
ggagatgatacttgaggatt

SEQ ID NO: 88492 - DNA, 20 bp, Artificial Sequence
  chemically synthesized
tggtatggagatgatacttg

SEQ ID NO: 88493 - DNA, 20 bp, Artificial Sequence
  chemically synthesized
ttggtatggagatgatactt

SEQ ID NO: 88494 - DNA, 20 bp, Artificial Sequence
  chemically synthesized
tcaagtatcatctccatacc

SEQ ID NO: 88495 - DNA, 20 bp, Artificial Sequence
  chemically synthesized
tcatttatttgcttggtatg

SEQ ID NO: 88496 - DNA, 20 bp, Artificial Sequence
  chemically synthesized
aatcatttatttgcttggta

SEQ ID NO: 88497 - DNA, 20 bp, Artificial Sequence
  chemically synthesized
aaatgaatcatttatttgct

SEQ ID NO: 88498 - DNA, 20 bp, Artificial Sequence
  chemically synthesized
tgattcatttattcaaaata

SEQ ID NO: 88499 - DNA, 20 bp, Artificial Sequence
  chemically synthesized
acagtgaatcattctgaaat

SEQ ID NO: 88500 - DNA, 20 bp, Artificial Sequence
  chemically synthesized
ctacgtaaatcatccaattt

SEQ ID NO: 88501 - DNA, 20 bp, Artificial Sequence
  chemically synthesized
ctgaaattggatgatttacg

SEQ ID NO: 88502 - DNA, 20 bp, Artificial Sequence
  chemically synthesized
gatgatttacgtagacatgt

SEQ ID NO: 88503 - DNA, 20 bp, Artificial Sequence
  chemically synthesized
tacgtagacatgtgagatac

SEQ ID NO: 88504 - DNA, 20 bp, Artificial Sequence
  chemically synthesized
attgtcttagcacaagtaac

SEQ ID NO: 88505 - DNA, 20 bp, Artificial Sequence
  chemically synthesized
agataccagttacttgtgct

SEQ ID NO: 88506 - DNA, 20 bp, Artificial Sequence
  chemically synthesized
tttcctcattgtcttagcac

SEQ ID NO: 88507 - DNA, 20 bp, Artificial Sequence
  chemically synthesized
gttacttgtgctaagacaat

SEQ ID NO: 88508 - DNA, 20 bp, Artificial Sequence
  chemically synthesized
ccaaattttcctcattgtct

SEQ ID NO: 88509 - DNA, 20 bp, Artificial Sequence
  chemically synthesized
ttacttgtgctaagacaatg

SEQ ID NO: 88510 - DNA, 20 bp, Artificial Sequence
  chemically synthesized
ctaagacaatgaggaaaatt

SEQ ID NO: 88511 - DNA, 20 bp, Artificial Sequence
  chemically synthesized
aggccacaaatgaattaaaa

SEQ ID NO: 88512 - DNA, 20 bp, Artificial Sequence
  chemically synthesized
tggccattttaattcatttg

SEQ ID NO: 88513 - DNA, 20 bp, Artificial Sequence
  chemically synthesized
ggaaaagatgtggagcaaaa

SEQ ID NO: 88514 - DNA, 20 bp, Artificial Sequence
  chemically synthesized
aggaaaagatgtggagcaaa

SEQ ID NO: 88515 - DNA, 20 bp, Artificial Sequence
  chemically synthesized
attaggtaggaaaagatgtg

SEQ ID NO: 88516 - DNA, 20 bp, Artificial Sequence
  chemically synthesized
acattaggtaggaaaagatg

SEQ ID NO: 88517 - DNA, 20 bp, Artificial Sequence
  chemically synthesized
ctctcaacattaggtaggaa

SEQ ID NO: 88518 - DNA, 20 bp, Artificial Sequence
  chemically synthesized
aaagtctctcaacattaggt

SEQ ID NO: 88519 - DNA, 20 bp, Artificial Sequence
  chemically synthesized
aaaagtctctcaacattagg

SEQ ID NO: 88520 - DNA, 20 bp, Artificial Sequence
  chemically synthesized
atcttttcctacctaatgtt

SEQ ID NO: 88521 - DNA, 20 bp, Artificial Sequence
  chemically synthesized
ggaaaaagtctctcaacatt

SEQ ID NO: 88522 - DNA, 20 bp, Artificial Sequence
  chemically synthesized
cttttcctacctaatgttga

SEQ ID NO: 88523 - DNA, 20 bp, Artificial Sequence
  chemically synthesized
cggaaaaagtctctcaacat

SEQ ID NO: 88524 - DNA, 20 bp, Artificial Sequence
  chemically synthesized
atgttgagagactttttccg

SEQ ID NO: 88525 - DNA, 20 bp, Artificial Sequence
  chemically synthesized
agtggagtgaacttcggaaa

SEQ ID NO: 88526 - DNA, 20 bp, Artificial Sequence
  chemically synthesized
acttcaagtggagtgaactt

SEQ ID NO: 88527 - DNA, 20 bp, Artificial Sequence
  chemically synthesized
tccgaagttcactccacttg

SEQ ID NO: 88528 - DNA, 20 bp, Artificial Sequence
  chemically synthesized
gataacatgaacttcaagtg

SEQ ID NO: 88529 - DNA, 20 bp, Artificial Sequence
  chemically synthesized
tggataacatgaacttcaag

SEQ ID NO: 88530 - DNA, 20 bp, Artificial Sequence
  chemically synthesized
gtttggataacatgaacttc

SEQ ID NO: 88531 - DNA, 20 bp, Artificial Sequence
  chemically synthesized
agtcctgttacaaagacgtt

SEQ ID NO: 88532 - DNA, 20 bp, Artificial Sequence
  chemically synthesized
ttatccaaacgtctttgtaa

SEQ ID NO: 88533 - DNA, 20 bp, Artificial Sequence
  chemically synthesized
tatccaaacgtctttgtaac

SEQ ID NO: 88534 - DNA, 20 bp, Artificial Sequence
  chemically synthesized
gatgatgcagtcctgttaca

SEQ ID NO: 88535 - DNA, 20 bp, Artificial Sequence
  chemically synthesized
ttgtaacaggactgcatcat

SEQ ID NO: 88536 - DNA, 20 bp, Artificial Sequence
  chemically synthesized
cctggaaggttccgatgatg

SEQ ID NO: 88537 - DNA, 20 bp, Artificial Sequence
  chemically synthesized
actgcatcatcggaaccttc

SEQ ID NO: 88538 - DNA, 20 bp, Artificial Sequence
  chemically synthesized
ctgcatcatcggaaccttcc

SEQ ID NO: 88539 - DNA, 20 bp, Artificial Sequence
  chemically synthesized
tgcatcatcggaaccttcca

SEQ ID NO: 88540 - DNA, 20 bp, Artificial Sequence
  chemically synthesized
aaaatcctgagatccctgga

SEQ ID NO: 88541 - DNA, 20 bp, Artificial Sequence
  chemically synthesized
aaaaatcctgagatccctgg

SEQ ID NO: 88542 - DNA, 20 bp, Artificial Sequence
  chemically synthesized
tcggaaccttccagggatct

SEQ ID NO: 88543 - DNA, 20 bp, Artificial Sequence
  chemically synthesized
ccaaaaaatcctgagatccc

SEQ ID NO: 88544 - DNA, 20 bp, Artificial Sequence
  chemically synthesized
cggaaccttccagggatctc

SEQ ID NO: 88545 - DNA, 20 bp, Artificial Sequence
  chemically synthesized
gaaaacagccaaaaaatcct

SEQ ID NO: 88546 - DNA, 20 bp, Artificial Sequence
  chemically synthesized
ccagggatctcaggattttt

SEQ ID NO: 88547 - DNA, 20 bp, Artificial Sequence
  chemically synthesized
tatcacaacctggatgaaaa

SEQ ID NO: 88548 - DNA, 20 bp, Artificial Sequence
  chemically synthesized
attttttggctgttttcatc

SEQ ID NO: 88549 - DNA, 20 bp, Artificial Sequence
  chemically synthesized
ttttttggctgttttcatcc

SEQ ID NO: 88550 - DNA, 20 bp, Artificial Sequence
  chemically synthesized
cacagatgtttatcacaacc

SEQ ID NO: 88551 - DNA, 20 bp, Artificial Sequence
  chemically synthesized
gttgtgataaacatctgtgt

SEQ ID NO: 88552 - DNA, 20 bp, Artificial Sequence
  chemically synthesized
aggtgaaattgaagctcaca

SEQ ID NO: 88553 - DNA, 20 bp, Artificial Sequence
  chemically synthesized
ggacctccaaggtgaaattg

SEQ ID NO: 88554 - DNA, 20 bp, Artificial Sequence
  chemically synthesized
tgtgagcttcaatttcacct

SEQ ID NO: 88555 - DNA, 20 bp, Artificial Sequence
  chemically synthesized
tgagcttcaatttcaccttg

SEQ ID NO: 88556 - DNA, 20 bp, Artificial Sequence
  chemically synthesized
gagcttcaatttcaccttgg

SEQ ID NO: 88557 - DNA, 20 bp, Artificial Sequence
  chemically synthesized
gctgtcctgtaggacctcca

SEQ ID NO: 88558 - DNA, 20 bp, Artificial Sequence
  chemically synthesized
tgctgtcctgtaggacctcc

SEQ ID NO: 88559 - DNA, 20 bp, Artificial Sequence
  chemically synthesized
atttcaccttggaggtccta

SEQ ID NO: 88560 - DNA, 20 bp, Artificial Sequence
  chemically synthesized
tttcaccttggaggtcctac

SEQ ID NO: 88561 - DNA, 20 bp, Artificial Sequence
  chemically synthesized
accttggaggtcctacagga

SEQ ID NO: 88562 - DNA, 20 bp, Artificial Sequence
  chemically synthesized
tcttcttcctgctgtcctgt

SEQ ID NO: 88563 - DNA, 20 bp, Artificial Sequence
  chemically synthesized
ttcttcttcctgctgtcctg

SEQ ID NO: 88564 - DNA, 20 bp, Artificial Sequence
  chemically synthesized
ttggaggtcctacaggacag

SEQ ID NO: 88565 - DNA, 20 bp, Artificial Sequence
  chemically synthesized
tggaggtcctacaggacagc

SEQ ID NO: 88566 - DNA, 20 bp, Artificial Sequence
  chemically synthesized
aggtcctacaggacagcagg

SEQ ID NO: 88567 - DNA, 20 bp, Artificial Sequence
  chemically synthesized
tcctacaggacagcaggaag

SEQ ID NO: 88568 - DNA, 20 bp, Artificial Sequence
  chemically synthesized
agcaggaagaagaatatgtg

SEQ ID NO: 88569 - DNA, 20 bp, Artificial Sequence
  chemically synthesized
tgtgcagaattaccaaacaa

SEQ ID NO: 88570 - DNA, 20 bp, Artificial Sequence
  chemically synthesized
catcgcttgtttcttttgtt

SEQ ID NO: 88571 - DNA, 20 bp, Artificial Sequence
  chemically synthesized
aattaccaaacaaaagaaac

SEQ ID NO: 88572 - DNA, 20 bp, Artificial Sequence
  chemically synthesized
acaagcgatgaatgtgaatt

SEQ ID NO: 88573 - DNA, 20 bp, Artificial Sequence
  chemically synthesized
aagcgatgaatgtgaatttg

SEQ ID NO: 88574 - DNA, 20 bp, Artificial Sequence
  chemically synthesized
tgcaaaatataaataattat

SEQ ID NO: 88575 - DNA, 20 bp, Artificial Sequence
  chemically synthesized
ataaataattattagttcaa

SEQ ID NO: 88576 - DNA, 20 bp, Artificial Sequence
  chemically synthesized
agttcaaaagacatttcaat

SEQ ID NO: 88577 - DNA, 20 bp, Artificial Sequence
  chemically synthesized
gttcaaaagacatttcaatc

SEQ ID NO: 88578 - DNA, 20 bp, Artificial Sequence
  chemically synthesized
ttcaatcaggctaaactaac

SEQ ID NO: 88579 - DNA, 20 bp, Artificial Sequence
  chemically synthesized
gatgtatcttcttgttagtt

SEQ ID NO: 88580 - DNA, 20 bp, Artificial Sequence
  chemically synthesized
aatcaggctaaactaacaag

SEQ ID NO: 88581 - DNA, 20 bp, Artificial Sequence
  chemically synthesized
tttgagatgtatcttcttgt

SEQ ID NO: 88582 - DNA, 20 bp, Artificial Sequence
  chemically synthesized
tacgccaagaaaagggattt

SEQ ID NO: 88583 - DNA, 20 bp, Artificial Sequence
  chemically synthesized
acatctcaaatcccttttct

SEQ ID NO: 88584 - DNA, 20 bp, Artificial Sequence
  chemically synthesized
aaggcaatacgccaagaaaa

SEQ ID NO: 88585 - DNA, 20 bp, Artificial Sequence
  chemically synthesized
gaaggcaatacgccaagaaa

SEQ ID NO: 88586 - DNA, 20 bp, Artificial Sequence
  chemically synthesized
agaaggcaatacgccaagaa

SEQ ID NO: 88587 - DNA, 20 bp, Artificial Sequence
  chemically synthesized
acaggagaaggcaatacgcc

SEQ ID NO: 88588 - DNA, 20 bp, Artificial Sequence
  chemically synthesized
atctacataataacaggaga

SEQ ID NO: 88589 - DNA, 20 bp, Artificial Sequence
  chemically synthesized
aatctacataataacaggag

SEQ ID NO: 88590 - DNA, 20 bp, Artificial Sequence
  chemically synthesized
ttaaatctacataataacag

SEQ ID NO: 88591 - DNA, 20 bp, Artificial Sequence
  chemically synthesized
ttttaaatctacataataac

SEQ ID NO: 88592 - DNA, 20 bp, Artificial Sequence
  chemically synthesized
attttaaatctacataataa

SEQ ID NO: 88593 - DNA, 20 bp, Artificial Sequence
  chemically synthesized
tgccttctcctgttattatg

SEQ ID NO: 88594 - DNA, 20 bp, Artificial Sequence
  chemically synthesized
gttattatgtagatttaaaa

SEQ ID NO: 88595 - DNA, 20 bp, Artificial Sequence
  chemically synthesized
ttattatgtagatttaaaat

SEQ ID NO: 88596 - DNA, 20 bp, Artificial Sequence
  chemically synthesized
atttaaaatgggcatcttat

SEQ ID NO: 88597 - DNA, 20 bp, Artificial Sequence
  chemically synthesized
ataaatctattacaactaat

SEQ ID NO: 88598 - DNA, 20 bp, Artificial Sequence
  chemically synthesized
gggcatcttattagttgtaa

SEQ ID NO: 88599 - DNA, 20 bp, Artificial Sequence
  chemically synthesized
ctttccaactcataatggca

SEQ ID NO: 88600 - DNA, 20 bp, Artificial Sequence
  chemically synthesized
actttccaactcataatggc

SEQ ID NO: 88601 - DNA, 20 bp, Artificial Sequence
  chemically synthesized
gatttattccttgccattat

SEQ ID NO: 88602 - DNA, 20 bp, Artificial Sequence
  chemically synthesized
cattactttccaactcataa

SEQ ID NO: 88603 - DNA, 20 bp, Artificial Sequence
  chemically synthesized
tattccttgccattatgagt

SEQ ID NO: 88604 - DNA, 20 bp, Artificial Sequence
  chemically synthesized
ccttgccattatgagttgga

SEQ ID NO: 88605 - DNA, 20 bp, Artificial Sequence
  chemically synthesized
aatgtatttataactttata

SEQ ID NO: 88606 - DNA, 20 bp, Artificial Sequence
  chemically synthesized
tataacttgtgaactttata

SEQ ID NO: 88607 - DNA, 20 bp, Artificial Sequence
  chemically synthesized
tataactttataaagttcac

SEQ ID NO: 88608 - DNA, 20 bp, Artificial Sequence
  chemically synthesized
agttcacaagttatatcttc

SEQ ID NO: 88609 - DNA, 20 bp, Artificial Sequence
  chemically synthesized
acattttgtccatagactag

SEQ ID NO: 88610 - DNA, 20 bp, Artificial Sequence
  chemically synthesized
aagttatatcttctagtcta

SEQ ID NO: 88611 - DNA, 20 bp, Artificial Sequence
  chemically synthesized
aatacattttgtccatagac

SEQ ID NO: 88612 - DNA, 20 bp, Artificial Sequence
  chemically synthesized
aaaataatacattttgtcca

SEQ ID NO: 88613 - DNA, 20 bp, Artificial Sequence
  chemically synthesized
ggacaaaatgtattatttta

SEQ ID NO: 88614 - DNA, 20 bp, Artificial Sequence
  chemically synthesized
caaaatgtattattttatgg

SEQ ID NO: 88615 - DNA, 20 bp, Artificial Sequence
  chemically synthesized
gtattattttatggaagtga

SEQ ID NO: 88616 - DNA, 20 bp, Artificial Sequence
  chemically synthesized
tattattttatggaagtgat

SEQ ID NO: 88617 - DNA, 20 bp, Artificial Sequence
  chemically synthesized
ggcaataaaattctatgata

SEQ ID NO: 88618 - DNA, 20 bp, Artificial Sequence
  chemically synthesized
cactggggtacactttatca

SEQ ID NO: 88619 - DNA, 20 bp, Artificial Sequence
  chemically synthesized
ttctatgataaagtgtaccc

SEQ ID NO: 88620 - DNA, 20 bp, Artificial Sequence
  chemically synthesized
taatgaaattattggcactg

SEQ ID NO: 88621 - DNA, 20 bp, Artificial Sequence
  chemically synthesized
gtaatgaaattattggcact

SEQ ID NO: 88622 - DNA, 20 bp, Artificial Sequence
  chemically synthesized
agtaatgaaattattggcac

SEQ ID NO: 88623 - DNA, 20 bp, Artificial Sequence
  chemically synthesized
ccatatagtaatgaaattat

SEQ ID NO: 88624 - DNA, 20 bp, Artificial Sequence
  chemically synthesized
ccaataatttcattactata

SEQ ID NO: 88625 - DNA, 20 bp, Artificial Sequence
  chemically synthesized
aaaatatgacttgatccata

SEQ ID NO: 88626 - DNA, 20 bp, Artificial Sequence
  chemically synthesized
atttcattactatatggatc

SEQ ID NO: 88627 - DNA, 20 bp, Artificial Sequence
  chemically synthesized
agtcatattttctatttacg

SEQ ID NO: 88628 - DNA, 20 bp, Artificial Sequence
  chemically synthesized
tctacagattactacgtaaa

SEQ ID NO: 88629 - DNA, 20 bp, Artificial Sequence
  chemically synthesized
tctatttacgtagtaatctg

SEQ ID NO: 88630 - DNA, 20 bp, Artificial Sequence
  chemically synthesized
tatttacgtagtaatctgta

SEQ ID NO: 88631 - DNA, 20 bp, Artificial Sequence
  chemically synthesized
tatggtcagagttaactcta

SEQ ID NO: 88632 - DNA, 20 bp, Artificial Sequence
  chemically synthesized
tctccacgcttttatggtca

SEQ ID NO: 88633 - DNA, 20 bp, Artificial Sequence
  chemically synthesized
agagttaactctgaccataa

SEQ ID NO: 88634 - DNA, 20 bp, Artificial Sequence
  chemically synthesized
tctctccacgcttttatggt

SEQ ID NO: 88635 - DNA, 20 bp, Artificial Sequence
  chemically synthesized
ttagtctctccacgctttta

SEQ ID NO: 88636 - DNA, 20 bp, Artificial Sequence
  chemically synthesized
taactctgaccataaaagcg

SEQ ID NO: 88637 - DNA, 20 bp, Artificial Sequence
  chemically synthesized
actctgaccataaaagcgtg

SEQ ID NO: 88638 - DNA, 20 bp, Artificial Sequence
  chemically synthesized
tctgaccataaaagcgtgga

SEQ ID NO: 88639 - DNA, 20 bp, Artificial Sequence
  chemically synthesized
gcgtggagagactaataaac

SEQ ID NO: 88640 - DNA, 20 bp, Artificial Sequence
  chemically synthesized
ccaagtgcaatcttgtttat

SEQ ID NO: 88641 - DNA, 20 bp, Artificial Sequence
  chemically synthesized
ctaataaacaagattgcact

SEQ ID NO: 88642 - DNA, 20 bp, Artificial Sequence
  chemically synthesized
acaagattgcacttggccca

SEQ ID NO: 88643 - DNA, 20 bp, Artificial Sequence
  chemically synthesized
atgtgctggtgctgtgggcc

SEQ ID NO: 88644 - DNA, 20 bp, Artificial Sequence
  chemically synthesized
ttgcacttggcccacagcac

SEQ ID NO: 88645 - DNA, 20 bp, Artificial Sequence
  chemically synthesized
caggaatgtgctggtgctgt

SEQ ID NO: 88646 - DNA, 20 bp, Artificial Sequence
  chemically synthesized
ccaggaatgtgctggtgctg

SEQ ID NO: 88647 - DNA, 20 bp, Artificial Sequence
  chemically synthesized
acagactcccaggaatgtgc

SEQ ID NO: 88648 - DNA, 20 bp, Artificial Sequence
  chemically synthesized
ccacagcaccagcacattcc

SEQ ID NO: 88649 - DNA, 20 bp, Artificial Sequence
  chemically synthesized
cacagcaccagcacattcct

SEQ ID NO: 88650 - DNA, 20 bp, Artificial Sequence
  chemically synthesized
cagcaccagcacattcctgg

SEQ ID NO: 88651 - DNA, 20 bp, Artificial Sequence
  chemically synthesized
ctctcccatgacagactccc

SEQ ID NO: 88652 - DNA, 20 bp, Artificial Sequence
  chemically synthesized
tctctcccatgacagactcc

SEQ ID NO: 88653 - DNA, 20 bp, Artificial Sequence
  chemically synthesized
acattcctgggagtctgtca

SEQ ID NO: 88654 - DNA, 20 bp, Artificial Sequence
  chemically synthesized
cattcctgggagtctgtcat

SEQ ID NO: 88655 - DNA, 20 bp, Artificial Sequence
  chemically synthesized
ttcctgggagtctgtcatgg

SEQ ID NO: 88656 - DNA, 20 bp, Artificial Sequence
  chemically synthesized
gaagattttctctcccatga

SEQ ID NO: 88657 - DNA, 20 bp, Artificial Sequence
  chemically synthesized
cctgggagtctgtcatggga

SEQ ID NO: 88658 - DNA, 20 bp, Artificial Sequence
  chemically synthesized
acttaatttgtgttgtcaag

SEQ ID NO: 88659 - DNA, 20 bp, Artificial Sequence
  chemically synthesized
tgaacttaatttgtgttgtc

SEQ ID NO: 88660 - DNA, 20 bp, Artificial Sequence
  chemically synthesized
tcttcttgacaacacaaatt

SEQ ID NO: 88661 - DNA, 20 bp, Artificial Sequence
  chemically synthesized
aacacaaattaagttcacct

SEQ ID NO: 88662 - DNA, 20 bp, Artificial Sequence
  chemically synthesized
tgtatgatgctataatacca

SEQ ID NO: 88663 - DNA, 20 bp, Artificial Sequence
  chemically synthesized
ttaagttcaccttggtatta

SEQ ID NO: 88664 - DNA, 20 bp, Artificial Sequence
  chemically synthesized
atgtatgatgctataatacc

SEQ ID NO: 88665 - DNA, 20 bp, Artificial Sequence
  chemically synthesized
gtattatagcatcatacata

SEQ ID NO: 88666 - DNA, 20 bp, Artificial Sequence
  chemically synthesized
atagcatcatacatatagta

SEQ ID NO: 88667 - DNA, 20 bp, Artificial Sequence
  chemically synthesized
gtacagcatcatacatttat

SEQ ID NO: 88668 - DNA, 20 bp, Artificial Sequence
  chemically synthesized
cctaaaaatgtgtattaaat

SEQ ID NO: 88669 - DNA, 20 bp, Artificial Sequence
  chemically synthesized
gcctaaaaatgtgtattaaa

SEQ ID NO: 88670 - DNA, 20 bp, Artificial Sequence
  chemically synthesized
tcccatttaatacacatttt

SEQ ID NO: 88671 - DNA, 20 bp, Artificial Sequence
  chemically synthesized
cccatttaatacacattttt

SEQ ID NO: 88672 - DNA, 20 bp, Artificial Sequence
  chemically synthesized
atacacatttttaggcttga

SEQ ID NO: 88673 - DNA, 20 bp, Artificial Sequence
  chemically synthesized
tacacatttttaggcttgac

SEQ ID NO: 88674 - DNA, 20 bp, Artificial Sequence
  chemically synthesized
acatttttaggcttgacagg

SEQ ID NO: 88675 - DNA, 20 bp, Artificial Sequence
  chemically synthesized
ctatgtactttccacctgtc

SEQ ID NO: 88676 - DNA, 20 bp, Artificial Sequence
  chemically synthesized
ttttaggcttgacaggtgga

SEQ ID NO: 88677 - DNA, 20 bp, Artificial Sequence
  chemically synthesized
cttgacaggtggaaagtaca

SEQ ID NO: 88678 - DNA, 20 bp, Artificial Sequence
  chemically synthesized
ttgacaggtggaaagtacat

SEQ ID NO: 88679 - DNA, 20 bp, Artificial Sequence
  chemically synthesized
gtggaaagtacataggacct

SEQ ID NO: 88680 - DNA, 20 bp, Artificial Sequence
  chemically synthesized
aaagtacataggaccttggt

SEQ ID NO: 88681 - DNA, 20 bp, Artificial Sequence
  chemically synthesized
agtacataggaccttggtaa

SEQ ID NO: 88682 - DNA, 20 bp, Artificial Sequence
  chemically synthesized
tcttatcataactcttacca

SEQ ID NO: 88683 - DNA, 20 bp, Artificial Sequence
  chemically synthesized
ctcttatcataactcttacc

SEQ ID NO: 88684 - DNA, 20 bp, Artificial Sequence
  chemically synthesized
accttggtaagagttatgat

SEQ ID NO: 88685 - DNA, 20 bp, Artificial Sequence
  chemically synthesized
cttggtaagagttatgataa

SEQ ID NO: 88686 - DNA, 20 bp, Artificial Sequence
  chemically synthesized
ttggtaagagttatgataag

SEQ ID NO: 88687 - DNA, 20 bp, Artificial Sequence
  chemically synthesized
gatctgtgtgtatacaagtg

SEQ ID NO: 88688 - DNA, 20 bp, Artificial Sequence
  chemically synthesized
ttcttgatctgtgtgtatac

SEQ ID NO: 88689 - DNA, 20 bp, Artificial Sequence
  chemically synthesized
caacttcacttgtatacaca

SEQ ID NO: 88690 - DNA, 20 bp, Artificial Sequence
  chemically synthesized
cacttgtatacacacagatc

SEQ ID NO: 88691 - DNA, 20 bp, Artificial Sequence
  chemically synthesized
acagatcaagaaaattatta

SEQ ID NO: 88692 - DNA, 20 bp, Artificial Sequence
  chemically synthesized
gatcaagaaaattattatag

SEQ ID NO: 88693 - DNA, 20 bp, Artificial Sequence
  chemically synthesized
caagaaaattattatagtag

SEQ ID NO: 88694 - DNA, 20 bp, Artificial Sequence
  chemically synthesized
aagacataccatgtaaaggt

SEQ ID NO: 88695 - DNA, 20 bp, Artificial Sequence
  chemically synthesized
agaagaatctgacctttaca

SEQ ID NO: 88696 - DNA, 20 bp, Artificial Sequence
  chemically synthesized
caggaagacataccatgtaa

SEQ ID NO: 88697 - DNA, 20 bp, Artificial Sequence
  chemically synthesized
acaggaagacataccatgta

SEQ ID NO: 88698 - DNA, 20 bp, Artificial Sequence
  chemically synthesized
agctgaaaatgttacacagg

SEQ ID NO: 88699 - DNA, 20 bp, Artificial Sequence
  chemically synthesized
tcaagctgaaaatgttacac

SEQ ID NO: 88700 - DNA, 20 bp, Artificial Sequence
  chemically synthesized
ttcaagctgaaaatgttaca

SEQ ID NO: 88701 - DNA, 20 bp, Artificial Sequence
  chemically synthesized
gtcttcctgtgtaacatttt

SEQ ID NO: 88702 - DNA, 20 bp, Artificial Sequence
  chemically synthesized
gtaacattttcagcttgaac

SEQ ID NO: 88703 - DNA, 20 bp, Artificial Sequence
  chemically synthesized
taacattttcagcttgaacc

SEQ ID NO: 88704 - DNA, 20 bp, Artificial Sequence
  chemically synthesized
agtgctgtagtgcccggttc

SEQ ID NO: 88705 - DNA, 20 bp, Artificial Sequence
  chemically synthesized
tcagcttgaaccgggcacta

SEQ ID NO: 88706 - DNA, 20 bp, Artificial Sequence
  chemically synthesized
aggatcagtgctgtagtgcc

SEQ ID NO: 88707 - DNA, 20 bp, Artificial Sequence
  chemically synthesized
atgcaacaggatcagtgctg

SEQ ID NO: 88708 - DNA, 20 bp, Artificial Sequence
  chemically synthesized
ggattgctatgcaacaggat

SEQ ID NO: 88709 - DNA, 20 bp, Artificial Sequence
  chemically synthesized
acagcactgatcctgttgca

SEQ ID NO: 88710 - DNA, 20 bp, Artificial Sequence
  chemically synthesized
tctcaggattgctatgcaac

SEQ ID NO: 88711 - DNA, 20 bp, Artificial Sequence
  chemically synthesized
ttctcaggattgctatgcaa

SEQ ID NO: 88712 - DNA, 20 bp, Artificial Sequence
  chemically synthesized
tcctgttgcatagcaatcct

SEQ ID NO: 88713 - DNA, 20 bp, Artificial Sequence
  chemically synthesized
ttcagtttctgggttttctc

SEQ ID NO: 88714 - DNA, 20 bp, Artificial Sequence
  chemically synthesized
tttcagtttctgggttttct

SEQ ID NO: 88715 - DNA, 20 bp, Artificial Sequence
  chemically synthesized
atagcaatcctgagaaaacc

SEQ ID NO: 88716 - DNA, 20 bp, Artificial Sequence
  chemically synthesized
gcagggctctttcagtttct

SEQ ID NO: 88717 - DNA, 20 bp, Artificial Sequence
  chemically synthesized
agcagggctctttcagtttc

SEQ ID NO: 88718 - DNA, 20 bp, Artificial Sequence
  chemically synthesized
tgagaaaacccagaaactga

SEQ ID NO: 88719 - DNA, 20 bp, Artificial Sequence
  chemically synthesized
agaaaacccagaaactgaaa

SEQ ID NO: 88720 - DNA, 20 bp, Artificial Sequence
  chemically synthesized
attttaaagcagggctcttt

SEQ ID NO: 88721 - DNA, 20 bp, Artificial Sequence
  chemically synthesized
aaagttggcattttaaagca

SEQ ID NO: 88722 - DNA, 20 bp, Artificial Sequence
  chemically synthesized
caaagttggcattttaaagc

SEQ ID NO: 88723 - DNA, 20 bp, Artificial Sequence
  chemically synthesized
gcaaagttggcattttaaag

SEQ ID NO: 88724 - DNA, 20 bp, Artificial Sequence
  chemically synthesized
taagcaaagttggcatttta

SEQ ID NO: 88725 - DNA, 20 bp, Artificial Sequence
  chemically synthesized
caacagaatgtaagcaaagt

SEQ ID NO: 88726 - DNA, 20 bp, Artificial Sequence
  chemically synthesized
ctgtcaacagaatgtaagca

SEQ ID NO: 88727 - DNA, 20 bp, Artificial Sequence
  chemically synthesized
tcattctgtcaacagaatgt

SEQ ID NO: 88728 - DNA, 20 bp, Artificial Sequence
  chemically synthesized
ctttgcttacattctgttga

SEQ ID NO: 88729 - DNA, 20 bp, Artificial Sequence
  chemically synthesized
tccaaaattcattctgtcaa

SEQ ID NO: 88730 - DNA, 20 bp, Artificial Sequence
  chemically synthesized
tctgttgacagaatgaattt

SEQ ID NO: 88731 - DNA, 20 bp, Artificial Sequence
  chemically synthesized
tgttgacagaatgaattttg

SEQ ID NO: 88732 - DNA, 20 bp, Artificial Sequence
  chemically synthesized
acagaatgaattttggagca

SEQ ID NO: 88733 - DNA, 20 bp, Artificial Sequence
  chemically synthesized
cagaatgaattttggagcac

SEQ ID NO: 88734 - DNA, 20 bp, Artificial Sequence
  chemically synthesized
ttttggagcacaggcctcac

SEQ ID NO: 88735 - DNA, 20 bp, Artificial Sequence
  chemically synthesized
tttattattattgactggtg

SEQ ID NO: 88736 - DNA, 20 bp, Artificial Sequence
  chemically synthesized
gtttattattattgactggt

SEQ ID NO: 88737 - DNA, 20 bp, Artificial Sequence
  chemically synthesized
ggccgtttattattattgac

SEQ ID NO: 88738 - DNA, 20 bp, Artificial Sequence
  chemically synthesized
caccagtcaataataataaa

SEQ ID NO: 88739 - DNA, 20 bp, Artificial Sequence
  chemically synthesized
gtttagtgcggagtacaaag

SEQ ID NO: 88740 - DNA, 20 bp, Artificial Sequence
  chemically synthesized
actgtttagtgcggagtaca

SEQ ID NO: 88741 - DNA, 20 bp, Artificial Sequence
  chemically synthesized
cctggctactgtttagtgcg

SEQ ID NO: 88742 - DNA, 20 bp, Artificial Sequence
  chemically synthesized
actttgtactccgcactaaa

SEQ ID NO: 88743 - DNA, 20 bp, Artificial Sequence
  chemically synthesized
cgcctggctactgtttagtg

SEQ ID NO: 88744 - DNA, 20 bp, Artificial Sequence
  chemically synthesized
ttgtactccgcactaaacag

SEQ ID NO: 88745 - DNA, 20 bp, Artificial Sequence
  chemically synthesized
ccacacgcctggctactgtt

SEQ ID NO: 88746 - DNA, 20 bp, Artificial Sequence
  chemically synthesized
actccgcactaaacagtagc

SEQ ID NO: 88747 - DNA, 20 bp, Artificial Sequence
  chemically synthesized
ctccgcactaaacagtagcc

SEQ ID NO: 88748 - DNA, 20 bp, Artificial Sequence
  chemically synthesized
ctaaacagtagccaggcgtg

SEQ ID NO: 88749 - DNA, 20 bp, Artificial Sequence
  chemically synthesized
tcctcccacatccacacgcc

SEQ ID NO: 88750 - DNA, 20 bp, Artificial Sequence
  chemically synthesized
agtagccaggcgtgtggatg

SEQ ID NO: 88751 - DNA, 20 bp, Artificial Sequence
  chemically synthesized
gtagccaggcgtgtggatgt

SEQ ID NO: 88752 - DNA, 20 bp, Artificial Sequence
  chemically synthesized
agccaggcgtgtggatgtgg

SEQ ID NO: 88753 - DNA, 20 bp, Artificial Sequence
  chemically synthesized
gccaggcgtgtggatgtggg

SEQ ID NO: 88754 - DNA, 20 bp, Artificial Sequence
  chemically synthesized
tggatgtgggaggaacctca

SEQ ID NO: 88755 - DNA, 20 bp, Artificial Sequence
  chemically synthesized
gatgtgggaggaacctcaaa

SEQ ID NO: 88756 - DNA, 20 bp, Artificial Sequence
  chemically synthesized
tgtgggaggaacctcaaaga

SEQ ID NO: 88757 - DNA, 20 bp, Artificial Sequence
  chemically synthesized
gtgggaggaacctcaaagag

SEQ ID NO: 88758 - DNA, 20 bp, Artificial Sequence
  chemically synthesized
ttccaggcctcctctctttg

SEQ ID NO: 88759 - DNA, 20 bp, Artificial Sequence
  chemically synthesized
attccaggcctcctctcttt

SEQ ID NO: 88760 - DNA, 20 bp, Artificial Sequence
  chemically synthesized
gggaggaacctcaaagagag

SEQ ID NO: 88761 - DNA, 20 bp, Artificial Sequence
  chemically synthesized
ggaggaacctcaaagagagg

SEQ ID NO: 88762 - DNA, 20 bp, Artificial Sequence
  chemically synthesized
aacctcaaagagaggaggcc

SEQ ID NO: 88763 - DNA, 20 bp, Artificial Sequence
  chemically synthesized
aactgtcagttgcatattcc

SEQ ID NO: 88764 - DNA, 20 bp, Artificial Sequence
  chemically synthesized
aaactgtcagttgcatattc

SEQ ID NO: 88765 - DNA, 20 bp, Artificial Sequence
  chemically synthesized
ggcctggaatatgcaactga

SEQ ID NO: 88766 - DNA, 20 bp, Artificial Sequence
  chemically synthesized
ggctgtttaatataaactgt

SEQ ID NO: 88767 - DNA, 20 bp, Artificial Sequence
  chemically synthesized
aactgacagtttatattaaa

SEQ ID NO: 88768 - DNA, 20 bp, Artificial Sequence
  chemically synthesized
ggcagaatgataagaaaagt

SEQ ID NO: 88769 - DNA, 20 bp, Artificial Sequence
  chemically synthesized
taatggcagaatgataagaa

SEQ ID NO: 88770 - DNA, 20 bp, Artificial Sequence
  chemically synthesized
gcttgtaatggcagaatgat

SEQ ID NO: 88771 - DNA, 20 bp, Artificial Sequence
  chemically synthesized
tcttatcattctgccattac

SEQ ID NO: 88772 - DNA, 20 bp, Artificial Sequence
  chemically synthesized
atgtctctggcttgtaatgg

SEQ ID NO: 88773 - DNA, 20 bp, Artificial Sequence
  chemically synthesized
ataatgtctctggcttgtaa

SEQ ID NO: 88774 - DNA, 20 bp, Artificial Sequence
  chemically synthesized
atcattctgccattacaagc

SEQ ID NO: 88775 - DNA, 20 bp, Artificial Sequence
  chemically synthesized
cattctgccattacaagcca

SEQ ID NO: 88776 - DNA, 20 bp, Artificial Sequence
  chemically synthesized
aaatgaatttataatgtctc

SEQ ID NO: 88777 - DNA, 20 bp, Artificial Sequence
  chemically synthesized
tattctgctgggaacaagga

SEQ ID NO: 88778 - DNA, 20 bp, Artificial Sequence
  chemically synthesized
ctattctgctgggaacaagg

SEQ ID NO: 88779 - DNA, 20 bp, Artificial Sequence
  chemically synthesized
tgtgtttccttccttgttcc

SEQ ID NO: 88780 - DNA, 20 bp, Artificial Sequence
  chemically synthesized
tgactattctgctgggaaca

SEQ ID NO: 88781 - DNA, 20 bp, Artificial Sequence
  chemically synthesized
ttgactattctgctgggaac

SEQ ID NO: 88782 - DNA, 20 bp, Artificial Sequence
  chemically synthesized
gtttccttccttgttcccag

SEQ ID NO: 88783 - DNA, 20 bp, Artificial Sequence
  chemically synthesized
cttccttgttcccagcagaa

SEQ ID NO: 88784 - DNA, 20 bp, Artificial Sequence
  chemically synthesized
ttggctttgactattctgct

SEQ ID NO: 88785 - DNA, 20 bp, Artificial Sequence
  chemically synthesized
cttggctttgactattctgc

SEQ ID NO: 88786 - DNA, 20 bp, Artificial Sequence
  chemically synthesized
tgttcccagcagaatagtca

SEQ ID NO: 88787 - DNA, 20 bp, Artificial Sequence
  chemically synthesized
ccagcagaatagtcaaagcc

SEQ ID NO: 88788 - DNA, 20 bp, Artificial Sequence
  chemically synthesized
cagcagaatagtcaaagcca

SEQ ID NO: 88789 - DNA, 20 bp, Artificial Sequence
  chemically synthesized
agcagaatagtcaaagccaa

SEQ ID NO: 88790 - DNA, 20 bp, Artificial Sequence
  chemically synthesized
ctctctgaggaatgttccct

SEQ ID NO: 88791 - DNA, 20 bp, Artificial Sequence
  chemically synthesized
aaagccaagggaacattcct

SEQ ID NO: 88792 - DNA, 20 bp, Artificial Sequence
  chemically synthesized
agccaagggaacattcctca

SEQ ID NO: 88793 - DNA, 20 bp, Artificial Sequence
  chemically synthesized
ccaagggaacattcctcaga

SEQ ID NO: 88794 - DNA, 20 bp, Artificial Sequence
  chemically synthesized
tggtacccggcagctctctg

SEQ ID NO: 88795 - DNA, 20 bp, Artificial Sequence
  chemically synthesized
ctggtacccggcagctctct

SEQ ID NO: 88796 - DNA, 20 bp, Artificial Sequence
  chemically synthesized
aacattcctcagagagctgc

SEQ ID NO: 88797 - DNA, 20 bp, Artificial Sequence
  chemically synthesized
acattcctcagagagctgcc

SEQ ID NO: 88798 - DNA, 20 bp, Artificial Sequence
  chemically synthesized
aaaggaatgctggtacccgg

SEQ ID NO: 88799 - DNA, 20 bp, Artificial Sequence
  chemically synthesized
ctcagagagctgccgggtac

SEQ ID NO: 88800 - DNA, 20 bp, Artificial Sequence
  chemically synthesized
cagaaaggaatgctggtacc

SEQ ID NO: 88801 - DNA, 20 bp, Artificial Sequence
  chemically synthesized
gtgtaggcagaaaggaatgc

SEQ ID NO: 88802 - DNA, 20 bp, Artificial Sequence
  chemically synthesized
cattcattgtgtaggcagaa

SEQ ID NO: 88803 - DNA, 20 bp, Artificial Sequence
  chemically synthesized
ccattcattgtgtaggcaga

SEQ ID NO: 88804 - DNA, 20 bp, Artificial Sequence
  chemically synthesized
gcctccattcattgtgtagg

SEQ ID NO: 88805 - DNA, 20 bp, Artificial Sequence
  chemically synthesized
aaagcctccattcattgtgt

SEQ ID NO: 88806 - DNA, 20 bp, Artificial Sequence
  chemically synthesized
caaagcctccattcattgtg

SEQ ID NO: 88807 - DNA, 20 bp, Artificial Sequence
  chemically synthesized
ctttctgcctacacaatgaa

SEQ ID NO: 88808 - DNA, 20 bp, Artificial Sequence
  chemically synthesized
ttctgcctacacaatgaatg

SEQ ID NO: 88809 - DNA, 20 bp, Artificial Sequence
  chemically synthesized
tctgcctacacaatgaatgg

SEQ ID NO: 88810 - DNA, 20 bp, Artificial Sequence
  chemically synthesized
agcaagtcagataatataca

SEQ ID NO: 88811 - DNA, 20 bp, Artificial Sequence
  chemically synthesized
acaaatctctaagagcaagt

SEQ ID NO: 88812 - DNA, 20 bp, Artificial Sequence
  chemically synthesized
tatattatctgacttgctct

SEQ ID NO: 88813 - DNA, 20 bp, Artificial Sequence
  chemically synthesized
tattatctgacttgctctta

SEQ ID NO: 88814 - DNA, 20 bp, Artificial Sequence
  chemically synthesized
gcatacaaatctctaagagc

SEQ ID NO: 88815 - DNA, 20 bp, Artificial Sequence
  chemically synthesized
agaagcatacaaatctctaa

SEQ ID NO: 88816 - DNA, 20 bp, Artificial Sequence
  chemically synthesized
acagaagcatacaaatctct

SEQ ID NO: 88817 - DNA, 20 bp, Artificial Sequence
  chemically synthesized
tttttaaacttgttgaacag

SEQ ID NO: 88818 - DNA, 20 bp, Artificial Sequence
  chemically synthesized
tttgtatgcttctgttcaac

SEQ ID NO: 88819 - DNA, 20 bp, Artificial Sequence
  chemically synthesized
gaatttttaaacttgttgaa

SEQ ID NO: 88820 - DNA, 20 bp, Artificial Sequence
  chemically synthesized
aagtttaaaaattcattctg

SEQ ID NO: 88821 - DNA, 20 bp, Artificial Sequence
  chemically synthesized
aatccaattgtttggagctt

SEQ ID NO: 88822 - DNA, 20 bp, Artificial Sequence
  chemically synthesized
cagatcaatccaattgtttg

SEQ ID NO: 88823 - DNA, 20 bp, Artificial Sequence
  chemically synthesized
attctgaagctccaaacaat

SEQ ID NO: 88824 - DNA, 20 bp, Artificial Sequence
  chemically synthesized
cacagatcaatccaattgtt

SEQ ID NO: 88825 - DNA, 20 bp, Artificial Sequence
  chemically synthesized
attggattgatctgtgtaac

SEQ ID NO: 88826 - DNA, 20 bp, Artificial Sequence
  chemically synthesized
aaaaaacttttctagttaca

SEQ ID NO: 88827 - DNA, 20 bp, Artificial Sequence
  chemically synthesized
attgatctgtgtaactagaa

SEQ ID NO: 88828 - DNA, 20 bp, Artificial Sequence
  chemically synthesized
agagaaaaaaaaaacttttc

SEQ ID NO: 88829 - DNA, 20 bp, Artificial Sequence
  chemically synthesized
aattcaatttgagagagaga

SEQ ID NO: 88830 - DNA, 20 bp, Artificial Sequence
  chemically synthesized
ttaattcaatttgagagaga

SEQ ID NO: 88831 - DNA, 20 bp, Artificial Sequence
  chemically synthesized
atttaattcaatttgagaga

SEQ ID NO: 88832 - DNA, 20 bp, Artificial Sequence
  chemically synthesized
taatttaattcaatttgaga

SEQ ID NO: 88833 - DNA, 20 bp, Artificial Sequence
  chemically synthesized
agtaatttaattcaatttga

SEQ ID NO: 88834 - DNA, 20 bp, Artificial Sequence
  chemically synthesized
agagtaatttaattcaattt

SEQ ID NO: 88835 - DNA, 20 bp, Artificial Sequence
  chemically synthesized
tgaattaaattactctgcta

SEQ ID NO: 88836 - DNA, 20 bp, Artificial Sequence
  chemically synthesized
ttttctcccttactttagca

SEQ ID NO: 88837 - DNA, 20 bp, Artificial Sequence
  chemically synthesized
ttaaattactctgctaaagt

SEQ ID NO: 88838 - DNA, 20 bp, Artificial Sequence
  chemically synthesized
ctttttctcccttactttag

SEQ ID NO: 88839 - DNA, 20 bp, Artificial Sequence
  chemically synthesized
taaattactctgctaaagta

SEQ ID NO: 88840 - DNA, 20 bp, Artificial Sequence
  chemically synthesized
aaattactctgctaaagtaa

SEQ ID NO: 88841 - DNA, 20 bp, Artificial Sequence
  chemically synthesized
ccactttttctcccttactt

SEQ ID NO: 88842 - DNA, 20 bp, Artificial Sequence
  chemically synthesized
attactctgctaaagtaagg

SEQ ID NO: 88843 - DNA, 20 bp, Artificial Sequence
  chemically synthesized
ctgctaaagtaagggagaaa

SEQ ID NO: 88844 - DNA, 20 bp, Artificial Sequence
  chemically synthesized
ctaaagtaagggagaaaaag

SEQ ID NO: 88845 - DNA, 20 bp, Artificial Sequence
  chemically synthesized
aagtaagggagaaaaagtgg

SEQ ID NO: 88846 - DNA, 20 bp, Artificial Sequence
  chemically synthesized
aagtggcagaaataacatgt

SEQ ID NO: 88847 - DNA, 20 bp, Artificial Sequence
  chemically synthesized
ataacatgttagaaattctg

SEQ ID NO: 88848 - DNA, 20 bp, Artificial Sequence
  chemically synthesized
tgttagaaattctgaagaac

SEQ ID NO: 88849 - DNA, 20 bp, Artificial Sequence
  chemically synthesized
gaaaacttgagccagttctt

SEQ ID NO: 88850 - DNA, 20 bp, Artificial Sequence
  chemically synthesized
aaattctgaagaactggctc

SEQ ID NO: 88851 - DNA, 20 bp, Artificial Sequence
  chemically synthesized
ctgtggctgaaaacttgagc

SEQ ID NO: 88852 - DNA, 20 bp, Artificial Sequence
  chemically synthesized
gaagaactggctcaagtttt

SEQ ID NO: 88853 - DNA, 20 bp, Artificial Sequence
  chemically synthesized
gaggctgtggctgaaaactt

SEQ ID NO: 88854 - DNA, 20 bp, Artificial Sequence
  chemically synthesized
ctggctcaagttttcagcca

SEQ ID NO: 88855 - DNA, 20 bp, Artificial Sequence
  chemically synthesized
ttctgcatcttaagaggctg

SEQ ID NO: 88856 - DNA, 20 bp, Artificial Sequence
  chemically synthesized
gttttcagccacagcctctt

SEQ ID NO: 88857 - DNA, 20 bp, Artificial Sequence
  chemically synthesized
tcagaattctgcatcttaag

SEQ ID NO: 88858 - DNA, 20 bp, Artificial Sequence
  chemically synthesized
ttcagaattctgcatcttaa

SEQ ID NO: 88859 - DNA, 20 bp, Artificial Sequence
  chemically synthesized
agccacagcctcttaagatg

SEQ ID NO: 88860 - DNA, 20 bp, Artificial Sequence
  chemically synthesized
cattcagaattctgcatctt

SEQ ID NO: 88861 - DNA, 20 bp, Artificial Sequence
  chemically synthesized
taccttacttgttcaacatt

SEQ ID NO: 88862 - DNA, 20 bp, Artificial Sequence
  chemically synthesized
cagaattctgaatgttgaac

SEQ ID NO: 88863 - DNA, 20 bp, Artificial Sequence
  chemically synthesized
attctgaatgttgaacaagt

SEQ ID NO: 88864 - DNA, 20 bp, Artificial Sequence
  chemically synthesized
ttctgaatgttgaacaagta

SEQ ID NO: 88865 - DNA, 20 bp, Artificial Sequence
  chemically synthesized
tgaatgttgaacaagtaagg

SEQ ID NO: 88866 - DNA, 20 bp, Artificial Sequence
  chemically synthesized
tgttgaacaagtaaggtaga

SEQ ID NO: 88867 - DNA, 20 bp, Artificial Sequence
  chemically synthesized
gctgccaaaaatagtgacaa

SEQ ID NO: 88868 - DNA, 20 bp, Artificial Sequence
  chemically synthesized
atgtctattgtcactatttt

SEQ ID NO: 88869 - DNA, 20 bp, Artificial Sequence
  chemically synthesized
tctattgtcactatttttgg

SEQ ID NO: 88870 - DNA, 20 bp, Artificial Sequence
  chemically synthesized
gatgctttagctgccaaaaa

SEQ ID NO: 88871 - DNA, 20 bp, Artificial Sequence
  chemically synthesized
gtcactatttttggcagcta

SEQ ID NO: 88872 - DNA, 20 bp, Artificial Sequence
  chemically synthesized
agagtccatcagtgatgctt

SEQ ID NO: 88873 - DNA, 20 bp, Artificial Sequence
  chemically synthesized
ggcagctaaagcatcactga

SEQ ID NO: 88874 - DNA, 20 bp, Artificial Sequence
  chemically synthesized
caactctctttagagtccat

SEQ ID NO: 88875 - DNA, 20 bp, Artificial Sequence
  chemically synthesized
agcatcactgatggactcta

SEQ ID NO: 88876 - DNA, 20 bp, Artificial Sequence
  chemically synthesized
catcactgatggactctaaa

SEQ ID NO: 88877 - DNA, 20 bp, Artificial Sequence
  chemically synthesized
tcactgatggactctaaaga

SEQ ID NO: 88878 - DNA, 20 bp, Artificial Sequence
  chemically synthesized
atgggacacaactctcttta

SEQ ID NO: 88879 - DNA, 20 bp, Artificial Sequence
  chemically synthesized
gaatgggacacaactctctt

SEQ ID NO: 88880 - DNA, 20 bp, Artificial Sequence
  chemically synthesized
gtctcccagtcaaagagaat

SEQ ID NO: 88881 - DNA, 20 bp, Artificial Sequence
  chemically synthesized
tgtctcccagtcaaagagaa

SEQ ID NO: 88882 - DNA, 20 bp, Artificial Sequence
  chemically synthesized
tgtgtcccattctctttgac

SEQ ID NO: 88883 - DNA, 20 bp, Artificial Sequence
  chemically synthesized
gtgtcccattctctttgact

SEQ ID NO: 88884 - DNA, 20 bp, Artificial Sequence
  chemically synthesized
ctgcctgtctcccagtcaaa

SEQ ID NO: 88885 - DNA, 20 bp, Artificial Sequence
  chemically synthesized
gtcccattctctttgactgg

SEQ ID NO: 88886 - DNA, 20 bp, Artificial Sequence
  chemically synthesized
ccctgcctgtctcccagtca

SEQ ID NO: 88887 - DNA, 20 bp, Artificial Sequence
  chemically synthesized
cattctctttgactgggaga

SEQ ID NO: 88888 - DNA, 20 bp, Artificial Sequence
  chemically synthesized
attctctttgactgggagac

SEQ ID NO: 88889 - DNA, 20 bp, Artificial Sequence
  chemically synthesized
atattcccctgcctgtctcc

SEQ ID NO: 88890 - DNA, 20 bp, Artificial Sequence
  chemically synthesized
ctctttgactgggagacagg

SEQ ID NO: 88891 - DNA, 20 bp, Artificial Sequence
  chemically synthesized
tctttgactgggagacaggc

SEQ ID NO: 88892 - DNA, 20 bp, Artificial Sequence
  chemically synthesized
ctttgactgggagacaggca

SEQ ID NO: 88893 - DNA, 20 bp, Artificial Sequence
  chemically synthesized
tttgactgggagacaggcag

SEQ ID NO: 88894 - DNA, 20 bp, Artificial Sequence
  chemically synthesized
gggagacaggcaggggaata

SEQ ID NO: 88895 - DNA, 20 bp, Artificial Sequence
  chemically synthesized
gacaggcaggggaatatgga

SEQ ID NO: 88896 - DNA, 20 bp, Artificial Sequence
  chemically synthesized
gaatatggatagaatcacat

SEQ ID NO: 88897 - DNA, 20 bp, Artificial Sequence
  chemically synthesized
tatggatagaatcacatcag

SEQ ID NO: 88898 - DNA, 20 bp, Artificial Sequence
  chemically synthesized
agaatcacatcagaagttga

SEQ ID NO: 88899 - DNA, 20 bp, Artificial Sequence
  chemically synthesized
atcacatcagaagttgaaag

SEQ ID NO: 88900 - DNA, 20 bp, Artificial Sequence
  chemically synthesized
tcacatcagaagttgaaaga

SEQ ID NO: 88901 - DNA, 20 bp, Artificial Sequence
  chemically synthesized
cacatcagaagttgaaagaa

SEQ ID NO: 88902 - DNA, 20 bp, Artificial Sequence
  chemically synthesized
tgaaagaagggaaatactga

SEQ ID NO: 88903 - DNA, 20 bp, Artificial Sequence
  chemically synthesized
atactactcagaaatacttt

SEQ ID NO: 88904 - DNA, 20 bp, Artificial Sequence
  chemically synthesized
gaaatactgaaagtatttct

SEQ ID NO: 88905 - DNA, 20 bp, Artificial Sequence
  chemically synthesized
atactgaaagtatttctgag

SEQ ID NO: 88906 - DNA, 20 bp, Artificial Sequence
  chemically synthesized
tactactcagagatactact

SEQ ID NO: 88907 - DNA, 20 bp, Artificial Sequence
  chemically synthesized
tatttctgagtagtatctct

SEQ ID NO: 88908 - DNA, 20 bp, Artificial Sequence
  chemically synthesized
ttctgagtagtatctctgag

SEQ ID NO: 88909 - DNA, 20 bp, Artificial Sequence
  chemically synthesized
aacctggtttgtactactca

SEQ ID NO: 88910 - DNA, 20 bp, Artificial Sequence
  chemically synthesized
caaacctggtttgtactact

SEQ ID NO: 88911 - DNA, 20 bp, Artificial Sequence
  chemically synthesized
tatctctgagtagtacaaac

SEQ ID NO: 88912 - DNA, 20 bp, Artificial Sequence
  chemically synthesized
atctctgagtagtacaaacc

SEQ ID NO: 88913 - DNA, 20 bp, Artificial Sequence
  chemically synthesized
atatccttccagtacaaacc

SEQ ID NO: 88914 - DNA, 20 bp, Artificial Sequence
  chemically synthesized
agtacaaaccaggtttgtac

SEQ ID NO: 88915 - DNA, 20 bp, Artificial Sequence
  chemically synthesized
acaaaccaggtttgtactgg

SEQ ID NO: 88916 - DNA, 20 bp, Artificial Sequence
  chemically synthesized
caaaccaggtttgtactgga

SEQ ID NO: 88917 - DNA, 20 bp, Artificial Sequence
  chemically synthesized
aaaatcaggctatatccttc

SEQ ID NO: 88918 - DNA, 20 bp, Artificial Sequence
  chemically synthesized
aggtttgtactggaaggata

SEQ ID NO: 88919 - DNA, 20 bp, Artificial Sequence
  chemically synthesized
tataaactactttcaaaatc

SEQ ID NO: 88920 - DNA, 20 bp, Artificial Sequence
  chemically synthesized
aggatatagcctgattttga

SEQ ID NO: 88921 - DNA, 20 bp, Artificial Sequence
  chemically synthesized
atataaactactttcaaaat

SEQ ID NO: 88922 - DNA, 20 bp, Artificial Sequence
  chemically synthesized
atatagcctgattttgaaag

SEQ ID NO: 88923 - DNA, 20 bp, Artificial Sequence
  chemically synthesized
gattttgaaagtagtttata

SEQ ID NO: 88924 - DNA, 20 bp, Artificial Sequence
  chemically synthesized
tttgaaagtagtttatatgg

SEQ ID NO: 88925 - DNA, 20 bp, Artificial Sequence
  chemically synthesized
gaaagtagtttatatggtag

SEQ ID NO: 88926 - DNA, 20 bp, Artificial Sequence
  chemically synthesized
aaagtagtttatatggtaga

SEQ ID NO: 88927 - DNA, 20 bp, Artificial Sequence
  chemically synthesized
tagtttatatggtagaaggt

SEQ ID NO: 88928 - DNA, 20 bp, Artificial Sequence
  chemically synthesized
atatggtagaaggttagtat

SEQ ID NO: 88929 - DNA, 20 bp, Artificial Sequence
  chemically synthesized
tatggtagaaggttagtatt

SEQ ID NO: 88930 - DNA, 20 bp, Artificial Sequence
  chemically synthesized
ggttagtattgggattcttg

SEQ ID NO: 88931 - DNA, 20 bp, Artificial Sequence
  chemically synthesized
ttgaccaaacttcgttctgc

SEQ ID NO: 88932 - DNA, 20 bp, Artificial Sequence
  chemically synthesized
attgggattcttgcagaacg

SEQ ID NO: 88933 - DNA, 20 bp, Artificial Sequence
  chemically synthesized
gattcttgcagaacgaagtt

SEQ ID NO: 88934 - DNA, 20 bp, Artificial Sequence
  chemically synthesized
acgaagtttggtcaaatata

SEQ ID NO: 88935 - DNA, 20 bp, Artificial Sequence
  chemically synthesized
aaagaaagaaaaacataaaa

SEQ ID NO: 88936 - DNA, 20 bp, Artificial Sequence
  chemically synthesized
gtaggcaaaaggaaaaaaga

SEQ ID NO: 88937 - DNA, 20 bp, Artificial Sequence
  chemically synthesized
ccacgtaggcaaaaggaaaa

SEQ ID NO: 88938 - DNA, 20 bp, Artificial Sequence
  chemically synthesized
tgttattccacgtaggcaaa

SEQ ID NO: 88939 - DNA, 20 bp, Artificial Sequence
  chemically synthesized
atgttattccacgtaggcaa

SEQ ID NO: 88940 - DNA, 20 bp, Artificial Sequence
  chemically synthesized
cttttttccttttgcctacg

SEQ ID NO: 88941 - DNA, 20 bp, Artificial Sequence
  chemically synthesized
gcaggcatgttattccacgt

SEQ ID NO: 88942 - DNA, 20 bp, Artificial Sequence
  chemically synthesized
ggcaggcatgttattccacg

SEQ ID NO: 88943 - DNA, 20 bp, Artificial Sequence
  chemically synthesized
tgaagaagtgcaaattaggc

SEQ ID NO: 88944 - DNA, 20 bp, Artificial Sequence
  chemically synthesized
ctgaagaagtgcaaattagg

SEQ ID NO: 88945 - DNA, 20 bp, Artificial Sequence
  chemically synthesized
ttgctgaagaagtgcaaatt

SEQ ID NO: 88946 - DNA, 20 bp, Artificial Sequence
  chemically synthesized
tttgctgaagaagtgcaaat

SEQ ID NO: 88947 - DNA, 20 bp, Artificial Sequence
  chemically synthesized
ctgcctaatttgcacttctt

SEQ ID NO: 88948 - DNA, 20 bp, Artificial Sequence
  chemically synthesized
acttttctcttttgctgaag

SEQ ID NO: 88949 - DNA, 20 bp, Artificial Sequence
  chemically synthesized
aatttgcacttcttcagcaa

SEQ ID NO: 88950 - DNA, 20 bp, Artificial Sequence
  chemically synthesized
ctcacttttctcttttgctg

SEQ ID NO: 88951 - DNA, 20 bp, Artificial Sequence
  chemically synthesized
tttgcacttcttcagcaaaa

SEQ ID NO: 88952 - DNA, 20 bp, Artificial Sequence
  chemically synthesized
acttcttcagcaaaagagaa

SEQ ID NO: 88953 - DNA, 20 bp, Artificial Sequence
  chemically synthesized
cttcagcaaaagagaaaagt

SEQ ID NO: 88954 - DNA, 20 bp, Artificial Sequence
  chemically synthesized
aaaagtgagttaatttatct

SEQ ID NO: 88955 - DNA, 20 bp, Artificial Sequence
  chemically synthesized
gttaatttatctaagtactt

SEQ ID NO: 88956 - DNA, 20 bp, Artificial Sequence
  chemically synthesized
gctttttctcctgaagtact

SEQ ID NO: 88957 - DNA, 20 bp, Artificial Sequence
  chemically synthesized
ttaatttatctaagtacttc

SEQ ID NO: 88958 - DNA, 20 bp, Artificial Sequence
  chemically synthesized
aatttatctaagtacttcag

SEQ ID NO: 88959 - DNA, 20 bp, Artificial Sequence
  chemically synthesized
ctggttggctttttctcctg

SEQ ID NO: 88960 - DNA, 20 bp, Artificial Sequence
  chemically synthesized
tctaagtacttcaggagaaa

SEQ ID NO: 88961 - DNA, 20 bp, Artificial Sequence
  chemically synthesized
cttcaggagaaaaagccaac

SEQ ID NO: 88962 - DNA, 20 bp, Artificial Sequence
  chemically synthesized
atctggaacttagatctggt

SEQ ID NO: 88963 - DNA, 20 bp, Artificial Sequence
  chemically synthesized
agaaaaagccaaccagatct

SEQ ID NO: 88964 - DNA, 20 bp, Artificial Sequence
  chemically synthesized
aattatctggaacttagatc

SEQ ID NO: 88965 - DNA, 20 bp, Artificial Sequence
  chemically synthesized
agccaaccagatctaagttc

SEQ ID NO: 88966 - DNA, 20 bp, Artificial Sequence
  chemically synthesized
tgaaggaattatctggaact

SEQ ID NO: 88967 - DNA, 20 bp, Artificial Sequence
  chemically synthesized
agacaagtgaaggaattatc

SEQ ID NO: 88968 - DNA, 20 bp, Artificial Sequence
  chemically synthesized
gtaaagtaaaagacaagtga

SEQ ID NO: 88969 - DNA, 20 bp, Artificial Sequence
  chemically synthesized
agtaaagtaaaagacaagtg

SEQ ID NO: 88970 - DNA, 20 bp, Artificial Sequence
  chemically synthesized
gaagaagtaaagtaaaagac

SEQ ID NO: 88971 - DNA, 20 bp, Artificial Sequence
  chemically synthesized
caacagaagaagtaaagtaa

SEQ ID NO: 88972 - DNA, 20 bp, Artificial Sequence
  chemically synthesized
caagtacaacagaagaagta

SEQ ID NO: 88973 - DNA, 20 bp, Artificial Sequence
  chemically synthesized
caaatcaagtacaacagaag

SEQ ID NO: 88974 - DNA, 20 bp, Artificial Sequence
  chemically synthesized
gtacaaatcaagtacaacag

SEQ ID NO: 88975 - DNA, 20 bp, Artificial Sequence
  chemically synthesized
actgtacaaatcaagtacaa

SEQ ID NO: 88976 - DNA, 20 bp, Artificial Sequence
  chemically synthesized
aggaaagtactgtacaaatc

SEQ ID NO: 88977 - DNA, 20 bp, Artificial Sequence
  chemically synthesized
tctgttgtacttgatttgta

SEQ ID NO: 88978 - DNA, 20 bp, Artificial Sequence
  chemically synthesized
taagtgcatacacaaaagga

SEQ ID NO: 88979 - DNA, 20 bp, Artificial Sequence
  chemically synthesized
cccctaagtgcatacacaaa

SEQ ID NO: 88980 - DNA, 20 bp, Artificial Sequence
  chemically synthesized
tcccctaagtgcatacacaa

SEQ ID NO: 88981 - DNA, 20 bp, Artificial Sequence
  chemically synthesized
tttccttttgtgtatgcact

SEQ ID NO: 88982 - DNA, 20 bp, Artificial Sequence
  chemically synthesized
ttccttttgtgtatgcactt

SEQ ID NO: 88983 - DNA, 20 bp, Artificial Sequence
  chemically synthesized
tccttttgtgtatgcactta

SEQ ID NO: 88984 - DNA, 20 bp, Artificial Sequence
  chemically synthesized
ccttttgtgtatgcacttag

SEQ ID NO: 88985 - DNA, 20 bp, Artificial Sequence
  chemically synthesized
aagtttgtctttaatcccct

SEQ ID NO: 88986 - DNA, 20 bp, Artificial Sequence
  chemically synthesized
tgtatgcacttaggggatta

SEQ ID NO: 88987 - DNA, 20 bp, Artificial Sequence
  chemically synthesized
ggggattaaagacaaacttt

SEQ ID NO: 88988 - DNA, 20 bp, Artificial Sequence
  chemically synthesized
acttttacttgaacaactaa

SEQ ID NO: 88989 - DNA, 20 bp, Artificial Sequence
  chemically synthesized
agacaaacttttagttgttc

SEQ ID NO: 88990 - DNA, 20 bp, Artificial Sequence
  chemically synthesized
acttttagttgttcaagtaa

SEQ ID NO: 88991 - DNA, 20 bp, Artificial Sequence
  chemically synthesized
tcaagtaaaagtattctcac

SEQ ID NO: 88992 - DNA, 20 bp, Artificial Sequence
  chemically synthesized
agtaaaagtattctcactag

SEQ ID NO: 88993 - DNA, 20 bp, Artificial Sequence
  chemically synthesized
agaaaactgatgctactagt

SEQ ID NO: 88994 - DNA, 20 bp, Artificial Sequence
  chemically synthesized
agtattctcactagtagcat

SEQ ID NO: 88995 - DNA, 20 bp, Artificial Sequence
  chemically synthesized
acatagaaaactgatgctac

SEQ ID NO: 88996 - DNA, 20 bp, Artificial Sequence
  chemically synthesized
gtatgttaatgtagtaaaca

SEQ ID NO: 88997 - DNA, 20 bp, Artificial Sequence
  chemically synthesized
cctttatatgtatgttaatg

SEQ ID NO: 88998 - DNA, 20 bp, Artificial Sequence
  chemically synthesized
actacattaacatacatata

SEQ ID NO: 88999 - DNA, 20 bp, Artificial Sequence
  chemically synthesized
ctacattaacatacatataa

SEQ ID NO: 89000 - DNA, 20 bp, Artificial Sequence
  chemically synthesized
attaacatacatataaagga

SEQ ID NO: 89001 - DNA, 20 bp, Artificial Sequence
  chemically synthesized
aaatttatatcctacattga

SEQ ID NO: 89002 - DNA, 20 bp, Artificial Sequence
  chemically synthesized
tgggtctctgctatcaatgt

SEQ ID NO: 89003 - DNA, 20 bp, Artificial Sequence
  chemically synthesized
ctgggtctctgctatcaatg

SEQ ID NO: 89004 - DNA, 20 bp, Artificial Sequence
  chemically synthesized
tttatatcctacattgatag

SEQ ID NO: 89005 - DNA, 20 bp, Artificial Sequence
  chemically synthesized
tatatcctacattgatagca

SEQ ID NO: 89006 - DNA, 20 bp, Artificial Sequence
  chemically synthesized
ctacattgatagcagagacc

SEQ ID NO: 89007 - DNA, 20 bp, Artificial Sequence
  chemically synthesized
tacattgatagcagagaccc

SEQ ID NO: 89008 - DNA, 20 bp, Artificial Sequence
  chemically synthesized
aggagctcgtgattgagcct

SEQ ID NO: 89009 - DNA, 20 bp, Artificial Sequence
  chemically synthesized
aaggagctcgtgattgagcc

SEQ ID NO: 89010 - DNA, 20 bp, Artificial Sequence
  chemically synthesized
agagacccaggctcaatcac

SEQ ID NO: 89011 - DNA, 20 bp, Artificial Sequence
  chemically synthesized
accttaaggagctcgtgatt

SEQ ID NO: 89012 - DNA, 20 bp, Artificial Sequence
  chemically synthesized
ggctcaatcacgagctcctt

SEQ ID NO: 89013 - DNA, 20 bp, Artificial Sequence
  chemically synthesized
gctcaatcacgagctcctta

SEQ ID NO: 89014 - DNA, 20 bp, Artificial Sequence
  chemically synthesized
atggtatacataaccttaag

SEQ ID NO: 89015 - DNA, 20 bp, Artificial Sequence
  chemically synthesized
tcatggtatacataacctta

SEQ ID NO: 89016 - DNA, 20 bp, Artificial Sequence
  chemically synthesized
ttcatggtatacataacctt

SEQ ID NO: 89017 - DNA, 20 bp, Artificial Sequence
  chemically synthesized
ttaaggttatgtataccatg

SEQ ID NO: 89018 - DNA, 20 bp, Artificial Sequence
  chemically synthesized
agaaagtgttggtgacttca

SEQ ID NO: 89019 - DNA, 20 bp, Artificial Sequence
  chemically synthesized
tgagaagacaaagaaagtgt

SEQ ID NO: 89020 - DNA, 20 bp, Artificial Sequence
  chemically synthesized
tatgcttgagaagacaaaga

SEQ ID NO: 89021 - DNA, 20 bp, Artificial Sequence
  chemically synthesized
tatttatgcttgagaagaca

SEQ ID NO: 89022 - DNA, 20 bp, Artificial Sequence
  chemically synthesized
aacactttctttgtcttctc

SEQ ID NO: 89023 - DNA, 20 bp, Artificial Sequence
  chemically synthesized
acatcctatttatgcttgag

SEQ ID NO: 89024 - DNA, 20 bp, Artificial Sequence
  chemically synthesized
tcaacatcctatttatgctt

SEQ ID NO: 89025 - DNA, 20 bp, Artificial Sequence
  chemically synthesized
tttgtcttctcaagcataaa

SEQ ID NO: 89026 - DNA, 20 bp, Artificial Sequence
  chemically synthesized
ttgtcttctcaagcataaat

SEQ ID NO: 89027 - DNA, 20 bp, Artificial Sequence
  chemically synthesized
tatatggcaaagatgaaaag

SEQ ID NO: 89028 - DNA, 20 bp, Artificial Sequence
  chemically synthesized
atatatatggcaaagatgaa

SEQ ID NO: 89029 - DNA, 20 bp, Artificial Sequence
  chemically synthesized
gcagtataatatatatggca

SEQ ID NO: 89030 - DNA, 20 bp, Artificial Sequence
  chemically synthesized
tatatgcagtataatatata

SEQ ID NO: 89031 - DNA, 20 bp, Artificial Sequence
  chemically synthesized
acaacaaagatgtttatatg

SEQ ID NO: 89032 - DNA, 20 bp, Artificial Sequence
  chemically synthesized
tatttgttgataatacaaca

SEQ ID NO: 89033 - DNA, 20 bp, Artificial Sequence
  chemically synthesized
tgaatataaaattgataaac

SEQ ID NO: 89034 - DNA, 20 bp, Artificial Sequence
  chemically synthesized
ttgataaacaagcatttatt

SEQ ID NO: 89035 - DNA, 20 bp, Artificial Sequence
  chemically synthesized
tgataaacaagcatttattg

SEQ ID NO: 89036 - DNA, 20 bp, Artificial Sequence
  chemically synthesized
gctaaaactagacaataaat

SEQ ID NO: 89037 - DNA, 20 bp, Artificial Sequence
  chemically synthesized
ttgaggactgatttattgtc

SEQ ID NO: 89038 - DNA, 20 bp, Artificial Sequence
  chemically synthesized
actgatttattgtctagttt

SEQ ID NO: 89039 - DNA, 20 bp, Artificial Sequence
  chemically synthesized
atttcccaaagtgctaaaac

SEQ ID NO: 89040 - DNA, 20 bp, Artificial Sequence
  chemically synthesized
attgtctagttttagcactt

SEQ ID NO: 89041 - DNA, 20 bp, Artificial Sequence
  chemically synthesized
ttgtctagttttagcacttt

SEQ ID NO: 89042 - DNA, 20 bp, Artificial Sequence
  chemically synthesized
tactcctcttacatttccca

SEQ ID NO: 89043 - DNA, 20 bp, Artificial Sequence
  chemically synthesized
tttagcactttgggaaatgt

SEQ ID NO: 89044 - DNA, 20 bp, Artificial Sequence
  chemically synthesized
tagcactttgggaaatgtaa

SEQ ID NO: 89045 - DNA, 20 bp, Artificial Sequence
  chemically synthesized
agcactttgggaaatgtaag

SEQ ID NO: 89046 - DNA, 20 bp, Artificial Sequence
  chemically synthesized
cactttgggaaatgtaagag

SEQ ID NO: 89047 - DNA, 20 bp, Artificial Sequence
  chemically synthesized
tgtaagaggagtacaaatga

SEQ ID NO: 89048 - DNA, 20 bp, Artificial Sequence
  chemically synthesized
ggttttaggaaaattaaaga

SEQ ID NO: 89049 - DNA, 20 bp, Artificial Sequence
  chemically synthesized
actaggttttaggaaaatta

SEQ ID NO: 89050 - DNA, 20 bp, Artificial Sequence
  chemically synthesized
tctttaattttcctaaaacc

SEQ ID NO: 89051 - DNA, 20 bp, Artificial Sequence
  chemically synthesized
aaaaatgcacactaggtttt

SEQ ID NO: 89052 - DNA, 20 bp, Artificial Sequence
  chemically synthesized
caaaaatgcacactaggttt

SEQ ID NO: 89053 - DNA, 20 bp, Artificial Sequence
  chemically synthesized
attaaacaaaaatgcacact

SEQ ID NO: 89054 - DNA, 20 bp, Artificial Sequence
  chemically synthesized
aattaaacaaaaatgcacac

SEQ ID NO: 89055 - DNA, 20 bp, Artificial Sequence
  chemically synthesized
aattgccgtcaatatttagt

SEQ ID NO: 89056 - DNA, 20 bp, Artificial Sequence
  chemically synthesized
caggaattgccgtcaatatt

SEQ ID NO: 89057 - DNA, 20 bp, Artificial Sequence
  chemically synthesized
tattaccaactaaatattga

SEQ ID NO: 89058 - DNA, 20 bp, Artificial Sequence
  chemically synthesized
tattgacggcaattcctgcc

SEQ ID NO: 89059 - DNA, 20 bp, Artificial Sequence
  chemically synthesized
agtatctatgaagacttggc

SEQ ID NO: 89060 - DNA, 20 bp, Artificial Sequence
  chemically synthesized
cagtatctatgaagacttgg

SEQ ID NO: 89061 - DNA, 20 bp, Artificial Sequence
  chemically synthesized
tcccagtatctatgaagact

SEQ ID NO: 89062 - DNA, 20 bp, Artificial Sequence
  chemically synthesized
caattcctgccaagtcttca

SEQ ID NO: 89063 - DNA, 20 bp, Artificial Sequence
  chemically synthesized
tctttatcccagtatctatg

SEQ ID NO: 89064 - DNA, 20 bp, Artificial Sequence
  chemically synthesized
tgccaagtcttcatagatac

SEQ ID NO: 89065 - DNA, 20 bp, Artificial Sequence
  chemically synthesized
gccaagtcttcatagatact

SEQ ID NO: 89066 - DNA, 20 bp, Artificial Sequence
  chemically synthesized
tcttcatagatactgggata

SEQ ID NO: 89067 - DNA, 20 bp, Artificial Sequence
  chemically synthesized
aaaggaaggagtctttatcc

SEQ ID NO: 89068 - DNA, 20 bp, Artificial Sequence
  chemically synthesized
gggataaagactccttcctt

SEQ ID NO: 89069 - DNA, 20 bp, Artificial Sequence
  chemically synthesized
ttctgcatttctaaaggaag

SEQ ID NO: 89070 - DNA, 20 bp, Artificial Sequence
  chemically synthesized
atttctgcatttctaaagga

SEQ ID NO: 89071 - DNA, 20 bp, Artificial Sequence
  chemically synthesized
catttctgcatttctaaagg

SEQ ID NO: 89072 - DNA, 20 bp, Artificial Sequence
  chemically synthesized
agccatttctgcatttctaa

SEQ ID NO: 89073 - DNA, 20 bp, Artificial Sequence
  chemically synthesized
tagccatttctgcatttcta

SEQ ID NO: 89074 - DNA, 20 bp, Artificial Sequence
  chemically synthesized
gactccttcctttagaaatg

SEQ ID NO: 89075 - DNA, 20 bp, Artificial Sequence
  chemically synthesized
ttcctttagaaatgcagaaa

SEQ ID NO: 89076 - DNA, 20 bp, Artificial Sequence
  chemically synthesized
tagaaatgcagaaatggcta

SEQ ID NO: 89077 - DNA, 20 bp, Artificial Sequence
  chemically synthesized
tgccaatgctaagataactt

SEQ ID NO: 89078 - DNA, 20 bp, Artificial Sequence
  chemically synthesized
agaaatggctaaagttatct

SEQ ID NO: 89079 - DNA, 20 bp, Artificial Sequence
  chemically synthesized
ggctaaagttatcttagcat

SEQ ID NO: 89080 - DNA, 20 bp, Artificial Sequence
  chemically synthesized
cttatcttcttgccaatgct

SEQ ID NO: 89081 - DNA, 20 bp, Artificial Sequence
  chemically synthesized
aaagttatcttagcattggc

SEQ ID NO: 89082 - DNA, 20 bp, Artificial Sequence
  chemically synthesized
gttatcttagcattggcaag

SEQ ID NO: 89083 - DNA, 20 bp, Artificial Sequence
  chemically synthesized
cttagcattggcaagaagat

SEQ ID NO: 89084 - DNA, 20 bp, Artificial Sequence
  chemically synthesized
caagaagataagtcttctgt

SEQ ID NO: 89085 - DNA, 20 bp, Artificial Sequence
  chemically synthesized
tagaaaagcagtactgacag

SEQ ID NO: 89086 - DNA, 20 bp, Artificial Sequence
  chemically synthesized
acctagaaaagcagtactga

SEQ ID NO: 89087 - DNA, 20 bp, Artificial Sequence
  chemically synthesized
ttctgtcagtactgcttttc

SEQ ID NO: 89088 - DNA, 20 bp, Artificial Sequence
  chemically synthesized
tctgtcagtactgcttttct

SEQ ID NO: 89089 - DNA, 20 bp, Artificial Sequence
  chemically synthesized
accatcatgacctagaaaag

SEQ ID NO: 89090 - DNA, 20 bp, Artificial Sequence
  chemically synthesized
atcaccatcatgacctagaa

SEQ ID NO: 89091 - DNA, 20 bp, Artificial Sequence
  chemically synthesized
tctgtatcaccatcatgacc

SEQ ID NO: 89092 - DNA, 20 bp, Artificial Sequence
  chemically synthesized
actgcttttctaggtcatga

SEQ ID NO: 89093 - DNA, 20 bp, Artificial Sequence
  chemically synthesized
tctaggtcatgatggtgata

SEQ ID NO: 89094 - DNA, 20 bp, Artificial Sequence
  chemically synthesized
taggtcatgatggtgataca

SEQ ID NO: 89095 - DNA, 20 bp, Artificial Sequence
  chemically synthesized
tactgtacacgtgtcattta

SEQ ID NO: 89096 - DNA, 20 bp, Artificial Sequence
  chemically synthesized
agctgtaaatgacacgtgta

SEQ ID NO: 89097 - DNA, 20 bp, Artificial Sequence
  chemically synthesized
taaatgacacgtgtacagta

SEQ ID NO: 89098 - DNA, 20 bp, Artificial Sequence
  chemically synthesized
aaatgacacgtgtacagtaa

SEQ ID NO: 89099 - DNA, 20 bp, Artificial Sequence
  chemically synthesized
aatgacacgtgtacagtaaa

SEQ ID NO: 89100 - DNA, 20 bp, Artificial Sequence
  chemically synthesized
gtgtacagtaaagggcttta

SEQ ID NO: 89101 - DNA, 20 bp, Artificial Sequence
  chemically synthesized
tgtacagtaaagggctttac

SEQ ID NO: 89102 - DNA, 20 bp, Artificial Sequence
  chemically synthesized
tacgtgctttgtaacctgta

SEQ ID NO: 89103 - DNA, 20 bp, Artificial Sequence
  chemically synthesized
aaagggctttacaggttaca

SEQ ID NO: 89104 - DNA, 20 bp, Artificial Sequence
  chemically synthesized
cacgtacaaatgtaccacct

SEQ ID NO: 89105 - DNA, 20 bp, Artificial Sequence
  chemically synthesized
agggggaggaataactaagg

SEQ ID NO: 89106 - DNA, 20 bp, Artificial Sequence
  chemically synthesized
gccagggggaggaataacta

SEQ ID NO: 89107 - DNA, 20 bp, Artificial Sequence
  chemically synthesized
agccagggggaggaataact

SEQ ID NO: 89108 - DNA, 20 bp, Artificial Sequence
  chemically synthesized
accttagttattcctccccc

SEQ ID NO: 89109 - DNA, 20 bp, Artificial Sequence
  chemically synthesized
tacttcacagagccaggggg

SEQ ID NO: 89110 - DNA, 20 bp, Artificial Sequence
  chemically synthesized
gtacttcacagagccagggg

SEQ ID NO: 89111 - DNA, 20 bp, Artificial Sequence
  chemically synthesized
atgtacttcacagagccagg

SEQ ID NO: 89112 - DNA, 20 bp, Artificial Sequence
  chemically synthesized
gatgtacttcacagagccag

SEQ ID NO: 89113 - DNA, 20 bp, Artificial Sequence
  chemically synthesized
tgatgtacttcacagagcca

SEQ ID NO: 89114 - DNA, 20 bp, Artificial Sequence
  chemically synthesized
gtgatgtacttcacagagcc

SEQ ID NO: 89115 - DNA, 20 bp, Artificial Sequence
  chemically synthesized
tgtgatgtacttcacagagc

SEQ ID NO: 89116 - DNA, 20 bp, Artificial Sequence
  chemically synthesized
ttcctccccctggctctgtg

SEQ ID NO: 89117 - DNA, 20 bp, Artificial Sequence
  chemically synthesized
aaaatgtgatgtacttcaca

SEQ ID NO: 89118 - DNA, 20 bp, Artificial Sequence
  chemically synthesized
agaaaatgtgatgtacttca

SEQ ID NO: 89119 - DNA, 20 bp, Artificial Sequence
  chemically synthesized
acatcacattttctgttttg

SEQ ID NO: 89120 - DNA, 20 bp, Artificial Sequence
  chemically synthesized
cagtgctctcatctgcaaaa

SEQ ID NO: 89121 - DNA, 20 bp, Artificial Sequence
  chemically synthesized
acattttctgttttgcagat

SEQ ID NO: 89122 - DNA, 20 bp, Artificial Sequence
  chemically synthesized
attttctgttttgcagatga

SEQ ID NO: 89123 - DNA, 20 bp, Artificial Sequence
  chemically synthesized
gttttgcagatgagagcact

SEQ ID NO: 89124 - DNA, 20 bp, Artificial Sequence
  chemically synthesized
cagatgagagcactgagact

SEQ ID NO: 89125 - DNA, 20 bp, Artificial Sequence
  chemically synthesized
tcagttaaacatccgagtct

SEQ ID NO: 89126 - DNA, 20 bp, Artificial Sequence
  chemically synthesized
ggcaagtcagttaaacatcc

SEQ ID NO: 89127 - DNA, 20 bp, Artificial Sequence
  chemically synthesized
tatatggcttttaggcaagt

SEQ ID NO: 89128 - DNA, 20 bp, Artificial Sequence
  chemically synthesized
tgtttaactgacttgcctaa

SEQ ID NO: 89129 - DNA, 20 bp, Artificial Sequence
  chemically synthesized
cagctatatggcttttaggc

SEQ ID NO: 89130 - DNA, 20 bp, Artificial Sequence
  chemically synthesized
ttatcagctatatggctttt

SEQ ID NO: 89131 - DNA, 20 bp, Artificial Sequence
  chemically synthesized
cttatcagctatatggcttt

SEQ ID NO: 89132 - DNA, 20 bp, Artificial Sequence
  chemically synthesized
tgacttgcctaaaagccata

SEQ ID NO: 89133 - DNA, 20 bp, Artificial Sequence
  chemically synthesized
tctaacacttatcagctata

SEQ ID NO: 89134 - DNA, 20 bp, Artificial Sequence
  chemically synthesized
ctaaaagccatatagctgat

SEQ ID NO: 89135 - DNA, 20 bp, Artificial Sequence
  chemically synthesized
ttcccagttctaacacttat

SEQ ID NO: 89136 - DNA, 20 bp, Artificial Sequence
  chemically synthesized
gccatatagctgataagtgt

SEQ ID NO: 89137 - DNA, 20 bp, Artificial Sequence
  chemically synthesized
tagctgataagtgttagaac

SEQ ID NO: 89138 - DNA, 20 bp, Artificial Sequence
  chemically synthesized
agctgataagtgttagaact

SEQ ID NO: 89139 - DNA, 20 bp, Artificial Sequence
  chemically synthesized
taagtgttagaactgggaaa

SEQ ID NO: 89140 - DNA, 20 bp, Artificial Sequence
  chemically synthesized
agagaattggatccatttcc

SEQ ID NO: 89141 - DNA, 20 bp, Artificial Sequence
  chemically synthesized
tcttctagaatcaagagaat

SEQ ID NO: 89142 - DNA, 20 bp, Artificial Sequence
  chemically synthesized
ggatccaattctcttgattc

SEQ ID NO: 89143 - DNA, 20 bp, Artificial Sequence
  chemically synthesized
ccaagatcttctagaatcaa

SEQ ID NO: 89144 - DNA, 20 bp, Artificial Sequence
  chemically synthesized
gcccaagatcttctagaatc

SEQ ID NO: 89145 - DNA, 20 bp, Artificial Sequence
  chemically synthesized
tccaattctcttgattctag

SEQ ID NO: 89146 - DNA, 20 bp, Artificial Sequence
  chemically synthesized
ggaggcagcccaagatcttc

SEQ ID NO: 89147 - DNA, 20 bp, Artificial Sequence
  chemically synthesized
ctcttgattctagaagatct

SEQ ID NO: 89148 - DNA, 20 bp, Artificial Sequence
  chemically synthesized
tcttgattctagaagatctt

SEQ ID NO: 89149 - DNA, 20 bp, Artificial Sequence
  chemically synthesized
tgggttggtggaggcagccc

SEQ ID NO: 89150 - DNA, 20 bp, Artificial Sequence
  chemically synthesized
ggcaagtgggttggtggagg

SEQ ID NO: 89151 - DNA, 20 bp, Artificial Sequence
  chemically synthesized
tctggcaagtgggttggtgg

SEQ ID NO: 89152 - DNA, 20 bp, Artificial Sequence
  chemically synthesized
ttctggcaagtgggttggtg

SEQ ID NO: 89153 - DNA, 20 bp, Artificial Sequence
  chemically synthesized
gcttctggcaagtgggttgg

SEQ ID NO: 89154 - DNA, 20 bp, Artificial Sequence
  chemically synthesized
aatgcttctggcaagtgggt

SEQ ID NO: 89155 - DNA, 20 bp, Artificial Sequence
  chemically synthesized
gcctccaccaacccacttgc

SEQ ID NO: 89156 - DNA, 20 bp, Artificial Sequence
  chemically synthesized
atccaatgcttctggcaagt

SEQ ID NO: 89157 - DNA, 20 bp, Artificial Sequence
  chemically synthesized
tatccaatgcttctggcaag

SEQ ID NO: 89158 - DNA, 20 bp, Artificial Sequence
  chemically synthesized
tccaccaacccacttgccag

SEQ ID NO: 89159 - DNA, 20 bp, Artificial Sequence
  chemically synthesized
ttatatccaatgcttctggc

SEQ ID NO: 89160 - DNA, 20 bp, Artificial Sequence
  chemically synthesized
aacccacttgccagaagcat

SEQ ID NO: 89161 - DNA, 20 bp, Artificial Sequence
  chemically synthesized
tgtattatatccaatgcttc

SEQ ID NO: 89162 - DNA, 20 bp, Artificial Sequence
  chemically synthesized
gaagcattggatataataca

SEQ ID NO: 89163 - DNA, 20 bp, Artificial Sequence
  chemically synthesized
gcattggatataatacacag

SEQ ID NO: 89164 - DNA, 20 bp, Artificial Sequence
  chemically synthesized
gtagtatcttcgttcaggtt

SEQ ID NO: 89165 - DNA, 20 bp, Artificial Sequence
  chemically synthesized
gtagtcactgaacctgaacg

SEQ ID NO: 89166 - DNA, 20 bp, Artificial Sequence
  chemically synthesized
tgcaagtagtatcttcgttc

SEQ ID NO: 89167 - DNA, 20 bp, Artificial Sequence
  chemically synthesized
ttgcaagtagtatcttcgtt

SEQ ID NO: 89168 - DNA, 20 bp, Artificial Sequence
  chemically synthesized
tgaacgaagatactacttgc

SEQ ID NO: 89169 - DNA, 20 bp, Artificial Sequence
  chemically synthesized
aacgaagatactacttgcaa

SEQ ID NO: 89170 - DNA, 20 bp, Artificial Sequence
  chemically synthesized
cacttatttcctcttgcaag

SEQ ID NO: 89171 - DNA, 20 bp, Artificial Sequence
  chemically synthesized
acgaagatactacttgcaag

SEQ ID NO: 89172 - DNA, 20 bp, Artificial Sequence
  chemically synthesized
agtcacttatttcctcttgc

SEQ ID NO: 89173 - DNA, 20 bp, Artificial Sequence
  chemically synthesized
tactacttgcaagaggaaat

SEQ ID NO: 89174 - DNA, 20 bp, Artificial Sequence
  chemically synthesized
agaggaaataagtgactgtt

SEQ ID NO: 89175 - DNA, 20 bp, Artificial Sequence
  chemically synthesized
gaggaaataagtgactgttg

SEQ ID NO: 89176 - DNA, 20 bp, Artificial Sequence
  chemically synthesized
aggaaataagtgactgttga

SEQ ID NO: 89177 - DNA, 20 bp, Artificial Sequence
  chemically synthesized
tcagggtgcttttccctcaa

SEQ ID NO: 89178 - DNA, 20 bp, Artificial Sequence
  chemically synthesized
ataagtgactgttgagggaa

SEQ ID NO: 89179 - DNA, 20 bp, Artificial Sequence
  chemically synthesized
ttgagggaaaagcaccctga

SEQ ID NO: 89180 - DNA, 20 bp, Artificial Sequence
  chemically synthesized
gggaaaagcaccctgaaaga

SEQ ID NO: 89181 - DNA, 20 bp, Artificial Sequence
  chemically synthesized
ctcaagaatgctgtctttca

SEQ ID NO: 89182 - DNA, 20 bp, Artificial Sequence
  chemically synthesized
actcaagaatgctgtctttc

SEQ ID NO: 89183 - DNA, 20 bp, Artificial Sequence
  chemically synthesized
aactcaagaatgctgtcttt

SEQ ID NO: 89184 - DNA, 20 bp, Artificial Sequence
  chemically synthesized
ccctgaaagacagcattctt

SEQ ID NO: 89185 - DNA, 20 bp, Artificial Sequence
  chemically synthesized
gtaaacattttatcaaactc

SEQ ID NO: 89186 - DNA, 20 bp, Artificial Sequence
  chemically synthesized
tgataaaatgtttacccacg

SEQ ID NO: 89187 - DNA, 20 bp, Artificial Sequence
  chemically synthesized
cagaacaaatcaatccacgt

SEQ ID NO: 89188 - DNA, 20 bp, Artificial Sequence
  chemically synthesized
tcagaacaaatcaatccacg

SEQ ID NO: 89189 - DNA, 20 bp, Artificial Sequence
  chemically synthesized
tcagaattcaatttttcatt

SEQ ID NO: 89190 - DNA, 20 bp, Artificial Sequence
  chemically synthesized
aaaaaaaaaaaaagagcagt

SEQ ID NO: 89191 - DNA, 20 bp, Artificial Sequence
  chemically synthesized
aaaaaaaaaaaaaaaaagag

SEQ ID NO: 89192 - DNA, 20 bp, Artificial Sequence
  chemically synthesized
caaaaaaaaaaaaaaaaaaa

SEQ ID NO: 89193 - DNA, 20 bp, Artificial Sequence
  chemically synthesized
ctcaaaaaaaaaaaaaaaaa

SEQ ID NO: 89194 - DNA, 20 bp, Artificial Sequence
  chemically synthesized
cttttttttttttttttttt

SEQ ID NO: 89195 - DNA, 20 bp, Artificial Sequence
  chemically synthesized
ttttttttttttttttgaga

SEQ ID NO: 89196 - DNA, 20 bp, Artificial Sequence
  chemically synthesized
ttttttttttttttgagaca

SEQ ID NO: 89197 - DNA, 20 bp, Artificial Sequence
  chemically synthesized
tccagcctgggtgacagagc

SEQ ID NO: 89198 - DNA, 20 bp, Artificial Sequence
  chemically synthesized
cagagtctcgctctgtcacc

SEQ ID NO: 89199 - DNA, 20 bp, Artificial Sequence
  chemically synthesized
gtgctccagcctgggtgaca

SEQ ID NO: 89200 - DNA, 20 bp, Artificial Sequence
  chemically synthesized
agagtctcgctctgtcaccc

SEQ ID NO: 89201 - DNA, 20 bp, Artificial Sequence
  chemically synthesized
ctgtgctccagcctgggtga

SEQ ID NO: 89202 - DNA, 20 bp, Artificial Sequence
  chemically synthesized
tctcgctctgtcacccaggc

SEQ ID NO: 89203 - DNA, 20 bp, Artificial Sequence
  chemically synthesized
tcgctctgtcacccaggctg

SEQ ID NO: 89204 - DNA, 20 bp, Artificial Sequence
  chemically synthesized
gcgccactgtgctccagcct

SEQ ID NO: 89205 - DNA, 20 bp, Artificial Sequence
  chemically synthesized
cgcgccactgtgctccagcc

SEQ ID NO: 89206 - DNA, 20 bp, Artificial Sequence
  chemically synthesized
ctgtcacccaggctggagca

SEQ ID NO: 89207 - DNA, 20 bp, Artificial Sequence
  chemically synthesized
aagatcgcgccactgtgctc

SEQ ID NO: 89208 - DNA, 20 bp, Artificial Sequence
  chemically synthesized
tcacccaggctggagcacag

SEQ ID NO: 89209 - DNA, 20 bp, Artificial Sequence
  chemically synthesized
ggagcacagtggcgcgatct

SEQ ID NO: 89210 - DNA, 20 bp, Artificial Sequence
  chemically synthesized
ggcggagcttgcagtgagcc

SEQ ID NO: 89211 - DNA, 20 bp, Artificial Sequence
  chemically synthesized
gcgcgatcttggctcactgc

SEQ ID NO: 89212 - DNA, 20 bp, Artificial Sequence
  chemically synthesized
tgggaggcggagcttgcagt

SEQ ID NO: 89213 - DNA, 20 bp, Artificial Sequence
  chemically synthesized
aacctgggaggcggagcttg

SEQ ID NO: 89214 - DNA, 20 bp, Artificial Sequence
  chemically synthesized
tcactgcaagctccgcctcc

SEQ ID NO: 89215 - DNA, 20 bp, Artificial Sequence
  chemically synthesized
tggcgtgaacctgggaggcg

SEQ ID NO: 89216 - DNA, 20 bp, Artificial Sequence
  chemically synthesized
cactgcaagctccgcctccc

SEQ ID NO: 89217 - DNA, 20 bp, Artificial Sequence
  chemically synthesized
aatggcgtgaacctgggagg

SEQ ID NO: 89218 - DNA, 20 bp, Artificial Sequence
  chemically synthesized
gagaatggcgtgaacctggg

SEQ ID NO: 89219 - DNA, 20 bp, Artificial Sequence
  chemically synthesized
ggagaatggcgtgaacctgg

SEQ ID NO: 89220 - DNA, 20 bp, Artificial Sequence
  chemically synthesized
caggagaatggcgtgaacct

SEQ ID NO: 89221 - DNA, 20 bp, Artificial Sequence
  chemically synthesized
gcaggagaatggcgtgaacc

SEQ ID NO: 89222 - DNA, 20 bp, Artificial Sequence
  chemically synthesized
gggaggctgaggcaggagaa

SEQ ID NO: 89223 - DNA, 20 bp, Artificial Sequence
  chemically synthesized
ttcacgccattctcctgcct

SEQ ID NO: 89224 - DNA, 20 bp, Artificial Sequence
  chemically synthesized
tacttgggaggctgaggcag

SEQ ID NO: 89225 - DNA, 20 bp, Artificial Sequence
  chemically synthesized
gctacttgggaggctgaggc

SEQ ID NO: 89226 - DNA, 20 bp, Artificial Sequence
  chemically synthesized
agctacttgggaggctgagg

SEQ ID NO: 89227 - DNA, 20 bp, Artificial Sequence
  chemically synthesized
cccagctacttgggaggctg

SEQ ID NO: 89228 - DNA, 20 bp, Artificial Sequence
  chemically synthesized
tcccagctacttgggaggct

SEQ ID NO: 89229 - DNA, 20 bp, Artificial Sequence
  chemically synthesized
ttctcctgcctcagcctccc

SEQ ID NO: 89230 - DNA, 20 bp, Artificial Sequence
  chemically synthesized
tcctgcctcagcctcccaag

SEQ ID NO: 89231 - DNA, 20 bp, Artificial Sequence
  chemically synthesized
tatagtcccagctacttggg

SEQ ID NO: 89232 - DNA, 20 bp, Artificial Sequence
  chemically synthesized
ctatagtcccagctacttgg

SEQ ID NO: 89233 - DNA, 20 bp, Artificial Sequence
  chemically synthesized
gcctcagcctcccaagtagc

SEQ ID NO: 89234 - DNA, 20 bp, Artificial Sequence
  chemically synthesized
gcctatagtcccagctactt

SEQ ID NO: 89235 - DNA, 20 bp, Artificial Sequence
  chemically synthesized
cctcagcctcccaagtagct

SEQ ID NO: 89236 - DNA, 20 bp, Artificial Sequence
  chemically synthesized
cgcctatagtcccagctact

SEQ ID NO: 89237 - DNA, 20 bp, Artificial Sequence
  chemically synthesized
ctcccaagtagctgggacta

SEQ ID NO: 89238 - DNA, 20 bp, Artificial Sequence
  chemically synthesized
tcccaagtagctgggactat

SEQ ID NO: 89239 - DNA, 20 bp, Artificial Sequence
  chemically synthesized
gtggcgggcgcctatagtcc

SEQ ID NO: 89240 - DNA, 20 bp, Artificial Sequence
  chemically synthesized
ggcgtggtggcgggcgccta

SEQ ID NO: 89241 - DNA, 20 bp, Artificial Sequence
  chemically synthesized
aattagccaggcgtggtggc

SEQ ID NO: 89242 - DNA, 20 bp, Artificial Sequence
  chemically synthesized
aaattagccaggcgtggtgg

SEQ ID NO: 89243 - DNA, 20 bp, Artificial Sequence
  chemically synthesized
taggcgcccgccaccacgcc

SEQ ID NO: 89244 - DNA, 20 bp, Artificial Sequence
  chemically synthesized
aaaaaattagccaggcgtgg

SEQ ID NO: 89245 - DNA, 20 bp, Artificial Sequence
  chemically synthesized
caaaaaaaattagccaggcg

SEQ ID NO: 89246 - DNA, 20 bp, Artificial Sequence
  chemically synthesized
aaatacaaaaaaaattagcc

SEQ ID NO: 89247 - DNA, 20 bp, Artificial Sequence
  chemically synthesized
aaaatacaaaaaaaattagc

SEQ ID NO: 89248 - DNA, 20 bp, Artificial Sequence
  chemically synthesized
actaaaaatacaaaaaaaat

SEQ ID NO: 89249 - DNA, 20 bp, Artificial Sequence
  chemically synthesized
gctaattttttttgtatttt

SEQ ID NO: 89250 - DNA, 20 bp, Artificial Sequence
  chemically synthesized
aattttttttgtatttttag

SEQ ID NO: 89251 - DNA, 20 bp, Artificial Sequence
  chemically synthesized
ttttgtatttttagtagaaa

SEQ ID NO: 89252 - DNA, 20 bp, Artificial Sequence
  chemically synthesized
tttgtatttttagtagaaac

SEQ ID NO: 89253 - DNA, 20 bp, Artificial Sequence
  chemically synthesized
ttgtatttttagtagaaaca

SEQ ID NO: 89254 - DNA, 20 bp, Artificial Sequence
  chemically synthesized
gaaacagggtttcaccatgt

SEQ ID NO: 89255 - DNA, 20 bp, Artificial Sequence
  chemically synthesized
cagggtttcaccatgttagc

SEQ ID NO: 89256 - DNA, 20 bp, Artificial Sequence
  chemically synthesized
cgagaccatcctggctaaca

SEQ ID NO: 89257 - DNA, 20 bp, Artificial Sequence
  chemically synthesized
agggtttcaccatgttagcc

SEQ ID NO: 89258 - DNA, 20 bp, Artificial Sequence
  chemically synthesized
tttcaccatgttagccagga

SEQ ID NO: 89259 - DNA, 20 bp, Artificial Sequence
  chemically synthesized
tcaggagatcgagaccatcc

SEQ ID NO: 89260 - DNA, 20 bp, Artificial Sequence
  chemically synthesized
gatcacgaggtcaggagatc

SEQ ID NO: 89261 - DNA, 20 bp, Artificial Sequence
  chemically synthesized
tgggcggatcacgaggtcag

SEQ ID NO: 89262 - DNA, 20 bp, Artificial Sequence
  chemically synthesized
ggtgggcggatcacgaggtc

SEQ ID NO: 89263 - DNA, 20 bp, Artificial Sequence
  chemically synthesized
aggtgggcggatcacgaggt

SEQ ID NO: 89264 - DNA, 20 bp, Artificial Sequence
  chemically synthesized
gccaaggtgggcggatcacg

SEQ ID NO: 89265 - DNA, 20 bp, Artificial Sequence
  chemically synthesized
ggccaaggtgggcggatcac

SEQ ID NO: 89266 - DNA, 20 bp, Artificial Sequence
  chemically synthesized
acctcgtgatccgcccacct

SEQ ID NO: 89267 - DNA, 20 bp, Artificial Sequence
  chemically synthesized
ctttgggaggccaaggtggg

SEQ ID NO: 89268 - DNA, 20 bp, Artificial Sequence
  chemically synthesized
gcactttgggaggccaaggt

SEQ ID NO: 89269 - DNA, 20 bp, Artificial Sequence
  chemically synthesized
agcactttgggaggccaagg

SEQ ID NO: 89270 - DNA, 20 bp, Artificial Sequence
  chemically synthesized
ccaagcactttgggaggcca

SEQ ID NO: 89271 - DNA, 20 bp, Artificial Sequence
  chemically synthesized
tccaagcactttgggaggcc

SEQ ID NO: 89272 - DNA, 20 bp, Artificial Sequence
  chemically synthesized
ccgcccaccttggcctccca

SEQ ID NO: 89273 - DNA, 20 bp, Artificial Sequence
  chemically synthesized
tgtaatccaagcactttggg

SEQ ID NO: 89274 - DNA, 20 bp, Artificial Sequence
  chemically synthesized
ctgtaatccaagcactttgg

SEQ ID NO: 89275 - DNA, 20 bp, Artificial Sequence
  chemically synthesized
gcctgtaatccaagcacttt

SEQ ID NO: 89276 - DNA, 20 bp, Artificial Sequence
  chemically synthesized
ccttggcctcccaaagtgct

SEQ ID NO: 89277 - DNA, 20 bp, Artificial Sequence
  chemically synthesized
cgcctgtaatccaagcactt

SEQ ID NO: 89278 - DNA, 20 bp, Artificial Sequence
  chemically synthesized
ctcccaaagtgcttggatta

SEQ ID NO: 89279 - DNA, 20 bp, Artificial Sequence
  chemically synthesized
tcccaaagtgcttggattac

SEQ ID NO: 89280 - DNA, 20 bp, Artificial Sequence
  chemically synthesized
gtggctcacgcctgtaatcc

SEQ ID NO: 89281 - DNA, 20 bp, Artificial Sequence
  chemically synthesized
agtgcttggattacaggcgt

SEQ ID NO: 89282 - DNA, 20 bp, Artificial Sequence
  chemically synthesized
caggcgtgagccaccacacc

SEQ ID NO: 89283 - DNA, 20 bp, Artificial Sequence
  chemically synthesized
gcaatcagggccaggtgtgg

SEQ ID NO: 89284 - DNA, 20 bp, Artificial Sequence
  chemically synthesized
agagcaatcagggccaggtg

SEQ ID NO: 89285 - DNA, 20 bp, Artificial Sequence
  chemically synthesized
tgaaaagagcaatcagggcc

SEQ ID NO: 89286 - DNA, 20 bp, Artificial Sequence
  chemically synthesized
gtgaaaagagcaatcagggc

SEQ ID NO: 89287 - DNA, 20 bp, Artificial Sequence
  chemically synthesized
agaagtgaaaagagcaatca

SEQ ID NO: 89288 - DNA, 20 bp, Artificial Sequence
  chemically synthesized
gagaagtgaaaagagcaatc

SEQ ID NO: 89289 - DNA, 20 bp, Artificial Sequence
  chemically synthesized
tgagaagtgaaaagagcaat

SEQ ID NO: 89290 - DNA, 20 bp, Artificial Sequence
  chemically synthesized
tgctaaatgagaagtgaaaa

SEQ ID NO: 89291 - DNA, 20 bp, Artificial Sequence
  chemically synthesized
aatgctaaatgagaagtgaa

SEQ ID NO: 89292 - DNA, 20 bp, Artificial Sequence
  chemically synthesized
tgctcttttcacttctcatt

SEQ ID NO: 89293 - DNA, 20 bp, Artificial Sequence
  chemically synthesized
gatgcccaatgctaaatgag

SEQ ID NO: 89294 - DNA, 20 bp, Artificial Sequence
  chemically synthesized
caggatgcccaatgctaaat

SEQ ID NO: 89295 - DNA, 20 bp, Artificial Sequence
  chemically synthesized
tttcacttctcatttagcat

SEQ ID NO: 89296 - DNA, 20 bp, Artificial Sequence
  chemically synthesized
ttcacttctcatttagcatt

SEQ ID NO: 89297 - DNA, 20 bp, Artificial Sequence
  chemically synthesized
tcatttagcattgggcatcc

SEQ ID NO: 89298 - DNA, 20 bp, Artificial Sequence
  chemically synthesized
tttttgctcacaggtggtcc

SEQ ID NO: 89299 - DNA, 20 bp, Artificial Sequence
  chemically synthesized
ttttttgctcacaggtggtc

SEQ ID NO: 89300 - DNA, 20 bp, Artificial Sequence
  chemically synthesized
gggcatcctggaccacctgt

SEQ ID NO: 89301 - DNA, 20 bp, Artificial Sequence
  chemically synthesized
gaacattttttgctcacagg

SEQ ID NO: 89302 - DNA, 20 bp, Artificial Sequence
  chemically synthesized
tgtgaacattttttgctcac

SEQ ID NO: 89303 - DNA, 20 bp, Artificial Sequence
  chemically synthesized
gtgtgaacattttttgctca

SEQ ID NO: 89304 - DNA, 20 bp, Artificial Sequence
  chemically synthesized
caaaaaatgttcacactgaa

SEQ ID NO: 89305 - DNA, 20 bp, Artificial Sequence
  chemically synthesized
aaaaaatgttcacactgaaa

SEQ ID NO: 89306 - DNA, 20 bp, Artificial Sequence
  chemically synthesized
ttgcagaaaggagacctttt

SEQ ID NO: 89307 - DNA, 20 bp, Artificial Sequence
  chemically synthesized
acagggaaatttgcagaaag

SEQ ID NO: 89308 - DNA, 20 bp, Artificial Sequence
  chemically synthesized
caacagggaaatttgcagaa

SEQ ID NO: 89309 - DNA, 20 bp, Artificial Sequence
  chemically synthesized
gcaacagggaaatttgcaga

SEQ ID NO: 89310 - DNA, 20 bp, Artificial Sequence
  chemically synthesized
tctggcaacagggaaatttg

SEQ ID NO: 89311 - DNA, 20 bp, Artificial Sequence
  chemically synthesized
tctgcaaatttccctgttgc

SEQ ID NO: 89312 - DNA, 20 bp, Artificial Sequence
  chemically synthesized
gaatttctgttctggcaaca

SEQ ID NO: 89313 - DNA, 20 bp, Artificial Sequence
  chemically synthesized
agaatttctgttctggcaac

SEQ ID NO: 89314 - DNA, 20 bp, Artificial Sequence
  chemically synthesized
cagaatttctgttctggcaa

SEQ ID NO: 89315 - DNA, 20 bp, Artificial Sequence
  chemically synthesized
aaatttccctgttgccagaa

SEQ ID NO: 89316 - DNA, 20 bp, Artificial Sequence
  chemically synthesized
tgatggcagaatttctgttc

SEQ ID NO: 89317 - DNA, 20 bp, Artificial Sequence
  chemically synthesized
cagaacagaaattctgccat

SEQ ID NO: 89318 - DNA, 20 bp, Artificial Sequence
  chemically synthesized
aagagatgaattactgatgg

SEQ ID NO: 89319 - DNA, 20 bp, Artificial Sequence
  chemically synthesized
acaaagagatgaattactga

SEQ ID NO: 89320 - DNA, 20 bp, Artificial Sequence
  chemically synthesized
acatggctcttgtagacaaa

SEQ ID NO: 89321 - DNA, 20 bp, Artificial Sequence
  chemically synthesized
taattcatctctttgtctac

SEQ ID NO: 89322 - DNA, 20 bp, Artificial Sequence
  chemically synthesized
ccacatggctcttgtagaca

SEQ ID NO: 89323 - DNA, 20 bp, Artificial Sequence
  chemically synthesized
attcatctctttgtctacaa

SEQ ID NO: 89324 - DNA, 20 bp, Artificial Sequence
  chemically synthesized
agtagtccacatggctcttg

SEQ ID NO: 89325 - DNA, 20 bp, Artificial Sequence
  chemically synthesized
ctttgtctacaagagccatg

SEQ ID NO: 89326 - DNA, 20 bp, Artificial Sequence
  chemically synthesized
atggttcatagtagtccaca

SEQ ID NO: 89327 - DNA, 20 bp, Artificial Sequence
  chemically synthesized
tttcttggtatggttcatag

SEQ ID NO: 89328 - DNA, 20 bp, Artificial Sequence
  chemically synthesized
tcatttcttggtatggttca

SEQ ID NO: 89329 - DNA, 20 bp, Artificial Sequence
  chemically synthesized
ggactactatgaaccatacc

SEQ ID NO: 89330 - DNA, 20 bp, Artificial Sequence
  chemically synthesized
tgtcaagtcatttcttggta

SEQ ID NO: 89331 - DNA, 20 bp, Artificial Sequence
  chemically synthesized
tgatgtgtcaagtcatttct

SEQ ID NO: 89332 - DNA, 20 bp, Artificial Sequence
  chemically synthesized
caagaaatgacttgacacat

SEQ ID NO: 89333 - DNA, 20 bp, Artificial Sequence
  chemically synthesized
tatgtttatgctgatgtgtc

SEQ ID NO: 89334 - DNA, 20 bp, Artificial Sequence
  chemically synthesized
ttgacacatcagcataaaca

SEQ ID NO: 89335 - DNA, 20 bp, Artificial Sequence
  chemically synthesized
cctgccatcccaaaggaaca

SEQ ID NO: 89336 - DNA, 20 bp, Artificial Sequence
  chemically synthesized
atagttcatccatgttcctt

SEQ ID NO: 89337 - DNA, 20 bp, Artificial Sequence
  chemically synthesized
tagttcatccatgttccttt

SEQ ID NO: 89338 - DNA, 20 bp, Artificial Sequence
  chemically synthesized
tcatccatgttcctttggga

SEQ ID NO: 89339 - DNA, 20 bp, Artificial Sequence
  chemically synthesized
ctaccagcctgccatcccaa

SEQ ID NO: 89340 - DNA, 20 bp, Artificial Sequence
  chemically synthesized
cctaccagcctgccatccca

SEQ ID NO: 89341 - DNA, 20 bp, Artificial Sequence
  chemically synthesized
tccatgttcctttgggatgg

SEQ ID NO: 89342 - DNA, 20 bp, Artificial Sequence
  chemically synthesized
ccatgttcctttgggatggc

SEQ ID NO: 89343 - DNA, 20 bp, Artificial Sequence
  chemically synthesized
gttcctttgggatggcaggc

SEQ ID NO: 89344 - DNA, 20 bp, Artificial Sequence
  chemically synthesized
cctttgggatggcaggctgg

SEQ ID NO: 89345 - DNA, 20 bp, Artificial Sequence
  chemically synthesized
ctttgggatggcaggctggt

SEQ ID NO: 89346 - DNA, 20 bp, Artificial Sequence
  chemically synthesized
tagcttgaaagatttcctac

SEQ ID NO: 89347 - DNA, 20 bp, Artificial Sequence
  chemically synthesized
aggctggtaggaaatctttc

SEQ ID NO: 89348 - DNA, 20 bp, Artificial Sequence
  chemically synthesized
atctgagtcctgtagcttga

SEQ ID NO: 89349 - DNA, 20 bp, Artificial Sequence
  chemically synthesized
gtaggaaatctttcaagcta

SEQ ID NO: 89350 - DNA, 20 bp, Artificial Sequence
  chemically synthesized
taggaaatctttcaagctac

SEQ ID NO: 89351 - DNA, 20 bp, Artificial Sequence
  chemically synthesized
atctttcaagctacaggact

SEQ ID NO: 89352 - DNA, 20 bp, Artificial Sequence
  chemically synthesized
ggcaacctatctgagtcctg

SEQ ID NO: 89353 - DNA, 20 bp, Artificial Sequence
  chemically synthesized
ttcaagctacaggactcaga

SEQ ID NO: 89354 - DNA, 20 bp, Artificial Sequence
  chemically synthesized
tcaagctacaggactcagat

SEQ ID NO: 89355 - DNA, 20 bp, Artificial Sequence
  chemically synthesized
ccttttagggcaacctatct

SEQ ID NO: 89356 - DNA, 20 bp, Artificial Sequence
  chemically synthesized
actcagataggttgccctaa

SEQ ID NO: 89357 - DNA, 20 bp, Artificial Sequence
  chemically synthesized
ctcagataggttgccctaaa

SEQ ID NO: 89358 - DNA, 20 bp, Artificial Sequence
  chemically synthesized
agataggttgccctaaaagg

SEQ ID NO: 89359 - DNA, 20 bp, Artificial Sequence
  chemically synthesized
caatacttaccttcctttta

SEQ ID NO: 89360 - DNA, 20 bp, Artificial Sequence
  chemically synthesized
gataggttgccctaaaagga

SEQ ID NO: 89361 - DNA, 20 bp, Artificial Sequence
  chemically synthesized
ccaatacttaccttcctttt

SEQ ID NO: 89362 - DNA, 20 bp, Artificial Sequence
  chemically synthesized
cccaatacttaccttccttt

SEQ ID NO: 89363 - DNA, 20 bp, Artificial Sequence
  chemically synthesized
ggttgccctaaaaggaaggt

SEQ ID NO: 89364 - DNA, 20 bp, Artificial Sequence
  chemically synthesized
cctaaaaggaaggtaagtat

SEQ ID NO: 89365 - DNA, 20 bp, Artificial Sequence
  chemically synthesized
ctaaaaggaaggtaagtatt

SEQ ID NO: 89366 - DNA, 20 bp, Artificial Sequence
  chemically synthesized
aaggaaggtaagtattggga

SEQ ID NO: 89367 - DNA, 20 bp, Artificial Sequence
  chemically synthesized
taagtattgggaaagaaccc

SEQ ID NO: 89368 - DNA, 20 bp, Artificial Sequence
  chemically synthesized
aagtattgggaaagaaccca

SEQ ID NO: 89369 - DNA, 20 bp, Artificial Sequence
  chemically synthesized
agcttttgaaagagagcctt

SEQ ID NO: 89370 - DNA, 20 bp, Artificial Sequence
  chemically synthesized
cagcttttgaaagagagcct

SEQ ID NO: 89371 - DNA, 20 bp, Artificial Sequence
  chemically synthesized
gcatgccagcttttgaaaga

SEQ ID NO: 89372 - DNA, 20 bp, Artificial Sequence
  chemically synthesized
aacccaaggctctctttcaa

SEQ ID NO: 89373 - DNA, 20 bp, Artificial Sequence
  chemically synthesized
cagcatgccagcttttgaaa

SEQ ID NO: 89374 - DNA, 20 bp, Artificial Sequence
  chemically synthesized
tacagcatgccagcttttga

SEQ ID NO: 89375 - DNA, 20 bp, Artificial Sequence
  chemically synthesized
caaggctctctttcaaaagc

SEQ ID NO: 89376 - DNA, 20 bp, Artificial Sequence
  chemically synthesized
aaatctccactacagcatgc

SEQ ID NO: 89377 - DNA, 20 bp, Artificial Sequence
  chemically synthesized
tttcaaaagctggcatgctg

SEQ ID NO: 89378 - DNA, 20 bp, Artificial Sequence
  chemically synthesized
caaaagctggcatgctgtag

SEQ ID NO: 89379 - DNA, 20 bp, Artificial Sequence
  chemically synthesized
aaagctggcatgctgtagtg

SEQ ID NO: 89380 - DNA, 20 bp, Artificial Sequence
  chemically synthesized
atactgaaaaatctccacta

SEQ ID NO: 89381 - DNA, 20 bp, Artificial Sequence
  chemically synthesized
atgctgtagtggagattttt

SEQ ID NO: 89382 - DNA, 20 bp, Artificial Sequence
  chemically synthesized
ggagatttttcagtatcaat

SEQ ID NO: 89383 - DNA, 20 bp, Artificial Sequence
  chemically synthesized
gagatttttcagtatcaata

SEQ ID NO: 89384 - DNA, 20 bp, Artificial Sequence
  chemically synthesized
atttttcagtatcaataagg

SEQ ID NO: 89385 - DNA, 20 bp, Artificial Sequence
  chemically synthesized
cagtatcaataaggcagcat

SEQ ID NO: 89386 - DNA, 20 bp, Artificial Sequence
  chemically synthesized
caataaggcagcatgagtca

SEQ ID NO: 89387 - DNA, 20 bp, Artificial Sequence
  chemically synthesized
aggcagcatgagtcatagat

SEQ ID NO: 89388 - DNA, 20 bp, Artificial Sequence
  chemically synthesized
ggcagcatgagtcatagatt

SEQ ID NO: 89389 - DNA, 20 bp, Artificial Sequence
  chemically synthesized
tgagtcatagattgggaatg

SEQ ID NO: 89390 - DNA, 20 bp, Artificial Sequence
  chemically synthesized
gagtcatagattgggaatgc

SEQ ID NO: 89391 - DNA, 20 bp, Artificial Sequence
  chemically synthesized
agtcatagattgggaatgca

SEQ ID NO: 89392 - DNA, 20 bp, Artificial Sequence
  chemically synthesized
catagattgggaatgcaggg

SEQ ID NO: 89393 - DNA, 20 bp, Artificial Sequence
  chemically synthesized
atagattgggaatgcagggc

SEQ ID NO: 89394 - DNA, 20 bp, Artificial Sequence
  chemically synthesized
gggaatgcagggcaggctgc

SEQ ID NO: 89395 - DNA, 20 bp, Artificial Sequence
  chemically synthesized
ggaatgcagggcaggctgca

SEQ ID NO: 89396 - DNA, 20 bp, Artificial Sequence
  chemically synthesized
tgtataatgtatattccttg

SEQ ID NO: 89397 - DNA, 20 bp, Artificial Sequence
  chemically synthesized
ttagacaaatatcattatgg

SEQ ID NO: 89398 - DNA, 20 bp, Artificial Sequence
  chemically synthesized
agtttagacaaatatcatta

SEQ ID NO: 89399 - DNA, 20 bp, Artificial Sequence
  chemically synthesized
taaataaaaaatgatgagtt

SEQ ID NO: 89400 - DNA, 20 bp, Artificial Sequence
  chemically synthesized
ataaataaataaaaaatgat

SEQ ID NO: 89401 - DNA, 20 bp, Artificial Sequence
  chemically synthesized
tattattatactttaaattt

SEQ ID NO: 89402 - DNA, 20 bp, Artificial Sequence
  chemically synthesized
cacatgtaccctaaaattta

SEQ ID NO: 89403 - DNA, 20 bp, Artificial Sequence
  chemically synthesized
attattatactttaaatttt

SEQ ID NO: 89404 - DNA, 20 bp, Artificial Sequence
  chemically synthesized
ttattatactttaaatttta

SEQ ID NO: 89405 - DNA, 20 bp, Artificial Sequence
  chemically synthesized
gggtacatgtgcacaacgtg

SEQ ID NO: 89406 - DNA, 20 bp, Artificial Sequence
  chemically synthesized
ggtacatgtgcacaacgtgc

SEQ ID NO: 89407 - DNA, 20 bp, Artificial Sequence
  chemically synthesized
catgtgcacaacgtgcaggt

SEQ ID NO: 89408 - DNA, 20 bp, Artificial Sequence
  chemically synthesized
tatgtatacatgtgccatgc

SEQ ID NO: 89409 - DNA, 20 bp, Artificial Sequence
  chemically synthesized
gtgggtgcagcgcaccagca

SEQ ID NO: 89410 - DNA, 20 bp, Artificial Sequence
  chemically synthesized
agttagtgggtgcagcgcac

SEQ ID NO: 89411 - DNA, 20 bp, Artificial Sequence
  chemically synthesized
agatgatgagttagtgggtg

SEQ ID NO: 89412 - DNA, 20 bp, Artificial Sequence
  chemically synthesized
atgctagatgatgagttagt

SEQ ID NO: 89413 - DNA, 20 bp, Artificial Sequence
  chemically synthesized
aatgctagatgatgagttag

SEQ ID NO: 89414 - DNA, 20 bp, Artificial Sequence
  chemically synthesized
cctaatgctagatgatgagt

SEQ ID NO: 89415 - DNA, 20 bp, Artificial Sequence
  chemically synthesized
gcacccactaactcatcatc

SEQ ID NO: 89416 - DNA, 20 bp, Artificial Sequence
  chemically synthesized
tatacctaatgctagatgat

SEQ ID NO: 89417 - DNA, 20 bp, Artificial Sequence
  chemically synthesized
actaactcatcatctagcat

SEQ ID NO: 89418 - DNA, 20 bp, Artificial Sequence
  chemically synthesized
ctaactcatcatctagcatt

SEQ ID NO: 89419 - DNA, 20 bp, Artificial Sequence
  chemically synthesized
ttgggagatatacctaatgc

SEQ ID NO: 89420 - DNA, 20 bp, Artificial Sequence
  chemically synthesized
ggggggagggatagcattgg

SEQ ID NO: 89421 - DNA, 20 bp, Artificial Sequence
  chemically synthesized
gaggggggagggatagcatt

SEQ ID NO: 89422 - DNA, 20 bp, Artificial Sequence
  chemically synthesized
ggaggggggagggatagcat

SEQ ID NO: 89423 - DNA, 20 bp, Artificial Sequence
  chemically synthesized
gtggggggaggggggaggga

SEQ ID NO: 89424 - DNA, 20 bp, Artificial Sequence
  chemically synthesized
tggggtggggggagggggga

SEQ ID NO: 89425 - DNA, 20 bp, Artificial Sequence
  chemically synthesized
gtggggtggggggagggggg

SEQ ID NO: 89426 - DNA, 20 bp, Artificial Sequence
  chemically synthesized
tgtggggtggggggaggggg

SEQ ID NO: 89427 - DNA, 20 bp, Artificial Sequence
  chemically synthesized
gttgtggggtggggggaggg

SEQ ID NO: 89428 - DNA, 20 bp, Artificial Sequence
  chemically synthesized
tgttgtggggtggggggagg

SEQ ID NO: 89429 - DNA, 20 bp, Artificial Sequence
  chemically synthesized
ctgttgtggggtggggggag

SEQ ID NO: 89430 - DNA, 20 bp, Artificial Sequence
  chemically synthesized
actgttgtggggtgggggga

SEQ ID NO: 89431 - DNA, 20 bp, Artificial Sequence
  chemically synthesized
gactgttgtggggtgggggg

SEQ ID NO: 89432 - DNA, 20 bp, Artificial Sequence
  chemically synthesized
ggactgttgtggggtggggg

SEQ ID NO: 89433 - DNA, 20 bp, Artificial Sequence
  chemically synthesized
ggggactgttgtggggtggg

SEQ ID NO: 89434 - DNA, 20 bp, Artificial Sequence
  chemically synthesized
tggggactgttgtggggtgg

SEQ ID NO: 89435 - DNA, 20 bp, Artificial Sequence
  chemically synthesized
ctggggactgttgtggggtg

SEQ ID NO: 89436 - DNA, 20 bp, Artificial Sequence
  chemically synthesized
tctggggactgttgtggggt

SEQ ID NO: 89437 - DNA, 20 bp, Artificial Sequence
  chemically synthesized
ctctggggactgttgtgggg

SEQ ID NO: 89438 - DNA, 20 bp, Artificial Sequence
  chemically synthesized
cccctccccccaccccacaa

SEQ ID NO: 89439 - DNA, 20 bp, Artificial Sequence
  chemically synthesized
acactctggggactgttgtg

SEQ ID NO: 89440 - DNA, 20 bp, Artificial Sequence
  chemically synthesized
cacactctggggactgttgt

SEQ ID NO: 89441 - DNA, 20 bp, Artificial Sequence
  chemically synthesized
tcacactctggggactgttg

SEQ ID NO: 89442 - DNA, 20 bp, Artificial Sequence
  chemically synthesized
ccccaccccacaacagtccc

SEQ ID NO: 89443 - DNA, 20 bp, Artificial Sequence
  chemically synthesized
ccaccccacaacagtcccca

SEQ ID NO: 89444 - DNA, 20 bp, Artificial Sequence
  chemically synthesized
aaggggaacatcacactctg

SEQ ID NO: 89445 - DNA, 20 bp, Artificial Sequence
  chemically synthesized
gaaggggaacatcacactct

SEQ ID NO: 89446 - DNA, 20 bp, Artificial Sequence
  chemically synthesized
ggaaggggaacatcacactc

SEQ ID NO: 89447 - DNA, 20 bp, Artificial Sequence
  chemically synthesized
gaacacatggacacaggaag

SEQ ID NO: 89448 - DNA, 20 bp, Artificial Sequence
  chemically synthesized
agaacacatggacacaggaa

SEQ ID NO: 89449 - DNA, 20 bp, Artificial Sequence
  chemically synthesized
gagaacacatggacacagga

SEQ ID NO: 89450 - DNA, 20 bp, Artificial Sequence
  chemically synthesized
tgagaacacatggacacagg

SEQ ID NO: 89451 - DNA, 20 bp, Artificial Sequence
  chemically synthesized
caatgagaacacatggacac

SEQ ID NO: 89452 - DNA, 20 bp, Artificial Sequence
  chemically synthesized
acaatgagaacacatggaca

SEQ ID NO: 89453 - DNA, 20 bp, Artificial Sequence
  chemically synthesized
aattgaacaatgagaacaca

SEQ ID NO: 89454 - DNA, 20 bp, Artificial Sequence
  chemically synthesized
ataggtgggaattgaacaat

SEQ ID NO: 89455 - DNA, 20 bp, Artificial Sequence
  chemically synthesized
attgttcaattcccacctat

SEQ ID NO: 89456 - DNA, 20 bp, Artificial Sequence
  chemically synthesized
gcatattctcactcataggt

SEQ ID NO: 89457 - DNA, 20 bp, Artificial Sequence
  chemically synthesized
cgcatattctcactcatagg

SEQ ID NO: 89458 - DNA, 20 bp, Artificial Sequence
  chemically synthesized
ttcaattcccacctatgagt

SEQ ID NO: 89459 - DNA, 20 bp, Artificial Sequence
  chemically synthesized
caccgcatattctcactcat

SEQ ID NO: 89460 - DNA, 20 bp, Artificial Sequence
  chemically synthesized
acaccgcatattctcactca

SEQ ID NO: 89461 - DNA, 20 bp, Artificial Sequence
  chemically synthesized
cacctatgagtgagaatatg

SEQ ID NO: 89462 - DNA, 20 bp, Artificial Sequence
  chemically synthesized
gagtgagaatatgcggtgtt

SEQ ID NO: 89463 - DNA, 20 bp, Artificial Sequence
  chemically synthesized
tcagtaaactatcacaagaa

SEQ ID NO: 89464 - DNA, 20 bp, Artificial Sequence
  chemically synthesized
ttggtgttctgttcttgtga

SEQ ID NO: 89465 - DNA, 20 bp, Artificial Sequence
  chemically synthesized
tattctcagtaaactatcac

SEQ ID NO: 89466 - DNA, 20 bp, Artificial Sequence
  chemically synthesized
tgttcttgtgatagtttact

SEQ ID NO: 89467 - DNA, 20 bp, Artificial Sequence
  chemically synthesized
aaattggaaatcattattct

SEQ ID NO: 89468 - DNA, 20 bp, Artificial Sequence
  chemically synthesized
tgtagggacatggatgaaat

SEQ ID NO: 89469 - DNA, 20 bp, Artificial Sequence
  chemically synthesized
tcacatcctttgtagggaca

SEQ ID NO: 89470 - DNA, 20 bp, Artificial Sequence
  chemically synthesized
atttcatccatgtccctaca

SEQ ID NO: 89471 - DNA, 20 bp, Artificial Sequence
  chemically synthesized
tttcatccatgtccctacaa

SEQ ID NO: 89472 - DNA, 20 bp, Artificial Sequence
  chemically synthesized
atgagttcacatcctttgta

SEQ ID NO: 89473 - DNA, 20 bp, Artificial Sequence
  chemically synthesized
gatgagttcacatcctttgt

SEQ ID NO: 89474 - DNA, 20 bp, Artificial Sequence
  chemically synthesized
ggatgagttcacatcctttg

SEQ ID NO: 89475 - DNA, 20 bp, Artificial Sequence
  chemically synthesized
tgcagccataaaaaaaggat

SEQ ID NO: 89476 - DNA, 20 bp, Artificial Sequence
  chemically synthesized
gtgaactcatccttttttta

SEQ ID NO: 89477 - DNA, 20 bp, Artificial Sequence
  chemically synthesized
tactatgcagccataaaaaa

SEQ ID NO: 89478 - DNA, 20 bp, Artificial Sequence
  chemically synthesized
atactatgcagccataaaaa

SEQ ID NO: 89479 - DNA, 20 bp, Artificial Sequence
  chemically synthesized
atcctttttttatggctgca

SEQ ID NO: 89480 - DNA, 20 bp, Artificial Sequence
  chemically synthesized
atacaccatggaatactatg

SEQ ID NO: 89481 - DNA, 20 bp, Artificial Sequence
  chemically synthesized
tatggctgcatagtattcca

SEQ ID NO: 89482 - DNA, 20 bp, Artificial Sequence
  chemically synthesized
aatgtggcacatatacacca

SEQ ID NO: 89483 - DNA, 20 bp, Artificial Sequence
  chemically synthesized
tagactggattaagaaaatg

SEQ ID NO: 89484 - DNA, 20 bp, Artificial Sequence
  chemically synthesized
tgtgccacattttcttaatc

SEQ ID NO: 89485 - DNA, 20 bp, Artificial Sequence
  chemically synthesized
caacagtgatagactggatt

SEQ ID NO: 89486 - DNA, 20 bp, Artificial Sequence
  chemically synthesized
aatgtccaacagtgatagac

SEQ ID NO: 89487 - DNA, 20 bp, Artificial Sequence
  chemically synthesized
ttaatccagtctatcactgt

SEQ ID NO: 89488 - DNA, 20 bp, Artificial Sequence
  chemically synthesized
acccaaatgtccaacagtga

SEQ ID NO: 89489 - DNA, 20 bp, Artificial Sequence
  chemically synthesized
gaaccaacccaaatgtccaa

SEQ ID NO: 89490 - DNA, 20 bp, Artificial Sequence
  chemically synthesized
gtctatcactgttggacatt

SEQ ID NO: 89491 - DNA, 20 bp, Artificial Sequence
  chemically synthesized
tctatcactgttggacattt

SEQ ID NO: 89492 - DNA, 20 bp, Artificial Sequence
  chemically synthesized
tcactgttggacatttgggt

SEQ ID NO: 89493 - DNA, 20 bp, Artificial Sequence
  chemically synthesized
tggacatttgggttggttcc

SEQ ID NO: 89494 - DNA, 20 bp, Artificial Sequence
  chemically synthesized
tattcacaatagcaaagact

SEQ ID NO: 89495 - DNA, 20 bp, Artificial Sequence
  chemically synthesized
cggcactattcacaatagca

SEQ ID NO: 89496 - DNA, 20 bp, Artificial Sequence
  chemically synthesized
caagtctttgctattgtgaa

SEQ ID NO: 89497 - DNA, 20 bp, Artificial Sequence
  chemically synthesized
tattgcggcactattcacaa

SEQ ID NO: 89498 - DNA, 20 bp, Artificial Sequence
  chemically synthesized
atgcacacgtatgtttattg

SEQ ID NO: 89499 - DNA, 20 bp, Artificial Sequence
  chemically synthesized
tacgtgtgcatgtgtcttta

SEQ ID NO: 89500 - DNA, 20 bp, Artificial Sequence
  chemically synthesized
gtgtgcatgtgtctttatag

SEQ ID NO: 89501 - DNA, 20 bp, Artificial Sequence
  chemically synthesized
ctataaatcatgctgctata

SEQ ID NO: 89502 - DNA, 20 bp, Artificial Sequence
  chemically synthesized
ctttatagcagcatgattta

SEQ ID NO: 89503 - DNA, 20 bp, Artificial Sequence
  chemically synthesized
cagcatgatttatagtcctt

SEQ ID NO: 89504 - DNA, 20 bp, Artificial Sequence
  chemically synthesized
agcatgatttatagtccttt

SEQ ID NO: 89505 - DNA, 20 bp, Artificial Sequence
  chemically synthesized
attactgggtatatacccaa

SEQ ID NO: 89506 - DNA, 20 bp, Artificial Sequence
  chemically synthesized
cattactgggtatataccca

SEQ ID NO: 89507 - DNA, 20 bp, Artificial Sequence
  chemically synthesized
tagtcctttgggtatatacc

SEQ ID NO: 89508 - DNA, 20 bp, Artificial Sequence
  chemically synthesized
tttgggtatatacccagtaa

SEQ ID NO: 89509 - DNA, 20 bp, Artificial Sequence
  chemically synthesized
ttgggtatatacccagtaat

SEQ ID NO: 89510 - DNA, 20 bp, Artificial Sequence
  chemically synthesized
gacccagccatcccattact

SEQ ID NO: 89511 - DNA, 20 bp, Artificial Sequence
  chemically synthesized
tgacccagccatcccattac

SEQ ID NO: 89512 - DNA, 20 bp, Artificial Sequence
  chemically synthesized
gtatatacccagtaatggga

SEQ ID NO: 89513 - DNA, 20 bp, Artificial Sequence
  chemically synthesized
atacccagtaatgggatggc

SEQ ID NO: 89514 - DNA, 20 bp, Artificial Sequence
  chemically synthesized
tacccagtaatgggatggct

SEQ ID NO: 89515 - DNA, 20 bp, Artificial Sequence
  chemically synthesized
aatgggatggctgggtcaaa

SEQ ID NO: 89516 - DNA, 20 bp, Artificial Sequence
  chemically synthesized
actagaaataccatttgacc

SEQ ID NO: 89517 - DNA, 20 bp, Artificial Sequence
  chemically synthesized
gctgggtcaaatggtatttc

SEQ ID NO: 89518 - DNA, 20 bp, Artificial Sequence
  chemically synthesized
tcaaatggtatttctagttc

SEQ ID NO: 89519 - DNA, 20 bp, Artificial Sequence
  chemically synthesized
attcctcagggatctagaac

SEQ ID NO: 89520 - DNA, 20 bp, Artificial Sequence
  chemically synthesized
atttctagttctagatccct

SEQ ID NO: 89521 - DNA, 20 bp, Artificial Sequence
  chemically synthesized
gtggcgattcctcagggatc

SEQ ID NO: 89522 - DNA, 20 bp, Artificial Sequence
  chemically synthesized
tttctagttctagatccctg

SEQ ID NO: 89523 - DNA, 20 bp, Artificial Sequence
  chemically synthesized
gtcagtgtggcgattcctca

SEQ ID NO: 89524 - DNA, 20 bp, Artificial Sequence
  chemically synthesized
agtcagtgtggcgattcctc

SEQ ID NO: 89525 - DNA, 20 bp, Artificial Sequence
  chemically synthesized
aagtcagtgtggcgattcct

SEQ ID NO: 89526 - DNA, 20 bp, Artificial Sequence
  chemically synthesized
aaccattgtggaagtcagtg

SEQ ID NO: 89527 - DNA, 20 bp, Artificial Sequence
  chemically synthesized
agttcaaccattgtggaagt

SEQ ID NO: 89528 - DNA, 20 bp, Artificial Sequence
  chemically synthesized
cgccacactgacttccacaa

SEQ ID NO: 89529 - DNA, 20 bp, Artificial Sequence
  chemically synthesized
aactagttcaaccattgtgg

SEQ ID NO: 89530 - DNA, 20 bp, Artificial Sequence
  chemically synthesized
gtaaactagttcaaccattg

SEQ ID NO: 89531 - DNA, 20 bp, Artificial Sequence
  chemically synthesized
gacttccacaatggttgaac

SEQ ID NO: 89532 - DNA, 20 bp, Artificial Sequence
  chemically synthesized
acaatggttgaactagttta

SEQ ID NO: 89533 - DNA, 20 bp, Artificial Sequence
  chemically synthesized
ctgttggtgggactgtaaac

SEQ ID NO: 89534 - DNA, 20 bp, Artificial Sequence
  chemically synthesized
ctagtttacagtcccaccaa

SEQ ID NO: 89535 - DNA, 20 bp, Artificial Sequence
  chemically synthesized
aacacttctacactgttggt

SEQ ID NO: 89536 - DNA, 20 bp, Artificial Sequence
  chemically synthesized
gaacacttctacactgttgg

SEQ ID NO: 89537 - DNA, 20 bp, Artificial Sequence
  chemically synthesized
ttacagtcccaccaacagtg

SEQ ID NO: 89538 - DNA, 20 bp, Artificial Sequence
  chemically synthesized
taggaacacttctacactgt

SEQ ID NO: 89539 - DNA, 20 bp, Artificial Sequence
  chemically synthesized
cagtcccaccaacagtgtag

SEQ ID NO: 89540 - DNA, 20 bp, Artificial Sequence
  chemically synthesized
tggagaggatgtggagaaat

SEQ ID NO: 89541 - DNA, 20 bp, Artificial Sequence
  chemically synthesized
ctggagaggatgtggagaaa

SEQ ID NO: 89542 - DNA, 20 bp, Artificial Sequence
  chemically synthesized
caggtgctggagaggatgtg

SEQ ID NO: 89543 - DNA, 20 bp, Artificial Sequence
  chemically synthesized
aacaggtgctggagaggatg

SEQ ID NO: 89544 - DNA, 20 bp, Artificial Sequence
  chemically synthesized
ctatttctccacatcctctc

SEQ ID NO: 89545 - DNA, 20 bp, Artificial Sequence
  chemically synthesized
ggaaacaacaggtgctggag

SEQ ID NO: 89546 - DNA, 20 bp, Artificial Sequence
  chemically synthesized
aggaaacaacaggtgctgga

SEQ ID NO: 89547 - DNA, 20 bp, Artificial Sequence
  chemically synthesized
tcaggaaacaacaggtgctg

SEQ ID NO: 89548 - DNA, 20 bp, Artificial Sequence
  chemically synthesized
agtcaggaaacaacaggtgc

SEQ ID NO: 89549 - DNA, 20 bp, Artificial Sequence
  chemically synthesized
tttaaaagtcaggaaacaac

SEQ ID NO: 89550 - DNA, 20 bp, Artificial Sequence
  chemically synthesized
atttaaaagtcaggaaacaa

SEQ ID NO: 89551 - DNA, 20 bp, Artificial Sequence
  chemically synthesized
atggcaatcatttaaaagtc

SEQ ID NO: 89552 - DNA, 20 bp, Artificial Sequence
  chemically synthesized
aatggcaatcatttaaaagt

SEQ ID NO: 89553 - DNA, 20 bp, Artificial Sequence
  chemically synthesized
ttagaatggcaatcatttaa

SEQ ID NO: 89554 - DNA, 20 bp, Artificial Sequence
  chemically synthesized
taaatgattgccattctaac

SEQ ID NO: 89555 - DNA, 20 bp, Artificial Sequence
  chemically synthesized
ccatctcacaccagttagaa

SEQ ID NO: 89556 - DNA, 20 bp, Artificial Sequence
  chemically synthesized
agataccatctcacaccagt

SEQ ID NO: 89557 - DNA, 20 bp, Artificial Sequence
  chemically synthesized
attgccattctaactggtgt

SEQ ID NO: 89558 - DNA, 20 bp, Artificial Sequence
  chemically synthesized
aatgagataccatctcacac

SEQ ID NO: 89559 - DNA, 20 bp, Artificial Sequence
  chemically synthesized
ccattctaactggtgtgaga

SEQ ID NO: 89560 - DNA, 20 bp, Artificial Sequence
  chemically synthesized
tgtgagatggtatctcattg

SEQ ID NO: 89561 - DNA, 20 bp, Artificial Sequence
  chemically synthesized
atgcaaatcaaaaccacaat

SEQ ID NO: 89562 - DNA, 20 bp, Artificial Sequence
  chemically synthesized
tttgatttgcatttctctga

SEQ ID NO: 89563 - DNA, 20 bp, Artificial Sequence
  chemically synthesized
atttgcatttctctgatggc

SEQ ID NO: 89564 - DNA, 20 bp, Artificial Sequence
  chemically synthesized
ctcaccatcactggccatca

SEQ ID NO: 89565 - DNA, 20 bp, Artificial Sequence
  chemically synthesized
tgctcaccatcactggccat

SEQ ID NO: 89566 - DNA, 20 bp, Artificial Sequence
  chemically synthesized
atttctctgatggccagtga

SEQ ID NO: 89567 - DNA, 20 bp, Artificial Sequence
  chemically synthesized
gaaaaaatgctcaccatcac

SEQ ID NO: 89568 - DNA, 20 bp, Artificial Sequence
  chemically synthesized
ctctgatggccagtgatggt

SEQ ID NO: 89569 - DNA, 20 bp, Artificial Sequence
  chemically synthesized
gcattttttcatgtgtcttt

SEQ ID NO: 89570 - DNA, 20 bp, Artificial Sequence
  chemically synthesized
gaagacatttatgcagccaa

SEQ ID NO: 89571 - DNA, 20 bp, Artificial Sequence
  chemically synthesized
ctcaaaagaagacatttatg

SEQ ID NO: 89572 - DNA, 20 bp, Artificial Sequence
  chemically synthesized
ctgcataaatgtcttctttt

SEQ ID NO: 89573 - DNA, 20 bp, Artificial Sequence
  chemically synthesized
gaacagacacttctcaaaag

SEQ ID NO: 89574 - DNA, 20 bp, Artificial Sequence
  chemically synthesized
cataaatgtcttcttttgag

SEQ ID NO: 89575 - DNA, 20 bp, Artificial Sequence
  chemically synthesized
catgaacagacacttctcaa

SEQ ID NO: 89576 - DNA, 20 bp, Artificial Sequence
  chemically synthesized
aagtgggtgaaggacatgaa

SEQ ID NO: 89577 - DNA, 20 bp, Artificial Sequence
  chemically synthesized
ccccatcaaaaagtgggtga

SEQ ID NO: 89578 - DNA, 20 bp, Artificial Sequence
  chemically synthesized
accccatcaaaaagtgggtg

SEQ ID NO: 89579 - DNA, 20 bp, Artificial Sequence
  chemically synthesized
aaacaaccccatcaaaaagt

SEQ ID NO: 89580 - DNA, 20 bp, Artificial Sequence
  chemically synthesized
caaacaaccccatcaaaaag

SEQ ID NO: 89581 - DNA, 20 bp, Artificial Sequence
  chemically synthesized
gtccttcacccactttttga

SEQ ID NO: 89582 - DNA, 20 bp, Artificial Sequence
  chemically synthesized
tccttcacccactttttgat

SEQ ID NO: 89583 - DNA, 20 bp, Artificial Sequence
  chemically synthesized
ccttcacccactttttgatg

SEQ ID NO: 89584 - DNA, 20 bp, Artificial Sequence
  chemically synthesized
aaacaaacaaccccatcaaa

SEQ ID NO: 89585 - DNA, 20 bp, Artificial Sequence
  chemically synthesized
atgaactcaaacaaatgtac

SEQ ID NO: 89586 - DNA, 20 bp, Artificial Sequence
  chemically synthesized
tttttcttgtacatttgttt

SEQ ID NO: 89587 - DNA, 20 bp, Artificial Sequence
  chemically synthesized
acatttgtttgagttcattg

SEQ ID NO: 89588 - DNA, 20 bp, Artificial Sequence
  chemically synthesized
tttgagttcattgtagattc

SEQ ID NO: 89589 - DNA, 20 bp, Artificial Sequence
  chemically synthesized
tcattgtagattctggatat

SEQ ID NO: 89590 - DNA, 20 bp, Artificial Sequence
  chemically synthesized
tctgacaaagggctaatatc

SEQ ID NO: 89591 - DNA, 20 bp, Artificial Sequence
  chemically synthesized
tctggatattagccctttgt

SEQ ID NO: 89592 - DNA, 20 bp, Artificial Sequence
  chemically synthesized
caacctactcatctgacaaa

SEQ ID NO: 89593 - DNA, 20 bp, Artificial Sequence
  chemically synthesized
gcaacctactcatctgacaa

SEQ ID NO: 89594 - DNA, 20 bp, Artificial Sequence
  chemically synthesized
cgcaacctactcatctgaca

SEQ ID NO: 89595 - DNA, 20 bp, Artificial Sequence
  chemically synthesized
atattagccctttgtcagat

SEQ ID NO: 89596 - DNA, 20 bp, Artificial Sequence
  chemically synthesized
ttagccctttgtcagatgag

SEQ ID NO: 89597 - DNA, 20 bp, Artificial Sequence
  chemically synthesized
tagccctttgtcagatgagt

SEQ ID NO: 89598 - DNA, 20 bp, Artificial Sequence
  chemically synthesized
acaggcaacctacaacatgg

SEQ ID NO: 89599 - DNA, 20 bp, Artificial Sequence
  chemically synthesized
gaaaattttctcccatgttg

SEQ ID NO: 89600 - DNA, 20 bp, Artificial Sequence
  chemically synthesized
aaaattttctcccatgttgt

SEQ ID NO: 89601 - DNA, 20 bp, Artificial Sequence
  chemically synthesized
gaacaggcaacctacaacat

SEQ ID NO: 89602 - DNA, 20 bp, Artificial Sequence
  chemically synthesized
tgaacaggcaacctacaaca

SEQ ID NO: 89603 - DNA, 20 bp, Artificial Sequence
  chemically synthesized
aaactaccatcagagtgaac

SEQ ID NO: 89604 - DNA, 20 bp, Artificial Sequence
  chemically synthesized
gaaactaccatcagagtgaa

SEQ ID NO: 89605 - DNA, 20 bp, Artificial Sequence
  chemically synthesized
aggttgcctgttcactctga

SEQ ID NO: 89606 - DNA, 20 bp, Artificial Sequence
  chemically synthesized
ttgcctgttcactctgatgg

SEQ ID NO: 89607 - DNA, 20 bp, Artificial Sequence
  chemically synthesized
agcaaaagaaactaccatca

SEQ ID NO: 89608 - DNA, 20 bp, Artificial Sequence
  chemically synthesized
acagcaaaagaaactaccat

SEQ ID NO: 89609 - DNA, 20 bp, Artificial Sequence
  chemically synthesized
aaagagcttctgcacagcaa

SEQ ID NO: 89610 - DNA, 20 bp, Artificial Sequence
  chemically synthesized
tggtagtttcttttgctgtg

SEQ ID NO: 89611 - DNA, 20 bp, Artificial Sequence
  chemically synthesized
tagtttcttttgctgtgcag

SEQ ID NO: 89612 - DNA, 20 bp, Artificial Sequence
  chemically synthesized
taaactaaagagcttctgca

SEQ ID NO: 89613 - DNA, 20 bp, Artificial Sequence
  chemically synthesized
tttgctgtgcagaagctctt

SEQ ID NO: 89614 - DNA, 20 bp, Artificial Sequence
  chemically synthesized
tgggatctaattaaactaaa

SEQ ID NO: 89615 - DNA, 20 bp, Artificial Sequence
  chemically synthesized
aatgggatctaattaaacta

SEQ ID NO: 89616 - DNA, 20 bp, Artificial Sequence
  chemically synthesized
cagaagctctttagtttaat

SEQ ID NO: 89617 - DNA, 20 bp, Artificial Sequence
  chemically synthesized
aaaagccagaattgacaaat

SEQ ID NO: 89618 - DNA, 20 bp, Artificial Sequence
  chemically synthesized
caaaagccagaattgacaaa

SEQ ID NO: 89619 - DNA, 20 bp, Artificial Sequence
  chemically synthesized
tagatcccatttgtcaattc

SEQ ID NO: 89620 - DNA, 20 bp, Artificial Sequence
  chemically synthesized
aaagcaatggcaacaaaagc

SEQ ID NO: 89621 - DNA, 20 bp, Artificial Sequence
  chemically synthesized
accaaaagcaatggcaacaa

SEQ ID NO: 89622 - DNA, 20 bp, Artificial Sequence
  chemically synthesized
gcttttgttgccattgcttt

SEQ ID NO: 89623 - DNA, 20 bp, Artificial Sequence
  chemically synthesized
gtctaaaacaccaaaagcaa

SEQ ID NO: 89624 - DNA, 20 bp, Artificial Sequence
  chemically synthesized
cttcatgtctaaaacaccaa

SEQ ID NO: 89625 - DNA, 20 bp, Artificial Sequence
  chemically synthesized
tgccattgcttttggtgttt

SEQ ID NO: 89626 - DNA, 20 bp, Artificial Sequence
  chemically synthesized
cttttggtgttttagacatg

SEQ ID NO: 89627 - DNA, 20 bp, Artificial Sequence
  chemically synthesized
tcaggacataggcatgggca

SEQ ID NO: 89628 - DNA, 20 bp, Artificial Sequence
  chemically synthesized
ttcaggacataggcatgggc

SEQ ID NO: 89629 - DNA, 20 bp, Artificial Sequence
  chemically synthesized
accattcaggacataggcat

SEQ ID NO: 89630 - DNA, 20 bp, Artificial Sequence
  chemically synthesized
taccattcaggacataggca

SEQ ID NO: 89631 - DNA, 20 bp, Artificial Sequence
  chemically synthesized
ggcattaccattcaggacat

SEQ ID NO: 89632 - DNA, 20 bp, Artificial Sequence
  chemically synthesized
aggcattaccattcaggaca

SEQ ID NO: 89633 - DNA, 20 bp, Artificial Sequence
  chemically synthesized
gcccatgcctatgtcctgaa

SEQ ID NO: 89634 - DNA, 20 bp, Artificial Sequence
  chemically synthesized
aaacctaggcattaccattc

SEQ ID NO: 89635 - DNA, 20 bp, Artificial Sequence
  chemically synthesized
aaaacctaggcattaccatt

SEQ ID NO: 89636 - DNA, 20 bp, Artificial Sequence
  chemically synthesized
atgtcctgaatggtaatgcc

SEQ ID NO: 89637 - DNA, 20 bp, Artificial Sequence
  chemically synthesized
tgtcctgaatggtaatgcct

SEQ ID NO: 89638 - DNA, 20 bp, Artificial Sequence
  chemically synthesized
aaaaccctagaagaaaacct

SEQ ID NO: 89639 - DNA, 20 bp, Artificial Sequence
  chemically synthesized
aaaaaccctagaagaaaacc

SEQ ID NO: 89640 - DNA, 20 bp, Artificial Sequence
  chemically synthesized
gtaatgcctaggttttcttc

SEQ ID NO: 89641 - DNA, 20 bp, Artificial Sequence
  chemically synthesized
taatgcctaggttttcttct

SEQ ID NO: 89642 - DNA, 20 bp, Artificial Sequence
  chemically synthesized
aatgcctaggttttcttcta

SEQ ID NO: 89643 - DNA, 20 bp, Artificial Sequence
  chemically synthesized
taaaaccataaaaaccctag

SEQ ID NO: 89644 - DNA, 20 bp, Artificial Sequence
  chemically synthesized
acctaaaaccataaaaaccc

SEQ ID NO: 89645 - DNA, 20 bp, Artificial Sequence
  chemically synthesized
gttttcttctagggttttta

SEQ ID NO: 89646 - DNA, 20 bp, Artificial Sequence
  chemically synthesized
ttctagggtttttatggttt

SEQ ID NO: 89647 - DNA, 20 bp, Artificial Sequence
  chemically synthesized
tctagggtttttatggtttt

SEQ ID NO: 89648 - DNA, 20 bp, Artificial Sequence
  chemically synthesized
tggttttaggtctaacgttt

SEQ ID NO: 89649 - DNA, 20 bp, Artificial Sequence
  chemically synthesized
tggattaaagacttaaacgt

SEQ ID NO: 89650 - DNA, 20 bp, Artificial Sequence
  chemically synthesized
aatcaattcaagatggatta

SEQ ID NO: 89651 - DNA, 20 bp, Artificial Sequence
  chemically synthesized
atacaaaaatcaattcaaga

SEQ ID NO: 89652 - DNA, 20 bp, Artificial Sequence
  chemically synthesized
ccttatacaaaaatcaattc

SEQ ID NO: 89653 - DNA, 20 bp, Artificial Sequence
  chemically synthesized
tcttgaattgatttttgtat

SEQ ID NO: 89654 - DNA, 20 bp, Artificial Sequence
  chemically synthesized
cttgaattgatttttgtata

SEQ ID NO: 89655 - DNA, 20 bp, Artificial Sequence
  chemically synthesized
ttgatttttgtataaggtgt

SEQ ID NO: 89656 - DNA, 20 bp, Artificial Sequence
  chemically synthesized
tgatttttgtataaggtgta

SEQ ID NO: 89657 - DNA, 20 bp, Artificial Sequence
  chemically synthesized
tttttgtataaggtgtaagg

SEQ ID NO: 89658 - DNA, 20 bp, Artificial Sequence
  chemically synthesized
ttttgtataaggtgtaagga

SEQ ID NO: 89659 - DNA, 20 bp, Artificial Sequence
  chemically synthesized
tttgtataaggtgtaaggaa

SEQ ID NO: 89660 - DNA, 20 bp, Artificial Sequence
  chemically synthesized
taaggtgtaaggaagggatc

SEQ ID NO: 89661 - DNA, 20 bp, Artificial Sequence
  chemically synthesized
gtaaggaagggatccagttt

SEQ ID NO: 89662 - DNA, 20 bp, Artificial Sequence
  chemically synthesized
catatgtagaaagctgaaac

SEQ ID NO: 89663 - DNA, 20 bp, Artificial Sequence
  chemically synthesized
actggctagccatatgtaga

SEQ ID NO: 89664 - DNA, 20 bp, Artificial Sequence
  chemically synthesized
cagtttcagctttctacata

SEQ ID NO: 89665 - DNA, 20 bp, Artificial Sequence
  chemically synthesized
gaaaactggctagccatatg

SEQ ID NO: 89666 - DNA, 20 bp, Artificial Sequence
  chemically synthesized
ttcagctttctacatatggc

SEQ ID NO: 89667 - DNA, 20 bp, Artificial Sequence
  chemically synthesized
gctttctacatatggctagc

SEQ ID NO: 89668 - DNA, 20 bp, Artificial Sequence
  chemically synthesized
atggtgctgggaaaactggc

SEQ ID NO: 89669 - DNA, 20 bp, Artificial Sequence
  chemically synthesized
atatggctagccagttttcc

SEQ ID NO: 89670 - DNA, 20 bp, Artificial Sequence
  chemically synthesized
ataaatggtgctgggaaaac

SEQ ID NO: 89671 - DNA, 20 bp, Artificial Sequence
  chemically synthesized
cctatttaataaatggtgct

SEQ ID NO: 89672 - DNA, 20 bp, Artificial Sequence
  chemically synthesized
ccctatttaataaatggtgc

SEQ ID NO: 89673 - DNA, 20 bp, Artificial Sequence
  chemically synthesized
aggattccctatttaataaa

SEQ ID NO: 89674 - DNA, 20 bp, Artificial Sequence
  chemically synthesized
tcccagcaccatttattaaa

SEQ ID NO: 89675 - DNA, 20 bp, Artificial Sequence
  chemically synthesized
cccagcaccatttattaaat

SEQ ID NO: 89676 - DNA, 20 bp, Artificial Sequence
  chemically synthesized
ccagcaccatttattaaata

SEQ ID NO: 89677 - DNA, 20 bp, Artificial Sequence
  chemically synthesized
gaaaaacaagcaatggggaa

SEQ ID NO: 89678 - DNA, 20 bp, Artificial Sequence
  chemically synthesized
agaaaaacaagcaatgggga

SEQ ID NO: 89679 - DNA, 20 bp, Artificial Sequence
  chemically synthesized
cctgagaaaaacaagcaatg

SEQ ID NO: 89680 - DNA, 20 bp, Artificial Sequence
  chemically synthesized
acctgagaaaaacaagcaat

SEQ ID NO: 89681 - DNA, 20 bp, Artificial Sequence
  chemically synthesized
aacctgagaaaaacaagcaa

SEQ ID NO: 89682 - DNA, 20 bp, Artificial Sequence
  chemically synthesized
ttaacaaacctgagaaaaac

SEQ ID NO: 89683 - DNA, 20 bp, Artificial Sequence
  chemically synthesized
tccccattgcttgtttttct

SEQ ID NO: 89684 - DNA, 20 bp, Artificial Sequence
  chemically synthesized
ccccattgcttgtttttctc

SEQ ID NO: 89685 - DNA, 20 bp, Artificial Sequence
  chemically synthesized
atctgatctttaacaaacct

SEQ ID NO: 89686 - DNA, 20 bp, Artificial Sequence
  chemically synthesized
tgtttttctcaggtttgtta

SEQ ID NO: 89687 - DNA, 20 bp, Artificial Sequence
  chemically synthesized
ttctcaggtttgttaaagat

SEQ ID NO: 89688 - DNA, 20 bp, Artificial Sequence
  chemically synthesized
caggtttgttaaagatcaga

SEQ ID NO: 89689 - DNA, 20 bp, Artificial Sequence
  chemically synthesized
tgttaaagatcagatagttg

SEQ ID NO: 89690 - DNA, 20 bp, Artificial Sequence
  chemically synthesized
atcagatagttgtagatatg

SEQ ID NO: 89691 - DNA, 20 bp, Artificial Sequence
  chemically synthesized
agatatgcggcattatttct

SEQ ID NO: 89692 - DNA, 20 bp, Artificial Sequence
  chemically synthesized
gatatgcggcattatttctg

SEQ ID NO: 89693 - DNA, 20 bp, Artificial Sequence
  chemically synthesized
atatgcggcattatttctga

SEQ ID NO: 89694 - DNA, 20 bp, Artificial Sequence
  chemically synthesized
gtggaacagaacagagccct

SEQ ID NO: 89695 - DNA, 20 bp, Artificial Sequence
  chemically synthesized
tagatcagtggaacagaaca

SEQ ID NO: 89696 - DNA, 20 bp, Artificial Sequence
  chemically synthesized
tatagatcagtggaacagaa

SEQ ID NO: 89697 - DNA, 20 bp, Artificial Sequence
  chemically synthesized
agagatatagatcagtggaa

SEQ ID NO: 89698 - DNA, 20 bp, Artificial Sequence
  chemically synthesized
aaaacagagatatagatcag

SEQ ID NO: 89699 - DNA, 20 bp, Artificial Sequence
  chemically synthesized
accaaaacagagatatagat

SEQ ID NO: 89700 - DNA, 20 bp, Artificial Sequence
  chemically synthesized
ctggtaccaaaacagagata

SEQ ID NO: 89701 - DNA, 20 bp, Artificial Sequence
  chemically synthesized
actgatctatatctctgttt

SEQ ID NO: 89702 - DNA, 20 bp, Artificial Sequence
  chemically synthesized
atggtactggtaccaaaaca

SEQ ID NO: 89703 - DNA, 20 bp, Artificial Sequence
  chemically synthesized
acatggtactggtaccaaaa

SEQ ID NO: 89704 - DNA, 20 bp, Artificial Sequence
  chemically synthesized
ctatatctctgttttggtac

SEQ ID NO: 89705 - DNA, 20 bp, Artificial Sequence
  chemically synthesized
taaccaaaacaacatggtac

SEQ ID NO: 89706 - DNA, 20 bp, Artificial Sequence
  chemically synthesized
ctacagtaaccaaaacaaca

SEQ ID NO: 89707 - DNA, 20 bp, Artificial Sequence
  chemically synthesized
gtaccagtaccatgttgttt

SEQ ID NO: 89708 - DNA, 20 bp, Artificial Sequence
  chemically synthesized
ccatgttgttttggttactg

SEQ ID NO: 89709 - DNA, 20 bp, Artificial Sequence
  chemically synthesized
caaactatactacaaggcta

SEQ ID NO: 89710 - DNA, 20 bp, Artificial Sequence
  chemically synthesized
ttttggttactgtagccttg

SEQ ID NO: 89711 - DNA, 20 bp, Artificial Sequence
  chemically synthesized
gttactgtagccttgtagta

SEQ ID NO: 89712 - DNA, 20 bp, Artificial Sequence
  chemically synthesized
tgacttcaaactatactaca

SEQ ID NO: 89713 - DNA, 20 bp, Artificial Sequence
  chemically synthesized
ctgacttcaaactatactac

SEQ ID NO: 89714 - DNA, 20 bp, Artificial Sequence
  chemically synthesized
tagccttgtagtatagtttg

SEQ ID NO: 89715 - DNA, 20 bp, Artificial Sequence
  chemically synthesized
cttgtagtatagtttgaagt

SEQ ID NO: 89716 - DNA, 20 bp, Artificial Sequence
  chemically synthesized
tagtatagtttgaagtcagc

SEQ ID NO: 89717 - DNA, 20 bp, Artificial Sequence
  chemically synthesized
caaagctggaggcatcacac

SEQ ID NO: 89718 - DNA, 20 bp, Artificial Sequence
  chemically synthesized
gtcagctagtgtgatgcctc

SEQ ID NO: 89719 - DNA, 20 bp, Artificial Sequence
  chemically synthesized
agccaaaagaacaaagctgg

SEQ ID NO: 89720 - DNA, 20 bp, Artificial Sequence
  chemically synthesized
gagccaaaagaacaaagctg

SEQ ID NO: 89721 - DNA, 20 bp, Artificial Sequence
  chemically synthesized
ctgagccaaaagaacaaagc

SEQ ID NO: 89722 - DNA, 20 bp, Artificial Sequence
  chemically synthesized
aatcctgagccaaaagaaca

SEQ ID NO: 89723 - DNA, 20 bp, Artificial Sequence
  chemically synthesized
tgcctccagctttgttcttt

SEQ ID NO: 89724 - DNA, 20 bp, Artificial Sequence
  chemically synthesized
ccagctttgttcttttggct

SEQ ID NO: 89725 - DNA, 20 bp, Artificial Sequence
  chemically synthesized
cagctttgttcttttggctc

SEQ ID NO: 89726 - DNA, 20 bp, Artificial Sequence
  chemically synthesized
ccaagtcaatcctgagccaa

SEQ ID NO: 89727 - DNA, 20 bp, Artificial Sequence
  chemically synthesized
cacatcgccaagtcaatcct

SEQ ID NO: 89728 - DNA, 20 bp, Artificial Sequence
  chemically synthesized
cttttggctcaggattgact

SEQ ID NO: 89729 - DNA, 20 bp, Artificial Sequence
  chemically synthesized
tcaggattgacttggcgatg

SEQ ID NO: 89730 - DNA, 20 bp, Artificial Sequence
  chemically synthesized
aaaaaagagcccacatcgcc

SEQ ID NO: 89731 - DNA, 20 bp, Artificial Sequence
  chemically synthesized
caggattgacttggcgatgt

SEQ ID NO: 89732 - DNA, 20 bp, Artificial Sequence
  chemically synthesized
tggcgatgtgggctcttttt

SEQ ID NO: 89733 - DNA, 20 bp, Artificial Sequence
  chemically synthesized
gttcatatggaaccaaaaaa

SEQ ID NO: 89734 - DNA, 20 bp, Artificial Sequence
  chemically synthesized
aagttcatatggaaccaaaa

SEQ ID NO: 89735 - DNA, 20 bp, Artificial Sequence
  chemically synthesized
aaactactttaaagttcata

SEQ ID NO: 89736 - DNA, 20 bp, Artificial Sequence
  chemically synthesized
ttggttccatatgaacttta

SEQ ID NO: 89737 - DNA, 20 bp, Artificial Sequence
  chemically synthesized
gttccatatgaactttaaag

SEQ ID NO: 89738 - DNA, 20 bp, Artificial Sequence
  chemically synthesized
aattggaaaaaactacttta

SEQ ID NO: 89739 - DNA, 20 bp, Artificial Sequence
  chemically synthesized
aatgcctttcttcacagaat

SEQ ID NO: 89740 - DNA, 20 bp, Artificial Sequence
  chemically synthesized
tagttttttccaattctgtg

SEQ ID NO: 89741 - DNA, 20 bp, Artificial Sequence
  chemically synthesized
tttttccaattctgtgaaga

SEQ ID NO: 89742 - DNA, 20 bp, Artificial Sequence
  chemically synthesized
ttttccaattctgtgaagaa

SEQ ID NO: 89743 - DNA, 20 bp, Artificial Sequence
  chemically synthesized
gctaccaatgcctttcttca

SEQ ID NO: 89744 - DNA, 20 bp, Artificial Sequence
  chemically synthesized
aattctgtgaagaaaggcat

SEQ ID NO: 89745 - DNA, 20 bp, Artificial Sequence
  chemically synthesized
tctgtgaagaaaggcattgg

SEQ ID NO: 89746 - DNA, 20 bp, Artificial Sequence
  chemically synthesized
gaaaggcattggtagcttga

SEQ ID NO: 89747 - DNA, 20 bp, Artificial Sequence
  chemically synthesized
aaaggcattggtagcttgat

SEQ ID NO: 89748 - DNA, 20 bp, Artificial Sequence
  chemically synthesized
aaggcattggtagcttgatg

SEQ ID NO: 89749 - DNA, 20 bp, Artificial Sequence
  chemically synthesized
gattcaatgccatccccatc

SEQ ID NO: 89750 - DNA, 20 bp, Artificial Sequence
  chemically synthesized
cattggtagcttgatgggga

SEQ ID NO: 89751 - DNA, 20 bp, Artificial Sequence
  chemically synthesized
atactgcccaaggtgattta

SEQ ID NO: 89752 - DNA, 20 bp, Artificial Sequence
  chemically synthesized
attgaatctgtaaatcacct

SEQ ID NO: 89753 - DNA, 20 bp, Artificial Sequence
  chemically synthesized
ttgaatctgtaaatcacctt

SEQ ID NO: 89754 - DNA, 20 bp, Artificial Sequence
  chemically synthesized
aatctgtaaatcaccttggg

SEQ ID NO: 89755 - DNA, 20 bp, Artificial Sequence
  chemically synthesized
gaaaatggccatactgccca

SEQ ID NO: 89756 - DNA, 20 bp, Artificial Sequence
  chemically synthesized
tgaaaatggccatactgccc

SEQ ID NO: 89757 - DNA, 20 bp, Artificial Sequence
  chemically synthesized
gtaaatcaccttgggcagta

SEQ ID NO: 89758 - DNA, 20 bp, Artificial Sequence
  chemically synthesized
aagaatcaatattgtgaaaa

SEQ ID NO: 89759 - DNA, 20 bp, Artificial Sequence
  chemically synthesized
attccatgctcatgggtagg

SEQ ID NO: 89760 - DNA, 20 bp, Artificial Sequence
  chemically synthesized
tattgattcttcctacccat

SEQ ID NO: 89761 - DNA, 20 bp, Artificial Sequence
  chemically synthesized
aacattccatgctcatgggt

SEQ ID NO: 89762 - DNA, 20 bp, Artificial Sequence
  chemically synthesized
gaacattccatgctcatggg

SEQ ID NO: 89763 - DNA, 20 bp, Artificial Sequence
  chemically synthesized
attcttcctacccatgagca

SEQ ID NO: 89764 - DNA, 20 bp, Artificial Sequence
  chemically synthesized
gaagaacattccatgctcat

SEQ ID NO: 89765 - DNA, 20 bp, Artificial Sequence
  chemically synthesized
ggaagaacattccatgctca

SEQ ID NO: 89766 - DNA, 20 bp, Artificial Sequence
  chemically synthesized
aagaggacacaaacaaatgg

SEQ ID NO: 89767 - DNA, 20 bp, Artificial Sequence
  chemically synthesized
taaaagaggacacaaacaaa

SEQ ID NO: 89768 - DNA, 20 bp, Artificial Sequence
  chemically synthesized
actgctcaaggaaataaaag

SEQ ID NO: 89769 - DNA, 20 bp, Artificial Sequence
  chemically synthesized
cactgctcaaggaaataaaa

SEQ ID NO: 89770 - DNA, 20 bp, Artificial Sequence
  chemically synthesized
accactgctcaaggaaataa

SEQ ID NO: 89771 - DNA, 20 bp, Artificial Sequence
  chemically synthesized
gtgtcctcttttatttcctt

SEQ ID NO: 89772 - DNA, 20 bp, Artificial Sequence
  chemically synthesized
tcctcttttatttccttgag

SEQ ID NO: 89773 - DNA, 20 bp, Artificial Sequence
  chemically synthesized
tcttttatttccttgagcag

SEQ ID NO: 89774 - DNA, 20 bp, Artificial Sequence
  chemically synthesized
gaactacaaaccactgctca

SEQ ID NO: 89775 - DNA, 20 bp, Artificial Sequence
  chemically synthesized
agaactacaaaccactgctc

SEQ ID NO: 89776 - DNA, 20 bp, Artificial Sequence
  chemically synthesized
tttccttgagcagtggtttg

SEQ ID NO: 89777 - DNA, 20 bp, Artificial Sequence
  chemically synthesized
gtggtttgtagttctccttg

SEQ ID NO: 89778 - DNA, 20 bp, Artificial Sequence
  chemically synthesized
ggtttgtagttctccttgaa

SEQ ID NO: 89779 - DNA, 20 bp, Artificial Sequence
  chemically synthesized
gtttgtagttctccttgaag

SEQ ID NO: 89780 - DNA, 20 bp, Artificial Sequence
  chemically synthesized
atgtgaaggacctcttcaag

SEQ ID NO: 89781 - DNA, 20 bp, Artificial Sequence
  chemically synthesized
ggatgtgaaggacctcttca

SEQ ID NO: 89782 - DNA, 20 bp, Artificial Sequence
  chemically synthesized
gggatgtgaaggacctcttc

SEQ ID NO: 89783 - DNA, 20 bp, Artificial Sequence
  chemically synthesized
gcaacttacaagggatgtga

SEQ ID NO: 89784 - DNA, 20 bp, Artificial Sequence
  chemically synthesized
tgcaacttacaagggatgtg

SEQ ID NO: 89785 - DNA, 20 bp, Artificial Sequence
  chemically synthesized
aggtccttcacatcccttgt

SEQ ID NO: 89786 - DNA, 20 bp, Artificial Sequence
  chemically synthesized
cctaggaatgcaacttacaa

SEQ ID NO: 89787 - DNA, 20 bp, Artificial Sequence
  chemically synthesized
acctaggaatgcaacttaca

SEQ ID NO: 89788 - DNA, 20 bp, Artificial Sequence
  chemically synthesized
tacctaggaatgcaacttac

SEQ ID NO: 89789 - DNA, 20 bp, Artificial Sequence
  chemically synthesized
tcccttgtaagttgcattcc

SEQ ID NO: 89790 - DNA, 20 bp, Artificial Sequence
  chemically synthesized
cccttgtaagttgcattcct

SEQ ID NO: 89791 - DNA, 20 bp, Artificial Sequence
  chemically synthesized
tcaaagagaataaaatacct

SEQ ID NO: 89792 - DNA, 20 bp, Artificial Sequence
  chemically synthesized
ttcaaagagaataaaatacc

SEQ ID NO: 89793 - DNA, 20 bp, Artificial Sequence
  chemically synthesized
taggtattttattctctttg

SEQ ID NO: 89794 - DNA, 20 bp, Artificial Sequence
  chemically synthesized
ccattcacaattgcttcaaa

SEQ ID NO: 89795 - DNA, 20 bp, Artificial Sequence
  chemically synthesized
tcccattcacaattgcttca

SEQ ID NO: 89796 - DNA, 20 bp, Artificial Sequence
  chemically synthesized
ctctttgaagcaattgtgaa

SEQ ID NO: 89797 - DNA, 20 bp, Artificial Sequence
  chemically synthesized
tctttgaagcaattgtgaat

SEQ ID NO: 89798 - DNA, 20 bp, Artificial Sequence
  chemically synthesized
tttgaagcaattgtgaatgg

SEQ ID NO: 89799 - DNA, 20 bp, Artificial Sequence
  chemically synthesized
atgggagttcactcatgatt

SEQ ID NO: 89800 - DNA, 20 bp, Artificial Sequence
  chemically synthesized
caaacagagagccaaatcat

SEQ ID NO: 89801 - DNA, 20 bp, Artificial Sequence
  chemically synthesized
accaacaacagacaaacaga

SEQ ID NO: 89802 - DNA, 20 bp, Artificial Sequence
  chemically synthesized
acaccaacaacagacaaaca

SEQ ID NO: 89803 - DNA, 20 bp, Artificial Sequence
  chemically synthesized
atacaccaacaacagacaaa

SEQ ID NO: 89804 - DNA, 20 bp, Artificial Sequence
  chemically synthesized
gctctctgtttgtctgttgt

SEQ ID NO: 89805 - DNA, 20 bp, Artificial Sequence
  chemically synthesized
gcattcttatacaccaacaa

SEQ ID NO: 89806 - DNA, 20 bp, Artificial Sequence
  chemically synthesized
tttgtctgttgttggtgtat

SEQ ID NO: 89807 - DNA, 20 bp, Artificial Sequence
  chemically synthesized
aatcaatgtacaaaaatcac

SEQ ID NO: 89808 - DNA, 20 bp, Artificial Sequence
  chemically synthesized
gtacattgattttgtatcct

SEQ ID NO: 89809 - DNA, 20 bp, Artificial Sequence
  chemically synthesized
agcaacttcagcaaagtctc

SEQ ID NO: 89810 - DNA, 20 bp, Artificial Sequence
  chemically synthesized
aagcaacttcagcaaagtct

SEQ ID NO: 89811 - DNA, 20 bp, Artificial Sequence
  chemically synthesized
tgtatcctgagactttgctg

SEQ ID NO: 89812 - DNA, 20 bp, Artificial Sequence
  chemically synthesized
gctgataagcaacttcagca

SEQ ID NO: 89813 - DNA, 20 bp, Artificial Sequence
  chemically synthesized
cttaagctgataagcaactt

SEQ ID NO: 89814 - DNA, 20 bp, Artificial Sequence
  chemically synthesized
actttgctgaagttgcttat

SEQ ID NO: 89815 - DNA, 20 bp, Artificial Sequence
  chemically synthesized
caaaatctccttaagctgat

SEQ ID NO: 89816 - DNA, 20 bp, Artificial Sequence
  chemically synthesized
ctgaagttgcttatcagctt

SEQ ID NO: 89817 - DNA, 20 bp, Artificial Sequence
  chemically synthesized
tgaagttgcttatcagctta

SEQ ID NO: 89818 - DNA, 20 bp, Artificial Sequence
  chemically synthesized
aagttgcttatcagcttaag

SEQ ID NO: 89819 - DNA, 20 bp, Artificial Sequence
  chemically synthesized
tctcagcccaaaatctcctt

SEQ ID NO: 89820 - DNA, 20 bp, Artificial Sequence
  chemically synthesized
ttatcagcttaaggagattt

SEQ ID NO: 89821 - DNA, 20 bp, Artificial Sequence
  chemically synthesized
tatcagcttaaggagatttt

SEQ ID NO: 89822 - DNA, 20 bp, Artificial Sequence
  chemically synthesized
gcttaaggagattttgggct

SEQ ID NO: 89823 - DNA, 20 bp, Artificial Sequence
  chemically synthesized
gagattttgggctgagacga

SEQ ID NO: 89824 - DNA, 20 bp, Artificial Sequence
  chemically synthesized
agattttgggctgagacgat

SEQ ID NO: 89825 - DNA, 20 bp, Artificial Sequence
  chemically synthesized
tctagaaaaccccatcgtct

SEQ ID NO: 89826 - DNA, 20 bp, Artificial Sequence
  chemically synthesized
gattttgggctgagacgatg

SEQ ID NO: 89827 - DNA, 20 bp, Artificial Sequence
  chemically synthesized
gctgagacgatggggttttc

SEQ ID NO: 89828 - DNA, 20 bp, Artificial Sequence
  chemically synthesized
agacgacatgattgtatatc

SEQ ID NO: 89829 - DNA, 20 bp, Artificial Sequence
  chemically synthesized
acaatcatgtcgtctgcaaa

SEQ ID NO: 89830 - DNA, 20 bp, Artificial Sequence
  chemically synthesized
caatcatgtcgtctgcaaac

SEQ ID NO: 89831 - DNA, 20 bp, Artificial Sequence
  chemically synthesized
aatcatgtcgtctgcaaaca

SEQ ID NO: 89832 - DNA, 20 bp, Artificial Sequence
  chemically synthesized
agtcaaattgtccctgtttg

SEQ ID NO: 89833 - DNA, 20 bp, Artificial Sequence
  chemically synthesized
tattcaattaggaaaagagg

SEQ ID NO: 89834 - DNA, 20 bp, Artificial Sequence
  chemically synthesized
gggtattcaattaggaaaag

SEQ ID NO: 89835 - DNA, 20 bp, Artificial Sequence
  chemically synthesized
agggtattcaattaggaaaa

SEQ ID NO: 89836 - DNA, 20 bp, Artificial Sequence
  chemically synthesized
aaagggtattcaattaggaa

SEQ ID NO: 89837 - DNA, 20 bp, Artificial Sequence
  chemically synthesized
gaaataaagggtattcaatt

SEQ ID NO: 89838 - DNA, 20 bp, Artificial Sequence
  chemically synthesized
ggaaataaagggtattcaat

SEQ ID NO: 89839 - DNA, 20 bp, Artificial Sequence
  chemically synthesized
aggcaggagaaggaaataaa

SEQ ID NO: 89840 - DNA, 20 bp, Artificial Sequence
  chemically synthesized
caggcaggagaaggaaataa

SEQ ID NO: 89841 - DNA, 20 bp, Artificial Sequence
  chemically synthesized
tcaggcaggagaaggaaata

SEQ ID NO: 89842 - DNA, 20 bp, Artificial Sequence
  chemically synthesized
cagggcaatcaggcaggaga

SEQ ID NO: 89843 - DNA, 20 bp, Artificial Sequence
  chemically synthesized
ccagggcaatcaggcaggag

SEQ ID NO: 89844 - DNA, 20 bp, Artificial Sequence
  chemically synthesized
tggccagggcaatcaggcag

SEQ ID NO: 89845 - DNA, 20 bp, Artificial Sequence
  chemically synthesized
tctggccagggcaatcaggc

SEQ ID NO: 89846 - DNA, 20 bp, Artificial Sequence
  chemically synthesized
ttctggccagggcaatcagg

SEQ ID NO: 89847 - DNA, 20 bp, Artificial Sequence
  chemically synthesized
aagttctggccagggcaatc

SEQ ID NO: 89848 - DNA, 20 bp, Artificial Sequence
  chemically synthesized
cttctcctgcctgattgccc

SEQ ID NO: 89849 - DNA, 20 bp, Artificial Sequence
  chemically synthesized
gaagttctggccagggcaat

SEQ ID NO: 89850 - DNA, 20 bp, Artificial Sequence
  chemically synthesized
tcctgcctgattgccctggc

SEQ ID NO: 89851 - DNA, 20 bp, Artificial Sequence
  chemically synthesized
agtgttggaagttctggcca

SEQ ID NO: 89852 - DNA, 20 bp, Artificial Sequence
  chemically synthesized
tagtgttggaagttctggcc

SEQ ID NO: 89853 - DNA, 20 bp, Artificial Sequence
  chemically synthesized
atagtgttggaagttctggc

SEQ ID NO: 89854 - DNA, 20 bp, Artificial Sequence
  chemically synthesized
caacatagtgttggaagttc

SEQ ID NO: 89855 - DNA, 20 bp, Artificial Sequence
  chemically synthesized
cctattcaacatagtgttgg

SEQ ID NO: 89856 - DNA, 20 bp, Artificial Sequence
  chemically synthesized
actcctattcaacatagtgt

SEQ ID NO: 89857 - DNA, 20 bp, Artificial Sequence
  chemically synthesized
acttccaacactatgttgaa

SEQ ID NO: 89858 - DNA, 20 bp, Artificial Sequence
  chemically synthesized
ctcaccactcctattcaaca

SEQ ID NO: 89859 - DNA, 20 bp, Artificial Sequence
  chemically synthesized
cttccaacactatgttgaat

SEQ ID NO: 89860 - DNA, 20 bp, Artificial Sequence
  chemically synthesized
tccaacactatgttgaatag

SEQ ID NO: 89861 - DNA, 20 bp, Artificial Sequence
  chemically synthesized
aacactatgttgaataggag

SEQ ID NO: 89862 - DNA, 20 bp, Artificial Sequence
  chemically synthesized
ctatgttgaataggagtggt

SEQ ID NO: 89863 - DNA, 20 bp, Artificial Sequence
  chemically synthesized
atgttgaataggagtggtga

SEQ ID NO: 89864 - DNA, 20 bp, Artificial Sequence
  chemically synthesized
gttgaataggagtggtgaga

SEQ ID NO: 89865 - DNA, 20 bp, Artificial Sequence
  chemically synthesized
ttgaataggagtggtgagag

SEQ ID NO: 89866 - DNA, 20 bp, Artificial Sequence
  chemically synthesized
tgaataggagtggtgagaga

SEQ ID NO: 89867 - DNA, 20 bp, Artificial Sequence
  chemically synthesized
gagtttattggcacaagaca

SEQ ID NO: 89868 - DNA, 20 bp, Artificial Sequence
  chemically synthesized
tgagtttattggcacaagac

SEQ ID NO: 89869 - DNA, 20 bp, Artificial Sequence
  chemically synthesized
atgagtttattggcacaaga

SEQ ID NO: 89870 - DNA, 20 bp, Artificial Sequence
  chemically synthesized
aatgatgagtttattggcac

SEQ ID NO: 89871 - DNA, 20 bp, Artificial Sequence
  chemically synthesized
tctttaaatgatgagtttat

SEQ ID NO: 89872 - DNA, 20 bp, Artificial Sequence
  chemically synthesized
aggtgtagtctttaaatgat

SEQ ID NO: 89873 - DNA, 20 bp, Artificial Sequence
  chemically synthesized
gccaataaactcatcattta

SEQ ID NO: 89874 - DNA, 20 bp, Artificial Sequence
  chemically synthesized
atcatttaaagactacacct

SEQ ID NO: 89875 - DNA, 20 bp, Artificial Sequence
  chemically synthesized
tgctacctgagtctgaggtg

SEQ ID NO: 89876 - DNA, 20 bp, Artificial Sequence
  chemically synthesized
taaagactacacctcagact

SEQ ID NO: 89877 - DNA, 20 bp, Artificial Sequence
  chemically synthesized
aaagactacacctcagactc

SEQ ID NO: 89878 - DNA, 20 bp, Artificial Sequence
  chemically synthesized
ttttgtgctacctgagtctg

SEQ ID NO: 89879 - DNA, 20 bp, Artificial Sequence
  chemically synthesized
cttttgtgctacctgagtct

SEQ ID NO: 89880 - DNA, 20 bp, Artificial Sequence
  chemically synthesized
gactacacctcagactcagg

SEQ ID NO: 89881 - DNA, 20 bp, Artificial Sequence
  chemically synthesized
tttgctcttttgtgctacct

SEQ ID NO: 89882 - DNA, 20 bp, Artificial Sequence
  chemically synthesized
ctcagactcaggtagcacaa

SEQ ID NO: 89883 - DNA, 20 bp, Artificial Sequence
  chemically synthesized
cagactcaggtagcacaaaa

SEQ ID NO: 89884 - DNA, 20 bp, Artificial Sequence
  chemically synthesized
caggtagcacaaaagagcaa

SEQ ID NO: 89885 - DNA, 20 bp, Artificial Sequence
  chemically synthesized
aaaagagcaaaagattgata

SEQ ID NO: 89886 - DNA, 20 bp, Artificial Sequence
  chemically synthesized
aagagcaaaagattgatatg

SEQ ID NO: 89887 - DNA, 20 bp, Artificial Sequence
  chemically synthesized
aaagattgatatggagaatc

SEQ ID NO: 89888 - DNA, 20 bp, Artificial Sequence
  chemically synthesized
gattgatatggagaatcaag

SEQ ID NO: 89889 - DNA, 20 bp, Artificial Sequence
  chemically synthesized
ttgatatggagaatcaagtg

SEQ ID NO: 89890 - DNA, 20 bp, Artificial Sequence
  chemically synthesized
ggagaatcaagtggagttct

SEQ ID NO: 89891 - DNA, 20 bp, Artificial Sequence
  chemically synthesized
gaatcaagtggagttctcag

SEQ ID NO: 89892 - DNA, 20 bp, Artificial Sequence
  chemically synthesized
aatcaagtggagttctcagt

SEQ ID NO: 89893 - DNA, 20 bp, Artificial Sequence
  chemically synthesized
caagtggagttctcagtggg

SEQ ID NO: 89894 - DNA, 20 bp, Artificial Sequence
  chemically synthesized
gtccagattggctacccact

SEQ ID NO: 89895 - DNA, 20 bp, Artificial Sequence
  chemically synthesized
ttctcagtgggtagccaatc

SEQ ID NO: 89896 - DNA, 20 bp, Artificial Sequence
  chemically synthesized
aaattatcctttgtccagat

SEQ ID NO: 89897 - DNA, 20 bp, Artificial Sequence
  chemically synthesized
gtgggtagccaatctggaca

SEQ ID NO: 89898 - DNA, 20 bp, Artificial Sequence
  chemically synthesized
tgggtagccaatctggacaa

SEQ ID NO: 89899 - DNA, 20 bp, Artificial Sequence
  chemically synthesized
tatgaaaattatcctttgtc

SEQ ID NO: 89900 - DNA, 20 bp, Artificial Sequence
  chemically synthesized
tggacaaaggataattttca

SEQ ID NO: 89901 - DNA, 20 bp, Artificial Sequence
  chemically synthesized
ataattttcatagaaatttt

SEQ ID NO: 89902 - DNA, 20 bp, Artificial Sequence
  chemically synthesized
ttttcatagaaatttttgga

SEQ ID NO: 89903 - DNA, 20 bp, Artificial Sequence
  chemically synthesized
atcttttctagttaagtcag

SEQ ID NO: 89904 - DNA, 20 bp, Artificial Sequence
  chemically synthesized
tatttcacttctgacttaac

SEQ ID NO: 89905 - DNA, 20 bp, Artificial Sequence
  chemically synthesized
atgatcttttctagttaagt

SEQ ID NO: 89906 - DNA, 20 bp, Artificial Sequence
  chemically synthesized
ttgaatgatcttttctagtt

SEQ ID NO: 89907 - DNA, 20 bp, Artificial Sequence
  chemically synthesized
cacttctgacttaactagaa

SEQ ID NO: 89908 - DNA, 20 bp, Artificial Sequence
  chemically synthesized
aaggcttgaatgatcttttc

SEQ ID NO: 89909 - DNA, 20 bp, Artificial Sequence
  chemically synthesized
ttaactagaaaagatcattc

SEQ ID NO: 89910 - DNA, 20 bp, Artificial Sequence
  chemically synthesized
tacagtgaatgcagtaatga

SEQ ID NO: 89911 - DNA, 20 bp, Artificial Sequence
  chemically synthesized
atacagtgaatgcagtaatg

SEQ ID NO: 89912 - DNA, 20 bp, Artificial Sequence
  chemically synthesized
tagagagcatacagtgaatg

SEQ ID NO: 89913 - DNA, 20 bp, Artificial Sequence
  chemically synthesized
gaaaaaaattagagagcata

SEQ ID NO: 89914 - DNA, 20 bp, Artificial Sequence
  chemically synthesized
aaaagaagaaaaaaattaga

SEQ ID NO: 89915 - DNA, 20 bp, Artificial Sequence
  chemically synthesized
aaaaaagaagaaaaaaatta

SEQ ID NO: 89916 - DNA, 20 bp, Artificial Sequence
  chemically synthesized
acaaaaaagaagaaaaaaat

SEQ ID NO: 89917 - DNA, 20 bp, Artificial Sequence
  chemically synthesized
agactacaatcacaaaaaag

SEQ ID NO: 89918 - DNA, 20 bp, Artificial Sequence
  chemically synthesized
taaagactacaatcacaaaa

SEQ ID NO: 89919 - DNA, 20 bp, Artificial Sequence
  chemically synthesized
tttcttcttttttgtgattg

SEQ ID NO: 89920 - DNA, 20 bp, Artificial Sequence
  chemically synthesized
ttttttgtgattgtagtctt

SEQ ID NO: 89921 - DNA, 20 bp, Artificial Sequence
  chemically synthesized
tttttgtgattgtagtcttt

SEQ ID NO: 89922 - DNA, 20 bp, Artificial Sequence
  chemically synthesized
gtgattgtagtctttaggaa

SEQ ID NO: 89923 - DNA, 20 bp, Artificial Sequence
  chemically synthesized
attcgttattgcttttccta

SEQ ID NO: 89924 - DNA, 20 bp, Artificial Sequence
  chemically synthesized
aaagcaataacgaatgaaca

SEQ ID NO: 89925 - DNA, 20 bp, Artificial Sequence
  chemically synthesized
aagcaataacgaatgaacaa

SEQ ID NO: 89926 - DNA, 20 bp, Artificial Sequence
  chemically synthesized
agcaataacgaatgaacaaa

SEQ ID NO: 89927 - DNA, 20 bp, Artificial Sequence
  chemically synthesized
gcaataacgaatgaacaaag

SEQ ID NO: 89928 - DNA, 20 bp, Artificial Sequence
  chemically synthesized
aacgaatgaacaaaggggaa

SEQ ID NO: 89929 - DNA, 20 bp, Artificial Sequence
  chemically synthesized
acgaatgaacaaaggggaaa

SEQ ID NO: 89930 - DNA, 20 bp, Artificial Sequence
  chemically synthesized
aatgaacaaaggggaaaagg

SEQ ID NO: 89931 - DNA, 20 bp, Artificial Sequence
  chemically synthesized
ttgttacataacaaaaacca

SEQ ID NO: 89932 - DNA, 20 bp, Artificial Sequence
  chemically synthesized
ttacataacaaaaaccatag

SEQ ID NO: 89933 - DNA, 20 bp, Artificial Sequence
  chemically synthesized
cataacaaaaaccatagcag

SEQ ID NO: 89934 - DNA, 20 bp, Artificial Sequence
  chemically synthesized
tgctgctgctgctgctgcta

SEQ ID NO: 89935 - DNA, 20 bp, Artificial Sequence
  chemically synthesized
aacaaaaaccatagcagcag

SEQ ID NO: 89936 - DNA, 20 bp, Artificial Sequence
  chemically synthesized
aaaaaccatagcagcagcag

SEQ ID NO: 89937 - DNA, 20 bp, Artificial Sequence
  chemically synthesized
aaccatagcagcagcagcag

SEQ ID NO: 89938 - DNA, 20 bp, Artificial Sequence
  chemically synthesized
atagcagcagcagcagcagc

SEQ ID NO: 89939 - DNA, 20 bp, Artificial Sequence
  chemically synthesized
acagcacctgatgtacagta

SEQ ID NO: 89940 - DNA, 20 bp, Artificial Sequence
  chemically synthesized
gacagcacctgatgtacagt

SEQ ID NO: 89941 - DNA, 20 bp, Artificial Sequence
  chemically synthesized
acatgaaccttactgtacat

SEQ ID NO: 89942 - DNA, 20 bp, Artificial Sequence
  chemically synthesized
catgaaccttactgtacatc

SEQ ID NO: 89943 - DNA, 20 bp, Artificial Sequence
  chemically synthesized
tttggacagcacctgatgta

SEQ ID NO: 89944 - DNA, 20 bp, Artificial Sequence
  chemically synthesized
tgtacatcaggtgctgtcca

SEQ ID NO: 89945 - DNA, 20 bp, Artificial Sequence
  chemically synthesized
tgtatatacagtgctttgga

SEQ ID NO: 89946 - DNA, 20 bp, Artificial Sequence
  chemically synthesized
ctcatgtatatacagtgctt

SEQ ID NO: 89947 - DNA, 20 bp, Artificial Sequence
  chemically synthesized
aaaatgagctcatgtatata

SEQ ID NO: 89948 - DNA, 20 bp, Artificial Sequence
  chemically synthesized
ccaaagcactgtatatacat

SEQ ID NO: 89949 - DNA, 20 bp, Artificial Sequence
  chemically synthesized
ggttgttgagaggagaaaat

SEQ ID NO: 89950 - DNA, 20 bp, Artificial Sequence
  chemically synthesized
ccctagagggttgttgagag

SEQ ID NO: 89951 - DNA, 20 bp, Artificial Sequence
  chemically synthesized
taccctagagggttgttgag

SEQ ID NO: 89952 - DNA, 20 bp, Artificial Sequence
  chemically synthesized
ctaccctagagggttgttga

SEQ ID NO: 89953 - DNA, 20 bp, Artificial Sequence
  chemically synthesized
ccctaccctagagggttgtt

SEQ ID NO: 89954 - DNA, 20 bp, Artificial Sequence
  chemically synthesized
ttctcctctcaacaaccctc

SEQ ID NO: 89955 - DNA, 20 bp, Artificial Sequence
  chemically synthesized
tctcctctcaacaaccctct

SEQ ID NO: 89956 - DNA, 20 bp, Artificial Sequence
  chemically synthesized
ctcctctcaacaaccctcta

SEQ ID NO: 89957 - DNA, 20 bp, Artificial Sequence
  chemically synthesized
ctctcaacaaccctctaggg

SEQ ID NO: 89958 - DNA, 20 bp, Artificial Sequence
  chemically synthesized
atagtagcccctaccctaga

SEQ ID NO: 89959 - DNA, 20 bp, Artificial Sequence
  chemically synthesized
tctcaacaaccctctagggt

SEQ ID NO: 89960 - DNA, 20 bp, Artificial Sequence
  chemically synthesized
aatagtagcccctaccctag

SEQ ID NO: 89961 - DNA, 20 bp, Artificial Sequence
  chemically synthesized
ctcaacaaccctctagggta

SEQ ID NO: 89962 - DNA, 20 bp, Artificial Sequence
  chemically synthesized
taatagtagcccctacccta

SEQ ID NO: 89963 - DNA, 20 bp, Artificial Sequence
  chemically synthesized
tcaacaaccctctagggtag

SEQ ID NO: 89964 - DNA, 20 bp, Artificial Sequence
  chemically synthesized
gataatagtagcccctaccc

SEQ ID NO: 89965 - DNA, 20 bp, Artificial Sequence
  chemically synthesized
atggaaaatgaagataatag

SEQ ID NO: 89966 - DNA, 20 bp, Artificial Sequence
  chemically synthesized
tatatggaaaatgaagataa

SEQ ID NO: 89967 - DNA, 20 bp, Artificial Sequence
  chemically synthesized
attatcttatatggaaaatg

SEQ ID NO: 89968 - DNA, 20 bp, Artificial Sequence
  chemically synthesized
attatcttcattttccatat

SEQ ID NO: 89969 - DNA, 20 bp, Artificial Sequence
  chemically synthesized
agtagtttcattatcttata

SEQ ID NO: 89970 - DNA, 20 bp, Artificial Sequence
  chemically synthesized
taagataatgaaactactgt

SEQ ID NO: 89971 - DNA, 20 bp, Artificial Sequence
  chemically synthesized
aagataatgaaactactgta

SEQ ID NO: 89972 - DNA, 20 bp, Artificial Sequence
  chemically synthesized
atttttagttaaccttacag

SEQ ID NO: 89973 - DNA, 20 bp, Artificial Sequence
  chemically synthesized
ggcatttttagttaacctta

SEQ ID NO: 89974 - DNA, 20 bp, Artificial Sequence
  chemically synthesized
tgtgtgaacctgggcatttt

SEQ ID NO: 89975 - DNA, 20 bp, Artificial Sequence
  chemically synthesized
taaggttaactaaaaatgcc

SEQ ID NO: 89976 - DNA, 20 bp, Artificial Sequence
  chemically synthesized
aaggttaactaaaaatgccc

SEQ ID NO: 89977 - DNA, 20 bp, Artificial Sequence
  chemically synthesized
tttattagctgtgtgaacct

SEQ ID NO: 89978 - DNA, 20 bp, Artificial Sequence
  chemically synthesized
atttattagctgtgtgaacc

SEQ ID NO: 89979 - DNA, 20 bp, Artificial Sequence
  chemically synthesized
taaaaatgcccaggttcaca

SEQ ID NO: 89980 - DNA, 20 bp, Artificial Sequence
  chemically synthesized
gttcacacagctaataaatg

SEQ ID NO: 89981 - DNA, 20 bp, Artificial Sequence
  chemically synthesized
ctaaatcttgctgcatttat

SEQ ID NO: 89982 - DNA, 20 bp, Artificial Sequence
  chemically synthesized
acacagctaataaatgcagc

SEQ ID NO: 89983 - DNA, 20 bp, Artificial Sequence
  chemically synthesized
ctaataaatgcagcaagatt

SEQ ID NO: 89984 - DNA, 20 bp, Artificial Sequence
  chemically synthesized
agcaagatttagaacctcgt

SEQ ID NO: 89985 - DNA, 20 bp, Artificial Sequence
  chemically synthesized
agatttagaacctcgtcagt

SEQ ID NO: 89986 - DNA, 20 bp, Artificial Sequence
  chemically synthesized
tccctgaagtctgactgacg

SEQ ID NO: 89987 - DNA, 20 bp, Artificial Sequence
  chemically synthesized
atccctgaagtctgactgac

SEQ ID NO: 89988 - DNA, 20 bp, Artificial Sequence
  chemically synthesized
gaacctcgtcagtcagactt

SEQ ID NO: 89989 - DNA, 20 bp, Artificial Sequence
  chemically synthesized
aacctcgtcagtcagacttc

SEQ ID NO: 89990 - DNA, 20 bp, Artificial Sequence
  chemically synthesized
acctcgtcagtcagacttca

SEQ ID NO: 89991 - DNA, 20 bp, Artificial Sequence
  chemically synthesized
ggctaagagcacaatccctg

SEQ ID NO: 89992 - DNA, 20 bp, Artificial Sequence
  chemically synthesized
gacttcagggattgtgctct

SEQ ID NO: 89993 - DNA, 20 bp, Artificial Sequence
  chemically synthesized
taatatagcctagtggctaa

SEQ ID NO: 89994 - DNA, 20 bp, Artificial Sequence
  chemically synthesized
gggattgtgctcttagccac

SEQ ID NO: 89995 - DNA, 20 bp, Artificial Sequence
  chemically synthesized
ggattgtgctcttagccact

SEQ ID NO: 89996 - DNA, 20 bp, Artificial Sequence
  chemically synthesized
ggtaatatagcctagtggct

SEQ ID NO: 89997 - DNA, 20 bp, Artificial Sequence
  chemically synthesized
tgaaaggtaatatagcctag

SEQ ID NO: 89998 - DNA, 20 bp, Artificial Sequence
  chemically synthesized
acttgaaaggtaatatagcc

SEQ ID NO: 89999 - DNA, 20 bp, Artificial Sequence
  chemically synthesized
actaaacttgaaaggtaata

SEQ ID NO: 90000 - DNA, 20 bp, Artificial Sequence
  chemically synthesized
actaggctatattacctttc

SEQ ID NO: 90001 - DNA, 20 bp, Artificial Sequence
  chemically synthesized
caccaacaactaaacttgaa

SEQ ID NO: 90002 - DNA, 20 bp, Artificial Sequence
  chemically synthesized
gctatattacctttcaagtt

SEQ ID NO: 90003 - DNA, 20 bp, Artificial Sequence
  chemically synthesized
ccaccaacaactaaacttga

SEQ ID NO: 90004 - DNA, 20 bp, Artificial Sequence
  chemically synthesized
tacctttcaagtttagttgt

SEQ ID NO: 90005 - DNA, 20 bp, Artificial Sequence
  chemically synthesized
ctttcaagtttagttgttgg

SEQ ID NO: 90006 - DNA, 20 bp, Artificial Sequence
  chemically synthesized
tcaagtttagttgttggtgg

SEQ ID NO: 90007 - DNA, 20 bp, Artificial Sequence
  chemically synthesized
taggtagtagcattattaat

SEQ ID NO: 90008 - DNA, 20 bp, Artificial Sequence
  chemically synthesized
ttaggtagtagcattattaa

SEQ ID NO: 90009 - DNA, 20 bp, Artificial Sequence
  chemically synthesized
atttgctaaaatttaggtag

SEQ ID NO: 90010 - DNA, 20 bp, Artificial Sequence
  chemically synthesized
tagatttgctaaaatttagg

SEQ ID NO: 90011 - DNA, 20 bp, Artificial Sequence
  chemically synthesized
taatgctactacctaaattt

SEQ ID NO: 90012 - DNA, 20 bp, Artificial Sequence
  chemically synthesized
tgctagatttgctaaaattt

SEQ ID NO: 90013 - DNA, 20 bp, Artificial Sequence
  chemically synthesized
gtgctagatttgctaaaatt

SEQ ID NO: 90014 - DNA, 20 bp, Artificial Sequence
  chemically synthesized
tacctaaattttagcaaatc

SEQ ID NO: 90015 - DNA, 20 bp, Artificial Sequence
  chemically synthesized
ttattttctaatggcagtgc

SEQ ID NO: 90016 - DNA, 20 bp, Artificial Sequence
  chemically synthesized
agcaaatctagcactgccat

SEQ ID NO: 90017 - DNA, 20 bp, Artificial Sequence
  chemically synthesized
tatcctttattttctaatgg

SEQ ID NO: 90018 - DNA, 20 bp, Artificial Sequence
  chemically synthesized
agttatcctttattttctaa

SEQ ID NO: 90019 - DNA, 20 bp, Artificial Sequence
  chemically synthesized
agcactgccattagaaaata

SEQ ID NO: 90020 - DNA, 20 bp, Artificial Sequence
  chemically synthesized
gcactgccattagaaaataa

SEQ ID NO: 90021 - DNA, 20 bp, Artificial Sequence
  chemically synthesized
aaaataaaggataactatgt

SEQ ID NO: 90022 - DNA, 20 bp, Artificial Sequence
  chemically synthesized
ttgctctttgtgtgctgaca

SEQ ID NO: 90023 - DNA, 20 bp, Artificial Sequence
  chemically synthesized
gataactatgtcagcacaca

SEQ ID NO: 90024 - DNA, 20 bp, Artificial Sequence
  chemically synthesized
taactatgtcagcacacaaa

SEQ ID NO: 90025 - DNA, 20 bp, Artificial Sequence
  chemically synthesized
gcacacaaagagcaatttca

SEQ ID NO: 90026 - DNA, 20 bp, Artificial Sequence
  chemically synthesized
ttaatagtctttatattaat

SEQ ID NO: 90027 - DNA, 20 bp, Artificial Sequence
  chemically synthesized
ttcatggtcttattaatata

SEQ ID NO: 90028 - DNA, 20 bp, Artificial Sequence
  chemically synthesized
ttaatataaagactattaaa

SEQ ID NO: 90029 - DNA, 20 bp, Artificial Sequence
  chemically synthesized
actgctacaaatctgtttaa

SEQ ID NO: 90030 - DNA, 20 bp, Artificial Sequence
  chemically synthesized
aagactattaaacagatttg

SEQ ID NO: 90031 - DNA, 20 bp, Artificial Sequence
  chemically synthesized
actattaaacagatttgtag

SEQ ID NO: 90032 - DNA, 20 bp, Artificial Sequence
  chemically synthesized
attaaacagatttgtagcag

SEQ ID NO: 90033 - DNA, 20 bp, Artificial Sequence
  chemically synthesized
aacagatttgtagcagtgga

SEQ ID NO: 90034 - DNA, 20 bp, Artificial Sequence
  chemically synthesized
cagatttgtagcagtggata

SEQ ID NO: 90035 - DNA, 20 bp, Artificial Sequence
  chemically synthesized
agagatgcatccaatacaac

SEQ ID NO: 90036 - DNA, 20 bp, Artificial Sequence
  chemically synthesized
tgtgttttctcttgttgtat

SEQ ID NO: 90037 - DNA, 20 bp, Artificial Sequence
  chemically synthesized
agatgcatccaatacaacaa

SEQ ID NO: 90038 - DNA, 20 bp, Artificial Sequence
  chemically synthesized
atacaacaagagaaaacaca

SEQ ID NO: 90039 - DNA, 20 bp, Artificial Sequence
  chemically synthesized
agagaaaacacaaagtaatt

SEQ ID NO: 90040 - DNA, 20 bp, Artificial Sequence
  chemically synthesized
acacaaagtaattgagaaaa

SEQ ID NO: 90041 - DNA, 20 bp, Artificial Sequence
  chemically synthesized
cacaaagtaattgagaaaat

SEQ ID NO: 90042 - DNA, 20 bp, Artificial Sequence
  chemically synthesized
aataatgtgtgtccccataa

SEQ ID NO: 90043 - DNA, 20 bp, Artificial Sequence
  chemically synthesized
ggccaaatgtttcttttatg

SEQ ID NO: 90044 - DNA, 20 bp, Artificial Sequence
  chemically synthesized
aggccaaatgtttcttttat

SEQ ID NO: 90045 - DNA, 20 bp, Artificial Sequence
  chemically synthesized
taggccaaatgtttctttta

SEQ ID NO: 90046 - DNA, 20 bp, Artificial Sequence
  chemically synthesized
gtccccataaaagaaacatt

SEQ ID NO: 90047 - DNA, 20 bp, Artificial Sequence
  chemically synthesized
taaaagaaacatttggccta

SEQ ID NO: 90048 - DNA, 20 bp, Artificial Sequence
  chemically synthesized
ctataattgtacagaacttt

SEQ ID NO: 90049 - DNA, 20 bp, Artificial Sequence
  chemically synthesized
tctataattgtacagaactt

SEQ ID NO: 90050 - DNA, 20 bp, Artificial Sequence
  chemically synthesized
aaatttgctctataattgta

SEQ ID NO: 90051 - DNA, 20 bp, Artificial Sequence
  chemically synthesized
cctaaagttctgtacaatta

SEQ ID NO: 90052 - DNA, 20 bp, Artificial Sequence
  chemically synthesized
taaagttctgtacaattata

SEQ ID NO: 90053 - DNA, 20 bp, Artificial Sequence
  chemically synthesized
tacaattatagagcaaattt

SEQ ID NO: 90054 - DNA, 20 bp, Artificial Sequence
  chemically synthesized
ttatagagcaaatttcagct

SEQ ID NO: 90055 - DNA, 20 bp, Artificial Sequence
  chemically synthesized
atagagcaaatttcagctga

SEQ ID NO: 90056 - DNA, 20 bp, Artificial Sequence
  chemically synthesized
ctgaacttttttggtactct

SEQ ID NO: 90057 - DNA, 20 bp, Artificial Sequence
  chemically synthesized
ttcagctgagagtaccaaaa

SEQ ID NO: 90058 - DNA, 20 bp, Artificial Sequence
  chemically synthesized
gtctcataactgaacttttt

SEQ ID NO: 90059 - DNA, 20 bp, Artificial Sequence
  chemically synthesized
ctgagagtaccaaaaaagtt

SEQ ID NO: 90060 - DNA, 20 bp, Artificial Sequence
  chemically synthesized
taccaaaaaagttcagttat

SEQ ID NO: 90061 - DNA, 20 bp, Artificial Sequence
  chemically synthesized
aaaaagttcagttatgagac

SEQ ID NO: 90062 - DNA, 20 bp, Artificial Sequence
  chemically synthesized
tgagacaagcaatatgttca

SEQ ID NO: 90063 - DNA, 20 bp, Artificial Sequence
  chemically synthesized
caagcaatatgttcacagta

SEQ ID NO: 90064 - DNA, 20 bp, Artificial Sequence
  chemically synthesized
gcaatatgttcacagtatag

SEQ ID NO: 90065 - DNA, 20 bp, Artificial Sequence
  chemically synthesized
tgttcacagtatagcagttt

SEQ ID NO: 90066 - DNA, 20 bp, Artificial Sequence
  chemically synthesized
gttcacagtatagcagtttt

SEQ ID NO: 90067 - DNA, 20 bp, Artificial Sequence
  chemically synthesized
tcacagtatagcagttttag

SEQ ID NO: 90068 - DNA, 20 bp, Artificial Sequence
  chemically synthesized
cagtatagcagttttaggag

SEQ ID NO: 90069 - DNA, 20 bp, Artificial Sequence
  chemically synthesized
agtatagcagttttaggagt

SEQ ID NO: 90070 - DNA, 20 bp, Artificial Sequence
  chemically synthesized
gtatagcagttttaggagta

SEQ ID NO: 90071 - DNA, 20 bp, Artificial Sequence
  chemically synthesized
tatagcagttttaggagtag

SEQ ID NO: 90072 - DNA, 20 bp, Artificial Sequence
  chemically synthesized
tagcagttttaggagtaggg

SEQ ID NO: 90073 - DNA, 20 bp, Artificial Sequence
  chemically synthesized
gaaaaagcccttcagaaaac

SEQ ID NO: 90074 - DNA, 20 bp, Artificial Sequence
  chemically synthesized
aggggagatcctgttttctg

SEQ ID NO: 90075 - DNA, 20 bp, Artificial Sequence
  chemically synthesized
tgaaaaagcccttcagaaaa

SEQ ID NO: 90076 - DNA, 20 bp, Artificial Sequence
  chemically synthesized
ggggagatcctgttttctga

SEQ ID NO: 90077 - DNA, 20 bp, Artificial Sequence
  chemically synthesized
gggagatcctgttttctgaa

SEQ ID NO: 90078 - DNA, 20 bp, Artificial Sequence
  chemically synthesized
tggaatttgaaaaagccctt

SEQ ID NO: 90079 - DNA, 20 bp, Artificial Sequence
  chemically synthesized
aggaagtgtggaatttgaaa

SEQ ID NO: 90080 - DNA, 20 bp, Artificial Sequence
  chemically synthesized
actcagataagaaggaagtg

SEQ ID NO: 90081 - DNA, 20 bp, Artificial Sequence
  chemically synthesized
atgagactcagataagaagg

SEQ ID NO: 90082 - DNA, 20 bp, Artificial Sequence
  chemically synthesized
tagatgagactcagataaga

SEQ ID NO: 90083 - DNA, 20 bp, Artificial Sequence
  chemically synthesized
tccacacttccttcttatct

SEQ ID NO: 90084 - DNA, 20 bp, Artificial Sequence
  chemically synthesized
gtagatgagactcagataag

SEQ ID NO: 90085 - DNA, 20 bp, Artificial Sequence
  chemically synthesized
agagtagatgagactcagat

SEQ ID NO: 90086 - DNA, 20 bp, Artificial Sequence
  chemically synthesized
caacaagagtagatgagact

SEQ ID NO: 90087 - DNA, 20 bp, Artificial Sequence
  chemically synthesized
gattcacaacaagagtagat

SEQ ID NO: 90088 - DNA, 20 bp, Artificial Sequence
  chemically synthesized
aaggagattcacaacaagag

SEQ ID NO: 90089 - DNA, 20 bp, Artificial Sequence
  chemically synthesized
agaaaggagattcacaacaa

SEQ ID NO: 90090 - DNA, 20 bp, Artificial Sequence
  chemically synthesized
tgagaaaggagattcacaac

SEQ ID NO: 90091 - DNA, 20 bp, Artificial Sequence
  chemically synthesized
ttgttgtgaatctcctttct

SEQ ID NO: 90092 - DNA, 20 bp, Artificial Sequence
  chemically synthesized
ttctctggaagctgagaaag

SEQ ID NO: 90093 - DNA, 20 bp, Artificial Sequence
  chemically synthesized
ttttctctggaagctgagaa

SEQ ID NO: 90094 - DNA, 20 bp, Artificial Sequence
  chemically synthesized
gttttctctggaagctgaga

SEQ ID NO: 90095 - DNA, 20 bp, Artificial Sequence
  chemically synthesized
gaatctcctttctcagcttc

SEQ ID NO: 90096 - DNA, 20 bp, Artificial Sequence
  chemically synthesized
atgagttttctctggaagct

SEQ ID NO: 90097 - DNA, 20 bp, Artificial Sequence
  chemically synthesized
atctcctttctcagcttcca

SEQ ID NO: 90098 - DNA, 20 bp, Artificial Sequence
  chemically synthesized
ttgccatgagttttctctgg

SEQ ID NO: 90099 - DNA, 20 bp, Artificial Sequence
  chemically synthesized
actttgccatgagttttctc

SEQ ID NO: 90100 - DNA, 20 bp, Artificial Sequence
  chemically synthesized
cagcttccagagaaaactca

SEQ ID NO: 90101 - DNA, 20 bp, Artificial Sequence
  chemically synthesized
tccagagaaaactcatggca

SEQ ID NO: 90102 - DNA, 20 bp, Artificial Sequence
  chemically synthesized
atttaactgcactttgccat

SEQ ID NO: 90103 - DNA, 20 bp, Artificial Sequence
  chemically synthesized
agaaaactcatggcaaagtg

SEQ ID NO: 90104 - DNA, 20 bp, Artificial Sequence
  chemically synthesized
catggcaaagtgcagttaaa

SEQ ID NO: 90105 - DNA, 20 bp, Artificial Sequence
  chemically synthesized
aaagtgcagttaaatagaca

SEQ ID NO: 90106 - DNA, 20 bp, Artificial Sequence
  chemically synthesized
aagtgcagttaaatagacat

SEQ ID NO: 90107 - DNA, 20 bp, Artificial Sequence
  chemically synthesized
ataagggaaagagaagagaa

SEQ ID NO: 90108 - DNA, 20 bp, Artificial Sequence
  chemically synthesized
aataagggaaagagaagaga

SEQ ID NO: 90109 - DNA, 20 bp, Artificial Sequence
  chemically synthesized
taataagggaaagagaagag

SEQ ID NO: 90110 - DNA, 20 bp, Artificial Sequence
  chemically synthesized
ggctaataagggaaagagaa

SEQ ID NO: 90111 - DNA, 20 bp, Artificial Sequence
  chemically synthesized
gtggctaataagggaaagag

SEQ ID NO: 90112 - DNA, 20 bp, Artificial Sequence
  chemically synthesized
tatgtggctaataagggaaa

SEQ ID NO: 90113 - DNA, 20 bp, Artificial Sequence
  chemically synthesized
attatgtggctaataaggga

SEQ ID NO: 90114 - DNA, 20 bp, Artificial Sequence
  chemically synthesized
ttctcttctctttcccttat

SEQ ID NO: 90115 - DNA, 20 bp, Artificial Sequence
  chemically synthesized
catcattatgtggctaataa

SEQ ID NO: 90116 - DNA, 20 bp, Artificial Sequence
  chemically synthesized
tcatcattatgtggctaata

SEQ ID NO: 90117 - DNA, 20 bp, Artificial Sequence
  chemically synthesized
ttcatcattatgtggctaat

SEQ ID NO: 90118 - DNA, 20 bp, Artificial Sequence
  chemically synthesized
aaagagttttcatcattatg

SEQ ID NO: 90119 - DNA, 20 bp, Artificial Sequence
  chemically synthesized
gtgaaaccaaagtaatgaaa

SEQ ID NO: 90120 - DNA, 20 bp, Artificial Sequence
  chemically synthesized
tagtgaaaccaaagtaatga

SEQ ID NO: 90121 - DNA, 20 bp, Artificial Sequence
  chemically synthesized
tgaaaactctttcattactt

SEQ ID NO: 90122 - DNA, 20 bp, Artificial Sequence
  chemically synthesized
tttcatgtttagtgaaacca

SEQ ID NO: 90123 - DNA, 20 bp, Artificial Sequence
  chemically synthesized
atgtattattatttcatgtt

SEQ ID NO: 90124 - DNA, 20 bp, Artificial Sequence
  chemically synthesized
taatattcaaaaaattcagc

SEQ ID NO: 90125 - DNA, 20 bp, Artificial Sequence
  chemically synthesized
gtaatattcaaaaaattcag

SEQ ID NO: 90126 - DNA, 20 bp, Artificial Sequence
  chemically synthesized
catgtaatattcaaaaaatt

SEQ ID NO: 90127 - DNA, 20 bp, Artificial Sequence
  chemically synthesized
tgaattttttgaatattaca

SEQ ID NO: 90128 - DNA, 20 bp, Artificial Sequence
  chemically synthesized
tttttgtaaaatactttgaa

SEQ ID NO: 90129 - DNA, 20 bp, Artificial Sequence
  chemically synthesized
tgtgttctagacgctattca

SEQ ID NO: 90130 - DNA, 20 bp, Artificial Sequence
  chemically synthesized
aaaatactttgaatagcgtc

SEQ ID NO: 90131 - DNA, 20 bp, Artificial Sequence
  chemically synthesized
ttgaatagcgtctagaacac

SEQ ID NO: 90132 - DNA, 20 bp, Artificial Sequence
  chemically synthesized
attaaagatctcttgtgttc

SEQ ID NO: 90133 - DNA, 20 bp, Artificial Sequence
  chemically synthesized
gaatagcgtctagaacacaa

SEQ ID NO: 90134 - DNA, 20 bp, Artificial Sequence
  chemically synthesized
gcatttgctattatttatta

SEQ ID NO: 90135 - DNA, 20 bp, Artificial Sequence
  chemically synthesized
aagagatctttaataaataa

SEQ ID NO: 90136 - DNA, 20 bp, Artificial Sequence
  chemically synthesized
ttaataaataatagcaaatg

SEQ ID NO: 90137 - DNA, 20 bp, Artificial Sequence
  chemically synthesized
taataaataatagcaaatgc

SEQ ID NO: 90138 - DNA, 20 bp, Artificial Sequence
  chemically synthesized
aataaataatagcaaatgca

SEQ ID NO: 90139 - DNA, 20 bp, Artificial Sequence
  chemically synthesized
atggattatcttgtaatagt

SEQ ID NO: 90140 - DNA, 20 bp, Artificial Sequence
  chemically synthesized
aatgcagggcttactattac

SEQ ID NO: 90141 - DNA, 20 bp, Artificial Sequence
  chemically synthesized
ccacatggattatcttgtaa

SEQ ID NO: 90142 - DNA, 20 bp, Artificial Sequence
  chemically synthesized
ctattacaagataatccatg

SEQ ID NO: 90143 - DNA, 20 bp, Artificial Sequence
  chemically synthesized
tctaacatctgatttccaca

SEQ ID NO: 90144 - DNA, 20 bp, Artificial Sequence
  chemically synthesized
aagataatccatgtggaaat

SEQ ID NO: 90145 - DNA, 20 bp, Artificial Sequence
  chemically synthesized
tccatgtggaaatcagatgt

SEQ ID NO: 90146 - DNA, 20 bp, Artificial Sequence
  chemically synthesized
tggaaatcagatgttagaaa

SEQ ID NO: 90147 - DNA, 20 bp, Artificial Sequence
  chemically synthesized
tgttagaaatagatttcatg

SEQ ID NO: 90148 - DNA, 20 bp, Artificial Sequence
  chemically synthesized
aaatagatttcatgaagtta

SEQ ID NO: 90149 - DNA, 20 bp, Artificial Sequence
  chemically synthesized
aatagatttcatgaagttac

SEQ ID NO: 90150 - DNA, 20 bp, Artificial Sequence
  chemically synthesized
tttcatgaagttacaggact

SEQ ID NO: 90151 - DNA, 20 bp, Artificial Sequence
  chemically synthesized
gaagttacaggacttggctt

SEQ ID NO: 90152 - DNA, 20 bp, Artificial Sequence
  chemically synthesized
catccctcaaggctcaagcc

SEQ ID NO: 90153 - DNA, 20 bp, Artificial Sequence
  chemically synthesized
caggacttggcttgagcctt

SEQ ID NO: 90154 - DNA, 20 bp, Artificial Sequence
  chemically synthesized
gtatacatccctcaaggctc

SEQ ID NO: 90155 - DNA, 20 bp, Artificial Sequence
  chemically synthesized
aggacttggcttgagccttg

SEQ ID NO: 90156 - DNA, 20 bp, Artificial Sequence
  chemically synthesized
ggacttggcttgagccttga

SEQ ID NO: 90157 - DNA, 20 bp, Artificial Sequence
  chemically synthesized
ccaatcgtatacatccctca

SEQ ID NO: 90158 - DNA, 20 bp, Artificial Sequence
  chemically synthesized
cccaatcgtatacatccctc

SEQ ID NO: 90159 - DNA, 20 bp, Artificial Sequence
  chemically synthesized
ccttgagggatgtatacgat

SEQ ID NO: 90160 - DNA, 20 bp, Artificial Sequence
  chemically synthesized
cttgagggatgtatacgatt

SEQ ID NO: 90161 - DNA, 20 bp, Artificial Sequence
  chemically synthesized
gatgtatacgattgggaaat

SEQ ID NO: 90162 - DNA, 20 bp, Artificial Sequence
  chemically synthesized
cgattgggaaattggaacaa

SEQ ID NO: 90163 - DNA, 20 bp, Artificial Sequence
  chemically synthesized
tggaacaaaagaaaatattc

SEQ ID NO: 90164 - DNA, 20 bp, Artificial Sequence
  chemically synthesized
ggaacaaaagaaaatattcc

SEQ ID NO: 90165 - DNA, 20 bp, Artificial Sequence
  chemically synthesized
aagaaaatattccaggtaaa

SEQ ID NO: 90166 - DNA, 20 bp, Artificial Sequence
  chemically synthesized
cccatgctattctttttacc

SEQ ID NO: 90167 - DNA, 20 bp, Artificial Sequence
  chemically synthesized
aatattccaggtaaaaagaa

SEQ ID NO: 90168 - DNA, 20 bp, Artificial Sequence
  chemically synthesized
tccaggtaaaaagaatagca

SEQ ID NO: 90169 - DNA, 20 bp, Artificial Sequence
  chemically synthesized
ccaggtaaaaagaatagcat

SEQ ID NO: 90170 - DNA, 20 bp, Artificial Sequence
  chemically synthesized
taaaaagaatagcatgggaa

SEQ ID NO: 90171 - DNA, 20 bp, Artificial Sequence
  chemically synthesized
aaaagaatagcatgggaatg

SEQ ID NO: 90172 - DNA, 20 bp, Artificial Sequence
  chemically synthesized
aatagcatgggaatggagta

SEQ ID NO: 90173 - DNA, 20 bp, Artificial Sequence
  chemically synthesized
atagcatgggaatggagtaa

SEQ ID NO: 90174 - DNA, 20 bp, Artificial Sequence
  chemically synthesized
gagtaaaggtgaaatgaatt

SEQ ID NO: 90175 - DNA, 20 bp, Artificial Sequence
  chemically synthesized
gtgaaatgaatttggtttat

SEQ ID NO: 90176 - DNA, 20 bp, Artificial Sequence
  chemically synthesized
aaatgaatttggtttatgag

SEQ ID NO: 90177 - DNA, 20 bp, Artificial Sequence
  chemically synthesized
aatgaatttggtttatgagc

SEQ ID NO: 90178 - DNA, 20 bp, Artificial Sequence
  chemically synthesized
atgaatttggtttatgagca

SEQ ID NO: 90179 - DNA, 20 bp, Artificial Sequence
  chemically synthesized
aatgaattgcacaacctgat

SEQ ID NO: 90180 - DNA, 20 bp, Artificial Sequence
  chemically synthesized
tctcattgtccattccaatc

SEQ ID NO: 90181 - DNA, 20 bp, Artificial Sequence
  chemically synthesized
attgcacaacctgattggaa

SEQ ID NO: 90182 - DNA, 20 bp, Artificial Sequence
  chemically synthesized
ctctcattgtccattccaat

SEQ ID NO: 90183 - DNA, 20 bp, Artificial Sequence
  chemically synthesized
acctgattggaatggacaat

SEQ ID NO: 90184 - DNA, 20 bp, Artificial Sequence
  chemically synthesized
ctgattggaatggacaatga

SEQ ID NO: 90185 - DNA, 20 bp, Artificial Sequence
  chemically synthesized
tggaatggacaatgagagtt

SEQ ID NO: 90186 - DNA, 20 bp, Artificial Sequence
  chemically synthesized
gaatggacaatgagagttga

SEQ ID NO: 90187 - DNA, 20 bp, Artificial Sequence
  chemically synthesized
acaatgagagttgagagaaa

SEQ ID NO: 90188 - DNA, 20 bp, Artificial Sequence
  chemically synthesized
caatgagagttgagagaaat

SEQ ID NO: 90189 - DNA, 20 bp, Artificial Sequence
  chemically synthesized
tgagagttgagagaaatagg

SEQ ID NO: 90190 - DNA, 20 bp, Artificial Sequence
  chemically synthesized
tgagagaaataggtagaatg

SEQ ID NO: 90191 - DNA, 20 bp, Artificial Sequence
  chemically synthesized
ttctacttggtttaagcagt

SEQ ID NO: 90192 - DNA, 20 bp, Artificial Sequence
  chemically synthesized
tttattctacttggtttaag

SEQ ID NO: 90193 - DNA, 20 bp, Artificial Sequence
  chemically synthesized
gcagaccaactgcttaaacc

SEQ ID NO: 90194 - DNA, 20 bp, Artificial Sequence
  chemically synthesized
gactttattctacttggttt

SEQ ID NO: 90195 - DNA, 20 bp, Artificial Sequence
  chemically synthesized
gaccaactgcttaaaccaag

SEQ ID NO: 90196 - DNA, 20 bp, Artificial Sequence
  chemically synthesized
aaggaagactttattctact

SEQ ID NO: 90197 - DNA, 20 bp, Artificial Sequence
  chemically synthesized
tgcttaaaccaagtagaata

SEQ ID NO: 90198 - DNA, 20 bp, Artificial Sequence
  chemically synthesized
agtagaataaagtcttcctt

SEQ ID NO: 90199 - DNA, 20 bp, Artificial Sequence
  chemically synthesized
gtagaataaagtcttccttt

SEQ ID NO: 90200 - DNA, 20 bp, Artificial Sequence
  chemically synthesized
tctcggtggcttcctaaagg

SEQ ID NO: 90201 - DNA, 20 bp, Artificial Sequence
  chemically synthesized
gaataaagtcttcctttagg

SEQ ID NO: 90202 - DNA, 20 bp, Artificial Sequence
  chemically synthesized
tattctcggtggcttcctaa

SEQ ID NO: 90203 - DNA, 20 bp, Artificial Sequence
  chemically synthesized
ttattctcggtggcttccta

SEQ ID NO: 90204 - DNA, 20 bp, Artificial Sequence
  chemically synthesized
tcttcctttaggaagccacc

SEQ ID NO: 90205 - DNA, 20 bp, Artificial Sequence
  chemically synthesized
ttctaaacttttattctcgg

SEQ ID NO: 90206 - DNA, 20 bp, Artificial Sequence
  chemically synthesized
taggaagccaccgagaataa

SEQ ID NO: 90207 - DNA, 20 bp, Artificial Sequence
  chemically synthesized
tctttctaaacttttattct

SEQ ID NO: 90208 - DNA, 20 bp, Artificial Sequence
  chemically synthesized
agccaccgagaataaaagtt

SEQ ID NO: 90209 - DNA, 20 bp, Artificial Sequence
  chemically synthesized
accgagaataaaagtttaga

SEQ ID NO: 90210 - DNA, 20 bp, Artificial Sequence
  chemically synthesized
gaataaaagtttagaaagaa

SEQ ID NO: 90211 - DNA, 20 bp, Artificial Sequence
  chemically synthesized
agtttagaaagaaaagtaca

SEQ ID NO: 90212 - DNA, 20 bp, Artificial Sequence
  chemically synthesized
agaaagaaaagtacaaagac

SEQ ID NO: 90213 - DNA, 20 bp, Artificial Sequence
  chemically synthesized
attctactttttgaatgaaa

SEQ ID NO: 90214 - DNA, 20 bp, Artificial Sequence
  chemically synthesized
tttgtactatttcattcaaa

SEQ ID NO: 90215 - DNA, 20 bp, Artificial Sequence
  chemically synthesized
gtactatttcattcaaaaag

SEQ ID NO: 90216 - DNA, 20 bp, Artificial Sequence
  chemically synthesized
tcaaaaagtagaatgatcca

SEQ ID NO: 90217 - DNA, 20 bp, Artificial Sequence
  chemically synthesized
attattacttatgaacacca

SEQ ID NO: 90218 - DNA, 20 bp, Artificial Sequence
  chemically synthesized
gaatgatccatggtgttcat

SEQ ID NO: 90219 - DNA, 20 bp, Artificial Sequence
  chemically synthesized
ttcataagtaataatacaac

SEQ ID NO: 90220 - DNA, 20 bp, Artificial Sequence
  chemically synthesized
tcataagtaataatacaact

SEQ ID NO: 90221 - DNA, 20 bp, Artificial Sequence
  chemically synthesized
cataagtaataatacaactg

SEQ ID NO: 90222 - DNA, 20 bp, Artificial Sequence
  chemically synthesized
aagtaataatacaactgggg

SEQ ID NO: 90223 - DNA, 20 bp, Artificial Sequence
  chemically synthesized
taacttttcctattcttccc

SEQ ID NO: 90224 - DNA, 20 bp, Artificial Sequence
  chemically synthesized
ataatacaactggggaagaa

SEQ ID NO: 90225 - DNA, 20 bp, Artificial Sequence
  chemically synthesized
taatacaactggggaagaat

SEQ ID NO: 90226 - DNA, 20 bp, Artificial Sequence
  chemically synthesized
caactggggaagaataggaa

SEQ ID NO: 90227 - DNA, 20 bp, Artificial Sequence
  chemically synthesized
gggaagaataggaaaagtta

SEQ ID NO: 90228 - DNA, 20 bp, Artificial Sequence
  chemically synthesized
aaaagttatggatgttttac

SEQ ID NO: 90229 - DNA, 20 bp, Artificial Sequence
  chemically synthesized
agttatggatgttttactag

SEQ ID NO: 90230 - DNA, 20 bp, Artificial Sequence
  chemically synthesized
tcccttctttatttttcttc

SEQ ID NO: 90231 - DNA, 20 bp, Artificial Sequence
  chemically synthesized
gttttactagaagaaaaata

SEQ ID NO: 90232 - DNA, 20 bp, Artificial Sequence
  chemically synthesized
ttactagaagaaaaataaag

SEQ ID NO: 90233 - DNA, 20 bp, Artificial Sequence
  chemically synthesized
tactagaagaaaaataaaga

SEQ ID NO: 90234 - DNA, 20 bp, Artificial Sequence
  chemically synthesized
actagaagaaaaataaagaa

SEQ ID NO: 90235 - DNA, 20 bp, Artificial Sequence
  chemically synthesized
tagaagaaaaataaagaagg

SEQ ID NO: 90236 - DNA, 20 bp, Artificial Sequence
  chemically synthesized
aaataaagaagggagatgtc

SEQ ID NO: 90237 - DNA, 20 bp, Artificial Sequence
  chemically synthesized
agaagggagatgtcaagaat

SEQ ID NO: 90238 - DNA, 20 bp, Artificial Sequence
  chemically synthesized
taataataaaaagaagggta

SEQ ID NO: 90239 - DNA, 20 bp, Artificial Sequence
  chemically synthesized
atggttaataataaaaagaa

SEQ ID NO: 90240 - DNA, 20 bp, Artificial Sequence
  chemically synthesized
aatggttaataataaaaaga

SEQ ID NO: 90241 - DNA, 20 bp, Artificial Sequence
  chemically synthesized
aaatggttaataataaaaag

SEQ ID NO: 90242 - DNA, 20 bp, Artificial Sequence
  chemically synthesized
ataaaatggttaataataaa

SEQ ID NO: 90243 - DNA, 20 bp, Artificial Sequence
  chemically synthesized
ctgcttaatggttaataaaa

SEQ ID NO: 90244 - DNA, 20 bp, Artificial Sequence
  chemically synthesized
taaccattttattaaccatt

SEQ ID NO: 90245 - DNA, 20 bp, Artificial Sequence
  chemically synthesized
ccattttattaaccattaag

SEQ ID NO: 90246 - DNA, 20 bp, Artificial Sequence
  chemically synthesized
tatcacaaccatctgcttaa

SEQ ID NO: 90247 - DNA, 20 bp, Artificial Sequence
  chemically synthesized
tttattaaccattaagcaga

SEQ ID NO: 90248 - DNA, 20 bp, Artificial Sequence
  chemically synthesized
agatggttgtgatactattc

SEQ ID NO: 90249 - DNA, 20 bp, Artificial Sequence
  chemically synthesized
ttattcatgatgttctagaa

SEQ ID NO: 90250 - DNA, 20 bp, Artificial Sequence
  chemically synthesized
tacgattattcatgatgttc

SEQ ID NO: 90251 - DNA, 20 bp, Artificial Sequence
  chemically synthesized
tacataggaaaggaaatatg

SEQ ID NO: 90252 - DNA, 20 bp, Artificial Sequence
  chemically synthesized
taattccatttacataggaa

SEQ ID NO: 90253 - DNA, 20 bp, Artificial Sequence
  chemically synthesized
ataattccatttacatagga

SEQ ID NO: 90254 - DNA, 20 bp, Artificial Sequence
  chemically synthesized
tatttcctttcctatgtaaa

SEQ ID NO: 90255 - DNA, 20 bp, Artificial Sequence
  chemically synthesized
accaataattccatttacat

SEQ ID NO: 90256 - DNA, 20 bp, Artificial Sequence
  chemically synthesized
gaccaataattccatttaca

SEQ ID NO: 90257 - DNA, 20 bp, Artificial Sequence
  chemically synthesized
tcctatgtaaatggaattat

SEQ ID NO: 90258 - DNA, 20 bp, Artificial Sequence
  chemically synthesized
ggaattattggtctctaaaa

SEQ ID NO: 90259 - DNA, 20 bp, Artificial Sequence
  chemically synthesized
gaattattggtctctaaaat

SEQ ID NO: 90260 - DNA, 20 bp, Artificial Sequence
  chemically synthesized
atttgctgagtcctatttta

SEQ ID NO: 90261 - DNA, 20 bp, Artificial Sequence
  chemically synthesized
tcatttgctgagtcctattt

SEQ ID NO: 90262 - DNA, 20 bp, Artificial Sequence
  chemically synthesized
ttggtctctaaaataggact

SEQ ID NO: 90263 - DNA, 20 bp, Artificial Sequence
  chemically synthesized
tggggaagttttcatttgct

SEQ ID NO: 90264 - DNA, 20 bp, Artificial Sequence
  chemically synthesized
tcagctatattaaaatgggg

SEQ ID NO: 90265 - DNA, 20 bp, Artificial Sequence
  chemically synthesized
ttctcagctatattaaaatg

SEQ ID NO: 90266 - DNA, 20 bp, Artificial Sequence
  chemically synthesized
cttctcagctatattaaaat

SEQ ID NO: 90267 - DNA, 20 bp, Artificial Sequence
  chemically synthesized
acttctcagctatattaaaa

SEQ ID NO: 90268 - DNA, 20 bp, Artificial Sequence
  chemically synthesized
aaaacttccccattttaata

SEQ ID NO: 90269 - DNA, 20 bp, Artificial Sequence
  chemically synthesized
ttccccattttaatatagct

SEQ ID NO: 90270 - DNA, 20 bp, Artificial Sequence
  chemically synthesized
cccattttaatatagctgag

SEQ ID NO: 90271 - DNA, 20 bp, Artificial Sequence
  chemically synthesized
ttttaatatagctgagaagt

SEQ ID NO: 90272 - DNA, 20 bp, Artificial Sequence
  chemically synthesized
tttaatatagctgagaagta

SEQ ID NO: 90273 - DNA, 20 bp, Artificial Sequence
  chemically synthesized
gtgtttgtttccttacttct

SEQ ID NO: 90274 - DNA, 20 bp, Artificial Sequence
  chemically synthesized
aagtaaggaaacaaacacaa

SEQ ID NO: 90275 - DNA, 20 bp, Artificial Sequence
  chemically synthesized
aggaaacaaacacaatggtg

SEQ ID NO: 90276 - DNA, 20 bp, Artificial Sequence
  chemically synthesized
aacaaacacaatggtgtaga

SEQ ID NO: 90277 - DNA, 20 bp, Artificial Sequence
  chemically synthesized
ggtgtagaaagaataacaat

SEQ ID NO: 90278 - DNA, 20 bp, Artificial Sequence
  chemically synthesized
ataaaattcttaaggagatt

SEQ ID NO: 90279 - DNA, 20 bp, Artificial Sequence
  chemically synthesized
ataagtgaccaaatctcctt

SEQ ID NO: 90280 - DNA, 20 bp, Artificial Sequence
  chemically synthesized
tctataataaaattcttaag

SEQ ID NO: 90281 - DNA, 20 bp, Artificial Sequence
  chemically synthesized
tgtctataataaaattctta

SEQ ID NO: 90282 - DNA, 20 bp, Artificial Sequence
  chemically synthesized
ctgtctataataaaattctt

SEQ ID NO: 90283 - DNA, 20 bp, Artificial Sequence
  chemically synthesized
tctccttaagaattttatta

SEQ ID NO: 90284 - DNA, 20 bp, Artificial Sequence
  chemically synthesized
cttaagaattttattataga

SEQ ID NO: 90285 - DNA, 20 bp, Artificial Sequence
  chemically synthesized
attatagacagattatctct

SEQ ID NO: 90286 - DNA, 20 bp, Artificial Sequence
  chemically synthesized
actgctttcagaaaagctta

SEQ ID NO: 90287 - DNA, 20 bp, Artificial Sequence
  chemically synthesized
taactgctttcagaaaagct

SEQ ID NO: 90288 - DNA, 20 bp, Artificial Sequence
  chemically synthesized
ttatctctaagcttttctga

SEQ ID NO: 90289 - DNA, 20 bp, Artificial Sequence
  chemically synthesized
tatactaactgctttcagaa

SEQ ID NO: 90290 - DNA, 20 bp, Artificial Sequence
  chemically synthesized
tctctaagcttttctgaaag

SEQ ID NO: 90291 - DNA, 20 bp, Artificial Sequence
  chemically synthesized
attcatatactaactgcttt

SEQ ID NO: 90292 - DNA, 20 bp, Artificial Sequence
  chemically synthesized
taagcttttctgaaagcagt

SEQ ID NO: 90293 - DNA, 20 bp, Artificial Sequence
  chemically synthesized
gttagtatatgaataattat

SEQ ID NO: 90294 - DNA, 20 bp, Artificial Sequence
  chemically synthesized
ttagtatatgaataattata

SEQ ID NO: 90295 - DNA, 20 bp, Artificial Sequence
  chemically synthesized
atgaataattataaggccat

SEQ ID NO: 90296 - DNA, 20 bp, Artificial Sequence
  chemically synthesized
tatcagtaaggaggaactaa

SEQ ID NO: 90297 - DNA, 20 bp, Artificial Sequence
  chemically synthesized
gataaaaattatcagtaagg

SEQ ID NO: 90298 - DNA, 20 bp, Artificial Sequence
  chemically synthesized
agataaaaattatcagtaag

SEQ ID NO: 90299 - DNA, 20 bp, Artificial Sequence
  chemically synthesized
ttagataaaaattatcagta

SEQ ID NO: 90300 - DNA, 20 bp, Artificial Sequence
  chemically synthesized
attagataaaaattatcagt

SEQ ID NO: 90301 - DNA, 20 bp, Artificial Sequence
  chemically synthesized
ttaaattagataaaaattat

SEQ ID NO: 90302 - DNA, 20 bp, Artificial Sequence
  chemically synthesized
cccatcaagctaatttaaat

SEQ ID NO: 90303 - DNA, 20 bp, Artificial Sequence
  chemically synthesized
aatttttatctaatttaaat

SEQ ID NO: 90304 - DNA, 20 bp, Artificial Sequence
  chemically synthesized
tctaatttaaattagcttga

SEQ ID NO: 90305 - DNA, 20 bp, Artificial Sequence
  chemically synthesized
ctaatttaaattagcttgat

SEQ ID NO: 90306 - DNA, 20 bp, Artificial Sequence
  chemically synthesized
agaccactttttttcccatc

SEQ ID NO: 90307 - DNA, 20 bp, Artificial Sequence
  chemically synthesized
aattagcttgatgggaaaaa

SEQ ID NO: 90308 - DNA, 20 bp, Artificial Sequence
  chemically synthesized
tagcttgatgggaaaaaaag

SEQ ID NO: 90309 - DNA, 20 bp, Artificial Sequence
  chemically synthesized
aaaaaagtggtctgatttct

SEQ ID NO: 90310 - DNA, 20 bp, Artificial Sequence
  chemically synthesized
ccttctaagttcttagaaat

SEQ ID NO: 90311 - DNA, 20 bp, Artificial Sequence
  chemically synthesized
tggtctgatttctaagaact

SEQ ID NO: 90312 - DNA, 20 bp, Artificial Sequence
  chemically synthesized
ttcctgaccttctaagttct

SEQ ID NO: 90313 - DNA, 20 bp, Artificial Sequence
  chemically synthesized
tctgatttctaagaacttag

SEQ ID NO: 90314 - DNA, 20 bp, Artificial Sequence
  chemically synthesized
ctgatttctaagaacttaga

SEQ ID NO: 90315 - DNA, 20 bp, Artificial Sequence
  chemically synthesized
tttctaagaacttagaaggt

SEQ ID NO: 90316 - DNA, 20 bp, Artificial Sequence
  chemically synthesized
ttgtatgttcctgaccttct

SEQ ID NO: 90317 - DNA, 20 bp, Artificial Sequence
  chemically synthesized
ttctaagaacttagaaggtc

SEQ ID NO: 90318 - DNA, 20 bp, Artificial Sequence
  chemically synthesized
caggaacatacaattcaaaa

SEQ ID NO: 90319 - DNA, 20 bp, Artificial Sequence
  chemically synthesized
acatacaattcaaaatagta

SEQ ID NO: 90320 - DNA, 20 bp, Artificial Sequence
  chemically synthesized
aatagtaaagaaattatcct

SEQ ID NO: 90321 - DNA, 20 bp, Artificial Sequence
  chemically synthesized
agtaaagaaattatcctaag

SEQ ID NO: 90322 - DNA, 20 bp, Artificial Sequence
  chemically synthesized
tactctcaatttagccactt

SEQ ID NO: 90323 - DNA, 20 bp, Artificial Sequence
  chemically synthesized
ctactctcaatttagccact

SEQ ID NO: 90324 - DNA, 20 bp, Artificial Sequence
  chemically synthesized
ttatcctaagtggctaaatt

SEQ ID NO: 90325 - DNA, 20 bp, Artificial Sequence
  chemically synthesized
atcctaagtggctaaattga

SEQ ID NO: 90326 - DNA, 20 bp, Artificial Sequence
  chemically synthesized
acttcttcctactctcaatt

SEQ ID NO: 90327 - DNA, 20 bp, Artificial Sequence
  chemically synthesized
ctaagtggctaaattgagag

SEQ ID NO: 90328 - DNA, 20 bp, Artificial Sequence
  chemically synthesized
taagtggctaaattgagagt

SEQ ID NO: 90329 - DNA, 20 bp, Artificial Sequence
  chemically synthesized
gtggctaaattgagagtagg

SEQ ID NO: 90330 - DNA, 20 bp, Artificial Sequence
  chemically synthesized
gctaaattgagagtaggaag

SEQ ID NO: 90331 - DNA, 20 bp, Artificial Sequence
  chemically synthesized
taggaagaagtgacacctta

SEQ ID NO: 90332 - DNA, 20 bp, Artificial Sequence
  chemically synthesized
ggaagaagtgacaccttaca

SEQ ID NO: 90333 - DNA, 20 bp, Artificial Sequence
  chemically synthesized
cacctttctgattctctgta

SEQ ID NO: 90334 - DNA, 20 bp, Artificial Sequence
  chemically synthesized
acacctttctgattctctgt

SEQ ID NO: 90335 - DNA, 20 bp, Artificial Sequence
  chemically synthesized
agtgacaccttacagagaat

SEQ ID NO: 90336 - DNA, 20 bp, Artificial Sequence
  chemically synthesized
acaccttacagagaatcaga

SEQ ID NO: 90337 - DNA, 20 bp, Artificial Sequence
  chemically synthesized
caccttacagagaatcagaa

SEQ ID NO: 90338 - DNA, 20 bp, Artificial Sequence
  chemically synthesized
agagaatcagaaaggtgtaa

SEQ ID NO: 90339 - DNA, 20 bp, Artificial Sequence
  chemically synthesized
gagaatcagaaaggtgtaaa

SEQ ID NO: 90340 - DNA, 20 bp, Artificial Sequence
  chemically synthesized
gaatcagaaaggtgtaaaag

SEQ ID NO: 90341 - DNA, 20 bp, Artificial Sequence
  chemically synthesized
gaaaggtgtaaaaggagcca

SEQ ID NO: 90342 - DNA, 20 bp, Artificial Sequence
  chemically synthesized
aaaggtgtaaaaggagccat

SEQ ID NO: 90343 - DNA, 20 bp, Artificial Sequence
  chemically synthesized
tggtcaattatgcatgccca

SEQ ID NO: 90344 - DNA, 20 bp, Artificial Sequence
  chemically synthesized
catgggcatgcataattgac

SEQ ID NO: 90345 - DNA, 20 bp, Artificial Sequence
  chemically synthesized
atgggcatgcataattgacc

SEQ ID NO: 90346 - DNA, 20 bp, Artificial Sequence
  chemically synthesized
tgggcatgcataattgacca

SEQ ID NO: 90347 - DNA, 20 bp, Artificial Sequence
  chemically synthesized
gtttccacactgtgtgaccc

SEQ ID NO: 90348 - DNA, 20 bp, Artificial Sequence
  chemically synthesized
cataattgaccagggtcaca

SEQ ID NO: 90349 - DNA, 20 bp, Artificial Sequence
  chemically synthesized
ttgaccagggtcacacagtg

SEQ ID NO: 90350 - DNA, 20 bp, Artificial Sequence
  chemically synthesized
tcacacagtgtggaaactaa

SEQ ID NO: 90351 - DNA, 20 bp, Artificial Sequence
  chemically synthesized
actgatgcatggagagctgt

SEQ ID NO: 90352 - DNA, 20 bp, Artificial Sequence
  chemically synthesized
aagggctactgatgcatgga

SEQ ID NO: 90353 - DNA, 20 bp, Artificial Sequence
  chemically synthesized
actaacagctctccatgcat

SEQ ID NO: 90354 - DNA, 20 bp, Artificial Sequence
  chemically synthesized
tcaagggctactgatgcatg

SEQ ID NO: 90355 - DNA, 20 bp, Artificial Sequence
  chemically synthesized
cttcaagggctactgatgca

SEQ ID NO: 90356 - DNA, 20 bp, Artificial Sequence
  chemically synthesized
aacagctctccatgcatcag

SEQ ID NO: 90357 - DNA, 20 bp, Artificial Sequence
  chemically synthesized
ccatgcatcagtagcccttg

SEQ ID NO: 90358 - DNA, 20 bp, Artificial Sequence
  chemically synthesized
catgcatcagtagcccttga

SEQ ID NO: 90359 - DNA, 20 bp, Artificial Sequence
  chemically synthesized
aaacgaggtgatgccttcaa

SEQ ID NO: 90360 - DNA, 20 bp, Artificial Sequence
  chemically synthesized
aaaacgaggtgatgccttca

SEQ ID NO: 90361 - DNA, 20 bp, Artificial Sequence
  chemically synthesized
taaaacgaggtgatgccttc

SEQ ID NO: 90362 - DNA, 20 bp, Artificial Sequence
  chemically synthesized
gaaggcatcacctcgtttta

SEQ ID NO: 90363 - DNA, 20 bp, Artificial Sequence
  chemically synthesized
ttttgcttcgctataaaacg

SEQ ID NO: 90364 - DNA, 20 bp, Artificial Sequence
  chemically synthesized
attttgcttcgctataaaac

SEQ ID NO: 90365 - DNA, 20 bp, Artificial Sequence
  chemically synthesized
catcacctcgttttatagcg

SEQ ID NO: 90366 - DNA, 20 bp, Artificial Sequence
  chemically synthesized
cgttttatagcgaagcaaaa

SEQ ID NO: 90367 - DNA, 20 bp, Artificial Sequence
  chemically synthesized
gaagcaaaatagttaatgct

SEQ ID NO: 90368 - DNA, 20 bp, Artificial Sequence
  chemically synthesized
aagcaaaatagttaatgctc

SEQ ID NO: 90369 - DNA, 20 bp, Artificial Sequence
  chemically synthesized
taattcagcatcatcatcct

SEQ ID NO: 90370 - DNA, 20 bp, Artificial Sequence
  chemically synthesized
tcaggatgatgatgctgaat

SEQ ID NO: 90371 - DNA, 20 bp, Artificial Sequence
  chemically synthesized
gatgatgatgctgaattagc

SEQ ID NO: 90372 - DNA, 20 bp, Artificial Sequence
  chemically synthesized
tctgctttccctggctaatt

SEQ ID NO: 90373 - DNA, 20 bp, Artificial Sequence
  chemically synthesized
atgatgatgctgaattagcc

SEQ ID NO: 90374 - DNA, 20 bp, Artificial Sequence
  chemically synthesized
tgatgatgctgaattagcca

SEQ ID NO: 90375 - DNA, 20 bp, Artificial Sequence
  chemically synthesized
gatgctgaattagccaggga

SEQ ID NO: 90376 - DNA, 20 bp, Artificial Sequence
  chemically synthesized
gctgaattagccagggaaag

SEQ ID NO: 90377 - DNA, 20 bp, Artificial Sequence
  chemically synthesized
gaatgtaaatctgctttccc

SEQ ID NO: 90378 - DNA, 20 bp, Artificial Sequence
  chemically synthesized
agggaaagcagatttacatt

SEQ ID NO: 90379 - DNA, 20 bp, Artificial Sequence
  chemically synthesized
acattcagtaaaatctgttt

SEQ ID NO: 90380 - DNA, 20 bp, Artificial Sequence
  chemically synthesized
ttcagtaaaatctgtttaag

SEQ ID NO: 90381 - DNA, 20 bp, Artificial Sequence
  chemically synthesized
tacactgctttcttcttaaa

SEQ ID NO: 90382 - DNA, 20 bp, Artificial Sequence
  chemically synthesized
gtaaaatctgtttaagaaga

SEQ ID NO: 90383 - DNA, 20 bp, Artificial Sequence
  chemically synthesized
aaatctgtttaagaagaaag

SEQ ID NO: 90384 - DNA, 20 bp, Artificial Sequence
  chemically synthesized
aacagtcatttggtcatttg

SEQ ID NO: 90385 - DNA, 20 bp, Artificial Sequence
  chemically synthesized
tgtatcaaataacagtcatt

SEQ ID NO: 90386 - DNA, 20 bp, Artificial Sequence
  chemically synthesized
aaaacaactgtatcaaataa

SEQ ID NO: 90387 - DNA, 20 bp, Artificial Sequence
  chemically synthesized
caaatgactgttatttgata

SEQ ID NO: 90388 - DNA, 20 bp, Artificial Sequence
  chemically synthesized
tttgatacagttgttttgaa

SEQ ID NO: 90389 - DNA, 20 bp, Artificial Sequence
  chemically synthesized
ttgatacagttgttttgaaa

SEQ ID NO: 90390 - DNA, 20 bp, Artificial Sequence
  chemically synthesized
aaacaaaaacaattatatga

SEQ ID NO: 90391 - DNA, 20 bp, Artificial Sequence
  chemically synthesized
caaaaacaattatatgaaag

SEQ ID NO: 90392 - DNA, 20 bp, Artificial Sequence
  chemically synthesized
atatgaaagtagaactccct

SEQ ID NO: 90393 - DNA, 20 bp, Artificial Sequence
  chemically synthesized
gttggataaccagtctaagg

SEQ ID NO: 90394 - DNA, 20 bp, Artificial Sequence
  chemically synthesized
aaagtagaactcccttagac

SEQ ID NO: 90395 - DNA, 20 bp, Artificial Sequence
  chemically synthesized
atgttggataaccagtctaa

SEQ ID NO: 90396 - DNA, 20 bp, Artificial Sequence
  chemically synthesized
catgttggataaccagtcta

SEQ ID NO: 90397 - DNA, 20 bp, Artificial Sequence
  chemically synthesized
tcatgttggataaccagtct

SEQ ID NO: 90398 - DNA, 20 bp, Artificial Sequence
  chemically synthesized
aatgagtcatgttggataac

SEQ ID NO: 90399 - DNA, 20 bp, Artificial Sequence
  chemically synthesized
tcatgtttaatgagtcatgt

SEQ ID NO: 90400 - DNA, 20 bp, Artificial Sequence
  chemically synthesized
atttagagctcatgtttaat

SEQ ID NO: 90401 - DNA, 20 bp, Artificial Sequence
  chemically synthesized
caacatgactcattaaacat

SEQ ID NO: 90402 - DNA, 20 bp, Artificial Sequence
  chemically synthesized
cattaaacatgagctctaaa

SEQ ID NO: 90403 - DNA, 20 bp, Artificial Sequence
  chemically synthesized
taaacatgagctctaaatag

SEQ ID NO: 90404 - DNA, 20 bp, Artificial Sequence
  chemically synthesized
tccaaaagctctactattta

SEQ ID NO: 90405 - DNA, 20 bp, Artificial Sequence
  chemically synthesized
aacatgagctctaaatagta

SEQ ID NO: 90406 - DNA, 20 bp, Artificial Sequence
  chemically synthesized
gctccaaaagctctactatt

SEQ ID NO: 90407 - DNA, 20 bp, Artificial Sequence
  chemically synthesized
gctctaaatagtagagcttt

SEQ ID NO: 90408 - DNA, 20 bp, Artificial Sequence
  chemically synthesized
tctaaatagtagagcttttg

SEQ ID NO: 90409 - DNA, 20 bp, Artificial Sequence
  chemically synthesized
tgtatgcaagtgtgctccaa

SEQ ID NO: 90410 - DNA, 20 bp, Artificial Sequence
  chemically synthesized
gtatacgtatgagtgtatgc

SEQ ID NO: 90411 - DNA, 20 bp, Artificial Sequence
  chemically synthesized
ttctgtgtgtgtatacgtat

SEQ ID NO: 90412 - DNA, 20 bp, Artificial Sequence
  chemically synthesized
cactcatacgtatacacaca

SEQ ID NO: 90413 - DNA, 20 bp, Artificial Sequence
  chemically synthesized
tacgtatacacacacagaaa

SEQ ID NO: 90414 - DNA, 20 bp, Artificial Sequence
  chemically synthesized
gaaacagatattctattatg

SEQ ID NO: 90415 - DNA, 20 bp, Artificial Sequence
  chemically synthesized
ctgttcttatgtcttcataa

SEQ ID NO: 90416 - DNA, 20 bp, Artificial Sequence
  chemically synthesized
atattctattatgaagacat

SEQ ID NO: 90417 - DNA, 20 bp, Artificial Sequence
  chemically synthesized
ctattatgaagacataagaa

SEQ ID NO: 90418 - DNA, 20 bp, Artificial Sequence
  chemically synthesized
gacataagaacagaaattga

SEQ ID NO: 90419 - DNA, 20 bp, Artificial Sequence
  chemically synthesized
agaaattgaaagcaaatctt

SEQ ID NO: 90420 - DNA, 20 bp, Artificial Sequence
  chemically synthesized
gattgctgtacacgtttcta

SEQ ID NO: 90421 - DNA, 20 bp, Artificial Sequence
  chemically synthesized
caaatctttagaaacgtgta

SEQ ID NO: 90422 - DNA, 20 bp, Artificial Sequence
  chemically synthesized
aagccgatgctttttatttt

SEQ ID NO: 90423 - DNA, 20 bp, Artificial Sequence
  chemically synthesized
tacagcaatctaaaaataaa

SEQ ID NO: 90424 - DNA, 20 bp, Artificial Sequence
  chemically synthesized
aatctaaaaataaaaagcat

SEQ ID NO: 90425 - DNA, 20 bp, Artificial Sequence
  chemically synthesized
ataccagacatacaaaattt

SEQ ID NO: 90426 - DNA, 20 bp, Artificial Sequence
  chemically synthesized
cggcttaaattttgtatgtc

SEQ ID NO: 90427 - DNA, 20 bp, Artificial Sequence
  chemically synthesized
attttaaaaattacaaatac

SEQ ID NO: 90428 - DNA, 20 bp, Artificial Sequence
  chemically synthesized
atttttattgcatgttacaa

SEQ ID NO: 90429 - DNA, 20 bp, Artificial Sequence
  chemically synthesized
attgcatgttacaaaagtat

SEQ ID NO: 90430 - DNA, 20 bp, Artificial Sequence
  chemically synthesized
acaaaagtatcagtctatta

SEQ ID NO: 90431 - DNA, 20 bp, Artificial Sequence
  chemically synthesized
ttttaattcccaatccataa

SEQ ID NO: 90432 - DNA, 20 bp, Artificial Sequence
  chemically synthesized
agtatcagtctattatggat

SEQ ID NO: 90433 - DNA, 20 bp, Artificial Sequence
  chemically synthesized
gtatcagtctattatggatt

SEQ ID NO: 90434 - DNA, 20 bp, Artificial Sequence
  chemically synthesized
tatggattgggaattaaaac

SEQ ID NO: 90435 - DNA, 20 bp, Artificial Sequence
  chemically synthesized
aaaaaaaaaaaaaaaacccg

SEQ ID NO: 90436 - DNA, 20 bp, Artificial Sequence
  chemically synthesized
aaaaaaaaaaaaacccgaag

SEQ ID NO: 90437 - DNA, 20 bp, Artificial Sequence
  chemically synthesized
tgttaggaaagatccacttc

SEQ ID NO: 90438 - DNA, 20 bp, Artificial Sequence
  chemically synthesized
ttgttaggaaagatccactt

SEQ ID NO: 90439 - DNA, 20 bp, Artificial Sequence
  chemically synthesized
cgaagtggatctttcctaac

SEQ ID NO: 90440 - DNA, 20 bp, Artificial Sequence
  chemically synthesized
tctcgaaaaacttgttagga

SEQ ID NO: 90441 - DNA, 20 bp, Artificial Sequence
  chemically synthesized
ttcttctcgaaaaacttgtt

SEQ ID NO: 90442 - DNA, 20 bp, Artificial Sequence
  chemically synthesized
attcttctcgaaaaacttgt

SEQ ID NO: 90443 - DNA, 20 bp, Artificial Sequence
  chemically synthesized
tctttcctaacaagtttttc

SEQ ID NO: 90444 - DNA, 20 bp, Artificial Sequence
  chemically synthesized
ttcctaacaagtttttcgag

SEQ ID NO: 90445 - DNA, 20 bp, Artificial Sequence
  chemically synthesized
agtttttcgagaagaatcca

SEQ ID NO: 90446 - DNA, 20 bp, Artificial Sequence
  chemically synthesized
gtttttcgagaagaatccat

SEQ ID NO: 90447 - DNA, 20 bp, Artificial Sequence
  chemically synthesized
tttcgagaagaatccatagg

SEQ ID NO: 90448 - DNA, 20 bp, Artificial Sequence
  chemically synthesized
gtgggtccaatttcttccta

SEQ ID NO: 90449 - DNA, 20 bp, Artificial Sequence
  chemically synthesized
aagaatccataggaagaaat

SEQ ID NO: 90450 - DNA, 20 bp, Artificial Sequence
  chemically synthesized
ataggaagaaattggaccca

SEQ ID NO: 90451 - DNA, 20 bp, Artificial Sequence
  chemically synthesized
agaaattggacccacagtct

SEQ ID NO: 90452 - DNA, 20 bp, Artificial Sequence
  chemically synthesized
cctgataaggccaagactgt

SEQ ID NO: 90453 - DNA, 20 bp, Artificial Sequence
  chemically synthesized
tcctgataaggccaagactg

SEQ ID NO: 90454 - DNA, 20 bp, Artificial Sequence
  chemically synthesized
attagaatcctgataaggcc

SEQ ID NO: 90455 - DNA, 20 bp, Artificial Sequence
  chemically synthesized
acccacagtcttggccttat

SEQ ID NO: 90456 - DNA, 20 bp, Artificial Sequence
  chemically synthesized
cccacagtcttggccttatc

SEQ ID NO: 90457 - DNA, 20 bp, Artificial Sequence
  chemically synthesized
gttagattagaatcctgata

SEQ ID NO: 90458 - DNA, 20 bp, Artificial Sequence
  chemically synthesized
ggttagattagaatcctgat

SEQ ID NO: 90459 - DNA, 20 bp, Artificial Sequence
  chemically synthesized
ggaacctccggtggttagat

SEQ ID NO: 90460 - DNA, 20 bp, Artificial Sequence
  chemically synthesized
caggattctaatctaaccac

SEQ ID NO: 90461 - DNA, 20 bp, Artificial Sequence
  chemically synthesized
ggattctaatctaaccaccg

SEQ ID NO: 90462 - DNA, 20 bp, Artificial Sequence
  chemically synthesized
ggttaggaacctccggtggt

SEQ ID NO: 90463 - DNA, 20 bp, Artificial Sequence
  chemically synthesized
gattctaatctaaccaccgg

SEQ ID NO: 90464 - DNA, 20 bp, Artificial Sequence
  chemically synthesized
atctggttaggaacctccgg

SEQ ID NO: 90465 - DNA, 20 bp, Artificial Sequence
  chemically synthesized
ctgatctggttaggaacctc

SEQ ID NO: 90466 - DNA, 20 bp, Artificial Sequence
  chemically synthesized
aaccaccggaggttcctaac

SEQ ID NO: 90467 - DNA, 20 bp, Artificial Sequence
  chemically synthesized
ctgcattttctgatctggtt

SEQ ID NO: 90468 - DNA, 20 bp, Artificial Sequence
  chemically synthesized
ccggaggttcctaaccagat

SEQ ID NO: 90469 - DNA, 20 bp, Artificial Sequence
  chemically synthesized
actgcattttctgatctggt

SEQ ID NO: 90470 - DNA, 20 bp, Artificial Sequence
  chemically synthesized
tccaactgcattttctgatc

SEQ ID NO: 90471 - DNA, 20 bp, Artificial Sequence
  chemically synthesized
cctaaccagatcagaaaatg

SEQ ID NO: 90472 - DNA, 20 bp, Artificial Sequence
  chemically synthesized
accagatcagaaaatgcagt

SEQ ID NO: 90473 - DNA, 20 bp, Artificial Sequence
  chemically synthesized
tcagaaaatgcagttggata

SEQ ID NO: 90474 - DNA, 20 bp, Artificial Sequence
  chemically synthesized
gcagttggatacagactcac

SEQ ID NO: 90475 - DNA, 20 bp, Artificial Sequence
  chemically synthesized
agttggatacagactcacaa

SEQ ID NO: 90476 - DNA, 20 bp, Artificial Sequence
  chemically synthesized
gttggatacagactcacaag

SEQ ID NO: 90477 - DNA, 20 bp, Artificial Sequence
  chemically synthesized
ttggatacagactcacaaga

SEQ ID NO: 90478 - DNA, 20 bp, Artificial Sequence
  chemically synthesized
aaacagtcacaccctcttgt

SEQ ID NO: 90479 - DNA, 20 bp, Artificial Sequence
  chemically synthesized
tagaataagaagggaaaaaa

SEQ ID NO: 90480 - DNA, 20 bp, Artificial Sequence
  chemically synthesized
ggccacatatagaataagaa

SEQ ID NO: 90481 - DNA, 20 bp, Artificial Sequence
  chemically synthesized
tggccacatatagaataaga

SEQ ID NO: 90482 - DNA, 20 bp, Artificial Sequence
  chemically synthesized
gtggccacatatagaataag

SEQ ID NO: 90483 - DNA, 20 bp, Artificial Sequence
  chemically synthesized
tgcgtggccacatatagaat

SEQ ID NO: 90484 - DNA, 20 bp, Artificial Sequence
  chemically synthesized
ttcccttcttattctatatg

SEQ ID NO: 90485 - DNA, 20 bp, Artificial Sequence
  chemically synthesized
aggtgttgcgtggccacata

SEQ ID NO: 90486 - DNA, 20 bp, Artificial Sequence
  chemically synthesized
ctgcttttaaaggtgttgcg

SEQ ID NO: 90487 - DNA, 20 bp, Artificial Sequence
  chemically synthesized
tggccacgcaacacctttaa

SEQ ID NO: 90488 - DNA, 20 bp, Artificial Sequence
  chemically synthesized
ccacgcaacacctttaaaag

SEQ ID NO: 90489 - DNA, 20 bp, Artificial Sequence
  chemically synthesized
gacaactctgctgcttttaa

SEQ ID NO: 90490 - DNA, 20 bp, Artificial Sequence
  chemically synthesized
cgacaactctgctgctttta

SEQ ID NO: 90491 - DNA, 20 bp, Artificial Sequence
  chemically synthesized
cgcaacacctttaaaagcag

SEQ ID NO: 90492 - DNA, 20 bp, Artificial Sequence
  chemically synthesized
caacacctttaaaagcagca

SEQ ID NO: 90493 - DNA, 20 bp, Artificial Sequence
  chemically synthesized
agcagcagagttgtcgtccc

SEQ ID NO: 90494 - DNA, 20 bp, Artificial Sequence
  chemically synthesized
cagcagagttgtcgtcccaa

SEQ ID NO: 90495 - DNA, 20 bp, Artificial Sequence
  chemically synthesized
aattaactcttgtttctctt

SEQ ID NO: 90496 - DNA, 20 bp, Artificial Sequence
  chemically synthesized
aaattaactcttgtttctct

SEQ ID NO: 90497 - DNA, 20 bp, Artificial Sequence
  chemically synthesized
gttgtcgtcccaagagaaac

SEQ ID NO: 90498 - DNA, 20 bp, Artificial Sequence
  chemically synthesized
tgtcgtcccaagagaaacaa

SEQ ID NO: 90499 - DNA, 20 bp, Artificial Sequence
  chemically synthesized
agagaaacaagagttaattt

SEQ ID NO: 90500 - DNA, 20 bp, Artificial Sequence
  chemically synthesized
gagaaacaagagttaatttg

SEQ ID NO: 90501 - DNA, 20 bp, Artificial Sequence
  chemically synthesized
ttaatttgaggactgctgtt

SEQ ID NO: 90502 - DNA, 20 bp, Artificial Sequence
  chemically synthesized
ccaggctccaagccaaacag

SEQ ID NO: 90503 - DNA, 20 bp, Artificial Sequence
  chemically synthesized
ttgaggactgctgtttggct

SEQ ID NO: 90504 - DNA, 20 bp, Artificial Sequence
  chemically synthesized
caaccaggctccaagccaaa

SEQ ID NO: 90505 - DNA, 20 bp, Artificial Sequence
  chemically synthesized
gaggactgctgtttggcttg

SEQ ID NO: 90506 - DNA, 20 bp, Artificial Sequence
  chemically synthesized
ctgctgtttggcttggagcc

SEQ ID NO: 90507 - DNA, 20 bp, Artificial Sequence
  chemically synthesized
acctagagcaaccaggctcc

SEQ ID NO: 90508 - DNA, 20 bp, Artificial Sequence
  chemically synthesized
cttatctacctagagcaacc

SEQ ID NO: 90509 - DNA, 20 bp, Artificial Sequence
  chemically synthesized
ggcttggagcctggttgctc

SEQ ID NO: 90510 - DNA, 20 bp, Artificial Sequence
  chemically synthesized
ccttatctacctagagcaac

SEQ ID NO: 90511 - DNA, 20 bp, Artificial Sequence
  chemically synthesized
gcttggagcctggttgctct

SEQ ID NO: 90512 - DNA, 20 bp, Artificial Sequence
  chemically synthesized
tggagcctggttgctctagg

SEQ ID NO: 90513 - DNA, 20 bp, Artificial Sequence
  chemically synthesized
acatactccttatctaccta

SEQ ID NO: 90514 - DNA, 20 bp, Artificial Sequence
  chemically synthesized
cctggttgctctaggtagat

SEQ ID NO: 90515 - DNA, 20 bp, Artificial Sequence
  chemically synthesized
aaacatactccttatctacc

SEQ ID NO: 90516 - DNA, 20 bp, Artificial Sequence
  chemically synthesized
ctggttgctctaggtagata

SEQ ID NO: 90517 - DNA, 20 bp, Artificial Sequence
  chemically synthesized
ggttgctctaggtagataag

SEQ ID NO: 90518 - DNA, 20 bp, Artificial Sequence
  chemically synthesized
gtagataaggagtatgtttt

SEQ ID NO: 90519 - DNA, 20 bp, Artificial Sequence
  chemically synthesized
tagataaggagtatgttttc

SEQ ID NO: 90520 - DNA, 20 bp, Artificial Sequence
  chemically synthesized
taagatgcaacgcaatgcag

SEQ ID NO: 90521 - DNA, 20 bp, Artificial Sequence
  chemically synthesized
gtttaagatgcaacgcaatg

SEQ ID NO: 90522 - DNA, 20 bp, Artificial Sequence
  chemically synthesized
cattgcgttgcatcttaaac

SEQ ID NO: 90523 - DNA, 20 bp, Artificial Sequence
  chemically synthesized
tgcgttgcatcttaaacgag

SEQ ID NO: 90524 - DNA, 20 bp, Artificial Sequence
  chemically synthesized
aaatccatagctgctcgttt

SEQ ID NO: 90525 - DNA, 20 bp, Artificial Sequence
  chemically synthesized
gcatcttaaacgagcagcta

SEQ ID NO: 90526 - DNA, 20 bp, Artificial Sequence
  chemically synthesized
taaacgagcagctatggatt

SEQ ID NO: 90527 - DNA, 20 bp, Artificial Sequence
  chemically synthesized
aaacgagcagctatggattt

SEQ ID NO: 90528 - DNA, 20 bp, Artificial Sequence
  chemically synthesized
cctgtggactcctaaatcca

SEQ ID NO: 90529 - DNA, 20 bp, Artificial Sequence
  chemically synthesized
acgagcagctatggatttag

SEQ ID NO: 90530 - DNA, 20 bp, Artificial Sequence
  chemically synthesized
gctatggatttaggagtcca

SEQ ID NO: 90531 - DNA, 20 bp, Artificial Sequence
  chemically synthesized
ctatggatttaggagtccac

SEQ ID NO: 90532 - DNA, 20 bp, Artificial Sequence
  chemically synthesized
cgtttttaaagcaaagcctg

SEQ ID NO: 90533 - DNA, 20 bp, Artificial Sequence
  chemically synthesized
taacagccgtttttaaagca

SEQ ID NO: 90534 - DNA, 20 bp, Artificial Sequence
  chemically synthesized
cacaggctttgctttaaaaa

SEQ ID NO: 90535 - DNA, 20 bp, Artificial Sequence
  chemically synthesized
tttaataacagccgttttta

SEQ ID NO: 90536 - DNA, 20 bp, Artificial Sequence
  chemically synthesized
tttaaaaacggctgttatta

SEQ ID NO: 90537 - DNA, 20 bp, Artificial Sequence
  chemically synthesized
gtctctgaggactttaataa

SEQ ID NO: 90538 - DNA, 20 bp, Artificial Sequence
  chemically synthesized
acggctgttattaaagtcct

SEQ ID NO: 90539 - DNA, 20 bp, Artificial Sequence
  chemically synthesized
ggctgttattaaagtcctca

SEQ ID NO: 90540 - DNA, 20 bp, Artificial Sequence
  chemically synthesized
ctgcaggataatagtctctg

SEQ ID NO: 90541 - DNA, 20 bp, Artificial Sequence
  chemically synthesized
cctgcaggataatagtctct

SEQ ID NO: 90542 - DNA, 20 bp, Artificial Sequence
  chemically synthesized
caacaaaccctgcaggataa

SEQ ID NO: 90543 - DNA, 20 bp, Artificial Sequence
  chemically synthesized
cctcagagactattatcctg

SEQ ID NO: 90544 - DNA, 20 bp, Artificial Sequence
  chemically synthesized
ctcagagactattatcctgc

SEQ ID NO: 90545 - DNA, 20 bp, Artificial Sequence
  chemically synthesized
tcagagactattatcctgca

SEQ ID NO: 90546 - DNA, 20 bp, Artificial Sequence
  chemically synthesized
gcaaagacaacaaaccctgc

SEQ ID NO: 90547 - DNA, 20 bp, Artificial Sequence
  chemically synthesized
agcaaagacaacaaaccctg

SEQ ID NO: 90548 - DNA, 20 bp, Artificial Sequence
  chemically synthesized
tcgaatgagatatgaaagca

SEQ ID NO: 90549 - DNA, 20 bp, Artificial Sequence
  chemically synthesized
aattttcgaatgagatatga

SEQ ID NO: 90550 - DNA, 20 bp, Artificial Sequence
  chemically synthesized
aagtgtgagaattttcgaat

SEQ ID NO: 90551 - DNA, 20 bp, Artificial Sequence
  chemically synthesized
attcgaaaattctcacactt

SEQ ID NO: 90552 - DNA, 20 bp, Artificial Sequence
  chemically synthesized
ctgttgcagtgcttaagtgt

SEQ ID NO: 90553 - DNA, 20 bp, Artificial Sequence
  chemically synthesized
tctctgctgttgcagtgctt

SEQ ID NO: 90554 - DNA, 20 bp, Artificial Sequence
  chemically synthesized
ctcacacttaagcactgcaa

SEQ ID NO: 90555 - DNA, 20 bp, Artificial Sequence
  chemically synthesized
acacttaagcactgcaacag

SEQ ID NO: 90556 - DNA, 20 bp, Artificial Sequence
  chemically synthesized
atcccttctctctgctgttg

SEQ ID NO: 90557 - DNA, 20 bp, Artificial Sequence
  chemically synthesized
acttaagcactgcaacagca

SEQ ID NO: 90558 - DNA, 20 bp, Artificial Sequence
  chemically synthesized
ttaagcactgcaacagcaga

SEQ ID NO: 90559 - DNA, 20 bp, Artificial Sequence
  chemically synthesized
agcactgcaacagcagagag

SEQ ID NO: 90560 - DNA, 20 bp, Artificial Sequence
  chemically synthesized
gcactgcaacagcagagaga

SEQ ID NO: 90561 - DNA, 20 bp, Artificial Sequence
  chemically synthesized
cactgcaacagcagagagaa

SEQ ID NO: 90562 - DNA, 20 bp, Artificial Sequence
  chemically synthesized
agagaagggatatgctctct

SEQ ID NO: 90563 - DNA, 20 bp, Artificial Sequence
  chemically synthesized
gaagggatatgctctctcag

SEQ ID NO: 90564 - DNA, 20 bp, Artificial Sequence
  chemically synthesized
aagggatatgctctctcagc

SEQ ID NO: 90565 - DNA, 20 bp, Artificial Sequence
  chemically synthesized
atcccttctccctgctgaga

SEQ ID NO: 90566 - DNA, 20 bp, Artificial Sequence
  chemically synthesized
agggatatgctctctcagca

SEQ ID NO: 90567 - DNA, 20 bp, Artificial Sequence
  chemically synthesized
atatcccttctccctgctga

SEQ ID NO: 90568 - DNA, 20 bp, Artificial Sequence
  chemically synthesized
ggatatgctctctcagcagg

SEQ ID NO: 90569 - DNA, 20 bp, Artificial Sequence
  chemically synthesized
gcatatcccttctccctgct

SEQ ID NO: 90570 - DNA, 20 bp, Artificial Sequence
  chemically synthesized
tatgctctctcagcagggag

SEQ ID NO: 90571 - DNA, 20 bp, Artificial Sequence
  chemically synthesized
atgctctctcagcagggaga

SEQ ID NO: 90572 - DNA, 20 bp, Artificial Sequence
  chemically synthesized
tgctctctcagcagggagaa

SEQ ID NO: 90573 - DNA, 20 bp, Artificial Sequence
  chemically synthesized
gggaatatactgaggcaaga

SEQ ID NO: 90574 - DNA, 20 bp, Artificial Sequence
  chemically synthesized
agggatatgctttcttgcct

SEQ ID NO: 90575 - DNA, 20 bp, Artificial Sequence
  chemically synthesized
acttgggaatatactgaggc

SEQ ID NO: 90576 - DNA, 20 bp, Artificial Sequence
  chemically synthesized
ttgcacttgggaatatactg

SEQ ID NO: 90577 - DNA, 20 bp, Artificial Sequence
  chemically synthesized
tttgcacttgggaatatact

SEQ ID NO: 90578 - DNA, 20 bp, Artificial Sequence
  chemically synthesized
tcttgcctcagtatattccc

SEQ ID NO: 90579 - DNA, 20 bp, Artificial Sequence
  chemically synthesized
tcagtatattcccaagtgca

SEQ ID NO: 90580 - DNA, 20 bp, Artificial Sequence
  chemically synthesized
tgaaatgaagctttgcactt

SEQ ID NO: 90581 - DNA, 20 bp, Artificial Sequence
  chemically synthesized
ttgaaatgaagctttgcact

SEQ ID NO: 90582 - DNA, 20 bp, Artificial Sequence
  chemically synthesized
aaagattagattttgaaatg

SEQ ID NO: 90583 - DNA, 20 bp, Artificial Sequence
  chemically synthesized
ggccaggcatttttaaagat

SEQ ID NO: 90584 - DNA, 20 bp, Artificial Sequence
  chemically synthesized
ccctaggccaggcattttta

SEQ ID NO: 90585 - DNA, 20 bp, Artificial Sequence
  chemically synthesized
atctaatctttaaaaatgcc

SEQ ID NO: 90586 - DNA, 20 bp, Artificial Sequence
  chemically synthesized
atctttaaaaatgcctggcc

SEQ ID NO: 90587 - DNA, 20 bp, Artificial Sequence
  chemically synthesized
tctttaaaaatgcctggcct

SEQ ID NO: 90588 - DNA, 20 bp, Artificial Sequence
  chemically synthesized
ctttaaaaatgcctggccta

SEQ ID NO: 90589 - DNA, 20 bp, Artificial Sequence
  chemically synthesized
ggggtaatccaccctaggcc

SEQ ID NO: 90590 - DNA, 20 bp, Artificial Sequence
  chemically synthesized
gggggtaatccaccctaggc

SEQ ID NO: 90591 - DNA, 20 bp, Artificial Sequence
  chemically synthesized
taaaaatgcctggcctaggg

SEQ ID NO: 90592 - DNA, 20 bp, Artificial Sequence
  chemically synthesized
ctccgggggtaatccaccct

SEQ ID NO: 90593 - DNA, 20 bp, Artificial Sequence
  chemically synthesized
cctccgggggtaatccaccc

SEQ ID NO: 90594 - DNA, 20 bp, Artificial Sequence
  chemically synthesized
ggcctagggtggattacccc

SEQ ID NO: 90595 - DNA, 20 bp, Artificial Sequence
  chemically synthesized
cctagggtggattacccccg

SEQ ID NO: 90596 - DNA, 20 bp, Artificial Sequence
  chemically synthesized
ctagggtggattacccccgg

SEQ ID NO: 90597 - DNA, 20 bp, Artificial Sequence
  chemically synthesized
ggtttgacagtttcctccgg

SEQ ID NO: 90598 - DNA, 20 bp, Artificial Sequence
  chemically synthesized
cggtttgacagtttcctccg

SEQ ID NO: 90599 - DNA, 20 bp, Artificial Sequence
  chemically synthesized
gcggtttgacagtttcctcc

SEQ ID NO: 90600 - DNA, 20 bp, Artificial Sequence
  chemically synthesized
ggcggtttgacagtttcctc

SEQ ID NO: 90601 - DNA, 20 bp, Artificial Sequence
  chemically synthesized
gattgcttaaggcggtttga

SEQ ID NO: 90602 - DNA, 20 bp, Artificial Sequence
  chemically synthesized
ggaaactgtcaaaccgcctt

SEQ ID NO: 90603 - DNA, 20 bp, Artificial Sequence
  chemically synthesized
gagttcgggattgcttaagg

SEQ ID NO: 90604 - DNA, 20 bp, Artificial Sequence
  chemically synthesized
ccagagttcgggattgctta

SEQ ID NO: 90605 - DNA, 20 bp, Artificial Sequence
  chemically synthesized
accagagttcgggattgctt

SEQ ID NO: 90606 - DNA, 20 bp, Artificial Sequence
  chemically synthesized
ccttaagcaatcccgaactc

SEQ ID NO: 90607 - DNA, 20 bp, Artificial Sequence
  chemically synthesized
atcacgtattaccagagttc

SEQ ID NO: 90608 - DNA, 20 bp, Artificial Sequence
  chemically synthesized
catcacgtattaccagagtt

SEQ ID NO: 90609 - DNA, 20 bp, Artificial Sequence
  chemically synthesized
gaaagcatcacgtattacca

SEQ ID NO: 90610 - DNA, 20 bp, Artificial Sequence
  chemically synthesized
gagaaagcatcacgtattac

SEQ ID NO: 90611 - DNA, 20 bp, Artificial Sequence
  chemically synthesized
gagggtcacacaaggagaga

SEQ ID NO: 90612 - DNA, 20 bp, Artificial Sequence
  chemically synthesized
gtcagagggtcacacaagga

SEQ ID NO: 90613 - DNA, 20 bp, Artificial Sequence
  chemically synthesized
gagtcagagggtcacacaag

SEQ ID NO: 90614 - DNA, 20 bp, Artificial Sequence
  chemically synthesized
tggagtcagagggtcacaca

SEQ ID NO: 90615 - DNA, 20 bp, Artificial Sequence
  chemically synthesized
atggagtcagagggtcacac

SEQ ID NO: 90616 - DNA, 20 bp, Artificial Sequence
  chemically synthesized
atcttaagaatggagtcaga

SEQ ID NO: 90617 - DNA, 20 bp, Artificial Sequence
  chemically synthesized
aatcttaagaatggagtcag

SEQ ID NO: 90618 - DNA, 20 bp, Artificial Sequence
  chemically synthesized
taatcttaagaatggagtca

SEQ ID NO: 90619 - DNA, 20 bp, Artificial Sequence
  chemically synthesized
ggtaatcttaagaatggagt

SEQ ID NO: 90620 - DNA, 20 bp, Artificial Sequence
  chemically synthesized
gaccctctgactccattctt

SEQ ID NO: 90621 - DNA, 20 bp, Artificial Sequence
  chemically synthesized
aaaaggtaatcttaagaatg

SEQ ID NO: 90622 - DNA, 20 bp, Artificial Sequence
  chemically synthesized
ttaaaaggtaatcttaagaa

SEQ ID NO: 90623 - DNA, 20 bp, Artificial Sequence
  chemically synthesized
cagttttaaaaggtaatctt

SEQ ID NO: 90624 - DNA, 20 bp, Artificial Sequence
  chemically synthesized
atgaactcatcagttttaaa

SEQ ID NO: 90625 - DNA, 20 bp, Artificial Sequence
  chemically synthesized
aatgaactcatcagttttaa

SEQ ID NO: 90626 - DNA, 20 bp, Artificial Sequence
  chemically synthesized
gattaccttttaaaactgat

SEQ ID NO: 90627 - DNA, 20 bp, Artificial Sequence
  chemically synthesized
gagatcttaaatgaactcat

SEQ ID NO: 90628 - DNA, 20 bp, Artificial Sequence
  chemically synthesized
taaaactgatgagttcattt

SEQ ID NO: 90629 - DNA, 20 bp, Artificial Sequence
  chemically synthesized
tgagttcatttaagatctcc

SEQ ID NO: 90630 - DNA, 20 bp, Artificial Sequence
  chemically synthesized
gagttcatttaagatctcct

SEQ ID NO: 90631 - DNA, 20 bp, Artificial Sequence
  chemically synthesized
tcatttaagatctcctaggt

SEQ ID NO: 90632 - DNA, 20 bp, Artificial Sequence
  chemically synthesized
tcatcttacttccaacctag

SEQ ID NO: 90633 - DNA, 20 bp, Artificial Sequence
  chemically synthesized
tttaagatctcctaggttgg

SEQ ID NO: 90634 - DNA, 20 bp, Artificial Sequence
  chemically synthesized
tctcatcttacttccaacct

SEQ ID NO: 90635 - DNA, 20 bp, Artificial Sequence
  chemically synthesized
ctctcatcttacttccaacc

SEQ ID NO: 90636 - DNA, 20 bp, Artificial Sequence
  chemically synthesized
agatctcctaggttggaagt

SEQ ID NO: 90637 - DNA, 20 bp, Artificial Sequence
  chemically synthesized
tcctaggttggaagtaagat

SEQ ID NO: 90638 - DNA, 20 bp, Artificial Sequence
  chemically synthesized
ctaggttggaagtaagatga

SEQ ID NO: 90639 - DNA, 20 bp, Artificial Sequence
  chemically synthesized
taggttggaagtaagatgag

SEQ ID NO: 90640 - DNA, 20 bp, Artificial Sequence
  chemically synthesized
aaaacaagacgtagatgaga

SEQ ID NO: 90641 - DNA, 20 bp, Artificial Sequence
  chemically synthesized
aggaaaaacaagacgtagat

SEQ ID NO: 90642 - DNA, 20 bp, Artificial Sequence
  chemically synthesized
aaactaggaaaaacaagacg

SEQ ID NO: 90643 - DNA, 20 bp, Artificial Sequence
  chemically synthesized
gagaagaaactaggaaaaac

SEQ ID NO: 90644 - DNA, 20 bp, Artificial Sequence
  chemically synthesized
catctacgtcttgtttttcc

SEQ ID NO: 90645 - DNA, 20 bp, Artificial Sequence
  chemically synthesized
tgactggatgagaagaaact

SEQ ID NO: 90646 - DNA, 20 bp, Artificial Sequence
  chemically synthesized
gtgactggatgagaagaaac

SEQ ID NO: 90647 - DNA, 20 bp, Artificial Sequence
  chemically synthesized
tttcctagtttcttctcatc

SEQ ID NO: 90648 - DNA, 20 bp, Artificial Sequence
  chemically synthesized
ttgcattgtgactggatgag

SEQ ID NO: 90649 - DNA, 20 bp, Artificial Sequence
  chemically synthesized
tttttgcattgtgactggat

SEQ ID NO: 90650 - DNA, 20 bp, Artificial Sequence
  chemically synthesized
gggaatttttgcattgtgac

SEQ ID NO: 90651 - DNA, 20 bp, Artificial Sequence
  chemically synthesized
tttgtgatgaataaatattc

SEQ ID NO: 90652 - DNA, 20 bp, Artificial Sequence
  chemically synthesized
ttttgtgatgaataaatatt

SEQ ID NO: 90653 - DNA, 20 bp, Artificial Sequence
  chemically synthesized
tcatcacaaaaatgtgcatt

SEQ ID NO: 90654 - DNA, 20 bp, Artificial Sequence
  chemically synthesized
cctacttatagacatacaat

SEQ ID NO: 90655 - DNA, 20 bp, Artificial Sequence
  chemically synthesized
ccctacttatagacatacaa

SEQ ID NO: 90656 - DNA, 20 bp, Artificial Sequence
  chemically synthesized
agtacctattgtatgtctat

SEQ ID NO: 90657 - DNA, 20 bp, Artificial Sequence
  chemically synthesized
acctattgtatgtctataag

SEQ ID NO: 90658 - DNA, 20 bp, Artificial Sequence
  chemically synthesized
cctattgtatgtctataagt

SEQ ID NO: 90659 - DNA, 20 bp, Artificial Sequence
  chemically synthesized
ctattgtatgtctataagta

SEQ ID NO: 90660 - DNA, 20 bp, Artificial Sequence
  chemically synthesized
ggtattatcggccctactta

SEQ ID NO: 90661 - DNA, 20 bp, Artificial Sequence
  chemically synthesized
ccttaaaaggtaggtattat

SEQ ID NO: 90662 - DNA, 20 bp, Artificial Sequence
  chemically synthesized
gccgataatacctacctttt

SEQ ID NO: 90663 - DNA, 20 bp, Artificial Sequence
  chemically synthesized
ttgccaaaaccttaaaaggt

SEQ ID NO: 90664 - DNA, 20 bp, Artificial Sequence
  chemically synthesized
ccgataatacctacctttta

SEQ ID NO: 90665 - DNA, 20 bp, Artificial Sequence
  chemically synthesized
tttgccaaaaccttaaaagg

SEQ ID NO: 90666 - DNA, 20 bp, Artificial Sequence
  chemically synthesized
atctttgccaaaaccttaaa

SEQ ID NO: 90667 - DNA, 20 bp, Artificial Sequence
  chemically synthesized
aatctttgccaaaaccttaa

SEQ ID NO: 90668 - DNA, 20 bp, Artificial Sequence
  chemically synthesized
atacctaccttttaaggttt

SEQ ID NO: 90669 - DNA, 20 bp, Artificial Sequence
  chemically synthesized
taccttttaaggttttggca

SEQ ID NO: 90670 - DNA, 20 bp, Artificial Sequence
  chemically synthesized
tttaaggttttggcaaagat

SEQ ID NO: 90671 - DNA, 20 bp, Artificial Sequence
  chemically synthesized
ggttttggcaaagattagat

SEQ ID NO: 90672 - DNA, 20 bp, Artificial Sequence
  chemically synthesized
aagattagatgagatgatgt

SEQ ID NO: 90673 - DNA, 20 bp, Artificial Sequence
  chemically synthesized
attagatgagatgatgtgag

SEQ ID NO: 90674 - DNA, 20 bp, Artificial Sequence
  chemically synthesized
atgatgtgagtagatcaacc

SEQ ID NO: 90675 - DNA, 20 bp, Artificial Sequence
  chemically synthesized
taggcattgggttaggtact

SEQ ID NO: 90676 - DNA, 20 bp, Artificial Sequence
  chemically synthesized
aataggttaggcattgggtt

SEQ ID NO: 90677 - DNA, 20 bp, Artificial Sequence
  chemically synthesized
caataggttaggcattgggt

SEQ ID NO: 90678 - DNA, 20 bp, Artificial Sequence
  chemically synthesized
ctcacaataggttaggcatt

SEQ ID NO: 90679 - DNA, 20 bp, Artificial Sequence
  chemically synthesized
cctcacaataggttaggcat

SEQ ID NO: 90680 - DNA, 20 bp, Artificial Sequence
  chemically synthesized
atgaaacctcacaataggtt

SEQ ID NO: 90681 - DNA, 20 bp, Artificial Sequence
  chemically synthesized
aatgaaacctcacaataggt

SEQ ID NO: 90682 - DNA, 20 bp, Artificial Sequence
  chemically synthesized
cccaatgcctaacctattgt

SEQ ID NO: 90683 - DNA, 20 bp, Artificial Sequence
  chemically synthesized
ccaatgcctaacctattgtg

SEQ ID NO: 90684 - DNA, 20 bp, Artificial Sequence
  chemically synthesized
cattaatgaaacctcacaat

SEQ ID NO: 90685 - DNA, 20 bp, Artificial Sequence
  chemically synthesized
acattaatgaaacctcacaa

SEQ ID NO: 90686 - DNA, 20 bp, Artificial Sequence
  chemically synthesized
tcattaatgttgcatccttc

SEQ ID NO: 90687 - DNA, 20 bp, Artificial Sequence
  chemically synthesized
aaagtgagagggggactaga

SEQ ID NO: 90688 - DNA, 20 bp, Artificial Sequence
  chemically synthesized
gaaagtgagagggggactag

SEQ ID NO: 90689 - DNA, 20 bp, Artificial Sequence
  chemically synthesized
gcagaaagtgagagggggac

SEQ ID NO: 90690 - DNA, 20 bp, Artificial Sequence
  chemically synthesized
tcatggcagaaagtgagagg

SEQ ID NO: 90691 - DNA, 20 bp, Artificial Sequence
  chemically synthesized
gtcatggcagaaagtgagag

SEQ ID NO: 90692 - DNA, 20 bp, Artificial Sequence
  chemically synthesized
agtcatggcagaaagtgaga

SEQ ID NO: 90693 - DNA, 20 bp, Artificial Sequence
  chemically synthesized
gagtcatggcagaaagtgag

SEQ ID NO: 90694 - DNA, 20 bp, Artificial Sequence
  chemically synthesized
ggagtcatggcagaaagtga

SEQ ID NO: 90695 - DNA, 20 bp, Artificial Sequence
  chemically synthesized
ttggagtcatggcagaaagt

SEQ ID NO: 90696 - DNA, 20 bp, Artificial Sequence
  chemically synthesized
aggattggagtcatggcaga

SEQ ID NO: 90697 - DNA, 20 bp, Artificial Sequence
  chemically synthesized
tagcaggattggagtcatgg

SEQ ID NO: 90698 - DNA, 20 bp, Artificial Sequence
  chemically synthesized
tgctagcaggattggagtca

SEQ ID NO: 90699 - DNA, 20 bp, Artificial Sequence
  chemically synthesized
cttctctgctagcaggattg

SEQ ID NO: 90700 - DNA, 20 bp, Artificial Sequence
  chemically synthesized
tgccatgactccaatcctgc

SEQ ID NO: 90701 - DNA, 20 bp, Artificial Sequence
  chemically synthesized
atcttctctgctagcaggat

SEQ ID NO: 90702 - DNA, 20 bp, Artificial Sequence
  chemically synthesized
catgactccaatcctgctag

SEQ ID NO: 90703 - DNA, 20 bp, Artificial Sequence
  chemically synthesized
tgactccaatcctgctagca

SEQ ID NO: 90704 - DNA, 20 bp, Artificial Sequence
  chemically synthesized
ctcatatcttctctgctagc

SEQ ID NO: 90705 - DNA, 20 bp, Artificial Sequence
  chemically synthesized
cctcatatcttctctgctag

SEQ ID NO: 90706 - DNA, 20 bp, Artificial Sequence
  chemically synthesized
ctccaatcctgctagcagag

SEQ ID NO: 90707 - DNA, 20 bp, Artificial Sequence
  chemically synthesized
cggcctcatatcttctctgc

SEQ ID NO: 90708 - DNA, 20 bp, Artificial Sequence
  chemically synthesized
cctgctagcagagaagatat

SEQ ID NO: 90709 - DNA, 20 bp, Artificial Sequence
  chemically synthesized
ctgctagcagagaagatatg

SEQ ID NO: 90710 - DNA, 20 bp, Artificial Sequence
  chemically synthesized
gaagatatgaggccgttcaa

SEQ ID NO: 90711 - DNA, 20 bp, Artificial Sequence
  chemically synthesized
ggtattcgttttcttttgaa

SEQ ID NO: 90712 - DNA, 20 bp, Artificial Sequence
  chemically synthesized
ggctcccatcttcatgcagt

SEQ ID NO: 90713 - DNA, 20 bp, Artificial Sequence
  chemically synthesized
aaacgaatacctactgcatg

SEQ ID NO: 90714 - DNA, 20 bp, Artificial Sequence
  chemically synthesized
tggctcccatcttcatgcag

SEQ ID NO: 90715 - DNA, 20 bp, Artificial Sequence
  chemically synthesized
ctctggctcccatcttcatg

SEQ ID NO: 90716 - DNA, 20 bp, Artificial Sequence
  chemically synthesized
gaatacctactgcatgaaga

SEQ ID NO: 90717 - DNA, 20 bp, Artificial Sequence
  chemically synthesized
aatacctactgcatgaagat

SEQ ID NO: 90718 - DNA, 20 bp, Artificial Sequence
  chemically synthesized
tacctactgcatgaagatgg

SEQ ID NO: 90719 - DNA, 20 bp, Artificial Sequence
  chemically synthesized
tactgcatgaagatgggagc

SEQ ID NO: 90720 - DNA, 20 bp, Artificial Sequence
  chemically synthesized
ctgcatgaagatgggagcca

SEQ ID NO: 90721 - DNA, 20 bp, Artificial Sequence
  chemically synthesized
gaagatgggagccagagcta

SEQ ID NO: 90722 - DNA, 20 bp, Artificial Sequence
  chemically synthesized
aagatgggagccagagctac

SEQ ID NO: 90723 - DNA, 20 bp, Artificial Sequence
  chemically synthesized
ttagctcctgcctgtagctc

SEQ ID NO: 90724 - DNA, 20 bp, Artificial Sequence
  chemically synthesized
atgggagccagagctacagg

SEQ ID NO: 90725 - DNA, 20 bp, Artificial Sequence
  chemically synthesized
tgggagccagagctacaggc

SEQ ID NO: 90726 - DNA, 20 bp, Artificial Sequence
  chemically synthesized
ggagccagagctacaggcag

SEQ ID NO: 90727 - DNA, 20 bp, Artificial Sequence
  chemically synthesized
tacctcttagctcctgcctg

SEQ ID NO: 90728 - DNA, 20 bp, Artificial Sequence
  chemically synthesized
cagagctacaggcaggagct

SEQ ID NO: 90729 - DNA, 20 bp, Artificial Sequence
  chemically synthesized
gagctacaggcaggagctaa

SEQ ID NO: 90730 - DNA, 20 bp, Artificial Sequence
  chemically synthesized
agctacaggcaggagctaag

SEQ ID NO: 90731 - DNA, 20 bp, Artificial Sequence
  chemically synthesized
tacaggcaggagctaagagg

SEQ ID NO: 90732 - DNA, 20 bp, Artificial Sequence
  chemically synthesized
acttcctgagaactacctct

SEQ ID NO: 90733 - DNA, 20 bp, Artificial Sequence
  chemically synthesized
aggagctaagaggtagttct

SEQ ID NO: 90734 - DNA, 20 bp, Artificial Sequence
  chemically synthesized
ggagctaagaggtagttctc

SEQ ID NO: 90735 - DNA, 20 bp, Artificial Sequence
  chemically synthesized
gctaagaggtagttctcagg

SEQ ID NO: 90736 - DNA, 20 bp, Artificial Sequence
  chemically synthesized
cctttgaacctgaacttcct

SEQ ID NO: 90737 - DNA, 20 bp, Artificial Sequence
  chemically synthesized
gaggtagttctcaggaagtt

SEQ ID NO: 90738 - DNA, 20 bp, Artificial Sequence
  chemically synthesized
aggtagttctcaggaagttc

SEQ ID NO: 90739 - DNA, 20 bp, Artificial Sequence
  chemically synthesized
tctcaggaagttcaggttca

SEQ ID NO: 90740 - DNA, 20 bp, Artificial Sequence
  chemically synthesized
ctcaggaagttcaggttcaa

SEQ ID NO: 90741 - DNA, 20 bp, Artificial Sequence
  chemically synthesized
tcaggaagttcaggttcaaa

SEQ ID NO: 90742 - DNA, 20 bp, Artificial Sequence
  chemically synthesized
aagttcaggttcaaagggta

SEQ ID NO: 90743 - DNA, 20 bp, Artificial Sequence
  chemically synthesized
caggttcaaagggtacagtg

SEQ ID NO: 90744 - DNA, 20 bp, Artificial Sequence
  chemically synthesized
aagggtacagtgtagccaat

SEQ ID NO: 90745 - DNA, 20 bp, Artificial Sequence
  chemically synthesized
gggtacagtgtagccaatga

SEQ ID NO: 90746 - DNA, 20 bp, Artificial Sequence
  chemically synthesized
gcggcattctaagctctcat

SEQ ID NO: 90747 - DNA, 20 bp, Artificial Sequence
  chemically synthesized
cagtgtagccaatgagagct

SEQ ID NO: 90748 - DNA, 20 bp, Artificial Sequence
  chemically synthesized
aaatctccaggcggcattct

SEQ ID NO: 90749 - DNA, 20 bp, Artificial Sequence
  chemically synthesized
tgagagcttagaatgccgcc

SEQ ID NO: 90750 - DNA, 20 bp, Artificial Sequence
  chemically synthesized
agagcttagaatgccgcctg

SEQ ID NO: 90751 - DNA, 20 bp, Artificial Sequence
  chemically synthesized
atcagataaaaatctccagg

SEQ ID NO: 90752 - DNA, 20 bp, Artificial Sequence
  chemically synthesized
agaatcagataaaaatctcc

SEQ ID NO: 90753 - DNA, 20 bp, Artificial Sequence
  chemically synthesized
cagaatcagataaaaatctc

SEQ ID NO: 90754 - DNA, 20 bp, Artificial Sequence
  chemically synthesized
agatttttatctgattctgt

SEQ ID NO: 90755 - DNA, 20 bp, Artificial Sequence
  chemically synthesized
gaatattatccttacagaat

SEQ ID NO: 90756 - DNA, 20 bp, Artificial Sequence
  chemically synthesized
gatttttatctgattctgta

SEQ ID NO: 90757 - DNA, 20 bp, Artificial Sequence
  chemically synthesized
acagtggaatattatcctta

SEQ ID NO: 90758 - DNA, 20 bp, Artificial Sequence
  chemically synthesized
gtaaggataatattccactg

SEQ ID NO: 90759 - DNA, 20 bp, Artificial Sequence
  chemically synthesized
ctttacacaagaagctacag

SEQ ID NO: 90760 - DNA, 20 bp, Artificial Sequence
  chemically synthesized
cacctttacacaagaagcta

SEQ ID NO: 90761 - DNA, 20 bp, Artificial Sequence
  chemically synthesized
atgttacacctttacacaag

SEQ ID NO: 90762 - DNA, 20 bp, Artificial Sequence
  chemically synthesized
ccactgtagcttcttgtgta

SEQ ID NO: 90763 - DNA, 20 bp, Artificial Sequence
  chemically synthesized
cactgtagcttcttgtgtaa

SEQ ID NO: 90764 - DNA, 20 bp, Artificial Sequence
  chemically synthesized
acaatgttacacctttacac

SEQ ID NO: 90765 - DNA, 20 bp, Artificial Sequence
  chemically synthesized
aaggtgtaacattgtgaaaa

SEQ ID NO: 90766 - DNA, 20 bp, Artificial Sequence
  chemically synthesized
aacattgtgaaaatagcatc

SEQ ID NO: 90767 - DNA, 20 bp, Artificial Sequence
  chemically synthesized
atcctcccaataatcattac

SEQ ID NO: 90768 - DNA, 20 bp, Artificial Sequence
  chemically synthesized
tagcatctggtaatgattat

SEQ ID NO: 90769 - DNA, 20 bp, Artificial Sequence
  chemically synthesized
agcatctggtaatgattatt

SEQ ID NO: 90770 - DNA, 20 bp, Artificial Sequence
  chemically synthesized
catctggtaatgattattgg

SEQ ID NO: 90771 - DNA, 20 bp, Artificial Sequence
  chemically synthesized
atctggtaatgattattggg

SEQ ID NO: 90772 - DNA, 20 bp, Artificial Sequence
  chemically synthesized
ggtaatgattattgggagga

SEQ ID NO: 90773 - DNA, 20 bp, Artificial Sequence
  chemically synthesized
attattgggaggatggtgtt

SEQ ID NO: 90774 - DNA, 20 bp, Artificial Sequence
  chemically synthesized
ttattgggaggatggtgttc

SEQ ID NO: 90775 - DNA, 20 bp, Artificial Sequence
  chemically synthesized
tattgggaggatggtgttca

SEQ ID NO: 90776 - DNA, 20 bp, Artificial Sequence
  chemically synthesized
gatggtgttcagggtaaatg

SEQ ID NO: 90777 - DNA, 20 bp, Artificial Sequence
  chemically synthesized
ggtgttcagggtaaatgtag

SEQ ID NO: 90778 - DNA, 20 bp, Artificial Sequence
  chemically synthesized
gtgttcagggtaaatgtagc

SEQ ID NO: 90779 - DNA, 20 bp, Artificial Sequence
  chemically synthesized
tgttcagggtaaatgtagca

SEQ ID NO: 90780 - DNA, 20 bp, Artificial Sequence
  chemically synthesized
cagggtaaatgtagcagggt

SEQ ID NO: 90781 - DNA, 20 bp, Artificial Sequence
  chemically synthesized
gggtaaatgtagcagggtca

SEQ ID NO: 90782 - DNA, 20 bp, Artificial Sequence
  chemically synthesized
aatgtagcagggtcagagtg

SEQ ID NO: 90783 - DNA, 20 bp, Artificial Sequence
  chemically synthesized
atgtagcagggtcagagtga

SEQ ID NO: 90784 - DNA, 20 bp, Artificial Sequence
  chemically synthesized
tagcagggtcagagtgaagg

SEQ ID NO: 90785 - DNA, 20 bp, Artificial Sequence
  chemically synthesized
agcagggtcagagtgaaggc

SEQ ID NO: 90786 - DNA, 20 bp, Artificial Sequence
  chemically synthesized
agggtcagagtgaaggcagg

SEQ ID NO: 90787 - DNA, 20 bp, Artificial Sequence
  chemically synthesized
cagagtgaaggcaggaagtc

SEQ ID NO: 90788 - DNA, 20 bp, Artificial Sequence
  chemically synthesized
agtgaaggcaggaagtctag

SEQ ID NO: 90789 - DNA, 20 bp, Artificial Sequence
  chemically synthesized
aaggcaggaagtctagtgga

SEQ ID NO: 90790 - DNA, 20 bp, Artificial Sequence
  chemically synthesized
aggcaggaagtctagtggac

SEQ ID NO: 90791 - DNA, 20 bp, Artificial Sequence
  chemically synthesized
ggctgggactgcctgtccac

SEQ ID NO: 90792 - DNA, 20 bp, Artificial Sequence
  chemically synthesized
caggaagtctagtggacagg

SEQ ID NO: 90793 - DNA, 20 bp, Artificial Sequence
  chemically synthesized
gtctagtggacaggcagtcc

SEQ ID NO: 90794 - DNA, 20 bp, Artificial Sequence
  chemically synthesized
gacaggcagtcccagccata

SEQ ID NO: 90795 - DNA, 20 bp, Artificial Sequence
  chemically synthesized
gttttggttcctgtatggct

SEQ ID NO: 90796 - DNA, 20 bp, Artificial Sequence
  chemically synthesized
acaggcagtcccagccatac

SEQ ID NO: 90797 - DNA, 20 bp, Artificial Sequence
  chemically synthesized
tgttttggttcctgtatggc

SEQ ID NO: 90798 - DNA, 20 bp, Artificial Sequence
  chemically synthesized
ctgctgttttggttcctgta

SEQ ID NO: 90799 - DNA, 20 bp, Artificial Sequence
  chemically synthesized
cagccatacaggaaccaaaa

SEQ ID NO: 90800 - DNA, 20 bp, Artificial Sequence
  chemically synthesized
ccatacaggaaccaaaacag

SEQ ID NO: 90801 - DNA, 20 bp, Artificial Sequence
  chemically synthesized
ttctgaagccactgctgttt

SEQ ID NO: 90802 - DNA, 20 bp, Artificial Sequence
  chemically synthesized
tacaggaaccaaaacagcag

SEQ ID NO: 90803 - DNA, 20 bp, Artificial Sequence
  chemically synthesized
aaccaaaacagcagtggctt

SEQ ID NO: 90804 - DNA, 20 bp, Artificial Sequence
  chemically synthesized
aacagcagtggcttcagaat

SEQ ID NO: 90805 - DNA, 20 bp, Artificial Sequence
  chemically synthesized
ttaccttctctctgattctg

SEQ ID NO: 90806 - DNA, 20 bp, Artificial Sequence
  chemically synthesized
cagcagtggcttcagaatca

SEQ ID NO: 90807 - DNA, 20 bp, Artificial Sequence
  chemically synthesized
gcagtggcttcagaatcaga

SEQ ID NO: 90808 - DNA, 20 bp, Artificial Sequence
  chemically synthesized
gtggcttcagaatcagagag

SEQ ID NO: 90809 - DNA, 20 bp, Artificial Sequence
  chemically synthesized
tggcttcagaatcagagaga

SEQ ID NO: 90810 - DNA, 20 bp, Artificial Sequence
  chemically synthesized
tcagaatcagagagaaggta

SEQ ID NO: 90811 - DNA, 20 bp, Artificial Sequence
  chemically synthesized
gaatcagagagaaggtaaag

SEQ ID NO: 90812 - DNA, 20 bp, Artificial Sequence
  chemically synthesized
atcagagagaaggtaaagaa

SEQ ID NO: 90813 - DNA, 20 bp, Artificial Sequence
  chemically synthesized
tcagagagaaggtaaagaag

SEQ ID NO: 90814 - DNA, 20 bp, Artificial Sequence
  chemically synthesized
cagagagaaggtaaagaaga

SEQ ID NO: 90815 - DNA, 20 bp, Artificial Sequence
  chemically synthesized
ttatgagcactcaatgatgg

SEQ ID NO: 90816 - DNA, 20 bp, Artificial Sequence
  chemically synthesized
agagggatgctaccatcatt

SEQ ID NO: 90817 - DNA, 20 bp, Artificial Sequence
  chemically synthesized
aacttatgagcactcaatga

SEQ ID NO: 90818 - DNA, 20 bp, Artificial Sequence
  chemically synthesized
taccatcattgagtgctcat

SEQ ID NO: 90819 - DNA, 20 bp, Artificial Sequence
  chemically synthesized
cagctatttttataacttat

SEQ ID NO: 90820 - DNA, 20 bp, Artificial Sequence
  chemically synthesized
gtgctcataagttataaaaa

SEQ ID NO: 90821 - DNA, 20 bp, Artificial Sequence
  chemically synthesized
atggaattaaatcacacatg

SEQ ID NO: 90822 - DNA, 20 bp, Artificial Sequence
  chemically synthesized
aaggtaggacaagagaagga

SEQ ID NO: 90823 - DNA, 20 bp, Artificial Sequence
  chemically synthesized
tccaaaggtaggacaagaga

SEQ ID NO: 90824 - DNA, 20 bp, Artificial Sequence
  chemically synthesized
ttccaaaggtaggacaagag

SEQ ID NO: 90825 - DNA, 20 bp, Artificial Sequence
  chemically synthesized
accttccaaaggtaggacaa

SEQ ID NO: 90826 - DNA, 20 bp, Artificial Sequence
  chemically synthesized
ctaccttccaaaggtaggac

SEQ ID NO: 90827 - DNA, 20 bp, Artificial Sequence
  chemically synthesized
tccttctcttgtcctacctt

SEQ ID NO: 90828 - DNA, 20 bp, Artificial Sequence
  chemically synthesized
gaattctaccttccaaaggt

SEQ ID NO: 90829 - DNA, 20 bp, Artificial Sequence
  chemically synthesized
ttctcttgtcctacctttgg

SEQ ID NO: 90830 - DNA, 20 bp, Artificial Sequence
  chemically synthesized
tgaattctaccttccaaagg

SEQ ID NO: 90831 - DNA, 20 bp, Artificial Sequence
  chemically synthesized
tctcttgtcctacctttgga

SEQ ID NO: 90832 - DNA, 20 bp, Artificial Sequence
  chemically synthesized
tcctgaattctaccttccaa

SEQ ID NO: 90833 - DNA, 20 bp, Artificial Sequence
  chemically synthesized
cttgtcctacctttggaagg

SEQ ID NO: 90834 - DNA, 20 bp, Artificial Sequence
  chemically synthesized
ttcctgaattctaccttcca

SEQ ID NO: 90835 - DNA, 20 bp, Artificial Sequence
  chemically synthesized
tacctttggaaggtagaatt

SEQ ID NO: 90836 - DNA, 20 bp, Artificial Sequence
  chemically synthesized
acctttggaaggtagaattc

SEQ ID NO: 90837 - DNA, 20 bp, Artificial Sequence
  chemically synthesized
ttggaaggtagaattcagga

SEQ ID NO: 90838 - DNA, 20 bp, Artificial Sequence
  chemically synthesized
ggaaagtgataactattcac

SEQ ID NO: 90839 - DNA, 20 bp, Artificial Sequence
  chemically synthesized
ctttaaaatgtacttgtgaa

SEQ ID NO: 90840 - DNA, 20 bp, Artificial Sequence
  chemically synthesized
ctattcacaagtacatttta

SEQ ID NO: 90841 - DNA, 20 bp, Artificial Sequence
  chemically synthesized
tcacaagtacattttaaaga

SEQ ID NO: 90842 - DNA, 20 bp, Artificial Sequence
  chemically synthesized
aaagatagaaatgttattta

SEQ ID NO: 90843 - DNA, 20 bp, Artificial Sequence
  chemically synthesized
tatttaaagttctatttctc

SEQ ID NO: 90844 - DNA, 20 bp, Artificial Sequence
  chemically synthesized
atttaaagttctatttctca

SEQ ID NO: 90845 - DNA, 20 bp, Artificial Sequence
  chemically synthesized
ttttcttactccttgagaaa

SEQ ID NO: 90846 - DNA, 20 bp, Artificial Sequence
  chemically synthesized
ttaaagttctatttctcaag

SEQ ID NO: 90847 - DNA, 20 bp, Artificial Sequence
  chemically synthesized
agttctatttctcaaggagt

SEQ ID NO: 90848 - DNA, 20 bp, Artificial Sequence
  chemically synthesized
gtatttttttcttactcctt

SEQ ID NO: 90849 - DNA, 20 bp, Artificial Sequence
  chemically synthesized
gtgtgtgtgtgtttgaaaca

SEQ ID NO: 90850 - DNA, 20 bp, Artificial Sequence
  chemically synthesized
acacacacacacacacacct

SEQ ID NO: 90851 - DNA, 20 bp, Artificial Sequence
  chemically synthesized
cacacacacacacacacctt

SEQ ID NO: 90852 - DNA, 20 bp, Artificial Sequence
  chemically synthesized
acacacacacacacaccttg

SEQ ID NO: 90853 - DNA, 20 bp, Artificial Sequence
  chemically synthesized
ttctaatttatttggcccca

SEQ ID NO: 90854 - DNA, 20 bp, Artificial Sequence
  chemically synthesized
attctaatttatttggcccc

SEQ ID NO: 90855 - DNA, 20 bp, Artificial Sequence
  chemically synthesized
caccttggggccaaataaat

SEQ ID NO: 90856 - DNA, 20 bp, Artificial Sequence
  chemically synthesized
ttttgtcattctaatttatt

SEQ ID NO: 90857 - DNA, 20 bp, Artificial Sequence
  chemically synthesized
cccttgtcatttggtgtcaa

SEQ ID NO: 90858 - DNA, 20 bp, Artificial Sequence
  chemically synthesized
aaccattgacaccaaatgac

SEQ ID NO: 90859 - DNA, 20 bp, Artificial Sequence
  chemically synthesized
accattgacaccaaatgaca

SEQ ID NO: 90860 - DNA, 20 bp, Artificial Sequence
  chemically synthesized
atgtcaatgcccttgtcatt

SEQ ID NO: 90861 - DNA, 20 bp, Artificial Sequence
  chemically synthesized
ccattgacaccaaatgacaa

SEQ ID NO: 90862 - DNA, 20 bp, Artificial Sequence
  chemically synthesized
tgacaagggcattgacatca

SEQ ID NO: 90863 - DNA, 20 bp, Artificial Sequence
  chemically synthesized
attgacatcaaagctccata

SEQ ID NO: 90864 - DNA, 20 bp, Artificial Sequence
  chemically synthesized
ttgacatcaaagctccatat

SEQ ID NO: 90865 - DNA, 20 bp, Artificial Sequence
  chemically synthesized
gagtcacctgtgcctatatg

SEQ ID NO: 90866 - DNA, 20 bp, Artificial Sequence
  chemically synthesized
gggagtcacctgtgcctata

SEQ ID NO: 90867 - DNA, 20 bp, Artificial Sequence
  chemically synthesized
atcaaagctccatataggca

SEQ ID NO: 90868 - DNA, 20 bp, Artificial Sequence
  chemically synthesized
tcaaagctccatataggcac

SEQ ID NO: 90869 - DNA, 20 bp, Artificial Sequence
  chemically synthesized
atagggtatattttaggtgg

SEQ ID NO: 90870 - DNA, 20 bp, Artificial Sequence
  chemically synthesized
tgatagggtatattttaggt

SEQ ID NO: 90871 - DNA, 20 bp, Artificial Sequence
  chemically synthesized
ttgatagggtatattttagg

SEQ ID NO: 90872 - DNA, 20 bp, Artificial Sequence
  chemically synthesized
tgcttgatagggtatatttt

SEQ ID NO: 90873 - DNA, 20 bp, Artificial Sequence
  chemically synthesized
atgcttgatagggtatattt

SEQ ID NO: 90874 - DNA, 20 bp, Artificial Sequence
  chemically synthesized
cacctaaaatataccctatc

SEQ ID NO: 90875 - DNA, 20 bp, Artificial Sequence
  chemically synthesized
tagtttaggaatgcttgata

SEQ ID NO: 90876 - DNA, 20 bp, Artificial Sequence
  chemically synthesized
atagtttaggaatgcttgat

SEQ ID NO: 90877 - DNA, 20 bp, Artificial Sequence
  chemically synthesized
tatagtttaggaatgcttga

SEQ ID NO: 90878 - DNA, 20 bp, Artificial Sequence
  chemically synthesized
aactggcacccatatagttt

SEQ ID NO: 90879 - DNA, 20 bp, Artificial Sequence
  chemically synthesized
tcaagcattcctaaactata

SEQ ID NO: 90880 - DNA, 20 bp, Artificial Sequence
  chemically synthesized
gaactggcacccatatagtt

SEQ ID NO: 90881 - DNA, 20 bp, Artificial Sequence
  chemically synthesized
caagcattcctaaactatat

SEQ ID NO: 90882 - DNA, 20 bp, Artificial Sequence
  chemically synthesized
ctttagaactggcacccata

SEQ ID NO: 90883 - DNA, 20 bp, Artificial Sequence
  chemically synthesized
ttcctaaactatatgggtgc

SEQ ID NO: 90884 - DNA, 20 bp, Artificial Sequence
  chemically synthesized
ctatatgggtgccagttcta

SEQ ID NO: 90885 - DNA, 20 bp, Artificial Sequence
  chemically synthesized
tatatgggtgccagttctaa

SEQ ID NO: 90886 - DNA, 20 bp, Artificial Sequence
  chemically synthesized
gaaattgtgtcctttagaac

SEQ ID NO: 90887 - DNA, 20 bp, Artificial Sequence
  chemically synthesized
tctcaggaaattgtgtcctt

SEQ ID NO: 90888 - DNA, 20 bp, Artificial Sequence
  chemically synthesized
tctaaaggacacaatttcct

SEQ ID NO: 90889 - DNA, 20 bp, Artificial Sequence
  chemically synthesized
ggacacaatttcctgagaaa

SEQ ID NO: 90890 - DNA, 20 bp, Artificial Sequence
  chemically synthesized
tactctacccactttttctc

SEQ ID NO: 90891 - DNA, 20 bp, Artificial Sequence
  chemically synthesized
ttactctacccactttttct

SEQ ID NO: 90892 - DNA, 20 bp, Artificial Sequence
  chemically synthesized
cacaatttcctgagaaaaag

SEQ ID NO: 90893 - DNA, 20 bp, Artificial Sequence
  chemically synthesized
acaatttcctgagaaaaagt

SEQ ID NO: 90894 - DNA, 20 bp, Artificial Sequence
  chemically synthesized
atttcctgagaaaaagtggg

SEQ ID NO: 90895 - DNA, 20 bp, Artificial Sequence
  chemically synthesized
ttcctgagaaaaagtgggta

SEQ ID NO: 90896 - DNA, 20 bp, Artificial Sequence
  chemically synthesized
tgggtagagtaacactgctt

SEQ ID NO: 90897 - DNA, 20 bp, Artificial Sequence
  chemically synthesized
ctttttaaaaatatctgaag

SEQ ID NO: 90898 - DNA, 20 bp, Artificial Sequence
  chemically synthesized
cttctttttaaaaatatctg

SEQ ID NO: 90899 - DNA, 20 bp, Artificial Sequence
  chemically synthesized
ctgcttcagatatttttaaa

SEQ ID NO: 90900 - DNA, 20 bp, Artificial Sequence
  chemically synthesized
cttcagatatttttaaaaag

SEQ ID NO: 90901 - DNA, 20 bp, Artificial Sequence
  chemically synthesized
atatttttaaaaagaagccg

SEQ ID NO: 90902 - DNA, 20 bp, Artificial Sequence
  chemically synthesized
ttaaaaagaagccgtggacc

SEQ ID NO: 90903 - DNA, 20 bp, Artificial Sequence
  chemically synthesized
ttagttctccactgggtcca

SEQ ID NO: 90904 - DNA, 20 bp, Artificial Sequence
  chemically synthesized
aaaagaagccgtggacccag

SEQ ID NO: 90905 - DNA, 20 bp, Artificial Sequence
  chemically synthesized
aagaagccgtggacccagtg

SEQ ID NO: 90906 - DNA, 20 bp, Artificial Sequence
  chemically synthesized
atcaacattagttctccact

SEQ ID NO: 90907 - DNA, 20 bp, Artificial Sequence
  chemically synthesized
tatcaacattagttctccac

SEQ ID NO: 90908 - DNA, 20 bp, Artificial Sequence
  chemically synthesized
agccaaatgaatatcaacat

SEQ ID NO: 90909 - DNA, 20 bp, Artificial Sequence
  chemically synthesized
aactaatgttgatattcatt

SEQ ID NO: 90910 - DNA, 20 bp, Artificial Sequence
  chemically synthesized
ttttttaaagtttatgtgca

SEQ ID NO: 90911 - DNA, 20 bp, Artificial Sequence
  chemically synthesized
tcttttttaaagtttatgtg

SEQ ID NO: 90912 - DNA, 20 bp, Artificial Sequence
  chemically synthesized
tctgcacataaactttaaaa

SEQ ID NO: 90913 - DNA, 20 bp, Artificial Sequence
  chemically synthesized
aggcatgccattctttttta

SEQ ID NO: 90914 - DNA, 20 bp, Artificial Sequence
  chemically synthesized
acataaactttaaaaaagaa

SEQ ID NO: 90915 - DNA, 20 bp, Artificial Sequence
  chemically synthesized
ctttcaacaccagaattaaa

SEQ ID NO: 90916 - DNA, 20 bp, Artificial Sequence
  chemically synthesized
aatggcatgccttttaattc

SEQ ID NO: 90917 - DNA, 20 bp, Artificial Sequence
  chemically synthesized
tctttcaacaccagaattaa

SEQ ID NO: 90918 - DNA, 20 bp, Artificial Sequence
  chemically synthesized
ccttttaattctggtgttga

SEQ ID NO: 90919 - DNA, 20 bp, Artificial Sequence
  chemically synthesized
ctcgttttctctttcaacac

SEQ ID NO: 90920 - DNA, 20 bp, Artificial Sequence
  chemically synthesized
ttttaattctggtgttgaaa

SEQ ID NO: 90921 - DNA, 20 bp, Artificial Sequence
  chemically synthesized
ctggtgttgaaagagaaaac

SEQ ID NO: 90922 - DNA, 20 bp, Artificial Sequence
  chemically synthesized
gaaagagaaaacgagtctta

SEQ ID NO: 90923 - DNA, 20 bp, Artificial Sequence
  chemically synthesized
gagaaaacgagtcttaaaga

SEQ ID NO: 90924 - DNA, 20 bp, Artificial Sequence
  chemically synthesized
agaaaacgagtcttaaagac

SEQ ID NO: 90925 - DNA, 20 bp, Artificial Sequence
  chemically synthesized
agaaaactcagcctgtcttt

SEQ ID NO: 90926 - DNA, 20 bp, Artificial Sequence
  chemically synthesized
acgagtcttaaagacaggct

SEQ ID NO: 90927 - DNA, 20 bp, Artificial Sequence
  chemically synthesized
agtattaaaaaaagaaaact

SEQ ID NO: 90928 - DNA, 20 bp, Artificial Sequence
  chemically synthesized
tttagatgcagtattaaaaa

SEQ ID NO: 90929 - DNA, 20 bp, Artificial Sequence
  chemically synthesized
ttttctatggattttagatg

SEQ ID NO: 90930 - DNA, 20 bp, Artificial Sequence
  chemically synthesized
aatactgcatctaaaatcca

SEQ ID NO: 90931 - DNA, 20 bp, Artificial Sequence
  chemically synthesized
acagtattttctatggattt

SEQ ID NO: 90932 - DNA, 20 bp, Artificial Sequence
  chemically synthesized
ttgcagcacagtattttcta

SEQ ID NO: 90933 - DNA, 20 bp, Artificial Sequence
  chemically synthesized
tcagaaataatattgcagca

SEQ ID NO: 90934 - DNA, 20 bp, Artificial Sequence
  chemically synthesized
caatatcagaaataatattg

SEQ ID NO: 90935 - DNA, 20 bp, Artificial Sequence
  chemically synthesized
ctgaggctgtatagcaatat

SEQ ID NO: 90936 - DNA, 20 bp, Artificial Sequence
  chemically synthesized
ttatttctgatattgctata

SEQ ID NO: 90937 - DNA, 20 bp, Artificial Sequence
  chemically synthesized
ttatgagcactgaggctgta

SEQ ID NO: 90938 - DNA, 20 bp, Artificial Sequence
  chemically synthesized
ctgatattgctatacagcct

SEQ ID NO: 90939 - DNA, 20 bp, Artificial Sequence
  chemically synthesized
tcacccaattatgagcactg

SEQ ID NO: 90940 - DNA, 20 bp, Artificial Sequence
  chemically synthesized
ctcacccaattatgagcact

SEQ ID NO: 90941 - DNA, 20 bp, Artificial Sequence
  chemically synthesized
acagcctcagtgctcataat

SEQ ID NO: 90942 - DNA, 20 bp, Artificial Sequence
  chemically synthesized
cagcctcagtgctcataatt

SEQ ID NO: 90943 - DNA, 20 bp, Artificial Sequence
  chemically synthesized
ggaaatgctcacccaattat

SEQ ID NO: 90944 - DNA, 20 bp, Artificial Sequence
  chemically synthesized
ctcagtgctcataattgggt

SEQ ID NO: 90945 - DNA, 20 bp, Artificial Sequence
  chemically synthesized
tgggtgagcatttcctgcat

SEQ ID NO: 90946 - DNA, 20 bp, Artificial Sequence
  chemically synthesized
atctgaaagatgtctcatgc

SEQ ID NO: 90947 - DNA, 20 bp, Artificial Sequence
  chemically synthesized
gatctgaaagatgtctcatg

SEQ ID NO: 90948 - DNA, 20 bp, Artificial Sequence
  chemically synthesized
ttcctgcatgagacatcttt

SEQ ID NO: 90949 - DNA, 20 bp, Artificial Sequence
  chemically synthesized
gcatgagacatctttcagat

SEQ ID NO: 90950 - DNA, 20 bp, Artificial Sequence
  chemically synthesized
tactgttggcactgatctga

SEQ ID NO: 90951 - DNA, 20 bp, Artificial Sequence
  chemically synthesized
atctttcagatcagtgccaa

SEQ ID NO: 90952 - DNA, 20 bp, Artificial Sequence
  chemically synthesized
aggtctttcaagattactgt

SEQ ID NO: 90953 - DNA, 20 bp, Artificial Sequence
  chemically synthesized
agtgccaacagtaatcttga

SEQ ID NO: 90954 - DNA, 20 bp, Artificial Sequence
  chemically synthesized
tttgcatgttaaggtctttc

SEQ ID NO: 90955 - DNA, 20 bp, Artificial Sequence
  chemically synthesized
aatctagggtttgcatgtta

SEQ ID NO: 90956 - DNA, 20 bp, Artificial Sequence
  chemically synthesized
caatctagggtttgcatgtt

SEQ ID NO: 90957 - DNA, 20 bp, Artificial Sequence
  chemically synthesized
agaccttaacatgcaaaccc

SEQ ID NO: 90958 - DNA, 20 bp, Artificial Sequence
  chemically synthesized
tgacttaaatgtacaatcta

SEQ ID NO: 90959 - DNA, 20 bp, Artificial Sequence
  chemically synthesized
gtgacttaaatgtacaatct

SEQ ID NO: 90960 - DNA, 20 bp, Artificial Sequence
  chemically synthesized
tgtgacttaaatgtacaatc

SEQ ID NO: 90961 - DNA, 20 bp, Artificial Sequence
  chemically synthesized
aaaccctagattgtacattt

SEQ ID NO: 90962 - DNA, 20 bp, Artificial Sequence
  chemically synthesized
tagattgtacatttaagtca

SEQ ID NO: 90963 - DNA, 20 bp, Artificial Sequence
  chemically synthesized
gattgtacatttaagtcaca

SEQ ID NO: 90964 - DNA, 20 bp, Artificial Sequence
  chemically synthesized
cattgtagacttttcatatg

SEQ ID NO: 90965 - DNA, 20 bp, Artificial Sequence
  chemically synthesized
cagagacaaccacatatgaa

SEQ ID NO: 90966 - DNA, 20 bp, Artificial Sequence
  chemically synthesized
caaaagtaccttcaacattg

SEQ ID NO: 90967 - DNA, 20 bp, Artificial Sequence
  chemically synthesized
atgaaaagtctacaatgttg

SEQ ID NO: 90968 - DNA, 20 bp, Artificial Sequence
  chemically synthesized
tgaaaagtctacaatgttga

SEQ ID NO: 90969 - DNA, 20 bp, Artificial Sequence
  chemically synthesized
tacaatgttgaaggtacttt

SEQ ID NO: 90970 - DNA, 20 bp, Artificial Sequence
  chemically synthesized
aatataatataaaaaaccaa

SEQ ID NO: 90971 - DNA, 20 bp, Artificial Sequence
  chemically synthesized
tttatattatattttatgtg

SEQ ID NO: 90972 - DNA, 20 bp, Artificial Sequence
  chemically synthesized
ttatattatattttatgtgc

SEQ ID NO: 90973 - DNA, 20 bp, Artificial Sequence
  chemically synthesized
tatattttatgtgcaggaat

SEQ ID NO: 90974 - DNA, 20 bp, Artificial Sequence
  chemically synthesized
tgcaggaatcagtctgtttg

SEQ ID NO: 90975 - DNA, 20 bp, Artificial Sequence
  chemically synthesized
taagggtagttttcttcaaa

SEQ ID NO: 90976 - DNA, 20 bp, Artificial Sequence
  chemically synthesized
tggtctttctcagataaggg

SEQ ID NO: 90977 - DNA, 20 bp, Artificial Sequence
  chemically synthesized
gaagaaaactacccttatct

SEQ ID NO: 90978 - DNA, 20 bp, Artificial Sequence
  chemically synthesized
atctggtctttctcagataa

SEQ ID NO: 90979 - DNA, 20 bp, Artificial Sequence
  chemically synthesized
catctggtctttctcagata

SEQ ID NO: 90980 - DNA, 20 bp, Artificial Sequence
  chemically synthesized
ccatctggtctttctcagat

SEQ ID NO: 90981 - DNA, 20 bp, Artificial Sequence
  chemically synthesized
aaaactacccttatctgaga

SEQ ID NO: 90982 - DNA, 20 bp, Artificial Sequence
  chemically synthesized
aagacccatctggtctttct

SEQ ID NO: 90983 - DNA, 20 bp, Artificial Sequence
  chemically synthesized
tacccttatctgagaaagac

SEQ ID NO: 90984 - DNA, 20 bp, Artificial Sequence
  chemically synthesized
cttatctgagaaagaccaga

SEQ ID NO: 90985 - DNA, 20 bp, Artificial Sequence
  chemically synthesized
ttatctgagaaagaccagat

SEQ ID NO: 90986 - DNA, 20 bp, Artificial Sequence
  chemically synthesized
cagagttggaaagacccatc

SEQ ID NO: 90987 - DNA, 20 bp, Artificial Sequence
  chemically synthesized
aaatatgtctcagagttgga

SEQ ID NO: 90988 - DNA, 20 bp, Artificial Sequence
  chemically synthesized
agatgggtctttccaactct

SEQ ID NO: 90989 - DNA, 20 bp, Artificial Sequence
  chemically synthesized
aaacaaatatgtctcagagt

SEQ ID NO: 90990 - DNA, 20 bp, Artificial Sequence
  chemically synthesized
gcaaaaacaaatatgtctca

SEQ ID NO: 90991 - DNA, 20 bp, Artificial Sequence
  chemically synthesized
ctgcaaaaacaaatatgtct

SEQ ID NO: 90992 - DNA, 20 bp, Artificial Sequence
  chemically synthesized
ctgagacatatttgtttttg

SEQ ID NO: 90993 - DNA, 20 bp, Artificial Sequence
  chemically synthesized
gagacatatttgtttttgca

SEQ ID NO: 90994 - DNA, 20 bp, Artificial Sequence
  chemically synthesized
tgtttttgcagagccatgat

SEQ ID NO: 90995 - DNA, 20 bp, Artificial Sequence
  chemically synthesized
gtttttgcagagccatgatg

SEQ ID NO: 90996 - DNA, 20 bp, Artificial Sequence
  chemically synthesized
tttttgcagagccatgatga

SEQ ID NO: 90997 - DNA, 20 bp, Artificial Sequence
  chemically synthesized
ttttgcagagccatgatgag

SEQ ID NO: 90998 - DNA, 20 bp, Artificial Sequence
  chemically synthesized
cctacccccacccctcatca

SEQ ID NO: 90999 - DNA, 20 bp, Artificial Sequence
  chemically synthesized
tgcagagccatgatgagggg

SEQ ID NO: 91000 - DNA, 20 bp, Artificial Sequence
  chemically synthesized
gcagagccatgatgaggggt

SEQ ID NO: 91001 - DNA, 20 bp, Artificial Sequence
  chemically synthesized
cagagccatgatgaggggtg

SEQ ID NO: 91002 - DNA, 20 bp, Artificial Sequence
  chemically synthesized
agagccatgatgaggggtgg

SEQ ID NO: 91003 - DNA, 20 bp, Artificial Sequence
  chemically synthesized
gccatgatgaggggtggggg

SEQ ID NO: 91004 - DNA, 20 bp, Artificial Sequence
  chemically synthesized
ccatgatgaggggtgggggt

SEQ ID NO: 91005 - DNA, 20 bp, Artificial Sequence
  chemically synthesized
catgatgaggggtgggggta

SEQ ID NO: 91006 - DNA, 20 bp, Artificial Sequence
  chemically synthesized
gatgaggggtgggggtaggg

SEQ ID NO: 91007 - DNA, 20 bp, Artificial Sequence
  chemically synthesized
atgaggggtgggggtagggt

SEQ ID NO: 91008 - DNA, 20 bp, Artificial Sequence
  chemically synthesized
tgaggggtgggggtagggta

SEQ ID NO: 91009 - DNA, 20 bp, Artificial Sequence
  chemically synthesized
gaggggtgggggtagggtag

SEQ ID NO: 91010 - DNA, 20 bp, Artificial Sequence
  chemically synthesized
aggggtgggggtagggtagg

SEQ ID NO: 91011 - DNA, 20 bp, Artificial Sequence
  chemically synthesized
ggtagggtagggggatgaaa

SEQ ID NO: 91012 - DNA, 20 bp, Artificial Sequence
  chemically synthesized
gtagggtagggggatgaaac

SEQ ID NO: 91013 - DNA, 20 bp, Artificial Sequence
  chemically synthesized
tagggtagggggatgaaaca

SEQ ID NO: 91014 - DNA, 20 bp, Artificial Sequence
  chemically synthesized
ggtagggggatgaaacaggg

SEQ ID NO: 91015 - DNA, 20 bp, Artificial Sequence
  chemically synthesized
gtagggggatgaaacagggc

SEQ ID NO: 91016 - DNA, 20 bp, Artificial Sequence
  chemically synthesized
agggcaggaactaatactta

SEQ ID NO: 91017 - DNA, 20 bp, Artificial Sequence
  chemically synthesized
tttataagggctgtaagtat

SEQ ID NO: 91018 - DNA, 20 bp, Artificial Sequence
  chemically synthesized
aaaggatttataagggctgt

SEQ ID NO: 91019 - DNA, 20 bp, Artificial Sequence
  chemically synthesized
ttggtgtaaaggatttataa

SEQ ID NO: 91020 - DNA, 20 bp, Artificial Sequence
  chemically synthesized
gttggtgtaaaggatttata

SEQ ID NO: 91021 - DNA, 20 bp, Artificial Sequence
  chemically synthesized
agttggtgtaaaggatttat

SEQ ID NO: 91022 - DNA, 20 bp, Artificial Sequence
  chemically synthesized
atttcatagagttggtgtaa

SEQ ID NO: 91023 - DNA, 20 bp, Artificial Sequence
  chemically synthesized
tatttcatagagttggtgta

SEQ ID NO: 91024 - DNA, 20 bp, Artificial Sequence
  chemically synthesized
gaaggcctatttcatagagt

SEQ ID NO: 91025 - DNA, 20 bp, Artificial Sequence
  chemically synthesized
tttacaccaactctatgaaa

SEQ ID NO: 91026 - DNA, 20 bp, Artificial Sequence
  chemically synthesized
taaagaaggcctatttcata

SEQ ID NO: 91027 - DNA, 20 bp, Artificial Sequence
  chemically synthesized
ttacaccaactctatgaaat

SEQ ID NO: 91028 - DNA, 20 bp, Artificial Sequence
  chemically synthesized
gataaagaaggcctatttca

SEQ ID NO: 91029 - DNA, 20 bp, Artificial Sequence
  chemically synthesized
tcctcgataggggataaaga

SEQ ID NO: 91030 - DNA, 20 bp, Artificial Sequence
  chemically synthesized
ttcctcgataggggataaag

SEQ ID NO: 91031 - DNA, 20 bp, Artificial Sequence
  chemically synthesized
ggtttcctcgataggggata

SEQ ID NO: 91032 - DNA, 20 bp, Artificial Sequence
  chemically synthesized
ggccttctttatcccctatc

SEQ ID NO: 91033 - DNA, 20 bp, Artificial Sequence
  chemically synthesized
gccttctttatcccctatcg

SEQ ID NO: 91034 - DNA, 20 bp, Artificial Sequence
  chemically synthesized
actcgtggtttcctcgatag

SEQ ID NO: 91035 - DNA, 20 bp, Artificial Sequence
  chemically synthesized
aactcgtggtttcctcgata

SEQ ID NO: 91036 - DNA, 20 bp, Artificial Sequence
  chemically synthesized
aaactcgtggtttcctcgat

SEQ ID NO: 91037 - DNA, 20 bp, Artificial Sequence
  chemically synthesized
caaactcgtggtttcctcga

SEQ ID NO: 91038 - DNA, 20 bp, Artificial Sequence
  chemically synthesized
tcccctatcgaggaaaccac

SEQ ID NO: 91039 - DNA, 20 bp, Artificial Sequence
  chemically synthesized
atcgaggaaaccacgagttt

SEQ ID NO: 91040 - DNA, 20 bp, Artificial Sequence
  chemically synthesized
tactttacctctcaaactcg

SEQ ID NO: 91041 - DNA, 20 bp, Artificial Sequence
  chemically synthesized
cgaggaaaccacgagtttga

SEQ ID NO: 91042 - DNA, 20 bp, Artificial Sequence
  chemically synthesized
gaggaaaccacgagtttgag

SEQ ID NO: 91043 - DNA, 20 bp, Artificial Sequence
  chemically synthesized
aaccacgagtttgagaggta

SEQ ID NO: 91044 - DNA, 20 bp, Artificial Sequence
  chemically synthesized
aacaactctatgatttgtat

SEQ ID NO: 91045 - DNA, 20 bp, Artificial Sequence
  chemically synthesized
aaagtaacttatacaaatca

SEQ ID NO: 91046 - DNA, 20 bp, Artificial Sequence
  chemically synthesized
agtaacttatacaaatcata

SEQ ID NO: 91047 - DNA, 20 bp, Artificial Sequence
  chemically synthesized
atcatagagttgttgttatg

SEQ ID NO: 91048 - DNA, 20 bp, Artificial Sequence
  chemically synthesized
atagagttgttgttatgtgg

SEQ ID NO: 91049 - DNA, 20 bp, Artificial Sequence
  chemically synthesized
gagttgttgttatgtggcag

SEQ ID NO: 91050 - DNA, 20 bp, Artificial Sequence
  chemically synthesized
ttgttgttatgtggcagaag

SEQ ID NO: 91051 - DNA, 20 bp, Artificial Sequence
  chemically synthesized
tgttgttatgtggcagaagc

SEQ ID NO: 91052 - DNA, 20 bp, Artificial Sequence
  chemically synthesized
gttgttatgtggcagaagca

SEQ ID NO: 91053 - DNA, 20 bp, Artificial Sequence
  chemically synthesized
ttatgtggcagaagcagggt

SEQ ID NO: 91054 - DNA, 20 bp, Artificial Sequence
  chemically synthesized
atgtggcagaagcagggtta

SEQ ID NO: 91055 - DNA, 20 bp, Artificial Sequence
  chemically synthesized
gcagaagcagggttagagca

SEQ ID NO: 91056 - DNA, 20 bp, Artificial Sequence
  chemically synthesized
aaaaataacctagtttcagg

SEQ ID NO: 91057 - DNA, 20 bp, Artificial Sequence
  chemically synthesized
agcatagatcttcctgaaac

SEQ ID NO: 91058 - DNA, 20 bp, Artificial Sequence
  chemically synthesized
gcatagatcttcctgaaact

SEQ ID NO: 91059 - DNA, 20 bp, Artificial Sequence
  chemically synthesized
aataaaaataacctagtttc

SEQ ID NO: 91060 - DNA, 20 bp, Artificial Sequence
  chemically synthesized
gaataaaaataacctagttt

SEQ ID NO: 91061 - DNA, 20 bp, Artificial Sequence
  chemically synthesized
ggaagagaataaaaataacc

SEQ ID NO: 91062 - DNA, 20 bp, Artificial Sequence
  chemically synthesized
acactggagcttggagggaa

SEQ ID NO: 91063 - DNA, 20 bp, Artificial Sequence
  chemically synthesized
atttttattctcttccctcc

SEQ ID NO: 91064 - DNA, 20 bp, Artificial Sequence
  chemically synthesized
agacactggagcttggaggg

SEQ ID NO: 91065 - DNA, 20 bp, Artificial Sequence
  chemically synthesized
ggaagacactggagcttgga

SEQ ID NO: 91066 - DNA, 20 bp, Artificial Sequence
  chemically synthesized
gggaagacactggagcttgg

SEQ ID NO: 91067 - DNA, 20 bp, Artificial Sequence
  chemically synthesized
attctcttccctccaagctc

SEQ ID NO: 91068 - DNA, 20 bp, Artificial Sequence
  chemically synthesized
ggggaagacactggagcttg

SEQ ID NO: 91069 - DNA, 20 bp, Artificial Sequence
  chemically synthesized
atggggaagacactggagct

SEQ ID NO: 91070 - DNA, 20 bp, Artificial Sequence
  chemically synthesized
aatggatggggaagacactg

SEQ ID NO: 91071 - DNA, 20 bp, Artificial Sequence
  chemically synthesized
ttaatggatggggaagacac

SEQ ID NO: 91072 - DNA, 20 bp, Artificial Sequence
  chemically synthesized
tttgtatttaatggatgggg

SEQ ID NO: 91073 - DNA, 20 bp, Artificial Sequence
  chemically synthesized
tgctttgtatttaatggatg

SEQ ID NO: 91074 - DNA, 20 bp, Artificial Sequence
  chemically synthesized
ttgctttgtatttaatggat

SEQ ID NO: 91075 - DNA, 20 bp, Artificial Sequence
  chemically synthesized
cttgctttgtatttaatgga

SEQ ID NO: 91076 - DNA, 20 bp, Artificial Sequence
  chemically synthesized
gtcacttgctttgtatttaa

SEQ ID NO: 91077 - DNA, 20 bp, Artificial Sequence
  chemically synthesized
ttccccatccattaaataca

SEQ ID NO: 91078 - DNA, 20 bp, Artificial Sequence
  chemically synthesized
ccatccattaaatacaaagc

SEQ ID NO: 91079 - DNA, 20 bp, Artificial Sequence
  chemically synthesized
aaagcaagtgacttctgact

SEQ ID NO: 91080 - DNA, 20 bp, Artificial Sequence
  chemically synthesized
aagcaagtgacttctgactt

SEQ ID NO: 91081 - DNA, 20 bp, Artificial Sequence
  chemically synthesized
atacatgtagcccaagtcag

SEQ ID NO: 91082 - DNA, 20 bp, Artificial Sequence
  chemically synthesized
gtgatacatgtagcccaagt

SEQ ID NO: 91083 - DNA, 20 bp, Artificial Sequence
  chemically synthesized
tgctgtgatacatgtagccc

SEQ ID NO: 91084 - DNA, 20 bp, Artificial Sequence
  chemically synthesized
ttatgttgctgtgatacatg

SEQ ID NO: 91085 - DNA, 20 bp, Artificial Sequence
  chemically synthesized
gacttgggctacatgtatca

SEQ ID NO: 91086 - DNA, 20 bp, Artificial Sequence
  chemically synthesized
cataattataataactcatt

SEQ ID NO: 91087 - DNA, 20 bp, Artificial Sequence
  chemically synthesized
ataattataataactcatta

SEQ ID NO: 91088 - DNA, 20 bp, Artificial Sequence
  chemically synthesized
tatctcacagatgccttaat

SEQ ID NO: 91089 - DNA, 20 bp, Artificial Sequence
  chemically synthesized
taactcattaaggcatctgt

SEQ ID NO: 91090 - DNA, 20 bp, Artificial Sequence
  chemically synthesized
ctctgaaactaaatatctca

SEQ ID NO: 91091 - DNA, 20 bp, Artificial Sequence
  chemically synthesized
taaggcatctgtgagatatt

SEQ ID NO: 91092 - DNA, 20 bp, Artificial Sequence
  chemically synthesized
atctgtgagatatttagttt

SEQ ID NO: 91093 - DNA, 20 bp, Artificial Sequence
  chemically synthesized
ctgtgagatatttagtttca

SEQ ID NO: 91094 - DNA, 20 bp, Artificial Sequence
  chemically synthesized
atttagtttcagagcactga

SEQ ID NO: 91095 - DNA, 20 bp, Artificial Sequence
  chemically synthesized
tttagtttcagagcactgat

SEQ ID NO: 91096 - DNA, 20 bp, Artificial Sequence
  chemically synthesized
tttcagagcactgataggaa

SEQ ID NO: 91097 - DNA, 20 bp, Artificial Sequence
  chemically synthesized
cagttgttgaccattcctat

SEQ ID NO: 91098 - DNA, 20 bp, Artificial Sequence
  chemically synthesized
tacctaattggaaaattatt

SEQ ID NO: 91099 - DNA, 20 bp, Artificial Sequence
  chemically synthesized
caactgaataattttccaat

SEQ ID NO: 91100 - DNA, 20 bp, Artificial Sequence
  chemically synthesized
aactgaataattttccaatt

SEQ ID NO: 91101 - DNA, 20 bp, Artificial Sequence
  chemically synthesized
ttttaaaagcaatacctaat

SEQ ID NO: 91102 - DNA, 20 bp, Artificial Sequence
  chemically synthesized
gactaaggataaatttttaa

SEQ ID NO: 91103 - DNA, 20 bp, Artificial Sequence
  chemically synthesized
tgcttttaaaaatttatcct

SEQ ID NO: 91104 - DNA, 20 bp, Artificial Sequence
  chemically synthesized
tattagttctgagttgacta

SEQ ID NO: 91105 - DNA, 20 bp, Artificial Sequence
  chemically synthesized
atattagttctgagttgact

SEQ ID NO: 91106 - DNA, 20 bp, Artificial Sequence
  chemically synthesized
aaatttatccttagtcaact

SEQ ID NO: 91107 - DNA, 20 bp, Artificial Sequence
  chemically synthesized
acatcaatgatattagttct

SEQ ID NO: 91108 - DNA, 20 bp, Artificial Sequence
  chemically synthesized
ttcagaaacatcaatgatat

SEQ ID NO: 91109 - DNA, 20 bp, Artificial Sequence
  chemically synthesized
atatcattgatgtttctgaa

SEQ ID NO: 91110 - DNA, 20 bp, Artificial Sequence
  chemically synthesized
tgtgttcatttagaaccatt

SEQ ID NO: 91111 - DNA, 20 bp, Artificial Sequence
  chemically synthesized
aggagtgtattgtgttcatt

SEQ ID NO: 91112 - DNA, 20 bp, Artificial Sequence
  chemically synthesized
gttacctatttgaagaatag

SEQ ID NO: 91113 - DNA, 20 bp, Artificial Sequence
  chemically synthesized
gagttacctatttgaagaat

SEQ ID NO: 91114 - DNA, 20 bp, Artificial Sequence
  chemically synthesized
agagttacctatttgaagaa

SEQ ID NO: 91115 - DNA, 20 bp, Artificial Sequence
  chemically synthesized
atacactcctattcttcaaa

SEQ ID NO: 91116 - DNA, 20 bp, Artificial Sequence
  chemically synthesized
tacactcctattcttcaaat

SEQ ID NO: 91117 - DNA, 20 bp, Artificial Sequence
  chemically synthesized
ggaagagagttacctatttg

SEQ ID NO: 91118 - DNA, 20 bp, Artificial Sequence
  chemically synthesized
tgtattggtccatgggaaga

SEQ ID NO: 91119 - DNA, 20 bp, Artificial Sequence
  chemically synthesized
aataggtaactctcttccca

SEQ ID NO: 91120 - DNA, 20 bp, Artificial Sequence
  chemically synthesized
tatgtattggtccatgggaa

SEQ ID NO: 91121 - DNA, 20 bp, Artificial Sequence
  chemically synthesized
aatatgtattggtccatggg

SEQ ID NO: 91122 - DNA, 20 bp, Artificial Sequence
  chemically synthesized
ccaaatatgtattggtccat

SEQ ID NO: 91123 - DNA, 20 bp, Artificial Sequence
  chemically synthesized
accaaatatgtattggtcca

SEQ ID NO: 91124 - DNA, 20 bp, Artificial Sequence
  chemically synthesized
taatataaccaaatatgtat

SEQ ID NO: 91125 - DNA, 20 bp, Artificial Sequence
  chemically synthesized
cccatggaccaatacatatt

SEQ ID NO: 91126 - DNA, 20 bp, Artificial Sequence
  chemically synthesized
tgtaatatagacaaattgca

SEQ ID NO: 91127 - DNA, 20 bp, Artificial Sequence
  chemically synthesized
tgcaatttgtctatattaca

SEQ ID NO: 91128 - DNA, 20 bp, Artificial Sequence
  chemically synthesized
ttttaactctctatgtaata

SEQ ID NO: 91129 - DNA, 20 bp, Artificial Sequence
  chemically synthesized
caatttgtctatattacata

SEQ ID NO: 91130 - DNA, 20 bp, Artificial Sequence
  chemically synthesized
atttgtctatattacataga

SEQ ID NO: 91131 - DNA, 20 bp, Artificial Sequence
  chemically synthesized
tatattacatagagagttaa

SEQ ID NO: 91132 - DNA, 20 bp, Artificial Sequence
  chemically synthesized
tagagagttaaaagctcgaa

SEQ ID NO: 91133 - DNA, 20 bp, Artificial Sequence
  chemically synthesized
tccagaaataagagcttttc

SEQ ID NO: 91134 - DNA, 20 bp, Artificial Sequence
  chemically synthesized
gctcgaaaagctcttatttc

SEQ ID NO: 91135 - DNA, 20 bp, Artificial Sequence
  chemically synthesized
caaagagattccagaaataa

SEQ ID NO: 91136 - DNA, 20 bp, Artificial Sequence
  chemically synthesized
gacaaagagattccagaaat

SEQ ID NO: 91137 - DNA, 20 bp, Artificial Sequence
  chemically synthesized
gcttagtgacaaagagattc

SEQ ID NO: 91138 - DNA, 20 bp, Artificial Sequence
  chemically synthesized
aaaaatagcttagtgacaaa

SEQ ID NO: 91139 - DNA, 20 bp, Artificial Sequence
  chemically synthesized
tctggaatctctttgtcact

SEQ ID NO: 91140 - DNA, 20 bp, Artificial Sequence
  chemically synthesized
caaaaaatagcttagtgaca

SEQ ID NO: 91141 - DNA, 20 bp, Artificial Sequence
  chemically synthesized
ctggaggacaaaaaatagct

SEQ ID NO: 91142 - DNA, 20 bp, Artificial Sequence
  chemically synthesized
attctctggaggacaaaaaa

SEQ ID NO: 91143 - DNA, 20 bp, Artificial Sequence
  chemically synthesized
ctaagctattttttgtcctc

SEQ ID NO: 91144 - DNA, 20 bp, Artificial Sequence
  chemically synthesized
aagctattttttgtcctcca

SEQ ID NO: 91145 - DNA, 20 bp, Artificial Sequence
  chemically synthesized
gaaccacagtgattctctgg

SEQ ID NO: 91146 - DNA, 20 bp, Artificial Sequence
  chemically synthesized
tgaaccacagtgattctctg

SEQ ID NO: 91147 - DNA, 20 bp, Artificial Sequence
  chemically synthesized
cttgaaccacagtgattctc

SEQ ID NO: 91148 - DNA, 20 bp, Artificial Sequence
  chemically synthesized
tgtcctccagagaatcactg

SEQ ID NO: 91149 - DNA, 20 bp, Artificial Sequence
  chemically synthesized
ccagagaatcactgtggttc

SEQ ID NO: 91150 - DNA, 20 bp, Artificial Sequence
  chemically synthesized
cagagaatcactgtggttca

SEQ ID NO: 91151 - DNA, 20 bp, Artificial Sequence
  chemically synthesized
taatatacaaccttgaacca

SEQ ID NO: 91152 - DNA, 20 bp, Artificial Sequence
  chemically synthesized
tgtggttcaaggttgtatat

SEQ ID NO: 91153 - DNA, 20 bp, Artificial Sequence
  chemically synthesized
caaggttgtatattagaaaa

SEQ ID NO: 91154 - DNA, 20 bp, Artificial Sequence
  chemically synthesized
gtatattagaaaaaagcaat

SEQ ID NO: 91155 - DNA, 20 bp, Artificial Sequence
  chemically synthesized
aaaagcaattagttgatgtc

SEQ ID NO: 91156 - DNA, 20 bp, Artificial Sequence
  chemically synthesized
atgtgttattgggaaaagat

SEQ ID NO: 91157 - DNA, 20 bp, Artificial Sequence
  chemically synthesized
tagatatgtgttattgggaa

SEQ ID NO: 91158 - DNA, 20 bp, Artificial Sequence
  chemically synthesized
cttcttagatatgtgttatt

SEQ ID NO: 91159 - DNA, 20 bp, Artificial Sequence
  chemically synthesized
tcttcttagatatgtgttat

SEQ ID NO: 91160 - DNA, 20 bp, Artificial Sequence
  chemically synthesized
tttcccaataacacatatct

SEQ ID NO: 91161 - DNA, 20 bp, Artificial Sequence
  chemically synthesized
cccaataacacatatctaag

SEQ ID NO: 91162 - DNA, 20 bp, Artificial Sequence
  chemically synthesized
ataacacatatctaagaaga

SEQ ID NO: 91163 - DNA, 20 bp, Artificial Sequence
  chemically synthesized
atatgttcttgctttcttct

SEQ ID NO: 91164 - DNA, 20 bp, Artificial Sequence
  chemically synthesized
cacatatctaagaagaaagc

SEQ ID NO: 91165 - DNA, 20 bp, Artificial Sequence
  chemically synthesized
aagaagaaagcaagaacata

SEQ ID NO: 91166 - DNA, 20 bp, Artificial Sequence
  chemically synthesized
gaaagcaagaacatatggca

SEQ ID NO: 91167 - DNA, 20 bp, Artificial Sequence
  chemically synthesized
tgtatgatcaaaaataatta

SEQ ID NO: 91168 - DNA, 20 bp, Artificial Sequence
  chemically synthesized
aattatttttgatcatacac

SEQ ID NO: 91169 - DNA, 20 bp, Artificial Sequence
  chemically synthesized
tacatggctgttgtgatttc

SEQ ID NO: 91170 - DNA, 20 bp, Artificial Sequence
  chemically synthesized
tcatacactagaaatcacaa

SEQ ID NO: 91171 - DNA, 20 bp, Artificial Sequence
  chemically synthesized
tagaaatcacaacagccatg

SEQ ID NO: 91172 - DNA, 20 bp, Artificial Sequence
  chemically synthesized
agaaatcacaacagccatgt

SEQ ID NO: 91173 - DNA, 20 bp, Artificial Sequence
  chemically synthesized
gccagagggaattacctaca

SEQ ID NO: 91174 - DNA, 20 bp, Artificial Sequence
  chemically synthesized
gccatgtaggtaattccctc

SEQ ID NO: 91175 - DNA, 20 bp, Artificial Sequence
  chemically synthesized
aataattaaaacaagccaga

SEQ ID NO: 91176 - DNA, 20 bp, Artificial Sequence
  chemically synthesized
taataattaaaacaagccag

SEQ ID NO: 91177 - DNA, 20 bp, Artificial Sequence
  chemically synthesized
ctaataattaaaacaagcca

SEQ ID NO: 91178 - DNA, 20 bp, Artificial Sequence
  chemically synthesized
ccctaataattaaaacaagc

SEQ ID NO: 91179 - DNA, 20 bp, Artificial Sequence
  chemically synthesized
acaaccctaataattaaaac

SEQ ID NO: 91180 - DNA, 20 bp, Artificial Sequence
  chemically synthesized
ctctggcttgttttaattat

SEQ ID NO: 91181 - DNA, 20 bp, Artificial Sequence
  chemically synthesized
tctggcttgttttaattatt

SEQ ID NO: 91182 - DNA, 20 bp, Artificial Sequence
  chemically synthesized
ctggcttgttttaattatta

SEQ ID NO: 91183 - DNA, 20 bp, Artificial Sequence
  chemically synthesized
gtaaagtgggggatagaatg

SEQ ID NO: 91184 - DNA, 20 bp, Artificial Sequence
  chemically synthesized
ttagggggtaaagtggggga

SEQ ID NO: 91185 - DNA, 20 bp, Artificial Sequence
  chemically synthesized
gtttttagggggtaaagtgg

SEQ ID NO: 91186 - DNA, 20 bp, Artificial Sequence
  chemically synthesized
ggtttttagggggtaaagtg

SEQ ID NO: 91187 - DNA, 20 bp, Artificial Sequence
  chemically synthesized
aggtttttagggggtaaagt

SEQ ID NO: 91188 - DNA, 20 bp, Artificial Sequence
  chemically synthesized
gaggtttttagggggtaaag

SEQ ID NO: 91189 - DNA, 20 bp, Artificial Sequence
  chemically synthesized
tttgaggtttttagggggta

SEQ ID NO: 91190 - DNA, 20 bp, Artificial Sequence
  chemically synthesized
agtattttgaggtttttagg

SEQ ID NO: 91191 - DNA, 20 bp, Artificial Sequence
  chemically synthesized
gagtattttgaggtttttag

SEQ ID NO: 91192 - DNA, 20 bp, Artificial Sequence
  chemically synthesized
ggagtattttgaggttttta

SEQ ID NO: 91193 - DNA, 20 bp, Artificial Sequence
  chemically synthesized
gggagtattttgaggttttt

SEQ ID NO: 91194 - DNA, 20 bp, Artificial Sequence
  chemically synthesized
tgggagtattttgaggtttt

SEQ ID NO: 91195 - DNA, 20 bp, Artificial Sequence
  chemically synthesized
ggttgcgtgggagtattttg

SEQ ID NO: 91196 - DNA, 20 bp, Artificial Sequence
  chemically synthesized
tggttgcgtgggagtatttt

SEQ ID NO: 91197 - DNA, 20 bp, Artificial Sequence
  chemically synthesized
gttgttttgtggttgcgtgg

SEQ ID NO: 91198 - DNA, 20 bp, Artificial Sequence
  chemically synthesized
gggttgttttgtggttgcgt

SEQ ID NO: 91199 - DNA, 20 bp, Artificial Sequence
  chemically synthesized
agggttgttttgtggttgcg

SEQ ID NO: 91200 - DNA, 20 bp, Artificial Sequence
  chemically synthesized
atcagtgtagggttgttttg

SEQ ID NO: 91201 - DNA, 20 bp, Artificial Sequence
  chemically synthesized
taaacaattacatcagtgta

SEQ ID NO: 91202 - DNA, 20 bp, Artificial Sequence
  chemically synthesized
gtaaacaattacatcagtgt

SEQ ID NO: 91203 - DNA, 20 bp, Artificial Sequence
  chemically synthesized
tgtaaacaattacatcagtg

SEQ ID NO: 91204 - DNA, 20 bp, Artificial Sequence
  chemically synthesized
cctattgtaaacaattacat

SEQ ID NO: 91205 - DNA, 20 bp, Artificial Sequence
  chemically synthesized
actgatgtaattgtttacaa

SEQ ID NO: 91206 - DNA, 20 bp, Artificial Sequence
  chemically synthesized
ctgatgtaattgtttacaat

SEQ ID NO: 91207 - DNA, 20 bp, Artificial Sequence
  chemically synthesized
tgtttacaataggttaatga

SEQ ID NO: 91208 - DNA, 20 bp, Artificial Sequence
  chemically synthesized
gtttacaataggttaatgat

SEQ ID NO: 91209 - DNA, 20 bp, Artificial Sequence
  chemically synthesized
ggttaatgataggaaaatct

SEQ ID NO: 91210 - DNA, 20 bp, Artificial Sequence
  chemically synthesized
tgaaaaaaatagaaatgtct

SEQ ID NO: 91211 - DNA, 20 bp, Artificial Sequence
  chemically synthesized
gctatttaaaatgaaaaaaa

SEQ ID NO: 91212 - DNA, 20 bp, Artificial Sequence
  chemically synthesized
tctatttttttcattttaaa

SEQ ID NO: 91213 - DNA, 20 bp, Artificial Sequence
  chemically synthesized
atttttttcattttaaatag

SEQ ID NO: 91214 - DNA, 20 bp, Artificial Sequence
  chemically synthesized
tttttttcattttaaatagc

SEQ ID NO: 91215 - DNA, 20 bp, Artificial Sequence
  chemically synthesized
atgagtgtctgtgattattt

SEQ ID NO: 91216 - DNA, 20 bp, Artificial Sequence
  chemically synthesized
gacaatttccaaaataatca

SEQ ID NO: 91217 - DNA, 20 bp, Artificial Sequence
  chemically synthesized
aaataatcacagacactcat

SEQ ID NO: 91218 - DNA, 20 bp, Artificial Sequence
  chemically synthesized
tgaatacagttgtgtctgat

SEQ ID NO: 91219 - DNA, 20 bp, Artificial Sequence
  chemically synthesized
agagtacccacaaatgaata

SEQ ID NO: 91220 - DNA, 20 bp, Artificial Sequence
  chemically synthesized
gacacaactgtattcatttg

SEQ ID NO: 91221 - DNA, 20 bp, Artificial Sequence
  chemically synthesized
acacaactgtattcatttgt

SEQ ID NO: 91222 - DNA, 20 bp, Artificial Sequence
  chemically synthesized
attcatttgtgggtactctt

SEQ ID NO: 91223 - DNA, 20 bp, Artificial Sequence
  chemically synthesized
tctctatgctgtgggctaaa

SEQ ID NO: 91224 - DNA, 20 bp, Artificial Sequence
  chemically synthesized
tgtgggtactctttagccca

SEQ ID NO: 91225 - DNA, 20 bp, Artificial Sequence
  chemically synthesized
tatctctatgctgtgggcta

SEQ ID NO: 91226 - DNA, 20 bp, Artificial Sequence
  chemically synthesized
gtactctttagcccacagca

SEQ ID NO: 91227 - DNA, 20 bp, Artificial Sequence
  chemically synthesized
ggttaatatctctatgctgt

SEQ ID NO: 91228 - DNA, 20 bp, Artificial Sequence
  chemically synthesized
actctttagcccacagcata

SEQ ID NO: 91229 - DNA, 20 bp, Artificial Sequence
  chemically synthesized
aggttaatatctctatgctg

SEQ ID NO: 91230 - DNA, 20 bp, Artificial Sequence
  chemically synthesized
aatacctagaaatagtttta

SEQ ID NO: 91231 - DNA, 20 bp, Artificial Sequence
  chemically synthesized
gaatacctagaaatagtttt

SEQ ID NO: 91232 - DNA, 20 bp, Artificial Sequence
  chemically synthesized
attaaccttaaaactatttc

SEQ ID NO: 91233 - DNA, 20 bp, Artificial Sequence
  chemically synthesized
ttaaccttaaaactatttct

SEQ ID NO: 91234 - DNA, 20 bp, Artificial Sequence
  chemically synthesized
aacttatgaatacctagaaa

SEQ ID NO: 91235 - DNA, 20 bp, Artificial Sequence
  chemically synthesized
attcaaaacttatgaatacc

SEQ ID NO: 91236 - DNA, 20 bp, Artificial Sequence
  chemically synthesized
aactatttctaggtattcat

SEQ ID NO: 91237 - DNA, 20 bp, Artificial Sequence
  chemically synthesized
ttcataagttttgaatgtta

SEQ ID NO: 91238 - DNA, 20 bp, Artificial Sequence
  chemically synthesized
ataagttttgaatgttaaag

SEQ ID NO: 91239 - DNA, 20 bp, Artificial Sequence
  chemically synthesized
taagttttgaatgttaaaga

SEQ ID NO: 91240 - DNA, 20 bp, Artificial Sequence
  chemically synthesized
ttgaatgttaaagaaggttc

SEQ ID NO: 91241 - DNA, 20 bp, Artificial Sequence
  chemically synthesized
tttagtttacatcatggtac

SEQ ID NO: 91242 - DNA, 20 bp, Artificial Sequence
  chemically synthesized
caggactttagtttacatca

SEQ ID NO: 91243 - DNA, 20 bp, Artificial Sequence
  chemically synthesized
tagtaccatgatgtaaacta

SEQ ID NO: 91244 - DNA, 20 bp, Artificial Sequence
  chemically synthesized
caattatatcagcaggactt

SEQ ID NO: 91245 - DNA, 20 bp, Artificial Sequence
  chemically synthesized
tcagatccaattatatcagc

SEQ ID NO: 91246 - DNA, 20 bp, Artificial Sequence
  chemically synthesized
atcagatccaattatatcag

SEQ ID NO: 91247 - DNA, 20 bp, Artificial Sequence
  chemically synthesized
taaagtcctgctgatataat

SEQ ID NO: 91248 - DNA, 20 bp, Artificial Sequence
  chemically synthesized
agaatcagatccaattatat

SEQ ID NO: 91249 - DNA, 20 bp, Artificial Sequence
  chemically synthesized
tataattggatctgattctc

SEQ ID NO: 91250 - DNA, 20 bp, Artificial Sequence
  chemically synthesized
actgaagatcaccagagaat

SEQ ID NO: 91251 - DNA, 20 bp, Artificial Sequence
  chemically synthesized
taactcactgaagatcacca

SEQ ID NO: 91252 - DNA, 20 bp, Artificial Sequence
  chemically synthesized
attaactcactgaagatcac

SEQ ID NO: 91253 - DNA, 20 bp, Artificial Sequence
  chemically synthesized
tctgattctctggtgatctt

SEQ ID NO: 91254 - DNA, 20 bp, Artificial Sequence
  chemically synthesized
attctctggtgatcttcagt

SEQ ID NO: 91255 - DNA, 20 bp, Artificial Sequence
  chemically synthesized
agacagaaattaactcactg

SEQ ID NO: 91256 - DNA, 20 bp, Artificial Sequence
  chemically synthesized
ttgctctacttggtagtaga

SEQ ID NO: 91257 - DNA, 20 bp, Artificial Sequence
  chemically synthesized
gttaatttctgtctactacc

SEQ ID NO: 91258 - DNA, 20 bp, Artificial Sequence
  chemically synthesized
gaatttgctctacttggtag

SEQ ID NO: 91259 - DNA, 20 bp, Artificial Sequence
  chemically synthesized
aatttctgtctactaccaag

SEQ ID NO: 91260 - DNA, 20 bp, Artificial Sequence
  chemically synthesized
tttctgtctactaccaagta

SEQ ID NO: 91261 - DNA, 20 bp, Artificial Sequence
  chemically synthesized
aaagaatttgctctacttgg

SEQ ID NO: 91262 - DNA, 20 bp, Artificial Sequence
  chemically synthesized
aagaaagaatttgctctact

SEQ ID NO: 91263 - DNA, 20 bp, Artificial Sequence
  chemically synthesized
gtagagcaaattctttcttc

SEQ ID NO: 91264 - DNA, 20 bp, Artificial Sequence
  chemically synthesized
agagcaaattctttcttctg

SEQ ID NO: 91265 - DNA, 20 bp, Artificial Sequence
  chemically synthesized
aagtcacactctccagaaga

SEQ ID NO: 91266 - DNA, 20 bp, Artificial Sequence
  chemically synthesized
agcaaattctttcttctgga

SEQ ID NO: 91267 - DNA, 20 bp, Artificial Sequence
  chemically synthesized
acaaaagtcacactctccag

SEQ ID NO: 91268 - DNA, 20 bp, Artificial Sequence
  chemically synthesized
cacacaaaagtcacactctc

SEQ ID NO: 91269 - DNA, 20 bp, Artificial Sequence
  chemically synthesized
ctatctaggcacacacacaa

SEQ ID NO: 91270 - DNA, 20 bp, Artificial Sequence
  chemically synthesized
gtgacttttgtgtgtgtgcc

SEQ ID NO: 91271 - DNA, 20 bp, Artificial Sequence
  chemically synthesized
cttttgtgtgtgtgcctaga

SEQ ID NO: 91272 - DNA, 20 bp, Artificial Sequence
  chemically synthesized
ataggatgaaagaactatct

SEQ ID NO: 91273 - DNA, 20 bp, Artificial Sequence
  chemically synthesized
aataggatgaaagaactatc

SEQ ID NO: 91274 - DNA, 20 bp, Artificial Sequence
  chemically synthesized
agaaaagcaaaataggatga

SEQ ID NO: 91275 - DNA, 20 bp, Artificial Sequence
  chemically synthesized
taagagaagaaaagcaaaat

SEQ ID NO: 91276 - DNA, 20 bp, Artificial Sequence
  chemically synthesized
ataagagaagaaaagcaaaa

SEQ ID NO: 91277 - DNA, 20 bp, Artificial Sequence
  chemically synthesized
cctattgtataagagaagaa

SEQ ID NO: 91278 - DNA, 20 bp, Artificial Sequence
  chemically synthesized
ttcaccctattgtataagag

SEQ ID NO: 91279 - DNA, 20 bp, Artificial Sequence
  chemically synthesized
ctgttcaccctattgtataa

SEQ ID NO: 91280 - DNA, 20 bp, Artificial Sequence
  chemically synthesized
gcttttcttctcttatacaa

SEQ ID NO: 91281 - DNA, 20 bp, Artificial Sequence
  chemically synthesized
cttttcttctcttatacaat

SEQ ID NO: 91282 - DNA, 20 bp, Artificial Sequence
  chemically synthesized
cactgttcaccctattgtat

SEQ ID NO: 91283 - DNA, 20 bp, Artificial Sequence
  chemically synthesized
ttttcttctcttatacaata

SEQ ID NO: 91284 - DNA, 20 bp, Artificial Sequence
  chemically synthesized
ctcttatacaatagggtgaa

SEQ ID NO: 91285 - DNA, 20 bp, Artificial Sequence
  chemically synthesized
tacaatagggtgaacagtga

SEQ ID NO: 91286 - DNA, 20 bp, Artificial Sequence
  chemically synthesized
acaatagggtgaacagtgat

SEQ ID NO: 91287 - DNA, 20 bp, Artificial Sequence
  chemically synthesized
caatagggtgaacagtgatg

SEQ ID NO: 91288 - DNA, 20 bp, Artificial Sequence
  chemically synthesized
atagggtgaacagtgatggg

SEQ ID NO: 91289 - DNA, 20 bp, Artificial Sequence
  chemically synthesized
acagtgatggggagaaaaca

SEQ ID NO: 91290 - DNA, 20 bp, Artificial Sequence
  chemically synthesized
ttcctcatacattaacaaaa

SEQ ID NO: 91291 - DNA, 20 bp, Artificial Sequence
  chemically synthesized
ttttcctcatacattaacaa

SEQ ID NO: 91292 - DNA, 20 bp, Artificial Sequence
  chemically synthesized
ttactcttttgttaatgtat

SEQ ID NO: 91293 - DNA, 20 bp, Artificial Sequence
  chemically synthesized
tactcttttgttaatgtatg

SEQ ID NO: 91294 - DNA, 20 bp, Artificial Sequence
  chemically synthesized
ttttgttaatgtatgaggaa

SEQ ID NO: 91295 - DNA, 20 bp, Artificial Sequence
  chemically synthesized
tttgttaatgtatgaggaaa

SEQ ID NO: 91296 - DNA, 20 bp, Artificial Sequence
  chemically synthesized
tgttaatgtatgaggaaaag

SEQ ID NO: 91297 - DNA, 20 bp, Artificial Sequence
  chemically synthesized
gttaatgtatgaggaaaagg

SEQ ID NO: 91298 - DNA, 20 bp, Artificial Sequence
  chemically synthesized
aatgtatgaggaaaaggagg

SEQ ID NO: 91299 - DNA, 20 bp, Artificial Sequence
  chemically synthesized
tatgaggaaaaggaggaaga

SEQ ID NO: 91300 - DNA, 20 bp, Artificial Sequence
  chemically synthesized
atgaggaaaaggaggaagac

SEQ ID NO: 91301 - DNA, 20 bp, Artificial Sequence
  chemically synthesized
tgaggaaaaggaggaagaca

SEQ ID NO: 91302 - DNA, 20 bp, Artificial Sequence
  chemically synthesized
gaggaaaaggaggaagacag

SEQ ID NO: 91303 - DNA, 20 bp, Artificial Sequence
  chemically synthesized
gaagacaggggatatgcatg

SEQ ID NO: 91304 - DNA, 20 bp, Artificial Sequence
  chemically synthesized
tgcatgtggacactgatgta

SEQ ID NO: 91305 - DNA, 20 bp, Artificial Sequence
  chemically synthesized
gcatgtggacactgatgtaa

SEQ ID NO: 91306 - DNA, 20 bp, Artificial Sequence
  chemically synthesized
aatattacctacctttacat

SEQ ID NO: 91307 - DNA, 20 bp, Artificial Sequence
  chemically synthesized
tgtggacactgatgtaaagg

SEQ ID NO: 91308 - DNA, 20 bp, Artificial Sequence
  chemically synthesized
gtggacactgatgtaaaggt

SEQ ID NO: 91309 - DNA, 20 bp, Artificial Sequence
  chemically synthesized
atgtaaaggtaggtaatatt

SEQ ID NO: 91310 - DNA, 20 bp, Artificial Sequence
  chemically synthesized
gtaatatttggcatatttgc

SEQ ID NO: 91311 - DNA, 20 bp, Artificial Sequence
  chemically synthesized
taatatttggcatatttgcc

SEQ ID NO: 91312 - DNA, 20 bp, Artificial Sequence
  chemically synthesized
cctttatgacatttttttcc

SEQ ID NO: 91313 - DNA, 20 bp, Artificial Sequence
  chemically synthesized
gccgggaaaaaaatgtcata

SEQ ID NO: 91314 - DNA, 20 bp, Artificial Sequence
  chemically synthesized
ccgggaaaaaaatgtcataa

SEQ ID NO: 91315 - DNA, 20 bp, Artificial Sequence
  chemically synthesized
aaaaaaatgtcataaaggaa

SEQ ID NO: 91316 - DNA, 20 bp, Artificial Sequence
  chemically synthesized
aaaatgtcataaaggaaaag

SEQ ID NO: 91317 - DNA, 20 bp, Artificial Sequence
  chemically synthesized
aaatgtcataaaggaaaagt

SEQ ID NO: 91318 - DNA, 20 bp, Artificial Sequence
  chemically synthesized
ggaaaagtaggcaaaatgct

SEQ ID NO: 91319 - DNA, 20 bp, Artificial Sequence
  chemically synthesized
gaaaagtaggcaaaatgcta

SEQ ID NO: 91320 - DNA, 20 bp, Artificial Sequence
  chemically synthesized
aagaatgaggaaatgtacct

SEQ ID NO: 91321 - DNA, 20 bp, Artificial Sequence
  chemically synthesized
aaggtacatttcctcattct

SEQ ID NO: 91322 - DNA, 20 bp, Artificial Sequence
  chemically synthesized
atgaatgggttctaagaatg

SEQ ID NO: 91323 - DNA, 20 bp, Artificial Sequence
  chemically synthesized
catgaatgggttctaagaat

SEQ ID NO: 91324 - DNA, 20 bp, Artificial Sequence
  chemically synthesized
aaagctcatgaatgggttct

SEQ ID NO: 91325 - DNA, 20 bp, Artificial Sequence
  chemically synthesized
cattcttagaacccattcat

SEQ ID NO: 91326 - DNA, 20 bp, Artificial Sequence
  chemically synthesized
acaatggaaagctcatgaat

SEQ ID NO: 91327 - DNA, 20 bp, Artificial Sequence
  chemically synthesized
cacaatggaaagctcatgaa

SEQ ID NO: 91328 - DNA, 20 bp, Artificial Sequence
  chemically synthesized
ccaaaccatatcacaatgga

SEQ ID NO: 91329 - DNA, 20 bp, Artificial Sequence
  chemically synthesized
aaagccaaaccatatcacaa

SEQ ID NO: 91330 - DNA, 20 bp, Artificial Sequence
  chemically synthesized
atgagctttccattgtgata

SEQ ID NO: 91331 - DNA, 20 bp, Artificial Sequence
  chemically synthesized
ctttccattgtgatatggtt

SEQ ID NO: 91332 - DNA, 20 bp, Artificial Sequence
  chemically synthesized
gagatttgggtgaggacaca

SEQ ID NO: 91333 - DNA, 20 bp, Artificial Sequence
  chemically synthesized
ttctagatgagatttgggtg

SEQ ID NO: 91334 - DNA, 20 bp, Artificial Sequence
  chemically synthesized
gttctagatgagatttgggt

SEQ ID NO: 91335 - DNA, 20 bp, Artificial Sequence
  chemically synthesized
tacagttctagatgagattt

SEQ ID NO: 91336 - DNA, 20 bp, Artificial Sequence
  chemically synthesized
ttacagttctagatgagatt

SEQ ID NO: 91337 - DNA, 20 bp, Artificial Sequence
  chemically synthesized
gtcctcacccaaatctcatc

SEQ ID NO: 91338 - DNA, 20 bp, Artificial Sequence
  chemically synthesized
cccggattacagttctagat

SEQ ID NO: 91339 - DNA, 20 bp, Artificial Sequence
  chemically synthesized
gttcccccggattacagttc

SEQ ID NO: 91340 - DNA, 20 bp, Artificial Sequence
  chemically synthesized
tctcatctagaactgtaatc

SEQ ID NO: 91341 - DNA, 20 bp, Artificial Sequence
  chemically synthesized
ctcatctagaactgtaatcc

SEQ ID NO: 91342 - DNA, 20 bp, Artificial Sequence
  chemically synthesized
tcatctagaactgtaatccg

SEQ ID NO: 91343 - DNA, 20 bp, Artificial Sequence
  chemically synthesized
caccaggttcccccggatta

SEQ ID NO: 91344 - DNA, 20 bp, Artificial Sequence
  chemically synthesized
catctagaactgtaatccgg

SEQ ID NO: 91345 - DNA, 20 bp, Artificial Sequence
  chemically synthesized
cacctcccaccaggttcccc

SEQ ID NO: 91346 - DNA, 20 bp, Artificial Sequence
  chemically synthesized
aactgtaatccgggggaacc

SEQ ID NO: 91347 - DNA, 20 bp, Artificial Sequence
  chemically synthesized
tgtaatccgggggaacctgg

SEQ ID NO: 91348 - DNA, 20 bp, Artificial Sequence
  chemically synthesized
gtaatccgggggaacctggt

SEQ ID NO: 91349 - DNA, 20 bp, Artificial Sequence
  chemically synthesized
aatccgggggaacctggtgg

SEQ ID NO: 91350 - DNA, 20 bp, Artificial Sequence
  chemically synthesized
atccgggggaacctggtggg

SEQ ID NO: 91351 - DNA, 20 bp, Artificial Sequence
  chemically synthesized
tgatccaatcacctcccacc

SEQ ID NO: 91352 - DNA, 20 bp, Artificial Sequence
  chemically synthesized
atgatccaatcacctcccac

SEQ ID NO: 91353 - DNA, 20 bp, Artificial Sequence
  chemically synthesized
ggaacctggtgggaggtgat

SEQ ID NO: 91354 - DNA, 20 bp, Artificial Sequence
  chemically synthesized
ggtgggaggtgattggatca

SEQ ID NO: 91355 - DNA, 20 bp, Artificial Sequence
  chemically synthesized
gtgggaggtgattggatcat

SEQ ID NO: 91356 - DNA, 20 bp, Artificial Sequence
  chemically synthesized
tgggaggtgattggatcatg

SEQ ID NO: 91357 - DNA, 20 bp, Artificial Sequence
  chemically synthesized
gggaggtgattggatcatgg

SEQ ID NO: 91358 - DNA, 20 bp, Artificial Sequence
  chemically synthesized
aggtgattggatcatggggg

SEQ ID NO: 91359 - DNA, 20 bp, Artificial Sequence
  chemically synthesized
atgggaaaacagcatggggg

SEQ ID NO: 91360 - DNA, 20 bp, Artificial Sequence
  chemically synthesized
cacatgggaaaacagcatgg

SEQ ID NO: 91361 - DNA, 20 bp, Artificial Sequence
  chemically synthesized
tcacatgggaaaacagcatg

SEQ ID NO: 91362 - DNA, 20 bp, Artificial Sequence
  chemically synthesized
atcacatgggaaaacagcat

SEQ ID NO: 91363 - DNA, 20 bp, Artificial Sequence
  chemically synthesized
tatcacatgggaaaacagca

SEQ ID NO: 91364 - DNA, 20 bp, Artificial Sequence
  chemically synthesized
ctcactatcacatgggaaaa

SEQ ID NO: 91365 - DNA, 20 bp, Artificial Sequence
  chemically synthesized
catgctgttttcccatgtga

SEQ ID NO: 91366 - DNA, 20 bp, Artificial Sequence
  chemically synthesized
gaactcactcactatcacat

SEQ ID NO: 91367 - DNA, 20 bp, Artificial Sequence
  chemically synthesized
agaactcactcactatcaca

SEQ ID NO: 91368 - DNA, 20 bp, Artificial Sequence
  chemically synthesized
ctgttttcccatgtgatagt

SEQ ID NO: 91369 - DNA, 20 bp, Artificial Sequence
  chemically synthesized
tttcccatgtgatagtgagt

SEQ ID NO: 91370 - DNA, 20 bp, Artificial Sequence
  chemically synthesized
gatagtgagtgagttctcat

SEQ ID NO: 91371 - DNA, 20 bp, Artificial Sequence
  chemically synthesized
ataaaaccatcaaatctcat

SEQ ID NO: 91372 - DNA, 20 bp, Artificial Sequence
  chemically synthesized
tgagttctcatgagatttga

SEQ ID NO: 91373 - DNA, 20 bp, Artificial Sequence
  chemically synthesized
atgagatttgatggttttat

SEQ ID NO: 91374 - DNA, 20 bp, Artificial Sequence
  chemically synthesized
tgagatttgatggttttata

SEQ ID NO: 91375 - DNA, 20 bp, Artificial Sequence
  chemically synthesized
gagatttgatggttttataa

SEQ ID NO: 91376 - DNA, 20 bp, Artificial Sequence
  chemically synthesized
agatttgatggttttataag

SEQ ID NO: 91377 - DNA, 20 bp, Artificial Sequence
  chemically synthesized
agagaaagagtgaatgggaa

SEQ ID NO: 91378 - DNA, 20 bp, Artificial Sequence
  chemically synthesized
agagagaaagagtgaatggg

SEQ ID NO: 91379 - DNA, 20 bp, Artificial Sequence
  chemically synthesized
gagagagagaaagagtgaat

SEQ ID NO: 91380 - DNA, 20 bp, Artificial Sequence
  chemically synthesized
agagagagagaaagagtgaa

SEQ ID NO: 91381 - DNA, 20 bp, Artificial Sequence
  chemically synthesized
cagcaggagagagagagaaa

SEQ ID NO: 91382 - DNA, 20 bp, Artificial Sequence
  chemically synthesized
ggcagcaggagagagagaga

SEQ ID NO: 91383 - DNA, 20 bp, Artificial Sequence
  chemically synthesized
acaaggcagcaggagagaga

SEQ ID NO: 91384 - DNA, 20 bp, Artificial Sequence
  chemically synthesized
tcacaaggcagcaggagaga

SEQ ID NO: 91385 - DNA, 20 bp, Artificial Sequence
  chemically synthesized
cttcacaaggcagcaggaga

SEQ ID NO: 91386 - DNA, 20 bp, Artificial Sequence
  chemically synthesized
accttcacaaggcagcagga

SEQ ID NO: 91387 - DNA, 20 bp, Artificial Sequence
  chemically synthesized
gcaccttcacaaggcagcag

SEQ ID NO: 91388 - DNA, 20 bp, Artificial Sequence
  chemically synthesized
aagcaccttcacaaggcagc

SEQ ID NO: 91389 - DNA, 20 bp, Artificial Sequence
  chemically synthesized
gaagcaccttcacaaggcag

SEQ ID NO: 91390 - DNA, 20 bp, Artificial Sequence
  chemically synthesized
ctctctcctgctgccttgtg

SEQ ID NO: 91391 - DNA, 20 bp, Artificial Sequence
  chemically synthesized
aaggaagcaccttcacaagg

SEQ ID NO: 91392 - DNA, 20 bp, Artificial Sequence
  chemically synthesized
tctctcctgctgccttgtga

SEQ ID NO: 91393 - DNA, 20 bp, Artificial Sequence
  chemically synthesized
gggaaggaagcaccttcaca

SEQ ID NO: 91394 - DNA, 20 bp, Artificial Sequence
  chemically synthesized
ggggaaggaagcaccttcac

SEQ ID NO: 91395 - DNA, 20 bp, Artificial Sequence
  chemically synthesized
gtggaaagcaaaggggaagg

SEQ ID NO: 91396 - DNA, 20 bp, Artificial Sequence
  chemically synthesized
atggtggaaagcaaagggga

SEQ ID NO: 91397 - DNA, 20 bp, Artificial Sequence
  chemically synthesized
catggtggaaagcaaagggg

SEQ ID NO: 91398 - DNA, 20 bp, Artificial Sequence
  chemically synthesized
aatcatggtggaaagcaaag

SEQ ID NO: 91399 - DNA, 20 bp, Artificial Sequence
  chemically synthesized
taatcatggtggaaagcaaa

SEQ ID NO: 91400 - DNA, 20 bp, Artificial Sequence
  chemically synthesized
ataatcatggtggaaagcaa

SEQ ID NO: 91401 - DNA, 20 bp, Artificial Sequence
  chemically synthesized
tataatcatggtggaaagca

SEQ ID NO: 91402 - DNA, 20 bp, Artificial Sequence
  chemically synthesized
aaacttataatcatggtgga

SEQ ID NO: 91403 - DNA, 20 bp, Artificial Sequence
  chemically synthesized
caggaaacttataatcatgg

SEQ ID NO: 91404 - DNA, 20 bp, Artificial Sequence
  chemically synthesized
ttgctttccaccatgattat

SEQ ID NO: 91405 - DNA, 20 bp, Artificial Sequence
  chemically synthesized
cctcaggaaacttataatca

SEQ ID NO: 91406 - DNA, 20 bp, Artificial Sequence
  chemically synthesized
accatgattataagtttcct

SEQ ID NO: 91407 - DNA, 20 bp, Artificial Sequence
  chemically synthesized
ccatgattataagtttcctg

SEQ ID NO: 91408 - DNA, 20 bp, Artificial Sequence
  chemically synthesized
tgtgtggctggggaggcctc

SEQ ID NO: 91409 - DNA, 20 bp, Artificial Sequence
  chemically synthesized
ctgtgtggctggggaggcct

SEQ ID NO: 91410 - DNA, 20 bp, Artificial Sequence
  chemically synthesized
taagtttcctgaggcctccc

SEQ ID NO: 91411 - DNA, 20 bp, Artificial Sequence
  chemically synthesized
acagttctgtgtggctgggg

SEQ ID NO: 91412 - DNA, 20 bp, Artificial Sequence
  chemically synthesized
cacagttctgtgtggctggg

SEQ ID NO: 91413 - DNA, 20 bp, Artificial Sequence
  chemically synthesized
ctcacagttctgtgtggctg

SEQ ID NO: 91414 - DNA, 20 bp, Artificial Sequence
  chemically synthesized
ctgaggcctccccagccaca

SEQ ID NO: 91415 - DNA, 20 bp, Artificial Sequence
  chemically synthesized
actcacagttctgtgtggct

SEQ ID NO: 91416 - DNA, 20 bp, Artificial Sequence
  chemically synthesized
gactcacagttctgtgtggc

SEQ ID NO: 91417 - DNA, 20 bp, Artificial Sequence
  chemically synthesized
agttgactcacagttctgtg

SEQ ID NO: 91418 - DNA, 20 bp, Artificial Sequence
  chemically synthesized
ccccagccacacagaactgt

SEQ ID NO: 91419 - DNA, 20 bp, Artificial Sequence
  chemically synthesized
aaagaggtttagttgactca

SEQ ID NO: 91420 - DNA, 20 bp, Artificial Sequence
  chemically synthesized
tatttaaagaaaaagaggtt

SEQ ID NO: 91421 - DNA, 20 bp, Artificial Sequence
  chemically synthesized
taatttatttaaagaaaaag

SEQ ID NO: 91422 - DNA, 20 bp, Artificial Sequence
  chemically synthesized
gtaatttatttaaagaaaaa

SEQ ID NO: 91423 - DNA, 20 bp, Artificial Sequence
  chemically synthesized
gggtaatttatttaaagaaa

SEQ ID NO: 91424 - DNA, 20 bp, Artificial Sequence
  chemically synthesized
agactggggtaatttattta

SEQ ID NO: 91425 - DNA, 20 bp, Artificial Sequence
  chemically synthesized
tttctttaaataaattaccc

SEQ ID NO: 91426 - DNA, 20 bp, Artificial Sequence
  chemically synthesized
taaataaattaccccagtct

SEQ ID NO: 91427 - DNA, 20 bp, Artificial Sequence
  chemically synthesized
aaataaattaccccagtctc

SEQ ID NO: 91428 - DNA, 20 bp, Artificial Sequence
  chemically synthesized
aaagaacttccctgagactg

SEQ ID NO: 91429 - DNA, 20 bp, Artificial Sequence
  chemically synthesized
aataaattaccccagtctca

SEQ ID NO: 91430 - DNA, 20 bp, Artificial Sequence
  chemically synthesized
taaagaacttccctgagact

SEQ ID NO: 91431 - DNA, 20 bp, Artificial Sequence
  chemically synthesized
ataaagaacttccctgagac

SEQ ID NO: 91432 - DNA, 20 bp, Artificial Sequence
  chemically synthesized
aaattaccccagtctcaggg

SEQ ID NO: 91433 - DNA, 20 bp, Artificial Sequence
  chemically synthesized
ctgctataaagaacttccct

SEQ ID NO: 91434 - DNA, 20 bp, Artificial Sequence
  chemically synthesized
agtctcagggaagttcttta

SEQ ID NO: 91435 - DNA, 20 bp, Artificial Sequence
  chemically synthesized
ctcagggaagttctttatag

SEQ ID NO: 91436 - DNA, 20 bp, Artificial Sequence
  chemically synthesized
gttcgtttcacactgctata

SEQ ID NO: 91437 - DNA, 20 bp, Artificial Sequence
  chemically synthesized
aatagatacacgatgtatat

SEQ ID NO: 91438 - DNA, 20 bp, Artificial Sequence
  chemically synthesized
aatgctttgggaagaattaa

SEQ ID NO: 91439 - DNA, 20 bp, Artificial Sequence
  chemically synthesized
gtatctattaattcttccca

SEQ ID NO: 91440 - DNA, 20 bp, Artificial Sequence
  chemically synthesized
actgaactgaatgctttggg

SEQ ID NO: 91441 - DNA, 20 bp, Artificial Sequence
  chemically synthesized
tgaactgaactgaatgcttt

SEQ ID NO: 91442 - DNA, 20 bp, Artificial Sequence
  chemically synthesized
ttaattcttcccaaagcatt

SEQ ID NO: 91443 - DNA, 20 bp, Artificial Sequence
  chemically synthesized
ctgaactgaactgaatgctt

SEQ ID NO: 91444 - DNA, 20 bp, Artificial Sequence
  chemically synthesized
tcttcccaaagcattcagtt

SEQ ID NO: 91445 - DNA, 20 bp, Artificial Sequence
  chemically synthesized
ccaaagcattcagttcagtt

SEQ ID NO: 91446 - DNA, 20 bp, Artificial Sequence
  chemically synthesized
aagcattcagttcagttcag

SEQ ID NO: 91447 - DNA, 20 bp, Artificial Sequence
  chemically synthesized
cagttcagttcagaagatgc

SEQ ID NO: 91448 - DNA, 20 bp, Artificial Sequence
  chemically synthesized
gttcagttcagaagatgcta

SEQ ID NO: 91449 - DNA, 20 bp, Artificial Sequence
  chemically synthesized
tgagatggtctaagggtctc

SEQ ID NO: 91450 - DNA, 20 bp, Artificial Sequence
  chemically synthesized
cagaagatgctagagaccct

SEQ ID NO: 91451 - DNA, 20 bp, Artificial Sequence
  chemically synthesized
gcttcagtgagatggtctaa

SEQ ID NO: 91452 - DNA, 20 bp, Artificial Sequence
  chemically synthesized
tgcttcagtgagatggtcta

SEQ ID NO: 91453 - DNA, 20 bp, Artificial Sequence
  chemically synthesized
ctgcttcagtgagatggtct

SEQ ID NO: 91454 - DNA, 20 bp, Artificial Sequence
  chemically synthesized
ctggacctgcttcagtgaga

SEQ ID NO: 91455 - DNA, 20 bp, Artificial Sequence
  chemically synthesized
acccttagaccatctcactg

SEQ ID NO: 91456 - DNA, 20 bp, Artificial Sequence
  chemically synthesized
cttagaccatctcactgaag

SEQ ID NO: 91457 - DNA, 20 bp, Artificial Sequence
  chemically synthesized
taccctggacctgcttcagt

SEQ ID NO: 91458 - DNA, 20 bp, Artificial Sequence
  chemically synthesized
ttagaccatctcactgaagc

SEQ ID NO: 91459 - DNA, 20 bp, Artificial Sequence
  chemically synthesized
aaaataccctggacctgctt

SEQ ID NO: 91460 - DNA, 20 bp, Artificial Sequence
  chemically synthesized
ccatctcactgaagcaggtc

SEQ ID NO: 91461 - DNA, 20 bp, Artificial Sequence
  chemically synthesized
catctcactgaagcaggtcc

SEQ ID NO: 91462 - DNA, 20 bp, Artificial Sequence
  chemically synthesized
atctcactgaagcaggtcca

SEQ ID NO: 91463 - DNA, 20 bp, Artificial Sequence
  chemically synthesized
caaggacacaaaaaataccc

SEQ ID NO: 91464 - DNA, 20 bp, Artificial Sequence
  chemically synthesized
gaacattgcatcatggcaca

SEQ ID NO: 91465 - DNA, 20 bp, Artificial Sequence
  chemically synthesized
agaacattgcatcatggcac

SEQ ID NO: 91466 - DNA, 20 bp, Artificial Sequence
  chemically synthesized
aagaaaagaacattgcatca

SEQ ID NO: 91467 - DNA, 20 bp, Artificial Sequence
  chemically synthesized
tcaaaaaaaaagaagaagaa

SEQ ID NO: 91468 - DNA, 20 bp, Artificial Sequence
  chemically synthesized
ccgtctcaaaaaaaaagaag

SEQ ID NO: 91469 - DNA, 20 bp, Artificial Sequence
  chemically synthesized
actccgtctcaaaaaaaaag

SEQ ID NO: 91470 - DNA, 20 bp, Artificial Sequence
  chemically synthesized
ttttcttcttcttttttttt

SEQ ID NO: 91471 - DNA, 20 bp, Artificial Sequence
  chemically synthesized
aagactccgtctcaaaaaaa

SEQ ID NO: 91472 - DNA, 20 bp, Artificial Sequence
  chemically synthesized
cttcttctttttttttgaga

SEQ ID NO: 91473 - DNA, 20 bp, Artificial Sequence
  chemically synthesized
tcttctttttttttgagacg

SEQ ID NO: 91474 - DNA, 20 bp, Artificial Sequence
  chemically synthesized
tccagcctgggcaacagagc

SEQ ID NO: 91475 - DNA, 20 bp, Artificial Sequence
  chemically synthesized
cggagtcttgctctgttgcc

SEQ ID NO: 91476 - DNA, 20 bp, Artificial Sequence
  chemically synthesized
gcactccagcctgggcaaca

SEQ ID NO: 91477 - DNA, 20 bp, Artificial Sequence
  chemically synthesized
ggagtcttgctctgttgccc

SEQ ID NO: 91478 - DNA, 20 bp, Artificial Sequence
  chemically synthesized
ctgcactccagcctgggcaa

SEQ ID NO: 91479 - DNA, 20 bp, Artificial Sequence
  chemically synthesized
tcttgctctgttgcccaggc

SEQ ID NO: 91480 - DNA, 20 bp, Artificial Sequence
  chemically synthesized
ttgctctgttgcccaggctg

SEQ ID NO: 91481 - DNA, 20 bp, Artificial Sequence
  chemically synthesized
gcgccactgcactccagcct

SEQ ID NO: 91482 - DNA, 20 bp, Artificial Sequence
  chemically synthesized
cgcgccactgcactccagcc

SEQ ID NO: 91483 - DNA, 20 bp, Artificial Sequence
  chemically synthesized
ctgttgcccaggctggagtg

SEQ ID NO: 91484 - DNA, 20 bp, Artificial Sequence
  chemically synthesized
gagatcgcgccactgcactc

SEQ ID NO: 91485 - DNA, 20 bp, Artificial Sequence
  chemically synthesized
ttgcccaggctggagtgcag

SEQ ID NO: 91486 - DNA, 20 bp, Artificial Sequence
  chemically synthesized
ggagtgcagtggcgcgatct

SEQ ID NO: 91487 - DNA, 20 bp, Artificial Sequence
  chemically synthesized
ggtggagcttgcagtgagcc

SEQ ID NO: 91488 - DNA, 20 bp, Artificial Sequence
  chemically synthesized
gcgcgatctcggctcactgc

SEQ ID NO: 91489 - DNA, 20 bp, Artificial Sequence
  chemically synthesized
cgggaggtggagcttgcagt

SEQ ID NO: 91490 - DNA, 20 bp, Artificial Sequence
  chemically synthesized
aacccgggaggtggagcttg

SEQ ID NO: 91491 - DNA, 20 bp, Artificial Sequence
  chemically synthesized
tcactgcaagctccacctcc

SEQ ID NO: 91492 - DNA, 20 bp, Artificial Sequence
  chemically synthesized
tggcgtgaacccgggaggtg

SEQ ID NO: 91493 - DNA, 20 bp, Artificial Sequence
  chemically synthesized
cactgcaagctccacctccc

SEQ ID NO: 91494 - DNA, 20 bp, Artificial Sequence
  chemically synthesized
aatggcgtgaacccgggagg

SEQ ID NO: 91495 - DNA, 20 bp, Artificial Sequence
  chemically synthesized
gagaatggcgtgaacccggg

SEQ ID NO: 91496 - DNA, 20 bp, Artificial Sequence
  chemically synthesized
ggagaatggcgtgaacccgg

SEQ ID NO: 91497 - DNA, 20 bp, Artificial Sequence
  chemically synthesized
caggagaatggcgtgaaccc

SEQ ID NO: 91498 - DNA, 20 bp, Artificial Sequence
  chemically synthesized
gcaggagaatggcgtgaacc

SEQ ID NO: 91499 - DNA, 20 bp, Artificial Sequence
  chemically synthesized
gggaggctgaggcaggagaa

SEQ ID NO: 91500 - DNA, 20 bp, Artificial Sequence
  chemically synthesized
ttcacgccattctcctgcct

SEQ ID NO: 91501 - DNA, 20 bp, Artificial Sequence
  chemically synthesized
tacttgggaggctgaggcag

SEQ ID NO: 91502 - DNA, 20 bp, Artificial Sequence
  chemically synthesized
gctacttgggaggctgaggc

SEQ ID NO: 91503 - DNA, 20 bp, Artificial Sequence
  chemically synthesized
agctacttgggaggctgagg

SEQ ID NO: 91504 - DNA, 20 bp, Artificial Sequence
  chemically synthesized
cccagctacttgggaggctg

SEQ ID NO: 91505 - DNA, 20 bp, Artificial Sequence
  chemically synthesized
tcccagctacttgggaggct

SEQ ID NO: 91506 - DNA, 20 bp, Artificial Sequence
  chemically synthesized
ttctcctgcctcagcctccc

SEQ ID NO: 91507 - DNA, 20 bp, Artificial Sequence
  chemically synthesized
tcctgcctcagcctcccaag

SEQ ID NO: 91508 - DNA, 20 bp, Artificial Sequence
  chemically synthesized
tgtagtcccagctacttggg

SEQ ID NO: 91509 - DNA, 20 bp, Artificial Sequence
  chemically synthesized
ctgtagtcccagctacttgg

SEQ ID NO: 91510 - DNA, 20 bp, Artificial Sequence
  chemically synthesized
gcctcagcctcccaagtagc

SEQ ID NO: 91511 - DNA, 20 bp, Artificial Sequence
  chemically synthesized
gcctgtagtcccagctactt

SEQ ID NO: 91512 - DNA, 20 bp, Artificial Sequence
  chemically synthesized
cctcagcctcccaagtagct

SEQ ID NO: 91513 - DNA, 20 bp, Artificial Sequence
  chemically synthesized
cgcctgtagtcccagctact

SEQ ID NO: 91514 - DNA, 20 bp, Artificial Sequence
  chemically synthesized
ctcccaagtagctgggacta

SEQ ID NO: 91515 - DNA, 20 bp, Artificial Sequence
  chemically synthesized
tcccaagtagctgggactac

SEQ ID NO: 91516 - DNA, 20 bp, Artificial Sequence
  chemically synthesized
gtggcgggcgcctgtagtcc

SEQ ID NO: 91517 - DNA, 20 bp, Artificial Sequence
  chemically synthesized
ggcgtggtggcgggcgcctg

SEQ ID NO: 91518 - DNA, 20 bp, Artificial Sequence
  chemically synthesized
aattagccgggcgtggtggc

SEQ ID NO: 91519 - DNA, 20 bp, Artificial Sequence
  chemically synthesized
aaattagccgggcgtggtgg

SEQ ID NO: 91520 - DNA, 20 bp, Artificial Sequence
  chemically synthesized
caggcgcccgccaccacgcc

SEQ ID NO: 91521 - DNA, 20 bp, Artificial Sequence
  chemically synthesized
aaaaaattagccgggcgtgg

SEQ ID NO: 91522 - DNA, 20 bp, Artificial Sequence
  chemically synthesized
tacaaaaaattagccgggcg

SEQ ID NO: 91523 - DNA, 20 bp, Artificial Sequence
  chemically synthesized
taaaatacaaaaaattagcc

SEQ ID NO: 91524 - DNA, 20 bp, Artificial Sequence
  chemically synthesized
ttaaaatacaaaaaattagc

SEQ ID NO: 91525 - DNA, 20 bp, Artificial Sequence
  chemically synthesized
ctacttaaaatacaaaaaat

SEQ ID NO: 91526 - DNA, 20 bp, Artificial Sequence
  chemically synthesized
cggctaattttttgtatttt

SEQ ID NO: 91527 - DNA, 20 bp, Artificial Sequence
  chemically synthesized
ctaattttttgtattttaag

SEQ ID NO: 91528 - DNA, 20 bp, Artificial Sequence
  chemically synthesized
ttttgtattttaagtagata

SEQ ID NO: 91529 - DNA, 20 bp, Artificial Sequence
  chemically synthesized
tttgtattttaagtagatac

SEQ ID NO: 91530 - DNA, 20 bp, Artificial Sequence
  chemically synthesized
ttgtattttaagtagatacg

SEQ ID NO: 91531 - DNA, 20 bp, Artificial Sequence
  chemically synthesized
gatacggggtgtcaccatgt

SEQ ID NO: 91532 - DNA, 20 bp, Artificial Sequence
  chemically synthesized
cggggtgtcaccatgttagc

SEQ ID NO: 91533 - DNA, 20 bp, Artificial Sequence
  chemically synthesized
cgagaccatcctggctaaca

SEQ ID NO: 91534 - DNA, 20 bp, Artificial Sequence
  chemically synthesized
ggggtgtcaccatgttagcc

SEQ ID NO: 91535 - DNA, 20 bp, Artificial Sequence
  chemically synthesized
tgtcaccatgttagccagga

SEQ ID NO: 91536 - DNA, 20 bp, Artificial Sequence
  chemically synthesized
tcaggagatcgagaccatcc

SEQ ID NO: 91537 - DNA, 20 bp, Artificial Sequence
  chemically synthesized
gatcacgaggtcaggagatc

SEQ ID NO: 91538 - DNA, 20 bp, Artificial Sequence
  chemically synthesized
tgggcagatcacgaggtcag

SEQ ID NO: 91539 - DNA, 20 bp, Artificial Sequence
  chemically synthesized
ggtgggcagatcacgaggtc

SEQ ID NO: 91540 - DNA, 20 bp, Artificial Sequence
  chemically synthesized
aggtgggcagatcacgaggt

SEQ ID NO: 91541 - DNA, 20 bp, Artificial Sequence
  chemically synthesized
gctgaggtgggcagatcacg

SEQ ID NO: 91542 - DNA, 20 bp, Artificial Sequence
  chemically synthesized
ggctgaggtgggcagatcac

SEQ ID NO: 91543 - DNA, 20 bp, Artificial Sequence
  chemically synthesized
acctcgtgatctgcccacct

SEQ ID NO: 91544 - DNA, 20 bp, Artificial Sequence
  chemically synthesized
ctttgggaggctgaggtggg

SEQ ID NO: 91545 - DNA, 20 bp, Artificial Sequence
  chemically synthesized
gcactttgggaggctgaggt

SEQ ID NO: 91546 - DNA, 20 bp, Artificial Sequence
  chemically synthesized
agcactttgggaggctgagg

SEQ ID NO: 91547 - DNA, 20 bp, Artificial Sequence
  chemically synthesized
cccagcactttgggaggctg

SEQ ID NO: 91548 - DNA, 20 bp, Artificial Sequence
  chemically synthesized
tcccagcactttgggaggct

SEQ ID NO: 91549 - DNA, 20 bp, Artificial Sequence
  chemically synthesized
ctgcccacctcagcctccca

SEQ ID NO: 91550 - DNA, 20 bp, Artificial Sequence
  chemically synthesized
tgtaatcccagcactttggg

SEQ ID NO: 91551 - DNA, 20 bp, Artificial Sequence
  chemically synthesized
ctgtaatcccagcactttgg

SEQ ID NO: 91552 - DNA, 20 bp, Artificial Sequence
  chemically synthesized
acctcagcctcccaaagtgc

SEQ ID NO: 91553 - DNA, 20 bp, Artificial Sequence
  chemically synthesized
gcctgtaatcccagcacttt

SEQ ID NO: 91554 - DNA, 20 bp, Artificial Sequence
  chemically synthesized
cctcagcctcccaaagtgct

SEQ ID NO: 91555 - DNA, 20 bp, Artificial Sequence
  chemically synthesized
cgcctgtaatcccagcactt

SEQ ID NO: 91556 - DNA, 20 bp, Artificial Sequence
  chemically synthesized
ctcccaaagtgctgggatta

SEQ ID NO: 91557 - DNA, 20 bp, Artificial Sequence
  chemically synthesized
tcccaaagtgctgggattac

SEQ ID NO: 91558 - DNA, 20 bp, Artificial Sequence
  chemically synthesized
tggctcaacgcctgtaatcc

SEQ ID NO: 91559 - DNA, 20 bp, Artificial Sequence
  chemically synthesized
gtgctgggattacaggcgtt

SEQ ID NO: 91560 - DNA, 20 bp, Artificial Sequence
  chemically synthesized
aggcgttgagccaccgcgcc

SEQ ID NO: 91561 - DNA, 20 bp, Artificial Sequence
  chemically synthesized
agcattgcggccgggcgcgg

SEQ ID NO: 91562 - DNA, 20 bp, Artificial Sequence
  chemically synthesized
aagagcattgcggccgggcg

SEQ ID NO: 91563 - DNA, 20 bp, Artificial Sequence
  chemically synthesized
ttgaaaagagcattgcggcc

SEQ ID NO: 91564 - DNA, 20 bp, Artificial Sequence
  chemically synthesized
gttgaaaagagcattgcggc

SEQ ID NO: 91565 - DNA, 20 bp, Artificial Sequence
  chemically synthesized
ctcagttgaaaagagcattg

SEQ ID NO: 91566 - DNA, 20 bp, Artificial Sequence
  chemically synthesized
tacttgttctcagttgaaaa

SEQ ID NO: 91567 - DNA, 20 bp, Artificial Sequence
  chemically synthesized
ccgcaatgctcttttcaact

SEQ ID NO: 91568 - DNA, 20 bp, Artificial Sequence
  chemically synthesized
tgtacttgttctcagttgaa

SEQ ID NO: 91569 - DNA, 20 bp, Artificial Sequence
  chemically synthesized
tgctcttttcaactgagaac

SEQ ID NO: 91570 - DNA, 20 bp, Artificial Sequence
  chemically synthesized
tttccaaatgtacttgttct

SEQ ID NO: 91571 - DNA, 20 bp, Artificial Sequence
  chemically synthesized
caactgagaacaagtacatt

SEQ ID NO: 91572 - DNA, 20 bp, Artificial Sequence
  chemically synthesized
atttggaaaatcatccccaa

SEQ ID NO: 91573 - DNA, 20 bp, Artificial Sequence
  chemically synthesized
ttggaaaatcatccccaaaa

SEQ ID NO: 91574 - DNA, 20 bp, Artificial Sequence
  chemically synthesized
tcccaaaccttgctcttttg

SEQ ID NO: 91575 - DNA, 20 bp, Artificial Sequence
  chemically synthesized
ttcccaaaccttgctctttt

SEQ ID NO: 91576 - DNA, 20 bp, Artificial Sequence
  chemically synthesized
aaaatcatccccaaaagagc

SEQ ID NO: 91577 - DNA, 20 bp, Artificial Sequence
  chemically synthesized
cttcccaaaccttgctcttt

SEQ ID NO: 91578 - DNA, 20 bp, Artificial Sequence
  chemically synthesized
aaatcatccccaaaagagca

SEQ ID NO: 91579 - DNA, 20 bp, Artificial Sequence
  chemically synthesized
atccccaaaagagcaaggtt

SEQ ID NO: 91580 - DNA, 20 bp, Artificial Sequence
  chemically synthesized
tccccaaaagagcaaggttt

SEQ ID NO: 91581 - DNA, 20 bp, Artificial Sequence
  chemically synthesized
ccaaaagagcaaggtttggg

SEQ ID NO: 91582 - DNA, 20 bp, Artificial Sequence
  chemically synthesized
caaaagagcaaggtttggga

SEQ ID NO: 91583 - DNA, 20 bp, Artificial Sequence
  chemically synthesized
gagcaaggtttgggaaggct

SEQ ID NO: 91584 - DNA, 20 bp, Artificial Sequence
  chemically synthesized
agcaaggtttgggaaggctt

SEQ ID NO: 91585 - DNA, 20 bp, Artificial Sequence
  chemically synthesized
atatgggcatggaaaggcct

SEQ ID NO: 91586 - DNA, 20 bp, Artificial Sequence
  chemically synthesized
catgtcatatgggcatggaa

SEQ ID NO: 91587 - DNA, 20 bp, Artificial Sequence
  chemically synthesized
acatgtcatatgggcatgga

SEQ ID NO: 91588 - DNA, 20 bp, Artificial Sequence
  chemically synthesized
tataacatgtcatatgggca

SEQ ID NO: 91589 - DNA, 20 bp, Artificial Sequence
  chemically synthesized
acttatataacatgtcatat

SEQ ID NO: 91590 - DNA, 20 bp, Artificial Sequence
  chemically synthesized
gacttatataacatgtcata

SEQ ID NO: 91591 - DNA, 20 bp, Artificial Sequence
  chemically synthesized
gcccatatgacatgttatat

SEQ ID NO: 91592 - DNA, 20 bp, Artificial Sequence
  chemically synthesized
catgttatataagtcttatg

SEQ ID NO: 91593 - DNA, 20 bp, Artificial Sequence
  chemically synthesized
tatctgttctagttcttcat

SEQ ID NO: 91594 - DNA, 20 bp, Artificial Sequence
  chemically synthesized
atataagtcttatgaagaac

SEQ ID NO: 91595 - DNA, 20 bp, Artificial Sequence
  chemically synthesized
agtcttatgaagaactagaa

SEQ ID NO: 91596 - DNA, 20 bp, Artificial Sequence
  chemically synthesized
agtcatcctcttatctgttc

SEQ ID NO: 91597 - DNA, 20 bp, Artificial Sequence
  chemically synthesized
tatgaagaactagaacagat

SEQ ID NO: 91598 - DNA, 20 bp, Artificial Sequence
  chemically synthesized
tgaagaactagaacagataa

SEQ ID NO: 91599 - DNA, 20 bp, Artificial Sequence
  chemically synthesized
gaagaactagaacagataag

SEQ ID NO: 91600 - DNA, 20 bp, Artificial Sequence
  chemically synthesized
cagataagaggatgacttta

SEQ ID NO: 91601 - DNA, 20 bp, Artificial Sequence
  chemically synthesized
ttcttgtaaaataatctgta

SEQ ID NO: 91602 - DNA, 20 bp, Artificial Sequence
  chemically synthesized
gactttacagattattttac

SEQ ID NO: 91603 - DNA, 20 bp, Artificial Sequence
  chemically synthesized
ttttacaagaatttttacat

SEQ ID NO: 91604 - DNA, 20 bp, Artificial Sequence
  chemically synthesized
tctgtctcaaaaaaaaaaaa

SEQ ID NO: 91605 - DNA, 20 bp, Artificial Sequence
  chemically synthesized
aatgactttttttttttttt

SEQ ID NO: 91606 - DNA, 20 bp, Artificial Sequence
  chemically synthesized
acttttttttttttttgaga

SEQ ID NO: 91607 - DNA, 20 bp, Artificial Sequence
  chemically synthesized
ttttttttttttttgagaca

SEQ ID NO: 91608 - DNA, 20 bp, Artificial Sequence
  chemically synthesized
cactccagcctgggcgacaa

SEQ ID NO: 91609 - DNA, 20 bp, Artificial Sequence
  chemically synthesized
agagttttgctcttgtcgcc

SEQ ID NO: 91610 - DNA, 20 bp, Artificial Sequence
  chemically synthesized
gagttttgctcttgtcgccc

SEQ ID NO: 91611 - DNA, 20 bp, Artificial Sequence
  chemically synthesized
tgcactccagcctgggcgac

SEQ ID NO: 91612 - DNA, 20 bp, Artificial Sequence
  chemically synthesized
tttgctcttgtcgcccaggc

SEQ ID NO: 91613 - DNA, 20 bp, Artificial Sequence
  chemically synthesized
tgctcttgtcgcccaggctg

SEQ ID NO: 91614 - DNA, 20 bp, Artificial Sequence
  chemically synthesized
acaccattgcactccagcct

SEQ ID NO: 91615 - DNA, 20 bp, Artificial Sequence
  chemically synthesized
cacaccattgcactccagcc

SEQ ID NO: 91616 - DNA, 20 bp, Artificial Sequence
  chemically synthesized
gagatcacaccattgcactc

SEQ ID NO: 91617 - DNA, 20 bp, Artificial Sequence
  chemically synthesized
tcgcccaggctggagtgcaa

SEQ ID NO: 91618 - DNA, 20 bp, Artificial Sequence
  chemically synthesized
ggagtgcaatggtgtgatct

SEQ ID NO: 91619 - DNA, 20 bp, Artificial Sequence
  chemically synthesized
gacagaggttgcagtgagcc

SEQ ID NO: 91620 - DNA, 20 bp, Artificial Sequence
  chemically synthesized
agggggacagaggttgcagt

SEQ ID NO: 91621 - DNA, 20 bp, Artificial Sequence
  chemically synthesized
caggagggggacagaggttg

SEQ ID NO: 91622 - DNA, 20 bp, Artificial Sequence
  chemically synthesized
tgaacccaggagggggacag

SEQ ID NO: 91623 - DNA, 20 bp, Artificial Sequence
  chemically synthesized
ttgaacccaggagggggaca

SEQ ID NO: 91624 - DNA, 20 bp, Artificial Sequence
  chemically synthesized
gcttgaacccaggaggggga

SEQ ID NO: 91625 - DNA, 20 bp, Artificial Sequence
  chemically synthesized
tgcaacctctgtccccctcc

SEQ ID NO: 91626 - DNA, 20 bp, Artificial Sequence
  chemically synthesized
gcaacctctgtccccctcct

SEQ ID NO: 91627 - DNA, 20 bp, Artificial Sequence
  chemically synthesized
aatcgcttgaacccaggagg

SEQ ID NO: 91628 - DNA, 20 bp, Artificial Sequence
  chemically synthesized
gaatcgcttgaacccaggag

SEQ ID NO: 91629 - DNA, 20 bp, Artificial Sequence
  chemically synthesized
agaatcgcttgaacccagga

SEQ ID NO: 91630 - DNA, 20 bp, Artificial Sequence
  chemically synthesized
gagaatcgcttgaacccagg

SEQ ID NO: 91631 - DNA, 20 bp, Artificial Sequence
  chemically synthesized
ggagaatcgcttgaacccag

SEQ ID NO: 91632 - DNA, 20 bp, Artificial Sequence
  chemically synthesized
tctgtccccctcctgggttc

SEQ ID NO: 91633 - DNA, 20 bp, Artificial Sequence
  chemically synthesized
caggagaatcgcttgaaccc

SEQ ID NO: 91634 - DNA, 20 bp, Artificial Sequence
  chemically synthesized
gcaggagaatcgcttgaacc

SEQ ID NO: 91635 - DNA, 20 bp, Artificial Sequence
  chemically synthesized
ttcaagcgattctcctgcct

SEQ ID NO: 91636 - DNA, 20 bp, Artificial Sequence
  chemically synthesized
tactcaggaggctgaggcag

SEQ ID NO: 91637 - DNA, 20 bp, Artificial Sequence
  chemically synthesized
gctactcaggaggctgaggc

SEQ ID NO: 91638 - DNA, 20 bp, Artificial Sequence
  chemically synthesized
agctactcaggaggctgagg

SEQ ID NO: 91639 - DNA, 20 bp, Artificial Sequence
  chemically synthesized
cccagctactcaggaggctg

SEQ ID NO: 91640 - DNA, 20 bp, Artificial Sequence
  chemically synthesized
tcccagctactcaggaggct

SEQ ID NO: 91641 - DNA, 20 bp, Artificial Sequence
  chemically synthesized
ttctcctgcctcagcctcct

SEQ ID NO: 91642 - DNA, 20 bp, Artificial Sequence
  chemically synthesized
tcctgcctcagcctcctgag

SEQ ID NO: 91643 - DNA, 20 bp, Artificial Sequence
  chemically synthesized
tgtaatcccagctactcagg

SEQ ID NO: 91644 - DNA, 20 bp, Artificial Sequence
  chemically synthesized
ctgtaatcccagctactcag

SEQ ID NO: 91645 - DNA, 20 bp, Artificial Sequence
  chemically synthesized
gcctcagcctcctgagtagc

SEQ ID NO: 91646 - DNA, 20 bp, Artificial Sequence
  chemically synthesized
gcctgtaatcccagctactc

SEQ ID NO: 91647 - DNA, 20 bp, Artificial Sequence
  chemically synthesized
cctcagcctcctgagtagct

SEQ ID NO: 91648 - DNA, 20 bp, Artificial Sequence
  chemically synthesized
tgcctgtaatcccagctact

SEQ ID NO: 91649 - DNA, 20 bp, Artificial Sequence
  chemically synthesized
ctcctgagtagctgggatta

SEQ ID NO: 91650 - DNA, 20 bp, Artificial Sequence
  chemically synthesized
tcctgagtagctgggattac

SEQ ID NO: 91651 - DNA, 20 bp, Artificial Sequence
  chemically synthesized
gtggcaggtgcctgtaatcc

SEQ ID NO: 91652 - DNA, 20 bp, Artificial Sequence
  chemically synthesized
aactggccgggcatggtggc

SEQ ID NO: 91653 - DNA, 20 bp, Artificial Sequence
  chemically synthesized
aaactggccgggcatggtgg

SEQ ID NO: 91654 - DNA, 20 bp, Artificial Sequence
  chemically synthesized
caggcacctgccaccatgcc

SEQ ID NO: 91655 - DNA, 20 bp, Artificial Sequence
  chemically synthesized
aaaaaactggccgggcatgg

SEQ ID NO: 91656 - DNA, 20 bp, Artificial Sequence
  chemically synthesized
ataaaaaaactggccgggca

SEQ ID NO: 91657 - DNA, 20 bp, Artificial Sequence
  chemically synthesized
cacctgccaccatgcccggc

SEQ ID NO: 91658 - DNA, 20 bp, Artificial Sequence
  chemically synthesized
taaaaataaaaaaactggcc

SEQ ID NO: 91659 - DNA, 20 bp, Artificial Sequence
  chemically synthesized
ctaaaaataaaaaaactggc

SEQ ID NO: 91660 - DNA, 20 bp, Artificial Sequence
  chemically synthesized
tctactaaaaataaaaaaac

SEQ ID NO: 91661 - DNA, 20 bp, Artificial Sequence
  chemically synthesized
ccggccagtttttttatttt

SEQ ID NO: 91662 - DNA, 20 bp, Artificial Sequence
  chemically synthesized
gccagtttttttatttttag

SEQ ID NO: 91663 - DNA, 20 bp, Artificial Sequence
  chemically synthesized
cagtttttttatttttagta

SEQ ID NO: 91664 - DNA, 20 bp, Artificial Sequence
  chemically synthesized
ttttttatttttagtagaga

SEQ ID NO: 91665 - DNA, 20 bp, Artificial Sequence
  chemically synthesized
tttttatttttagtagagac

SEQ ID NO: 91666 - DNA, 20 bp, Artificial Sequence
  chemically synthesized
ttttatttttagtagagaca

SEQ ID NO: 91667 - DNA, 20 bp, Artificial Sequence
  chemically synthesized
gagacagggtttcaccatgt

SEQ ID NO: 91668 - DNA, 20 bp, Artificial Sequence
  chemically synthesized
cagggtttcaccatgttggc

SEQ ID NO: 91669 - DNA, 20 bp, Artificial Sequence
  chemically synthesized
cgacaccagcctggccaaca

SEQ ID NO: 91670 - DNA, 20 bp, Artificial Sequence
  chemically synthesized
agggtttcaccatgttggcc

SEQ ID NO: 91671 - DNA, 20 bp, Artificial Sequence
  chemically synthesized
tttcaccatgttggccaggc

SEQ ID NO: 91672 - DNA, 20 bp, Artificial Sequence
  chemically synthesized
ttaggagttcgacaccagcc

SEQ ID NO: 91673 - DNA, 20 bp, Artificial Sequence
  chemically synthesized
taaggttaggagttcgacac

SEQ ID NO: 91674 - DNA, 20 bp, Artificial Sequence
  chemically synthesized
ggtgggtcacataaggttag

SEQ ID NO: 91675 - DNA, 20 bp, Artificial Sequence
  chemically synthesized
caggtgggtcacataaggtt

SEQ ID NO: 91676 - DNA, 20 bp, Artificial Sequence
  chemically synthesized
gcaggtgggtcacataaggt

SEQ ID NO: 91677 - DNA, 20 bp, Artificial Sequence
  chemically synthesized
tgaggcaggtgggtcacata

SEQ ID NO: 91678 - DNA, 20 bp, Artificial Sequence
  chemically synthesized
ctgaggcaggtgggtcacat

SEQ ID NO: 91679 - DNA, 20 bp, Artificial Sequence
  chemically synthesized
tttgggaagctgaggcaggt

SEQ ID NO: 91680 - DNA, 20 bp, Artificial Sequence
  chemically synthesized
cttatgtgacccacctgcct

SEQ ID NO: 91681 - DNA, 20 bp, Artificial Sequence
  chemically synthesized
ctttgggaagctgaggcagg

SEQ ID NO: 91682 - DNA, 20 bp, Artificial Sequence
  chemically synthesized
gcactttgggaagctgaggc

SEQ ID NO: 91683 - DNA, 20 bp, Artificial Sequence
  chemically synthesized
agcactttgggaagctgagg

SEQ ID NO: 91684 - DNA, 20 bp, Artificial Sequence
  chemically synthesized
cccagcactttgggaagctg

SEQ ID NO: 91685 - DNA, 20 bp, Artificial Sequence
  chemically synthesized
tcccagcactttgggaagct

SEQ ID NO: 91686 - DNA, 20 bp, Artificial Sequence
  chemically synthesized
ccacctgcctcagcttccca

SEQ ID NO: 91687 - DNA, 20 bp, Artificial Sequence
  chemically synthesized
tataatcccagcactttggg

SEQ ID NO: 91688 - DNA, 20 bp, Artificial Sequence
  chemically synthesized
gcctcagcttcccaaagtgc

SEQ ID NO: 91689 - DNA, 20 bp, Artificial Sequence
  chemically synthesized
gcctataatcccagcacttt

SEQ ID NO: 91690 - DNA, 20 bp, Artificial Sequence
  chemically synthesized
cctcagcttcccaaagtgct

SEQ ID NO: 91691 - DNA, 20 bp, Artificial Sequence
  chemically synthesized
cgcctataatcccagcactt

SEQ ID NO: 91692 - DNA, 20 bp, Artificial Sequence
  chemically synthesized
ttcccaaagtgctgggatta

SEQ ID NO: 91693 - DNA, 20 bp, Artificial Sequence
  chemically synthesized
tcccaaagtgctgggattat

SEQ ID NO: 91694 - DNA, 20 bp, Artificial Sequence
  chemically synthesized
gtggctcacgcctataatcc

SEQ ID NO: 91695 - DNA, 20 bp, Artificial Sequence
  chemically synthesized
agtgctgggattataggcgt

SEQ ID NO: 91696 - DNA, 20 bp, Artificial Sequence
  chemically synthesized
taggcgtgagccactgcacc

SEQ ID NO: 91697 - DNA, 20 bp, Artificial Sequence
  chemically synthesized
aaaatgtagtccaggtgcag

SEQ ID NO: 91698 - DNA, 20 bp, Artificial Sequence
  chemically synthesized
attaaaatgtagtccaggtg

SEQ ID NO: 91699 - DNA, 20 bp, Artificial Sequence
  chemically synthesized
tcgttattaaaatgtagtcc

SEQ ID NO: 91700 - DNA, 20 bp, Artificial Sequence
  chemically synthesized
atcgttattaaaatgtagtc

SEQ ID NO: 91701 - DNA, 20 bp, Artificial Sequence
  chemically synthesized
ctttaatcgttattaaaatg

SEQ ID NO: 91702 - DNA, 20 bp, Artificial Sequence
  chemically synthesized
ctacattttaataacgatta

SEQ ID NO: 91703 - DNA, 20 bp, Artificial Sequence
  chemically synthesized
ttttaataacgattaaagaa

SEQ ID NO: 91704 - DNA, 20 bp, Artificial Sequence
  chemically synthesized
taataacgattaaagaacag

SEQ ID NO: 91705 - DNA, 20 bp, Artificial Sequence
  chemically synthesized
ttactcagggtgttatgaag

SEQ ID NO: 91706 - DNA, 20 bp, Artificial Sequence
  chemically synthesized
ttcttactcagggtgttatg

SEQ ID NO: 91707 - DNA, 20 bp, Artificial Sequence
  chemically synthesized
aatctgcttcataacaccct

SEQ ID NO: 91708 - DNA, 20 bp, Artificial Sequence
  chemically synthesized
tgcttcataacaccctgagt

SEQ ID NO: 91709 - DNA, 20 bp, Artificial Sequence
  chemically synthesized
aatttctcatttcttactca

SEQ ID NO: 91710 - DNA, 20 bp, Artificial Sequence
  chemically synthesized
caatttctcatttcttactc

SEQ ID NO: 91711 - DNA, 20 bp, Artificial Sequence
  chemically synthesized
acaatttctcatttcttact

SEQ ID NO: 91712 - DNA, 20 bp, Artificial Sequence
  chemically synthesized
taacaccctgagtaagaaat

SEQ ID NO: 91713 - DNA, 20 bp, Artificial Sequence
  chemically synthesized
gagtaagaaatgagaaattg

SEQ ID NO: 91714 - DNA, 20 bp, Artificial Sequence
  chemically synthesized
gagaaattgtagctgcatat

SEQ ID NO: 91715 - DNA, 20 bp, Artificial Sequence
  chemically synthesized
tcagcgacaatgctgatatg

SEQ ID NO: 91716 - DNA, 20 bp, Artificial Sequence
  chemically synthesized
tcagcattgtcgctgaccct

SEQ ID NO: 91717 - DNA, 20 bp, Artificial Sequence
  chemically synthesized
tcttcgtttatactcagggt

SEQ ID NO: 91718 - DNA, 20 bp, Artificial Sequence
  chemically synthesized
ggcttcttcgtttatactca

SEQ ID NO: 91719 - DNA, 20 bp, Artificial Sequence
  chemically synthesized
aggcttcttcgtttatactc

SEQ ID NO: 91720 - DNA, 20 bp, Artificial Sequence
  chemically synthesized
gaggcttcttcgtttatact

SEQ ID NO: 91721 - DNA, 20 bp, Artificial Sequence
  chemically synthesized
gctgaccctgagtataaacg

SEQ ID NO: 91722 - DNA, 20 bp, Artificial Sequence
  chemically synthesized
gaccctgagtataaacgaag

SEQ ID NO: 91723 - DNA, 20 bp, Artificial Sequence
  chemically synthesized
gtataaacgaagaagcctca

SEQ ID NO: 91724 - DNA, 20 bp, Artificial Sequence
  chemically synthesized
tctctgtttgggtcaccatg

SEQ ID NO: 91725 - DNA, 20 bp, Artificial Sequence
  chemically synthesized
ttctctgtttgggtcaccat

SEQ ID NO: 91726 - DNA, 20 bp, Artificial Sequence
  chemically synthesized
aagcctcatggtgacccaaa

SEQ ID NO: 91727 - DNA, 20 bp, Artificial Sequence
  chemically synthesized
gcctcatggtgacccaaaca

SEQ ID NO: 91728 - DNA, 20 bp, Artificial Sequence
  chemically synthesized
tagttaacaattctctgttt

SEQ ID NO: 91729 - DNA, 20 bp, Artificial Sequence
  chemically synthesized
ttagttaacaattctctgtt

SEQ ID NO: 91730 - DNA, 20 bp, Artificial Sequence
  chemically synthesized
caaacagagaattgttaact

SEQ ID NO: 91731 - DNA, 20 bp, Artificial Sequence
  chemically synthesized
aaagcactatggacatgact

SEQ ID NO: 91732 - DNA, 20 bp, Artificial Sequence
  chemically synthesized
tgttaactaagtcatgtcca

SEQ ID NO: 91733 - DNA, 20 bp, Artificial Sequence
  chemically synthesized
ttgtccatggtaaagcacta

SEQ ID NO: 91734 - DNA, 20 bp, Artificial Sequence
  chemically synthesized
atgtccatagtgctttacca

SEQ ID NO: 91735 - DNA, 20 bp, Artificial Sequence
  chemically synthesized
aaaaacatttgtccatggta

SEQ ID NO: 91736 - DNA, 20 bp, Artificial Sequence
  chemically synthesized
ggatcaaaaacatttgtcca

SEQ ID NO: 91737 - DNA, 20 bp, Artificial Sequence
  chemically synthesized
tgtttttgatccacccttct

SEQ ID NO: 91738 - DNA, 20 bp, Artificial Sequence
  chemically synthesized
ctacccctgccttagaaggg

SEQ ID NO: 91739 - DNA, 20 bp, Artificial Sequence
  chemically synthesized
gtttttgatccacccttcta

SEQ ID NO: 91740 - DNA, 20 bp, Artificial Sequence
  chemically synthesized
tttctacccctgccttagaa

SEQ ID NO: 91741 - DNA, 20 bp, Artificial Sequence
  chemically synthesized
tttgatccacccttctaagg

SEQ ID NO: 91742 - DNA, 20 bp, Artificial Sequence
  chemically synthesized
ttttctacccctgccttaga

SEQ ID NO: 91743 - DNA, 20 bp, Artificial Sequence
  chemically synthesized
ttgatccacccttctaaggc

SEQ ID NO: 91744 - DNA, 20 bp, Artificial Sequence
  chemically synthesized
cttttctacccctgccttag

SEQ ID NO: 91745 - DNA, 20 bp, Artificial Sequence
  chemically synthesized
tgatccacccttctaaggca

SEQ ID NO: 91746 - DNA, 20 bp, Artificial Sequence
  chemically synthesized
gatccacccttctaaggcag

SEQ ID NO: 91747 - DNA, 20 bp, Artificial Sequence
  chemically synthesized
cagcttttctacccctgcct

SEQ ID NO: 91748 - DNA, 20 bp, Artificial Sequence
  chemically synthesized
ccacccttctaaggcagggg

SEQ ID NO: 91749 - DNA, 20 bp, Artificial Sequence
  chemically synthesized
cttctaaggcaggggtagaa

SEQ ID NO: 91750 - DNA, 20 bp, Artificial Sequence
  chemically synthesized
agagatttacaacatttcaa

SEQ ID NO: 91751 - DNA, 20 bp, Artificial Sequence
  chemically synthesized
aatgttgtaaatctctgctt

SEQ ID NO: 91752 - DNA, 20 bp, Artificial Sequence
  chemically synthesized
ccgtatcacaaactcaagca

SEQ ID NO: 91753 - DNA, 20 bp, Artificial Sequence
  chemically synthesized
aaccgtatcacaaactcaag

SEQ ID NO: 91754 - DNA, 20 bp, Artificial Sequence
  chemically synthesized
taaaaccgtatcacaaactc

SEQ ID NO: 91755 - DNA, 20 bp, Artificial Sequence
  chemically synthesized
ctctgcttgagtttgtgata

SEQ ID NO: 91756 - DNA, 20 bp, Artificial Sequence
  chemically synthesized
ttgtgatacggttttaaatt

SEQ ID NO: 91757 - DNA, 20 bp, Artificial Sequence
  chemically synthesized
tgatacggttttaaatttag

SEQ ID NO: 91758 - DNA, 20 bp, Artificial Sequence
  chemically synthesized
agcagaaaaatattcaccaa

SEQ ID NO: 91759 - DNA, 20 bp, Artificial Sequence
  chemically synthesized
gcagaaaaatattcaccaac

SEQ ID NO: 91760 - DNA, 20 bp, Artificial Sequence
  chemically synthesized
agaaaaatattcaccaacag

SEQ ID NO: 91761 - DNA, 20 bp, Artificial Sequence
  chemically synthesized
ttggtttctcattctcctgt

SEQ ID NO: 91762 - DNA, 20 bp, Artificial Sequence
  chemically synthesized
atattcaccaacaggagaat

SEQ ID NO: 91763 - DNA, 20 bp, Artificial Sequence
  chemically synthesized
aggagaatgagaaaccaacg

SEQ ID NO: 91764 - DNA, 20 bp, Artificial Sequence
  chemically synthesized
acattaataattatccacgt

SEQ ID NO: 91765 - DNA, 20 bp, Artificial Sequence
  chemically synthesized
attattaatgttatcctgaa

SEQ ID NO: 91766 - DNA, 20 bp, Artificial Sequence
  chemically synthesized
agtctttttattttctgttc

SEQ ID NO: 91767 - DNA, 20 bp, Artificial Sequence
  chemically synthesized
aagtctttttattttctgtt

SEQ ID NO: 91768 - DNA, 20 bp, Artificial Sequence
  chemically synthesized
tatcctgaacagaaaataaa

SEQ ID NO: 91769 - DNA, 20 bp, Artificial Sequence
  chemically synthesized
aggcagaaaggtttttcagc

SEQ ID NO: 91770 - DNA, 20 bp, Artificial Sequence
  chemically synthesized
aaccaggcagaaaggttttt

SEQ ID NO: 91771 - DNA, 20 bp, Artificial Sequence
  chemically synthesized
tgctgaaaaacctttctgcc

SEQ ID NO: 91772 - DNA, 20 bp, Artificial Sequence
  chemically synthesized
tctgacaaaaccaggcagaa

SEQ ID NO: 91773 - DNA, 20 bp, Artificial Sequence
  chemically synthesized
ctctgacaaaaccaggcaga

SEQ ID NO: 91774 - DNA, 20 bp, Artificial Sequence
  chemically synthesized
agaactctgacaaaaccagg

SEQ ID NO: 91775 - DNA, 20 bp, Artificial Sequence
  chemically synthesized
aagagaactctgacaaaacc

SEQ ID NO: 91776 - DNA, 20 bp, Artificial Sequence
  chemically synthesized
acctttctgcctggttttgt

SEQ ID NO: 91777 - DNA, 20 bp, Artificial Sequence
  chemically synthesized
gaagagaactctgacaaaac

SEQ ID NO: 91778 - DNA, 20 bp, Artificial Sequence
  chemically synthesized
ctttctgcctggttttgtca

SEQ ID NO: 91779 - DNA, 20 bp, Artificial Sequence
  chemically synthesized
aagtgaatgtgtaaaaggaa

SEQ ID NO: 91780 - DNA, 20 bp, Artificial Sequence
  chemically synthesized
aaaagtgaatgtgtaaaagg

SEQ ID NO: 91781 - DNA, 20 bp, Artificial Sequence
  chemically synthesized
tcaaaaagtgaatgtgtaaa

SEQ ID NO: 91782 - DNA, 20 bp, Artificial Sequence
  chemically synthesized
atcaaaaagtgaatgtgtaa

SEQ ID NO: 91783 - DNA, 20 bp, Artificial Sequence
  chemically synthesized
cacaaaaggaaaacatcaaa

SEQ ID NO: 91784 - DNA, 20 bp, Artificial Sequence
  chemically synthesized
tttttgatgttttccttttg

SEQ ID NO: 91785 - DNA, 20 bp, Artificial Sequence
  chemically synthesized
ttttgatgttttccttttgt

SEQ ID NO: 91786 - DNA, 20 bp, Artificial Sequence
  chemically synthesized
tctttctgccagcccacaaa

SEQ ID NO: 91787 - DNA, 20 bp, Artificial Sequence
  chemically synthesized
atctttctgccagcccacaa

SEQ ID NO: 91788 - DNA, 20 bp, Artificial Sequence
  chemically synthesized
gatgttttccttttgtgggc

SEQ ID NO: 91789 - DNA, 20 bp, Artificial Sequence
  chemically synthesized
gttttccttttgtgggctgg

SEQ ID NO: 91790 - DNA, 20 bp, Artificial Sequence
  chemically synthesized
tccttttgtgggctggcaga

SEQ ID NO: 91791 - DNA, 20 bp, Artificial Sequence
  chemically synthesized
agtgacccccatctttctgc

SEQ ID NO: 91792 - DNA, 20 bp, Artificial Sequence
  chemically synthesized
tttgtgggctggcagaaaga

SEQ ID NO: 91793 - DNA, 20 bp, Artificial Sequence
  chemically synthesized
ttgtgggctggcagaaagat

SEQ ID NO: 91794 - DNA, 20 bp, Artificial Sequence
  chemically synthesized
tgtgggctggcagaaagatg

SEQ ID NO: 91795 - DNA, 20 bp, Artificial Sequence
  chemically synthesized
gtgggctggcagaaagatgg

SEQ ID NO: 91796 - DNA, 20 bp, Artificial Sequence
  chemically synthesized
gtatttttagtaaaagttta

SEQ ID NO: 91797 - DNA, 20 bp, Artificial Sequence
  chemically synthesized
gagtatttttagtaaaagtt

SEQ ID NO: 91798 - DNA, 20 bp, Artificial Sequence
  chemically synthesized
tttaagagtatttttagtaa

SEQ ID NO: 91799 - DNA, 20 bp, Artificial Sequence
  chemically synthesized
tgtagttttaagagtatttt

SEQ ID NO: 91800 - DNA, 20 bp, Artificial Sequence
  chemically synthesized
cttacatcttgtagttttaa

SEQ ID NO: 91801 - DNA, 20 bp, Artificial Sequence
  chemically synthesized
aacttacatcttgtagtttt

SEQ ID NO: 91802 - DNA, 20 bp, Artificial Sequence
  chemically synthesized
aaaaatactcttaaaactac

SEQ ID NO: 91803 - DNA, 20 bp, Artificial Sequence
  chemically synthesized
aatagagaacttacatcttg

SEQ ID NO: 91804 - DNA, 20 bp, Artificial Sequence
  chemically synthesized
ctcttaaaactacaagatgt

SEQ ID NO: 91805 - DNA, 20 bp, Artificial Sequence
  chemically synthesized
gatgtaagttctctatttta

SEQ ID NO: 91806 - DNA, 20 bp, Artificial Sequence
  chemically synthesized
gctatgggctctttaaaata

SEQ ID NO: 91807 - DNA, 20 bp, Artificial Sequence
  chemically synthesized
tgtaagttctctattttaaa

SEQ ID NO: 91808 - DNA, 20 bp, Artificial Sequence
  chemically synthesized
aggctatgggctctttaaaa

SEQ ID NO: 91809 - DNA, 20 bp, Artificial Sequence
  chemically synthesized
tctctattttaaagagccca

SEQ ID NO: 91810 - DNA, 20 bp, Artificial Sequence
  chemically synthesized
agactttttcagaaggctat

SEQ ID NO: 91811 - DNA, 20 bp, Artificial Sequence
  chemically synthesized
aagactttttcagaaggcta

SEQ ID NO: 91812 - DNA, 20 bp, Artificial Sequence
  chemically synthesized
gagcccatagccttctgaaa

SEQ ID NO: 91813 - DNA, 20 bp, Artificial Sequence
  chemically synthesized
ttgcttaagactttttcaga

SEQ ID NO: 91814 - DNA, 20 bp, Artificial Sequence
  chemically synthesized
tttgcttaagactttttcag

SEQ ID NO: 91815 - DNA, 20 bp, Artificial Sequence
  chemically synthesized
ttatttgcttaagacttttt

SEQ ID NO: 91816 - DNA, 20 bp, Artificial Sequence
  chemically synthesized
tagccttctgaaaaagtctt

SEQ ID NO: 91817 - DNA, 20 bp, Artificial Sequence
  chemically synthesized
tttggttcatttatttgctt

SEQ ID NO: 91818 - DNA, 20 bp, Artificial Sequence
  chemically synthesized
aacatgatcacatgttattt

SEQ ID NO: 91819 - DNA, 20 bp, Artificial Sequence
  chemically synthesized
aacatgtgatcatgttaaac

SEQ ID NO: 91820 - DNA, 20 bp, Artificial Sequence
  chemically synthesized
gatcatgttaaactggaaca

SEQ ID NO: 91821 - DNA, 20 bp, Artificial Sequence
  chemically synthesized
gttcccacagggctgtgttc

SEQ ID NO: 91822 - DNA, 20 bp, Artificial Sequence
  chemically synthesized
taaactggaacacagccctg

SEQ ID NO: 91823 - DNA, 20 bp, Artificial Sequence
  chemically synthesized
aaactggaacacagccctgt

SEQ ID NO: 91824 - DNA, 20 bp, Artificial Sequence
  chemically synthesized
aattgttctttgttcccaca

SEQ ID NO: 91825 - DNA, 20 bp, Artificial Sequence
  chemically synthesized
taattgttctttgttcccac

SEQ ID NO: 91826 - DNA, 20 bp, Artificial Sequence
  chemically synthesized
ctaattgttctttgttccca

SEQ ID NO: 91827 - DNA, 20 bp, Artificial Sequence
  chemically synthesized
aacacagccctgtgggaaca

SEQ ID NO: 91828 - DNA, 20 bp, Artificial Sequence
  chemically synthesized
ctgtgggaacaaagaacaat

SEQ ID NO: 91829 - DNA, 20 bp, Artificial Sequence
  chemically synthesized
tctgcaaatcttggggggca

SEQ ID NO: 91830 - DNA, 20 bp, Artificial Sequence
  chemically synthesized
aacaattagccttgcccccc

SEQ ID NO: 91831 - DNA, 20 bp, Artificial Sequence
  chemically synthesized
atctgcaaatcttggggggc

SEQ ID NO: 91832 - DNA, 20 bp, Artificial Sequence
  chemically synthesized
tggcatctgcaaatcttggg

SEQ ID NO: 91833 - DNA, 20 bp, Artificial Sequence
  chemically synthesized
atggcatctgcaaatcttgg

SEQ ID NO: 91834 - DNA, 20 bp, Artificial Sequence
  chemically synthesized
gatggcatctgcaaatcttg

SEQ ID NO: 91835 - DNA, 20 bp, Artificial Sequence
  chemically synthesized
tgatggcatctgcaaatctt

SEQ ID NO: 91836 - DNA, 20 bp, Artificial Sequence
  chemically synthesized
gccttgccccccaagatttg

SEQ ID NO: 91837 - DNA, 20 bp, Artificial Sequence
  chemically synthesized
atgatggcatctgcaaatct

SEQ ID NO: 91838 - DNA, 20 bp, Artificial Sequence
  chemically synthesized
atttgcagatgccatcatac

SEQ ID NO: 91839 - DNA, 20 bp, Artificial Sequence
  chemically synthesized
aaatatcatcacttgtatga

SEQ ID NO: 91840 - DNA, 20 bp, Artificial Sequence
  chemically synthesized
tacaagtgatgatatttgat

SEQ ID NO: 91841 - DNA, 20 bp, Artificial Sequence
  chemically synthesized
acaagtgatgatatttgatc

SEQ ID NO: 91842 - DNA, 20 bp, Artificial Sequence
  chemically synthesized
caagtgatgatatttgatca

SEQ ID NO: 91843 - DNA, 20 bp, Artificial Sequence
  chemically synthesized
tgatatttgatcagggtctt

SEQ ID NO: 91844 - DNA, 20 bp, Artificial Sequence
  chemically synthesized
gatatttgatcagggtcttg

SEQ ID NO: 91845 - DNA, 20 bp, Artificial Sequence
  chemically synthesized
atatttgatcagggtcttga

SEQ ID NO: 91846 - DNA, 20 bp, Artificial Sequence
  chemically synthesized
tgatcagggtcttgagggat

SEQ ID NO: 91847 - DNA, 20 bp, Artificial Sequence
  chemically synthesized
ccagctgctactcatccctc

SEQ ID NO: 91848 - DNA, 20 bp, Artificial Sequence
  chemically synthesized
tcagggtcttgagggatgag

SEQ ID NO: 91849 - DNA, 20 bp, Artificial Sequence
  chemically synthesized
gggtcttgagggatgagtag

SEQ ID NO: 91850 - DNA, 20 bp, Artificial Sequence
  chemically synthesized
cttgagggatgagtagcagc

SEQ ID NO: 91851 - DNA, 20 bp, Artificial Sequence
  chemically synthesized
agggatgagtagcagctggc

SEQ ID NO: 91852 - DNA, 20 bp, Artificial Sequence
  chemically synthesized
gggatgagtagcagctggcc

SEQ ID NO: 91853 - DNA, 20 bp, Artificial Sequence
  chemically synthesized
ggatgagtagcagctggcca

SEQ ID NO: 91854 - DNA, 20 bp, Artificial Sequence
  chemically synthesized
gatgagtagcagctggccag

SEQ ID NO: 91855 - DNA, 20 bp, Artificial Sequence
  chemically synthesized
tgagtagcagctggccaggg

SEQ ID NO: 91856 - DNA, 20 bp, Artificial Sequence
  chemically synthesized
tctcccacttctcccctggc

SEQ ID NO: 91857 - DNA, 20 bp, Artificial Sequence
  chemically synthesized
gtagcagctggccaggggag

SEQ ID NO: 91858 - DNA, 20 bp, Artificial Sequence
  chemically synthesized
tcactctcccacttctcccc

SEQ ID NO: 91859 - DNA, 20 bp, Artificial Sequence
  chemically synthesized
gcagctggccaggggagaag

SEQ ID NO: 91860 - DNA, 20 bp, Artificial Sequence
  chemically synthesized
cagctggccaggggagaagt

SEQ ID NO: 91861 - DNA, 20 bp, Artificial Sequence
  chemically synthesized
gctggccaggggagaagtgg

SEQ ID NO: 91862 - DNA, 20 bp, Artificial Sequence
  chemically synthesized
tggccaggggagaagtggga

SEQ ID NO: 91863 - DNA, 20 bp, Artificial Sequence
  chemically synthesized
aagtgggagagtgaaatttg

SEQ ID NO: 91864 - DNA, 20 bp, Artificial Sequence
  chemically synthesized
tgggagagtgaaatttgaag

SEQ ID NO: 91865 - DNA, 20 bp, Artificial Sequence
  chemically synthesized
gagagtgaaatttgaagcag

SEQ ID NO: 91866 - DNA, 20 bp, Artificial Sequence
  chemically synthesized
agagtgaaatttgaagcagt

SEQ ID NO: 91867 - DNA, 20 bp, Artificial Sequence
  chemically synthesized
cagtgggaaaaacatgaatg

SEQ ID NO: 91868 - DNA, 20 bp, Artificial Sequence
  chemically synthesized
gaaaaacatgaatgaagttg

SEQ ID NO: 91869 - DNA, 20 bp, Artificial Sequence
  chemically synthesized
acatgaatgaagttgaagat

SEQ ID NO: 91870 - DNA, 20 bp, Artificial Sequence
  chemically synthesized
aatgaagttgaagataagac

SEQ ID NO: 91871 - DNA, 20 bp, Artificial Sequence
  chemically synthesized
agttgaagataagacgagat

SEQ ID NO: 91872 - DNA, 20 bp, Artificial Sequence
  chemically synthesized
gacgagataagaatacacat

SEQ ID NO: 91873 - DNA, 20 bp, Artificial Sequence
  chemically synthesized
cgagataagaatacacatca

SEQ ID NO: 91874 - DNA, 20 bp, Artificial Sequence
  chemically synthesized
taagaatacacatcagagct

SEQ ID NO: 91875 - DNA, 20 bp, Artificial Sequence
  chemically synthesized
ctcttccctccggagttact

SEQ ID NO: 91876 - DNA, 20 bp, Artificial Sequence
  chemically synthesized
acatcagagctaagtaactc

SEQ ID NO: 91877 - DNA, 20 bp, Artificial Sequence
  chemically synthesized
atcagagctaagtaactccg

SEQ ID NO: 91878 - DNA, 20 bp, Artificial Sequence
  chemically synthesized
tcagagctaagtaactccgg

SEQ ID NO: 91879 - DNA, 20 bp, Artificial Sequence
  chemically synthesized
cagagctaagtaactccgga

SEQ ID NO: 91880 - DNA, 20 bp, Artificial Sequence
  chemically synthesized
agctaagtaactccggaggg

SEQ ID NO: 91881 - DNA, 20 bp, Artificial Sequence
  chemically synthesized
gtcttcccctcttccctccg

SEQ ID NO: 91882 - DNA, 20 bp, Artificial Sequence
  chemically synthesized
ctaagtaactccggagggaa

SEQ ID NO: 91883 - DNA, 20 bp, Artificial Sequence
  chemically synthesized
gggtcttcccctcttccctc

SEQ ID NO: 91884 - DNA, 20 bp, Artificial Sequence
  chemically synthesized
taagtaactccggagggaag

SEQ ID NO: 91885 - DNA, 20 bp, Artificial Sequence
  chemically synthesized
aagtaactccggagggaaga

SEQ ID NO: 91886 - DNA, 20 bp, Artificial Sequence
  chemically synthesized
agtaactccggagggaagag

SEQ ID NO: 91887 - DNA, 20 bp, Artificial Sequence
  chemically synthesized
aactccggagggaagagggg

SEQ ID NO: 91888 - DNA, 20 bp, Artificial Sequence
  chemically synthesized
agggaagaggggaagaccca

SEQ ID NO: 91889 - DNA, 20 bp, Artificial Sequence
  chemically synthesized
gaagaggggaagacccatgg

SEQ ID NO: 91890 - DNA, 20 bp, Artificial Sequence
  chemically synthesized
aagaggggaagacccatggc

SEQ ID NO: 91891 - DNA, 20 bp, Artificial Sequence
  chemically synthesized
tctgtctctcttcccgccat

SEQ ID NO: 91892 - DNA, 20 bp, Artificial Sequence
  chemically synthesized
aggggaagacccatggcggg

SEQ ID NO: 91893 - DNA, 20 bp, Artificial Sequence
  chemically synthesized
ctctgtctctcttcccgcca

SEQ ID NO: 91894 - DNA, 20 bp, Artificial Sequence
  chemically synthesized
gggaagacccatggcgggaa

SEQ ID NO: 91895 - DNA, 20 bp, Artificial Sequence
  chemically synthesized
gaagacccatggcgggaaga

SEQ ID NO: 91896 - DNA, 20 bp, Artificial Sequence
  chemically synthesized
acccatggcgggaagagaga

SEQ ID NO: 91897 - DNA, 20 bp, Artificial Sequence
  chemically synthesized
ccatggcgggaagagagaca

SEQ ID NO: 91898 - DNA, 20 bp, Artificial Sequence
  chemically synthesized
tggcgggaagagagacagag

SEQ ID NO: 91899 - DNA, 20 bp, Artificial Sequence
  chemically synthesized
gggaagagagacagagtggt

SEQ ID NO: 91900 - DNA, 20 bp, Artificial Sequence
  chemically synthesized
gagagagagagagagagaga

SEQ ID NO: 91901 - DNA, 20 bp, Artificial Sequence
  chemically synthesized
gagagagagagagagagaga

SEQ ID NO: 91902 - DNA, 20 bp, Artificial Sequence
  chemically synthesized
gagagagagagagagagaga

SEQ ID NO: 91903 - DNA, 20 bp, Artificial Sequence
  chemically synthesized
gagagagagagagagagaga

SEQ ID NO: 91904 - DNA, 20 bp, Artificial Sequence
  chemically synthesized
gagagagagagagagagaga

SEQ ID NO: 91905 - DNA, 20 bp, Artificial Sequence
  chemically synthesized
gagagagagagagagagaga

SEQ ID NO: 91906 - DNA, 20 bp, Artificial Sequence
  chemically synthesized
gagagagagagagagagaga

SEQ ID NO: 91907 - DNA, 20 bp, Artificial Sequence
  chemically synthesized
gagagagagagagagagaga

SEQ ID NO: 91908 - DNA, 20 bp, Artificial Sequence
  chemically synthesized
tagagagagagagagagaga

SEQ ID NO: 91909 - DNA, 20 bp, Artificial Sequence
  chemically synthesized
tatagagagagagagagaga

SEQ ID NO: 91910 - DNA, 20 bp, Artificial Sequence
  chemically synthesized
tatatagagagagagagaga

SEQ ID NO: 91911 - DNA, 20 bp, Artificial Sequence
  chemically synthesized
tatatatagagagagagaga

SEQ ID NO: 91912 - DNA, 20 bp, Artificial Sequence
  chemically synthesized
tatatatatagagagagaga

SEQ ID NO: 91913 - DNA, 20 bp, Artificial Sequence
  chemically synthesized
tatatatatatagagagaga

SEQ ID NO: 91914 - DNA, 20 bp, Artificial Sequence
  chemically synthesized
tatatatatatatagagaga

SEQ ID NO: 91915 - DNA, 20 bp, Artificial Sequence
  chemically synthesized
tatatatatatatatagaga

SEQ ID NO: 91916 - DNA, 20 bp, Artificial Sequence
  chemically synthesized
tatatatatatatatataga

SEQ ID NO: 91917 - DNA, 20 bp, Artificial Sequence
  chemically synthesized
tatatatatatatatatata

SEQ ID NO: 91918 - DNA, 20 bp, Artificial Sequence
  chemically synthesized
tatatatatatatatatata

SEQ ID NO: 91919 - DNA, 20 bp, Artificial Sequence
  chemically synthesized
tatatatatatatatatata

SEQ ID NO: 91920 - DNA, 20 bp, Artificial Sequence
  chemically synthesized
tatatatatatatagctgca

SEQ ID NO: 91921 - DNA, 20 bp, Artificial Sequence
  chemically synthesized
atatatatatatagctgcac

SEQ ID NO: 91922 - DNA, 20 bp, Artificial Sequence
  chemically synthesized
tatatatatagctgcacagg

SEQ ID NO: 91923 - DNA, 20 bp, Artificial Sequence
  chemically synthesized
atatatatagctgcacagga

SEQ ID NO: 91924 - DNA, 20 bp, Artificial Sequence
  chemically synthesized
tccaggccctccttcctgtg

SEQ ID NO: 91925 - DNA, 20 bp, Artificial Sequence
  chemically synthesized
atatatagctgcacaggaag

SEQ ID NO: 91926 - DNA, 20 bp, Artificial Sequence
  chemically synthesized
tatatagctgcacaggaagg

SEQ ID NO: 91927 - DNA, 20 bp, Artificial Sequence
  chemically synthesized
atatagctgcacaggaagga

SEQ ID NO: 91928 - DNA, 20 bp, Artificial Sequence
  chemically synthesized
gctgcacaggaaggagggcc

SEQ ID NO: 91929 - DNA, 20 bp, Artificial Sequence
  chemically synthesized
cacaagccccttcacaatcc

SEQ ID NO: 91930 - DNA, 20 bp, Artificial Sequence
  chemically synthesized
gaaggagggcctggattgtg

SEQ ID NO: 91931 - DNA, 20 bp, Artificial Sequence
  chemically synthesized
acacaagccccttcacaatc

SEQ ID NO: 91932 - DNA, 20 bp, Artificial Sequence
  chemically synthesized
aaggagggcctggattgtga

SEQ ID NO: 91933 - DNA, 20 bp, Artificial Sequence
  chemically synthesized
aggagggcctggattgtgaa

SEQ ID NO: 91934 - DNA, 20 bp, Artificial Sequence
  chemically synthesized
ggagggcctggattgtgaag

SEQ ID NO: 91935 - DNA, 20 bp, Artificial Sequence
  chemically synthesized
tgtgaaggggcttgtgtatc

SEQ ID NO: 91936 - DNA, 20 bp, Artificial Sequence
  chemically synthesized
aaacccttagcttgatacac

SEQ ID NO: 91937 - DNA, 20 bp, Artificial Sequence
  chemically synthesized
aggggcttgtgtatcaagct

SEQ ID NO: 91938 - DNA, 20 bp, Artificial Sequence
  chemically synthesized
ggggcttgtgtatcaagcta

SEQ ID NO: 91939 - DNA, 20 bp, Artificial Sequence
  chemically synthesized
gggcttgtgtatcaagctaa

SEQ ID NO: 91940 - DNA, 20 bp, Artificial Sequence
  chemically synthesized
tgtgtatcaagctaagggtt

SEQ ID NO: 91941 - DNA, 20 bp, Artificial Sequence
  chemically synthesized
caggataaagtccaaaccct

SEQ ID NO: 91942 - DNA, 20 bp, Artificial Sequence
  chemically synthesized
ttagacatcttcacaggata

SEQ ID NO: 91943 - DNA, 20 bp, Artificial Sequence
  chemically synthesized
ggtttggactttatcctgtg

SEQ ID NO: 91944 - DNA, 20 bp, Artificial Sequence
  chemically synthesized
aacagattagacatcttcac

SEQ ID NO: 91945 - DNA, 20 bp, Artificial Sequence
  chemically synthesized
aaacagattagacatcttca

SEQ ID NO: 91946 - DNA, 20 bp, Artificial Sequence
  chemically synthesized
ccaaaaaatcttaaacagat

SEQ ID NO: 91947 - DNA, 20 bp, Artificial Sequence
  chemically synthesized
tgaagatgtctaatctgttt

SEQ ID NO: 91948 - DNA, 20 bp, Artificial Sequence
  chemically synthesized
tgttaccaaaaaatcttaaa

SEQ ID NO: 91949 - DNA, 20 bp, Artificial Sequence
  chemically synthesized
ctaatctgtttaagattttt

SEQ ID NO: 91950 - DNA, 20 bp, Artificial Sequence
  chemically synthesized
attttttggtaacatcatct

SEQ ID NO: 91951 - DNA, 20 bp, Artificial Sequence
  chemically synthesized
ttttggtaacatcatcttgg

SEQ ID NO: 91952 - DNA, 20 bp, Artificial Sequence
  chemically synthesized
tggtaacatcatcttggtgg

SEQ ID NO: 91953 - DNA, 20 bp, Artificial Sequence
  chemically synthesized
tgtaccttttcactgccacc

SEQ ID NO: 91954 - DNA, 20 bp, Artificial Sequence
  chemically synthesized
atcatcttggtggcagtgaa

SEQ ID NO: 91955 - DNA, 20 bp, Artificial Sequence
  chemically synthesized
tcatcttggtggcagtgaaa

SEQ ID NO: 91956 - DNA, 20 bp, Artificial Sequence
  chemically synthesized
gtggcagtgaaaaggtacat

SEQ ID NO: 91957 - DNA, 20 bp, Artificial Sequence
  chemically synthesized
ggcagtgaaaaggtacatta

SEQ ID NO: 91958 - DNA, 20 bp, Artificial Sequence
  chemically synthesized
gcagtgaaaaggtacattag

SEQ ID NO: 91959 - DNA, 20 bp, Artificial Sequence
  chemically synthesized
tgaaaaggtacattagaggc

SEQ ID NO: 91960 - DNA, 20 bp, Artificial Sequence
  chemically synthesized
tacattagaggcaagaacat

SEQ ID NO: 91961 - DNA, 20 bp, Artificial Sequence
  chemically synthesized
cattagaggcaagaacatta

SEQ ID NO: 91962 - DNA, 20 bp, Artificial Sequence
  chemically synthesized
attagaggcaagaacattag

SEQ ID NO: 91963 - DNA, 20 bp, Artificial Sequence
  chemically synthesized
gaggcaagaacattagaggc

SEQ ID NO: 91964 - DNA, 20 bp, Artificial Sequence
  chemically synthesized
ggcaagaacattagaggcaa

SEQ ID NO: 91965 - DNA, 20 bp, Artificial Sequence
  chemically synthesized
acattagaggcaagagaata

SEQ ID NO: 91966 - DNA, 20 bp, Artificial Sequence
  chemically synthesized
attagaggcaagagaatatg

SEQ ID NO: 91967 - DNA, 20 bp, Artificial Sequence
  chemically synthesized
agaatatggagatctaaact

SEQ ID NO: 91968 - DNA, 20 bp, Artificial Sequence
  chemically synthesized
gaatatggagatctaaactg

SEQ ID NO: 91969 - DNA, 20 bp, Artificial Sequence
  chemically synthesized
ctgtgtctattacctcagtt

SEQ ID NO: 91970 - DNA, 20 bp, Artificial Sequence
  chemically synthesized
ggagatctaaactgaggtaa

SEQ ID NO: 91971 - DNA, 20 bp, Artificial Sequence
  chemically synthesized
tcatcctgtgtctattacct

SEQ ID NO: 91972 - DNA, 20 bp, Artificial Sequence
  chemically synthesized
ctaaactgaggtaatagaca

SEQ ID NO: 91973 - DNA, 20 bp, Artificial Sequence
  chemically synthesized
taaactgaggtaatagacac

SEQ ID NO: 91974 - DNA, 20 bp, Artificial Sequence
  chemically synthesized
tgaggtaatagacacaggat

SEQ ID NO: 91975 - DNA, 20 bp, Artificial Sequence
  chemically synthesized
aatagacacaggatgagaaa

SEQ ID NO: 91976 - DNA, 20 bp, Artificial Sequence
  chemically synthesized
atagacacaggatgagaaaa

SEQ ID NO: 91977 - DNA, 20 bp, Artificial Sequence
  chemically synthesized
tagacacaggatgagaaaaa

SEQ ID NO: 91978 - DNA, 20 bp, Artificial Sequence
  chemically synthesized
gacacaggatgagaaaaagg

SEQ ID NO: 91979 - DNA, 20 bp, Artificial Sequence
  chemically synthesized
agaaaaagggagatattttt

SEQ ID NO: 91980 - DNA, 20 bp, Artificial Sequence
  chemically synthesized
aaaaagggagatatttttga

SEQ ID NO: 91981 - DNA, 20 bp, Artificial Sequence
  chemically synthesized
gagagatcatgaatacaact

SEQ ID NO: 91982 - DNA, 20 bp, Artificial Sequence
  chemically synthesized
gagatcatgaatacaactta

SEQ ID NO: 91983 - DNA, 20 bp, Artificial Sequence
  chemically synthesized
cttgcattcagtcagtctct

SEQ ID NO: 91984 - DNA, 20 bp, Artificial Sequence
  chemically synthesized
atgttatccttgcattcagt

SEQ ID NO: 91985 - DNA, 20 bp, Artificial Sequence
  chemically synthesized
cttagagactgactgaatgc

SEQ ID NO: 91986 - DNA, 20 bp, Artificial Sequence
  chemically synthesized
ttagagactgactgaatgca

SEQ ID NO: 91987 - DNA, 20 bp, Artificial Sequence
  chemically synthesized
ctatatgttatccttgcatt

SEQ ID NO: 91988 - DNA, 20 bp, Artificial Sequence
  chemically synthesized
ctgaatgcaaggataacata

SEQ ID NO: 91989 - DNA, 20 bp, Artificial Sequence
  chemically synthesized
tgaatgcaaggataacatat

SEQ ID NO: 91990 - DNA, 20 bp, Artificial Sequence
  chemically synthesized
gaatgcaaggataacatata

SEQ ID NO: 91991 - DNA, 20 bp, Artificial Sequence
  chemically synthesized
atgcaaggataacatatagg

SEQ ID NO: 91992 - DNA, 20 bp, Artificial Sequence
  chemically synthesized
tgcaaggataacatataggg

SEQ ID NO: 91993 - DNA, 20 bp, Artificial Sequence
  chemically synthesized
aggataacatatagggaggc

SEQ ID NO: 91994 - DNA, 20 bp, Artificial Sequence
  chemically synthesized
taacatatagggaggcaagt

SEQ ID NO: 91995 - DNA, 20 bp, Artificial Sequence
  chemically synthesized
aacatatagggaggcaagtt

SEQ ID NO: 91996 - DNA, 20 bp, Artificial Sequence
  chemically synthesized
agggaggcaagttgggtttc

SEQ ID NO: 91997 - DNA, 20 bp, Artificial Sequence
  chemically synthesized
ggcaagttgggtttctggct

SEQ ID NO: 91998 - DNA, 20 bp, Artificial Sequence
  chemically synthesized
caagttgggtttctggctta

SEQ ID NO: 91999 - DNA, 20 bp, Artificial Sequence
  chemically synthesized
ccccatcttcttctctaagc

SEQ ID NO: 92000 - DNA, 20 bp, Artificial Sequence
  chemically synthesized
gttgggtttctggcttagag

SEQ ID NO: 92001 - DNA, 20 bp, Artificial Sequence
  chemically synthesized
gggtttctggcttagagaag

SEQ ID NO: 92002 - DNA, 20 bp, Artificial Sequence
  chemically synthesized
tcacccccatcttcttctct

SEQ ID NO: 92003 - DNA, 20 bp, Artificial Sequence
  chemically synthesized
ttctggcttagagaagaaga

SEQ ID NO: 92004 - DNA, 20 bp, Artificial Sequence
  chemically synthesized
tctggcttagagaagaagat

SEQ ID NO: 92005 - DNA, 20 bp, Artificial Sequence
  chemically synthesized
ctggcttagagaagaagatg

SEQ ID NO: 92006 - DNA, 20 bp, Artificial Sequence
  chemically synthesized
tggcttagagaagaagatgg

SEQ ID NO: 92007 - DNA, 20 bp, Artificial Sequence
  chemically synthesized
ttcaacactttaataatagg

SEQ ID NO: 92008 - DNA, 20 bp, Artificial Sequence
  chemically synthesized
gataatgctacctattatta

SEQ ID NO: 92009 - DNA, 20 bp, Artificial Sequence
  chemically synthesized
aaattcaacactttaataat

SEQ ID NO: 92010 - DNA, 20 bp, Artificial Sequence
  chemically synthesized
gaaattcaacactttaataa

SEQ ID NO: 92011 - DNA, 20 bp, Artificial Sequence
  chemically synthesized
tattaaagtgttgaatttcc

SEQ ID NO: 92012 - DNA, 20 bp, Artificial Sequence
  chemically synthesized
attaaagtgttgaatttcca

SEQ ID NO: 92013 - DNA, 20 bp, Artificial Sequence
  chemically synthesized
taaagtgttgaatttccaag

SEQ ID NO: 92014 - DNA, 20 bp, Artificial Sequence
  chemically synthesized
ttaaactgctcacatctcct

SEQ ID NO: 92015 - DNA, 20 bp, Artificial Sequence
  chemically synthesized
ttgaatttccaaggagatgt

SEQ ID NO: 92016 - DNA, 20 bp, Artificial Sequence
  chemically synthesized
aatttccaaggagatgtgag

SEQ ID NO: 92017 - DNA, 20 bp, Artificial Sequence
  chemically synthesized
gagatgtgagcagtttaaca

SEQ ID NO: 92018 - DNA, 20 bp, Artificial Sequence
  chemically synthesized
agatgtgagcagtttaacat

SEQ ID NO: 92019 - DNA, 20 bp, Artificial Sequence
  chemically synthesized
tgagcagtttaacataggct

SEQ ID NO: 92020 - DNA, 20 bp, Artificial Sequence
  chemically synthesized
ctatcactaagtgacaggct

SEQ ID NO: 92021 - DNA, 20 bp, Artificial Sequence
  chemically synthesized
cataggcttagcctgtcact

SEQ ID NO: 92022 - DNA, 20 bp, Artificial Sequence
  chemically synthesized
acaccctatcactaagtgac

SEQ ID NO: 92023 - DNA, 20 bp, Artificial Sequence
  chemically synthesized
cacaccctatcactaagtga

SEQ ID NO: 92024 - DNA, 20 bp, Artificial Sequence
  chemically synthesized
cttagcctgtcacttagtga

SEQ ID NO: 92025 - DNA, 20 bp, Artificial Sequence
  chemically synthesized
ttagcctgtcacttagtgat

SEQ ID NO: 92026 - DNA, 20 bp, Artificial Sequence
  chemically synthesized
tagcctgtcacttagtgata

SEQ ID NO: 92027 - DNA, 20 bp, Artificial Sequence
  chemically synthesized
cccttccacaccctatcact

SEQ ID NO: 92028 - DNA, 20 bp, Artificial Sequence
  chemically synthesized
tgtcacttagtgatagggtg

SEQ ID NO: 92029 - DNA, 20 bp, Artificial Sequence
  chemically synthesized
cacttagtgatagggtgtgg

SEQ ID NO: 92030 - DNA, 20 bp, Artificial Sequence
  chemically synthesized
acttagtgatagggtgtgga

SEQ ID NO: 92031 - DNA, 20 bp, Artificial Sequence
  chemically synthesized
cttagtgatagggtgtggaa

SEQ ID NO: 92032 - DNA, 20 bp, Artificial Sequence
  chemically synthesized
tagtgatagggtgtggaagg

SEQ ID NO: 92033 - DNA, 20 bp, Artificial Sequence
  chemically synthesized
gtgatagggtgtggaaggga

SEQ ID NO: 92034 - DNA, 20 bp, Artificial Sequence
  chemically synthesized
atagggtgtggaagggagag

SEQ ID NO: 92035 - DNA, 20 bp, Artificial Sequence
  chemically synthesized
agagtggtgttgacctttgt

SEQ ID NO: 92036 - DNA, 20 bp, Artificial Sequence
  chemically synthesized
gagtggtgttgacctttgtc

SEQ ID NO: 92037 - DNA, 20 bp, Artificial Sequence
  chemically synthesized
agtggtgttgacctttgtcg

SEQ ID NO: 92038 - DNA, 20 bp, Artificial Sequence
  chemically synthesized
gtggtgttgacctttgtcgg

SEQ ID NO: 92039 - DNA, 20 bp, Artificial Sequence
  chemically synthesized
tgacacgtaccccccgacaa

SEQ ID NO: 92040 - DNA, 20 bp, Artificial Sequence
  chemically synthesized
tggtgttgacctttgtcggg

SEQ ID NO: 92041 - DNA, 20 bp, Artificial Sequence
  chemically synthesized
atgacacgtaccccccgaca

SEQ ID NO: 92042 - DNA, 20 bp, Artificial Sequence
  chemically synthesized
gggtacgtgtcatccactca

SEQ ID NO: 92043 - DNA, 20 bp, Artificial Sequence
  chemically synthesized
ggtacgtgtcatccactcat

SEQ ID NO: 92044 - DNA, 20 bp, Artificial Sequence
  chemically synthesized
caggctaccatgcccatgag

SEQ ID NO: 92045 - DNA, 20 bp, Artificial Sequence
  chemically synthesized
gtgtcatccactcatgggca

SEQ ID NO: 92046 - DNA, 20 bp, Artificial Sequence
  chemically synthesized
tttcaggctaccatgcccat

SEQ ID NO: 92047 - DNA, 20 bp, Artificial Sequence
  chemically synthesized
tcatccactcatgggcatgg

SEQ ID NO: 92048 - DNA, 20 bp, Artificial Sequence
  chemically synthesized
atgggcatggtagcctgaaa

SEQ ID NO: 92049 - DNA, 20 bp, Artificial Sequence
  chemically synthesized
tgggcatggtagcctgaaat

SEQ ID NO: 92050 - DNA, 20 bp, Artificial Sequence
  chemically synthesized
gggcatggtagcctgaaata

SEQ ID NO: 92051 - DNA, 20 bp, Artificial Sequence
  chemically synthesized
ggcatggtagcctgaaatag

SEQ ID NO: 92052 - DNA, 20 bp, Artificial Sequence
  chemically synthesized
ttctttaccgcccctatttc

SEQ ID NO: 92053 - DNA, 20 bp, Artificial Sequence
  chemically synthesized
cttctttaccgcccctattt

SEQ ID NO: 92054 - DNA, 20 bp, Artificial Sequence
  chemically synthesized
atggtagcctgaaatagggg

SEQ ID NO: 92055 - DNA, 20 bp, Artificial Sequence
  chemically synthesized
agcctgaaataggggcggta

SEQ ID NO: 92056 - DNA, 20 bp, Artificial Sequence
  chemically synthesized
ctgaaataggggcggtaaag

SEQ ID NO: 92057 - DNA, 20 bp, Artificial Sequence
  chemically synthesized
tgaaataggggcggtaaaga

SEQ ID NO: 92058 - DNA, 20 bp, Artificial Sequence
  chemically synthesized
gaaataggggcggtaaagaa

SEQ ID NO: 92059 - DNA, 20 bp, Artificial Sequence
  chemically synthesized
aggggcggtaaagaagggcc

SEQ ID NO: 92060 - DNA, 20 bp, Artificial Sequence
  chemically synthesized
ggcggtaaagaagggcccag

SEQ ID NO: 92061 - DNA, 20 bp, Artificial Sequence
  chemically synthesized
gcggtaaagaagggcccagc

SEQ ID NO: 92062 - DNA, 20 bp, Artificial Sequence
  chemically synthesized
cggtaaagaagggcccagca

SEQ ID NO: 92063 - DNA, 20 bp, Artificial Sequence
  chemically synthesized
gtaaagaagggcccagcagg

SEQ ID NO: 92064 - DNA, 20 bp, Artificial Sequence
  chemically synthesized
agactgtctgactccctgct

SEQ ID NO: 92065 - DNA, 20 bp, Artificial Sequence
  chemically synthesized
tagactgtctgactccctgc

SEQ ID NO: 92066 - DNA, 20 bp, Artificial Sequence
  chemically synthesized
agaagggcccagcagggagt

SEQ ID NO: 92067 - DNA, 20 bp, Artificial Sequence
  chemically synthesized
gggcccagcagggagtcaga

SEQ ID NO: 92068 - DNA, 20 bp, Artificial Sequence
  chemically synthesized
agagagcaagaaagacaaca

SEQ ID NO: 92069 - DNA, 20 bp, Artificial Sequence
  chemically synthesized
agacgcctgagagagcaaga

SEQ ID NO: 92070 - DNA, 20 bp, Artificial Sequence
  chemically synthesized
tgttgtctttcttgctctct

SEQ ID NO: 92071 - DNA, 20 bp, Artificial Sequence
  chemically synthesized
acacagacgcctgagagagc

SEQ ID NO: 92072 - DNA, 20 bp, Artificial Sequence
  chemically synthesized
gttgtctttcttgctctctc

SEQ ID NO: 92073 - DNA, 20 bp, Artificial Sequence
  chemically synthesized
aagaacacagacgcctgaga

SEQ ID NO: 92074 - DNA, 20 bp, Artificial Sequence
  chemically synthesized
caaagaacacagacgcctga

SEQ ID NO: 92075 - DNA, 20 bp, Artificial Sequence
  chemically synthesized
cacaaagaacacagacgcct

SEQ ID NO: 92076 - DNA, 20 bp, Artificial Sequence
  chemically synthesized
tgtgaatgacacaaagaaca

SEQ ID NO: 92077 - DNA, 20 bp, Artificial Sequence
  chemically synthesized
aggcacgtgtgaatgacaca

SEQ ID NO: 92078 - DNA, 20 bp, Artificial Sequence
  chemically synthesized
tgtcattcacacgtgcctgt

SEQ ID NO: 92079 - DNA, 20 bp, Artificial Sequence
  chemically synthesized
tgatgcaagttcacgctcac

SEQ ID NO: 92080 - DNA, 20 bp, Artificial Sequence
  chemically synthesized
atgatgcaagttcacgctca

SEQ ID NO: 92081 - DNA, 20 bp, Artificial Sequence
  chemically synthesized
gaactactgatgcatgatgc

SEQ ID NO: 92082 - DNA, 20 bp, Artificial Sequence
  chemically synthesized
cgtgaacttgcatcatgcat

SEQ ID NO: 92083 - DNA, 20 bp, Artificial Sequence
  chemically synthesized
gaacttgcatcatgcatcag

SEQ ID NO: 92084 - DNA, 20 bp, Artificial Sequence
  chemically synthesized
tcatgcatcagtagttccct

SEQ ID NO: 92085 - DNA, 20 bp, Artificial Sequence
  chemically synthesized
catcagtagttcccttagta

SEQ ID NO: 92086 - DNA, 20 bp, Artificial Sequence
  chemically synthesized
tttgagaaccactgtactaa

SEQ ID NO: 92087 - DNA, 20 bp, Artificial Sequence
  chemically synthesized
gtttgagaaccactgtacta

SEQ ID NO: 92088 - DNA, 20 bp, Artificial Sequence
  chemically synthesized
cagtagttcccttagtacag

SEQ ID NO: 92089 - DNA, 20 bp, Artificial Sequence
  chemically synthesized
agtttgagaaccactgtact

SEQ ID NO: 92090 - DNA, 20 bp, Artificial Sequence
  chemically synthesized
gtacagtggttctcaaactt

SEQ ID NO: 92091 - DNA, 20 bp, Artificial Sequence
  chemically synthesized
tctcaagcccactcaagttt

SEQ ID NO: 92092 - DNA, 20 bp, Artificial Sequence
  chemically synthesized
cagtggttctcaaacttgag

SEQ ID NO: 92093 - DNA, 20 bp, Artificial Sequence
  chemically synthesized
agtggttctcaaacttgagt

SEQ ID NO: 92094 - DNA, 20 bp, Artificial Sequence
  chemically synthesized
ggtgattctcaagcccactc

SEQ ID NO: 92095 - DNA, 20 bp, Artificial Sequence
  chemically synthesized
tctcaaacttgagtgggctt

SEQ ID NO: 92096 - DNA, 20 bp, Artificial Sequence
  chemically synthesized
gagccctctgggtgattctc

SEQ ID NO: 92097 - DNA, 20 bp, Artificial Sequence
  chemically synthesized
gagtgggcttgagaatcacc

SEQ ID NO: 92098 - DNA, 20 bp, Artificial Sequence
  chemically synthesized
gtgggcttgagaatcaccca

SEQ ID NO: 92099 - DNA, 20 bp, Artificial Sequence
  chemically synthesized
tgggcttgagaatcacccag

SEQ ID NO: 92100 - DNA, 20 bp, Artificial Sequence
  chemically synthesized
gggcttgagaatcacccaga

SEQ ID NO: 92101 - DNA, 20 bp, Artificial Sequence
  chemically synthesized
tgtgttttaatgagccctct

SEQ ID NO: 92102 - DNA, 20 bp, Artificial Sequence
  chemically synthesized
ctgtgttttaatgagccctc

SEQ ID NO: 92103 - DNA, 20 bp, Artificial Sequence
  chemically synthesized
ccagcagcctgtgttttaat

SEQ ID NO: 92104 - DNA, 20 bp, Artificial Sequence
  chemically synthesized
ccagagggctcattaaaaca

SEQ ID NO: 92105 - DNA, 20 bp, Artificial Sequence
  chemically synthesized
cagagggctcattaaaacac

SEQ ID NO: 92106 - DNA, 20 bp, Artificial Sequence
  chemically synthesized
ctcattaaaacacaggctgc

SEQ ID NO: 92107 - DNA, 20 bp, Artificial Sequence
  chemically synthesized
tcattaaaacacaggctgct

SEQ ID NO: 92108 - DNA, 20 bp, Artificial Sequence
  chemically synthesized
tctctcagagtggagcccag

SEQ ID NO: 92109 - DNA, 20 bp, Artificial Sequence
  chemically synthesized
tgatctctcagagtggagcc

SEQ ID NO: 92110 - DNA, 20 bp, Artificial Sequence
  chemically synthesized
aggctgctgggctccactct

SEQ ID NO: 92111 - DNA, 20 bp, Artificial Sequence
  chemically synthesized
aatcatgatctctcagagtg

SEQ ID NO: 92112 - DNA, 20 bp, Artificial Sequence
  chemically synthesized
gctgctgggctccactctga

SEQ ID NO: 92113 - DNA, 20 bp, Artificial Sequence
  chemically synthesized
agaatcatgatctctcagag

SEQ ID NO: 92114 - DNA, 20 bp, Artificial Sequence
  chemically synthesized
tacagaatcatgatctctca

SEQ ID NO: 92115 - DNA, 20 bp, Artificial Sequence
  chemically synthesized
catacagaatcatgatctct

SEQ ID NO: 92116 - DNA, 20 bp, Artificial Sequence
  chemically synthesized
agatcatgattctgtatgtc

SEQ ID NO: 92117 - DNA, 20 bp, Artificial Sequence
  chemically synthesized
gatcatgattctgtatgtct

SEQ ID NO: 92118 - DNA, 20 bp, Artificial Sequence
  chemically synthesized
tgagttctaccccagacata

SEQ ID NO: 92119 - DNA, 20 bp, Artificial Sequence
  chemically synthesized
atcatgattctgtatgtctg

SEQ ID NO: 92120 - DNA, 20 bp, Artificial Sequence
  chemically synthesized
atgattctgtatgtctgggg

SEQ ID NO: 92121 - DNA, 20 bp, Artificial Sequence
  chemically synthesized
caaattcttgagttctaccc

SEQ ID NO: 92122 - DNA, 20 bp, Artificial Sequence
  chemically synthesized
gtatgtctggggtagaactc

SEQ ID NO: 92123 - DNA, 20 bp, Artificial Sequence
  chemically synthesized
tctaagaaatgcaaattctt

SEQ ID NO: 92124 - DNA, 20 bp, Artificial Sequence
  chemically synthesized
actcaagaatttgcatttct

SEQ ID NO: 92125 - DNA, 20 bp, Artificial Sequence
  chemically synthesized
caagaatttgcatttcttag

SEQ ID NO: 92126 - DNA, 20 bp, Artificial Sequence
  chemically synthesized
ggcatcacttgggaacttct

SEQ ID NO: 92127 - DNA, 20 bp, Artificial Sequence
  chemically synthesized
tgcatttcttagaagttccc

SEQ ID NO: 92128 - DNA, 20 bp, Artificial Sequence
  chemically synthesized
tagcagtatcggcatcactt

SEQ ID NO: 92129 - DNA, 20 bp, Artificial Sequence
  chemically synthesized
ctagcagtatcggcatcact

SEQ ID NO: 92130 - DNA, 20 bp, Artificial Sequence
  chemically synthesized
ccaagtgatgccgatactgc

SEQ ID NO: 92131 - DNA, 20 bp, Artificial Sequence
  chemically synthesized
ggtctctggactagcagtat

SEQ ID NO: 92132 - DNA, 20 bp, Artificial Sequence
  chemically synthesized
tgatgccgatactgctagtc

SEQ ID NO: 92133 - DNA, 20 bp, Artificial Sequence
  chemically synthesized
aaatggggtctctggactag

SEQ ID NO: 92134 - DNA, 20 bp, Artificial Sequence
  chemically synthesized
atgccgatactgctagtcca

SEQ ID NO: 92135 - DNA, 20 bp, Artificial Sequence
  chemically synthesized
ttaaaatggggtctctggac

SEQ ID NO: 92136 - DNA, 20 bp, Artificial Sequence
  chemically synthesized
cattcttaaaatggggtctc

SEQ ID NO: 92137 - DNA, 20 bp, Artificial Sequence
  chemically synthesized
tagtccagagaccccatttt

SEQ ID NO: 92138 - DNA, 20 bp, Artificial Sequence
  chemically synthesized
agtgtttcattcttaaaatg

SEQ ID NO: 92139 - DNA, 20 bp, Artificial Sequence
  chemically synthesized
cagtgtttcattcttaaaat

SEQ ID NO: 92140 - DNA, 20 bp, Artificial Sequence
  chemically synthesized
acagtgtttcattcttaaaa

SEQ ID NO: 92141 - DNA, 20 bp, Artificial Sequence
  chemically synthesized
ttaagaatgaaacactgttc

SEQ ID NO: 92142 - DNA, 20 bp, Artificial Sequence
  chemically synthesized
taagggctgttatgctagaa

SEQ ID NO: 92143 - DNA, 20 bp, Artificial Sequence
  chemically synthesized
gaaacactgttctagcataa

SEQ ID NO: 92144 - DNA, 20 bp, Artificial Sequence
  chemically synthesized
aagattaagggctgttatgc

SEQ ID NO: 92145 - DNA, 20 bp, Artificial Sequence
  chemically synthesized
catgacctccagaagattaa

SEQ ID NO: 92146 - DNA, 20 bp, Artificial Sequence
  chemically synthesized
tcatgacctccagaagatta

SEQ ID NO: 92147 - DNA, 20 bp, Artificial Sequence
  chemically synthesized
cataacagcccttaatcttc

SEQ ID NO: 92148 - DNA, 20 bp, Artificial Sequence
  chemically synthesized
ttcatgacctccagaagatt

SEQ ID NO: 92149 - DNA, 20 bp, Artificial Sequence
  chemically synthesized
taacagcccttaatcttctg

SEQ ID NO: 92150 - DNA, 20 bp, Artificial Sequence
  chemically synthesized
aacagcccttaatcttctgg

SEQ ID NO: 92151 - DNA, 20 bp, Artificial Sequence
  chemically synthesized
aaggcattcatgacctccag

SEQ ID NO: 92152 - DNA, 20 bp, Artificial Sequence
  chemically synthesized
ataaaggcattcatgacctc

SEQ ID NO: 92153 - DNA, 20 bp, Artificial Sequence
  chemically synthesized
gaggtcatgaatgcctttat

SEQ ID NO: 92154 - DNA, 20 bp, Artificial Sequence
  chemically synthesized
aagatccatcattcttataa

SEQ ID NO: 92155 - DNA, 20 bp, Artificial Sequence
  chemically synthesized
gaagatccatcattcttata

SEQ ID NO: 92156 - DNA, 20 bp, Artificial Sequence
  chemically synthesized
gaatgcctttataagaatga

SEQ ID NO: 92157 - DNA, 20 bp, Artificial Sequence
  chemically synthesized
ttctgcaggtttttgaggag

SEQ ID NO: 92158 - DNA, 20 bp, Artificial Sequence
  chemically synthesized
tatttctgcaggtttttgag

SEQ ID NO: 92159 - DNA, 20 bp, Artificial Sequence
  chemically synthesized
aatatttctgcaggtttttg

SEQ ID NO: 92160 - DNA, 20 bp, Artificial Sequence
  chemically synthesized
aaatatttctgcaggttttt

SEQ ID NO: 92161 - DNA, 20 bp, Artificial Sequence
  chemically synthesized
atcttctcctcaaaaacctg

SEQ ID NO: 92162 - DNA, 20 bp, Artificial Sequence
  chemically synthesized
gtgtttataaatatttctgc

SEQ ID NO: 92163 - DNA, 20 bp, Artificial Sequence
  chemically synthesized
tgtgtttataaatatttctg

SEQ ID NO: 92164 - DNA, 20 bp, Artificial Sequence
  chemically synthesized
gcagaagcccgtgaagtaat

SEQ ID NO: 92165 - DNA, 20 bp, Artificial Sequence
  chemically synthesized
agcagaagcccgtgaagtaa

SEQ ID NO: 92166 - DNA, 20 bp, Artificial Sequence
  chemically synthesized
aaatacgacctattacttca

SEQ ID NO: 92167 - DNA, 20 bp, Artificial Sequence
  chemically synthesized
aatacgacctattacttcac

SEQ ID NO: 92168 - DNA, 20 bp, Artificial Sequence
  chemically synthesized
ggcagtagcagaagcccgtg

SEQ ID NO: 92169 - DNA, 20 bp, Artificial Sequence
  chemically synthesized
ggtggaggtggcagtagcag

SEQ ID NO: 92170 - DNA, 20 bp, Artificial Sequence
  chemically synthesized
ggaggtggaggtggcagtag

SEQ ID NO: 92171 - DNA, 20 bp, Artificial Sequence
  chemically synthesized
ggtggaggtggaggtggcag

SEQ ID NO: 92172 - DNA, 20 bp, Artificial Sequence
  chemically synthesized
gggggtggaggtggaggtgg

SEQ ID NO: 92173 - DNA, 20 bp, Artificial Sequence
  chemically synthesized
cccgggggtggaggtggagg

SEQ ID NO: 92174 - DNA, 20 bp, Artificial Sequence
  chemically synthesized
tgtcccgggggtggaggtgg

SEQ ID NO: 92175 - DNA, 20 bp, Artificial Sequence
  chemically synthesized
atgtcccgggggtggaggtg

SEQ ID NO: 92176 - DNA, 20 bp, Artificial Sequence
  chemically synthesized
gtatgtcccgggggtggagg

SEQ ID NO: 92177 - DNA, 20 bp, Artificial Sequence
  chemically synthesized
gccacctccacctccacccc

SEQ ID NO: 92178 - DNA, 20 bp, Artificial Sequence
  chemically synthesized
attgtatgtcccgggggtgg

SEQ ID NO: 92179 - DNA, 20 bp, Artificial Sequence
  chemically synthesized
ccacctccacctccaccccc

SEQ ID NO: 92180 - DNA, 20 bp, Artificial Sequence
  chemically synthesized
cattgtatgtcccgggggtg

SEQ ID NO: 92181 - DNA, 20 bp, Artificial Sequence
  chemically synthesized
tccattgtatgtcccggggg

SEQ ID NO: 92182 - DNA, 20 bp, Artificial Sequence
  chemically synthesized
taatccattgtatgtcccgg

SEQ ID NO: 92183 - DNA, 20 bp, Artificial Sequence
  chemically synthesized
ttaatccattgtatgtcccg

SEQ ID NO: 92184 - DNA, 20 bp, Artificial Sequence
  chemically synthesized
attaatccattgtatgtccc

SEQ ID NO: 92185 - DNA, 20 bp, Artificial Sequence
  chemically synthesized
cattaatccattgtatgtcc

SEQ ID NO: 92186 - DNA, 20 bp, Artificial Sequence
  chemically synthesized
tccacccccgggacatacaa

SEQ ID NO: 92187 - DNA, 20 bp, Artificial Sequence
  chemically synthesized
ggacatacaatggattaatg

SEQ ID NO: 92188 - DNA, 20 bp, Artificial Sequence
  chemically synthesized
atgaagacaacgtatccttc

SEQ ID NO: 92189 - DNA, 20 bp, Artificial Sequence
  chemically synthesized
tcctttaaaatggtactgga

SEQ ID NO: 92190 - DNA, 20 bp, Artificial Sequence
  chemically synthesized
ctcctttaaaatggtactgg

SEQ ID NO: 92191 - DNA, 20 bp, Artificial Sequence
  chemically synthesized
gttctcctttaaaatggtac

SEQ ID NO: 92192 - DNA, 20 bp, Artificial Sequence
  chemically synthesized
atccttccagtaccatttta

SEQ ID NO: 92193 - DNA, 20 bp, Artificial Sequence
  chemically synthesized
tccttccagtaccattttaa

SEQ ID NO: 92194 - DNA, 20 bp, Artificial Sequence
  chemically synthesized
ttgggggttctcctttaaaa

SEQ ID NO: 92195 - DNA, 20 bp, Artificial Sequence
  chemically synthesized
cttccagtaccattttaaag

SEQ ID NO: 92196 - DNA, 20 bp, Artificial Sequence
  chemically synthesized
cattttaaaggagaaccccc

SEQ ID NO: 92197 - DNA, 20 bp, Artificial Sequence
  chemically synthesized
tttaaaggagaacccccaag

SEQ ID NO: 92198 - DNA, 20 bp, Artificial Sequence
  chemically synthesized
caatgtattcttcttcttgg

SEQ ID NO: 92199 - DNA, 20 bp, Artificial Sequence
  chemically synthesized
aaaggagaacccccaagaag

SEQ ID NO: 92200 - DNA, 20 bp, Artificial Sequence
  chemically synthesized
ccaatgtattcttcttcttg

SEQ ID NO: 92201 - DNA, 20 bp, Artificial Sequence
  chemically synthesized
tccaatgtattcttcttctt

SEQ ID NO: 92202 - DNA, 20 bp, Artificial Sequence
  chemically synthesized
ttccaatgtattcttcttct

SEQ ID NO: 92203 - DNA, 20 bp, Artificial Sequence
  chemically synthesized
ccccaagaagaagaatacat

SEQ ID NO: 92204 - DNA, 20 bp, Artificial Sequence
  chemically synthesized
aagaagaatacattggaaaa

SEQ ID NO: 92205 - DNA, 20 bp, Artificial Sequence
  chemically synthesized
aaataagtaaaatcacattt

SEQ ID NO: 92206 - DNA, 20 bp, Artificial Sequence
  chemically synthesized
aaaatgtgattttacttatt

SEQ ID NO: 92207 - DNA, 20 bp, Artificial Sequence
  chemically synthesized
taattctaagacaactaaat

SEQ ID NO: 92208 - DNA, 20 bp, Artificial Sequence
  chemically synthesized
ttttacttatttagttgtct

SEQ ID NO: 92209 - DNA, 20 bp, Artificial Sequence
  chemically synthesized
ggctcactgggagtaattct

SEQ ID NO: 92210 - DNA, 20 bp, Artificial Sequence
  chemically synthesized
agttgtcttagaattactcc

SEQ ID NO: 92211 - DNA, 20 bp, Artificial Sequence
  chemically synthesized
gtcttagaattactcccagt

SEQ ID NO: 92212 - DNA, 20 bp, Artificial Sequence
  chemically synthesized
tttgtacgtaggctcactgg

SEQ ID NO: 92213 - DNA, 20 bp, Artificial Sequence
  chemically synthesized
attttgtacgtaggctcact

SEQ ID NO: 92214 - DNA, 20 bp, Artificial Sequence
  chemically synthesized
cattttgtacgtaggctcac

SEQ ID NO: 92215 - DNA, 20 bp, Artificial Sequence
  chemically synthesized
aatcgggtcattttgtacgt

SEQ ID NO: 92216 - DNA, 20 bp, Artificial Sequence
  chemically synthesized
aaatcgggtcattttgtacg

SEQ ID NO: 92217 - DNA, 20 bp, Artificial Sequence
  chemically synthesized
acgtacaaaatgacccgatt

SEQ ID NO: 92218 - DNA, 20 bp, Artificial Sequence
  chemically synthesized
cgtacaaaatgacccgattt

SEQ ID NO: 92219 - DNA, 20 bp, Artificial Sequence
  chemically synthesized
gtacaaaatgacccgatttg

SEQ ID NO: 92220 - DNA, 20 bp, Artificial Sequence
  chemically synthesized
caggtctccttccccaaatc

SEQ ID NO: 92221 - DNA, 20 bp, Artificial Sequence
  chemically synthesized
acaggtctccttccccaaat

SEQ ID NO: 92222 - DNA, 20 bp, Artificial Sequence
  chemically synthesized
caaaatgacccgatttgggg

SEQ ID NO: 92223 - DNA, 20 bp, Artificial Sequence
  chemically synthesized
aaaatgacccgatttgggga

SEQ ID NO: 92224 - DNA, 20 bp, Artificial Sequence
  chemically synthesized
aatgacccgatttggggaag

SEQ ID NO: 92225 - DNA, 20 bp, Artificial Sequence
  chemically synthesized
ttggggaaggagacctgtca

SEQ ID NO: 92226 - DNA, 20 bp, Artificial Sequence
  chemically synthesized
tggggaaggagacctgtcaa

SEQ ID NO: 92227 - DNA, 20 bp, Artificial Sequence
  chemically synthesized
cccaagaactgtcctttgac

SEQ ID NO: 92228 - DNA, 20 bp, Artificial Sequence
  chemically synthesized
acccaagaactgtcctttga

SEQ ID NO: 92229 - DNA, 20 bp, Artificial Sequence
  chemically synthesized
gaaggagacctgtcaaagga

SEQ ID NO: 92230 - DNA, 20 bp, Artificial Sequence
  chemically synthesized
acctgtcaaaggacagttct

SEQ ID NO: 92231 - DNA, 20 bp, Artificial Sequence
  chemically synthesized
cctgtcaaaggacagttctt

SEQ ID NO: 92232 - DNA, 20 bp, Artificial Sequence
  chemically synthesized
tgaatttcctcattgcaccc

SEQ ID NO: 92233 - DNA, 20 bp, Artificial Sequence
  chemically synthesized
ggacagttcttgggtgcaat

SEQ ID NO: 92234 - DNA, 20 bp, Artificial Sequence
  chemically synthesized
gacagttcttgggtgcaatg

SEQ ID NO: 92235 - DNA, 20 bp, Artificial Sequence
  chemically synthesized
aggttatctgaatgtggtta

SEQ ID NO: 92236 - DNA, 20 bp, Artificial Sequence
  chemically synthesized
tcaggttatctgaatgtggt

SEQ ID NO: 92237 - DNA, 20 bp, Artificial Sequence
  chemically synthesized
catttcactctaaccacatt

SEQ ID NO: 92238 - DNA, 20 bp, Artificial Sequence
  chemically synthesized
aaggtcaggttatctgaatg

SEQ ID NO: 92239 - DNA, 20 bp, Artificial Sequence
  chemically synthesized
ggttaaaatgggaaaaggtc

SEQ ID NO: 92240 - DNA, 20 bp, Artificial Sequence
  chemically synthesized
aggttaaaatgggaaaaggt

SEQ ID NO: 92241 - DNA, 20 bp, Artificial Sequence
  chemically synthesized
tggcaggttaaaatgggaaa

SEQ ID NO: 92242 - DNA, 20 bp, Artificial Sequence
  chemically synthesized
atggcaggttaaaatgggaa

SEQ ID NO: 92243 - DNA, 20 bp, Artificial Sequence
  chemically synthesized
agtgaatggcaggttaaaat

SEQ ID NO: 92244 - DNA, 20 bp, Artificial Sequence
  chemically synthesized
aagtgaatggcaggttaaaa

SEQ ID NO: 92245 - DNA, 20 bp, Artificial Sequence
  chemically synthesized
ttacttcccaagtgaatggc

SEQ ID NO: 92246 - DNA, 20 bp, Artificial Sequence
  chemically synthesized
gttacttcccaagtgaatgg

SEQ ID NO: 92247 - DNA, 20 bp, Artificial Sequence
  chemically synthesized
attttaacctgccattcact

SEQ ID NO: 92248 - DNA, 20 bp, Artificial Sequence
  chemically synthesized
ttttaacctgccattcactt

SEQ ID NO: 92249 - DNA, 20 bp, Artificial Sequence
  chemically synthesized
tttgttacttcccaagtgaa

SEQ ID NO: 92250 - DNA, 20 bp, Artificial Sequence
  chemically synthesized
taacctgccattcacttggg

SEQ ID NO: 92251 - DNA, 20 bp, Artificial Sequence
  chemically synthesized
tctgttatttgttacttccc

SEQ ID NO: 92252 - DNA, 20 bp, Artificial Sequence
  chemically synthesized
acttgggaagtaacaaataa

SEQ ID NO: 92253 - DNA, 20 bp, Artificial Sequence
  chemically synthesized
ttgggaagtaacaaataaca

SEQ ID NO: 92254 - DNA, 20 bp, Artificial Sequence
  chemically synthesized
gggaagtaacaaataacaga

SEQ ID NO: 92255 - DNA, 20 bp, Artificial Sequence
  chemically synthesized
ggaagtaacaaataacagag

SEQ ID NO: 92256 - DNA, 20 bp, Artificial Sequence
  chemically synthesized
agtaacaaataacagagagg

SEQ ID NO: 92257 - DNA, 20 bp, Artificial Sequence
  chemically synthesized
gtaacaaataacagagaggt

SEQ ID NO: 92258 - DNA, 20 bp, Artificial Sequence
  chemically synthesized
acaaataacagagaggtggg

SEQ ID NO: 92259 - DNA, 20 bp, Artificial Sequence
  chemically synthesized
caaataacagagaggtgggt

SEQ ID NO: 92260 - DNA, 20 bp, Artificial Sequence
  chemically synthesized
gagaggtgggtgggtaacca

SEQ ID NO: 92261 - DNA, 20 bp, Artificial Sequence
  chemically synthesized
gaggtgggtgggtaaccatg

SEQ ID NO: 92262 - DNA, 20 bp, Artificial Sequence
  chemically synthesized
gggtgggtaaccatggagaa

SEQ ID NO: 92263 - DNA, 20 bp, Artificial Sequence
  chemically synthesized
tgaatgcacccttttctcca

SEQ ID NO: 92264 - DNA, 20 bp, Artificial Sequence
  chemically synthesized
ggtgggtaaccatggagaaa

SEQ ID NO: 92265 - DNA, 20 bp, Artificial Sequence
  chemically synthesized
gtgggtaaccatggagaaaa

SEQ ID NO: 92266 - DNA, 20 bp, Artificial Sequence
  chemically synthesized
catggagaaaagggtgcatt

SEQ ID NO: 92267 - DNA, 20 bp, Artificial Sequence
  chemically synthesized
gagaaaagggtgcattcagc

SEQ ID NO: 92268 - DNA, 20 bp, Artificial Sequence
  chemically synthesized
agaaaagggtgcattcagcc

SEQ ID NO: 92269 - DNA, 20 bp, Artificial Sequence
  chemically synthesized
gaaaagggtgcattcagcca

SEQ ID NO: 92270 - DNA, 20 bp, Artificial Sequence
  chemically synthesized
aaaagggtgcattcagccag

SEQ ID NO: 92271 - DNA, 20 bp, Artificial Sequence
  chemically synthesized
tccttccacaggcaggcccc

SEQ ID NO: 92272 - DNA, 20 bp, Artificial Sequence
  chemically synthesized
ttcagccaggggcctgcctg

SEQ ID NO: 92273 - DNA, 20 bp, Artificial Sequence
  chemically synthesized
tgctccgtccttccacaggc

SEQ ID NO: 92274 - DNA, 20 bp, Artificial Sequence
  chemically synthesized
agccaggggcctgcctgtgg

SEQ ID NO: 92275 - DNA, 20 bp, Artificial Sequence
  chemically synthesized
ctgctccgtccttccacagg

SEQ ID NO: 92276 - DNA, 20 bp, Artificial Sequence
  chemically synthesized
gccaggggcctgcctgtgga

SEQ ID NO: 92277 - DNA, 20 bp, Artificial Sequence
  chemically synthesized
aaactgctccgtccttccac

SEQ ID NO: 92278 - DNA, 20 bp, Artificial Sequence
  chemically synthesized
caaactgctccgtccttcca

SEQ ID NO: 92279 - DNA, 20 bp, Artificial Sequence
  chemically synthesized
ggggcctgcctgtggaagga

SEQ ID NO: 92280 - DNA, 20 bp, Artificial Sequence
  chemically synthesized
ggcctgcctgtggaaggacg

SEQ ID NO: 92281 - DNA, 20 bp, Artificial Sequence
  chemically synthesized
ctgcctgtggaaggacggag

SEQ ID NO: 92282 - DNA, 20 bp, Artificial Sequence
  chemically synthesized
ggacggagcagtttgcacct

SEQ ID NO: 92283 - DNA, 20 bp, Artificial Sequence
  chemically synthesized
gacggagcagtttgcacctc

SEQ ID NO: 92284 - DNA, 20 bp, Artificial Sequence
  chemically synthesized
acggagcagtttgcacctcg

SEQ ID NO: 92285 - DNA, 20 bp, Artificial Sequence
  chemically synthesized
agcagtttgcacctcgggga

SEQ ID NO: 92286 - DNA, 20 bp, Artificial Sequence
  chemically synthesized
ccctacctccgctttccccg

SEQ ID NO: 92287 - DNA, 20 bp, Artificial Sequence
  chemically synthesized
gccctacctccgctttcccc

SEQ ID NO: 92288 - DNA, 20 bp, Artificial Sequence
  chemically synthesized
agtttgcacctcggggaaag

SEQ ID NO: 92289 - DNA, 20 bp, Artificial Sequence
  chemically synthesized
tttgcacctcggggaaagcg

SEQ ID NO: 92290 - DNA, 20 bp, Artificial Sequence
  chemically synthesized
ttgcacctcggggaaagcgg

SEQ ID NO: 92291 - DNA, 20 bp, Artificial Sequence
  chemically synthesized
cacctcggggaaagcggagg

SEQ ID NO: 92292 - DNA, 20 bp, Artificial Sequence
  chemically synthesized
acctcggggaaagcggaggt

SEQ ID NO: 92293 - DNA, 20 bp, Artificial Sequence
  chemically synthesized
cctcggggaaagcggaggta

SEQ ID NO: 92294 - DNA, 20 bp, Artificial Sequence
  chemically synthesized
ggaaagcggaggtagggctc

SEQ ID NO: 92295 - DNA, 20 bp, Artificial Sequence
  chemically synthesized
gaaagcggaggtagggctct

SEQ ID NO: 92296 - DNA, 20 bp, Artificial Sequence
  chemically synthesized
gctaccagacagagagccta

SEQ ID NO: 92297 - DNA, 20 bp, Artificial Sequence
  chemically synthesized
gggctaccagacagagagcc

SEQ ID NO: 92298 - DNA, 20 bp, Artificial Sequence
  chemically synthesized
agggctctaggctctctgtc

SEQ ID NO: 92299 - DNA, 20 bp, Artificial Sequence
  chemically synthesized
tccctgggctaccagacaga

SEQ ID NO: 92300 - DNA, 20 bp, Artificial Sequence
  chemically synthesized
gctctaggctctctgtctgg

SEQ ID NO: 92301 - DNA, 20 bp, Artificial Sequence
  chemically synthesized
tttccctgggctaccagaca

SEQ ID NO: 92302 - DNA, 20 bp, Artificial Sequence
  chemically synthesized
tgtttccctgggctaccaga

SEQ ID NO: 92303 - DNA, 20 bp, Artificial Sequence
  chemically synthesized
aggctctctgtctggtagcc

SEQ ID NO: 92304 - DNA, 20 bp, Artificial Sequence
  chemically synthesized
ggctctctgtctggtagccc

SEQ ID NO: 92305 - DNA, 20 bp, Artificial Sequence
  chemically synthesized
gaactgtttccctgggctac

SEQ ID NO: 92306 - DNA, 20 bp, Artificial Sequence
  chemically synthesized
gctctctgtctggtagccca

SEQ ID NO: 92307 - DNA, 20 bp, Artificial Sequence
  chemically synthesized
tgtctggtagcccagggaaa

SEQ ID NO: 92308 - DNA, 20 bp, Artificial Sequence
  chemically synthesized
tgatcttgaactgtttccct

SEQ ID NO: 92309 - DNA, 20 bp, Artificial Sequence
  chemically synthesized
ttgatcttgaactgtttccc

SEQ ID NO: 92310 - DNA, 20 bp, Artificial Sequence
  chemically synthesized
gtagcccagggaaacagttc

SEQ ID NO: 92311 - DNA, 20 bp, Artificial Sequence
  chemically synthesized
agggaaacagttcaagatca

SEQ ID NO: 92312 - DNA, 20 bp, Artificial Sequence
  chemically synthesized
gggaaacagttcaagatcaa

SEQ ID NO: 92313 - DNA, 20 bp, Artificial Sequence
  chemically synthesized
acagttcaagatcaaaggaa

SEQ ID NO: 92314 - DNA, 20 bp, Artificial Sequence
  chemically synthesized
gatcaaaggaaaagataatt

SEQ ID NO: 92315 - DNA, 20 bp, Artificial Sequence
  chemically synthesized
ataattaagaatgtgcttaa

SEQ ID NO: 92316 - DNA, 20 bp, Artificial Sequence
  chemically synthesized
ctgatttgaagttttctttt

SEQ ID NO: 92317 - DNA, 20 bp, Artificial Sequence
  chemically synthesized
cttaaaagaaaacttcaaat

SEQ ID NO: 92318 - DNA, 20 bp, Artificial Sequence
  chemically synthesized
tgtgtagcacagctgatttg

SEQ ID NO: 92319 - DNA, 20 bp, Artificial Sequence
  chemically synthesized
tctcatatctttgtgtagca

SEQ ID NO: 92320 - DNA, 20 bp, Artificial Sequence
  chemically synthesized
caaatcagctgtgctacaca

SEQ ID NO: 92321 - DNA, 20 bp, Artificial Sequence
  chemically synthesized
cattgtctcatatctttgtg

SEQ ID NO: 92322 - DNA, 20 bp, Artificial Sequence
  chemically synthesized
gctgtgctacacaaagatat

SEQ ID NO: 92323 - DNA, 20 bp, Artificial Sequence
  chemically synthesized
atatgagacaatgcctgttg

SEQ ID NO: 92324 - DNA, 20 bp, Artificial Sequence
  chemically synthesized
atgagacaatgcctgttgta

SEQ ID NO: 92325 - DNA, 20 bp, Artificial Sequence
  chemically synthesized
aatgctcttttctctacaac

SEQ ID NO: 92326 - DNA, 20 bp, Artificial Sequence
  chemically synthesized
aaatgctcttttctctacaa

SEQ ID NO: 92327 - DNA, 20 bp, Artificial Sequence
  chemically synthesized
acaatgcctgttgtagagaa

SEQ ID NO: 92328 - DNA, 20 bp, Artificial Sequence
  chemically synthesized
aatgcctgttgtagagaaaa

SEQ ID NO: 92329 - DNA, 20 bp, Artificial Sequence
  chemically synthesized
gagcattttgactttaccct

SEQ ID NO: 92330 - DNA, 20 bp, Artificial Sequence
  chemically synthesized
taagaaagattcttagggta

SEQ ID NO: 92331 - DNA, 20 bp, Artificial Sequence
  chemically synthesized
gcacataagaaagattctta

SEQ ID NO: 92332 - DNA, 20 bp, Artificial Sequence
  chemically synthesized
agcacataagaaagattctt

SEQ ID NO: 92333 - DNA, 20 bp, Artificial Sequence
  chemically synthesized
aagcacataagaaagattct

SEQ ID NO: 92334 - DNA, 20 bp, Artificial Sequence
  chemically synthesized
gctatggaaagcacataaga

SEQ ID NO: 92335 - DNA, 20 bp, Artificial Sequence
  chemically synthesized
ctgggctatggaaagcacat

SEQ ID NO: 92336 - DNA, 20 bp, Artificial Sequence
  chemically synthesized
tctttcttatgtgctttcca

SEQ ID NO: 92337 - DNA, 20 bp, Artificial Sequence
  chemically synthesized
ctataccgctgggctatgga

SEQ ID NO: 92338 - DNA, 20 bp, Artificial Sequence
  chemically synthesized
cttatgtgctttccatagcc

SEQ ID NO: 92339 - DNA, 20 bp, Artificial Sequence
  chemically synthesized
ataactataccgctgggcta

SEQ ID NO: 92340 - DNA, 20 bp, Artificial Sequence
  chemically synthesized
atgtgctttccatagcccag

SEQ ID NO: 92341 - DNA, 20 bp, Artificial Sequence
  chemically synthesized
ctttccatagcccagcggta

SEQ ID NO: 92342 - DNA, 20 bp, Artificial Sequence
  chemically synthesized
ttaaaaataactataccgct

SEQ ID NO: 92343 - DNA, 20 bp, Artificial Sequence
  chemically synthesized
tttaaaaataactataccgc

SEQ ID NO: 92344 - DNA, 20 bp, Artificial Sequence
  chemically synthesized
tagttatttttaaatgaccc

SEQ ID NO: 92345 - DNA, 20 bp, Artificial Sequence
  chemically synthesized
tatttttaaatgaccctgga

SEQ ID NO: 92346 - DNA, 20 bp, Artificial Sequence
  chemically synthesized
atttttaaatgaccctggaa

SEQ ID NO: 92347 - DNA, 20 bp, Artificial Sequence
  chemically synthesized
acacctctgcttcctttcca

SEQ ID NO: 92348 - DNA, 20 bp, Artificial Sequence
  chemically synthesized
tttaaatgaccctggaaagg

SEQ ID NO: 92349 - DNA, 20 bp, Artificial Sequence
  chemically synthesized
aacacctctgcttcctttcc

SEQ ID NO: 92350 - DNA, 20 bp, Artificial Sequence
  chemically synthesized
gaacacctctgcttcctttc

SEQ ID NO: 92351 - DNA, 20 bp, Artificial Sequence
  chemically synthesized
aaatgaccctggaaaggaag

SEQ ID NO: 92352 - DNA, 20 bp, Artificial Sequence
  chemically synthesized
atgaccctggaaaggaagca

SEQ ID NO: 92353 - DNA, 20 bp, Artificial Sequence
  chemically synthesized
tgaccctggaaaggaagcag

SEQ ID NO: 92354 - DNA, 20 bp, Artificial Sequence
  chemically synthesized
tgccttctattcatgcaata

SEQ ID NO: 92355 - DNA, 20 bp, Artificial Sequence
  chemically synthesized
ggtgttctttattgcatgaa

SEQ ID NO: 92356 - DNA, 20 bp, Artificial Sequence
  chemically synthesized
gttctttattgcatgaatag

SEQ ID NO: 92357 - DNA, 20 bp, Artificial Sequence
  chemically synthesized
ttctttattgcatgaataga

SEQ ID NO: 92358 - DNA, 20 bp, Artificial Sequence
  chemically synthesized
agaaggcaatctttcattta

SEQ ID NO: 92359 - DNA, 20 bp, Artificial Sequence
  chemically synthesized
ggttaaggttctttaaatga

SEQ ID NO: 92360 - DNA, 20 bp, Artificial Sequence
  chemically synthesized
atgcatgcagagcggggtta

SEQ ID NO: 92361 - DNA, 20 bp, Artificial Sequence
  chemically synthesized
catgcatgcagagcggggtt

SEQ ID NO: 92362 - DNA, 20 bp, Artificial Sequence
  chemically synthesized
tcatgcatgcatgcagagcg

SEQ ID NO: 92363 - DNA, 20 bp, Artificial Sequence
  chemically synthesized
ttcatgcatgcatgcagagc

SEQ ID NO: 92364 - DNA, 20 bp, Artificial Sequence
  chemically synthesized
cttcatgcatgcatgcagag

SEQ ID NO: 92365 - DNA, 20 bp, Artificial Sequence
  chemically synthesized
tgacttcatgcatgcatgca

SEQ ID NO: 92366 - DNA, 20 bp, Artificial Sequence
  chemically synthesized
cctgacttcatgcatgcatg

SEQ ID NO: 92367 - DNA, 20 bp, Artificial Sequence
  chemically synthesized
ccgctctgcatgcatgcatg

SEQ ID NO: 92368 - DNA, 20 bp, Artificial Sequence
  chemically synthesized
tctgcatgcatgcatgaagt

SEQ ID NO: 92369 - DNA, 20 bp, Artificial Sequence
  chemically synthesized
ctgcatgcatgcatgaagtc

SEQ ID NO: 92370 - DNA, 20 bp, Artificial Sequence
  chemically synthesized
atgcatgaagtcaggaacac

SEQ ID NO: 92371 - DNA, 20 bp, Artificial Sequence
  chemically synthesized
tgcatgaagtcaggaacaca

SEQ ID NO: 92372 - DNA, 20 bp, Artificial Sequence
  chemically synthesized
gcatgaagtcaggaacacaa

SEQ ID NO: 92373 - DNA, 20 bp, Artificial Sequence
  chemically synthesized
agttgccaaaatgaataata

SEQ ID NO: 92374 - DNA, 20 bp, Artificial Sequence
  chemically synthesized
caatactgtattattcattt

SEQ ID NO: 92375 - DNA, 20 bp, Artificial Sequence
  chemically synthesized
agagccatcatttgaattta

SEQ ID NO: 92376 - DNA, 20 bp, Artificial Sequence
  chemically synthesized
gcaactataaattcaaatga

SEQ ID NO: 92377 - DNA, 20 bp, Artificial Sequence
  chemically synthesized
taaattcaaatgatggctct

SEQ ID NO: 92378 - DNA, 20 bp, Artificial Sequence
  chemically synthesized
aaattcaaatgatggctctg

SEQ ID NO: 92379 - DNA, 20 bp, Artificial Sequence
  chemically synthesized
tcaaatgatggctctgaggt

SEQ ID NO: 92380 - DNA, 20 bp, Artificial Sequence
  chemically synthesized
caaatgatggctctgaggtt

SEQ ID NO: 92381 - DNA, 20 bp, Artificial Sequence
  chemically synthesized
cctttttctccccaacctca

SEQ ID NO: 92382 - DNA, 20 bp, Artificial Sequence
  chemically synthesized
aaatgatggctctgaggttg

SEQ ID NO: 92383 - DNA, 20 bp, Artificial Sequence
  chemically synthesized
ggcctttttctccccaacct

SEQ ID NO: 92384 - DNA, 20 bp, Artificial Sequence
  chemically synthesized
atgatggctctgaggttggg

SEQ ID NO: 92385 - DNA, 20 bp, Artificial Sequence
  chemically synthesized
gctctgaggttggggagaaa

SEQ ID NO: 92386 - DNA, 20 bp, Artificial Sequence
  chemically synthesized
ctctgaggttggggagaaaa

SEQ ID NO: 92387 - DNA, 20 bp, Artificial Sequence
  chemically synthesized
tggggagaaaaaggcccgct

SEQ ID NO: 92388 - DNA, 20 bp, Artificial Sequence
  chemically synthesized
gagaaaaaggcccgctgagc

SEQ ID NO: 92389 - DNA, 20 bp, Artificial Sequence
  chemically synthesized
gttctgctctccagctcagc

SEQ ID NO: 92390 - DNA, 20 bp, Artificial Sequence
  chemically synthesized
cgttctgctctccagctcag

SEQ ID NO: 92391 - DNA, 20 bp, Artificial Sequence
  chemically synthesized
gaaaaaggcccgctgagctg

SEQ ID NO: 92392 - DNA, 20 bp, Artificial Sequence
  chemically synthesized
aaaaggcccgctgagctgga

SEQ ID NO: 92393 - DNA, 20 bp, Artificial Sequence
  chemically synthesized
aagcgttctgctctccagct

SEQ ID NO: 92394 - DNA, 20 bp, Artificial Sequence
  chemically synthesized
aggcccgctgagctggagag

SEQ ID NO: 92395 - DNA, 20 bp, Artificial Sequence
  chemically synthesized
gaaggaagcgttctgctctc

SEQ ID NO: 92396 - DNA, 20 bp, Artificial Sequence
  chemically synthesized
ggagagcagaacgcttcctt

SEQ ID NO: 92397 - DNA, 20 bp, Artificial Sequence
  chemically synthesized
cttctttgataagctgaagg

SEQ ID NO: 92398 - DNA, 20 bp, Artificial Sequence
  chemically synthesized
tcacttctttgataagctga

SEQ ID NO: 92399 - DNA, 20 bp, Artificial Sequence
  chemically synthesized
atcacttctttgataagctg

SEQ ID NO: 92400 - DNA, 20 bp, Artificial Sequence
  chemically synthesized
acgcttccttcagcttatca

SEQ ID NO: 92401 - DNA, 20 bp, Artificial Sequence
  chemically synthesized
cttccttcagcttatcaaag

SEQ ID NO: 92402 - DNA, 20 bp, Artificial Sequence
  chemically synthesized
agcactatcacttctttgat

SEQ ID NO: 92403 - DNA, 20 bp, Artificial Sequence
  chemically synthesized
tcagcttatcaaagaagtga

SEQ ID NO: 92404 - DNA, 20 bp, Artificial Sequence
  chemically synthesized
tcaaagaagtgatagtgcta

SEQ ID NO: 92405 - DNA, 20 bp, Artificial Sequence
  chemically synthesized
caaagaagtgatagtgctac

SEQ ID NO: 92406 - DNA, 20 bp, Artificial Sequence
  chemically synthesized
agaagtgatagtgctacagg

SEQ ID NO: 92407 - DNA, 20 bp, Artificial Sequence
  chemically synthesized
gaagtgatagtgctacaggc

SEQ ID NO: 92408 - DNA, 20 bp, Artificial Sequence
  chemically synthesized
agtgatagtgctacaggcag

SEQ ID NO: 92409 - DNA, 20 bp, Artificial Sequence
  chemically synthesized
ttatggggcactcctgcctg

SEQ ID NO: 92410 - DNA, 20 bp, Artificial Sequence
  chemically synthesized
attttccctagattattatg

SEQ ID NO: 92411 - DNA, 20 bp, Artificial Sequence
  chemically synthesized
tattttccctagattattat

SEQ ID NO: 92412 - DNA, 20 bp, Artificial Sequence
  chemically synthesized
gtattttccctagattatta

SEQ ID NO: 92413 - DNA, 20 bp, Artificial Sequence
  chemically synthesized
aggagtgccccataataatc

SEQ ID NO: 92414 - DNA, 20 bp, Artificial Sequence
  chemically synthesized
ggagtgccccataataatct

SEQ ID NO: 92415 - DNA, 20 bp, Artificial Sequence
  chemically synthesized
gagtgccccataataatcta

SEQ ID NO: 92416 - DNA, 20 bp, Artificial Sequence
  chemically synthesized
actcagaggcgtattttccc

SEQ ID NO: 92417 - DNA, 20 bp, Artificial Sequence
  chemically synthesized
tctagggaaaatacgcctct

SEQ ID NO: 92418 - DNA, 20 bp, Artificial Sequence
  chemically synthesized
gaaaatcttcattgactcag

SEQ ID NO: 92419 - DNA, 20 bp, Artificial Sequence
  chemically synthesized
agaaaatcttcattgactca

SEQ ID NO: 92420 - DNA, 20 bp, Artificial Sequence
  chemically synthesized
acagaaaatcttcattgact

SEQ ID NO: 92421 - DNA, 20 bp, Artificial Sequence
  chemically synthesized
aatacgcctctgagtcaatg

SEQ ID NO: 92422 - DNA, 20 bp, Artificial Sequence
  chemically synthesized
caaaacagcccatgcaataa

SEQ ID NO: 92423 - DNA, 20 bp, Artificial Sequence
  chemically synthesized
gaagattttctgttattgca

SEQ ID NO: 92424 - DNA, 20 bp, Artificial Sequence
  chemically synthesized
aagattttctgttattgcat

SEQ ID NO: 92425 - DNA, 20 bp, Artificial Sequence
  chemically synthesized
tttcttggctgtaggcaaaa

SEQ ID NO: 92426 - DNA, 20 bp, Artificial Sequence
  chemically synthesized
tgcatgggctgttttgccta

SEQ ID NO: 92427 - DNA, 20 bp, Artificial Sequence
  chemically synthesized
gggctgttttgcctacagcc

SEQ ID NO: 92428 - DNA, 20 bp, Artificial Sequence
  chemically synthesized
gacagaattttcttggctgt

SEQ ID NO: 92429 - DNA, 20 bp, Artificial Sequence
  chemically synthesized
agacagaattttcttggctg

SEQ ID NO: 92430 - DNA, 20 bp, Artificial Sequence
  chemically synthesized
accatcagacagaattttct

SEQ ID NO: 92431 - DNA, 20 bp, Artificial Sequence
  chemically synthesized
gccaagaaaattctgtctga

SEQ ID NO: 92432 - DNA, 20 bp, Artificial Sequence
  chemically synthesized
gctaaaacattaccatcaga

SEQ ID NO: 92433 - DNA, 20 bp, Artificial Sequence
  chemically synthesized
agcagctaaaacattaccat

SEQ ID NO: 92434 - DNA, 20 bp, Artificial Sequence
  chemically synthesized
tctgtctgatggtaatgttt

SEQ ID NO: 92435 - DNA, 20 bp, Artificial Sequence
  chemically synthesized
agacagaggagatgaatcag

SEQ ID NO: 92436 - DNA, 20 bp, Artificial Sequence
  chemically synthesized
tgaagacagaggagatgaat

SEQ ID NO: 92437 - DNA, 20 bp, Artificial Sequence
  chemically synthesized
gagaagaattgaagacagag

SEQ ID NO: 92438 - DNA, 20 bp, Artificial Sequence
  chemically synthesized
ctgagaagaattgaagacag

SEQ ID NO: 92439 - DNA, 20 bp, Artificial Sequence
  chemically synthesized
gctgagaagaattgaagaca

SEQ ID NO: 92440 - DNA, 20 bp, Artificial Sequence
  chemically synthesized
ttgctgagaagaattgaaga

SEQ ID NO: 92441 - DNA, 20 bp, Artificial Sequence
  chemically synthesized
aagtttgctgagaagaattg

SEQ ID NO: 92442 - DNA, 20 bp, Artificial Sequence
  chemically synthesized
cctctgtcttcaattcttct

SEQ ID NO: 92443 - DNA, 20 bp, Artificial Sequence
  chemically synthesized
cccaataaaagtttgctgag

SEQ ID NO: 92444 - DNA, 20 bp, Artificial Sequence
  chemically synthesized
agacccaataaaagtttgct

SEQ ID NO: 92445 - DNA, 20 bp, Artificial Sequence
  chemically synthesized
tcttctcagcaaacttttat

SEQ ID NO: 92446 - DNA, 20 bp, Artificial Sequence
  chemically synthesized
cttctcagcaaacttttatt

SEQ ID NO: 92447 - DNA, 20 bp, Artificial Sequence
  chemically synthesized
cccaggatgagacccaataa

SEQ ID NO: 92448 - DNA, 20 bp, Artificial Sequence
  chemically synthesized
acttttattgggtctcatcc

SEQ ID NO: 92449 - DNA, 20 bp, Artificial Sequence
  chemically synthesized
cttttattgggtctcatcct

SEQ ID NO: 92450 - DNA, 20 bp, Artificial Sequence
  chemically synthesized
tctgtaaatgtgcccaggat

SEQ ID NO: 92451 - DNA, 20 bp, Artificial Sequence
  chemically synthesized
attgctctgtaaatgtgccc

SEQ ID NO: 92452 - DNA, 20 bp, Artificial Sequence
  chemically synthesized
aattgctctgtaaatgtgcc

SEQ ID NO: 92453 - DNA, 20 bp, Artificial Sequence
  chemically synthesized
tctcatcctgggcacattta

SEQ ID NO: 92454 - DNA, 20 bp, Artificial Sequence
  chemically synthesized
tcatcctgggcacatttaca

SEQ ID NO: 92455 - DNA, 20 bp, Artificial Sequence
  chemically synthesized
ttgaagagatgttatcatta

SEQ ID NO: 92456 - DNA, 20 bp, Artificial Sequence
  chemically synthesized
atgataacatctcttcaaat

SEQ ID NO: 92457 - DNA, 20 bp, Artificial Sequence
  chemically synthesized
cactttaaatctcatttgaa

SEQ ID NO: 92458 - DNA, 20 bp, Artificial Sequence
  chemically synthesized
tacactttaaatctcatttg

SEQ ID NO: 92459 - DNA, 20 bp, Artificial Sequence
  chemically synthesized
atctcttcaaatgagattta

SEQ ID NO: 92460 - DNA, 20 bp, Artificial Sequence
  chemically synthesized
gagatttaaagtgtaattaa

SEQ ID NO: 92461 - DNA, 20 bp, Artificial Sequence
  chemically synthesized
agatttaaagtgtaattaaa

SEQ ID NO: 92462 - DNA, 20 bp, Artificial Sequence
  chemically synthesized
attaaaaggcacatgtgttg

SEQ ID NO: 92463 - DNA, 20 bp, Artificial Sequence
  chemically synthesized
aaggcacatgtgttgtggca

SEQ ID NO: 92464 - DNA, 20 bp, Artificial Sequence
  chemically synthesized
aggcacatgtgttgtggcaa

SEQ ID NO: 92465 - DNA, 20 bp, Artificial Sequence
  chemically synthesized
gtggcaaaggcgttgttgtg

SEQ ID NO: 92466 - DNA, 20 bp, Artificial Sequence
  chemically synthesized
ctccatggcacgatgatgta

SEQ ID NO: 92467 - DNA, 20 bp, Artificial Sequence
  chemically synthesized
gaccatacatcatcgtgcca

SEQ ID NO: 92468 - DNA, 20 bp, Artificial Sequence
  chemically synthesized
ccatacatcatcgtgccatg

SEQ ID NO: 92469 - DNA, 20 bp, Artificial Sequence
  chemically synthesized
ctggctgagtgagagctcca

SEQ ID NO: 92470 - DNA, 20 bp, Artificial Sequence
  chemically synthesized
cgtgccatggagctctcact

SEQ ID NO: 92471 - DNA, 20 bp, Artificial Sequence
  chemically synthesized
tccataggctggctgagtga

SEQ ID NO: 92472 - DNA, 20 bp, Artificial Sequence
  chemically synthesized
ccatggagctctcactcagc

SEQ ID NO: 92473 - DNA, 20 bp, Artificial Sequence
  chemically synthesized
attccataggctggctgagt

SEQ ID NO: 92474 - DNA, 20 bp, Artificial Sequence
  chemically synthesized
ggtcattccataggctggct

SEQ ID NO: 92475 - DNA, 20 bp, Artificial Sequence
  chemically synthesized
gctctcactcagccagccta

SEQ ID NO: 92476 - DNA, 20 bp, Artificial Sequence
  chemically synthesized
accggggtcattccataggc

SEQ ID NO: 92477 - DNA, 20 bp, Artificial Sequence
  chemically synthesized
tgaaaccggggtcattccat

SEQ ID NO: 92478 - DNA, 20 bp, Artificial Sequence
  chemically synthesized
gtgaaaccggggtcattcca

SEQ ID NO: 92479 - DNA, 20 bp, Artificial Sequence
  chemically synthesized
gccagcctatggaatgaccc

SEQ ID NO: 92480 - DNA, 20 bp, Artificial Sequence
  chemically synthesized
atcttatcagagtgaaaccg

SEQ ID NO: 92481 - DNA, 20 bp, Artificial Sequence
  chemically synthesized
aatcttatcagagtgaaacc

SEQ ID NO: 92482 - DNA, 20 bp, Artificial Sequence
  chemically synthesized
gaatcttatcagagtgaaac

SEQ ID NO: 92483 - DNA, 20 bp, Artificial Sequence
  chemically synthesized
gaccccggtttcactctgat

SEQ ID NO: 92484 - DNA, 20 bp, Artificial Sequence
  chemically synthesized
aaagccatggaatcttatca

SEQ ID NO: 92485 - DNA, 20 bp, Artificial Sequence
  chemically synthesized
acaaagccatggaatcttat

SEQ ID NO: 92486 - DNA, 20 bp, Artificial Sequence
  chemically synthesized
ttcactctgataagattcca

SEQ ID NO: 92487 - DNA, 20 bp, Artificial Sequence
  chemically synthesized
attagcctcaaacaaagcca

SEQ ID NO: 92488 - DNA, 20 bp, Artificial Sequence
  chemically synthesized
aagattccatggctttgttt

SEQ ID NO: 92489 - DNA, 20 bp, Artificial Sequence
  chemically synthesized
agattccatggctttgtttg

SEQ ID NO: 92490 - DNA, 20 bp, Artificial Sequence
  chemically synthesized
gaagccattagcctcaaaca

SEQ ID NO: 92491 - DNA, 20 bp, Artificial Sequence
  chemically synthesized
atggctttgtttgaggctaa

SEQ ID NO: 92492 - DNA, 20 bp, Artificial Sequence
  chemically synthesized
attttttctaatgaagccat

SEQ ID NO: 92493 - DNA, 20 bp, Artificial Sequence
  chemically synthesized
tttgaggctaatggcttcat

SEQ ID NO: 92494 - DNA, 20 bp, Artificial Sequence
  chemically synthesized
tttatttattttttctaatg

SEQ ID NO: 92495 - DNA, 20 bp, Artificial Sequence
  chemically synthesized
tagaaaaaataaataaataa

SEQ ID NO: 92496 - DNA, 20 bp, Artificial Sequence
  chemically synthesized
aaaaaataaataaataaaag

SEQ ID NO: 92497 - DNA, 20 bp, Artificial Sequence
  chemically synthesized
taaataaaagaagataaaac

SEQ ID NO: 92498 - DNA, 20 bp, Artificial Sequence
  chemically synthesized
agataaaacaagctctttat

SEQ ID NO: 92499 - DNA, 20 bp, Artificial Sequence
  chemically synthesized
ataaaacaagctctttattg

SEQ ID NO: 92500 - DNA, 20 bp, Artificial Sequence
  chemically synthesized
ggacttatctctccaataaa

SEQ ID NO: 92501 - DNA, 20 bp, Artificial Sequence
  chemically synthesized
aaaacaagctctttattgga

SEQ ID NO: 92502 - DNA, 20 bp, Artificial Sequence
  chemically synthesized
atggacttatctctccaata

SEQ ID NO: 92503 - DNA, 20 bp, Artificial Sequence
  chemically synthesized
aagctctttattggagagat

SEQ ID NO: 92504 - DNA, 20 bp, Artificial Sequence
  chemically synthesized
agaagtctaacgcatgttca

SEQ ID NO: 92505 - DNA, 20 bp, Artificial Sequence
  chemically synthesized
ataagtccatgaacatgcgt

SEQ ID NO: 92506 - DNA, 20 bp, Artificial Sequence
  chemically synthesized
acgaagggagaagggtgcag

SEQ ID NO: 92507 - DNA, 20 bp, Artificial Sequence
  chemically synthesized
agaacgaagggagaagggtg

SEQ ID NO: 92508 - DNA, 20 bp, Artificial Sequence
  chemically synthesized
gagacagaacgaagggagaa

SEQ ID NO: 92509 - DNA, 20 bp, Artificial Sequence
  chemically synthesized
agagacagaacgaagggaga

SEQ ID NO: 92510 - DNA, 20 bp, Artificial Sequence
  chemically synthesized
aagagacagaacgaagggag

SEQ ID NO: 92511 - DNA, 20 bp, Artificial Sequence
  chemically synthesized
tctaagagacagaacgaagg

SEQ ID NO: 92512 - DNA, 20 bp, Artificial Sequence
  chemically synthesized
gttctaagagacagaacgaa

SEQ ID NO: 92513 - DNA, 20 bp, Artificial Sequence
  chemically synthesized
agttctaagagacagaacga

SEQ ID NO: 92514 - DNA, 20 bp, Artificial Sequence
  chemically synthesized
gagttctaagagacagaacg

SEQ ID NO: 92515 - DNA, 20 bp, Artificial Sequence
  chemically synthesized
tctcccttcgttctgtctct

SEQ ID NO: 92516 - DNA, 20 bp, Artificial Sequence
  chemically synthesized
tgcctctgagttctaagaga

SEQ ID NO: 92517 - DNA, 20 bp, Artificial Sequence
  chemically synthesized
ttgttgcctctgagttctaa

SEQ ID NO: 92518 - DNA, 20 bp, Artificial Sequence
  chemically synthesized
tcgttctgtctcttagaact

SEQ ID NO: 92519 - DNA, 20 bp, Artificial Sequence
  chemically synthesized
tcttgttgcctctgagttct

SEQ ID NO: 92520 - DNA, 20 bp, Artificial Sequence
  chemically synthesized
gttctgtctcttagaactca

SEQ ID NO: 92521 - DNA, 20 bp, Artificial Sequence
  chemically synthesized
ttctgtctcttagaactcag

SEQ ID NO: 92522 - DNA, 20 bp, Artificial Sequence
  chemically synthesized
aggagtttcttgttgcctct

SEQ ID NO: 92523 - DNA, 20 bp, Artificial Sequence
  chemically synthesized
tcttagaactcagaggcaac

SEQ ID NO: 92524 - DNA, 20 bp, Artificial Sequence
  chemically synthesized
gaggcaacaagaaactcctt

SEQ ID NO: 92525 - DNA, 20 bp, Artificial Sequence
  chemically synthesized
tgttcacttccgtgctcaag

SEQ ID NO: 92526 - DNA, 20 bp, Artificial Sequence
  chemically synthesized
aacaagaaactccttgagca

SEQ ID NO: 92527 - DNA, 20 bp, Artificial Sequence
  chemically synthesized
agtgttcacttccgtgctca

SEQ ID NO: 92528 - DNA, 20 bp, Artificial Sequence
  chemically synthesized
tagtgttcacttccgtgctc

SEQ ID NO: 92529 - DNA, 20 bp, Artificial Sequence
  chemically synthesized
aagaaactccttgagcacgg

SEQ ID NO: 92530 - DNA, 20 bp, Artificial Sequence
  chemically synthesized
cggaagtgaacactaacaaa

SEQ ID NO: 92531 - DNA, 20 bp, Artificial Sequence
  chemically synthesized
gctttcacctgtccgtttgt

SEQ ID NO: 92532 - DNA, 20 bp, Artificial Sequence
  chemically synthesized
agtgaacactaacaaacgga

SEQ ID NO: 92533 - DNA, 20 bp, Artificial Sequence
  chemically synthesized
gtgaacactaacaaacggac

SEQ ID NO: 92534 - DNA, 20 bp, Artificial Sequence
  chemically synthesized
actaacaaacggacaggtga

SEQ ID NO: 92535 - DNA, 20 bp, Artificial Sequence
  chemically synthesized
aacggacaggtgaaagctga

SEQ ID NO: 92536 - DNA, 20 bp, Artificial Sequence
  chemically synthesized
acggacaggtgaaagctgaa

SEQ ID NO: 92537 - DNA, 20 bp, Artificial Sequence
  chemically synthesized
tcagggcaagcacatccttt

SEQ ID NO: 92538 - DNA, 20 bp, Artificial Sequence
  chemically synthesized
tgaaaggatgtgcttgccct

SEQ ID NO: 92539 - DNA, 20 bp, Artificial Sequence
  chemically synthesized
ggagctcagcttctcagggc

SEQ ID NO: 92540 - DNA, 20 bp, Artificial Sequence
  chemically synthesized
aaggatgtgcttgccctgag

SEQ ID NO: 92541 - DNA, 20 bp, Artificial Sequence
  chemically synthesized
ataaggagctcagcttctca

SEQ ID NO: 92542 - DNA, 20 bp, Artificial Sequence
  chemically synthesized
cataaggagctcagcttctc

SEQ ID NO: 92543 - DNA, 20 bp, Artificial Sequence
  chemically synthesized
tgtgcttgccctgagaagct

SEQ ID NO: 92544 - DNA, 20 bp, Artificial Sequence
  chemically synthesized
acataaggagctcagcttct

SEQ ID NO: 92545 - DNA, 20 bp, Artificial Sequence
  chemically synthesized
gccataggacataaggagct

SEQ ID NO: 92546 - DNA, 20 bp, Artificial Sequence
  chemically synthesized
agtaggccataggacataag

SEQ ID NO: 92547 - DNA, 20 bp, Artificial Sequence
  chemically synthesized
agagtaggccataggacata

SEQ ID NO: 92548 - DNA, 20 bp, Artificial Sequence
  chemically synthesized
gagagtaggccataggacat

SEQ ID NO: 92549 - DNA, 20 bp, Artificial Sequence
  chemically synthesized
gctgagctccttatgtccta

SEQ ID NO: 92550 - DNA, 20 bp, Artificial Sequence
  chemically synthesized
aaaccatgagagtaggccat

SEQ ID NO: 92551 - DNA, 20 bp, Artificial Sequence
  chemically synthesized
aaaaccatgagagtaggcca

SEQ ID NO: 92552 - DNA, 20 bp, Artificial Sequence
  chemically synthesized
tgtcctatggcctactctca

SEQ ID NO: 92553 - DNA, 20 bp, Artificial Sequence
  chemically synthesized
acacttaaaaccatgagagt

SEQ ID NO: 92554 - DNA, 20 bp, Artificial Sequence
  chemically synthesized
cacacttaaaaccatgagag

SEQ ID NO: 92555 - DNA, 20 bp, Artificial Sequence
  chemically synthesized
aatcacacttaaaaccatga

SEQ ID NO: 92556 - DNA, 20 bp, Artificial Sequence
  chemically synthesized
gcaatcacacttaaaaccat

SEQ ID NO: 92557 - DNA, 20 bp, Artificial Sequence
  chemically synthesized
tggcctactctcatggtttt

SEQ ID NO: 92558 - DNA, 20 bp, Artificial Sequence
  chemically synthesized
atggttttaagtgtgattgc

SEQ ID NO: 92559 - DNA, 20 bp, Artificial Sequence
  chemically synthesized
tttaagtgtgattgctagaa

SEQ ID NO: 92560 - DNA, 20 bp, Artificial Sequence
  chemically synthesized
aagtgtgattgctagaaaag

SEQ ID NO: 92561 - DNA, 20 bp, Artificial Sequence
  chemically synthesized
acctgtagtttccacttttc

SEQ ID NO: 92562 - DNA, 20 bp, Artificial Sequence
  chemically synthesized
tgctagaaaagtggaaacta

SEQ ID NO: 92563 - DNA, 20 bp, Artificial Sequence
  chemically synthesized
gctagaaaagtggaaactac

SEQ ID NO: 92564 - DNA, 20 bp, Artificial Sequence
  chemically synthesized
attcagggaattgtaacctg

SEQ ID NO: 92565 - DNA, 20 bp, Artificial Sequence
  chemically synthesized
acaggttacaattccctgaa

SEQ ID NO: 92566 - DNA, 20 bp, Artificial Sequence
  chemically synthesized
agcaagcattcatccattca

SEQ ID NO: 92567 - DNA, 20 bp, Artificial Sequence
  chemically synthesized
gagcaagcattcatccattc

SEQ ID NO: 92568 - DNA, 20 bp, Artificial Sequence
  chemically synthesized
ggagcaagcattcatccatt

SEQ ID NO: 92569 - DNA, 20 bp, Artificial Sequence
  chemically synthesized
ccaggcagtttttcaggagc

SEQ ID NO: 92570 - DNA, 20 bp, Artificial Sequence
  chemically synthesized
ggcaccaggcagtttttcag

SEQ ID NO: 92571 - DNA, 20 bp, Artificial Sequence
  chemically synthesized
caggcaccaggcagtttttc

SEQ ID NO: 92572 - DNA, 20 bp, Artificial Sequence
  chemically synthesized
tcaggcaccaggcagttttt

SEQ ID NO: 92573 - DNA, 20 bp, Artificial Sequence
  chemically synthesized
cttgctcctgaaaaactgcc

SEQ ID NO: 92574 - DNA, 20 bp, Artificial Sequence
  chemically synthesized
ttgctttctcaggcaccagg

SEQ ID NO: 92575 - DNA, 20 bp, Artificial Sequence
  chemically synthesized
tgaaaaactgcctggtgcct

SEQ ID NO: 92576 - DNA, 20 bp, Artificial Sequence
  chemically synthesized
tccttgctttctcaggcacc

SEQ ID NO: 92577 - DNA, 20 bp, Artificial Sequence
  chemically synthesized
ttccttgctttctcaggcac

SEQ ID NO: 92578 - DNA, 20 bp, Artificial Sequence
  chemically synthesized
aaactgcctggtgcctgaga

SEQ ID NO: 92579 - DNA, 20 bp, Artificial Sequence
  chemically synthesized
gagtatttccttgctttctc

SEQ ID NO: 92580 - DNA, 20 bp, Artificial Sequence
  chemically synthesized
tgcctggtgcctgagaaagc

SEQ ID NO: 92581 - DNA, 20 bp, Artificial Sequence
  chemically synthesized
ggagtatttccttgctttct

SEQ ID NO: 92582 - DNA, 20 bp, Artificial Sequence
  chemically synthesized
gcctggtgcctgagaaagca

SEQ ID NO: 92583 - DNA, 20 bp, Artificial Sequence
  chemically synthesized
aaagcaaggaaatactcctt

SEQ ID NO: 92584 - DNA, 20 bp, Artificial Sequence
  chemically synthesized
gcaaggaaatactccttgag

SEQ ID NO: 92585 - DNA, 20 bp, Artificial Sequence
  chemically synthesized
tcaaacattgactactcaag

SEQ ID NO: 92586 - DNA, 20 bp, Artificial Sequence
  chemically synthesized
tttcaaacattgactactca

SEQ ID NO: 92587 - DNA, 20 bp, Artificial Sequence
  chemically synthesized
gtttcaaacattgactactc

SEQ ID NO: 92588 - DNA, 20 bp, Artificial Sequence
  chemically synthesized
gtcaatgtttgaaacctcca

SEQ ID NO: 92589 - DNA, 20 bp, Artificial Sequence
  chemically synthesized
aatgtttgaaacctccaaag

SEQ ID NO: 92590 - DNA, 20 bp, Artificial Sequence
  chemically synthesized
aatagtcttagctactttgg

SEQ ID NO: 92591 - DNA, 20 bp, Artificial Sequence
  chemically synthesized
aaatagtcttagctactttg

SEQ ID NO: 92592 - DNA, 20 bp, Artificial Sequence
  chemically synthesized
agaaatagtcttagctactt

SEQ ID NO: 92593 - DNA, 20 bp, Artificial Sequence
  chemically synthesized
ttgaaacctccaaagtagct

SEQ ID NO: 92594 - DNA, 20 bp, Artificial Sequence
  chemically synthesized
cagtgaagaagaaatagtct

SEQ ID NO: 92595 - DNA, 20 bp, Artificial Sequence
  chemically synthesized
attttacagtgaagaagaaa

SEQ ID NO: 92596 - DNA, 20 bp, Artificial Sequence
  chemically synthesized
atattgattttacagtgaag

SEQ ID NO: 92597 - DNA, 20 bp, Artificial Sequence
  chemically synthesized
cttatattgattttacagtg

SEQ ID NO: 92598 - DNA, 20 bp, Artificial Sequence
  chemically synthesized
aaaatcttatattgatttta

SEQ ID NO: 92599 - DNA, 20 bp, Artificial Sequence
  chemically synthesized
cttcactgtaaaatcaatat

SEQ ID NO: 92600 - DNA, 20 bp, Artificial Sequence
  chemically synthesized
aaaatcaatataagattttt

SEQ ID NO: 92601 - DNA, 20 bp, Artificial Sequence
  chemically synthesized
aatataagatttttaagctt

SEQ ID NO: 92602 - DNA, 20 bp, Artificial Sequence
  chemically synthesized
ttcgggtttgagtagttcca

SEQ ID NO: 92603 - DNA, 20 bp, Artificial Sequence
  chemically synthesized
aagctattttcgggtttgag

SEQ ID NO: 92604 - DNA, 20 bp, Artificial Sequence
  chemically synthesized
ggcaagctattttcgggttt

SEQ ID NO: 92605 - DNA, 20 bp, Artificial Sequence
  chemically synthesized
gaactactcaaacccgaaaa

SEQ ID NO: 92606 - DNA, 20 bp, Artificial Sequence
  chemically synthesized
tgggtaggcaagctattttc

SEQ ID NO: 92607 - DNA, 20 bp, Artificial Sequence
  chemically synthesized
ctgggtaggcaagctatttt

SEQ ID NO: 92608 - DNA, 20 bp, Artificial Sequence
  chemically synthesized
ccgaaaatagcttgcctacc

SEQ ID NO: 92609 - DNA, 20 bp, Artificial Sequence
  chemically synthesized
gagtcaggatctgggtaggc

SEQ ID NO: 92610 - DNA, 20 bp, Artificial Sequence
  chemically synthesized
ctatgagtcaggatctgggt

SEQ ID NO: 92611 - DNA, 20 bp, Artificial Sequence
  chemically synthesized
actatgagtcaggatctggg

SEQ ID NO: 92612 - DNA, 20 bp, Artificial Sequence
  chemically synthesized
aatactatgagtcaggatct

SEQ ID NO: 92613 - DNA, 20 bp, Artificial Sequence
  chemically synthesized
gaatactatgagtcaggatc

SEQ ID NO: 92614 - DNA, 20 bp, Artificial Sequence
  chemically synthesized
cctacccagatcctgactca

SEQ ID NO: 92615 - DNA, 20 bp, Artificial Sequence
  chemically synthesized
tttaatgaatactatgagtc

SEQ ID NO: 92616 - DNA, 20 bp, Artificial Sequence
  chemically synthesized
atttaatgaatactatgagt

SEQ ID NO: 92617 - DNA, 20 bp, Artificial Sequence
  chemically synthesized
tatcatttaatgaatactat

SEQ ID NO: 92618 - DNA, 20 bp, Artificial Sequence
  chemically synthesized
ccagcagccaagtaaaaaat

SEQ ID NO: 92619 - DNA, 20 bp, Artificial Sequence
  chemically synthesized
atatgaactgattttttact

SEQ ID NO: 92620 - DNA, 20 bp, Artificial Sequence
  chemically synthesized
ctgattttttacttggctgc

SEQ ID NO: 92621 - DNA, 20 bp, Artificial Sequence
  chemically synthesized
aatacttaaaaccagcagcc

SEQ ID NO: 92622 - DNA, 20 bp, Artificial Sequence
  chemically synthesized
ctatcaatacttaaaaccag

SEQ ID NO: 92623 - DNA, 20 bp, Artificial Sequence
  chemically synthesized
tttacttggctgctggtttt

SEQ ID NO: 92624 - DNA, 20 bp, Artificial Sequence
  chemically synthesized
tatctatcaatacttaaaac

SEQ ID NO: 92625 - DNA, 20 bp, Artificial Sequence
  chemically synthesized
ctgctggttttaagtattga

SEQ ID NO: 92626 - DNA, 20 bp, Artificial Sequence
  chemically synthesized
tagataatcatatcatatga

SEQ ID NO: 92627 - DNA, 20 bp, Artificial Sequence
  chemically synthesized
agataatcatatcatatgac

SEQ ID NO: 92628 - DNA, 20 bp, Artificial Sequence
  chemically synthesized
gataatcatatcatatgaca

SEQ ID NO: 92629 - DNA, 20 bp, Artificial Sequence
  chemically synthesized
agggaaatcatattaacaca

SEQ ID NO: 92630 - DNA, 20 bp, Artificial Sequence
  chemically synthesized
gggaaatcatattaacacat

SEQ ID NO: 92631 - DNA, 20 bp, Artificial Sequence
  chemically synthesized
ggaaatcatattaacacatg

SEQ ID NO: 92632 - DNA, 20 bp, Artificial Sequence
  chemically synthesized
gggcgaataaaatctttcaa

SEQ ID NO: 92633 - DNA, 20 bp, Artificial Sequence
  chemically synthesized
tctcaaaactgatcttttga

SEQ ID NO: 92634 - DNA, 20 bp, Artificial Sequence
  chemically synthesized
aataaaatctttcaaaagat

SEQ ID NO: 92635 - DNA, 20 bp, Artificial Sequence
  chemically synthesized
tctttcaaaagatcagtttt

SEQ ID NO: 92636 - DNA, 20 bp, Artificial Sequence
  chemically synthesized
aaagatcagttttgagatcc

SEQ ID NO: 92637 - DNA, 20 bp, Artificial Sequence
  chemically synthesized
ctattatttaatgatcatct

SEQ ID NO: 92638 - DNA, 20 bp, Artificial Sequence
  chemically synthesized
ccaagatgatcattaaataa

SEQ ID NO: 92639 - DNA, 20 bp, Artificial Sequence
  chemically synthesized
tcattaaataatagattctg

SEQ ID NO: 92640 - DNA, 20 bp, Artificial Sequence
  chemically synthesized
aagtcctcttttaaatgctt

SEQ ID NO: 92641 - DNA, 20 bp, Artificial Sequence
  chemically synthesized
atagattctgaagcatttaa

SEQ ID NO: 92642 - DNA, 20 bp, Artificial Sequence
  chemically synthesized
agattctgaagcatttaaaa

SEQ ID NO: 92643 - DNA, 20 bp, Artificial Sequence
  chemically synthesized
gattctgaagcatttaaaag

SEQ ID NO: 92644 - DNA, 20 bp, Artificial Sequence
  chemically synthesized
gaagcatttaaaagaggact

SEQ ID NO: 92645 - DNA, 20 bp, Artificial Sequence
  chemically synthesized
atatggcatttaaaagttcc

SEQ ID NO: 92646 - DNA, 20 bp, Artificial Sequence
  chemically synthesized
atcgaacatatggcatttaa

SEQ ID NO: 92647 - DNA, 20 bp, Artificial Sequence
  chemically synthesized
taaaaaggtgatcgaacata

SEQ ID NO: 92648 - DNA, 20 bp, Artificial Sequence
  chemically synthesized
tgtcatgttatgttttaaaa

SEQ ID NO: 92649 - DNA, 20 bp, Artificial Sequence
  chemically synthesized
ttgtcatgttatgttttaaa

SEQ ID NO: 92650 - DNA, 20 bp, Artificial Sequence
  chemically synthesized
acataacatgacaatattca

SEQ ID NO: 92651 - DNA, 20 bp, Artificial Sequence
  chemically synthesized
ataacatgacaatattcatg

SEQ ID NO: 92652 - DNA, 20 bp, Artificial Sequence
  chemically synthesized
tagacattacatggcatatt

SEQ ID NO: 92653 - DNA, 20 bp, Artificial Sequence
  chemically synthesized
taagtaacgtagacattaca

SEQ ID NO: 92654 - DNA, 20 bp, Artificial Sequence
  chemically synthesized
actctctgctgtaagtaacg

SEQ ID NO: 92655 - DNA, 20 bp, Artificial Sequence
  chemically synthesized
tgtaatgtctacgttactta

SEQ ID NO: 92656 - DNA, 20 bp, Artificial Sequence
  chemically synthesized
aatgtctacgttacttacag

SEQ ID NO: 92657 - DNA, 20 bp, Artificial Sequence
  chemically synthesized
tgtctacgttacttacagca

SEQ ID NO: 92658 - DNA, 20 bp, Artificial Sequence
  chemically synthesized
ttagtggaactctctgctgt

SEQ ID NO: 92659 - DNA, 20 bp, Artificial Sequence
  chemically synthesized
tctacgttacttacagcaga

SEQ ID NO: 92660 - DNA, 20 bp, Artificial Sequence
  chemically synthesized
aaaggagcacagaaaattag

SEQ ID NO: 92661 - DNA, 20 bp, Artificial Sequence
  chemically synthesized
aagaaaggagcacagaaaat

SEQ ID NO: 92662 - DNA, 20 bp, Artificial Sequence
  chemically synthesized
tttaggcaaagaaaggagca

SEQ ID NO: 92663 - DNA, 20 bp, Artificial Sequence
  chemically synthesized
gttcatttaggcaaagaaag

SEQ ID NO: 92664 - DNA, 20 bp, Artificial Sequence
  chemically synthesized
tagttcatttaggcaaagaa

SEQ ID NO: 92665 - DNA, 20 bp, Artificial Sequence
  chemically synthesized
atagttcatttaggcaaaga

SEQ ID NO: 92666 - DNA, 20 bp, Artificial Sequence
  chemically synthesized
tgaaatagttcatttaggca

SEQ ID NO: 92667 - DNA, 20 bp, Artificial Sequence
  chemically synthesized
ctaaatgaaatagttcattt

SEQ ID NO: 92668 - DNA, 20 bp, Artificial Sequence
  chemically synthesized
gctaaatgaaatagttcatt

SEQ ID NO: 92669 - DNA, 20 bp, Artificial Sequence
  chemically synthesized
cctaaatgaactatttcatt

SEQ ID NO: 92670 - DNA, 20 bp, Artificial Sequence
  chemically synthesized
aaatattgtgctaaatgaaa

SEQ ID NO: 92671 - DNA, 20 bp, Artificial Sequence
  chemically synthesized
ttagcacaatattttgtttg

SEQ ID NO: 92672 - DNA, 20 bp, Artificial Sequence
  chemically synthesized
tcataactcccaacatcaca

SEQ ID NO: 92673 - DNA, 20 bp, Artificial Sequence
  chemically synthesized
aaaatttatccttgtgatgt

SEQ ID NO: 92674 - DNA, 20 bp, Artificial Sequence
  chemically synthesized
ttcataactcccaacatcac

SEQ ID NO: 92675 - DNA, 20 bp, Artificial Sequence
  chemically synthesized
aaatttatccttgtgatgtt

SEQ ID NO: 92676 - DNA, 20 bp, Artificial Sequence
  chemically synthesized
atttatccttgtgatgttgg

SEQ ID NO: 92677 - DNA, 20 bp, Artificial Sequence
  chemically synthesized
aatgatattttaaaacacat

SEQ ID NO: 92678 - DNA, 20 bp, Artificial Sequence
  chemically synthesized
ttaaaatatcattaaatgta

SEQ ID NO: 92679 - DNA, 20 bp, Artificial Sequence
  chemically synthesized
gtacggaattaaactataat

SEQ ID NO: 92680 - DNA, 20 bp, Artificial Sequence
  chemically synthesized
cggaattaaactataattag

SEQ ID NO: 92681 - DNA, 20 bp, Artificial Sequence
  chemically synthesized
caaatgatttctactaatta

SEQ ID NO: 92682 - DNA, 20 bp, Artificial Sequence
  chemically synthesized
ataattagtagaaatcattt

SEQ ID NO: 92683 - DNA, 20 bp, Artificial Sequence
  chemically synthesized
taattagtagaaatcatttg

SEQ ID NO: 92684 - DNA, 20 bp, Artificial Sequence
  chemically synthesized
aattagtagaaatcatttga

SEQ ID NO: 92685 - DNA, 20 bp, Artificial Sequence
  chemically synthesized
ttgtcagcatcagtaaatta

SEQ ID NO: 92686 - DNA, 20 bp, Artificial Sequence
  chemically synthesized
tgatgagaatttgtcagcat

SEQ ID NO: 92687 - DNA, 20 bp, Artificial Sequence
  chemically synthesized
actatttgatgagaatttgt

SEQ ID NO: 92688 - DNA, 20 bp, Artificial Sequence
  chemically synthesized
gctgacaaattctcatcaaa

SEQ ID NO: 92689 - DNA, 20 bp, Artificial Sequence
  chemically synthesized
aagcacagtaactatttgat

SEQ ID NO: 92690 - DNA, 20 bp, Artificial Sequence
  chemically synthesized
caaatagttactgtgctttc

SEQ ID NO: 92691 - DNA, 20 bp, Artificial Sequence
  chemically synthesized
tgttattttacttgaaagca

SEQ ID NO: 92692 - DNA, 20 bp, Artificial Sequence
  chemically synthesized
aaagatgttattttacttga

SEQ ID NO: 92693 - DNA, 20 bp, Artificial Sequence
  chemically synthesized
caagtaaaataacatctttg

SEQ ID NO: 92694 - DNA, 20 bp, Artificial Sequence
  chemically synthesized
aagtaaaataacatctttgt

SEQ ID NO: 92695 - DNA, 20 bp, Artificial Sequence
  chemically synthesized
taaaataacatctttgtagg

SEQ ID NO: 92696 - DNA, 20 bp, Artificial Sequence
  chemically synthesized
gtgtcttacatctgcctaca

SEQ ID NO: 92697 - DNA, 20 bp, Artificial Sequence
  chemically synthesized
acatctttgtaggcagatgt

SEQ ID NO: 92698 - DNA, 20 bp, Artificial Sequence
  chemically synthesized
tgtaggcagatgtaagacac

SEQ ID NO: 92699 - DNA, 20 bp, Artificial Sequence
  chemically synthesized
gaaagtgtacattatttttc

SEQ ID NO: 92700 - DNA, 20 bp, Artificial Sequence
  chemically synthesized
aaaaataatgtacactttca

SEQ ID NO: 92701 - DNA, 20 bp, Artificial Sequence
  chemically synthesized
aaataatgtacactttcaaa

SEQ ID NO: 92702 - DNA, 20 bp, Artificial Sequence
  chemically synthesized
gaggttcactttctctttga

SEQ ID NO: 92703 - DNA, 20 bp, Artificial Sequence
  chemically synthesized
aatgtacactttcaaagaga

SEQ ID NO: 92704 - DNA, 20 bp, Artificial Sequence
  chemically synthesized
ttttatttcagaggtatggg

SEQ ID NO: 92705 - DNA, 20 bp, Artificial Sequence
  chemically synthesized
cttttatttcagaggtatgg

SEQ ID NO: 92706 - DNA, 20 bp, Artificial Sequence
  chemically synthesized
tgcttttatttcagaggtat

SEQ ID NO: 92707 - DNA, 20 bp, Artificial Sequence
  chemically synthesized
ttgcttttatttcagaggta

SEQ ID NO: 92708 - DNA, 20 bp, Artificial Sequence
  chemically synthesized
ctaaattgcttttatttcag

SEQ ID NO: 92709 - DNA, 20 bp, Artificial Sequence
  chemically synthesized
tctaaattgcttttatttca

SEQ ID NO: 92710 - DNA, 20 bp, Artificial Sequence
  chemically synthesized
ctcccatacctctgaaataa

SEQ ID NO: 92711 - DNA, 20 bp, Artificial Sequence
  chemically synthesized
tttctaaattgcttttattt

SEQ ID NO: 92712 - DNA, 20 bp, Artificial Sequence
  chemically synthesized
cctctgaaataaaagcaatt

SEQ ID NO: 92713 - DNA, 20 bp, Artificial Sequence
  chemically synthesized
gtgcctcttttaaaatatat

SEQ ID NO: 92714 - DNA, 20 bp, Artificial Sequence
  chemically synthesized
agaaatctgatatattttaa

SEQ ID NO: 92715 - DNA, 20 bp, Artificial Sequence
  chemically synthesized
aaatctgatatattttaaaa

SEQ ID NO: 92716 - DNA, 20 bp, Artificial Sequence
  chemically synthesized
aatctgatatattttaaaag

SEQ ID NO: 92717 - DNA, 20 bp, Artificial Sequence
  chemically synthesized
atattttaaaagaggcacat

SEQ ID NO: 92718 - DNA, 20 bp, Artificial Sequence
  chemically synthesized
aacgagtaaagtgaaattta

SEQ ID NO: 92719 - DNA, 20 bp, Artificial Sequence
  chemically synthesized
catttcaccgtcaacgagta

SEQ ID NO: 92720 - DNA, 20 bp, Artificial Sequence
  chemically synthesized
aatttcactttactcgttga

SEQ ID NO: 92721 - DNA, 20 bp, Artificial Sequence
  chemically synthesized
cgtagcatttcaccgtcaac

SEQ ID NO: 92722 - DNA, 20 bp, Artificial Sequence
  chemically synthesized
ctgtaacaacagattgaacg

SEQ ID NO: 92723 - DNA, 20 bp, Artificial Sequence
  chemically synthesized
ctacgttcaatctgttgtta

SEQ ID NO: 92724 - DNA, 20 bp, Artificial Sequence
  chemically synthesized
ttaactttttgctgtaacaa

SEQ ID NO: 92725 - DNA, 20 bp, Artificial Sequence
  chemically synthesized
caatctgttgttacagcaaa

SEQ ID NO: 92726 - DNA, 20 bp, Artificial Sequence
  chemically synthesized
ttgttacagcaaaaagttaa

SEQ ID NO: 92727 - DNA, 20 bp, Artificial Sequence
  chemically synthesized
tacagcaaaaagttaatgga

SEQ ID NO: 92728 - DNA, 20 bp, Artificial Sequence
  chemically synthesized
aagaggatattgttacagtg

SEQ ID NO: 92729 - DNA, 20 bp, Artificial Sequence
  chemically synthesized
gttaaaagaggatattgtta

SEQ ID NO: 92730 - DNA, 20 bp, Artificial Sequence
  chemically synthesized
gaaggttatttggttaaaag

SEQ ID NO: 92731 - DNA, 20 bp, Artificial Sequence
  chemically synthesized
ggaaggttatttggttaaaa

SEQ ID NO: 92732 - DNA, 20 bp, Artificial Sequence
  chemically synthesized
aaggaaggttatttggttaa

SEQ ID NO: 92733 - DNA, 20 bp, Artificial Sequence
  chemically synthesized
aaggtttaaggaaggttatt

SEQ ID NO: 92734 - DNA, 20 bp, Artificial Sequence
  chemically synthesized
ttttatccaaggtttaagga

SEQ ID NO: 92735 - DNA, 20 bp, Artificial Sequence
  chemically synthesized
attttatccaaggtttaagg

SEQ ID NO: 92736 - DNA, 20 bp, Artificial Sequence
  chemically synthesized
aaataaccttccttaaacct

SEQ ID NO: 92737 - DNA, 20 bp, Artificial Sequence
  chemically synthesized
ggaattttatccaaggttta

SEQ ID NO: 92738 - DNA, 20 bp, Artificial Sequence
  chemically synthesized
gggaattttatccaaggttt

SEQ ID NO: 92739 - DNA, 20 bp, Artificial Sequence
  chemically synthesized
aaacaggggaattttatcca

SEQ ID NO: 92740 - DNA, 20 bp, Artificial Sequence
  chemically synthesized
gaaacaggggaattttatcc

SEQ ID NO: 92741 - DNA, 20 bp, Artificial Sequence
  chemically synthesized
atggtgatagtgtgaaacag

SEQ ID NO: 92742 - DNA, 20 bp, Artificial Sequence
  chemically synthesized
gatggtgatagtgtgaaaca

SEQ ID NO: 92743 - DNA, 20 bp, Artificial Sequence
  chemically synthesized
tgatggtgatagtgtgaaac

SEQ ID NO: 92744 - DNA, 20 bp, Artificial Sequence
  chemically synthesized
gtgatggtgatagtgtgaaa

SEQ ID NO: 92745 - DNA, 20 bp, Artificial Sequence
  chemically synthesized
ccgtttatctgtgatggtga

SEQ ID NO: 92746 - DNA, 20 bp, Artificial Sequence
  chemically synthesized
gtttcacactatcaccatca

SEQ ID NO: 92747 - DNA, 20 bp, Artificial Sequence
  chemically synthesized
ttcaatccgtttatctgtga

SEQ ID NO: 92748 - DNA, 20 bp, Artificial Sequence
  chemically synthesized
ctatcaccatcacagataaa

SEQ ID NO: 92749 - DNA, 20 bp, Artificial Sequence
  chemically synthesized
tcacagataaacggattgaa

SEQ ID NO: 92750 - DNA, 20 bp, Artificial Sequence
  chemically synthesized
tgaaaagacaacaccattct

SEQ ID NO: 92751 - DNA, 20 bp, Artificial Sequence
  chemically synthesized
aaagacaacaccattctcag

SEQ ID NO: 92752 - DNA, 20 bp, Artificial Sequence
  chemically synthesized
gcaaacagttctactgagaa

SEQ ID NO: 92753 - DNA, 20 bp, Artificial Sequence
  chemically synthesized
tgtaagcaaacagttctact

SEQ ID NO: 92754 - DNA, 20 bp, Artificial Sequence
  chemically synthesized
gctaactgagtgtaagcaaa

SEQ ID NO: 92755 - DNA, 20 bp, Artificial Sequence
  chemically synthesized
tagaactgtttgcttacact

SEQ ID NO: 92756 - DNA, 20 bp, Artificial Sequence
  chemically synthesized
aagcttggctaactgagtgt

SEQ ID NO: 92757 - DNA, 20 bp, Artificial Sequence
  chemically synthesized
actgtttgcttacactcagt

SEQ ID NO: 92758 - DNA, 20 bp, Artificial Sequence
  chemically synthesized
tagtagaagcttggctaact

SEQ ID NO: 92759 - DNA, 20 bp, Artificial Sequence
  chemically synthesized
ttgcttacactcagttagcc

SEQ ID NO: 92760 - DNA, 20 bp, Artificial Sequence
  chemically synthesized
gaaatcaggtagtagaagct

SEQ ID NO: 92761 - DNA, 20 bp, Artificial Sequence
  chemically synthesized
gcaatgaaatcaggtagtag

SEQ ID NO: 92762 - DNA, 20 bp, Artificial Sequence
  chemically synthesized
atggcaatgaaatcaggtag

SEQ ID NO: 92763 - DNA, 20 bp, Artificial Sequence
  chemically synthesized
tccatggcaatgaaatcagg

SEQ ID NO: 92764 - DNA, 20 bp, Artificial Sequence
  chemically synthesized
ttttccatggcaatgaaatc

SEQ ID NO: 92765 - DNA, 20 bp, Artificial Sequence
  chemically synthesized
attttccatggcaatgaaat

SEQ ID NO: 92766 - DNA, 20 bp, Artificial Sequence
  chemically synthesized
actacctgatttcattgcca

SEQ ID NO: 92767 - DNA, 20 bp, Artificial Sequence
  chemically synthesized
ttatcctggaggattttcca

SEQ ID NO: 92768 - DNA, 20 bp, Artificial Sequence
  chemically synthesized
cattgccatggaaaatcctc

SEQ ID NO: 92769 - DNA, 20 bp, Artificial Sequence
  chemically synthesized
attgccatggaaaatcctcc

SEQ ID NO: 92770 - DNA, 20 bp, Artificial Sequence
  chemically synthesized
tgctacccaagttatcctgg

SEQ ID NO: 92771 - DNA, 20 bp, Artificial Sequence
  chemically synthesized
ctgctacccaagttatcctg

SEQ ID NO: 92772 - DNA, 20 bp, Artificial Sequence
  chemically synthesized
agctgctacccaagttatcc

SEQ ID NO: 92773 - DNA, 20 bp, Artificial Sequence
  chemically synthesized
gaaaatcctccaggataact

SEQ ID NO: 92774 - DNA, 20 bp, Artificial Sequence
  chemically synthesized
aaaatcctccaggataactt

SEQ ID NO: 92775 - DNA, 20 bp, Artificial Sequence
  chemically synthesized
atcctccaggataacttggg

SEQ ID NO: 92776 - DNA, 20 bp, Artificial Sequence
  chemically synthesized
ctccaggataacttgggtag

SEQ ID NO: 92777 - DNA, 20 bp, Artificial Sequence
  chemically synthesized
aatagaggtagctgctaccc

SEQ ID NO: 92778 - DNA, 20 bp, Artificial Sequence
  chemically synthesized
gttgggagaagtaatagagg

SEQ ID NO: 92779 - DNA, 20 bp, Artificial Sequence
  chemically synthesized
gatgttgggagaagtaatag

SEQ ID NO: 92780 - DNA, 20 bp, Artificial Sequence
  chemically synthesized
ggatgttgggagaagtaata

SEQ ID NO: 92781 - DNA, 20 bp, Artificial Sequence
  chemically synthesized
tgggatgttgggagaagtaa

SEQ ID NO: 92782 - DNA, 20 bp, Artificial Sequence
  chemically synthesized
aagcagtgggatgttgggag

SEQ ID NO: 92783 - DNA, 20 bp, Artificial Sequence
  chemically synthesized
tggaagcagtgggatgttgg

SEQ ID NO: 92784 - DNA, 20 bp, Artificial Sequence
  chemically synthesized
actggaagcagtgggatgtt

SEQ ID NO: 92785 - DNA, 20 bp, Artificial Sequence
  chemically synthesized
aactggaagcagtgggatgt

SEQ ID NO: 92786 - DNA, 20 bp, Artificial Sequence
  chemically synthesized
cagtagcaactggaagcagt

SEQ ID NO: 92787 - DNA, 20 bp, Artificial Sequence
  chemically synthesized
tcccaacatcccactgcttc

SEQ ID NO: 92788 - DNA, 20 bp, Artificial Sequence
  chemically synthesized
acagtagcaactggaagcag

SEQ ID NO: 92789 - DNA, 20 bp, Artificial Sequence
  chemically synthesized
caaacagtagcaactggaag

SEQ ID NO: 92790 - DNA, 20 bp, Artificial Sequence
  chemically synthesized
cagcaaacagtagcaactgg

SEQ ID NO: 92791 - DNA, 20 bp, Artificial Sequence
  chemically synthesized
taacagcaaacagtagcaac

SEQ ID NO: 92792 - DNA, 20 bp, Artificial Sequence
  chemically synthesized
ctgattgtaacagcaaacag

SEQ ID NO: 92793 - DNA, 20 bp, Artificial Sequence
  chemically synthesized
ccactgattgtaacagcaaa

SEQ ID NO: 92794 - DNA, 20 bp, Artificial Sequence
  chemically synthesized
ctactgtttgctgttacaat

SEQ ID NO: 92795 - DNA, 20 bp, Artificial Sequence
  chemically synthesized
taggctaccactgattgtaa

SEQ ID NO: 92796 - DNA, 20 bp, Artificial Sequence
  chemically synthesized
ctgtttgctgttacaatcag

SEQ ID NO: 92797 - DNA, 20 bp, Artificial Sequence
  chemically synthesized
tttgctgttacaatcagtgg

SEQ ID NO: 92798 - DNA, 20 bp, Artificial Sequence
  chemically synthesized
tgttacaatcagtggtagcc

SEQ ID NO: 92799 - DNA, 20 bp, Artificial Sequence
  chemically synthesized
cttgggtggttcaagtttct

SEQ ID NO: 92800 - DNA, 20 bp, Artificial Sequence
  chemically synthesized
acttgggtggttcaagtttc

SEQ ID NO: 92801 - DNA, 20 bp, Artificial Sequence
  chemically synthesized
ttaaaacacttgggtggttc

SEQ ID NO: 92802 - DNA, 20 bp, Artificial Sequence
  chemically synthesized
cctagaaacttgaaccaccc

SEQ ID NO: 92803 - DNA, 20 bp, Artificial Sequence
  chemically synthesized
ccgcatttaaaacacttggg

SEQ ID NO: 92804 - DNA, 20 bp, Artificial Sequence
  chemically synthesized
cttccgcatttaaaacactt

SEQ ID NO: 92805 - DNA, 20 bp, Artificial Sequence
  chemically synthesized
tcttccgcatttaaaacact

SEQ ID NO: 92806 - DNA, 20 bp, Artificial Sequence
  chemically synthesized
ccacccaagtgttttaaatg

SEQ ID NO: 92807 - DNA, 20 bp, Artificial Sequence
  chemically synthesized
cccaagtgttttaaatgcgg

SEQ ID NO: 92808 - DNA, 20 bp, Artificial Sequence
  chemically synthesized
caagtgttttaaatgcggaa

SEQ ID NO: 92809 - DNA, 20 bp, Artificial Sequence
  chemically synthesized
aaatgcggaagagaaaatct

SEQ ID NO: 92810 - DNA, 20 bp, Artificial Sequence
  chemically synthesized
aatgcggaagagaaaatctg

SEQ ID NO: 92811 - DNA, 20 bp, Artificial Sequence
  chemically synthesized
atgcggaagagaaaatctga

SEQ ID NO: 92812 - DNA, 20 bp, Artificial Sequence
  chemically synthesized
tttccttcccaattttccct

SEQ ID NO: 92813 - DNA, 20 bp, Artificial Sequence
  chemically synthesized
gagaaaatctgagggaaaat

SEQ ID NO: 92814 - DNA, 20 bp, Artificial Sequence
  chemically synthesized
agaaaatctgagggaaaatt

SEQ ID NO: 92815 - DNA, 20 bp, Artificial Sequence
  chemically synthesized
aaatctgagggaaaattggg

SEQ ID NO: 92816 - DNA, 20 bp, Artificial Sequence
  chemically synthesized
aatctgagggaaaattggga

SEQ ID NO: 92817 - DNA, 20 bp, Artificial Sequence
  chemically synthesized
agggaaaattgggaaggaaa

SEQ ID NO: 92818 - DNA, 20 bp, Artificial Sequence
  chemically synthesized
aatgccgctcttcggaaaca

SEQ ID NO: 92819 - DNA, 20 bp, Artificial Sequence
  chemically synthesized
aaagtgtttccatgtttccg

SEQ ID NO: 92820 - DNA, 20 bp, Artificial Sequence
  chemically synthesized
agtgtttccatgtttccgaa

SEQ ID NO: 92821 - DNA, 20 bp, Artificial Sequence
  chemically synthesized
gtttccatgtttccgaagag

SEQ ID NO: 92822 - DNA, 20 bp, Artificial Sequence
  chemically synthesized
acaagcacaatgccgctctt

SEQ ID NO: 92823 - DNA, 20 bp, Artificial Sequence
  chemically synthesized
ctgatgaaaaacagtcatac

SEQ ID NO: 92824 - DNA, 20 bp, Artificial Sequence
  chemically synthesized
aagtcaaagctgatgaaaaa

SEQ ID NO: 92825 - DNA, 20 bp, Artificial Sequence
  chemically synthesized
cttgtatgactgtttttcat

SEQ ID NO: 92826 - DNA, 20 bp, Artificial Sequence
  chemically synthesized
actgcctctccaaaaagtca

SEQ ID NO: 92827 - DNA, 20 bp, Artificial Sequence
  chemically synthesized
tttcatcagctttgactttt

SEQ ID NO: 92828 - DNA, 20 bp, Artificial Sequence
  chemically synthesized
tcatcagctttgactttttg

SEQ ID NO: 92829 - DNA, 20 bp, Artificial Sequence
  chemically synthesized
atcagctttgactttttgga

SEQ ID NO: 92830 - DNA, 20 bp, Artificial Sequence
  chemically synthesized
tcagctttgactttttggag

SEQ ID NO: 92831 - DNA, 20 bp, Artificial Sequence
  chemically synthesized
agtaaaactgcctctccaaa

SEQ ID NO: 92832 - DNA, 20 bp, Artificial Sequence
  chemically synthesized
gctttgactttttggagagg

SEQ ID NO: 92833 - DNA, 20 bp, Artificial Sequence
  chemically synthesized
agaggcagttttacttttca

SEQ ID NO: 92834 - DNA, 20 bp, Artificial Sequence
  chemically synthesized
aatattagactagctatgaa

SEQ ID NO: 92835 - DNA, 20 bp, Artificial Sequence
  chemically synthesized
gcagttttacttttcatagc

SEQ ID NO: 92836 - DNA, 20 bp, Artificial Sequence
  chemically synthesized
agtgagaagaaatattagac

SEQ ID NO: 92837 - DNA, 20 bp, Artificial Sequence
  chemically synthesized
tatttagtgagaagaaatat

SEQ ID NO: 92838 - DNA, 20 bp, Artificial Sequence
  chemically synthesized
ttaattcactatttagtgag

SEQ ID NO: 92839 - DNA, 20 bp, Artificial Sequence
  chemically synthesized
taatatttcttctcactaaa

SEQ ID NO: 92840 - DNA, 20 bp, Artificial Sequence
  chemically synthesized
gtgttaattcactatttagt

SEQ ID NO: 92841 - DNA, 20 bp, Artificial Sequence
  chemically synthesized
cactgtgttaattcactatt

SEQ ID NO: 92842 - DNA, 20 bp, Artificial Sequence
  chemically synthesized
cactaaatagtgaattaaca

SEQ ID NO: 92843 - DNA, 20 bp, Artificial Sequence
  chemically synthesized
gaattaacacagtgcaaatt

SEQ ID NO: 92844 - DNA, 20 bp, Artificial Sequence
  chemically synthesized
ttaacacagtgcaaatttag

SEQ ID NO: 92845 - DNA, 20 bp, Artificial Sequence
  chemically synthesized
ttatgagtaaagatgtcaaa

SEQ ID NO: 92846 - DNA, 20 bp, Artificial Sequence
  chemically synthesized
tttatgagtaaagatgtcaa

SEQ ID NO: 92847 - DNA, 20 bp, Artificial Sequence
  chemically synthesized
ttttacttattttatgagta

SEQ ID NO: 92848 - DNA, 20 bp, Artificial Sequence
  chemically synthesized
gacatctttactcataaaat

SEQ ID NO: 92849 - DNA, 20 bp, Artificial Sequence
  chemically synthesized
attgcttttacttattttat

SEQ ID NO: 92850 - DNA, 20 bp, Artificial Sequence
  chemically synthesized
tttactcataaaataagtaa

SEQ ID NO: 92851 - DNA, 20 bp, Artificial Sequence
  chemically synthesized
agagaactctttgtaagttg

SEQ ID NO: 92852 - DNA, 20 bp, Artificial Sequence
  chemically synthesized
tagagaactctttgtaagtt

SEQ ID NO: 92853 - DNA, 20 bp, Artificial Sequence
  chemically synthesized
aaagcaatccccaacttaca

SEQ ID NO: 92854 - DNA, 20 bp, Artificial Sequence
  chemically synthesized
ttagagaactctttgtaagt

SEQ ID NO: 92855 - DNA, 20 bp, Artificial Sequence
  chemically synthesized
agcaatccccaacttacaaa

SEQ ID NO: 92856 - DNA, 20 bp, Artificial Sequence
  chemically synthesized
ttggttagagaactctttgt

SEQ ID NO: 92857 - DNA, 20 bp, Artificial Sequence
  chemically synthesized
ttgcaagtgatttttggtta

SEQ ID NO: 92858 - DNA, 20 bp, Artificial Sequence
  chemically synthesized
atttgcaagtgatttttggt

SEQ ID NO: 92859 - DNA, 20 bp, Artificial Sequence
  chemically synthesized
atttatttgcaagtgatttt

SEQ ID NO: 92860 - DNA, 20 bp, Artificial Sequence
  chemically synthesized
gttctggaccatttatttgc

SEQ ID NO: 92861 - DNA, 20 bp, Artificial Sequence
  chemically synthesized
aaaaatcacttgcaaataaa

SEQ ID NO: 92862 - DNA, 20 bp, Artificial Sequence
  chemically synthesized
tcacttgcaaataaatggtc

SEQ ID NO: 92863 - DNA, 20 bp, Artificial Sequence
  chemically synthesized
gaaatttgagtttggggttc

SEQ ID NO: 92864 - DNA, 20 bp, Artificial Sequence
  chemically synthesized
tccatggaaatttgagtttg

SEQ ID NO: 92865 - DNA, 20 bp, Artificial Sequence
  chemically synthesized
gtccatggaaatttgagttt

SEQ ID NO: 92866 - DNA, 20 bp, Artificial Sequence
  chemically synthesized
tgtccatggaaatttgagtt

SEQ ID NO: 92867 - DNA, 20 bp, Artificial Sequence
  chemically synthesized
tattgtgtccatggaaattt

SEQ ID NO: 92868 - DNA, 20 bp, Artificial Sequence
  chemically synthesized
accccaaactcaaatttcca

SEQ ID NO: 92869 - DNA, 20 bp, Artificial Sequence
  chemically synthesized
gtatatgactattgtgtcca

SEQ ID NO: 92870 - DNA, 20 bp, Artificial Sequence
  chemically synthesized
tcaaatttccatggacacaa

SEQ ID NO: 92871 - DNA, 20 bp, Artificial Sequence
  chemically synthesized
caatagtcatatacatgtct

SEQ ID NO: 92872 - DNA, 20 bp, Artificial Sequence
  chemically synthesized
gtcatatacatgtctcagac

SEQ ID NO: 92873 - DNA, 20 bp, Artificial Sequence
  chemically synthesized
atatatgtatatgctggtct

SEQ ID NO: 92874 - DNA, 20 bp, Artificial Sequence
  chemically synthesized
atagctatatatgtatatgc

SEQ ID NO: 92875 - DNA, 20 bp, Artificial Sequence
  chemically synthesized
cagaccagcatatacatata

SEQ ID NO: 92876 - DNA, 20 bp, Artificial Sequence
  chemically synthesized
catccatggtataggttaaa

SEQ ID NO: 92877 - DNA, 20 bp, Artificial Sequence
  chemically synthesized
tagctatttaacctatacca

SEQ ID NO: 92878 - DNA, 20 bp, Artificial Sequence
  chemically synthesized
atataaatcatccatggtat

SEQ ID NO: 92879 - DNA, 20 bp, Artificial Sequence
  chemically synthesized
gatataaatcatccatggta

SEQ ID NO: 92880 - DNA, 20 bp, Artificial Sequence
  chemically synthesized
aaaatgatataaatcatcca

SEQ ID NO: 92881 - DNA, 20 bp, Artificial Sequence
  chemically synthesized
gatgatttatatcattttga

SEQ ID NO: 92882 - DNA, 20 bp, Artificial Sequence
  chemically synthesized
tcattttgatagcatgactt

SEQ ID NO: 92883 - DNA, 20 bp, Artificial Sequence
  chemically synthesized
cattttgatagcatgacttt

SEQ ID NO: 92884 - DNA, 20 bp, Artificial Sequence
  chemically synthesized
ttcccaaatcatataaccca

SEQ ID NO: 92885 - DNA, 20 bp, Artificial Sequence
  chemically synthesized
tgactttgggttatatgatt

SEQ ID NO: 92886 - DNA, 20 bp, Artificial Sequence
  chemically synthesized
gactttgggttatatgattt

SEQ ID NO: 92887 - DNA, 20 bp, Artificial Sequence
  chemically synthesized
tttgggaaatatgcatcttt

SEQ ID NO: 92888 - DNA, 20 bp, Artificial Sequence
  chemically synthesized
ttgggaaatatgcatctttt

SEQ ID NO: 92889 - DNA, 20 bp, Artificial Sequence
  chemically synthesized
ttgaatctttcatatcccaa

SEQ ID NO: 92890 - DNA, 20 bp, Artificial Sequence
  chemically synthesized
atgcatcttttgggatatga

SEQ ID NO: 92891 - DNA, 20 bp, Artificial Sequence
  chemically synthesized
ttttgggatatgaaagattc

SEQ ID NO: 92892 - DNA, 20 bp, Artificial Sequence
  chemically synthesized
tgggatatgaaagattcaag

SEQ ID NO: 92893 - DNA, 20 bp, Artificial Sequence
  chemically synthesized
tatgaaagattcaagaagta

SEQ ID NO: 92894 - DNA, 20 bp, Artificial Sequence
  chemically synthesized
aagattcaagaagtacggaa

SEQ ID NO: 92895 - DNA, 20 bp, Artificial Sequence
  chemically synthesized
aatccaggtcttaaaatagg

SEQ ID NO: 92896 - DNA, 20 bp, Artificial Sequence
  chemically synthesized
aaagaaatacttcctatttt

SEQ ID NO: 92897 - DNA, 20 bp, Artificial Sequence
  chemically synthesized
acaaatccaggtcttaaaat

SEQ ID NO: 92898 - DNA, 20 bp, Artificial Sequence
  chemically synthesized
gacaaatccaggtcttaaaa

SEQ ID NO: 92899 - DNA, 20 bp, Artificial Sequence
  chemically synthesized
atacttcctattttaagacc

SEQ ID NO: 92900 - DNA, 20 bp, Artificial Sequence
  chemically synthesized
gttgggtgttggacaaatcc

SEQ ID NO: 92901 - DNA, 20 bp, Artificial Sequence
  chemically synthesized
tgttgggtgttggacaaatc

SEQ ID NO: 92902 - DNA, 20 bp, Artificial Sequence
  chemically synthesized
atatctcctttgttgggtgt

SEQ ID NO: 92903 - DNA, 20 bp, Artificial Sequence
  chemically synthesized
gatttgtccaacacccaaca

SEQ ID NO: 92904 - DNA, 20 bp, Artificial Sequence
  chemically synthesized
atttgtccaacacccaacaa

SEQ ID NO: 92905 - DNA, 20 bp, Artificial Sequence
  chemically synthesized
ttgtccaacacccaacaaag

SEQ ID NO: 92906 - DNA, 20 bp, Artificial Sequence
  chemically synthesized
atttatatatctcctttgtt

SEQ ID NO: 92907 - DNA, 20 bp, Artificial Sequence
  chemically synthesized
catttatatatctcctttgt

SEQ ID NO: 92908 - DNA, 20 bp, Artificial Sequence
  chemically synthesized
caacaaaggagatatataaa

SEQ ID NO: 92909 - DNA, 20 bp, Artificial Sequence
  chemically synthesized
aacaaaggagatatataaat

SEQ ID NO: 92910 - DNA, 20 bp, Artificial Sequence
  chemically synthesized
cagaaggtggaaggagagag

SEQ ID NO: 92911 - DNA, 20 bp, Artificial Sequence
  chemically synthesized
caccagaaggtggaaggaga

SEQ ID NO: 92912 - DNA, 20 bp, Artificial Sequence
  chemically synthesized
ggcaccagaaggtggaagga

SEQ ID NO: 92913 - DNA, 20 bp, Artificial Sequence
  chemically synthesized
tgggcaccagaaggtggaag

SEQ ID NO: 92914 - DNA, 20 bp, Artificial Sequence
  chemically synthesized
tatgggcaccagaaggtgga

SEQ ID NO: 92915 - DNA, 20 bp, Artificial Sequence
  chemically synthesized
atatgggcaccagaaggtgg

SEQ ID NO: 92916 - DNA, 20 bp, Artificial Sequence
  chemically synthesized
tgctctctccttccaccttc

SEQ ID NO: 92917 - DNA, 20 bp, Artificial Sequence
  chemically synthesized
aaaatatgggcaccagaagg

SEQ ID NO: 92918 - DNA, 20 bp, Artificial Sequence
  chemically synthesized
tagaaaatatgggcaccaga

SEQ ID NO: 92919 - DNA, 20 bp, Artificial Sequence
  chemically synthesized
gtagaaaatatgggcaccag

SEQ ID NO: 92920 - DNA, 20 bp, Artificial Sequence
  chemically synthesized
ggagtagaaaatatgggcac

SEQ ID NO: 92921 - DNA, 20 bp, Artificial Sequence
  chemically synthesized
agtttgggagtagaaaatat

SEQ ID NO: 92922 - DNA, 20 bp, Artificial Sequence
  chemically synthesized
aagtttgggagtagaaaata

SEQ ID NO: 92923 - DNA, 20 bp, Artificial Sequence
  chemically synthesized
aacataaggaagtttgggag

SEQ ID NO: 92924 - DNA, 20 bp, Artificial Sequence
  chemically synthesized
taaaacataaggaagtttgg

SEQ ID NO: 92925 - DNA, 20 bp, Artificial Sequence
  chemically synthesized
attaaaacataaggaagttt

SEQ ID NO: 92926 - DNA, 20 bp, Artificial Sequence
  chemically synthesized
gattaaaacataaggaagtt

SEQ ID NO: 92927 - DNA, 20 bp, Artificial Sequence
  chemically synthesized
atgaggattaaaacataagg

SEQ ID NO: 92928 - DNA, 20 bp, Artificial Sequence
  chemically synthesized
agaatgaggattaaaacata

SEQ ID NO: 92929 - DNA, 20 bp, Artificial Sequence
  chemically synthesized
gagaatgaggattaaaacat

SEQ ID NO: 92930 - DNA, 20 bp, Artificial Sequence
  chemically synthesized
tcaacagatagaagagaatg

SEQ ID NO: 92931 - DNA, 20 bp, Artificial Sequence
  chemically synthesized
ttcaacagatagaagagaat

SEQ ID NO: 92932 - DNA, 20 bp, Artificial Sequence
  chemically synthesized
aagattttcaacagatagaa

SEQ ID NO: 92933 - DNA, 20 bp, Artificial Sequence
  chemically synthesized
ataagattttcaacagatag

SEQ ID NO: 92934 - DNA, 20 bp, Artificial Sequence
  chemically synthesized
ggaataagattttcaacaga

SEQ ID NO: 92935 - DNA, 20 bp, Artificial Sequence
  chemically synthesized
tttgggaataagattttcaa

SEQ ID NO: 92936 - DNA, 20 bp, Artificial Sequence
  chemically synthesized
tgttgaaaatcttattccca

SEQ ID NO: 92937 - DNA, 20 bp, Artificial Sequence
  chemically synthesized
tcagtctatactttgggaat

SEQ ID NO: 92938 - DNA, 20 bp, Artificial Sequence
  chemically synthesized
aaaatcttattcccaaagta

SEQ ID NO: 92939 - DNA, 20 bp, Artificial Sequence
  chemically synthesized
aagttgtcagtctatacttt

SEQ ID NO: 92940 - DNA, 20 bp, Artificial Sequence
  chemically synthesized
aaagttgtcagtctatactt

SEQ ID NO: 92941 - DNA, 20 bp, Artificial Sequence
  chemically synthesized
tcccagaatgtgaaagttgt

SEQ ID NO: 92942 - DNA, 20 bp, Artificial Sequence
  chemically synthesized
aaaaatctcccagaatgtga

SEQ ID NO: 92943 - DNA, 20 bp, Artificial Sequence
  chemically synthesized
gactgacaactttcacattc

SEQ ID NO: 92944 - DNA, 20 bp, Artificial Sequence
  chemically synthesized
actgacaactttcacattct

SEQ ID NO: 92945 - DNA, 20 bp, Artificial Sequence
  chemically synthesized
tgacaactttcacattctgg

SEQ ID NO: 92946 - DNA, 20 bp, Artificial Sequence
  chemically synthesized
tttaaaatataaaaatctcc

SEQ ID NO: 92947 - DNA, 20 bp, Artificial Sequence
  chemically synthesized
ggagatttttatattttaaa

SEQ ID NO: 92948 - DNA, 20 bp, Artificial Sequence
  chemically synthesized
agatttttatattttaaaaa

SEQ ID NO: 92949 - DNA, 20 bp, Artificial Sequence
  chemically synthesized
gatttttatattttaaaaag

SEQ ID NO: 92950 - DNA, 20 bp, Artificial Sequence
  chemically synthesized
atttttatattttaaaaaga

SEQ ID NO: 92951 - DNA, 20 bp, Artificial Sequence
  chemically synthesized
tttttatattttaaaaagag

SEQ ID NO: 92952 - DNA, 20 bp, Artificial Sequence
  chemically synthesized
tatattttaaaaagaggggc

SEQ ID NO: 92953 - DNA, 20 bp, Artificial Sequence
  chemically synthesized
atattttaaaaagaggggct

SEQ ID NO: 92954 - DNA, 20 bp, Artificial Sequence
  chemically synthesized
ttaaaaagaggggctgggca

SEQ ID NO: 92955 - DNA, 20 bp, Artificial Sequence
  chemically synthesized
aaaagaggggctgggcatgg

SEQ ID NO: 92956 - DNA, 20 bp, Artificial Sequence
  chemically synthesized
cagatgtgagccaccatgcc

SEQ ID NO: 92957 - DNA, 20 bp, Artificial Sequence
  chemically synthesized
cgtgctggaattacagatgt

SEQ ID NO: 92958 - DNA, 20 bp, Artificial Sequence
  chemically synthesized
gtggctcacatctgtaattc

SEQ ID NO: 92959 - DNA, 20 bp, Artificial Sequence
  chemically synthesized
ctgacaacgtgctggaatta

SEQ ID NO: 92960 - DNA, 20 bp, Artificial Sequence
  chemically synthesized
accttggcctgacaacgtgc

SEQ ID NO: 92961 - DNA, 20 bp, Artificial Sequence
  chemically synthesized
ctgtaattccagcacgttgt

SEQ ID NO: 92962 - DNA, 20 bp, Artificial Sequence
  chemically synthesized
tgtaattccagcacgttgtc

SEQ ID NO: 92963 - DNA, 20 bp, Artificial Sequence
  chemically synthesized
ttccagcacgttgtcaggcc

SEQ ID NO: 92964 - DNA, 20 bp, Artificial Sequence
  chemically synthesized
tccagcacgttgtcaggcca

SEQ ID NO: 92965 - DNA, 20 bp, Artificial Sequence
  chemically synthesized
agcacgttgtcaggccaagg

SEQ ID NO: 92966 - DNA, 20 bp, Artificial Sequence
  chemically synthesized
gcacgttgtcaggccaaggt

SEQ ID NO: 92967 - DNA, 20 bp, Artificial Sequence
  chemically synthesized
cgttgtcaggccaaggtggg

SEQ ID NO: 92968 - DNA, 20 bp, Artificial Sequence
  chemically synthesized
ctgaagtgatccacccacct

SEQ ID NO: 92969 - DNA, 20 bp, Artificial Sequence
  chemically synthesized
ccaaggtgggtggatcactt

SEQ ID NO: 92970 - DNA, 20 bp, Artificial Sequence
  chemically synthesized
gtgggtggatcacttcagcc

SEQ ID NO: 92971 - DNA, 20 bp, Artificial Sequence
  chemically synthesized
tgggtggatcacttcagccc

SEQ ID NO: 92972 - DNA, 20 bp, Artificial Sequence
  chemically synthesized
ggtctcagattcctgggctg

SEQ ID NO: 92973 - DNA, 20 bp, Artificial Sequence
  chemically synthesized
taagctggtctcagattcct

SEQ ID NO: 92974 - DNA, 20 bp, Artificial Sequence
  chemically synthesized
tcacttcagcccaggaatct

SEQ ID NO: 92975 - DNA, 20 bp, Artificial Sequence
  chemically synthesized
ctaagctggtctcagattcc

SEQ ID NO: 92976 - DNA, 20 bp, Artificial Sequence
  chemically synthesized
tcagcccaggaatctgagac

SEQ ID NO: 92977 - DNA, 20 bp, Artificial Sequence
  chemically synthesized
cacattgcctaagctggtct

SEQ ID NO: 92978 - DNA, 20 bp, Artificial Sequence
  chemically synthesized
ccaggaatctgagaccagct

SEQ ID NO: 92979 - DNA, 20 bp, Artificial Sequence
  chemically synthesized
caggaatctgagaccagctt

SEQ ID NO: 92980 - DNA, 20 bp, Artificial Sequence
  chemically synthesized
tttcgccacattgcctaagc

SEQ ID NO: 92981 - DNA, 20 bp, Artificial Sequence
  chemically synthesized
agagtttcgccacattgcct

SEQ ID NO: 92982 - DNA, 20 bp, Artificial Sequence
  chemically synthesized
tgagaccagcttaggcaatg

SEQ ID NO: 92983 - DNA, 20 bp, Artificial Sequence
  chemically synthesized
ttgtattttctgtagaaaca

SEQ ID NO: 92984 - DNA, 20 bp, Artificial Sequence
  chemically synthesized
gtggcgaaactctgtttcta

SEQ ID NO: 92985 - DNA, 20 bp, Artificial Sequence
  chemically synthesized
ttttgtattttctgtagaaa

SEQ ID NO: 92986 - DNA, 20 bp, Artificial Sequence
  chemically synthesized
gctactttttgtattttctg

SEQ ID NO: 92987 - DNA, 20 bp, Artificial Sequence
  chemically synthesized
gtttctacagaaaatacaaa

SEQ ID NO: 92988 - DNA, 20 bp, Artificial Sequence
  chemically synthesized
tctacagaaaatacaaaaag

SEQ ID NO: 92989 - DNA, 20 bp, Artificial Sequence
  chemically synthesized
acagaaaatacaaaaagtag

SEQ ID NO: 92990 - DNA, 20 bp, Artificial Sequence
  chemically synthesized
cagaaaatacaaaaagtagc

SEQ ID NO: 92991 - DNA, 20 bp, Artificial Sequence
  chemically synthesized
agaaaatacaaaaagtagcg

SEQ ID NO: 92992 - DNA, 20 bp, Artificial Sequence
  chemically synthesized
atacaaaaagtagcggggtg

SEQ ID NO: 92993 - DNA, 20 bp, Artificial Sequence
  chemically synthesized
caaaaagtagcggggtgtgg

SEQ ID NO: 92994 - DNA, 20 bp, Artificial Sequence
  chemically synthesized
ggtgtggtggcacgtgcctg

SEQ ID NO: 92995 - DNA, 20 bp, Artificial Sequence
  chemically synthesized
gtggcacgtgcctgtagtcc

SEQ ID NO: 92996 - DNA, 20 bp, Artificial Sequence
  chemically synthesized
tcccaagtggctgggactac

SEQ ID NO: 92997 - DNA, 20 bp, Artificial Sequence
  chemically synthesized
ctcccaagtggctgggacta

SEQ ID NO: 92998 - DNA, 20 bp, Artificial Sequence
  chemically synthesized
tgcctgtagtcccagccact

SEQ ID NO: 92999 - DNA, 20 bp, Artificial Sequence
  chemically synthesized
cctcagcctcccaagtggct

SEQ ID NO: 93000 - DNA, 20 bp, Artificial Sequence
  chemically synthesized
gcctgtagtcccagccactt

SEQ ID NO: 93001 - DNA, 20 bp, Artificial Sequence
  chemically synthesized
acctcagcctcccaagtggc

SEQ ID NO: 93002 - DNA, 20 bp, Artificial Sequence
  chemically synthesized
ctgtagtcccagccacttgg

SEQ ID NO: 93003 - DNA, 20 bp, Artificial Sequence
  chemically synthesized
tgtagtcccagccacttggg

SEQ ID NO: 93004 - DNA, 20 bp, Artificial Sequence
  chemically synthesized
tcccacctcagcctcccaag

SEQ ID NO: 93005 - DNA, 20 bp, Artificial Sequence
  chemically synthesized
ccctcccacctcagcctccc

SEQ ID NO: 93006 - DNA, 20 bp, Artificial Sequence
  chemically synthesized
tcccagccacttgggaggct

SEQ ID NO: 93007 - DNA, 20 bp, Artificial Sequence
  chemically synthesized
cccagccacttgggaggctg

SEQ ID NO: 93008 - DNA, 20 bp, Artificial Sequence
  chemically synthesized
agccacttgggaggctgagg

SEQ ID NO: 93009 - DNA, 20 bp, Artificial Sequence
  chemically synthesized
gccacttgggaggctgaggt

SEQ ID NO: 93010 - DNA, 20 bp, Artificial Sequence
  chemically synthesized
cacttgggaggctgaggtgg

SEQ ID NO: 93011 - DNA, 20 bp, Artificial Sequence
  chemically synthesized
acttgggaggctgaggtggg

SEQ ID NO: 93012 - DNA, 20 bp, Artificial Sequence
  chemically synthesized
ggtgatcctccctcccacct

SEQ ID NO: 93013 - DNA, 20 bp, Artificial Sequence
  chemically synthesized
cttgggaggctgaggtggga

SEQ ID NO: 93014 - DNA, 20 bp, Artificial Sequence
  chemically synthesized
tgggaggctgaggtgggagg

SEQ ID NO: 93015 - DNA, 20 bp, Artificial Sequence
  chemically synthesized
gggaggctgaggtgggaggg

SEQ ID NO: 93016 - DNA, 20 bp, Artificial Sequence
  chemically synthesized
ggtgggagggaggatcacct

SEQ ID NO: 93017 - DNA, 20 bp, Artificial Sequence
  chemically synthesized
gagggaggatcacctgagcc

SEQ ID NO: 93018 - DNA, 20 bp, Artificial Sequence
  chemically synthesized
agggaggatcacctgagccc

SEQ ID NO: 93019 - DNA, 20 bp, Artificial Sequence
  chemically synthesized
gggaggatcacctgagccca

SEQ ID NO: 93020 - DNA, 20 bp, Artificial Sequence
  chemically synthesized
acttcgacatccctgggctc

SEQ ID NO: 93021 - DNA, 20 bp, Artificial Sequence
  chemically synthesized
aacttcgacatccctgggct

SEQ ID NO: 93022 - DNA, 20 bp, Artificial Sequence
  chemically synthesized
actgcaacttcgacatccct

SEQ ID NO: 93023 - DNA, 20 bp, Artificial Sequence
  chemically synthesized
cactgcaacttcgacatccc

SEQ ID NO: 93024 - DNA, 20 bp, Artificial Sequence
  chemically synthesized
acctgagcccagggatgtcg

SEQ ID NO: 93025 - DNA, 20 bp, Artificial Sequence
  chemically synthesized
gcccagggatgtcgaagttg

SEQ ID NO: 93026 - DNA, 20 bp, Artificial Sequence
  chemically synthesized
agggatgtcgaagttgcagt

SEQ ID NO: 93027 - DNA, 20 bp, Artificial Sequence
  chemically synthesized
ggagtgcagtggcacaatca

SEQ ID NO: 93028 - DNA, 20 bp, Artificial Sequence
  chemically synthesized
tcacccaggctggagtgcag

SEQ ID NO: 93029 - DNA, 20 bp, Artificial Sequence
  chemically synthesized
atgattgtgccactgcactc

SEQ ID NO: 93030 - DNA, 20 bp, Artificial Sequence
  chemically synthesized
ctgtcacccaggctggagtg

SEQ ID NO: 93031 - DNA, 20 bp, Artificial Sequence
  chemically synthesized
tgtgccactgcactccagcc

SEQ ID NO: 93032 - DNA, 20 bp, Artificial Sequence
  chemically synthesized
gtgccactgcactccagcct

SEQ ID NO: 93033 - DNA, 20 bp, Artificial Sequence
  chemically synthesized
ataccctgtcacccaggctg

SEQ ID NO: 93034 - DNA, 20 bp, Artificial Sequence
  chemically synthesized
tcataccctgtcacccaggc

SEQ ID NO: 93035 - DNA, 20 bp, Artificial Sequence
  chemically synthesized
ctgcactccagcctgggtga

SEQ ID NO: 93036 - DNA, 20 bp, Artificial Sequence
  chemically synthesized
tgcactccagcctgggtgac

SEQ ID NO: 93037 - DNA, 20 bp, Artificial Sequence
  chemically synthesized
agggtcataccctgtcaccc

SEQ ID NO: 93038 - DNA, 20 bp, Artificial Sequence
  chemically synthesized
gcactccagcctgggtgaca

SEQ ID NO: 93039 - DNA, 20 bp, Artificial Sequence
  chemically synthesized
cagggtcataccctgtcacc

SEQ ID NO: 93040 - DNA, 20 bp, Artificial Sequence
  chemically synthesized
tccccttttttttggagaca

SEQ ID NO: 93041 - DNA, 20 bp, Artificial Sequence
  chemically synthesized
ttccccttttttttggagac

SEQ ID NO: 93042 - DNA, 20 bp, Artificial Sequence
  chemically synthesized
cttccccttttttttggaga

SEQ ID NO: 93043 - DNA, 20 bp, Artificial Sequence
  chemically synthesized
atgaccctgtctccaaaaaa

SEQ ID NO: 93044 - DNA, 20 bp, Artificial Sequence
  chemically synthesized
tcagcttccccttttttttg

SEQ ID NO: 93045 - DNA, 20 bp, Artificial Sequence
  chemically synthesized
tgaccctgtctccaaaaaaa

SEQ ID NO: 93046 - DNA, 20 bp, Artificial Sequence
  chemically synthesized
gaccctgtctccaaaaaaaa

SEQ ID NO: 93047 - DNA, 20 bp, Artificial Sequence
  chemically synthesized
actcagcttccccttttttt

SEQ ID NO: 93048 - DNA, 20 bp, Artificial Sequence
  chemically synthesized
accctgtctccaaaaaaaag

SEQ ID NO: 93049 - DNA, 20 bp, Artificial Sequence
  chemically synthesized
ctgtctccaaaaaaaagggg

SEQ ID NO: 93050 - DNA, 20 bp, Artificial Sequence
  chemically synthesized
tccaaaaaaaaggggaagct

SEQ ID NO: 93051 - DNA, 20 bp, Artificial Sequence
  chemically synthesized
cagattggtttggtttaact

SEQ ID NO: 93052 - DNA, 20 bp, Artificial Sequence
  chemically synthesized
atctgtgattcagattggtt

SEQ ID NO: 93053 - DNA, 20 bp, Artificial Sequence
  chemically synthesized
tatcaatctgtgattcagat

SEQ ID NO: 93054 - DNA, 20 bp, Artificial Sequence
  chemically synthesized
aaccaaaccaatctgaatca

SEQ ID NO: 93055 - DNA, 20 bp, Artificial Sequence
  chemically synthesized
aatcctatcaatctgtgatt

SEQ ID NO: 93056 - DNA, 20 bp, Artificial Sequence
  chemically synthesized
caatctgaatcacagattga

SEQ ID NO: 93057 - DNA, 20 bp, Artificial Sequence
  chemically synthesized
aatctgaatcacagattgat

SEQ ID NO: 93058 - DNA, 20 bp, Artificial Sequence
  chemically synthesized
cacagattgataggatttcc

SEQ ID NO: 93059 - DNA, 20 bp, Artificial Sequence
  chemically synthesized
gataggatttccaagaatat

SEQ ID NO: 93060 - DNA, 20 bp, Artificial Sequence
  chemically synthesized
actttgcattcttatattct

SEQ ID NO: 93061 - DNA, 20 bp, Artificial Sequence
  chemically synthesized
tccaagaatataagaatgca

SEQ ID NO: 93062 - DNA, 20 bp, Artificial Sequence
  chemically synthesized
gaatgcaaagtaaaaatatt

SEQ ID NO: 93063 - DNA, 20 bp, Artificial Sequence
  chemically synthesized
gcaaagtaaaaatattcaga

SEQ ID NO: 93064 - DNA, 20 bp, Artificial Sequence
  chemically synthesized
aagtaaaaatattcagatgg

SEQ ID NO: 93065 - DNA, 20 bp, Artificial Sequence
  chemically synthesized
aaatattcagatggtagcat

SEQ ID NO: 93066 - DNA, 20 bp, Artificial Sequence
  chemically synthesized
cagatggtagcataagcgtc

SEQ ID NO: 93067 - DNA, 20 bp, Artificial Sequence
  chemically synthesized
agatggtagcataagcgtct

SEQ ID NO: 93068 - DNA, 20 bp, Artificial Sequence
  chemically synthesized
gatggtagcataagcgtctg

SEQ ID NO: 93069 - DNA, 20 bp, Artificial Sequence
  chemically synthesized
atggtagcataagcgtctgg

SEQ ID NO: 93070 - DNA, 20 bp, Artificial Sequence
  chemically synthesized
gtagcataagcgtctggggg

SEQ ID NO: 93071 - DNA, 20 bp, Artificial Sequence
  chemically synthesized
agctaaagcctttctgcccc

SEQ ID NO: 93072 - DNA, 20 bp, Artificial Sequence
  chemically synthesized
cataagcgtctgggggcaga

SEQ ID NO: 93073 - DNA, 20 bp, Artificial Sequence
  chemically synthesized
ataagcgtctgggggcagaa

SEQ ID NO: 93074 - DNA, 20 bp, Artificial Sequence
  chemically synthesized
gtctgggggcagaaaggctt

SEQ ID NO: 93075 - DNA, 20 bp, Artificial Sequence
  chemically synthesized
ttgcctaccaagaatagcta

SEQ ID NO: 93076 - DNA, 20 bp, Artificial Sequence
  chemically synthesized
agaaaggctttagctattct

SEQ ID NO: 93077 - DNA, 20 bp, Artificial Sequence
  chemically synthesized
aaggctttagctattcttgg

SEQ ID NO: 93078 - DNA, 20 bp, Artificial Sequence
  chemically synthesized
agtagattgcctaccaagaa

SEQ ID NO: 93079 - DNA, 20 bp, Artificial Sequence
  chemically synthesized
aggctttagctattcttggt

SEQ ID NO: 93080 - DNA, 20 bp, Artificial Sequence
  chemically synthesized
accaaagtagattgcctacc

SEQ ID NO: 93081 - DNA, 20 bp, Artificial Sequence
  chemically synthesized
tcttggtaggcaatctactt

SEQ ID NO: 93082 - DNA, 20 bp, Artificial Sequence
  chemically synthesized
gttcacagtattaaccaaag

SEQ ID NO: 93083 - DNA, 20 bp, Artificial Sequence
  chemically synthesized
ccagttcacagtattaacca

SEQ ID NO: 93084 - DNA, 20 bp, Artificial Sequence
  chemically synthesized
ctttggttaatactgtgaac

SEQ ID NO: 93085 - DNA, 20 bp, Artificial Sequence
  chemically synthesized
gatttaggtgagccagttca

SEQ ID NO: 93086 - DNA, 20 bp, Artificial Sequence
  chemically synthesized
gtaagtagatttaggtgagc

SEQ ID NO: 93087 - DNA, 20 bp, Artificial Sequence
  chemically synthesized
gatggtaagtagatttaggt

SEQ ID NO: 93088 - DNA, 20 bp, Artificial Sequence
  chemically synthesized
gaaggatggtaagtagattt

SEQ ID NO: 93089 - DNA, 20 bp, Artificial Sequence
  chemically synthesized
ggaaggatggtaagtagatt

SEQ ID NO: 93090 - DNA, 20 bp, Artificial Sequence
  chemically synthesized
ccaactggaaggatggtaag

SEQ ID NO: 93091 - DNA, 20 bp, Artificial Sequence
  chemically synthesized
tgtccaactggaaggatggt

SEQ ID NO: 93092 - DNA, 20 bp, Artificial Sequence
  chemically synthesized
aaatctacttaccatccttc

SEQ ID NO: 93093 - DNA, 20 bp, Artificial Sequence
  chemically synthesized
aacctgtccaactggaagga

SEQ ID NO: 93094 - DNA, 20 bp, Artificial Sequence
  chemically synthesized
ctacttaccatccttccagt

SEQ ID NO: 93095 - DNA, 20 bp, Artificial Sequence
  chemically synthesized
ttccaacctgtccaactgga

SEQ ID NO: 93096 - DNA, 20 bp, Artificial Sequence
  chemically synthesized
tttccaacctgtccaactgg

SEQ ID NO: 93097 - DNA, 20 bp, Artificial Sequence
  chemically synthesized
ttaccatccttccagttgga

SEQ ID NO: 93098 - DNA, 20 bp, Artificial Sequence
  chemically synthesized
taccatccttccagttggac

SEQ ID NO: 93099 - DNA, 20 bp, Artificial Sequence
  chemically synthesized
taatttccaacctgtccaac

SEQ ID NO: 93100 - DNA, 20 bp, Artificial Sequence
  chemically synthesized
atccttccagttggacaggt

SEQ ID NO: 93101 - DNA, 20 bp, Artificial Sequence
  chemically synthesized
aaattaaaaactgtatttgc

SEQ ID NO: 93102 - DNA, 20 bp, Artificial Sequence
  chemically synthesized
gcatggaagtctggcaaata

SEQ ID NO: 93103 - DNA, 20 bp, Artificial Sequence
  chemically synthesized
acactagctgcatggaagtc

SEQ ID NO: 93104 - DNA, 20 bp, Artificial Sequence
  chemically synthesized
gtatttgccagacttccatg

SEQ ID NO: 93105 - DNA, 20 bp, Artificial Sequence
  chemically synthesized
tcagaacactagctgcatgg

SEQ ID NO: 93106 - DNA, 20 bp, Artificial Sequence
  chemically synthesized
ttgccagacttccatgcagc

SEQ ID NO: 93107 - DNA, 20 bp, Artificial Sequence
  chemically synthesized
taatcagaacactagctgca

SEQ ID NO: 93108 - DNA, 20 bp, Artificial Sequence
  chemically synthesized
ctaattcataatcagaacac

SEQ ID NO: 93109 - DNA, 20 bp, Artificial Sequence
  chemically synthesized
attatatcctaattcataat

SEQ ID NO: 93110 - DNA, 20 bp, Artificial Sequence
  chemically synthesized
ctagtgttctgattatgaat

SEQ ID NO: 93111 - DNA, 20 bp, Artificial Sequence
  chemically synthesized
tagtgttctgattatgaatt

SEQ ID NO: 93112 - DNA, 20 bp, Artificial Sequence
  chemically synthesized
attatgaattaggatataat

SEQ ID NO: 93113 - DNA, 20 bp, Artificial Sequence
  chemically synthesized
tgaattaggatataataagt

SEQ ID NO: 93114 - DNA, 20 bp, Artificial Sequence
  chemically synthesized
gaattaggatataataagtt

SEQ ID NO: 93115 - DNA, 20 bp, Artificial Sequence
  chemically synthesized
aattaggatataataagtta

SEQ ID NO: 93116 - DNA, 20 bp, Artificial Sequence
  chemically synthesized
atataataagttagggttgt

SEQ ID NO: 93117 - DNA, 20 bp, Artificial Sequence
  chemically synthesized
agggttgtcagataaaatac

SEQ ID NO: 93118 - DNA, 20 bp, Artificial Sequence
  chemically synthesized
gggttgtcagataaaataca

SEQ ID NO: 93119 - DNA, 20 bp, Artificial Sequence
  chemically synthesized
cagataaaatacaaggcacc

SEQ ID NO: 93120 - DNA, 20 bp, Artificial Sequence
  chemically synthesized
tagaaaatttaaatttaact

SEQ ID NO: 93121 - DNA, 20 bp, Artificial Sequence
  chemically synthesized
gtagaaaatttaaatttaac

SEQ ID NO: 93122 - DNA, 20 bp, Artificial Sequence
  chemically synthesized
ctaaataaaaaaagattgtg

SEQ ID NO: 93123 - DNA, 20 bp, Artificial Sequence
  chemically synthesized
tacttaacactaaataaaaa

SEQ ID NO: 93124 - DNA, 20 bp, Artificial Sequence
  chemically synthesized
ctacacaatctttttttatt

SEQ ID NO: 93125 - DNA, 20 bp, Artificial Sequence
  chemically synthesized
atctttttttatttagtgtt

SEQ ID NO: 93126 - DNA, 20 bp, Artificial Sequence
  chemically synthesized
ttatttttatttgctaaatc

SEQ ID NO: 93127 - DNA, 20 bp, Artificial Sequence
  chemically synthesized
tggcaaaacgttgccagatt

SEQ ID NO: 93128 - DNA, 20 bp, Artificial Sequence
  chemically synthesized
cacatttggcaaaacgttgc

SEQ ID NO: 93129 - DNA, 20 bp, Artificial Sequence
  chemically synthesized
ctctcacaagtatacacatt

SEQ ID NO: 93130 - DNA, 20 bp, Artificial Sequence
  chemically synthesized
tgccaaatgtgtatacttgt

SEQ ID NO: 93131 - DNA, 20 bp, Artificial Sequence
  chemically synthesized
ccaaatgtgtatacttgtga

SEQ ID NO: 93132 - DNA, 20 bp, Artificial Sequence
  chemically synthesized
ccactttccagatctctcac

SEQ ID NO: 93133 - DNA, 20 bp, Artificial Sequence
  chemically synthesized
gtgtatacttgtgagagatc

SEQ ID NO: 93134 - DNA, 20 bp, Artificial Sequence
  chemically synthesized
atacttgtgagagatctgga

SEQ ID NO: 93135 - DNA, 20 bp, Artificial Sequence
  chemically synthesized
cttgtgagagatctggaaag

SEQ ID NO: 93136 - DNA, 20 bp, Artificial Sequence
  chemically synthesized
tatgcctcacttccactttc

SEQ ID NO: 93137 - DNA, 20 bp, Artificial Sequence
  chemically synthesized
gtgagagatctggaaagtgg

SEQ ID NO: 93138 - DNA, 20 bp, Artificial Sequence
  chemically synthesized
gagatctggaaagtggaagt

SEQ ID NO: 93139 - DNA, 20 bp, Artificial Sequence
  chemically synthesized
agatctggaaagtggaagtg

SEQ ID NO: 93140 - DNA, 20 bp, Artificial Sequence
  chemically synthesized
tggaaagtggaagtgaggca

SEQ ID NO: 93141 - DNA, 20 bp, Artificial Sequence
  chemically synthesized
ggaaagtggaagtgaggcat

SEQ ID NO: 93142 - DNA, 20 bp, Artificial Sequence
  chemically synthesized
aatagccaaaaggggcagaa

SEQ ID NO: 93143 - DNA, 20 bp, Artificial Sequence
  chemically synthesized
aaatagccaaaaggggcaga

SEQ ID NO: 93144 - DNA, 20 bp, Artificial Sequence
  chemically synthesized
ggtcacctttctgccccttt

SEQ ID NO: 93145 - DNA, 20 bp, Artificial Sequence
  chemically synthesized
acagaaatagccaaaagggg

SEQ ID NO: 93146 - DNA, 20 bp, Artificial Sequence
  chemically synthesized
ccaacagaaatagccaaaag

SEQ ID NO: 93147 - DNA, 20 bp, Artificial Sequence
  chemically synthesized
gccaacagaaatagccaaaa

SEQ ID NO: 93148 - DNA, 20 bp, Artificial Sequence
  chemically synthesized
cgccaacagaaatagccaaa

SEQ ID NO: 93149 - DNA, 20 bp, Artificial Sequence
  chemically synthesized
tcgccaacagaaatagccaa

SEQ ID NO: 93150 - DNA, 20 bp, Artificial Sequence
  chemically synthesized
ccccttttggctatttctgt

SEQ ID NO: 93151 - DNA, 20 bp, Artificial Sequence
  chemically synthesized
actaagctcgccaacagaaa

SEQ ID NO: 93152 - DNA, 20 bp, Artificial Sequence
  chemically synthesized
ttttggctatttctgttggc

SEQ ID NO: 93153 - DNA, 20 bp, Artificial Sequence
  chemically synthesized
tctttgactaagctcgccaa

SEQ ID NO: 93154 - DNA, 20 bp, Artificial Sequence
  chemically synthesized
gctatttctgttggcgagct

SEQ ID NO: 93155 - DNA, 20 bp, Artificial Sequence
  chemically synthesized
tctgttggcgagcttagtca

SEQ ID NO: 93156 - DNA, 20 bp, Artificial Sequence
  chemically synthesized
aatctcatgtttctttgact

SEQ ID NO: 93157 - DNA, 20 bp, Artificial Sequence
  chemically synthesized
gagcttagtcaaagaaacat

SEQ ID NO: 93158 - DNA, 20 bp, Artificial Sequence
  chemically synthesized
aaacatgagatttcctacat

SEQ ID NO: 93159 - DNA, 20 bp, Artificial Sequence
  chemically synthesized
acatgagatttcctacatca

SEQ ID NO: 93160 - DNA, 20 bp, Artificial Sequence
  chemically synthesized
gaactttggaactctgatgt

SEQ ID NO: 93161 - DNA, 20 bp, Artificial Sequence
  chemically synthesized
agaactttggaactctgatg

SEQ ID NO: 93162 - DNA, 20 bp, Artificial Sequence
  chemically synthesized
tttcctacatcagagttcca

SEQ ID NO: 93163 - DNA, 20 bp, Artificial Sequence
  chemically synthesized
ggaagctggagaaagaactt

SEQ ID NO: 93164 - DNA, 20 bp, Artificial Sequence
  chemically synthesized
gagttccaaagttctttctc

SEQ ID NO: 93165 - DNA, 20 bp, Artificial Sequence
  chemically synthesized
tccagccaggaagctggaga

SEQ ID NO: 93166 - DNA, 20 bp, Artificial Sequence
  chemically synthesized
cttctccagccaggaagctg

SEQ ID NO: 93167 - DNA, 20 bp, Artificial Sequence
  chemically synthesized
aagttctttctccagcttcc

SEQ ID NO: 93168 - DNA, 20 bp, Artificial Sequence
  chemically synthesized
cccttctccagccaggaagc

SEQ ID NO: 93169 - DNA, 20 bp, Artificial Sequence
  chemically synthesized
tctttctccagcttcctggc

SEQ ID NO: 93170 - DNA, 20 bp, Artificial Sequence
  chemically synthesized
actgcccttctccagccagg

SEQ ID NO: 93171 - DNA, 20 bp, Artificial Sequence
  chemically synthesized
tttctccagcttcctggctg

SEQ ID NO: 93172 - DNA, 20 bp, Artificial Sequence
  chemically synthesized
gcaactgcccttctccagcc

SEQ ID NO: 93173 - DNA, 20 bp, Artificial Sequence
  chemically synthesized
ctccagcttcctggctggag

SEQ ID NO: 93174 - DNA, 20 bp, Artificial Sequence
  chemically synthesized
agcaactgcccttctccagc

SEQ ID NO: 93175 - DNA, 20 bp, Artificial Sequence
  chemically synthesized
tccagcttcctggctggaga

SEQ ID NO: 93176 - DNA, 20 bp, Artificial Sequence
  chemically synthesized
ccagcttcctggctggagaa

SEQ ID NO: 93177 - DNA, 20 bp, Artificial Sequence
  chemically synthesized
tgttagcaactgcccttctc

SEQ ID NO: 93178 - DNA, 20 bp, Artificial Sequence
  chemically synthesized
gcttcctggctggagaaggg

SEQ ID NO: 93179 - DNA, 20 bp, Artificial Sequence
  chemically synthesized
tggagaagggcagttgctaa

SEQ ID NO: 93180 - DNA, 20 bp, Artificial Sequence
  chemically synthesized
agaagggcagttgctaacag

SEQ ID NO: 93181 - DNA, 20 bp, Artificial Sequence
  chemically synthesized
accacttttgaagctgctgt

SEQ ID NO: 93182 - DNA, 20 bp, Artificial Sequence
  chemically synthesized
gttgctaacagcagcttcaa

SEQ ID NO: 93183 - DNA, 20 bp, Artificial Sequence
  chemically synthesized
gctaacagcagcttcaaaag

SEQ ID NO: 93184 - DNA, 20 bp, Artificial Sequence
  chemically synthesized
tctagacgctaccacttttg

SEQ ID NO: 93185 - DNA, 20 bp, Artificial Sequence
  chemically synthesized
aacagcagcttcaaaagtgg

SEQ ID NO: 93186 - DNA, 20 bp, Artificial Sequence
  chemically synthesized
gcttcaaaagtggtagcgtc

SEQ ID NO: 93187 - DNA, 20 bp, Artificial Sequence
  chemically synthesized
ggaaccaggaggttgaaatc

SEQ ID NO: 93188 - DNA, 20 bp, Artificial Sequence
  chemically synthesized
gcgtctagatttcaacctcc

SEQ ID NO: 93189 - DNA, 20 bp, Artificial Sequence
  chemically synthesized
aataggaactaggaaccagg

SEQ ID NO: 93190 - DNA, 20 bp, Artificial Sequence
  chemically synthesized
aaataggaactaggaaccag

SEQ ID NO: 93191 - DNA, 20 bp, Artificial Sequence
  chemically synthesized
gatttcaacctcctggttcc

SEQ ID NO: 93192 - DNA, 20 bp, Artificial Sequence
  chemically synthesized
gtaaataggaactaggaacc

SEQ ID NO: 93193 - DNA, 20 bp, Artificial Sequence
  chemically synthesized
tgtaaataggaactaggaac

SEQ ID NO: 93194 - DNA, 20 bp, Artificial Sequence
  chemically synthesized
atactttgtaaataggaact

SEQ ID NO: 93195 - DNA, 20 bp, Artificial Sequence
  chemically synthesized
catactttgtaaataggaac

SEQ ID NO: 93196 - DNA, 20 bp, Artificial Sequence
  chemically synthesized
gttcctagttcctatttaca

SEQ ID NO: 93197 - DNA, 20 bp, Artificial Sequence
  chemically synthesized
caagaacatactttgtaaat

SEQ ID NO: 93198 - DNA, 20 bp, Artificial Sequence
  chemically synthesized
tcaagaacatactttgtaaa

SEQ ID NO: 93199 - DNA, 20 bp, Artificial Sequence
  chemically synthesized
accactgaagcaatgatttc

SEQ ID NO: 93200 - DNA, 20 bp, Artificial Sequence
  chemically synthesized
tgttcttgaaatcattgctt

SEQ ID NO: 93201 - DNA, 20 bp, Artificial Sequence
  chemically synthesized
tcttgaaatcattgcttcag

SEQ ID NO: 93202 - DNA, 20 bp, Artificial Sequence
  chemically synthesized
ccatctccggggtaccactg

SEQ ID NO: 93203 - DNA, 20 bp, Artificial Sequence
  chemically synthesized
tcattgcttcagtggtaccc

SEQ ID NO: 93204 - DNA, 20 bp, Artificial Sequence
  chemically synthesized
attgcttcagtggtaccccg

SEQ ID NO: 93205 - DNA, 20 bp, Artificial Sequence
  chemically synthesized
cttcagtggtaccccggaga

SEQ ID NO: 93206 - DNA, 20 bp, Artificial Sequence
  chemically synthesized
ataagaaactaccatctccg

SEQ ID NO: 93207 - DNA, 20 bp, Artificial Sequence
  chemically synthesized
aataagaaactaccatctcc

SEQ ID NO: 93208 - DNA, 20 bp, Artificial Sequence
  chemically synthesized
cagtggtaccccggagatgg

SEQ ID NO: 93209 - DNA, 20 bp, Artificial Sequence
  chemically synthesized
caataagaaactaccatctc

SEQ ID NO: 93210 - DNA, 20 bp, Artificial Sequence
  chemically synthesized
cggagatggtagtttcttat

SEQ ID NO: 93211 - DNA, 20 bp, Artificial Sequence
  chemically synthesized
atggtagtttcttattggat

SEQ ID NO: 93212 - DNA, 20 bp, Artificial Sequence
  chemically synthesized
ctatatagaactgatccaat

SEQ ID NO: 93213 - DNA, 20 bp, Artificial Sequence
  chemically synthesized
cttattggatcagttctata

SEQ ID NO: 93214 - DNA, 20 bp, Artificial Sequence
  chemically synthesized
gacagatttctaaaactata

SEQ ID NO: 93215 - DNA, 20 bp, Artificial Sequence
  chemically synthesized
ggatcagttctatatagttt

SEQ ID NO: 93216 - DNA, 20 bp, Artificial Sequence
  chemically synthesized
gttttagaaatctgtcctcg

SEQ ID NO: 93217 - DNA, 20 bp, Artificial Sequence
  chemically synthesized
tttagacttggcttcgagga

SEQ ID NO: 93218 - DNA, 20 bp, Artificial Sequence
  chemically synthesized
agaaatctgtcctcgaagcc

SEQ ID NO: 93219 - DNA, 20 bp, Artificial Sequence
  chemically synthesized
aggttttagacttggcttcg

SEQ ID NO: 93220 - DNA, 20 bp, Artificial Sequence
  chemically synthesized
caggttttagacttggcttc

SEQ ID NO: 93221 - DNA, 20 bp, Artificial Sequence
  chemically synthesized
aaagtagcaggttttagact

SEQ ID NO: 93222 - DNA, 20 bp, Artificial Sequence
  chemically synthesized
aaggctaaagtagcaggttt

SEQ ID NO: 93223 - DNA, 20 bp, Artificial Sequence
  chemically synthesized
aagtctaaaacctgctactt

SEQ ID NO: 93224 - DNA, 20 bp, Artificial Sequence
  chemically synthesized
tttggaaaggctaaagtagc

SEQ ID NO: 93225 - DNA, 20 bp, Artificial Sequence
  chemically synthesized
ttttggaaaggctaaagtag

SEQ ID NO: 93226 - DNA, 20 bp, Artificial Sequence
  chemically synthesized
aagttttggaaaggctaaag

SEQ ID NO: 93227 - DNA, 20 bp, Artificial Sequence
  chemically synthesized
tcaaagttttggaaaggcta

SEQ ID NO: 93228 - DNA, 20 bp, Artificial Sequence
  chemically synthesized
cacatatcaaagttttggaa

SEQ ID NO: 93229 - DNA, 20 bp, Artificial Sequence
  chemically synthesized
acacatatcaaagttttgga

SEQ ID NO: 93230 - DNA, 20 bp, Artificial Sequence
  chemically synthesized
ttagacacatatcaaagttt

SEQ ID NO: 93231 - DNA, 20 bp, Artificial Sequence
  chemically synthesized
ggtacgttagacacatatca

SEQ ID NO: 93232 - DNA, 20 bp, Artificial Sequence
  chemically synthesized
tgatatgtgtctaacgtacc

SEQ ID NO: 93233 - DNA, 20 bp, Artificial Sequence
  chemically synthesized
agaaactactctaggtacgt

SEQ ID NO: 93234 - DNA, 20 bp, Artificial Sequence
  chemically synthesized
atatgtgtctaacgtaccta

SEQ ID NO: 93235 - DNA, 20 bp, Artificial Sequence
  chemically synthesized
tgtgtctaacgtacctagag

SEQ ID NO: 93236 - DNA, 20 bp, Artificial Sequence
  chemically synthesized
cagaaaagagaaactactct

SEQ ID NO: 93237 - DNA, 20 bp, Artificial Sequence
  chemically synthesized
gcagaaaagagaaactactc

SEQ ID NO: 93238 - DNA, 20 bp, Artificial Sequence
  chemically synthesized
agagtagtttctcttttctg

SEQ ID NO: 93239 - DNA, 20 bp, Artificial Sequence
  chemically synthesized
acggagttcactgcagaaaa

SEQ ID NO: 93240 - DNA, 20 bp, Artificial Sequence
  chemically synthesized
taacggagttcactgcagaa

SEQ ID NO: 93241 - DNA, 20 bp, Artificial Sequence
  chemically synthesized
caatataacggagttcactg

SEQ ID NO: 93242 - DNA, 20 bp, Artificial Sequence
  chemically synthesized
ccctgaaggtcaatataacg

SEQ ID NO: 93243 - DNA, 20 bp, Artificial Sequence
  chemically synthesized
ggccctgaaggtcaatataa

SEQ ID NO: 93244 - DNA, 20 bp, Artificial Sequence
  chemically synthesized
aactccgttatattgacctt

SEQ ID NO: 93245 - DNA, 20 bp, Artificial Sequence
  chemically synthesized
actccgttatattgaccttc

SEQ ID NO: 93246 - DNA, 20 bp, Artificial Sequence
  chemically synthesized
ctccgttatattgaccttca

SEQ ID NO: 93247 - DNA, 20 bp, Artificial Sequence
  chemically synthesized
aatagaggaggtggccctga

SEQ ID NO: 93248 - DNA, 20 bp, Artificial Sequence
  chemically synthesized
aaatagaggaggtggccctg

SEQ ID NO: 93249 - DNA, 20 bp, Artificial Sequence
  chemically synthesized
gtagaaacaaatagaggagg

SEQ ID NO: 93250 - DNA, 20 bp, Artificial Sequence
  chemically synthesized
gtagtagaaacaaatagagg

SEQ ID NO: 93251 - DNA, 20 bp, Artificial Sequence
  chemically synthesized
agtagtagaaacaaatagag

SEQ ID NO: 93252 - DNA, 20 bp, Artificial Sequence
  chemically synthesized
caagtagtagaaacaaatag

SEQ ID NO: 93253 - DNA, 20 bp, Artificial Sequence
  chemically synthesized
gcaagtagtagaaacaaata

SEQ ID NO: 93254 - DNA, 20 bp, Artificial Sequence
  chemically synthesized
ttgcaagtagtagaaacaaa

SEQ ID NO: 93255 - DNA, 20 bp, Artificial Sequence
  chemically synthesized
aaggaagatattgcaagtag

SEQ ID NO: 93256 - DNA, 20 bp, Artificial Sequence
  chemically synthesized
ctaaaggaagatattgcaag

SEQ ID NO: 93257 - DNA, 20 bp, Artificial Sequence
  chemically synthesized
tgactaaaggaagatattgc

SEQ ID NO: 93258 - DNA, 20 bp, Artificial Sequence
  chemically synthesized
ctacttgcaatatcttcctt

SEQ ID NO: 93259 - DNA, 20 bp, Artificial Sequence
  chemically synthesized
atttttttaatgactaaagg

SEQ ID NO: 93260 - DNA, 20 bp, Artificial Sequence
  chemically synthesized
tagatttttttaatgactaa

SEQ ID NO: 93261 - DNA, 20 bp, Artificial Sequence
  chemically synthesized
gtagatttttttaatgacta

SEQ ID NO: 93262 - DNA, 20 bp, Artificial Sequence
  chemically synthesized
ccataaagttgtattgtttg

SEQ ID NO: 93263 - DNA, 20 bp, Artificial Sequence
  chemically synthesized
ctacaaacaatacaacttta

SEQ ID NO: 93264 - DNA, 20 bp, Artificial Sequence
  chemically synthesized
accatgttaagaaaaccata

SEQ ID NO: 93265 - DNA, 20 bp, Artificial Sequence
  chemically synthesized
actttatggttttcttaaca

SEQ ID NO: 93266 - DNA, 20 bp, Artificial Sequence
  chemically synthesized
ctgtgacaaagaaccatgtt

SEQ ID NO: 93267 - DNA, 20 bp, Artificial Sequence
  chemically synthesized
cttaacatggttctttgtca

SEQ ID NO: 93268 - DNA, 20 bp, Artificial Sequence
  chemically synthesized
gggaaatctctgctgtgaca

SEQ ID NO: 93269 - DNA, 20 bp, Artificial Sequence
  chemically synthesized
aacatggttctttgtcacag

SEQ ID NO: 93270 - DNA, 20 bp, Artificial Sequence
  chemically synthesized
catggttctttgtcacagca

SEQ ID NO: 93271 - DNA, 20 bp, Artificial Sequence
  chemically synthesized
acagcagagatttcccatca

SEQ ID NO: 93272 - DNA, 20 bp, Artificial Sequence
  chemically synthesized
gcagagatttcccatcacag

SEQ ID NO: 93273 - DNA, 20 bp, Artificial Sequence
  chemically synthesized
aattcctatccttctgtgat

SEQ ID NO: 93274 - DNA, 20 bp, Artificial Sequence
  chemically synthesized
cagagatttcccatcacaga

SEQ ID NO: 93275 - DNA, 20 bp, Artificial Sequence
  chemically synthesized
caattcctatccttctgtga

SEQ ID NO: 93276 - DNA, 20 bp, Artificial Sequence
  chemically synthesized
gatttcccatcacagaagga

SEQ ID NO: 93277 - DNA, 20 bp, Artificial Sequence
  chemically synthesized
atttcccatcacagaaggat

SEQ ID NO: 93278 - DNA, 20 bp, Artificial Sequence
  chemically synthesized
atcacagaaggataggaatt

SEQ ID NO: 93279 - DNA, 20 bp, Artificial Sequence
  chemically synthesized
tcacagaaggataggaattg

SEQ ID NO: 93280 - DNA, 20 bp, Artificial Sequence
  chemically synthesized
cagaaggataggaattgagg

SEQ ID NO: 93281 - DNA, 20 bp, Artificial Sequence
  chemically synthesized
agaaggataggaattgagga

SEQ ID NO: 93282 - DNA, 20 bp, Artificial Sequence
  chemically synthesized
ggataggaattgaggaaggc

SEQ ID NO: 93283 - DNA, 20 bp, Artificial Sequence
  chemically synthesized
taggaattgaggaaggcaag

SEQ ID NO: 93284 - DNA, 20 bp, Artificial Sequence
  chemically synthesized
ggcaagtggatttgtaccta

SEQ ID NO: 93285 - DNA, 20 bp, Artificial Sequence
  chemically synthesized
caagtggatttgtacctatg

SEQ ID NO: 93286 - DNA, 20 bp, Artificial Sequence
  chemically synthesized
agtggatttgtacctatgga

SEQ ID NO: 93287 - DNA, 20 bp, Artificial Sequence
  chemically synthesized
aaaacaagacatctctccat

SEQ ID NO: 93288 - DNA, 20 bp, Artificial Sequence
  chemically synthesized
taaaacaagacatctctcca

SEQ ID NO: 93289 - DNA, 20 bp, Artificial Sequence
  chemically synthesized
agaaataaaataaataaaac

SEQ ID NO: 93290 - DNA, 20 bp, Artificial Sequence
  chemically synthesized
ttttatttattttatttcta

SEQ ID NO: 93291 - DNA, 20 bp, Artificial Sequence
  chemically synthesized
gtcttgtaaagtatgttctt

SEQ ID NO: 93292 - DNA, 20 bp, Artificial Sequence
  chemically synthesized
ttctaaagaacatactttac

SEQ ID NO: 93293 - DNA, 20 bp, Artificial Sequence
  chemically synthesized
acaacctaaagtgtcttgta

SEQ ID NO: 93294 - DNA, 20 bp, Artificial Sequence
  chemically synthesized
acatactttacaagacactt

SEQ ID NO: 93295 - DNA, 20 bp, Artificial Sequence
  chemically synthesized
catactttacaagacacttt

SEQ ID NO: 93296 - DNA, 20 bp, Artificial Sequence
  chemically synthesized
taatgcactgttacaaccta

SEQ ID NO: 93297 - DNA, 20 bp, Artificial Sequence
  chemically synthesized
caagacactttaggttgtaa

SEQ ID NO: 93298 - DNA, 20 bp, Artificial Sequence
  chemically synthesized
agtgcattaaaatacctaaa

SEQ ID NO: 93299 - DNA, 20 bp, Artificial Sequence
  chemically synthesized
aggatgctggtatactgttt

SEQ ID NO: 93300 - DNA, 20 bp, Artificial Sequence
  chemically synthesized
aaggatgctggtatactgtt

SEQ ID NO: 93301 - DNA, 20 bp, Artificial Sequence
  chemically synthesized
aaaatacctaaacagtatac

SEQ ID NO: 93302 - DNA, 20 bp, Artificial Sequence
  chemically synthesized
aaagtgttcctaaaggatgc

SEQ ID NO: 93303 - DNA, 20 bp, Artificial Sequence
  chemically synthesized
aacagtataccagcatcctt

SEQ ID NO: 93304 - DNA, 20 bp, Artificial Sequence
  chemically synthesized
acagtataccagcatccttt

SEQ ID NO: 93305 - DNA, 20 bp, Artificial Sequence
  chemically synthesized
taatagtaaagtgttcctaa

SEQ ID NO: 93306 - DNA, 20 bp, Artificial Sequence
  chemically synthesized
ataatagtaaagtgttccta

SEQ ID NO: 93307 - DNA, 20 bp, Artificial Sequence
  chemically synthesized
agatgagaaaaataatagta

SEQ ID NO: 93308 - DNA, 20 bp, Artificial Sequence
  chemically synthesized
aaaagagatgagaaaaataa

SEQ ID NO: 93309 - DNA, 20 bp, Artificial Sequence
  chemically synthesized
atatgagggacaaaagagat

SEQ ID NO: 93310 - DNA, 20 bp, Artificial Sequence
  chemically synthesized
tctagatatgagggacaaaa

SEQ ID NO: 93311 - DNA, 20 bp, Artificial Sequence
  chemically synthesized
catctagatatgagggacaa

SEQ ID NO: 93312 - DNA, 20 bp, Artificial Sequence
  chemically synthesized
tctcttttgtccctcatatc

SEQ ID NO: 93313 - DNA, 20 bp, Artificial Sequence
  chemically synthesized
aatttgacatctagatatga

SEQ ID NO: 93314 - DNA, 20 bp, Artificial Sequence
  chemically synthesized
aaatttgacatctagatatg

SEQ ID NO: 93315 - DNA, 20 bp, Artificial Sequence
  chemically synthesized
gaaatttgacatctagatat

SEQ ID NO: 93316 - DNA, 20 bp, Artificial Sequence
  chemically synthesized
gtcagtggaaatttgacatc

SEQ ID NO: 93317 - DNA, 20 bp, Artificial Sequence
  chemically synthesized
gatgtcaaatttccactgac

SEQ ID NO: 93318 - DNA, 20 bp, Artificial Sequence
  chemically synthesized
ggcatcaaattacttgtcag

SEQ ID NO: 93319 - DNA, 20 bp, Artificial Sequence
  chemically synthesized
ctaggcatcaaattacttgt

SEQ ID NO: 93320 - DNA, 20 bp, Artificial Sequence
  chemically synthesized
ctgacaagtaatttgatgcc

SEQ ID NO: 93321 - DNA, 20 bp, Artificial Sequence
  chemically synthesized
tgacaagtaatttgatgcct

SEQ ID NO: 93322 - DNA, 20 bp, Artificial Sequence
  chemically synthesized
gacaagtaatttgatgccta

SEQ ID NO: 93323 - DNA, 20 bp, Artificial Sequence
  chemically synthesized
ttgaatcgaatattttccct

SEQ ID NO: 93324 - DNA, 20 bp, Artificial Sequence
  chemically synthesized
gttgaatcgaatattttccc

SEQ ID NO: 93325 - DNA, 20 bp, Artificial Sequence
  chemically synthesized
agggaaaatattcgattcaa

SEQ ID NO: 93326 - DNA, 20 bp, Artificial Sequence
  chemically synthesized
tgtatcatgttttaattaat

SEQ ID NO: 93327 - DNA, 20 bp, Artificial Sequence
  chemically synthesized
gtgtatcatgttttaattaa

SEQ ID NO: 93328 - DNA, 20 bp, Artificial Sequence
  chemically synthesized
ttcatttggaaatttaatgt

SEQ ID NO: 93329 - DNA, 20 bp, Artificial Sequence
  chemically synthesized
acattaaatttccaaatgaa

SEQ ID NO: 93330 - DNA, 20 bp, Artificial Sequence
  chemically synthesized
cttctgggcttcttttcatt

SEQ ID NO: 93331 - DNA, 20 bp, Artificial Sequence
  chemically synthesized
ttaaatttccaaatgaaaag

SEQ ID NO: 93332 - DNA, 20 bp, Artificial Sequence
  chemically synthesized
tttccaaatgaaaagaagcc

SEQ ID NO: 93333 - DNA, 20 bp, Artificial Sequence
  chemically synthesized
ccaaatgaaaagaagcccag

SEQ ID NO: 93334 - DNA, 20 bp, Artificial Sequence
  chemically synthesized
gtttgtgatatttcacttct

SEQ ID NO: 93335 - DNA, 20 bp, Artificial Sequence
  chemically synthesized
agtttgtgatatttcacttc

SEQ ID NO: 93336 - DNA, 20 bp, Artificial Sequence
  chemically synthesized
tgtgactatacgtatgtatc

SEQ ID NO: 93337 - DNA, 20 bp, Artificial Sequence
  chemically synthesized
acaaacttgatacatacgta

SEQ ID NO: 93338 - DNA, 20 bp, Artificial Sequence
  chemically synthesized
gatacatacgtatagtcaca

SEQ ID NO: 93339 - DNA, 20 bp, Artificial Sequence
  chemically synthesized
tacatacgtatagtcacatg

SEQ ID NO: 93340 - DNA, 20 bp, Artificial Sequence
  chemically synthesized
acatacgtatagtcacatgg

SEQ ID NO: 93341 - DNA, 20 bp, Artificial Sequence
  chemically synthesized
catacgtatagtcacatgga

SEQ ID NO: 93342 - DNA, 20 bp, Artificial Sequence
  chemically synthesized
atacgtatagtcacatggag

SEQ ID NO: 93343 - DNA, 20 bp, Artificial Sequence
  chemically synthesized
cgtatagtcacatggagggg

SEQ ID NO: 93344 - DNA, 20 bp, Artificial Sequence
  chemically synthesized
tatagtcacatggaggggtg

SEQ ID NO: 93345 - DNA, 20 bp, Artificial Sequence
  chemically synthesized
atagtcacatggaggggtgg

SEQ ID NO: 93346 - DNA, 20 bp, Artificial Sequence
  chemically synthesized
tagtcacatggaggggtgga

SEQ ID NO: 93347 - DNA, 20 bp, Artificial Sequence
  chemically synthesized
tggaggggtggagggatact

SEQ ID NO: 93348 - DNA, 20 bp, Artificial Sequence
  chemically synthesized
ggaggggtggagggatacta

SEQ ID NO: 93349 - DNA, 20 bp, Artificial Sequence
  chemically synthesized
gggtggagggatactaagga

SEQ ID NO: 93350 - DNA, 20 bp, Artificial Sequence
  chemically synthesized
gaaaacacactgtctttcct

SEQ ID NO: 93351 - DNA, 20 bp, Artificial Sequence
  chemically synthesized
ggagggatactaaggaaaga

SEQ ID NO: 93352 - DNA, 20 bp, Artificial Sequence
  chemically synthesized
agacagtgtgttttcaaacc

SEQ ID NO: 93353 - DNA, 20 bp, Artificial Sequence
  chemically synthesized
tcacctcacacgtgcaagcc

SEQ ID NO: 93354 - DNA, 20 bp, Artificial Sequence
  chemically synthesized
ttcacctcacacgtgcaagc

SEQ ID NO: 93355 - DNA, 20 bp, Artificial Sequence
  chemically synthesized
agtgttcacctcacacgtgc

SEQ ID NO: 93356 - DNA, 20 bp, Artificial Sequence
  chemically synthesized
caaacctggcttgcacgtgt

SEQ ID NO: 93357 - DNA, 20 bp, Artificial Sequence
  chemically synthesized
aaacctggcttgcacgtgtg

SEQ ID NO: 93358 - DNA, 20 bp, Artificial Sequence
  chemically synthesized
tgcacgtgtgaggtgaacac

SEQ ID NO: 93359 - DNA, 20 bp, Artificial Sequence
  chemically synthesized
cacgtgtgaggtgaacactg

SEQ ID NO: 93360 - DNA, 20 bp, Artificial Sequence
  chemically synthesized
gtgaggtgaacactggagaa

SEQ ID NO: 93361 - DNA, 20 bp, Artificial Sequence
  chemically synthesized
gagaggtaagttctgttctc

SEQ ID NO: 93362 - DNA, 20 bp, Artificial Sequence
  chemically synthesized
agtgctgacagcagagaggt

SEQ ID NO: 93363 - DNA, 20 bp, Artificial Sequence
  chemically synthesized
tccaagtgctgacagcagag

SEQ ID NO: 93364 - DNA, 20 bp, Artificial Sequence
  chemically synthesized
ttccaagtgctgacagcaga

SEQ ID NO: 93365 - DNA, 20 bp, Artificial Sequence
  chemically synthesized
agaacttacctctctgctgt

SEQ ID NO: 93366 - DNA, 20 bp, Artificial Sequence
  chemically synthesized
tgttccaagtgctgacagca

SEQ ID NO: 93367 - DNA, 20 bp, Artificial Sequence
  chemically synthesized
gctgttccaagtgctgacag

SEQ ID NO: 93368 - DNA, 20 bp, Artificial Sequence
  chemically synthesized
agtgctgttccaagtgctga

SEQ ID NO: 93369 - DNA, 20 bp, Artificial Sequence
  chemically synthesized
acctctctgctgtcagcact

SEQ ID NO: 93370 - DNA, 20 bp, Artificial Sequence
  chemically synthesized
tctgctgtcagcacttggaa

SEQ ID NO: 93371 - DNA, 20 bp, Artificial Sequence
  chemically synthesized
agtgcgctcagtgctgttcc

SEQ ID NO: 93372 - DNA, 20 bp, Artificial Sequence
  chemically synthesized
tcagcacttggaacagcact

SEQ ID NO: 93373 - DNA, 20 bp, Artificial Sequence
  chemically synthesized
ttgagcgcctcgagtgcgct

SEQ ID NO: 93374 - DNA, 20 bp, Artificial Sequence
  chemically synthesized
gaacagcactgagcgcactc

SEQ ID NO: 93375 - DNA, 20 bp, Artificial Sequence
  chemically synthesized
aacagcactgagcgcactcg

SEQ ID NO: 93376 - DNA, 20 bp, Artificial Sequence
  chemically synthesized
ctcgatttattgagcgcctc

SEQ ID NO: 93377 - DNA, 20 bp, Artificial Sequence
  chemically synthesized
aaaattaagctcgatttatt

SEQ ID NO: 93378 - DNA, 20 bp, Artificial Sequence
  chemically synthesized
ctcgaggcgctcaataaatc

SEQ ID NO: 93379 - DNA, 20 bp, Artificial Sequence
  chemically synthesized
gcgaaaagatttaaaaaatt

SEQ ID NO: 93380 - DNA, 20 bp, Artificial Sequence
  chemically synthesized
gaatgggcgaagggagcgaa

SEQ ID NO: 93381 - DNA, 20 bp, Artificial Sequence
  chemically synthesized
atatgcagaatgggcgaagg

SEQ ID NO: 93382 - DNA, 20 bp, Artificial Sequence
  chemically synthesized
atatatgcagaatgggcgaa

SEQ ID NO: 93383 - DNA, 20 bp, Artificial Sequence
  chemically synthesized
gatatatgcagaatgggcga

SEQ ID NO: 93384 - DNA, 20 bp, Artificial Sequence
  chemically synthesized
agatatatgcagaatgggcg

SEQ ID NO: 93385 - DNA, 20 bp, Artificial Sequence
  chemically synthesized
acatgagatatatgcagaat

SEQ ID NO: 93386 - DNA, 20 bp, Artificial Sequence
  chemically synthesized
tacatgagatatatgcagaa

SEQ ID NO: 93387 - DNA, 20 bp, Artificial Sequence
  chemically synthesized
aattgtacatgagatatatg

SEQ ID NO: 93388 - DNA, 20 bp, Artificial Sequence
  chemically synthesized
tgggaaatgaaattgtacat

SEQ ID NO: 93389 - DNA, 20 bp, Artificial Sequence
  chemically synthesized
tgtacaatttcatttcccaa

SEQ ID NO: 93390 - DNA, 20 bp, Artificial Sequence
  chemically synthesized
tgttagaacctggtactttt

SEQ ID NO: 93391 - DNA, 20 bp, Artificial Sequence
  chemically synthesized
atttcatttcccaaaagtac

SEQ ID NO: 93392 - DNA, 20 bp, Artificial Sequence
  chemically synthesized
atgttagaacctggtacttt

SEQ ID NO: 93393 - DNA, 20 bp, Artificial Sequence
  chemically synthesized
tttcatttcccaaaagtacc

SEQ ID NO: 93394 - DNA, 20 bp, Artificial Sequence
  chemically synthesized
ttcttcctgatgttagaacc

SEQ ID NO: 93395 - DNA, 20 bp, Artificial Sequence
  chemically synthesized
aaagtaccaggttctaacat

SEQ ID NO: 93396 - DNA, 20 bp, Artificial Sequence
  chemically synthesized
aagtaccaggttctaacatc

SEQ ID NO: 93397 - DNA, 20 bp, Artificial Sequence
  chemically synthesized
atatattttcttcctgatgt

SEQ ID NO: 93398 - DNA, 20 bp, Artificial Sequence
  chemically synthesized
taccaggttctaacatcagg

SEQ ID NO: 93399 - DNA, 20 bp, Artificial Sequence
  chemically synthesized
aacatcaggaagaaaatata

SEQ ID NO: 93400 - DNA, 20 bp, Artificial Sequence
  chemically synthesized
tcaggaagaaaatatatggt

SEQ ID NO: 93401 - DNA, 20 bp, Artificial Sequence
  chemically synthesized
tggtgagtattgaccatttc

SEQ ID NO: 93402 - DNA, 20 bp, Artificial Sequence
  chemically synthesized
tgagtattgaccatttctgg

SEQ ID NO: 93403 - DNA, 20 bp, Artificial Sequence
  chemically synthesized
gagaccttgaccaccagaaa

SEQ ID NO: 93404 - DNA, 20 bp, Artificial Sequence
  chemically synthesized
attgaccatttctggtggtc

SEQ ID NO: 93405 - DNA, 20 bp, Artificial Sequence
  chemically synthesized
ttgaccatttctggtggtca

SEQ ID NO: 93406 - DNA, 20 bp, Artificial Sequence
  chemically synthesized
agagtagagaccttgaccac

SEQ ID NO: 93407 - DNA, 20 bp, Artificial Sequence
  chemically synthesized
attacatgagattaagagta

SEQ ID NO: 93408 - DNA, 20 bp, Artificial Sequence
  chemically synthesized
taattacatgagattaagag

SEQ ID NO: 93409 - DNA, 20 bp, Artificial Sequence
  chemically synthesized
ccctaattacatgagattaa

SEQ ID NO: 93410 - DNA, 20 bp, Artificial Sequence
  chemically synthesized
caccctaattacatgagatt

SEQ ID NO: 93411 - DNA, 20 bp, Artificial Sequence
  chemically synthesized
tactcttaatctcatgtaat

SEQ ID NO: 93412 - DNA, 20 bp, Artificial Sequence
  chemically synthesized
taggatcaccctaattacat

SEQ ID NO: 93413 - DNA, 20 bp, Artificial Sequence
  chemically synthesized
actcttaatctcatgtaatt

SEQ ID NO: 93414 - DNA, 20 bp, Artificial Sequence
  chemically synthesized
ctcttaatctcatgtaatta

SEQ ID NO: 93415 - DNA, 20 bp, Artificial Sequence
  chemically synthesized
atgtaattagggtgatccta

SEQ ID NO: 93416 - DNA, 20 bp, Artificial Sequence
  chemically synthesized
aggtttggacaatgaactat

SEQ ID NO: 93417 - DNA, 20 bp, Artificial Sequence
  chemically synthesized
caggtttggacaatgaacta

SEQ ID NO: 93418 - DNA, 20 bp, Artificial Sequence
  chemically synthesized
ctctcaaaagtgttcaggtt

SEQ ID NO: 93419 - DNA, 20 bp, Artificial Sequence
  chemically synthesized
ggacactctcaaaagtgttc

SEQ ID NO: 93420 - DNA, 20 bp, Artificial Sequence
  chemically synthesized
tggacactctcaaaagtgtt

SEQ ID NO: 93421 - DNA, 20 bp, Artificial Sequence
  chemically synthesized
gtccaaacctgaacactttt

SEQ ID NO: 93422 - DNA, 20 bp, Artificial Sequence
  chemically synthesized
ccaaacctgaacacttttga

SEQ ID NO: 93423 - DNA, 20 bp, Artificial Sequence
  chemically synthesized
agcatcctggacactctcaa

SEQ ID NO: 93424 - DNA, 20 bp, Artificial Sequence
  chemically synthesized
tgaacacttttgagagtgtc

SEQ ID NO: 93425 - DNA, 20 bp, Artificial Sequence
  chemically synthesized
gaacacttttgagagtgtcc

SEQ ID NO: 93426 - DNA, 20 bp, Artificial Sequence
  chemically synthesized
tgtgattattattagcatcc

SEQ ID NO: 93427 - DNA, 20 bp, Artificial Sequence
  chemically synthesized
tgaccctgtgtgattattat

SEQ ID NO: 93428 - DNA, 20 bp, Artificial Sequence
  chemically synthesized
ggatgctaataataatcaca

SEQ ID NO: 93429 - DNA, 20 bp, Artificial Sequence
  chemically synthesized
gatgctaataataatcacac

SEQ ID NO: 93430 - DNA, 20 bp, Artificial Sequence
  chemically synthesized
atgctaataataatcacaca

SEQ ID NO: 93431 - DNA, 20 bp, Artificial Sequence
  chemically synthesized
taataataatcacacagggt

SEQ ID NO: 93432 - DNA, 20 bp, Artificial Sequence
  chemically synthesized
aataataatcacacagggtc

SEQ ID NO: 93433 - DNA, 20 bp, Artificial Sequence
  chemically synthesized
tcacacagggtcaggcacac

SEQ ID NO: 93434 - DNA, 20 bp, Artificial Sequence
  chemically synthesized
cctggattacaggcatgagc

SEQ ID NO: 93435 - DNA, 20 bp, Artificial Sequence
  chemically synthesized
agcacctggattacaggcat

SEQ ID NO: 93436 - DNA, 20 bp, Artificial Sequence
  chemically synthesized
actggctcatgcctgtaatc

SEQ ID NO: 93437 - DNA, 20 bp, Artificial Sequence
  chemically synthesized
ctggctcatgcctgtaatcc

SEQ ID NO: 93438 - DNA, 20 bp, Artificial Sequence
  chemically synthesized
tcccaaagcacctggattac

SEQ ID NO: 93439 - DNA, 20 bp, Artificial Sequence
  chemically synthesized
ctcccaaagcacctggatta

SEQ ID NO: 93440 - DNA, 20 bp, Artificial Sequence
  chemically synthesized
tgcctgtaatccaggtgctt

SEQ ID NO: 93441 - DNA, 20 bp, Artificial Sequence
  chemically synthesized
cctcggcctcccaaagcacc

SEQ ID NO: 93442 - DNA, 20 bp, Artificial Sequence
  chemically synthesized
gcctgtaatccaggtgcttt

SEQ ID NO: 93443 - DNA, 20 bp, Artificial Sequence
  chemically synthesized
ctgtaatccaggtgctttgg

SEQ ID NO: 93444 - DNA, 20 bp, Artificial Sequence
  chemically synthesized
tgtaatccaggtgctttggg

SEQ ID NO: 93445 - DNA, 20 bp, Artificial Sequence
  chemically synthesized
actcctacctcggcctccca

SEQ ID NO: 93446 - DNA, 20 bp, Artificial Sequence
  chemically synthesized
tccaggtgctttgggaggcc

SEQ ID NO: 93447 - DNA, 20 bp, Artificial Sequence
  chemically synthesized
ccaggtgctttgggaggccg

SEQ ID NO: 93448 - DNA, 20 bp, Artificial Sequence
  chemically synthesized
ggtgctttgggaggccgagg

SEQ ID NO: 93449 - DNA, 20 bp, Artificial Sequence
  chemically synthesized
gtgctttgggaggccgaggt

SEQ ID NO: 93450 - DNA, 20 bp, Artificial Sequence
  chemically synthesized
gctttgggaggccgaggtag

SEQ ID NO: 93451 - DNA, 20 bp, Artificial Sequence
  chemically synthesized
ttcaagcaatactcctacct

SEQ ID NO: 93452 - DNA, 20 bp, Artificial Sequence
  chemically synthesized
cgaggtaggagtattgcttg

SEQ ID NO: 93453 - DNA, 20 bp, Artificial Sequence
  chemically synthesized
gtaggagtattgcttgaagc

SEQ ID NO: 93454 - DNA, 20 bp, Artificial Sequence
  chemically synthesized
taggagtattgcttgaagcc

SEQ ID NO: 93455 - DNA, 20 bp, Artificial Sequence
  chemically synthesized
gatctcaaactcctggcttc

SEQ ID NO: 93456 - DNA, 20 bp, Artificial Sequence
  chemically synthesized
ggagtattgcttgaagccag

SEQ ID NO: 93457 - DNA, 20 bp, Artificial Sequence
  chemically synthesized
ttgcttgaagccaggagttt

SEQ ID NO: 93458 - DNA, 20 bp, Artificial Sequence
  chemically synthesized
ccaggctgatctcaaactcc

SEQ ID NO: 93459 - DNA, 20 bp, Artificial Sequence
  chemically synthesized
tgaagccaggagtttgagat

SEQ ID NO: 93460 - DNA, 20 bp, Artificial Sequence
  chemically synthesized
ccaggagtttgagatcagcc

SEQ ID NO: 93461 - DNA, 20 bp, Artificial Sequence
  chemically synthesized
caggagtttgagatcagcct

SEQ ID NO: 93462 - DNA, 20 bp, Artificial Sequence
  chemically synthesized
agagtcatgctacattgccc

SEQ ID NO: 93463 - DNA, 20 bp, Artificial Sequence
  chemically synthesized
tgagatcagcctgggcaatg

SEQ ID NO: 93464 - DNA, 20 bp, Artificial Sequence
  chemically synthesized
aagagtcatgctacattgcc

SEQ ID NO: 93465 - DNA, 20 bp, Artificial Sequence
  chemically synthesized
aaaacatattgtagagataa

SEQ ID NO: 93466 - DNA, 20 bp, Artificial Sequence
  chemically synthesized
ttaaaacatattgtagagat

SEQ ID NO: 93467 - DNA, 20 bp, Artificial Sequence
  chemically synthesized
aatttttaaaacatattgta

SEQ ID NO: 93468 - DNA, 20 bp, Artificial Sequence
  chemically synthesized
ttaatttttaaaacatattg

SEQ ID NO: 93469 - DNA, 20 bp, Artificial Sequence
  chemically synthesized
taaaaataaaaataaaaaaa

SEQ ID NO: 93470 - DNA, 20 bp, Artificial Sequence
  chemically synthesized
taaaaataaaaaaacagtta

SEQ ID NO: 93471 - DNA, 20 bp, Artificial Sequence
  chemically synthesized
aaaaataaaaaaacagttaa

SEQ ID NO: 93472 - DNA, 20 bp, Artificial Sequence
  chemically synthesized
aaataaaaaaacagttaaag

SEQ ID NO: 93473 - DNA, 20 bp, Artificial Sequence
  chemically synthesized
aaaaacagttaaaggagttt

SEQ ID NO: 93474 - DNA, 20 bp, Artificial Sequence
  chemically synthesized
cagttaaaggagtttgagaa

SEQ ID NO: 93475 - DNA, 20 bp, Artificial Sequence
  chemically synthesized
aaaggagtttgagaacagcc

SEQ ID NO: 93476 - DNA, 20 bp, Artificial Sequence
  chemically synthesized
agagtttcgccatgttggcc

SEQ ID NO: 93477 - DNA, 20 bp, Artificial Sequence
  chemically synthesized
tgagaacagcctggccaaca

SEQ ID NO: 93478 - DNA, 20 bp, Artificial Sequence
  chemically synthesized
cagagtttcgccatgttggc

SEQ ID NO: 93479 - DNA, 20 bp, Artificial Sequence
  chemically synthesized
gagacagagtttcgccatgt

SEQ ID NO: 93480 - DNA, 20 bp, Artificial Sequence
  chemically synthesized
ttgtatttttagtagagaca

SEQ ID NO: 93481 - DNA, 20 bp, Artificial Sequence
  chemically synthesized
ttttgtatttttagtagaga

SEQ ID NO: 93482 - DNA, 20 bp, Artificial Sequence
  chemically synthesized
taatttttgtatttttagta

SEQ ID NO: 93483 - DNA, 20 bp, Artificial Sequence
  chemically synthesized
gctaatttttgtatttttag

SEQ ID NO: 93484 - DNA, 20 bp, Artificial Sequence
  chemically synthesized
cctgctaatttttgtatttt

SEQ ID NO: 93485 - DNA, 20 bp, Artificial Sequence
  chemically synthesized
tctactaaaaatacaaaaat

SEQ ID NO: 93486 - DNA, 20 bp, Artificial Sequence
  chemically synthesized
actaaaaatacaaaaattag

SEQ ID NO: 93487 - DNA, 20 bp, Artificial Sequence
  chemically synthesized
ctaaaaatacaaaaattagc

SEQ ID NO: 93488 - DNA, 20 bp, Artificial Sequence
  chemically synthesized
taaaaatacaaaaattagca

SEQ ID NO: 93489 - DNA, 20 bp, Artificial Sequence
  chemically synthesized
atacaaaaattagcagggca

SEQ ID NO: 93490 - DNA, 20 bp, Artificial Sequence
  chemically synthesized
caaaaattagcagggcatgg

SEQ ID NO: 93491 - DNA, 20 bp, Artificial Sequence
  chemically synthesized
aaattagcagggcatggtgg

SEQ ID NO: 93492 - DNA, 20 bp, Artificial Sequence
  chemically synthesized
aattagcagggcatggtggt

SEQ ID NO: 93493 - DNA, 20 bp, Artificial Sequence
  chemically synthesized
gtggtgggcacctgtaatcc

SEQ ID NO: 93494 - DNA, 20 bp, Artificial Sequence
  chemically synthesized
tcctgagtagctgggattac

SEQ ID NO: 93495 - DNA, 20 bp, Artificial Sequence
  chemically synthesized
ctcctgagtagctgggatta

SEQ ID NO: 93496 - DNA, 20 bp, Artificial Sequence
  chemically synthesized
cacctgtaatcccagctact

SEQ ID NO: 93497 - DNA, 20 bp, Artificial Sequence
  chemically synthesized
cctcagcctcctgagtagct

SEQ ID NO: 93498 - DNA, 20 bp, Artificial Sequence
  chemically synthesized
acctgtaatcccagctactc

SEQ ID NO: 93499 - DNA, 20 bp, Artificial Sequence
  chemically synthesized
gcctcagcctcctgagtagc

SEQ ID NO: 93500 - DNA, 20 bp, Artificial Sequence
  chemically synthesized
ctgtaatcccagctactcag

SEQ ID NO: 93501 - DNA, 20 bp, Artificial Sequence
  chemically synthesized
tgtaatcccagctactcagg

SEQ ID NO: 93502 - DNA, 20 bp, Artificial Sequence
  chemically synthesized
tcctgcctcagcctcctgag

SEQ ID NO: 93503 - DNA, 20 bp, Artificial Sequence
  chemically synthesized
ttctcctgcctcagcctcct

SEQ ID NO: 93504 - DNA, 20 bp, Artificial Sequence
  chemically synthesized
tcccagctactcaggaggct

SEQ ID NO: 93505 - DNA, 20 bp, Artificial Sequence
  chemically synthesized
cccagctactcaggaggctg

SEQ ID NO: 93506 - DNA, 20 bp, Artificial Sequence
  chemically synthesized
agctactcaggaggctgagg

SEQ ID NO: 93507 - DNA, 20 bp, Artificial Sequence
  chemically synthesized
gctactcaggaggctgaggc

SEQ ID NO: 93508 - DNA, 20 bp, Artificial Sequence
  chemically synthesized
tactcaggaggctgaggcag

SEQ ID NO: 93509 - DNA, 20 bp, Artificial Sequence
  chemically synthesized
ttcaagcgattctcctgcct

SEQ ID NO: 93510 - DNA, 20 bp, Artificial Sequence
  chemically synthesized
gcaggagaatcgcttgaacc

SEQ ID NO: 93511 - DNA, 20 bp, Artificial Sequence
  chemically synthesized
caggagaatcgcttgaaccc

SEQ ID NO: 93512 - DNA, 20 bp, Artificial Sequence
  chemically synthesized
aacctccacctcccgggttc

SEQ ID NO: 93513 - DNA, 20 bp, Artificial Sequence
  chemically synthesized
ggagaatcgcttgaacccgg

SEQ ID NO: 93514 - DNA, 20 bp, Artificial Sequence
  chemically synthesized
gagaatcgcttgaacccggg

SEQ ID NO: 93515 - DNA, 20 bp, Artificial Sequence
  chemically synthesized
aatcgcttgaacccgggagg

SEQ ID NO: 93516 - DNA, 20 bp, Artificial Sequence
  chemically synthesized
cactgcaacctccacctccc

SEQ ID NO: 93517 - DNA, 20 bp, Artificial Sequence
  chemically synthesized
tcgcttgaacccgggaggtg

SEQ ID NO: 93518 - DNA, 20 bp, Artificial Sequence
  chemically synthesized
tcactgcaacctccacctcc

SEQ ID NO: 93519 - DNA, 20 bp, Artificial Sequence
  chemically synthesized
cgcttgaacccgggaggtgg

SEQ ID NO: 93520 - DNA, 20 bp, Artificial Sequence
  chemically synthesized
aacccgggaggtggaggttg

SEQ ID NO: 93521 - DNA, 20 bp, Artificial Sequence
  chemically synthesized
cgggaggtggaggttgcagt

SEQ ID NO: 93522 - DNA, 20 bp, Artificial Sequence
  chemically synthesized
ggtggaggttgcagtgagcc

SEQ ID NO: 93523 - DNA, 20 bp, Artificial Sequence
  chemically synthesized
gcagtgcagtggtgcgatct

SEQ ID NO: 93524 - DNA, 20 bp, Artificial Sequence
  chemically synthesized
tcacccaagctgcagtgcag

SEQ ID NO: 93525 - DNA, 20 bp, Artificial Sequence
  chemically synthesized
gagatcgcaccactgcactg

SEQ ID NO: 93526 - DNA, 20 bp, Artificial Sequence
  chemically synthesized
ctgtcacccaagctgcagtg

SEQ ID NO: 93527 - DNA, 20 bp, Artificial Sequence
  chemically synthesized
cgcaccactgcactgcagct

SEQ ID NO: 93528 - DNA, 20 bp, Artificial Sequence
  chemically synthesized
gcaccactgcactgcagctt

SEQ ID NO: 93529 - DNA, 20 bp, Artificial Sequence
  chemically synthesized
tcgctctgtcacccaagctg

SEQ ID NO: 93530 - DNA, 20 bp, Artificial Sequence
  chemically synthesized
ctgcactgcagcttgggtga

SEQ ID NO: 93531 - DNA, 20 bp, Artificial Sequence
  chemically synthesized
ggagtctcgctctgtcaccc

SEQ ID NO: 93532 - DNA, 20 bp, Artificial Sequence
  chemically synthesized
gcactgcagcttgggtgaca

SEQ ID NO: 93533 - DNA, 20 bp, Artificial Sequence
  chemically synthesized
tgcagcttgggtgacagagc

SEQ ID NO: 93534 - DNA, 20 bp, Artificial Sequence
  chemically synthesized
ttttttttttttttgaaatg

SEQ ID NO: 93535 - DNA, 20 bp, Artificial Sequence
  chemically synthesized
aattttttttttttttgaaa

SEQ ID NO: 93536 - DNA, 20 bp, Artificial Sequence
  chemically synthesized
atttcaaaaaaaaaaaaaat

SEQ ID NO: 93537 - DNA, 20 bp, Artificial Sequence
  chemically synthesized
tttcaaaaaaaaaaaaaatt

SEQ ID NO: 93538 - DNA, 20 bp, Artificial Sequence
  chemically synthesized
caaaaaaaaaaaaaattagg

SEQ ID NO: 93539 - DNA, 20 bp, Artificial Sequence
  chemically synthesized
aaaaaaaaaaaaaattaggt

SEQ ID NO: 93540 - DNA, 20 bp, Artificial Sequence
  chemically synthesized
aaaaaaaaattaggtgggca

SEQ ID NO: 93541 - DNA, 20 bp, Artificial Sequence
  chemically synthesized
aaaaaattaggtgggcatag

SEQ ID NO: 93542 - DNA, 20 bp, Artificial Sequence
  chemically synthesized
taggtgggcatagtggtgca

SEQ ID NO: 93543 - DNA, 20 bp, Artificial Sequence
  chemically synthesized
gtggtgcacagctataatcc

SEQ ID NO: 93544 - DNA, 20 bp, Artificial Sequence
  chemically synthesized
ctactgagtagccaggatta

SEQ ID NO: 93545 - DNA, 20 bp, Artificial Sequence
  chemically synthesized
cagctataatcctggctact

SEQ ID NO: 93546 - DNA, 20 bp, Artificial Sequence
  chemically synthesized
cttcagcctactgagtagcc

SEQ ID NO: 93547 - DNA, 20 bp, Artificial Sequence
  chemically synthesized
ccttcagcctactgagtagc

SEQ ID NO: 93548 - DNA, 20 bp, Artificial Sequence
  chemically synthesized
ctataatcctggctactcag

SEQ ID NO: 93549 - DNA, 20 bp, Artificial Sequence
  chemically synthesized
tataatcctggctactcagt

SEQ ID NO: 93550 - DNA, 20 bp, Artificial Sequence
  chemically synthesized
tcctccttcagcctactgag

SEQ ID NO: 93551 - DNA, 20 bp, Artificial Sequence
  chemically synthesized
tcctcctccttcagcctact

SEQ ID NO: 93552 - DNA, 20 bp, Artificial Sequence
  chemically synthesized
cctggctactcagtaggctg

SEQ ID NO: 93553 - DNA, 20 bp, Artificial Sequence
  chemically synthesized
ctggctactcagtaggctga

SEQ ID NO: 93554 - DNA, 20 bp, Artificial Sequence
  chemically synthesized
ggctactcagtaggctgaag

SEQ ID NO: 93555 - DNA, 20 bp, Artificial Sequence
  chemically synthesized
gctactcagtaggctgaagg

SEQ ID NO: 93556 - DNA, 20 bp, Artificial Sequence
  chemically synthesized
tactcagtaggctgaaggag

SEQ ID NO: 93557 - DNA, 20 bp, Artificial Sequence
  chemically synthesized
actcagtaggctgaaggagg

SEQ ID NO: 93558 - DNA, 20 bp, Artificial Sequence
  chemically synthesized
ctcaagcaatcctcctcctt

SEQ ID NO: 93559 - DNA, 20 bp, Artificial Sequence
  chemically synthesized
ctgaaggaggaggattgctt

SEQ ID NO: 93560 - DNA, 20 bp, Artificial Sequence
  chemically synthesized
ggaggaggattgcttgagct

SEQ ID NO: 93561 - DNA, 20 bp, Artificial Sequence
  chemically synthesized
gaggaggattgcttgagctc

SEQ ID NO: 93562 - DNA, 20 bp, Artificial Sequence
  chemically synthesized
agcctcaaactcctgagctc

SEQ ID NO: 93563 - DNA, 20 bp, Artificial Sequence
  chemically synthesized
ggaggattgcttgagctcag

SEQ ID NO: 93564 - DNA, 20 bp, Artificial Sequence
  chemically synthesized
cactgcagcctcaaactcct

SEQ ID NO: 93565 - DNA, 20 bp, Artificial Sequence
  chemically synthesized
ttgcttgagctcaggagttt

SEQ ID NO: 93566 - DNA, 20 bp, Artificial Sequence
  chemically synthesized
tgcttgagctcaggagtttg

SEQ ID NO: 93567 - DNA, 20 bp, Artificial Sequence
  chemically synthesized
agctcaggagtttgaggctg

SEQ ID NO: 93568 - DNA, 20 bp, Artificial Sequence
  chemically synthesized
caggagtttgaggctgcagt

SEQ ID NO: 93569 - DNA, 20 bp, Artificial Sequence
  chemically synthesized
ggcatgatcatagctcactg

SEQ ID NO: 93570 - DNA, 20 bp, Artificial Sequence
  chemically synthesized
ggagtggagtggcatgatca

SEQ ID NO: 93571 - DNA, 20 bp, Artificial Sequence
  chemically synthesized
tcacccaggctggagtggag

SEQ ID NO: 93572 - DNA, 20 bp, Artificial Sequence
  chemically synthesized
atgatcatgccactccactc

SEQ ID NO: 93573 - DNA, 20 bp, Artificial Sequence
  chemically synthesized
ctgtcacccaggctggagtg

SEQ ID NO: 93574 - DNA, 20 bp, Artificial Sequence
  chemically synthesized
ctctgtcacccaggctggag

SEQ ID NO: 93575 - DNA, 20 bp, Artificial Sequence
  chemically synthesized
catgccactccactccagcc

SEQ ID NO: 93576 - DNA, 20 bp, Artificial Sequence
  chemically synthesized
atgccactccactccagcct

SEQ ID NO: 93577 - DNA, 20 bp, Artificial Sequence
  chemically synthesized
ttgctctgtcacccaggctg

SEQ ID NO: 93578 - DNA, 20 bp, Artificial Sequence
  chemically synthesized
tcttgctctgtcacccaggc

SEQ ID NO: 93579 - DNA, 20 bp, Artificial Sequence
  chemically synthesized
ctccactccagcctgggtga

SEQ ID NO: 93580 - DNA, 20 bp, Artificial Sequence
  chemically synthesized
agagtcttgctctgtcaccc

SEQ ID NO: 93581 - DNA, 20 bp, Artificial Sequence
  chemically synthesized
ccactccagcctgggtgaca

SEQ ID NO: 93582 - DNA, 20 bp, Artificial Sequence
  chemically synthesized
cagagtcttgctctgtcacc

SEQ ID NO: 93583 - DNA, 20 bp, Artificial Sequence
  chemically synthesized
tccagcctgggtgacagagc

SEQ ID NO: 93584 - DNA, 20 bp, Artificial Sequence
  chemically synthesized
ttttatttattttagagaca

SEQ ID NO: 93585 - DNA, 20 bp, Artificial Sequence
  chemically synthesized
tattttatttattttagaga

SEQ ID NO: 93586 - DNA, 20 bp, Artificial Sequence
  chemically synthesized
attttattttatttatttta

SEQ ID NO: 93587 - DNA, 20 bp, Artificial Sequence
  chemically synthesized
ttattttattttatttattt

SEQ ID NO: 93588 - DNA, 20 bp, Artificial Sequence
  chemically synthesized
aaataaaataaaataaaata

SEQ ID NO: 93589 - DNA, 20 bp, Artificial Sequence
  chemically synthesized
aaataaaataaaatatagta

SEQ ID NO: 93590 - DNA, 20 bp, Artificial Sequence
  chemically synthesized
aaataaaatatagtaaagta

SEQ ID NO: 93591 - DNA, 20 bp, Artificial Sequence
  chemically synthesized
atagtaaagtaaagtaacac

SEQ ID NO: 93592 - DNA, 20 bp, Artificial Sequence
  chemically synthesized
gtaaagtaacacaagaataa

SEQ ID NO: 93593 - DNA, 20 bp, Artificial Sequence
  chemically synthesized
taaagtaacacaagaataac

SEQ ID NO: 93594 - DNA, 20 bp, Artificial Sequence
  chemically synthesized
aaagtaacacaagaataaca

SEQ ID NO: 93595 - DNA, 20 bp, Artificial Sequence
  chemically synthesized
caagaataacagggataaac

SEQ ID NO: 93596 - DNA, 20 bp, Artificial Sequence
  chemically synthesized
aagaataacagggataaact

SEQ ID NO: 93597 - DNA, 20 bp, Artificial Sequence
  chemically synthesized
ataacagggataaactggga

SEQ ID NO: 93598 - DNA, 20 bp, Artificial Sequence
  chemically synthesized
cagggataaactgggacagc

SEQ ID NO: 93599 - DNA, 20 bp, Artificial Sequence
  chemically synthesized
taatttgtctccggctgtcc

SEQ ID NO: 93600 - DNA, 20 bp, Artificial Sequence
  chemically synthesized
gggataaactgggacagccg

SEQ ID NO: 93601 - DNA, 20 bp, Artificial Sequence
  chemically synthesized
catctatcctaatttgtctc

SEQ ID NO: 93602 - DNA, 20 bp, Artificial Sequence
  chemically synthesized
tgggacagccggagacaaat

SEQ ID NO: 93603 - DNA, 20 bp, Artificial Sequence
  chemically synthesized
gggacagccggagacaaatt

SEQ ID NO: 93604 - DNA, 20 bp, Artificial Sequence
  chemically synthesized
cagccggagacaaattagga

SEQ ID NO: 93605 - DNA, 20 bp, Artificial Sequence
  chemically synthesized
aattaggatagatgaaccta

SEQ ID NO: 93606 - DNA, 20 bp, Artificial Sequence
  chemically synthesized
taggatagatgaacctatag

SEQ ID NO: 93607 - DNA, 20 bp, Artificial Sequence
  chemically synthesized
cccattttattgactgctat

SEQ ID NO: 93608 - DNA, 20 bp, Artificial Sequence
  chemically synthesized
gcccattttattgactgcta

SEQ ID NO: 93609 - DNA, 20 bp, Artificial Sequence
  chemically synthesized
acctatagcagtcaataaaa

SEQ ID NO: 93610 - DNA, 20 bp, Artificial Sequence
  chemically synthesized
cctatagcagtcaataaaat

SEQ ID NO: 93611 - DNA, 20 bp, Artificial Sequence
  chemically synthesized
gcagtcaataaaatgggcaa

SEQ ID NO: 93612 - DNA, 20 bp, Artificial Sequence
  chemically synthesized
cagtcaataaaatgggcaaa

SEQ ID NO: 93613 - DNA, 20 bp, Artificial Sequence
  chemically synthesized
agtcaataaaatgggcaaaa

SEQ ID NO: 93614 - DNA, 20 bp, Artificial Sequence
  chemically synthesized
taaaatgggcaaaagggtct

SEQ ID NO: 93615 - DNA, 20 bp, Artificial Sequence
  chemically synthesized
aatgggcaaaagggtctcag

SEQ ID NO: 93616 - DNA, 20 bp, Artificial Sequence
  chemically synthesized
gggcaaaagggtctcagtag

SEQ ID NO: 93617 - DNA, 20 bp, Artificial Sequence
  chemically synthesized
aggctgcctctgctgctact

SEQ ID NO: 93618 - DNA, 20 bp, Artificial Sequence
  chemically synthesized
caaaagggtctcagtagcag

SEQ ID NO: 93619 - DNA, 20 bp, Artificial Sequence
  chemically synthesized
aaagggtctcagtagcagca

SEQ ID NO: 93620 - DNA, 20 bp, Artificial Sequence
  chemically synthesized
aagggtctcagtagcagcag

SEQ ID NO: 93621 - DNA, 20 bp, Artificial Sequence
  chemically synthesized
ggtctcagtagcagcagagg

SEQ ID NO: 93622 - DNA, 20 bp, Artificial Sequence
  chemically synthesized
gagagaatgagcgggaagaa

SEQ ID NO: 93623 - DNA, 20 bp, Artificial Sequence
  chemically synthesized
ggagagaatgagcgggaaga

SEQ ID NO: 93624 - DNA, 20 bp, Artificial Sequence
  chemically synthesized
acttggagagaatgagcggg

SEQ ID NO: 93625 - DNA, 20 bp, Artificial Sequence
  chemically synthesized
gttacttggagagaatgagc

SEQ ID NO: 93626 - DNA, 20 bp, Artificial Sequence
  chemically synthesized
tgttacttggagagaatgag

SEQ ID NO: 93627 - DNA, 20 bp, Artificial Sequence
  chemically synthesized
ttttgttacttggagagaat

SEQ ID NO: 93628 - DNA, 20 bp, Artificial Sequence
  chemically synthesized
tcttcccgctcattctctcc

SEQ ID NO: 93629 - DNA, 20 bp, Artificial Sequence
  chemically synthesized
cagaccttttgttacttgga

SEQ ID NO: 93630 - DNA, 20 bp, Artificial Sequence
  chemically synthesized
cacagaccttttgttacttg

SEQ ID NO: 93631 - DNA, 20 bp, Artificial Sequence
  chemically synthesized
gtcacagaccttttgttact

SEQ ID NO: 93632 - DNA, 20 bp, Artificial Sequence
  chemically synthesized
tcattctctccaagtaacaa

SEQ ID NO: 93633 - DNA, 20 bp, Artificial Sequence
  chemically synthesized
cattctctccaagtaacaaa

SEQ ID NO: 93634 - DNA, 20 bp, Artificial Sequence
  chemically synthesized
agaaagagaacgtcgtgtca

SEQ ID NO: 93635 - DNA, 20 bp, Artificial Sequence
  chemically synthesized
cagtgaaccccaggcagaaa

SEQ ID NO: 93636 - DNA, 20 bp, Artificial Sequence
  chemically synthesized
cacgacgttctctttctgcc

SEQ ID NO: 93637 - DNA, 20 bp, Artificial Sequence
  chemically synthesized
acgacgttctctttctgcct

SEQ ID NO: 93638 - DNA, 20 bp, Artificial Sequence
  chemically synthesized
tgcagtgaaccccaggcaga

SEQ ID NO: 93639 - DNA, 20 bp, Artificial Sequence
  chemically synthesized
cgacgttctctttctgcctg

SEQ ID NO: 93640 - DNA, 20 bp, Artificial Sequence
  chemically synthesized
tgcgtgcagtgaaccccagg

SEQ ID NO: 93641 - DNA, 20 bp, Artificial Sequence
  chemically synthesized
cactgcgtgcagtgaacccc

SEQ ID NO: 93642 - DNA, 20 bp, Artificial Sequence
  chemically synthesized
tcactgcgtgcagtgaaccc

SEQ ID NO: 93643 - DNA, 20 bp, Artificial Sequence
  chemically synthesized
tgcctggggttcactgcacg

SEQ ID NO: 93644 - DNA, 20 bp, Artificial Sequence
  chemically synthesized
agtgatcaattcactgcgtg

SEQ ID NO: 93645 - DNA, 20 bp, Artificial Sequence
  chemically synthesized
ctgaatgtaagaaacaggtg

SEQ ID NO: 93646 - DNA, 20 bp, Artificial Sequence
  chemically synthesized
gttccctgaatgtaagaaac

SEQ ID NO: 93647 - DNA, 20 bp, Artificial Sequence
  chemically synthesized
cgttccctgaatgtaagaaa

SEQ ID NO: 93648 - DNA, 20 bp, Artificial Sequence
  chemically synthesized
ctgcacctgtttcttacatt

SEQ ID NO: 93649 - DNA, 20 bp, Artificial Sequence
  chemically synthesized
tgcacctgtttcttacattc

SEQ ID NO: 93650 - DNA, 20 bp, Artificial Sequence
  chemically synthesized
gcacctgtttcttacattca

SEQ ID NO: 93651 - DNA, 20 bp, Artificial Sequence
  chemically synthesized
gctttccgttccctgaatgt

SEQ ID NO: 93652 - DNA, 20 bp, Artificial Sequence
  chemically synthesized
tgtttcttacattcagggaa

SEQ ID NO: 93653 - DNA, 20 bp, Artificial Sequence
  chemically synthesized
tcttacattcagggaacgga

SEQ ID NO: 93654 - DNA, 20 bp, Artificial Sequence
  chemically synthesized
tacattcagggaacggaaag

SEQ ID NO: 93655 - DNA, 20 bp, Artificial Sequence
  chemically synthesized
cattcagggaacggaaagca

SEQ ID NO: 93656 - DNA, 20 bp, Artificial Sequence
  chemically synthesized
cagggaacggaaagcagaga

SEQ ID NO: 93657 - DNA, 20 bp, Artificial Sequence
  chemically synthesized
agggaacggaaagcagagaa

SEQ ID NO: 93658 - DNA, 20 bp, Artificial Sequence
  chemically synthesized
aacggaaagcagagaaaggc

SEQ ID NO: 93659 - DNA, 20 bp, Artificial Sequence
  chemically synthesized
ggaaagcagagaaaggccag

SEQ ID NO: 93660 - DNA, 20 bp, Artificial Sequence
  chemically synthesized
caaacagtggtgtgaaccac

SEQ ID NO: 93661 - DNA, 20 bp, Artificial Sequence
  chemically synthesized
gcacctgggtgcacaaacag

SEQ ID NO: 93662 - DNA, 20 bp, Artificial Sequence
  chemically synthesized
agggcacctgggtgcacaaa

SEQ ID NO: 93663 - DNA, 20 bp, Artificial Sequence
  chemically synthesized
cacaccactgtttgtgcacc

SEQ ID NO: 93664 - DNA, 20 bp, Artificial Sequence
  chemically synthesized
acaccactgtttgtgcaccc

SEQ ID NO: 93665 - DNA, 20 bp, Artificial Sequence
  chemically synthesized
cccacggtgagagggcacct

SEQ ID NO: 93666 - DNA, 20 bp, Artificial Sequence
  chemically synthesized
ccccacggtgagagggcacc

SEQ ID NO: 93667 - DNA, 20 bp, Artificial Sequence
  chemically synthesized
gtttactccccacggtgaga

SEQ ID NO: 93668 - DNA, 20 bp, Artificial Sequence
  chemically synthesized
acccaggtgccctctcaccg

SEQ ID NO: 93669 - DNA, 20 bp, Artificial Sequence
  chemically synthesized
tgtttactccccacggtgag

SEQ ID NO: 93670 - DNA, 20 bp, Artificial Sequence
  chemically synthesized
cccaggtgccctctcaccgt

SEQ ID NO: 93671 - DNA, 20 bp, Artificial Sequence
  chemically synthesized
gtgtttactccccacggtga

SEQ ID NO: 93672 - DNA, 20 bp, Artificial Sequence
  chemically synthesized
ccaggtgccctctcaccgtg

SEQ ID NO: 93673 - DNA, 20 bp, Artificial Sequence
  chemically synthesized
aggtgtttactccccacggt

SEQ ID NO: 93674 - DNA, 20 bp, Artificial Sequence
  chemically synthesized
aggtgccctctcaccgtggg

SEQ ID NO: 93675 - DNA, 20 bp, Artificial Sequence
  chemically synthesized
ccgaaggtgtttactcccca

SEQ ID NO: 93676 - DNA, 20 bp, Artificial Sequence
  chemically synthesized
ccgtggggagtaaacacctt

SEQ ID NO: 93677 - DNA, 20 bp, Artificial Sequence
  chemically synthesized
tccgtagcaaacagaaccga

SEQ ID NO: 93678 - DNA, 20 bp, Artificial Sequence
  chemically synthesized
ttccgtagcaaacagaaccg

SEQ ID NO: 93679 - DNA, 20 bp, Artificial Sequence
  chemically synthesized
accttcggttctgtttgcta

SEQ ID NO: 93680 - DNA, 20 bp, Artificial Sequence
  chemically synthesized
tttttcttttccgtagcaaa

SEQ ID NO: 93681 - DNA, 20 bp, Artificial Sequence
  chemically synthesized
cggttctgtttgctacggaa

SEQ ID NO: 93682 - DNA, 20 bp, Artificial Sequence
  chemically synthesized
cttttcatttttcttttccg

SEQ ID NO: 93683 - DNA, 20 bp, Artificial Sequence
  chemically synthesized
ctacggaaaagaaaaatgaa

SEQ ID NO: 93684 - DNA, 20 bp, Artificial Sequence
  chemically synthesized
acggaaaagaaaaatgaaaa

SEQ ID NO: 93685 - DNA, 20 bp, Artificial Sequence
  chemically synthesized
cggaaaagaaaaatgaaaag

SEQ ID NO: 93686 - DNA, 20 bp, Artificial Sequence
  chemically synthesized
ggaaaagaaaaatgaaaaga

SEQ ID NO: 93687 - DNA, 20 bp, Artificial Sequence
  chemically synthesized
tttgaagggcattttgttat

SEQ ID NO: 93688 - DNA, 20 bp, Artificial Sequence
  chemically synthesized
caataacaaaatgcccttca

SEQ ID NO: 93689 - DNA, 20 bp, Artificial Sequence
  chemically synthesized
cacaaagtgttttctttgaa

SEQ ID NO: 93690 - DNA, 20 bp, Artificial Sequence
  chemically synthesized
tcacaaagtgttttctttga

SEQ ID NO: 93691 - DNA, 20 bp, Artificial Sequence
  chemically synthesized
ctcacaaagtgttttctttg

SEQ ID NO: 93692 - DNA, 20 bp, Artificial Sequence
  chemically synthesized
cttcaaagaaaacactttgt

SEQ ID NO: 93693 - DNA, 20 bp, Artificial Sequence
  chemically synthesized
ttgctacacacaggctcaca

SEQ ID NO: 93694 - DNA, 20 bp, Artificial Sequence
  chemically synthesized
acactttgtgagcctgtgtg

SEQ ID NO: 93695 - DNA, 20 bp, Artificial Sequence
  chemically synthesized
ttcttatctttgctacacac

SEQ ID NO: 93696 - DNA, 20 bp, Artificial Sequence
  chemically synthesized
gttcttatctttgctacaca

SEQ ID NO: 93697 - DNA, 20 bp, Artificial Sequence
  chemically synthesized
ttgtgagcctgtgtgtagca

SEQ ID NO: 93698 - DNA, 20 bp, Artificial Sequence
  chemically synthesized
agcctgtgtgtagcaaagat

SEQ ID NO: 93699 - DNA, 20 bp, Artificial Sequence
  chemically synthesized
tgtgtagcaaagataagaac

SEQ ID NO: 93700 - DNA, 20 bp, Artificial Sequence
  chemically synthesized
gtgtagcaaagataagaact

SEQ ID NO: 93701 - DNA, 20 bp, Artificial Sequence
  chemically synthesized
tctttctcatgacagtgtcc

SEQ ID NO: 93702 - DNA, 20 bp, Artificial Sequence
  chemically synthesized
aagaactaggacactgtcat

SEQ ID NO: 93703 - DNA, 20 bp, Artificial Sequence
  chemically synthesized
ttctaggatctttctcatga

SEQ ID NO: 93704 - DNA, 20 bp, Artificial Sequence
  chemically synthesized
actaggacactgtcatgaga

SEQ ID NO: 93705 - DNA, 20 bp, Artificial Sequence
  chemically synthesized
cactgtcatgagaaagatcc

SEQ ID NO: 93706 - DNA, 20 bp, Artificial Sequence
  chemically synthesized
tcatgagaaagatcctagaa

SEQ ID NO: 93707 - DNA, 20 bp, Artificial Sequence
  chemically synthesized
ttctttcaagaagctattct

SEQ ID NO: 93708 - DNA, 20 bp, Artificial Sequence
  chemically synthesized
tttctttcaagaagctattc

SEQ ID NO: 93709 - DNA, 20 bp, Artificial Sequence
  chemically synthesized
atcctagaatagcttcttga

SEQ ID NO: 93710 - DNA, 20 bp, Artificial Sequence
  chemically synthesized
aaagaaatctttctttcaag

SEQ ID NO: 93711 - DNA, 20 bp, Artificial Sequence
  chemically synthesized
tagaatagcttcttgaaaga

SEQ ID NO: 93712 - DNA, 20 bp, Artificial Sequence
  chemically synthesized
tttaaagaaatctttctttc

SEQ ID NO: 93713 - DNA, 20 bp, Artificial Sequence
  chemically synthesized
attcttttttttttttttta

SEQ ID NO: 93714 - DNA, 20 bp, Artificial Sequence
  chemically synthesized
tttctttaaaaaaaaaaaaa

SEQ ID NO: 93715 - DNA, 20 bp, Artificial Sequence
  chemically synthesized
aaaaaaaaaaaaaagaatgc

SEQ ID NO: 93716 - DNA, 20 bp, Artificial Sequence
  chemically synthesized
ataatacacaatagatgtcg

SEQ ID NO: 93717 - DNA, 20 bp, Artificial Sequence
  chemically synthesized
atatggcagataatacacaa

SEQ ID NO: 93718 - DNA, 20 bp, Artificial Sequence
  chemically synthesized
atttgctaagagggatatgg

SEQ ID NO: 93719 - DNA, 20 bp, Artificial Sequence
  chemically synthesized
gtcatttgctaagagggata

SEQ ID NO: 93720 - DNA, 20 bp, Artificial Sequence
  chemically synthesized
attatctgccatatccctct

SEQ ID NO: 93721 - DNA, 20 bp, Artificial Sequence
  chemically synthesized
ttaatcgtcatttgctaaga

SEQ ID NO: 93722 - DNA, 20 bp, Artificial Sequence
  chemically synthesized
tttaatcgtcatttgctaag

SEQ ID NO: 93723 - DNA, 20 bp, Artificial Sequence
  chemically synthesized
ctttaatcgtcatttgctaa

SEQ ID NO: 93724 - DNA, 20 bp, Artificial Sequence
  chemically synthesized
aactttaatcgtcatttgct

SEQ ID NO: 93725 - DNA, 20 bp, Artificial Sequence
  chemically synthesized
ctcttagcaaatgacgatta

SEQ ID NO: 93726 - DNA, 20 bp, Artificial Sequence
  chemically synthesized
attaaagtttctgcatctgt

SEQ ID NO: 93727 - DNA, 20 bp, Artificial Sequence
  chemically synthesized
gtttgcattaccgacagatg

SEQ ID NO: 93728 - DNA, 20 bp, Artificial Sequence
  chemically synthesized
tttcccgtttgcattaccga

SEQ ID NO: 93729 - DNA, 20 bp, Artificial Sequence
  chemically synthesized
gcatctgtcggtaatgcaaa

SEQ ID NO: 93730 - DNA, 20 bp, Artificial Sequence
  chemically synthesized
catctgtcggtaatgcaaac

SEQ ID NO: 93731 - DNA, 20 bp, Artificial Sequence
  chemically synthesized
tgtcggtaatgcaaacggga

SEQ ID NO: 93732 - DNA, 20 bp, Artificial Sequence
  chemically synthesized
atttaaagtaaatttcagga

SEQ ID NO: 93733 - DNA, 20 bp, Artificial Sequence
  chemically synthesized
gaaaatttaaagtaaatttc

SEQ ID NO: 93734 - DNA, 20 bp, Artificial Sequence
  chemically synthesized
ggaaaatttaaagtaaattt

SEQ ID NO: 93735 - DNA, 20 bp, Artificial Sequence
  chemically synthesized
tctccgtaaaggaaaattta

SEQ ID NO: 93736 - DNA, 20 bp, Artificial Sequence
  chemically synthesized
ttactttaaattttccttta

SEQ ID NO: 93737 - DNA, 20 bp, Artificial Sequence
  chemically synthesized
actttaaattttcctttacg

SEQ ID NO: 93738 - DNA, 20 bp, Artificial Sequence
  chemically synthesized
aatgaatcatttctccgtaa

SEQ ID NO: 93739 - DNA, 20 bp, Artificial Sequence
  chemically synthesized
gaatgaatcatttctccgta

SEQ ID NO: 93740 - DNA, 20 bp, Artificial Sequence
  chemically synthesized
tatcaggtatgaaatacagg

SEQ ID NO: 93741 - DNA, 20 bp, Artificial Sequence
  chemically synthesized
atatcaggtatgaaatacag

SEQ ID NO: 93742 - DNA, 20 bp, Artificial Sequence
  chemically synthesized
catatcaggtatgaaataca

SEQ ID NO: 93743 - DNA, 20 bp, Artificial Sequence
  chemically synthesized
acatatcaggtatgaaatac

SEQ ID NO: 93744 - DNA, 20 bp, Artificial Sequence
  chemically synthesized
tacatatcaggtatgaaata

SEQ ID NO: 93745 - DNA, 20 bp, Artificial Sequence
  chemically synthesized
taaaatctgtattacatatc

SEQ ID NO: 93746 - DNA, 20 bp, Artificial Sequence
  chemically synthesized
ataaaatctgtattacatat

SEQ ID NO: 93747 - DNA, 20 bp, Artificial Sequence
  chemically synthesized
ttcatacctgatatgtaata

SEQ ID NO: 93748 - DNA, 20 bp, Artificial Sequence
  chemically synthesized
agattttatgtttaaaaaaa

SEQ ID NO: 93749 - DNA, 20 bp, Artificial Sequence
  chemically synthesized
tgtttaaaaaaatggctttg

SEQ ID NO: 93750 - DNA, 20 bp, Artificial Sequence
  chemically synthesized
gtttaaaaaaatggctttgt

SEQ ID NO: 93751 - DNA, 20 bp, Artificial Sequence
  chemically synthesized
tttaaaaaaatggctttgtg

SEQ ID NO: 93752 - DNA, 20 bp, Artificial Sequence
  chemically synthesized
gttagtatgggagccccaca

SEQ ID NO: 93753 - DNA, 20 bp, Artificial Sequence
  chemically synthesized
gaaatttttggttagtatgg

SEQ ID NO: 93754 - DNA, 20 bp, Artificial Sequence
  chemically synthesized
aagaaatttttggttagtat

SEQ ID NO: 93755 - DNA, 20 bp, Artificial Sequence
  chemically synthesized
gaagaaatttttggttagta

SEQ ID NO: 93756 - DNA, 20 bp, Artificial Sequence
  chemically synthesized
tctaggaagaaatttttggt

SEQ ID NO: 93757 - DNA, 20 bp, Artificial Sequence
  chemically synthesized
aatgtctaggaagaaatttt

SEQ ID NO: 93758 - DNA, 20 bp, Artificial Sequence
  chemically synthesized
actaaccaaaaatttcttcc

SEQ ID NO: 93759 - DNA, 20 bp, Artificial Sequence
  chemically synthesized
tacagttagaaatgtctagg

SEQ ID NO: 93760 - DNA, 20 bp, Artificial Sequence
  chemically synthesized
agatacagttagaaatgtct

SEQ ID NO: 93761 - DNA, 20 bp, Artificial Sequence
  chemically synthesized
tagatacagttagaaatgtc

SEQ ID NO: 93762 - DNA, 20 bp, Artificial Sequence
  chemically synthesized
ctgttttctctagatacagt

SEQ ID NO: 93763 - DNA, 20 bp, Artificial Sequence
  chemically synthesized
tagacatttctaactgtatc

SEQ ID NO: 93764 - DNA, 20 bp, Artificial Sequence
  chemically synthesized
gacatttctaactgtatcta

SEQ ID NO: 93765 - DNA, 20 bp, Artificial Sequence
  chemically synthesized
gtccctgttttctctagata

SEQ ID NO: 93766 - DNA, 20 bp, Artificial Sequence
  chemically synthesized
ctaactgtatctagagaaaa

SEQ ID NO: 93767 - DNA, 20 bp, Artificial Sequence
  chemically synthesized
tttgatgtccctgttttctc

SEQ ID NO: 93768 - DNA, 20 bp, Artificial Sequence
  chemically synthesized
taactgtatctagagaaaac

SEQ ID NO: 93769 - DNA, 20 bp, Artificial Sequence
  chemically synthesized
aactgtatctagagaaaaca

SEQ ID NO: 93770 - DNA, 20 bp, Artificial Sequence
  chemically synthesized
cagggacatcaaaacaaaac

SEQ ID NO: 93771 - DNA, 20 bp, Artificial Sequence
  chemically synthesized
aaaacaagaacacaacaaca

SEQ ID NO: 93772 - DNA, 20 bp, Artificial Sequence
  chemically synthesized
acaacaacacagcaaaatcc

SEQ ID NO: 93773 - DNA, 20 bp, Artificial Sequence
  chemically synthesized
actttataaattgaaaatcc

SEQ ID NO: 93774 - DNA, 20 bp, Artificial Sequence
  chemically synthesized
gactttataaattgaaaatc

SEQ ID NO: 93775 - DNA, 20 bp, Artificial Sequence
  chemically synthesized
tcctggattttcaatttata

SEQ ID NO: 93776 - DNA, 20 bp, Artificial Sequence
  chemically synthesized
attttcaatttataaagtca

SEQ ID NO: 93777 - DNA, 20 bp, Artificial Sequence
  chemically synthesized
aatttataaagtcatggatg

SEQ ID NO: 93778 - DNA, 20 bp, Artificial Sequence
  chemically synthesized
taaagtcatggatgaagaac

SEQ ID NO: 93779 - DNA, 20 bp, Artificial Sequence
  chemically synthesized
tatggattttaggtttaaac

SEQ ID NO: 93780 - DNA, 20 bp, Artificial Sequence
  chemically synthesized
gttctctgattatggatttt

SEQ ID NO: 93781 - DNA, 20 bp, Artificial Sequence
  chemically synthesized
agttctctgattatggattt

SEQ ID NO: 93782 - DNA, 20 bp, Artificial Sequence
  chemically synthesized
ttaaacctaaaatccataat

SEQ ID NO: 93783 - DNA, 20 bp, Artificial Sequence
  chemically synthesized
aaacctaaaatccataatca

SEQ ID NO: 93784 - DNA, 20 bp, Artificial Sequence
  chemically synthesized
tctttgaagttctctgatta

SEQ ID NO: 93785 - DNA, 20 bp, Artificial Sequence
  chemically synthesized
tccataatcagagaacttca

SEQ ID NO: 93786 - DNA, 20 bp, Artificial Sequence
  chemically synthesized
cataatcagagaacttcaaa

SEQ ID NO: 93787 - DNA, 20 bp, Artificial Sequence
  chemically synthesized
taatataccatatctctttg

SEQ ID NO: 93788 - DNA, 20 bp, Artificial Sequence
  chemically synthesized
cagagaacttcaaagagata

SEQ ID NO: 93789 - DNA, 20 bp, Artificial Sequence
  chemically synthesized
atatggtatattatacacat

SEQ ID NO: 93790 - DNA, 20 bp, Artificial Sequence
  chemically synthesized
tgcttttcttcaaaaggaaa

SEQ ID NO: 93791 - DNA, 20 bp, Artificial Sequence
  chemically synthesized
ctgcttttcttcaaaaggaa

SEQ ID NO: 93792 - DNA, 20 bp, Artificial Sequence
  chemically synthesized
acatcagccttttccttttg

SEQ ID NO: 93793 - DNA, 20 bp, Artificial Sequence
  chemically synthesized
tctctctgcttttcttcaaa

SEQ ID NO: 93794 - DNA, 20 bp, Artificial Sequence
  chemically synthesized
ttctctctgcttttcttcaa

SEQ ID NO: 93795 - DNA, 20 bp, Artificial Sequence
  chemically synthesized
agccttttccttttgaagaa

SEQ ID NO: 93796 - DNA, 20 bp, Artificial Sequence
  chemically synthesized
cttttccttttgaagaaaag

SEQ ID NO: 93797 - DNA, 20 bp, Artificial Sequence
  chemically synthesized
tttccttttgaagaaaagca

SEQ ID NO: 93798 - DNA, 20 bp, Artificial Sequence
  chemically synthesized
tccttttgaagaaaagcaga

SEQ ID NO: 93799 - DNA, 20 bp, Artificial Sequence
  chemically synthesized
ttttgaagaaaagcagagag

SEQ ID NO: 93800 - DNA, 20 bp, Artificial Sequence
  chemically synthesized
gaaaagcagagagaagacac

SEQ ID NO: 93801 - DNA, 20 bp, Artificial Sequence
  chemically synthesized
aagcagagagaagacactgg

SEQ ID NO: 93802 - DNA, 20 bp, Artificial Sequence
  chemically synthesized
agcagagagaagacactgga

SEQ ID NO: 93803 - DNA, 20 bp, Artificial Sequence
  chemically synthesized
gcagagagaagacactggaa

SEQ ID NO: 93804 - DNA, 20 bp, Artificial Sequence
  chemically synthesized
cagagagaagacactggaag

SEQ ID NO: 93805 - DNA, 20 bp, Artificial Sequence
  chemically synthesized
tagcaggaggtttccccttc

SEQ ID NO: 93806 - DNA, 20 bp, Artificial Sequence
  chemically synthesized
ggagctcccagagtagcagg

SEQ ID NO: 93807 - DNA, 20 bp, Artificial Sequence
  chemically synthesized
aggagctcccagagtagcag

SEQ ID NO: 93808 - DNA, 20 bp, Artificial Sequence
  chemically synthesized
ggggaaacctcctgctactc

SEQ ID NO: 93809 - DNA, 20 bp, Artificial Sequence
  chemically synthesized
ttaggagctcccagagtagc

SEQ ID NO: 93810 - DNA, 20 bp, Artificial Sequence
  chemically synthesized
gggaaacctcctgctactct

SEQ ID NO: 93811 - DNA, 20 bp, Artificial Sequence
  chemically synthesized
cttaggagctcccagagtag

SEQ ID NO: 93812 - DNA, 20 bp, Artificial Sequence
  chemically synthesized
gaaacctcctgctactctgg

SEQ ID NO: 93813 - DNA, 20 bp, Artificial Sequence
  chemically synthesized
gcccttaggagctcccagag

SEQ ID NO: 93814 - DNA, 20 bp, Artificial Sequence
  chemically synthesized
ccagcccttaggagctccca

SEQ ID NO: 93815 - DNA, 20 bp, Artificial Sequence
  chemically synthesized
tcccagcccttaggagctcc

SEQ ID NO: 93816 - DNA, 20 bp, Artificial Sequence
  chemically synthesized
ctgctactctgggagctcct

SEQ ID NO: 93817 - DNA, 20 bp, Artificial Sequence
  chemically synthesized
tgctactctgggagctccta

SEQ ID NO: 93818 - DNA, 20 bp, Artificial Sequence
  chemically synthesized
gctactctgggagctcctaa

SEQ ID NO: 93819 - DNA, 20 bp, Artificial Sequence
  chemically synthesized
gatatggtcccagcccttag

SEQ ID NO: 93820 - DNA, 20 bp, Artificial Sequence
  chemically synthesized
ctctgggagctcctaagggc

SEQ ID NO: 93821 - DNA, 20 bp, Artificial Sequence
  chemically synthesized
tctgggagctcctaagggct

SEQ ID NO: 93822 - DNA, 20 bp, Artificial Sequence
  chemically synthesized
cagatatggtcccagccctt

SEQ ID NO: 93823 - DNA, 20 bp, Artificial Sequence
  chemically synthesized
gcagatatggtcccagccct

SEQ ID NO: 93824 - DNA, 20 bp, Artificial Sequence
  chemically synthesized
agacaaggcagatatggtcc

SEQ ID NO: 93825 - DNA, 20 bp, Artificial Sequence
  chemically synthesized
agccgcagacaaggcagata

SEQ ID NO: 93826 - DNA, 20 bp, Artificial Sequence
  chemically synthesized
agatacagccgcagacaagg

SEQ ID NO: 93827 - DNA, 20 bp, Artificial Sequence
  chemically synthesized
gaccatatctgccttgtctg

SEQ ID NO: 93828 - DNA, 20 bp, Artificial Sequence
  chemically synthesized
gggagatacagccgcagaca

SEQ ID NO: 93829 - DNA, 20 bp, Artificial Sequence
  chemically synthesized
tgggagatacagccgcagac

SEQ ID NO: 93830 - DNA, 20 bp, Artificial Sequence
  chemically synthesized
ggaagtgggagatacagccg

SEQ ID NO: 93831 - DNA, 20 bp, Artificial Sequence
  chemically synthesized
caagctggaagtgggagata

SEQ ID NO: 93832 - DNA, 20 bp, Artificial Sequence
  chemically synthesized
gcggctgtatctcccacttc

SEQ ID NO: 93833 - DNA, 20 bp, Artificial Sequence
  chemically synthesized
agctatcaagctggaagtgg

SEQ ID NO: 93834 - DNA, 20 bp, Artificial Sequence
  chemically synthesized
ccagctatcaagctggaagt

SEQ ID NO: 93835 - DNA, 20 bp, Artificial Sequence
  chemically synthesized
accagctatcaagctggaag

SEQ ID NO: 93836 - DNA, 20 bp, Artificial Sequence
  chemically synthesized
cataccagctatcaagctgg

SEQ ID NO: 93837 - DNA, 20 bp, Artificial Sequence
  chemically synthesized
atctcccacttccagcttga

SEQ ID NO: 93838 - DNA, 20 bp, Artificial Sequence
  chemically synthesized
ttgcataccagctatcaagc

SEQ ID NO: 93839 - DNA, 20 bp, Artificial Sequence
  chemically synthesized
cccacttccagcttgatagc

SEQ ID NO: 93840 - DNA, 20 bp, Artificial Sequence
  chemically synthesized
gcagttgcataccagctatc

SEQ ID NO: 93841 - DNA, 20 bp, Artificial Sequence
  chemically synthesized
aagcaaaagcagttgcatac

SEQ ID NO: 93842 - DNA, 20 bp, Artificial Sequence
  chemically synthesized
aactttattgaaagcaaaag

SEQ ID NO: 93843 - DNA, 20 bp, Artificial Sequence
  chemically synthesized
gataactttattgaaagcaa

SEQ ID NO: 93844 - DNA, 20 bp, Artificial Sequence
  chemically synthesized
aactgcttttgctttcaata

SEQ ID NO: 93845 - DNA, 20 bp, Artificial Sequence
  chemically synthesized
ttactcgataactttattga

SEQ ID NO: 93846 - DNA, 20 bp, Artificial Sequence
  chemically synthesized
ttgctttcaataaagttatc

SEQ ID NO: 93847 - DNA, 20 bp, Artificial Sequence
  chemically synthesized
aaagttatcgagtaaatgat

SEQ ID NO: 93848 - DNA, 20 bp, Artificial Sequence
  chemically synthesized
ggatacattaatacattgat

SEQ ID NO: 93849 - DNA, 20 bp, Artificial Sequence
  chemically synthesized
aatacattgattagttatga

SEQ ID NO: 93850 - DNA, 20 bp, Artificial Sequence
  chemically synthesized
gattagttatgaaagacatc

SEQ ID NO: 93851 - DNA, 20 bp, Artificial Sequence
  chemically synthesized
ttatgaaagacatcaagtac

SEQ ID NO: 93852 - DNA, 20 bp, Artificial Sequence
  chemically synthesized
atgaaagacatcaagtacca

SEQ ID NO: 93853 - DNA, 20 bp, Artificial Sequence
  chemically synthesized
tagccttctttgatgttctc

SEQ ID NO: 93854 - DNA, 20 bp, Artificial Sequence
  chemically synthesized
tcaagtaccagagaacatca

SEQ ID NO: 93855 - DNA, 20 bp, Artificial Sequence
  chemically synthesized
agtaccagagaacatcaaag

SEQ ID NO: 93856 - DNA, 20 bp, Artificial Sequence
  chemically synthesized
gtaccagagaacatcaaaga

SEQ ID NO: 93857 - DNA, 20 bp, Artificial Sequence
  chemically synthesized
catcaaagaaggctaataat

SEQ ID NO: 93858 - DNA, 20 bp, Artificial Sequence
  chemically synthesized
tcaaagaaggctaataatga

SEQ ID NO: 93859 - DNA, 20 bp, Artificial Sequence
  chemically synthesized
cactgcttgactctcattat

SEQ ID NO: 93860 - DNA, 20 bp, Artificial Sequence
  chemically synthesized
gaaggctaataatgagagtc

SEQ ID NO: 93861 - DNA, 20 bp, Artificial Sequence
  chemically synthesized
ggctaataatgagagtcaag

SEQ ID NO: 93862 - DNA, 20 bp, Artificial Sequence
  chemically synthesized
taataatgagagtcaagcag

SEQ ID NO: 93863 - DNA, 20 bp, Artificial Sequence
  chemically synthesized
aataatgagagtcaagcagt

SEQ ID NO: 93864 - DNA, 20 bp, Artificial Sequence
  chemically synthesized
agtcaagcagtgggtaacct

SEQ ID NO: 93865 - DNA, 20 bp, Artificial Sequence
  chemically synthesized
tattatctaggtatatacca

SEQ ID NO: 93866 - DNA, 20 bp, Artificial Sequence
  chemically synthesized
ctattatctaggtatatacc

SEQ ID NO: 93867 - DNA, 20 bp, Artificial Sequence
  chemically synthesized
gggtaaccttggtatatacc

SEQ ID NO: 93868 - DNA, 20 bp, Artificial Sequence
  chemically synthesized
cttggtatatacctagataa

SEQ ID NO: 93869 - DNA, 20 bp, Artificial Sequence
  chemically synthesized
aaaccagtgctctattatct

SEQ ID NO: 93870 - DNA, 20 bp, Artificial Sequence
  chemically synthesized
tggtatatacctagataata

SEQ ID NO: 93871 - DNA, 20 bp, Artificial Sequence
  chemically synthesized
gaaaccagtgctctattatc

SEQ ID NO: 93872 - DNA, 20 bp, Artificial Sequence
  chemically synthesized
atacctagataatagagcac

SEQ ID NO: 93873 - DNA, 20 bp, Artificial Sequence
  chemically synthesized
aaaaaaaaaaaaagagaaac

SEQ ID NO: 93874 - DNA, 20 bp, Artificial Sequence
  chemically synthesized
aaaaaaaaaaaaaaaaaaaa

SEQ ID NO: 93875 - DNA, 20 bp, Artificial Sequence
  chemically synthesized
aaaaaaaaaaaaaaaaaaaa

SEQ ID NO: 93876 - DNA, 20 bp, Artificial Sequence
  chemically synthesized
ttttttttttattatactct

SEQ ID NO: 93877 - DNA, 20 bp, Artificial Sequence
  chemically synthesized
ttttattatactctaagttt

SEQ ID NO: 93878 - DNA, 20 bp, Artificial Sequence
  chemically synthesized
cacatgtaccctaaaactta

SEQ ID NO: 93879 - DNA, 20 bp, Artificial Sequence
  chemically synthesized
tttattatactctaagtttt

SEQ ID NO: 93880 - DNA, 20 bp, Artificial Sequence
  chemically synthesized
ttattatactctaagtttta

SEQ ID NO: 93881 - DNA, 20 bp, Artificial Sequence
  chemically synthesized
tgcacatgtaccctaaaact

SEQ ID NO: 93882 - DNA, 20 bp, Artificial Sequence
  chemically synthesized
gggtacatgtgcacattgtg

SEQ ID NO: 93883 - DNA, 20 bp, Artificial Sequence
  chemically synthesized
ggtacatgtgcacattgtgc

SEQ ID NO: 93884 - DNA, 20 bp, Artificial Sequence
  chemically synthesized
catgtgcacattgtgcaggt

SEQ ID NO: 93885 - DNA, 20 bp, Artificial Sequence
  chemically synthesized
tatgtatacatgtgccatgc

SEQ ID NO: 93886 - DNA, 20 bp, Artificial Sequence
  chemically synthesized
gtgggtgcagcgcaccagca

SEQ ID NO: 93887 - DNA, 20 bp, Artificial Sequence
  chemically synthesized
cgttagtgggtgcagcgcac

SEQ ID NO: 93888 - DNA, 20 bp, Artificial Sequence
  chemically synthesized
agatgacacgttagtgggtg

SEQ ID NO: 93889 - DNA, 20 bp, Artificial Sequence
  chemically synthesized
atgctagatgacacgttagt

SEQ ID NO: 93890 - DNA, 20 bp, Artificial Sequence
  chemically synthesized
aatgctagatgacacgttag

SEQ ID NO: 93891 - DNA, 20 bp, Artificial Sequence
  chemically synthesized
cctaatgctagatgacacgt

SEQ ID NO: 93892 - DNA, 20 bp, Artificial Sequence
  chemically synthesized
gcacccactaacgtgtcatc

SEQ ID NO: 93893 - DNA, 20 bp, Artificial Sequence
  chemically synthesized
actaacgtgtcatctagcat

SEQ ID NO: 93894 - DNA, 20 bp, Artificial Sequence
  chemically synthesized
ctaacgtgtcatctagcatt

SEQ ID NO: 93895 - DNA, 20 bp, Artificial Sequence
  chemically synthesized
ttgggagatatacctaatgc

SEQ ID NO: 93896 - DNA, 20 bp, Artificial Sequence
  chemically synthesized
ggggggagggatagcattgg

SEQ ID NO: 93897 - DNA, 20 bp, Artificial Sequence
  chemically synthesized
gaggggggagggatagcatt

SEQ ID NO: 93898 - DNA, 20 bp, Artificial Sequence
  chemically synthesized
ggaggggggagggatagcat

SEQ ID NO: 93899 - DNA, 20 bp, Artificial Sequence
  chemically synthesized
gtcgggggaggggggaggga

SEQ ID NO: 93900 - DNA, 20 bp, Artificial Sequence
  chemically synthesized
tggggtcgggggagggggga

SEQ ID NO: 93901 - DNA, 20 bp, Artificial Sequence
  chemically synthesized
gtggggtcgggggagggggg

SEQ ID NO: 93902 - DNA, 20 bp, Artificial Sequence
  chemically synthesized
ggtggggtcgggggaggggg

SEQ ID NO: 93903 - DNA, 20 bp, Artificial Sequence
  chemically synthesized
gtggtggggtcgggggaggg

SEQ ID NO: 93904 - DNA, 20 bp, Artificial Sequence
  chemically synthesized
tgtggtggggtcgggggagg

SEQ ID NO: 93905 - DNA, 20 bp, Artificial Sequence
  chemically synthesized
ctgtggtggggtcgggggag

SEQ ID NO: 93906 - DNA, 20 bp, Artificial Sequence
  chemically synthesized
actgtggtggggtcggggga

SEQ ID NO: 93907 - DNA, 20 bp, Artificial Sequence
  chemically synthesized
gactgtggtggggtcggggg

SEQ ID NO: 93908 - DNA, 20 bp, Artificial Sequence
  chemically synthesized
ggactgtggtggggtcgggg

SEQ ID NO: 93909 - DNA, 20 bp, Artificial Sequence
  chemically synthesized
ggggactgtggtggggtcgg

SEQ ID NO: 93910 - DNA, 20 bp, Artificial Sequence
  chemically synthesized
tggggactgtggtggggtcg

SEQ ID NO: 93911 - DNA, 20 bp, Artificial Sequence
  chemically synthesized
ctggggactgtggtggggtc

SEQ ID NO: 93912 - DNA, 20 bp, Artificial Sequence
  chemically synthesized
tctggggactgtggtggggt

SEQ ID NO: 93913 - DNA, 20 bp, Artificial Sequence
  chemically synthesized
cccctcccccgaccccacca

SEQ ID NO: 93914 - DNA, 20 bp, Artificial Sequence
  chemically synthesized
acactctggggactgtggtg

SEQ ID NO: 93915 - DNA, 20 bp, Artificial Sequence
  chemically synthesized
cacactctggggactgtggt

SEQ ID NO: 93916 - DNA, 20 bp, Artificial Sequence
  chemically synthesized
tcacactctggggactgtgg

SEQ ID NO: 93917 - DNA, 20 bp, Artificial Sequence
  chemically synthesized
cccgaccccaccacagtccc

SEQ ID NO: 93918 - DNA, 20 bp, Artificial Sequence
  chemically synthesized
atatcacactctggggactg

SEQ ID NO: 93919 - DNA, 20 bp, Artificial Sequence
  chemically synthesized
cgaccccaccacagtcccca

SEQ ID NO: 93920 - DNA, 20 bp, Artificial Sequence
  chemically synthesized
aaggggaatatcacactctg

SEQ ID NO: 93921 - DNA, 20 bp, Artificial Sequence
  chemically synthesized
gaaggggaatatcacactct

SEQ ID NO: 93922 - DNA, 20 bp, Artificial Sequence
  chemically synthesized
ggaaggggaatatcacactc

SEQ ID NO: 93923 - DNA, 20 bp, Artificial Sequence
  chemically synthesized
gatcacatggacacaggaag

SEQ ID NO: 93924 - DNA, 20 bp, Artificial Sequence
  chemically synthesized
agatcacatggacacaggaa

SEQ ID NO: 93925 - DNA, 20 bp, Artificial Sequence
  chemically synthesized
gagatcacatggacacagga

SEQ ID NO: 93926 - DNA, 20 bp, Artificial Sequence
  chemically synthesized
tgagatcacatggacacagg

SEQ ID NO: 93927 - DNA, 20 bp, Artificial Sequence
  chemically synthesized
caatgagatcacatggacac

SEQ ID NO: 93928 - DNA, 20 bp, Artificial Sequence
  chemically synthesized
acaatgagatcacatggaca

SEQ ID NO: 93929 - DNA, 20 bp, Artificial Sequence
  chemically synthesized
aattgaacaatgagatcaca

SEQ ID NO: 93930 - DNA, 20 bp, Artificial Sequence
  chemically synthesized
ataggtgggaattgaacaat

SEQ ID NO: 93931 - DNA, 20 bp, Artificial Sequence
  chemically synthesized
attgttcaattcccacctat

SEQ ID NO: 93932 - DNA, 20 bp, Artificial Sequence
  chemically synthesized
gcatattctcactcataggt

SEQ ID NO: 93933 - DNA, 20 bp, Artificial Sequence
  chemically synthesized
cgcatattctcactcatagg

SEQ ID NO: 93934 - DNA, 20 bp, Artificial Sequence
  chemically synthesized
ttcaattcccacctatgagt

SEQ ID NO: 93935 - DNA, 20 bp, Artificial Sequence
  chemically synthesized
caccgcatattctcactcat

SEQ ID NO: 93936 - DNA, 20 bp, Artificial Sequence
  chemically synthesized
acaccgcatattctcactca

SEQ ID NO: 93937 - DNA, 20 bp, Artificial Sequence
  chemically synthesized
cacctatgagtgagaatatg

SEQ ID NO: 93938 - DNA, 20 bp, Artificial Sequence
  chemically synthesized
gagtgagaatatgcggtgtt

SEQ ID NO: 93939 - DNA, 20 bp, Artificial Sequence
  chemically synthesized
ttggttttttgttcttgcga

SEQ ID NO: 93940 - DNA, 20 bp, Artificial Sequence
  chemically synthesized
cattctcagtaaactatcgc

SEQ ID NO: 93941 - DNA, 20 bp, Artificial Sequence
  chemically synthesized
tgttcttgcgatagtttact

SEQ ID NO: 93942 - DNA, 20 bp, Artificial Sequence
  chemically synthesized
cgatagtttactgagaatga

SEQ ID NO: 93943 - DNA, 20 bp, Artificial Sequence
  chemically synthesized
aaattggaaaccatcattct

SEQ ID NO: 93944 - DNA, 20 bp, Artificial Sequence
  chemically synthesized
tgtagggacatggatgaaat

SEQ ID NO: 93945 - DNA, 20 bp, Artificial Sequence
  chemically synthesized
tcatgtccgttgtagggaca

SEQ ID NO: 93946 - DNA, 20 bp, Artificial Sequence
  chemically synthesized
tttcatccatgtccctacaa

SEQ ID NO: 93947 - DNA, 20 bp, Artificial Sequence
  chemically synthesized
atgagttcatgtccgttgta

SEQ ID NO: 93948 - DNA, 20 bp, Artificial Sequence
  chemically synthesized
gatgagttcatgtccgttgt

SEQ ID NO: 93949 - DNA, 20 bp, Artificial Sequence
  chemically synthesized
tgatgagttcatgtccgttg

SEQ ID NO: 93950 - DNA, 20 bp, Artificial Sequence
  chemically synthesized
atgcagccataaaaaatgat

SEQ ID NO: 93951 - DNA, 20 bp, Artificial Sequence
  chemically synthesized
catgaactcatcatttttta

SEQ ID NO: 93952 - DNA, 20 bp, Artificial Sequence
  chemically synthesized
catcattttttatggctgca

SEQ ID NO: 93953 - DNA, 20 bp, Artificial Sequence
  chemically synthesized
atccaccatggaatactatg

SEQ ID NO: 93954 - DNA, 20 bp, Artificial Sequence
  chemically synthesized
tatggctgcatagtattcca

SEQ ID NO: 93955 - DNA, 20 bp, Artificial Sequence
  chemically synthesized
ggctgcatagtattccatgg

SEQ ID NO: 93956 - DNA, 20 bp, Artificial Sequence
  chemically synthesized
aatgtggcacatatccacca

SEQ ID NO: 93957 - DNA, 20 bp, Artificial Sequence
  chemically synthesized
tagactggattaagaaaatg

SEQ ID NO: 93958 - DNA, 20 bp, Artificial Sequence
  chemically synthesized
tgtgccacattttcttaatc

SEQ ID NO: 93959 - DNA, 20 bp, Artificial Sequence
  chemically synthesized
caacaatgatagactggatt

SEQ ID NO: 93960 - DNA, 20 bp, Artificial Sequence
  chemically synthesized
aatgtccaacaatgatagac

SEQ ID NO: 93961 - DNA, 20 bp, Artificial Sequence
  chemically synthesized
ttaatccagtctatcattgt

SEQ ID NO: 93962 - DNA, 20 bp, Artificial Sequence
  chemically synthesized
acccaaatgtccaacaatga

SEQ ID NO: 93963 - DNA, 20 bp, Artificial Sequence
  chemically synthesized
gtctatcattgttggacatt

SEQ ID NO: 93964 - DNA, 20 bp, Artificial Sequence
  chemically synthesized
tctatcattgttggacattt

SEQ ID NO: 93965 - DNA, 20 bp, Artificial Sequence
  chemically synthesized
tcattgttggacatttgggt

SEQ ID NO: 93966 - DNA, 20 bp, Artificial Sequence
  chemically synthesized
tggacatttgggttggttcc

SEQ ID NO: 93967 - DNA, 20 bp, Artificial Sequence
  chemically synthesized
tattcacaatagcaaagact

SEQ ID NO: 93968 - DNA, 20 bp, Artificial Sequence
  chemically synthesized
cggcactattcacaatagca

SEQ ID NO: 93969 - DNA, 20 bp, Artificial Sequence
  chemically synthesized
caagtctttgctattgtgaa

SEQ ID NO: 93970 - DNA, 20 bp, Artificial Sequence
  chemically synthesized
tattgcggcactattcacaa

SEQ ID NO: 93971 - DNA, 20 bp, Artificial Sequence
  chemically synthesized
atgcacacgtatgtttattg

SEQ ID NO: 93972 - DNA, 20 bp, Artificial Sequence
  chemically synthesized
tacgtgtgcatgtgtcttta

SEQ ID NO: 93973 - DNA, 20 bp, Artificial Sequence
  chemically synthesized
gtgtgcatgtgtctttatag

SEQ ID NO: 93974 - DNA, 20 bp, Artificial Sequence
  chemically synthesized
ctataaatcatgctgctata

SEQ ID NO: 93975 - DNA, 20 bp, Artificial Sequence
  chemically synthesized
ctttatagcagcatgattta

SEQ ID NO: 93976 - DNA, 20 bp, Artificial Sequence
  chemically synthesized
cagcatgatttatagtcctt

SEQ ID NO: 93977 - DNA, 20 bp, Artificial Sequence
  chemically synthesized
agcatgatttatagtccttt

SEQ ID NO: 93978 - DNA, 20 bp, Artificial Sequence
  chemically synthesized
attactgggtatatacccaa

SEQ ID NO: 93979 - DNA, 20 bp, Artificial Sequence
  chemically synthesized
cattactgggtatataccca

SEQ ID NO: 93980 - DNA, 20 bp, Artificial Sequence
  chemically synthesized
tagtcctttgggtatatacc

SEQ ID NO: 93981 - DNA, 20 bp, Artificial Sequence
  chemically synthesized
tttgggtatatacccagtaa

SEQ ID NO: 93982 - DNA, 20 bp, Artificial Sequence
  chemically synthesized
ttgggtatatacccagtaat

SEQ ID NO: 93983 - DNA, 20 bp, Artificial Sequence
  chemically synthesized
gacccagccatcccattact

SEQ ID NO: 93984 - DNA, 20 bp, Artificial Sequence
  chemically synthesized
tgacccagccatcccattac

SEQ ID NO: 93985 - DNA, 20 bp, Artificial Sequence
  chemically synthesized
gtatatacccagtaatggga

SEQ ID NO: 93986 - DNA, 20 bp, Artificial Sequence
  chemically synthesized
atacccagtaatgggatggc

SEQ ID NO: 93987 - DNA, 20 bp, Artificial Sequence
  chemically synthesized
tacccagtaatgggatggct

SEQ ID NO: 93988 - DNA, 20 bp, Artificial Sequence
  chemically synthesized
aatgggatggctgggtcaaa

SEQ ID NO: 93989 - DNA, 20 bp, Artificial Sequence
  chemically synthesized
actagaaataccatttgacc

SEQ ID NO: 93990 - DNA, 20 bp, Artificial Sequence
  chemically synthesized
gctgggtcaaatggtatttc

SEQ ID NO: 93991 - DNA, 20 bp, Artificial Sequence
  chemically synthesized
tcaaatggtatttctagttc

SEQ ID NO: 93992 - DNA, 20 bp, Artificial Sequence
  chemically synthesized
attcctcagggatctagaac

SEQ ID NO: 93993 - DNA, 20 bp, Artificial Sequence
  chemically synthesized
atttctagttctagatccct

SEQ ID NO: 93994 - DNA, 20 bp, Artificial Sequence
  chemically synthesized
gtggcgattcctcagggatc

SEQ ID NO: 93995 - DNA, 20 bp, Artificial Sequence
  chemically synthesized
tttctagttctagatccctg

SEQ ID NO: 93996 - DNA, 20 bp, Artificial Sequence
  chemically synthesized
gtcagtgtggcgattcctca

SEQ ID NO: 93997 - DNA, 20 bp, Artificial Sequence
  chemically synthesized
agtcagtgtggcgattcctc

SEQ ID NO: 93998 - DNA, 20 bp, Artificial Sequence
  chemically synthesized
aagtcagtgtggcgattcct

SEQ ID NO: 93999 - DNA, 20 bp, Artificial Sequence
  chemically synthesized
aaccattgtggaagtcagtg

SEQ ID NO: 94000 - DNA, 20 bp, Artificial Sequence
  chemically synthesized
agttcaaccattgtggaagt

SEQ ID NO: 94001 - DNA, 20 bp, Artificial Sequence
  chemically synthesized
cgccacactgacttccacaa

SEQ ID NO: 94002 - DNA, 20 bp, Artificial Sequence
  chemically synthesized
aactagttcaaccattgtgg

SEQ ID NO: 94003 - DNA, 20 bp, Artificial Sequence
  chemically synthesized
gtaaactagttcaaccattg

SEQ ID NO: 94004 - DNA, 20 bp, Artificial Sequence
  chemically synthesized
gacttccacaatggttgaac

SEQ ID NO: 94005 - DNA, 20 bp, Artificial Sequence
  chemically synthesized
acaatggttgaactagttta

SEQ ID NO: 94006 - DNA, 20 bp, Artificial Sequence
  chemically synthesized
ctgttggtgggactgtaaac

SEQ ID NO: 94007 - DNA, 20 bp, Artificial Sequence
  chemically synthesized
ctagtttacagtcccaccaa

SEQ ID NO: 94008 - DNA, 20 bp, Artificial Sequence
  chemically synthesized
aacactcttacactgttggt

SEQ ID NO: 94009 - DNA, 20 bp, Artificial Sequence
  chemically synthesized
gaacactcttacactgttgg

SEQ ID NO: 94010 - DNA, 20 bp, Artificial Sequence
  chemically synthesized
tacagtcccaccaacagtgt

SEQ ID NO: 94011 - DNA, 20 bp, Artificial Sequence
  chemically synthesized
taggaacactcttacactgt

SEQ ID NO: 94012 - DNA, 20 bp, Artificial Sequence
  chemically synthesized
cagtcccaccaacagtgtaa

SEQ ID NO: 94013 - DNA, 20 bp, Artificial Sequence
  chemically synthesized
tggagaggatgtggagaaat

SEQ ID NO: 94014 - DNA, 20 bp, Artificial Sequence
  chemically synthesized
ctggagaggatgtggagaaa

SEQ ID NO: 94015 - DNA, 20 bp, Artificial Sequence
  chemically synthesized
caggtgctggagaggatgtg

SEQ ID NO: 94016 - DNA, 20 bp, Artificial Sequence
  chemically synthesized
aacaggtgctggagaggatg

SEQ ID NO: 94017 - DNA, 20 bp, Artificial Sequence
  chemically synthesized
ctatttctccacatcctctc

SEQ ID NO: 94018 - DNA, 20 bp, Artificial Sequence
  chemically synthesized
ggaaacaacaggtgctggag

SEQ ID NO: 94019 - DNA, 20 bp, Artificial Sequence
  chemically synthesized
aggaaacaacaggtgctgga

SEQ ID NO: 94020 - DNA, 20 bp, Artificial Sequence
  chemically synthesized
tcaggaaacaacaggtgctg

SEQ ID NO: 94021 - DNA, 20 bp, Artificial Sequence
  chemically synthesized
agtcaggaaacaacaggtgc

SEQ ID NO: 94022 - DNA, 20 bp, Artificial Sequence
  chemically synthesized
ttaaaaagtcaggaaacaac

SEQ ID NO: 94023 - DNA, 20 bp, Artificial Sequence
  chemically synthesized
attaaaaagtcaggaaacaa

SEQ ID NO: 94024 - DNA, 20 bp, Artificial Sequence
  chemically synthesized
atggcaatcattaaaaagtc

SEQ ID NO: 94025 - DNA, 20 bp, Artificial Sequence
  chemically synthesized
aatggcaatcattaaaaagt

SEQ ID NO: 94026 - DNA, 20 bp, Artificial Sequence
  chemically synthesized
ttagaatggcaatcattaaa

SEQ ID NO: 94027 - DNA, 20 bp, Artificial Sequence
  chemically synthesized
ttaatgattgccattctaac

SEQ ID NO: 94028 - DNA, 20 bp, Artificial Sequence
  chemically synthesized
tcatctcacaccagttagaa

SEQ ID NO: 94029 - DNA, 20 bp, Artificial Sequence
  chemically synthesized
agatatcatctcacaccagt

SEQ ID NO: 94030 - DNA, 20 bp, Artificial Sequence
  chemically synthesized
attgccattctaactggtgt

SEQ ID NO: 94031 - DNA, 20 bp, Artificial Sequence
  chemically synthesized
tatgagatatcatctcacac

SEQ ID NO: 94032 - DNA, 20 bp, Artificial Sequence
  chemically synthesized
tggtgtgagatgatatctca

SEQ ID NO: 94033 - DNA, 20 bp, Artificial Sequence
  chemically synthesized
tgtgagatgatatctcatag

SEQ ID NO: 94034 - DNA, 20 bp, Artificial Sequence
  chemically synthesized
atgcaaatcaaaaccactat

SEQ ID NO: 94035 - DNA, 20 bp, Artificial Sequence
  chemically synthesized
tttgatttgcatttctctga

SEQ ID NO: 94036 - DNA, 20 bp, Artificial Sequence
  chemically synthesized
atttgcatttctctgatggc

SEQ ID NO: 94037 - DNA, 20 bp, Artificial Sequence
  chemically synthesized
ctcatcatcactggccatca

SEQ ID NO: 94038 - DNA, 20 bp, Artificial Sequence
  chemically synthesized
tgctcatcatcactggccat

SEQ ID NO: 94039 - DNA, 20 bp, Artificial Sequence
  chemically synthesized
gaagaaatgctcatcatcac

SEQ ID NO: 94040 - DNA, 20 bp, Artificial Sequence
  chemically synthesized
ctctgatggccagtgatgat

SEQ ID NO: 94041 - DNA, 20 bp, Artificial Sequence
  chemically synthesized
atgcagccaaaaaacacatg

SEQ ID NO: 94042 - DNA, 20 bp, Artificial Sequence
  chemically synthesized
gcatttcttcatgtgttttt

SEQ ID NO: 94043 - DNA, 20 bp, Artificial Sequence
  chemically synthesized
ctcaaaagaagacatttatg

SEQ ID NO: 94044 - DNA, 20 bp, Artificial Sequence
  chemically synthesized
ctgcataaatgtcttctttt

SEQ ID NO: 94045 - DNA, 20 bp, Artificial Sequence
  chemically synthesized
gaacagacacttctcaaaag

SEQ ID NO: 94046 - DNA, 20 bp, Artificial Sequence
  chemically synthesized
cataaatgtcttcttttgag

SEQ ID NO: 94047 - DNA, 20 bp, Artificial Sequence
  chemically synthesized
catgaacagacacttctcaa

SEQ ID NO: 94048 - DNA, 20 bp, Artificial Sequence
  chemically synthesized
aagtgggcgaaggacatgaa

SEQ ID NO: 94049 - DNA, 20 bp, Artificial Sequence
  chemically synthesized
ccccatcaaaaagtgggcga

SEQ ID NO: 94050 - DNA, 20 bp, Artificial Sequence
  chemically synthesized
accccatcaaaaagtgggcg

SEQ ID NO: 94051 - DNA, 20 bp, Artificial Sequence
  chemically synthesized
aaacaaccccatcaaaaagt

SEQ ID NO: 94052 - DNA, 20 bp, Artificial Sequence
  chemically synthesized
caaacaaccccatcaaaaag

SEQ ID NO: 94053 - DNA, 20 bp, Artificial Sequence
  chemically synthesized
gtccttcgcccactttttga

SEQ ID NO: 94054 - DNA, 20 bp, Artificial Sequence
  chemically synthesized
tccttcgcccactttttgat

SEQ ID NO: 94055 - DNA, 20 bp, Artificial Sequence
  chemically synthesized
ccttcgcccactttttgatg

SEQ ID NO: 94056 - DNA, 20 bp, Artificial Sequence
  chemically synthesized
aaacaaacaaccccatcaaa

SEQ ID NO: 94057 - DNA, 20 bp, Artificial Sequence
  chemically synthesized
atgaactcaaacaaatttac

SEQ ID NO: 94058 - DNA, 20 bp, Artificial Sequence
  chemically synthesized
tttttcttgtaaatttgttt

SEQ ID NO: 94059 - DNA, 20 bp, Artificial Sequence
  chemically synthesized
aaatttgtttgagttcattg

SEQ ID NO: 94060 - DNA, 20 bp, Artificial Sequence
  chemically synthesized
tttgagttcattgtagattc

SEQ ID NO: 94061 - DNA, 20 bp, Artificial Sequence
  chemically synthesized
tcattgtagattctggatat

SEQ ID NO: 94062 - DNA, 20 bp, Artificial Sequence
  chemically synthesized
tctgacaaagggctaatatc

SEQ ID NO: 94063 - DNA, 20 bp, Artificial Sequence
  chemically synthesized
tctggatattagccctttgt

SEQ ID NO: 94064 - DNA, 20 bp, Artificial Sequence
  chemically synthesized
caacctactcatctgacaaa

SEQ ID NO: 94065 - DNA, 20 bp, Artificial Sequence
  chemically synthesized
gcaacctactcatctgacaa

SEQ ID NO: 94066 - DNA, 20 bp, Artificial Sequence
  chemically synthesized
cgcaacctactcatctgaca

SEQ ID NO: 94067 - DNA, 20 bp, Artificial Sequence
  chemically synthesized
atattagccctttgtcagat

SEQ ID NO: 94068 - DNA, 20 bp, Artificial Sequence
  chemically synthesized
ttagccctttgtcagatgag

SEQ ID NO: 94069 - DNA, 20 bp, Artificial Sequence
  chemically synthesized
tagccctttgtcagatgagt

SEQ ID NO: 94070 - DNA, 20 bp, Artificial Sequence
  chemically synthesized
tttgtcagatgagtaggttg

SEQ ID NO: 94071 - DNA, 20 bp, Artificial Sequence
  chemically synthesized
acaggcaacctacaacatgg

SEQ ID NO: 94072 - DNA, 20 bp, Artificial Sequence
  chemically synthesized
ggaaattttctcccatgttg

SEQ ID NO: 94073 - DNA, 20 bp, Artificial Sequence
  chemically synthesized
gaaattttctcccatgttgt

SEQ ID NO: 94074 - DNA, 20 bp, Artificial Sequence
  chemically synthesized
gaacaggcaacctacaacat

SEQ ID NO: 94075 - DNA, 20 bp, Artificial Sequence
  chemically synthesized
tgaacaggcaacctacaaca

SEQ ID NO: 94076 - DNA, 20 bp, Artificial Sequence
  chemically synthesized
aaactaccatcagagtgaac

SEQ ID NO: 94077 - DNA, 20 bp, Artificial Sequence
  chemically synthesized
gaaactaccatcagagtgaa

SEQ ID NO: 94078 - DNA, 20 bp, Artificial Sequence
  chemically synthesized
aggttgcctgttcactctga

SEQ ID NO: 94079 - DNA, 20 bp, Artificial Sequence
  chemically synthesized
ttgcctgttcactctgatgg

SEQ ID NO: 94080 - DNA, 20 bp, Artificial Sequence
  chemically synthesized
agcaaaagaaactaccatca

SEQ ID NO: 94081 - DNA, 20 bp, Artificial Sequence
  chemically synthesized
acagcaaaagaaactaccat

SEQ ID NO: 94082 - DNA, 20 bp, Artificial Sequence
  chemically synthesized
caagagcttctgcacagcaa

SEQ ID NO: 94083 - DNA, 20 bp, Artificial Sequence
  chemically synthesized
tggtagtttcttttgctgtg

SEQ ID NO: 94084 - DNA, 20 bp, Artificial Sequence
  chemically synthesized
tagtttcttttgctgtgcag

SEQ ID NO: 94085 - DNA, 20 bp, Artificial Sequence
  chemically synthesized
taaactcaagagcttctgca

SEQ ID NO: 94086 - DNA, 20 bp, Artificial Sequence
  chemically synthesized
tttgctgtgcagaagctctt

SEQ ID NO: 94087 - DNA, 20 bp, Artificial Sequence
  chemically synthesized
tgggatctaattaaactcaa

SEQ ID NO: 94088 - DNA, 20 bp, Artificial Sequence
  chemically synthesized
aatgggatctaattaaactc

SEQ ID NO: 94089 - DNA, 20 bp, Artificial Sequence
  chemically synthesized
cagaagctcttgagtttaat

SEQ ID NO: 94090 - DNA, 20 bp, Artificial Sequence
  chemically synthesized
aaaagccaaaattgacaaat

SEQ ID NO: 94091 - DNA, 20 bp, Artificial Sequence
  chemically synthesized
caaaagccaaaattgacaaa

SEQ ID NO: 94092 - DNA, 20 bp, Artificial Sequence
  chemically synthesized
tagatcccatttgtcaattt

SEQ ID NO: 94093 - DNA, 20 bp, Artificial Sequence
  chemically synthesized
ttcaaaagcaatggcaacaa

SEQ ID NO: 94094 - DNA, 20 bp, Artificial Sequence
  chemically synthesized
tcaaagtttttcaaaagcaa

SEQ ID NO: 94095 - DNA, 20 bp, Artificial Sequence
  chemically synthesized
tttttttcaaagtttttcaa

SEQ ID NO: 94096 - DNA, 20 bp, Artificial Sequence
  chemically synthesized
attcttctaaatttttttca

SEQ ID NO: 94097 - DNA, 20 bp, Artificial Sequence
  chemically synthesized
gaaaaactttgaaaaaaatt

SEQ ID NO: 94098 - DNA, 20 bp, Artificial Sequence
  chemically synthesized
aaactttgaaaaaaatttag

SEQ ID NO: 94099 - DNA, 20 bp, Artificial Sequence
  chemically synthesized
aatttagaagaatgtataac

SEQ ID NO: 94100 - DNA, 20 bp, Artificial Sequence
  chemically synthesized
cttctctgtattcgttattc

SEQ ID NO: 94101 - DNA, 20 bp, Artificial Sequence
  chemically synthesized
tataactagaataacgaata

SEQ ID NO: 94102 - DNA, 20 bp, Artificial Sequence
  chemically synthesized
taactagaataacgaataca

SEQ ID NO: 94103 - DNA, 20 bp, Artificial Sequence
  chemically synthesized
ctagaataacgaatacagag

SEQ ID NO: 94104 - DNA, 20 bp, Artificial Sequence
  chemically synthesized
cgaatacagagaagtgctta

SEQ ID NO: 94105 - DNA, 20 bp, Artificial Sequence
  chemically synthesized
gaatacagagaagtgcttaa

SEQ ID NO: 94106 - DNA, 20 bp, Artificial Sequence
  chemically synthesized
atacagagaagtgcttaaag

SEQ ID NO: 94107 - DNA, 20 bp, Artificial Sequence
  chemically synthesized
tcagctccatcagctccttt

SEQ ID NO: 94108 - DNA, 20 bp, Artificial Sequence
  chemically synthesized
gaagtgcttaaaggagctga

SEQ ID NO: 94109 - DNA, 20 bp, Artificial Sequence
  chemically synthesized
agtgcttaaaggagctgatg

SEQ ID NO: 94110 - DNA, 20 bp, Artificial Sequence
  chemically synthesized
gccttggttttcagctccat

SEQ ID NO: 94111 - DNA, 20 bp, Artificial Sequence
  chemically synthesized
agctgatggagctgaaaacc

SEQ ID NO: 94112 - DNA, 20 bp, Artificial Sequence
  chemically synthesized
gctgatggagctgaaaacca

SEQ ID NO: 94113 - DNA, 20 bp, Artificial Sequence
  chemically synthesized
agttctcgagccttggtttt

SEQ ID NO: 94114 - DNA, 20 bp, Artificial Sequence
  chemically synthesized
ggagctgaaaaccaaggctc

SEQ ID NO: 94115 - DNA, 20 bp, Artificial Sequence
  chemically synthesized
ttcacgtagttctcgagcct

SEQ ID NO: 94116 - DNA, 20 bp, Artificial Sequence
  chemically synthesized
gcattcttcacgtagttctc

SEQ ID NO: 94117 - DNA, 20 bp, Artificial Sequence
  chemically synthesized
caaggctcgagaactacgtg

SEQ ID NO: 94118 - DNA, 20 bp, Artificial Sequence
  chemically synthesized
aggcttctgcattcttcacg

SEQ ID NO: 94119 - DNA, 20 bp, Artificial Sequence
  chemically synthesized
cgagaactacgtgaagaatg

SEQ ID NO: 94120 - DNA, 20 bp, Artificial Sequence
  chemically synthesized
gaactacgtgaagaatgcag

SEQ ID NO: 94121 - DNA, 20 bp, Artificial Sequence
  chemically synthesized
cgtgaagaatgcagaagcct

SEQ ID NO: 94122 - DNA, 20 bp, Artificial Sequence
  chemically synthesized
gtgaagaatgcagaagcctc

SEQ ID NO: 94123 - DNA, 20 bp, Artificial Sequence
  chemically synthesized
gaagaatgcagaagcctcag

SEQ ID NO: 94124 - DNA, 20 bp, Artificial Sequence
  chemically synthesized
gttgatcgcatcggctcctg

SEQ ID NO: 94125 - DNA, 20 bp, Artificial Sequence
  chemically synthesized
agttgatcgcatcggctcct

SEQ ID NO: 94126 - DNA, 20 bp, Artificial Sequence
  chemically synthesized
tttcttccagttgatcgcat

SEQ ID NO: 94127 - DNA, 20 bp, Artificial Sequence
  chemically synthesized
caggagccgatgcgatcaac

SEQ ID NO: 94128 - DNA, 20 bp, Artificial Sequence
  chemically synthesized
gagccgatgcgatcaactgg

SEQ ID NO: 94129 - DNA, 20 bp, Artificial Sequence
  chemically synthesized
cgatgcgatcaactggaaga

SEQ ID NO: 94130 - DNA, 20 bp, Artificial Sequence
  chemically synthesized
gatgcgatcaactggaagaa

SEQ ID NO: 94131 - DNA, 20 bp, Artificial Sequence
  chemically synthesized
atgcgatcaactggaagaaa

SEQ ID NO: 94132 - DNA, 20 bp, Artificial Sequence
  chemically synthesized
attgctgataccctttcttc

SEQ ID NO: 94133 - DNA, 20 bp, Artificial Sequence
  chemically synthesized
tcaactggaagaaagggtat

SEQ ID NO: 94134 - DNA, 20 bp, Artificial Sequence
  chemically synthesized
ggaagaaagggtatcagcaa

SEQ ID NO: 94135 - DNA, 20 bp, Artificial Sequence
  chemically synthesized
agaaagggtatcagcaatgg

SEQ ID NO: 94136 - DNA, 20 bp, Artificial Sequence
  chemically synthesized
aagatgaaatgaatgaaatg

SEQ ID NO: 94137 - DNA, 20 bp, Artificial Sequence
  chemically synthesized
tgaaatgaatgaaatgaagc

SEQ ID NO: 94138 - DNA, 20 bp, Artificial Sequence
  chemically synthesized
aatgaatgaaatgaagcgag

SEQ ID NO: 94139 - DNA, 20 bp, Artificial Sequence
  chemically synthesized
atgaatgaaatgaagcgaga

SEQ ID NO: 94140 - DNA, 20 bp, Artificial Sequence
  chemically synthesized
tgaatgaaatgaagcgagaa

SEQ ID NO: 94141 - DNA, 20 bp, Artificial Sequence
  chemically synthesized
atgaaatgaagcgagaaggg

SEQ ID NO: 94142 - DNA, 20 bp, Artificial Sequence
  chemically synthesized
atgaagcgagaagggaagtt

SEQ ID NO: 94143 - DNA, 20 bp, Artificial Sequence
  chemically synthesized
gaagcgagaagggaagttta

SEQ ID NO: 94144 - DNA, 20 bp, Artificial Sequence
  chemically synthesized
gaagggaagtttagagaaaa

SEQ ID NO: 94145 - DNA, 20 bp, Artificial Sequence
  chemically synthesized
tttagagaaaaaagaataaa

SEQ ID NO: 94146 - DNA, 20 bp, Artificial Sequence
  chemically synthesized
aaaaaagaataaaaagaaat

SEQ ID NO: 94147 - DNA, 20 bp, Artificial Sequence
  chemically synthesized
agaataaaaagaaatgagca

SEQ ID NO: 94148 - DNA, 20 bp, Artificial Sequence
  chemically synthesized
aagaaatgagcaaagcctcc

SEQ ID NO: 94149 - DNA, 20 bp, Artificial Sequence
  chemically synthesized
catagtcccatatttcttgg

SEQ ID NO: 94150 - DNA, 20 bp, Artificial Sequence
  chemically synthesized
acatagtcccatatttcttg

SEQ ID NO: 94151 - DNA, 20 bp, Artificial Sequence
  chemically synthesized
agcaaagcctccaagaaata

SEQ ID NO: 94152 - DNA, 20 bp, Artificial Sequence
  chemically synthesized
tcacatagtcccatatttct

SEQ ID NO: 94153 - DNA, 20 bp, Artificial Sequence
  chemically synthesized
gcaaagcctccaagaaatat

SEQ ID NO: 94154 - DNA, 20 bp, Artificial Sequence
  chemically synthesized
gaaatatgggactatgtgaa

SEQ ID NO: 94155 - DNA, 20 bp, Artificial Sequence
  chemically synthesized
gtagatttggtcttttcaca

SEQ ID NO: 94156 - DNA, 20 bp, Artificial Sequence
  chemically synthesized
acaccaatcagacgtagatt

SEQ ID NO: 94157 - DNA, 20 bp, Artificial Sequence
  chemically synthesized
tcaggtacaccaatcagacg

SEQ ID NO: 94158 - DNA, 20 bp, Artificial Sequence
  chemically synthesized
agaccaaatctacgtctgat

SEQ ID NO: 94159 - DNA, 20 bp, Artificial Sequence
  chemically synthesized
tcactttcaggtacaccaat

SEQ ID NO: 94160 - DNA, 20 bp, Artificial Sequence
  chemically synthesized
cgtctgattggtgtacctga

SEQ ID NO: 94161 - DNA, 20 bp, Artificial Sequence
  chemically synthesized
ccattctccacatcactttc

SEQ ID NO: 94162 - DNA, 20 bp, Artificial Sequence
  chemically synthesized
tccattctccacatcacttt

SEQ ID NO: 94163 - DNA, 20 bp, Artificial Sequence
  chemically synthesized
tggtgtacctgaaagtgatg

SEQ ID NO: 94164 - DNA, 20 bp, Artificial Sequence
  chemically synthesized
gtgtacctgaaagtgatgtg

SEQ ID NO: 94165 - DNA, 20 bp, Artificial Sequence
  chemically synthesized
cctgaaagtgatgtggagaa

SEQ ID NO: 94166 - DNA, 20 bp, Artificial Sequence
  chemically synthesized
gtgatgtggagaatggaacc

SEQ ID NO: 94167 - DNA, 20 bp, Artificial Sequence
  chemically synthesized
tgtggagaatggaaccaagt

SEQ ID NO: 94168 - DNA, 20 bp, Artificial Sequence
  chemically synthesized
ctgcagagtgttttccaact

SEQ ID NO: 94169 - DNA, 20 bp, Artificial Sequence
  chemically synthesized
ccaagttggaaaacactctg

SEQ ID NO: 94170 - DNA, 20 bp, Artificial Sequence
  chemically synthesized
caagttggaaaacactctgc

SEQ ID NO: 94171 - DNA, 20 bp, Artificial Sequence
  chemically synthesized
ctcctggataatatcctgca

SEQ ID NO: 94172 - DNA, 20 bp, Artificial Sequence
  chemically synthesized
ttctcctggataatatcctg

SEQ ID NO: 94173 - DNA, 20 bp, Artificial Sequence
  chemically synthesized
acactctgcaggatattatc

SEQ ID NO: 94174 - DNA, 20 bp, Artificial Sequence
  chemically synthesized
cactctgcaggatattatcc

SEQ ID NO: 94175 - DNA, 20 bp, Artificial Sequence
  chemically synthesized
ctctgcaggatattatccag

SEQ ID NO: 94176 - DNA, 20 bp, Artificial Sequence
  chemically synthesized
ctagattggggaagttctcc

SEQ ID NO: 94177 - DNA, 20 bp, Artificial Sequence
  chemically synthesized
cctgccttactagattgggg

SEQ ID NO: 94178 - DNA, 20 bp, Artificial Sequence
  chemically synthesized
ccaggagaacttccccaatc

SEQ ID NO: 94179 - DNA, 20 bp, Artificial Sequence
  chemically synthesized
tggcctgccttactagattg

SEQ ID NO: 94180 - DNA, 20 bp, Artificial Sequence
  chemically synthesized
ttggcctgccttactagatt

SEQ ID NO: 94181 - DNA, 20 bp, Artificial Sequence
  chemically synthesized
gagaacttccccaatctagt

SEQ ID NO: 94182 - DNA, 20 bp, Artificial Sequence
  chemically synthesized
gttggcctgccttactagat

SEQ ID NO: 94183 - DNA, 20 bp, Artificial Sequence
  chemically synthesized
agaacttccccaatctagta

SEQ ID NO: 94184 - DNA, 20 bp, Artificial Sequence
  chemically synthesized
acttccccaatctagtaagg

SEQ ID NO: 94185 - DNA, 20 bp, Artificial Sequence
  chemically synthesized
cttccccaatctagtaaggc

SEQ ID NO: 94186 - DNA, 20 bp, Artificial Sequence
  chemically synthesized
tgaacgttggcctgccttac

SEQ ID NO: 94187 - DNA, 20 bp, Artificial Sequence
  chemically synthesized
tagtaaggcaggccaacgtt

SEQ ID NO: 94188 - DNA, 20 bp, Artificial Sequence
  chemically synthesized
tatttcctgaatctgaacgt

SEQ ID NO: 94189 - DNA, 20 bp, Artificial Sequence
  chemically synthesized
ggcaggccaacgttcagatt

SEQ ID NO: 94190 - DNA, 20 bp, Artificial Sequence
  chemically synthesized
gcaggccaacgttcagattc

SEQ ID NO: 94191 - DNA, 20 bp, Artificial Sequence
  chemically synthesized
acgttcagattcaggaaata

SEQ ID NO: 94192 - DNA, 20 bp, Artificial Sequence
  chemically synthesized
gttcagattcaggaaataca

SEQ ID NO: 94193 - DNA, 20 bp, Artificial Sequence
  chemically synthesized
gaaatacagagaacgccaca

SEQ ID NO: 94194 - DNA, 20 bp, Artificial Sequence
  chemically synthesized
cttctcgaggagtatctttg

SEQ ID NO: 94195 - DNA, 20 bp, Artificial Sequence
  chemically synthesized
acgccacaaagatactcctc

SEQ ID NO: 94196 - DNA, 20 bp, Artificial Sequence
  chemically synthesized
ccacaaagatactcctcgag

SEQ ID NO: 94197 - DNA, 20 bp, Artificial Sequence
  chemically synthesized
ttggagttgctcttctcgag

SEQ ID NO: 94198 - DNA, 20 bp, Artificial Sequence
  chemically synthesized
acaaagatactcctcgagaa

SEQ ID NO: 94199 - DNA, 20 bp, Artificial Sequence
  chemically synthesized
tcttggagttgctcttctcg

SEQ ID NO: 94200 - DNA, 20 bp, Artificial Sequence
  chemically synthesized
gtcttggagttgctcttctc

SEQ ID NO: 94201 - DNA, 20 bp, Artificial Sequence
  chemically synthesized
tcctcgagaagagcaactcc

SEQ ID NO: 94202 - DNA, 20 bp, Artificial Sequence
  chemically synthesized
tctgacaattatgtgtcttg

SEQ ID NO: 94203 - DNA, 20 bp, Artificial Sequence
  chemically synthesized
aatctgacaattatgtgtct

SEQ ID NO: 94204 - DNA, 20 bp, Artificial Sequence
  chemically synthesized
actccaagacacataattgt

SEQ ID NO: 94205 - DNA, 20 bp, Artificial Sequence
  chemically synthesized
acataattgtcagattcacc

SEQ ID NO: 94206 - DNA, 20 bp, Artificial Sequence
  chemically synthesized
ttttttccttcatttcaact

SEQ ID NO: 94207 - DNA, 20 bp, Artificial Sequence
  chemically synthesized
agattcaccaagttgaaatg

SEQ ID NO: 94208 - DNA, 20 bp, Artificial Sequence
  chemically synthesized
gattcaccaagttgaaatga

SEQ ID NO: 94209 - DNA, 20 bp, Artificial Sequence
  chemically synthesized
gaaatgaaggaaaaaatgtt

SEQ ID NO: 94210 - DNA, 20 bp, Artificial Sequence
  chemically synthesized
aaatgaaggaaaaaatgtta

SEQ ID NO: 94211 - DNA, 20 bp, Artificial Sequence
  chemically synthesized
aatgaaggaaaaaatgttaa

SEQ ID NO: 94212 - DNA, 20 bp, Artificial Sequence
  chemically synthesized
gaaggaaaaaatgttaaggg

SEQ ID NO: 94213 - DNA, 20 bp, Artificial Sequence
  chemically synthesized
gaaaaaatgttaagggcagc

SEQ ID NO: 94214 - DNA, 20 bp, Artificial Sequence
  chemically synthesized
aaaaatgttaagggcagcca

SEQ ID NO: 94215 - DNA, 20 bp, Artificial Sequence
  chemically synthesized
aaatgttaagggcagccaga

SEQ ID NO: 94216 - DNA, 20 bp, Artificial Sequence
  chemically synthesized
gttaagggcagccagagaga

SEQ ID NO: 94217 - DNA, 20 bp, Artificial Sequence
  chemically synthesized
ttaagggcagccagagagaa

SEQ ID NO: 94218 - DNA, 20 bp, Artificial Sequence
  chemically synthesized
ggtaactcgacctttctctc

SEQ ID NO: 94219 - DNA, 20 bp, Artificial Sequence
  chemically synthesized
ggcagccagagagaaaggtc

SEQ ID NO: 94220 - DNA, 20 bp, Artificial Sequence
  chemically synthesized
gaaaggtcgagttaccctca

SEQ ID NO: 94221 - DNA, 20 bp, Artificial Sequence
  chemically synthesized
aaaggtcgagttaccctcaa

SEQ ID NO: 94222 - DNA, 20 bp, Artificial Sequence
  chemically synthesized
tctgatgggctttcctttga

SEQ ID NO: 94223 - DNA, 20 bp, Artificial Sequence
  chemically synthesized
gtcgagttaccctcaaagga

SEQ ID NO: 94224 - DNA, 20 bp, Artificial Sequence
  chemically synthesized
gtctgatgggctttcctttg

SEQ ID NO: 94225 - DNA, 20 bp, Artificial Sequence
  chemically synthesized
agtctgatgggctttccttt

SEQ ID NO: 94226 - DNA, 20 bp, Artificial Sequence
  chemically synthesized
accctcaaaggaaagcccat

SEQ ID NO: 94227 - DNA, 20 bp, Artificial Sequence
  chemically synthesized
agatccgctgttagtctgat

SEQ ID NO: 94228 - DNA, 20 bp, Artificial Sequence
  chemically synthesized
gagatccgctgttagtctga

SEQ ID NO: 94229 - DNA, 20 bp, Artificial Sequence
  chemically synthesized
aggaaagcccatcagactaa

SEQ ID NO: 94230 - DNA, 20 bp, Artificial Sequence
  chemically synthesized
aaagcccatcagactaacag

SEQ ID NO: 94231 - DNA, 20 bp, Artificial Sequence
  chemically synthesized
tctgccgagagatccgctgt

SEQ ID NO: 94232 - DNA, 20 bp, Artificial Sequence
  chemically synthesized
cagactaacagcggatctct

SEQ ID NO: 94233 - DNA, 20 bp, Artificial Sequence
  chemically synthesized
actaacagcggatctctcgg

SEQ ID NO: 94234 - DNA, 20 bp, Artificial Sequence
  chemically synthesized
gcttgtagggtttctgccga

SEQ ID NO: 94235 - DNA, 20 bp, Artificial Sequence
  chemically synthesized
tggcttgtagggtttctgcc

SEQ ID NO: 94236 - DNA, 20 bp, Artificial Sequence
  chemically synthesized
tctctcggcagaaaccctac

SEQ ID NO: 94237 - DNA, 20 bp, Artificial Sequence
  chemically synthesized
tcggcagaaaccctacaagc

SEQ ID NO: 94238 - DNA, 20 bp, Artificial Sequence
  chemically synthesized
ccactctcttctggcttgta

SEQ ID NO: 94239 - DNA, 20 bp, Artificial Sequence
  chemically synthesized
cccactctcttctggcttgt

SEQ ID NO: 94240 - DNA, 20 bp, Artificial Sequence
  chemically synthesized
ccccactctcttctggcttg

SEQ ID NO: 94241 - DNA, 20 bp, Artificial Sequence
  chemically synthesized
gcagaaaccctacaagccag

SEQ ID NO: 94242 - DNA, 20 bp, Artificial Sequence
  chemically synthesized
agaaaccctacaagccagaa

SEQ ID NO: 94243 - DNA, 20 bp, Artificial Sequence
  chemically synthesized
aaaccctacaagccagaaga

SEQ ID NO: 94244 - DNA, 20 bp, Artificial Sequence
  chemically synthesized
tattggcccccactctcttc

SEQ ID NO: 94245 - DNA, 20 bp, Artificial Sequence
  chemically synthesized
ccctacaagccagaagagag

SEQ ID NO: 94246 - DNA, 20 bp, Artificial Sequence
  chemically synthesized
cctacaagccagaagagagt

SEQ ID NO: 94247 - DNA, 20 bp, Artificial Sequence
  chemically synthesized
ctacaagccagaagagagtg

SEQ ID NO: 94248 - DNA, 20 bp, Artificial Sequence
  chemically synthesized
tacaagccagaagagagtgg

SEQ ID NO: 94249 - DNA, 20 bp, Artificial Sequence
  chemically synthesized
tctttaagaatgttgaatat

SEQ ID NO: 94250 - DNA, 20 bp, Artificial Sequence
  chemically synthesized
gccaatattcaacattctta

SEQ ID NO: 94251 - DNA, 20 bp, Artificial Sequence
  chemically synthesized
tattcaacattcttaaagaa

SEQ ID NO: 94252 - DNA, 20 bp, Artificial Sequence
  chemically synthesized
ggttgaaaattcttttcttt

SEQ ID NO: 94253 - DNA, 20 bp, Artificial Sequence
  chemically synthesized
aaagaaaagaattttcaacc

SEQ ID NO: 94254 - DNA, 20 bp, Artificial Sequence
  chemically synthesized
ttggctggatatgaaattct

SEQ ID NO: 94255 - DNA, 20 bp, Artificial Sequence
  chemically synthesized
tttggctggatatgaaattc

SEQ ID NO: 94256 - DNA, 20 bp, Artificial Sequence
  chemically synthesized
tcaacccagaatttcatatc

SEQ ID NO: 94257 - DNA, 20 bp, Artificial Sequence
  chemically synthesized
cttatgaagcttagtttggc

SEQ ID NO: 94258 - DNA, 20 bp, Artificial Sequence
  chemically synthesized
atttcatatccagccaaact

SEQ ID NO: 94259 - DNA, 20 bp, Artificial Sequence
  chemically synthesized
ttcacttatgaagcttagtt

SEQ ID NO: 94260 - DNA, 20 bp, Artificial Sequence
  chemically synthesized
tctccttcacttatgaagct

SEQ ID NO: 94261 - DNA, 20 bp, Artificial Sequence
  chemically synthesized
ccagccaaactaagcttcat

SEQ ID NO: 94262 - DNA, 20 bp, Artificial Sequence
  chemically synthesized
ttatttctccttcacttatg

SEQ ID NO: 94263 - DNA, 20 bp, Artificial Sequence
  chemically synthesized
caaactaagcttcataagtg

SEQ ID NO: 94264 - DNA, 20 bp, Artificial Sequence
  chemically synthesized
aaactaagcttcataagtga

SEQ ID NO: 94265 - DNA, 20 bp, Artificial Sequence
  chemically synthesized
actaagcttcataagtgaag

SEQ ID NO: 94266 - DNA, 20 bp, Artificial Sequence
  chemically synthesized
aggagaaataaaatacttta

SEQ ID NO: 94267 - DNA, 20 bp, Artificial Sequence
  chemically synthesized
aaataaaatactttatagac

SEQ ID NO: 94268 - DNA, 20 bp, Artificial Sequence
  chemically synthesized
tcagcatttgcttgtctata

SEQ ID NO: 94269 - DNA, 20 bp, Artificial Sequence
  chemically synthesized
tttatagacaagcaaatgct

SEQ ID NO: 94270 - DNA, 20 bp, Artificial Sequence
  chemically synthesized
tatagacaagcaaatgctga

SEQ ID NO: 94271 - DNA, 20 bp, Artificial Sequence
  chemically synthesized
ctggtggtgacaaaatctct

SEQ ID NO: 94272 - DNA, 20 bp, Artificial Sequence
  chemically synthesized
ctgagagattttgtcaccac

SEQ ID NO: 94273 - DNA, 20 bp, Artificial Sequence
  chemically synthesized
tgagagattttgtcaccacc

SEQ ID NO: 94274 - DNA, 20 bp, Artificial Sequence
  chemically synthesized
ctcttttagggcaggcctgg

SEQ ID NO: 94275 - DNA, 20 bp, Artificial Sequence
  chemically synthesized
gagctcttttagggcaggcc

SEQ ID NO: 94276 - DNA, 20 bp, Artificial Sequence
  chemically synthesized
caccaccaggcctgccctaa

SEQ ID NO: 94277 - DNA, 20 bp, Artificial Sequence
  chemically synthesized
ttcaggagctcttttagggc

SEQ ID NO: 94278 - DNA, 20 bp, Artificial Sequence
  chemically synthesized
cttcaggagctcttttaggg

SEQ ID NO: 94279 - DNA, 20 bp, Artificial Sequence
  chemically synthesized
ccaccaggcctgccctaaaa

SEQ ID NO: 94280 - DNA, 20 bp, Artificial Sequence
  chemically synthesized
ttccttcaggagctctttta

SEQ ID NO: 94281 - DNA, 20 bp, Artificial Sequence
  chemically synthesized
cttccttcaggagctctttt

SEQ ID NO: 94282 - DNA, 20 bp, Artificial Sequence
  chemically synthesized
gcttccttcaggagctcttt

SEQ ID NO: 94283 - DNA, 20 bp, Artificial Sequence
  chemically synthesized
ctgccctaaaagagctcctg

SEQ ID NO: 94284 - DNA, 20 bp, Artificial Sequence
  chemically synthesized
tgccctaaaagagctcctga

SEQ ID NO: 94285 - DNA, 20 bp, Artificial Sequence
  chemically synthesized
cctaaaagagctcctgaagg

SEQ ID NO: 94286 - DNA, 20 bp, Artificial Sequence
  chemically synthesized
atgtttagcgcttccttcag

SEQ ID NO: 94287 - DNA, 20 bp, Artificial Sequence
  chemically synthesized
ccatgtttagcgcttccttc

SEQ ID NO: 94288 - DNA, 20 bp, Artificial Sequence
  chemically synthesized
tccatgtttagcgcttcctt

SEQ ID NO: 94289 - DNA, 20 bp, Artificial Sequence
  chemically synthesized
cctgaaggaagcgctaaaca

SEQ ID NO: 94290 - DNA, 20 bp, Artificial Sequence
  chemically synthesized
cggttgttcctttccatgtt

SEQ ID NO: 94291 - DNA, 20 bp, Artificial Sequence
  chemically synthesized
aaggaagcgctaaacatgga

SEQ ID NO: 94292 - DNA, 20 bp, Artificial Sequence
  chemically synthesized
aggaagcgctaaacatggaa

SEQ ID NO: 94293 - DNA, 20 bp, Artificial Sequence
  chemically synthesized
taaacatggaaaggaacaac

SEQ ID NO: 94294 - DNA, 20 bp, Artificial Sequence
  chemically synthesized
tggaaaggaacaaccggtac

SEQ ID NO: 94295 - DNA, 20 bp, Artificial Sequence
  chemically synthesized
gattttgcagcggctggtac

SEQ ID NO: 94296 - DNA, 20 bp, Artificial Sequence
  chemically synthesized
tggcatgattttgcagcggc

SEQ ID NO: 94297 - DNA, 20 bp, Artificial Sequence
  chemically synthesized
attttggcatgattttgcag

SEQ ID NO: 94298 - DNA, 20 bp, Artificial Sequence
  chemically synthesized
tacattttggcatgattttg

SEQ ID NO: 94299 - DNA, 20 bp, Artificial Sequence
  chemically synthesized
caaaatcatgccaaaatgta

SEQ ID NO: 94300 - DNA, 20 bp, Artificial Sequence
  chemically synthesized
tctcgatggtctttacattt

SEQ ID NO: 94301 - DNA, 20 bp, Artificial Sequence
  chemically synthesized
gccaaaatgtaaagaccatc

SEQ ID NO: 94302 - DNA, 20 bp, Artificial Sequence
  chemically synthesized
aatgtaaagaccatcgagac

SEQ ID NO: 94303 - DNA, 20 bp, Artificial Sequence
  chemically synthesized
cagtttcttcctagtctcga

SEQ ID NO: 94304 - DNA, 20 bp, Artificial Sequence
  chemically synthesized
atgtaaagaccatcgagact

SEQ ID NO: 94305 - DNA, 20 bp, Artificial Sequence
  chemically synthesized
taaagaccatcgagactagg

SEQ ID NO: 94306 - DNA, 20 bp, Artificial Sequence
  chemically synthesized
tagttgatgcagtttcttcc

SEQ ID NO: 94307 - DNA, 20 bp, Artificial Sequence
  chemically synthesized
attttgctcattagttgatg

SEQ ID NO: 94308 - DNA, 20 bp, Artificial Sequence
  chemically synthesized
aagaaactgcatcaactaat

SEQ ID NO: 94309 - DNA, 20 bp, Artificial Sequence
  chemically synthesized
tagctggtgattttgctcat

SEQ ID NO: 94310 - DNA, 20 bp, Artificial Sequence
  chemically synthesized
caactaatgagcaaaatcac

SEQ ID NO: 94311 - DNA, 20 bp, Artificial Sequence
  chemically synthesized
cctgtcattatgatgttagc

SEQ ID NO: 94312 - DNA, 20 bp, Artificial Sequence
  chemically synthesized
tgatcctgtcattatgatgt

SEQ ID NO: 94313 - DNA, 20 bp, Artificial Sequence
  chemically synthesized
accagctaacatcataatga

SEQ ID NO: 94314 - DNA, 20 bp, Artificial Sequence
  chemically synthesized
ccagctaacatcataatgac

SEQ ID NO: 94315 - DNA, 20 bp, Artificial Sequence
  chemically synthesized
atttagtccatttatattta

SEQ ID NO: 94316 - DNA, 20 bp, Artificial Sequence
  chemically synthesized
atattaactttaaatataaa

SEQ ID NO: 94317 - DNA, 20 bp, Artificial Sequence
  chemically synthesized
tgtcttttaattgcagaatt

SEQ ID NO: 94318 - DNA, 20 bp, Artificial Sequence
  chemically synthesized
ggactaaattctgcaattaa

SEQ ID NO: 94319 - DNA, 20 bp, Artificial Sequence
  chemically synthesized
cagtctgtgtcttttaattg

SEQ ID NO: 94320 - DNA, 20 bp, Artificial Sequence
  chemically synthesized
aattctgcaattaaaagaca

SEQ ID NO: 94321 - DNA, 20 bp, Artificial Sequence
  chemically synthesized
tgcaattaaaagacacagac

SEQ ID NO: 94322 - DNA, 20 bp, Artificial Sequence
  chemically synthesized
attaaaagacacagactggc

SEQ ID NO: 94323 - DNA, 20 bp, Artificial Sequence
  chemically synthesized
aaagacacagactggcaagt

SEQ ID NO: 94324 - DNA, 20 bp, Artificial Sequence
  chemically synthesized
tgactctttatccaacttgc

SEQ ID NO: 94325 - DNA, 20 bp, Artificial Sequence
  chemically synthesized
acagactggcaagttggata

SEQ ID NO: 94326 - DNA, 20 bp, Artificial Sequence
  chemically synthesized
agactggcaagttggataaa

SEQ ID NO: 94327 - DNA, 20 bp, Artificial Sequence
  chemically synthesized
ggcaagttggataaagagtc

SEQ ID NO: 94328 - DNA, 20 bp, Artificial Sequence
  chemically synthesized
gataaagagtcaagacccat

SEQ ID NO: 94329 - DNA, 20 bp, Artificial Sequence
  chemically synthesized
cctgaatacagcacactgat

SEQ ID NO: 94330 - DNA, 20 bp, Artificial Sequence
  chemically synthesized
tcctgaatacagcacactga

SEQ ID NO: 94331 - DNA, 20 bp, Artificial Sequence
  chemically synthesized
acccatcagtgtgctgtatt

SEQ ID NO: 94332 - DNA, 20 bp, Artificial Sequence
  chemically synthesized
cccatcagtgtgctgtattc

SEQ ID NO: 94333 - DNA, 20 bp, Artificial Sequence
  chemically synthesized
tgagatgggtttcctgaata

SEQ ID NO: 94334 - DNA, 20 bp, Artificial Sequence
  chemically synthesized
tgtgtctctgcacgtgagat

SEQ ID NO: 94335 - DNA, 20 bp, Artificial Sequence
  chemically synthesized
gtgtgtctctgcacgtgaga

SEQ ID NO: 94336 - DNA, 20 bp, Artificial Sequence
  chemically synthesized
caggaaacccatctcacgtg

SEQ ID NO: 94337 - DNA, 20 bp, Artificial Sequence
  chemically synthesized
ggaaacccatctcacgtgca

SEQ ID NO: 94338 - DNA, 20 bp, Artificial Sequence
  chemically synthesized
ctatgtgtgtctctgcacgt

SEQ ID NO: 94339 - DNA, 20 bp, Artificial Sequence
  chemically synthesized
ctcacgtgcagagacacaca

SEQ ID NO: 94340 - DNA, 20 bp, Artificial Sequence
  chemically synthesized
tcacgtgcagagacacacat

SEQ ID NO: 94341 - DNA, 20 bp, Artificial Sequence
  chemically synthesized
cacacataggctcaaaataa

SEQ ID NO: 94342 - DNA, 20 bp, Artificial Sequence
  chemically synthesized
ttcctccatccttttatttt

SEQ ID NO: 94343 - DNA, 20 bp, Artificial Sequence
  chemically synthesized
acacataggctcaaaataaa

SEQ ID NO: 94344 - DNA, 20 bp, Artificial Sequence
  chemically synthesized
ataggctcaaaataaaagga

SEQ ID NO: 94345 - DNA, 20 bp, Artificial Sequence
  chemically synthesized
aggctcaaaataaaaggatg

SEQ ID NO: 94346 - DNA, 20 bp, Artificial Sequence
  chemically synthesized
ggctcaaaataaaaggatgg

SEQ ID NO: 94347 - DNA, 20 bp, Artificial Sequence
  chemically synthesized
tcaaaataaaaggatggagg

SEQ ID NO: 94348 - DNA, 20 bp, Artificial Sequence
  chemically synthesized
aggatggaggaagatctacc

SEQ ID NO: 94349 - DNA, 20 bp, Artificial Sequence
  chemically synthesized
tttgttttccatttgcttgg

SEQ ID NO: 94350 - DNA, 20 bp, Artificial Sequence
  chemically synthesized
aggaagatctaccaagcaaa

SEQ ID NO: 94351 - DNA, 20 bp, Artificial Sequence
  chemically synthesized
ttttttgttttccatttgct

SEQ ID NO: 94352 - DNA, 20 bp, Artificial Sequence
  chemically synthesized
aagcaaatggaaaacaaaaa

SEQ ID NO: 94353 - DNA, 20 bp, Artificial Sequence
  chemically synthesized
agcaaatggaaaacaaaaaa

SEQ ID NO: 94354 - DNA, 20 bp, Artificial Sequence
  chemically synthesized
aaatggaaaacaaaaaaagg

SEQ ID NO: 94355 - DNA, 20 bp, Artificial Sequence
  chemically synthesized
aatggaaaacaaaaaaaggc

SEQ ID NO: 94356 - DNA, 20 bp, Artificial Sequence
  chemically synthesized
atggaaaacaaaaaaaggca

SEQ ID NO: 94357 - DNA, 20 bp, Artificial Sequence
  chemically synthesized
tggaaaacaaaaaaaggcag

SEQ ID NO: 94358 - DNA, 20 bp, Artificial Sequence
  chemically synthesized
aaaggcaggggttgcaatcc

SEQ ID NO: 94359 - DNA, 20 bp, Artificial Sequence
  chemically synthesized
agtctgttttatcagagact

SEQ ID NO: 94360 - DNA, 20 bp, Artificial Sequence
  chemically synthesized
aagtctgttttatcagagac

SEQ ID NO: 94361 - DNA, 20 bp, Artificial Sequence
  chemically synthesized
gtttaaagtctgttttatca

SEQ ID NO: 94362 - DNA, 20 bp, Artificial Sequence
  chemically synthesized
aatcctagtctctgataaaa

SEQ ID NO: 94363 - DNA, 20 bp, Artificial Sequence
  chemically synthesized
tggtttaaagtctgttttat

SEQ ID NO: 94364 - DNA, 20 bp, Artificial Sequence
  chemically synthesized
ttttgatctttgttggttta

SEQ ID NO: 94365 - DNA, 20 bp, Artificial Sequence
  chemically synthesized
aaacagactttaaaccaaca

SEQ ID NO: 94366 - DNA, 20 bp, Artificial Sequence
  chemically synthesized
ttgtctcttttgatctttgt

SEQ ID NO: 94367 - DNA, 20 bp, Artificial Sequence
  chemically synthesized
tttaaaccaacaaagatcaa

SEQ ID NO: 94368 - DNA, 20 bp, Artificial Sequence
  chemically synthesized
taaaccaacaaagatcaaaa

SEQ ID NO: 94369 - DNA, 20 bp, Artificial Sequence
  chemically synthesized
aacaaagatcaaaagagaca

SEQ ID NO: 94370 - DNA, 20 bp, Artificial Sequence
  chemically synthesized
aaagatcaaaagagacaaag

SEQ ID NO: 94371 - DNA, 20 bp, Artificial Sequence
  chemically synthesized
aagatcaaaagagacaaaga

SEQ ID NO: 94372 - DNA, 20 bp, Artificial Sequence
  chemically synthesized
atccctttaccattatgtaa

SEQ ID NO: 94373 - DNA, 20 bp, Artificial Sequence
  chemically synthesized
caaagaaggccattacataa

SEQ ID NO: 94374 - DNA, 20 bp, Artificial Sequence
  chemically synthesized
aaggccattacataatggta

SEQ ID NO: 94375 - DNA, 20 bp, Artificial Sequence
  chemically synthesized
aggccattacataatggtaa

SEQ ID NO: 94376 - DNA, 20 bp, Artificial Sequence
  chemically synthesized
ggccattacataatggtaaa

SEQ ID NO: 94377 - DNA, 20 bp, Artificial Sequence
  chemically synthesized
ggtaaagggatcaattcaac

SEQ ID NO: 94378 - DNA, 20 bp, Artificial Sequence
  chemically synthesized
taaagggatcaattcaacaa

SEQ ID NO: 94379 - DNA, 20 bp, Artificial Sequence
  chemically synthesized
aaagggatcaattcaacaag

SEQ ID NO: 94380 - DNA, 20 bp, Artificial Sequence
  chemically synthesized
agggatcaattcaacaagag

SEQ ID NO: 94381 - DNA, 20 bp, Artificial Sequence
  chemically synthesized
gcataaatatttaggatagt

SEQ ID NO: 94382 - DNA, 20 bp, Artificial Sequence
  chemically synthesized
gggtgcataaatatttagga

SEQ ID NO: 94383 - DNA, 20 bp, Artificial Sequence
  chemically synthesized
tattgggtgcataaatattt

SEQ ID NO: 94384 - DNA, 20 bp, Artificial Sequence
  chemically synthesized
gtattgggtgcataaatatt

SEQ ID NO: 94385 - DNA, 20 bp, Artificial Sequence
  chemically synthesized
aaatatttatgcacccaata

SEQ ID NO: 94386 - DNA, 20 bp, Artificial Sequence
  chemically synthesized
aatatttatgcacccaatac

SEQ ID NO: 94387 - DNA, 20 bp, Artificial Sequence
  chemically synthesized
tatttatgcacccaatacag

SEQ ID NO: 94388 - DNA, 20 bp, Artificial Sequence
  chemically synthesized
aatctgggtgctcctgtatt

SEQ ID NO: 94389 - DNA, 20 bp, Artificial Sequence
  chemically synthesized
gaatctgggtgctcctgtat

SEQ ID NO: 94390 - DNA, 20 bp, Artificial Sequence
  chemically synthesized
gcacccaatacaggagcacc

SEQ ID NO: 94391 - DNA, 20 bp, Artificial Sequence
  chemically synthesized
aggacttgctttatgaatct

SEQ ID NO: 94392 - DNA, 20 bp, Artificial Sequence
  chemically synthesized
caggacttgctttatgaatc

SEQ ID NO: 94393 - DNA, 20 bp, Artificial Sequence
  chemically synthesized
caggagcacccagattcata

SEQ ID NO: 94394 - DNA, 20 bp, Artificial Sequence
  chemically synthesized
agcacccagattcataaagc

SEQ ID NO: 94395 - DNA, 20 bp, Artificial Sequence
  chemically synthesized
agattcataaagcaagtcct

SEQ ID NO: 94396 - DNA, 20 bp, Artificial Sequence
  chemically synthesized
agtctctttgtaggtcactc

SEQ ID NO: 94397 - DNA, 20 bp, Artificial Sequence
  chemically synthesized
aagtctctttgtaggtcact

SEQ ID NO: 94398 - DNA, 20 bp, Artificial Sequence
  chemically synthesized
caagtcctgagtgacctaca

SEQ ID NO: 94399 - DNA, 20 bp, Artificial Sequence
  chemically synthesized
agtcctgagtgacctacaaa

SEQ ID NO: 94400 - DNA, 20 bp, Artificial Sequence
  chemically synthesized
gggagtctaagtctctttgt

SEQ ID NO: 94401 - DNA, 20 bp, Artificial Sequence
  chemically synthesized
tgggagtctaagtctctttg

SEQ ID NO: 94402 - DNA, 20 bp, Artificial Sequence
  chemically synthesized
gagtgacctacaaagagact

SEQ ID NO: 94403 - DNA, 20 bp, Artificial Sequence
  chemically synthesized
ttattaatgtgtgggagtct

SEQ ID NO: 94404 - DNA, 20 bp, Artificial Sequence
  chemically synthesized
ctcccattattaatgtgtgg

SEQ ID NO: 94405 - DNA, 20 bp, Artificial Sequence
  chemically synthesized
gtctcccattattaatgtgt

SEQ ID NO: 94406 - DNA, 20 bp, Artificial Sequence
  chemically synthesized
agtctcccattattaatgtg

SEQ ID NO: 94407 - DNA, 20 bp, Artificial Sequence
  chemically synthesized
agactcccacacattaataa

SEQ ID NO: 94408 - DNA, 20 bp, Artificial Sequence
  chemically synthesized
gactcccacacattaataat

SEQ ID NO: 94409 - DNA, 20 bp, Artificial Sequence
  chemically synthesized
ctcccacacattaataatgg

SEQ ID NO: 94410 - DNA, 20 bp, Artificial Sequence
  chemically synthesized
atgttgacagtggggtgtta

SEQ ID NO: 94411 - DNA, 20 bp, Artificial Sequence
  chemically synthesized
tctgtctaatgttgacagtg

SEQ ID NO: 94412 - DNA, 20 bp, Artificial Sequence
  chemically synthesized
atctgtctaatgttgacagt

SEQ ID NO: 94413 - DNA, 20 bp, Artificial Sequence
  chemically synthesized
gatctgtctaatgttgacag

SEQ ID NO: 94414 - DNA, 20 bp, Artificial Sequence
  chemically synthesized
taacaccccactgtcaacat

SEQ ID NO: 94415 - DNA, 20 bp, Artificial Sequence
  chemically synthesized
gttgatctgtctaatgttga

SEQ ID NO: 94416 - DNA, 20 bp, Artificial Sequence
  chemically synthesized
accccactgtcaacattaga

SEQ ID NO: 94417 - DNA, 20 bp, Artificial Sequence
  chemically synthesized
tcaacattagacagatcaac

SEQ ID NO: 94418 - DNA, 20 bp, Artificial Sequence
  chemically synthesized
cattagacagatcaacgaga

SEQ ID NO: 94419 - DNA, 20 bp, Artificial Sequence
  chemically synthesized
agacagatcaacgagacaga

SEQ ID NO: 94420 - DNA, 20 bp, Artificial Sequence
  chemically synthesized
caacgagacagaaagtcaac

SEQ ID NO: 94421 - DNA, 20 bp, Artificial Sequence
  chemically synthesized
aacgagacagaaagtcaaca

SEQ ID NO: 94422 - DNA, 20 bp, Artificial Sequence
  chemically synthesized
agaaagtcaacaaggatacc

SEQ ID NO: 94423 - DNA, 20 bp, Artificial Sequence
  chemically synthesized
gaaagtcaacaaggataccc

SEQ ID NO: 94424 - DNA, 20 bp, Artificial Sequence
  chemically synthesized
cagagctgagttcaattcct

SEQ ID NO: 94425 - DNA, 20 bp, Artificial Sequence
  chemically synthesized
gcagagctgagttcaattcc

SEQ ID NO: 94426 - DNA, 20 bp, Artificial Sequence
  chemically synthesized
ggatacccaggaattgaact

SEQ ID NO: 94427 - DNA, 20 bp, Artificial Sequence
  chemically synthesized
ggtctccttggtgcagagct

SEQ ID NO: 94428 - DNA, 20 bp, Artificial Sequence
  chemically synthesized
attgaactcagctctgcacc

SEQ ID NO: 94429 - DNA, 20 bp, Artificial Sequence
  chemically synthesized
ttgaactcagctctgcacca

SEQ ID NO: 94430 - DNA, 20 bp, Artificial Sequence
  chemically synthesized
tattaggtctccttggtgca

SEQ ID NO: 94431 - DNA, 20 bp, Artificial Sequence
  chemically synthesized
gaactcagctctgcaccaag

SEQ ID NO: 94432 - DNA, 20 bp, Artificial Sequence
  chemically synthesized
tctattaggtctccttggtg

SEQ ID NO: 94433 - DNA, 20 bp, Artificial Sequence
  chemically synthesized
agatgtctattaggtctcct

SEQ ID NO: 94434 - DNA, 20 bp, Artificial Sequence
  chemically synthesized
tctgcaccaaggagacctaa

SEQ ID NO: 94435 - DNA, 20 bp, Artificial Sequence
  chemically synthesized
gagttctgtagatgtctatt

SEQ ID NO: 94436 - DNA, 20 bp, Artificial Sequence
  chemically synthesized
agagttctgtagatgtctat

SEQ ID NO: 94437 - DNA, 20 bp, Artificial Sequence
  chemically synthesized
ggagacctaatagacatcta

SEQ ID NO: 94438 - DNA, 20 bp, Artificial Sequence
  chemically synthesized
atttggggtggagagttctg

SEQ ID NO: 94439 - DNA, 20 bp, Artificial Sequence
  chemically synthesized
ttctgttgatttggggtgga

SEQ ID NO: 94440 - DNA, 20 bp, Artificial Sequence
  chemically synthesized
tattctgttgatttggggtg

SEQ ID NO: 94441 - DNA, 20 bp, Artificial Sequence
  chemically synthesized
tatattctgttgatttgggg

SEQ ID NO: 94442 - DNA, 20 bp, Artificial Sequence
  chemically synthesized
atgtatattctgttgatttg

SEQ ID NO: 94443 - DNA, 20 bp, Artificial Sequence
  chemically synthesized
aactctccaccccaaatcaa

SEQ ID NO: 94444 - DNA, 20 bp, Artificial Sequence
  chemically synthesized
aatgtatattctgttgattt

SEQ ID NO: 94445 - DNA, 20 bp, Artificial Sequence
  chemically synthesized
aaatgtatattctgttgatt

SEQ ID NO: 94446 - DNA, 20 bp, Artificial Sequence
  chemically synthesized
aacagaatatacattttttt

SEQ ID NO: 94447 - DNA, 20 bp, Artificial Sequence
  chemically synthesized
attttggaataggtgtggtg

SEQ ID NO: 94448 - DNA, 20 bp, Artificial Sequence
  chemically synthesized
ggtcaattttggaataggtg

SEQ ID NO: 94449 - DNA, 20 bp, Artificial Sequence
  chemically synthesized
tatgtggtcaattttggaat

SEQ ID NO: 94450 - DNA, 20 bp, Artificial Sequence
  chemically synthesized
gtatgtggtcaattttggaa

SEQ ID NO: 94451 - DNA, 20 bp, Artificial Sequence
  chemically synthesized
tccaagtatgtggtcaattt

SEQ ID NO: 94452 - DNA, 20 bp, Artificial Sequence
  chemically synthesized
tccaaaattgaccacatact

SEQ ID NO: 94453 - DNA, 20 bp, Artificial Sequence
  chemically synthesized
gagctttacttccaagtatg

SEQ ID NO: 94454 - DNA, 20 bp, Artificial Sequence
  chemically synthesized
aaaattgaccacatacttgg

SEQ ID NO: 94455 - DNA, 20 bp, Artificial Sequence
  chemically synthesized
tgaccacatacttggaagta

SEQ ID NO: 94456 - DNA, 20 bp, Artificial Sequence
  chemically synthesized
ctgaggagagctttacttcc

SEQ ID NO: 94457 - DNA, 20 bp, Artificial Sequence
  chemically synthesized
cttggaagtaaagctctcct

SEQ ID NO: 94458 - DNA, 20 bp, Artificial Sequence
  chemically synthesized
tcttttacatttgctgagga

SEQ ID NO: 94459 - DNA, 20 bp, Artificial Sequence
  chemically synthesized
gttcttttacatttgctgag

SEQ ID NO: 94460 - DNA, 20 bp, Artificial Sequence
  chemically synthesized
ctgttcttttacatttgctg

SEQ ID NO: 94461 - DNA, 20 bp, Artificial Sequence
  chemically synthesized
tctgttcttttacatttgct

SEQ ID NO: 94462 - DNA, 20 bp, Artificial Sequence
  chemically synthesized
gctctcctcagcaaatgtaa

SEQ ID NO: 94463 - DNA, 20 bp, Artificial Sequence
  chemically synthesized
cctcagcaaatgtaaaagaa

SEQ ID NO: 94464 - DNA, 20 bp, Artificial Sequence
  chemically synthesized
aattataacaaactatctct

SEQ ID NO: 94465 - DNA, 20 bp, Artificial Sequence
  chemically synthesized
ttgcactgtggtctgagaga

SEQ ID NO: 94466 - DNA, 20 bp, Artificial Sequence
  chemically synthesized
ttgattgcactgtggtctga

SEQ ID NO: 94467 - DNA, 20 bp, Artificial Sequence
  chemically synthesized
acaaactatctctcagacca

SEQ ID NO: 94468 - DNA, 20 bp, Artificial Sequence
  chemically synthesized
gtttgattgcactgtggtct

SEQ ID NO: 94469 - DNA, 20 bp, Artificial Sequence
  chemically synthesized
gttctagtttgattgcactg

SEQ ID NO: 94470 - DNA, 20 bp, Artificial Sequence
  chemically synthesized
agaccacagtgcaatcaaac

SEQ ID NO: 94471 - DNA, 20 bp, Artificial Sequence
  chemically synthesized
agtgcaatcaaactagaact

SEQ ID NO: 94472 - DNA, 20 bp, Artificial Sequence
  chemically synthesized
gtgcaatcaaactagaactc

SEQ ID NO: 94473 - DNA, 20 bp, Artificial Sequence
  chemically synthesized
agattcttaatcctgagttc

SEQ ID NO: 94474 - DNA, 20 bp, Artificial Sequence
  chemically synthesized
tcaaactagaactcaggatt

SEQ ID NO: 94475 - DNA, 20 bp, Artificial Sequence
  chemically synthesized
tgagtgagattcttaatcct

SEQ ID NO: 94476 - DNA, 20 bp, Artificial Sequence
  chemically synthesized
aggattaagaatctcactca

SEQ ID NO: 94477 - DNA, 20 bp, Artificial Sequence
  chemically synthesized
gtagttgagcggctttgagt

SEQ ID NO: 94478 - DNA, 20 bp, Artificial Sequence
  chemically synthesized
ccatgtagttgagcggcttt

SEQ ID NO: 94479 - DNA, 20 bp, Artificial Sequence
  chemically synthesized
tcagtttccatgtagttgag

SEQ ID NO: 94480 - DNA, 20 bp, Artificial Sequence
  chemically synthesized
ctcaaagccgctcaactaca

SEQ ID NO: 94481 - DNA, 20 bp, Artificial Sequence
  chemically synthesized
tgttcagtttccatgtagtt

SEQ ID NO: 94482 - DNA, 20 bp, Artificial Sequence
  chemically synthesized
caggttgttcagtttccatg

SEQ ID NO: 94483 - DNA, 20 bp, Artificial Sequence
  chemically synthesized
tcattcaggagcaggttgtt

SEQ ID NO: 94484 - DNA, 20 bp, Artificial Sequence
  chemically synthesized
cccagtagtcattcaggagc

SEQ ID NO: 94485 - DNA, 20 bp, Artificial Sequence
  chemically synthesized
acccagtagtcattcaggag

SEQ ID NO: 94486 - DNA, 20 bp, Artificial Sequence
  chemically synthesized
tgtacccagtagtcattcag

SEQ ID NO: 94487 - DNA, 20 bp, Artificial Sequence
  chemically synthesized
tatgtacccagtagtcattc

SEQ ID NO: 94488 - DNA, 20 bp, Artificial Sequence
  chemically synthesized
ttatgtacccagtagtcatt

SEQ ID NO: 94489 - DNA, 20 bp, Artificial Sequence
  chemically synthesized
acctgctcctgaatgactac

SEQ ID NO: 94490 - DNA, 20 bp, Artificial Sequence
  chemically synthesized
cctgctcctgaatgactact

SEQ ID NO: 94491 - DNA, 20 bp, Artificial Sequence
  chemically synthesized
tcatttcgttatgtacccag

SEQ ID NO: 94492 - DNA, 20 bp, Artificial Sequence
  chemically synthesized
ccttcatttcgttatgtacc

SEQ ID NO: 94493 - DNA, 20 bp, Artificial Sequence
  chemically synthesized
actgggtacataacgaaatg

SEQ ID NO: 94494 - DNA, 20 bp, Artificial Sequence
  chemically synthesized
ctgggtacataacgaaatga

SEQ ID NO: 94495 - DNA, 20 bp, Artificial Sequence
  chemically synthesized
ggtacataacgaaatgaagg

SEQ ID NO: 94496 - DNA, 20 bp, Artificial Sequence
  chemically synthesized
acgaaatgaaggcagaaata

SEQ ID NO: 94497 - DNA, 20 bp, Artificial Sequence
  chemically synthesized
ctttgttctcgttggtttca

SEQ ID NO: 94498 - DNA, 20 bp, Artificial Sequence
  chemically synthesized
agatgttctttgaaaccaac

SEQ ID NO: 94499 - DNA, 20 bp, Artificial Sequence
  chemically synthesized
tgtggtgtctttgttctcgt

SEQ ID NO: 94500 - DNA, 20 bp, Artificial Sequence
  chemically synthesized
ctttgaaaccaacgagaaca

SEQ ID NO: 94501 - DNA, 20 bp, Artificial Sequence
  chemically synthesized
agaacaaagacaccacatac

SEQ ID NO: 94502 - DNA, 20 bp, Artificial Sequence
  chemically synthesized
gtcccagagattctggtatg

SEQ ID NO: 94503 - DNA, 20 bp, Artificial Sequence
  chemically synthesized
acaccacataccagaatctc

SEQ ID NO: 94504 - DNA, 20 bp, Artificial Sequence
  chemically synthesized
tgaatgcgtcccagagattc

SEQ ID NO: 94505 - DNA, 20 bp, Artificial Sequence
  chemically synthesized
caccacataccagaatctct

SEQ ID NO: 94506 - DNA, 20 bp, Artificial Sequence
  chemically synthesized
actgctttgaatgcgtccca

SEQ ID NO: 94507 - DNA, 20 bp, Artificial Sequence
  chemically synthesized
acactgctttgaatgcgtcc

SEQ ID NO: 94508 - DNA, 20 bp, Artificial Sequence
  chemically synthesized
gaatctctgggacgcattca

SEQ ID NO: 94509 - DNA, 20 bp, Artificial Sequence
  chemically synthesized
tctctgggacgcattcaaag

SEQ ID NO: 94510 - DNA, 20 bp, Artificial Sequence
  chemically synthesized
gacgcattcaaagcagtgtg

SEQ ID NO: 94511 - DNA, 20 bp, Artificial Sequence
  chemically synthesized
cgcattcaaagcagtgtgta

SEQ ID NO: 94512 - DNA, 20 bp, Artificial Sequence
  chemically synthesized
gcattcaaagcagtgtgtag

SEQ ID NO: 94513 - DNA, 20 bp, Artificial Sequence
  chemically synthesized
cattcaaagcagtgtgtaga

SEQ ID NO: 94514 - DNA, 20 bp, Artificial Sequence
  chemically synthesized
agtgtgtagagggaaattta

SEQ ID NO: 94515 - DNA, 20 bp, Artificial Sequence
  chemically synthesized
tgctttctcttgtaggcatt

SEQ ID NO: 94516 - DNA, 20 bp, Artificial Sequence
  chemically synthesized
ttatagcactaaatgcctac

SEQ ID NO: 94517 - DNA, 20 bp, Artificial Sequence
  chemically synthesized
atagcactaaatgcctacaa

SEQ ID NO: 94518 - DNA, 20 bp, Artificial Sequence
  chemically synthesized
tctttcctgctttctcttgt

SEQ ID NO: 94519 - DNA, 20 bp, Artificial Sequence
  chemically synthesized
cactaaatgcctacaagaga

SEQ ID NO: 94520 - DNA, 20 bp, Artificial Sequence
  chemically synthesized
atctttcctgctttctcttg

SEQ ID NO: 94521 - DNA, 20 bp, Artificial Sequence
  chemically synthesized
taaatgcctacaagagaaag

SEQ ID NO: 94522 - DNA, 20 bp, Artificial Sequence
  chemically synthesized
aaatgcctacaagagaaagc

SEQ ID NO: 94523 - DNA, 20 bp, Artificial Sequence
  chemically synthesized
gcctacaagagaaagcagga

SEQ ID NO: 94524 - DNA, 20 bp, Artificial Sequence
  chemically synthesized
tgatgttagggtgtcaattt

SEQ ID NO: 94525 - DNA, 20 bp, Artificial Sequence
  chemically synthesized
ttcttttaattgtgatgtta

SEQ ID NO: 94526 - DNA, 20 bp, Artificial Sequence
  chemically synthesized
gttcttttaattgtgatgtt

SEQ ID NO: 94527 - DNA, 20 bp, Artificial Sequence
  chemically synthesized
agttcttttaattgtgatgt

SEQ ID NO: 94528 - DNA, 20 bp, Artificial Sequence
  chemically synthesized
caccctaacatcacaattaa

SEQ ID NO: 94529 - DNA, 20 bp, Artificial Sequence
  chemically synthesized
aacatcacaattaaaagaac

SEQ ID NO: 94530 - DNA, 20 bp, Artificial Sequence
  chemically synthesized
cacaattaaaagaactagaa

SEQ ID NO: 94531 - DNA, 20 bp, Artificial Sequence
  chemically synthesized
attaaaagaactagaaaagc

SEQ ID NO: 94532 - DNA, 20 bp, Artificial Sequence
  chemically synthesized
tgtgtttgctcttgcttttc

SEQ ID NO: 94533 - DNA, 20 bp, Artificial Sequence
  chemically synthesized
taaaagaactagaaaagcaa

SEQ ID NO: 94534 - DNA, 20 bp, Artificial Sequence
  chemically synthesized
gcaagagcaaacacattcaa

SEQ ID NO: 94535 - DNA, 20 bp, Artificial Sequence
  chemically synthesized
gagcaaacacattcaaaagc

SEQ ID NO: 94536 - DNA, 20 bp, Artificial Sequence
  chemically synthesized
caaacacattcaaaagctag

SEQ ID NO: 94537 - DNA, 20 bp, Artificial Sequence
  chemically synthesized
acacattcaaaagctagcag

SEQ ID NO: 94538 - DNA, 20 bp, Artificial Sequence
  chemically synthesized
cacattcaaaagctagcaga

SEQ ID NO: 94539 - DNA, 20 bp, Artificial Sequence
  chemically synthesized
agttatttcttgccttctgc

SEQ ID NO: 94540 - DNA, 20 bp, Artificial Sequence
  chemically synthesized
ttcaaaagctagcagaaggc

SEQ ID NO: 94541 - DNA, 20 bp, Artificial Sequence
  chemically synthesized
aggcaagaaataactaaaat

SEQ ID NO: 94542 - DNA, 20 bp, Artificial Sequence
  chemically synthesized
gcaagaaataactaaaatca

SEQ ID NO: 94543 - DNA, 20 bp, Artificial Sequence
  chemically synthesized
cttcagttctgctctgattt

SEQ ID NO: 94544 - DNA, 20 bp, Artificial Sequence
  chemically synthesized
agaaataactaaaatcagag

SEQ ID NO: 94545 - DNA, 20 bp, Artificial Sequence
  chemically synthesized
ctaaaatcagagcagaactg

SEQ ID NO: 94546 - DNA, 20 bp, Artificial Sequence
  chemically synthesized
taaaatcagagcagaactga

SEQ ID NO: 94547 - DNA, 20 bp, Artificial Sequence
  chemically synthesized
cagagcagaactgaaggaaa

SEQ ID NO: 94548 - DNA, 20 bp, Artificial Sequence
  chemically synthesized
ttttgtgtctctatttcctt

SEQ ID NO: 94549 - DNA, 20 bp, Artificial Sequence
  chemically synthesized
gagcagaactgaaggaaata

SEQ ID NO: 94550 - DNA, 20 bp, Artificial Sequence
  chemically synthesized
ggattcattgattttttgaa

SEQ ID NO: 94551 - DNA, 20 bp, Artificial Sequence
  chemically synthesized
tggattcattgattttttga

SEQ ID NO: 94552 - DNA, 20 bp, Artificial Sequence
  chemically synthesized
ctggattcattgattttttg

SEQ ID NO: 94553 - DNA, 20 bp, Artificial Sequence
  chemically synthesized
cttcaaaaaatcaatgaatc

SEQ ID NO: 94554 - DNA, 20 bp, Artificial Sequence
  chemically synthesized
ttcaaaaaatcaatgaatcc

SEQ ID NO: 94555 - DNA, 20 bp, Artificial Sequence
  chemically synthesized
caaaaaatcaatgaatccag

SEQ ID NO: 94556 - DNA, 20 bp, Artificial Sequence
  chemically synthesized
aaatcaatgaatccaggagc

SEQ ID NO: 94557 - DNA, 20 bp, Artificial Sequence
  chemically synthesized
cctttcaaaaaaccagctcc

SEQ ID NO: 94558 - DNA, 20 bp, Artificial Sequence
  chemically synthesized
tgttgatcctttcaaaaaac

SEQ ID NO: 94559 - DNA, 20 bp, Artificial Sequence
  chemically synthesized
tccaggagctggttttttga

SEQ ID NO: 94560 - DNA, 20 bp, Artificial Sequence
  chemically synthesized
ccaggagctggttttttgaa

SEQ ID NO: 94561 - DNA, 20 bp, Artificial Sequence
  chemically synthesized
gaaaggatcaacaaaattga

SEQ ID NO: 94562 - DNA, 20 bp, Artificial Sequence
  chemically synthesized
caacaaaattgatagaccgc

SEQ ID NO: 94563 - DNA, 20 bp, Artificial Sequence
  chemically synthesized
aaaattgatagaccgctagc

SEQ ID NO: 94564 - DNA, 20 bp, Artificial Sequence
  chemically synthesized
ttctttattagtcttgctag

SEQ ID NO: 94565 - DNA, 20 bp, Artificial Sequence
  chemically synthesized
tttttctttattagtcttgc

SEQ ID NO: 94566 - DNA, 20 bp, Artificial Sequence
  chemically synthesized
gaccgctagcaagactaata

SEQ ID NO: 94567 - DNA, 20 bp, Artificial Sequence
  chemically synthesized
ttctctctttttttctttat

SEQ ID NO: 94568 - DNA, 20 bp, Artificial Sequence
  chemically synthesized
gcaagactaataaagaaaaa

SEQ ID NO: 94569 - DNA, 20 bp, Artificial Sequence
  chemically synthesized
aagactaataaagaaaaaaa

SEQ ID NO: 94570 - DNA, 20 bp, Artificial Sequence
  chemically synthesized
gactaataaagaaaaaaaga

SEQ ID NO: 94571 - DNA, 20 bp, Artificial Sequence
  chemically synthesized
taataaagaaaaaaagagag

SEQ ID NO: 94572 - DNA, 20 bp, Artificial Sequence
  chemically synthesized
aaaaagagagaagaatcaaa

SEQ ID NO: 94573 - DNA, 20 bp, Artificial Sequence
  chemically synthesized
agacacaataaaaaatgata

SEQ ID NO: 94574 - DNA, 20 bp, Artificial Sequence
  chemically synthesized
gacacaataaaaaatgataa

SEQ ID NO: 94575 - DNA, 20 bp, Artificial Sequence
  chemically synthesized
acacaataaaaaatgataaa

SEQ ID NO: 94576 - DNA, 20 bp, Artificial Sequence
  chemically synthesized
cacaataaaaaatgataaag

SEQ ID NO: 94577 - DNA, 20 bp, Artificial Sequence
  chemically synthesized
ttgtatttctgtgggatcgg

SEQ ID NO: 94578 - DNA, 20 bp, Artificial Sequence
  chemically synthesized
ggatatcaccaccgatccca

SEQ ID NO: 94579 - DNA, 20 bp, Artificial Sequence
  chemically synthesized
agtttgtatttctgtgggat

SEQ ID NO: 94580 - DNA, 20 bp, Artificial Sequence
  chemically synthesized
atggtagtttgtatttctgt

SEQ ID NO: 94581 - DNA, 20 bp, Artificial Sequence
  chemically synthesized
gatggtagtttgtatttctg

SEQ ID NO: 94582 - DNA, 20 bp, Artificial Sequence
  chemically synthesized
acagaaatacaaactaccat

SEQ ID NO: 94583 - DNA, 20 bp, Artificial Sequence
  chemically synthesized
agaaatacaaactaccatca

SEQ ID NO: 94584 - DNA, 20 bp, Artificial Sequence
  chemically synthesized
tttgtagtattctctgatgg

SEQ ID NO: 94585 - DNA, 20 bp, Artificial Sequence
  chemically synthesized
gtgtttgtagtattctctga

SEQ ID NO: 94586 - DNA, 20 bp, Artificial Sequence
  chemically synthesized
tatttgcatagaggtgtttg

SEQ ID NO: 94587 - DNA, 20 bp, Artificial Sequence
  chemically synthesized
tttctagtttatttgcatag

SEQ ID NO: 94588 - DNA, 20 bp, Artificial Sequence
  chemically synthesized
ttttctagtttatttgcata

SEQ ID NO: 94589 - DNA, 20 bp, Artificial Sequence
  chemically synthesized
gattttctagtttatttgca

SEQ ID NO: 94590 - DNA, 20 bp, Artificial Sequence
  chemically synthesized
acacctctatgcaaataaac

SEQ ID NO: 94591 - DNA, 20 bp, Artificial Sequence
  chemically synthesized
tgcaaataaactagaaaatc

SEQ ID NO: 94592 - DNA, 20 bp, Artificial Sequence
  chemically synthesized
tccatttcttctagattttc

SEQ ID NO: 94593 - DNA, 20 bp, Artificial Sequence
  chemically synthesized
aaataaactagaaaatctag

SEQ ID NO: 94594 - DNA, 20 bp, Artificial Sequence
  chemically synthesized
actagaaaatctagaagaaa

SEQ ID NO: 94595 - DNA, 20 bp, Artificial Sequence
  chemically synthesized
aggaatgtatccatttcttc

SEQ ID NO: 94596 - DNA, 20 bp, Artificial Sequence
  chemically synthesized
ttgggagagtgtatgtgtcg

SEQ ID NO: 94597 - DNA, 20 bp, Artificial Sequence
  chemically synthesized
cttgggagagtgtatgtgtc

SEQ ID NO: 94598 - DNA, 20 bp, Artificial Sequence
  chemically synthesized
ctcgacacatacactctccc

SEQ ID NO: 94599 - DNA, 20 bp, Artificial Sequence
  chemically synthesized
ttcctggtttagtcttggga

SEQ ID NO: 94600 - DNA, 20 bp, Artificial Sequence
  chemically synthesized
tcttcctggtttagtcttgg

SEQ ID NO: 94601 - DNA, 20 bp, Artificial Sequence
  chemically synthesized
cttcttcctggtttagtctt

SEQ ID NO: 94602 - DNA, 20 bp, Artificial Sequence
  chemically synthesized
acttcttcctggtttagtct

SEQ ID NO: 94603 - DNA, 20 bp, Artificial Sequence
  chemically synthesized
acactctcccaagactaaac

SEQ ID NO: 94604 - DNA, 20 bp, Artificial Sequence
  chemically synthesized
cactctcccaagactaaacc

SEQ ID NO: 94605 - DNA, 20 bp, Artificial Sequence
  chemically synthesized
tctcccaagactaaaccagg

SEQ ID NO: 94606 - DNA, 20 bp, Artificial Sequence
  chemically synthesized
gattcaacttcttcctggtt

SEQ ID NO: 94607 - DNA, 20 bp, Artificial Sequence
  chemically synthesized
cccaagactaaaccaggaag

SEQ ID NO: 94608 - DNA, 20 bp, Artificial Sequence
  chemically synthesized
tcagagattcaacttcttcc

SEQ ID NO: 94609 - DNA, 20 bp, Artificial Sequence
  chemically synthesized
gaagaagttgaatctctgaa

SEQ ID NO: 94610 - DNA, 20 bp, Artificial Sequence
  chemically synthesized
gcctgttattggtctattca

SEQ ID NO: 94611 - DNA, 20 bp, Artificial Sequence
  chemically synthesized
gagcctgttattggtctatt

SEQ ID NO: 94612 - DNA, 20 bp, Artificial Sequence
  chemically synthesized
atctctgaatagaccaataa

SEQ ID NO: 94613 - DNA, 20 bp, Artificial Sequence
  chemically synthesized
tctctgaatagaccaataac

SEQ ID NO: 94614 - DNA, 20 bp, Artificial Sequence
  chemically synthesized
acaatttcagagcctgttat

SEQ ID NO: 94615 - DNA, 20 bp, Artificial Sequence
  chemically synthesized
tgattattgccacaatttca

SEQ ID NO: 94616 - DNA, 20 bp, Artificial Sequence
  chemically synthesized
aataacaggctctgaaattg

SEQ ID NO: 94617 - DNA, 20 bp, Artificial Sequence
  chemically synthesized
attgattattgccacaattt

SEQ ID NO: 94618 - DNA, 20 bp, Artificial Sequence
  chemically synthesized
tcaatattttaccaaccaaa

SEQ ID NO: 94619 - DNA, 20 bp, Artificial Sequence
  chemically synthesized
ggtcctggactctttttggt

SEQ ID NO: 94620 - DNA, 20 bp, Artificial Sequence
  chemically synthesized
aatattttaccaaccaaaaa

SEQ ID NO: 94621 - DNA, 20 bp, Artificial Sequence
  chemically synthesized
atctggtcctggactctttt

SEQ ID NO: 94622 - DNA, 20 bp, Artificial Sequence
  chemically synthesized
tttaccaaccaaaaagagtc

SEQ ID NO: 94623 - DNA, 20 bp, Artificial Sequence
  chemically synthesized
ttaccaaccaaaaagagtcc

SEQ ID NO: 94624 - DNA, 20 bp, Artificial Sequence
  chemically synthesized
aaccaaaaagagtccaggac

SEQ ID NO: 94625 - DNA, 20 bp, Artificial Sequence
  chemically synthesized
gctgtgaatccatctggtcc

SEQ ID NO: 94626 - DNA, 20 bp, Artificial Sequence
  chemically synthesized
aaaaagagtccaggaccaga

SEQ ID NO: 94627 - DNA, 20 bp, Artificial Sequence
  chemically synthesized
aattcggctgtgaatccatc

SEQ ID NO: 94628 - DNA, 20 bp, Artificial Sequence
  chemically synthesized
tccaggaccagatggattca

SEQ ID NO: 94629 - DNA, 20 bp, Artificial Sequence
  chemically synthesized
cttgtacctctggtagaatt

SEQ ID NO: 94630 - DNA, 20 bp, Artificial Sequence
  chemically synthesized
gattcacagccgaattctac

SEQ ID NO: 94631 - DNA, 20 bp, Artificial Sequence
  chemically synthesized
ttcacagccgaattctacca

SEQ ID NO: 94632 - DNA, 20 bp, Artificial Sequence
  chemically synthesized
tcacagccgaattctaccag

SEQ ID NO: 94633 - DNA, 20 bp, Artificial Sequence
  chemically synthesized
gttcctccttgtacctctgg

SEQ ID NO: 94634 - DNA, 20 bp, Artificial Sequence
  chemically synthesized
ccgaattctaccagaggtac

SEQ ID NO: 94635 - DNA, 20 bp, Artificial Sequence
  chemically synthesized
ccagttcctccttgtacctc

SEQ ID NO: 94636 - DNA, 20 bp, Artificial Sequence
  chemically synthesized
cgaattctaccagaggtaca

SEQ ID NO: 94637 - DNA, 20 bp, Artificial Sequence
  chemically synthesized
aattctaccagaggtacaag

SEQ ID NO: 94638 - DNA, 20 bp, Artificial Sequence
  chemically synthesized
attctaccagaggtacaagg

SEQ ID NO: 94639 - DNA, 20 bp, Artificial Sequence
  chemically synthesized
ccagaggtacaaggaggaac

SEQ ID NO: 94640 - DNA, 20 bp, Artificial Sequence
  chemically synthesized
agtttcagaaggaatggtac

SEQ ID NO: 94641 - DNA, 20 bp, Artificial Sequence
  chemically synthesized
tggaatagtttcagaaggaa

SEQ ID NO: 94642 - DNA, 20 bp, Artificial Sequence
  chemically synthesized
ttgattggaatagtttcaga

SEQ ID NO: 94643 - DNA, 20 bp, Artificial Sequence
  chemically synthesized
attgattggaatagtttcag

SEQ ID NO: 94644 - DNA, 20 bp, Artificial Sequence
  chemically synthesized
tctattgattggaatagttt

SEQ ID NO: 94645 - DNA, 20 bp, Artificial Sequence
  chemically synthesized
tctttttctattgattggaa

SEQ ID NO: 94646 - DNA, 20 bp, Artificial Sequence
  chemically synthesized
tctgaaactattccaatcaa

SEQ ID NO: 94647 - DNA, 20 bp, Artificial Sequence
  chemically synthesized
ttccctctttttctattgat

SEQ ID NO: 94648 - DNA, 20 bp, Artificial Sequence
  chemically synthesized
actattccaatcaatagaaa

SEQ ID NO: 94649 - DNA, 20 bp, Artificial Sequence
  chemically synthesized
tattccaatcaatagaaaaa

SEQ ID NO: 94650 - DNA, 20 bp, Artificial Sequence
  chemically synthesized
attccaatcaatagaaaaag

SEQ ID NO: 94651 - DNA, 20 bp, Artificial Sequence
  chemically synthesized
ttccaatcaatagaaaaaga

SEQ ID NO: 94652 - DNA, 20 bp, Artificial Sequence
  chemically synthesized
cctcataaaatgagttaggg

SEQ ID NO: 94653 - DNA, 20 bp, Artificial Sequence
  chemically synthesized
gcctcataaaatgagttagg

SEQ ID NO: 94654 - DNA, 20 bp, Artificial Sequence
  chemically synthesized
tggcctcataaaatgagtta

SEQ ID NO: 94655 - DNA, 20 bp, Artificial Sequence
  chemically synthesized
ctggcctcataaaatgagtt

SEQ ID NO: 94656 - DNA, 20 bp, Artificial Sequence
  chemically synthesized
gctggcctcataaaatgagt

SEQ ID NO: 94657 - DNA, 20 bp, Artificial Sequence
  chemically synthesized
tcctccctaactcattttat

SEQ ID NO: 94658 - DNA, 20 bp, Artificial Sequence
  chemically synthesized
tgatgctggcctcataaaat

SEQ ID NO: 94659 - DNA, 20 bp, Artificial Sequence
  chemically synthesized
cctccctaactcattttatg

SEQ ID NO: 94660 - DNA, 20 bp, Artificial Sequence
  chemically synthesized
cctaactcattttatgaggc

SEQ ID NO: 94661 - DNA, 20 bp, Artificial Sequence
  chemically synthesized
ctttggtatcagaatgatgc

SEQ ID NO: 94662 - DNA, 20 bp, Artificial Sequence
  chemically synthesized
ccagcatcattctgatacca

SEQ ID NO: 94663 - DNA, 20 bp, Artificial Sequence
  chemically synthesized
tctctgcccggctttggtat

SEQ ID NO: 94664 - DNA, 20 bp, Artificial Sequence
  chemically synthesized
catcattctgataccaaagc

SEQ ID NO: 94665 - DNA, 20 bp, Artificial Sequence
  chemically synthesized
atcattctgataccaaagcc

SEQ ID NO: 94666 - DNA, 20 bp, Artificial Sequence
  chemically synthesized
gttgtgtctctgcccggctt

SEQ ID NO: 94667 - DNA, 20 bp, Artificial Sequence
  chemically synthesized
attctgataccaaagccggg

SEQ ID NO: 94668 - DNA, 20 bp, Artificial Sequence
  chemically synthesized
tctgataccaaagccgggca

SEQ ID NO: 94669 - DNA, 20 bp, Artificial Sequence
  chemically synthesized
tttttggttgtgtctctgcc

SEQ ID NO: 94670 - DNA, 20 bp, Artificial Sequence
  chemically synthesized
gggcagagacacaaccaaaa

SEQ ID NO: 94671 - DNA, 20 bp, Artificial Sequence
  chemically synthesized
gcagagacacaaccaaaaaa

SEQ ID NO: 94672 - DNA, 20 bp, Artificial Sequence
  chemically synthesized
tggtctaaaattctcttttt

SEQ ID NO: 94673 - DNA, 20 bp, Artificial Sequence
  chemically synthesized
acaaccaaaaaagagaattt

SEQ ID NO: 94674 - DNA, 20 bp, Artificial Sequence
  chemically synthesized
tcaatgttcatcaaggatat

SEQ ID NO: 94675 - DNA, 20 bp, Artificial Sequence
  chemically synthesized
ttttgcatcaatgttcatca

SEQ ID NO: 94676 - DNA, 20 bp, Artificial Sequence
  chemically synthesized
gttttgcatcaatgttcatc

SEQ ID NO: 94677 - DNA, 20 bp, Artificial Sequence
  chemically synthesized
tttgccagtattttattgag

SEQ ID NO: 94678 - DNA, 20 bp, Artificial Sequence
  chemically synthesized
ggtttgccagtattttattg

SEQ ID NO: 94679 - DNA, 20 bp, Artificial Sequence
  chemically synthesized
cggtttgccagtattttatt

SEQ ID NO: 94680 - DNA, 20 bp, Artificial Sequence
  chemically synthesized
aaaactcctcaataaaatac

SEQ ID NO: 94681 - DNA, 20 bp, Artificial Sequence
  chemically synthesized
tgctgctggattcggtttgc

SEQ ID NO: 94682 - DNA, 20 bp, Artificial Sequence
  chemically synthesized
aaatactggcaaaccgaatc

SEQ ID NO: 94683 - DNA, 20 bp, Artificial Sequence
  chemically synthesized
tactggcaaaccgaatccag

SEQ ID NO: 94684 - DNA, 20 bp, Artificial Sequence
  chemically synthesized
ttttgatgtgctgctggatt

SEQ ID NO: 94685 - DNA, 20 bp, Artificial Sequence
  chemically synthesized
taagctttttgatgtgctgc

SEQ ID NO: 94686 - DNA, 20 bp, Artificial Sequence
  chemically synthesized
gaatccagcagcacatcaaa

SEQ ID NO: 94687 - DNA, 20 bp, Artificial Sequence
  chemically synthesized
cccacttgatcatggtggat

SEQ ID NO: 94688 - DNA, 20 bp, Artificial Sequence
  chemically synthesized
tgaagcccacttgatcatgg

SEQ ID NO: 94689 - DNA, 20 bp, Artificial Sequence
  chemically synthesized
aaagcttatccaccatgatc

SEQ ID NO: 94690 - DNA, 20 bp, Artificial Sequence
  chemically synthesized
ggatgaagcccacttgatca

SEQ ID NO: 94691 - DNA, 20 bp, Artificial Sequence
  chemically synthesized
gcttatccaccatgatcaag

SEQ ID NO: 94692 - DNA, 20 bp, Artificial Sequence
  chemically synthesized
cttatccaccatgatcaagt

SEQ ID NO: 94693 - DNA, 20 bp, Artificial Sequence
  chemically synthesized
gatcaagtgggcttcatccc

SEQ ID NO: 94694 - DNA, 20 bp, Artificial Sequence
  chemically synthesized
atcaagtgggcttcatccct

SEQ ID NO: 94695 - DNA, 20 bp, Artificial Sequence
  chemically synthesized
agccttgcatcccagggatg

SEQ ID NO: 94696 - DNA, 20 bp, Artificial Sequence
  chemically synthesized
tgaaccagccttgcatccca

SEQ ID NO: 94697 - DNA, 20 bp, Artificial Sequence
  chemically synthesized
gggcttcatccctgggatgc

SEQ ID NO: 94698 - DNA, 20 bp, Artificial Sequence
  chemically synthesized
ttgaaccagccttgcatccc

SEQ ID NO: 94699 - DNA, 20 bp, Artificial Sequence
  chemically synthesized
ggcttcatccctgggatgca

SEQ ID NO: 94700 - DNA, 20 bp, Artificial Sequence
  chemically synthesized
attgaaccagccttgcatcc

SEQ ID NO: 94701 - DNA, 20 bp, Artificial Sequence
  chemically synthesized
tcatccctgggatgcaaggc

SEQ ID NO: 94702 - DNA, 20 bp, Artificial Sequence
  chemically synthesized
ttgatttgcgtatattgaac

SEQ ID NO: 94703 - DNA, 20 bp, Artificial Sequence
  chemically synthesized
gcaaatcaataaatgtaatc

SEQ ID NO: 94704 - DNA, 20 bp, Artificial Sequence
  chemically synthesized
ctttggctctgtttatatgc

SEQ ID NO: 94705 - DNA, 20 bp, Artificial Sequence
  chemically synthesized
aatgtaatccagcatataaa

SEQ ID NO: 94706 - DNA, 20 bp, Artificial Sequence
  chemically synthesized
tgtaatccagcatataaaca

SEQ ID NO: 94707 - DNA, 20 bp, Artificial Sequence
  chemically synthesized
ccagcatataaacagagcca

SEQ ID NO: 94708 - DNA, 20 bp, Artificial Sequence
  chemically synthesized
aatcatgtggtttttgtctt

SEQ ID NO: 94709 - DNA, 20 bp, Artificial Sequence
  chemically synthesized
catctattgagataatcatg

SEQ ID NO: 94710 - DNA, 20 bp, Artificial Sequence
  chemically synthesized
aaaccacatgattatctcaa

SEQ ID NO: 94711 - DNA, 20 bp, Artificial Sequence
  chemically synthesized
aggctttttctgcatctatt

SEQ ID NO: 94712 - DNA, 20 bp, Artificial Sequence
  chemically synthesized
catgattatctcaatagatg

SEQ ID NO: 94713 - DNA, 20 bp, Artificial Sequence
  chemically synthesized
tatctcaatagatgcagaaa

SEQ ID NO: 94714 - DNA, 20 bp, Artificial Sequence
  chemically synthesized
gggttgttgaattttgtcaa

SEQ ID NO: 94715 - DNA, 20 bp, Artificial Sequence
  chemically synthesized
agggttgttgaattttgtca

SEQ ID NO: 94716 - DNA, 20 bp, Artificial Sequence
  chemically synthesized
ttgagagtttttagcatgaa

SEQ ID NO: 94717 - DNA, 20 bp, Artificial Sequence
  chemically synthesized
attgagagtttttagcatga

SEQ ID NO: 94718 - DNA, 20 bp, Artificial Sequence
  chemically synthesized
tattgagagtttttagcatg

SEQ ID NO: 94719 - DNA, 20 bp, Artificial Sequence
  chemically synthesized
cctaatttattgagagtttt

SEQ ID NO: 94720 - DNA, 20 bp, Artificial Sequence
  chemically synthesized
atcaatacctaatttattga

SEQ ID NO: 94721 - DNA, 20 bp, Artificial Sequence
  chemically synthesized
gctaaaaactctcaataaat

SEQ ID NO: 94722 - DNA, 20 bp, Artificial Sequence
  chemically synthesized
ccatcaatacctaatttatt

SEQ ID NO: 94723 - DNA, 20 bp, Artificial Sequence
  chemically synthesized
ctaaaaactctcaataaatt

SEQ ID NO: 94724 - DNA, 20 bp, Artificial Sequence
  chemically synthesized
ctcaataaattaggtattga

SEQ ID NO: 94725 - DNA, 20 bp, Artificial Sequence
  chemically synthesized
tcaataaattaggtattgat

SEQ ID NO: 94726 - DNA, 20 bp, Artificial Sequence
  chemically synthesized
gggacgtatttcaaaataat

SEQ ID NO: 94727 - DNA, 20 bp, Artificial Sequence
  chemically synthesized
gacgtatttcaaaataataa

SEQ ID NO: 94728 - DNA, 20 bp, Artificial Sequence
  chemically synthesized
ggctgtgggtttgtcataga

SEQ ID NO: 94729 - DNA, 20 bp, Artificial Sequence
  chemically synthesized
tattggctgtgggtttgtca

SEQ ID NO: 94730 - DNA, 20 bp, Artificial Sequence
  chemically synthesized
agctatctatgacaaaccca

SEQ ID NO: 94731 - DNA, 20 bp, Artificial Sequence
  chemically synthesized
ttcagtatgatattggctgt

SEQ ID NO: 94732 - DNA, 20 bp, Artificial Sequence
  chemically synthesized
attcagtatgatattggctg

SEQ ID NO: 94733 - DNA, 20 bp, Artificial Sequence
  chemically synthesized
ttgcccattcagtatgatat

SEQ ID NO: 94734 - DNA, 20 bp, Artificial Sequence
  chemically synthesized
acagccaatatcatactgaa

SEQ ID NO: 94735 - DNA, 20 bp, Artificial Sequence
  chemically synthesized
cagccaatatcatactgaat

SEQ ID NO: 94736 - DNA, 20 bp, Artificial Sequence
  chemically synthesized
gcttccagtttttgcccatt

SEQ ID NO: 94737 - DNA, 20 bp, Artificial Sequence
  chemically synthesized
catactgaatgggcaaaaac

SEQ ID NO: 94738 - DNA, 20 bp, Artificial Sequence
  chemically synthesized
actgaatgggcaaaaactgg

SEQ ID NO: 94739 - DNA, 20 bp, Artificial Sequence
  chemically synthesized
gtttttaaagggaatgcttc

SEQ ID NO: 94740 - DNA, 20 bp, Artificial Sequence
  chemically synthesized
gtcttgtgccagtttttaaa

SEQ ID NO: 94741 - DNA, 20 bp, Artificial Sequence
  chemically synthesized
tgtcttgtgccagtttttaa

SEQ ID NO: 94742 - DNA, 20 bp, Artificial Sequence
  chemically synthesized
gaagcattccctttaaaaac

SEQ ID NO: 94743 - DNA, 20 bp, Artificial Sequence
  chemically synthesized
ctgtcttgtgccagttttta

SEQ ID NO: 94744 - DNA, 20 bp, Artificial Sequence
  chemically synthesized
ttccctttaaaaactggcac

SEQ ID NO: 94745 - DNA, 20 bp, Artificial Sequence
  chemically synthesized
agggcatccctgtcttgtgc

SEQ ID NO: 94746 - DNA, 20 bp, Artificial Sequence
  chemically synthesized
ctttaaaaactggcacaaga

SEQ ID NO: 94747 - DNA, 20 bp, Artificial Sequence
  chemically synthesized
tttaaaaactggcacaagac

SEQ ID NO: 94748 - DNA, 20 bp, Artificial Sequence
  chemically synthesized
ttaaaaactggcacaagaca

SEQ ID NO: 94749 - DNA, 20 bp, Artificial Sequence
  chemically synthesized
tgaataggagtggtgagaga

SEQ ID NO: 94750 - DNA, 20 bp, Artificial Sequence
  chemically synthesized
ttgaataggagtggtgagag

SEQ ID NO: 94751 - DNA, 20 bp, Artificial Sequence
  chemically synthesized
gttgaataggagtggtgaga

SEQ ID NO: 94752 - DNA, 20 bp, Artificial Sequence
  chemically synthesized
atgttgaataggagtggtga

SEQ ID NO: 94753 - DNA, 20 bp, Artificial Sequence
  chemically synthesized
ctatgttgaataggagtggt

SEQ ID NO: 94754 - DNA, 20 bp, Artificial Sequence
  chemically synthesized
aacactatgttgaataggag

SEQ ID NO: 94755 - DNA, 20 bp, Artificial Sequence
  chemically synthesized
tccaacactatgttgaatag

SEQ ID NO: 94756 - DNA, 20 bp, Artificial Sequence
  chemically synthesized
cttccaacactatgttgaat

SEQ ID NO: 94757 - DNA, 20 bp, Artificial Sequence
  chemically synthesized
ctcaccactcctattcaaca

SEQ ID NO: 94758 - DNA, 20 bp, Artificial Sequence
  chemically synthesized
acttccaacactatgttgaa

SEQ ID NO: 94759 - DNA, 20 bp, Artificial Sequence
  chemically synthesized
actcctattcaacatagtgt

SEQ ID NO: 94760 - DNA, 20 bp, Artificial Sequence
  chemically synthesized
cctattcaacatagtgttgg

SEQ ID NO: 94761 - DNA, 20 bp, Artificial Sequence
  chemically synthesized
caacatagtgttggaagttc

SEQ ID NO: 94762 - DNA, 20 bp, Artificial Sequence
  chemically synthesized
atagtgttggaagttctggc

SEQ ID NO: 94763 - DNA, 20 bp, Artificial Sequence
  chemically synthesized
tagtgttggaagttctggcc

SEQ ID NO: 94764 - DNA, 20 bp, Artificial Sequence
  chemically synthesized
agtgttggaagttctggcca

SEQ ID NO: 94765 - DNA, 20 bp, Artificial Sequence
  chemically synthesized
tcctgcctgattgccctggc

SEQ ID NO: 94766 - DNA, 20 bp, Artificial Sequence
  chemically synthesized
gaagttctggccagggcaat

SEQ ID NO: 94767 - DNA, 20 bp, Artificial Sequence
  chemically synthesized
cttctcctgcctgattgccc

SEQ ID NO: 94768 - DNA, 20 bp, Artificial Sequence
  chemically synthesized
aagttctggccagggcaatc

SEQ ID NO: 94769 - DNA, 20 bp, Artificial Sequence
  chemically synthesized
ttctggccagggcaatcagg

SEQ ID NO: 94770 - DNA, 20 bp, Artificial Sequence
  chemically synthesized
tctggccagggcaatcaggc

SEQ ID NO: 94771 - DNA, 20 bp, Artificial Sequence
  chemically synthesized
tggccagggcaatcaggcag

SEQ ID NO: 94772 - DNA, 20 bp, Artificial Sequence
  chemically synthesized
ccagggcaatcaggcaggag

SEQ ID NO: 94773 - DNA, 20 bp, Artificial Sequence
  chemically synthesized
cagggcaatcaggcaggaga

SEQ ID NO: 94774 - DNA, 20 bp, Artificial Sequence
  chemically synthesized
tcaggcaggagaaggaaata

SEQ ID NO: 94775 - DNA, 20 bp, Artificial Sequence
  chemically synthesized
caggcaggagaaggaaataa

SEQ ID NO: 94776 - DNA, 20 bp, Artificial Sequence
  chemically synthesized
aggcaggagaaggaaataaa

SEQ ID NO: 94777 - DNA, 20 bp, Artificial Sequence
  chemically synthesized
ggaaataaagggtattcaat

SEQ ID NO: 94778 - DNA, 20 bp, Artificial Sequence
  chemically synthesized
gaaataaagggtattcaatt

SEQ ID NO: 94779 - DNA, 20 bp, Artificial Sequence
  chemically synthesized
aaagggtattcaattaggaa

SEQ ID NO: 94780 - DNA, 20 bp, Artificial Sequence
  chemically synthesized
agggtattcaattaggaaaa

SEQ ID NO: 94781 - DNA, 20 bp, Artificial Sequence
  chemically synthesized
gggtattcaattaggaaaag

SEQ ID NO: 94782 - DNA, 20 bp, Artificial Sequence
  chemically synthesized
tattcaattaggaaaagagg

SEQ ID NO: 94783 - DNA, 20 bp, Artificial Sequence
  chemically synthesized
agtcaaattgtccctgtttg

SEQ ID NO: 94784 - DNA, 20 bp, Artificial Sequence
  chemically synthesized
aatcatgtcgtctgcaaaca

SEQ ID NO: 94785 - DNA, 20 bp, Artificial Sequence
  chemically synthesized
caatcatgtcgtctgcaaac

SEQ ID NO: 94786 - DNA, 20 bp, Artificial Sequence
  chemically synthesized
acaatcatgtcgtctgcaaa

SEQ ID NO: 94787 - DNA, 20 bp, Artificial Sequence
  chemically synthesized
agacgacatgattgtttatc

SEQ ID NO: 94788 - DNA, 20 bp, Artificial Sequence
  chemically synthesized
gctgagacgatggggttttc

SEQ ID NO: 94789 - DNA, 20 bp, Artificial Sequence
  chemically synthesized
gattttgggctgagacgatg

SEQ ID NO: 94790 - DNA, 20 bp, Artificial Sequence
  chemically synthesized
tctagaaaaccccatcgtct

SEQ ID NO: 94791 - DNA, 20 bp, Artificial Sequence
  chemically synthesized
agattttgggctgagacgat

SEQ ID NO: 94792 - DNA, 20 bp, Artificial Sequence
  chemically synthesized
gagattttgggctgagacga

SEQ ID NO: 94793 - DNA, 20 bp, Artificial Sequence
  chemically synthesized
gcttaaggagattttgggct

SEQ ID NO: 94794 - DNA, 20 bp, Artificial Sequence
  chemically synthesized
tatcagcttaaggagatttt

SEQ ID NO: 94795 - DNA, 20 bp, Artificial Sequence
  chemically synthesized
ttatcagcttaaggagattt

SEQ ID NO: 94796 - DNA, 20 bp, Artificial Sequence
  chemically synthesized
tctcagcccaaaatctcctt

SEQ ID NO: 94797 - DNA, 20 bp, Artificial Sequence
  chemically synthesized
aagttgcttatcagcttaag

SEQ ID NO: 94798 - DNA, 20 bp, Artificial Sequence
  chemically synthesized
tgaagttgcttatcagctta

SEQ ID NO: 94799 - DNA, 20 bp, Artificial Sequence
  chemically synthesized
ctgaagttgcttatcagctt

SEQ ID NO: 94800 - DNA, 20 bp, Artificial Sequence
  chemically synthesized
caaaatctccttaagctgat

SEQ ID NO: 94801 - DNA, 20 bp, Artificial Sequence
  chemically synthesized
actttgctgaagttgcttat

SEQ ID NO: 94802 - DNA, 20 bp, Artificial Sequence
  chemically synthesized
cttaagctgataagcaactt

SEQ ID NO: 94803 - DNA, 20 bp, Artificial Sequence
  chemically synthesized
gctgataagcaacttcagca

SEQ ID NO: 94804 - DNA, 20 bp, Artificial Sequence
  chemically synthesized
tgtatcctgagactttgctg

SEQ ID NO: 94805 - DNA, 20 bp, Artificial Sequence
  chemically synthesized
aagcaacttcagcaaagtct

SEQ ID NO: 94806 - DNA, 20 bp, Artificial Sequence
  chemically synthesized
agcaacttcagcaaagtctc

SEQ ID NO: 94807 - DNA, 20 bp, Artificial Sequence
  chemically synthesized
gtacattgattttgtatcct

SEQ ID NO: 94808 - DNA, 20 bp, Artificial Sequence
  chemically synthesized
aatcaatgtactaaaatcac

SEQ ID NO: 94809 - DNA, 20 bp, Artificial Sequence
  chemically synthesized
tataagaatgcttgtgattt

SEQ ID NO: 94810 - DNA, 20 bp, Artificial Sequence
  chemically synthesized
tttgtctgttgttggtgtat

SEQ ID NO: 94811 - DNA, 20 bp, Artificial Sequence
  chemically synthesized
gcattcttatacaccaacaa

SEQ ID NO: 94812 - DNA, 20 bp, Artificial Sequence
  chemically synthesized
gctctctgtttgtctgttgt

SEQ ID NO: 94813 - DNA, 20 bp, Artificial Sequence
  chemically synthesized
atacaccaacaacagacaaa

SEQ ID NO: 94814 - DNA, 20 bp, Artificial Sequence
  chemically synthesized
acaccaacaacagacaaaca

SEQ ID NO: 94815 - DNA, 20 bp, Artificial Sequence
  chemically synthesized
accaacaacagacaaacaga

SEQ ID NO: 94816 - DNA, 20 bp, Artificial Sequence
  chemically synthesized
caaacagagagccaaatcat

SEQ ID NO: 94817 - DNA, 20 bp, Artificial Sequence
  chemically synthesized
atgggagttcactcatgatt

SEQ ID NO: 94818 - DNA, 20 bp, Artificial Sequence
  chemically synthesized
tttgaagcaattgtgaatgg

SEQ ID NO: 94819 - DNA, 20 bp, Artificial Sequence
  chemically synthesized
tctttgaagcaattgtgaat

SEQ ID NO: 94820 - DNA, 20 bp, Artificial Sequence
  chemically synthesized
ctctttgaagcaattgtgaa

SEQ ID NO: 94821 - DNA, 20 bp, Artificial Sequence
  chemically synthesized
tcccattcacaattgcttca

SEQ ID NO: 94822 - DNA, 20 bp, Artificial Sequence
  chemically synthesized
ccattcacaattgcttcaaa

SEQ ID NO: 94823 - DNA, 20 bp, Artificial Sequence
  chemically synthesized
taggtattttattctctttg

SEQ ID NO: 94824 - DNA, 20 bp, Artificial Sequence
  chemically synthesized
ttcaaagagaataaaatacc

SEQ ID NO: 94825 - DNA, 20 bp, Artificial Sequence
  chemically synthesized
tcaaagagaataaaatacct

SEQ ID NO: 94826 - DNA, 20 bp, Artificial Sequence
  chemically synthesized
cccttgtaagttggattcct

SEQ ID NO: 94827 - DNA, 20 bp, Artificial Sequence
  chemically synthesized
tcccttgtaagttggattcc

SEQ ID NO: 94828 - DNA, 20 bp, Artificial Sequence
  chemically synthesized
tacctaggaatccaacttac

SEQ ID NO: 94829 - DNA, 20 bp, Artificial Sequence
  chemically synthesized
acctaggaatccaacttaca

SEQ ID NO: 94830 - DNA, 20 bp, Artificial Sequence
  chemically synthesized
ccttcacatcccttgtaagt

SEQ ID NO: 94831 - DNA, 20 bp, Artificial Sequence
  chemically synthesized
cctaggaatccaacttacaa

SEQ ID NO: 94832 - DNA, 20 bp, Artificial Sequence
  chemically synthesized
aggtccttcacatcccttgt

SEQ ID NO: 94833 - DNA, 20 bp, Artificial Sequence
  chemically synthesized
tccaacttacaagggatgtg

SEQ ID NO: 94834 - DNA, 20 bp, Artificial Sequence
  chemically synthesized
ccaacttacaagggatgtga

SEQ ID NO: 94835 - DNA, 20 bp, Artificial Sequence
  chemically synthesized
gggatgtgaaggacctcttc

SEQ ID NO: 94836 - DNA, 20 bp, Artificial Sequence
  chemically synthesized
ggatgtgaaggacctcttca

SEQ ID NO: 94837 - DNA, 20 bp, Artificial Sequence
  chemically synthesized
atgtgaaggacctcttcaag

SEQ ID NO: 94838 - DNA, 20 bp, Artificial Sequence
  chemically synthesized
gtttgtagttctccttgaag

SEQ ID NO: 94839 - DNA, 20 bp, Artificial Sequence
  chemically synthesized
ggtttgtagttctccttgaa

SEQ ID NO: 94840 - DNA, 20 bp, Artificial Sequence
  chemically synthesized
gtggtttgtagttctccttg

SEQ ID NO: 94841 - DNA, 20 bp, Artificial Sequence
  chemically synthesized
tttccttgagcagtggtttg

SEQ ID NO: 94842 - DNA, 20 bp, Artificial Sequence
  chemically synthesized
agaactacaaaccactgctc

SEQ ID NO: 94843 - DNA, 20 bp, Artificial Sequence
  chemically synthesized
gaactacaaaccactgctca

SEQ ID NO: 94844 - DNA, 20 bp, Artificial Sequence
  chemically synthesized
tcttttatttccttgagcag

SEQ ID NO: 94845 - DNA, 20 bp, Artificial Sequence
  chemically synthesized
tcctcttttatttccttgag

SEQ ID NO: 94846 - DNA, 20 bp, Artificial Sequence
  chemically synthesized
gtgtcctcttttatttcctt

SEQ ID NO: 94847 - DNA, 20 bp, Artificial Sequence
  chemically synthesized
accactgctcaaggaaataa

SEQ ID NO: 94848 - DNA, 20 bp, Artificial Sequence
  chemically synthesized
cactgctcaaggaaataaaa

SEQ ID NO: 94849 - DNA, 20 bp, Artificial Sequence
  chemically synthesized
actgctcaaggaaataaaag

SEQ ID NO: 94850 - DNA, 20 bp, Artificial Sequence
  chemically synthesized
taaaagaggacacaaacaaa

SEQ ID NO: 94851 - DNA, 20 bp, Artificial Sequence
  chemically synthesized
aagaggacacaaacaaatgg

SEQ ID NO: 94852 - DNA, 20 bp, Artificial Sequence
  chemically synthesized
ggaagaatattccatgctca

SEQ ID NO: 94853 - DNA, 20 bp, Artificial Sequence
  chemically synthesized
gaagaatattccatgctcat

SEQ ID NO: 94854 - DNA, 20 bp, Artificial Sequence
  chemically synthesized
attcttcctacccatgagca

SEQ ID NO: 94855 - DNA, 20 bp, Artificial Sequence
  chemically synthesized
gaatattccatgctcatggg

SEQ ID NO: 94856 - DNA, 20 bp, Artificial Sequence
  chemically synthesized
aatattccatgctcatgggt

SEQ ID NO: 94857 - DNA, 20 bp, Artificial Sequence
  chemically synthesized
tattgattcttcctacccat

SEQ ID NO: 94858 - DNA, 20 bp, Artificial Sequence
  chemically synthesized
attccatgctcatgggtagg

SEQ ID NO: 94859 - DNA, 20 bp, Artificial Sequence
  chemically synthesized
aagaatcaatatcgtgaaaa

SEQ ID NO: 94860 - DNA, 20 bp, Artificial Sequence
  chemically synthesized
gtaaattaccttgggcagta

SEQ ID NO: 94861 - DNA, 20 bp, Artificial Sequence
  chemically synthesized
tgaaaatggccatactgccc

SEQ ID NO: 94862 - DNA, 20 bp, Artificial Sequence
  chemically synthesized
gaaaatggccatactgccca

SEQ ID NO: 94863 - DNA, 20 bp, Artificial Sequence
  chemically synthesized
aatctgtaaattaccttggg

SEQ ID NO: 94864 - DNA, 20 bp, Artificial Sequence
  chemically synthesized
ttgaatctgtaaattacctt

SEQ ID NO: 94865 - DNA, 20 bp, Artificial Sequence
  chemically synthesized
attgaatctgtaaattacct

SEQ ID NO: 94866 - DNA, 20 bp, Artificial Sequence
  chemically synthesized
atactgcccaaggtaattta

SEQ ID NO: 94867 - DNA, 20 bp, Artificial Sequence
  chemically synthesized
cattggtagcttgatgggga

SEQ ID NO: 94868 - DNA, 20 bp, Artificial Sequence
  chemically synthesized
gattcaatgccatccccatc

SEQ ID NO: 94869 - DNA, 20 bp, Artificial Sequence
  chemically synthesized
aagtcattggtagcttgatg

SEQ ID NO: 94870 - DNA, 20 bp, Artificial Sequence
  chemically synthesized
aaagtcattggtagcttgat

SEQ ID NO: 94871 - DNA, 20 bp, Artificial Sequence
  chemically synthesized
gaaagtcattggtagcttga

SEQ ID NO: 94872 - DNA, 20 bp, Artificial Sequence
  chemically synthesized
tctgtgaagaaagtcattgg

SEQ ID NO: 94873 - DNA, 20 bp, Artificial Sequence
  chemically synthesized
aattctgtgaagaaagtcat

SEQ ID NO: 94874 - DNA, 20 bp, Artificial Sequence
  chemically synthesized
gctaccaatgactttcttca

SEQ ID NO: 94875 - DNA, 20 bp, Artificial Sequence
  chemically synthesized
tttttccaattctgtgaaga

SEQ ID NO: 94876 - DNA, 20 bp, Artificial Sequence
  chemically synthesized
tagttttttccaattctgtg

SEQ ID NO: 94877 - DNA, 20 bp, Artificial Sequence
  chemically synthesized
aatgactttcttcacagaat

SEQ ID NO: 94878 - DNA, 20 bp, Artificial Sequence
  chemically synthesized
aattggaaaaaactacttta

SEQ ID NO: 94879 - DNA, 20 bp, Artificial Sequence
  chemically synthesized
gttccatatgaactttaaag

SEQ ID NO: 94880 - DNA, 20 bp, Artificial Sequence
  chemically synthesized
ttggttccatatgaacttta

SEQ ID NO: 94881 - DNA, 20 bp, Artificial Sequence
  chemically synthesized
aaactactttaaagttcata

SEQ ID NO: 94882 - DNA, 20 bp, Artificial Sequence
  chemically synthesized
aagttcatatggaaccaaaa

SEQ ID NO: 94883 - DNA, 20 bp, Artificial Sequence
  chemically synthesized
gttcatatggaaccaaaaaa

SEQ ID NO: 94884 - DNA, 20 bp, Artificial Sequence
  chemically synthesized
tggcgatgcgggctcttttt

SEQ ID NO: 94885 - DNA, 20 bp, Artificial Sequence
  chemically synthesized
taggattgacttggcgatgc

SEQ ID NO: 94886 - DNA, 20 bp, Artificial Sequence
  chemically synthesized
aaaaaagagcccgcatcgcc

SEQ ID NO: 94887 - DNA, 20 bp, Artificial Sequence
  chemically synthesized
ttaggattgacttggcgatg

SEQ ID NO: 94888 - DNA, 20 bp, Artificial Sequence
  chemically synthesized
cttttggcttaggattgact

SEQ ID NO: 94889 - DNA, 20 bp, Artificial Sequence
  chemically synthesized
cgcatcgccaagtcaatcct

SEQ ID NO: 94890 - DNA, 20 bp, Artificial Sequence
  chemically synthesized
ccaagtcaatcctaagccaa

SEQ ID NO: 94891 - DNA, 20 bp, Artificial Sequence
  chemically synthesized
cagctttgttcttttggctt

SEQ ID NO: 94892 - DNA, 20 bp, Artificial Sequence
  chemically synthesized
ccagctttgttcttttggct

SEQ ID NO: 94893 - DNA, 20 bp, Artificial Sequence
  chemically synthesized
tgcctccagctttgttcttt

SEQ ID NO: 94894 - DNA, 20 bp, Artificial Sequence
  chemically synthesized
aatcctaagccaaaagaaca

SEQ ID NO: 94895 - DNA, 20 bp, Artificial Sequence
  chemically synthesized
ctaagccaaaagaacaaagc

SEQ ID NO: 94896 - DNA, 20 bp, Artificial Sequence
  chemically synthesized
aagccaaaagaacaaagctg

SEQ ID NO: 94897 - DNA, 20 bp, Artificial Sequence
  chemically synthesized
agccaaaagaacaaagctgg

SEQ ID NO: 94898 - DNA, 20 bp, Artificial Sequence
  chemically synthesized
gtcaggtagtgtgatgcctc

SEQ ID NO: 94899 - DNA, 20 bp, Artificial Sequence
  chemically synthesized
tagtatagtttgaagtcagg

SEQ ID NO: 94900 - DNA, 20 bp, Artificial Sequence
  chemically synthesized
ttgtagtatagtttgaagtc

SEQ ID NO: 94901 - DNA, 20 bp, Artificial Sequence
  chemically synthesized
cttgtagtatagtttgaagt

SEQ ID NO: 94902 - DNA, 20 bp, Artificial Sequence
  chemically synthesized
tagccttgtagtatagtttg

SEQ ID NO: 94903 - DNA, 20 bp, Artificial Sequence
  chemically synthesized
ctgacttcaaactatactac

SEQ ID NO: 94904 - DNA, 20 bp, Artificial Sequence
  chemically synthesized
tgacttcaaactatactaca

SEQ ID NO: 94905 - DNA, 20 bp, Artificial Sequence
  chemically synthesized
gttactgtagccttgtagta

SEQ ID NO: 94906 - DNA, 20 bp, Artificial Sequence
  chemically synthesized
ttttggttactgtagccttg

SEQ ID NO: 94907 - DNA, 20 bp, Artificial Sequence
  chemically synthesized
caaactatactacaaggcta

SEQ ID NO: 94908 - DNA, 20 bp, Artificial Sequence
  chemically synthesized
ccatgctgttttggttactg

SEQ ID NO: 94909 - DNA, 20 bp, Artificial Sequence
  chemically synthesized
caaggctacagtaaccaaaa

SEQ ID NO: 94910 - DNA, 20 bp, Artificial Sequence
  chemically synthesized
gtaccagtaccatgctgttt

SEQ ID NO: 94911 - DNA, 20 bp, Artificial Sequence
  chemically synthesized
ctacagtaaccaaaacagca

SEQ ID NO: 94912 - DNA, 20 bp, Artificial Sequence
  chemically synthesized
taaccaaaacagcatggtac

SEQ ID NO: 94913 - DNA, 20 bp, Artificial Sequence
  chemically synthesized
ctatatctctgttttggtac

SEQ ID NO: 94914 - DNA, 20 bp, Artificial Sequence
  chemically synthesized
gcatggtactggtaccaaaa

SEQ ID NO: 94915 - DNA, 20 bp, Artificial Sequence
  chemically synthesized
atggtactggtaccaaaaca

SEQ ID NO: 94916 - DNA, 20 bp, Artificial Sequence
  chemically synthesized
attgatctatatctctgttt

SEQ ID NO: 94917 - DNA, 20 bp, Artificial Sequence
  chemically synthesized
ctggtaccaaaacagagata

SEQ ID NO: 94918 - DNA, 20 bp, Artificial Sequence
  chemically synthesized
aaaacagagatatagatcaa

SEQ ID NO: 94919 - DNA, 20 bp, Artificial Sequence
  chemically synthesized
agagatatagatcaatggaa

SEQ ID NO: 94920 - DNA, 20 bp, Artificial Sequence
  chemically synthesized
tatagatcaatggaacagaa

SEQ ID NO: 94921 - DNA, 20 bp, Artificial Sequence
  chemically synthesized
tagatcaatggaacagaaca

SEQ ID NO: 94922 - DNA, 20 bp, Artificial Sequence
  chemically synthesized
atggaacagaacagagccct

SEQ ID NO: 94923 - DNA, 20 bp, Artificial Sequence
  chemically synthesized
atatgcggcattatttctga

SEQ ID NO: 94924 - DNA, 20 bp, Artificial Sequence
  chemically synthesized
gatatgcggcattatttctg

SEQ ID NO: 94925 - DNA, 20 bp, Artificial Sequence
  chemically synthesized
agatatgcggcattatttct

SEQ ID NO: 94926 - DNA, 20 bp, Artificial Sequence
  chemically synthesized
atcagatagttgtagatatg

SEQ ID NO: 94927 - DNA, 20 bp, Artificial Sequence
  chemically synthesized
tgtcaaagatcagatagttg

SEQ ID NO: 94928 - DNA, 20 bp, Artificial Sequence
  chemically synthesized
caggtttgtcaaagatcaga

SEQ ID NO: 94929 - DNA, 20 bp, Artificial Sequence
  chemically synthesized
ttctcaggtttgtcaaagat

SEQ ID NO: 94930 - DNA, 20 bp, Artificial Sequence
  chemically synthesized
tgtttttctcaggtttgtca

SEQ ID NO: 94931 - DNA, 20 bp, Artificial Sequence
  chemically synthesized
atctgatctttgacaaacct

SEQ ID NO: 94932 - DNA, 20 bp, Artificial Sequence
  chemically synthesized
ccccattgcttgtttttctc

SEQ ID NO: 94933 - DNA, 20 bp, Artificial Sequence
  chemically synthesized
tccccattgcttgtttttct

SEQ ID NO: 94934 - DNA, 20 bp, Artificial Sequence
  chemically synthesized
ttgacaaacctgagaaaaac

SEQ ID NO: 94935 - DNA, 20 bp, Artificial Sequence
  chemically synthesized
aacctgagaaaaacaagcaa

SEQ ID NO: 94936 - DNA, 20 bp, Artificial Sequence
  chemically synthesized
acctgagaaaaacaagcaat

SEQ ID NO: 94937 - DNA, 20 bp, Artificial Sequence
  chemically synthesized
cctgagaaaaacaagcaatg

SEQ ID NO: 94938 - DNA, 20 bp, Artificial Sequence
  chemically synthesized
agaaaaacaagcaatgggga

SEQ ID NO: 94939 - DNA, 20 bp, Artificial Sequence
  chemically synthesized
gaaaaacaagcaatggggaa

SEQ ID NO: 94940 - DNA, 20 bp, Artificial Sequence
  chemically synthesized
ccagcaccatttattaaata

SEQ ID NO: 94941 - DNA, 20 bp, Artificial Sequence
  chemically synthesized
cccagcaccatttattaaat

SEQ ID NO: 94942 - DNA, 20 bp, Artificial Sequence
  chemically synthesized
tcccagcaccatttattaaa

SEQ ID NO: 94943 - DNA, 20 bp, Artificial Sequence
  chemically synthesized
aggattccctatttaataaa

SEQ ID NO: 94944 - DNA, 20 bp, Artificial Sequence
  chemically synthesized
ccctatttaataaatggtgc

SEQ ID NO: 94945 - DNA, 20 bp, Artificial Sequence
  chemically synthesized
cctatttaataaatggtgct

SEQ ID NO: 94946 - DNA, 20 bp, Artificial Sequence
  chemically synthesized
ataaatggtgctgggaaaac

SEQ ID NO: 94947 - DNA, 20 bp, Artificial Sequence
  chemically synthesized
atatggctagccagttttcc

SEQ ID NO: 94948 - DNA, 20 bp, Artificial Sequence
  chemically synthesized
atggtgctgggaaaactggc

SEQ ID NO: 94949 - DNA, 20 bp, Artificial Sequence
  chemically synthesized
gctttctacatatggctagc

SEQ ID NO: 94950 - DNA, 20 bp, Artificial Sequence
  chemically synthesized
ttcagctttctacatatggc

SEQ ID NO: 94951 - DNA, 20 bp, Artificial Sequence
  chemically synthesized
gaaaactggctagccatatg

SEQ ID NO: 94952 - DNA, 20 bp, Artificial Sequence
  chemically synthesized
cagtttcagctttctacata

SEQ ID NO: 94953 - DNA, 20 bp, Artificial Sequence
  chemically synthesized
actggctagccatatgtaga

SEQ ID NO: 94954 - DNA, 20 bp, Artificial Sequence
  chemically synthesized
catatgtagaaagctgaaac

SEQ ID NO: 94955 - DNA, 20 bp, Artificial Sequence
  chemically synthesized
gtaaggaagggatccagttt

SEQ ID NO: 94956 - DNA, 20 bp, Artificial Sequence
  chemically synthesized
taaggtgtaaggaagggatc

SEQ ID NO: 94957 - DNA, 20 bp, Artificial Sequence
  chemically synthesized
tttgtataaggtgtaaggaa

SEQ ID NO: 94958 - DNA, 20 bp, Artificial Sequence
  chemically synthesized
ttttgtataaggtgtaagga

SEQ ID NO: 94959 - DNA, 20 bp, Artificial Sequence
  chemically synthesized
tttttgtataaggtgtaagg

SEQ ID NO: 94960 - DNA, 20 bp, Artificial Sequence
  chemically synthesized
tgatttttgtataaggtgta

SEQ ID NO: 94961 - DNA, 20 bp, Artificial Sequence
  chemically synthesized
ttgatttttgtataaggtgt

SEQ ID NO: 94962 - DNA, 20 bp, Artificial Sequence
  chemically synthesized
cttgaattgatttttgtata

SEQ ID NO: 94963 - DNA, 20 bp, Artificial Sequence
  chemically synthesized
tcttgaattgatttttgtat

SEQ ID NO: 94964 - DNA, 20 bp, Artificial Sequence
  chemically synthesized
ccttatacaaaaatcaattc

SEQ ID NO: 94965 - DNA, 20 bp, Artificial Sequence
  chemically synthesized
atacaaaaatcaattcaaga

SEQ ID NO: 94966 - DNA, 20 bp, Artificial Sequence
  chemically synthesized
aatcaattcaagatggatta

SEQ ID NO: 94967 - DNA, 20 bp, Artificial Sequence
  chemically synthesized
tggattaaagatttaaacgt

SEQ ID NO: 94968 - DNA, 20 bp, Artificial Sequence
  chemically synthesized
tctagggtttttatggtttt

SEQ ID NO: 94969 - DNA, 20 bp, Artificial Sequence
  chemically synthesized
ttctagggtttttatggttt

SEQ ID NO: 94970 - DNA, 20 bp, Artificial Sequence
  chemically synthesized
gttttcttctagggttttta

SEQ ID NO: 94971 - DNA, 20 bp, Artificial Sequence
  chemically synthesized
acctaaaaccataaaaaccc

SEQ ID NO: 94972 - DNA, 20 bp, Artificial Sequence
  chemically synthesized
taaaaccataaaaaccctag

SEQ ID NO: 94973 - DNA, 20 bp, Artificial Sequence
  chemically synthesized
aatgcctaggttttcttcta

SEQ ID NO: 94974 - DNA, 20 bp, Artificial Sequence
  chemically synthesized
taatgcctaggttttcttct

SEQ ID NO: 94975 - DNA, 20 bp, Artificial Sequence
  chemically synthesized
gtaatgcctaggttttcttc

SEQ ID NO: 94976 - DNA, 20 bp, Artificial Sequence
  chemically synthesized
aaaaaccctagaagaaaacc

SEQ ID NO: 94977 - DNA, 20 bp, Artificial Sequence
  chemically synthesized
aaaaccctagaagaaaacct

SEQ ID NO: 94978 - DNA, 20 bp, Artificial Sequence
  chemically synthesized
tgtcctgaatggtaatgcct

SEQ ID NO: 94979 - DNA, 20 bp, Artificial Sequence
  chemically synthesized
atgtcctgaatggtaatgcc

SEQ ID NO: 94980 - DNA, 20 bp, Artificial Sequence
  chemically synthesized
aaaacctaggcattaccatt

SEQ ID NO: 94981 - DNA, 20 bp, Artificial Sequence
  chemically synthesized
aaacctaggcattaccattc

SEQ ID NO: 94982 - DNA, 20 bp, Artificial Sequence
  chemically synthesized
gcccacgcctatgtcctgaa

SEQ ID NO: 94983 - DNA, 20 bp, Artificial Sequence
  chemically synthesized
aggcattaccattcaggaca

SEQ ID NO: 94984 - DNA, 20 bp, Artificial Sequence
  chemically synthesized
ggcattaccattcaggacat

SEQ ID NO: 94985 - DNA, 20 bp, Artificial Sequence
  chemically synthesized
taccattcaggacataggcg

SEQ ID NO: 94986 - DNA, 20 bp, Artificial Sequence
  chemically synthesized
accattcaggacataggcgt

SEQ ID NO: 94987 - DNA, 20 bp, Artificial Sequence
  chemically synthesized
ttcaggacataggcgtgggc

SEQ ID NO: 94988 - DNA, 20 bp, Artificial Sequence
  chemically synthesized
tcaggacataggcgtgggca

SEQ ID NO: 94989 - DNA, 20 bp, Artificial Sequence
  chemically synthesized
cttttggtgttttggacatg

SEQ ID NO: 94990 - DNA, 20 bp, Artificial Sequence
  chemically synthesized
tgccattgcttttggtgttt

SEQ ID NO: 94991 - DNA, 20 bp, Artificial Sequence
  chemically synthesized
cttcatgtccaaaacaccaa

SEQ ID NO: 94992 - DNA, 20 bp, Artificial Sequence
  chemically synthesized
gtccaaaacaccaaaagcaa

SEQ ID NO: 94993 - DNA, 20 bp, Artificial Sequence
  chemically synthesized
gcttttgttgccattgcttt

SEQ ID NO: 94994 - DNA, 20 bp, Artificial Sequence
  chemically synthesized
accaaaagcaatggcaacaa

SEQ ID NO: 94995 - DNA, 20 bp, Artificial Sequence
  chemically synthesized
gagaaaccatttgtcaattt

SEQ ID NO: 94996 - DNA, 20 bp, Artificial Sequence
  chemically synthesized
caaaagccaaaattgacaaa

SEQ ID NO: 94997 - DNA, 20 bp, Artificial Sequence
  chemically synthesized
tgacaaatggtttctcttga

SEQ ID NO: 94998 - DNA, 20 bp, Artificial Sequence
  chemically synthesized
caaatggtttctcttgatag

SEQ ID NO: 94999 - DNA, 20 bp, Artificial Sequence
  chemically synthesized
gtaaactgggctgctatcaa

SEQ ID NO: 95000 - DNA, 20 bp, Artificial Sequence
  chemically synthesized
cagtaaactgggctgctatc

SEQ ID NO: 95001 - DNA, 20 bp, Artificial Sequence
  chemically synthesized
ggtttctcttgatagcagcc

SEQ ID NO: 95002 - DNA, 20 bp, Artificial Sequence
  chemically synthesized
aaacaatcatacagtaaact

SEQ ID NO: 95003 - DNA, 20 bp, Artificial Sequence
  chemically synthesized
aaaacaatcatacagtaaac

SEQ ID NO: 95004 - DNA, 20 bp, Artificial Sequence
  chemically synthesized
aggtggctaaaacaatcata

SEQ ID NO: 95005 - DNA, 20 bp, Artificial Sequence
  chemically synthesized
agtttactgtatgattgttt

SEQ ID NO: 95006 - DNA, 20 bp, Artificial Sequence
  chemically synthesized
aagattggagggggaaaagg

SEQ ID NO: 95007 - DNA, 20 bp, Artificial Sequence
  chemically synthesized
tggaagattggagggggaaa

SEQ ID NO: 95008 - DNA, 20 bp, Artificial Sequence
  chemically synthesized
ttggaagattggagggggaa

SEQ ID NO: 95009 - DNA, 20 bp, Artificial Sequence
  chemically synthesized
gtaacttggaagattggagg

SEQ ID NO: 95010 - DNA, 20 bp, Artificial Sequence
  chemically synthesized
tgtaacttggaagattggag

SEQ ID NO: 95011 - DNA, 20 bp, Artificial Sequence
  chemically synthesized
ctgtaacttggaagattgga

SEQ ID NO: 95012 - DNA, 20 bp, Artificial Sequence
  chemically synthesized
gctgtaacttggaagattgg

SEQ ID NO: 95013 - DNA, 20 bp, Artificial Sequence
  chemically synthesized
tgctgtaacttggaagattg

SEQ ID NO: 95014 - DNA, 20 bp, Artificial Sequence
  chemically synthesized
ttttccccctccaatcttcc

SEQ ID NO: 95015 - DNA, 20 bp, Artificial Sequence
  chemically synthesized
actgctgtaacttggaagat

SEQ ID NO: 95016 - DNA, 20 bp, Artificial Sequence
  chemically synthesized
ggagaactgctgtaacttgg

SEQ ID NO: 95017 - DNA, 20 bp, Artificial Sequence
  chemically synthesized
ccctccaatcttccaagtta

SEQ ID NO: 95018 - DNA, 20 bp, Artificial Sequence
  chemically synthesized
tgaggagaactgctgtaact

SEQ ID NO: 95019 - DNA, 20 bp, Artificial Sequence
  chemically synthesized
tccaatcttccaagttacag

SEQ ID NO: 95020 - DNA, 20 bp, Artificial Sequence
  chemically synthesized
atcacacttttggtagtgag

SEQ ID NO: 95021 - DNA, 20 bp, Artificial Sequence
  chemically synthesized
ccatcacacttttggtagtg

SEQ ID NO: 95022 - DNA, 20 bp, Artificial Sequence
  chemically synthesized
accatcacacttttggtagt

SEQ ID NO: 95023 - DNA, 20 bp, Artificial Sequence
  chemically synthesized
gcagttctcctcactaccaa

SEQ ID NO: 95024 - DNA, 20 bp, Artificial Sequence
  chemically synthesized
tcctaccatcacacttttgg

SEQ ID NO: 95025 - DNA, 20 bp, Artificial Sequence
  chemically synthesized
tagtcctaccatcacacttt

SEQ ID NO: 95026 - DNA, 20 bp, Artificial Sequence
  chemically synthesized
cctcactaccaaaagtgtga

SEQ ID NO: 95027 - DNA, 20 bp, Artificial Sequence
  chemically synthesized
cactaccaaaagtgtgatgg

SEQ ID NO: 95028 - DNA, 20 bp, Artificial Sequence
  chemically synthesized
actaccaaaagtgtgatggt

SEQ ID NO: 95029 - DNA, 20 bp, Artificial Sequence
  chemically synthesized
aaagtgtgatggtaggacta

SEQ ID NO: 95030 - DNA, 20 bp, Artificial Sequence
  chemically synthesized
gaagggacaatggcaaacta

SEQ ID NO: 95031 - DNA, 20 bp, Artificial Sequence
  chemically synthesized
tagaatgaatgaagggacaa

SEQ ID NO: 95032 - DNA, 20 bp, Artificial Sequence
  chemically synthesized
gtatttgtagaatgaatgaa

SEQ ID NO: 95033 - DNA, 20 bp, Artificial Sequence
  chemically synthesized
agtatttgtagaatgaatga

SEQ ID NO: 95034 - DNA, 20 bp, Artificial Sequence
  chemically synthesized
cagtatttgtagaatgaatg

SEQ ID NO: 95035 - DNA, 20 bp, Artificial Sequence
  chemically synthesized
tgcatctccctcagtatttg

SEQ ID NO: 95036 - DNA, 20 bp, Artificial Sequence
  chemically synthesized
tcattcattctacaaatact

SEQ ID NO: 95037 - DNA, 20 bp, Artificial Sequence
  chemically synthesized
cattcattctacaaatactg

SEQ ID NO: 95038 - DNA, 20 bp, Artificial Sequence
  chemically synthesized
attcattctacaaatactga

SEQ ID NO: 95039 - DNA, 20 bp, Artificial Sequence
  chemically synthesized
tcattctacaaatactgagg

SEQ ID NO: 95040 - DNA, 20 bp, Artificial Sequence
  chemically synthesized
gttcatcactgcatctccct

SEQ ID NO: 95041 - DNA, 20 bp, Artificial Sequence
  chemically synthesized
tacaaatactgagggagatg

SEQ ID NO: 95042 - DNA, 20 bp, Artificial Sequence
  chemically synthesized
agatgcagtgatgaacatga

SEQ ID NO: 95043 - DNA, 20 bp, Artificial Sequence
  chemically synthesized
gaacatgacagacactgtcc

SEQ ID NO: 95044 - DNA, 20 bp, Artificial Sequence
  chemically synthesized
aaccccggattagactggga

SEQ ID NO: 95045 - DNA, 20 bp, Artificial Sequence
  chemically synthesized
agaaaaccccggattagact

SEQ ID NO: 95046 - DNA, 20 bp, Artificial Sequence
  chemically synthesized
cagaaaaccccggattagac

SEQ ID NO: 95047 - DNA, 20 bp, Artificial Sequence
  chemically synthesized
gacactgtcccagtctaatc

SEQ ID NO: 95048 - DNA, 20 bp, Artificial Sequence
  chemically synthesized
acactgtcccagtctaatcc

SEQ ID NO: 95049 - DNA, 20 bp, Artificial Sequence
  chemically synthesized
cactgtcccagtctaatccg

SEQ ID NO: 95050 - DNA, 20 bp, Artificial Sequence
  chemically synthesized
tataacagaaaaccccggat

SEQ ID NO: 95051 - DNA, 20 bp, Artificial Sequence
  chemically synthesized
tcttttataacagaaaaccc

SEQ ID NO: 95052 - DNA, 20 bp, Artificial Sequence
  chemically synthesized
tccggggttttctgttataa

SEQ ID NO: 95053 - DNA, 20 bp, Artificial Sequence
  chemically synthesized
ctgatatcattcttttataa

SEQ ID NO: 95054 - DNA, 20 bp, Artificial Sequence
  chemically synthesized
ctgttataaaagaatgatat

SEQ ID NO: 95055 - DNA, 20 bp, Artificial Sequence
  chemically synthesized
tgttataaaagaatgatatc

SEQ ID NO: 95056 - DNA, 20 bp, Artificial Sequence
  chemically synthesized
gttataaaagaatgatatca

SEQ ID NO: 95057 - DNA, 20 bp, Artificial Sequence
  chemically synthesized
aaaagaatgatatcagggtt

SEQ ID NO: 95058 - DNA, 20 bp, Artificial Sequence
  chemically synthesized
aatgatatcagggtttagat

SEQ ID NO: 95059 - DNA, 20 bp, Artificial Sequence
  chemically synthesized
atgatatcagggtttagatt

SEQ ID NO: 95060 - DNA, 20 bp, Artificial Sequence
  chemically synthesized
ttcaaagggctttgcattca

SEQ ID NO: 95061 - DNA, 20 bp, Artificial Sequence
  chemically synthesized
gattaggtactctgaatgca

SEQ ID NO: 95062 - DNA, 20 bp, Artificial Sequence
  chemically synthesized
ctttcaaagggctttgcatt

SEQ ID NO: 95063 - DNA, 20 bp, Artificial Sequence
  chemically synthesized
ctgaatgcaaagccctttga

SEQ ID NO: 95064 - DNA, 20 bp, Artificial Sequence
  chemically synthesized
agagttgtccaactttcaaa

SEQ ID NO: 95065 - DNA, 20 bp, Artificial Sequence
  chemically synthesized
cagagttgtccaactttcaa

SEQ ID NO: 95066 - DNA, 20 bp, Artificial Sequence
  chemically synthesized
atgcaaagccctttgaaagt

SEQ ID NO: 95067 - DNA, 20 bp, Artificial Sequence
  chemically synthesized
tcagagttgtccaactttca

SEQ ID NO: 95068 - DNA, 20 bp, Artificial Sequence
  chemically synthesized
taggatccctgatgtgttca

SEQ ID NO: 95069 - DNA, 20 bp, Artificial Sequence
  chemically synthesized
ttggacaactctgaacacat

SEQ ID NO: 95070 - DNA, 20 bp, Artificial Sequence
  chemically synthesized
actaggatccctgatgtgtt

SEQ ID NO: 95071 - DNA, 20 bp, Artificial Sequence
  chemically synthesized
tggacaactctgaacacatc

SEQ ID NO: 95072 - DNA, 20 bp, Artificial Sequence
  chemically synthesized
ggacaactctgaacacatca

SEQ ID NO: 95073 - DNA, 20 bp, Artificial Sequence
  chemically synthesized
tctgaacacatcagggatcc

SEQ ID NO: 95074 - DNA, 20 bp, Artificial Sequence
  chemically synthesized
atacttgttcatcatgtact

SEQ ID NO: 95075 - DNA, 20 bp, Artificial Sequence
  chemically synthesized
gatacttgttcatcatgtac

SEQ ID NO: 95076 - DNA, 20 bp, Artificial Sequence
  chemically synthesized
gatcctagtacatgatgaac

SEQ ID NO: 95077 - DNA, 20 bp, Artificial Sequence
  chemically synthesized
tacatgatgaacaagtatct

SEQ ID NO: 95078 - DNA, 20 bp, Artificial Sequence
  chemically synthesized
catgatgaacaagtatctga

SEQ ID NO: 95079 - DNA, 20 bp, Artificial Sequence
  chemically synthesized
ttaaattaagaaaattctct

SEQ ID NO: 95080 - DNA, 20 bp, Artificial Sequence
  chemically synthesized
gattttctaggtgttaaatt

SEQ ID NO: 95081 - DNA, 20 bp, Artificial Sequence
  chemically synthesized
aattttcttaatttaacacc

SEQ ID NO: 95082 - DNA, 20 bp, Artificial Sequence
  chemically synthesized
taatttaacacctagaaaat

SEQ ID NO: 95083 - DNA, 20 bp, Artificial Sequence
  chemically synthesized
acccttttagctgattttct

SEQ ID NO: 95084 - DNA, 20 bp, Artificial Sequence
  chemically synthesized
tacccttttagctgattttc

SEQ ID NO: 95085 - DNA, 20 bp, Artificial Sequence
  chemically synthesized
acacctagaaaatcagctaa

SEQ ID NO: 95086 - DNA, 20 bp, Artificial Sequence
  chemically synthesized
cacctagaaaatcagctaaa

SEQ ID NO: 95087 - DNA, 20 bp, Artificial Sequence
  chemically synthesized
acctagaaaatcagctaaaa

SEQ ID NO: 95088 - DNA, 20 bp, Artificial Sequence
  chemically synthesized
tgcaaacagttttacccttt

SEQ ID NO: 95089 - DNA, 20 bp, Artificial Sequence
  chemically synthesized
aaagggtaaaactgtttgca

SEQ ID NO: 95090 - DNA, 20 bp, Artificial Sequence
  chemically synthesized
ggtttggttttctgtgcaaa

SEQ ID NO: 95091 - DNA, 20 bp, Artificial Sequence
  chemically synthesized
caatctcttcttaaatggtt

SEQ ID NO: 95092 - DNA, 20 bp, Artificial Sequence
  chemically synthesized
cacagaaaaccaaaccattt

SEQ ID NO: 95093 - DNA, 20 bp, Artificial Sequence
  chemically synthesized
agaaaaccaaaccatttaag

SEQ ID NO: 95094 - DNA, 20 bp, Artificial Sequence
  chemically synthesized
ctattcaatctcttcttaaa

SEQ ID NO: 95095 - DNA, 20 bp, Artificial Sequence
  chemically synthesized
aaaaccaaaccatttaagaa

SEQ ID NO: 95096 - DNA, 20 bp, Artificial Sequence
  chemically synthesized
ccatttaagaagagattgaa

SEQ ID NO: 95097 - DNA, 20 bp, Artificial Sequence
  chemically synthesized
agaagagattgaatagttat

SEQ ID NO: 95098 - DNA, 20 bp, Artificial Sequence
  chemically synthesized
agttattagattcttttgat

SEQ ID NO: 95099 - DNA, 20 bp, Artificial Sequence
  chemically synthesized
gttattagattcttttgatc

SEQ ID NO: 95100 - DNA, 20 bp, Artificial Sequence
  chemically synthesized
taggttttctacctgatcaa

SEQ ID NO: 95101 - DNA, 20 bp, Artificial Sequence
  chemically synthesized
attagattcttttgatcagg

SEQ ID NO: 95102 - DNA, 20 bp, Artificial Sequence
  chemically synthesized
atcaggtagaaaacctatcc

SEQ ID NO: 95103 - DNA, 20 bp, Artificial Sequence
  chemically synthesized
tcaggtagaaaacctatcct

SEQ ID NO: 95104 - DNA, 20 bp, Artificial Sequence
  chemically synthesized
aggtagaaaacctatcctgg

SEQ ID NO: 95105 - DNA, 20 bp, Artificial Sequence
  chemically synthesized
gagattttaactcccaggat

SEQ ID NO: 95106 - DNA, 20 bp, Artificial Sequence
  chemically synthesized
tgagattttaactcccagga

SEQ ID NO: 95107 - DNA, 20 bp, Artificial Sequence
  chemically synthesized
atcttgagattttaactccc

SEQ ID NO: 95108 - DNA, 20 bp, Artificial Sequence
  chemically synthesized
tatcttgagattttaactcc

SEQ ID NO: 95109 - DNA, 20 bp, Artificial Sequence
  chemically synthesized
atcctgggagttaaaatctc

SEQ ID NO: 95110 - DNA, 20 bp, Artificial Sequence
  chemically synthesized
tgggagttaaaatctcaaga

SEQ ID NO: 95111 - DNA, 20 bp, Artificial Sequence
  chemically synthesized
gggagttaaaatctcaagat

SEQ ID NO: 95112 - DNA, 20 bp, Artificial Sequence
  chemically synthesized
ggccaagaagagcctatctt

SEQ ID NO: 95113 - DNA, 20 bp, Artificial Sequence
  chemically synthesized
atctcaagataggctcttct

SEQ ID NO: 95114 - DNA, 20 bp, Artificial Sequence
  chemically synthesized
tagatattataggccaagaa

SEQ ID NO: 95115 - DNA, 20 bp, Artificial Sequence
  chemically synthesized
aatagatattataggccaag

SEQ ID NO: 95116 - DNA, 20 bp, Artificial Sequence
  chemically synthesized
ccaaatagatattataggcc

SEQ ID NO: 95117 - DNA, 20 bp, Artificial Sequence
  chemically synthesized
ctagtccaaatagatattat

SEQ ID NO: 95118 - DNA, 20 bp, Artificial Sequence
  chemically synthesized
actagtccaaatagatatta

SEQ ID NO: 95119 - DNA, 20 bp, Artificial Sequence
  chemically synthesized
cttggcctataatatctatt

SEQ ID NO: 95120 - DNA, 20 bp, Artificial Sequence
  chemically synthesized
cctataatatctatttggac

SEQ ID NO: 95121 - DNA, 20 bp, Artificial Sequence
  chemically synthesized
ggccatgtgactagtccaaa

SEQ ID NO: 95122 - DNA, 20 bp, Artificial Sequence
  chemically synthesized
atctatttggactagtcaca

SEQ ID NO: 95123 - DNA, 20 bp, Artificial Sequence
  chemically synthesized
ttaatttcaggccatgtgac

SEQ ID NO: 95124 - DNA, 20 bp, Artificial Sequence
  chemically synthesized
tcaattatctcattaatttc

SEQ ID NO: 95125 - DNA, 20 bp, Artificial Sequence
  chemically synthesized
ttcaattatctcattaattt

SEQ ID NO: 95126 - DNA, 20 bp, Artificial Sequence
  chemically synthesized
tcacatggcctgaaattaat

SEQ ID NO: 95127 - DNA, 20 bp, Artificial Sequence
  chemically synthesized
gaggagattctagtggagga

SEQ ID NO: 95128 - DNA, 20 bp, Artificial Sequence
  chemically synthesized
aattgaaaactatcctccac

SEQ ID NO: 95129 - DNA, 20 bp, Artificial Sequence
  chemically synthesized
aaatgaggagattctagtgg

SEQ ID NO: 95130 - DNA, 20 bp, Artificial Sequence
  chemically synthesized
aaaatgaggagattctagtg

SEQ ID NO: 95131 - DNA, 20 bp, Artificial Sequence
  chemically synthesized
ataaaatgaggagattctag

SEQ ID NO: 95132 - DNA, 20 bp, Artificial Sequence
  chemically synthesized
tgcataaaatgaggagattc

SEQ ID NO: 95133 - DNA, 20 bp, Artificial Sequence
  chemically synthesized
cataaaatgcataaaatgag

SEQ ID NO: 95134 - DNA, 20 bp, Artificial Sequence
  chemically synthesized
tgcataaaatgcataaaatg

SEQ ID NO: 95135 - DNA, 20 bp, Artificial Sequence
  chemically synthesized
ttgcataaaatgcataaaat

SEQ ID NO: 95136 - DNA, 20 bp, Artificial Sequence
  chemically synthesized
tcattttatgcattttatgc

SEQ ID NO: 95137 - DNA, 20 bp, Artificial Sequence
  chemically synthesized
cattttatgcattttatgca

SEQ ID NO: 95138 - DNA, 20 bp, Artificial Sequence
  chemically synthesized
gcattttatgcaaggttgct

SEQ ID NO: 95139 - DNA, 20 bp, Artificial Sequence
  chemically synthesized
ttttatgcaaggttgcttag

SEQ ID NO: 95140 - DNA, 20 bp, Artificial Sequence
  chemically synthesized
tgcaaggttgcttagtggcc

SEQ ID NO: 95141 - DNA, 20 bp, Artificial Sequence
  chemically synthesized
attatcaatcctaggccact

SEQ ID NO: 95142 - DNA, 20 bp, Artificial Sequence
  chemically synthesized
gcaaggttgcttagtggcct

SEQ ID NO: 95143 - DNA, 20 bp, Artificial Sequence
  chemically synthesized
tacttattattatcaatcct

SEQ ID NO: 95144 - DNA, 20 bp, Artificial Sequence
  chemically synthesized
ttacttattattatcaatcc

SEQ ID NO: 95145 - DNA, 20 bp, Artificial Sequence
  chemically synthesized
ggcctaggattgataataat

SEQ ID NO: 95146 - DNA, 20 bp, Artificial Sequence
  chemically synthesized
taggattgataataataagt

SEQ ID NO: 95147 - DNA, 20 bp, Artificial Sequence
  chemically synthesized
cagtttgggattgggttcat

SEQ ID NO: 95148 - DNA, 20 bp, Artificial Sequence
  chemically synthesized
tgcaaaatcagtttgggatt

SEQ ID NO: 95149 - DNA, 20 bp, Artificial Sequence
  chemically synthesized
ctgcaaaatcagtttgggat

SEQ ID NO: 95150 - DNA, 20 bp, Artificial Sequence
  chemically synthesized
agatactgcaaaatcagttt

SEQ ID NO: 95151 - DNA, 20 bp, Artificial Sequence
  chemically synthesized
aagatactgcaaaatcagtt

SEQ ID NO: 95152 - DNA, 20 bp, Artificial Sequence
  chemically synthesized
ccaatcccaaactgattttg

SEQ ID NO: 95153 - DNA, 20 bp, Artificial Sequence
  chemically synthesized
gataaaagatactgcaaaat

SEQ ID NO: 95154 - DNA, 20 bp, Artificial Sequence
  chemically synthesized
gattttgcagtatcttttat

SEQ ID NO: 95155 - DNA, 20 bp, Artificial Sequence
  chemically synthesized
tttgcagtatcttttatcag

SEQ ID NO: 95156 - DNA, 20 bp, Artificial Sequence
  chemically synthesized
gccatgaaatctactgataa

SEQ ID NO: 95157 - DNA, 20 bp, Artificial Sequence
  chemically synthesized
tcttttatcagtagatttca

SEQ ID NO: 95158 - DNA, 20 bp, Artificial Sequence
  chemically synthesized
tttatcagtagatttcatgg

SEQ ID NO: 95159 - DNA, 20 bp, Artificial Sequence
  chemically synthesized
attttttacaattaaatata

SEQ ID NO: 95160 - DNA, 20 bp, Artificial Sequence
  chemically synthesized
atatttaattgtaaaaaatt

SEQ ID NO: 95161 - DNA, 20 bp, Artificial Sequence
  chemically synthesized
tatttaattgtaaaaaattc

SEQ ID NO: 95162 - DNA, 20 bp, Artificial Sequence
  chemically synthesized
aaattcgggactgtttaaac

SEQ ID NO: 95163 - DNA, 20 bp, Artificial Sequence
  chemically synthesized
tctcacctccccagtttaaa

SEQ ID NO: 95164 - DNA, 20 bp, Artificial Sequence
  chemically synthesized
aattcgggactgtttaaact

SEQ ID NO: 95165 - DNA, 20 bp, Artificial Sequence
  chemically synthesized
attcgggactgtttaaactg

SEQ ID NO: 95166 - DNA, 20 bp, Artificial Sequence
  chemically synthesized
tcgggactgtttaaactggg

SEQ ID NO: 95167 - DNA, 20 bp, Artificial Sequence
  chemically synthesized
cgggactgtttaaactgggg

SEQ ID NO: 95168 - DNA, 20 bp, Artificial Sequence
  chemically synthesized
actgtttaaactggggaggt

SEQ ID NO: 95169 - DNA, 20 bp, Artificial Sequence
  chemically synthesized
cttctgttttctcacctccc

SEQ ID NO: 95170 - DNA, 20 bp, Artificial Sequence
  chemically synthesized
aaactggggaggtgagaaaa

SEQ ID NO: 95171 - DNA, 20 bp, Artificial Sequence
  chemically synthesized
ctggggaggtgagaaaacag

SEQ ID NO: 95172 - DNA, 20 bp, Artificial Sequence
  chemically synthesized
tggggaggtgagaaaacaga

SEQ ID NO: 95173 - DNA, 20 bp, Artificial Sequence
  chemically synthesized
aggtgagaaaacagaaggaa

SEQ ID NO: 95174 - DNA, 20 bp, Artificial Sequence
  chemically synthesized
gtgagaaaacagaaggaaaa

SEQ ID NO: 95175 - DNA, 20 bp, Artificial Sequence
  chemically synthesized
tgagaaaacagaaggaaaag

SEQ ID NO: 95176 - DNA, 20 bp, Artificial Sequence
  chemically synthesized
gaaaacagaaggaaaagagg

SEQ ID NO: 95177 - DNA, 20 bp, Artificial Sequence
  chemically synthesized
gaaggaaaagaggtagaaat

SEQ ID NO: 95178 - DNA, 20 bp, Artificial Sequence
  chemically synthesized
ggaaaagaggtagaaataag

SEQ ID NO: 95179 - DNA, 20 bp, Artificial Sequence
  chemically synthesized
gaggtagaaataagaagcac

SEQ ID NO: 95180 - DNA, 20 bp, Artificial Sequence
  chemically synthesized
gtagaaataagaagcacaag

SEQ ID NO: 95181 - DNA, 20 bp, Artificial Sequence
  chemically synthesized
agcacaagaagattgtgaac

SEQ ID NO: 95182 - DNA, 20 bp, Artificial Sequence
  chemically synthesized
gcttctaagtttatgaaaac

SEQ ID NO: 95183 - DNA, 20 bp, Artificial Sequence
  chemically synthesized
tgaaccagttttcataaact

SEQ ID NO: 95184 - DNA, 20 bp, Artificial Sequence
  chemically synthesized
accagttttcataaacttag

SEQ ID NO: 95185 - DNA, 20 bp, Artificial Sequence
  chemically synthesized
aagtacctttcattgcttct

SEQ ID NO: 95186 - DNA, 20 bp, Artificial Sequence
  chemically synthesized
cataaacttagaagcaatga

SEQ ID NO: 95187 - DNA, 20 bp, Artificial Sequence
  chemically synthesized
ataaacttagaagcaatgaa

SEQ ID NO: 95188 - DNA, 20 bp, Artificial Sequence
  chemically synthesized
tctattctgtttgcagtttc

SEQ ID NO: 95189 - DNA, 20 bp, Artificial Sequence
  chemically synthesized
aaggtacttgaaactgcaaa

SEQ ID NO: 95190 - DNA, 20 bp, Artificial Sequence
  chemically synthesized
agtccactctattctgtttg

SEQ ID NO: 95191 - DNA, 20 bp, Artificial Sequence
  chemically synthesized
acttgaaactgcaaacagaa

SEQ ID NO: 95192 - DNA, 20 bp, Artificial Sequence
  chemically synthesized
ttgaaactgcaaacagaata

SEQ ID NO: 95193 - DNA, 20 bp, Artificial Sequence
  chemically synthesized
aaactgcaaacagaatagag

SEQ ID NO: 95194 - DNA, 20 bp, Artificial Sequence
  chemically synthesized
cacaatcagtgagcagtttt

SEQ ID NO: 95195 - DNA, 20 bp, Artificial Sequence
  chemically synthesized
ttgagtacacaatcagtgag

SEQ ID NO: 95196 - DNA, 20 bp, Artificial Sequence
  chemically synthesized
atgttgagtacacaatcagt

SEQ ID NO: 95197 - DNA, 20 bp, Artificial Sequence
  chemically synthesized
gaaaatgttgagtacacaat

SEQ ID NO: 95198 - DNA, 20 bp, Artificial Sequence
  chemically synthesized
tatttaacagagaaaatgtt

SEQ ID NO: 95199 - DNA, 20 bp, Artificial Sequence
  chemically synthesized
tcaacattttctctgttaaa

SEQ ID NO: 95200 - DNA, 20 bp, Artificial Sequence
  chemically synthesized
ctctaggatcctatttaaca

SEQ ID NO: 95201 - DNA, 20 bp, Artificial Sequence
  chemically synthesized
caacattttctctgttaaat

SEQ ID NO: 95202 - DNA, 20 bp, Artificial Sequence
  chemically synthesized
tgctctaggatcctatttaa

SEQ ID NO: 95203 - DNA, 20 bp, Artificial Sequence
  chemically synthesized
ttctctgttaaataggatcc

SEQ ID NO: 95204 - DNA, 20 bp, Artificial Sequence
  chemically synthesized
ctctgttaaataggatccta

SEQ ID NO: 95205 - DNA, 20 bp, Artificial Sequence
  chemically synthesized
tgttaaataggatcctagag

SEQ ID NO: 95206 - DNA, 20 bp, Artificial Sequence
  chemically synthesized
caatttgaaatagctgctct

SEQ ID NO: 95207 - DNA, 20 bp, Artificial Sequence
  chemically synthesized
gcaatttgaaatagctgctc

SEQ ID NO: 95208 - DNA, 20 bp, Artificial Sequence
  chemically synthesized
aggtgagtggcaatttgaaa

SEQ ID NO: 95209 - DNA, 20 bp, Artificial Sequence
  chemically synthesized
agtctgagatttaaggtgag

SEQ ID NO: 95210 - DNA, 20 bp, Artificial Sequence
  chemically synthesized
tggagtctgagatttaaggt

SEQ ID NO: 95211 - DNA, 20 bp, Artificial Sequence
  chemically synthesized
ttgccactcaccttaaatct

SEQ ID NO: 95212 - DNA, 20 bp, Artificial Sequence
  chemically synthesized
gtgttggagtctgagattta

SEQ ID NO: 95213 - DNA, 20 bp, Artificial Sequence
  chemically synthesized
ggtgttggagtctgagattt

SEQ ID NO: 95214 - DNA, 20 bp, Artificial Sequence
  chemically synthesized
tgaggaaggtgttggagtct

SEQ ID NO: 95215 - DNA, 20 bp, Artificial Sequence
  chemically synthesized
cagtgatgaggaaggtgttg

SEQ ID NO: 95216 - DNA, 20 bp, Artificial Sequence
  chemically synthesized
cccagtgatgaggaaggtgt

SEQ ID NO: 95217 - DNA, 20 bp, Artificial Sequence
  chemically synthesized
taaatgcccagtgatgagga

SEQ ID NO: 95218 - DNA, 20 bp, Artificial Sequence
  chemically synthesized
ctaaatgcccagtgatgagg

SEQ ID NO: 95219 - DNA, 20 bp, Artificial Sequence
  chemically synthesized
tccaacaccttcctcatcac

SEQ ID NO: 95220 - DNA, 20 bp, Artificial Sequence
  chemically synthesized
ccaacaccttcctcatcact

SEQ ID NO: 95221 - DNA, 20 bp, Artificial Sequence
  chemically synthesized
cagctaaatgcccagtgatg

SEQ ID NO: 95222 - DNA, 20 bp, Artificial Sequence
  chemically synthesized
gcagctaaatgcccagtgat

SEQ ID NO: 95223 - DNA, 20 bp, Artificial Sequence
  chemically synthesized
cttcctcatcactgggcatt

SEQ ID NO: 95224 - DNA, 20 bp, Artificial Sequence
  chemically synthesized
ggaagctgcagctaaatgcc

SEQ ID NO: 95225 - DNA, 20 bp, Artificial Sequence
  chemically synthesized
catcactgggcatttagctg

SEQ ID NO: 95226 - DNA, 20 bp, Artificial Sequence
  chemically synthesized
ttttattgaagtggaagctg

SEQ ID NO: 95227 - DNA, 20 bp, Artificial Sequence
  chemically synthesized
tttattttttattgaagtgg

SEQ ID NO: 95228 - DNA, 20 bp, Artificial Sequence
  chemically synthesized
ggatttattttttattgaag

SEQ ID NO: 95229 - DNA, 20 bp, Artificial Sequence
  chemically synthesized
attggatttattttttattg

SEQ ID NO: 95230 - DNA, 20 bp, Artificial Sequence
  chemically synthesized
gttaagtaggattgttgtat

SEQ ID NO: 95231 - DNA, 20 bp, Artificial Sequence
  chemically synthesized
agtttggtgaaaggttaagt

SEQ ID NO: 95232 - DNA, 20 bp, Artificial Sequence
  chemically synthesized
aagtttggtgaaaggttaag

SEQ ID NO: 95233 - DNA, 20 bp, Artificial Sequence
  chemically synthesized
tgtaagtttggtgaaaggtt

SEQ ID NO: 95234 - DNA, 20 bp, Artificial Sequence
  chemically synthesized
agttttgtaagtttggtgaa

SEQ ID NO: 95235 - DNA, 20 bp, Artificial Sequence
  chemically synthesized
tagttttgtaagtttggtga

SEQ ID NO: 95236 - DNA, 20 bp, Artificial Sequence
  chemically synthesized
tactggtagttttgtaagtt

SEQ ID NO: 95237 - DNA, 20 bp, Artificial Sequence
  chemically synthesized
atagctactggtagttttgt

SEQ ID NO: 95238 - DNA, 20 bp, Artificial Sequence
  chemically synthesized
caccaaacttacaaaactac

SEQ ID NO: 95239 - DNA, 20 bp, Artificial Sequence
  chemically synthesized
caaacttacaaaactaccag

SEQ ID NO: 95240 - DNA, 20 bp, Artificial Sequence
  chemically synthesized
aggatgggcatagctactgg

SEQ ID NO: 95241 - DNA, 20 bp, Artificial Sequence
  chemically synthesized
aggaggatgggcatagctac

SEQ ID NO: 95242 - DNA, 20 bp, Artificial Sequence
  chemically synthesized
gaagggaaggaggatgggca

SEQ ID NO: 95243 - DNA, 20 bp, Artificial Sequence
  chemically synthesized
ggggagaagggaaggaggat

SEQ ID NO: 95244 - DNA, 20 bp, Artificial Sequence
  chemically synthesized
aggggagaagggaaggagga

SEQ ID NO: 95245 - DNA, 20 bp, Artificial Sequence
  chemically synthesized
catcaggggagaagggaagg

SEQ ID NO: 95246 - DNA, 20 bp, Artificial Sequence
  chemically synthesized
acatcaggggagaagggaag

SEQ ID NO: 95247 - DNA, 20 bp, Artificial Sequence
  chemically synthesized
caacatcaggggagaaggga

SEQ ID NO: 95248 - DNA, 20 bp, Artificial Sequence
  chemically synthesized
acaacatcaggggagaaggg

SEQ ID NO: 95249 - DNA, 20 bp, Artificial Sequence
  chemically synthesized
attacaacatcaggggagaa

SEQ ID NO: 95250 - DNA, 20 bp, Artificial Sequence
  chemically synthesized
tattacaacatcaggggaga

SEQ ID NO: 95251 - DNA, 20 bp, Artificial Sequence
  chemically synthesized
ctattacaacatcaggggag

SEQ ID NO: 95252 - DNA, 20 bp, Artificial Sequence
  chemically synthesized
cttctattacaacatcaggg

SEQ ID NO: 95253 - DNA, 20 bp, Artificial Sequence
  chemically synthesized
agcttctattacaacatcag

SEQ ID NO: 95254 - DNA, 20 bp, Artificial Sequence
  chemically synthesized
cagcttctattacaacatca

SEQ ID NO: 95255 - DNA, 20 bp, Artificial Sequence
  chemically synthesized
acagcttctattacaacatc

SEQ ID NO: 95256 - DNA, 20 bp, Artificial Sequence
  chemically synthesized
tacagcttctattacaacat

SEQ ID NO: 95257 - DNA, 20 bp, Artificial Sequence
  chemically synthesized
cttctcccctgatgttgtaa

SEQ ID NO: 95258 - DNA, 20 bp, Artificial Sequence
  chemically synthesized
ctcccctgatgttgtaatag

SEQ ID NO: 95259 - DNA, 20 bp, Artificial Sequence
  chemically synthesized
ttcagataggaaggaaagta

SEQ ID NO: 95260 - DNA, 20 bp, Artificial Sequence
  chemically synthesized
ttagcttcagataggaagga

SEQ ID NO: 95261 - DNA, 20 bp, Artificial Sequence
  chemically synthesized
gaaattagcttcagatagga

SEQ ID NO: 95262 - DNA, 20 bp, Artificial Sequence
  chemically synthesized
agaaattagcttcagatagg

SEQ ID NO: 95263 - DNA, 20 bp, Artificial Sequence
  chemically synthesized
tgtactttccttcctatctg

SEQ ID NO: 95264 - DNA, 20 bp, Artificial Sequence
  chemically synthesized
tttagaaattagcttcagat

SEQ ID NO: 95265 - DNA, 20 bp, Artificial Sequence
  chemically synthesized
atttagaaattagcttcaga

SEQ ID NO: 95266 - DNA, 20 bp, Artificial Sequence
  chemically synthesized
tgaaatttagaaattagctt

SEQ ID NO: 95267 - DNA, 20 bp, Artificial Sequence
  chemically synthesized
gaaagatgaaatttagaaat

SEQ ID NO: 95268 - DNA, 20 bp, Artificial Sequence
  chemically synthesized
gaaggcagaaagatgaaatt

SEQ ID NO: 95269 - DNA, 20 bp, Artificial Sequence
  chemically synthesized
caggtacttgagaaggcaga

SEQ ID NO: 95270 - DNA, 20 bp, Artificial Sequence
  chemically synthesized
tttcatctttctgccttctc

SEQ ID NO: 95271 - DNA, 20 bp, Artificial Sequence
  chemically synthesized
agcacaggtacttgagaagg

SEQ ID NO: 95272 - DNA, 20 bp, Artificial Sequence
  chemically synthesized
aatagcacaggtacttgaga

SEQ ID NO: 95273 - DNA, 20 bp, Artificial Sequence
  chemically synthesized
caatagcacaggtacttgag

SEQ ID NO: 95274 - DNA, 20 bp, Artificial Sequence
  chemically synthesized
aatcaatagcacaggtactt

SEQ ID NO: 95275 - DNA, 20 bp, Artificial Sequence
  chemically synthesized
ttagagataatcaatagcac

SEQ ID NO: 95276 - DNA, 20 bp, Artificial Sequence
  chemically synthesized
attagagataatcaatagca

SEQ ID NO: 95277 - DNA, 20 bp, Artificial Sequence
  chemically synthesized
gagaaattagagataatcaa

SEQ ID NO: 95278 - DNA, 20 bp, Artificial Sequence
  chemically synthesized
tgaggatgcaggagaaatta

SEQ ID NO: 95279 - DNA, 20 bp, Artificial Sequence
  chemically synthesized
gttgaggatgcaggagaaat

SEQ ID NO: 95280 - DNA, 20 bp, Artificial Sequence
  chemically synthesized
gggagaggttgaggatgcag

SEQ ID NO: 95281 - DNA, 20 bp, Artificial Sequence
  chemically synthesized
gagggagaggttgaggatgc

SEQ ID NO: 95282 - DNA, 20 bp, Artificial Sequence
  chemically synthesized
agagggagaggttgaggatg

SEQ ID NO: 95283 - DNA, 20 bp, Artificial Sequence
  chemically synthesized
tggtagagagggagaggttg

SEQ ID NO: 95284 - DNA, 20 bp, Artificial Sequence
  chemically synthesized
atggtagagagggagaggtt

SEQ ID NO: 95285 - DNA, 20 bp, Artificial Sequence
  chemically synthesized
agaagatggtagagagggag

SEQ ID NO: 95286 - DNA, 20 bp, Artificial Sequence
  chemically synthesized
aagaagatggtagagaggga

SEQ ID NO: 95287 - DNA, 20 bp, Artificial Sequence
  chemically synthesized
agaagaagatggtagagagg

SEQ ID NO: 95288 - DNA, 20 bp, Artificial Sequence
  chemically synthesized
tgagaagaagatggtagaga

SEQ ID NO: 95289 - DNA, 20 bp, Artificial Sequence
  chemically synthesized
atgagaagaagatggtagag

SEQ ID NO: 95290 - DNA, 20 bp, Artificial Sequence
  chemically synthesized
aatgagaagaagatggtaga

SEQ ID NO: 95291 - DNA, 20 bp, Artificial Sequence
  chemically synthesized
gcaatgagaagaagatggta

SEQ ID NO: 95292 - DNA, 20 bp, Artificial Sequence
  chemically synthesized
tggcaatgagaagaagatgg

SEQ ID NO: 95293 - DNA, 20 bp, Artificial Sequence
  chemically synthesized
aaatggcaatgagaagaaga

SEQ ID NO: 95294 - DNA, 20 bp, Artificial Sequence
  chemically synthesized
gtttaaatggcaatgagaag

SEQ ID NO: 95295 - DNA, 20 bp, Artificial Sequence
  chemically synthesized
catgtttaaatggcaatgag

SEQ ID NO: 95296 - DNA, 20 bp, Artificial Sequence
  chemically synthesized
acacatgtttaaatggcaat

SEQ ID NO: 95297 - DNA, 20 bp, Artificial Sequence
  chemically synthesized
gtgacttacacatgtttaaa

SEQ ID NO: 95298 - DNA, 20 bp, Artificial Sequence
  chemically synthesized
attgccatttaaacatgtgt

SEQ ID NO: 95299 - DNA, 20 bp, Artificial Sequence
  chemically synthesized
gtgtaagtcactaccctttt

SEQ ID NO: 95300 - DNA, 20 bp, Artificial Sequence
  chemically synthesized
agaacacactcttaaaaggg

SEQ ID NO: 95301 - DNA, 20 bp, Artificial Sequence
  chemically synthesized
gtaagtcactacccttttaa

SEQ ID NO: 95302 - DNA, 20 bp, Artificial Sequence
  chemically synthesized
ggaagaacacactcttaaaa

SEQ ID NO: 95303 - DNA, 20 bp, Artificial Sequence
  chemically synthesized
aggaagaacacactcttaaa

SEQ ID NO: 95304 - DNA, 20 bp, Artificial Sequence
  chemically synthesized
caggaagaacacactcttaa

SEQ ID NO: 95305 - DNA, 20 bp, Artificial Sequence
  chemically synthesized
aagatggatgtaggggcagg

SEQ ID NO: 95306 - DNA, 20 bp, Artificial Sequence
  chemically synthesized
cagaagatggatgtaggggc

SEQ ID NO: 95307 - DNA, 20 bp, Artificial Sequence
  chemically synthesized
gcagaagatggatgtagggg

SEQ ID NO: 95308 - DNA, 20 bp, Artificial Sequence
  chemically synthesized
gtagcagaagatggatgtag

SEQ ID NO: 95309 - DNA, 20 bp, Artificial Sequence
  chemically synthesized
agtagcagaagatggatgta

SEQ ID NO: 95310 - DNA, 20 bp, Artificial Sequence
  chemically synthesized
tagtagcagaagatggatgt

SEQ ID NO: 95311 - DNA, 20 bp, Artificial Sequence
  chemically synthesized
atagtagcagaagatggatg

SEQ ID NO: 95312 - DNA, 20 bp, Artificial Sequence
  chemically synthesized
agggccatagtagcagaaga

SEQ ID NO: 95313 - DNA, 20 bp, Artificial Sequence
  chemically synthesized
agaaagggccatagtagcag

SEQ ID NO: 95314 - DNA, 20 bp, Artificial Sequence
  chemically synthesized
acatccatcttctgctacta

SEQ ID NO: 95315 - DNA, 20 bp, Artificial Sequence
  chemically synthesized
gagagaaagggccatagtag

SEQ ID NO: 95316 - DNA, 20 bp, Artificial Sequence
  chemically synthesized
gaagagagaaagggccatag

SEQ ID NO: 95317 - DNA, 20 bp, Artificial Sequence
  chemically synthesized
tgggaagagagaaagggcca

SEQ ID NO: 95318 - DNA, 20 bp, Artificial Sequence
  chemically synthesized
ctgcgatgggaagagagaaa

SEQ ID NO: 95319 - DNA, 20 bp, Artificial Sequence
  chemically synthesized
gctgcgatgggaagagagaa

SEQ ID NO: 95320 - DNA, 20 bp, Artificial Sequence
  chemically synthesized
ggctgcgatgggaagagaga

SEQ ID NO: 95321 - DNA, 20 bp, Artificial Sequence
  chemically synthesized
ttttggctgcgatgggaaga

SEQ ID NO: 95322 - DNA, 20 bp, Artificial Sequence
  chemically synthesized
acttttggctgcgatgggaa

SEQ ID NO: 95323 - DNA, 20 bp, Artificial Sequence
  chemically synthesized
ccctttctctcttcccatcg

SEQ ID NO: 95324 - DNA, 20 bp, Artificial Sequence
  chemically synthesized
agacttttggctgcgatggg

SEQ ID NO: 95325 - DNA, 20 bp, Artificial Sequence
  chemically synthesized
ttaagacttttggctgcgat

SEQ ID NO: 95326 - DNA, 20 bp, Artificial Sequence
  chemically synthesized
tttaagacttttggctgcga

SEQ ID NO: 95327 - DNA, 20 bp, Artificial Sequence
  chemically synthesized
tctcttcccatcgcagccaa

SEQ ID NO: 95328 - DNA, 20 bp, Artificial Sequence
  chemically synthesized
aacaattattttaagacttt

SEQ ID NO: 95329 - DNA, 20 bp, Artificial Sequence
  chemically synthesized
aagtgtaaaacaattatttt

SEQ ID NO: 95330 - DNA, 20 bp, Artificial Sequence
  chemically synthesized
aattgagaaagtgggggagc

SEQ ID NO: 95331 - DNA, 20 bp, Artificial Sequence
  chemically synthesized
tgagaattgagaaagtgggg

SEQ ID NO: 95332 - DNA, 20 bp, Artificial Sequence
  chemically synthesized
attgagaattgagaaagtgg

SEQ ID NO: 95333 - DNA, 20 bp, Artificial Sequence
  chemically synthesized
gattgagaattgagaaagtg

SEQ ID NO: 95334 - DNA, 20 bp, Artificial Sequence
  chemically synthesized
tgattgagaattgagaaagt

SEQ ID NO: 95335 - DNA, 20 bp, Artificial Sequence
  chemically synthesized
atgattgagaattgagaaag

SEQ ID NO: 95336 - DNA, 20 bp, Artificial Sequence
  chemically synthesized
ggcatgattgagaattgaga

SEQ ID NO: 95337 - DNA, 20 bp, Artificial Sequence
  chemically synthesized
ttcaggcatgattgagaatt

SEQ ID NO: 95338 - DNA, 20 bp, Artificial Sequence
  chemically synthesized
cagtacgttcaggcatgatt

SEQ ID NO: 95339 - DNA, 20 bp, Artificial Sequence
  chemically synthesized
accaagattgcagtacgttc

SEQ ID NO: 95340 - DNA, 20 bp, Artificial Sequence
  chemically synthesized
aaccaagattgcagtacgtt

SEQ ID NO: 95341 - DNA, 20 bp, Artificial Sequence
  chemically synthesized
gcctgaacgtactgcaatct

SEQ ID NO: 95342 - DNA, 20 bp, Artificial Sequence
  chemically synthesized
taactaaagaaccaagattg

SEQ ID NO: 95343 - DNA, 20 bp, Artificial Sequence
  chemically synthesized
gtactgcaatcttggttctt

SEQ ID NO: 95344 - DNA, 20 bp, Artificial Sequence
  chemically synthesized
ttggtggtaactaaagaacc

SEQ ID NO: 95345 - DNA, 20 bp, Artificial Sequence
  chemically synthesized
taattacttggtggtaacta

SEQ ID NO: 95346 - DNA, 20 bp, Artificial Sequence
  chemically synthesized
ttggttctttagttaccacc

SEQ ID NO: 95347 - DNA, 20 bp, Artificial Sequence
  chemically synthesized
agaactcagtaattacttgg

SEQ ID NO: 95348 - DNA, 20 bp, Artificial Sequence
  chemically synthesized
tggagaactcagtaattact

SEQ ID NO: 95349 - DNA, 20 bp, Artificial Sequence
  chemically synthesized
gttaccaccaagtaattact

SEQ ID NO: 95350 - DNA, 20 bp, Artificial Sequence
  chemically synthesized
agtgttgattatggagaact

SEQ ID NO: 95351 - DNA, 20 bp, Artificial Sequence
  chemically synthesized
tgatttcagtgttgattatg

SEQ ID NO: 95352 - DNA, 20 bp, Artificial Sequence
  chemically synthesized
agtgatttcagtgttgatta

SEQ ID NO: 95353 - DNA, 20 bp, Artificial Sequence
  chemically synthesized
aacctttatgcaagtgattt

SEQ ID NO: 95354 - DNA, 20 bp, Artificial Sequence
  chemically synthesized
acactgaaatcacttgcata

SEQ ID NO: 95355 - DNA, 20 bp, Artificial Sequence
  chemically synthesized
cactgaaatcacttgcataa

SEQ ID NO: 95356 - DNA, 20 bp, Artificial Sequence
  chemically synthesized
ggtattgacaacctttatgc

SEQ ID NO: 95357 - DNA, 20 bp, Artificial Sequence
  chemically synthesized
tattaatttagcaacaagga

SEQ ID NO: 95358 - DNA, 20 bp, Artificial Sequence
  chemically synthesized
ctattaatttagcaacaagg

SEQ ID NO: 95359 - DNA, 20 bp, Artificial Sequence
  chemically synthesized
atcctattaatttagcaaca

SEQ ID NO: 95360 - DNA, 20 bp, Artificial Sequence
  chemically synthesized
tatcctattaatttagcaac

SEQ ID NO: 95361 - DNA, 20 bp, Artificial Sequence
  chemically synthesized
cttccttgttgctaaattaa

SEQ ID NO: 95362 - DNA, 20 bp, Artificial Sequence
  chemically synthesized
ttccttgttgctaaattaat

SEQ ID NO: 95363 - DNA, 20 bp, Artificial Sequence
  chemically synthesized
caaaatatatcctattaatt

SEQ ID NO: 95364 - DNA, 20 bp, Artificial Sequence
  chemically synthesized
taaattaataggatatattt

SEQ ID NO: 95365 - DNA, 20 bp, Artificial Sequence
  chemically synthesized
acaaaagcatcatgaaagat

SEQ ID NO: 95366 - DNA, 20 bp, Artificial Sequence
  chemically synthesized
atactacaaaagcatcatga

SEQ ID NO: 95367 - DNA, 20 bp, Artificial Sequence
  chemically synthesized
tatctttcatgatgcttttg

SEQ ID NO: 95368 - DNA, 20 bp, Artificial Sequence
  chemically synthesized
agaggtgtcaaatactacaa

SEQ ID NO: 95369 - DNA, 20 bp, Artificial Sequence
  chemically synthesized
caagaaaaagtaacatttag

SEQ ID NO: 95370 - DNA, 20 bp, Artificial Sequence
  chemically synthesized
tcaagaaaaagtaacattta

SEQ ID NO: 95371 - DNA, 20 bp, Artificial Sequence
  chemically synthesized
tttcaagaaaaagtaacatt

SEQ ID NO: 95372 - DNA, 20 bp, Artificial Sequence
  chemically synthesized
gaagagaggttttcaagaaa

SEQ ID NO: 95373 - DNA, 20 bp, Artificial Sequence
  chemically synthesized
ccaagggaagagaggttttc

SEQ ID NO: 95374 - DNA, 20 bp, Artificial Sequence
  chemically synthesized
cacagaatccaagggaagag

SEQ ID NO: 95375 - DNA, 20 bp, Artificial Sequence
  chemically synthesized
tcacagaatccaagggaaga

SEQ ID NO: 95376 - DNA, 20 bp, Artificial Sequence
  chemically synthesized
cttgaaaacctctcttccct

SEQ ID NO: 95377 - DNA, 20 bp, Artificial Sequence
  chemically synthesized
tgtcacagaatccaagggaa

SEQ ID NO: 95378 - DNA, 20 bp, Artificial Sequence
  chemically synthesized
gatgtcacagaatccaaggg

SEQ ID NO: 95379 - DNA, 20 bp, Artificial Sequence
  chemically synthesized
tgtgatgtcacagaatccaa

SEQ ID NO: 95380 - DNA, 20 bp, Artificial Sequence
  chemically synthesized
gtgtgatgtcacagaatcca

SEQ ID NO: 95381 - DNA, 20 bp, Artificial Sequence
  chemically synthesized
cgtgtgatgtcacagaatcc

SEQ ID NO: 95382 - DNA, 20 bp, Artificial Sequence
  chemically synthesized
actaggttcgtgtgatgtca

SEQ ID NO: 95383 - DNA, 20 bp, Artificial Sequence
  chemically synthesized
tctgtgacatcacacgaacc

SEQ ID NO: 95384 - DNA, 20 bp, Artificial Sequence
  chemically synthesized
cagtagataggagacagact

SEQ ID NO: 95385 - DNA, 20 bp, Artificial Sequence
  chemically synthesized
tcagtagataggagacagac

SEQ ID NO: 95386 - DNA, 20 bp, Artificial Sequence
  chemically synthesized
gcagttcagtagataggaga

SEQ ID NO: 95387 - DNA, 20 bp, Artificial Sequence
  chemically synthesized
atttgcagttcagtagatag

SEQ ID NO: 95388 - DNA, 20 bp, Artificial Sequence
  chemically synthesized
aaatttgcagttcagtagat

SEQ ID NO: 95389 - DNA, 20 bp, Artificial Sequence
  chemically synthesized
gaaatttgcagttcagtaga

SEQ ID NO: 95390 - DNA, 20 bp, Artificial Sequence
  chemically synthesized
cagggaaatttgcagttcag

SEQ ID NO: 95391 - DNA, 20 bp, Artificial Sequence
  chemically synthesized
agacagggaaatttgcagtt

SEQ ID NO: 95392 - DNA, 20 bp, Artificial Sequence
  chemically synthesized
agtggagacagggaaatttg

SEQ ID NO: 95393 - DNA, 20 bp, Artificial Sequence
  chemically synthesized
ataagctttcagtggagaca

SEQ ID NO: 95394 - DNA, 20 bp, Artificial Sequence
  chemically synthesized
aataagctttcagtggagac

SEQ ID NO: 95395 - DNA, 20 bp, Artificial Sequence
  chemically synthesized
aaataagctttcagtggaga

SEQ ID NO: 95396 - DNA, 20 bp, Artificial Sequence
  chemically synthesized
aatttccctgtctccactga

SEQ ID NO: 95397 - DNA, 20 bp, Artificial Sequence
  chemically synthesized
agaaaaataagctttcagtg

SEQ ID NO: 95398 - DNA, 20 bp, Artificial Sequence
  chemically synthesized
aaagaaaaataagctttcag

SEQ ID NO: 95399 - DNA, 20 bp, Artificial Sequence
  chemically synthesized
aataaagaaaaataagcttt

SEQ ID NO: 95400 - DNA, 20 bp, Artificial Sequence
  chemically synthesized
aggggtaaataaagaaaaat

SEQ ID NO: 95401 - DNA, 20 bp, Artificial Sequence
  chemically synthesized
caaagtttcaggggtaaata

SEQ ID NO: 95402 - DNA, 20 bp, Artificial Sequence
  chemically synthesized
ggaaaatggcaaagtttcag

SEQ ID NO: 95403 - DNA, 20 bp, Artificial Sequence
  chemically synthesized
aggaaaatggcaaagtttca

SEQ ID NO: 95404 - DNA, 20 bp, Artificial Sequence
  chemically synthesized
caggaaaatggcaaagtttc

SEQ ID NO: 95405 - DNA, 20 bp, Artificial Sequence
  chemically synthesized
ccaggaaaatggcaaagttt

SEQ ID NO: 95406 - DNA, 20 bp, Artificial Sequence
  chemically synthesized
gtgaacccaggaaaatggca

SEQ ID NO: 95407 - DNA, 20 bp, Artificial Sequence
  chemically synthesized
ctgaaactttgccattttcc

SEQ ID NO: 95408 - DNA, 20 bp, Artificial Sequence
  chemically synthesized
tgaaactttgccattttcct

SEQ ID NO: 95409 - DNA, 20 bp, Artificial Sequence
  chemically synthesized
taggagtgaacccaggaaaa

SEQ ID NO: 95410 - DNA, 20 bp, Artificial Sequence
  chemically synthesized
gagggcctaggagtgaaccc

SEQ ID NO: 95411 - DNA, 20 bp, Artificial Sequence
  chemically synthesized
agagggcctaggagtgaacc

SEQ ID NO: 95412 - DNA, 20 bp, Artificial Sequence
  chemically synthesized
cattttcctgggttcactcc

SEQ ID NO: 95413 - DNA, 20 bp, Artificial Sequence
  chemically synthesized
attttcctgggttcactcct

SEQ ID NO: 95414 - DNA, 20 bp, Artificial Sequence
  chemically synthesized
tagatgagaagagggcctag

SEQ ID NO: 95415 - DNA, 20 bp, Artificial Sequence
  chemically synthesized
cgtagatgagaagagggcct

SEQ ID NO: 95416 - DNA, 20 bp, Artificial Sequence
  chemically synthesized
tcgtagatgagaagagggcc

SEQ ID NO: 95417 - DNA, 20 bp, Artificial Sequence
  chemically synthesized
aaagttcgtagatgagaaga

SEQ ID NO: 95418 - DNA, 20 bp, Artificial Sequence
  chemically synthesized
taaagttcgtagatgagaag

SEQ ID NO: 95419 - DNA, 20 bp, Artificial Sequence
  chemically synthesized
gtaaagttcgtagatgagaa

SEQ ID NO: 95420 - DNA, 20 bp, Artificial Sequence
  chemically synthesized
gagtaaagttcgtagatgag

SEQ ID NO: 95421 - DNA, 20 bp, Artificial Sequence
  chemically synthesized
tcagagtaaagttcgtagat

SEQ ID NO: 95422 - DNA, 20 bp, Artificial Sequence
  chemically synthesized
atggttcagagtaaagttcg

SEQ ID NO: 95423 - DNA, 20 bp, Artificial Sequence
  chemically synthesized
gtttgaaatggttcagagta

SEQ ID NO: 95424 - DNA, 20 bp, Artificial Sequence
  chemically synthesized
caagggtttgaaatggttca

SEQ ID NO: 95425 - DNA, 20 bp, Artificial Sequence
  chemically synthesized
tgcaagggtttgaaatggtt

SEQ ID NO: 95426 - DNA, 20 bp, Artificial Sequence
  chemically synthesized
aaccttgcaagggtttgaaa

SEQ ID NO: 95427 - DNA, 20 bp, Artificial Sequence
  chemically synthesized
gaaccatttcaaacccttgc

SEQ ID NO: 95428 - DNA, 20 bp, Artificial Sequence
  chemically synthesized
aaccatttcaaacccttgca

SEQ ID NO: 95429 - DNA, 20 bp, Artificial Sequence
  chemically synthesized
acgtaattaaaaccttgcaa

SEQ ID NO: 95430 - DNA, 20 bp, Artificial Sequence
  chemically synthesized
tacgtaattaaaaccttgca

SEQ ID NO: 95431 - DNA, 20 bp, Artificial Sequence
  chemically synthesized
atacgtaattaaaaccttgc

SEQ ID NO: 95432 - DNA, 20 bp, Artificial Sequence
  chemically synthesized
ttaattggatatttaattat

SEQ ID NO: 95433 - DNA, 20 bp, Artificial Sequence
  chemically synthesized
gataattaaatatccaatta

SEQ ID NO: 95434 - DNA, 20 bp, Artificial Sequence
  chemically synthesized
taggctagagaatctttaat

SEQ ID NO: 95435 - DNA, 20 bp, Artificial Sequence
  chemically synthesized
atatccaattaaagattctc

SEQ ID NO: 95436 - DNA, 20 bp, Artificial Sequence
  chemically synthesized
caattaaagattctctagcc

SEQ ID NO: 95437 - DNA, 20 bp, Artificial Sequence
  chemically synthesized
tggagaaatgttctaggcta

SEQ ID NO: 95438 - DNA, 20 bp, Artificial Sequence
  chemically synthesized
tatggagaaatgttctaggc

SEQ ID NO: 95439 - DNA, 20 bp, Artificial Sequence
  chemically synthesized
aacctatggagaaatgttct

SEQ ID NO: 95440 - DNA, 20 bp, Artificial Sequence
  chemically synthesized
gaacctatggagaaatgttc

SEQ ID NO: 95441 - DNA, 20 bp, Artificial Sequence
  chemically synthesized
tagcctagaacatttctcca

SEQ ID NO: 95442 - DNA, 20 bp, Artificial Sequence
  chemically synthesized
agcctagaacatttctccat

SEQ ID NO: 95443 - DNA, 20 bp, Artificial Sequence
  chemically synthesized
gtatgtgagctgaacctatg

SEQ ID NO: 95444 - DNA, 20 bp, Artificial Sequence
  chemically synthesized
agaacatttctccataggtt

SEQ ID NO: 95445 - DNA, 20 bp, Artificial Sequence
  chemically synthesized
aggtatgtgagctgaaccta

SEQ ID NO: 95446 - DNA, 20 bp, Artificial Sequence
  chemically synthesized
ataggttcagctcacatacc

SEQ ID NO: 95447 - DNA, 20 bp, Artificial Sequence
  chemically synthesized
gttgtgatacctaggtatgt

SEQ ID NO: 95448 - DNA, 20 bp, Artificial Sequence
  chemically synthesized
taggttcagctcacatacct

SEQ ID NO: 95449 - DNA, 20 bp, Artificial Sequence
  chemically synthesized
gtaactaagttgtgatacct

SEQ ID NO: 95450 - DNA, 20 bp, Artificial Sequence
  chemically synthesized
tgtaactaagttgtgatacc

SEQ ID NO: 95451 - DNA, 20 bp, Artificial Sequence
  chemically synthesized
catacctaggtatcacaact

SEQ ID NO: 95452 - DNA, 20 bp, Artificial Sequence
  chemically synthesized
gtaatgatgatagtgtaact

SEQ ID NO: 95453 - DNA, 20 bp, Artificial Sequence
  chemically synthesized
gtccaggtgagtaatgatga

SEQ ID NO: 95454 - DNA, 20 bp, Artificial Sequence
  chemically synthesized
cactatcatcattactcacc

SEQ ID NO: 95455 - DNA, 20 bp, Artificial Sequence
  chemically synthesized
actattgaaattgtccaggt

SEQ ID NO: 95456 - DNA, 20 bp, Artificial Sequence
  chemically synthesized
gcacactattgaaattgtcc

SEQ ID NO: 95457 - DNA, 20 bp, Artificial Sequence
  chemically synthesized
agcacactattgaaattgtc

SEQ ID NO: 95458 - DNA, 20 bp, Artificial Sequence
  chemically synthesized
actcacctggacaatttcaa

SEQ ID NO: 95459 - DNA, 20 bp, Artificial Sequence
  chemically synthesized
acaatttcaatagtgtgctg

SEQ ID NO: 95460 - DNA, 20 bp, Artificial Sequence
  chemically synthesized
tggaggcaagaagatagctt

SEQ ID NO: 95461 - DNA, 20 bp, Artificial Sequence
  chemically synthesized
gcaaactggaggcaagaaga

SEQ ID NO: 95462 - DNA, 20 bp, Artificial Sequence
  chemically synthesized
cttagcaaactggaggcaag

SEQ ID NO: 95463 - DNA, 20 bp, Artificial Sequence
  chemically synthesized
tgaagctatcttcttgcctc

SEQ ID NO: 95464 - DNA, 20 bp, Artificial Sequence
  chemically synthesized
aagcttagcaaactggaggc

SEQ ID NO: 95465 - DNA, 20 bp, Artificial Sequence
  chemically synthesized
gaggaagcttagcaaactgg

SEQ ID NO: 95466 - DNA, 20 bp, Artificial Sequence
  chemically synthesized
agaggaagcttagcaaactg

SEQ ID NO: 95467 - DNA, 20 bp, Artificial Sequence
  chemically synthesized
cttcttgcctccagtttgct

SEQ ID NO: 95468 - DNA, 20 bp, Artificial Sequence
  chemically synthesized
ctagaggaagcttagcaaac

SEQ ID NO: 95469 - DNA, 20 bp, Artificial Sequence
  chemically synthesized
tcaagggactagaggaagct

SEQ ID NO: 95470 - DNA, 20 bp, Artificial Sequence
  chemically synthesized
ccagtttgctaagcttcctc

SEQ ID NO: 95471 - DNA, 20 bp, Artificial Sequence
  chemically synthesized
ttatttcaagggactagagg

SEQ ID NO: 95472 - DNA, 20 bp, Artificial Sequence
  chemically synthesized
atgttatttcaagggactag

SEQ ID NO: 95473 - DNA, 20 bp, Artificial Sequence
  chemically synthesized
catgttatttcaagggacta

SEQ ID NO: 95474 - DNA, 20 bp, Artificial Sequence
  chemically synthesized
gtcatgttatttcaagggac

SEQ ID NO: 95475 - DNA, 20 bp, Artificial Sequence
  chemically synthesized
gtcatgtcatgttatttcaa

SEQ ID NO: 95476 - DNA, 20 bp, Artificial Sequence
  chemically synthesized
agtcatgtcatgttatttca

SEQ ID NO: 95477 - DNA, 20 bp, Artificial Sequence
  chemically synthesized
aagtcatgtcatgttatttc

SEQ ID NO: 95478 - DNA, 20 bp, Artificial Sequence
  chemically synthesized
ataaaggcctggaagtgaga

SEQ ID NO: 95479 - DNA, 20 bp, Artificial Sequence
  chemically synthesized
tgacatgactttctcacttc

SEQ ID NO: 95480 - DNA, 20 bp, Artificial Sequence
  chemically synthesized
gacatgactttctcacttcc

SEQ ID NO: 95481 - DNA, 20 bp, Artificial Sequence
  chemically synthesized
atgcataaaggcctggaagt

SEQ ID NO: 95482 - DNA, 20 bp, Artificial Sequence
  chemically synthesized
tactatgcataaaggcctgg

SEQ ID NO: 95483 - DNA, 20 bp, Artificial Sequence
  chemically synthesized
gaatactatgcataaaggcc

SEQ ID NO: 95484 - DNA, 20 bp, Artificial Sequence
  chemically synthesized
cacttccaggcctttatgca

SEQ ID NO: 95485 - DNA, 20 bp, Artificial Sequence
  chemically synthesized
agatggaatactatgcataa

SEQ ID NO: 95486 - DNA, 20 bp, Artificial Sequence
  chemically synthesized
cagatggaatactatgcata

SEQ ID NO: 95487 - DNA, 20 bp, Artificial Sequence
  chemically synthesized
atgcatagtattccatctgc

SEQ ID NO: 95488 - DNA, 20 bp, Artificial Sequence
  chemically synthesized
tgcatagtattccatctgct

SEQ ID NO: 95489 - DNA, 20 bp, Artificial Sequence
  chemically synthesized
ggaggtggagtcccagcaga

SEQ ID NO: 95490 - DNA, 20 bp, Artificial Sequence
  chemically synthesized
tggaggaggtggagtcccag

SEQ ID NO: 95491 - DNA, 20 bp, Artificial Sequence
  chemically synthesized
atttggaggaggtggagtcc

SEQ ID NO: 95492 - DNA, 20 bp, Artificial Sequence
  chemically synthesized
ttggggatttggaggaggtg

SEQ ID NO: 95493 - DNA, 20 bp, Artificial Sequence
  chemically synthesized
agttggggatttggaggagg

SEQ ID NO: 95494 - DNA, 20 bp, Artificial Sequence
  chemically synthesized
tcaagttggggatttggagg

SEQ ID NO: 95495 - DNA, 20 bp, Artificial Sequence
  chemically synthesized
gtcaagttggggatttggag

SEQ ID NO: 95496 - DNA, 20 bp, Artificial Sequence
  chemically synthesized
aggtcaagttggggatttgg

SEQ ID NO: 95497 - DNA, 20 bp, Artificial Sequence
  chemically synthesized
caggtcaagttggggatttg

SEQ ID NO: 95498 - DNA, 20 bp, Artificial Sequence
  chemically synthesized
gacaggtcaagttggggatt

SEQ ID NO: 95499 - DNA, 20 bp, Artificial Sequence
  chemically synthesized
gagttagacaggtcaagttg

SEQ ID NO: 95500 - DNA, 20 bp, Artificial Sequence
  chemically synthesized
ggagttagacaggtcaagtt

SEQ ID NO: 95501 - DNA, 20 bp, Artificial Sequence
  chemically synthesized
aggagttagacaggtcaagt

SEQ ID NO: 95502 - DNA, 20 bp, Artificial Sequence
  chemically synthesized
aagcaggagttagacaggtc

SEQ ID NO: 95503 - DNA, 20 bp, Artificial Sequence
  chemically synthesized
aagagaagcaggagttagac

SEQ ID NO: 95504 - DNA, 20 bp, Artificial Sequence
  chemically synthesized
gaagagaagcaggagttaga

SEQ ID NO: 95505 - DNA, 20 bp, Artificial Sequence
  chemically synthesized
acctgaagagaagcaggagt

SEQ ID NO: 95506 - DNA, 20 bp, Artificial Sequence
  chemically synthesized
tgagacctgaagagaagcag

SEQ ID NO: 95507 - DNA, 20 bp, Artificial Sequence
  chemically synthesized
gctgagacctgaagagaagc

SEQ ID NO: 95508 - DNA, 20 bp, Artificial Sequence
  chemically synthesized
agctgagacctgaagagaag

SEQ ID NO: 95509 - DNA, 20 bp, Artificial Sequence
  chemically synthesized
gtctaactcctgcttctctt

SEQ ID NO: 95510 - DNA, 20 bp, Artificial Sequence
  chemically synthesized
tctaactcctgcttctcttc

SEQ ID NO: 95511 - DNA, 20 bp, Artificial Sequence
  chemically synthesized
ctcagctgagacctgaagag

SEQ ID NO: 95512 - DNA, 20 bp, Artificial Sequence
  chemically synthesized
tacctcagctgagacctgaa

SEQ ID NO: 95513 - DNA, 20 bp, Artificial Sequence
  chemically synthesized
tcctgcttctcttcaggtct

SEQ ID NO: 95514 - DNA, 20 bp, Artificial Sequence
  chemically synthesized
cttacctcagctgagacctg

SEQ ID NO: 95515 - DNA, 20 bp, Artificial Sequence
  chemically synthesized
cttctcttcaggtctcagct

SEQ ID NO: 95516 - DNA, 20 bp, Artificial Sequence
  chemically synthesized
ttctcttcaggtctcagctg

SEQ ID NO: 95517 - DNA, 20 bp, Artificial Sequence
  chemically synthesized
aaggaagccttacctcagct

SEQ ID NO: 95518 - DNA, 20 bp, Artificial Sequence
  chemically synthesized
cttcaggtctcagctgaggt

SEQ ID NO: 95519 - DNA, 20 bp, Artificial Sequence
  chemically synthesized
ttcaggtctcagctgaggta

SEQ ID NO: 95520 - DNA, 20 bp, Artificial Sequence
  chemically synthesized
ttcccaaggaagccttacct

SEQ ID NO: 95521 - DNA, 20 bp, Artificial Sequence
  chemically synthesized
cagctgaggtaaggcttcct

SEQ ID NO: 95522 - DNA, 20 bp, Artificial Sequence
  chemically synthesized
agctgaggtaaggcttcctt

SEQ ID NO: 95523 - DNA, 20 bp, Artificial Sequence
  chemically synthesized
tgcagaaggctttcccaagg

SEQ ID NO: 95524 - DNA, 20 bp, Artificial Sequence
  chemically synthesized
gaggtaaggcttccttggga

SEQ ID NO: 95525 - DNA, 20 bp, Artificial Sequence
  chemically synthesized
ggatgcagaaggctttccca

SEQ ID NO: 95526 - DNA, 20 bp, Artificial Sequence
  chemically synthesized
aggatgcagaaggctttccc

SEQ ID NO: 95527 - DNA, 20 bp, Artificial Sequence
  chemically synthesized
ctggcttggcaggatgcaga

SEQ ID NO: 95528 - DNA, 20 bp, Artificial Sequence
  chemically synthesized
cctggcttggcaggatgcag

SEQ ID NO: 95529 - DNA, 20 bp, Artificial Sequence
  chemically synthesized
gaccctggcttggcaggatg

SEQ ID NO: 95530 - DNA, 20 bp, Artificial Sequence
  chemically synthesized
aaagccttctgcatcctgcc

SEQ ID NO: 95531 - DNA, 20 bp, Artificial Sequence
  chemically synthesized
ccttctgcatcctgccaagc

SEQ ID NO: 95532 - DNA, 20 bp, Artificial Sequence
  chemically synthesized
gtaattgaccctggcttggc

SEQ ID NO: 95533 - DNA, 20 bp, Artificial Sequence
  chemically synthesized
cttctgcatcctgccaagcc

SEQ ID NO: 95534 - DNA, 20 bp, Artificial Sequence
  chemically synthesized
ggtaattgaccctggcttgg

SEQ ID NO: 95535 - DNA, 20 bp, Artificial Sequence
  chemically synthesized
ttctgcatcctgccaagcca

SEQ ID NO: 95536 - DNA, 20 bp, Artificial Sequence
  chemically synthesized
caaggtaattgaccctggct

SEQ ID NO: 95537 - DNA, 20 bp, Artificial Sequence
  chemically synthesized
tacatcaaggtaattgaccc

SEQ ID NO: 95538 - DNA, 20 bp, Artificial Sequence
  chemically synthesized
agtgctacgggtgtacatca

SEQ ID NO: 95539 - DNA, 20 bp, Artificial Sequence
  chemically synthesized
tagtgctacgggtgtacatc

SEQ ID NO: 95540 - DNA, 20 bp, Artificial Sequence
  chemically synthesized
attaccttgatgtacacccg

SEQ ID NO: 95541 - DNA, 20 bp, Artificial Sequence
  chemically synthesized
tattactatgatagtgctac

SEQ ID NO: 95542 - DNA, 20 bp, Artificial Sequence
  chemically synthesized
gtattactatgatagtgcta

SEQ ID NO: 95543 - DNA, 20 bp, Artificial Sequence
  chemically synthesized
gtacacccgtagcactatca

SEQ ID NO: 95544 - DNA, 20 bp, Artificial Sequence
  chemically synthesized
tggtaagggtattactatga

SEQ ID NO: 95545 - DNA, 20 bp, Artificial Sequence
  chemically synthesized
attcaacctatagatggtaa

SEQ ID NO: 95546 - DNA, 20 bp, Artificial Sequence
  chemically synthesized
tattcaacctatagatggta

SEQ ID NO: 95547 - DNA, 20 bp, Artificial Sequence
  chemically synthesized
atattcaacctatagatggt

SEQ ID NO: 95548 - DNA, 20 bp, Artificial Sequence
  chemically synthesized
agtaatacccttaccatcta

SEQ ID NO: 95549 - DNA, 20 bp, Artificial Sequence
  chemically synthesized
gtaatacccttaccatctat

SEQ ID NO: 95550 - DNA, 20 bp, Artificial Sequence
  chemically synthesized
tgagatattcaacctataga

SEQ ID NO: 95551 - DNA, 20 bp, Artificial Sequence
  chemically synthesized
gatatgagatattcaaccta

SEQ ID NO: 95552 - DNA, 20 bp, Artificial Sequence
  chemically synthesized
gtcgcaagtattttggatat

SEQ ID NO: 95553 - DNA, 20 bp, Artificial Sequence
  chemically synthesized
actttcagtcgcaagtattt

SEQ ID NO: 95554 - DNA, 20 bp, Artificial Sequence
  chemically synthesized
tttgaaatactttcagtcgc

SEQ ID NO: 95555 - DNA, 20 bp, Artificial Sequence
  chemically synthesized
tccaaaatacttgcgactga

SEQ ID NO: 95556 - DNA, 20 bp, Artificial Sequence
  chemically synthesized
cctgaaatttgaaatacttt

SEQ ID NO: 95557 - DNA, 20 bp, Artificial Sequence
  chemically synthesized
actgaaagtatttcaaattt

SEQ ID NO: 95558 - DNA, 20 bp, Artificial Sequence
  chemically synthesized
ctgaaagtatttcaaatttc

SEQ ID NO: 95559 - DNA, 20 bp, Artificial Sequence
  chemically synthesized
gtatttcaaatttcaggttt

SEQ ID NO: 95560 - DNA, 20 bp, Artificial Sequence
  chemically synthesized
ggaatatttgcattacccta

SEQ ID NO: 95561 - DNA, 20 bp, Artificial Sequence
  chemically synthesized
aggcctgcatgatatccata

SEQ ID NO: 95562 - DNA, 20 bp, Artificial Sequence
  chemically synthesized
aaggcctgcatgatatccat

SEQ ID NO: 95563 - DNA, 20 bp, Artificial Sequence
  chemically synthesized
aaaggcctgcatgatatcca

SEQ ID NO: 95564 - DNA, 20 bp, Artificial Sequence
  chemically synthesized
attaccctatggatatcatg

SEQ ID NO: 95565 - DNA, 20 bp, Artificial Sequence
  chemically synthesized
ttaccctatggatatcatgc

SEQ ID NO: 95566 - DNA, 20 bp, Artificial Sequence
  chemically synthesized
atggatatcatgcaggcctt

SEQ ID NO: 95567 - DNA, 20 bp, Artificial Sequence
  chemically synthesized
tggatatcatgcaggccttt

SEQ ID NO: 95568 - DNA, 20 bp, Artificial Sequence
  chemically synthesized
ggatatcatgcaggccttta

SEQ ID NO: 95569 - DNA, 20 bp, Artificial Sequence
  chemically synthesized
tattgttgaaaatgccctaa

SEQ ID NO: 95570 - DNA, 20 bp, Artificial Sequence
  chemically synthesized
atattgttgaaaatgcccta

SEQ ID NO: 95571 - DNA, 20 bp, Artificial Sequence
  chemically synthesized
gtatattctctggtggtgtc

SEQ ID NO: 95572 - DNA, 20 bp, Artificial Sequence
  chemically synthesized
caacaatatcttgacaccac

SEQ ID NO: 95573 - DNA, 20 bp, Artificial Sequence
  chemically synthesized
acaatatcttgacaccacca

SEQ ID NO: 95574 - DNA, 20 bp, Artificial Sequence
  chemically synthesized
tttgctggtatattctctgg

SEQ ID NO: 95575 - DNA, 20 bp, Artificial Sequence
  chemically synthesized
gtgtttgctggtatattctc

SEQ ID NO: 95576 - DNA, 20 bp, Artificial Sequence
  chemically synthesized
gacaccaccagagaatatac

SEQ ID NO: 95577 - DNA, 20 bp, Artificial Sequence
  chemically synthesized
agagaatataccagcaaaca

SEQ ID NO: 95578 - DNA, 20 bp, Artificial Sequence
  chemically synthesized
gcattaatcactgtgtttgc

SEQ ID NO: 95579 - DNA, 20 bp, Artificial Sequence
  chemically synthesized
aacacagtgattaatgcacg

SEQ ID NO: 95580 - DNA, 20 bp, Artificial Sequence
  chemically synthesized
acacagtgattaatgcacgt

SEQ ID NO: 95581 - DNA, 20 bp, Artificial Sequence
  chemically synthesized
tgattaatgcacgtaggttt

SEQ ID NO: 95582 - DNA, 20 bp, Artificial Sequence
  chemically synthesized
cgtaggttttggccccatgc

SEQ ID NO: 95583 - DNA, 20 bp, Artificial Sequence
  chemically synthesized
accctacaatgtccagcatg

SEQ ID NO: 95584 - DNA, 20 bp, Artificial Sequence
  chemically synthesized
taccctacaatgtccagcat

SEQ ID NO: 95585 - DNA, 20 bp, Artificial Sequence
  chemically synthesized
gtaccctacaatgtccagca

SEQ ID NO: 95586 - DNA, 20 bp, Artificial Sequence
  chemically synthesized
tggccccatgctggacattg

SEQ ID NO: 95587 - DNA, 20 bp, Artificial Sequence
  chemically synthesized
ggcaggtaccctacaatgtc

SEQ ID NO: 95588 - DNA, 20 bp, Artificial Sequence
  chemically synthesized
ggccccatgctggacattgt

SEQ ID NO: 95589 - DNA, 20 bp, Artificial Sequence
  chemically synthesized
gccccatgctggacattgta

SEQ ID NO: 95590 - DNA, 20 bp, Artificial Sequence
  chemically synthesized
gggctagacgcgacaacggc

SEQ ID NO: 95591 - DNA, 20 bp, Artificial Sequence
  chemically synthesized
cgggctagacgcgacaacgg

SEQ ID NO: 95592 - DNA, 20 bp, Artificial Sequence
  chemically synthesized
gtgcgggctagacgcgacaa

SEQ ID NO: 95593 - DNA, 20 bp, Artificial Sequence
  chemically synthesized
gtacctgccgttgtcgcgtc

SEQ ID NO: 95594 - DNA, 20 bp, Artificial Sequence
  chemically synthesized
aaaatggcacatgtgcgggc

SEQ ID NO: 95595 - DNA, 20 bp, Artificial Sequence
  chemically synthesized
acgaaaaatggcacatgtgc

SEQ ID NO: 95596 - DNA, 20 bp, Artificial Sequence
  chemically synthesized
tacgaaaaatggcacatgtg

SEQ ID NO: 95597 - DNA, 20 bp, Artificial Sequence
  chemically synthesized
cccacaaaaggtacgaaaaa

SEQ ID NO: 95598 - DNA, 20 bp, Artificial Sequence
  chemically synthesized
gccatttttcgtaccttttg

SEQ ID NO: 95599 - DNA, 20 bp, Artificial Sequence
  chemically synthesized
ccatttttcgtaccttttgt

SEQ ID NO: 95600 - DNA, 20 bp, Artificial Sequence
  chemically synthesized
catacaagcaaacccacaaa

SEQ ID NO: 95601 - DNA, 20 bp, Artificial Sequence
  chemically synthesized
tcatacaagcaaacccacaa

SEQ ID NO: 95602 - DNA, 20 bp, Artificial Sequence
  chemically synthesized
ttgtgggtttgcttgtatga

SEQ ID NO: 95603 - DNA, 20 bp, Artificial Sequence
  chemically synthesized
acacccagattccatcatac

SEQ ID NO: 95604 - DNA, 20 bp, Artificial Sequence
  chemically synthesized
tttgcttgtatgatggaatc

SEQ ID NO: 95605 - DNA, 20 bp, Artificial Sequence
  chemically synthesized
ttgcttgtatgatggaatct

SEQ ID NO: 95606 - DNA, 20 bp, Artificial Sequence
  chemically synthesized
tgtatgatggaatctgggtg

SEQ ID NO: 95607 - DNA, 20 bp, Artificial Sequence
  chemically synthesized
gtatgatggaatctgggtgt

SEQ ID NO: 95608 - DNA, 20 bp, Artificial Sequence
  chemically synthesized
atatcttttccacccacacc

SEQ ID NO: 95609 - DNA, 20 bp, Artificial Sequence
  chemically synthesized
tgatggaatctgggtgtggg

SEQ ID NO: 95610 - DNA, 20 bp, Artificial Sequence
  chemically synthesized
gaatctgggtgtgggtggaa

SEQ ID NO: 95611 - DNA, 20 bp, Artificial Sequence
  chemically synthesized
tgggtggaaaagatatatca

SEQ ID NO: 95612 - DNA, 20 bp, Artificial Sequence
  chemically synthesized
aaaagatatatcacagctaa

SEQ ID NO: 95613 - DNA, 20 bp, Artificial Sequence
  chemically synthesized
aaagatatatcacagctaac

SEQ ID NO: 95614 - DNA, 20 bp, Artificial Sequence
  chemically synthesized
aagatatatcacagctaacg

SEQ ID NO: 95615 - DNA, 20 bp, Artificial Sequence
  chemically synthesized
agatatatcacagctaacgg

SEQ ID NO: 95616 - DNA, 20 bp, Artificial Sequence
  chemically synthesized
aagatcctctcagcccccgt

SEQ ID NO: 95617 - DNA, 20 bp, Artificial Sequence
  chemically synthesized
tatcacagctaacgggggct

SEQ ID NO: 95618 - DNA, 20 bp, Artificial Sequence
  chemically synthesized
tcacagctaacgggggctga

SEQ ID NO: 95619 - DNA, 20 bp, Artificial Sequence
  chemically synthesized
cacagctaacgggggctgag

SEQ ID NO: 95620 - DNA, 20 bp, Artificial Sequence
  chemically synthesized
caagggaagaaagatcctct

SEQ ID NO: 95621 - DNA, 20 bp, Artificial Sequence
  chemically synthesized
tcagcatccccaagggaaga

SEQ ID NO: 95622 - DNA, 20 bp, Artificial Sequence
  chemically synthesized
tgagaggatctttcttccct

SEQ ID NO: 95623 - DNA, 20 bp, Artificial Sequence
  chemically synthesized
gagaggatctttcttccctt

SEQ ID NO: 95624 - DNA, 20 bp, Artificial Sequence
  chemically synthesized
agaggatctttcttcccttg

SEQ ID NO: 95625 - DNA, 20 bp, Artificial Sequence
  chemically synthesized
ttattcagcatccccaaggg

SEQ ID NO: 95626 - DNA, 20 bp, Artificial Sequence
  chemically synthesized
agtttattcagcatccccaa

SEQ ID NO: 95627 - DNA, 20 bp, Artificial Sequence
  chemically synthesized
gagtttattcagcatcccca

SEQ ID NO: 95628 - DNA, 20 bp, Artificial Sequence
  chemically synthesized
agagtttattcagcatcccc

SEQ ID NO: 95629 - DNA, 20 bp, Artificial Sequence
  chemically synthesized
cacaccacatagagtttatt

SEQ ID NO: 95630 - DNA, 20 bp, Artificial Sequence
  chemically synthesized
gatgctgaataaactctatg

SEQ ID NO: 95631 - DNA, 20 bp, Artificial Sequence
  chemically synthesized
aaatgcaggcacaccacata

SEQ ID NO: 95632 - DNA, 20 bp, Artificial Sequence
  chemically synthesized
gaaaatgcaggcacaccaca

SEQ ID NO: 95633 - DNA, 20 bp, Artificial Sequence
  chemically synthesized
acaagtcacagtgaaaatgc

SEQ ID NO: 95634 - DNA, 20 bp, Artificial Sequence
  chemically synthesized
gacaagtcacagtgaaaatg

SEQ ID NO: 95635 - DNA, 20 bp, Artificial Sequence
  chemically synthesized
tgacctcatgtgacaagtca

SEQ ID NO: 95636 - DNA, 20 bp, Artificial Sequence
  chemically synthesized
ttcactgtgacttgtcacat

SEQ ID NO: 95637 - DNA, 20 bp, Artificial Sequence
  chemically synthesized
cacttctgacctcatgtgac

SEQ ID NO: 95638 - DNA, 20 bp, Artificial Sequence
  chemically synthesized
tcactgtgacttgtcacatg

SEQ ID NO: 95639 - DNA, 20 bp, Artificial Sequence
  chemically synthesized
tgtgacttgtcacatgaggt

SEQ ID NO: 95640 - DNA, 20 bp, Artificial Sequence
  chemically synthesized
gacttgtcacatgaggtcag

SEQ ID NO: 95641 - DNA, 20 bp, Artificial Sequence
  chemically synthesized
ttgtcacatgaggtcagaag

SEQ ID NO: 95642 - DNA, 20 bp, Artificial Sequence
  chemically synthesized
gtcacatgaggtcagaagtg

SEQ ID NO: 95643 - DNA, 20 bp, Artificial Sequence
  chemically synthesized
tgctgacatgacatcacaaa

SEQ ID NO: 95644 - DNA, 20 bp, Artificial Sequence
  chemically synthesized
ttccatttgtgatgtcatgt

SEQ ID NO: 95645 - DNA, 20 bp, Artificial Sequence
  chemically synthesized
atgtcatgtcagcattcaaa

SEQ ID NO: 95646 - DNA, 20 bp, Artificial Sequence
  chemically synthesized
tgtcagcattcaaacagttt

SEQ ID NO: 95647 - DNA, 20 bp, Artificial Sequence
  chemically synthesized
attcaaacagttttggaatt

SEQ ID NO: 95648 - DNA, 20 bp, Artificial Sequence
  chemically synthesized
gttttggaatttggaacatt

SEQ ID NO: 95649 - DNA, 20 bp, Artificial Sequence
  chemically synthesized
aatttggaacatttggattt

SEQ ID NO: 95650 - DNA, 20 bp, Artificial Sequence
  chemically synthesized
atttggaacatttggatttc

SEQ ID NO: 95651 - DNA, 20 bp, Artificial Sequence
  chemically synthesized
acatttggatttcaggtttt

SEQ ID NO: 95652 - DNA, 20 bp, Artificial Sequence
  chemically synthesized
tggatttcaggtttttggat

SEQ ID NO: 95653 - DNA, 20 bp, Artificial Sequence
  chemically synthesized
ggatttcaggtttttggatc

SEQ ID NO: 95654 - DNA, 20 bp, Artificial Sequence
  chemically synthesized
gatttcaggtttttggatca

SEQ ID NO: 95655 - DNA, 20 bp, Artificial Sequence
  chemically synthesized
gatcagggatgttcaacctg

SEQ ID NO: 95656 - DNA, 20 bp, Artificial Sequence
  chemically synthesized
cagggatgttcaacctgtag

SEQ ID NO: 95657 - DNA, 20 bp, Artificial Sequence
  chemically synthesized
attaaacaagtaactactac

SEQ ID NO: 95658 - DNA, 20 bp, Artificial Sequence
  chemically synthesized
aattaaacaagtaactacta

SEQ ID NO: 95659 - DNA, 20 bp, Artificial Sequence
  chemically synthesized
ggggaggaaggaaattaaac

SEQ ID NO: 95660 - DNA, 20 bp, Artificial Sequence
  chemically synthesized
tgtagtttagtgggggagga

SEQ ID NO: 95661 - DNA, 20 bp, Artificial Sequence
  chemically synthesized
ctgtagtttagtgggggagg

SEQ ID NO: 95662 - DNA, 20 bp, Artificial Sequence
  chemically synthesized
gatctgtagtttagtggggg

SEQ ID NO: 95663 - DNA, 20 bp, Artificial Sequence
  chemically synthesized
tgatctgtagtttagtgggg

SEQ ID NO: 95664 - DNA, 20 bp, Artificial Sequence
  chemically synthesized
tttgatctgtagtttagtgg

SEQ ID NO: 95665 - DNA, 20 bp, Artificial Sequence
  chemically synthesized
ctttgatctgtagtttagtg

SEQ ID NO: 95666 - DNA, 20 bp, Artificial Sequence
  chemically synthesized
tctttgatctgtagtttagt

SEQ ID NO: 95667 - DNA, 20 bp, Artificial Sequence
  chemically synthesized
ttctttgatctgtagtttag

SEQ ID NO: 95668 - DNA, 20 bp, Artificial Sequence
  chemically synthesized
cttcctcccccactaaacta

SEQ ID NO: 95669 - DNA, 20 bp, Artificial Sequence
  chemically synthesized
atcttctttgatctgtagtt

SEQ ID NO: 95670 - DNA, 20 bp, Artificial Sequence
  chemically synthesized
ccccactaaactacagatca

SEQ ID NO: 95671 - DNA, 20 bp, Artificial Sequence
  chemically synthesized
tctctatcttctttgatctg

SEQ ID NO: 95672 - DNA, 20 bp, Artificial Sequence
  chemically synthesized
cactaaactacagatcaaag

SEQ ID NO: 95673 - DNA, 20 bp, Artificial Sequence
  chemically synthesized
aaactacagatcaaagaaga

SEQ ID NO: 95674 - DNA, 20 bp, Artificial Sequence
  chemically synthesized
actacagatcaaagaagata

SEQ ID NO: 95675 - DNA, 20 bp, Artificial Sequence
  chemically synthesized
catcaataaataaaggaaat

SEQ ID NO: 95676 - DNA, 20 bp, Artificial Sequence
  chemically synthesized
acatcaataaataaaggaaa

SEQ ID NO: 95677 - DNA, 20 bp, Artificial Sequence
  chemically synthesized
agagacacatcaataaataa

SEQ ID NO: 95678 - DNA, 20 bp, Artificial Sequence
  chemically synthesized
tagagacacatcaataaata

SEQ ID NO: 95679 - DNA, 20 bp, Artificial Sequence
  chemically synthesized
tttatttattgatgtgtctc

SEQ ID NO: 95680 - DNA, 20 bp, Artificial Sequence
  chemically synthesized
attgatgtgtctctagtgtc

SEQ ID NO: 95681 - DNA, 20 bp, Artificial Sequence
  chemically synthesized
aaacattaggctagacacta

SEQ ID NO: 95682 - DNA, 20 bp, Artificial Sequence
  chemically synthesized
ccaaacattaggctagacac

SEQ ID NO: 95683 - DNA, 20 bp, Artificial Sequence
  chemically synthesized
tgatgttccaaacattaggc

SEQ ID NO: 95684 - DNA, 20 bp, Artificial Sequence
  chemically synthesized
ctagtgtctagcctaatgtt

SEQ ID NO: 95685 - DNA, 20 bp, Artificial Sequence
  chemically synthesized
ttattgatgttccaaacatt

SEQ ID NO: 95686 - DNA, 20 bp, Artificial Sequence
  chemically synthesized
tttattgatgttccaaacat

SEQ ID NO: 95687 - DNA, 20 bp, Artificial Sequence
  chemically synthesized
acatcaataaatattcatga

SEQ ID NO: 95688 - DNA, 20 bp, Artificial Sequence
  chemically synthesized
ataaatattcatgaaagaaa

SEQ ID NO: 95689 - DNA, 20 bp, Artificial Sequence
  chemically synthesized
tatcttctggtgcaagcata

SEQ ID NO: 95690 - DNA, 20 bp, Artificial Sequence
  chemically synthesized
aaataactgtatgcttgcac

SEQ ID NO: 95691 - DNA, 20 bp, Artificial Sequence
  chemically synthesized
taactgtatgcttgcaccag

SEQ ID NO: 95692 - DNA, 20 bp, Artificial Sequence
  chemically synthesized
tgtgggatatcttctggtgc

SEQ ID NO: 95693 - DNA, 20 bp, Artificial Sequence
  chemically synthesized
gactgctgtgggatatcttc

SEQ ID NO: 95694 - DNA, 20 bp, Artificial Sequence
  chemically synthesized
ttgcaccagaagatatccca

SEQ ID NO: 95695 - DNA, 20 bp, Artificial Sequence
  chemically synthesized
caccagaagatatcccacag

SEQ ID NO: 95696 - DNA, 20 bp, Artificial Sequence
  chemically synthesized
ggattagaaaagactgctgt

SEQ ID NO: 95697 - DNA, 20 bp, Artificial Sequence
  chemically synthesized
aggattagaaaagactgctg

SEQ ID NO: 95698 - DNA, 20 bp, Artificial Sequence
  chemically synthesized
caaattaccaaggattagaa

SEQ ID NO: 95699 - DNA, 20 bp, Artificial Sequence
  chemically synthesized
cagcagtcttttctaatcct

SEQ ID NO: 95700 - DNA, 20 bp, Artificial Sequence
  chemically synthesized
aaattcaaattaccaaggat

SEQ ID NO: 95701 - DNA, 20 bp, Artificial Sequence
  chemically synthesized
acaaaaaattcaaattacca

SEQ ID NO: 95702 - DNA, 20 bp, Artificial Sequence
  chemically synthesized
tacaaaaaattcaaattacc

SEQ ID NO: 95703 - DNA, 20 bp, Artificial Sequence
  chemically synthesized
tgtattattgatttatatac

SEQ ID NO: 95704 - DNA, 20 bp, Artificial Sequence
  chemically synthesized
gtattattgatttatataca

SEQ ID NO: 95705 - DNA, 20 bp, Artificial Sequence
  chemically synthesized
tattattgatttatatacaa

SEQ ID NO: 95706 - DNA, 20 bp, Artificial Sequence
  chemically synthesized
actactacttcgcaggacat

SEQ ID NO: 95707 - DNA, 20 bp, Artificial Sequence
  chemically synthesized
acaagggctaatgtcctgcg

SEQ ID NO: 95708 - DNA, 20 bp, Artificial Sequence
  chemically synthesized
agggctaatgtcctgcgaag

SEQ ID NO: 95709 - DNA, 20 bp, Artificial Sequence
  chemically synthesized
catatgtactactacttcgc

SEQ ID NO: 95710 - DNA, 20 bp, Artificial Sequence
  chemically synthesized
acatatgtactactacttcg

SEQ ID NO: 95711 - DNA, 20 bp, Artificial Sequence
  chemically synthesized
gctaatgtcctgcgaagtag

SEQ ID NO: 95712 - DNA, 20 bp, Artificial Sequence
  chemically synthesized
acatatgtttctgtttttaa

SEQ ID NO: 95713 - DNA, 20 bp, Artificial Sequence
  chemically synthesized
gaaacaatgtcttttaaaaa

SEQ ID NO: 95714 - DNA, 20 bp, Artificial Sequence
  chemically synthesized
gcccatgcttttcattataa

SEQ ID NO: 95715 - DNA, 20 bp, Artificial Sequence
  chemically synthesized
taaaattctattataatgaa

SEQ ID NO: 95716 - DNA, 20 bp, Artificial Sequence
  chemically synthesized
ttctattataatgaaaagca

SEQ ID NO: 95717 - DNA, 20 bp, Artificial Sequence
  chemically synthesized
tctattataatgaaaagcat

SEQ ID NO: 95718 - DNA, 20 bp, Artificial Sequence
  chemically synthesized
tccatgaaggaaaaatgtaa

SEQ ID NO: 95719 - DNA, 20 bp, Artificial Sequence
  chemically synthesized
gctattacatttttccttca

SEQ ID NO: 95720 - DNA, 20 bp, Artificial Sequence
  chemically synthesized
tattacatttttccttcatg

SEQ ID NO: 95721 - DNA, 20 bp, Artificial Sequence
  chemically synthesized
tataagaaatatctccatga

SEQ ID NO: 95722 - DNA, 20 bp, Artificial Sequence
  chemically synthesized
atataagaaatatctccatg

SEQ ID NO: 95723 - DNA, 20 bp, Artificial Sequence
  chemically synthesized
tttctagatttacgatatat

SEQ ID NO: 95724 - DNA, 20 bp, Artificial Sequence
  chemically synthesized
tttcttatatatcgtaaatc

SEQ ID NO: 95725 - DNA, 20 bp, Artificial Sequence
  chemically synthesized
tctaatttaatacacatttc

SEQ ID NO: 95726 - DNA, 20 bp, Artificial Sequence
  chemically synthesized
tctagaaatgtgtattaaat

SEQ ID NO: 95727 - DNA, 20 bp, Artificial Sequence
  chemically synthesized
gtgtattaaattagacatac

SEQ ID NO: 95728 - DNA, 20 bp, Artificial Sequence
  chemically synthesized
tattaaattagacatactag

SEQ ID NO: 95729 - DNA, 20 bp, Artificial Sequence
  chemically synthesized
attagacatactagaagtca

SEQ ID NO: 95730 - DNA, 20 bp, Artificial Sequence
  chemically synthesized
tacctcagttctttgacttc

SEQ ID NO: 95731 - DNA, 20 bp, Artificial Sequence
  chemically synthesized
atactagaagtcaaagaact

SEQ ID NO: 95732 - DNA, 20 bp, Artificial Sequence
  chemically synthesized
tactagaagtcaaagaactg

SEQ ID NO: 95733 - DNA, 20 bp, Artificial Sequence
  chemically synthesized
gaagtcaaagaactgaggta

SEQ ID NO: 95734 - DNA, 20 bp, Artificial Sequence
  chemically synthesized
atttctaaatagctgtacct

SEQ ID NO: 95735 - DNA, 20 bp, Artificial Sequence
  chemically synthesized
agaactgaggtacagctatt

SEQ ID NO: 95736 - DNA, 20 bp, Artificial Sequence
  chemically synthesized
tccacaaattcatttctaaa

SEQ ID NO: 95737 - DNA, 20 bp, Artificial Sequence
  chemically synthesized
gctatttagaaatgaatttg

SEQ ID NO: 95738 - DNA, 20 bp, Artificial Sequence
  chemically synthesized
atttagaaatgaatttgtgg

SEQ ID NO: 95739 - DNA, 20 bp, Artificial Sequence
  chemically synthesized
tagaaatgaatttgtggaag

SEQ ID NO: 95740 - DNA, 20 bp, Artificial Sequence
  chemically synthesized
gaaatgaatttgtggaagca

SEQ ID NO: 95741 - DNA, 20 bp, Artificial Sequence
  chemically synthesized
aaatgaatttgtggaagcag

SEQ ID NO: 95742 - DNA, 20 bp, Artificial Sequence
  chemically synthesized
aatgaatttgtggaagcaga

SEQ ID NO: 95743 - DNA, 20 bp, Artificial Sequence
  chemically synthesized
tggaagcagagggccatgaa

SEQ ID NO: 95744 - DNA, 20 bp, Artificial Sequence
  chemically synthesized
acaacttgcacagctgttca

SEQ ID NO: 95745 - DNA, 20 bp, Artificial Sequence
  chemically synthesized
agggccatgaacagctgtgc

SEQ ID NO: 95746 - DNA, 20 bp, Artificial Sequence
  chemically synthesized
ttctcggtgtacaacttgca

SEQ ID NO: 95747 - DNA, 20 bp, Artificial Sequence
  chemically synthesized
agctgtgcaagttgtacacc

SEQ ID NO: 95748 - DNA, 20 bp, Artificial Sequence
  chemically synthesized
tggtacttctttgtttttct

SEQ ID NO: 95749 - DNA, 20 bp, Artificial Sequence
  chemically synthesized
gttgtacaccgagaaaaaca

SEQ ID NO: 95750 - DNA, 20 bp, Artificial Sequence
  chemically synthesized
gtacaccgagaaaaacaaag

SEQ ID NO: 95751 - DNA, 20 bp, Artificial Sequence
  chemically synthesized
catacaactcatgatgtgaa

SEQ ID NO: 95752 - DNA, 20 bp, Artificial Sequence
  chemically synthesized
agaagtaccattcacatcat

SEQ ID NO: 95753 - DNA, 20 bp, Artificial Sequence
  chemically synthesized
gagttgtatgtttcacaatc

SEQ ID NO: 95754 - DNA, 20 bp, Artificial Sequence
  chemically synthesized
tgtatgtttcacaatctgga

SEQ ID NO: 95755 - DNA, 20 bp, Artificial Sequence
  chemically synthesized
gactgccatgaagagccgtc

SEQ ID NO: 95756 - DNA, 20 bp, Artificial Sequence
  chemically synthesized
acaatctggacggctcttca

SEQ ID NO: 95757 - DNA, 20 bp, Artificial Sequence
  chemically synthesized
atctggacggctcttcatgg

SEQ ID NO: 95758 - DNA, 20 bp, Artificial Sequence
  chemically synthesized
caattcaggactgccatgaa

SEQ ID NO: 95759 - DNA, 20 bp, Artificial Sequence
  chemically synthesized
tacaattcaggactgccatg

SEQ ID NO: 95760 - DNA, 20 bp, Artificial Sequence
  chemically synthesized
ttcatggcagtcctgaattg

SEQ ID NO: 95761 - DNA, 20 bp, Artificial Sequence
  chemically synthesized
cttctcttttactacaattc

SEQ ID NO: 95762 - DNA, 20 bp, Artificial Sequence
  chemically synthesized
ccttctcttttactacaatt

SEQ ID NO: 95763 - DNA, 20 bp, Artificial Sequence
  chemically synthesized
gcagtcctgaattgtagtaa

SEQ ID NO: 95764 - DNA, 20 bp, Artificial Sequence
  chemically synthesized
agtcctgaattgtagtaaaa

SEQ ID NO: 95765 - DNA, 20 bp, Artificial Sequence
  chemically synthesized
cctgaattgtagtaaaagag

SEQ ID NO: 95766 - DNA, 20 bp, Artificial Sequence
  chemically synthesized
ctgaattgtagtaaaagaga

SEQ ID NO: 95767 - DNA, 20 bp, Artificial Sequence
  chemically synthesized
tgaattgtagtaaaagagaa

SEQ ID NO: 95768 - DNA, 20 bp, Artificial Sequence
  chemically synthesized
gagtctgaggaaaaaataat

SEQ ID NO: 95769 - DNA, 20 bp, Artificial Sequence
  chemically synthesized
cgttctcattattttttcct

SEQ ID NO: 95770 - DNA, 20 bp, Artificial Sequence
  chemically synthesized
caccatgaagagagagtctg

SEQ ID NO: 95771 - DNA, 20 bp, Artificial Sequence
  chemically synthesized
tcaccatgaagagagagtct

SEQ ID NO: 95772 - DNA, 20 bp, Artificial Sequence
  chemically synthesized
catccctcaccatgaagaga

SEQ ID NO: 95773 - DNA, 20 bp, Artificial Sequence
  chemically synthesized
ttcctcagactctctcttca

SEQ ID NO: 95774 - DNA, 20 bp, Artificial Sequence
  chemically synthesized
atcatccctcaccatgaaga

SEQ ID NO: 95775 - DNA, 20 bp, Artificial Sequence
  chemically synthesized
taatcatccctcaccatgaa

SEQ ID NO: 95776 - DNA, 20 bp, Artificial Sequence
  chemically synthesized
tcagactctctcttcatggt

SEQ ID NO: 95777 - DNA, 20 bp, Artificial Sequence
  chemically synthesized
cagactctctcttcatggtg

SEQ ID NO: 95778 - DNA, 20 bp, Artificial Sequence
  chemically synthesized
aataatcatccctcaccatg

SEQ ID NO: 95779 - DNA, 20 bp, Artificial Sequence
  chemically synthesized
agactctctcttcatggtga

SEQ ID NO: 95780 - DNA, 20 bp, Artificial Sequence
  chemically synthesized
agactgaaatttaagaatac

SEQ ID NO: 95781 - DNA, 20 bp, Artificial Sequence
  chemically synthesized
attctcgtattcttaaattt

SEQ ID NO: 95782 - DNA, 20 bp, Artificial Sequence
  chemically synthesized
actctattagactgaaattt

SEQ ID NO: 95783 - DNA, 20 bp, Artificial Sequence
  chemically synthesized
attcttaaatttcagtctaa

SEQ ID NO: 95784 - DNA, 20 bp, Artificial Sequence
  chemically synthesized
tcttaaatttcagtctaata

SEQ ID NO: 95785 - DNA, 20 bp, Artificial Sequence
  chemically synthesized
taaaattctaataactctat

SEQ ID NO: 95786 - DNA, 20 bp, Artificial Sequence
  chemically synthesized
tttcagtctaatagagttat

SEQ ID NO: 95787 - DNA, 20 bp, Artificial Sequence
  chemically synthesized
atagagttattagaatttta

SEQ ID NO: 95788 - DNA, 20 bp, Artificial Sequence
  chemically synthesized
agttattagaattttaaagc

SEQ ID NO: 95789 - DNA, 20 bp, Artificial Sequence
  chemically synthesized
ttattagaattttaaagctg

SEQ ID NO: 95790 - DNA, 20 bp, Artificial Sequence
  chemically synthesized
attagaattttaaagctgga

SEQ ID NO: 95791 - DNA, 20 bp, Artificial Sequence
  chemically synthesized
ttcatgtttaagatactctc

SEQ ID NO: 95792 - DNA, 20 bp, Artificial Sequence
  chemically synthesized
tggagagtatcttaaacatg

SEQ ID NO: 95793 - DNA, 20 bp, Artificial Sequence
  chemically synthesized
ctctaggctacttcatgttt

SEQ ID NO: 95794 - DNA, 20 bp, Artificial Sequence
  chemically synthesized
agagtatcttaaacatgaag

SEQ ID NO: 95795 - DNA, 20 bp, Artificial Sequence
  chemically synthesized
atcttaaacatgaagtagcc

SEQ ID NO: 95796 - DNA, 20 bp, Artificial Sequence
  chemically synthesized
cttaaacatgaagtagccta

SEQ ID NO: 95797 - DNA, 20 bp, Artificial Sequence
  chemically synthesized
aaaacctctttgtcatctct

SEQ ID NO: 95798 - DNA, 20 bp, Artificial Sequence
  chemically synthesized
taaaacctctttgtcatctc

SEQ ID NO: 95799 - DNA, 20 bp, Artificial Sequence
  chemically synthesized
gaagtagcctagagatgaca

SEQ ID NO: 95800 - DNA, 20 bp, Artificial Sequence
  chemically synthesized
agtagcctagagatgacaaa

SEQ ID NO: 95801 - DNA, 20 bp, Artificial Sequence
  chemically synthesized
gtagcctagagatgacaaag

SEQ ID NO: 95802 - DNA, 20 bp, Artificial Sequence
  chemically synthesized
actaatgagagttagcacat

SEQ ID NO: 95803 - DNA, 20 bp, Artificial Sequence
  chemically synthesized
cactaatgagagttagcaca

SEQ ID NO: 95804 - DNA, 20 bp, Artificial Sequence
  chemically synthesized
taccactcactaatgagagt

SEQ ID NO: 95805 - DNA, 20 bp, Artificial Sequence
  chemically synthesized
acctatgtgctaactctcat

SEQ ID NO: 95806 - DNA, 20 bp, Artificial Sequence
  chemically synthesized
tagctaccactcactaatga

SEQ ID NO: 95807 - DNA, 20 bp, Artificial Sequence
  chemically synthesized
atgtgctaactctcattagt

SEQ ID NO: 95808 - DNA, 20 bp, Artificial Sequence
  chemically synthesized
ggtagctaccactcactaat

SEQ ID NO: 95809 - DNA, 20 bp, Artificial Sequence
  chemically synthesized
tgctaactctcattagtgag

SEQ ID NO: 95810 - DNA, 20 bp, Artificial Sequence
  chemically synthesized
taactctcattagtgagtgg

SEQ ID NO: 95811 - DNA, 20 bp, Artificial Sequence
  chemically synthesized
attagtgagtggtagctacc

SEQ ID NO: 95812 - DNA, 20 bp, Artificial Sequence
  chemically synthesized
tagtgagtggtagctacctg

SEQ ID NO: 95813 - DNA, 20 bp, Artificial Sequence
  chemically synthesized
tctcaaggcaatgctccagg

SEQ ID NO: 95814 - DNA, 20 bp, Artificial Sequence
  chemically synthesized
acttctcaaggcaatgctcc

SEQ ID NO: 95815 - DNA, 20 bp, Artificial Sequence
  chemically synthesized
cacttctcaaggcaatgctc

SEQ ID NO: 95816 - DNA, 20 bp, Artificial Sequence
  chemically synthesized
gctacctggagcattgcctt

SEQ ID NO: 95817 - DNA, 20 bp, Artificial Sequence
  chemically synthesized
acctggagcattgccttgag

SEQ ID NO: 95818 - DNA, 20 bp, Artificial Sequence
  chemically synthesized
ctgtatcagagcacttctca

SEQ ID NO: 95819 - DNA, 20 bp, Artificial Sequence
  chemically synthesized
tctgtatcagagcacttctc

SEQ ID NO: 95820 - DNA, 20 bp, Artificial Sequence
  chemically synthesized
ccttgagaagtgctctgata

SEQ ID NO: 95821 - DNA, 20 bp, Artificial Sequence
  chemically synthesized
ttgagaagtgctctgataca

SEQ ID NO: 95822 - DNA, 20 bp, Artificial Sequence
  chemically synthesized
agtcagtcagctctgtatca

SEQ ID NO: 95823 - DNA, 20 bp, Artificial Sequence
  chemically synthesized
ctagtcagtcagctctgtat

SEQ ID NO: 95824 - DNA, 20 bp, Artificial Sequence
  chemically synthesized
ctgatacagagctgactgac

SEQ ID NO: 95825 - DNA, 20 bp, Artificial Sequence
  chemically synthesized
gaaagacatggctagtcagt

SEQ ID NO: 95826 - DNA, 20 bp, Artificial Sequence
  chemically synthesized
ccctgaaagacatggctagt

SEQ ID NO: 95827 - DNA, 20 bp, Artificial Sequence
  chemically synthesized
ttacccctgaaagacatggc

SEQ ID NO: 95828 - DNA, 20 bp, Artificial Sequence
  chemically synthesized
gactgactagccatgtcttt

SEQ ID NO: 95829 - DNA, 20 bp, Artificial Sequence
  chemically synthesized
tcgtttacccctgaaagaca

SEQ ID NO: 95830 - DNA, 20 bp, Artificial Sequence
  chemically synthesized
actgactagccatgtctttc

SEQ ID NO: 95831 - DNA, 20 bp, Artificial Sequence
  chemically synthesized
ctgactagccatgtctttca

SEQ ID NO: 95832 - DNA, 20 bp, Artificial Sequence
  chemically synthesized
tgactagccatgtctttcag

SEQ ID NO: 95833 - DNA, 20 bp, Artificial Sequence
  chemically synthesized
tctgtctcgtttacccctga

SEQ ID NO: 95834 - DNA, 20 bp, Artificial Sequence
  chemically synthesized
catgtctttcaggggtaaac

SEQ ID NO: 95835 - DNA, 20 bp, Artificial Sequence
  chemically synthesized
tctttcaggggtaaacgaga

SEQ ID NO: 95836 - DNA, 20 bp, Artificial Sequence
  chemically synthesized
aggggtaaacgagacagaaa

SEQ ID NO: 95837 - DNA, 20 bp, Artificial Sequence
  chemically synthesized
ggtaaacgagacagaaacgg

SEQ ID NO: 95838 - DNA, 20 bp, Artificial Sequence
  chemically synthesized
aaggaaggaaaatacgtgaa

SEQ ID NO: 95839 - DNA, 20 bp, Artificial Sequence
  chemically synthesized
tagattaactggaacaagga

SEQ ID NO: 95840 - DNA, 20 bp, Artificial Sequence
  chemically synthesized
atagattaactggaacaagg

SEQ ID NO: 95841 - DNA, 20 bp, Artificial Sequence
  chemically synthesized
cgtattttccttccttgttc

SEQ ID NO: 95842 - DNA, 20 bp, Artificial Sequence
  chemically synthesized
tgaatagattaactggaaca

SEQ ID NO: 95843 - DNA, 20 bp, Artificial Sequence
  chemically synthesized
atgaatagattaactggaac

SEQ ID NO: 95844 - DNA, 20 bp, Artificial Sequence
  chemically synthesized
tggaaaatgaatagattaac

SEQ ID NO: 95845 - DNA, 20 bp, Artificial Sequence
  chemically synthesized
tttctcttctggaaaatgaa

SEQ ID NO: 95846 - DNA, 20 bp, Artificial Sequence
  chemically synthesized
cagttaatctattcattttc

SEQ ID NO: 95847 - DNA, 20 bp, Artificial Sequence
  chemically synthesized
ttaatctattcattttccag

SEQ ID NO: 95848 - DNA, 20 bp, Artificial Sequence
  chemically synthesized
aatctattcattttccagaa

SEQ ID NO: 95849 - DNA, 20 bp, Artificial Sequence
  chemically synthesized
tggaccttaattttctcttc

SEQ ID NO: 95850 - DNA, 20 bp, Artificial Sequence
  chemically synthesized
attttccagaagagaaaatt

SEQ ID NO: 95851 - DNA, 20 bp, Artificial Sequence
  chemically synthesized
ttttccagaagagaaaatta

SEQ ID NO: 95852 - DNA, 20 bp, Artificial Sequence
  chemically synthesized
cagaagagaaaattaaggtc

SEQ ID NO: 95853 - DNA, 20 bp, Artificial Sequence
  chemically synthesized
gagaaaattaaggtccagaa

SEQ ID NO: 95854 - DNA, 20 bp, Artificial Sequence
  chemically synthesized
agcaagttgcattgcttttc

SEQ ID NO: 95855 - DNA, 20 bp, Artificial Sequence
  chemically synthesized
ccagcactgatgttaagagc

SEQ ID NO: 95856 - DNA, 20 bp, Artificial Sequence
  chemically synthesized
atgcaacttgctcttaacat

SEQ ID NO: 95857 - DNA, 20 bp, Artificial Sequence
  chemically synthesized
tgctccagcactgatgttaa

SEQ ID NO: 95858 - DNA, 20 bp, Artificial Sequence
  chemically synthesized
tctgctccagcactgatgtt

SEQ ID NO: 95859 - DNA, 20 bp, Artificial Sequence
  chemically synthesized
cttgctcttaacatcagtgc

SEQ ID NO: 95860 - DNA, 20 bp, Artificial Sequence
  chemically synthesized
tgctcttaacatcagtgctg

SEQ ID NO: 95861 - DNA, 20 bp, Artificial Sequence
  chemically synthesized
tcttaacatcagtgctggag

SEQ ID NO: 95862 - DNA, 20 bp, Artificial Sequence
  chemically synthesized
cagaaacctgggttctgctc

SEQ ID NO: 95863 - DNA, 20 bp, Artificial Sequence
  chemically synthesized
atcagtgctggagcagaacc

SEQ ID NO: 95864 - DNA, 20 bp, Artificial Sequence
  chemically synthesized
tcagtgctggagcagaaccc

SEQ ID NO: 95865 - DNA, 20 bp, Artificial Sequence
  chemically synthesized
ggctagaagtacagaaacct

SEQ ID NO: 95866 - DNA, 20 bp, Artificial Sequence
  chemically synthesized
aggctagaagtacagaaacc

SEQ ID NO: 95867 - DNA, 20 bp, Artificial Sequence
  chemically synthesized
aacccaggtttctgtacttc

SEQ ID NO: 95868 - DNA, 20 bp, Artificial Sequence
  chemically synthesized
agggacgtaggctagaagta

SEQ ID NO: 95869 - DNA, 20 bp, Artificial Sequence
  chemically synthesized
aaggaagggacgtaggctag

SEQ ID NO: 95870 - DNA, 20 bp, Artificial Sequence
  chemically synthesized
gtgaaggaagggacgtaggc

SEQ ID NO: 95871 - DNA, 20 bp, Artificial Sequence
  chemically synthesized
aggtgtgaaggaagggacgt

SEQ ID NO: 95872 - DNA, 20 bp, Artificial Sequence
  chemically synthesized
caggtgtgaaggaagggacg

SEQ ID NO: 95873 - DNA, 20 bp, Artificial Sequence
  chemically synthesized
tgaaaccaggtgtgaaggaa

SEQ ID NO: 95874 - DNA, 20 bp, Artificial Sequence
  chemically synthesized
ttgaaaccaggtgtgaagga

SEQ ID NO: 95875 - DNA, 20 bp, Artificial Sequence
  chemically synthesized
cttgaaaccaggtgtgaagg

SEQ ID NO: 95876 - DNA, 20 bp, Artificial Sequence
  chemically synthesized
tacgtcccttccttcacacc

SEQ ID NO: 95877 - DNA, 20 bp, Artificial Sequence
  chemically synthesized
aatcttgaaaccaggtgtga

SEQ ID NO: 95878 - DNA, 20 bp, Artificial Sequence
  chemically synthesized
gaatcttgaaaccaggtgtg

SEQ ID NO: 95879 - DNA, 20 bp, Artificial Sequence
  chemically synthesized
cttccttcacacctggtttc

SEQ ID NO: 95880 - DNA, 20 bp, Artificial Sequence
  chemically synthesized
ctttaaggaatcttgaaacc

SEQ ID NO: 95881 - DNA, 20 bp, Artificial Sequence
  chemically synthesized
tctttaaggaatcttgaaac

SEQ ID NO: 95882 - DNA, 20 bp, Artificial Sequence
  chemically synthesized
cctggtttcaagattcctta

SEQ ID NO: 95883 - DNA, 20 bp, Artificial Sequence
  chemically synthesized
gaatttataatttatcttta

SEQ ID NO: 95884 - DNA, 20 bp, Artificial Sequence
  chemically synthesized
agaatttataatttatcttt

SEQ ID NO: 95885 - DNA, 20 bp, Artificial Sequence
  chemically synthesized
taaagataaattataaattc

SEQ ID NO: 95886 - DNA, 20 bp, Artificial Sequence
  chemically synthesized
aaattataaattctagccct

SEQ ID NO: 95887 - DNA, 20 bp, Artificial Sequence
  chemically synthesized
aaggcagcaaatcttagggc

SEQ ID NO: 95888 - DNA, 20 bp, Artificial Sequence
  chemically synthesized
ttgaaaggcagcaaatctta

SEQ ID NO: 95889 - DNA, 20 bp, Artificial Sequence
  chemically synthesized
tttgaaaggcagcaaatctt

SEQ ID NO: 95890 - DNA, 20 bp, Artificial Sequence
  chemically synthesized
atttgaaaggcagcaaatct

SEQ ID NO: 95891 - DNA, 20 bp, Artificial Sequence
  chemically synthesized
ataggttaaaatttgaaagg

SEQ ID NO: 95892 - DNA, 20 bp, Artificial Sequence
  chemically synthesized
aaaataggttaaaatttgaa

SEQ ID NO: 95893 - DNA, 20 bp, Artificial Sequence
  chemically synthesized
gaaaataggttaaaatttga

SEQ ID NO: 95894 - DNA, 20 bp, Artificial Sequence
  chemically synthesized
tcaaattttaacctattttc

SEQ ID NO: 95895 - DNA, 20 bp, Artificial Sequence
  chemically synthesized
caaattttaacctattttca

SEQ ID NO: 95896 - DNA, 20 bp, Artificial Sequence
  chemically synthesized
aggtagttaaccttgaaaat

SEQ ID NO: 95897 - DNA, 20 bp, Artificial Sequence
  chemically synthesized
caggtagttaaccttgaaaa

SEQ ID NO: 95898 - DNA, 20 bp, Artificial Sequence
  chemically synthesized
tgctggtgaccaaaggcagg

SEQ ID NO: 95899 - DNA, 20 bp, Artificial Sequence
  chemically synthesized
caaggttaactacctgcctt

SEQ ID NO: 95900 - DNA, 20 bp, Artificial Sequence
  chemically synthesized
ttatgctggtgaccaaaggc

SEQ ID NO: 95901 - DNA, 20 bp, Artificial Sequence
  chemically synthesized
tttatgctggtgaccaaagg

SEQ ID NO: 95902 - DNA, 20 bp, Artificial Sequence
  chemically synthesized
ttatttatgctggtgaccaa

SEQ ID NO: 95903 - DNA, 20 bp, Artificial Sequence
  chemically synthesized
aactacctgcctttggtcac

SEQ ID NO: 95904 - DNA, 20 bp, Artificial Sequence
  chemically synthesized
tttatttatgctggtgacca

SEQ ID NO: 95905 - DNA, 20 bp, Artificial Sequence
  chemically synthesized
atatccagatttatttatgc

SEQ ID NO: 95906 - DNA, 20 bp, Artificial Sequence
  chemically synthesized
gtcaccagcataaataaatc

SEQ ID NO: 95907 - DNA, 20 bp, Artificial Sequence
  chemically synthesized
gtgttctcacatggcatatc

SEQ ID NO: 95908 - DNA, 20 bp, Artificial Sequence
  chemically synthesized
taaatctggatatgccatgt

SEQ ID NO: 95909 - DNA, 20 bp, Artificial Sequence
  chemically synthesized
gatgatgctgtgttctcaca

SEQ ID NO: 95910 - DNA, 20 bp, Artificial Sequence
  chemically synthesized
ggatatgccatgtgagaaca

SEQ ID NO: 95911 - DNA, 20 bp, Artificial Sequence
  chemically synthesized
gtgagaacacagcatcatca

SEQ ID NO: 95912 - DNA, 20 bp, Artificial Sequence
  chemically synthesized
cacagcatcatcacagcaaa

SEQ ID NO: 95913 - DNA, 20 bp, Artificial Sequence
  chemically synthesized
tcatcacagcaaatagtctt

SEQ ID NO: 95914 - DNA, 20 bp, Artificial Sequence
  chemically synthesized
gtgatagttttatgatgcta

SEQ ID NO: 95915 - DNA, 20 bp, Artificial Sequence
  chemically synthesized
tggcactacattttatgtga

SEQ ID NO: 95916 - DNA, 20 bp, Artificial Sequence
  chemically synthesized
taaaactatcacataaaatg

SEQ ID NO: 95917 - DNA, 20 bp, Artificial Sequence
  chemically synthesized
atcacataaaatgtagtgcc

SEQ ID NO: 95918 - DNA, 20 bp, Artificial Sequence
  chemically synthesized
tgccttttaggtagtgcact

SEQ ID NO: 95919 - DNA, 20 bp, Artificial Sequence
  chemically synthesized
gtgccaagtgcactacctaa

SEQ ID NO: 95920 - DNA, 20 bp, Artificial Sequence
  chemically synthesized
tgccaagtgcactacctaaa

SEQ ID NO: 95921 - DNA, 20 bp, Artificial Sequence
  chemically synthesized
tataacatgtgccttttagg

SEQ ID NO: 95922 - DNA, 20 bp, Artificial Sequence
  chemically synthesized
acttataacatgtgcctttt

SEQ ID NO: 95923 - DNA, 20 bp, Artificial Sequence
  chemically synthesized
tacttataacatgtgccttt

SEQ ID NO: 95924 - DNA, 20 bp, Artificial Sequence
  chemically synthesized
acctaaaaggcacatgttat

SEQ ID NO: 95925 - DNA, 20 bp, Artificial Sequence
  chemically synthesized
taaaaggcacatgttataag

SEQ ID NO: 95926 - DNA, 20 bp, Artificial Sequence
  chemically synthesized
aaggcacatgttataagtag

SEQ ID NO: 95927 - DNA, 20 bp, Artificial Sequence
  chemically synthesized
aggcacatgttataagtagt

SEQ ID NO: 95928 - DNA, 20 bp, Artificial Sequence
  chemically synthesized
ggcacatgttataagtagta

SEQ ID NO: 95929 - DNA, 20 bp, Artificial Sequence
  chemically synthesized
gcacatgttataagtagtag

SEQ ID NO: 95930 - DNA, 20 bp, Artificial Sequence
  chemically synthesized
agtaggggtcattgtcaatc

SEQ ID NO: 95931 - DNA, 20 bp, Artificial Sequence
  chemically synthesized
gggtcattgtcaatcaagtt

SEQ ID NO: 95932 - DNA, 20 bp, Artificial Sequence
  chemically synthesized
gtcaatcaagttaagcaatg

SEQ ID NO: 95933 - DNA, 20 bp, Artificial Sequence
  chemically synthesized
tcaatcaagttaagcaatgc

SEQ ID NO: 95934 - DNA, 20 bp, Artificial Sequence
  chemically synthesized
caatcaagttaagcaatgca

SEQ ID NO: 95935 - DNA, 20 bp, Artificial Sequence
  chemically synthesized
aatcaagttaagcaatgcag

SEQ ID NO: 95936 - DNA, 20 bp, Artificial Sequence
  chemically synthesized
atcaagttaagcaatgcagg

SEQ ID NO: 95937 - DNA, 20 bp, Artificial Sequence
  chemically synthesized
tcaagttaagcaatgcaggg

SEQ ID NO: 95938 - DNA, 20 bp, Artificial Sequence
  chemically synthesized
gttaagcaatgcagggggga

SEQ ID NO: 95939 - DNA, 20 bp, Artificial Sequence
  chemically synthesized
gcaggggggaaagaaattgt

SEQ ID NO: 95940 - DNA, 20 bp, Artificial Sequence
  chemically synthesized
aggggggaaagaaattgtca

SEQ ID NO: 95941 - DNA, 20 bp, Artificial Sequence
  chemically synthesized
ggggggaaagaaattgtcag

SEQ ID NO: 95942 - DNA, 20 bp, Artificial Sequence
  chemically synthesized
aaattgtcagaggaacaacg

SEQ ID NO: 95943 - DNA, 20 bp, Artificial Sequence
  chemically synthesized
attgtcagaggaacaacgaa

SEQ ID NO: 95944 - DNA, 20 bp, Artificial Sequence
  chemically synthesized
tatgtctcaaaacgatatta

SEQ ID NO: 95945 - DNA, 20 bp, Artificial Sequence
  chemically synthesized
atcatctgtaatatcgtttt

SEQ ID NO: 95946 - DNA, 20 bp, Artificial Sequence
  chemically synthesized
atatcgttttgagacatatt

SEQ ID NO: 95947 - DNA, 20 bp, Artificial Sequence
  chemically synthesized
gctgccatttgtatagattc

SEQ ID NO: 95948 - DNA, 20 bp, Artificial Sequence
  chemically synthesized
ttggcttgaatctatacaaa

SEQ ID NO: 95949 - DNA, 20 bp, Artificial Sequence
  chemically synthesized
gtattctgctgccatttgta

SEQ ID NO: 95950 - DNA, 20 bp, Artificial Sequence
  chemically synthesized
gcttgaatctatacaaatgg

SEQ ID NO: 95951 - DNA, 20 bp, Artificial Sequence
  chemically synthesized
tgaatctatacaaatggcag

SEQ ID NO: 95952 - DNA, 20 bp, Artificial Sequence
  chemically synthesized
aatggcagcagaatacttgc

SEQ ID NO: 95953 - DNA, 20 bp, Artificial Sequence
  chemically synthesized
atggcagcagaatacttgca

SEQ ID NO: 95954 - DNA, 20 bp, Artificial Sequence
  chemically synthesized
actgggacaaaagtccttgc

SEQ ID NO: 95955 - DNA, 20 bp, Artificial Sequence
  chemically synthesized
acttgcaaggacttttgtcc

SEQ ID NO: 95956 - DNA, 20 bp, Artificial Sequence
  chemically synthesized
acctcttcacactgggacaa

SEQ ID NO: 95957 - DNA, 20 bp, Artificial Sequence
  chemically synthesized
aggacttttgtcccagtgtg

SEQ ID NO: 95958 - DNA, 20 bp, Artificial Sequence
  chemically synthesized
agttgttacctcttcacact

SEQ ID NO: 95959 - DNA, 20 bp, Artificial Sequence
  chemically synthesized
gacttttgtcccagtgtgaa

SEQ ID NO: 95960 - DNA, 20 bp, Artificial Sequence
  chemically synthesized
cagttgttacctcttcacac

SEQ ID NO: 95961 - DNA, 20 bp, Artificial Sequence
  chemically synthesized
acttttgtcccagtgtgaag

SEQ ID NO: 95962 - DNA, 20 bp, Artificial Sequence
  chemically synthesized
cagtgtgaagaggtaacaac

SEQ ID NO: 95963 - DNA, 20 bp, Artificial Sequence
  chemically synthesized
aatagacgttgaatcaattc

SEQ ID NO: 95964 - DNA, 20 bp, Artificial Sequence
  chemically synthesized
gattcaacgtctattaacat

SEQ ID NO: 95965 - DNA, 20 bp, Artificial Sequence
  chemically synthesized
agcaccatgaccaatgttaa

SEQ ID NO: 95966 - DNA, 20 bp, Artificial Sequence
  chemically synthesized
acgtctattaacattggtca

SEQ ID NO: 95967 - DNA, 20 bp, Artificial Sequence
  chemically synthesized
attaacattggtcatggtgc

SEQ ID NO: 95968 - DNA, 20 bp, Artificial Sequence
  chemically synthesized
tggtcatggtgctagatact

SEQ ID NO: 95969 - DNA, 20 bp, Artificial Sequence
  chemically synthesized
actggtggattctcagtatc

SEQ ID NO: 95970 - DNA, 20 bp, Artificial Sequence
  chemically synthesized
cctgtttactggtggattct

SEQ ID NO: 95971 - DNA, 20 bp, Artificial Sequence
  chemically synthesized
gctagatactgagaatccac

SEQ ID NO: 95972 - DNA, 20 bp, Artificial Sequence
  chemically synthesized
atgtctttcctgtttactgg

SEQ ID NO: 95973 - DNA, 20 bp, Artificial Sequence
  chemically synthesized
actgagaatccaccagtaaa

SEQ ID NO: 95974 - DNA, 20 bp, Artificial Sequence
  chemically synthesized
ctgagaatccaccagtaaac

SEQ ID NO: 95975 - DNA, 20 bp, Artificial Sequence
  chemically synthesized
actatgtctttcctgtttac

SEQ ID NO: 95976 - DNA, 20 bp, Artificial Sequence
  chemically synthesized
gaatccaccagtaaacagga

SEQ ID NO: 95977 - DNA, 20 bp, Artificial Sequence
  chemically synthesized
accagtaaacaggaaagaca

SEQ ID NO: 95978 - DNA, 20 bp, Artificial Sequence
  chemically synthesized
tgtaaccaaccacaaagata

SEQ ID NO: 95979 - DNA, 20 bp, Artificial Sequence
  chemically synthesized
agacatagtccctatctttg

SEQ ID NO: 95980 - DNA, 20 bp, Artificial Sequence
  chemically synthesized
atgtaaccaaccacaaagat

SEQ ID NO: 95981 - DNA, 20 bp, Artificial Sequence
  chemically synthesized
aatgtaaccaaccacaaaga

SEQ ID NO: 95982 - DNA, 20 bp, Artificial Sequence
  chemically synthesized
atagtccctatctttgtggt

SEQ ID NO: 95983 - DNA, 20 bp, Artificial Sequence
  chemically synthesized
ctaaaatgtaaccaaccaca

SEQ ID NO: 95984 - DNA, 20 bp, Artificial Sequence
  chemically synthesized
ctttgtggttggttacattt

SEQ ID NO: 95985 - DNA, 20 bp, Artificial Sequence
  chemically synthesized
tgtggttggttacattttag

SEQ ID NO: 95986 - DNA, 20 bp, Artificial Sequence
  chemically synthesized
tggttggttacattttagta

SEQ ID NO: 95987 - DNA, 20 bp, Artificial Sequence
  chemically synthesized
ttggttacattttagtagag

SEQ ID NO: 95988 - DNA, 20 bp, Artificial Sequence
  chemically synthesized
ttacattttagtagagaagt

SEQ ID NO: 95989 - DNA, 20 bp, Artificial Sequence
  chemically synthesized
tacattttagtagagaagtg

SEQ ID NO: 95990 - DNA, 20 bp, Artificial Sequence
  chemically synthesized
aaaacactcacatcattgtt

SEQ ID NO: 95991 - DNA, 20 bp, Artificial Sequence
  chemically synthesized
gaggcactgaacaatgatgt

SEQ ID NO: 95992 - DNA, 20 bp, Artificial Sequence
  chemically synthesized
caatgatgtgagtgttttga

SEQ ID NO: 95993 - DNA, 20 bp, Artificial Sequence
  chemically synthesized
atgatgtgagtgttttgaaa

SEQ ID NO: 95994 - DNA, 20 bp, Artificial Sequence
  chemically synthesized
tgatgtgagtgttttgaaag

SEQ ID NO: 95995 - DNA, 20 bp, Artificial Sequence
  chemically synthesized
tgtgagtgttttgaaagagg

SEQ ID NO: 95996 - DNA, 20 bp, Artificial Sequence
  chemically synthesized
tgttttgaaagaggaagtac

SEQ ID NO: 95997 - DNA, 20 bp, Artificial Sequence
  chemically synthesized
gttttgaaagaggaagtaca

SEQ ID NO: 95998 - DNA, 20 bp, Artificial Sequence
  chemically synthesized
aggaagtacaaggaacttct

SEQ ID NO: 95999 - DNA, 20 bp, Artificial Sequence
  chemically synthesized
ggaagtacaaggaacttctt

SEQ ID NO: 96000 - DNA, 20 bp, Artificial Sequence
  chemically synthesized
gaagtacaaggaacttctta

SEQ ID NO: 96001 - DNA, 20 bp, Artificial Sequence
  chemically synthesized
aagtacaaggaacttcttag

SEQ ID NO: 96002 - DNA, 20 bp, Artificial Sequence
  chemically synthesized
ctacccctcccacccctaag

SEQ ID NO: 96003 - DNA, 20 bp, Artificial Sequence
  chemically synthesized
tacaaggaacttcttagggg

SEQ ID NO: 96004 - DNA, 20 bp, Artificial Sequence
  chemically synthesized
acaaggaacttcttaggggt

SEQ ID NO: 96005 - DNA, 20 bp, Artificial Sequence
  chemically synthesized
cggctacccctcccacccct

SEQ ID NO: 96006 - DNA, 20 bp, Artificial Sequence
  chemically synthesized
aaggaacttcttaggggtgg

SEQ ID NO: 96007 - DNA, 20 bp, Artificial Sequence
  chemically synthesized
aggaacttcttaggggtggg

SEQ ID NO: 96008 - DNA, 20 bp, Artificial Sequence
  chemically synthesized
ggaacttcttaggggtggga

SEQ ID NO: 96009 - DNA, 20 bp, Artificial Sequence
  chemically synthesized
gaacttcttaggggtgggag

SEQ ID NO: 96010 - DNA, 20 bp, Artificial Sequence
  chemically synthesized
cttcttaggggtgggagggg

SEQ ID NO: 96011 - DNA, 20 bp, Artificial Sequence
  chemically synthesized
tgtcaaaaatttggggtcat

SEQ ID NO: 96012 - DNA, 20 bp, Artificial Sequence
  chemically synthesized
tggcaattgtcaaaaatttg

SEQ ID NO: 96013 - DNA, 20 bp, Artificial Sequence
  chemically synthesized
gtggcaattgtcaaaaattt

SEQ ID NO: 96014 - DNA, 20 bp, Artificial Sequence
  chemically synthesized
agtggcaattgtcaaaaatt

SEQ ID NO: 96015 - DNA, 20 bp, Artificial Sequence
  chemically synthesized
aatttttgacaattgccact

SEQ ID NO: 96016 - DNA, 20 bp, Artificial Sequence
  chemically synthesized
ctctatattctgtttccgag

SEQ ID NO: 96017 - DNA, 20 bp, Artificial Sequence
  chemically synthesized
tgacaattgccactcggaaa

SEQ ID NO: 96018 - DNA, 20 bp, Artificial Sequence
  chemically synthesized
gatctctatattctgtttcc

SEQ ID NO: 96019 - DNA, 20 bp, Artificial Sequence
  chemically synthesized
tgccactcggaaacagaata

SEQ ID NO: 96020 - DNA, 20 bp, Artificial Sequence
  chemically synthesized
ccactcggaaacagaatata

SEQ ID NO: 96021 - DNA, 20 bp, Artificial Sequence
  chemically synthesized
caatttgtgataactttctg

SEQ ID NO: 96022 - DNA, 20 bp, Artificial Sequence
  chemically synthesized
ggatgcagaatagctgcaga

SEQ ID NO: 96023 - DNA, 20 bp, Artificial Sequence
  chemically synthesized
gcctggatgcagaatagctg

SEQ ID NO: 96024 - DNA, 20 bp, Artificial Sequence
  chemically synthesized
tatccagcctggatgcagaa

SEQ ID NO: 96025 - DNA, 20 bp, Artificial Sequence
  chemically synthesized
ttctgcagctattctgcatc

SEQ ID NO: 96026 - DNA, 20 bp, Artificial Sequence
  chemically synthesized
tctgcagctattctgcatcc

SEQ ID NO: 96027 - DNA, 20 bp, Artificial Sequence
  chemically synthesized
ttggatatccagcctggatg

SEQ ID NO: 96028 - DNA, 20 bp, Artificial Sequence
  chemically synthesized
cagctattctgcatccaggc

SEQ ID NO: 96029 - DNA, 20 bp, Artificial Sequence
  chemically synthesized
tttgttttggatatccagcc

SEQ ID NO: 96030 - DNA, 20 bp, Artificial Sequence
  chemically synthesized
cagtgtttgttttggatatc

SEQ ID NO: 96031 - DNA, 20 bp, Artificial Sequence
  chemically synthesized
cagcaatccagtgtttgttt

SEQ ID NO: 96032 - DNA, 20 bp, Artificial Sequence
  chemically synthesized
tggatatccaaaacaaacac

SEQ ID NO: 96033 - DNA, 20 bp, Artificial Sequence
  chemically synthesized
caaaacaaacactggattgc

SEQ ID NO: 96034 - DNA, 20 bp, Artificial Sequence
  chemically synthesized
tcctaagttttccagcaatc

SEQ ID NO: 96035 - DNA, 20 bp, Artificial Sequence
  chemically synthesized
cactggattgctggaaaact

SEQ ID NO: 96036 - DNA, 20 bp, Artificial Sequence
  chemically synthesized
tattaaattcctaagttttc

SEQ ID NO: 96037 - DNA, 20 bp, Artificial Sequence
  chemically synthesized
actggattgctggaaaactt

SEQ ID NO: 96038 - DNA, 20 bp, Artificial Sequence
  chemically synthesized
tttgtgaatattaaattcct

SEQ ID NO: 96039 - DNA, 20 bp, Artificial Sequence
  chemically synthesized
acaaatcgatattctaaaat

SEQ ID NO: 96040 - DNA, 20 bp, Artificial Sequence
  chemically synthesized
ctaattgtttttacttattt

SEQ ID NO: 96041 - DNA, 20 bp, Artificial Sequence
  chemically synthesized
ctaaaataagtaaaaacaat

SEQ ID NO: 96042 - DNA, 20 bp, Artificial Sequence
  chemically synthesized
ataagtaaaaacaattagaa

SEQ ID NO: 96043 - DNA, 20 bp, Artificial Sequence
  chemically synthesized
gtaaaaacaattagaaaaga

SEQ ID NO: 96044 - DNA, 20 bp, Artificial Sequence
  chemically synthesized
ttagaaaagacagattcaca

SEQ ID NO: 96045 - DNA, 20 bp, Artificial Sequence
  chemically synthesized
agaaaagacagattcacaca

SEQ ID NO: 96046 - DNA, 20 bp, Artificial Sequence
  chemically synthesized
agtatctattgagattcaaa

SEQ ID NO: 96047 - DNA, 20 bp, Artificial Sequence
  chemically synthesized
aataaccatttgaatctcaa

SEQ ID NO: 96048 - DNA, 20 bp, Artificial Sequence
  chemically synthesized
ttttataactagtatctatt

SEQ ID NO: 96049 - DNA, 20 bp, Artificial Sequence
  chemically synthesized
atttgaatctcaatagatac

SEQ ID NO: 96050 - DNA, 20 bp, Artificial Sequence
  chemically synthesized
ggtccgtatcattttataac

SEQ ID NO: 96051 - DNA, 20 bp, Artificial Sequence
  chemically synthesized
atactagttataaaatgata

SEQ ID NO: 96052 - DNA, 20 bp, Artificial Sequence
  chemically synthesized
aatgatacggacctttaaat

SEQ ID NO: 96053 - DNA, 20 bp, Artificial Sequence
  chemically synthesized
cagaagatgtactgatttaa

SEQ ID NO: 96054 - DNA, 20 bp, Artificial Sequence
  chemically synthesized
tcagaagatgtactgattta

SEQ ID NO: 96055 - DNA, 20 bp, Artificial Sequence
  chemically synthesized
aagcatcttttagacatcag

SEQ ID NO: 96056 - DNA, 20 bp, Artificial Sequence
  chemically synthesized
gataagcatcttttagacat

SEQ ID NO: 96057 - DNA, 20 bp, Artificial Sequence
  chemically synthesized
gtacatcttctgatgtctaa

SEQ ID NO: 96058 - DNA, 20 bp, Artificial Sequence
  chemically synthesized
gagtagtgataagcatcttt

SEQ ID NO: 96059 - DNA, 20 bp, Artificial Sequence
  chemically synthesized
agagtctagtgagtagtgat

SEQ ID NO: 96060 - DNA, 20 bp, Artificial Sequence
  chemically synthesized
agatgcttatcactactcac

SEQ ID NO: 96061 - DNA, 20 bp, Artificial Sequence
  chemically synthesized
gtgaaaaagagtctagtgag

SEQ ID NO: 96062 - DNA, 20 bp, Artificial Sequence
  chemically synthesized
caagtgaaaaagagtctagt

SEQ ID NO: 96063 - DNA, 20 bp, Artificial Sequence
  chemically synthesized
aaagcaagtgaaaaagagtc

SEQ ID NO: 96064 - DNA, 20 bp, Artificial Sequence
  chemically synthesized
tttgcaaagcaagtgaaaaa

SEQ ID NO: 96065 - DNA, 20 bp, Artificial Sequence
  chemically synthesized
gatttgcaaagcaagtgaaa

SEQ ID NO: 96066 - DNA, 20 bp, Artificial Sequence
  chemically synthesized
tttaaactgatttgcaaagc

SEQ ID NO: 96067 - DNA, 20 bp, Artificial Sequence
  chemically synthesized
ttttcacttgctttgcaaat

SEQ ID NO: 96068 - DNA, 20 bp, Artificial Sequence
  chemically synthesized
tatgtttaaactgatttgca

SEQ ID NO: 96069 - DNA, 20 bp, Artificial Sequence
  chemically synthesized
caaatcagtttaaacataca

SEQ ID NO: 96070 - DNA, 20 bp, Artificial Sequence
  chemically synthesized
gtttaaacatacatggtaat

SEQ ID NO: 96071 - DNA, 20 bp, Artificial Sequence
  chemically synthesized
tttaaacatacatggtaatc

SEQ ID NO: 96072 - DNA, 20 bp, Artificial Sequence
  chemically synthesized
taaacatacatggtaatcag

SEQ ID NO: 96073 - DNA, 20 bp, Artificial Sequence
  chemically synthesized
agtcattatttttattcact

SEQ ID NO: 96074 - DNA, 20 bp, Artificial Sequence
  chemically synthesized
attatttttattcacttgga

SEQ ID NO: 96075 - DNA, 20 bp, Artificial Sequence
  chemically synthesized
tttttattcacttggaaagt

SEQ ID NO: 96076 - DNA, 20 bp, Artificial Sequence
  chemically synthesized
aaaggtacttctgactttcc

SEQ ID NO: 96077 - DNA, 20 bp, Artificial Sequence
  chemically synthesized
ttattcacttggaaagtcag

SEQ ID NO: 96078 - DNA, 20 bp, Artificial Sequence
  chemically synthesized
aagtcagaagtaccttttcc

SEQ ID NO: 96079 - DNA, 20 bp, Artificial Sequence
  chemically synthesized
ttcaaaatctcactgggaaa

SEQ ID NO: 96080 - DNA, 20 bp, Artificial Sequence
  chemically synthesized
cttcaaaatctcactgggaa

SEQ ID NO: 96081 - DNA, 20 bp, Artificial Sequence
  chemically synthesized
cagaagtaccttttcccagt

SEQ ID NO: 96082 - DNA, 20 bp, Artificial Sequence
  chemically synthesized
ttttccttcaaaatctcact

SEQ ID NO: 96083 - DNA, 20 bp, Artificial Sequence
  chemically synthesized
cttttccttcaaaatctcac

SEQ ID NO: 96084 - DNA, 20 bp, Artificial Sequence
  chemically synthesized
cttttcccagtgagattttg

SEQ ID NO: 96085 - DNA, 20 bp, Artificial Sequence
  chemically synthesized
ttttcccagtgagattttga

SEQ ID NO: 96086 - DNA, 20 bp, Artificial Sequence
  chemically synthesized
ccagtgagattttgaaggaa

SEQ ID NO: 96087 - DNA, 20 bp, Artificial Sequence
  chemically synthesized
aaagtaaaacacccttcatt

SEQ ID NO: 96088 - DNA, 20 bp, Artificial Sequence
  chemically synthesized
ccataaaatctccaaatgaa

SEQ ID NO: 96089 - DNA, 20 bp, Artificial Sequence
  chemically synthesized
agtaaaacacccttcatttg

SEQ ID NO: 96090 - DNA, 20 bp, Artificial Sequence
  chemically synthesized
cccataaaatctccaaatga

SEQ ID NO: 96091 - DNA, 20 bp, Artificial Sequence
  chemically synthesized
acccataaaatctccaaatg

SEQ ID NO: 96092 - DNA, 20 bp, Artificial Sequence
  chemically synthesized
cccttcatttggagatttta

SEQ ID NO: 96093 - DNA, 20 bp, Artificial Sequence
  chemically synthesized
ccttcatttggagattttat

SEQ ID NO: 96094 - DNA, 20 bp, Artificial Sequence
  chemically synthesized
tgtttagaaaagcacatgtt

SEQ ID NO: 96095 - DNA, 20 bp, Artificial Sequence
  chemically synthesized
taaacatgtgcttttctaaa

SEQ ID NO: 96096 - DNA, 20 bp, Artificial Sequence
  chemically synthesized
aaatcatttcctgtttagaa

SEQ ID NO: 96097 - DNA, 20 bp, Artificial Sequence
  chemically synthesized
aaacatgtgcttttctaaac

SEQ ID NO: 96098 - DNA, 20 bp, Artificial Sequence
  chemically synthesized
gtcataaatcatttcctgtt

SEQ ID NO: 96099 - DNA, 20 bp, Artificial Sequence
  chemically synthesized
aaatgatttatgacttatca

SEQ ID NO: 96100 - DNA, 20 bp, Artificial Sequence
  chemically synthesized
aatgatttatgacttatcaa

SEQ ID NO: 96101 - DNA, 20 bp, Artificial Sequence
  chemically synthesized
actcaggcatatcctttgat

SEQ ID NO: 96102 - DNA, 20 bp, Artificial Sequence
  chemically synthesized
acttatcaaaggatatgcct

SEQ ID NO: 96103 - DNA, 20 bp, Artificial Sequence
  chemically synthesized
agagattaggtgagagactc

SEQ ID NO: 96104 - DNA, 20 bp, Artificial Sequence
  chemically synthesized
tagagattaggtgagagact

SEQ ID NO: 96105 - DNA, 20 bp, Artificial Sequence
  chemically synthesized
tgggtttagagattaggtga

SEQ ID NO: 96106 - DNA, 20 bp, Artificial Sequence
  chemically synthesized
gctgggtttagagattaggt

SEQ ID NO: 96107 - DNA, 20 bp, Artificial Sequence
  chemically synthesized
gtcagctgggtttagagatt

SEQ ID NO: 96108 - DNA, 20 bp, Artificial Sequence
  chemically synthesized
agtcagctgggtttagagat

SEQ ID NO: 96109 - DNA, 20 bp, Artificial Sequence
  chemically synthesized
tctcacctaatctctaaacc

SEQ ID NO: 96110 - DNA, 20 bp, Artificial Sequence
  chemically synthesized
gagaaagtcagctgggttta

SEQ ID NO: 96111 - DNA, 20 bp, Artificial Sequence
  chemically synthesized
tggagaaagtcagctgggtt

SEQ ID NO: 96112 - DNA, 20 bp, Artificial Sequence
  chemically synthesized
agaaatggagaaagtcagct

SEQ ID NO: 96113 - DNA, 20 bp, Artificial Sequence
  chemically synthesized
gagaaatggagaaagtcagc

SEQ ID NO: 96114 - DNA, 20 bp, Artificial Sequence
  chemically synthesized
gttagagaaatggagaaagt

SEQ ID NO: 96115 - DNA, 20 bp, Artificial Sequence
  chemically synthesized
cagtgttagagaaatggaga

SEQ ID NO: 96116 - DNA, 20 bp, Artificial Sequence
  chemically synthesized
cgctcagtgttagagaaatg

SEQ ID NO: 96117 - DNA, 20 bp, Artificial Sequence
  chemically synthesized
tacgctcagtgttagagaaa

SEQ ID NO: 96118 - DNA, 20 bp, Artificial Sequence
  chemically synthesized
ttctccatttctctaacact

SEQ ID NO: 96119 - DNA, 20 bp, Artificial Sequence
  chemically synthesized
ttttgctacgctcagtgtta

SEQ ID NO: 96120 - DNA, 20 bp, Artificial Sequence
  chemically synthesized
ccttttgctacgctcagtgt

SEQ ID NO: 96121 - DNA, 20 bp, Artificial Sequence
  chemically synthesized
catttctctaacactgagcg

SEQ ID NO: 96122 - DNA, 20 bp, Artificial Sequence
  chemically synthesized
gcgtctccttttgctacgct

SEQ ID NO: 96123 - DNA, 20 bp, Artificial Sequence
  chemically synthesized
tctaacactgagcgtagcaa

SEQ ID NO: 96124 - DNA, 20 bp, Artificial Sequence
  chemically synthesized
ctaacactgagcgtagcaaa

SEQ ID NO: 96125 - DNA, 20 bp, Artificial Sequence
  chemically synthesized
aacactgagcgtagcaaaag

SEQ ID NO: 96126 - DNA, 20 bp, Artificial Sequence
  chemically synthesized
caaaaggagacgctcttgat

SEQ ID NO: 96127 - DNA, 20 bp, Artificial Sequence
  chemically synthesized
agtgtctcttggctaatcaa

SEQ ID NO: 96128 - DNA, 20 bp, Artificial Sequence
  chemically synthesized
gcagtgtctcttggctaatc

SEQ ID NO: 96129 - DNA, 20 bp, Artificial Sequence
  chemically synthesized
ggagacgctcttgattagcc

SEQ ID NO: 96130 - DNA, 20 bp, Artificial Sequence
  chemically synthesized
agacgctcttgattagccaa

SEQ ID NO: 96131 - DNA, 20 bp, Artificial Sequence
  chemically synthesized
gtatgagcagcagtgtctct

SEQ ID NO: 96132 - DNA, 20 bp, Artificial Sequence
  chemically synthesized
ataggttggtgtatgagcag

SEQ ID NO: 96133 - DNA, 20 bp, Artificial Sequence
  chemically synthesized
aatataggttggtgtatgag

SEQ ID NO: 96134 - DNA, 20 bp, Artificial Sequence
  chemically synthesized
tcaaatataggttggtgtat

SEQ ID NO: 96135 - DNA, 20 bp, Artificial Sequence
  chemically synthesized
accctgagtcaaatataggt

SEQ ID NO: 96136 - DNA, 20 bp, Artificial Sequence
  chemically synthesized
cccaaccctgagtcaaatat

SEQ ID NO: 96137 - DNA, 20 bp, Artificial Sequence
  chemically synthesized
ccccaaccctgagtcaaata

SEQ ID NO: 96138 - DNA, 20 bp, Artificial Sequence
  chemically synthesized
acaccaacctatatttgact

SEQ ID NO: 96139 - DNA, 20 bp, Artificial Sequence
  chemically synthesized
caccaacctatatttgactc

SEQ ID NO: 96140 - DNA, 20 bp, Artificial Sequence
  chemically synthesized
accaacctatatttgactca

SEQ ID NO: 96141 - DNA, 20 bp, Artificial Sequence
  chemically synthesized
acctatatttgactcagggt

SEQ ID NO: 96142 - DNA, 20 bp, Artificial Sequence
  chemically synthesized
cctatatttgactcagggtt

SEQ ID NO: 96143 - DNA, 20 bp, Artificial Sequence
  chemically synthesized
ctatatttgactcagggttg

SEQ ID NO: 96144 - DNA, 20 bp, Artificial Sequence
  chemically synthesized
tttcacaattccccaaccct

SEQ ID NO: 96145 - DNA, 20 bp, Artificial Sequence
  chemically synthesized
attgtgaaacaacctaaatg

SEQ ID NO: 96146 - DNA, 20 bp, Artificial Sequence
  chemically synthesized
catctaaaagtgctgcattt

SEQ ID NO: 96147 - DNA, 20 bp, Artificial Sequence
  chemically synthesized
tcatctaaaagtgctgcatt

SEQ ID NO: 96148 - DNA, 20 bp, Artificial Sequence
  chemically synthesized
caacctaaatgcagcacttt

SEQ ID NO: 96149 - DNA, 20 bp, Artificial Sequence
  chemically synthesized
tcagagcaattttcatctaa

SEQ ID NO: 96150 - DNA, 20 bp, Artificial Sequence
  chemically synthesized
ttttagatgaaaattgctct

SEQ ID NO: 96151 - DNA, 20 bp, Artificial Sequence
  chemically synthesized
tttagatgaaaattgctctg

SEQ ID NO: 96152 - DNA, 20 bp, Artificial Sequence
  chemically synthesized
ttcagaatggaaaatcctca

SEQ ID NO: 96153 - DNA, 20 bp, Artificial Sequence
  chemically synthesized
ttttcagaatggaaaatcct

SEQ ID NO: 96154 - DNA, 20 bp, Artificial Sequence
  chemically synthesized
tgaggattttccattctgaa

SEQ ID NO: 96155 - DNA, 20 bp, Artificial Sequence
  chemically synthesized
tttccttctacttttcagaa

SEQ ID NO: 96156 - DNA, 20 bp, Artificial Sequence
  chemically synthesized
ggattttccattctgaaaag

SEQ ID NO: 96157 - DNA, 20 bp, Artificial Sequence
  chemically synthesized
cttggtttccttctactttt

SEQ ID NO: 96158 - DNA, 20 bp, Artificial Sequence
  chemically synthesized
ttttccattctgaaaagtag

SEQ ID NO: 96159 - DNA, 20 bp, Artificial Sequence
  chemically synthesized
tttccattctgaaaagtaga

SEQ ID NO: 96160 - DNA, 20 bp, Artificial Sequence
  chemically synthesized
ctgaaaagtagaaggaaacc

SEQ ID NO: 96161 - DNA, 20 bp, Artificial Sequence
  chemically synthesized
tgaaaagtagaaggaaacca

SEQ ID NO: 96162 - DNA, 20 bp, Artificial Sequence
  chemically synthesized
aaaagtagaaggaaaccaag

SEQ ID NO: 96163 - DNA, 20 bp, Artificial Sequence
  chemically synthesized
ctggtattataagaactcct

SEQ ID NO: 96164 - DNA, 20 bp, Artificial Sequence
  chemically synthesized
ccaaggagttcttataatac

SEQ ID NO: 96165 - DNA, 20 bp, Artificial Sequence
  chemically synthesized
tctaagttttctggtattat

SEQ ID NO: 96166 - DNA, 20 bp, Artificial Sequence
  chemically synthesized
tcttataataccagaaaact

SEQ ID NO: 96167 - DNA, 20 bp, Artificial Sequence
  chemically synthesized
ttaagggcttctaagttttc

SEQ ID NO: 96168 - DNA, 20 bp, Artificial Sequence
  chemically synthesized
tataataccagaaaacttag

SEQ ID NO: 96169 - DNA, 20 bp, Artificial Sequence
  chemically synthesized
attgtgcattaagggcttct

SEQ ID NO: 96170 - DNA, 20 bp, Artificial Sequence
  chemically synthesized
agtgtaatattgtgcattaa

SEQ ID NO: 96171 - DNA, 20 bp, Artificial Sequence
  chemically synthesized
cagtgtaatattgtgcatta

SEQ ID NO: 96172 - DNA, 20 bp, Artificial Sequence
  chemically synthesized
tcagtgtaatattgtgcatt

SEQ ID NO: 96173 - DNA, 20 bp, Artificial Sequence
  chemically synthesized
gcgaaggtcattttgtaggt

SEQ ID NO: 96174 - DNA, 20 bp, Artificial Sequence
  chemically synthesized
ttgtgcgaaggtcattttgt

SEQ ID NO: 96175 - DNA, 20 bp, Artificial Sequence
  chemically synthesized
tttgtgcgaaggtcattttg

SEQ ID NO: 96176 - DNA, 20 bp, Artificial Sequence
  chemically synthesized
tacaaaatgaccttcgcaca

SEQ ID NO: 96177 - DNA, 20 bp, Artificial Sequence
  chemically synthesized
aataagttaactttgtgcga

SEQ ID NO: 96178 - DNA, 20 bp, Artificial Sequence
  chemically synthesized
taataagttaactttgtgcg

SEQ ID NO: 96179 - DNA, 20 bp, Artificial Sequence
  chemically synthesized
tcgcacaaagttaacttatt

SEQ ID NO: 96180 - DNA, 20 bp, Artificial Sequence
  chemically synthesized
cacaaagttaacttattaag

SEQ ID NO: 96181 - DNA, 20 bp, Artificial Sequence
  chemically synthesized
tattttccttgcttcttaat

SEQ ID NO: 96182 - DNA, 20 bp, Artificial Sequence
  chemically synthesized
aagttaacttattaagaagc

SEQ ID NO: 96183 - DNA, 20 bp, Artificial Sequence
  chemically synthesized
agttaacttattaagaagca

SEQ ID NO: 96184 - DNA, 20 bp, Artificial Sequence
  chemically synthesized
ttattaagaagcaaggaaaa

SEQ ID NO: 96185 - DNA, 20 bp, Artificial Sequence
  chemically synthesized
tattaagaagcaaggaaaat

SEQ ID NO: 96186 - DNA, 20 bp, Artificial Sequence
  chemically synthesized
taagaagcaaggaaaatagg

SEQ ID NO: 96187 - DNA, 20 bp, Artificial Sequence
  chemically synthesized
aagcaaggaaaataggtaga

SEQ ID NO: 96188 - DNA, 20 bp, Artificial Sequence
  chemically synthesized
agcaaggaaaataggtagaa

SEQ ID NO: 96189 - DNA, 20 bp, Artificial Sequence
  chemically synthesized
aataggtagaaaggcattgt

SEQ ID NO: 96190 - DNA, 20 bp, Artificial Sequence
  chemically synthesized
aaaggcattgttggtacaaa

SEQ ID NO: 96191 - DNA, 20 bp, Artificial Sequence
  chemically synthesized
ttccagactcggcattttag

SEQ ID NO: 96192 - DNA, 20 bp, Artificial Sequence
  chemically synthesized
agaaacgctgctaaaatgcc

SEQ ID NO: 96193 - DNA, 20 bp, Artificial Sequence
  chemically synthesized
attttccagactcggcattt

SEQ ID NO: 96194 - DNA, 20 bp, Artificial Sequence
  chemically synthesized
cgctgctaaaatgccgagtc

SEQ ID NO: 96195 - DNA, 20 bp, Artificial Sequence
  chemically synthesized
tttttcaaattttccagact

SEQ ID NO: 96196 - DNA, 20 bp, Artificial Sequence
  chemically synthesized
aagatctttttcaaattttc

SEQ ID NO: 96197 - DNA, 20 bp, Artificial Sequence
  chemically synthesized
cgagtctggaaaatttgaaa

SEQ ID NO: 96198 - DNA, 20 bp, Artificial Sequence
  chemically synthesized
cagaaacagttttggaaatt

SEQ ID NO: 96199 - DNA, 20 bp, Artificial Sequence
  chemically synthesized
tttctgagcagaaacagttt

SEQ ID NO: 96200 - DNA, 20 bp, Artificial Sequence
  chemically synthesized
tacttctttctgagcagaaa

SEQ ID NO: 96201 - DNA, 20 bp, Artificial Sequence
  chemically synthesized
tttccaaaactgtttctgct

SEQ ID NO: 96202 - DNA, 20 bp, Artificial Sequence
  chemically synthesized
caaaactgtttctgctcaga

SEQ ID NO: 96203 - DNA, 20 bp, Artificial Sequence
  chemically synthesized
tcctcttacttctttctgag

SEQ ID NO: 96204 - DNA, 20 bp, Artificial Sequence
  chemically synthesized
aactgtttctgctcagaaag

SEQ ID NO: 96205 - DNA, 20 bp, Artificial Sequence
  chemically synthesized
tattcctcttacttctttct

SEQ ID NO: 96206 - DNA, 20 bp, Artificial Sequence
  chemically synthesized
gtttctgctcagaaagaagt

SEQ ID NO: 96207 - DNA, 20 bp, Artificial Sequence
  chemically synthesized
ttctgctcagaaagaagtaa

SEQ ID NO: 96208 - DNA, 20 bp, Artificial Sequence
  chemically synthesized
tctgctcagaaagaagtaag

SEQ ID NO: 96209 - DNA, 20 bp, Artificial Sequence
  chemically synthesized
gaagtaagaggaatatcatt

SEQ ID NO: 96210 - DNA, 20 bp, Artificial Sequence
  chemically synthesized
tcatttggtgatataaaact

SEQ ID NO: 96211 - DNA, 20 bp, Artificial Sequence
  chemically synthesized
cccacactctcaaaagggcc

SEQ ID NO: 96212 - DNA, 20 bp, Artificial Sequence
  chemically synthesized
atataaaacttggccctttt

SEQ ID NO: 96213 - DNA, 20 bp, Artificial Sequence
  chemically synthesized
ataaaacttggcccttttga

SEQ ID NO: 96214 - DNA, 20 bp, Artificial Sequence
  chemically synthesized
tttctcccacactctcaaaa

SEQ ID NO: 96215 - DNA, 20 bp, Artificial Sequence
  chemically synthesized
ttttctcccacactctcaaa

SEQ ID NO: 96216 - DNA, 20 bp, Artificial Sequence
  chemically synthesized
attttctcccacactctcaa

SEQ ID NO: 96217 - DNA, 20 bp, Artificial Sequence
  chemically synthesized
acttggcccttttgagagtg

SEQ ID NO: 96218 - DNA, 20 bp, Artificial Sequence
  chemically synthesized
cttggcccttttgagagtgt

SEQ ID NO: 96219 - DNA, 20 bp, Artificial Sequence
  chemically synthesized
tggcccttttgagagtgtgg

SEQ ID NO: 96220 - DNA, 20 bp, Artificial Sequence
  chemically synthesized
tttgagagtgtgggagaaaa

SEQ ID NO: 96221 - DNA, 20 bp, Artificial Sequence
  chemically synthesized
ttgagagtgtgggagaaaat

SEQ ID NO: 96222 - DNA, 20 bp, Artificial Sequence
  chemically synthesized
agagtgtgggagaaaatggg

SEQ ID NO: 96223 - DNA, 20 bp, Artificial Sequence
  chemically synthesized
agtgtgggagaaaatgggtg

SEQ ID NO: 96224 - DNA, 20 bp, Artificial Sequence
  chemically synthesized
agtgattatgtcagaatcaa

SEQ ID NO: 96225 - DNA, 20 bp, Artificial Sequence
  chemically synthesized
aaaatttgcagtgattatgt

SEQ ID NO: 96226 - DNA, 20 bp, Artificial Sequence
  chemically synthesized
atgacagtgtagaaaatttg

SEQ ID NO: 96227 - DNA, 20 bp, Artificial Sequence
  chemically synthesized
gaaattaatcaatgacagtg

SEQ ID NO: 96228 - DNA, 20 bp, Artificial Sequence
  chemically synthesized
ttgaagaaattaatcaatga

SEQ ID NO: 96229 - DNA, 20 bp, Artificial Sequence
  chemically synthesized
tcctaaatcgatgtttattg

SEQ ID NO: 96230 - DNA, 20 bp, Artificial Sequence
  chemically synthesized
ttcttcaataaacatcgatt

SEQ ID NO: 96231 - DNA, 20 bp, Artificial Sequence
  chemically synthesized
tcttcaataaacatcgattt

SEQ ID NO: 96232 - DNA, 20 bp, Artificial Sequence
  chemically synthesized
agcacagccctagaacacag

SEQ ID NO: 96233 - DNA, 20 bp, Artificial Sequence
  chemically synthesized
atttaggatctactgtgttc

SEQ ID NO: 96234 - DNA, 20 bp, Artificial Sequence
  chemically synthesized
tttaggatctactgtgttct

SEQ ID NO: 96235 - DNA, 20 bp, Artificial Sequence
  chemically synthesized
ttaggatctactgtgttcta

SEQ ID NO: 96236 - DNA, 20 bp, Artificial Sequence
  chemically synthesized
agcagcacagccctagaaca

SEQ ID NO: 96237 - DNA, 20 bp, Artificial Sequence
  chemically synthesized
tagacagagcagcacagccc

SEQ ID NO: 96238 - DNA, 20 bp, Artificial Sequence
  chemically synthesized
ctgtgttagacagagcagca

SEQ ID NO: 96239 - DNA, 20 bp, Artificial Sequence
  chemically synthesized
ggctcctgtgttagacagag

SEQ ID NO: 96240 - DNA, 20 bp, Artificial Sequence
  chemically synthesized
agtggctcctgtgttagaca

SEQ ID NO: 96241 - DNA, 20 bp, Artificial Sequence
  chemically synthesized
ctgtgctgctctgtctaaca

SEQ ID NO: 96242 - DNA, 20 bp, Artificial Sequence
  chemically synthesized
ccagtggctcctgtgttaga

SEQ ID NO: 96243 - DNA, 20 bp, Artificial Sequence
  chemically synthesized
tgtgctgctctgtctaacac

SEQ ID NO: 96244 - DNA, 20 bp, Artificial Sequence
  chemically synthesized
tgctgctctgtctaacacag

SEQ ID NO: 96245 - DNA, 20 bp, Artificial Sequence
  chemically synthesized
acagccagtggctcctgtgt

SEQ ID NO: 96246 - DNA, 20 bp, Artificial Sequence
  chemically synthesized
ctgtctaacacaggagccac

SEQ ID NO: 96247 - DNA, 20 bp, Artificial Sequence
  chemically synthesized
aacacaggagccactggctg

SEQ ID NO: 96248 - DNA, 20 bp, Artificial Sequence
  chemically synthesized
cggtagctacctacagccag

SEQ ID NO: 96249 - DNA, 20 bp, Artificial Sequence
  chemically synthesized
acacaggagccactggctgt

SEQ ID NO: 96250 - DNA, 20 bp, Artificial Sequence
  chemically synthesized
gctcggtagctacctacagc

SEQ ID NO: 96251 - DNA, 20 bp, Artificial Sequence
  chemically synthesized
caggagccactggctgtagg

SEQ ID NO: 96252 - DNA, 20 bp, Artificial Sequence
  chemically synthesized
aattgctcggtagctaccta

SEQ ID NO: 96253 - DNA, 20 bp, Artificial Sequence
  chemically synthesized
actggctgtaggtagctacc

SEQ ID NO: 96254 - DNA, 20 bp, Artificial Sequence
  chemically synthesized
gcctgatttcaattgctcgg

SEQ ID NO: 96255 - DNA, 20 bp, Artificial Sequence
  chemically synthesized
ctagcctgatttcaattgct

SEQ ID NO: 96256 - DNA, 20 bp, Artificial Sequence
  chemically synthesized
agctaccgagcaattgaaat

SEQ ID NO: 96257 - DNA, 20 bp, Artificial Sequence
  chemically synthesized
gctaccgagcaattgaaatc

SEQ ID NO: 96258 - DNA, 20 bp, Artificial Sequence
  chemically synthesized
ccgagcaattgaaatcaggc

SEQ ID NO: 96259 - DNA, 20 bp, Artificial Sequence
  chemically synthesized
gcaattgaaatcaggctagt

SEQ ID NO: 96260 - DNA, 20 bp, Artificial Sequence
  chemically synthesized
ttgaaatcaggctagtgaga

SEQ ID NO: 96261 - DNA, 20 bp, Artificial Sequence
  chemically synthesized
cttcagtctctccgtctcac

SEQ ID NO: 96262 - DNA, 20 bp, Artificial Sequence
  chemically synthesized
gaaatcaggctagtgagacg

SEQ ID NO: 96263 - DNA, 20 bp, Artificial Sequence
  chemically synthesized
aatcaggctagtgagacgga

SEQ ID NO: 96264 - DNA, 20 bp, Artificial Sequence
  chemically synthesized
ctagtgagacggagagactg

SEQ ID NO: 96265 - DNA, 20 bp, Artificial Sequence
  chemically synthesized
aataaaaatttgttaaactt

SEQ ID NO: 96266 - DNA, 20 bp, Artificial Sequence
  chemically synthesized
tatatttaaatttaataaaa

SEQ ID NO: 96267 - DNA, 20 bp, Artificial Sequence
  chemically synthesized
taaatttaaaaattgactct

SEQ ID NO: 96268 - DNA, 20 bp, Artificial Sequence
  chemically synthesized
ttaaaaattgactcttggtt

SEQ ID NO: 96269 - DNA, 20 bp, Artificial Sequence
  chemically synthesized
tttttcaataactgaaccaa

SEQ ID NO: 96270 - DNA, 20 bp, Artificial Sequence
  chemically synthesized
agtttttcaataactgaacc

SEQ ID NO: 96271 - DNA, 20 bp, Artificial Sequence
  chemically synthesized
gttgttccaaacatacacaa

SEQ ID NO: 96272 - DNA, 20 bp, Artificial Sequence
  chemically synthesized
gaaaaacttttgtgtatgtt

SEQ ID NO: 96273 - DNA, 20 bp, Artificial Sequence
  chemically synthesized
tgtgtatgtttggaacaact

SEQ ID NO: 96274 - DNA, 20 bp, Artificial Sequence
  chemically synthesized
gtgtatgtttggaacaactt

SEQ ID NO: 96275 - DNA, 20 bp, Artificial Sequence
  chemically synthesized
aaaagaagattcacattcct

SEQ ID NO: 96276 - DNA, 20 bp, Artificial Sequence
  chemically synthesized
aactttatagttgaaaaaag

SEQ ID NO: 96277 - DNA, 20 bp, Artificial Sequence
  chemically synthesized
ataaactttatagttgaaaa

SEQ ID NO: 96278 - DNA, 20 bp, Artificial Sequence
  chemically synthesized
atcttcttttttcaactata

SEQ ID NO: 96279 - DNA, 20 bp, Artificial Sequence
  chemically synthesized
tttacatttcataaacttta

SEQ ID NO: 96280 - DNA, 20 bp, Artificial Sequence
  chemically synthesized
taaagtttatgaaatgtaaa

SEQ ID NO: 96281 - DNA, 20 bp, Artificial Sequence
  chemically synthesized
aagtttatgaaatgtaaata

SEQ ID NO: 96282 - DNA, 20 bp, Artificial Sequence
  chemically synthesized
taaaaaaaaaagaaaatatt

SEQ ID NO: 96283 - DNA, 20 bp, Artificial Sequence
  chemically synthesized
ttaaagtataataaaaaaaa

SEQ ID NO: 96284 - DNA, 20 bp, Artificial Sequence
  chemically synthesized
ttttttttttattatacttt

SEQ ID NO: 96285 - DNA, 20 bp, Artificial Sequence
  chemically synthesized
ttttattatactttaagttc

SEQ ID NO: 96286 - DNA, 20 bp, Artificial Sequence
  chemically synthesized
cacatgtgccctagaactta

SEQ ID NO: 96287 - DNA, 20 bp, Artificial Sequence
  chemically synthesized
tttattatactttaagttct

SEQ ID NO: 96288 - DNA, 20 bp, Artificial Sequence
  chemically synthesized
ttattatactttaagttcta

SEQ ID NO: 96289 - DNA, 20 bp, Artificial Sequence
  chemically synthesized
cacgttgtgcacatgtgccc

SEQ ID NO: 96290 - DNA, 20 bp, Artificial Sequence
  chemically synthesized
gggcacatgtgcacaacgtg

SEQ ID NO: 96291 - DNA, 20 bp, Artificial Sequence
  chemically synthesized
ggcacatgtgcacaacgtgc

SEQ ID NO: 96292 - DNA, 20 bp, Artificial Sequence
  chemically synthesized
tatgtatacatgtgccatgt

SEQ ID NO: 96293 - DNA, 20 bp, Artificial Sequence
  chemically synthesized
atgggtgcagcacaccaaca

SEQ ID NO: 96294 - DNA, 20 bp, Artificial Sequence
  chemically synthesized
aaatgacgagttaatgggtg

SEQ ID NO: 96295 - DNA, 20 bp, Artificial Sequence
  chemically synthesized
aatgtaaatgacgagttaat

SEQ ID NO: 96296 - DNA, 20 bp, Artificial Sequence
  chemically synthesized
taatgtaaatgacgagttaa

SEQ ID NO: 96297 - DNA, 20 bp, Artificial Sequence
  chemically synthesized
atatacctaatgtaaatgac

SEQ ID NO: 96298 - DNA, 20 bp, Artificial Sequence
  chemically synthesized
cattaactcgtcatttacat

SEQ ID NO: 96299 - DNA, 20 bp, Artificial Sequence
  chemically synthesized
attaactcgtcatttacatt

SEQ ID NO: 96300 - DNA, 20 bp, Artificial Sequence
  chemically synthesized
ggggggagggatagcgttag

SEQ ID NO: 96301 - DNA, 20 bp, Artificial Sequence
  chemically synthesized
gaggggggagggatagcgtt

SEQ ID NO: 96302 - DNA, 20 bp, Artificial Sequence
  chemically synthesized
ggaggggggagggatagcgt

SEQ ID NO: 96303 - DNA, 20 bp, Artificial Sequence
  chemically synthesized
gtggggggaggggggaggga

SEQ ID NO: 96304 - DNA, 20 bp, Artificial Sequence
  chemically synthesized
tggggtggggggagggggga

SEQ ID NO: 96305 - DNA, 20 bp, Artificial Sequence
  chemically synthesized
gtggggtggggggagggggg

SEQ ID NO: 96306 - DNA, 20 bp, Artificial Sequence
  chemically synthesized
cgtggggtggggggaggggg

SEQ ID NO: 96307 - DNA, 20 bp, Artificial Sequence
  chemically synthesized
gtcgtggggtggggggaggg

SEQ ID NO: 96308 - DNA, 20 bp, Artificial Sequence
  chemically synthesized
tgtcgtggggtggggggagg

SEQ ID NO: 96309 - DNA, 20 bp, Artificial Sequence
  chemically synthesized
ctgtcgtggggtggggggag

SEQ ID NO: 96310 - DNA, 20 bp, Artificial Sequence
  chemically synthesized
cctgtcgtggggtgggggga

SEQ ID NO: 96311 - DNA, 20 bp, Artificial Sequence
  chemically synthesized
gcctgtcgtggggtgggggg

SEQ ID NO: 96312 - DNA, 20 bp, Artificial Sequence
  chemically synthesized
ggcctgtcgtggggtggggg

SEQ ID NO: 96313 - DNA, 20 bp, Artificial Sequence
  chemically synthesized
agggcctgtcgtggggtggg

SEQ ID NO: 96314 - DNA, 20 bp, Artificial Sequence
  chemically synthesized
cagggcctgtcgtggggtgg

SEQ ID NO: 96315 - DNA, 20 bp, Artificial Sequence
  chemically synthesized
ccagggcctgtcgtggggtg

SEQ ID NO: 96316 - DNA, 20 bp, Artificial Sequence
  chemically synthesized
accagggcctgtcgtggggt

SEQ ID NO: 96317 - DNA, 20 bp, Artificial Sequence
  chemically synthesized
caccagggcctgtcgtgggg

SEQ ID NO: 96318 - DNA, 20 bp, Artificial Sequence
  chemically synthesized
cccctccccccaccccacga

SEQ ID NO: 96319 - DNA, 20 bp, Artificial Sequence
  chemically synthesized
ccctccccccaccccacgac

SEQ ID NO: 96320 - DNA, 20 bp, Artificial Sequence
  chemically synthesized
acacaccagggcctgtcgtg

SEQ ID NO: 96321 - DNA, 20 bp, Artificial Sequence
  chemically synthesized
cacacaccagggcctgtcgt

SEQ ID NO: 96322 - DNA, 20 bp, Artificial Sequence
  chemically synthesized
tcacacaccagggcctgtcg

SEQ ID NO: 96323 - DNA, 20 bp, Artificial Sequence
  chemically synthesized
ccccaccccacgacaggccc

SEQ ID NO: 96324 - DNA, 20 bp, Artificial Sequence
  chemically synthesized
gtggggaacatcacacacca

SEQ ID NO: 96325 - DNA, 20 bp, Artificial Sequence
  chemically synthesized
ggtggggaacatcacacacc

SEQ ID NO: 96326 - DNA, 20 bp, Artificial Sequence
  chemically synthesized
gggtggggaacatcacacac

SEQ ID NO: 96327 - DNA, 20 bp, Artificial Sequence
  chemically synthesized
gaacacttggacacagggtg

SEQ ID NO: 96328 - DNA, 20 bp, Artificial Sequence
  chemically synthesized
agaacacttggacacagggt

SEQ ID NO: 96329 - DNA, 20 bp, Artificial Sequence
  chemically synthesized
gagaacacttggacacaggg

SEQ ID NO: 96330 - DNA, 20 bp, Artificial Sequence
  chemically synthesized
atgttccccaccctgtgtcc

SEQ ID NO: 96331 - DNA, 20 bp, Artificial Sequence
  chemically synthesized
aatgagaacacttggacaca

SEQ ID NO: 96332 - DNA, 20 bp, Artificial Sequence
  chemically synthesized
caatgagaacacttggacac

SEQ ID NO: 96333 - DNA, 20 bp, Artificial Sequence
  chemically synthesized
gcaatgagaacacttggaca

SEQ ID NO: 96334 - DNA, 20 bp, Artificial Sequence
  chemically synthesized
aattgagcaatgagaacact

SEQ ID NO: 96335 - DNA, 20 bp, Artificial Sequence
  chemically synthesized
acaggcgggaattgagcaat

SEQ ID NO: 96336 - DNA, 20 bp, Artificial Sequence
  chemically synthesized
cttactcacaggcgggaatt

SEQ ID NO: 96337 - DNA, 20 bp, Artificial Sequence
  chemically synthesized
attgctcaattcccgcctgt

SEQ ID NO: 96338 - DNA, 20 bp, Artificial Sequence
  chemically synthesized
acatgttcttactcacaggc

SEQ ID NO: 96339 - DNA, 20 bp, Artificial Sequence
  chemically synthesized
cacatgttcttactcacagg

SEQ ID NO: 96340 - DNA, 20 bp, Artificial Sequence
  chemically synthesized
ctcaattcccgcctgtgagt

SEQ ID NO: 96341 - DNA, 20 bp, Artificial Sequence
  chemically synthesized
caccacatgttcttactcac

SEQ ID NO: 96342 - DNA, 20 bp, Artificial Sequence
  chemically synthesized
acaccacatgttcttactca

SEQ ID NO: 96343 - DNA, 20 bp, Artificial Sequence
  chemically synthesized
cgcctgtgagtaagaacatg

SEQ ID NO: 96344 - DNA, 20 bp, Artificial Sequence
  chemically synthesized
gagtaagaacatgtggtgtt

SEQ ID NO: 96345 - DNA, 20 bp, Artificial Sequence
  chemically synthesized
tgagcaaactatcacaagga

SEQ ID NO: 96346 - DNA, 20 bp, Artificial Sequence
  chemically synthesized
ttggttttctgtccttgtga

SEQ ID NO: 96347 - DNA, 20 bp, Artificial Sequence
  chemically synthesized
attctgagcaaactatcaca

SEQ ID NO: 96348 - DNA, 20 bp, Artificial Sequence
  chemically synthesized
cattctgagcaaactatcac

SEQ ID NO: 96349 - DNA, 20 bp, Artificial Sequence
  chemically synthesized
tgtccttgtgatagtttgct

SEQ ID NO: 96350 - DNA, 20 bp, Artificial Sequence
  chemically synthesized
tgatagtttgctcagaatga

SEQ ID NO: 96351 - DNA, 20 bp, Artificial Sequence
  chemically synthesized
aagctggaaaccatcattct

SEQ ID NO: 96352 - DNA, 20 bp, Artificial Sequence
  chemically synthesized
ttgctcagaatgatggtttc

SEQ ID NO: 96353 - DNA, 20 bp, Artificial Sequence
  chemically synthesized
tgtagggacgtggatgaagc

SEQ ID NO: 96354 - DNA, 20 bp, Artificial Sequence
  chemically synthesized
cctttgtagggacgtggatg

SEQ ID NO: 96355 - DNA, 20 bp, Artificial Sequence
  chemically synthesized
tcaagtcctttgtagggacg

SEQ ID NO: 96356 - DNA, 20 bp, Artificial Sequence
  chemically synthesized
gcttcatccacgtccctaca

SEQ ID NO: 96357 - DNA, 20 bp, Artificial Sequence
  chemically synthesized
cttcatccacgtccctacaa

SEQ ID NO: 96358 - DNA, 20 bp, Artificial Sequence
  chemically synthesized
atgagttcaagtcctttgta

SEQ ID NO: 96359 - DNA, 20 bp, Artificial Sequence
  chemically synthesized
gatgagttcaagtcctttgt

SEQ ID NO: 96360 - DNA, 20 bp, Artificial Sequence
  chemically synthesized
ggatgagttcaagtcctttg

SEQ ID NO: 96361 - DNA, 20 bp, Artificial Sequence
  chemically synthesized
gccataaagaggatgagttc

SEQ ID NO: 96362 - DNA, 20 bp, Artificial Sequence
  chemically synthesized
tatgcagccataaagaggat

SEQ ID NO: 96363 - DNA, 20 bp, Artificial Sequence
  chemically synthesized
acttgaactcatcctcttta

SEQ ID NO: 96364 - DNA, 20 bp, Artificial Sequence
  chemically synthesized
aatactatgcagccataaag

SEQ ID NO: 96365 - DNA, 20 bp, Artificial Sequence
  chemically synthesized
gaatactatgcagccataaa

SEQ ID NO: 96366 - DNA, 20 bp, Artificial Sequence
  chemically synthesized
tggaatactatgcagccata

SEQ ID NO: 96367 - DNA, 20 bp, Artificial Sequence
  chemically synthesized
tcatcctctttatggctgca

SEQ ID NO: 96368 - DNA, 20 bp, Artificial Sequence
  chemically synthesized
atatatcatggaatactatg

SEQ ID NO: 96369 - DNA, 20 bp, Artificial Sequence
  chemically synthesized
aatgtggcacatatatatca

SEQ ID NO: 96370 - DNA, 20 bp, Artificial Sequence
  chemically synthesized
tagaccggattaagaaaatg

SEQ ID NO: 96371 - DNA, 20 bp, Artificial Sequence
  chemically synthesized
tgtgccacattttcttaatc

SEQ ID NO: 96372 - DNA, 20 bp, Artificial Sequence
  chemically synthesized
catcaatgatagaccggatt

SEQ ID NO: 96373 - DNA, 20 bp, Artificial Sequence
  chemically synthesized
aatgtccatcaatgatagac

SEQ ID NO: 96374 - DNA, 20 bp, Artificial Sequence
  chemically synthesized
ttaatccggtctatcattga

SEQ ID NO: 96375 - DNA, 20 bp, Artificial Sequence
  chemically synthesized
acccaaatgtccatcaatga

SEQ ID NO: 96376 - DNA, 20 bp, Artificial Sequence
  chemically synthesized
gtctatcattgatggacatt

SEQ ID NO: 96377 - DNA, 20 bp, Artificial Sequence
  chemically synthesized
tctatcattgatggacattt

SEQ ID NO: 96378 - DNA, 20 bp, Artificial Sequence
  chemically synthesized
tcattgatggacatttgggt

SEQ ID NO: 96379 - DNA, 20 bp, Artificial Sequence
  chemically synthesized
tggacatttgggttggttcc

SEQ ID NO: 96380 - DNA, 20 bp, Artificial Sequence
  chemically synthesized
tatttacagtagcaaagact

SEQ ID NO: 96381 - DNA, 20 bp, Artificial Sequence
  chemically synthesized
cggcactatttacagtagca

SEQ ID NO: 96382 - DNA, 20 bp, Artificial Sequence
  chemically synthesized
caagtctttgctactgtaaa

SEQ ID NO: 96383 - DNA, 20 bp, Artificial Sequence
  chemically synthesized
tattgcggcactatttacag

SEQ ID NO: 96384 - DNA, 20 bp, Artificial Sequence
  chemically synthesized
gtttattgcggcactattta

SEQ ID NO: 96385 - DNA, 20 bp, Artificial Sequence
  chemically synthesized
ctgcacacgtatgtttattg

SEQ ID NO: 96386 - DNA, 20 bp, Artificial Sequence
  chemically synthesized
ccgcaataaacatacgtgtg

SEQ ID NO: 96387 - DNA, 20 bp, Artificial Sequence
  chemically synthesized
cgcaataaacatacgtgtgc

SEQ ID NO: 96388 - DNA, 20 bp, Artificial Sequence
  chemically synthesized
ataaacatacgtgtgcaggt

SEQ ID NO: 96389 - DNA, 20 bp, Artificial Sequence
  chemically synthesized
gtattttcattgaaaatatt

SEQ ID NO: 96390 - DNA, 20 bp, Artificial Sequence
  chemically synthesized
aaatattttcaatgaaaata

SEQ ID NO: 96391 - DNA, 20 bp, Artificial Sequence
  chemically synthesized
gaaaatacggtgtccaaatt

SEQ ID NO: 96392 - DNA, 20 bp, Artificial Sequence
  chemically synthesized
aattgcatcccatctcaatt

SEQ ID NO: 96393 - DNA, 20 bp, Artificial Sequence
  chemically synthesized
atacggtgtccaaattgaga

SEQ ID NO: 96394 - DNA, 20 bp, Artificial Sequence
  chemically synthesized
tacggtgtccaaattgagat

SEQ ID NO: 96395 - DNA, 20 bp, Artificial Sequence
  chemically synthesized
ttgagatgggatgcaattga

SEQ ID NO: 96396 - DNA, 20 bp, Artificial Sequence
  chemically synthesized
tgcaattgaaagacacatgc

SEQ ID NO: 96397 - DNA, 20 bp, Artificial Sequence
  chemically synthesized
aagacacatgccagatttca

SEQ ID NO: 96398 - DNA, 20 bp, Artificial Sequence
  chemically synthesized
cattctaagtctttgaaatc

SEQ ID NO: 96399 - DNA, 20 bp, Artificial Sequence
  chemically synthesized
catgccagatttcaaagact

SEQ ID NO: 96400 - DNA, 20 bp, Artificial Sequence
  chemically synthesized
cagatttcaaagacttagaa

SEQ ID NO: 96401 - DNA, 20 bp, Artificial Sequence
  chemically synthesized
aaatttgctttttccattct

SEQ ID NO: 96402 - DNA, 20 bp, Artificial Sequence
  chemically synthesized
tcaaagacttagaatggaaa

SEQ ID NO: 96403 - DNA, 20 bp, Artificial Sequence
  chemically synthesized
ttcaatatgtaatcaataaa

SEQ ID NO: 96404 - DNA, 20 bp, Artificial Sequence
  chemically synthesized
atattgaaataataatatgt

SEQ ID NO: 96405 - DNA, 20 bp, Artificial Sequence
  chemically synthesized
taataatatgttggatatat

SEQ ID NO: 96406 - DNA, 20 bp, Artificial Sequence
  chemically synthesized
aataatatgttggatatatc

SEQ ID NO: 96407 - DNA, 20 bp, Artificial Sequence
  chemically synthesized
ataatatgttggatatatca

SEQ ID NO: 96408 - DNA, 20 bp, Artificial Sequence
  chemically synthesized
tatcagggtcaataaaatat

SEQ ID NO: 96409 - DNA, 20 bp, Artificial Sequence
  chemically synthesized
gccacgttctttaaaagtag

SEQ ID NO: 96410 - DNA, 20 bp, Artificial Sequence
  chemically synthesized
tagtttcacttctactttta

SEQ ID NO: 96411 - DNA, 20 bp, Artificial Sequence
  chemically synthesized
gtagccacgttctttaaaag

SEQ ID NO: 96412 - DNA, 20 bp, Artificial Sequence
  chemically synthesized
ctagtagccacgttctttaa

SEQ ID NO: 96413 - DNA, 20 bp, Artificial Sequence
  chemically synthesized
acttctacttttaaagaacg

SEQ ID NO: 96414 - DNA, 20 bp, Artificial Sequence
  chemically synthesized
cttttaaagaacgtggctac

SEQ ID NO: 96415 - DNA, 20 bp, Artificial Sequence
  chemically synthesized
tgtaatcttaagtattctag

SEQ ID NO: 96416 - DNA, 20 bp, Artificial Sequence
  chemically synthesized
ctatgtaatcttaagtattc

SEQ ID NO: 96417 - DNA, 20 bp, Artificial Sequence
  chemically synthesized
acgtggctactagaatactt

SEQ ID NO: 96418 - DNA, 20 bp, Artificial Sequence
  chemically synthesized
agagccacctatgtaatctt

SEQ ID NO: 96419 - DNA, 20 bp, Artificial Sequence
  chemically synthesized
ctagaatacttaagattaca

SEQ ID NO: 96420 - DNA, 20 bp, Artificial Sequence
  chemically synthesized
tagaatacttaagattacat

SEQ ID NO: 96421 - DNA, 20 bp, Artificial Sequence
  chemically synthesized
aatacttaagattacatagg

SEQ ID NO: 96422 - DNA, 20 bp, Artificial Sequence
  chemically synthesized
gtgttgtcccatagaaatga

SEQ ID NO: 96423 - DNA, 20 bp, Artificial Sequence
  chemically synthesized
ataggtggctctcatttcta

SEQ ID NO: 96424 - DNA, 20 bp, Artificial Sequence
  chemically synthesized
cagtgttgtcccatagaaat

SEQ ID NO: 96425 - DNA, 20 bp, Artificial Sequence
  chemically synthesized
taggtggctctcatttctat

SEQ ID NO: 96426 - DNA, 20 bp, Artificial Sequence
  chemically synthesized
tccagaacagtgttgtccca

SEQ ID NO: 96427 - DNA, 20 bp, Artificial Sequence
  chemically synthesized
tctatgggacaacactgttc

SEQ ID NO: 96428 - DNA, 20 bp, Artificial Sequence
  chemically synthesized
tgccagcacaatgtccagaa

SEQ ID NO: 96429 - DNA, 20 bp, Artificial Sequence
  chemically synthesized
cccaatgccagcacaatgtc

SEQ ID NO: 96430 - DNA, 20 bp, Artificial Sequence
  chemically synthesized
cactgttctggacattgtgc

SEQ ID NO: 96431 - DNA, 20 bp, Artificial Sequence
  chemically synthesized
tctggacattgtgctggcat

SEQ ID NO: 96432 - DNA, 20 bp, Artificial Sequence
  chemically synthesized
ctggacattgtgctggcatt

SEQ ID NO: 96433 - DNA, 20 bp, Artificial Sequence
  chemically synthesized
tagttttatgttcccaatgc

SEQ ID NO: 96434 - DNA, 20 bp, Artificial Sequence
  chemically synthesized
aaaatccttaagggaatgtt

SEQ ID NO: 96435 - DNA, 20 bp, Artificial Sequence
  chemically synthesized
ataaaactaaacattccctt

SEQ ID NO: 96436 - DNA, 20 bp, Artificial Sequence
  chemically synthesized
taaaactaaacattccctta

SEQ ID NO: 96437 - DNA, 20 bp, Artificial Sequence
  chemically synthesized
ccattccgtaaaatccttaa

SEQ ID NO: 96438 - DNA, 20 bp, Artificial Sequence
  chemically synthesized
accattccgtaaaatcctta

SEQ ID NO: 96439 - DNA, 20 bp, Artificial Sequence
  chemically synthesized
caccattccgtaaaatcctt

SEQ ID NO: 96440 - DNA, 20 bp, Artificial Sequence
  chemically synthesized
acattcccttaaggatttta

SEQ ID NO: 96441 - DNA, 20 bp, Artificial Sequence
  chemically synthesized
cccttaaggattttacggaa

SEQ ID NO: 96442 - DNA, 20 bp, Artificial Sequence
  chemically synthesized
ttaaggattttacggaatgg

SEQ ID NO: 96443 - DNA, 20 bp, Artificial Sequence
  chemically synthesized
tggtggtacatttactgcta

SEQ ID NO: 96444 - DNA, 20 bp, Artificial Sequence
  chemically synthesized
tggtacatttactgctatag

SEQ ID NO: 96445 - DNA, 20 bp, Artificial Sequence
  chemically synthesized
tctatatctctctgctatag

SEQ ID NO: 96446 - DNA, 20 bp, Artificial Sequence
  chemically synthesized
gtacatttactgctatagca

SEQ ID NO: 96447 - DNA, 20 bp, Artificial Sequence
  chemically synthesized
acatttactgctatagcaga

SEQ ID NO: 96448 - DNA, 20 bp, Artificial Sequence
  chemically synthesized
tcctctatatctctctgcta

SEQ ID NO: 96449 - DNA, 20 bp, Artificial Sequence
  chemically synthesized
actgctatagcagagagata

SEQ ID NO: 96450 - DNA, 20 bp, Artificial Sequence
  chemically synthesized
tgctatagcagagagatata

SEQ ID NO: 96451 - DNA, 20 bp, Artificial Sequence
  chemically synthesized
gctatagcagagagatatag

SEQ ID NO: 96452 - DNA, 20 bp, Artificial Sequence
  chemically synthesized
gagagatatagaggaatgca

SEQ ID NO: 96453 - DNA, 20 bp, Artificial Sequence
  chemically synthesized
agagatatagaggaatgcaa

SEQ ID NO: 96454 - DNA, 20 bp, Artificial Sequence
  chemically synthesized
gaggaatgcaaaggacgcta

SEQ ID NO: 96455 - DNA, 20 bp, Artificial Sequence
  chemically synthesized
aggaatgcaaaggacgctat

SEQ ID NO: 96456 - DNA, 20 bp, Artificial Sequence
  chemically synthesized
ggaatgcaaaggacgctatg

SEQ ID NO: 96457 - DNA, 20 bp, Artificial Sequence
  chemically synthesized
gctactcatctatgtcccca

SEQ ID NO: 96458 - DNA, 20 bp, Artificial Sequence
  chemically synthesized
caaaggacgctatggggaca

SEQ ID NO: 96459 - DNA, 20 bp, Artificial Sequence
  chemically synthesized
gacgctatggggacatagat

SEQ ID NO: 96460 - DNA, 20 bp, Artificial Sequence
  chemically synthesized
gctatggggacatagatgag

SEQ ID NO: 96461 - DNA, 20 bp, Artificial Sequence
  chemically synthesized
tagatgagtagcaattaaat

SEQ ID NO: 96462 - DNA, 20 bp, Artificial Sequence
  chemically synthesized
agatgagtagcaattaaatt

SEQ ID NO: 96463 - DNA, 20 bp, Artificial Sequence
  chemically synthesized
taggtagccatggttgacat

SEQ ID NO: 96464 - DNA, 20 bp, Artificial Sequence
  chemically synthesized
aattaggctgatgtcaacca

SEQ ID NO: 96465 - DNA, 20 bp, Artificial Sequence
  chemically synthesized
tgccttattttaggtagcca

SEQ ID NO: 96466 - DNA, 20 bp, Artificial Sequence
  chemically synthesized
taagcatgccttattttagg

SEQ ID NO: 96467 - DNA, 20 bp, Artificial Sequence
  chemically synthesized
caaccatggctacctaaaat

SEQ ID NO: 96468 - DNA, 20 bp, Artificial Sequence
  chemically synthesized
aaccatggctacctaaaata

SEQ ID NO: 96469 - DNA, 20 bp, Artificial Sequence
  chemically synthesized
atttaagcatgccttatttt

SEQ ID NO: 96470 - DNA, 20 bp, Artificial Sequence
  chemically synthesized
aatttaagcatgccttattt

SEQ ID NO: 96471 - DNA, 20 bp, Artificial Sequence
  chemically synthesized
caaactttaaggatcaattt

SEQ ID NO: 96472 - DNA, 20 bp, Artificial Sequence
  chemically synthesized
catgcttaaattgatcctta

SEQ ID NO: 96473 - DNA, 20 bp, Artificial Sequence
  chemically synthesized
taacttccactcaaacttta

SEQ ID NO: 96474 - DNA, 20 bp, Artificial Sequence
  chemically synthesized
taaattgatccttaaagttt

SEQ ID NO: 96475 - DNA, 20 bp, Artificial Sequence
  chemically synthesized
ctaacttccactcaaacttt

SEQ ID NO: 96476 - DNA, 20 bp, Artificial Sequence
  chemically synthesized
attgatccttaaagtttgag

SEQ ID NO: 96477 - DNA, 20 bp, Artificial Sequence
  chemically synthesized
gatccttaaagtttgagtgg

SEQ ID NO: 96478 - DNA, 20 bp, Artificial Sequence
  chemically synthesized
cttaaagtttgagtggaagt

SEQ ID NO: 96479 - DNA, 20 bp, Artificial Sequence
  chemically synthesized
gtttgagtggaagttagatg

SEQ ID NO: 96480 - DNA, 20 bp, Artificial Sequence
  chemically synthesized
gagtggaagttagatgaaga

SEQ ID NO: 96481 - DNA, 20 bp, Artificial Sequence
  chemically synthesized
aagttagatgaagaaagacg

SEQ ID NO: 96482 - DNA, 20 bp, Artificial Sequence
  chemically synthesized
agttagatgaagaaagacga

SEQ ID NO: 96483 - DNA, 20 bp, Artificial Sequence
  chemically synthesized
gttagatgaagaaagacgaa

SEQ ID NO: 96484 - DNA, 20 bp, Artificial Sequence
  chemically synthesized
aagaaagacgaagggtattc

SEQ ID NO: 96485 - DNA, 20 bp, Artificial Sequence
  chemically synthesized
agaaagacgaagggtattcc

SEQ ID NO: 96486 - DNA, 20 bp, Artificial Sequence
  chemically synthesized
aagacgaagggtattccagg

SEQ ID NO: 96487 - DNA, 20 bp, Artificial Sequence
  chemically synthesized
cgaagggtattccaggaaga

SEQ ID NO: 96488 - DNA, 20 bp, Artificial Sequence
  chemically synthesized
tacatgccattccgtcttcc

SEQ ID NO: 96489 - DNA, 20 bp, Artificial Sequence
  chemically synthesized
ggtattccaggaagacggaa

SEQ ID NO: 96490 - DNA, 20 bp, Artificial Sequence
  chemically synthesized
aatggcatgtacgataacat

SEQ ID NO: 96491 - DNA, 20 bp, Artificial Sequence
  chemically synthesized
atggcatgtacgataacatt

SEQ ID NO: 96492 - DNA, 20 bp, Artificial Sequence
  chemically synthesized
ggcatgtacgataacattgg

SEQ ID NO: 96493 - DNA, 20 bp, Artificial Sequence
  chemically synthesized
atgtacgataacattgggag

SEQ ID NO: 96494 - DNA, 20 bp, Artificial Sequence
  chemically synthesized
tacgataacattgggagaag

SEQ ID NO: 96495 - DNA, 20 bp, Artificial Sequence
  chemically synthesized
ttgggagaagtagtacaata

SEQ ID NO: 96496 - DNA, 20 bp, Artificial Sequence
  chemically synthesized
agtagtacaatacagtgatt

SEQ ID NO: 96497 - DNA, 20 bp, Artificial Sequence
  chemically synthesized
caatacagtgattaagaatc

SEQ ID NO: 96498 - DNA, 20 bp, Artificial Sequence
  chemically synthesized
gactcaaagggtagaggttc

SEQ ID NO: 96499 - DNA, 20 bp, Artificial Sequence
  chemically synthesized
gcatatgactcaaagggtag

SEQ ID NO: 96500 - DNA, 20 bp, Artificial Sequence
  chemically synthesized
tgcatatgactcaaagggta

SEQ ID NO: 96501 - DNA, 20 bp, Artificial Sequence
  chemically synthesized
atctagaacctctacccttt

SEQ ID NO: 96502 - DNA, 20 bp, Artificial Sequence
  chemically synthesized
agtgcatatgactcaaaggg

SEQ ID NO: 96503 - DNA, 20 bp, Artificial Sequence
  chemically synthesized
ttgagtgcatatgactcaaa

SEQ ID NO: 96504 - DNA, 20 bp, Artificial Sequence
  chemically synthesized
cttgagtgcatatgactcaa

SEQ ID NO: 96505 - DNA, 20 bp, Artificial Sequence
  chemically synthesized
gcttgagtgcatatgactca

SEQ ID NO: 96506 - DNA, 20 bp, Artificial Sequence
  chemically synthesized
cctttgagtcatatgcactc

SEQ ID NO: 96507 - DNA, 20 bp, Artificial Sequence
  chemically synthesized
gatagtaagtggtacagctt

SEQ ID NO: 96508 - DNA, 20 bp, Artificial Sequence
  chemically synthesized
ctcacagatagtaagtggta

SEQ ID NO: 96509 - DNA, 20 bp, Artificial Sequence
  chemically synthesized
atgatctcacagatagtaag

SEQ ID NO: 96510 - DNA, 20 bp, Artificial Sequence
  chemically synthesized
catatgatctcacagatagt

SEQ ID NO: 96511 - DNA, 20 bp, Artificial Sequence
  chemically synthesized
ctgtaccacttactatctgt

SEQ ID NO: 96512 - DNA, 20 bp, Artificial Sequence
  chemically synthesized
tttacatatgatctcacaga

SEQ ID NO: 96513 - DNA, 20 bp, Artificial Sequence
  chemically synthesized
gtaatttacatatgatctca

SEQ ID NO: 96514 - DNA, 20 bp, Artificial Sequence
  chemically synthesized
agaaggaaagagatacagat

SEQ ID NO: 96515 - DNA, 20 bp, Artificial Sequence
  chemically synthesized
cacagagaaggaaagagata

SEQ ID NO: 96516 - DNA, 20 bp, Artificial Sequence
  chemically synthesized
ctatttcacagagaaggaaa

SEQ ID NO: 96517 - DNA, 20 bp, Artificial Sequence
  chemically synthesized
ccctatttcacagagaagga

SEQ ID NO: 96518 - DNA, 20 bp, Artificial Sequence
  chemically synthesized
gtatccctatttcacagaga

SEQ ID NO: 96519 - DNA, 20 bp, Artificial Sequence
  chemically synthesized
agtatccctatttcacagag

SEQ ID NO: 96520 - DNA, 20 bp, Artificial Sequence
  chemically synthesized
ctctttccttctctgtgaaa

SEQ ID NO: 96521 - DNA, 20 bp, Artificial Sequence
  chemically synthesized
agtagtatccctatttcaca

SEQ ID NO: 96522 - DNA, 20 bp, Artificial Sequence
  chemically synthesized
tctttccttctctgtgaaat

SEQ ID NO: 96523 - DNA, 20 bp, Artificial Sequence
  chemically synthesized
ctttccttctctgtgaaata

SEQ ID NO: 96524 - DNA, 20 bp, Artificial Sequence
  chemically synthesized
gtagtagtatccctatttca

SEQ ID NO: 96525 - DNA, 20 bp, Artificial Sequence
  chemically synthesized
ctttataaggttgacagtag

SEQ ID NO: 96526 - DNA, 20 bp, Artificial Sequence
  chemically synthesized
taactttataaggttgacag

SEQ ID NO: 96527 - DNA, 20 bp, Artificial Sequence
  chemically synthesized
cgataactttataaggttga

SEQ ID NO: 96528 - DNA, 20 bp, Artificial Sequence
  chemically synthesized
ctactactgtcaaccttata

SEQ ID NO: 96529 - DNA, 20 bp, Artificial Sequence
  chemically synthesized
tttcttacgataactttata

SEQ ID NO: 96530 - DNA, 20 bp, Artificial Sequence
  chemically synthesized
atttcttacgataactttat

SEQ ID NO: 96531 - DNA, 20 bp, Artificial Sequence
  chemically synthesized
caaccttataaagttatcgt

SEQ ID NO: 96532 - DNA, 20 bp, Artificial Sequence
  chemically synthesized
agttatcgtaagaaatgcat

SEQ ID NO: 96533 - DNA, 20 bp, Artificial Sequence
  chemically synthesized
gcatgagttaatatactgct

SEQ ID NO: 96534 - DNA, 20 bp, Artificial Sequence
  chemically synthesized
ggaccagacacagttctgag

SEQ ID NO: 96535 - DNA, 20 bp, Artificial Sequence
  chemically synthesized
tgtggaccagacacagttct

SEQ ID NO: 96536 - DNA, 20 bp, Artificial Sequence
  chemically synthesized
atactgctcagaactgtgtc

SEQ ID NO: 96537 - DNA, 20 bp, Artificial Sequence
  chemically synthesized
aatacaatgtggaccagaca

SEQ ID NO: 96538 - DNA, 20 bp, Artificial Sequence
  chemically synthesized
gcaggaaatacaatgtggac

SEQ ID NO: 96539 - DNA, 20 bp, Artificial Sequence
  chemically synthesized
taatagcaggaaatacaatg

SEQ ID NO: 96540 - DNA, 20 bp, Artificial Sequence
  chemically synthesized
ttctaattcacaataatagc

SEQ ID NO: 96541 - DNA, 20 bp, Artificial Sequence
  chemically synthesized
tttctaattcacaataatag

SEQ ID NO: 96542 - DNA, 20 bp, Artificial Sequence
  chemically synthesized
tattttctaattcacaataa

SEQ ID NO: 96543 - DNA, 20 bp, Artificial Sequence
  chemically synthesized
ttcctgctattattgtgaat

SEQ ID NO: 96544 - DNA, 20 bp, Artificial Sequence
  chemically synthesized
tgaattagaaaatactccca

SEQ ID NO: 96545 - DNA, 20 bp, Artificial Sequence
  chemically synthesized
gaattagaaaatactcccac

SEQ ID NO: 96546 - DNA, 20 bp, Artificial Sequence
  chemically synthesized
ccctttactccaacctgtgg

SEQ ID NO: 96547 - DNA, 20 bp, Artificial Sequence
  chemically synthesized
tagaaaatactcccacaggt

SEQ ID NO: 96548 - DNA, 20 bp, Artificial Sequence
  chemically synthesized
ttccctttactccaacctgt

SEQ ID NO: 96549 - DNA, 20 bp, Artificial Sequence
  chemically synthesized
gaaaatactcccacaggttg

SEQ ID NO: 96550 - DNA, 20 bp, Artificial Sequence
  chemically synthesized
attccctttactccaacctg

SEQ ID NO: 96551 - DNA, 20 bp, Artificial Sequence
  chemically synthesized
tactcccacaggttggagta

SEQ ID NO: 96552 - DNA, 20 bp, Artificial Sequence
  chemically synthesized
actcccacaggttggagtaa

SEQ ID NO: 96553 - DNA, 20 bp, Artificial Sequence
  chemically synthesized
ctcccacaggttggagtaaa

SEQ ID NO: 96554 - DNA, 20 bp, Artificial Sequence
  chemically synthesized
aaagggaatactgtctgtga

SEQ ID NO: 96555 - DNA, 20 bp, Artificial Sequence
  chemically synthesized
ttccctgacactttcacaga

SEQ ID NO: 96556 - DNA, 20 bp, Artificial Sequence
  chemically synthesized
catcttccctgacactttca

SEQ ID NO: 96557 - DNA, 20 bp, Artificial Sequence
  chemically synthesized
aatactgtctgtgaaagtgt

SEQ ID NO: 96558 - DNA, 20 bp, Artificial Sequence
  chemically synthesized
atactgtctgtgaaagtgtc

SEQ ID NO: 96559 - DNA, 20 bp, Artificial Sequence
  chemically synthesized
tactgtctgtgaaagtgtca

SEQ ID NO: 96560 - DNA, 20 bp, Artificial Sequence
  chemically synthesized
tgtctgtgaaagtgtcaggg

SEQ ID NO: 96561 - DNA, 20 bp, Artificial Sequence
  chemically synthesized
tgtgaaagtgtcagggaaga

SEQ ID NO: 96562 - DNA, 20 bp, Artificial Sequence
  chemically synthesized
gtgaaagtgtcagggaagat

SEQ ID NO: 96563 - DNA, 20 bp, Artificial Sequence
  chemically synthesized
tgaaagtgtcagggaagatg

SEQ ID NO: 96564 - DNA, 20 bp, Artificial Sequence
  chemically synthesized
tgtcagggaagatggggcta

SEQ ID NO: 96565 - DNA, 20 bp, Artificial Sequence
  chemically synthesized
tcagggaagatggggctaca

SEQ ID NO: 96566 - DNA, 20 bp, Artificial Sequence
  chemically synthesized
cagggaagatggggctacag

SEQ ID NO: 96567 - DNA, 20 bp, Artificial Sequence
  chemically synthesized
atgatgcctggtcacctctg

SEQ ID NO: 96568 - DNA, 20 bp, Artificial Sequence
  chemically synthesized
gatggggctacagaggtgac

SEQ ID NO: 96569 - DNA, 20 bp, Artificial Sequence
  chemically synthesized
atggggctacagaggtgacc

SEQ ID NO: 96570 - DNA, 20 bp, Artificial Sequence
  chemically synthesized
tctggtgaatgcatgatgcc

SEQ ID NO: 96571 - DNA, 20 bp, Artificial Sequence
  chemically synthesized
accaggcatcatgcattcac

SEQ ID NO: 96572 - DNA, 20 bp, Artificial Sequence
  chemically synthesized
caggcatcatgcattcacca

SEQ ID NO: 96573 - DNA, 20 bp, Artificial Sequence
  chemically synthesized
gcatcatgcattcaccagag

SEQ ID NO: 96574 - DNA, 20 bp, Artificial Sequence
  chemically synthesized
gataaaaggtcaaactgctc

SEQ ID NO: 96575 - DNA, 20 bp, Artificial Sequence
  chemically synthesized
ctcacagcttgaaggataaa

SEQ ID NO: 96576 - DNA, 20 bp, Artificial Sequence
  chemically synthesized
tctcacagcttgaaggataa

SEQ ID NO: 96577 - DNA, 20 bp, Artificial Sequence
  chemically synthesized
agtttgaccttttatccttc

SEQ ID NO: 96578 - DNA, 20 bp, Artificial Sequence
  chemically synthesized
ctaatcctctcacagcttga

SEQ ID NO: 96579 - DNA, 20 bp, Artificial Sequence
  chemically synthesized
actaatcctctcacagcttg

SEQ ID NO: 96580 - DNA, 20 bp, Artificial Sequence
  chemically synthesized
ccttttatccttcaagctgt

SEQ ID NO: 96581 - DNA, 20 bp, Artificial Sequence
  chemically synthesized
ttttatccttcaagctgtga

SEQ ID NO: 96582 - DNA, 20 bp, Artificial Sequence
  chemically synthesized
tttatccttcaagctgtgag

SEQ ID NO: 96583 - DNA, 20 bp, Artificial Sequence
  chemically synthesized
agatgtgactaatcctctca

SEQ ID NO: 96584 - DNA, 20 bp, Artificial Sequence
  chemically synthesized
ccttcaagctgtgagaggat

SEQ ID NO: 96585 - DNA, 20 bp, Artificial Sequence
  chemically synthesized
tatgcctggaatatgttttc

SEQ ID NO: 96586 - DNA, 20 bp, Artificial Sequence
  chemically synthesized
cacatcttgaaaacatattc

SEQ ID NO: 96587 - DNA, 20 bp, Artificial Sequence
  chemically synthesized
acatcttgaaaacatattcc

SEQ ID NO: 96588 - DNA, 20 bp, Artificial Sequence
  chemically synthesized
tgaaaacatattccaggcat

SEQ ID NO: 96589 - DNA, 20 bp, Artificial Sequence
  chemically synthesized
aaaacatattccaggcataa

SEQ ID NO: 96590 - DNA, 20 bp, Artificial Sequence
  chemically synthesized
tgctctgctactcttatgcc

SEQ ID NO: 96591 - DNA, 20 bp, Artificial Sequence
  chemically synthesized
acatattccaggcataagag

SEQ ID NO: 96592 - DNA, 20 bp, Artificial Sequence
  chemically synthesized
tattccaggcataagagtag

SEQ ID NO: 96593 - DNA, 20 bp, Artificial Sequence
  chemically synthesized
ttccaggcataagagtagca

SEQ ID NO: 96594 - DNA, 20 bp, Artificial Sequence
  chemically synthesized
cataagagtagcagagcatt

SEQ ID NO: 96595 - DNA, 20 bp, Artificial Sequence
  chemically synthesized
agagtagcagagcatttaga

SEQ ID NO: 96596 - DNA, 20 bp, Artificial Sequence
  chemically synthesized
cagagcatttagatggatct

SEQ ID NO: 96597 - DNA, 20 bp, Artificial Sequence
  chemically synthesized
agagcatttagatggatcta

SEQ ID NO: 96598 - DNA, 20 bp, Artificial Sequence
  chemically synthesized
tttagatggatctaaggcaa

SEQ ID NO: 96599 - DNA, 20 bp, Artificial Sequence
  chemically synthesized
ttatctcttatctattgcct

SEQ ID NO: 96600 - DNA, 20 bp, Artificial Sequence
  chemically synthesized
atggatctaaggcaatagat

SEQ ID NO: 96601 - DNA, 20 bp, Artificial Sequence
  chemically synthesized
ggatctaaggcaatagataa

SEQ ID NO: 96602 - DNA, 20 bp, Artificial Sequence
  chemically synthesized
taaggcaatagataagagat

SEQ ID NO: 96603 - DNA, 20 bp, Artificial Sequence
  chemically synthesized
aggcaatagataagagataa

SEQ ID NO: 96604 - DNA, 20 bp, Artificial Sequence
  chemically synthesized
ggcaatagataagagataag

SEQ ID NO: 96605 - DNA, 20 bp, Artificial Sequence
  chemically synthesized
taagagataagaggccaatg

SEQ ID NO: 96606 - DNA, 20 bp, Artificial Sequence
  chemically synthesized
agataagaggccaatgcagc

SEQ ID NO: 96607 - DNA, 20 bp, Artificial Sequence
  chemically synthesized
gctcaactagcttgctgcat

SEQ ID NO: 96608 - DNA, 20 bp, Artificial Sequence
  chemically synthesized
aagaggccaatgcagcaagc

SEQ ID NO: 96609 - DNA, 20 bp, Artificial Sequence
  chemically synthesized
gccaatgcagcaagctagtt

SEQ ID NO: 96610 - DNA, 20 bp, Artificial Sequence
  chemically synthesized
aatgcagcaagctagttgag

SEQ ID NO: 96611 - DNA, 20 bp, Artificial Sequence
  chemically synthesized
gccccgcagcactgctcaac

SEQ ID NO: 96612 - DNA, 20 bp, Artificial Sequence
  chemically synthesized
aagctagttgagcagtgctg

SEQ ID NO: 96613 - DNA, 20 bp, Artificial Sequence
  chemically synthesized
agctagttgagcagtgctgc

SEQ ID NO: 96614 - DNA, 20 bp, Artificial Sequence
  chemically synthesized
gctagttgagcagtgctgcg

SEQ ID NO: 96615 - DNA, 20 bp, Artificial Sequence
  chemically synthesized
ctctattcgcagtggccccg

SEQ ID NO: 96616 - DNA, 20 bp, Artificial Sequence
  chemically synthesized
tgctgcggggccactgcgaa

SEQ ID NO: 96617 - DNA, 20 bp, Artificial Sequence
  chemically synthesized
gccctgccctctattcgcag

SEQ ID NO: 96618 - DNA, 20 bp, Artificial Sequence
  chemically synthesized
ctgcggggccactgcgaata

SEQ ID NO: 96619 - DNA, 20 bp, Artificial Sequence
  chemically synthesized
tgcggggccactgcgaatag

SEQ ID NO: 96620 - DNA, 20 bp, Artificial Sequence
  chemically synthesized
catgccctgccctctattcg

SEQ ID NO: 96621 - DNA, 20 bp, Artificial Sequence
  chemically synthesized
gcggggccactgcgaataga

SEQ ID NO: 96622 - DNA, 20 bp, Artificial Sequence
  chemically synthesized
gggccactgcgaatagaggg

SEQ ID NO: 96623 - DNA, 20 bp, Artificial Sequence
  chemically synthesized
ggccactgcgaatagagggc

SEQ ID NO: 96624 - DNA, 20 bp, Artificial Sequence
  chemically synthesized
gccactgcgaatagagggca

SEQ ID NO: 96625 - DNA, 20 bp, Artificial Sequence
  chemically synthesized
atagagggcagggcatgaat

SEQ ID NO: 96626 - DNA, 20 bp, Artificial Sequence
  chemically synthesized
tagagggcagggcatgaata

SEQ ID NO: 96627 - DNA, 20 bp, Artificial Sequence
  chemically synthesized
agggcagggcatgaataagg

SEQ ID NO: 96628 - DNA, 20 bp, Artificial Sequence
  chemically synthesized
gggcatgaataaggtggata

SEQ ID NO: 96629 - DNA, 20 bp, Artificial Sequence
  chemically synthesized
agaaaggtttcaagagcatt

SEQ ID NO: 96630 - DNA, 20 bp, Artificial Sequence
  chemically synthesized
gaagcagagaaaggtttcaa

SEQ ID NO: 96631 - DNA, 20 bp, Artificial Sequence
  chemically synthesized
aagaagcagagaaaggtttc

SEQ ID NO: 96632 - DNA, 20 bp, Artificial Sequence
  chemically synthesized
acctaaaaagaagcagagaa

SEQ ID NO: 96633 - DNA, 20 bp, Artificial Sequence
  chemically synthesized
tacctaaaaagaagcagaga

SEQ ID NO: 96634 - DNA, 20 bp, Artificial Sequence
  chemically synthesized
tagatacctaaaaagaagca

SEQ ID NO: 96635 - DNA, 20 bp, Artificial Sequence
  chemically synthesized
gctagatacctaaaaagaag

SEQ ID NO: 96636 - DNA, 20 bp, Artificial Sequence
  chemically synthesized
aacctttctctgcttctttt

SEQ ID NO: 96637 - DNA, 20 bp, Artificial Sequence
  chemically synthesized
acctttctctgcttcttttt

SEQ ID NO: 96638 - DNA, 20 bp, Artificial Sequence
  chemically synthesized
ctagctagatacctaaaaag

SEQ ID NO: 96639 - DNA, 20 bp, Artificial Sequence
  chemically synthesized
agtctagctagatacctaaa

SEQ ID NO: 96640 - DNA, 20 bp, Artificial Sequence
  chemically synthesized
tctgcttctttttaggtatc

SEQ ID NO: 96641 - DNA, 20 bp, Artificial Sequence
  chemically synthesized
cttctttttaggtatctagc

SEQ ID NO: 96642 - DNA, 20 bp, Artificial Sequence
  chemically synthesized
gctggaaaatgaagtctagc

SEQ ID NO: 96643 - DNA, 20 bp, Artificial Sequence
  chemically synthesized
aggggctggaaaatgaagtc

SEQ ID NO: 96644 - DNA, 20 bp, Artificial Sequence
  chemically synthesized
tctagctagacttcattttc

SEQ ID NO: 96645 - DNA, 20 bp, Artificial Sequence
  chemically synthesized
agcagaggggctggaaaatg

SEQ ID NO: 96646 - DNA, 20 bp, Artificial Sequence
  chemically synthesized
acatgtaacagcagaggggc

SEQ ID NO: 96647 - DNA, 20 bp, Artificial Sequence
  chemically synthesized
ggccacatgtaacagcagag

SEQ ID NO: 96648 - DNA, 20 bp, Artificial Sequence
  chemically synthesized
tggccacatgtaacagcaga

SEQ ID NO: 96649 - DNA, 20 bp, Artificial Sequence
  chemically synthesized
gtggccacatgtaacagcag

SEQ ID NO: 96650 - DNA, 20 bp, Artificial Sequence
  chemically synthesized
tgtggccacatgtaacagca

SEQ ID NO: 96651 - DNA, 20 bp, Artificial Sequence
  chemically synthesized
cctgtggccacatgtaacag

SEQ ID NO: 96652 - DNA, 20 bp, Artificial Sequence
  chemically synthesized
agcccctctgctgttacatg

SEQ ID NO: 96653 - DNA, 20 bp, Artificial Sequence
  chemically synthesized
tgccctgtggccacatgtaa

SEQ ID NO: 96654 - DNA, 20 bp, Artificial Sequence
  chemically synthesized
tctgctgttacatgtggcca

SEQ ID NO: 96655 - DNA, 20 bp, Artificial Sequence
  chemically synthesized
ctgctgttacatgtggccac

SEQ ID NO: 96656 - DNA, 20 bp, Artificial Sequence
  chemically synthesized
tgctgttacatgtggccaca

SEQ ID NO: 96657 - DNA, 20 bp, Artificial Sequence
  chemically synthesized
tgttacatgtggccacaggg

SEQ ID NO: 96658 - DNA, 20 bp, Artificial Sequence
  chemically synthesized
ttacatgtggccacagggca

SEQ ID NO: 96659 - DNA, 20 bp, Artificial Sequence
  chemically synthesized
ctggctagaactctgccctg

SEQ ID NO: 96660 - DNA, 20 bp, Artificial Sequence
  chemically synthesized
gtggccacagggcagagttc

SEQ ID NO: 96661 - DNA, 20 bp, Artificial Sequence
  chemically synthesized
ccacagggcagagttctagc

SEQ ID NO: 96662 - DNA, 20 bp, Artificial Sequence
  chemically synthesized
cagggcagagttctagccag

SEQ ID NO: 96663 - DNA, 20 bp, Artificial Sequence
  chemically synthesized
tgactcaaccttctactggc

SEQ ID NO: 96664 - DNA, 20 bp, Artificial Sequence
  chemically synthesized
ggcagagttctagccagtag

SEQ ID NO: 96665 - DNA, 20 bp, Artificial Sequence
  chemically synthesized
gcagagttctagccagtaga

SEQ ID NO: 96666 - DNA, 20 bp, Artificial Sequence
  chemically synthesized
cctttgactcaaccttctac

SEQ ID NO: 96667 - DNA, 20 bp, Artificial Sequence
  chemically synthesized
gttctagccagtagaaggtt

SEQ ID NO: 96668 - DNA, 20 bp, Artificial Sequence
  chemically synthesized
gccagtagaaggttgagtca

SEQ ID NO: 96669 - DNA, 20 bp, Artificial Sequence
  chemically synthesized
ccagtagaaggttgagtcaa

SEQ ID NO: 96670 - DNA, 20 bp, Artificial Sequence
  chemically synthesized
gaaggttgagtcaaaggaca

SEQ ID NO: 96671 - DNA, 20 bp, Artificial Sequence
  chemically synthesized
aaggttgagtcaaaggacat

SEQ ID NO: 96672 - DNA, 20 bp, Artificial Sequence
  chemically synthesized
acatgggacgcctccgtgtg

SEQ ID NO: 96673 - DNA, 20 bp, Artificial Sequence
  chemically synthesized
agctagaggactgcacacgg

SEQ ID NO: 96674 - DNA, 20 bp, Artificial Sequence
  chemically synthesized
gagctagaggactgcacacg

SEQ ID NO: 96675 - DNA, 20 bp, Artificial Sequence
  chemically synthesized
atgagctagaggactgcaca

SEQ ID NO: 96676 - DNA, 20 bp, Artificial Sequence
  chemically synthesized
cgcctccgtgtgcagtcctc

SEQ ID NO: 96677 - DNA, 20 bp, Artificial Sequence
  chemically synthesized
cccaaaggggaatgagctag

SEQ ID NO: 96678 - DNA, 20 bp, Artificial Sequence
  chemically synthesized
gcccaaaggggaatgagcta

SEQ ID NO: 96679 - DNA, 20 bp, Artificial Sequence
  chemically synthesized
cagcccaaaggggaatgagc

SEQ ID NO: 96680 - DNA, 20 bp, Artificial Sequence
  chemically synthesized
cagccagcccaaaggggaat

SEQ ID NO: 96681 - DNA, 20 bp, Artificial Sequence
  chemically synthesized
tcctctagctcattcccctt

SEQ ID NO: 96682 - DNA, 20 bp, Artificial Sequence
  chemically synthesized
cctctagctcattccccttt

SEQ ID NO: 96683 - DNA, 20 bp, Artificial Sequence
  chemically synthesized
gatattcagccagcccaaag

SEQ ID NO: 96684 - DNA, 20 bp, Artificial Sequence
  chemically synthesized
tagctcattcccctttgggc

SEQ ID NO: 96685 - DNA, 20 bp, Artificial Sequence
  chemically synthesized
agatattcagccagcccaaa

SEQ ID NO: 96686 - DNA, 20 bp, Artificial Sequence
  chemically synthesized
aagatattcagccagcccaa

SEQ ID NO: 96687 - DNA, 20 bp, Artificial Sequence
  chemically synthesized
gaagatattcagccagccca

SEQ ID NO: 96688 - DNA, 20 bp, Artificial Sequence
  chemically synthesized
ccctcctgaagatattcagc

SEQ ID NO: 96689 - DNA, 20 bp, Artificial Sequence
  chemically synthesized
gttgccctcctgaagatatt

SEQ ID NO: 96690 - DNA, 20 bp, Artificial Sequence
  chemically synthesized
ttgggctggctgaatatctt

SEQ ID NO: 96691 - DNA, 20 bp, Artificial Sequence
  chemically synthesized
tgggctggctgaatatcttc

SEQ ID NO: 96692 - DNA, 20 bp, Artificial Sequence
  chemically synthesized
ggctggctgaatatcttcag

SEQ ID NO: 96693 - DNA, 20 bp, Artificial Sequence
  chemically synthesized
gctggctgaatatcttcagg

SEQ ID NO: 96694 - DNA, 20 bp, Artificial Sequence
  chemically synthesized
ctggctgaatatcttcagga

SEQ ID NO: 96695 - DNA, 20 bp, Artificial Sequence
  chemically synthesized
ttgccgaggttgccctcctg

SEQ ID NO: 96696 - DNA, 20 bp, Artificial Sequence
  chemically synthesized
tatcttcaggagggcaacct

SEQ ID NO: 96697 - DNA, 20 bp, Artificial Sequence
  chemically synthesized
aggagggcaacctcggcaat

SEQ ID NO: 96698 - DNA, 20 bp, Artificial Sequence
  chemically synthesized
tctgcaatagccaattgccg

SEQ ID NO: 96699 - DNA, 20 bp, Artificial Sequence
  chemically synthesized
atctgcaatagccaattgcc

SEQ ID NO: 96700 - DNA, 20 bp, Artificial Sequence
  chemically synthesized
acctcggcaattggctattg

SEQ ID NO: 96701 - DNA, 20 bp, Artificial Sequence
  chemically synthesized
cggcaattggctattgcaga

SEQ ID NO: 96702 - DNA, 20 bp, Artificial Sequence
  chemically synthesized
caagggtcttccatctgcaa

SEQ ID NO: 96703 - DNA, 20 bp, Artificial Sequence
  chemically synthesized
caattggctattgcagatgg

SEQ ID NO: 96704 - DNA, 20 bp, Artificial Sequence
  chemically synthesized
tgcagatggaagacccttgc

SEQ ID NO: 96705 - DNA, 20 bp, Artificial Sequence
  chemically synthesized
aaaaaaaaacaggccagcaa

SEQ ID NO: 96706 - DNA, 20 bp, Artificial Sequence
  chemically synthesized
aaaaaaaaaacaggccagca

SEQ ID NO: 96707 - DNA, 20 bp, Artificial Sequence
  chemically synthesized
taaaaaaaaaacaggccagc

SEQ ID NO: 96708 - DNA, 20 bp, Artificial Sequence
  chemically synthesized
aaattaaaaaaaaaacaggc

SEQ ID NO: 96709 - DNA, 20 bp, Artificial Sequence
  chemically synthesized
aaataaattaaaaaaaaaac

SEQ ID NO: 96710 - DNA, 20 bp, Artificial Sequence
  chemically synthesized
aaaataaattaaaaaaaaaa

SEQ ID NO: 96711 - DNA, 20 bp, Artificial Sequence
  chemically synthesized
ttattttattttattttttt

SEQ ID NO: 96712 - DNA, 20 bp, Artificial Sequence
  chemically synthesized
tttattttattttttttaga

SEQ ID NO: 96713 - DNA, 20 bp, Artificial Sequence
  chemically synthesized
tattttattttttttagata

SEQ ID NO: 96714 - DNA, 20 bp, Artificial Sequence
  chemically synthesized
ctccagcctggcgacagagc

SEQ ID NO: 96715 - DNA, 20 bp, Artificial Sequence
  chemically synthesized
atagagtcttgctctgtcgc

SEQ ID NO: 96716 - DNA, 20 bp, Artificial Sequence
  chemically synthesized
tagagtcttgctctgtcgcc

SEQ ID NO: 96717 - DNA, 20 bp, Artificial Sequence
  chemically synthesized
tgcactccagcctggcgaca

SEQ ID NO: 96718 - DNA, 20 bp, Artificial Sequence
  chemically synthesized
actgcactccagcctggcga

SEQ ID NO: 96719 - DNA, 20 bp, Artificial Sequence
  chemically synthesized
gtcttgctctgtcgccaggc

SEQ ID NO: 96720 - DNA, 20 bp, Artificial Sequence
  chemically synthesized
cttgctctgtcgccaggctg

SEQ ID NO: 96721 - DNA, 20 bp, Artificial Sequence
  chemically synthesized
catgccactgcactccagcc

SEQ ID NO: 96722 - DNA, 20 bp, Artificial Sequence
  chemically synthesized
tctgtcgccaggctggagtg

SEQ ID NO: 96723 - DNA, 20 bp, Artificial Sequence
  chemically synthesized
aagatcatgccactgcactc

SEQ ID NO: 96724 - DNA, 20 bp, Artificial Sequence
  chemically synthesized
gtcgccaggctggagtgcag

SEQ ID NO: 96725 - DNA, 20 bp, Artificial Sequence
  chemically synthesized
ggcggaggttgcagtgagac

SEQ ID NO: 96726 - DNA, 20 bp, Artificial Sequence
  chemically synthesized
cgggaggcggaggttgcagt

SEQ ID NO: 96727 - DNA, 20 bp, Artificial Sequence
  chemically synthesized
aagccgggaggcggaggttg

SEQ ID NO: 96728 - DNA, 20 bp, Artificial Sequence
  chemically synthesized
cacttgaagccgggaggcgg

SEQ ID NO: 96729 - DNA, 20 bp, Artificial Sequence
  chemically synthesized
tcactgcaacctccgcctcc

SEQ ID NO: 96730 - DNA, 20 bp, Artificial Sequence
  chemically synthesized
tcacttgaagccgggaggcg

SEQ ID NO: 96731 - DNA, 20 bp, Artificial Sequence
  chemically synthesized
aatcacttgaagccgggagg

SEQ ID NO: 96732 - DNA, 20 bp, Artificial Sequence
  chemically synthesized
gagaatcacttgaagccggg

SEQ ID NO: 96733 - DNA, 20 bp, Artificial Sequence
  chemically synthesized
ggagaatcacttgaagccgg

SEQ ID NO: 96734 - DNA, 20 bp, Artificial Sequence
  chemically synthesized
aacctccgcctcccggcttc

SEQ ID NO: 96735 - DNA, 20 bp, Artificial Sequence
  chemically synthesized
caggagaatcacttgaagcc

SEQ ID NO: 96736 - DNA, 20 bp, Artificial Sequence
  chemically synthesized
gcaggagaatcacttgaagc

SEQ ID NO: 96737 - DNA, 20 bp, Artificial Sequence
  chemically synthesized
tgaagcaggagaatcacttg

SEQ ID NO: 96738 - DNA, 20 bp, Artificial Sequence
  chemically synthesized
ttcaagtgattctcctgctt

SEQ ID NO: 96739 - DNA, 20 bp, Artificial Sequence
  chemically synthesized
tacttgggaggctgaagcag

SEQ ID NO: 96740 - DNA, 20 bp, Artificial Sequence
  chemically synthesized
gctacttgggaggctgaagc

SEQ ID NO: 96741 - DNA, 20 bp, Artificial Sequence
  chemically synthesized
agctacttgggaggctgaag

SEQ ID NO: 96742 - DNA, 20 bp, Artificial Sequence
  chemically synthesized
cccagctacttgggaggctg

SEQ ID NO: 96743 - DNA, 20 bp, Artificial Sequence
  chemically synthesized
ttctcctgcttcagcctccc

SEQ ID NO: 96744 - DNA, 20 bp, Artificial Sequence
  chemically synthesized
tcctgcttcagcctcccaag

SEQ ID NO: 96745 - DNA, 20 bp, Artificial Sequence
  chemically synthesized
tgtaatcccagctacttggg

SEQ ID NO: 96746 - DNA, 20 bp, Artificial Sequence
  chemically synthesized
ctgtaatcccagctacttgg

SEQ ID NO: 96747 - DNA, 20 bp, Artificial Sequence
  chemically synthesized
gcttcagcctcccaagtagc

SEQ ID NO: 96748 - DNA, 20 bp, Artificial Sequence
  chemically synthesized
acctgtaatcccagctactt

SEQ ID NO: 96749 - DNA, 20 bp, Artificial Sequence
  chemically synthesized
cttcagcctcccaagtagct

SEQ ID NO: 96750 - DNA, 20 bp, Artificial Sequence
  chemically synthesized
cacctgtaatcccagctact

SEQ ID NO: 96751 - DNA, 20 bp, Artificial Sequence
  chemically synthesized
ctcccaagtagctgggatta

SEQ ID NO: 96752 - DNA, 20 bp, Artificial Sequence
  chemically synthesized
tcccaagtagctgggattac

SEQ ID NO: 96753 - DNA, 20 bp, Artificial Sequence
  chemically synthesized
gtggtgggcacctgtaatcc

SEQ ID NO: 96754 - DNA, 20 bp, Artificial Sequence
  chemically synthesized
aaatagctaggagtggtggt

SEQ ID NO: 96755 - DNA, 20 bp, Artificial Sequence
  chemically synthesized
aaaatagctaggagtggtgg

SEQ ID NO: 96756 - DNA, 20 bp, Artificial Sequence
  chemically synthesized
caggtgcccaccaccactcc

SEQ ID NO: 96757 - DNA, 20 bp, Artificial Sequence
  chemically synthesized
caaaaaatagctaggagtgg

SEQ ID NO: 96758 - DNA, 20 bp, Artificial Sequence
  chemically synthesized
atacaaaaaatagctaggag

SEQ ID NO: 96759 - DNA, 20 bp, Artificial Sequence
  chemically synthesized
aaaatacaaaaaatagctag

SEQ ID NO: 96760 - DNA, 20 bp, Artificial Sequence
  chemically synthesized
taaaaatacaaaaaatagct

SEQ ID NO: 96761 - DNA, 20 bp, Artificial Sequence
  chemically synthesized
ctaaaaatacaaaaaatagc

SEQ ID NO: 96762 - DNA, 20 bp, Artificial Sequence
  chemically synthesized
tctactaaaaatacaaaaaa

SEQ ID NO: 96763 - DNA, 20 bp, Artificial Sequence
  chemically synthesized
ctagctattttttgtatttt

SEQ ID NO: 96764 - DNA, 20 bp, Artificial Sequence
  chemically synthesized
gctattttttgtatttttag

SEQ ID NO: 96765 - DNA, 20 bp, Artificial Sequence
  chemically synthesized
tattttttgtatttttagta

SEQ ID NO: 96766 - DNA, 20 bp, Artificial Sequence
  chemically synthesized
ttttgtatttttagtagaga

SEQ ID NO: 96767 - DNA, 20 bp, Artificial Sequence
  chemically synthesized
tttgtatttttagtagagat

SEQ ID NO: 96768 - DNA, 20 bp, Artificial Sequence
  chemically synthesized
ttgtatttttagtagagatg

SEQ ID NO: 96769 - DNA, 20 bp, Artificial Sequence
  chemically synthesized
gagatggggtttcatcatgt

SEQ ID NO: 96770 - DNA, 20 bp, Artificial Sequence
  chemically synthesized
tggggtttcatcatgttggc

SEQ ID NO: 96771 - DNA, 20 bp, Artificial Sequence
  chemically synthesized
ggggtttcatcatgttggcc

SEQ ID NO: 96772 - DNA, 20 bp, Artificial Sequence
  chemically synthesized
tttcatcatgttggccagga

SEQ ID NO: 96773 - DNA, 20 bp, Artificial Sequence
  chemically synthesized
tcaggagctcgagaccatcc

SEQ ID NO: 96774 - DNA, 20 bp, Artificial Sequence
  chemically synthesized
atgttggccaggatggtctc

SEQ ID NO: 96775 - DNA, 20 bp, Artificial Sequence
  chemically synthesized
tcacctgaggtcaggagctc

SEQ ID NO: 96776 - DNA, 20 bp, Artificial Sequence
  chemically synthesized
tggtctcgagctcctgacct

SEQ ID NO: 96777 - DNA, 20 bp, Artificial Sequence
  chemically synthesized
ggcggatcacctgaggtcag

SEQ ID NO: 96778 - DNA, 20 bp, Artificial Sequence
  chemically synthesized
ggtctcgagctcctgacctc

SEQ ID NO: 96779 - DNA, 20 bp, Artificial Sequence
  chemically synthesized
tgggcggatcacctgaggtc

SEQ ID NO: 96780 - DNA, 20 bp, Artificial Sequence
  chemically synthesized
gtgggcggatcacctgaggt

SEQ ID NO: 96781 - DNA, 20 bp, Artificial Sequence
  chemically synthesized
caaggtgggcggatcacctg

SEQ ID NO: 96782 - DNA, 20 bp, Artificial Sequence
  chemically synthesized
ccaaggtgggcggatcacct

SEQ ID NO: 96783 - DNA, 20 bp, Artificial Sequence
  chemically synthesized
ctcaggtgatccgcccacct

SEQ ID NO: 96784 - DNA, 20 bp, Artificial Sequence
  chemically synthesized
ctttgggaggccaaggtggg

SEQ ID NO: 96785 - DNA, 20 bp, Artificial Sequence
  chemically synthesized
gcactttgggaggccaaggt

SEQ ID NO: 96786 - DNA, 20 bp, Artificial Sequence
  chemically synthesized
agcactttgggaggccaagg

SEQ ID NO: 96787 - DNA, 20 bp, Artificial Sequence
  chemically synthesized
cccagcactttgggaggcca

SEQ ID NO: 96788 - DNA, 20 bp, Artificial Sequence
  chemically synthesized
tcccagcactttgggaggcc

SEQ ID NO: 96789 - DNA, 20 bp, Artificial Sequence
  chemically synthesized
ccgcccaccttggcctccca

SEQ ID NO: 96790 - DNA, 20 bp, Artificial Sequence
  chemically synthesized
tgtaatcccagcactttggg

SEQ ID NO: 96791 - DNA, 20 bp, Artificial Sequence
  chemically synthesized
ctgtaatcccagcactttgg

SEQ ID NO: 96792 - DNA, 20 bp, Artificial Sequence
  chemically synthesized
accttggcctcccaaagtgc

SEQ ID NO: 96793 - DNA, 20 bp, Artificial Sequence
  chemically synthesized
acctgtaatcccagcacttt

SEQ ID NO: 96794 - DNA, 20 bp, Artificial Sequence
  chemically synthesized
ccttggcctcccaaagtgct

SEQ ID NO: 96795 - DNA, 20 bp, Artificial Sequence
  chemically synthesized
cacctgtaatcccagcactt

SEQ ID NO: 96796 - DNA, 20 bp, Artificial Sequence
  chemically synthesized
ctcccaaagtgctgggatta

SEQ ID NO: 96797 - DNA, 20 bp, Artificial Sequence
  chemically synthesized
tcccaaagtgctgggattac

SEQ ID NO: 96798 - DNA, 20 bp, Artificial Sequence
  chemically synthesized
gtggctcacacctgtaatcc

SEQ ID NO: 96799 - DNA, 20 bp, Artificial Sequence
  chemically synthesized
agtgctgggattacaggtgt

SEQ ID NO: 96800 - DNA, 20 bp, Artificial Sequence
  chemically synthesized
caggtgtgagccactgcacc

SEQ ID NO: 96801 - DNA, 20 bp, Artificial Sequence
  chemically synthesized
acaggccaggccaggtgcag

SEQ ID NO: 96802 - DNA, 20 bp, Artificial Sequence
  chemically synthesized
aatacaggccaggccaggtg

SEQ ID NO: 96803 - DNA, 20 bp, Artificial Sequence
  chemically synthesized
gtgagccactgcacctggcc

SEQ ID NO: 96804 - DNA, 20 bp, Artificial Sequence
  chemically synthesized
tcaagaatacaggccaggcc

SEQ ID NO: 96805 - DNA, 20 bp, Artificial Sequence
  chemically synthesized
ttcaagaatacaggccaggc

SEQ ID NO: 96806 - DNA, 20 bp, Artificial Sequence
  chemically synthesized
attattcaagaatacaggcc

SEQ ID NO: 96807 - DNA, 20 bp, Artificial Sequence
  chemically synthesized
aattattcaagaatacaggc

SEQ ID NO: 96808 - DNA, 20 bp, Artificial Sequence
  chemically synthesized
acataattattcaagaatac

SEQ ID NO: 96809 - DNA, 20 bp, Artificial Sequence
  chemically synthesized
cacataattattcaagaata

SEQ ID NO: 96810 - DNA, 20 bp, Artificial Sequence
  chemically synthesized
tgacacccacataattattc

SEQ ID NO: 96811 - DNA, 20 bp, Artificial Sequence
  chemically synthesized
tgtattcttgaataattatg

SEQ ID NO: 96812 - DNA, 20 bp, Artificial Sequence
  chemically synthesized
gtattcttgaataattatgt

SEQ ID NO: 96813 - DNA, 20 bp, Artificial Sequence
  chemically synthesized
atgtgtgtgtgggaagggag

SEQ ID NO: 96814 - DNA, 20 bp, Artificial Sequence
  chemically synthesized
gatgtgtgtgtgggaaggga

SEQ ID NO: 96815 - DNA, 20 bp, Artificial Sequence
  chemically synthesized
ggatgtgtgtgtgggaaggg

SEQ ID NO: 96816 - DNA, 20 bp, Artificial Sequence
  chemically synthesized
tggatgtgtgtgtgggaagg

SEQ ID NO: 96817 - DNA, 20 bp, Artificial Sequence
  chemically synthesized
gttggatgtgtgtgtgggaa

SEQ ID NO: 96818 - DNA, 20 bp, Artificial Sequence
  chemically synthesized
tgttggatgtgtgtgtggga

SEQ ID NO: 96819 - DNA, 20 bp, Artificial Sequence
  chemically synthesized
gtgttggatgtgtgtgtggg

SEQ ID NO: 96820 - DNA, 20 bp, Artificial Sequence
  chemically synthesized
ttggtgttggatgtgtgtgt

SEQ ID NO: 96821 - DNA, 20 bp, Artificial Sequence
  chemically synthesized
gttggtgttggatgtgtgtg

SEQ ID NO: 96822 - DNA, 20 bp, Artificial Sequence
  chemically synthesized
gaattcatgttagttggtgt

SEQ ID NO: 96823 - DNA, 20 bp, Artificial Sequence
  chemically synthesized
taaggtgaattcatgttagt

SEQ ID NO: 96824 - DNA, 20 bp, Artificial Sequence
  chemically synthesized
agtctaaggtgaattcatgt

SEQ ID NO: 96825 - DNA, 20 bp, Artificial Sequence
  chemically synthesized
caactaacatgaattcacct

SEQ ID NO: 96826 - DNA, 20 bp, Artificial Sequence
  chemically synthesized
tttctcatgtaaacagtcta

SEQ ID NO: 96827 - DNA, 20 bp, Artificial Sequence
  chemically synthesized
ctttctcatgtaaacagtct

SEQ ID NO: 96828 - DNA, 20 bp, Artificial Sequence
  chemically synthesized
tcaccttagactgtttacat

SEQ ID NO: 96829 - DNA, 20 bp, Artificial Sequence
  chemically synthesized
gtatttctttctcatgtaaa

SEQ ID NO: 96830 - DNA, 20 bp, Artificial Sequence
  chemically synthesized
cttagactgtttacatgaga

SEQ ID NO: 96831 - DNA, 20 bp, Artificial Sequence
  chemically synthesized
ttaaaatgacttaaacaaaa

SEQ ID NO: 96832 - DNA, 20 bp, Artificial Sequence
  chemically synthesized
aatacatttctattttgttt

SEQ ID NO: 96833 - DNA, 20 bp, Artificial Sequence
  chemically synthesized
ttttgtttaagtcattttaa

SEQ ID NO: 96834 - DNA, 20 bp, Artificial Sequence
  chemically synthesized
agtcattttaatagtccatt

SEQ ID NO: 96835 - DNA, 20 bp, Artificial Sequence
  chemically synthesized
cattttaatagtccatttgg

SEQ ID NO: 96836 - DNA, 20 bp, Artificial Sequence
  chemically synthesized
tatattaaacatccaccaaa

SEQ ID NO: 96837 - DNA, 20 bp, Artificial Sequence
  chemically synthesized
ggtggatgtttaatatatta

SEQ ID NO: 96838 - DNA, 20 bp, Artificial Sequence
  chemically synthesized
gtttaatatattatagctgt

SEQ ID NO: 96839 - DNA, 20 bp, Artificial Sequence
  chemically synthesized
taatagctaagataggctaa

SEQ ID NO: 96840 - DNA, 20 bp, Artificial Sequence
  chemically synthesized
ttatagctgttagcctatct

SEQ ID NO: 96841 - DNA, 20 bp, Artificial Sequence
  chemically synthesized
atatctataatagctaagat

SEQ ID NO: 96842 - DNA, 20 bp, Artificial Sequence
  chemically synthesized
catatctataatagctaaga

SEQ ID NO: 96843 - DNA, 20 bp, Artificial Sequence
  chemically synthesized
gtttcatatctataatagct

SEQ ID NO: 96844 - DNA, 20 bp, Artificial Sequence
  chemically synthesized
ttagcctatcttagctatta

SEQ ID NO: 96845 - DNA, 20 bp, Artificial Sequence
  chemically synthesized
agtatgtttcatatctataa

SEQ ID NO: 96846 - DNA, 20 bp, Artificial Sequence
  chemically synthesized
atagatatgaaacatactta

SEQ ID NO: 96847 - DNA, 20 bp, Artificial Sequence
  chemically synthesized
agatatgaaacatacttaaa

SEQ ID NO: 96848 - DNA, 20 bp, Artificial Sequence
  chemically synthesized
aaaaatgcttttagctcttt

SEQ ID NO: 96849 - DNA, 20 bp, Artificial Sequence
  chemically synthesized
aaacatacttaaagagctaa

SEQ ID NO: 96850 - DNA, 20 bp, Artificial Sequence
  chemically synthesized
tttcctcgtaaaaatgcttt

SEQ ID NO: 96851 - DNA, 20 bp, Artificial Sequence
  chemically synthesized
agagctaaaagcatttttac

SEQ ID NO: 96852 - DNA, 20 bp, Artificial Sequence
  chemically synthesized
gagctaaaagcatttttacg

SEQ ID NO: 96853 - DNA, 20 bp, Artificial Sequence
  chemically synthesized
agcatttttacgaggaaaaa

SEQ ID NO: 96854 - DNA, 20 bp, Artificial Sequence
  chemically synthesized
aggaaaaaaagacttgatga

SEQ ID NO: 96855 - DNA, 20 bp, Artificial Sequence
  chemically synthesized
ctcatatcttatctgtcatc

SEQ ID NO: 96856 - DNA, 20 bp, Artificial Sequence
  chemically synthesized
aaaaagacttgatgacagat

SEQ ID NO: 96857 - DNA, 20 bp, Artificial Sequence
  chemically synthesized
cttgatgacagataagatat

SEQ ID NO: 96858 - DNA, 20 bp, Artificial Sequence
  chemically synthesized
tgatgacagataagatatga

SEQ ID NO: 96859 - DNA, 20 bp, Artificial Sequence
  chemically synthesized
gataagatatgagagtgatg

SEQ ID NO: 96860 - DNA, 20 bp, Artificial Sequence
  chemically synthesized
agatatgagagtgatgaaga

SEQ ID NO: 96861 - DNA, 20 bp, Artificial Sequence
  chemically synthesized
gccctgctactcaaagaatt

SEQ ID NO: 96862 - DNA, 20 bp, Artificial Sequence
  chemically synthesized
aagttgtcactaaattcttt

SEQ ID NO: 96863 - DNA, 20 bp, Artificial Sequence
  chemically synthesized
ttgtcactaaattctttgag

SEQ ID NO: 96864 - DNA, 20 bp, Artificial Sequence
  chemically synthesized
tcactaaattctttgagtag

SEQ ID NO: 96865 - DNA, 20 bp, Artificial Sequence
  chemically synthesized
acttgaggccctgctactca

SEQ ID NO: 96866 - DNA, 20 bp, Artificial Sequence
  chemically synthesized
cactaaattctttgagtagc

SEQ ID NO: 96867 - DNA, 20 bp, Artificial Sequence
  chemically synthesized
actaaattctttgagtagca

SEQ ID NO: 96868 - DNA, 20 bp, Artificial Sequence
  chemically synthesized
tctttgagtagcagggcctc

SEQ ID NO: 96869 - DNA, 20 bp, Artificial Sequence
  chemically synthesized
tgcactcaagataacacttg

SEQ ID NO: 96870 - DNA, 20 bp, Artificial Sequence
  chemically synthesized
ttgcactcaagataacactt

SEQ ID NO: 96871 - DNA, 20 bp, Artificial Sequence
  chemically synthesized
agggcctcaagtgttatctt

SEQ ID NO: 96872 - DNA, 20 bp, Artificial Sequence
  chemically synthesized
cactgtttatatttgcactc

SEQ ID NO: 96873 - DNA, 20 bp, Artificial Sequence
  chemically synthesized
atcttgagtgcaaatataaa

SEQ ID NO: 96874 - DNA, 20 bp, Artificial Sequence
  chemically synthesized
aatataaacagtgaaccgat

SEQ ID NO: 96875 - DNA, 20 bp, Artificial Sequence
  chemically synthesized
ttcaccaagaacatacttat

SEQ ID NO: 96876 - DNA, 20 bp, Artificial Sequence
  chemically synthesized
tgaaccgataagtatgttct

SEQ ID NO: 96877 - DNA, 20 bp, Artificial Sequence
  chemically synthesized
tttactttggcgagttcacc

SEQ ID NO: 96878 - DNA, 20 bp, Artificial Sequence
  chemically synthesized
tgttcttggtgaactcgcca

SEQ ID NO: 96879 - DNA, 20 bp, Artificial Sequence
  chemically synthesized
ggctgaaaatttactttggc

SEQ ID NO: 96880 - DNA, 20 bp, Artificial Sequence
  chemically synthesized
tgctggctgaaaatttactt

SEQ ID NO: 96881 - DNA, 20 bp, Artificial Sequence
  chemically synthesized
aactcgccaaagtaaatttt

SEQ ID NO: 96882 - DNA, 20 bp, Artificial Sequence
  chemically synthesized
cgccaaagtaaattttcagc

SEQ ID NO: 96883 - DNA, 20 bp, Artificial Sequence
  chemically synthesized
ttcttactgttgttcattgc

SEQ ID NO: 96884 - DNA, 20 bp, Artificial Sequence
  chemically synthesized
tttcagccagcaatgaacaa

SEQ ID NO: 96885 - DNA, 20 bp, Artificial Sequence
  chemically synthesized
agccagcaatgaacaacagt

SEQ ID NO: 96886 - DNA, 20 bp, Artificial Sequence
  chemically synthesized
cagcaatgaacaacagtaag

SEQ ID NO: 96887 - DNA, 20 bp, Artificial Sequence
  chemically synthesized
caatgaacaacagtaagaag

SEQ ID NO: 96888 - DNA, 20 bp, Artificial Sequence
  chemically synthesized
aatgaacaacagtaagaagt

SEQ ID NO: 96889 - DNA, 20 bp, Artificial Sequence
  chemically synthesized
aacagtaagaagtaggaatt

SEQ ID NO: 96890 - DNA, 20 bp, Artificial Sequence
  chemically synthesized
gtaagaagtaggaatttggt

SEQ ID NO: 96891 - DNA, 20 bp, Artificial Sequence
  chemically synthesized
taagaagtaggaatttggtg

SEQ ID NO: 96892 - DNA, 20 bp, Artificial Sequence
  chemically synthesized
gtaggaatttggtgaggtta

SEQ ID NO: 96893 - DNA, 20 bp, Artificial Sequence
  chemically synthesized
tttggtgaggttaaagaaat

SEQ ID NO: 96894 - DNA, 20 bp, Artificial Sequence
  chemically synthesized
ttggtgaggttaaagaaatc

SEQ ID NO: 96895 - DNA, 20 bp, Artificial Sequence
  chemically synthesized
tcttttctgctgaattgagg

SEQ ID NO: 96896 - DNA, 20 bp, Artificial Sequence
  chemically synthesized
atcaggtatcttcctcaatt

SEQ ID NO: 96897 - DNA, 20 bp, Artificial Sequence
  chemically synthesized
acctcttttctgctgaattg

SEQ ID NO: 96898 - DNA, 20 bp, Artificial Sequence
  chemically synthesized
aggtatcttcctcaattcag

SEQ ID NO: 96899 - DNA, 20 bp, Artificial Sequence
  chemically synthesized
gacctcttttctgctgaatt

SEQ ID NO: 96900 - DNA, 20 bp, Artificial Sequence
  chemically synthesized
tcttcctcaattcagcagaa

SEQ ID NO: 96901 - DNA, 20 bp, Artificial Sequence
  chemically synthesized
ttcctcaattcagcagaaaa

SEQ ID NO: 96902 - DNA, 20 bp, Artificial Sequence
  chemically synthesized
tcctcaattcagcagaaaag

SEQ ID NO: 96903 - DNA, 20 bp, Artificial Sequence
  chemically synthesized
aattcagcagaaaagaggtc

SEQ ID NO: 96904 - DNA, 20 bp, Artificial Sequence
  chemically synthesized
gaaaagaggtcaagtttcaa

SEQ ID NO: 96905 - DNA, 20 bp, Artificial Sequence
  chemically synthesized
ggtcaagtttcaaaagacat

SEQ ID NO: 96906 - DNA, 20 bp, Artificial Sequence
  chemically synthesized
gtcaagtttcaaaagacatt

SEQ ID NO: 96907 - DNA, 20 bp, Artificial Sequence
  chemically synthesized
aagtttcaaaagacattggg

SEQ ID NO: 96908 - DNA, 20 bp, Artificial Sequence
  chemically synthesized
tcaaaagacattgggaagtg

SEQ ID NO: 96909 - DNA, 20 bp, Artificial Sequence
  chemically synthesized
caaaagacattgggaagtgt

SEQ ID NO: 96910 - DNA, 20 bp, Artificial Sequence
  chemically synthesized
gggaagtgtgggtgaccctc

SEQ ID NO: 96911 - DNA, 20 bp, Artificial Sequence
  chemically synthesized
cttcttatctaaattcttga

SEQ ID NO: 96912 - DNA, 20 bp, Artificial Sequence
  chemically synthesized
tcttcttatctaaattcttg

SEQ ID NO: 96913 - DNA, 20 bp, Artificial Sequence
  chemically synthesized
gtgggtgaccctcaagaatt

SEQ ID NO: 96914 - DNA, 20 bp, Artificial Sequence
  chemically synthesized
ctcttcttatctaaattctt

SEQ ID NO: 96915 - DNA, 20 bp, Artificial Sequence
  chemically synthesized
tgaccctcaagaatttagat

SEQ ID NO: 96916 - DNA, 20 bp, Artificial Sequence
  chemically synthesized
ccctcaagaatttagataag

SEQ ID NO: 96917 - DNA, 20 bp, Artificial Sequence
  chemically synthesized
ctcaagaatttagataagaa

SEQ ID NO: 96918 - DNA, 20 bp, Artificial Sequence
  chemically synthesized
tcaagaatttagataagaag

SEQ ID NO: 96919 - DNA, 20 bp, Artificial Sequence
  chemically synthesized
gataagaagaggaaaactgt

SEQ ID NO: 96920 - DNA, 20 bp, Artificial Sequence
  chemically synthesized
taagaagaggaaaactgtca

SEQ ID NO: 96921 - DNA, 20 bp, Artificial Sequence
  chemically synthesized
ccttaaccaaatgactctga

SEQ ID NO: 96922 - DNA, 20 bp, Artificial Sequence
  chemically synthesized
ggaaaactgtcagagtcatt

SEQ ID NO: 96923 - DNA, 20 bp, Artificial Sequence
  chemically synthesized
actgtcagagtcatttggtt

SEQ ID NO: 96924 - DNA, 20 bp, Artificial Sequence
  chemically synthesized
ctgtcagagtcatttggtta

SEQ ID NO: 96925 - DNA, 20 bp, Artificial Sequence
  chemically synthesized
catttggttaaggtattgat

SEQ ID NO: 96926 - DNA, 20 bp, Artificial Sequence
  chemically synthesized
ttaaggtattgataagattc

SEQ ID NO: 96927 - DNA, 20 bp, Artificial Sequence
  chemically synthesized
ttgataagattcaagctatg

SEQ ID NO: 96928 - DNA, 20 bp, Artificial Sequence
  chemically synthesized
taagattcaagctatgcggc

SEQ ID NO: 96929 - DNA, 20 bp, Artificial Sequence
  chemically synthesized
aagattcaagctatgcggct

SEQ ID NO: 96930 - DNA, 20 bp, Artificial Sequence
  chemically synthesized
agccaccgcacccagccgca

SEQ ID NO: 96931 - DNA, 20 bp, Artificial Sequence
  chemically synthesized
tcaagctatgcggctgggtg

SEQ ID NO: 96932 - DNA, 20 bp, Artificial Sequence
  chemically synthesized
agctatgcggctgggtgcgg

SEQ ID NO: 96933 - DNA, 20 bp, Artificial Sequence
  chemically synthesized
aagtgctgagccaccgcacc

SEQ ID NO: 96934 - DNA, 20 bp, Artificial Sequence
  chemically synthesized
tgcggctgggtgcggtggct

SEQ ID NO: 96935 - DNA, 20 bp, Artificial Sequence
  chemically synthesized
ggtgcggtggctcagcactt

SEQ ID NO: 96936 - DNA, 20 bp, Artificial Sequence
  chemically synthesized
cttcggcctcccaaagtgct

SEQ ID NO: 96937 - DNA, 20 bp, Artificial Sequence
  chemically synthesized
gtgcggtggctcagcacttt

SEQ ID NO: 96938 - DNA, 20 bp, Artificial Sequence
  chemically synthesized
gcggtggctcagcactttgg

SEQ ID NO: 96939 - DNA, 20 bp, Artificial Sequence
  chemically synthesized
cggtggctcagcactttggg

SEQ ID NO: 96940 - DNA, 20 bp, Artificial Sequence
  chemically synthesized
ccgcccacttcggcctccca

SEQ ID NO: 96941 - DNA, 20 bp, Artificial Sequence
  chemically synthesized
ctcagcactttgggaggccg

SEQ ID NO: 96942 - DNA, 20 bp, Artificial Sequence
  chemically synthesized
agcactttgggaggccgaag

SEQ ID NO: 96943 - DNA, 20 bp, Artificial Sequence
  chemically synthesized
gcactttgggaggccgaagt

SEQ ID NO: 96944 - DNA, 20 bp, Artificial Sequence
  chemically synthesized
ctttgggaggccgaagtggg

SEQ ID NO: 96945 - DNA, 20 bp, Artificial Sequence
  chemically synthesized
acctcgtggtccgcccactt

SEQ ID NO: 96946 - DNA, 20 bp, Artificial Sequence
  chemically synthesized
ggccgaagtgggcggaccac

SEQ ID NO: 96947 - DNA, 20 bp, Artificial Sequence
  chemically synthesized
gccgaagtgggcggaccacg

SEQ ID NO: 96948 - DNA, 20 bp, Artificial Sequence
  chemically synthesized
aagtgggcggaccacgaggt

SEQ ID NO: 96949 - DNA, 20 bp, Artificial Sequence
  chemically synthesized
agtgggcggaccacgaggtc

SEQ ID NO: 96950 - DNA, 20 bp, Artificial Sequence
  chemically synthesized
gtcttgaactcctgacctcg

SEQ ID NO: 96951 - DNA, 20 bp, Artificial Sequence
  chemically synthesized
tgggcggaccacgaggtcag

SEQ ID NO: 96952 - DNA, 20 bp, Artificial Sequence
  chemically synthesized
gaccacgaggtcaggagttc

SEQ ID NO: 96953 - DNA, 20 bp, Artificial Sequence
  chemically synthesized
cgaggtcaggagttcaagac

SEQ ID NO: 96954 - DNA, 20 bp, Artificial Sequence
  chemically synthesized
tcaggagttcaagaccagtc

SEQ ID NO: 96955 - DNA, 20 bp, Artificial Sequence
  chemically synthesized
tttcaccatgttagccggac

SEQ ID NO: 96956 - DNA, 20 bp, Artificial Sequence
  chemically synthesized
caagaccagtccggctaaca

SEQ ID NO: 96957 - DNA, 20 bp, Artificial Sequence
  chemically synthesized
tggggtttcaccatgttagc

SEQ ID NO: 96958 - DNA, 20 bp, Artificial Sequence
  chemically synthesized
gagatggggtttcaccatgt

SEQ ID NO: 96959 - DNA, 20 bp, Artificial Sequence
  chemically synthesized
ttgtatctttagtagagatg

SEQ ID NO: 96960 - DNA, 20 bp, Artificial Sequence
  chemically synthesized
tttgtatctttagtagagat

SEQ ID NO: 96961 - DNA, 20 bp, Artificial Sequence
  chemically synthesized
ttttgtatctttagtagaga

SEQ ID NO: 96962 - DNA, 20 bp, Artificial Sequence
  chemically synthesized
gtgaaaccccatctctacta

SEQ ID NO: 96963 - DNA, 20 bp, Artificial Sequence
  chemically synthesized
aattttttgtatctttagta

SEQ ID NO: 96964 - DNA, 20 bp, Artificial Sequence
  chemically synthesized
caaattttttgtatctttag

SEQ ID NO: 96965 - DNA, 20 bp, Artificial Sequence
  chemically synthesized
tggcaaattttttgtatctt

SEQ ID NO: 96966 - DNA, 20 bp, Artificial Sequence
  chemically synthesized
taaagatacaaaaaatttgc

SEQ ID NO: 96967 - DNA, 20 bp, Artificial Sequence
  chemically synthesized
aaagatacaaaaaatttgcc

SEQ ID NO: 96968 - DNA, 20 bp, Artificial Sequence
  chemically synthesized
tacaaaaaatttgccaggca

SEQ ID NO: 96969 - DNA, 20 bp, Artificial Sequence
  chemically synthesized
aaaaaatttgccaggcatgg

SEQ ID NO: 96970 - DNA, 20 bp, Artificial Sequence
  chemically synthesized
caggcacatgccaccatgcc

SEQ ID NO: 96971 - DNA, 20 bp, Artificial Sequence
  chemically synthesized
gtggcatgtgcctgtaatcc

SEQ ID NO: 96972 - DNA, 20 bp, Artificial Sequence
  chemically synthesized
tcccgagtaactgggattac

SEQ ID NO: 96973 - DNA, 20 bp, Artificial Sequence
  chemically synthesized
ctcccgagtaactgggatta

SEQ ID NO: 96974 - DNA, 20 bp, Artificial Sequence
  chemically synthesized
tgcctgtaatcccagttact

SEQ ID NO: 96975 - DNA, 20 bp, Artificial Sequence
  chemically synthesized
cctcagcctcccgagtaact

SEQ ID NO: 96976 - DNA, 20 bp, Artificial Sequence
  chemically synthesized
gcctgtaatcccagttactc

SEQ ID NO: 96977 - DNA, 20 bp, Artificial Sequence
  chemically synthesized
gcctcagcctcccgagtaac

SEQ ID NO: 96978 - DNA, 20 bp, Artificial Sequence
  chemically synthesized
ctgtaatcccagttactcgg

SEQ ID NO: 96979 - DNA, 20 bp, Artificial Sequence
  chemically synthesized
tgtaatcccagttactcggg

SEQ ID NO: 96980 - DNA, 20 bp, Artificial Sequence
  chemically synthesized
ttctcctgcctcagcctccc

SEQ ID NO: 96981 - DNA, 20 bp, Artificial Sequence
  chemically synthesized
tcccagttactcgggaggct

SEQ ID NO: 96982 - DNA, 20 bp, Artificial Sequence
  chemically synthesized
cccagttactcgggaggctg

SEQ ID NO: 96983 - DNA, 20 bp, Artificial Sequence
  chemically synthesized
agttactcgggaggctgagg

SEQ ID NO: 96984 - DNA, 20 bp, Artificial Sequence
  chemically synthesized
gttactcgggaggctgaggc

SEQ ID NO: 96985 - DNA, 20 bp, Artificial Sequence
  chemically synthesized
tactcgggaggctgaggcag

SEQ ID NO: 96986 - DNA, 20 bp, Artificial Sequence
  chemically synthesized
ttcaagtgattctcctgcct

SEQ ID NO: 96987 - DNA, 20 bp, Artificial Sequence
  chemically synthesized
gcaggagaatcacttgaact

SEQ ID NO: 96988 - DNA, 20 bp, Artificial Sequence
  chemically synthesized
caggagaatcacttgaactt

SEQ ID NO: 96989 - DNA, 20 bp, Artificial Sequence
  chemically synthesized
aacctccacctcccaagttc

SEQ ID NO: 96990 - DNA, 20 bp, Artificial Sequence
  chemically synthesized
ggagaatcacttgaacttgg

SEQ ID NO: 96991 - DNA, 20 bp, Artificial Sequence
  chemically synthesized
gagaatcacttgaacttggg

SEQ ID NO: 96992 - DNA, 20 bp, Artificial Sequence
  chemically synthesized
aatcacttgaacttgggagg

SEQ ID NO: 96993 - DNA, 20 bp, Artificial Sequence
  chemically synthesized
cactacaacctccacctccc

SEQ ID NO: 96994 - DNA, 20 bp, Artificial Sequence
  chemically synthesized
tcacttgaacttgggaggtg

SEQ ID NO: 96995 - DNA, 20 bp, Artificial Sequence
  chemically synthesized
cacttgaacttgggaggtgg

SEQ ID NO: 96996 - DNA, 20 bp, Artificial Sequence
  chemically synthesized
aacttgggaggtggaggttg

SEQ ID NO: 96997 - DNA, 20 bp, Artificial Sequence
  chemically synthesized
tgggaggtggaggttgtagt

SEQ ID NO: 96998 - DNA, 20 bp, Artificial Sequence
  chemically synthesized
ggtggaggttgtagtgagcc

SEQ ID NO: 96999 - DNA, 20 bp, Artificial Sequence
  chemically synthesized
ggagtgcaatggcacaatct

SEQ ID NO: 97000 - DNA, 20 bp, Artificial Sequence
  chemically synthesized
taacccaggctggagtgcaa

SEQ ID NO: 97001 - DNA, 20 bp, Artificial Sequence
  chemically synthesized
gagattgtgccattgcactc

SEQ ID NO: 97002 - DNA, 20 bp, Artificial Sequence
  chemically synthesized
tgtgccattgcactccagcc

SEQ ID NO: 97003 - DNA, 20 bp, Artificial Sequence
  chemically synthesized
gtgccattgcactccagcct

SEQ ID NO: 97004 - DNA, 20 bp, Artificial Sequence
  chemically synthesized
tcaccctgtaacccaggctg

SEQ ID NO: 97005 - DNA, 20 bp, Artificial Sequence
  chemically synthesized
tctcaccctgtaacccaggc

SEQ ID NO: 97006 - DNA, 20 bp, Artificial Sequence
  chemically synthesized
ttgcactccagcctgggtta

SEQ ID NO: 97007 - DNA, 20 bp, Artificial Sequence
  chemically synthesized
tgcactccagcctgggttac

SEQ ID NO: 97008 - DNA, 20 bp, Artificial Sequence
  chemically synthesized
ggagtctcaccctgtaaccc

SEQ ID NO: 97009 - DNA, 20 bp, Artificial Sequence
  chemically synthesized
gcactccagcctgggttaca

SEQ ID NO: 97010 - DNA, 20 bp, Artificial Sequence
  chemically synthesized
cggagtctcaccctgtaacc

SEQ ID NO: 97011 - DNA, 20 bp, Artificial Sequence
  chemically synthesized
tccagcctgggttacagggt

SEQ ID NO: 97012 - DNA, 20 bp, Artificial Sequence
  chemically synthesized
ttttttttttttttgagacg

SEQ ID NO: 97013 - DNA, 20 bp, Artificial Sequence
  chemically synthesized
ttttttttttttttttgaga

SEQ ID NO: 97014 - DNA, 20 bp, Artificial Sequence
  chemically synthesized
cctttttttttttttttttt

SEQ ID NO: 97015 - DNA, 20 bp, Artificial Sequence
  chemically synthesized
tctcaaaaaaaaaaaaaaaa

SEQ ID NO: 97016 - DNA, 20 bp, Artificial Sequence
  chemically synthesized
ctcaaaaaaaaaaaaaaaaa

SEQ ID NO: 97017 - DNA, 20 bp, Artificial Sequence
  chemically synthesized
aaaaaaaaaaaaaaggattc

SEQ ID NO: 97018 - DNA, 20 bp, Artificial Sequence
  chemically synthesized
ccatattgtggattttggag

SEQ ID NO: 97019 - DNA, 20 bp, Artificial Sequence
  chemically synthesized
ctgccatattgtggattttg

SEQ ID NO: 97020 - DNA, 20 bp, Artificial Sequence
  chemically synthesized
agctgccatattgtggattt

SEQ ID NO: 97021 - DNA, 20 bp, Artificial Sequence
  chemically synthesized
ctactccaaaatccacaata

SEQ ID NO: 97022 - DNA, 20 bp, Artificial Sequence
  chemically synthesized
aataccaagctgccatattg

SEQ ID NO: 97023 - DNA, 20 bp, Artificial Sequence
  chemically synthesized
ctccaaaatccacaatatgg

SEQ ID NO: 97024 - DNA, 20 bp, Artificial Sequence
  chemically synthesized
aaatccacaatatggcagct

SEQ ID NO: 97025 - DNA, 20 bp, Artificial Sequence
  chemically synthesized
aatatggcagcttggtattt

SEQ ID NO: 97026 - DNA, 20 bp, Artificial Sequence
  chemically synthesized
ctgctgtcttctcaaatacc

SEQ ID NO: 97027 - DNA, 20 bp, Artificial Sequence
  chemically synthesized
atggcagcttggtatttgag

SEQ ID NO: 97028 - DNA, 20 bp, Artificial Sequence
  chemically synthesized
cagcttggtatttgagaaga

SEQ ID NO: 97029 - DNA, 20 bp, Artificial Sequence
  chemically synthesized
cttggtatttgagaagacag

SEQ ID NO: 97030 - DNA, 20 bp, Artificial Sequence
  chemically synthesized
ggtatttgagaagacagcag

SEQ ID NO: 97031 - DNA, 20 bp, Artificial Sequence
  chemically synthesized
atttgagaagacagcagaag

SEQ ID NO: 97032 - DNA, 20 bp, Artificial Sequence
  chemically synthesized
tttgagaagacagcagaagc

SEQ ID NO: 97033 - DNA, 20 bp, Artificial Sequence
  chemically synthesized
agaagacagcagaagcagga

SEQ ID NO: 97034 - DNA, 20 bp, Artificial Sequence
  chemically synthesized
aagggggaaggggaaggtga

SEQ ID NO: 97035 - DNA, 20 bp, Artificial Sequence
  chemically synthesized
agaagggggaaggggaaggt

SEQ ID NO: 97036 - DNA, 20 bp, Artificial Sequence
  chemically synthesized
ggggagaagggggaagggga

SEQ ID NO: 97037 - DNA, 20 bp, Artificial Sequence
  chemically synthesized
aggggagaagggggaagggg

SEQ ID NO: 97038 - DNA, 20 bp, Artificial Sequence
  chemically synthesized
ttcaggggagaagggggaag

SEQ ID NO: 97039 - DNA, 20 bp, Artificial Sequence
  chemically synthesized
cttcaggggagaagggggaa

SEQ ID NO: 97040 - DNA, 20 bp, Artificial Sequence
  chemically synthesized
gcttcaggggagaaggggga

SEQ ID NO: 97041 - DNA, 20 bp, Artificial Sequence
  chemically synthesized
tgcttcaggggagaaggggg

SEQ ID NO: 97042 - DNA, 20 bp, Artificial Sequence
  chemically synthesized
acctgcttcaggggagaagg

SEQ ID NO: 97043 - DNA, 20 bp, Artificial Sequence
  chemically synthesized
gacctgcttcaggggagaag

SEQ ID NO: 97044 - DNA, 20 bp, Artificial Sequence
  chemically synthesized
tgacctgcttcaggggagaa

SEQ ID NO: 97045 - DNA, 20 bp, Artificial Sequence
  chemically synthesized
atgacctgcttcaggggaga

SEQ ID NO: 97046 - DNA, 20 bp, Artificial Sequence
  chemically synthesized
catgacctgcttcaggggag

SEQ ID NO: 97047 - DNA, 20 bp, Artificial Sequence
  chemically synthesized
cccttcccccttctcccctg

SEQ ID NO: 97048 - DNA, 20 bp, Artificial Sequence
  chemically synthesized
tctcatgacctgcttcaggg

SEQ ID NO: 97049 - DNA, 20 bp, Artificial Sequence
  chemically synthesized
ttcccccttctcccctgaag

SEQ ID NO: 97050 - DNA, 20 bp, Artificial Sequence
  chemically synthesized
tcccccttctcccctgaagc

SEQ ID NO: 97051 - DNA, 20 bp, Artificial Sequence
  chemically synthesized
agtctcatgacctgcttcag

SEQ ID NO: 97052 - DNA, 20 bp, Artificial Sequence
  chemically synthesized
tagtctcatgacctgcttca

SEQ ID NO: 97053 - DNA, 20 bp, Artificial Sequence
  chemically synthesized
atagtctcatgacctgcttc

SEQ ID NO: 97054 - DNA, 20 bp, Artificial Sequence
  chemically synthesized
gatagtctcatgacctgctt

SEQ ID NO: 97055 - DNA, 20 bp, Artificial Sequence
  chemically synthesized
tctcccctgaagcaggtcat

SEQ ID NO: 97056 - DNA, 20 bp, Artificial Sequence
  chemically synthesized
aggtcatgagactatcatac

SEQ ID NO: 97057 - DNA, 20 bp, Artificial Sequence
  chemically synthesized
taagggcacctctggtatga

SEQ ID NO: 97058 - DNA, 20 bp, Artificial Sequence
  chemically synthesized
gtcatgagactatcatacca

SEQ ID NO: 97059 - DNA, 20 bp, Artificial Sequence
  chemically synthesized
tcatgagactatcataccag

SEQ ID NO: 97060 - DNA, 20 bp, Artificial Sequence
  chemically synthesized
cagtatagtaagggcacctc

SEQ ID NO: 97061 - DNA, 20 bp, Artificial Sequence
  chemically synthesized
ctttccttccagtatagtaa

SEQ ID NO: 97062 - DNA, 20 bp, Artificial Sequence
  chemically synthesized
cctttccttccagtatagta

SEQ ID NO: 97063 - DNA, 20 bp, Artificial Sequence
  chemically synthesized
cagaggtgcccttactatac

SEQ ID NO: 97064 - DNA, 20 bp, Artificial Sequence
  chemically synthesized
tcctttccttccagtatagt

SEQ ID NO: 97065 - DNA, 20 bp, Artificial Sequence
  chemically synthesized
aggtgcccttactatactgg

SEQ ID NO: 97066 - DNA, 20 bp, Artificial Sequence
  chemically synthesized
ggtgcccttactatactgga

SEQ ID NO: 97067 - DNA, 20 bp, Artificial Sequence
  chemically synthesized
attttcctttccttccagta

SEQ ID NO: 97068 - DNA, 20 bp, Artificial Sequence
  chemically synthesized
cccttactatactggaagga

SEQ ID NO: 97069 - DNA, 20 bp, Artificial Sequence
  chemically synthesized
ccttactatactggaaggaa

SEQ ID NO: 97070 - DNA, 20 bp, Artificial Sequence
  chemically synthesized
taaaaattttcctttccttc

SEQ ID NO: 97071 - DNA, 20 bp, Artificial Sequence
  chemically synthesized
ctgtgtccctgtgttttcag

SEQ ID NO: 97072 - DNA, 20 bp, Artificial Sequence
  chemically synthesized
cctgtgtccctgtgttttca

SEQ ID NO: 97073 - DNA, 20 bp, Artificial Sequence
  chemically synthesized
aatttttacctctgaaaaca

SEQ ID NO: 97074 - DNA, 20 bp, Artificial Sequence
  chemically synthesized
atttttacctctgaaaacac

SEQ ID NO: 97075 - DNA, 20 bp, Artificial Sequence
  chemically synthesized
ctcctgtgtccctgtgtttt

SEQ ID NO: 97076 - DNA, 20 bp, Artificial Sequence
  chemically synthesized
tttttacctctgaaaacaca

SEQ ID NO: 97077 - DNA, 20 bp, Artificial Sequence
  chemically synthesized
cctctgaaaacacagggaca

SEQ ID NO: 97078 - DNA, 20 bp, Artificial Sequence
  chemically synthesized
ctctgaaaacacagggacac

SEQ ID NO: 97079 - DNA, 20 bp, Artificial Sequence
  chemically synthesized
ctgaaaacacagggacacag

SEQ ID NO: 97080 - DNA, 20 bp, Artificial Sequence
  chemically synthesized
tgaaaacacagggacacagg

SEQ ID NO: 97081 - DNA, 20 bp, Artificial Sequence
  chemically synthesized
cagggacacaggaggttctg

SEQ ID NO: 97082 - DNA, 20 bp, Artificial Sequence
  chemically synthesized
cacaggaggttctgcagaaa

SEQ ID NO: 97083 - DNA, 20 bp, Artificial Sequence
  chemically synthesized
acaggaggttctgcagaaac

SEQ ID NO: 97084 - DNA, 20 bp, Artificial Sequence
  chemically synthesized
cacagcaaggcctgtttctg

SEQ ID NO: 97085 - DNA, 20 bp, Artificial Sequence
  chemically synthesized
tgcagaaacaggccttgctg

SEQ ID NO: 97086 - DNA, 20 bp, Artificial Sequence
  chemically synthesized
aaactggggtgaccacagca

SEQ ID NO: 97087 - DNA, 20 bp, Artificial Sequence
  chemically synthesized
taaactggggtgaccacagc

SEQ ID NO: 97088 - DNA, 20 bp, Artificial Sequence
  chemically synthesized
gtaataaactggggtgacca

SEQ ID NO: 97089 - DNA, 20 bp, Artificial Sequence
  chemically synthesized
aggccttgctgtggtcaccc

SEQ ID NO: 97090 - DNA, 20 bp, Artificial Sequence
  chemically synthesized
aggggaatggtaataaactg

SEQ ID NO: 97091 - DNA, 20 bp, Artificial Sequence
  chemically synthesized
aaggggaatggtaataaact

SEQ ID NO: 97092 - DNA, 20 bp, Artificial Sequence
  chemically synthesized
aaaggggaatggtaataaac

SEQ ID NO: 97093 - DNA, 20 bp, Artificial Sequence
  chemically synthesized
tatgactggacaaaggggaa

SEQ ID NO: 97094 - DNA, 20 bp, Artificial Sequence
  chemically synthesized
tattaccattcccctttgtc

SEQ ID NO: 97095 - DNA, 20 bp, Artificial Sequence
  chemically synthesized
tccagtatgactggacaaag

SEQ ID NO: 97096 - DNA, 20 bp, Artificial Sequence
  chemically synthesized
gtccagtatgactggacaaa

SEQ ID NO: 97097 - DNA, 20 bp, Artificial Sequence
  chemically synthesized
tgtccagtatgactggacaa

SEQ ID NO: 97098 - DNA, 20 bp, Artificial Sequence
  chemically synthesized
atgtccagtatgactggaca

SEQ ID NO: 97099 - DNA, 20 bp, Artificial Sequence
  chemically synthesized
tcccctttgtccagtcatac

SEQ ID NO: 97100 - DNA, 20 bp, Artificial Sequence
  chemically synthesized
aagtagatgtccagtatgac

SEQ ID NO: 97101 - DNA, 20 bp, Artificial Sequence
  chemically synthesized
tttgaggaaaagtagatgtc

SEQ ID NO: 97102 - DNA, 20 bp, Artificial Sequence
  chemically synthesized
tgctctgatttgaggaaaag

SEQ ID NO: 97103 - DNA, 20 bp, Artificial Sequence
  chemically synthesized
ttatgctctgatttgaggaa

SEQ ID NO: 97104 - DNA, 20 bp, Artificial Sequence
  chemically synthesized
acatctacttttcctcaaat

SEQ ID NO: 97105 - DNA, 20 bp, Artificial Sequence
  chemically synthesized
atctacttttcctcaaatca

SEQ ID NO: 97106 - DNA, 20 bp, Artificial Sequence
  chemically synthesized
tatttttatgctctgatttg

SEQ ID NO: 97107 - DNA, 20 bp, Artificial Sequence
  chemically synthesized
gtatttttatgctctgattt

SEQ ID NO: 97108 - DNA, 20 bp, Artificial Sequence
  chemically synthesized
tgacccaaagaatcagggaa

SEQ ID NO: 97109 - DNA, 20 bp, Artificial Sequence
  chemically synthesized
agaaatgacccaaagaatca

SEQ ID NO: 97110 - DNA, 20 bp, Artificial Sequence
  chemically synthesized
cacacttttccctgattctt

SEQ ID NO: 97111 - DNA, 20 bp, Artificial Sequence
  chemically synthesized
cagaaatgacccaaagaatc

SEQ ID NO: 97112 - DNA, 20 bp, Artificial Sequence
  chemically synthesized
acacttttccctgattcttt

SEQ ID NO: 97113 - DNA, 20 bp, Artificial Sequence
  chemically synthesized
tcagaaatgacccaaagaat

SEQ ID NO: 97114 - DNA, 20 bp, Artificial Sequence
  chemically synthesized
gagccttcagaaatgaccca

SEQ ID NO: 97115 - DNA, 20 bp, Artificial Sequence
  chemically synthesized
gattctttgggtcatttctg

SEQ ID NO: 97116 - DNA, 20 bp, Artificial Sequence
  chemically synthesized
attctttgggtcatttctga

SEQ ID NO: 97117 - DNA, 20 bp, Artificial Sequence
  chemically synthesized
tcacatgacacaggagcctt

SEQ ID NO: 97118 - DNA, 20 bp, Artificial Sequence
  chemically synthesized
ataagtttcacatgacacag

SEQ ID NO: 97119 - DNA, 20 bp, Artificial Sequence
  chemically synthesized
atataagtttcacatgacac

SEQ ID NO: 97120 - DNA, 20 bp, Artificial Sequence
  chemically synthesized
aatataagtttcacatgaca

SEQ ID NO: 97121 - DNA, 20 bp, Artificial Sequence
  chemically synthesized
catgcgaatttatttaatat

SEQ ID NO: 97122 - DNA, 20 bp, Artificial Sequence
  chemically synthesized
aggacaaatcaacaacataa

SEQ ID NO: 97123 - DNA, 20 bp, Artificial Sequence
  chemically synthesized
tgttgatttgtccttcatta

SEQ ID NO: 97124 - DNA, 20 bp, Artificial Sequence
  chemically synthesized
gttgatttgtccttcattat

SEQ ID NO: 97125 - DNA, 20 bp, Artificial Sequence
  chemically synthesized
ggctgaggcacctataatga

SEQ ID NO: 97126 - DNA, 20 bp, Artificial Sequence
  chemically synthesized
tggctgaggcacctataatg

SEQ ID NO: 97127 - DNA, 20 bp, Artificial Sequence
  chemically synthesized
gtccttcattataggtgcct

SEQ ID NO: 97128 - DNA, 20 bp, Artificial Sequence
  chemically synthesized
catcgctaggttcatggctg

SEQ ID NO: 97129 - DNA, 20 bp, Artificial Sequence
  chemically synthesized
ccatcgctaggttcatggct

SEQ ID NO: 97130 - DNA, 20 bp, Artificial Sequence
  chemically synthesized
aggtgcctcagccatgaacc

SEQ ID NO: 97131 - DNA, 20 bp, Artificial Sequence
  chemically synthesized
ctcacccatcgctaggttca

SEQ ID NO: 97132 - DNA, 20 bp, Artificial Sequence
  chemically synthesized
ctcagccatgaacctagcga

SEQ ID NO: 97133 - DNA, 20 bp, Artificial Sequence
  chemically synthesized
tcagccatgaacctagcgat

SEQ ID NO: 97134 - DNA, 20 bp, Artificial Sequence
  chemically synthesized
ctcttttctcacccatcgct

SEQ ID NO: 97135 - DNA, 20 bp, Artificial Sequence
  chemically synthesized
tctcttttctcacccatcgc

SEQ ID NO: 97136 - DNA, 20 bp, Artificial Sequence
  chemically synthesized
ccatgaacctagcgatgggt

SEQ ID NO: 97137 - DNA, 20 bp, Artificial Sequence
  chemically synthesized
aacctagcgatgggtgagaa

SEQ ID NO: 97138 - DNA, 20 bp, Artificial Sequence
  chemically synthesized
cctagcgatgggtgagaaaa

SEQ ID NO: 97139 - DNA, 20 bp, Artificial Sequence
  chemically synthesized
ttgactcttacaggggagaa

SEQ ID NO: 97140 - DNA, 20 bp, Artificial Sequence
  chemically synthesized
agagatcttttctcccctgt

SEQ ID NO: 97141 - DNA, 20 bp, Artificial Sequence
  chemically synthesized
tctacttgactcttacaggg

SEQ ID NO: 97142 - DNA, 20 bp, Artificial Sequence
  chemically synthesized
agatcttttctcccctgtaa

SEQ ID NO: 97143 - DNA, 20 bp, Artificial Sequence
  chemically synthesized
aatctacttgactcttacag

SEQ ID NO: 97144 - DNA, 20 bp, Artificial Sequence
  chemically synthesized
gaatctacttgactcttaca

SEQ ID NO: 97145 - DNA, 20 bp, Artificial Sequence
  chemically synthesized
agaatctacttgactcttac

SEQ ID NO: 97146 - DNA, 20 bp, Artificial Sequence
  chemically synthesized
tagaatctacttgactctta

SEQ ID NO: 97147 - DNA, 20 bp, Artificial Sequence
  chemically synthesized
ttttctcccctgtaagagtc

SEQ ID NO: 97148 - DNA, 20 bp, Artificial Sequence
  chemically synthesized
tctcccctgtaagagtcaag

SEQ ID NO: 97149 - DNA, 20 bp, Artificial Sequence
  chemically synthesized
aacctgcttgtttagaattt

SEQ ID NO: 97150 - DNA, 20 bp, Artificial Sequence
  chemically synthesized
tagattctaaaattctaaac

SEQ ID NO: 97151 - DNA, 20 bp, Artificial Sequence
  chemically synthesized
attctaaaattctaaacaag

SEQ ID NO: 97152 - DNA, 20 bp, Artificial Sequence
  chemically synthesized
ttctaaaattctaaacaagc

SEQ ID NO: 97153 - DNA, 20 bp, Artificial Sequence
  chemically synthesized
gaacccgaaacctgcttgtt

SEQ ID NO: 97154 - DNA, 20 bp, Artificial Sequence
  chemically synthesized
aattctaaacaagcaggttt

SEQ ID NO: 97155 - DNA, 20 bp, Artificial Sequence
  chemically synthesized
attctaaacaagcaggtttc

SEQ ID NO: 97156 - DNA, 20 bp, Artificial Sequence
  chemically synthesized
acaagcaggtttcgggttct

SEQ ID NO: 97157 - DNA, 20 bp, Artificial Sequence
  chemically synthesized
ggtttcgggttctcagaaaa

SEQ ID NO: 97158 - DNA, 20 bp, Artificial Sequence
  chemically synthesized
gtttcgggttctcagaaaac

SEQ ID NO: 97159 - DNA, 20 bp, Artificial Sequence
  chemically synthesized
ttgtcaaccccctgttttct

SEQ ID NO: 97160 - DNA, 20 bp, Artificial Sequence
  chemically synthesized
tttcgggttctcagaaaaca

SEQ ID NO: 97161 - DNA, 20 bp, Artificial Sequence
  chemically synthesized
ttcgggttctcagaaaacag

SEQ ID NO: 97162 - DNA, 20 bp, Artificial Sequence
  chemically synthesized
tcgggttctcagaaaacagg

SEQ ID NO: 97163 - DNA, 20 bp, Artificial Sequence
  chemically synthesized
tcagaaaacagggggttgac

SEQ ID NO: 97164 - DNA, 20 bp, Artificial Sequence
  chemically synthesized
aaacagggggttgacaagaa

SEQ ID NO: 97165 - DNA, 20 bp, Artificial Sequence
  chemically synthesized
tgacaagaatggttctgaca

SEQ ID NO: 97166 - DNA, 20 bp, Artificial Sequence
  chemically synthesized
tttcacagtttgggctatgt

SEQ ID NO: 97167 - DNA, 20 bp, Artificial Sequence
  chemically synthesized
taattcagttttcacagttt

SEQ ID NO: 97168 - DNA, 20 bp, Artificial Sequence
  chemically synthesized
ataattcagttttcacagtt

SEQ ID NO: 97169 - DNA, 20 bp, Artificial Sequence
  chemically synthesized
gaatcataattcagttttca

SEQ ID NO: 97170 - DNA, 20 bp, Artificial Sequence
  chemically synthesized
attgccttggaatcataatt

SEQ ID NO: 97171 - DNA, 20 bp, Artificial Sequence
  chemically synthesized
gaaaactgaattatgattcc

SEQ ID NO: 97172 - DNA, 20 bp, Artificial Sequence
  chemically synthesized
aaaactgaattatgattcca

SEQ ID NO: 97173 - DNA, 20 bp, Artificial Sequence
  chemically synthesized
gaattatgattccaaggcaa

SEQ ID NO: 97174 - DNA, 20 bp, Artificial Sequence
  chemically synthesized
agtattaaatgctattgcct

SEQ ID NO: 97175 - DNA, 20 bp, Artificial Sequence
  chemically synthesized
cttgcctattcaacaagcat

SEQ ID NO: 97176 - DNA, 20 bp, Artificial Sequence
  chemically synthesized
taatactcatgcttgttgaa

SEQ ID NO: 97177 - DNA, 20 bp, Artificial Sequence
  chemically synthesized
aatactcatgcttgttgaat

SEQ ID NO: 97178 - DNA, 20 bp, Artificial Sequence
  chemically synthesized
gaagcccttgcctattcaac

SEQ ID NO: 97179 - DNA, 20 bp, Artificial Sequence
  chemically synthesized
ctcatgcttgttgaataggc

SEQ ID NO: 97180 - DNA, 20 bp, Artificial Sequence
  chemically synthesized
tcatgcttgttgaataggca

SEQ ID NO: 97181 - DNA, 20 bp, Artificial Sequence
  chemically synthesized
catgcttgttgaataggcaa

SEQ ID NO: 97182 - DNA, 20 bp, Artificial Sequence
  chemically synthesized
gttgaataggcaagggcttc

SEQ ID NO: 97183 - DNA, 20 bp, Artificial Sequence
  chemically synthesized
gaataggcaagggcttccag

SEQ ID NO: 97184 - DNA, 20 bp, Artificial Sequence
  chemically synthesized
aataggcaagggcttccaga

SEQ ID NO: 97185 - DNA, 20 bp, Artificial Sequence
  chemically synthesized
ggctctgatcttccttctgg

SEQ ID NO: 97186 - DNA, 20 bp, Artificial Sequence
  chemically synthesized
aggcaagggcttccagaagg

SEQ ID NO: 97187 - DNA, 20 bp, Artificial Sequence
  chemically synthesized
ccaggctctgatcttccttc

SEQ ID NO: 97188 - DNA, 20 bp, Artificial Sequence
  chemically synthesized
agggcttccagaaggaagat

SEQ ID NO: 97189 - DNA, 20 bp, Artificial Sequence
  chemically synthesized
ggcttccagaaggaagatca

SEQ ID NO: 97190 - DNA, 20 bp, Artificial Sequence
  chemically synthesized
ccagaaggaagatcagagcc

SEQ ID NO: 97191 - DNA, 20 bp, Artificial Sequence
  chemically synthesized
tttccagagatgaaaagacc

SEQ ID NO: 97192 - DNA, 20 bp, Artificial Sequence
  chemically synthesized
gtttccagagatgaaaagac

SEQ ID NO: 97193 - DNA, 20 bp, Artificial Sequence
  chemically synthesized
tctaggtttccagagatgaa

SEQ ID NO: 97194 - DNA, 20 bp, Artificial Sequence
  chemically synthesized
gagcctggtcttttcatctc

SEQ ID NO: 97195 - DNA, 20 bp, Artificial Sequence
  chemically synthesized
aaaccacatctaggtttcca

SEQ ID NO: 97196 - DNA, 20 bp, Artificial Sequence
  chemically synthesized
tcttttcatctctggaaacc

SEQ ID NO: 97197 - DNA, 20 bp, Artificial Sequence
  chemically synthesized
gtaaaccacatctaggtttc

SEQ ID NO: 97198 - DNA, 20 bp, Artificial Sequence
  chemically synthesized
catctctggaaacctagatg

SEQ ID NO: 97199 - DNA, 20 bp, Artificial Sequence
  chemically synthesized
tctaagagtaaaccacatct

SEQ ID NO: 97200 - DNA, 20 bp, Artificial Sequence
  chemically synthesized
ttctaagagtaaaccacatc

SEQ ID NO: 97201 - DNA, 20 bp, Artificial Sequence
  chemically synthesized
acctagatgtggtttactct

SEQ ID NO: 97202 - DNA, 20 bp, Artificial Sequence
  chemically synthesized
ttagccctttttcattctaa

SEQ ID NO: 97203 - DNA, 20 bp, Artificial Sequence
  chemically synthesized
acttagccctttttcattct

SEQ ID NO: 97204 - DNA, 20 bp, Artificial Sequence
  chemically synthesized
ggtttactcttagaatgaaa

SEQ ID NO: 97205 - DNA, 20 bp, Artificial Sequence
  chemically synthesized
gtttactcttagaatgaaaa

SEQ ID NO: 97206 - DNA, 20 bp, Artificial Sequence
  chemically synthesized
tttactcttagaatgaaaaa

SEQ ID NO: 97207 - DNA, 20 bp, Artificial Sequence
  chemically synthesized
tcttagaatgaaaaagggct

SEQ ID NO: 97208 - DNA, 20 bp, Artificial Sequence
  chemically synthesized
cttagagccccaggaagact

SEQ ID NO: 97209 - DNA, 20 bp, Artificial Sequence
  chemically synthesized
gaaaaagggctaagtcttcc

SEQ ID NO: 97210 - DNA, 20 bp, Artificial Sequence
  chemically synthesized
aaaaagggctaagtcttcct

SEQ ID NO: 97211 - DNA, 20 bp, Artificial Sequence
  chemically synthesized
aaaagggctaagtcttcctg

SEQ ID NO: 97212 - DNA, 20 bp, Artificial Sequence
  chemically synthesized
agagtccttagagccccagg

SEQ ID NO: 97213 - DNA, 20 bp, Artificial Sequence
  chemically synthesized
gggagagtccttagagcccc

SEQ ID NO: 97214 - DNA, 20 bp, Artificial Sequence
  chemically synthesized
ctaagtcttcctggggctct

SEQ ID NO: 97215 - DNA, 20 bp, Artificial Sequence
  chemically synthesized
agggagagtccttagagccc

SEQ ID NO: 97216 - DNA, 20 bp, Artificial Sequence
  chemically synthesized
taagtcttcctggggctcta

SEQ ID NO: 97217 - DNA, 20 bp, Artificial Sequence
  chemically synthesized
caacacagggagagtcctta

SEQ ID NO: 97218 - DNA, 20 bp, Artificial Sequence
  chemically synthesized
ttcaacacagggagagtcct

SEQ ID NO: 97219 - DNA, 20 bp, Artificial Sequence
  chemically synthesized
ttttctattcaacacaggga

SEQ ID NO: 97220 - DNA, 20 bp, Artificial Sequence
  chemically synthesized
ctttttctattcaacacagg

SEQ ID NO: 97221 - DNA, 20 bp, Artificial Sequence
  chemically synthesized
ccctttttctattcaacaca

SEQ ID NO: 97222 - DNA, 20 bp, Artificial Sequence
  chemically synthesized
tccctttttctattcaacac

SEQ ID NO: 97223 - DNA, 20 bp, Artificial Sequence
  chemically synthesized
aggactctccctgtgttgaa

SEQ ID NO: 97224 - DNA, 20 bp, Artificial Sequence
  chemically synthesized
atccctttttctattcaaca

SEQ ID NO: 97225 - DNA, 20 bp, Artificial Sequence
  chemically synthesized
ctccctgtgttgaatagaaa

SEQ ID NO: 97226 - DNA, 20 bp, Artificial Sequence
  chemically synthesized
tccctgtgttgaatagaaaa

SEQ ID NO: 97227 - DNA, 20 bp, Artificial Sequence
  chemically synthesized
ccctgtgttgaatagaaaaa

SEQ ID NO: 97228 - DNA, 20 bp, Artificial Sequence
  chemically synthesized
aaaagggataaaccttcaac

SEQ ID NO: 97229 - DNA, 20 bp, Artificial Sequence
  chemically synthesized
aaagggataaaccttcaact

SEQ ID NO: 97230 - DNA, 20 bp, Artificial Sequence
  chemically synthesized
tattttacaaacccagttga

SEQ ID NO: 97231 - DNA, 20 bp, Artificial Sequence
  chemically synthesized
atattttacaaacccagttg

SEQ ID NO: 97232 - DNA, 20 bp, Artificial Sequence
  chemically synthesized
acaacgatattttacaaacc

SEQ ID NO: 97233 - DNA, 20 bp, Artificial Sequence
  chemically synthesized
tgtaaaatatcgttgttcca

SEQ ID NO: 97234 - DNA, 20 bp, Artificial Sequence
  chemically synthesized
tggtcttgaatttgattcca

SEQ ID NO: 97235 - DNA, 20 bp, Artificial Sequence
  chemically synthesized
tgttccatggaatcaaattc

SEQ ID NO: 97236 - DNA, 20 bp, Artificial Sequence
  chemically synthesized
atggaatcaaattcaagacc

SEQ ID NO: 97237 - DNA, 20 bp, Artificial Sequence
  chemically synthesized
tggaatcaaattcaagacca

SEQ ID NO: 97238 - DNA, 20 bp, Artificial Sequence
  chemically synthesized
aaattcaagaccaaggtcaa

SEQ ID NO: 97239 - DNA, 20 bp, Artificial Sequence
  chemically synthesized
gtgaccatcacttttgacct

SEQ ID NO: 97240 - DNA, 20 bp, Artificial Sequence
  chemically synthesized
aagaccaaggtcaaaagtga

SEQ ID NO: 97241 - DNA, 20 bp, Artificial Sequence
  chemically synthesized
tgggtagggtcagagaaagc

SEQ ID NO: 97242 - DNA, 20 bp, Artificial Sequence
  chemically synthesized
atcctgggtagggtcagaga

SEQ ID NO: 97243 - DNA, 20 bp, Artificial Sequence
  chemically synthesized
tctgatcctgggtagggtca

SEQ ID NO: 97244 - DNA, 20 bp, Artificial Sequence
  chemically synthesized
gttctgatcctgggtagggt

SEQ ID NO: 97245 - DNA, 20 bp, Artificial Sequence
  chemically synthesized
ttgctttctctgaccctacc

SEQ ID NO: 97246 - DNA, 20 bp, Artificial Sequence
  chemically synthesized
tgctttctctgaccctaccc

SEQ ID NO: 97247 - DNA, 20 bp, Artificial Sequence
  chemically synthesized
tctggttctgatcctgggta

SEQ ID NO: 97248 - DNA, 20 bp, Artificial Sequence
  chemically synthesized
ctctggttctgatcctgggt

SEQ ID NO: 97249 - DNA, 20 bp, Artificial Sequence
  chemically synthesized
gctctggttctgatcctggg

SEQ ID NO: 97250 - DNA, 20 bp, Artificial Sequence
  chemically synthesized
tctctgaccctacccaggat

SEQ ID NO: 97251 - DNA, 20 bp, Artificial Sequence
  chemically synthesized
aaggctctggttctgatcct

SEQ ID NO: 97252 - DNA, 20 bp, Artificial Sequence
  chemically synthesized
gaaggctctggttctgatcc

SEQ ID NO: 97253 - DNA, 20 bp, Artificial Sequence
  chemically synthesized
accctacccaggatcagaac

SEQ ID NO: 97254 - DNA, 20 bp, Artificial Sequence
  chemically synthesized
cctacccaggatcagaacca

SEQ ID NO: 97255 - DNA, 20 bp, Artificial Sequence
  chemically synthesized
aggatcagaaccagagcctt

SEQ ID NO: 97256 - DNA, 20 bp, Artificial Sequence
  chemically synthesized
gggctgccagctgaaggctc

SEQ ID NO: 97257 - DNA, 20 bp, Artificial Sequence
  chemically synthesized
tcagaaccagagccttcagc

SEQ ID NO: 97258 - DNA, 20 bp, Artificial Sequence
  chemically synthesized
aggaatgggctgccagctga

SEQ ID NO: 97259 - DNA, 20 bp, Artificial Sequence
  chemically synthesized
gaaccagagccttcagctgg

SEQ ID NO: 97260 - DNA, 20 bp, Artificial Sequence
  chemically synthesized
aaggaatgggctgccagctg

SEQ ID NO: 97261 - DNA, 20 bp, Artificial Sequence
  chemically synthesized
cagcagaaggaatgggctgc

SEQ ID NO: 97262 - DNA, 20 bp, Artificial Sequence
  chemically synthesized
gtttcagcagcagaaggaat

SEQ ID NO: 97263 - DNA, 20 bp, Artificial Sequence
  chemically synthesized
ggtttcagcagcagaaggaa

SEQ ID NO: 97264 - DNA, 20 bp, Artificial Sequence
  chemically synthesized
ggattggtttcagcagcaga

SEQ ID NO: 97265 - DNA, 20 bp, Artificial Sequence
  chemically synthesized
aggattggtttcagcagcag

SEQ ID NO: 97266 - DNA, 20 bp, Artificial Sequence
  chemically synthesized
gtgaggattggtttcagcag

SEQ ID NO: 97267 - DNA, 20 bp, Artificial Sequence
  chemically synthesized
ctggtgaggattggtttcag

SEQ ID NO: 97268 - DNA, 20 bp, Artificial Sequence
  chemically synthesized
tggctggtgaggattggttt

SEQ ID NO: 97269 - DNA, 20 bp, Artificial Sequence
  chemically synthesized
attgcctggctggtgaggat

SEQ ID NO: 97270 - DNA, 20 bp, Artificial Sequence
  chemically synthesized
ctgctgaaaccaatcctcac

SEQ ID NO: 97271 - DNA, 20 bp, Artificial Sequence
  chemically synthesized
tgaaaccaatcctcaccagc

SEQ ID NO: 97272 - DNA, 20 bp, Artificial Sequence
  chemically synthesized
gctgaattgcctggctggtg

SEQ ID NO: 97273 - DNA, 20 bp, Artificial Sequence
  chemically synthesized
gaaaccaatcctcaccagcc

SEQ ID NO: 97274 - DNA, 20 bp, Artificial Sequence
  chemically synthesized
tgctgaattgcctggctggt

SEQ ID NO: 97275 - DNA, 20 bp, Artificial Sequence
  chemically synthesized
cttctgctgaattgcctggc

SEQ ID NO: 97276 - DNA, 20 bp, Artificial Sequence
  chemically synthesized
tcctcaccagccaggcaatt

SEQ ID NO: 97277 - DNA, 20 bp, Artificial Sequence
  chemically synthesized
tgagcttctgctgaattgcc

SEQ ID NO: 97278 - DNA, 20 bp, Artificial Sequence
  chemically synthesized
tcaccagccaggcaattcag

SEQ ID NO: 97279 - DNA, 20 bp, Artificial Sequence
  chemically synthesized
ccagccaggcaattcagcag

SEQ ID NO: 97280 - DNA, 20 bp, Artificial Sequence
  chemically synthesized
caattcagcagaagctcact

SEQ ID NO: 97281 - DNA, 20 bp, Artificial Sequence
  chemically synthesized
aattcagcagaagctcactc

SEQ ID NO: 97282 - DNA, 20 bp, Artificial Sequence
  chemically synthesized
attcagcagaagctcactca

SEQ ID NO: 97283 - DNA, 20 bp, Artificial Sequence
  chemically synthesized
cttccatgctgtccctgagt

SEQ ID NO: 97284 - DNA, 20 bp, Artificial Sequence
  chemically synthesized
agcagaagctcactcaggga

SEQ ID NO: 97285 - DNA, 20 bp, Artificial Sequence
  chemically synthesized
gcctcttccatgctgtccct

SEQ ID NO: 97286 - DNA, 20 bp, Artificial Sequence
  chemically synthesized
aagctcactcagggacagca

SEQ ID NO: 97287 - DNA, 20 bp, Artificial Sequence
  chemically synthesized
ctcactcagggacagcatgg

SEQ ID NO: 97288 - DNA, 20 bp, Artificial Sequence
  chemically synthesized
cactcagggacagcatggaa

SEQ ID NO: 97289 - DNA, 20 bp, Artificial Sequence
  chemically synthesized
actcagggacagcatggaag

SEQ ID NO: 97290 - DNA, 20 bp, Artificial Sequence
  chemically synthesized
ggacagcatggaagaggcgt

SEQ ID NO: 97291 - DNA, 20 bp, Artificial Sequence
  chemically synthesized
accggttaacagaatggcag

SEQ ID NO: 97292 - DNA, 20 bp, Artificial Sequence
  chemically synthesized
cacaccggttaacagaatgg

SEQ ID NO: 97293 - DNA, 20 bp, Artificial Sequence
  chemically synthesized
gctcacaccggttaacagaa

SEQ ID NO: 97294 - DNA, 20 bp, Artificial Sequence
  chemically synthesized
gctgctgccattctgttaac

SEQ ID NO: 97295 - DNA, 20 bp, Artificial Sequence
  chemically synthesized
ctagagctcacaccggttaa

SEQ ID NO: 97296 - DNA, 20 bp, Artificial Sequence
  chemically synthesized
gccattctgttaaccggtgt

SEQ ID NO: 97297 - DNA, 20 bp, Artificial Sequence
  chemically synthesized
atgaagtctagagctcacac

SEQ ID NO: 97298 - DNA, 20 bp, Artificial Sequence
  chemically synthesized
ctgttaaccggtgtgagctc

SEQ ID NO: 97299 - DNA, 20 bp, Artificial Sequence
  chemically synthesized
agtaatcatgatgaagtcta

SEQ ID NO: 97300 - DNA, 20 bp, Artificial Sequence
  chemically synthesized
atagtaatcatgatgaagtc

SEQ ID NO: 97301 - DNA, 20 bp, Artificial Sequence
  chemically synthesized
gaaatatagtaatcatgatg

SEQ ID NO: 97302 - DNA, 20 bp, Artificial Sequence
  chemically synthesized
ccagaaggcagaaggaaata

SEQ ID NO: 97303 - DNA, 20 bp, Artificial Sequence
  chemically synthesized
aaggaatcccagaaggcaga

SEQ ID NO: 97304 - DNA, 20 bp, Artificial Sequence
  chemically synthesized
gaaggaatcccagaaggcag

SEQ ID NO: 97305 - DNA, 20 bp, Artificial Sequence
  chemically synthesized
ctatatttccttctgccttc

SEQ ID NO: 97306 - DNA, 20 bp, Artificial Sequence
  chemically synthesized
tatatttccttctgccttct

SEQ ID NO: 97307 - DNA, 20 bp, Artificial Sequence
  chemically synthesized
tcagaaggaatcccagaagg

SEQ ID NO: 97308 - DNA, 20 bp, Artificial Sequence
  chemically synthesized
gtgtcagaaggaatcccaga

SEQ ID NO: 97309 - DNA, 20 bp, Artificial Sequence
  chemically synthesized
agtgtcagaaggaatcccag

SEQ ID NO: 97310 - DNA, 20 bp, Artificial Sequence
  chemically synthesized
acaagtgtcagaaggaatcc

SEQ ID NO: 97311 - DNA, 20 bp, Artificial Sequence
  chemically synthesized
aaactgaaacaagtgtcaga

SEQ ID NO: 97312 - DNA, 20 bp, Artificial Sequence
  chemically synthesized
taaactgaaacaagtgtcag

SEQ ID NO: 97313 - DNA, 20 bp, Artificial Sequence
  chemically synthesized
tcttaaactgaaacaagtgt

SEQ ID NO: 97314 - DNA, 20 bp, Artificial Sequence
  chemically synthesized
attccttctgacacttgttt

SEQ ID NO: 97315 - DNA, 20 bp, Artificial Sequence
  chemically synthesized
catggttcttaaactgaaac

SEQ ID NO: 97316 - DNA, 20 bp, Artificial Sequence
  chemically synthesized
tctgacacttgtttcagttt

SEQ ID NO: 97317 - DNA, 20 bp, Artificial Sequence
  chemically synthesized
aatgatttgagaaagaaaca

SEQ ID NO: 97318 - DNA, 20 bp, Artificial Sequence
  chemically synthesized
ataaggaaaatgatttgaga

SEQ ID NO: 97319 - DNA, 20 bp, Artificial Sequence
  chemically synthesized
cagcataaggaaaatgattt

SEQ ID NO: 97320 - DNA, 20 bp, Artificial Sequence
  chemically synthesized
tcctgtgaagaaacagcata

SEQ ID NO: 97321 - DNA, 20 bp, Artificial Sequence
  chemically synthesized
ttcctgtgaagaaacagcat

SEQ ID NO: 97322 - DNA, 20 bp, Artificial Sequence
  chemically synthesized
gtatcattcctgtgaagaaa

SEQ ID NO: 97323 - DNA, 20 bp, Artificial Sequence
  chemically synthesized
ttccttatgctgtttcttca

SEQ ID NO: 97324 - DNA, 20 bp, Artificial Sequence
  chemically synthesized
tccttatgctgtttcttcac

SEQ ID NO: 97325 - DNA, 20 bp, Artificial Sequence
  chemically synthesized
aaaagtgtatcattcctgtg

SEQ ID NO: 97326 - DNA, 20 bp, Artificial Sequence
  chemically synthesized
ttcaaaaattatgatgagaa

SEQ ID NO: 97327 - DNA, 20 bp, Artificial Sequence
  chemically synthesized
atattttcaaaaattatgat

SEQ ID NO: 97328 - DNA, 20 bp, Artificial Sequence
  chemically synthesized
taatcactgcagatagcaca

SEQ ID NO: 97329 - DNA, 20 bp, Artificial Sequence
  chemically synthesized
aaaatactgtgtgctatctg

SEQ ID NO: 97330 - DNA, 20 bp, Artificial Sequence
  chemically synthesized
gaaagaataatcactgcaga

SEQ ID NO: 97331 - DNA, 20 bp, Artificial Sequence
  chemically synthesized
aaaggaaagaataatcactg

SEQ ID NO: 97332 - DNA, 20 bp, Artificial Sequence
  chemically synthesized
tttctttttaaggcaaagga

SEQ ID NO: 97333 - DNA, 20 bp, Artificial Sequence
  chemically synthesized
atactttctttttaaggcaa

SEQ ID NO: 97334 - DNA, 20 bp, Artificial Sequence
  chemically synthesized
aatactttctttttaaggca

SEQ ID NO: 97335 - DNA, 20 bp, Artificial Sequence
  chemically synthesized
attctttcctttgccttaaa

SEQ ID NO: 97336 - DNA, 20 bp, Artificial Sequence
  chemically synthesized
cctagaatactttcttttta

SEQ ID NO: 97337 - DNA, 20 bp, Artificial Sequence
  chemically synthesized
tttcctttgccttaaaaaga

SEQ ID NO: 97338 - DNA, 20 bp, Artificial Sequence
  chemically synthesized
ccctagaatactttcttttt

SEQ ID NO: 97339 - DNA, 20 bp, Artificial Sequence
  chemically synthesized
gccttaaaaagaaagtattc

SEQ ID NO: 97340 - DNA, 20 bp, Artificial Sequence
  chemically synthesized
ccttaaaaagaaagtattct

SEQ ID NO: 97341 - DNA, 20 bp, Artificial Sequence
  chemically synthesized
cttaaaaagaaagtattcta

SEQ ID NO: 97342 - DNA, 20 bp, Artificial Sequence
  chemically synthesized
aaaagaaagtattctaggga

SEQ ID NO: 97343 - DNA, 20 bp, Artificial Sequence
  chemically synthesized
aaagaaagtattctagggaa

SEQ ID NO: 97344 - DNA, 20 bp, Artificial Sequence
  chemically synthesized
ggtgttttccatcctttccc

SEQ ID NO: 97345 - DNA, 20 bp, Artificial Sequence
  chemically synthesized
aaagtattctagggaaagga

SEQ ID NO: 97346 - DNA, 20 bp, Artificial Sequence
  chemically synthesized
ggaaaggatggaaaacacca

SEQ ID NO: 97347 - DNA, 20 bp, Artificial Sequence
  chemically synthesized
aaggatggaaaacaccacag

SEQ ID NO: 97348 - DNA, 20 bp, Artificial Sequence
  chemically synthesized
gcccattctcacaacttctg

SEQ ID NO: 97349 - DNA, 20 bp, Artificial Sequence
  chemically synthesized
gaaaacaccacagaagttgt

SEQ ID NO: 97350 - DNA, 20 bp, Artificial Sequence
  chemically synthesized
caccacagaagttgtgagaa

SEQ ID NO: 97351 - DNA, 20 bp, Artificial Sequence
  chemically synthesized
accacagaagttgtgagaat

SEQ ID NO: 97352 - DNA, 20 bp, Artificial Sequence
  chemically synthesized
gggcatttgtgatttctaac

SEQ ID NO: 97353 - DNA, 20 bp, Artificial Sequence
  chemically synthesized
ggcatttgtgatttctaaca

SEQ ID NO: 97354 - DNA, 20 bp, Artificial Sequence
  chemically synthesized
aaaggctgacaaatccttgt

SEQ ID NO: 97355 - DNA, 20 bp, Artificial Sequence
  chemically synthesized
gatttctaacaaggatttgt

SEQ ID NO: 97356 - DNA, 20 bp, Artificial Sequence
  chemically synthesized
gtaaagtccagagcagtcaa

SEQ ID NO: 97357 - DNA, 20 bp, Artificial Sequence
  chemically synthesized
ggtaaagtccagagcagtca

SEQ ID NO: 97358 - DNA, 20 bp, Artificial Sequence
  chemically synthesized
ttgtcagcctttgactgctc

SEQ ID NO: 97359 - DNA, 20 bp, Artificial Sequence
  chemically synthesized
gtggctggtaaagtccagag

SEQ ID NO: 97360 - DNA, 20 bp, Artificial Sequence
  chemically synthesized
actgtggctggtaaagtcca

SEQ ID NO: 97361 - DNA, 20 bp, Artificial Sequence
  chemically synthesized
caactgtggctggtaaagtc

SEQ ID NO: 97362 - DNA, 20 bp, Artificial Sequence
  chemically synthesized
ttgactgctctggactttac

SEQ ID NO: 97363 - DNA, 20 bp, Artificial Sequence
  chemically synthesized
ttcagcaactgtggctggta

SEQ ID NO: 97364 - DNA, 20 bp, Artificial Sequence
  chemically synthesized
gctctggactttaccagcca

SEQ ID NO: 97365 - DNA, 20 bp, Artificial Sequence
  chemically synthesized
atgtcttcagcaactgtggc

SEQ ID NO: 97366 - DNA, 20 bp, Artificial Sequence
  chemically synthesized
ctgcatgtcttcagcaactg

SEQ ID NO: 97367 - DNA, 20 bp, Artificial Sequence
  chemically synthesized
tttaccagccacagttgctg

SEQ ID NO: 97368 - DNA, 20 bp, Artificial Sequence
  chemically synthesized
tctttcaccctgcatgtctt

SEQ ID NO: 97369 - DNA, 20 bp, Artificial Sequence
  chemically synthesized
ccacagttgctgaagacatg

SEQ ID NO: 97370 - DNA, 20 bp, Artificial Sequence
  chemically synthesized
cacagttgctgaagacatgc

SEQ ID NO: 97371 - DNA, 20 bp, Artificial Sequence
  chemically synthesized
acagttgctgaagacatgca

SEQ ID NO: 97372 - DNA, 20 bp, Artificial Sequence
  chemically synthesized
gctgaagacatgcagggtga

SEQ ID NO: 97373 - DNA, 20 bp, Artificial Sequence
  chemically synthesized
agacatgcagggtgaaagat

SEQ ID NO: 97374 - DNA, 20 bp, Artificial Sequence
  chemically synthesized
gggtgaaagatcagccctta

SEQ ID NO: 97375 - DNA, 20 bp, Artificial Sequence
  chemically synthesized
tcattgatttagagctgtaa

SEQ ID NO: 97376 - DNA, 20 bp, Artificial Sequence
  chemically synthesized
ttcattgatttagagctgta

SEQ ID NO: 97377 - DNA, 20 bp, Artificial Sequence
  chemically synthesized
gttcattgatttagagctgt

SEQ ID NO: 97378 - DNA, 20 bp, Artificial Sequence
  chemically synthesized
ttaaggagttcattgattta

SEQ ID NO: 97379 - DNA, 20 bp, Artificial Sequence
  chemically synthesized
gtttaaggagttcattgatt

SEQ ID NO: 97380 - DNA, 20 bp, Artificial Sequence
  chemically synthesized
catttgggggcaggtttaag

SEQ ID NO: 97381 - DNA, 20 bp, Artificial Sequence
  chemically synthesized
tacatttgggggcaggttta

SEQ ID NO: 97382 - DNA, 20 bp, Artificial Sequence
  chemically synthesized
atacatttgggggcaggttt

SEQ ID NO: 97383 - DNA, 20 bp, Artificial Sequence
  chemically synthesized
ctcctgatacatttgggggc

SEQ ID NO: 97384 - DNA, 20 bp, Artificial Sequence
  chemically synthesized
gctcctgatacatttggggg

SEQ ID NO: 97385 - DNA, 20 bp, Artificial Sequence
  chemically synthesized
ccagctcctgatacatttgg

SEQ ID NO: 97386 - DNA, 20 bp, Artificial Sequence
  chemically synthesized
tccagctcctgatacatttg

SEQ ID NO: 97387 - DNA, 20 bp, Artificial Sequence
  chemically synthesized
gtccagctcctgatacattt

SEQ ID NO: 97388 - DNA, 20 bp, Artificial Sequence
  chemically synthesized
aaacctgcccccaaatgtat

SEQ ID NO: 97389 - DNA, 20 bp, Artificial Sequence
  chemically synthesized
ggtccagctcctgatacatt

SEQ ID NO: 97390 - DNA, 20 bp, Artificial Sequence
  chemically synthesized
aacctgcccccaaatgtatc

SEQ ID NO: 97391 - DNA, 20 bp, Artificial Sequence
  chemically synthesized
cctgcccccaaatgtatcag

SEQ ID NO: 97392 - DNA, 20 bp, Artificial Sequence
  chemically synthesized
cccccaaatgtatcaggagc

SEQ ID NO: 97393 - DNA, 20 bp, Artificial Sequence
  chemically synthesized
ctgcctgctagtggagggtc

SEQ ID NO: 97394 - DNA, 20 bp, Artificial Sequence
  chemically synthesized
tcaggagctggaccctccac

SEQ ID NO: 97395 - DNA, 20 bp, Artificial Sequence
  chemically synthesized
agaccctgcctgctagtgga

SEQ ID NO: 97396 - DNA, 20 bp, Artificial Sequence
  chemically synthesized
ggagctggaccctccactag

SEQ ID NO: 97397 - DNA, 20 bp, Artificial Sequence
  chemically synthesized
cagaccctgcctgctagtgg

SEQ ID NO: 97398 - DNA, 20 bp, Artificial Sequence
  chemically synthesized
gagctggaccctccactagc

SEQ ID NO: 97399 - DNA, 20 bp, Artificial Sequence
  chemically synthesized
tcagaccctgcctgctagtg

SEQ ID NO: 97400 - DNA, 20 bp, Artificial Sequence
  chemically synthesized
tctcagaccctgcctgctag

SEQ ID NO: 97401 - DNA, 20 bp, Artificial Sequence
  chemically synthesized
ctggaccctccactagcagg

SEQ ID NO: 97402 - DNA, 20 bp, Artificial Sequence
  chemically synthesized
tggaccctccactagcaggc

SEQ ID NO: 97403 - DNA, 20 bp, Artificial Sequence
  chemically synthesized
ggaccctccactagcaggca

SEQ ID NO: 97404 - DNA, 20 bp, Artificial Sequence
  chemically synthesized
aaatctcagaccctgcctgc

SEQ ID NO: 97405 - DNA, 20 bp, Artificial Sequence
  chemically synthesized
tccactagcaggcagggtct

SEQ ID NO: 97406 - DNA, 20 bp, Artificial Sequence
  chemically synthesized
gtgagtgctcaaggaaatct

SEQ ID NO: 97407 - DNA, 20 bp, Artificial Sequence
  chemically synthesized
gcagggtctgagatttcctt

SEQ ID NO: 97408 - DNA, 20 bp, Artificial Sequence
  chemically synthesized
tcgcacatagtgagtgctca

SEQ ID NO: 97409 - DNA, 20 bp, Artificial Sequence
  chemically synthesized
ctcgcacatagtgagtgctc

SEQ ID NO: 97410 - DNA, 20 bp, Artificial Sequence
  chemically synthesized
gacagtaactcgcacatagt

SEQ ID NO: 97411 - DNA, 20 bp, Artificial Sequence
  chemically synthesized
cttgagcactcactatgtgc

SEQ ID NO: 97412 - DNA, 20 bp, Artificial Sequence
  chemically synthesized
ttaggacagtaactcgcaca

SEQ ID NO: 97413 - DNA, 20 bp, Artificial Sequence
  chemically synthesized
tacactggacttatttagga

SEQ ID NO: 97414 - DNA, 20 bp, Artificial Sequence
  chemically synthesized
tgcgagttactgtcctaaat

SEQ ID NO: 97415 - DNA, 20 bp, Artificial Sequence
  chemically synthesized
ttactacactggacttattt

SEQ ID NO: 97416 - DNA, 20 bp, Artificial Sequence
  chemically synthesized
attactacactggacttatt

SEQ ID NO: 97417 - DNA, 20 bp, Artificial Sequence
  chemically synthesized
gttactgtcctaaataagtc

SEQ ID NO: 97418 - DNA, 20 bp, Artificial Sequence
  chemically synthesized
tgtcctaaataagtccagtg

SEQ ID NO: 97419 - DNA, 20 bp, Artificial Sequence
  chemically synthesized
aatgaagtgaattactacac

SEQ ID NO: 97420 - DNA, 20 bp, Artificial Sequence
  chemically synthesized
atagggttgttattagaatg

SEQ ID NO: 97421 - DNA, 20 bp, Artificial Sequence
  chemically synthesized
tgacctcatagggttgttat

SEQ ID NO: 97422 - DNA, 20 bp, Artificial Sequence
  chemically synthesized
cattctaataacaaccctat

SEQ ID NO: 97423 - DNA, 20 bp, Artificial Sequence
  chemically synthesized
attctaataacaaccctatg

SEQ ID NO: 97424 - DNA, 20 bp, Artificial Sequence
  chemically synthesized
tgaagattaatgacctcata

SEQ ID NO: 97425 - DNA, 20 bp, Artificial Sequence
  chemically synthesized
gtgaagattaatgacctcat

SEQ ID NO: 97426 - DNA, 20 bp, Artificial Sequence
  chemically synthesized
agtgaagattaatgacctca

SEQ ID NO: 97427 - DNA, 20 bp, Artificial Sequence
  chemically synthesized
gaggtcattaatcttcactg

SEQ ID NO: 97428 - DNA, 20 bp, Artificial Sequence
  chemically synthesized
gtttctttgtatccgcagtg

SEQ ID NO: 97429 - DNA, 20 bp, Artificial Sequence
  chemically synthesized
cctcagtttctttgtatccg

SEQ ID NO: 97430 - DNA, 20 bp, Artificial Sequence
  chemically synthesized
taatcttcactgcggataca

SEQ ID NO: 97431 - DNA, 20 bp, Artificial Sequence
  chemically synthesized
actgcggatacaaagaaact

SEQ ID NO: 97432 - DNA, 20 bp, Artificial Sequence
  chemically synthesized
ctgcggatacaaagaaactg

SEQ ID NO: 97433 - DNA, 20 bp, Artificial Sequence
  chemically synthesized
tacaaagaaactgaggtata

SEQ ID NO: 97434 - DNA, 20 bp, Artificial Sequence
  chemically synthesized
tgagtcacctctatatacct

SEQ ID NO: 97435 - DNA, 20 bp, Artificial Sequence
  chemically synthesized
caaagaaactgaggtatata

SEQ ID NO: 97436 - DNA, 20 bp, Artificial Sequence
  chemically synthesized
aaagaaactgaggtatatag

SEQ ID NO: 97437 - DNA, 20 bp, Artificial Sequence
  chemically synthesized
tgaggtatatagaggtgact

SEQ ID NO: 97438 - DNA, 20 bp, Artificial Sequence
  chemically synthesized
gtatatagaggtgactcagc

SEQ ID NO: 97439 - DNA, 20 bp, Artificial Sequence
  chemically synthesized
ttgactgccacattctagct

SEQ ID NO: 97440 - DNA, 20 bp, Artificial Sequence
  chemically synthesized
gaggtgactcagctagaatg

SEQ ID NO: 97441 - DNA, 20 bp, Artificial Sequence
  chemically synthesized
gtaacttgactgccacattc

SEQ ID NO: 97442 - DNA, 20 bp, Artificial Sequence
  chemically synthesized
gtgactcagctagaatgtgg

SEQ ID NO: 97443 - DNA, 20 bp, Artificial Sequence
  chemically synthesized
tcagctagaatgtggcagtc

SEQ ID NO: 97444 - DNA, 20 bp, Artificial Sequence
  chemically synthesized
agaatgtggcagtcaagtta

SEQ ID NO: 97445 - DNA, 20 bp, Artificial Sequence
  chemically synthesized
gaatgtggcagtcaagttac

SEQ ID NO: 97446 - DNA, 20 bp, Artificial Sequence
  chemically synthesized
ggaaaggcagttgtaaagaa

SEQ ID NO: 97447 - DNA, 20 bp, Artificial Sequence
  chemically synthesized
cttcaggaaaggcagttgta

SEQ ID NO: 97448 - DNA, 20 bp, Artificial Sequence
  chemically synthesized
agccattacttcaggaaagg

SEQ ID NO: 97449 - DNA, 20 bp, Artificial Sequence
  chemically synthesized
ctttacaactgcctttcctg

SEQ ID NO: 97450 - DNA, 20 bp, Artificial Sequence
  chemically synthesized
cacagccattacttcaggaa

SEQ ID NO: 97451 - DNA, 20 bp, Artificial Sequence
  chemically synthesized
acacagccattacttcagga

SEQ ID NO: 97452 - DNA, 20 bp, Artificial Sequence
  chemically synthesized
aactgcctttcctgaagtaa

SEQ ID NO: 97453 - DNA, 20 bp, Artificial Sequence
  chemically synthesized
ttatacacagccattacttc

SEQ ID NO: 97454 - DNA, 20 bp, Artificial Sequence
  chemically synthesized
attatacacagccattactt

SEQ ID NO: 97455 - DNA, 20 bp, Artificial Sequence
  chemically synthesized
aatcttaacaatattataca

SEQ ID NO: 97456 - DNA, 20 bp, Artificial Sequence
  chemically synthesized
tggctgtgtataatattgtt

SEQ ID NO: 97457 - DNA, 20 bp, Artificial Sequence
  chemically synthesized
gtgtataatattgttaagat

SEQ ID NO: 97458 - DNA, 20 bp, Artificial Sequence
  chemically synthesized
tgtataatattgttaagatt

SEQ ID NO: 97459 - DNA, 20 bp, Artificial Sequence
  chemically synthesized
ttgggtcgacaaaaatcaac

SEQ ID NO: 97460 - DNA, 20 bp, Artificial Sequence
  chemically synthesized
ttgggcttctaatatttgac

SEQ ID NO: 97461 - DNA, 20 bp, Artificial Sequence
  chemically synthesized
aaaatcaaccagtcaaatat

SEQ ID NO: 97462 - DNA, 20 bp, Artificial Sequence
  chemically synthesized
atcaaccagtcaaatattag

SEQ ID NO: 97463 - DNA, 20 bp, Artificial Sequence
  chemically synthesized
cagtcaaatattagaagccc

SEQ ID NO: 97464 - DNA, 20 bp, Artificial Sequence
  chemically synthesized
tccatctgttggcggggctt

SEQ ID NO: 97465 - DNA, 20 bp, Artificial Sequence
  chemically synthesized
atccatctgttggcggggct

SEQ ID NO: 97466 - DNA, 20 bp, Artificial Sequence
  chemically synthesized
agaagcccaagccccgccaa

SEQ ID NO: 97467 - DNA, 20 bp, Artificial Sequence
  chemically synthesized
caggaatccatctgttggcg

SEQ ID NO: 97468 - DNA, 20 bp, Artificial Sequence
  chemically synthesized
acaggaatccatctgttggc

SEQ ID NO: 97469 - DNA, 20 bp, Artificial Sequence
  chemically synthesized
tacaggaatccatctgttgg

SEQ ID NO: 97470 - DNA, 20 bp, Artificial Sequence
  chemically synthesized
gcccaagccccgccaacaga

SEQ ID NO: 97471 - DNA, 20 bp, Artificial Sequence
  chemically synthesized
taatacaggaatccatctgt

SEQ ID NO: 97472 - DNA, 20 bp, Artificial Sequence
  chemically synthesized
caacagatggattcctgtat

SEQ ID NO: 97473 - DNA, 20 bp, Artificial Sequence
  chemically synthesized
tcgggaaaatcatctaatac

SEQ ID NO: 97474 - DNA, 20 bp, Artificial Sequence
  chemically synthesized
ctcgggaaaatcatctaata

SEQ ID NO: 97475 - DNA, 20 bp, Artificial Sequence
  chemically synthesized
ctgtattagatgattttccc

SEQ ID NO: 97476 - DNA, 20 bp, Artificial Sequence
  chemically synthesized
tttttgtcgttagaagactc

SEQ ID NO: 97477 - DNA, 20 bp, Artificial Sequence
  chemically synthesized
gtttttgtcgttagaagact

SEQ ID NO: 97478 - DNA, 20 bp, Artificial Sequence
  chemically synthesized
attgctgtttttgtcgttag

SEQ ID NO: 97479 - DNA, 20 bp, Artificial Sequence
  chemically synthesized
gccattgctgtttttgtcgt

SEQ ID NO: 97480 - DNA, 20 bp, Artificial Sequence
  chemically synthesized
gagtcttctaacgacaaaaa

SEQ ID NO: 97481 - DNA, 20 bp, Artificial Sequence
  chemically synthesized
tctaacgacaaaaacagcaa

SEQ ID NO: 97482 - DNA, 20 bp, Artificial Sequence
  chemically synthesized
aacgacaaaaacagcaatgg

SEQ ID NO: 97483 - DNA, 20 bp, Artificial Sequence
  chemically synthesized
gacaaaaacagcaatggcag

SEQ ID NO: 97484 - DNA, 20 bp, Artificial Sequence
  chemically synthesized
taagtactcataaatatttg

SEQ ID NO: 97485 - DNA, 20 bp, Artificial Sequence
  chemically synthesized
cattatctgcaaatatttat

SEQ ID NO: 97486 - DNA, 20 bp, Artificial Sequence
  chemically synthesized
gtatgtggcacaacacaatt

SEQ ID NO: 97487 - DNA, 20 bp, Artificial Sequence
  chemically synthesized
aaaccacttaatatggtatg

SEQ ID NO: 97488 - DNA, 20 bp, Artificial Sequence
  chemically synthesized
gttgtgccacataccatatt

SEQ ID NO: 97489 - DNA, 20 bp, Artificial Sequence
  chemically synthesized
gtgccacataccatattaag

SEQ ID NO: 97490 - DNA, 20 bp, Artificial Sequence
  chemically synthesized
cacatggaaaccacttaata

SEQ ID NO: 97491 - DNA, 20 bp, Artificial Sequence
  chemically synthesized
gattacattgatttaacaca

SEQ ID NO: 97492 - DNA, 20 bp, Artificial Sequence
  chemically synthesized
gtgttaaatcaatgtaatcc

SEQ ID NO: 97493 - DNA, 20 bp, Artificial Sequence
  chemically synthesized
atcaatgtaatcccagtatc

SEQ ID NO: 97494 - DNA, 20 bp, Artificial Sequence
  chemically synthesized
gctgacgcccactggatact

SEQ ID NO: 97495 - DNA, 20 bp, Artificial Sequence
  chemically synthesized
tgctgacgcccactggatac

SEQ ID NO: 97496 - DNA, 20 bp, Artificial Sequence
  chemically synthesized
aatgtaatcccagtatccag

SEQ ID NO: 97497 - DNA, 20 bp, Artificial Sequence
  chemically synthesized
atgtaatcccagtatccagt

SEQ ID NO: 97498 - DNA, 20 bp, Artificial Sequence
  chemically synthesized
gcagctctgctgacgcccac

SEQ ID NO: 97499 - DNA, 20 bp, Artificial Sequence
  chemically synthesized
tcccagtatccagtgggcgt

SEQ ID NO: 97500 - DNA, 20 bp, Artificial Sequence
  chemically synthesized
cagtatccagtgggcgtcag

SEQ ID NO: 97501 - DNA, 20 bp, Artificial Sequence
  chemically synthesized
gtatccagtgggcgtcagca

SEQ ID NO: 97502 - DNA, 20 bp, Artificial Sequence
  chemically synthesized
ggcgtcagcagagctgcctt

SEQ ID NO: 97503 - DNA, 20 bp, Artificial Sequence
  chemically synthesized
aaagaggttgcagctcaagg

SEQ ID NO: 97504 - DNA, 20 bp, Artificial Sequence
  chemically synthesized
atgaaagaggttgcagctca

SEQ ID NO: 97505 - DNA, 20 bp, Artificial Sequence
  chemically synthesized
aatgaaagaggttgcagctc

SEQ ID NO: 97506 - DNA, 20 bp, Artificial Sequence
  chemically synthesized
gttgctaatgaaagaggttg

SEQ ID NO: 97507 - DNA, 20 bp, Artificial Sequence
  chemically synthesized
tgagctgcaacctctttcat

SEQ ID NO: 97508 - DNA, 20 bp, Artificial Sequence
  chemically synthesized
aagctggttgctaatgaaag

SEQ ID NO: 97509 - DNA, 20 bp, Artificial Sequence
  chemically synthesized
taagctggttgctaatgaaa

SEQ ID NO: 97510 - DNA, 20 bp, Artificial Sequence
  chemically synthesized
tctaagctggttgctaatga

SEQ ID NO: 97511 - DNA, 20 bp, Artificial Sequence
  chemically synthesized
caacctctttcattagcaac

SEQ ID NO: 97512 - DNA, 20 bp, Artificial Sequence
  chemically synthesized
tctttcattagcaaccagct

SEQ ID NO: 97513 - DNA, 20 bp, Artificial Sequence
  chemically synthesized
aatgactaagggatctaagc

SEQ ID NO: 97514 - DNA, 20 bp, Artificial Sequence
  chemically synthesized
ccaaaatgactaagggatct

SEQ ID NO: 97515 - DNA, 20 bp, Artificial Sequence
  chemically synthesized
agcaaccagcttagatccct

SEQ ID NO: 97516 - DNA, 20 bp, Artificial Sequence
  chemically synthesized
agcccagccaaaatgactaa

SEQ ID NO: 97517 - DNA, 20 bp, Artificial Sequence
  chemically synthesized
tagcccagccaaaatgacta

SEQ ID NO: 97518 - DNA, 20 bp, Artificial Sequence
  chemically synthesized
gtagcccagccaaaatgact

SEQ ID NO: 97519 - DNA, 20 bp, Artificial Sequence
  chemically synthesized
cttagatcccttagtcattt

SEQ ID NO: 97520 - DNA, 20 bp, Artificial Sequence
  chemically synthesized
gatcccttagtcattttggc

SEQ ID NO: 97521 - DNA, 20 bp, Artificial Sequence
  chemically synthesized
atcccttagtcattttggct

SEQ ID NO: 97522 - DNA, 20 bp, Artificial Sequence
  chemically synthesized
gaatcaccaccagagtagcc

SEQ ID NO: 97523 - DNA, 20 bp, Artificial Sequence
  chemically synthesized
tcattttggctgggctactc

SEQ ID NO: 97524 - DNA, 20 bp, Artificial Sequence
  chemically synthesized
ttttggctgggctactctgg

SEQ ID NO: 97525 - DNA, 20 bp, Artificial Sequence
  chemically synthesized
ggtatgaatcaccaccagag

SEQ ID NO: 97526 - DNA, 20 bp, Artificial Sequence
  chemically synthesized
tggggtatgaatcaccacca

SEQ ID NO: 97527 - DNA, 20 bp, Artificial Sequence
  chemically synthesized
cctggggtatgaatcaccac

SEQ ID NO: 97528 - DNA, 20 bp, Artificial Sequence
  chemically synthesized
tctggtggtgattcataccc

SEQ ID NO: 97529 - DNA, 20 bp, Artificial Sequence
  chemically synthesized
ctggtggtgattcatacccc

SEQ ID NO: 97530 - DNA, 20 bp, Artificial Sequence
  chemically synthesized
tggtggtgattcatacccca

SEQ ID NO: 97531 - DNA, 20 bp, Artificial Sequence
  chemically synthesized
tcagctcaggcaaggccctg

SEQ ID NO: 97532 - DNA, 20 bp, Artificial Sequence
  chemically synthesized
ttcagctcaggcaaggccct

SEQ ID NO: 97533 - DNA, 20 bp, Artificial Sequence
  chemically synthesized
cttcagctcaggcaaggccc

SEQ ID NO: 97534 - DNA, 20 bp, Artificial Sequence
  chemically synthesized
cataccccagggccttgcct

SEQ ID NO: 97535 - DNA, 20 bp, Artificial Sequence
  chemically synthesized
ttctagcttcagctcaggca

SEQ ID NO: 97536 - DNA, 20 bp, Artificial Sequence
  chemically synthesized
gttctagcttcagctcaggc

SEQ ID NO: 97537 - DNA, 20 bp, Artificial Sequence
  chemically synthesized
ccagggccttgcctgagctg

SEQ ID NO: 97538 - DNA, 20 bp, Artificial Sequence
  chemically synthesized
ccacgttctagcttcagctc

SEQ ID NO: 97539 - DNA, 20 bp, Artificial Sequence
  chemically synthesized
gccacgttctagcttcagct

SEQ ID NO: 97540 - DNA, 20 bp, Artificial Sequence
  chemically synthesized
ggccttgcctgagctgaagc

SEQ ID NO: 97541 - DNA, 20 bp, Artificial Sequence
  chemically synthesized
gcaaagccacgttctagctt

SEQ ID NO: 97542 - DNA, 20 bp, Artificial Sequence
  chemically synthesized
cctgagctgaagctagaacg

SEQ ID NO: 97543 - DNA, 20 bp, Artificial Sequence
  chemically synthesized
cagggtgcaaagccacgttc

SEQ ID NO: 97544 - DNA, 20 bp, Artificial Sequence
  chemically synthesized
tagaacgtggctttgcaccc

SEQ ID NO: 97545 - DNA, 20 bp, Artificial Sequence
  chemically synthesized
aggcaggtttccagggtgca

SEQ ID NO: 97546 - DNA, 20 bp, Artificial Sequence
  chemically synthesized
aaaatataggcaggtttcca

SEQ ID NO: 97547 - DNA, 20 bp, Artificial Sequence
  chemically synthesized
caaaatataggcaggtttcc

SEQ ID NO: 97548 - DNA, 20 bp, Artificial Sequence
  chemically synthesized
gcaaaatataggcaggtttc

SEQ ID NO: 97549 - DNA, 20 bp, Artificial Sequence
  chemically synthesized
aaaactggcaaaatataggc

SEQ ID NO: 97550 - DNA, 20 bp, Artificial Sequence
  chemically synthesized
gaaaactggcaaaatatagg

SEQ ID NO: 97551 - DNA, 20 bp, Artificial Sequence
  chemically synthesized
ggagaaaactggcaaaatat

SEQ ID NO: 97552 - DNA, 20 bp, Artificial Sequence
  chemically synthesized
gggagaaaactggcaaaata

SEQ ID NO: 97553 - DNA, 20 bp, Artificial Sequence
  chemically synthesized
gaaacctgcctatattttgc

SEQ ID NO: 97554 - DNA, 20 bp, Artificial Sequence
  chemically synthesized
gttccttaaggggagaaaac

SEQ ID NO: 97555 - DNA, 20 bp, Artificial Sequence
  chemically synthesized
tttgccagttttctcccctt

SEQ ID NO: 97556 - DNA, 20 bp, Artificial Sequence
  chemically synthesized
ttgccagttttctcccctta

SEQ ID NO: 97557 - DNA, 20 bp, Artificial Sequence
  chemically synthesized
aggtttcagttccttaaggg

SEQ ID NO: 97558 - DNA, 20 bp, Artificial Sequence
  chemically synthesized
ctaggtttcagttccttaag

SEQ ID NO: 97559 - DNA, 20 bp, Artificial Sequence
  chemically synthesized
gctaggtttcagttccttaa

SEQ ID NO: 97560 - DNA, 20 bp, Artificial Sequence
  chemically synthesized
agctaggtttcagttcctta

SEQ ID NO: 97561 - DNA, 20 bp, Artificial Sequence
  chemically synthesized
cagctaggtttcagttcctt

SEQ ID NO: 97562 - DNA, 20 bp, Artificial Sequence
  chemically synthesized
ccccttaaggaactgaaacc

SEQ ID NO: 97563 - DNA, 20 bp, Artificial Sequence
  chemically synthesized
cttaggtaccagctaggttt

SEQ ID NO: 97564 - DNA, 20 bp, Artificial Sequence
  chemically synthesized
ttaaggaactgaaacctagc

SEQ ID NO: 97565 - DNA, 20 bp, Artificial Sequence
  chemically synthesized
gcaattcttaggtaccagct

SEQ ID NO: 97566 - DNA, 20 bp, Artificial Sequence
  chemically synthesized
agcaattcttaggtaccagc

SEQ ID NO: 97567 - DNA, 20 bp, Artificial Sequence
  chemically synthesized
ctgaaacctagctggtacct

SEQ ID NO: 97568 - DNA, 20 bp, Artificial Sequence
  chemically synthesized
aagaagcaattcttaggtac

SEQ ID NO: 97569 - DNA, 20 bp, Artificial Sequence
  chemically synthesized
tttagaaagaagcaattctt

SEQ ID NO: 97570 - DNA, 20 bp, Artificial Sequence
  chemically synthesized
atttagaaagaagcaattct

SEQ ID NO: 97571 - DNA, 20 bp, Artificial Sequence
  chemically synthesized
agtaggctttatttagaaag

SEQ ID NO: 97572 - DNA, 20 bp, Artificial Sequence
  chemically synthesized
catagtaggctttatttaga

SEQ ID NO: 97573 - DNA, 20 bp, Artificial Sequence
  chemically synthesized
gaattgcttctttctaaata

SEQ ID NO: 97574 - DNA, 20 bp, Artificial Sequence
  chemically synthesized
tggccatagtaggctttatt

SEQ ID NO: 97575 - DNA, 20 bp, Artificial Sequence
  chemically synthesized
tttctaaataaagcctacta

SEQ ID NO: 97576 - DNA, 20 bp, Artificial Sequence
  chemically synthesized
gaaggtggtgtggccatagt

SEQ ID NO: 97577 - DNA, 20 bp, Artificial Sequence
  chemically synthesized
ggaaggtggtgtggccatag

SEQ ID NO: 97578 - DNA, 20 bp, Artificial Sequence
  chemically synthesized
ttgggaaggtggtgtggcca

SEQ ID NO: 97579 - DNA, 20 bp, Artificial Sequence
  chemically synthesized
cttagtttgggaaggtggtg

SEQ ID NO: 97580 - DNA, 20 bp, Artificial Sequence
  chemically synthesized
agcaccttagtttgggaagg

SEQ ID NO: 97581 - DNA, 20 bp, Artificial Sequence
  chemically synthesized
gtcagcaccttagtttggga

SEQ ID NO: 97582 - DNA, 20 bp, Artificial Sequence
  chemically synthesized
ggtcagcaccttagtttggg

SEQ ID NO: 97583 - DNA, 20 bp, Artificial Sequence
  chemically synthesized
ccacaccaccttcccaaact

SEQ ID NO: 97584 - DNA, 20 bp, Artificial Sequence
  chemically synthesized
cacaccaccttcccaaacta

SEQ ID NO: 97585 - DNA, 20 bp, Artificial Sequence
  chemically synthesized
atcggtcagcaccttagttt

SEQ ID NO: 97586 - DNA, 20 bp, Artificial Sequence
  chemically synthesized
catcggtcagcaccttagtt

SEQ ID NO: 97587 - DNA, 20 bp, Artificial Sequence
  chemically synthesized
gagagcatcggtcagcacct

SEQ ID NO: 97588 - DNA, 20 bp, Artificial Sequence
  chemically synthesized
aaggagaggagagcatcggt

SEQ ID NO: 97589 - DNA, 20 bp, Artificial Sequence
  chemically synthesized
gtagaaggagaggagagcat

SEQ ID NO: 97590 - DNA, 20 bp, Artificial Sequence
  chemically synthesized
aatctggtagaaggagagga

SEQ ID NO: 97591 - DNA, 20 bp, Artificial Sequence
  chemically synthesized
ggaatctggtagaaggagag

SEQ ID NO: 97592 - DNA, 20 bp, Artificial Sequence
  chemically synthesized
ttggaatctggtagaaggag

SEQ ID NO: 97593 - DNA, 20 bp, Artificial Sequence
  chemically synthesized
gttggaatctggtagaagga

SEQ ID NO: 97594 - DNA, 20 bp, Artificial Sequence
  chemically synthesized
atgctctcctctccttctac

SEQ ID NO: 97595 - DNA, 20 bp, Artificial Sequence
  chemically synthesized
aggttggaatctggtagaag

SEQ ID NO: 97596 - DNA, 20 bp, Artificial Sequence
  chemically synthesized
aaaggttggaatctggtaga

SEQ ID NO: 97597 - DNA, 20 bp, Artificial Sequence
  chemically synthesized
taaaggttggaatctggtag

SEQ ID NO: 97598 - DNA, 20 bp, Artificial Sequence
  chemically synthesized
aactaaaggttggaatctgg

SEQ ID NO: 97599 - DNA, 20 bp, Artificial Sequence
  chemically synthesized
aataactaaaggttggaatc

SEQ ID NO: 97600 - DNA, 20 bp, Artificial Sequence
  chemically synthesized
ttctaccagattccaacctt

SEQ ID NO: 97601 - DNA, 20 bp, Artificial Sequence
  chemically synthesized
aaatatgaataactaaaggt

SEQ ID NO: 97602 - DNA, 20 bp, Artificial Sequence
  chemically synthesized
actaaaatatgaataactaa

SEQ ID NO: 97603 - DNA, 20 bp, Artificial Sequence
  chemically synthesized
gactaaaatatgaataacta

SEQ ID NO: 97604 - DNA, 20 bp, Artificial Sequence
  chemically synthesized
acctttagttattcatattt

SEQ ID NO: 97605 - DNA, 20 bp, Artificial Sequence
  chemically synthesized
caagaggaagttgtaaagtt

SEQ ID NO: 97606 - DNA, 20 bp, Artificial Sequence
  chemically synthesized
gtgggcaagaggaagttgta

SEQ ID NO: 97607 - DNA, 20 bp, Artificial Sequence
  chemically synthesized
caaaatcagtgggcaagagg

SEQ ID NO: 97608 - DNA, 20 bp, Artificial Sequence
  chemically synthesized
ttccaaaatcagtgggcaag

SEQ ID NO: 97609 - DNA, 20 bp, Artificial Sequence
  chemically synthesized
attccaaaatcagtgggcaa

SEQ ID NO: 97610 - DNA, 20 bp, Artificial Sequence
  chemically synthesized
ctattccaaaatcagtgggc

SEQ ID NO: 97611 - DNA, 20 bp, Artificial Sequence
  chemically synthesized
ccagctattccaaaatcagt

SEQ ID NO: 97612 - DNA, 20 bp, Artificial Sequence
  chemically synthesized
ttcctcttgcccactgattt

SEQ ID NO: 97613 - DNA, 20 bp, Artificial Sequence
  chemically synthesized
accagctattccaaaatcag

SEQ ID NO: 97614 - DNA, 20 bp, Artificial Sequence
  chemically synthesized
gaaaccagctattccaaaat

SEQ ID NO: 97615 - DNA, 20 bp, Artificial Sequence
  chemically synthesized
cttgcccactgattttggaa

SEQ ID NO: 97616 - DNA, 20 bp, Artificial Sequence
  chemically synthesized
cccactgattttggaatagc

SEQ ID NO: 97617 - DNA, 20 bp, Artificial Sequence
  chemically synthesized
aagtcttcaagaaaggaaac

SEQ ID NO: 97618 - DNA, 20 bp, Artificial Sequence
  chemically synthesized
atagctggtttcctttcttg

SEQ ID NO: 97619 - DNA, 20 bp, Artificial Sequence
  chemically synthesized
ggtattcaagtcttcaagaa

SEQ ID NO: 97620 - DNA, 20 bp, Artificial Sequence
  chemically synthesized
tggtattcaagtcttcaaga

SEQ ID NO: 97621 - DNA, 20 bp, Artificial Sequence
  chemically synthesized
taattggtattcaagtcttc

SEQ ID NO: 97622 - DNA, 20 bp, Artificial Sequence
  chemically synthesized
tgccctggtaattggtattc

SEQ ID NO: 97623 - DNA, 20 bp, Artificial Sequence
  chemically synthesized
aagacttgaataccaattac

SEQ ID NO: 97624 - DNA, 20 bp, Artificial Sequence
  chemically synthesized
agacttgaataccaattacc

SEQ ID NO: 97625 - DNA, 20 bp, Artificial Sequence
  chemically synthesized
gacttgaataccaattacca

SEQ ID NO: 97626 - DNA, 20 bp, Artificial Sequence
  chemically synthesized
tagagggctgccctggtaat

SEQ ID NO: 97627 - DNA, 20 bp, Artificial Sequence
  chemically synthesized
ttgaataccaattaccaggg

SEQ ID NO: 97628 - DNA, 20 bp, Artificial Sequence
  chemically synthesized
aggaggctagagggctgccc

SEQ ID NO: 97629 - DNA, 20 bp, Artificial Sequence
  chemically synthesized
caattaccagggcagccctc

SEQ ID NO: 97630 - DNA, 20 bp, Artificial Sequence
  chemically synthesized
gctggagacaggaggctaga

SEQ ID NO: 97631 - DNA, 20 bp, Artificial Sequence
  chemically synthesized
tgctggagacaggaggctag

SEQ ID NO: 97632 - DNA, 20 bp, Artificial Sequence
  chemically synthesized
ctgctggagacaggaggcta

SEQ ID NO: 97633 - DNA, 20 bp, Artificial Sequence
  chemically synthesized
aactgctggagacaggaggc

SEQ ID NO: 97634 - DNA, 20 bp, Artificial Sequence
  chemically synthesized
agctaactgctggagacagg

SEQ ID NO: 97635 - DNA, 20 bp, Artificial Sequence
  chemically synthesized
gccctctagcctcctgtctc

SEQ ID NO: 97636 - DNA, 20 bp, Artificial Sequence
  chemically synthesized
cagctaactgctggagacag

SEQ ID NO: 97637 - DNA, 20 bp, Artificial Sequence
  chemically synthesized
agcagctaactgctggagac

SEQ ID NO: 97638 - DNA, 20 bp, Artificial Sequence
  chemically synthesized
ctctagcctcctgtctccag

SEQ ID NO: 97639 - DNA, 20 bp, Artificial Sequence
  chemically synthesized
tagcagctaactgctggaga

SEQ ID NO: 97640 - DNA, 20 bp, Artificial Sequence
  chemically synthesized
agcctcctgtctccagcagt

SEQ ID NO: 97641 - DNA, 20 bp, Artificial Sequence
  chemically synthesized
tctgtagcagctaactgctg

SEQ ID NO: 97642 - DNA, 20 bp, Artificial Sequence
  chemically synthesized
tgtctgtagcagctaactgc

SEQ ID NO: 97643 - DNA, 20 bp, Artificial Sequence
  chemically synthesized
tctccagcagttagctgcta

SEQ ID NO: 97644 - DNA, 20 bp, Artificial Sequence
  chemically synthesized
aagaagcataatgtctgtag

SEQ ID NO: 97645 - DNA, 20 bp, Artificial Sequence
  chemically synthesized
gacaagaagcataatgtctg

SEQ ID NO: 97646 - DNA, 20 bp, Artificial Sequence
  chemically synthesized
acagacattatgcttcttgt

SEQ ID NO: 97647 - DNA, 20 bp, Artificial Sequence
  chemically synthesized
agacattatgcttcttgtca

SEQ ID NO: 97648 - DNA, 20 bp, Artificial Sequence
  chemically synthesized
cccacattgcctctgacaag

SEQ ID NO: 97649 - DNA, 20 bp, Artificial Sequence
  chemically synthesized
gacattatgcttcttgtcag

SEQ ID NO: 97650 - DNA, 20 bp, Artificial Sequence
  chemically synthesized
tgacccacattgcctctgac

SEQ ID NO: 97651 - DNA, 20 bp, Artificial Sequence
  chemically synthesized
gcttcttgtcagaggcaatg

SEQ ID NO: 97652 - DNA, 20 bp, Artificial Sequence
  chemically synthesized
cttcttgtcagaggcaatgt

SEQ ID NO: 97653 - DNA, 20 bp, Artificial Sequence
  chemically synthesized
ggctattctgtttagaggta

SEQ ID NO: 97654 - DNA, 20 bp, Artificial Sequence
  chemically synthesized
ggtcatgctttacctctaaa

SEQ ID NO: 97655 - DNA, 20 bp, Artificial Sequence
  chemically synthesized
tagggggctattctgtttag

SEQ ID NO: 97656 - DNA, 20 bp, Artificial Sequence
  chemically synthesized
atagggggctattctgttta

SEQ ID NO: 97657 - DNA, 20 bp, Artificial Sequence
  chemically synthesized
tgctttacctctaaacagaa

SEQ ID NO: 97658 - DNA, 20 bp, Artificial Sequence
  chemically synthesized
agatagggggctattctgtt

SEQ ID NO: 97659 - DNA, 20 bp, Artificial Sequence
  chemically synthesized
tattctatgtcatagatagg

SEQ ID NO: 97660 - DNA, 20 bp, Artificial Sequence
  chemically synthesized
ctattctatgtcatagatag

SEQ ID NO: 97661 - DNA, 20 bp, Artificial Sequence
  chemically synthesized
cctattctatgtcatagata

SEQ ID NO: 97662 - DNA, 20 bp, Artificial Sequence
  chemically synthesized
tcctattctatgtcatagat

SEQ ID NO: 97663 - DNA, 20 bp, Artificial Sequence
  chemically synthesized
ttcctattctatgtcataga

SEQ ID NO: 97664 - DNA, 20 bp, Artificial Sequence
  chemically synthesized
atagccccctatctatgaca

SEQ ID NO: 97665 - DNA, 20 bp, Artificial Sequence
  chemically synthesized
gcatttcctattctatgtca

SEQ ID NO: 97666 - DNA, 20 bp, Artificial Sequence
  chemically synthesized
cccctatctatgacatagaa

SEQ ID NO: 97667 - DNA, 20 bp, Artificial Sequence
  chemically synthesized
ccctatctatgacatagaat

SEQ ID NO: 97668 - DNA, 20 bp, Artificial Sequence
  chemically synthesized
catagaataggaaatgcctg

SEQ ID NO: 97669 - DNA, 20 bp, Artificial Sequence
  chemically synthesized
atagaataggaaatgcctgc

SEQ ID NO: 97670 - DNA, 20 bp, Artificial Sequence
  chemically synthesized
gaataggaaatgcctgcagg

SEQ ID NO: 97671 - DNA, 20 bp, Artificial Sequence
  chemically synthesized
aataggaaatgcctgcaggc

SEQ ID NO: 97672 - DNA, 20 bp, Artificial Sequence
  chemically synthesized
ataggaaatgcctgcaggca

SEQ ID NO: 97673 - DNA, 20 bp, Artificial Sequence
  chemically synthesized
aagaccagatccctgcctgc

SEQ ID NO: 97674 - DNA, 20 bp, Artificial Sequence
  chemically synthesized
taagaccagatccctgcctg

SEQ ID NO: 97675 - DNA, 20 bp, Artificial Sequence
  chemically synthesized
aatgcctgcaggcagggatc

SEQ ID NO: 97676 - DNA, 20 bp, Artificial Sequence
  chemically synthesized
gatatgaagattaataagac

SEQ ID NO: 97677 - DNA, 20 bp, Artificial Sequence
  chemically synthesized
ttagagatatgaagattaat

SEQ ID NO: 97678 - DNA, 20 bp, Artificial Sequence
  chemically synthesized
gaaagagtgttagagatatg

SEQ ID NO: 97679 - DNA, 20 bp, Artificial Sequence
  chemically synthesized
taagaacagaaagagtgtta

SEQ ID NO: 97680 - DNA, 20 bp, Artificial Sequence
  chemically synthesized
gctaagaacagaaagagtgt

SEQ ID NO: 97681 - DNA, 20 bp, Artificial Sequence
  chemically synthesized
ctatgtgctaagaacagaaa

SEQ ID NO: 97682 - DNA, 20 bp, Artificial Sequence
  chemically synthesized
gtctatgtgctaagaacaga

SEQ ID NO: 97683 - DNA, 20 bp, Artificial Sequence
  chemically synthesized
tctaacactctttctgttct

SEQ ID NO: 97684 - DNA, 20 bp, Artificial Sequence
  chemically synthesized
aatagtctatgtgctaagaa

SEQ ID NO: 97685 - DNA, 20 bp, Artificial Sequence
  chemically synthesized
ctctttctgttcttagcaca

SEQ ID NO: 97686 - DNA, 20 bp, Artificial Sequence
  chemically synthesized
ttaagaatagtctatgtgct

SEQ ID NO: 97687 - DNA, 20 bp, Artificial Sequence
  chemically synthesized
attcattcacgtattaagaa

SEQ ID NO: 97688 - DNA, 20 bp, Artificial Sequence
  chemically synthesized
ccttcattcattcacgtatt

SEQ ID NO: 97689 - DNA, 20 bp, Artificial Sequence
  chemically synthesized
tcttaatacgtgaatgaatg

SEQ ID NO: 97690 - DNA, 20 bp, Artificial Sequence
  chemically synthesized
cttaatacgtgaatgaatga

SEQ ID NO: 97691 - DNA, 20 bp, Artificial Sequence
  chemically synthesized
cgtgaatgaatgaaggaatg

SEQ ID NO: 97692 - DNA, 20 bp, Artificial Sequence
  chemically synthesized
aggaatgaagaatgaatgaa

SEQ ID NO: 97693 - DNA, 20 bp, Artificial Sequence
  chemically synthesized
aatgaatgaacggctattga

SEQ ID NO: 97694 - DNA, 20 bp, Artificial Sequence
  chemically synthesized
tgaagattgatatctttcaa

SEQ ID NO: 97695 - DNA, 20 bp, Artificial Sequence
  chemically synthesized
aacagtgggaaaggaaaatg

SEQ ID NO: 97696 - DNA, 20 bp, Artificial Sequence
  chemically synthesized
ttgatttttaacagtgggaa

SEQ ID NO: 97697 - DNA, 20 bp, Artificial Sequence
  chemically synthesized
tttgatttttaacagtggga

SEQ ID NO: 97698 - DNA, 20 bp, Artificial Sequence
  chemically synthesized
tcgctttgatttttaacagt

SEQ ID NO: 97699 - DNA, 20 bp, Artificial Sequence
  chemically synthesized
atcgctttgatttttaacag

SEQ ID NO: 97700 - DNA, 20 bp, Artificial Sequence
  chemically synthesized
gttatcgctttgatttttaa

SEQ ID NO: 97701 - DNA, 20 bp, Artificial Sequence
  chemically synthesized
tttcccactgttaaaaatca

SEQ ID NO: 97702 - DNA, 20 bp, Artificial Sequence
  chemically synthesized
ttcattctaattggaaattt

SEQ ID NO: 97703 - DNA, 20 bp, Artificial Sequence
  chemically synthesized
cgataactcaaatttccaat

SEQ ID NO: 97704 - DNA, 20 bp, Artificial Sequence
  chemically synthesized
ctggtatgtttcattctaat

SEQ ID NO: 97705 - DNA, 20 bp, Artificial Sequence
  chemically synthesized
ccaattagaatgaaacatac

SEQ ID NO: 97706 - DNA, 20 bp, Artificial Sequence
  chemically synthesized
agaatgaaacataccagttc

SEQ ID NO: 97707 - DNA, 20 bp, Artificial Sequence
  chemically synthesized
gtcagaataccaactagaac

SEQ ID NO: 97708 - DNA, 20 bp, Artificial Sequence
  chemically synthesized
tgaaacataccagttctagt

SEQ ID NO: 97709 - DNA, 20 bp, Artificial Sequence
  chemically synthesized
ttttctgtcagaataccaac

SEQ ID NO: 97710 - DNA, 20 bp, Artificial Sequence
  chemically synthesized
agttctagttggtattctga

SEQ ID NO: 97711 - DNA, 20 bp, Artificial Sequence
  chemically synthesized
tgcagtataattttttctgt

SEQ ID NO: 97712 - DNA, 20 bp, Artificial Sequence
  chemically synthesized
tgacagaaaaaattatactg

SEQ ID NO: 97713 - DNA, 20 bp, Artificial Sequence
  chemically synthesized
gacagaaaaaattatactgc

SEQ ID NO: 97714 - DNA, 20 bp, Artificial Sequence
  chemically synthesized
tagtgtaaaaatataacctg

SEQ ID NO: 97715 - DNA, 20 bp, Artificial Sequence
  chemically synthesized
agttacgtgatggaaaattt

SEQ ID NO: 97716 - DNA, 20 bp, Artificial Sequence
  chemically synthesized
aattaattccagttacgtga

SEQ ID NO: 97717 - DNA, 20 bp, Artificial Sequence
  chemically synthesized
aaaattttccatcacgtaac

SEQ ID NO: 97718 - DNA, 20 bp, Artificial Sequence
  chemically synthesized
atcttggaataaattaattc

SEQ ID NO: 97719 - DNA, 20 bp, Artificial Sequence
  chemically synthesized
aactggaattaatttattcc

SEQ ID NO: 97720 - DNA, 20 bp, Artificial Sequence
  chemically synthesized
ggaattaatttattccaaga

SEQ ID NO: 97721 - DNA, 20 bp, Artificial Sequence
  chemically synthesized
attaatttattccaagatag

SEQ ID NO: 97722 - DNA, 20 bp, Artificial Sequence
  chemically synthesized
ccaatacatttctactatct

SEQ ID NO: 97723 - DNA, 20 bp, Artificial Sequence
  chemically synthesized
ccaagatagtagaaatgtat

SEQ ID NO: 97724 - DNA, 20 bp, Artificial Sequence
  chemically synthesized
atagtagaaatgtattggtg

SEQ ID NO: 97725 - DNA, 20 bp, Artificial Sequence
  chemically synthesized
tattggtgcagtatgaaatg

SEQ ID NO: 97726 - DNA, 20 bp, Artificial Sequence
  chemically synthesized
attggtgcagtatgaaatga

SEQ ID NO: 97727 - DNA, 20 bp, Artificial Sequence
  chemically synthesized
ttggtgcagtatgaaatgaa

SEQ ID NO: 97728 - DNA, 20 bp, Artificial Sequence
  chemically synthesized
tggtgcagtatgaaatgaag

SEQ ID NO: 97729 - DNA, 20 bp, Artificial Sequence
  chemically synthesized
gatttaaataacataataaa

SEQ ID NO: 97730 - DNA, 20 bp, Artificial Sequence
  chemically synthesized
ttaaataacataataaaaag

SEQ ID NO: 97731 - DNA, 20 bp, Artificial Sequence
  chemically synthesized
cagggttaggttatgttaaa

SEQ ID NO: 97732 - DNA, 20 bp, Artificial Sequence
  chemically synthesized
tgtttaacataacctaaccc

SEQ ID NO: 97733 - DNA, 20 bp, Artificial Sequence
  chemically synthesized
gtttaacataacctaaccct

SEQ ID NO: 97734 - DNA, 20 bp, Artificial Sequence
  chemically synthesized
ctattaatcttcccagggtt

SEQ ID NO: 97735 - DNA, 20 bp, Artificial Sequence
  chemically synthesized
gctattaatcttcccagggt

SEQ ID NO: 97736 - DNA, 20 bp, Artificial Sequence
  chemically synthesized
taacataacctaaccctggg

SEQ ID NO: 97737 - DNA, 20 bp, Artificial Sequence
  chemically synthesized
gaaagctattaatcttccca

SEQ ID NO: 97738 - DNA, 20 bp, Artificial Sequence
  chemically synthesized
tgaaagctattaatcttccc

SEQ ID NO: 97739 - DNA, 20 bp, Artificial Sequence
  chemically synthesized
ttgaaagctattaatcttcc

SEQ ID NO: 97740 - DNA, 20 bp, Artificial Sequence
  chemically synthesized
cctaaccctgggaagattaa

SEQ ID NO: 97741 - DNA, 20 bp, Artificial Sequence
  chemically synthesized
tcagtctttgtatgaattga

SEQ ID NO: 97742 - DNA, 20 bp, Artificial Sequence
  chemically synthesized
aatagctttcaattcataca

SEQ ID NO: 97743 - DNA, 20 bp, Artificial Sequence
  chemically synthesized
ttcaattcatacaaagactg

SEQ ID NO: 97744 - DNA, 20 bp, Artificial Sequence
  chemically synthesized
gtatatgaaattgtagactt

SEQ ID NO: 97745 - DNA, 20 bp, Artificial Sequence
  chemically synthesized
accatgtgtatatgaaattg

SEQ ID NO: 97746 - DNA, 20 bp, Artificial Sequence
  chemically synthesized
tctacaatttcatatacaca

SEQ ID NO: 97747 - DNA, 20 bp, Artificial Sequence
  chemically synthesized
aaccagctttcatttttaat

SEQ ID NO: 97748 - DNA, 20 bp, Artificial Sequence
  chemically synthesized
catggtcttattaaaaatga

SEQ ID NO: 97749 - DNA, 20 bp, Artificial Sequence
  chemically synthesized
gtcttattaaaaatgaaagc

SEQ ID NO: 97750 - DNA, 20 bp, Artificial Sequence
  chemically synthesized
tgctagcatttcattataac

SEQ ID NO: 97751 - DNA, 20 bp, Artificial Sequence
  chemically synthesized
agctggttataatgaaatgc

SEQ ID NO: 97752 - DNA, 20 bp, Artificial Sequence
  chemically synthesized
tgccaatcttagcgtggtgc

SEQ ID NO: 97753 - DNA, 20 bp, Artificial Sequence
  chemically synthesized
tgaaatgctagcaccacgct

SEQ ID NO: 97754 - DNA, 20 bp, Artificial Sequence
  chemically synthesized
acaccatgccaatcttagcg

SEQ ID NO: 97755 - DNA, 20 bp, Artificial Sequence
  chemically synthesized
tgctagcaccacgctaagat

SEQ ID NO: 97756 - DNA, 20 bp, Artificial Sequence
  chemically synthesized
ttcatacaccatgccaatct

SEQ ID NO: 97757 - DNA, 20 bp, Artificial Sequence
  chemically synthesized
gcaccacgctaagattggca

SEQ ID NO: 97758 - DNA, 20 bp, Artificial Sequence
  chemically synthesized
gattggcatggtgtatgaaa

SEQ ID NO: 97759 - DNA, 20 bp, Artificial Sequence
  chemically synthesized
gtatgaaatagacaaactaa

SEQ ID NO: 97760 - DNA, 20 bp, Artificial Sequence
  chemically synthesized
aaatagacaaactaacagtg

SEQ ID NO: 97761 - DNA, 20 bp, Artificial Sequence
  chemically synthesized
tccaactattgccacactgt

SEQ ID NO: 97762 - DNA, 20 bp, Artificial Sequence
  chemically synthesized
acaaactaacagtgtggcaa

SEQ ID NO: 97763 - DNA, 20 bp, Artificial Sequence
  chemically synthesized
actaacagtgtggcaatagt

SEQ ID NO: 97764 - DNA, 20 bp, Artificial Sequence
  chemically synthesized
taacagtgtggcaatagttg

SEQ ID NO: 97765 - DNA, 20 bp, Artificial Sequence
  chemically synthesized
aacagtgtggcaatagttgg

SEQ ID NO: 97766 - DNA, 20 bp, Artificial Sequence
  chemically synthesized
agtgtggcaatagttggagg

SEQ ID NO: 97767 - DNA, 20 bp, Artificial Sequence
  chemically synthesized
tagttggaggtggaatttca

SEQ ID NO: 97768 - DNA, 20 bp, Artificial Sequence
  chemically synthesized
agttggaggtggaatttcat

SEQ ID NO: 97769 - DNA, 20 bp, Artificial Sequence
  chemically synthesized
aatttcataggataactttt

SEQ ID NO: 97770 - DNA, 20 bp, Artificial Sequence
  chemically synthesized
ttgaccattttggaactaaa

SEQ ID NO: 97771 - DNA, 20 bp, Artificial Sequence
  chemically synthesized
ataactttttagttccaaaa

SEQ ID NO: 97772 - DNA, 20 bp, Artificial Sequence
  chemically synthesized
attgtgtgatttgaccattt

SEQ ID NO: 97773 - DNA, 20 bp, Artificial Sequence
  chemically synthesized
aaaatggtcaaatcacacaa

SEQ ID NO: 97774 - DNA, 20 bp, Artificial Sequence
  chemically synthesized
tggtcaaatcacacaatggc

SEQ ID NO: 97775 - DNA, 20 bp, Artificial Sequence
  chemically synthesized
gtcaaatcacacaatggctg

SEQ ID NO: 97776 - DNA, 20 bp, Artificial Sequence
  chemically synthesized
ctaattcttaattatatctc

SEQ ID NO: 97777 - DNA, 20 bp, Artificial Sequence
  chemically synthesized
caatggctggagatataatt

SEQ ID NO: 97778 - DNA, 20 bp, Artificial Sequence
  chemically synthesized
ctggagatataattaagaat

SEQ ID NO: 97779 - DNA, 20 bp, Artificial Sequence
  chemically synthesized
tggagatataattaagaatt

SEQ ID NO: 97780 - DNA, 20 bp, Artificial Sequence
  chemically synthesized
tgtttcagaatttgttttta

SEQ ID NO: 97781 - DNA, 20 bp, Artificial Sequence
  chemically synthesized
tctgtttcagaatttgtttt

SEQ ID NO: 97782 - DNA, 20 bp, Artificial Sequence
  chemically synthesized
tctaaaaacaaattctgaaa

SEQ ID NO: 97783 - DNA, 20 bp, Artificial Sequence
  chemically synthesized
aaaaacaaattctgaaacag

SEQ ID NO: 97784 - DNA, 20 bp, Artificial Sequence
  chemically synthesized
aaaacaaattctgaaacaga

SEQ ID NO: 97785 - DNA, 20 bp, Artificial Sequence
  chemically synthesized
atattaattaccttctgttt

SEQ ID NO: 97786 - DNA, 20 bp, Artificial Sequence
  chemically synthesized
gaaggtaattaatatatctt

SEQ ID NO: 97787 - DNA, 20 bp, Artificial Sequence
  chemically synthesized
aaggtaattaatatatcttc

SEQ ID NO: 97788 - DNA, 20 bp, Artificial Sequence
  chemically synthesized
aggtaattaatatatcttcg

SEQ ID NO: 97789 - DNA, 20 bp, Artificial Sequence
  chemically synthesized
aattaatatatcttcgggga

SEQ ID NO: 97790 - DNA, 20 bp, Artificial Sequence
  chemically synthesized
taaaaatccagctttccccg

SEQ ID NO: 97791 - DNA, 20 bp, Artificial Sequence
  chemically synthesized
aatatatcttcggggaaagc

SEQ ID NO: 97792 - DNA, 20 bp, Artificial Sequence
  chemically synthesized
tgtctgattcattaaaaatc

SEQ ID NO: 97793 - DNA, 20 bp, Artificial Sequence
  chemically synthesized
aagctggatttttaatgaat

SEQ ID NO: 97794 - DNA, 20 bp, Artificial Sequence
  chemically synthesized
taatgaatcagacatgaccg

SEQ ID NO: 97795 - DNA, 20 bp, Artificial Sequence
  chemically synthesized
atgaatcagacatgaccgca

SEQ ID NO: 97796 - DNA, 20 bp, Artificial Sequence
  chemically synthesized
atcagacatgaccgcagaga

SEQ ID NO: 97797 - DNA, 20 bp, Artificial Sequence
  chemically synthesized
tcagacatgaccgcagagaa

SEQ ID NO: 97798 - DNA, 20 bp, Artificial Sequence
  chemically synthesized
caacatcgagcctttctctg

SEQ ID NO: 97799 - DNA, 20 bp, Artificial Sequence
  chemically synthesized
agagagtacagggcaacatc

SEQ ID NO: 97800 - DNA, 20 bp, Artificial Sequence
  chemically synthesized
aaccagactaagagagtaca

SEQ ID NO: 97801 - DNA, 20 bp, Artificial Sequence
  chemically synthesized
taaccagactaagagagtac

SEQ ID NO: 97802 - DNA, 20 bp, Artificial Sequence
  chemically synthesized
ctaaccagactaagagagta

SEQ ID NO: 97803 - DNA, 20 bp, Artificial Sequence
  chemically synthesized
gatgttgccctgtactctct

SEQ ID NO: 97804 - DNA, 20 bp, Artificial Sequence
  chemically synthesized
tttagctaaccagactaaga

SEQ ID NO: 97805 - DNA, 20 bp, Artificial Sequence
  chemically synthesized
tgccctgtactctcttagtc

SEQ ID NO: 97806 - DNA, 20 bp, Artificial Sequence
  chemically synthesized
gttttagctaaccagactaa

SEQ ID NO: 97807 - DNA, 20 bp, Artificial Sequence
  chemically synthesized
tggttttagctaaccagact

SEQ ID NO: 97808 - DNA, 20 bp, Artificial Sequence
  chemically synthesized
ctgtactctcttagtctggt

SEQ ID NO: 97809 - DNA, 20 bp, Artificial Sequence
  chemically synthesized
gtggggtggttttagctaac

SEQ ID NO: 97810 - DNA, 20 bp, Artificial Sequence
  chemically synthesized
tccctagtgtggggtggttt

SEQ ID NO: 97811 - DNA, 20 bp, Artificial Sequence
  chemically synthesized
aggaggtccctagtgtgggg

SEQ ID NO: 97812 - DNA, 20 bp, Artificial Sequence
  chemically synthesized
tagctaaaaccaccccacac

SEQ ID NO: 97813 - DNA, 20 bp, Artificial Sequence
  chemically synthesized
agctaaaaccaccccacact

SEQ ID NO: 97814 - DNA, 20 bp, Artificial Sequence
  chemically synthesized
gctaaaaccaccccacacta

SEQ ID NO: 97815 - DNA, 20 bp, Artificial Sequence
  chemically synthesized
actaggaggtccctagtgtg

SEQ ID NO: 97816 - DNA, 20 bp, Artificial Sequence
  chemically synthesized
cactaggaggtccctagtgt

SEQ ID NO: 97817 - DNA, 20 bp, Artificial Sequence
  chemically synthesized
gcactaggaggtccctagtg

SEQ ID NO: 97818 - DNA, 20 bp, Artificial Sequence
  chemically synthesized
cccatgcactaggaggtccc

SEQ ID NO: 97819 - DNA, 20 bp, Artificial Sequence
  chemically synthesized
accccacactagggacctcc

SEQ ID NO: 97820 - DNA, 20 bp, Artificial Sequence
  chemically synthesized
atttaaccccatgcactagg

SEQ ID NO: 97821 - DNA, 20 bp, Artificial Sequence
  chemically synthesized
aatttaaccccatgcactag

SEQ ID NO: 97822 - DNA, 20 bp, Artificial Sequence
  chemically synthesized
actagggacctcctagtgca

SEQ ID NO: 97823 - DNA, 20 bp, Artificial Sequence
  chemically synthesized
ctagggacctcctagtgcat

SEQ ID NO: 97824 - DNA, 20 bp, Artificial Sequence
  chemically synthesized
gaaatttaaccccatgcact

SEQ ID NO: 97825 - DNA, 20 bp, Artificial Sequence
  chemically synthesized
tagggacctcctagtgcatg

SEQ ID NO: 97826 - DNA, 20 bp, Artificial Sequence
  chemically synthesized
tgaaatttaaccccatgcac

SEQ ID NO: 97827 - DNA, 20 bp, Artificial Sequence
  chemically synthesized
gggttaaatttcacatttgt

SEQ ID NO: 97828 - DNA, 20 bp, Artificial Sequence
  chemically synthesized
ttaaatttcacatttgtgag

SEQ ID NO: 97829 - DNA, 20 bp, Artificial Sequence
  chemically synthesized
atttcacatttgtgagcagt

SEQ ID NO: 97830 - DNA, 20 bp, Artificial Sequence
  chemically synthesized
agcagtaagcatgtgtttgc

SEQ ID NO: 97831 - DNA, 20 bp, Artificial Sequence
  chemically synthesized
ccagtatgctgcaagagtgc

SEQ ID NO: 97832 - DNA, 20 bp, Artificial Sequence
  chemically synthesized
tgtgtttgctggcactcttg

SEQ ID NO: 97833 - DNA, 20 bp, Artificial Sequence
  chemically synthesized
gcatgcccagtatgctgcaa

SEQ ID NO: 97834 - DNA, 20 bp, Artificial Sequence
  chemically synthesized
cagcatgcccagtatgctgc

SEQ ID NO: 97835 - DNA, 20 bp, Artificial Sequence
  chemically synthesized
ctggcactcttgcagcatac

SEQ ID NO: 97836 - DNA, 20 bp, Artificial Sequence
  chemically synthesized
tggcactcttgcagcatact

SEQ ID NO: 97837 - DNA, 20 bp, Artificial Sequence
  chemically synthesized
tgatccttccacagcatgcc

SEQ ID NO: 97838 - DNA, 20 bp, Artificial Sequence
  chemically synthesized
gcagcatactgggcatgctg

SEQ ID NO: 97839 - DNA, 20 bp, Artificial Sequence
  chemically synthesized
gcatactgggcatgctgtgg

SEQ ID NO: 97840 - DNA, 20 bp, Artificial Sequence
  chemically synthesized
catactgggcatgctgtgga

SEQ ID NO: 97841 - DNA, 20 bp, Artificial Sequence
  chemically synthesized
aaaattctctgatccttcca

SEQ ID NO: 97842 - DNA, 20 bp, Artificial Sequence
  chemically synthesized
tgggcatgctgtggaaggat

SEQ ID NO: 97843 - DNA, 20 bp, Artificial Sequence
  chemically synthesized
ggcatgctgtggaaggatca

SEQ ID NO: 97844 - DNA, 20 bp, Artificial Sequence
  chemically synthesized
tggaaggatcagagaatttt

SEQ ID NO: 97845 - DNA, 20 bp, Artificial Sequence
  chemically synthesized
ctgtatagaacaaagacatt

SEQ ID NO: 97846 - DNA, 20 bp, Artificial Sequence
  chemically synthesized
atttaaaactgtatagaaca

SEQ ID NO: 97847 - DNA, 20 bp, Artificial Sequence
  chemically synthesized
ctaaatgtctttgttctata

SEQ ID NO: 97848 - DNA, 20 bp, Artificial Sequence
  chemically synthesized
ctcatttatttaaaactgta

SEQ ID NO: 97849 - DNA, 20 bp, Artificial Sequence
  chemically synthesized
ctatacagttttaaataaat

SEQ ID NO: 97850 - DNA, 20 bp, Artificial Sequence
  chemically synthesized
ttaaataaatgagtcatttt

SEQ ID NO: 97851 - DNA, 20 bp, Artificial Sequence
  chemically synthesized
aaatgagtcattttcagact

SEQ ID NO: 97852 - DNA, 20 bp, Artificial Sequence
  chemically synthesized
atgagtcattttcagacttg

SEQ ID NO: 97853 - DNA, 20 bp, Artificial Sequence
  chemically synthesized
cagatttaaagaaaaactcc

SEQ ID NO: 97854 - DNA, 20 bp, Artificial Sequence
  chemically synthesized
attttataccaacagattta

SEQ ID NO: 97855 - DNA, 20 bp, Artificial Sequence
  chemically synthesized
gagtttttctttaaatctgt

SEQ ID NO: 97856 - DNA, 20 bp, Artificial Sequence
  chemically synthesized
aaaataggattttataccaa

SEQ ID NO: 97857 - DNA, 20 bp, Artificial Sequence
  chemically synthesized
tatggtttcatttagaaaat

SEQ ID NO: 97858 - DNA, 20 bp, Artificial Sequence
  chemically synthesized
gtatggtttcatttagaaaa

SEQ ID NO: 97859 - DNA, 20 bp, Artificial Sequence
  chemically synthesized
cttttgagtatggtttcatt

SEQ ID NO: 97860 - DNA, 20 bp, Artificial Sequence
  chemically synthesized
ctaaatgaaaccatactcaa

SEQ ID NO: 97861 - DNA, 20 bp, Artificial Sequence
  chemically synthesized
atatattccacttttgagta

SEQ ID NO: 97862 - DNA, 20 bp, Artificial Sequence
  chemically synthesized
aatgaaaccatactcaaaag

SEQ ID NO: 97863 - DNA, 20 bp, Artificial Sequence
  chemically synthesized
ctttcatatattccactttt

SEQ ID NO: 97864 - DNA, 20 bp, Artificial Sequence
  chemically synthesized
ctcaaaagtggaatatatga

SEQ ID NO: 97865 - DNA, 20 bp, Artificial Sequence
  chemically synthesized
caaaagtggaatatatgaaa

SEQ ID NO: 97866 - DNA, 20 bp, Artificial Sequence
  chemically synthesized
ggaatatatgaaagagataa

SEQ ID NO: 97867 - DNA, 20 bp, Artificial Sequence
  chemically synthesized
atgaaagagataaaagatga

SEQ ID NO: 97868 - DNA, 20 bp, Artificial Sequence
  chemically synthesized
gataaaagatgaaagtattc

SEQ ID NO: 97869 - DNA, 20 bp, Artificial Sequence
  chemically synthesized
aaaagatgaaagtattcaag

SEQ ID NO: 97870 - DNA, 20 bp, Artificial Sequence
  chemically synthesized
aaagatgaaagtattcaagt

SEQ ID NO: 97871 - DNA, 20 bp, Artificial Sequence
  chemically synthesized
atgaaagtattcaagtgggt

SEQ ID NO: 97872 - DNA, 20 bp, Artificial Sequence
  chemically synthesized
tgaaagtattcaagtgggtt

SEQ ID NO: 97873 - DNA, 20 bp, Artificial Sequence
  chemically synthesized
gaaagtattcaagtgggtta

SEQ ID NO: 97874 - DNA, 20 bp, Artificial Sequence
  chemically synthesized
tcaagtgggttagggaacct

SEQ ID NO: 97875 - DNA, 20 bp, Artificial Sequence
  chemically synthesized
gtgggttagggaaccttgga

SEQ ID NO: 97876 - DNA, 20 bp, Artificial Sequence
  chemically synthesized
gggttagggaaccttggaaa

SEQ ID NO: 97877 - DNA, 20 bp, Artificial Sequence
  chemically synthesized
gattgaatgggctctttcca

SEQ ID NO: 97878 - DNA, 20 bp, Artificial Sequence
  chemically synthesized
ggattgaatgggctctttcc

SEQ ID NO: 97879 - DNA, 20 bp, Artificial Sequence
  chemically synthesized
gatgggaagagggattgaat

SEQ ID NO: 97880 - DNA, 20 bp, Artificial Sequence
  chemically synthesized
agatgggaagagggattgaa

SEQ ID NO: 97881 - DNA, 20 bp, Artificial Sequence
  chemically synthesized
caaagggagagatgggaaga

SEQ ID NO: 97882 - DNA, 20 bp, Artificial Sequence
  chemically synthesized
ccaaagggagagatgggaag

SEQ ID NO: 97883 - DNA, 20 bp, Artificial Sequence
  chemically synthesized
gccaaagggagagatgggaa

SEQ ID NO: 97884 - DNA, 20 bp, Artificial Sequence
  chemically synthesized
aggccaaagggagagatggg

SEQ ID NO: 97885 - DNA, 20 bp, Artificial Sequence
  chemically synthesized
cagaggccaaagggagagat

SEQ ID NO: 97886 - DNA, 20 bp, Artificial Sequence
  chemically synthesized
tcagaggccaaagggagaga

SEQ ID NO: 97887 - DNA, 20 bp, Artificial Sequence
  chemically synthesized
cctcttcccatctctccctt

SEQ ID NO: 97888 - DNA, 20 bp, Artificial Sequence
  chemically synthesized
tgcctcagaggccaaaggga

SEQ ID NO: 97889 - DNA, 20 bp, Artificial Sequence
  chemically synthesized
ggtgcctcagaggccaaagg

SEQ ID NO: 97890 - DNA, 20 bp, Artificial Sequence
  chemically synthesized
aaggtgcctcagaggccaaa

SEQ ID NO: 97891 - DNA, 20 bp, Artificial Sequence
  chemically synthesized
caaggtgcctcagaggccaa

SEQ ID NO: 97892 - DNA, 20 bp, Artificial Sequence
  chemically synthesized
gcaaggtgcctcagaggcca

SEQ ID NO: 97893 - DNA, 20 bp, Artificial Sequence
  chemically synthesized
catctctccctttggcctct

SEQ ID NO: 97894 - DNA, 20 bp, Artificial Sequence
  chemically synthesized
atctctccctttggcctctg

SEQ ID NO: 97895 - DNA, 20 bp, Artificial Sequence
  chemically synthesized
agttctgcaaggtgcctcag

SEQ ID NO: 97896 - DNA, 20 bp, Artificial Sequence
  chemically synthesized
aagttctgcaaggtgcctca

SEQ ID NO: 97897 - DNA, 20 bp, Artificial Sequence
  chemically synthesized
gaaagttctgcaaggtgcct

SEQ ID NO: 97898 - DNA, 20 bp, Artificial Sequence
  chemically synthesized
ttggcctctgaggcaccttg

SEQ ID NO: 97899 - DNA, 20 bp, Artificial Sequence
  chemically synthesized
tcattctagaaagttctgca

SEQ ID NO: 97900 - DNA, 20 bp, Artificial Sequence
  chemically synthesized
gtcattctagaaagttctgc

SEQ ID NO: 97901 - DNA, 20 bp, Artificial Sequence
  chemically synthesized
aggcaccttgcagaactttc

SEQ ID NO: 97902 - DNA, 20 bp, Artificial Sequence
  chemically synthesized
accattcaagtcattctaga

SEQ ID NO: 97903 - DNA, 20 bp, Artificial Sequence
  chemically synthesized
gcaaaccattcaagtcattc

SEQ ID NO: 97904 - DNA, 20 bp, Artificial Sequence
  chemically synthesized
actttctagaatgacttgaa

SEQ ID NO: 97905 - DNA, 20 bp, Artificial Sequence
  chemically synthesized
tcaaaccatgcaaaccattc

SEQ ID NO: 97906 - DNA, 20 bp, Artificial Sequence
  chemically synthesized
aatgacttgaatggtttgca

SEQ ID NO: 97907 - DNA, 20 bp, Artificial Sequence
  chemically synthesized
tggtttgaattcgatttgca

SEQ ID NO: 97908 - DNA, 20 bp, Artificial Sequence
  chemically synthesized
attcgatttgcatggtctga

SEQ ID NO: 97909 - DNA, 20 bp, Artificial Sequence
  chemically synthesized
gctccagatctggaggcttt

SEQ ID NO: 97910 - DNA, 20 bp, Artificial Sequence
  chemically synthesized
ttgcatggtctgaaagcctc

SEQ ID NO: 97911 - DNA, 20 bp, Artificial Sequence
  chemically synthesized
ggtctgaaagcctccagatc

SEQ ID NO: 97912 - DNA, 20 bp, Artificial Sequence
  chemically synthesized
gagtgttgctccagatctgg

SEQ ID NO: 97913 - DNA, 20 bp, Artificial Sequence
  chemically synthesized
tgagtgttgctccagatctg

SEQ ID NO: 97914 - DNA, 20 bp, Artificial Sequence
  chemically synthesized
tctgaaagcctccagatctg

SEQ ID NO: 97915 - DNA, 20 bp, Artificial Sequence
  chemically synthesized
tatgagtgttgctccagatc

SEQ ID NO: 97916 - DNA, 20 bp, Artificial Sequence
  chemically synthesized
gaaaagtatgagtgttgctc

SEQ ID NO: 97917 - DNA, 20 bp, Artificial Sequence
  chemically synthesized
ttacctcacctgaaaagtat

SEQ ID NO: 97918 - DNA, 20 bp, Artificial Sequence
  chemically synthesized
ggagcaacactcatactttt

SEQ ID NO: 97919 - DNA, 20 bp, Artificial Sequence
  chemically synthesized
gagcaacactcatacttttc

SEQ ID NO: 97920 - DNA, 20 bp, Artificial Sequence
  chemically synthesized
aacactcatacttttcaggt

SEQ ID NO: 97921 - DNA, 20 bp, Artificial Sequence
  chemically synthesized
tcccagttacctcacctgaa

SEQ ID NO: 97922 - DNA, 20 bp, Artificial Sequence
  chemically synthesized
acactcatacttttcaggtg

SEQ ID NO: 97923 - DNA, 20 bp, Artificial Sequence
  chemically synthesized
tacttttcaggtgaggtaac

SEQ ID NO: 97924 - DNA, 20 bp, Artificial Sequence
  chemically synthesized
acttttcaggtgaggtaact

SEQ ID NO: 97925 - DNA, 20 bp, Artificial Sequence
  chemically synthesized
aggtgaggtaactgggattt

SEQ ID NO: 97926 - DNA, 20 bp, Artificial Sequence
  chemically synthesized
tccctgaacttcttaaatcc

SEQ ID NO: 97927 - DNA, 20 bp, Artificial Sequence
  chemically synthesized
tgaggtaactgggatttaag

SEQ ID NO: 97928 - DNA, 20 bp, Artificial Sequence
  chemically synthesized
taactgggatttaagaagtt

SEQ ID NO: 97929 - DNA, 20 bp, Artificial Sequence
  chemically synthesized
aactgggatttaagaagttc

SEQ ID NO: 97930 - DNA, 20 bp, Artificial Sequence
  chemically synthesized
actgggatttaagaagttca

SEQ ID NO: 97931 - DNA, 20 bp, Artificial Sequence
  chemically synthesized
ttttgcaaaatcacaccgac

SEQ ID NO: 97932 - DNA, 20 bp, Artificial Sequence
  chemically synthesized
ctctcaactgatttacttgt

SEQ ID NO: 97933 - DNA, 20 bp, Artificial Sequence
  chemically synthesized
aatcacaccgacaagtaaat

SEQ ID NO: 97934 - DNA, 20 bp, Artificial Sequence
  chemically synthesized
caccgacaagtaaatcagtt

SEQ ID NO: 97935 - DNA, 20 bp, Artificial Sequence
  chemically synthesized
ccgacaagtaaatcagttga

SEQ ID NO: 97936 - DNA, 20 bp, Artificial Sequence
  chemically synthesized
cgacaagtaaatcagttgag

SEQ ID NO: 97937 - DNA, 20 bp, Artificial Sequence
  chemically synthesized
gacaagtaaatcagttgaga

SEQ ID NO: 97938 - DNA, 20 bp, Artificial Sequence
  chemically synthesized
aagtaaatcagttgagaggg

SEQ ID NO: 97939 - DNA, 20 bp, Artificial Sequence
  chemically synthesized
agtaaatcagttgagaggga

SEQ ID NO: 97940 - DNA, 20 bp, Artificial Sequence
  chemically synthesized
tcagttgagagggaaggaac

SEQ ID NO: 97941 - DNA, 20 bp, Artificial Sequence
  chemically synthesized
agttgagagggaaggaacca

SEQ ID NO: 97942 - DNA, 20 bp, Artificial Sequence
  chemically synthesized
ctggtgctacgaaaatactc

SEQ ID NO: 97943 - DNA, 20 bp, Artificial Sequence
  chemically synthesized
aaggaaccagagtattttcg

SEQ ID NO: 97944 - DNA, 20 bp, Artificial Sequence
  chemically synthesized
ccagagtattttcgtagcac

SEQ ID NO: 97945 - DNA, 20 bp, Artificial Sequence
  chemically synthesized
cagagtattttcgtagcacc

SEQ ID NO: 97946 - DNA, 20 bp, Artificial Sequence
  chemically synthesized
attttcgtagcaccaggtct

SEQ ID NO: 97947 - DNA, 20 bp, Artificial Sequence
  chemically synthesized
ttttcgtagcaccaggtctt

SEQ ID NO: 97948 - DNA, 20 bp, Artificial Sequence
  chemically synthesized
tttcgtagcaccaggtcttg

SEQ ID NO: 97949 - DNA, 20 bp, Artificial Sequence
  chemically synthesized
aagtcaaaagccccaagacc

SEQ ID NO: 97950 - DNA, 20 bp, Artificial Sequence
  chemically synthesized
aaattgaagtcaaaagcccc

SEQ ID NO: 97951 - DNA, 20 bp, Artificial Sequence
  chemically synthesized
caatgagaaattgaagtcaa

SEQ ID NO: 97952 - DNA, 20 bp, Artificial Sequence
  chemically synthesized
ggcagggcaatgagaaattg

SEQ ID NO: 97953 - DNA, 20 bp, Artificial Sequence
  chemically synthesized
gttccagggggcagggcaat

SEQ ID NO: 97954 - DNA, 20 bp, Artificial Sequence
  chemically synthesized
tttctcattgccctgccccc

SEQ ID NO: 97955 - DNA, 20 bp, Artificial Sequence
  chemically synthesized
tggcactgttccagggggca

SEQ ID NO: 97956 - DNA, 20 bp, Artificial Sequence
  chemically synthesized
gtggcactgttccagggggc

SEQ ID NO: 97957 - DNA, 20 bp, Artificial Sequence
  chemically synthesized
agtggcactgttccaggggg

SEQ ID NO: 97958 - DNA, 20 bp, Artificial Sequence
  chemically synthesized
cattgccctgccccctggaa

SEQ ID NO: 97959 - DNA, 20 bp, Artificial Sequence
  chemically synthesized
ttgagtggcactgttccagg

SEQ ID NO: 97960 - DNA, 20 bp, Artificial Sequence
  chemically synthesized
attgagtggcactgttccag

SEQ ID NO: 97961 - DNA, 20 bp, Artificial Sequence
  chemically synthesized
cattgagtggcactgttcca

SEQ ID NO: 97962 - DNA, 20 bp, Artificial Sequence
  chemically synthesized
ccattgagtggcactgttcc

SEQ ID NO: 97963 - DNA, 20 bp, Artificial Sequence
  chemically synthesized
accattgagtggcactgttc

SEQ ID NO: 97964 - DNA, 20 bp, Artificial Sequence
  chemically synthesized
cctggaacagtgccactcaa

SEQ ID NO: 97965 - DNA, 20 bp, Artificial Sequence
  chemically synthesized
gcaacctatgaaccattgag

SEQ ID NO: 97966 - DNA, 20 bp, Artificial Sequence
  chemically synthesized
ctggcaacctatgaaccatt

SEQ ID NO: 97967 - DNA, 20 bp, Artificial Sequence
  chemically synthesized
cagtgccactcaatggttca

SEQ ID NO: 97968 - DNA, 20 bp, Artificial Sequence
  chemically synthesized
agtgccactcaatggttcat

SEQ ID NO: 97969 - DNA, 20 bp, Artificial Sequence
  chemically synthesized
ctcaatggttcataggttgc

SEQ ID NO: 97970 - DNA, 20 bp, Artificial Sequence
  chemically synthesized
ggttcataggttgccagcat

SEQ ID NO: 97971 - DNA, 20 bp, Artificial Sequence
  chemically synthesized
ccaggtgatgacactcatgc

SEQ ID NO: 97972 - DNA, 20 bp, Artificial Sequence
  chemically synthesized
ccagcatgagtgtcatcacc

SEQ ID NO: 97973 - DNA, 20 bp, Artificial Sequence
  chemically synthesized
cagcatgagtgtcatcacct

SEQ ID NO: 97974 - DNA, 20 bp, Artificial Sequence
  chemically synthesized
gcatgagtgtcatcacctgg

SEQ ID NO: 97975 - DNA, 20 bp, Artificial Sequence
  chemically synthesized
gagtgtcatcacctgggagc

SEQ ID NO: 97976 - DNA, 20 bp, Artificial Sequence
  chemically synthesized
tgcattgctaaccagctccc

SEQ ID NO: 97977 - DNA, 20 bp, Artificial Sequence
  chemically synthesized
ctgcattgctaaccagctcc

SEQ ID NO: 97978 - DNA, 20 bp, Artificial Sequence
  chemically synthesized
gtcatcacctgggagctggt

SEQ ID NO: 97979 - DNA, 20 bp, Artificial Sequence
  chemically synthesized
tgcgattctgcattgctaac

SEQ ID NO: 97980 - DNA, 20 bp, Artificial Sequence
  chemically synthesized
ctgggagctggttagcaatg

SEQ ID NO: 97981 - DNA, 20 bp, Artificial Sequence
  chemically synthesized
tggttagcaatgcagaatcg

SEQ ID NO: 97982 - DNA, 20 bp, Artificial Sequence
  chemically synthesized
ggttagcaatgcagaatcgc

SEQ ID NO: 97983 - DNA, 20 bp, Artificial Sequence
  chemically synthesized
cagaatcgcaggccttgcca

SEQ ID NO: 97984 - DNA, 20 bp, Artificial Sequence
  chemically synthesized
gatttagcaggtctgtggca

SEQ ID NO: 97985 - DNA, 20 bp, Artificial Sequence
  chemically synthesized
tgatttagcaggtctgtggc

SEQ ID NO: 97986 - DNA, 20 bp, Artificial Sequence
  chemically synthesized
attctgatttagcaggtctg

SEQ ID NO: 97987 - DNA, 20 bp, Artificial Sequence
  chemically synthesized
ttgccacagacctgctaaat

SEQ ID NO: 97988 - DNA, 20 bp, Artificial Sequence
  chemically synthesized
cacagagattctgatttagc

SEQ ID NO: 97989 - DNA, 20 bp, Artificial Sequence
  chemically synthesized
ccacagagattctgatttag

SEQ ID NO: 97990 - DNA, 20 bp, Artificial Sequence
  chemically synthesized
ccaccacagagattctgatt

SEQ ID NO: 97991 - DNA, 20 bp, Artificial Sequence
  chemically synthesized
ctgctaaatcagaatctctg

SEQ ID NO: 97992 - DNA, 20 bp, Artificial Sequence
  chemically synthesized
ctaaatcagaatctctgtgg

SEQ ID NO: 97993 - DNA, 20 bp, Artificial Sequence
  chemically synthesized
taaatcagaatctctgtggt

SEQ ID NO: 97994 - DNA, 20 bp, Artificial Sequence
  chemically synthesized
gttgtctggatcccaccaca

SEQ ID NO: 97995 - DNA, 20 bp, Artificial Sequence
  chemically synthesized
cagttgtctggatcccacca

SEQ ID NO: 97996 - DNA, 20 bp, Artificial Sequence
  chemically synthesized
agaatctctgtggtgggatc

SEQ ID NO: 97997 - DNA, 20 bp, Artificial Sequence
  chemically synthesized
cttatgaaaatgcagttgtc

SEQ ID NO: 97998 - DNA, 20 bp, Artificial Sequence
  chemically synthesized
ctggcaagcttatgaaaatg

SEQ ID NO: 97999 - DNA, 20 bp, Artificial Sequence
  chemically synthesized
ccagacaactgcattttcat

SEQ ID NO: 98000 - DNA, 20 bp, Artificial Sequence
  chemically synthesized
ctgcattttcataagcttgc

SEQ ID NO: 98001 - DNA, 20 bp, Artificial Sequence
  chemically synthesized
tgcattttcataagcttgcc

SEQ ID NO: 98002 - DNA, 20 bp, Artificial Sequence
  chemically synthesized
atgcttaagaatgacctggc

SEQ ID NO: 98003 - DNA, 20 bp, Artificial Sequence
  chemically synthesized
gaggatgcttaagaatgacc

SEQ ID NO: 98004 - DNA, 20 bp, Artificial Sequence
  chemically synthesized
aagcttgccaggtcattctt

SEQ ID NO: 98005 - DNA, 20 bp, Artificial Sequence
  chemically synthesized
gttcaagggtgaggatgctt

SEQ ID NO: 98006 - DNA, 20 bp, Artificial Sequence
  chemically synthesized
gggaaagatgttcaagggtg

SEQ ID NO: 98007 - DNA, 20 bp, Artificial Sequence
  chemically synthesized
cgggaaagatgttcaagggt

SEQ ID NO: 98008 - DNA, 20 bp, Artificial Sequence
  chemically synthesized
aagacgggaaagatgttcaa

SEQ ID NO: 98009 - DNA, 20 bp, Artificial Sequence
  chemically synthesized
aaagacgggaaagatgttca

SEQ ID NO: 98010 - DNA, 20 bp, Artificial Sequence
  chemically synthesized
gaaagacgggaaagatgttc

SEQ ID NO: 98011 - DNA, 20 bp, Artificial Sequence
  chemically synthesized
gaagaaaaggaaagacggga

SEQ ID NO: 98012 - DNA, 20 bp, Artificial Sequence
  chemically synthesized
accagaagaaaaggaaagac

SEQ ID NO: 98013 - DNA, 20 bp, Artificial Sequence
  chemically synthesized
gaccagaagaaaaggaaaga

SEQ ID NO: 98014 - DNA, 20 bp, Artificial Sequence
  chemically synthesized
tcatgaccagaagaaaagga

SEQ ID NO: 98015 - DNA, 20 bp, Artificial Sequence
  chemically synthesized
tcccgtctttccttttcttc

SEQ ID NO: 98016 - DNA, 20 bp, Artificial Sequence
  chemically synthesized
ggaatcatgaccagaagaaa

SEQ ID NO: 98017 - DNA, 20 bp, Artificial Sequence
  chemically synthesized
aggaatcatgaccagaagaa

SEQ ID NO: 98018 - DNA, 20 bp, Artificial Sequence
  chemically synthesized
agttgaggaatcatgaccag

SEQ ID NO: 98019 - DNA, 20 bp, Artificial Sequence
  chemically synthesized
gggagttgaggaatcatgac

SEQ ID NO: 98020 - DNA, 20 bp, Artificial Sequence
  chemically synthesized
acttttgagcttgggagttg

SEQ ID NO: 98021 - DNA, 20 bp, Artificial Sequence
  chemically synthesized
gtcatgattcctcaactccc

SEQ ID NO: 98022 - DNA, 20 bp, Artificial Sequence
  chemically synthesized
tacttttgagcttgggagtt

SEQ ID NO: 98023 - DNA, 20 bp, Artificial Sequence
  chemically synthesized
ttcactacttttgagcttgg

SEQ ID NO: 98024 - DNA, 20 bp, Artificial Sequence
  chemically synthesized
ttttcactacttttgagctt

SEQ ID NO: 98025 - DNA, 20 bp, Artificial Sequence
  chemically synthesized
tcctcaactcccaagctcaa

SEQ ID NO: 98026 - DNA, 20 bp, Artificial Sequence
  chemically synthesized
attttcactacttttgagct

SEQ ID NO: 98027 - DNA, 20 bp, Artificial Sequence
  chemically synthesized
tcaactcccaagctcaaaag

SEQ ID NO: 98028 - DNA, 20 bp, Artificial Sequence
  chemically synthesized
acaacattttcactactttt

SEQ ID NO: 98029 - DNA, 20 bp, Artificial Sequence
  chemically synthesized
gtagtgaaaatgttgttata

SEQ ID NO: 98030 - DNA, 20 bp, Artificial Sequence
  chemically synthesized
tagtgaaaatgttgttataa

SEQ ID NO: 98031 - DNA, 20 bp, Artificial Sequence
  chemically synthesized
aaaatgttgttataaaggaa

SEQ ID NO: 98032 - DNA, 20 bp, Artificial Sequence
  chemically synthesized
taaaggaacagaaaaaaaat

SEQ ID NO: 98033 - DNA, 20 bp, Artificial Sequence
  chemically synthesized
aaaggaacagaaaaaaaatt

SEQ ID NO: 98034 - DNA, 20 bp, Artificial Sequence
  chemically synthesized
aggaacagaaaaaaaattag

SEQ ID NO: 98035 - DNA, 20 bp, Artificial Sequence
  chemically synthesized
gaacagaaaaaaaattagga

SEQ ID NO: 98036 - DNA, 20 bp, Artificial Sequence
  chemically synthesized
aacagaaaaaaaattaggag

SEQ ID NO: 98037 - DNA, 20 bp, Artificial Sequence
  chemically synthesized
aaaaaaaattaggagaggaa

SEQ ID NO: 98038 - DNA, 20 bp, Artificial Sequence
  chemically synthesized
aaaaaattaggagaggaata

SEQ ID NO: 98039 - DNA, 20 bp, Artificial Sequence
  chemically synthesized
aaaattaggagaggaataga

SEQ ID NO: 98040 - DNA, 20 bp, Artificial Sequence
  chemically synthesized
aatagagagtgaaattactc

SEQ ID NO: 98041 - DNA, 20 bp, Artificial Sequence
  chemically synthesized
tagagagtgaaattactcca

SEQ ID NO: 98042 - DNA, 20 bp, Artificial Sequence
  chemically synthesized
gtgagggaataaaggctctg

SEQ ID NO: 98043 - DNA, 20 bp, Artificial Sequence
  chemically synthesized
aggtgagggaataaaggctc

SEQ ID NO: 98044 - DNA, 20 bp, Artificial Sequence
  chemically synthesized
gacctgaggtgagggaataa

SEQ ID NO: 98045 - DNA, 20 bp, Artificial Sequence
  chemically synthesized
ggacctgaggtgagggaata

SEQ ID NO: 98046 - DNA, 20 bp, Artificial Sequence
  chemically synthesized
gagcctttattccctcacct

SEQ ID NO: 98047 - DNA, 20 bp, Artificial Sequence
  chemically synthesized
agcctttattccctcacctc

SEQ ID NO: 98048 - DNA, 20 bp, Artificial Sequence
  chemically synthesized
ttcagtgggacctgaggtga

SEQ ID NO: 98049 - DNA, 20 bp, Artificial Sequence
  chemically synthesized
cttcagtgggacctgaggtg

SEQ ID NO: 98050 - DNA, 20 bp, Artificial Sequence
  chemically synthesized
acttcagtgggacctgaggt

SEQ ID NO: 98051 - DNA, 20 bp, Artificial Sequence
  chemically synthesized
aatgacttcagtgggacctg

SEQ ID NO: 98052 - DNA, 20 bp, Artificial Sequence
  chemically synthesized
aaatgacttcagtgggacct

SEQ ID NO: 98053 - DNA, 20 bp, Artificial Sequence
  chemically synthesized
cctcacctcaggtcccactg

SEQ ID NO: 98054 - DNA, 20 bp, Artificial Sequence
  chemically synthesized
atttccaaaatgacttcagt

SEQ ID NO: 98055 - DNA, 20 bp, Artificial Sequence
  chemically synthesized
aatttccaaaatgacttcag

SEQ ID NO: 98056 - DNA, 20 bp, Artificial Sequence
  chemically synthesized
cataatttccaaaatgactt

SEQ ID NO: 98057 - DNA, 20 bp, Artificial Sequence
  chemically synthesized
aggtcccactgaagtcattt

SEQ ID NO: 98058 - DNA, 20 bp, Artificial Sequence
  chemically synthesized
aagtcattttggaaattatg

SEQ ID NO: 98059 - DNA, 20 bp, Artificial Sequence
  chemically synthesized
aaaaaaaaaagaaaaagaaa

SEQ ID NO: 98060 - DNA, 20 bp, Artificial Sequence
  chemically synthesized
aaaaaaaaaaaaaaaagaaa

SEQ ID NO: 98061 - DNA, 20 bp, Artificial Sequence
  chemically synthesized
tgtctcaaaaaaaaaaaaaa

SEQ ID NO: 98062 - DNA, 20 bp, Artificial Sequence
  chemically synthesized
tttctttttttttttttttt

SEQ ID NO: 98063 - DNA, 20 bp, Artificial Sequence
  chemically synthesized
ttttttttttttttttgaga

SEQ ID NO: 98064 - DNA, 20 bp, Artificial Sequence
  chemically synthesized
tttttttttttttttgagac

SEQ ID NO: 98065 - DNA, 20 bp, Artificial Sequence
  chemically synthesized
ttttttttttttttgagaca

SEQ ID NO: 98066 - DNA, 20 bp, Artificial Sequence
  chemically synthesized
gagacagggtttcaccatat

SEQ ID NO: 98067 - DNA, 20 bp, Artificial Sequence
  chemically synthesized
cgagaccagctttgccaata

SEQ ID NO: 98068 - DNA, 20 bp, Artificial Sequence
  chemically synthesized
agggtttcaccatattggca

SEQ ID NO: 98069 - DNA, 20 bp, Artificial Sequence
  chemically synthesized
tttcaccatattggcaaagc

SEQ ID NO: 98070 - DNA, 20 bp, Artificial Sequence
  chemically synthesized
tgaggtcaggagttcgagac

SEQ ID NO: 98071 - DNA, 20 bp, Artificial Sequence
  chemically synthesized
tcacttgaggtcaggagttc

SEQ ID NO: 98072 - DNA, 20 bp, Artificial Sequence
  chemically synthesized
ggcagatcacttgaggtcag

SEQ ID NO: 98073 - DNA, 20 bp, Artificial Sequence
  chemically synthesized
ggtctcgaactcctgacctc

SEQ ID NO: 98074 - DNA, 20 bp, Artificial Sequence
  chemically synthesized
agggcagatcacttgaggtc

SEQ ID NO: 98075 - DNA, 20 bp, Artificial Sequence
  chemically synthesized
gagggcagatcacttgaggt

SEQ ID NO: 98076 - DNA, 20 bp, Artificial Sequence
  chemically synthesized
tgaggagggcagatcacttg

SEQ ID NO: 98077 - DNA, 20 bp, Artificial Sequence
  chemically synthesized
ctgaggagggcagatcactt

SEQ ID NO: 98078 - DNA, 20 bp, Artificial Sequence
  chemically synthesized
ctcaagtgatctgccctcct

SEQ ID NO: 98079 - DNA, 20 bp, Artificial Sequence
  chemically synthesized
ctttgggaggctgaggaggg

SEQ ID NO: 98080 - DNA, 20 bp, Artificial Sequence
  chemically synthesized
gtactttgggaggctgagga

SEQ ID NO: 98081 - DNA, 20 bp, Artificial Sequence
  chemically synthesized
agtactttgggaggctgagg

SEQ ID NO: 98082 - DNA, 20 bp, Artificial Sequence
  chemically synthesized
cagtactttgggaggctgag

SEQ ID NO: 98083 - DNA, 20 bp, Artificial Sequence
  chemically synthesized
cccagtactttgggaggctg

SEQ ID NO: 98084 - DNA, 20 bp, Artificial Sequence
  chemically synthesized
tcccagtactttgggaggct

SEQ ID NO: 98085 - DNA, 20 bp, Artificial Sequence
  chemically synthesized
ctgccctcctcagcctccca

SEQ ID NO: 98086 - DNA, 20 bp, Artificial Sequence
  chemically synthesized
tgtaatcccagtactttggg

SEQ ID NO: 98087 - DNA, 20 bp, Artificial Sequence
  chemically synthesized
ctgtaatcccagtactttgg

SEQ ID NO: 98088 - DNA, 20 bp, Artificial Sequence
  chemically synthesized
tcctcagcctcccaaagtac

SEQ ID NO: 98089 - DNA, 20 bp, Artificial Sequence
  chemically synthesized
gcctgtaatcccagtacttt

SEQ ID NO: 98090 - DNA, 20 bp, Artificial Sequence
  chemically synthesized
cctcagcctcccaaagtact

SEQ ID NO: 98091 - DNA, 20 bp, Artificial Sequence
  chemically synthesized
agcctgtaatcccagtactt

SEQ ID NO: 98092 - DNA, 20 bp, Artificial Sequence
  chemically synthesized
ctcccaaagtactgggatta

SEQ ID NO: 98093 - DNA, 20 bp, Artificial Sequence
  chemically synthesized
tcccaaagtactgggattac

SEQ ID NO: 98094 - DNA, 20 bp, Artificial Sequence
  chemically synthesized
agtggcgcagcctgtaatcc

SEQ ID NO: 98095 - DNA, 20 bp, Artificial Sequence
  chemically synthesized
ccaggcctggtgcagtggcg

SEQ ID NO: 98096 - DNA, 20 bp, Artificial Sequence
  chemically synthesized
tacaggctgcgccactgcac

SEQ ID NO: 98097 - DNA, 20 bp, Artificial Sequence
  chemically synthesized
acaggctgcgccactgcacc

SEQ ID NO: 98098 - DNA, 20 bp, Artificial Sequence
  chemically synthesized
aatttccaggcctggtgcag

SEQ ID NO: 98099 - DNA, 20 bp, Artificial Sequence
  chemically synthesized
cttaatttccaggcctggtg

SEQ ID NO: 98100 - DNA, 20 bp, Artificial Sequence
  chemically synthesized
ctgcgccactgcaccaggcc

SEQ ID NO: 98101 - DNA, 20 bp, Artificial Sequence
  chemically synthesized
agatacttaatttccaggcc

SEQ ID NO: 98102 - DNA, 20 bp, Artificial Sequence
  chemically synthesized
ctgcaccaggcctggaaatt

SEQ ID NO: 98103 - DNA, 20 bp, Artificial Sequence
  chemically synthesized
aacaaagatacttaatttcc

SEQ ID NO: 98104 - DNA, 20 bp, Artificial Sequence
  chemically synthesized
aaacaaagatacttaatttc

SEQ ID NO: 98105 - DNA, 20 bp, Artificial Sequence
  chemically synthesized
cataatgccatcattaaaca

SEQ ID NO: 98106 - DNA, 20 bp, Artificial Sequence
  chemically synthesized
taagtatctttgtttaatga

SEQ ID NO: 98107 - DNA, 20 bp, Artificial Sequence
  chemically synthesized
ttaatgatggcattatgaaa

SEQ ID NO: 98108 - DNA, 20 bp, Artificial Sequence
  chemically synthesized
agaggagtggcagaacatat

SEQ ID NO: 98109 - DNA, 20 bp, Artificial Sequence
  chemically synthesized
gtaaccgggaagaggagtgg

SEQ ID NO: 98110 - DNA, 20 bp, Artificial Sequence
  chemically synthesized
gaagtaaccgggaagaggag

SEQ ID NO: 98111 - DNA, 20 bp, Artificial Sequence
  chemically synthesized
tgttctgccactcctcttcc

SEQ ID NO: 98112 - DNA, 20 bp, Artificial Sequence
  chemically synthesized
gctgaagtaaccgggaagag

SEQ ID NO: 98113 - DNA, 20 bp, Artificial Sequence
  chemically synthesized
aagctgaagtaaccgggaag

SEQ ID NO: 98114 - DNA, 20 bp, Artificial Sequence
  chemically synthesized
aaagctgaagtaaccgggaa

SEQ ID NO: 98115 - DNA, 20 bp, Artificial Sequence
  chemically synthesized
aaaaagctgaagtaaccggg

SEQ ID NO: 98116 - DNA, 20 bp, Artificial Sequence
  chemically synthesized
taaaaaaagctgaagtaacc

SEQ ID NO: 98117 - DNA, 20 bp, Artificial Sequence
  chemically synthesized
actcctcttcccggttactt

SEQ ID NO: 98118 - DNA, 20 bp, Artificial Sequence
  chemically synthesized
ttaaaaaaagctgaagtaac

SEQ ID NO: 98119 - DNA, 20 bp, Artificial Sequence
  chemically synthesized
tactcatttaaaaaaagctg

SEQ ID NO: 98120 - DNA, 20 bp, Artificial Sequence
  chemically synthesized
ctagtttactcatttaaaaa

SEQ ID NO: 98121 - DNA, 20 bp, Artificial Sequence
  chemically synthesized
tacttcagctttttttaaat

SEQ ID NO: 98122 - DNA, 20 bp, Artificial Sequence
  chemically synthesized
ctttttttaaatgagtaaac

SEQ ID NO: 98123 - DNA, 20 bp, Artificial Sequence
  chemically synthesized
tttgaaaaaaaatgattttc

SEQ ID NO: 98124 - DNA, 20 bp, Artificial Sequence
  chemically synthesized
atgataaacatgaagacatt

SEQ ID NO: 98125 - DNA, 20 bp, Artificial Sequence
  chemically synthesized
aatgttacatgataaacatg

SEQ ID NO: 98126 - DNA, 20 bp, Artificial Sequence
  chemically synthesized
agtccttctatttaaacaat

SEQ ID NO: 98127 - DNA, 20 bp, Artificial Sequence
  chemically synthesized
atgtaaactcattgtttaaa

SEQ ID NO: 98128 - DNA, 20 bp, Artificial Sequence
  chemically synthesized
taaactcattgtttaaatag

SEQ ID NO: 98129 - DNA, 20 bp, Artificial Sequence
  chemically synthesized
aaactcattgtttaaataga

SEQ ID NO: 98130 - DNA, 20 bp, Artificial Sequence
  chemically synthesized
cattgtttaaatagaaggac

SEQ ID NO: 98131 - DNA, 20 bp, Artificial Sequence
  chemically synthesized
attgtttaaatagaaggact

SEQ ID NO: 98132 - DNA, 20 bp, Artificial Sequence
  chemically synthesized
ttgtttaaatagaaggacta

SEQ ID NO: 98133 - DNA, 20 bp, Artificial Sequence
  chemically synthesized
tggccaaatgttgcacgccc

SEQ ID NO: 98134 - DNA, 20 bp, Artificial Sequence
  chemically synthesized
ggactagggcgtgcaacatt

SEQ ID NO: 98135 - DNA, 20 bp, Artificial Sequence
  chemically synthesized
cgtgcaacatttggccacaa

SEQ ID NO: 98136 - DNA, 20 bp, Artificial Sequence
  chemically synthesized
tgtgtgcatattttcttttg

SEQ ID NO: 98137 - DNA, 20 bp, Artificial Sequence
  chemically synthesized
gttttttttttaaaaaaaat

SEQ ID NO: 98138 - DNA, 20 bp, Artificial Sequence
  chemically synthesized
atttaactggcatattttta

SEQ ID NO: 98139 - DNA, 20 bp, Artificial Sequence
  chemically synthesized
gtattactttaaaaatatgc

SEQ ID NO: 98140 - DNA, 20 bp, Artificial Sequence
  chemically synthesized
cataagttttaacatttaac

SEQ ID NO: 98141 - DNA, 20 bp, Artificial Sequence
  chemically synthesized
tgtttagcacattcatacat

SEQ ID NO: 98142 - DNA, 20 bp, Artificial Sequence
  chemically synthesized
atgtatgaatgtgctaaaca

SEQ ID NO: 98143 - DNA, 20 bp, Artificial Sequence
  chemically synthesized
gtatgaatgtgctaaacaaa

SEQ ID NO: 98144 - DNA, 20 bp, Artificial Sequence
  chemically synthesized
tttgtgttagtctctttgtt

SEQ ID NO: 98145 - DNA, 20 bp, Artificial Sequence
  chemically synthesized
taccagaaattattttgtgt

SEQ ID NO: 98146 - DNA, 20 bp, Artificial Sequence
  chemically synthesized
gactaacacaaaataatttc

SEQ ID NO: 98147 - DNA, 20 bp, Artificial Sequence
  chemically synthesized
catgatactaaaaatgttac

SEQ ID NO: 98148 - DNA, 20 bp, Artificial Sequence
  chemically synthesized
ataatttctggtaacatttt

SEQ ID NO: 98149 - DNA, 20 bp, Artificial Sequence
  chemically synthesized
gtaacatttttagtatcatg

SEQ ID NO: 98150 - DNA, 20 bp, Artificial Sequence
  chemically synthesized
taacatttttagtatcatga

SEQ ID NO: 98151 - DNA, 20 bp, Artificial Sequence
  chemically synthesized
cataccctcctcatttttat

SEQ ID NO: 98152 - DNA, 20 bp, Artificial Sequence
  chemically synthesized
tcatgaaggcccataaaaat

SEQ ID NO: 98153 - DNA, 20 bp, Artificial Sequence
  chemically synthesized
ccataccctcctcattttta

SEQ ID NO: 98154 - DNA, 20 bp, Artificial Sequence
  chemically synthesized
catgaaggcccataaaaatg

SEQ ID NO: 98155 - DNA, 20 bp, Artificial Sequence
  chemically synthesized
tgaaggcccataaaaatgag

SEQ ID NO: 98156 - DNA, 20 bp, Artificial Sequence
  chemically synthesized
gaaggcccataaaaatgagg

SEQ ID NO: 98157 - DNA, 20 bp, Artificial Sequence
  chemically synthesized
aaggcccataaaaatgagga

SEQ ID NO: 98158 - DNA, 20 bp, Artificial Sequence
  chemically synthesized
ccataaaaatgaggagggta

SEQ ID NO: 98159 - DNA, 20 bp, Artificial Sequence
  chemically synthesized
ttattgaaattgtgtgaaat

SEQ ID NO: 98160 - DNA, 20 bp, Artificial Sequence
  chemically synthesized
tgtgaaattagaaaactaca

SEQ ID NO: 98161 - DNA, 20 bp, Artificial Sequence
  chemically synthesized
ttcacgggaatgtttctatg

SEQ ID NO: 98162 - DNA, 20 bp, Artificial Sequence
  chemically synthesized
ctttgtctccttgcattcac

SEQ ID NO: 98163 - DNA, 20 bp, Artificial Sequence
  chemically synthesized
agaaacattcccgtgaatgc

SEQ ID NO: 98164 - DNA, 20 bp, Artificial Sequence
  chemically synthesized
tctttgtctccttgcattca

SEQ ID NO: 98165 - DNA, 20 bp, Artificial Sequence
  chemically synthesized
gaaacattcccgtgaatgca

SEQ ID NO: 98166 - DNA, 20 bp, Artificial Sequence
  chemically synthesized
aacattcccgtgaatgcaag

SEQ ID NO: 98167 - DNA, 20 bp, Artificial Sequence
  chemically synthesized
cccgtgaatgcaaggagaca

SEQ ID NO: 98168 - DNA, 20 bp, Artificial Sequence
  chemically synthesized
cgtgaatgcaaggagacaaa

SEQ ID NO: 98169 - DNA, 20 bp, Artificial Sequence
  chemically synthesized
tgaatgcaaggagacaaaga

SEQ ID NO: 98170 - DNA, 20 bp, Artificial Sequence
  chemically synthesized
aaggagacaaagagagcaaa

SEQ ID NO: 98171 - DNA, 20 bp, Artificial Sequence
  chemically synthesized
gacaaagagagcaaatagtt

SEQ ID NO: 98172 - DNA, 20 bp, Artificial Sequence
  chemically synthesized
gagcaaatagttaagtacat

SEQ ID NO: 98173 - DNA, 20 bp, Artificial Sequence
  chemically synthesized
ttaaaggagcagatatggag

SEQ ID NO: 98174 - DNA, 20 bp, Artificial Sequence
  chemically synthesized
tttaaaggagcagatatgga

SEQ ID NO: 98175 - DNA, 20 bp, Artificial Sequence
  chemically synthesized
ttttaaaggagcagatatgg

SEQ ID NO: 98176 - DNA, 20 bp, Artificial Sequence
  chemically synthesized
tttttaaaggagcagatatg

SEQ ID NO: 98177 - DNA, 20 bp, Artificial Sequence
  chemically synthesized
attttttaaaggagcagata

SEQ ID NO: 98178 - DNA, 20 bp, Artificial Sequence
  chemically synthesized
atatacattttttaaaggag

SEQ ID NO: 98179 - DNA, 20 bp, Artificial Sequence
  chemically synthesized
gaaatatacattttttaaag

SEQ ID NO: 98180 - DNA, 20 bp, Artificial Sequence
  chemically synthesized
ctgaaatatacattttttaa

SEQ ID NO: 98181 - DNA, 20 bp, Artificial Sequence
  chemically synthesized
actgaaatatacatttttta

SEQ ID NO: 98182 - DNA, 20 bp, Artificial Sequence
  chemically synthesized
cctttaaaaaatgtatattt

SEQ ID NO: 98183 - DNA, 20 bp, Artificial Sequence
  chemically synthesized
ccaaaaacttttagaagagt

SEQ ID NO: 98184 - DNA, 20 bp, Artificial Sequence
  chemically synthesized
ttattatctgactcttctaa

SEQ ID NO: 98185 - DNA, 20 bp, Artificial Sequence
  chemically synthesized
tacaccaaaaacttttagaa

SEQ ID NO: 98186 - DNA, 20 bp, Artificial Sequence
  chemically synthesized
tttacaccaaaaacttttag

SEQ ID NO: 98187 - DNA, 20 bp, Artificial Sequence
  chemically synthesized
taatttacaccaaaaacttt

SEQ ID NO: 98188 - DNA, 20 bp, Artificial Sequence
  chemically synthesized
ctgactcttctaaaagtttt

SEQ ID NO: 98189 - DNA, 20 bp, Artificial Sequence
  chemically synthesized
aaagtttttggtgtaaatta

SEQ ID NO: 98190 - DNA, 20 bp, Artificial Sequence
  chemically synthesized
ttaaagatgatctgaattat

SEQ ID NO: 98191 - DNA, 20 bp, Artificial Sequence
  chemically synthesized
gtcctgattttctgataatt

SEQ ID NO: 98192 - DNA, 20 bp, Artificial Sequence
  chemically synthesized
gatctgaattatcagaaaat

SEQ ID NO: 98193 - DNA, 20 bp, Artificial Sequence
  chemically synthesized
atctgaattatcagaaaatc

SEQ ID NO: 98194 - DNA, 20 bp, Artificial Sequence
  chemically synthesized
attatcagaaaatcaggact

SEQ ID NO: 98195 - DNA, 20 bp, Artificial Sequence
  chemically synthesized
tttttcagggtagttgttct

SEQ ID NO: 98196 - DNA, 20 bp, Artificial Sequence
  chemically synthesized
tccatttttttttttcaggg

SEQ ID NO: 98197 - DNA, 20 bp, Artificial Sequence
  chemically synthesized
taatccatttttttttttca

SEQ ID NO: 98198 - DNA, 20 bp, Artificial Sequence
  chemically synthesized
gtaatccatttttttttttc

SEQ ID NO: 98199 - DNA, 20 bp, Artificial Sequence
  chemically synthesized
agtaatccattttttttttt

SEQ ID NO: 98200 - DNA, 20 bp, Artificial Sequence
  chemically synthesized
actaccctgaaaaaaaaaaa

SEQ ID NO: 98201 - DNA, 20 bp, Artificial Sequence
  chemically synthesized
aaaaaaaaaatggattactt

SEQ ID NO: 98202 - DNA, 20 bp, Artificial Sequence
  chemically synthesized
ggccattctttcacattcta

SEQ ID NO: 98203 - DNA, 20 bp, Artificial Sequence
  chemically synthesized
tggattactttagaatgtga

SEQ ID NO: 98204 - DNA, 20 bp, Artificial Sequence
  chemically synthesized
tactttagaatgtgaaagaa

SEQ ID NO: 98205 - DNA, 20 bp, Artificial Sequence
  chemically synthesized
tagaatgtgaaagaatggcc

SEQ ID NO: 98206 - DNA, 20 bp, Artificial Sequence
  chemically synthesized
agaatgtgaaagaatggcca

SEQ ID NO: 98207 - DNA, 20 bp, Artificial Sequence
  chemically synthesized
aaataactttgcatagacct

SEQ ID NO: 98208 - DNA, 20 bp, Artificial Sequence
  chemically synthesized
gaatggccaaggtctatgca

SEQ ID NO: 98209 - DNA, 20 bp, Artificial Sequence
  chemically synthesized
aaagcaaaaataactttgca

SEQ ID NO: 98210 - DNA, 20 bp, Artificial Sequence
  chemically synthesized
aaagttatttttgctttgaa

SEQ ID NO: 98211 - DNA, 20 bp, Artificial Sequence
  chemically synthesized
gcactcagggtttctattca

SEQ ID NO: 98212 - DNA, 20 bp, Artificial Sequence
  chemically synthesized
ttgctttgaatagaaaccct

SEQ ID NO: 98213 - DNA, 20 bp, Artificial Sequence
  chemically synthesized
attcttaaacattgcactca

SEQ ID NO: 98214 - DNA, 20 bp, Artificial Sequence
  chemically synthesized
tattcttaaacattgcactc

SEQ ID NO: 98215 - DNA, 20 bp, Artificial Sequence
  chemically synthesized
atattcttaaacattgcact

SEQ ID NO: 98216 - DNA, 20 bp, Artificial Sequence
  chemically synthesized
aaaccctgagtgcaatgttt

SEQ ID NO: 98217 - DNA, 20 bp, Artificial Sequence
  chemically synthesized
aatttttgcatgttgggaat

SEQ ID NO: 98218 - DNA, 20 bp, Artificial Sequence
  chemically synthesized
gaatttttgcatgttgggaa

SEQ ID NO: 98219 - DNA, 20 bp, Artificial Sequence
  chemically synthesized
ctatagaatttttgcatgtt

SEQ ID NO: 98220 - DNA, 20 bp, Artificial Sequence
  chemically synthesized
tctatagaatttttgcatgt

SEQ ID NO: 98221 - DNA, 20 bp, Artificial Sequence
  chemically synthesized
cccaacatgcaaaaattcta

SEQ ID NO: 98222 - DNA, 20 bp, Artificial Sequence
  chemically synthesized
ggttcatttgaagaattcta

SEQ ID NO: 98223 - DNA, 20 bp, Artificial Sequence
  chemically synthesized
tgacttggagggttcatttg

SEQ ID NO: 98224 - DNA, 20 bp, Artificial Sequence
  chemically synthesized
attcttcaaatgaaccctcc

SEQ ID NO: 98225 - DNA, 20 bp, Artificial Sequence
  chemically synthesized
ttcaaatgaaccctccaagt

SEQ ID NO: 98226 - DNA, 20 bp, Artificial Sequence
  chemically synthesized
agttaaaatactgacttgga

SEQ ID NO: 98227 - DNA, 20 bp, Artificial Sequence
  chemically synthesized
gagttaaaatactgacttgg

SEQ ID NO: 98228 - DNA, 20 bp, Artificial Sequence
  chemically synthesized
agagttaaaatactgacttg

SEQ ID NO: 98229 - DNA, 20 bp, Artificial Sequence
  chemically synthesized
gcagagttaaaatactgact

SEQ ID NO: 98230 - DNA, 20 bp, Artificial Sequence
  chemically synthesized
ctagcacatacacagtagca

SEQ ID NO: 98231 - DNA, 20 bp, Artificial Sequence
  chemically synthesized
acctagcacatacacagtag

SEQ ID NO: 98232 - DNA, 20 bp, Artificial Sequence
  chemically synthesized
gaaacctagcacatacacag

SEQ ID NO: 98233 - DNA, 20 bp, Artificial Sequence
  chemically synthesized
tgggaaacctagcacataca

SEQ ID NO: 98234 - DNA, 20 bp, Artificial Sequence
  chemically synthesized
ctctgctactgtgtatgtgc

SEQ ID NO: 98235 - DNA, 20 bp, Artificial Sequence
  chemically synthesized
tctgctactgtgtatgtgct

SEQ ID NO: 98236 - DNA, 20 bp, Artificial Sequence
  chemically synthesized
agaattccatttgggaaacc

SEQ ID NO: 98237 - DNA, 20 bp, Artificial Sequence
  chemically synthesized
tatgtgctaggtttcccaaa

SEQ ID NO: 98238 - DNA, 20 bp, Artificial Sequence
  chemically synthesized
gggaatagagaattccattt

SEQ ID NO: 98239 - DNA, 20 bp, Artificial Sequence
  chemically synthesized
tgggaatagagaattccatt

SEQ ID NO: 98240 - DNA, 20 bp, Artificial Sequence
  chemically synthesized
caaatggaattctctattcc

SEQ ID NO: 98241 - DNA, 20 bp, Artificial Sequence
  chemically synthesized
aaaagattgttctgggaata

SEQ ID NO: 98242 - DNA, 20 bp, Artificial Sequence
  chemically synthesized
agaaaagattgttctgggaa

SEQ ID NO: 98243 - DNA, 20 bp, Artificial Sequence
  chemically synthesized
gctttagaaaagattgttct

SEQ ID NO: 98244 - DNA, 20 bp, Artificial Sequence
  chemically synthesized
ggctttagaaaagattgttc

SEQ ID NO: 98245 - DNA, 20 bp, Artificial Sequence
  chemically synthesized
tcccagaacaatcttttcta

SEQ ID NO: 98246 - DNA, 20 bp, Artificial Sequence
  chemically synthesized
tgttttttgtggctttagaa

SEQ ID NO: 98247 - DNA, 20 bp, Artificial Sequence
  chemically synthesized
atttgtgttttttgtggctt

SEQ ID NO: 98248 - DNA, 20 bp, Artificial Sequence
  chemically synthesized
aattctatttgtgttttttg

SEQ ID NO: 98249 - DNA, 20 bp, Artificial Sequence
  chemically synthesized
aaagccacaaaaaacacaaa

SEQ ID NO: 98250 - DNA, 20 bp, Artificial Sequence
  chemically synthesized
aaaaacacaaatagaattca

SEQ ID NO: 98251 - DNA, 20 bp, Artificial Sequence
  chemically synthesized
gcataaagtatatcaagcat

SEQ ID NO: 98252 - DNA, 20 bp, Artificial Sequence
  chemically synthesized
aagaaggcataaagtatatc

SEQ ID NO: 98253 - DNA, 20 bp, Artificial Sequence
  chemically synthesized
gttttatgaaagaaggcata

SEQ ID NO: 98254 - DNA, 20 bp, Artificial Sequence
  chemically synthesized
gtgatgtgttttatgaaaga

SEQ ID NO: 98255 - DNA, 20 bp, Artificial Sequence
  chemically synthesized
ggtgatgtgttttatgaaag

SEQ ID NO: 98256 - DNA, 20 bp, Artificial Sequence
  chemically synthesized
ctaggtgatgtgttttatga

SEQ ID NO: 98257 - DNA, 20 bp, Artificial Sequence
  chemically synthesized
ctttcataaaacacatcacc

SEQ ID NO: 98258 - DNA, 20 bp, Artificial Sequence
  chemically synthesized
ttcagagaaacgtgaaaact

SEQ ID NO: 98259 - DNA, 20 bp, Artificial Sequence
  chemically synthesized
attcagagaaacgtgaaaac

SEQ ID NO: 98260 - DNA, 20 bp, Artificial Sequence
  chemically synthesized
gtgacaacataggatattca

SEQ ID NO: 98261 - DNA, 20 bp, Artificial Sequence
  chemically synthesized
ttgtgacaacataggatatt

SEQ ID NO: 98262 - DNA, 20 bp, Artificial Sequence
  chemically synthesized
tatatcttttgtgacaacat

SEQ ID NO: 98263 - DNA, 20 bp, Artificial Sequence
  chemically synthesized
atatatcttttgtgacaaca

SEQ ID NO: 98264 - DNA, 20 bp, Artificial Sequence
  chemically synthesized
aatatcctatgttgtcacaa

SEQ ID NO: 98265 - DNA, 20 bp, Artificial Sequence
  chemically synthesized
acaaaagatatatttctcct

SEQ ID NO: 98266 - DNA, 20 bp, Artificial Sequence
  chemically synthesized
agatatatttctcctaagtt

SEQ ID NO: 98267 - DNA, 20 bp, Artificial Sequence
  chemically synthesized
tgcgttttagcttaacttag

SEQ ID NO: 98268 - DNA, 20 bp, Artificial Sequence
  chemically synthesized
catgcgttttagcttaactt

SEQ ID NO: 98269 - DNA, 20 bp, Artificial Sequence
  chemically synthesized
tcatgcgttttagcttaact

SEQ ID NO: 98270 - DNA, 20 bp, Artificial Sequence
  chemically synthesized
tgtcttaaaatcatgcgttt

SEQ ID NO: 98271 - DNA, 20 bp, Artificial Sequence
  chemically synthesized
aagctaaaacgcatgatttt

SEQ ID NO: 98272 - DNA, 20 bp, Artificial Sequence
  chemically synthesized
tgtgtttgcaattttcattt

SEQ ID NO: 98273 - DNA, 20 bp, Artificial Sequence
  chemically synthesized
ttgtgtttgcaattttcatt

SEQ ID NO: 98274 - DNA, 20 bp, Artificial Sequence
  chemically synthesized
gctgtaagtcataatttcat

SEQ ID NO: 98275 - DNA, 20 bp, Artificial Sequence
  chemically synthesized
gcttatgaaattatgactta

SEQ ID NO: 98276 - DNA, 20 bp, Artificial Sequence
  chemically synthesized
gaaattatgacttacagcat

SEQ ID NO: 98277 - DNA, 20 bp, Artificial Sequence
  chemically synthesized
tcaagaataacttatgctgt

SEQ ID NO: 98278 - DNA, 20 bp, Artificial Sequence
  chemically synthesized
aaacgattcttttaaatatc

SEQ ID NO: 98279 - DNA, 20 bp, Artificial Sequence
  chemically synthesized
aagttattcttgatatttaa

SEQ ID NO: 98280 - DNA, 20 bp, Artificial Sequence
  chemically synthesized
tatttaaaagaatcgtttat

SEQ ID NO: 98281 - DNA, 20 bp, Artificial Sequence
  chemically synthesized
catcatgaatgtttgacaac

SEQ ID NO: 98282 - DNA, 20 bp, Artificial Sequence
  chemically synthesized
caacaagattatctgtgaac

SEQ ID NO: 98283 - DNA, 20 bp, Artificial Sequence
  chemically synthesized
acaagattatctgtgaacaa

SEQ ID NO: 98284 - DNA, 20 bp, Artificial Sequence
  chemically synthesized
cccacacaatctcttgttca

SEQ ID NO: 98285 - DNA, 20 bp, Artificial Sequence
  chemically synthesized
tctgtgaacaagagattgtg

SEQ ID NO: 98286 - DNA, 20 bp, Artificial Sequence
  chemically synthesized
ctgtgaacaagagattgtgt

SEQ ID NO: 98287 - DNA, 20 bp, Artificial Sequence
  chemically synthesized
agagattgtgtgggcttaca

SEQ ID NO: 98288 - DNA, 20 bp, Artificial Sequence
  chemically synthesized
tttagttgaaaatactgtgt

SEQ ID NO: 98289 - DNA, 20 bp, Artificial Sequence
  chemically synthesized
tacacagtattttcaactaa

SEQ ID NO: 98290 - DNA, 20 bp, Artificial Sequence
  chemically synthesized
gtattttcaactaaaagtta

SEQ ID NO: 98291 - DNA, 20 bp, Artificial Sequence
  chemically synthesized
aaacaaaataccgtaacttt

SEQ ID NO: 98292 - DNA, 20 bp, Artificial Sequence
  chemically synthesized
ttacggtattttgtttaaca

SEQ ID NO: 98293 - DNA, 20 bp, Artificial Sequence
  chemically synthesized
ttaacacagaaaccacacca

SEQ ID NO: 98294 - DNA, 20 bp, Artificial Sequence
  chemically synthesized
taacacagaaaccacaccat

SEQ ID NO: 98295 - DNA, 20 bp, Artificial Sequence
  chemically synthesized
ctcaaacttaacctatggtg

SEQ ID NO: 98296 - DNA, 20 bp, Artificial Sequence
  chemically synthesized
cagaaaccacaccataggtt

SEQ ID NO: 98297 - DNA, 20 bp, Artificial Sequence
  chemically synthesized
ataatctcaaacttaaccta

SEQ ID NO: 98298 - DNA, 20 bp, Artificial Sequence
  chemically synthesized
ccacaccataggttaagttt

SEQ ID NO: 98299 - DNA, 20 bp, Artificial Sequence
  chemically synthesized
tttgaaatatctgaactact

SEQ ID NO: 98300 - DNA, 20 bp, Artificial Sequence
  chemically synthesized
tttttacctgctgagtagtt

SEQ ID NO: 98301 - DNA, 20 bp, Artificial Sequence
  chemically synthesized
gaaatatctgaactactcag

SEQ ID NO: 98302 - DNA, 20 bp, Artificial Sequence
  chemically synthesized
aaatatctgaactactcagc

SEQ ID NO: 98303 - DNA, 20 bp, Artificial Sequence
  chemically synthesized
atttgtttttacctgctgag

SEQ ID NO: 98304 - DNA, 20 bp, Artificial Sequence
  chemically synthesized
attatttgtttttacctgct

SEQ ID NO: 98305 - DNA, 20 bp, Artificial Sequence
  chemically synthesized
gcaggtaaaaacaaataata

SEQ ID NO: 98306 - DNA, 20 bp, Artificial Sequence
  chemically synthesized
caaataatacagcccattta

SEQ ID NO: 98307 - DNA, 20 bp, Artificial Sequence
  chemically synthesized
aaaactgatgagctataaat

SEQ ID NO: 98308 - DNA, 20 bp, Artificial Sequence
  chemically synthesized
aaaaactgatgagctataaa

SEQ ID NO: 98309 - DNA, 20 bp, Artificial Sequence
  chemically synthesized
acagcccatttatagctcat

SEQ ID NO: 98310 - DNA, 20 bp, Artificial Sequence
  chemically synthesized
actcaaaacaaaaaactgat

SEQ ID NO: 98311 - DNA, 20 bp, Artificial Sequence
  chemically synthesized
gctcatcagttttttgtttt

SEQ ID NO: 98312 - DNA, 20 bp, Artificial Sequence
  chemically synthesized
ttttttgttttgagtcatct

SEQ ID NO: 98313 - DNA, 20 bp, Artificial Sequence
  chemically synthesized
accttccttgagttattgct

SEQ ID NO: 98314 - DNA, 20 bp, Artificial Sequence
  chemically synthesized
agtcatctaagcaataactc

SEQ ID NO: 98315 - DNA, 20 bp, Artificial Sequence
  chemically synthesized
gtcatctaagcaataactca

SEQ ID NO: 98316 - DNA, 20 bp, Artificial Sequence
  chemically synthesized
atctaagcaataactcaagg

SEQ ID NO: 98317 - DNA, 20 bp, Artificial Sequence
  chemically synthesized
tctaagcaataactcaagga

SEQ ID NO: 98318 - DNA, 20 bp, Artificial Sequence
  chemically synthesized
tgctctctctcaccttcctt

SEQ ID NO: 98319 - DNA, 20 bp, Artificial Sequence
  chemically synthesized
agcaataactcaaggaaggt

SEQ ID NO: 98320 - DNA, 20 bp, Artificial Sequence
  chemically synthesized
caataactcaaggaaggtga

SEQ ID NO: 98321 - DNA, 20 bp, Artificial Sequence
  chemically synthesized
ataactcaaggaaggtgaga

SEQ ID NO: 98322 - DNA, 20 bp, Artificial Sequence
  chemically synthesized
aactcaaggaaggtgagaga

SEQ ID NO: 98323 - DNA, 20 bp, Artificial Sequence
  chemically synthesized
agagagcatttgccaccctc

SEQ ID NO: 98324 - DNA, 20 bp, Artificial Sequence
  chemically synthesized
gagagcatttgccaccctcc

SEQ ID NO: 98325 - DNA, 20 bp, Artificial Sequence
  chemically synthesized
agagcatttgccaccctcca

SEQ ID NO: 98326 - DNA, 20 bp, Artificial Sequence
  chemically synthesized
tcagttgccaccctggaggg

SEQ ID NO: 98327 - DNA, 20 bp, Artificial Sequence
  chemically synthesized
gcatttgccaccctccaggg

SEQ ID NO: 98328 - DNA, 20 bp, Artificial Sequence
  chemically synthesized
agttcagttgccaccctgga

SEQ ID NO: 98329 - DNA, 20 bp, Artificial Sequence
  chemically synthesized
aagttcagttgccaccctgg

SEQ ID NO: 98330 - DNA, 20 bp, Artificial Sequence
  chemically synthesized
gaagttcagttgccaccctg

SEQ ID NO: 98331 - DNA, 20 bp, Artificial Sequence
  chemically synthesized
ctgaagttcagttgccaccc

SEQ ID NO: 98332 - DNA, 20 bp, Artificial Sequence
  chemically synthesized
ccagggtggcaactgaactt

SEQ ID NO: 98333 - DNA, 20 bp, Artificial Sequence
  chemically synthesized
cagggtggcaactgaacttc

SEQ ID NO: 98334 - DNA, 20 bp, Artificial Sequence
  chemically synthesized
tccagggaattcctgaagtt

SEQ ID NO: 98335 - DNA, 20 bp, Artificial Sequence
  chemically synthesized
gtatctccagggaattcctg

SEQ ID NO: 98336 - DNA, 20 bp, Artificial Sequence
  chemically synthesized
actgaacttcaggaattccc

SEQ ID NO: 98337 - DNA, 20 bp, Artificial Sequence
  chemically synthesized
tgaacttcaggaattccctg

SEQ ID NO: 98338 - DNA, 20 bp, Artificial Sequence
  chemically synthesized
atcaattggctgtatctcca

SEQ ID NO: 98339 - DNA, 20 bp, Artificial Sequence
  chemically synthesized
tcaggaattccctggagata

SEQ ID NO: 98340 - DNA, 20 bp, Artificial Sequence
  chemically synthesized
catcaattggctgtatctcc

SEQ ID NO: 98341 - DNA, 20 bp, Artificial Sequence
  chemically synthesized
gcatcaattggctgtatctc

SEQ ID NO: 98342 - DNA, 20 bp, Artificial Sequence
  chemically synthesized
gagagatgtgaagcatcaat

SEQ ID NO: 98343 - DNA, 20 bp, Artificial Sequence
  chemically synthesized
agagcatggtgagagatgtg

SEQ ID NO: 98344 - DNA, 20 bp, Artificial Sequence
  chemically synthesized
ttgatggcagagcatggtga

SEQ ID NO: 98345 - DNA, 20 bp, Artificial Sequence
  chemically synthesized
aattgatggcagagcatggt

SEQ ID NO: 98346 - DNA, 20 bp, Artificial Sequence
  chemically synthesized
ggagaattgatggcagagca

SEQ ID NO: 98347 - DNA, 20 bp, Artificial Sequence
  chemically synthesized
gcaatggagaattgatggca

SEQ ID NO: 98348 - DNA, 20 bp, Artificial Sequence
  chemically synthesized
tggcaatggagaattgatgg

SEQ ID NO: 98349 - DNA, 20 bp, Artificial Sequence
  chemically synthesized
ccatggcaatggagaattga

SEQ ID NO: 98350 - DNA, 20 bp, Artificial Sequence
  chemically synthesized
ttgtggattccatggcaatg

SEQ ID NO: 98351 - DNA, 20 bp, Artificial Sequence
  chemically synthesized
ccatcaattctccattgcca

SEQ ID NO: 98352 - DNA, 20 bp, Artificial Sequence
  chemically synthesized
cattgtggattccatggcaa

SEQ ID NO: 98353 - DNA, 20 bp, Artificial Sequence
  chemically synthesized
catttccattgtggattcca

SEQ ID NO: 98354 - DNA, 20 bp, Artificial Sequence
  chemically synthesized
cattgccatggaatccacaa

SEQ ID NO: 98355 - DNA, 20 bp, Artificial Sequence
  chemically synthesized
agtgtggcacatttccattg

SEQ ID NO: 98356 - DNA, 20 bp, Artificial Sequence
  chemically synthesized
caatggaaatgtgccacact

SEQ ID NO: 98357 - DNA, 20 bp, Artificial Sequence
  chemically synthesized
aatggaaatgtgccacactt

SEQ ID NO: 98358 - DNA, 20 bp, Artificial Sequence
  chemically synthesized
aatgaaaagtggcctaagtg

SEQ ID NO: 98359 - DNA, 20 bp, Artificial Sequence
  chemically synthesized
actgaaatgaaaagtggcct

SEQ ID NO: 98360 - DNA, 20 bp, Artificial Sequence
  chemically synthesized
aaaagaactgaaatgaaaag

SEQ ID NO: 98361 - DNA, 20 bp, Artificial Sequence
  chemically synthesized
acttaggccacttttcattt

SEQ ID NO: 98362 - DNA, 20 bp, Artificial Sequence
  chemically synthesized
tataaaagaactgaaatgaa

SEQ ID NO: 98363 - DNA, 20 bp, Artificial Sequence
  chemically synthesized
aaagggagggtaatatataa

SEQ ID NO: 98364 - DNA, 20 bp, Artificial Sequence
  chemically synthesized
aaggagaatatgaaaaggga

SEQ ID NO: 98365 - DNA, 20 bp, Artificial Sequence
  chemically synthesized
caaggagaatatgaaaaggg

SEQ ID NO: 98366 - DNA, 20 bp, Artificial Sequence
  chemically synthesized
ccaaggagaatatgaaaagg

SEQ ID NO: 98367 - DNA, 20 bp, Artificial Sequence
  chemically synthesized
ttccaaggagaatatgaaaa

SEQ ID NO: 98368 - DNA, 20 bp, Artificial Sequence
  chemically synthesized
gttccaaggagaatatgaaa

SEQ ID NO: 98369 - DNA, 20 bp, Artificial Sequence
  chemically synthesized
agttccaaggagaatatgaa

SEQ ID NO: 98370 - DNA, 20 bp, Artificial Sequence
  chemically synthesized
ctcccttttcatattctcct

SEQ ID NO: 98371 - DNA, 20 bp, Artificial Sequence
  chemically synthesized
gtaactcattcagttccaag

SEQ ID NO: 98372 - DNA, 20 bp, Artificial Sequence
  chemically synthesized
cagtaactcattcagttcca

SEQ ID NO: 98373 - DNA, 20 bp, Artificial Sequence
  chemically synthesized
acagtaactcattcagttcc

SEQ ID NO: 98374 - DNA, 20 bp, Artificial Sequence
  chemically synthesized
tattctccttggaactgaat

SEQ ID NO: 98375 - DNA, 20 bp, Artificial Sequence
  chemically synthesized
ctttgaaacagtaactcatt

SEQ ID NO: 98376 - DNA, 20 bp, Artificial Sequence
  chemically synthesized
ctgaatgagttactgtttca

SEQ ID NO: 98377 - DNA, 20 bp, Artificial Sequence
  chemically synthesized
agggcccccattctttgaaa

SEQ ID NO: 98378 - DNA, 20 bp, Artificial Sequence
  chemically synthesized
tgagttactgtttcaaagaa

SEQ ID NO: 98379 - DNA, 20 bp, Artificial Sequence
  chemically synthesized
gagttactgtttcaaagaat

SEQ ID NO: 98380 - DNA, 20 bp, Artificial Sequence
  chemically synthesized
agttactgtttcaaagaatg

SEQ ID NO: 98381 - DNA, 20 bp, Artificial Sequence
  chemically synthesized
gttactgtttcaaagaatgg

SEQ ID NO: 98382 - DNA, 20 bp, Artificial Sequence
  chemically synthesized
aaagaatgggggccctgtac

SEQ ID NO: 98383 - DNA, 20 bp, Artificial Sequence
  chemically synthesized
aagaatgggggccctgtact

SEQ ID NO: 98384 - DNA, 20 bp, Artificial Sequence
  chemically synthesized
agaatgggggccctgtacta

SEQ ID NO: 98385 - DNA, 20 bp, Artificial Sequence
  chemically synthesized
ccccacccttccctagtaca

SEQ ID NO: 98386 - DNA, 20 bp, Artificial Sequence
  chemically synthesized
accccacccttccctagtac

SEQ ID NO: 98387 - DNA, 20 bp, Artificial Sequence
  chemically synthesized
taccccacccttccctagta

SEQ ID NO: 98388 - DNA, 20 bp, Artificial Sequence
  chemically synthesized
atgggggccctgtactaggg

SEQ ID NO: 98389 - DNA, 20 bp, Artificial Sequence
  chemically synthesized
tgggggccctgtactaggga

SEQ ID NO: 98390 - DNA, 20 bp, Artificial Sequence
  chemically synthesized
gggggccctgtactagggaa

SEQ ID NO: 98391 - DNA, 20 bp, Artificial Sequence
  chemically synthesized
cattataccccacccttccc

SEQ ID NO: 98392 - DNA, 20 bp, Artificial Sequence
  chemically synthesized
ggccctgtactagggaaggg

SEQ ID NO: 98393 - DNA, 20 bp, Artificial Sequence
  chemically synthesized
gccctgtactagggaagggt

SEQ ID NO: 98394 - DNA, 20 bp, Artificial Sequence
  chemically synthesized
ccctgtactagggaagggtg

SEQ ID NO: 98395 - DNA, 20 bp, Artificial Sequence
  chemically synthesized
gaagggtggggtataatgac

SEQ ID NO: 98396 - DNA, 20 bp, Artificial Sequence
  chemically synthesized
ggtggggtataatgacaagc

SEQ ID NO: 98397 - DNA, 20 bp, Artificial Sequence
  chemically synthesized
gacaagcaagttcatttgtt

SEQ ID NO: 98398 - DNA, 20 bp, Artificial Sequence
  chemically synthesized
ttcatttgtttggaataaaa

SEQ ID NO: 98399 - DNA, 20 bp, Artificial Sequence
  chemically synthesized
tttgtttggaataaaatagt

SEQ ID NO: 98400 - DNA, 20 bp, Artificial Sequence
  chemically synthesized
tggaataaaatagtcagcaa

SEQ ID NO: 98401 - DNA, 20 bp, Artificial Sequence
  chemically synthesized
cagcaacagaacaataaaca

SEQ ID NO: 98402 - DNA, 20 bp, Artificial Sequence
  chemically synthesized
caacagaacaataaacacag

SEQ ID NO: 98403 - DNA, 20 bp, Artificial Sequence
  chemically synthesized
caataaacacagaagtctgc

SEQ ID NO: 98404 - DNA, 20 bp, Artificial Sequence
  chemically synthesized
taaacacagaagtctgctag

SEQ ID NO: 98405 - DNA, 20 bp, Artificial Sequence
  chemically synthesized
aacacagaagtctgctagaa

SEQ ID NO: 98406 - DNA, 20 bp, Artificial Sequence
  chemically synthesized
acacagaagtctgctagaag

SEQ ID NO: 98407 - DNA, 20 bp, Artificial Sequence
  chemically synthesized
aaactgaaggcctcttctag

SEQ ID NO: 98408 - DNA, 20 bp, Artificial Sequence
  chemically synthesized
gataaactgaaggcctcttc

SEQ ID NO: 98409 - DNA, 20 bp, Artificial Sequence
  chemically synthesized
agtctgctagaagaggcctt

SEQ ID NO: 98410 - DNA, 20 bp, Artificial Sequence
  chemically synthesized
tctttgtgttgataaactga

SEQ ID NO: 98411 - DNA, 20 bp, Artificial Sequence
  chemically synthesized
ctctttgtgttgataaactg

SEQ ID NO: 98412 - DNA, 20 bp, Artificial Sequence
  chemically synthesized
gccttcagtttatcaacaca

SEQ ID NO: 98413 - DNA, 20 bp, Artificial Sequence
  chemically synthesized
cttcagtttatcaacacaaa

SEQ ID NO: 98414 - DNA, 20 bp, Artificial Sequence
  chemically synthesized
tgacatccaaggaagtcatg

SEQ ID NO: 98415 - DNA, 20 bp, Artificial Sequence
  chemically synthesized
agttttcttcatgacttcct

SEQ ID NO: 98416 - DNA, 20 bp, Artificial Sequence
  chemically synthesized
aatgcaactgacatccaagg

SEQ ID NO: 98417 - DNA, 20 bp, Artificial Sequence
  chemically synthesized
ttcatgacttccttggatgt

SEQ ID NO: 98418 - DNA, 20 bp, Artificial Sequence
  chemically synthesized
ttaaatgcaactgacatcca

SEQ ID NO: 98419 - DNA, 20 bp, Artificial Sequence
  chemically synthesized
tttaaatgcaactgacatcc

SEQ ID NO: 98420 - DNA, 20 bp, Artificial Sequence
  chemically synthesized
atgtcagttgcatttaaata

SEQ ID NO: 98421 - DNA, 20 bp, Artificial Sequence
  chemically synthesized
gtcagttgcatttaaatata

SEQ ID NO: 98422 - DNA, 20 bp, Artificial Sequence
  chemically synthesized
taaagaggaaaggaaattat

SEQ ID NO: 98423 - DNA, 20 bp, Artificial Sequence
  chemically synthesized
attaaacgagtaaagaggaa

SEQ ID NO: 98424 - DNA, 20 bp, Artificial Sequence
  chemically synthesized
aattaaacgagtaaagagga

SEQ ID NO: 98425 - DNA, 20 bp, Artificial Sequence
  chemically synthesized
gcataattaaacgagtaaag

SEQ ID NO: 98426 - DNA, 20 bp, Artificial Sequence
  chemically synthesized
tgcataattaaacgagtaaa

SEQ ID NO: 98427 - DNA, 20 bp, Artificial Sequence
  chemically synthesized
attgcataattaaacgagta

SEQ ID NO: 98428 - DNA, 20 bp, Artificial Sequence
  chemically synthesized
atccgattgcataattaaac

SEQ ID NO: 98429 - DNA, 20 bp, Artificial Sequence
  chemically synthesized
tactcgtttaattatgcaat

SEQ ID NO: 98430 - DNA, 20 bp, Artificial Sequence
  chemically synthesized
aattatgcaatcggatatta

SEQ ID NO: 98431 - DNA, 20 bp, Artificial Sequence
  chemically synthesized
gcaatcggatattaaagcat

SEQ ID NO: 98432 - DNA, 20 bp, Artificial Sequence
  chemically synthesized
caatcggatattaaagcatt

SEQ ID NO: 98433 - DNA, 20 bp, Artificial Sequence
  chemically synthesized
cggatattaaagcattgggt

SEQ ID NO: 98434 - DNA, 20 bp, Artificial Sequence
  chemically synthesized
ggatattaaagcattgggtc

SEQ ID NO: 98435 - DNA, 20 bp, Artificial Sequence
  chemically synthesized
tcaggtattttgcccaattt

SEQ ID NO: 98436 - DNA, 20 bp, Artificial Sequence
  chemically synthesized
caaataaaatagctaaaatt

SEQ ID NO: 98437 - DNA, 20 bp, Artificial Sequence
  chemically synthesized
acaaataaaatagctaaaat

SEQ ID NO: 98438 - DNA, 20 bp, Artificial Sequence
  chemically synthesized
tagttaaaatacaaataaaa

SEQ ID NO: 98439 - DNA, 20 bp, Artificial Sequence
  chemically synthesized
agaacagttaaaattggaaa

SEQ ID NO: 98440 - DNA, 20 bp, Artificial Sequence
  chemically synthesized
aaatcaagaacagttaaaat

SEQ ID NO: 98441 - DNA, 20 bp, Artificial Sequence
  chemically synthesized
aattggatataaatcaagaa

SEQ ID NO: 98442 - DNA, 20 bp, Artificial Sequence
  chemically synthesized
aaataaattggatataaatc

SEQ ID NO: 98443 - DNA, 20 bp, Artificial Sequence
  chemically synthesized
aatataaattggaaataaat

SEQ ID NO: 98444 - DNA, 20 bp, Artificial Sequence
  chemically synthesized
ccaagatttccaatataaat

SEQ ID NO: 98445 - DNA, 20 bp, Artificial Sequence
  chemically synthesized
aatttatttccaatttatat

SEQ ID NO: 98446 - DNA, 20 bp, Artificial Sequence
  chemically synthesized
ccaatttatattggaaatct

SEQ ID NO: 98447 - DNA, 20 bp, Artificial Sequence
  chemically synthesized
tttatattggaaatcttggc

SEQ ID NO: 98448 - DNA, 20 bp, Artificial Sequence
  chemically synthesized
actcaaattatttactggcc

SEQ ID NO: 98449 - DNA, 20 bp, Artificial Sequence
  chemically synthesized
gctatactcaaattatttac

SEQ ID NO: 98450 - DNA, 20 bp, Artificial Sequence
  chemically synthesized
tcttggccagtaaataattt

SEQ ID NO: 98451 - DNA, 20 bp, Artificial Sequence
  chemically synthesized
gccagtaaataatttgagta

SEQ ID NO: 98452 - DNA, 20 bp, Artificial Sequence
  chemically synthesized
taaataatttgagtatagca

SEQ ID NO: 98453 - DNA, 20 bp, Artificial Sequence
  chemically synthesized
tagcatggtttaatattata

SEQ ID NO: 98454 - DNA, 20 bp, Artificial Sequence
  chemically synthesized
agcatggtttaatattataa

SEQ ID NO: 98455 - DNA, 20 bp, Artificial Sequence
  chemically synthesized
aaaggttatatatacataca

SEQ ID NO: 98456 - DNA, 20 bp, Artificial Sequence
  chemically synthesized
atatagttacatgggagaga

SEQ ID NO: 98457 - DNA, 20 bp, Artificial Sequence
  chemically synthesized
ggatatagttacatgggaga

SEQ ID NO: 98458 - DNA, 20 bp, Artificial Sequence
  chemically synthesized
gtggatatagttacatggga

SEQ ID NO: 98459 - DNA, 20 bp, Artificial Sequence
  chemically synthesized
tagtggatatagttacatgg

SEQ ID NO: 98460 - DNA, 20 bp, Artificial Sequence
  chemically synthesized
tttagtggatatagttacat

SEQ ID NO: 98461 - DNA, 20 bp, Artificial Sequence
  chemically synthesized
ctttagtggatatagttaca

SEQ ID NO: 98462 - DNA, 20 bp, Artificial Sequence
  chemically synthesized
ctttaggactttagtggata

SEQ ID NO: 98463 - DNA, 20 bp, Artificial Sequence
  chemically synthesized
ccatgtaactatatccacta

SEQ ID NO: 98464 - DNA, 20 bp, Artificial Sequence
  chemically synthesized
ttgttactttaggactttag

SEQ ID NO: 98465 - DNA, 20 bp, Artificial Sequence
  chemically synthesized
gcattgttactttaggactt

SEQ ID NO: 98466 - DNA, 20 bp, Artificial Sequence
  chemically synthesized
ctatatccactaaagtccta

SEQ ID NO: 98467 - DNA, 20 bp, Artificial Sequence
  chemically synthesized
gacagaggcattgttacttt

SEQ ID NO: 98468 - DNA, 20 bp, Artificial Sequence
  chemically synthesized
agacagaggcattgttactt

SEQ ID NO: 98469 - DNA, 20 bp, Artificial Sequence
  chemically synthesized
tgagtcaccataacagacag

SEQ ID NO: 98470 - DNA, 20 bp, Artificial Sequence
  chemically synthesized
ctgagtcaccataacagaca

SEQ ID NO: 98471 - DNA, 20 bp, Artificial Sequence
  chemically synthesized
aacaatgcctctgtctgtta

SEQ ID NO: 98472 - DNA, 20 bp, Artificial Sequence
  chemically synthesized
gactgagtcaccataacaga

SEQ ID NO: 98473 - DNA, 20 bp, Artificial Sequence
  chemically synthesized
cccagactgagtcaccataa

SEQ ID NO: 98474 - DNA, 20 bp, Artificial Sequence
  chemically synthesized
ctctgtctgttatggtgact

SEQ ID NO: 98475 - DNA, 20 bp, Artificial Sequence
  chemically synthesized
tctgttatggtgactcagtc

SEQ ID NO: 98476 - DNA, 20 bp, Artificial Sequence
  chemically synthesized
ctgttatggtgactcagtct

SEQ ID NO: 98477 - DNA, 20 bp, Artificial Sequence
  chemically synthesized
ctgtatgggaaacccagact

SEQ ID NO: 98478 - DNA, 20 bp, Artificial Sequence
  chemically synthesized
agtctgctgtatgggaaacc

SEQ ID NO: 98479 - DNA, 20 bp, Artificial Sequence
  chemically synthesized
ctcagtctgggtttcccata

SEQ ID NO: 98480 - DNA, 20 bp, Artificial Sequence
  chemically synthesized
agtctgggtttcccatacag

SEQ ID NO: 98481 - DNA, 20 bp, Artificial Sequence
  chemically synthesized
atcacctcagtctgctgtat

SEQ ID NO: 98482 - DNA, 20 bp, Artificial Sequence
  chemically synthesized
gatcacctcagtctgctgta

SEQ ID NO: 98483 - DNA, 20 bp, Artificial Sequence
  chemically synthesized
ggtttcccatacagcagact

SEQ ID NO: 98484 - DNA, 20 bp, Artificial Sequence
  chemically synthesized
gtttcccatacagcagactg

SEQ ID NO: 98485 - DNA, 20 bp, Artificial Sequence
  chemically synthesized
agtgtttcctaggatcacct

SEQ ID NO: 98486 - DNA, 20 bp, Artificial Sequence
  chemically synthesized
acagcagactgaggtgatcc

SEQ ID NO: 98487 - DNA, 20 bp, Artificial Sequence
  chemically synthesized
cagcagactgaggtgatcct

SEQ ID NO: 98488 - DNA, 20 bp, Artificial Sequence
  chemically synthesized
tgttccctacagtgtttcct

SEQ ID NO: 98489 - DNA, 20 bp, Artificial Sequence
  chemically synthesized
ctgttccctacagtgtttcc

SEQ ID NO: 98490 - DNA, 20 bp, Artificial Sequence
  chemically synthesized
ggtgatcctaggaaacactg

SEQ ID NO: 98491 - DNA, 20 bp, Artificial Sequence
  chemically synthesized
gtgatcctaggaaacactgt

SEQ ID NO: 98492 - DNA, 20 bp, Artificial Sequence
  chemically synthesized
tgatcctaggaaacactgta

SEQ ID NO: 98493 - DNA, 20 bp, Artificial Sequence
  chemically synthesized
ctaggaaacactgtagggaa

SEQ ID NO: 98494 - DNA, 20 bp, Artificial Sequence
  chemically synthesized
tcctcctttcctgttcccta

SEQ ID NO: 98495 - DNA, 20 bp, Artificial Sequence
  chemically synthesized
taggaaacactgtagggaac

SEQ ID NO: 98496 - DNA, 20 bp, Artificial Sequence
  chemically synthesized
aaacactgtagggaacagga

SEQ ID NO: 98497 - DNA, 20 bp, Artificial Sequence
  chemically synthesized
aacactgtagggaacaggaa

SEQ ID NO: 98498 - DNA, 20 bp, Artificial Sequence
  chemically synthesized
cactgtagggaacaggaaag

SEQ ID NO: 98499 - DNA, 20 bp, Artificial Sequence
  chemically synthesized
actgtagggaacaggaaagg

SEQ ID NO: 98500 - DNA, 20 bp, Artificial Sequence
  chemically synthesized
tgtagggaacaggaaaggag

SEQ ID NO: 98501 - DNA, 20 bp, Artificial Sequence
  chemically synthesized
tagggaacaggaaaggagga

SEQ ID NO: 98502 - DNA, 20 bp, Artificial Sequence
  chemically synthesized
agggaacaggaaaggaggag

SEQ ID NO: 98503 - DNA, 20 bp, Artificial Sequence
  chemically synthesized
acaggaaaggaggagaggaa

SEQ ID NO: 98504 - DNA, 20 bp, Artificial Sequence
  chemically synthesized
caggaaaggaggagaggaaa

SEQ ID NO: 98505 - DNA, 20 bp, Artificial Sequence
  chemically synthesized
gaaaggaggagaggaaaagg

SEQ ID NO: 98506 - DNA, 20 bp, Artificial Sequence
  chemically synthesized
aggaaaaggaagaaacaatc

SEQ ID NO: 98507 - DNA, 20 bp, Artificial Sequence
  chemically synthesized
gaaaaggaagaaacaatcca

SEQ ID NO: 98508 - DNA, 20 bp, Artificial Sequence
  chemically synthesized
cccagcccaataaagaactc

SEQ ID NO: 98509 - DNA, 20 bp, Artificial Sequence
  chemically synthesized
aacaatccagagttctttat

SEQ ID NO: 98510 - DNA, 20 bp, Artificial Sequence
  chemically synthesized
acaatccagagttctttatt

SEQ ID NO: 98511 - DNA, 20 bp, Artificial Sequence
  chemically synthesized
ccaccacgcccagcccaata

SEQ ID NO: 98512 - DNA, 20 bp, Artificial Sequence
  chemically synthesized
tccagagttctttattgggc

SEQ ID NO: 98513 - DNA, 20 bp, Artificial Sequence
  chemically synthesized
ccagagttctttattgggct

SEQ ID NO: 98514 - DNA, 20 bp, Artificial Sequence
  chemically synthesized
gttctttattgggctgggcg

SEQ ID NO: 98515 - DNA, 20 bp, Artificial Sequence
  chemically synthesized
ctttattgggctgggcgtgg

SEQ ID NO: 98516 - DNA, 20 bp, Artificial Sequence
  chemically synthesized
caggcatgagccaccacgcc

SEQ ID NO: 98517 - DNA, 20 bp, Artificial Sequence
  chemically synthesized
agtcctgggattacaggcat

SEQ ID NO: 98518 - DNA, 20 bp, Artificial Sequence
  chemically synthesized
gtggctcatgcctgtaatcc

SEQ ID NO: 98519 - DNA, 20 bp, Artificial Sequence
  chemically synthesized
tcccaaagtcctgggattac

SEQ ID NO: 98520 - DNA, 20 bp, Artificial Sequence
  chemically synthesized
tggctcatgcctgtaatccc

SEQ ID NO: 98521 - DNA, 20 bp, Artificial Sequence
  chemically synthesized
ctcccaaagtcctgggatta

SEQ ID NO: 98522 - DNA, 20 bp, Artificial Sequence
  chemically synthesized
tgcctgtaatcccaggactt

SEQ ID NO: 98523 - DNA, 20 bp, Artificial Sequence
  chemically synthesized
ccttggcctcccaaagtcct

SEQ ID NO: 98524 - DNA, 20 bp, Artificial Sequence
  chemically synthesized
gcctgtaatcccaggacttt

SEQ ID NO: 98525 - DNA, 20 bp, Artificial Sequence
  chemically synthesized
gccttggcctcccaaagtcc

SEQ ID NO: 98526 - DNA, 20 bp, Artificial Sequence
  chemically synthesized
ctgtaatcccaggactttgg

SEQ ID NO: 98527 - DNA, 20 bp, Artificial Sequence
  chemically synthesized
tgtaatcccaggactttggg

SEQ ID NO: 98528 - DNA, 20 bp, Artificial Sequence
  chemically synthesized
ccgcccgccttggcctccca

SEQ ID NO: 98529 - DNA, 20 bp, Artificial Sequence
  chemically synthesized
tcccaggactttgggaggcc

SEQ ID NO: 98530 - DNA, 20 bp, Artificial Sequence
  chemically synthesized
cccaggactttgggaggcca

SEQ ID NO: 98531 - DNA, 20 bp, Artificial Sequence
  chemically synthesized
aggactttgggaggccaagg

SEQ ID NO: 98532 - DNA, 20 bp, Artificial Sequence
  chemically synthesized
ggactttgggaggccaaggc

SEQ ID NO: 98533 - DNA, 20 bp, Artificial Sequence
  chemically synthesized
ctttgggaggccaaggcggg

SEQ ID NO: 98534 - DNA, 20 bp, Artificial Sequence
  chemically synthesized
ctcaagtgatccgcccgcct

SEQ ID NO: 98535 - DNA, 20 bp, Artificial Sequence
  chemically synthesized
ccaaggcgggcggatcactt

SEQ ID NO: 98536 - DNA, 20 bp, Artificial Sequence
  chemically synthesized
gcgggcggatcacttgagat

SEQ ID NO: 98537 - DNA, 20 bp, Artificial Sequence
  chemically synthesized
cgggcggatcacttgagatc

SEQ ID NO: 98538 - DNA, 20 bp, Artificial Sequence
  chemically synthesized
ggtctagaactcctgatctc

SEQ ID NO: 98539 - DNA, 20 bp, Artificial Sequence
  chemically synthesized
ggcggatcacttgagatcag

SEQ ID NO: 98540 - DNA, 20 bp, Artificial Sequence
  chemically synthesized
tcacttgagatcaggagttc

SEQ ID NO: 98541 - DNA, 20 bp, Artificial Sequence
  chemically synthesized
tgagatcaggagttctagac

SEQ ID NO: 98542 - DNA, 20 bp, Artificial Sequence
  chemically synthesized
accatttggccaggctggtc

SEQ ID NO: 98543 - DNA, 20 bp, Artificial Sequence
  chemically synthesized
tcaggagttctagaccagcc

SEQ ID NO: 98544 - DNA, 20 bp, Artificial Sequence
  chemically synthesized
gtttcaccatttggccaggc

SEQ ID NO: 98545 - DNA, 20 bp, Artificial Sequence
  chemically synthesized
tctagaccagcctggccaaa

SEQ ID NO: 98546 - DNA, 20 bp, Artificial Sequence
  chemically synthesized
tggggtttcaccatttggcc

SEQ ID NO: 98547 - DNA, 20 bp, Artificial Sequence
  chemically synthesized
atggggtttcaccatttggc

SEQ ID NO: 98548 - DNA, 20 bp, Artificial Sequence
  chemically synthesized
agagatggggtttcaccatt

SEQ ID NO: 98549 - DNA, 20 bp, Artificial Sequence
  chemically synthesized
ttgtatttttagtagagatg

SEQ ID NO: 98550 - DNA, 20 bp, Artificial Sequence
  chemically synthesized
tttgtatttttagtagagat

SEQ ID NO: 98551 - DNA, 20 bp, Artificial Sequence
  chemically synthesized
ttttgtatttttagtagaga

SEQ ID NO: 98552 - DNA, 20 bp, Artificial Sequence
  chemically synthesized
taatttttgtatttttagta

SEQ ID NO: 98553 - DNA, 20 bp, Artificial Sequence
  chemically synthesized
actaatttttgtatttttag

SEQ ID NO: 98554 - DNA, 20 bp, Artificial Sequence
  chemically synthesized
ccaactaatttttgtatttt

SEQ ID NO: 98555 - DNA, 20 bp, Artificial Sequence
  chemically synthesized
tctactaaaaatacaaaaat

SEQ ID NO: 98556 - DNA, 20 bp, Artificial Sequence
  chemically synthesized
ctaaaaatacaaaaattagt

SEQ ID NO: 98557 - DNA, 20 bp, Artificial Sequence
  chemically synthesized
taaaaatacaaaaattagtt

SEQ ID NO: 98558 - DNA, 20 bp, Artificial Sequence
  chemically synthesized
atacaaaaattagttgggtg

SEQ ID NO: 98559 - DNA, 20 bp, Artificial Sequence
  chemically synthesized
caaaaattagttgggtgtgg

SEQ ID NO: 98560 - DNA, 20 bp, Artificial Sequence
  chemically synthesized
ggtgtggtggcgcatgcctg

SEQ ID NO: 98561 - DNA, 20 bp, Artificial Sequence
  chemically synthesized
gtggcgcatgcctgtagtcc

SEQ ID NO: 98562 - DNA, 20 bp, Artificial Sequence
  chemically synthesized
tcttgagtagctgggactac

SEQ ID NO: 98563 - DNA, 20 bp, Artificial Sequence
  chemically synthesized
ctcttgagtagctgggacta

SEQ ID NO: 98564 - DNA, 20 bp, Artificial Sequence
  chemically synthesized
cctcagcctcttgagtagct

SEQ ID NO: 98565 - DNA, 20 bp, Artificial Sequence
  chemically synthesized
gcctgtagtcccagctactc

SEQ ID NO: 98566 - DNA, 20 bp, Artificial Sequence
  chemically synthesized
gcctcagcctcttgagtagc

SEQ ID NO: 98567 - DNA, 20 bp, Artificial Sequence
  chemically synthesized
ctgtagtcccagctactcaa

SEQ ID NO: 98568 - DNA, 20 bp, Artificial Sequence
  chemically synthesized
tgtagtcccagctactcaag

SEQ ID NO: 98569 - DNA, 20 bp, Artificial Sequence
  chemically synthesized
tcctgcctcagcctcttgag

SEQ ID NO: 98570 - DNA, 20 bp, Artificial Sequence
  chemically synthesized
ttctcctgcctcagcctctt

SEQ ID NO: 98571 - DNA, 20 bp, Artificial Sequence
  chemically synthesized
tcccagctactcaagaggct

SEQ ID NO: 98572 - DNA, 20 bp, Artificial Sequence
  chemically synthesized
cccagctactcaagaggctg

SEQ ID NO: 98573 - DNA, 20 bp, Artificial Sequence
  chemically synthesized
agctactcaagaggctgagg

SEQ ID NO: 98574 - DNA, 20 bp, Artificial Sequence
  chemically synthesized
gctactcaagaggctgaggc

SEQ ID NO: 98575 - DNA, 20 bp, Artificial Sequence
  chemically synthesized
tactcaagaggctgaggcag

SEQ ID NO: 98576 - DNA, 20 bp, Artificial Sequence
  chemically synthesized
ttcaagtgattctcctgcct

SEQ ID NO: 98577 - DNA, 20 bp, Artificial Sequence
  chemically synthesized
gcaggagaatcacttgaact

SEQ ID NO: 98578 - DNA, 20 bp, Artificial Sequence
  chemically synthesized
caggagaatcacttgaactc

SEQ ID NO: 98579 - DNA, 20 bp, Artificial Sequence
  chemically synthesized
aacctccacctcccgagttc

SEQ ID NO: 98580 - DNA, 20 bp, Artificial Sequence
  chemically synthesized
ggagaatcacttgaactcgg

SEQ ID NO: 98581 - DNA, 20 bp, Artificial Sequence
  chemically synthesized
gagaatcacttgaactcggg

SEQ ID NO: 98582 - DNA, 20 bp, Artificial Sequence
  chemically synthesized
aatcacttgaactcgggagg

SEQ ID NO: 98583 - DNA, 20 bp, Artificial Sequence
  chemically synthesized
cactgcaacctccacctccc

SEQ ID NO: 98584 - DNA, 20 bp, Artificial Sequence
  chemically synthesized
tcacttgaactcgggaggtg

SEQ ID NO: 98585 - DNA, 20 bp, Artificial Sequence
  chemically synthesized
cacttgaactcgggaggtgg

SEQ ID NO: 98586 - DNA, 20 bp, Artificial Sequence
  chemically synthesized
aactcgggaggtggaggttg

SEQ ID NO: 98587 - DNA, 20 bp, Artificial Sequence
  chemically synthesized
cgggaggtggaggttgcagt

SEQ ID NO: 98588 - DNA, 20 bp, Artificial Sequence
  chemically synthesized
ggtggaggttgcagtgagct

SEQ ID NO: 98589 - DNA, 20 bp, Artificial Sequence
  chemically synthesized
ggagtgcagtggcacaatct

SEQ ID NO: 98590 - DNA, 20 bp, Artificial Sequence
  chemically synthesized
gcaccctggctggagtgcag

SEQ ID NO: 98591 - DNA, 20 bp, Artificial Sequence
  chemically synthesized
gagattgtgccactgcactc

SEQ ID NO: 98592 - DNA, 20 bp, Artificial Sequence
  chemically synthesized
tctgcaccctggctggagtg

SEQ ID NO: 98593 - DNA, 20 bp, Artificial Sequence
  chemically synthesized
ttgtgccactgcactccagc

SEQ ID NO: 98594 - DNA, 20 bp, Artificial Sequence
  chemically synthesized
tgtgccactgcactccagcc

SEQ ID NO: 98595 - DNA, 20 bp, Artificial Sequence
  chemically synthesized
gtgccactgcactccagcca

SEQ ID NO: 98596 - DNA, 20 bp, Artificial Sequence
  chemically synthesized
ctcactctgcaccctggctg

SEQ ID NO: 98597 - DNA, 20 bp, Artificial Sequence
  chemically synthesized
gtctcactctgcaccctggc

SEQ ID NO: 98598 - DNA, 20 bp, Artificial Sequence
  chemically synthesized
actgcactccagccagggtg

SEQ ID NO: 98599 - DNA, 20 bp, Artificial Sequence
  chemically synthesized
tgcactccagccagggtgca

SEQ ID NO: 98600 - DNA, 20 bp, Artificial Sequence
  chemically synthesized
tggagtctcactctgcaccc

SEQ ID NO: 98601 - DNA, 20 bp, Artificial Sequence
  chemically synthesized
ctccagccagggtgcagagt

SEQ ID NO: 98602 - DNA, 20 bp, Artificial Sequence
  chemically synthesized
tgcagagtgagactccatct

SEQ ID NO: 98603 - DNA, 20 bp, Artificial Sequence
  chemically synthesized
gcagagtgagactccatctc

SEQ ID NO: 98604 - DNA, 20 bp, Artificial Sequence
  chemically synthesized
tttttttttttcccgagatg

SEQ ID NO: 98605 - DNA, 20 bp, Artificial Sequence
  chemically synthesized
tttttttttttttcccgaga

SEQ ID NO: 98606 - DNA, 20 bp, Artificial Sequence
  chemically synthesized
cttttttttttttttttccc

SEQ ID NO: 98607 - DNA, 20 bp, Artificial Sequence
  chemically synthesized
ctcgggaaaaaaaaaaaaaa

SEQ ID NO: 98608 - DNA, 20 bp, Artificial Sequence
  chemically synthesized
cgggaaaaaaaaaaaaaaaa

SEQ ID NO: 98609 - DNA, 20 bp, Artificial Sequence
  chemically synthesized
gggaaaaaaaaaaaaaaaag

SEQ ID NO: 98610 - DNA, 20 bp, Artificial Sequence
  chemically synthesized
aaaaaaaagaggtatttatt

SEQ ID NO: 98611 - DNA, 20 bp, Artificial Sequence
  chemically synthesized
aaaaagaggtatttattgag

SEQ ID NO: 98612 - DNA, 20 bp, Artificial Sequence
  chemically synthesized
tattgagtagattactaatc

SEQ ID NO: 98613 - DNA, 20 bp, Artificial Sequence
  chemically synthesized
attgagtagattactaatct

SEQ ID NO: 98614 - DNA, 20 bp, Artificial Sequence
  chemically synthesized
ttgagtagattactaatctg

SEQ ID NO: 98615 - DNA, 20 bp, Artificial Sequence
  chemically synthesized
tgagccccagttccccagat

SEQ ID NO: 98616 - DNA, 20 bp, Artificial Sequence
  chemically synthesized
agattactaatctggggaac

SEQ ID NO: 98617 - DNA, 20 bp, Artificial Sequence
  chemically synthesized
gattactaatctggggaact

SEQ ID NO: 98618 - DNA, 20 bp, Artificial Sequence
  chemically synthesized
agcattgagccccagttccc

SEQ ID NO: 98619 - DNA, 20 bp, Artificial Sequence
  chemically synthesized
attactaatctggggaactg

SEQ ID NO: 98620 - DNA, 20 bp, Artificial Sequence
  chemically synthesized
tccccaacagcattgagccc

SEQ ID NO: 98621 - DNA, 20 bp, Artificial Sequence
  chemically synthesized
agagcatccccaacagcatt

SEQ ID NO: 98622 - DNA, 20 bp, Artificial Sequence
  chemically synthesized
gaactggggctcaatgctgt

SEQ ID NO: 98623 - DNA, 20 bp, Artificial Sequence
  chemically synthesized
aactggggctcaatgctgtt

SEQ ID NO: 98624 - DNA, 20 bp, Artificial Sequence
  chemically synthesized
actggggctcaatgctgttg

SEQ ID NO: 98625 - DNA, 20 bp, Artificial Sequence
  chemically synthesized
gatcctcagagcatccccaa

SEQ ID NO: 98626 - DNA, 20 bp, Artificial Sequence
  chemically synthesized
aatgctgttggggatgctct

SEQ ID NO: 98627 - DNA, 20 bp, Artificial Sequence
  chemically synthesized
atgctgttggggatgctctg

SEQ ID NO: 98628 - DNA, 20 bp, Artificial Sequence
  chemically synthesized
atatattccaaagatcctca

SEQ ID NO: 98629 - DNA, 20 bp, Artificial Sequence
  chemically synthesized
agatatattccaaagatcct

SEQ ID NO: 98630 - DNA, 20 bp, Artificial Sequence
  chemically synthesized
ggggatgctctgaggatctt

SEQ ID NO: 98631 - DNA, 20 bp, Artificial Sequence
  chemically synthesized
taattttgagatatattcca

SEQ ID NO: 98632 - DNA, 20 bp, Artificial Sequence
  chemically synthesized
cccctcactgggataatttt

SEQ ID NO: 98633 - DNA, 20 bp, Artificial Sequence
  chemically synthesized
aatatatctcaaaattatcc

SEQ ID NO: 98634 - DNA, 20 bp, Artificial Sequence
  chemically synthesized
tatctcaaaattatcccagt

SEQ ID NO: 98635 - DNA, 20 bp, Artificial Sequence
  chemically synthesized
atctcaaaattatcccagtg

SEQ ID NO: 98636 - DNA, 20 bp, Artificial Sequence
  chemically synthesized
tctcaaaattatcccagtga

SEQ ID NO: 98637 - DNA, 20 bp, Artificial Sequence
  chemically synthesized
ctcaaaattatcccagtgag

SEQ ID NO: 98638 - DNA, 20 bp, Artificial Sequence
  chemically synthesized
cagctttctctcccctcact

SEQ ID NO: 98639 - DNA, 20 bp, Artificial Sequence
  chemically synthesized
caaaattatcccagtgaggg

SEQ ID NO: 98640 - DNA, 20 bp, Artificial Sequence
  chemically synthesized
tcagctttctctcccctcac

SEQ ID NO: 98641 - DNA, 20 bp, Artificial Sequence
  chemically synthesized
aaattatcccagtgagggga

SEQ ID NO: 98642 - DNA, 20 bp, Artificial Sequence
  chemically synthesized
tatcccagtgaggggagaga

SEQ ID NO: 98643 - DNA, 20 bp, Artificial Sequence
  chemically synthesized
cagtgaggggagagaaagct

SEQ ID NO: 98644 - DNA, 20 bp, Artificial Sequence
  chemically synthesized
gagtagatgggtacaaatct

SEQ ID NO: 98645 - DNA, 20 bp, Artificial Sequence
  chemically synthesized
accaataagggagagtagat

SEQ ID NO: 98646 - DNA, 20 bp, Artificial Sequence
  chemically synthesized
aaccaataagggagagtaga

SEQ ID NO: 98647 - DNA, 20 bp, Artificial Sequence
  chemically synthesized
actcaaccaataagggagag

SEQ ID NO: 98648 - DNA, 20 bp, Artificial Sequence
  chemically synthesized
aagactcaaccaataaggga

SEQ ID NO: 98649 - DNA, 20 bp, Artificial Sequence
  chemically synthesized
acccatctactctcccttat

SEQ ID NO: 98650 - DNA, 20 bp, Artificial Sequence
  chemically synthesized
gcaagactcaaccaataagg

SEQ ID NO: 98651 - DNA, 20 bp, Artificial Sequence
  chemically synthesized
gagcaagactcaaccaataa

SEQ ID NO: 98652 - DNA, 20 bp, Artificial Sequence
  chemically synthesized
ggagcaagactcaaccaata

SEQ ID NO: 98653 - DNA, 20 bp, Artificial Sequence
  chemically synthesized
tctactctcccttattggtt

SEQ ID NO: 98654 - DNA, 20 bp, Artificial Sequence
  chemically synthesized
aggagcaagactcaaccaat

SEQ ID NO: 98655 - DNA, 20 bp, Artificial Sequence
  chemically synthesized
gacagggtattaacaggagc

SEQ ID NO: 98656 - DNA, 20 bp, Artificial Sequence
  chemically synthesized
aagtgacagggtattaacag

SEQ ID NO: 98657 - DNA, 20 bp, Artificial Sequence
  chemically synthesized
caaagtgacagggtattaac

SEQ ID NO: 98658 - DNA, 20 bp, Artificial Sequence
  chemically synthesized
ccaaagtgacagggtattaa

SEQ ID NO: 98659 - DNA, 20 bp, Artificial Sequence
  chemically synthesized
ggaccaagcccaaagtgaca

SEQ ID NO: 98660 - DNA, 20 bp, Artificial Sequence
  chemically synthesized
ctgttaataccctgtcactt

SEQ ID NO: 98661 - DNA, 20 bp, Artificial Sequence
  chemically synthesized
tggaccaagcccaaagtgac

SEQ ID NO: 98662 - DNA, 20 bp, Artificial Sequence
  chemically synthesized
tgttaataccctgtcacttt

SEQ ID NO: 98663 - DNA, 20 bp, Artificial Sequence
  chemically synthesized
atggaccaagcccaaagtga

SEQ ID NO: 98664 - DNA, 20 bp, Artificial Sequence
  chemically synthesized
ataccctgtcactttgggct

SEQ ID NO: 98665 - DNA, 20 bp, Artificial Sequence
  chemically synthesized
gggcacatggaccaagccca

SEQ ID NO: 98666 - DNA, 20 bp, Artificial Sequence
  chemically synthesized
ggtagatgggcacatggacc

SEQ ID NO: 98667 - DNA, 20 bp, Artificial Sequence
  chemically synthesized
tggggtggtagatgggcaca

SEQ ID NO: 98668 - DNA, 20 bp, Artificial Sequence
  chemically synthesized
ttagctttggggtggtagat

SEQ ID NO: 98669 - DNA, 20 bp, Artificial Sequence
  chemically synthesized
cttagctttggggtggtaga

SEQ ID NO: 98670 - DNA, 20 bp, Artificial Sequence
  chemically synthesized
tcctcttagctttggggtgg

SEQ ID NO: 98671 - DNA, 20 bp, Artificial Sequence
  chemically synthesized
tgtgcccatctaccacccca

SEQ ID NO: 98672 - DNA, 20 bp, Artificial Sequence
  chemically synthesized
atgtcctcttagctttgggg

SEQ ID NO: 98673 - DNA, 20 bp, Artificial Sequence
  chemically synthesized
ccatctaccaccccaaagct

SEQ ID NO: 98674 - DNA, 20 bp, Artificial Sequence
  chemically synthesized
tccatgtcctcttagctttg

SEQ ID NO: 98675 - DNA, 20 bp, Artificial Sequence
  chemically synthesized
ttccatgtcctcttagcttt

SEQ ID NO: 98676 - DNA, 20 bp, Artificial Sequence
  chemically synthesized
atctaccaccccaaagctaa

SEQ ID NO: 98677 - DNA, 20 bp, Artificial Sequence
  chemically synthesized
tttccatgtcctcttagctt

SEQ ID NO: 98678 - DNA, 20 bp, Artificial Sequence
  chemically synthesized
tctaccaccccaaagctaag

SEQ ID NO: 98679 - DNA, 20 bp, Artificial Sequence
  chemically synthesized
gtatcctttccatgtcctct

SEQ ID NO: 98680 - DNA, 20 bp, Artificial Sequence
  chemically synthesized
accccaaagctaagaggaca

SEQ ID NO: 98681 - DNA, 20 bp, Artificial Sequence
  chemically synthesized
caaagctaagaggacatgga

SEQ ID NO: 98682 - DNA, 20 bp, Artificial Sequence
  chemically synthesized
aaagctaagaggacatggaa

SEQ ID NO: 98683 - DNA, 20 bp, Artificial Sequence
  chemically synthesized
ggacatggaaaggatacctg

SEQ ID NO: 98684 - DNA, 20 bp, Artificial Sequence
  chemically synthesized
ccatgtagaacagatgctgc

SEQ ID NO: 98685 - DNA, 20 bp, Artificial Sequence
  chemically synthesized
accatgtagaacagatgctg

SEQ ID NO: 98686 - DNA, 20 bp, Artificial Sequence
  chemically synthesized
cctgcagcatctgttctaca

SEQ ID NO: 98687 - DNA, 20 bp, Artificial Sequence
  chemically synthesized
atatcaaataccatgtagaa

SEQ ID NO: 98688 - DNA, 20 bp, Artificial Sequence
  chemically synthesized
gggtaatatcaaataccatg

SEQ ID NO: 98689 - DNA, 20 bp, Artificial Sequence
  chemically synthesized
gttttgtgggcacatattga

SEQ ID NO: 98690 - DNA, 20 bp, Artificial Sequence
  chemically synthesized
tgttttgtgggcacatattg

SEQ ID NO: 98691 - DNA, 20 bp, Artificial Sequence
  chemically synthesized
ctgttttgtgggcacatatt

SEQ ID NO: 98692 - DNA, 20 bp, Artificial Sequence
  chemically synthesized
ctcaatatgtgcccacaaaa

SEQ ID NO: 98693 - DNA, 20 bp, Artificial Sequence
  chemically synthesized
gatcctgtatactgttttgt

SEQ ID NO: 98694 - DNA, 20 bp, Artificial Sequence
  chemically synthesized
tgatcctgtatactgttttg

SEQ ID NO: 98695 - DNA, 20 bp, Artificial Sequence
  chemically synthesized
tgtgcccacaaaacagtata

SEQ ID NO: 98696 - DNA, 20 bp, Artificial Sequence
  chemically synthesized
gtgcccacaaaacagtatac

SEQ ID NO: 98697 - DNA, 20 bp, Artificial Sequence
  chemically synthesized
caaaacagtatacaggatca

SEQ ID NO: 98698 - DNA, 20 bp, Artificial Sequence
  chemically synthesized
ggatcatggactcaaaatga

SEQ ID NO: 98699 - DNA, 20 bp, Artificial Sequence
  chemically synthesized
gtttattttgctgtcatttt

SEQ ID NO: 98700 - DNA, 20 bp, Artificial Sequence
  chemically synthesized
caaaatgacagcaaaataaa

SEQ ID NO: 98701 - DNA, 20 bp, Artificial Sequence
  chemically synthesized
agatgcacacactgttcaca

SEQ ID NO: 98702 - DNA, 20 bp, Artificial Sequence
  chemically synthesized
gatgcacacactgttcacaa

SEQ ID NO: 98703 - DNA, 20 bp, Artificial Sequence
  chemically synthesized
ccaatcaaatcctttgtgaa

SEQ ID NO: 98704 - DNA, 20 bp, Artificial Sequence
  chemically synthesized
ctgttcacaaaggatttgat

SEQ ID NO: 98705 - DNA, 20 bp, Artificial Sequence
  chemically synthesized
tgttcacaaaggatttgatt

SEQ ID NO: 98706 - DNA, 20 bp, Artificial Sequence
  chemically synthesized
aggatttgattgggtttgca

SEQ ID NO: 98707 - DNA, 20 bp, Artificial Sequence
  chemically synthesized
tatatgcaaagaaatgtagg

SEQ ID NO: 98708 - DNA, 20 bp, Artificial Sequence
  chemically synthesized
tttatatgcaaagaaatgta

SEQ ID NO: 98709 - DNA, 20 bp, Artificial Sequence
  chemically synthesized
gtttatatgcaaagaaatgt

SEQ ID NO: 98710 - DNA, 20 bp, Artificial Sequence
  chemically synthesized
agtttatatgcaaagaaatg

SEQ ID NO: 98711 - DNA, 20 bp, Artificial Sequence
  chemically synthesized
atgagtctagtttatatgca

SEQ ID NO: 98712 - DNA, 20 bp, Artificial Sequence
  chemically synthesized
acatttctttgcatataaac

SEQ ID NO: 98713 - DNA, 20 bp, Artificial Sequence
  chemically synthesized
tgaaatttaagggatgagtc

SEQ ID NO: 98714 - DNA, 20 bp, Artificial Sequence
  chemically synthesized
tactttgaaatttaagggat

SEQ ID NO: 98715 - DNA, 20 bp, Artificial Sequence
  chemically synthesized
gattttactttgaaatttaa

SEQ ID NO: 98716 - DNA, 20 bp, Artificial Sequence
  chemically synthesized
agattttactttgaaattta

SEQ ID NO: 98717 - DNA, 20 bp, Artificial Sequence
  chemically synthesized
gagattttactttgaaattt

SEQ ID NO: 98718 - DNA, 20 bp, Artificial Sequence
  chemically synthesized
gactcatcccttaaatttca

SEQ ID NO: 98719 - DNA, 20 bp, Artificial Sequence
  chemically synthesized
aaagtaaaatctcaccaact

SEQ ID NO: 98720 - DNA, 20 bp, Artificial Sequence
  chemically synthesized
acagctttcgctcagttggt

SEQ ID NO: 98721 - DNA, 20 bp, Artificial Sequence
  chemically synthesized
tgccacagctttcgctcagt

SEQ ID NO: 98722 - DNA, 20 bp, Artificial Sequence
  chemically synthesized
aaatctcaccaactgagcga

SEQ ID NO: 98723 - DNA, 20 bp, Artificial Sequence
  chemically synthesized
tctgtgccacagctttcgct

SEQ ID NO: 98724 - DNA, 20 bp, Artificial Sequence
  chemically synthesized
caccaactgagcgaaagctg

SEQ ID NO: 98725 - DNA, 20 bp, Artificial Sequence
  chemically synthesized
actgagcgaaagctgtggca

SEQ ID NO: 98726 - DNA, 20 bp, Artificial Sequence
  chemically synthesized
tctgaggaacttctgtgcca

SEQ ID NO: 98727 - DNA, 20 bp, Artificial Sequence
  chemically synthesized
gagcgaaagctgtggcacag

SEQ ID NO: 98728 - DNA, 20 bp, Artificial Sequence
  chemically synthesized
gctgtggcacagaagttcct

SEQ ID NO: 98729 - DNA, 20 bp, Artificial Sequence
  chemically synthesized
tgtggcacagaagttcctca

SEQ ID NO: 98730 - DNA, 20 bp, Artificial Sequence
  chemically synthesized
gcacatcttttaaaactctg

SEQ ID NO: 98731 - DNA, 20 bp, Artificial Sequence
  chemically synthesized
agcacatcttttaaaactct

SEQ ID NO: 98732 - DNA, 20 bp, Artificial Sequence
  chemically synthesized
gaagttcctcagagttttaa

SEQ ID NO: 98733 - DNA, 20 bp, Artificial Sequence
  chemically synthesized
gagttttaaaagatgtgctt

SEQ ID NO: 98734 - DNA, 20 bp, Artificial Sequence
  chemically synthesized
agttttaaaagatgtgcttt

SEQ ID NO: 98735 - DNA, 20 bp, Artificial Sequence
  chemically synthesized
tgtggttggaattaaaccca

SEQ ID NO: 98736 - DNA, 20 bp, Artificial Sequence
  chemically synthesized
tggttttatatgtatgtggt

SEQ ID NO: 98737 - DNA, 20 bp, Artificial Sequence
  chemically synthesized
gacatggttttatatgtatg

SEQ ID NO: 98738 - DNA, 20 bp, Artificial Sequence
  chemically synthesized
acatacatataaaaccatgt

SEQ ID NO: 98739 - DNA, 20 bp, Artificial Sequence
  chemically synthesized
cctagactttgaaactgaca

SEQ ID NO: 98740 - DNA, 20 bp, Artificial Sequence
  chemically synthesized
ataaaaccatgtcagtttca

SEQ ID NO: 98741 - DNA, 20 bp, Artificial Sequence
  chemically synthesized
accatgtcagtttcaaagtc

SEQ ID NO: 98742 - DNA, 20 bp, Artificial Sequence
  chemically synthesized
ccatgtcagtttcaaagtct

SEQ ID NO: 98743 - DNA, 20 bp, Artificial Sequence
  chemically synthesized
gtcagtttcaaagtctaggt

SEQ ID NO: 98744 - DNA, 20 bp, Artificial Sequence
  chemically synthesized
tcagtttcaaagtctaggtc

SEQ ID NO: 98745 - DNA, 20 bp, Artificial Sequence
  chemically synthesized
cagtttcaaagtctaggtca

SEQ ID NO: 98746 - DNA, 20 bp, Artificial Sequence
  chemically synthesized
cagctttaagagccctgacc

SEQ ID NO: 98747 - DNA, 20 bp, Artificial Sequence
  chemically synthesized
agtctaggtcagggctctta

SEQ ID NO: 98748 - DNA, 20 bp, Artificial Sequence
  chemically synthesized
tctagctgtttcagctttaa

SEQ ID NO: 98749 - DNA, 20 bp, Artificial Sequence
  chemically synthesized
agtctagctgtttcagcttt

SEQ ID NO: 98750 - DNA, 20 bp, Artificial Sequence
  chemically synthesized
cagggctcttaaagctgaaa

SEQ ID NO: 98751 - DNA, 20 bp, Artificial Sequence
  chemically synthesized
gctcttaaagctgaaacagc

SEQ ID NO: 98752 - DNA, 20 bp, Artificial Sequence
  chemically synthesized
agatttgagtctagctgttt

SEQ ID NO: 98753 - DNA, 20 bp, Artificial Sequence
  chemically synthesized
aatgctctgagatttgagtc

SEQ ID NO: 98754 - DNA, 20 bp, Artificial Sequence
  chemically synthesized
aaacagctagactcaaatct

SEQ ID NO: 98755 - DNA, 20 bp, Artificial Sequence
  chemically synthesized
atgaaaatgctctgagattt

SEQ ID NO: 98756 - DNA, 20 bp, Artificial Sequence
  chemically synthesized
acagctagactcaaatctca

SEQ ID NO: 98757 - DNA, 20 bp, Artificial Sequence
  chemically synthesized
tccagttatgaaaatgctct

SEQ ID NO: 98758 - DNA, 20 bp, Artificial Sequence
  chemically synthesized
tctcagagcattttcataac

SEQ ID NO: 98759 - DNA, 20 bp, Artificial Sequence
  chemically synthesized
gcaagtgagtacagatcatc

SEQ ID NO: 98760 - DNA, 20 bp, Artificial Sequence
  chemically synthesized
cctgcaaatgcaagtgagta

SEQ ID NO: 98761 - DNA, 20 bp, Artificial Sequence
  chemically synthesized
ttttgcctgcaaatgcaagt

SEQ ID NO: 98762 - DNA, 20 bp, Artificial Sequence
  chemically synthesized
tctgtactcacttgcatttg

SEQ ID NO: 98763 - DNA, 20 bp, Artificial Sequence
  chemically synthesized
acaattttgcctgcaaatgc

SEQ ID NO: 98764 - DNA, 20 bp, Artificial Sequence
  chemically synthesized
ctgtactcacttgcatttgc

SEQ ID NO: 98765 - DNA, 20 bp, Artificial Sequence
  chemically synthesized
ttgcaggcaaaattgtaaat

SEQ ID NO: 98766 - DNA, 20 bp, Artificial Sequence
  chemically synthesized
tgcaggcaaaattgtaaatg

SEQ ID NO: 98767 - DNA, 20 bp, Artificial Sequence
  chemically synthesized
ggaattacaatatatacatt

SEQ ID NO: 98768 - DNA, 20 bp, Artificial Sequence
  chemically synthesized
tacaatatatacattcagaa

SEQ ID NO: 98769 - DNA, 20 bp, Artificial Sequence
  chemically synthesized
caatatatacattcagaaca

SEQ ID NO: 98770 - DNA, 20 bp, Artificial Sequence
  chemically synthesized
tatatacattcagaacagag

SEQ ID NO: 98771 - DNA, 20 bp, Artificial Sequence
  chemically synthesized
acagagaagaaatttcccta

SEQ ID NO: 98772 - DNA, 20 bp, Artificial Sequence
  chemically synthesized
gaagaaatttccctaaagac

SEQ ID NO: 98773 - DNA, 20 bp, Artificial Sequence
  chemically synthesized
atttttggtacttgtcttta

SEQ ID NO: 98774 - DNA, 20 bp, Artificial Sequence
  chemically synthesized
catttttggtacttgtcttt

SEQ ID NO: 98775 - DNA, 20 bp, Artificial Sequence
  chemically synthesized
acatttttggtacttgtctt

SEQ ID NO: 98776 - DNA, 20 bp, Artificial Sequence
  chemically synthesized
aatctttacattaacatttt

SEQ ID NO: 98777 - DNA, 20 bp, Artificial Sequence
  chemically synthesized
gtaccaaaaatgttaatgta

SEQ ID NO: 98778 - DNA, 20 bp, Artificial Sequence
  chemically synthesized
aatgtaaagatttgccactt

SEQ ID NO: 98779 - DNA, 20 bp, Artificial Sequence
  chemically synthesized
tttttccatttgttcttaag

SEQ ID NO: 98780 - DNA, 20 bp, Artificial Sequence
  chemically synthesized
ttttttttccatttgttctt

SEQ ID NO: 98781 - DNA, 20 bp, Artificial Sequence
  chemically synthesized
atttgccacttaagaacaaa

SEQ ID NO: 98782 - DNA, 20 bp, Artificial Sequence
  chemically synthesized
caaatggaaaaaaaaatcat

SEQ ID NO: 98783 - DNA, 20 bp, Artificial Sequence
  chemically synthesized
tagattatgtgtcgaaagtt

SEQ ID NO: 98784 - DNA, 20 bp, Artificial Sequence
  chemically synthesized
ttagattatgtgtcgaaagt

SEQ ID NO: 98785 - DNA, 20 bp, Artificial Sequence
  chemically synthesized
gaccttagattatgtgtcga

SEQ ID NO: 98786 - DNA, 20 bp, Artificial Sequence
  chemically synthesized
taactttcgacacataatct

SEQ ID NO: 98787 - DNA, 20 bp, Artificial Sequence
  chemically synthesized
aactttcgacacataatcta

SEQ ID NO: 98788 - DNA, 20 bp, Artificial Sequence
  chemically synthesized
gacacataatctaaggtctg

SEQ ID NO: 98789 - DNA, 20 bp, Artificial Sequence
  chemically synthesized
cacaaaaagacttcagacct

SEQ ID NO: 98790 - DNA, 20 bp, Artificial Sequence
  chemically synthesized
tgtgaaacacaaaaagactt

SEQ ID NO: 98791 - DNA, 20 bp, Artificial Sequence
  chemically synthesized
ttcatattgtgaaacacaaa

SEQ ID NO: 98792 - DNA, 20 bp, Artificial Sequence
  chemically synthesized
tttttgtgtttcacaatatg

SEQ ID NO: 98793 - DNA, 20 bp, Artificial Sequence
  chemically synthesized
ttttgtgtttcacaatatga

SEQ ID NO: 98794 - DNA, 20 bp, Artificial Sequence
  chemically synthesized
ttcacaatatgaaggtgccc

SEQ ID NO: 98795 - DNA, 20 bp, Artificial Sequence
  chemically synthesized
tagtataaatattgtggcca

SEQ ID NO: 98796 - DNA, 20 bp, Artificial Sequence
  chemically synthesized
atagtataaatattgtggcc

SEQ ID NO: 98797 - DNA, 20 bp, Artificial Sequence
  chemically synthesized
aatagtataaatattgtggc

SEQ ID NO: 98798 - DNA, 20 bp, Artificial Sequence
  chemically synthesized
taggaatagtataaatattg

SEQ ID NO: 98799 - DNA, 20 bp, Artificial Sequence
  chemically synthesized
cacaatatttatactattcc

SEQ ID NO: 98800 - DNA, 20 bp, Artificial Sequence
  chemically synthesized
aatatttatactattcctag

SEQ ID NO: 98801 - DNA, 20 bp, Artificial Sequence
  chemically synthesized
tatttacaatcttctaggaa

SEQ ID NO: 98802 - DNA, 20 bp, Artificial Sequence
  chemically synthesized
gatactatttacaatcttct

SEQ ID NO: 98803 - DNA, 20 bp, Artificial Sequence
  chemically synthesized
agatactatttacaatcttc

SEQ ID NO: 98804 - DNA, 20 bp, Artificial Sequence
  chemically synthesized
tattcctagaagattgtaaa

SEQ ID NO: 98805 - DNA, 20 bp, Artificial Sequence
  chemically synthesized
agaaactcacagtgcacatt

SEQ ID NO: 98806 - DNA, 20 bp, Artificial Sequence
  chemically synthesized
agtatctgaatgtgcactgt

SEQ ID NO: 98807 - DNA, 20 bp, Artificial Sequence
  chemically synthesized
ggttgaatctgagaaactca

SEQ ID NO: 98808 - DNA, 20 bp, Artificial Sequence
  chemically synthesized
aatgtgcactgtgagtttct

SEQ ID NO: 98809 - DNA, 20 bp, Artificial Sequence
  chemically synthesized
ttgttcctggggttgaatct

SEQ ID NO: 98810 - DNA, 20 bp, Artificial Sequence
  chemically synthesized
gagtttctcagattcaaccc

SEQ ID NO: 98811 - DNA, 20 bp, Artificial Sequence
  chemically synthesized
agtttctcagattcaacccc

SEQ ID NO: 98812 - DNA, 20 bp, Artificial Sequence
  chemically synthesized
catttgcgcaattgttcctg

SEQ ID NO: 98813 - DNA, 20 bp, Artificial Sequence
  chemically synthesized
gcatttgcgcaattgttcct

SEQ ID NO: 98814 - DNA, 20 bp, Artificial Sequence
  chemically synthesized
agcatttgcgcaattgttcc

SEQ ID NO: 98815 - DNA, 20 bp, Artificial Sequence
  chemically synthesized
agcagtttctatatgcagga

SEQ ID NO: 98816 - DNA, 20 bp, Artificial Sequence
  chemically synthesized
cgcaaatgctctcctgcata

SEQ ID NO: 98817 - DNA, 20 bp, Artificial Sequence
  chemically synthesized
ctagcagtttctatatgcag

SEQ ID NO: 98818 - DNA, 20 bp, Artificial Sequence
  chemically synthesized
atctagcagtttctatatgc

SEQ ID NO: 98819 - DNA, 20 bp, Artificial Sequence
  chemically synthesized
gatctagcagtttctatatg

SEQ ID NO: 98820 - DNA, 20 bp, Artificial Sequence
  chemically synthesized
ctcctgcatatagaaactgc

SEQ ID NO: 98821 - DNA, 20 bp, Artificial Sequence
  chemically synthesized
gctctgaaaagaggatctag

SEQ ID NO: 98822 - DNA, 20 bp, Artificial Sequence
  chemically synthesized
gcagctctgaaaagaggatc

SEQ ID NO: 98823 - DNA, 20 bp, Artificial Sequence
  chemically synthesized
aaactgctagatcctctttt

SEQ ID NO: 98824 - DNA, 20 bp, Artificial Sequence
  chemically synthesized
actgctagatcctcttttca

SEQ ID NO: 98825 - DNA, 20 bp, Artificial Sequence
  chemically synthesized
aaagcagcagctctgaaaag

SEQ ID NO: 98826 - DNA, 20 bp, Artificial Sequence
  chemically synthesized
aaaagcagcagctctgaaaa

SEQ ID NO: 98827 - DNA, 20 bp, Artificial Sequence
  chemically synthesized
caaaaagcagcagctctgaa

SEQ ID NO: 98828 - DNA, 20 bp, Artificial Sequence
  chemically synthesized
tccagaaaaacaaaaagcag

SEQ ID NO: 98829 - DNA, 20 bp, Artificial Sequence
  chemically synthesized
gtctccagaaaaacaaaaag

SEQ ID NO: 98830 - DNA, 20 bp, Artificial Sequence
  chemically synthesized
cctgtctccagaaaaacaaa

SEQ ID NO: 98831 - DNA, 20 bp, Artificial Sequence
  chemically synthesized
gctgctgctttttgtttttc

SEQ ID NO: 98832 - DNA, 20 bp, Artificial Sequence
  chemically synthesized
tgctgctttttgtttttctg

SEQ ID NO: 98833 - DNA, 20 bp, Artificial Sequence
  chemically synthesized
gctttttgtttttctggaga

SEQ ID NO: 98834 - DNA, 20 bp, Artificial Sequence
  chemically synthesized
ctttttgtttttctggagac

SEQ ID NO: 98835 - DNA, 20 bp, Artificial Sequence
  chemically synthesized
tttttgtttttctggagaca

SEQ ID NO: 98836 - DNA, 20 bp, Artificial Sequence
  chemically synthesized
gcagggtgagaccctgtctc

SEQ ID NO: 98837 - DNA, 20 bp, Artificial Sequence
  chemically synthesized
tccagcttgggcagcagggt

SEQ ID NO: 98838 - DNA, 20 bp, Artificial Sequence
  chemically synthesized
gcactccagcttgggcagca

SEQ ID NO: 98839 - DNA, 20 bp, Artificial Sequence
  chemically synthesized
agggtctcaccctgctgccc

SEQ ID NO: 98840 - DNA, 20 bp, Artificial Sequence
  chemically synthesized
tgcactccagcttgggcagc

SEQ ID NO: 98841 - DNA, 20 bp, Artificial Sequence
  chemically synthesized
ctgcactccagcttgggcag

SEQ ID NO: 98842 - DNA, 20 bp, Artificial Sequence
  chemically synthesized
tctcaccctgctgcccaagc

SEQ ID NO: 98843 - DNA, 20 bp, Artificial Sequence
  chemically synthesized
ccactgcactccagcttggg

SEQ ID NO: 98844 - DNA, 20 bp, Artificial Sequence
  chemically synthesized
tcaccctgctgcccaagctg

SEQ ID NO: 98845 - DNA, 20 bp, Artificial Sequence
  chemically synthesized
tcaccactgcactccagctt

SEQ ID NO: 98846 - DNA, 20 bp, Artificial Sequence
  chemically synthesized
ctcaccactgcactccagct

SEQ ID NO: 98847 - DNA, 20 bp, Artificial Sequence
  chemically synthesized
ctgctgcccaagctggagtg

SEQ ID NO: 98848 - DNA, 20 bp, Artificial Sequence
  chemically synthesized
gtggtctcaccactgcactc

SEQ ID NO: 98849 - DNA, 20 bp, Artificial Sequence
  chemically synthesized
ctgcccaagctggagtgcag

SEQ ID NO: 98850 - DNA, 20 bp, Artificial Sequence
  chemically synthesized
ccaagctggagtgcagtggt

SEQ ID NO: 98851 - DNA, 20 bp, Artificial Sequence
  chemically synthesized
ggagtgcagtggtgagacca

SEQ ID NO: 98852 - DNA, 20 bp, Artificial Sequence
  chemically synthesized
gtcgaagctgcagtgagccg

SEQ ID NO: 98853 - DNA, 20 bp, Artificial Sequence
  chemically synthesized
ggtgagaccacggctcactg

SEQ ID NO: 98854 - DNA, 20 bp, Artificial Sequence
  chemically synthesized
tgggaagtcgaagctgcagt

SEQ ID NO: 98855 - DNA, 20 bp, Artificial Sequence
  chemically synthesized
agcttgggaagtcgaagctg

SEQ ID NO: 98856 - DNA, 20 bp, Artificial Sequence
  chemically synthesized
tgcttgagcttgggaagtcg

SEQ ID NO: 98857 - DNA, 20 bp, Artificial Sequence
  chemically synthesized
cactgcagcttcgacttccc

SEQ ID NO: 98858 - DNA, 20 bp, Artificial Sequence
  chemically synthesized
gaggattgcttgagcttggg

SEQ ID NO: 98859 - DNA, 20 bp, Artificial Sequence
  chemically synthesized
agcttcgacttcccaagctc

SEQ ID NO: 98860 - DNA, 20 bp, Artificial Sequence
  chemically synthesized
tgggaggattgcttgagctt

SEQ ID NO: 98861 - DNA, 20 bp, Artificial Sequence
  chemically synthesized
gtgggaggattgcttgagct

SEQ ID NO: 98862 - DNA, 20 bp, Artificial Sequence
  chemically synthesized
ctgaggtgggaggattgctt

SEQ ID NO: 98863 - DNA, 20 bp, Artificial Sequence
  chemically synthesized
ctcaagcaatcctcccacct

SEQ ID NO: 98864 - DNA, 20 bp, Artificial Sequence
  chemically synthesized
actcaggaggctgaggtggg

SEQ ID NO: 98865 - DNA, 20 bp, Artificial Sequence
  chemically synthesized
tactcaggaggctgaggtgg

SEQ ID NO: 98866 - DNA, 20 bp, Artificial Sequence
  chemically synthesized
actactcaggaggctgaggt

SEQ ID NO: 98867 - DNA, 20 bp, Artificial Sequence
  chemically synthesized
aactactcaggaggctgagg

SEQ ID NO: 98868 - DNA, 20 bp, Artificial Sequence
  chemically synthesized
cccaactactcaggaggctg

SEQ ID NO: 98869 - DNA, 20 bp, Artificial Sequence
  chemically synthesized
tcccaactactcaggaggct

SEQ ID NO: 98870 - DNA, 20 bp, Artificial Sequence
  chemically synthesized
tcctcccacctcagcctcct

SEQ ID NO: 98871 - DNA, 20 bp, Artificial Sequence
  chemically synthesized
tcccacctcagcctcctgag

SEQ ID NO: 98872 - DNA, 20 bp, Artificial Sequence
  chemically synthesized
tataatcccaactactcagg

SEQ ID NO: 98873 - DNA, 20 bp, Artificial Sequence
  chemically synthesized
ctataatcccaactactcag

SEQ ID NO: 98874 - DNA, 20 bp, Artificial Sequence
  chemically synthesized
acctcagcctcctgagtagt

SEQ ID NO: 98875 - DNA, 20 bp, Artificial Sequence
  chemically synthesized
acctataatcccaactactc

SEQ ID NO: 98876 - DNA, 20 bp, Artificial Sequence
  chemically synthesized
cctcagcctcctgagtagtt

SEQ ID NO: 98877 - DNA, 20 bp, Artificial Sequence
  chemically synthesized
cacctataatcccaactact

SEQ ID NO: 98878 - DNA, 20 bp, Artificial Sequence
  chemically synthesized
ctcctgagtagttgggatta

SEQ ID NO: 98879 - DNA, 20 bp, Artificial Sequence
  chemically synthesized
tcctgagtagttgggattat

SEQ ID NO: 98880 - DNA, 20 bp, Artificial Sequence
  chemically synthesized
taggtgtgtgccaccacacc

SEQ ID NO: 98881 - DNA, 20 bp, Artificial Sequence
  chemically synthesized
aaaaacttagctgggtgtgg

SEQ ID NO: 98882 - DNA, 20 bp, Artificial Sequence
  chemically synthesized
ataaaaaacttagctgggtg

SEQ ID NO: 98883 - DNA, 20 bp, Artificial Sequence
  chemically synthesized
gtgtgccaccacacccagct

SEQ ID NO: 98884 - DNA, 20 bp, Artificial Sequence
  chemically synthesized
taaaaataaaaaacttagct

SEQ ID NO: 98885 - DNA, 20 bp, Artificial Sequence
  chemically synthesized
ataaaaataaaaaacttagc

SEQ ID NO: 98886 - DNA, 20 bp, Artificial Sequence
  chemically synthesized
tctaataaaaataaaaaact

SEQ ID NO: 98887 - DNA, 20 bp, Artificial Sequence
  chemically synthesized
gctaagttttttatttttat

SEQ ID NO: 98888 - DNA, 20 bp, Artificial Sequence
  chemically synthesized
taagttttttatttttatta

SEQ ID NO: 98889 - DNA, 20 bp, Artificial Sequence
  chemically synthesized
ttttatttttattagagatg

SEQ ID NO: 98890 - DNA, 20 bp, Artificial Sequence
  chemically synthesized
tattagagatgaagtcccac

SEQ ID NO: 98891 - DNA, 20 bp, Artificial Sequence
  chemically synthesized
accaaccctagcaatctagt

SEQ ID NO: 98892 - DNA, 20 bp, Artificial Sequence
  chemically synthesized
gaccaaccctagcaatctag

SEQ ID NO: 98893 - DNA, 20 bp, Artificial Sequence
  chemically synthesized
atgaagtcccactagattgc

SEQ ID NO: 98894 - DNA, 20 bp, Artificial Sequence
  chemically synthesized
tgaagtcccactagattgct

SEQ ID NO: 98895 - DNA, 20 bp, Artificial Sequence
  chemically synthesized
taagaccaaccctagcaatc

SEQ ID NO: 98896 - DNA, 20 bp, Artificial Sequence
  chemically synthesized
gaagtcccactagattgcta

SEQ ID NO: 98897 - DNA, 20 bp, Artificial Sequence
  chemically synthesized
tcccactagattgctagggt

SEQ ID NO: 98898 - DNA, 20 bp, Artificial Sequence
  chemically synthesized
caggaaattaagaccaaccc

SEQ ID NO: 98899 - DNA, 20 bp, Artificial Sequence
  chemically synthesized
tagggttggtcttaatttcc

SEQ ID NO: 98900 - DNA, 20 bp, Artificial Sequence
  chemically synthesized
tctcttgagcccaggaaatt

SEQ ID NO: 98901 - DNA, 20 bp, Artificial Sequence
  chemically synthesized
agggttggtcttaatttcct

SEQ ID NO: 98902 - DNA, 20 bp, Artificial Sequence
  chemically synthesized
ggtcttaatttcctgggctc

SEQ ID NO: 98903 - DNA, 20 bp, Artificial Sequence
  chemically synthesized
cgggaggatctcttgagccc

SEQ ID NO: 98904 - DNA, 20 bp, Artificial Sequence
  chemically synthesized
tcttaatttcctgggctcaa

SEQ ID NO: 98905 - DNA, 20 bp, Artificial Sequence
  chemically synthesized
gcgggaggatctcttgagcc

SEQ ID NO: 98906 - DNA, 20 bp, Artificial Sequence
  chemically synthesized
ctgaggcgggaggatctctt

SEQ ID NO: 98907 - DNA, 20 bp, Artificial Sequence
  chemically synthesized
ctcaagagatcctcccgcct

SEQ ID NO: 98908 - DNA, 20 bp, Artificial Sequence
  chemically synthesized
ctttgggaggctgaggcggg

SEQ ID NO: 98909 - DNA, 20 bp, Artificial Sequence
  chemically synthesized
gctttgggaggctgaggcgg

SEQ ID NO: 98910 - DNA, 20 bp, Artificial Sequence
  chemically synthesized
gtgctttgggaggctgaggc

SEQ ID NO: 98911 - DNA, 20 bp, Artificial Sequence
  chemically synthesized
agtgctttgggaggctgagg

SEQ ID NO: 98912 - DNA, 20 bp, Artificial Sequence
  chemically synthesized
cccagtgctttgggaggctg

SEQ ID NO: 98913 - DNA, 20 bp, Artificial Sequence
  chemically synthesized
tcccagtgctttgggaggct

SEQ ID NO: 98914 - DNA, 20 bp, Artificial Sequence
  chemically synthesized
cctcccgcctcagcctccca

SEQ ID NO: 98915 - DNA, 20 bp, Artificial Sequence
  chemically synthesized
tgtaatcccagtgctttggg

SEQ ID NO: 98916 - DNA, 20 bp, Artificial Sequence
  chemically synthesized
ttgtaatcccagtgctttgg

SEQ ID NO: 98917 - DNA, 20 bp, Artificial Sequence
  chemically synthesized
gcctcagcctcccaaagcac

SEQ ID NO: 98918 - DNA, 20 bp, Artificial Sequence
  chemically synthesized
acttgtaatcccagtgcttt

SEQ ID NO: 98919 - DNA, 20 bp, Artificial Sequence
  chemically synthesized
cctcagcctcccaaagcact

SEQ ID NO: 98920 - DNA, 20 bp, Artificial Sequence
  chemically synthesized
cacttgtaatcccagtgctt

SEQ ID NO: 98921 - DNA, 20 bp, Artificial Sequence
  chemically synthesized
tcccaaagcactgggattac

SEQ ID NO: 98922 - DNA, 20 bp, Artificial Sequence
  chemically synthesized
gtggctcacacttgtaatcc

SEQ ID NO: 98923 - DNA, 20 bp, Artificial Sequence
  chemically synthesized
agcactgggattacaagtgt

SEQ ID NO: 98924 - DNA, 20 bp, Artificial Sequence
  chemically synthesized
caagtgtgagccaccacaca

SEQ ID NO: 98925 - DNA, 20 bp, Artificial Sequence
  chemically synthesized
cagctctgggccatgtgtgg

SEQ ID NO: 98926 - DNA, 20 bp, Artificial Sequence
  chemically synthesized
aagcagctctgggccatgtg

SEQ ID NO: 98927 - DNA, 20 bp, Artificial Sequence
  chemically synthesized
gtgagccaccacacatggcc

SEQ ID NO: 98928 - DNA, 20 bp, Artificial Sequence
  chemically synthesized
gagccaccacacatggccca

SEQ ID NO: 98929 - DNA, 20 bp, Artificial Sequence
  chemically synthesized
gcctggtaagaagcagctct

SEQ ID NO: 98930 - DNA, 20 bp, Artificial Sequence
  chemically synthesized
tgcctggtaagaagcagctc

SEQ ID NO: 98931 - DNA, 20 bp, Artificial Sequence
  chemically synthesized
tctgtctgcctggtaagaag

SEQ ID NO: 98932 - DNA, 20 bp, Artificial Sequence
  chemically synthesized
ggcccagagctgcttcttac

SEQ ID NO: 98933 - DNA, 20 bp, Artificial Sequence
  chemically synthesized
gcccagagctgcttcttacc

SEQ ID NO: 98934 - DNA, 20 bp, Artificial Sequence
  chemically synthesized
ttctctgtctgcctggtaag

SEQ ID NO: 98935 - DNA, 20 bp, Artificial Sequence
  chemically synthesized
cagagctgcttcttaccagg

SEQ ID NO: 98936 - DNA, 20 bp, Artificial Sequence
  chemically synthesized
catttctctgtctgcctggt

SEQ ID NO: 98937 - DNA, 20 bp, Artificial Sequence
  chemically synthesized
gctgcttcttaccaggcaga

SEQ ID NO: 98938 - DNA, 20 bp, Artificial Sequence
  chemically synthesized
ctcccatttctctgtctgcc

SEQ ID NO: 98939 - DNA, 20 bp, Artificial Sequence
  chemically synthesized
tgcttcttaccaggcagaca

SEQ ID NO: 98940 - DNA, 20 bp, Artificial Sequence
  chemically synthesized
ttaccaggcagacagagaaa

SEQ ID NO: 98941 - DNA, 20 bp, Artificial Sequence
  chemically synthesized
taccaggcagacagagaaat

SEQ ID NO: 98942 - DNA, 20 bp, Artificial Sequence
  chemically synthesized
ccaggcagacagagaaatgg

SEQ ID NO: 98943 - DNA, 20 bp, Artificial Sequence
  chemically synthesized
caggcagacagagaaatggg

SEQ ID NO: 98944 - DNA, 20 bp, Artificial Sequence
  chemically synthesized
gcagacagagaaatgggagg

SEQ ID NO: 98945 - DNA, 20 bp, Artificial Sequence
  chemically synthesized
aatgggaggcagcacgacct

SEQ ID NO: 98946 - DNA, 20 bp, Artificial Sequence
  chemically synthesized
tgggaggcagcacgaccttg

SEQ ID NO: 98947 - DNA, 20 bp, Artificial Sequence
  chemically synthesized
gaggcagcacgaccttggag

SEQ ID NO: 98948 - DNA, 20 bp, Artificial Sequence
  chemically synthesized
aggcagcacgaccttggaga

SEQ ID NO: 98949 - DNA, 20 bp, Artificial Sequence
  chemically synthesized
gactatttcctccttctcca

SEQ ID NO: 98950 - DNA, 20 bp, Artificial Sequence
  chemically synthesized
gcagcacgaccttggagaag

SEQ ID NO: 98951 - DNA, 20 bp, Artificial Sequence
  chemically synthesized
tgactatttcctccttctcc

SEQ ID NO: 98952 - DNA, 20 bp, Artificial Sequence
  chemically synthesized
cagcacgaccttggagaagg

SEQ ID NO: 98953 - DNA, 20 bp, Artificial Sequence
  chemically synthesized
gaccttggagaaggaggaaa

SEQ ID NO: 98954 - DNA, 20 bp, Artificial Sequence
  chemically synthesized
gcactccctaataaaagaag

SEQ ID NO: 98955 - DNA, 20 bp, Artificial Sequence
  chemically synthesized
tgcactccctaataaaagaa

SEQ ID NO: 98956 - DNA, 20 bp, Artificial Sequence
  chemically synthesized
ctgcactccctaataaaaga

SEQ ID NO: 98957 - DNA, 20 bp, Artificial Sequence
  chemically synthesized
tcattgtccccttcttttat

SEQ ID NO: 98958 - DNA, 20 bp, Artificial Sequence
  chemically synthesized
cctgcactccctaataaaag

SEQ ID NO: 98959 - DNA, 20 bp, Artificial Sequence
  chemically synthesized
cattgtccccttcttttatt

SEQ ID NO: 98960 - DNA, 20 bp, Artificial Sequence
  chemically synthesized
attgtccccttcttttatta

SEQ ID NO: 98961 - DNA, 20 bp, Artificial Sequence
  chemically synthesized
gggcctgcactccctaataa

SEQ ID NO: 98962 - DNA, 20 bp, Artificial Sequence
  chemically synthesized
tgtccccttcttttattagg

SEQ ID NO: 98963 - DNA, 20 bp, Artificial Sequence
  chemically synthesized
ccttcttttattagggagtg

SEQ ID NO: 98964 - DNA, 20 bp, Artificial Sequence
  chemically synthesized
cttcttttattagggagtgc

SEQ ID NO: 98965 - DNA, 20 bp, Artificial Sequence
  chemically synthesized
ggtagaatagtagtatggtg

SEQ ID NO: 98966 - DNA, 20 bp, Artificial Sequence
  chemically synthesized
tggtagaatagtagtatggt

SEQ ID NO: 98967 - DNA, 20 bp, Artificial Sequence
  chemically synthesized
ctggtagaatagtagtatgg

SEQ ID NO: 98968 - DNA, 20 bp, Artificial Sequence
  chemically synthesized
gtgctggtagaatagtagta

SEQ ID NO: 98969 - DNA, 20 bp, Artificial Sequence
  chemically synthesized
gcactgtgctggtagaatag

SEQ ID NO: 98970 - DNA, 20 bp, Artificial Sequence
  chemically synthesized
ccaccatactactattctac

SEQ ID NO: 98971 - DNA, 20 bp, Artificial Sequence
  chemically synthesized
caggcactgtgctggtagaa

SEQ ID NO: 98972 - DNA, 20 bp, Artificial Sequence
  chemically synthesized
atactactattctaccagca

SEQ ID NO: 98973 - DNA, 20 bp, Artificial Sequence
  chemically synthesized
aggagcaggcactgtgctgg

SEQ ID NO: 98974 - DNA, 20 bp, Artificial Sequence
  chemically synthesized
cagaggagcaggcactgtgc

SEQ ID NO: 98975 - DNA, 20 bp, Artificial Sequence
  chemically synthesized
cagcacagtgcctgctcctc

SEQ ID NO: 98976 - DNA, 20 bp, Artificial Sequence
  chemically synthesized
aaggagcagcccagaggagc

SEQ ID NO: 98977 - DNA, 20 bp, Artificial Sequence
  chemically synthesized
agcacagtgcctgctcctct

SEQ ID NO: 98978 - DNA, 20 bp, Artificial Sequence
  chemically synthesized
gaaggagcagcccagaggag

SEQ ID NO: 98979 - DNA, 20 bp, Artificial Sequence
  chemically synthesized
ttggaaggagcagcccagag

SEQ ID NO: 98980 - DNA, 20 bp, Artificial Sequence
  chemically synthesized
ggttggaaggagcagcccag

SEQ ID NO: 98981 - DNA, 20 bp, Artificial Sequence
  chemically synthesized
aggttggaaggagcagccca

SEQ ID NO: 98982 - DNA, 20 bp, Artificial Sequence
  chemically synthesized
tgaggttggaaggagcagcc

SEQ ID NO: 98983 - DNA, 20 bp, Artificial Sequence
  chemically synthesized
agcagtgaggttggaaggag

SEQ ID NO: 98984 - DNA, 20 bp, Artificial Sequence
  chemically synthesized
ggcagcagtgaggttggaag

SEQ ID NO: 98985 - DNA, 20 bp, Artificial Sequence
  chemically synthesized
agggcagcagtgaggttgga

SEQ ID NO: 98986 - DNA, 20 bp, Artificial Sequence
  chemically synthesized
gagggcagcagtgaggttgg

SEQ ID NO: 98987 - DNA, 20 bp, Artificial Sequence
  chemically synthesized
gctgagggcagcagtgaggt

SEQ ID NO: 98988 - DNA, 20 bp, Artificial Sequence
  chemically synthesized
tgaggctgagggcagcagtg

SEQ ID NO: 98989 - DNA, 20 bp, Artificial Sequence
  chemically synthesized
atgaggctgagggcagcagt

SEQ ID NO: 98990 - DNA, 20 bp, Artificial Sequence
  chemically synthesized
tccaacctcactgctgccct

SEQ ID NO: 98991 - DNA, 20 bp, Artificial Sequence
  chemically synthesized
gaatatgaggctgagggcag

SEQ ID NO: 98992 - DNA, 20 bp, Artificial Sequence
  chemically synthesized
tctgaatatgaggctgaggg

SEQ ID NO: 98993 - DNA, 20 bp, Artificial Sequence
  chemically synthesized
tgttctgaatatgaggctga

SEQ ID NO: 98994 - DNA, 20 bp, Artificial Sequence
  chemically synthesized
atgttctgaatatgaggctg

SEQ ID NO: 98995 - DNA, 20 bp, Artificial Sequence
  chemically synthesized
aatgttctgaatatgaggct

SEQ ID NO: 98996 - DNA, 20 bp, Artificial Sequence
  chemically synthesized
gctgccctcagcctcatatt

SEQ ID NO: 98997 - DNA, 20 bp, Artificial Sequence
  chemically synthesized
actgaaatgttctgaatatg

SEQ ID NO: 98998 - DNA, 20 bp, Artificial Sequence
  chemically synthesized
cactgaaatgttctgaatat

SEQ ID NO: 98999 - DNA, 20 bp, Artificial Sequence
  chemically synthesized
gcctcatattcagaacattt

SEQ ID NO: 99000 - DNA, 20 bp, Artificial Sequence
  chemically synthesized
tcatattcagaacatttcag

SEQ ID NO: 99001 - DNA, 20 bp, Artificial Sequence
  chemically synthesized
ttcagaacatttcagtggtg

SEQ ID NO: 99002 - DNA, 20 bp, Artificial Sequence
  chemically synthesized
aacatttcagtggtgaagat

SEQ ID NO: 99003 - DNA, 20 bp, Artificial Sequence
  chemically synthesized
catttcagtggtgaagatca

SEQ ID NO: 99004 - DNA, 20 bp, Artificial Sequence
  chemically synthesized
tgaagatcagagcacataat

SEQ ID NO: 99005 - DNA, 20 bp, Artificial Sequence
  chemically synthesized
gagcacataatgagcttgtc

SEQ ID NO: 99006 - DNA, 20 bp, Artificial Sequence
  chemically synthesized
aatcttaatttgttccagac

SEQ ID NO: 99007 - DNA, 20 bp, Artificial Sequence
  chemically synthesized
cccggaatcttaatttgttc

SEQ ID NO: 99008 - DNA, 20 bp, Artificial Sequence
  chemically synthesized
gagcttgtctggaacaaatt

SEQ ID NO: 99009 - DNA, 20 bp, Artificial Sequence
  chemically synthesized
tctggaacaaattaagattc

SEQ ID NO: 99010 - DNA, 20 bp, Artificial Sequence
  chemically synthesized
ctggaacaaattaagattcc

SEQ ID NO: 99011 - DNA, 20 bp, Artificial Sequence
  chemically synthesized
aattaagattccgggcttta

SEQ ID NO: 99012 - DNA, 20 bp, Artificial Sequence
  chemically synthesized
gtctgtttgactttaaagcc

SEQ ID NO: 99013 - DNA, 20 bp, Artificial Sequence
  chemically synthesized
cccatgtctgtttgacttta

SEQ ID NO: 99014 - DNA, 20 bp, Artificial Sequence
  chemically synthesized
ttccgggctttaaagtcaaa

SEQ ID NO: 99015 - DNA, 20 bp, Artificial Sequence
  chemically synthesized
gctttaaagtcaaacagaca

SEQ ID NO: 99016 - DNA, 20 bp, Artificial Sequence
  chemically synthesized
ctttaaagtcaaacagacat

SEQ ID NO: 99017 - DNA, 20 bp, Artificial Sequence
  chemically synthesized
tcaaacagacatgggttaca

SEQ ID NO: 99018 - DNA, 20 bp, Artificial Sequence
  chemically synthesized
caaacagacatgggttacat

SEQ ID NO: 99019 - DNA, 20 bp, Artificial Sequence
  chemically synthesized
gacatgggttacatgggttt

SEQ ID NO: 99020 - DNA, 20 bp, Artificial Sequence
  chemically synthesized
acatgggtttgagtctcatt

SEQ ID NO: 99021 - DNA, 20 bp, Artificial Sequence
  chemically synthesized
tgaagatcgcagagccaaat

SEQ ID NO: 99022 - DNA, 20 bp, Artificial Sequence
  chemically synthesized
gaaatttgctgaagatcgca

SEQ ID NO: 99023 - DNA, 20 bp, Artificial Sequence
  chemically synthesized
tcatttggctctgcgatctt

SEQ ID NO: 99024 - DNA, 20 bp, Artificial Sequence
  chemically synthesized
aagaaatttgctgaagatcg

SEQ ID NO: 99025 - DNA, 20 bp, Artificial Sequence
  chemically synthesized
aatagataagaaatttgctg

SEQ ID NO: 99026 - DNA, 20 bp, Artificial Sequence
  chemically synthesized
ctgcggataaggaaatagat

SEQ ID NO: 99027 - DNA, 20 bp, Artificial Sequence
  chemically synthesized
ccattctgcggataaggaaa

SEQ ID NO: 99028 - DNA, 20 bp, Artificial Sequence
  chemically synthesized
cttatctatttccttatccg

SEQ ID NO: 99029 - DNA, 20 bp, Artificial Sequence
  chemically synthesized
tcatctccattctgcggata

SEQ ID NO: 99030 - DNA, 20 bp, Artificial Sequence
  chemically synthesized
atcatctccattctgcggat

SEQ ID NO: 99031 - DNA, 20 bp, Artificial Sequence
  chemically synthesized
ctatttccttatccgcagaa

SEQ ID NO: 99032 - DNA, 20 bp, Artificial Sequence
  chemically synthesized
atttccttatccgcagaatg

SEQ ID NO: 99033 - DNA, 20 bp, Artificial Sequence
  chemically synthesized
gtattatcatctccattctg

SEQ ID NO: 99034 - DNA, 20 bp, Artificial Sequence
  chemically synthesized
caaaagtcccttgaggaagg

SEQ ID NO: 99035 - DNA, 20 bp, Artificial Sequence
  chemically synthesized
atgataataccaccttcctc

SEQ ID NO: 99036 - DNA, 20 bp, Artificial Sequence
  chemically synthesized
tgataataccaccttcctca

SEQ ID NO: 99037 - DNA, 20 bp, Artificial Sequence
  chemically synthesized
gataataccaccttcctcaa

SEQ ID NO: 99038 - DNA, 20 bp, Artificial Sequence
  chemically synthesized
tcacaaaagtcccttgagga

SEQ ID NO: 99039 - DNA, 20 bp, Artificial Sequence
  chemically synthesized
atcacaaaagtcccttgagg

SEQ ID NO: 99040 - DNA, 20 bp, Artificial Sequence
  chemically synthesized
tacatcacaaaagtcccttg

SEQ ID NO: 99041 - DNA, 20 bp, Artificial Sequence
  chemically synthesized
atacatcacaaaagtccctt

SEQ ID NO: 99042 - DNA, 20 bp, Artificial Sequence
  chemically synthesized
gcactatatatacatcacaa

SEQ ID NO: 99043 - DNA, 20 bp, Artificial Sequence
  chemically synthesized
ggacttttgtgatgtatata

SEQ ID NO: 99044 - DNA, 20 bp, Artificial Sequence
  chemically synthesized
ttgtgatgtatatatagtgc

SEQ ID NO: 99045 - DNA, 20 bp, Artificial Sequence
  chemically synthesized
tgtgatgtatatatagtgct

SEQ ID NO: 99046 - DNA, 20 bp, Artificial Sequence
  chemically synthesized
tatatatagtgctgggtatt

SEQ ID NO: 99047 - DNA, 20 bp, Artificial Sequence
  chemically synthesized
tattttcagtactaaatacc

SEQ ID NO: 99048 - DNA, 20 bp, Artificial Sequence
  chemically synthesized
agcaacctctagcatatttt

SEQ ID NO: 99049 - DNA, 20 bp, Artificial Sequence
  chemically synthesized
atttagtactgaaaatatgc

SEQ ID NO: 99050 - DNA, 20 bp, Artificial Sequence
  chemically synthesized
ttagtactgaaaatatgcta

SEQ ID NO: 99051 - DNA, 20 bp, Artificial Sequence
  chemically synthesized
tagtactgaaaatatgctag

SEQ ID NO: 99052 - DNA, 20 bp, Artificial Sequence
  chemically synthesized
ctactacaaatagcaacctc

SEQ ID NO: 99053 - DNA, 20 bp, Artificial Sequence
  chemically synthesized
atgctagaggttgctatttg

SEQ ID NO: 99054 - DNA, 20 bp, Artificial Sequence
  chemically synthesized
ctagaggttgctatttgtag

SEQ ID NO: 99055 - DNA, 20 bp, Artificial Sequence
  chemically synthesized
accactactactactacaaa

SEQ ID NO: 99056 - DNA, 20 bp, Artificial Sequence
  chemically synthesized
gaggttgctatttgtagtag

SEQ ID NO: 99057 - DNA, 20 bp, Artificial Sequence
  chemically synthesized
gttgctatttgtagtagtag

SEQ ID NO: 99058 - DNA, 20 bp, Artificial Sequence
  chemically synthesized
gctatttgtagtagtagtag

SEQ ID NO: 99059 - DNA, 20 bp, Artificial Sequence
  chemically synthesized
atttgtagtagtagtagtgg

SEQ ID NO: 99060 - DNA, 20 bp, Artificial Sequence
  chemically synthesized
tgtagtagtagtagtggtag

SEQ ID NO: 99061 - DNA, 20 bp, Artificial Sequence
  chemically synthesized
agtagtagtagtggtagtag

SEQ ID NO: 99062 - DNA, 20 bp, Artificial Sequence
  chemically synthesized
agtagtagtggtagtagtag

SEQ ID NO: 99063 - DNA, 20 bp, Artificial Sequence
  chemically synthesized
tagtggtagtagtagtagta

SEQ ID NO: 99064 - DNA, 20 bp, Artificial Sequence
  chemically synthesized
ggtagtagtagtagtatgga

SEQ ID NO: 99065 - DNA, 20 bp, Artificial Sequence
  chemically synthesized
agtagtagtagtatggaaag

SEQ ID NO: 99066 - DNA, 20 bp, Artificial Sequence
  chemically synthesized
gtagtagtagtatggaaaga

SEQ ID NO: 99067 - DNA, 20 bp, Artificial Sequence
  chemically synthesized
gtagtagtatggaaagaagg

SEQ ID NO: 99068 - DNA, 20 bp, Artificial Sequence
  chemically synthesized
tagtatggaaagaaggaagc

SEQ ID NO: 99069 - DNA, 20 bp, Artificial Sequence
  chemically synthesized
gaaggaagcaagctaccgca

SEQ ID NO: 99070 - DNA, 20 bp, Artificial Sequence
  chemically synthesized
ttcaggagacttctgtgcgg

SEQ ID NO: 99071 - DNA, 20 bp, Artificial Sequence
  chemically synthesized
ggaagcaagctaccgcacag

SEQ ID NO: 99072 - DNA, 20 bp, Artificial Sequence
  chemically synthesized
attttcaggagacttctgtg

SEQ ID NO: 99073 - DNA, 20 bp, Artificial Sequence
  chemically synthesized
agcctttttcagattttcag

SEQ ID NO: 99074 - DNA, 20 bp, Artificial Sequence
  chemically synthesized
caagcctttttcagattttc

SEQ ID NO: 99075 - DNA, 20 bp, Artificial Sequence
  chemically synthesized
ccaagcctttttcagatttt

SEQ ID NO: 99076 - DNA, 20 bp, Artificial Sequence
  chemically synthesized
agtctcctgaaaatctgaaa

SEQ ID NO: 99077 - DNA, 20 bp, Artificial Sequence
  chemically synthesized
gtctcctgaaaatctgaaaa

SEQ ID NO: 99078 - DNA, 20 bp, Artificial Sequence
  chemically synthesized
ggatttccccaagccttttt

SEQ ID NO: 99079 - DNA, 20 bp, Artificial Sequence
  chemically synthesized
ctgaaaatctgaaaaaggct

SEQ ID NO: 99080 - DNA, 20 bp, Artificial Sequence
  chemically synthesized
tgaaaatctgaaaaaggctt

SEQ ID NO: 99081 - DNA, 20 bp, Artificial Sequence
  chemically synthesized
gaaaatctgaaaaaggcttg

SEQ ID NO: 99082 - DNA, 20 bp, Artificial Sequence
  chemically synthesized
tctctctgctggatttcccc

SEQ ID NO: 99083 - DNA, 20 bp, Artificial Sequence
  chemically synthesized
gaaaaaggcttggggaaatc

SEQ ID NO: 99084 - DNA, 20 bp, Artificial Sequence
  chemically synthesized
aaaggcttggggaaatccag

SEQ ID NO: 99085 - DNA, 20 bp, Artificial Sequence
  chemically synthesized
aggcttggggaaatccagca

SEQ ID NO: 99086 - DNA, 20 bp, Artificial Sequence
  chemically synthesized
gcttggggaaatccagcaga

SEQ ID NO: 99087 - DNA, 20 bp, Artificial Sequence
  chemically synthesized
ttggggaaatccagcagaga

SEQ ID NO: 99088 - DNA, 20 bp, Artificial Sequence
  chemically synthesized
aaagggaaagctctctctgc

SEQ ID NO: 99089 - DNA, 20 bp, Artificial Sequence
  chemically synthesized
ctctgctctgaagaaaggga

SEQ ID NO: 99090 - DNA, 20 bp, Artificial Sequence
  chemically synthesized
gagagagctttccctttctt

SEQ ID NO: 99091 - DNA, 20 bp, Artificial Sequence
  chemically synthesized
aaacctctgctctgaagaaa

SEQ ID NO: 99092 - DNA, 20 bp, Artificial Sequence
  chemically synthesized
gagagctttccctttcttca

SEQ ID NO: 99093 - DNA, 20 bp, Artificial Sequence
  chemically synthesized
aaaacctctgctctgaagaa

SEQ ID NO: 99094 - DNA, 20 bp, Artificial Sequence
  chemically synthesized
aaaaacctctgctctgaaga

SEQ ID NO: 99095 - DNA, 20 bp, Artificial Sequence
  chemically synthesized
agctttccctttcttcagag

SEQ ID NO: 99096 - DNA, 20 bp, Artificial Sequence
  chemically synthesized
ctttccctttcttcagagca

SEQ ID NO: 99097 - DNA, 20 bp, Artificial Sequence
  chemically synthesized
acttaaaaacctctgctctg

SEQ ID NO: 99098 - DNA, 20 bp, Artificial Sequence
  chemically synthesized
tttccctttcttcagagcag

SEQ ID NO: 99099 - DNA, 20 bp, Artificial Sequence
  chemically synthesized
tcttcagagcagaggttttt

SEQ ID NO: 99100 - DNA, 20 bp, Artificial Sequence
  chemically synthesized
aggtttttaagttgtgattc

SEQ ID NO: 99101 - DNA, 20 bp, Artificial Sequence
  chemically synthesized
ggtttttaagttgtgattca

SEQ ID NO: 99102 - DNA, 20 bp, Artificial Sequence
  chemically synthesized
gtttttaagttgtgattcaa

SEQ ID NO: 99103 - DNA, 20 bp, Artificial Sequence
  chemically synthesized
ttaagttgtgattcaagggc

SEQ ID NO: 99104 - DNA, 20 bp, Artificial Sequence
  chemically synthesized
aagttctcaggggatgttgc

SEQ ID NO: 99105 - DNA, 20 bp, Artificial Sequence
  chemically synthesized
aagggccggcaacatcccct

SEQ ID NO: 99106 - DNA, 20 bp, Artificial Sequence
  chemically synthesized
catctctaacaagttctcag

SEQ ID NO: 99107 - DNA, 20 bp, Artificial Sequence
  chemically synthesized
gcatctctaacaagttctca

SEQ ID NO: 99108 - DNA, 20 bp, Artificial Sequence
  chemically synthesized
tgcatctctaacaagttctc

SEQ ID NO: 99109 - DNA, 20 bp, Artificial Sequence
  chemically synthesized
ttgcatctctaacaagttct

SEQ ID NO: 99110 - DNA, 20 bp, Artificial Sequence
  chemically synthesized
aacatcccctgagaacttgt

SEQ ID NO: 99111 - DNA, 20 bp, Artificial Sequence
  chemically synthesized
catcccctgagaacttgtta

SEQ ID NO: 99112 - DNA, 20 bp, Artificial Sequence
  chemically synthesized
tgagaatttgcatctctaac

SEQ ID NO: 99113 - DNA, 20 bp, Artificial Sequence
  chemically synthesized
ttgttagagatgcaaattct

SEQ ID NO: 99114 - DNA, 20 bp, Artificial Sequence
  chemically synthesized
tgttagagatgcaaattctc

SEQ ID NO: 99115 - DNA, 20 bp, Artificial Sequence
  chemically synthesized
gttggtctgggatggggcct

SEQ ID NO: 99116 - DNA, 20 bp, Artificial Sequence
  chemically synthesized
caaattctcaggccccatcc

SEQ ID NO: 99117 - DNA, 20 bp, Artificial Sequence
  chemically synthesized
gtgtcagttggtctgggatg

SEQ ID NO: 99118 - DNA, 20 bp, Artificial Sequence
  chemically synthesized
tgtgtcagttggtctgggat

SEQ ID NO: 99119 - DNA, 20 bp, Artificial Sequence
  chemically synthesized
ctgtgtcagttggtctggga

SEQ ID NO: 99120 - DNA, 20 bp, Artificial Sequence
  chemically synthesized
gtttctgtgtcagttggtct

SEQ ID NO: 99121 - DNA, 20 bp, Artificial Sequence
  chemically synthesized
agtttctgtgtcagttggtc

SEQ ID NO: 99122 - DNA, 20 bp, Artificial Sequence
  chemically synthesized
ccatcccagaccaactgaca

SEQ ID NO: 99123 - DNA, 20 bp, Artificial Sequence
  chemically synthesized
cccagagtttctgtgtcagt

SEQ ID NO: 99124 - DNA, 20 bp, Artificial Sequence
  chemically synthesized
catccccagagtttctgtgt

SEQ ID NO: 99125 - DNA, 20 bp, Artificial Sequence
  chemically synthesized
accaactgacacagaaactc

SEQ ID NO: 99126 - DNA, 20 bp, Artificial Sequence
  chemically synthesized
ccaactgacacagaaactct

SEQ ID NO: 99127 - DNA, 20 bp, Artificial Sequence
  chemically synthesized
caactgacacagaaactctg

SEQ ID NO: 99128 - DNA, 20 bp, Artificial Sequence
  chemically synthesized
tgacacagaaactctgggga

SEQ ID NO: 99129 - DNA, 20 bp, Artificial Sequence
  chemically synthesized
gacacagaaactctggggat

SEQ ID NO: 99130 - DNA, 20 bp, Artificial Sequence
  chemically synthesized
ctggctgggccccatcccca

SEQ ID NO: 99131 - DNA, 20 bp, Artificial Sequence
  chemically synthesized
acacagaaactctggggatg

SEQ ID NO: 99132 - DNA, 20 bp, Artificial Sequence
  chemically synthesized
agctggctgggccccatccc

SEQ ID NO: 99133 - DNA, 20 bp, Artificial Sequence
  chemically synthesized
gaaactctggggatggggcc

SEQ ID NO: 99134 - DNA, 20 bp, Artificial Sequence
  chemically synthesized
ctctggggatggggcccagc

SEQ ID NO: 99135 - DNA, 20 bp, Artificial Sequence
  chemically synthesized
tttttaaaacgtagctggct

SEQ ID NO: 99136 - DNA, 20 bp, Artificial Sequence
  chemically synthesized
ctttttaaaacgtagctggc

SEQ ID NO: 99137 - DNA, 20 bp, Artificial Sequence
  chemically synthesized
atgcctttttaaaacgtagc

SEQ ID NO: 99138 - DNA, 20 bp, Artificial Sequence
  chemically synthesized
ctgaatgcctttttaaaacg

SEQ ID NO: 99139 - DNA, 20 bp, Artificial Sequence
  chemically synthesized
ccagccagctacgttttaaa

SEQ ID NO: 99140 - DNA, 20 bp, Artificial Sequence
  chemically synthesized
cagccagctacgttttaaaa

SEQ ID NO: 99141 - DNA, 20 bp, Artificial Sequence
  chemically synthesized
ctacgttttaaaaaggcatt

SEQ ID NO: 99142 - DNA, 20 bp, Artificial Sequence
  chemically synthesized
cgttttaaaaaggcattcag

SEQ ID NO: 99143 - DNA, 20 bp, Artificial Sequence
  chemically synthesized
gcattcagaagattccatta

SEQ ID NO: 99144 - DNA, 20 bp, Artificial Sequence
  chemically synthesized
cattcagaagattccattac

SEQ ID NO: 99145 - DNA, 20 bp, Artificial Sequence
  chemically synthesized
tctcaaaagttgacctgtaa

SEQ ID NO: 99146 - DNA, 20 bp, Artificial Sequence
  chemically synthesized
tccattacaggtcaactttt

SEQ ID NO: 99147 - DNA, 20 bp, Artificial Sequence
  chemically synthesized
attacaggtcaacttttgag

SEQ ID NO: 99148 - DNA, 20 bp, Artificial Sequence
  chemically synthesized
gctagagcagtgcttctcaa

SEQ ID NO: 99149 - DNA, 20 bp, Artificial Sequence
  chemically synthesized
acttttgagaagcactgctc

SEQ ID NO: 99150 - DNA, 20 bp, Artificial Sequence
  chemically synthesized
tttgagaagcactgctctag

SEQ ID NO: 99151 - DNA, 20 bp, Artificial Sequence
  chemically synthesized
ttcctgctattccgctagag

SEQ ID NO: 99152 - DNA, 20 bp, Artificial Sequence
  chemically synthesized
cccttcctgctattccgcta

SEQ ID NO: 99153 - DNA, 20 bp, Artificial Sequence
  chemically synthesized
gaagcactgctctagcggaa

SEQ ID NO: 99154 - DNA, 20 bp, Artificial Sequence
  chemically synthesized
tacccttcctgctattccgc

SEQ ID NO: 99155 - DNA, 20 bp, Artificial Sequence
  chemically synthesized
gcactgctctagcggaatag

SEQ ID NO: 99156 - DNA, 20 bp, Artificial Sequence
  chemically synthesized
cactgctctagcggaatagc

SEQ ID NO: 99157 - DNA, 20 bp, Artificial Sequence
  chemically synthesized
tgctctagcggaatagcagg

SEQ ID NO: 99158 - DNA, 20 bp, Artificial Sequence
  chemically synthesized
gctctagcggaatagcagga

SEQ ID NO: 99159 - DNA, 20 bp, Artificial Sequence
  chemically synthesized
ctctagcggaatagcaggaa

SEQ ID NO: 99160 - DNA, 20 bp, Artificial Sequence
  chemically synthesized
tagcaggaagggtaaatgct

SEQ ID NO: 99161 - DNA, 20 bp, Artificial Sequence
  chemically synthesized
ggaagggtaaatgctaagct

SEQ ID NO: 99162 - DNA, 20 bp, Artificial Sequence
  chemically synthesized
catatgaactaagctcagct

SEQ ID NO: 99163 - DNA, 20 bp, Artificial Sequence
  chemically synthesized
ggtaaatgctaagctgagct

SEQ ID NO: 99164 - DNA, 20 bp, Artificial Sequence
  chemically synthesized
cgtcccatatgaactaagct

SEQ ID NO: 99165 - DNA, 20 bp, Artificial Sequence
  chemically synthesized
gttaacgtcccatatgaact

SEQ ID NO: 99166 - DNA, 20 bp, Artificial Sequence
  chemically synthesized
taagctgagcttagttcata

SEQ ID NO: 99167 - DNA, 20 bp, Artificial Sequence
  chemically synthesized
aagctgagcttagttcatat

SEQ ID NO: 99168 - DNA, 20 bp, Artificial Sequence
  chemically synthesized
gttaacatttcctctctcat

SEQ ID NO: 99169 - DNA, 20 bp, Artificial Sequence
  chemically synthesized
gaggggaccactaatgagag

SEQ ID NO: 99170 - DNA, 20 bp, Artificial Sequence
  chemically synthesized
ggaggggaccactaatgaga

SEQ ID NO: 99171 - DNA, 20 bp, Artificial Sequence
  chemically synthesized
aacatttcctctctcattag

SEQ ID NO: 99172 - DNA, 20 bp, Artificial Sequence
  chemically synthesized
caggaggggaccactaatga

SEQ ID NO: 99173 - DNA, 20 bp, Artificial Sequence
  chemically synthesized
cccaggaggggaccactaat

SEQ ID NO: 99174 - DNA, 20 bp, Artificial Sequence
  chemically synthesized
tctcattagtggtcccctcc

SEQ ID NO: 99175 - DNA, 20 bp, Artificial Sequence
  chemically synthesized
ctcattagtggtcccctcct

SEQ ID NO: 99176 - DNA, 20 bp, Artificial Sequence
  chemically synthesized
atgctagatctgcccaggag

SEQ ID NO: 99177 - DNA, 20 bp, Artificial Sequence
  chemically synthesized
attagtggtcccctcctggg

SEQ ID NO: 99178 - DNA, 20 bp, Artificial Sequence
  chemically synthesized
aatgctagatctgcccagga

SEQ ID NO: 99179 - DNA, 20 bp, Artificial Sequence
  chemically synthesized
aaatgctagatctgcccagg

SEQ ID NO: 99180 - DNA, 20 bp, Artificial Sequence
  chemically synthesized
caaatgctagatctgcccag

SEQ ID NO: 99181 - DNA, 20 bp, Artificial Sequence
  chemically synthesized
ctcaaatgctagatctgccc

SEQ ID NO: 99182 - DNA, 20 bp, Artificial Sequence
  chemically synthesized
tctcaaatgctagatctgcc

SEQ ID NO: 99183 - DNA, 20 bp, Artificial Sequence
  chemically synthesized
ggtcccctcctgggcagatc

SEQ ID NO: 99184 - DNA, 20 bp, Artificial Sequence
  chemically synthesized
cctgggcagatctagcattt

SEQ ID NO: 99185 - DNA, 20 bp, Artificial Sequence
  chemically synthesized
taaatgaaaatctcaaatgc

SEQ ID NO: 99186 - DNA, 20 bp, Artificial Sequence
  chemically synthesized
agactgcatggtatataagt

SEQ ID NO: 99187 - DNA, 20 bp, Artificial Sequence
  chemically synthesized
cccaagactgcatggtatat

SEQ ID NO: 99188 - DNA, 20 bp, Artificial Sequence
  chemically synthesized
tttcttacttatataccatg

SEQ ID NO: 99189 - DNA, 20 bp, Artificial Sequence
  chemically synthesized
gggccctacccaagactgca

SEQ ID NO: 99190 - DNA, 20 bp, Artificial Sequence
  chemically synthesized
acttatataccatgcagtct

SEQ ID NO: 99191 - DNA, 20 bp, Artificial Sequence
  chemically synthesized
cttatataccatgcagtctt

SEQ ID NO: 99192 - DNA, 20 bp, Artificial Sequence
  chemically synthesized
atataccatgcagtcttggg

SEQ ID NO: 99193 - DNA, 20 bp, Artificial Sequence
  chemically synthesized
tataccatgcagtcttgggt

SEQ ID NO: 99194 - DNA, 20 bp, Artificial Sequence
  chemically synthesized
ataccatgcagtcttgggta

SEQ ID NO: 99195 - DNA, 20 bp, Artificial Sequence
  chemically synthesized
atctttaacgggccctaccc

SEQ ID NO: 99196 - DNA, 20 bp, Artificial Sequence
  chemically synthesized
gtcttgggtagggcccgtta

SEQ ID NO: 99197 - DNA, 20 bp, Artificial Sequence
  chemically synthesized
tatctacttccatctttaac

SEQ ID NO: 99198 - DNA, 20 bp, Artificial Sequence
  chemically synthesized
tgggtagggcccgttaaaga

SEQ ID NO: 99199 - DNA, 20 bp, Artificial Sequence
  chemically synthesized
ttatctacttccatctttaa

SEQ ID NO: 99200 - DNA, 20 bp, Artificial Sequence
  chemically synthesized
gtagggcccgttaaagatgg

SEQ ID NO: 99201 - DNA, 20 bp, Artificial Sequence
  chemically synthesized
gggcccgttaaagatggaag

SEQ ID NO: 99202 - DNA, 20 bp, Artificial Sequence
  chemically synthesized
agatggaagtagataactat

SEQ ID NO: 99203 - DNA, 20 bp, Artificial Sequence
  chemically synthesized
gatggaagtagataactatt

SEQ ID NO: 99204 - DNA, 20 bp, Artificial Sequence
  chemically synthesized
gaagtagataactattaggt

SEQ ID NO: 99205 - DNA, 20 bp, Artificial Sequence
  chemically synthesized
ttacttttgcaccaacctaa

SEQ ID NO: 99206 - DNA, 20 bp, Artificial Sequence
  chemically synthesized
taactattaggttggtgcaa

SEQ ID NO: 99207 - DNA, 20 bp, Artificial Sequence
  chemically synthesized
tgcgttttttttaccattaa

SEQ ID NO: 99208 - DNA, 20 bp, Artificial Sequence
  chemically synthesized
gtctttgccattgcttttaa

SEQ ID NO: 99209 - DNA, 20 bp, Artificial Sequence
  chemically synthesized
ttttttaccattaaaagcaa

SEQ ID NO: 99210 - DNA, 20 bp, Artificial Sequence
  chemically synthesized
taccattaaaagcaatggca

SEQ ID NO: 99211 - DNA, 20 bp, Artificial Sequence
  chemically synthesized
ggttggtgcaaaagtaattg

SEQ ID NO: 99212 - DNA, 20 bp, Artificial Sequence
  chemically synthesized
cagctgttaggttggtgcaa

SEQ ID NO: 99213 - DNA, 20 bp, Artificial Sequence
  chemically synthesized
ttacttttgcaccaacctaa

SEQ ID NO: 99214 - DNA, 20 bp, Artificial Sequence
  chemically synthesized
atcccttacagctgttaggt

SEQ ID NO: 99215 - DNA, 20 bp, Artificial Sequence
  chemically synthesized
aataatcccttacagctgtt

SEQ ID NO: 99216 - DNA, 20 bp, Artificial Sequence
  chemically synthesized
aaataatcccttacagctgt

SEQ ID NO: 99217 - DNA, 20 bp, Artificial Sequence
  chemically synthesized
tgcaccaacctaacagctgt

SEQ ID NO: 99218 - DNA, 20 bp, Artificial Sequence
  chemically synthesized
gcaccaacctaacagctgta

SEQ ID NO: 99219 - DNA, 20 bp, Artificial Sequence
  chemically synthesized
caccaacctaacagctgtaa

SEQ ID NO: 99220 - DNA, 20 bp, Artificial Sequence
  chemically synthesized
agagaacaaataatccctta

SEQ ID NO: 99221 - DNA, 20 bp, Artificial Sequence
  chemically synthesized
agtctttctggttttggaca

SEQ ID NO: 99222 - DNA, 20 bp, Artificial Sequence
  chemically synthesized
tcagtctttctggttttgga

SEQ ID NO: 99223 - DNA, 20 bp, Artificial Sequence
  chemically synthesized
atttgttctctgtccaaaac

SEQ ID NO: 99224 - DNA, 20 bp, Artificial Sequence
  chemically synthesized
ctagtcagtctttctggttt

SEQ ID NO: 99225 - DNA, 20 bp, Artificial Sequence
  chemically synthesized
gttctctgtccaaaaccaga

SEQ ID NO: 99226 - DNA, 20 bp, Artificial Sequence
  chemically synthesized
gtctttctagtcagtctttc

SEQ ID NO: 99227 - DNA, 20 bp, Artificial Sequence
  chemically synthesized
ccaaaaccagaaagactgac

SEQ ID NO: 99228 - DNA, 20 bp, Artificial Sequence
  chemically synthesized
aaccagaaagactgactaga

SEQ ID NO: 99229 - DNA, 20 bp, Artificial Sequence
  chemically synthesized
cctgtaaaagtctttctagt

SEQ ID NO: 99230 - DNA, 20 bp, Artificial Sequence
  chemically synthesized
atggcctgtaaaagtctttc

SEQ ID NO: 99231 - DNA, 20 bp, Artificial Sequence
  chemically synthesized
actgactagaaagactttta

SEQ ID NO: 99232 - DNA, 20 bp, Artificial Sequence
  chemically synthesized
ctgactagaaagacttttac

SEQ ID NO: 99233 - DNA, 20 bp, Artificial Sequence
  chemically synthesized
ggacttaaaatggcctgtaa

SEQ ID NO: 99234 - DNA, 20 bp, Artificial Sequence
  chemically synthesized
agacttttacaggccatttt

SEQ ID NO: 99235 - DNA, 20 bp, Artificial Sequence
  chemically synthesized
aaacaaacaaggacttaaaa

SEQ ID NO: 99236 - DNA, 20 bp, Artificial Sequence
  chemically synthesized
gtacatatttaaaacaaaca

SEQ ID NO: 99237 - DNA, 20 bp, Artificial Sequence
  chemically synthesized
tgtacatatttaaaacaaac

SEQ ID NO: 99238 - DNA, 20 bp, Artificial Sequence
  chemically synthesized
aaatatgtacatataaaaat

SEQ ID NO: 99239 - DNA, 20 bp, Artificial Sequence
  chemically synthesized
ctgaagtgcttatatagaca

SEQ ID NO: 99240 - DNA, 20 bp, Artificial Sequence
  chemically synthesized
atcagtatctatgtctatat

SEQ ID NO: 99241 - DNA, 20 bp, Artificial Sequence
  chemically synthesized
aacacactgaagtgcttata

SEQ ID NO: 99242 - DNA, 20 bp, Artificial Sequence
  chemically synthesized
ctatgtctatataagcactt

SEQ ID NO: 99243 - DNA, 20 bp, Artificial Sequence
  chemically synthesized
atatgattgttaacacactg

SEQ ID NO: 99244 - DNA, 20 bp, Artificial Sequence
  chemically synthesized
aatcatataatcacgcccat

SEQ ID NO: 99245 - DNA, 20 bp, Artificial Sequence
  chemically synthesized
tcatataatcacgcccatga

SEQ ID NO: 99246 - DNA, 20 bp, Artificial Sequence
  chemically synthesized
caattacatgatactctcat

SEQ ID NO: 99247 - DNA, 20 bp, Artificial Sequence
  chemically synthesized
tcaattacatgatactctca

SEQ ID NO: 99248 - DNA, 20 bp, Artificial Sequence
  chemically synthesized
tttcaacataatggtaatga

SEQ ID NO: 99249 - DNA, 20 bp, Artificial Sequence
  chemically synthesized
tgctcaccttttcaacataa

SEQ ID NO: 99250 - DNA, 20 bp, Artificial Sequence
  chemically synthesized
atcattaccattatgttgaa

SEQ ID NO: 99251 - DNA, 20 bp, Artificial Sequence
  chemically synthesized
tcattaccattatgttgaaa

SEQ ID NO: 99252 - DNA, 20 bp, Artificial Sequence
  chemically synthesized
taccattatgttgaaaaggt

SEQ ID NO: 99253 - DNA, 20 bp, Artificial Sequence
  chemically synthesized
tatgttgaaaaggtgagcaa

SEQ ID NO: 99254 - DNA, 20 bp, Artificial Sequence
  chemically synthesized
ttctaagtagatttaaagag

SEQ ID NO: 99255 - DNA, 20 bp, Artificial Sequence
  chemically synthesized
gatttctaagtagatttaaa

SEQ ID NO: 99256 - DNA, 20 bp, Artificial Sequence
  chemically synthesized
atgatttctaagtagattta

SEQ ID NO: 99257 - DNA, 20 bp, Artificial Sequence
  chemically synthesized
agctactctttaaatctact

SEQ ID NO: 99258 - DNA, 20 bp, Artificial Sequence
  chemically synthesized
aatcctgtatgatttctaag

SEQ ID NO: 99259 - DNA, 20 bp, Artificial Sequence
  chemically synthesized
cacaatcctgtatgatttct

SEQ ID NO: 99260 - DNA, 20 bp, Artificial Sequence
  chemically synthesized
aaatctacttagaaatcata

SEQ ID NO: 99261 - DNA, 20 bp, Artificial Sequence
  chemically synthesized
aatctacttagaaatcatac

SEQ ID NO: 99262 - DNA, 20 bp, Artificial Sequence
  chemically synthesized
agaaatcatacaggattgtg

SEQ ID NO: 99263 - DNA, 20 bp, Artificial Sequence
  chemically synthesized
tctgactttatgttaataca

SEQ ID NO: 99264 - DNA, 20 bp, Artificial Sequence
  chemically synthesized
aaattctgtgtattaacata

SEQ ID NO: 99265 - DNA, 20 bp, Artificial Sequence
  chemically synthesized
tctgtgtattaacataaagt

SEQ ID NO: 99266 - DNA, 20 bp, Artificial Sequence
  chemically synthesized
aagtcagatttcaaatctta

SEQ ID NO: 99267 - DNA, 20 bp, Artificial Sequence
  chemically synthesized
agtcagatttcaaatcttaa

SEQ ID NO: 99268 - DNA, 20 bp, Artificial Sequence
  chemically synthesized
atgttattctacaagccttt

SEQ ID NO: 99269 - DNA, 20 bp, Artificial Sequence
  chemically synthesized
tttcaaatcttaaaggcttg

SEQ ID NO: 99270 - DNA, 20 bp, Artificial Sequence
  chemically synthesized
ctgtgaaaatgttattctac

SEQ ID NO: 99271 - DNA, 20 bp, Artificial Sequence
  chemically synthesized
cttgtagaataacattttca

SEQ ID NO: 99272 - DNA, 20 bp, Artificial Sequence
  chemically synthesized
ataacattttcacagccata

SEQ ID NO: 99273 - DNA, 20 bp, Artificial Sequence
  chemically synthesized
ctttacaactattaaccata

SEQ ID NO: 99274 - DNA, 20 bp, Artificial Sequence
  chemically synthesized
tttcacagccatatggttaa

SEQ ID NO: 99275 - DNA, 20 bp, Artificial Sequence
  chemically synthesized
ccatatggttaatagttgta

SEQ ID NO: 99276 - DNA, 20 bp, Artificial Sequence
  chemically synthesized
tggttaatagttgtaaagaa

SEQ ID NO: 99277 - DNA, 20 bp, Artificial Sequence
  chemically synthesized
gacaatgtttttttactgct

SEQ ID NO: 99278 - DNA, 20 bp, Artificial Sequence
  chemically synthesized
tctgtagtcaaatttctcag

SEQ ID NO: 99279 - DNA, 20 bp, Artificial Sequence
  chemically synthesized
tcctctgtagtcaaatttct

SEQ ID NO: 99280 - DNA, 20 bp, Artificial Sequence
  chemically synthesized
actgctgagaaatttgacta

SEQ ID NO: 99281 - DNA, 20 bp, Artificial Sequence
  chemically synthesized
tgctgagaaatttgactaca

SEQ ID NO: 99282 - DNA, 20 bp, Artificial Sequence
  chemically synthesized
gctgagaaatttgactacag

SEQ ID NO: 99283 - DNA, 20 bp, Artificial Sequence
  chemically synthesized
caatacttaagagtcctctg

SEQ ID NO: 99284 - DNA, 20 bp, Artificial Sequence
  chemically synthesized
tttgactacagaggactctt

SEQ ID NO: 99285 - DNA, 20 bp, Artificial Sequence
  chemically synthesized
aaatgaaggacaatacttaa

SEQ ID NO: 99286 - DNA, 20 bp, Artificial Sequence
  chemically synthesized
ctaaatgaaggacaatactt

SEQ ID NO: 99287 - DNA, 20 bp, Artificial Sequence
  chemically synthesized
cttaagtattgtccttcatt

SEQ ID NO: 99288 - DNA, 20 bp, Artificial Sequence
  chemically synthesized
ttgtttaagattctaaatga

SEQ ID NO: 99289 - DNA, 20 bp, Artificial Sequence
  chemically synthesized
attgtttaagattctaaatg

SEQ ID NO: 99290 - DNA, 20 bp, Artificial Sequence
  chemically synthesized
catatgtaatgatattgttt

SEQ ID NO: 99291 - DNA, 20 bp, Artificial Sequence
  chemically synthesized
tgtattcattgaaaatcaaa

SEQ ID NO: 99292 - DNA, 20 bp, Artificial Sequence
  chemically synthesized
atgtattcattgaaaatcaa

SEQ ID NO: 99293 - DNA, 20 bp, Artificial Sequence
  chemically synthesized
atacatatttacataaaatg

SEQ ID NO: 99294 - DNA, 20 bp, Artificial Sequence
  chemically synthesized
tttcaacaatgaagaagtgg

SEQ ID NO: 99295 - DNA, 20 bp, Artificial Sequence
  chemically synthesized
aatttcaacaatgaagaagt

SEQ ID NO: 99296 - DNA, 20 bp, Artificial Sequence
  chemically synthesized
caatttcaacaatgaagaag

SEQ ID NO: 99297 - DNA, 20 bp, Artificial Sequence
  chemically synthesized
aggcaatttcaacaatgaag

SEQ ID NO: 99298 - DNA, 20 bp, Artificial Sequence
  chemically synthesized
cgaaggcaatttcaacaatg

SEQ ID NO: 99299 - DNA, 20 bp, Artificial Sequence
  chemically synthesized
gttgaaattgccttcgccaa

SEQ ID NO: 99300 - DNA, 20 bp, Artificial Sequence
  chemically synthesized
cactgcatagctgttggcga

SEQ ID NO: 99301 - DNA, 20 bp, Artificial Sequence
  chemically synthesized
acactgcatagctgttggcg

SEQ ID NO: 99302 - DNA, 20 bp, Artificial Sequence
  chemically synthesized
tcttgacactgcatagctgt

SEQ ID NO: 99303 - DNA, 20 bp, Artificial Sequence
  chemically synthesized
tgccttcgccaacagctatg

SEQ ID NO: 99304 - DNA, 20 bp, Artificial Sequence
  chemically synthesized
gatcccatcttgacactgca

SEQ ID NO: 99305 - DNA, 20 bp, Artificial Sequence
  chemically synthesized
gccaacagctatgcagtgtc

SEQ ID NO: 99306 - DNA, 20 bp, Artificial Sequence
  chemically synthesized
acagctatgcagtgtcaaga

SEQ ID NO: 99307 - DNA, 20 bp, Artificial Sequence
  chemically synthesized
cagctatgcagtgtcaagat

SEQ ID NO: 99308 - DNA, 20 bp, Artificial Sequence
  chemically synthesized
atgcagtgtcaagatgggat

SEQ ID NO: 99309 - DNA, 20 bp, Artificial Sequence
  chemically synthesized
caagatgggatcagaatgtg

SEQ ID NO: 99310 - DNA, 20 bp, Artificial Sequence
  chemically synthesized
aagatgggatcagaatgtgt

SEQ ID NO: 99311 - DNA, 20 bp, Artificial Sequence
  chemically synthesized
gatgggatcagaatgtgtgg

SEQ ID NO: 99312 - DNA, 20 bp, Artificial Sequence
  chemically synthesized
gggatcagaatgtgtgggag

SEQ ID NO: 99313 - DNA, 20 bp, Artificial Sequence
  chemically synthesized
gtgggagcagatattttttt

SEQ ID NO: 99314 - DNA, 20 bp, Artificial Sequence
  chemically synthesized
taacagtgcatatgtcagca

SEQ ID NO: 99315 - DNA, 20 bp, Artificial Sequence
  chemically synthesized
ttcgttaacagtgcatatgt

SEQ ID NO: 99316 - DNA, 20 bp, Artificial Sequence
  chemically synthesized
tttcagtggtaattcgttaa

SEQ ID NO: 99317 - DNA, 20 bp, Artificial Sequence
  chemically synthesized
agacacatatattgtttcag

SEQ ID NO: 99318 - DNA, 20 bp, Artificial Sequence
  chemically synthesized
cttagacacatatattgttt

SEQ ID NO: 99319 - DNA, 20 bp, Artificial Sequence
  chemically synthesized
ctgaaacaatatatgtgtct

SEQ ID NO: 99320 - DNA, 20 bp, Artificial Sequence
  chemically synthesized
cagctcttctacatgtttct

SEQ ID NO: 99321 - DNA, 20 bp, Artificial Sequence
  chemically synthesized
atatgtgtctaagaaacatg

SEQ ID NO: 99322 - DNA, 20 bp, Artificial Sequence
  chemically synthesized
tgtgtctaagaaacatgtag

SEQ ID NO: 99323 - DNA, 20 bp, Artificial Sequence
  chemically synthesized
tgtctaagaaacatgtagaa

SEQ ID NO: 99324 - DNA, 20 bp, Artificial Sequence
  chemically synthesized
taagaaacatgtagaagagc

SEQ ID NO: 99325 - DNA, 20 bp, Artificial Sequence
  chemically synthesized
catagataagaattaacagc

SEQ ID NO: 99326 - DNA, 20 bp, Artificial Sequence
  chemically synthesized
ctcgcatagataagaattaa

SEQ ID NO: 99327 - DNA, 20 bp, Artificial Sequence
  chemically synthesized
tctcttcttctcgcatagat

SEQ ID NO: 99328 - DNA, 20 bp, Artificial Sequence
  chemically synthesized
ctgttaattcttatctatgc

SEQ ID NO: 99329 - DNA, 20 bp, Artificial Sequence
  chemically synthesized
ttaattcttatctatgcgag

SEQ ID NO: 99330 - DNA, 20 bp, Artificial Sequence
  chemically synthesized
catattctcttcttctcgca

SEQ ID NO: 99331 - DNA, 20 bp, Artificial Sequence
  chemically synthesized
attcttatctatgcgagaag

SEQ ID NO: 99332 - DNA, 20 bp, Artificial Sequence
  chemically synthesized
tcttatctatgcgagaagaa

SEQ ID NO: 99333 - DNA, 20 bp, Artificial Sequence
  chemically synthesized
atgcgagaagaagagaatat

SEQ ID NO: 99334 - DNA, 20 bp, Artificial Sequence
  chemically synthesized
gcgagaagaagagaatatga

SEQ ID NO: 99335 - DNA, 20 bp, Artificial Sequence
  chemically synthesized
gaagaagagaatatgagagt

SEQ ID NO: 99336 - DNA, 20 bp, Artificial Sequence
  chemically synthesized
gaagagaatatgagagtaag

SEQ ID NO: 99337 - DNA, 20 bp, Artificial Sequence
  chemically synthesized
atatgagagtaagaagaact

SEQ ID NO: 99338 - DNA, 20 bp, Artificial Sequence
  chemically synthesized
aagttgagtctcaacaaacc

SEQ ID NO: 99339 - DNA, 20 bp, Artificial Sequence
  chemically synthesized
taagaagaacttggtttgtt

SEQ ID NO: 99340 - DNA, 20 bp, Artificial Sequence
  chemically synthesized
ggtttgttgagactcaactt

SEQ ID NO: 99341 - DNA, 20 bp, Artificial Sequence
  chemically synthesized
attccaatttagccaaagtt

SEQ ID NO: 99342 - DNA, 20 bp, Artificial Sequence
  chemically synthesized
taatgattccaatttagcca

SEQ ID NO: 99343 - DNA, 20 bp, Artificial Sequence
  chemically synthesized
agactcaactttggctaaat

SEQ ID NO: 99344 - DNA, 20 bp, Artificial Sequence
  chemically synthesized
aatctttaatgattccaatt

SEQ ID NO: 99345 - DNA, 20 bp, Artificial Sequence
  chemically synthesized
tggctaaattggaatcatta

SEQ ID NO: 99346 - DNA, 20 bp, Artificial Sequence
  chemically synthesized
agattaaaaacaatgatatc

SEQ ID NO: 99347 - DNA, 20 bp, Artificial Sequence
  chemically synthesized
gattaaaaacaatgatatct

SEQ ID NO: 99348 - DNA, 20 bp, Artificial Sequence
  chemically synthesized
tcagacttttgtggggaacc

SEQ ID NO: 99349 - DNA, 20 bp, Artificial Sequence
  chemically synthesized
gatatctgggttccccacaa

SEQ ID NO: 99350 - DNA, 20 bp, Artificial Sequence
  chemically synthesized
aatgatatcagacttttgtg

SEQ ID NO: 99351 - DNA, 20 bp, Artificial Sequence
  chemically synthesized
caatgatatcagacttttgt

SEQ ID NO: 99352 - DNA, 20 bp, Artificial Sequence
  chemically synthesized
ccaatgatatcagacttttg

SEQ ID NO: 99353 - DNA, 20 bp, Artificial Sequence
  chemically synthesized
ccacaaaagtctgatatcat

SEQ ID NO: 99354 - DNA, 20 bp, Artificial Sequence
  chemically synthesized
gtaccccaagccaatgatat

SEQ ID NO: 99355 - DNA, 20 bp, Artificial Sequence
  chemically synthesized
aaagtctgatatcattggct

SEQ ID NO: 99356 - DNA, 20 bp, Artificial Sequence
  chemically synthesized
aagtctgatatcattggctt

SEQ ID NO: 99357 - DNA, 20 bp, Artificial Sequence
  chemically synthesized
agtctgatatcattggcttg

SEQ ID NO: 99358 - DNA, 20 bp, Artificial Sequence
  chemically synthesized
gatatcattggcttggggta

SEQ ID NO: 99359 - DNA, 20 bp, Artificial Sequence
  chemically synthesized
aaatgccccagctgtacccc

SEQ ID NO: 99360 - DNA, 20 bp, Artificial Sequence
  chemically synthesized
tcattggcttggggtacagc

SEQ ID NO: 99361 - DNA, 20 bp, Artificial Sequence
  chemically synthesized
cattggcttggggtacagct

SEQ ID NO: 99362 - DNA, 20 bp, Artificial Sequence
  chemically synthesized
attggcttggggtacagctg

SEQ ID NO: 99363 - DNA, 20 bp, Artificial Sequence
  chemically synthesized
ggaagcttaaaaaaatgccc

SEQ ID NO: 99364 - DNA, 20 bp, Artificial Sequence
  chemically synthesized
tacagctggggcattttttt

SEQ ID NO: 99365 - DNA, 20 bp, Artificial Sequence
  chemically synthesized
gggcatttttttaagcttcc

SEQ ID NO: 99366 - DNA, 20 bp, Artificial Sequence
  chemically synthesized
gatcattagcatcatcttgg

SEQ ID NO: 99367 - DNA, 20 bp, Artificial Sequence
  chemically synthesized
aatgatcattagcatcatct

SEQ ID NO: 99368 - DNA, 20 bp, Artificial Sequence
  chemically synthesized
gaaatgacgctaatgatcat

SEQ ID NO: 99369 - DNA, 20 bp, Artificial Sequence
  chemically synthesized
aagatgatgctaatgatcat

SEQ ID NO: 99370 - DNA, 20 bp, Artificial Sequence
  chemically synthesized
tcattagcgtcatttcctta

SEQ ID NO: 99371 - DNA, 20 bp, Artificial Sequence
  chemically synthesized
cattagcgtcatttccttat

SEQ ID NO: 99372 - DNA, 20 bp, Artificial Sequence
  chemically synthesized
taggttagaggtgacctata

SEQ ID NO: 99373 - DNA, 20 bp, Artificial Sequence
  chemically synthesized
ttaggttagaggtgacctat

SEQ ID NO: 99374 - DNA, 20 bp, Artificial Sequence
  chemically synthesized
ctgtgaagtggttaggttag

SEQ ID NO: 99375 - DNA, 20 bp, Artificial Sequence
  chemically synthesized
actgtgaagtggttaggtta

SEQ ID NO: 99376 - DNA, 20 bp, Artificial Sequence
  chemically synthesized
ctactgtgaagtggttaggt

SEQ ID NO: 99377 - DNA, 20 bp, Artificial Sequence
  chemically synthesized
ttaactactgtgaagtggtt

SEQ ID NO: 99378 - DNA, 20 bp, Artificial Sequence
  chemically synthesized
tttaactactgtgaagtggt

SEQ ID NO: 99379 - DNA, 20 bp, Artificial Sequence
  chemically synthesized
cctctaacctaaccacttca

SEQ ID NO: 99380 - DNA, 20 bp, Artificial Sequence
  chemically synthesized
cagatttaactactgtgaag

SEQ ID NO: 99381 - DNA, 20 bp, Artificial Sequence
  chemically synthesized
ctaacctaaccacttcacag

SEQ ID NO: 99382 - DNA, 20 bp, Artificial Sequence
  chemically synthesized
agccagatttaactactgtg

SEQ ID NO: 99383 - DNA, 20 bp, Artificial Sequence
  chemically synthesized
cacttcacagtagttaaatc

SEQ ID NO: 99384 - DNA, 20 bp, Artificial Sequence
  chemically synthesized
cagctagtacagatcatagc

SEQ ID NO: 99385 - DNA, 20 bp, Artificial Sequence
  chemically synthesized
ataccagctagtacagatca

SEQ ID NO: 99386 - DNA, 20 bp, Artificial Sequence
  chemically synthesized
aatctggctatgatctgtac

SEQ ID NO: 99387 - DNA, 20 bp, Artificial Sequence
  chemically synthesized
tggctatgatctgtactagc

SEQ ID NO: 99388 - DNA, 20 bp, Artificial Sequence
  chemically synthesized
caaccagataccagctagta

SEQ ID NO: 99389 - DNA, 20 bp, Artificial Sequence
  chemically synthesized
tctcccaaccagataccagc

SEQ ID NO: 99390 - DNA, 20 bp, Artificial Sequence
  chemically synthesized
gatctgtactagctggtatc

SEQ ID NO: 99391 - DNA, 20 bp, Artificial Sequence
  chemically synthesized
tgattctcccaaccagatac

SEQ ID NO: 99392 - DNA, 20 bp, Artificial Sequence
  chemically synthesized
tgtactagctggtatctggt

SEQ ID NO: 99393 - DNA, 20 bp, Artificial Sequence
  chemically synthesized
gtactagctggtatctggtt

SEQ ID NO: 99394 - DNA, 20 bp, Artificial Sequence
  chemically synthesized
actagctggtatctggttgg

SEQ ID NO: 99395 - DNA, 20 bp, Artificial Sequence
  chemically synthesized
gtactagtgattctcccaac

SEQ ID NO: 99396 - DNA, 20 bp, Artificial Sequence
  chemically synthesized
tatctggttgggagaatcac

SEQ ID NO: 99397 - DNA, 20 bp, Artificial Sequence
  chemically synthesized
gttgggagaatcactagtac

SEQ ID NO: 99398 - DNA, 20 bp, Artificial Sequence
  chemically synthesized
ttgggagaatcactagtact

SEQ ID NO: 99399 - DNA, 20 bp, Artificial Sequence
  chemically synthesized
gaaatacaaaaacccagtac

SEQ ID NO: 99400 - DNA, 20 bp, Artificial Sequence
  chemically synthesized
tgggcagaaatacaaaaacc

SEQ ID NO: 99401 - DNA, 20 bp, Artificial Sequence
  chemically synthesized
tgggtttttgtatttctgcc

SEQ ID NO: 99402 - DNA, 20 bp, Artificial Sequence
  chemically synthesized
tttttgtatttctgcccagc

SEQ ID NO: 99403 - DNA, 20 bp, Artificial Sequence
  chemically synthesized
ttttgtatttctgcccagcc

SEQ ID NO: 99404 - DNA, 20 bp, Artificial Sequence
  chemically synthesized
atgatcaacgcctggctggg

SEQ ID NO: 99405 - DNA, 20 bp, Artificial Sequence
  chemically synthesized
aatatgatcaacgcctggct

SEQ ID NO: 99406 - DNA, 20 bp, Artificial Sequence
  chemically synthesized
aaatatgatcaacgcctggc

SEQ ID NO: 99407 - DNA, 20 bp, Artificial Sequence
  chemically synthesized
tgtaaaatatgatcaacgcc

SEQ ID NO: 99408 - DNA, 20 bp, Artificial Sequence
  chemically synthesized
gcgttgatcatattttacat

SEQ ID NO: 99409 - DNA, 20 bp, Artificial Sequence
  chemically synthesized
cgttgatcatattttacatt

SEQ ID NO: 99410 - DNA, 20 bp, Artificial Sequence
  chemically synthesized
ttacattaggatttgcataa

SEQ ID NO: 99411 - DNA, 20 bp, Artificial Sequence
  chemically synthesized
cattaggatttgcataaaag

SEQ ID NO: 99412 - DNA, 20 bp, Artificial Sequence
  chemically synthesized
taggatttgcataaaagaag

SEQ ID NO: 99413 - DNA, 20 bp, Artificial Sequence
  chemically synthesized
aggatttgcataaaagaagc

SEQ ID NO: 99414 - DNA, 20 bp, Artificial Sequence
  chemically synthesized
tttgcataaaagaagcaggc

SEQ ID NO: 99415 - DNA, 20 bp, Artificial Sequence
  chemically synthesized
ttgcataaaagaagcaggcc

SEQ ID NO: 99416 - DNA, 20 bp, Artificial Sequence
  chemically synthesized
cataaaagaagcaggccagg

SEQ ID NO: 99417 - DNA, 20 bp, Artificial Sequence
  chemically synthesized
aaaagaagcaggccaggcag

SEQ ID NO: 99418 - DNA, 20 bp, Artificial Sequence
  chemically synthesized
aggaacatagggccactgcc

SEQ ID NO: 99419 - DNA, 20 bp, Artificial Sequence
  chemically synthesized
tgtgtggggaaaggaacata

SEQ ID NO: 99420 - DNA, 20 bp, Artificial Sequence
  chemically synthesized
ttgtgtggggaaaggaacat

SEQ ID NO: 99421 - DNA, 20 bp, Artificial Sequence
  chemically synthesized
cttgtgtggggaaaggaaca

SEQ ID NO: 99422 - DNA, 20 bp, Artificial Sequence
  chemically synthesized
gtatgaccttgtgtggggaa

SEQ ID NO: 99423 - DNA, 20 bp, Artificial Sequence
  chemically synthesized
tgtatgaccttgtgtgggga

SEQ ID NO: 99424 - DNA, 20 bp, Artificial Sequence
  chemically synthesized
ctatgttcctttccccacac

SEQ ID NO: 99425 - DNA, 20 bp, Artificial Sequence
  chemically synthesized
tatgttcctttccccacaca

SEQ ID NO: 99426 - DNA, 20 bp, Artificial Sequence
  chemically synthesized
tttatgtatgaccttgtgtg

SEQ ID NO: 99427 - DNA, 20 bp, Artificial Sequence
  chemically synthesized
ttttatgtatgaccttgtgt

SEQ ID NO: 99428 - DNA, 20 bp, Artificial Sequence
  chemically synthesized
attttatgtatgaccttgtg

SEQ ID NO: 99429 - DNA, 20 bp, Artificial Sequence
  chemically synthesized
ttttttattttttccccctc

SEQ ID NO: 99430 - DNA, 20 bp, Artificial Sequence
  chemically synthesized
tacagggaaaaggccagagg

SEQ ID NO: 99431 - DNA, 20 bp, Artificial Sequence
  chemically synthesized
ttacagggaaaaggccagag

SEQ ID NO: 99432 - DNA, 20 bp, Artificial Sequence
  chemically synthesized
cttacagggaaaaggccaga

SEQ ID NO: 99433 - DNA, 20 bp, Artificial Sequence
  chemically synthesized
acttacagggaaaaggccag

SEQ ID NO: 99434 - DNA, 20 bp, Artificial Sequence
  chemically synthesized
tacttacagggaaaaggcca

SEQ ID NO: 99435 - DNA, 20 bp, Artificial Sequence
  chemically synthesized
tatacttacagggaaaaggc

SEQ ID NO: 99436 - DNA, 20 bp, Artificial Sequence
  chemically synthesized
aacatatacttacagggaaa

SEQ ID NO: 99437 - DNA, 20 bp, Artificial Sequence
  chemically synthesized
taacatatacttacagggaa

SEQ ID NO: 99438 - DNA, 20 bp, Artificial Sequence
  chemically synthesized
ccctctggccttttccctgt

SEQ ID NO: 99439 - DNA, 20 bp, Artificial Sequence
  chemically synthesized
agtgataacatatacttaca

SEQ ID NO: 99440 - DNA, 20 bp, Artificial Sequence
  chemically synthesized
aagtgataacatatacttac

SEQ ID NO: 99441 - DNA, 20 bp, Artificial Sequence
  chemically synthesized
aaagtgataacatatactta

SEQ ID NO: 99442 - DNA, 20 bp, Artificial Sequence
  chemically synthesized
attatgattcatttgtatca

SEQ ID NO: 99443 - DNA, 20 bp, Artificial Sequence
  chemically synthesized
agtgaatggagtgagtgaat

SEQ ID NO: 99444 - DNA, 20 bp, Artificial Sequence
  chemically synthesized
aataagtaagtgaatggagt

SEQ ID NO: 99445 - DNA, 20 bp, Artificial Sequence
  chemically synthesized
aatgaataagtaagtgaatg

SEQ ID NO: 99446 - DNA, 20 bp, Artificial Sequence
  chemically synthesized
ttaatgaataagtaagtgaa

SEQ ID NO: 99447 - DNA, 20 bp, Artificial Sequence
  chemically synthesized
gaaagcattaatgaataagt

SEQ ID NO: 99448 - DNA, 20 bp, Artificial Sequence
  chemically synthesized
taatgaaagcattaatgaat

SEQ ID NO: 99449 - DNA, 20 bp, Artificial Sequence
  chemically synthesized
acataataaatatttaatga

SEQ ID NO: 99450 - DNA, 20 bp, Artificial Sequence
  chemically synthesized
ttcattaaatatttattatg

SEQ ID NO: 99451 - DNA, 20 bp, Artificial Sequence
  chemically synthesized
attaaatatttattatgtgg

SEQ ID NO: 99452 - DNA, 20 bp, Artificial Sequence
  chemically synthesized
ttaaatatttattatgtggt

SEQ ID NO: 99453 - DNA, 20 bp, Artificial Sequence
  chemically synthesized
tttattatgtggtaggtata

SEQ ID NO: 99454 - DNA, 20 bp, Artificial Sequence
  chemically synthesized
attatgtggtaggtatacgg

SEQ ID NO: 99455 - DNA, 20 bp, Artificial Sequence
  chemically synthesized
aggtatacggaagtacaaaa

SEQ ID NO: 99456 - DNA, 20 bp, Artificial Sequence
  chemically synthesized
gaagtacaaaaaagtacaaa

SEQ ID NO: 99457 - DNA, 20 bp, Artificial Sequence
  chemically synthesized
aagtacaaaaagacctcaca

SEQ ID NO: 99458 - DNA, 20 bp, Artificial Sequence
  chemically synthesized
tttagatcttaagctttgtg

SEQ ID NO: 99459 - DNA, 20 bp, Artificial Sequence
  chemically synthesized
gtttagatcttaagctttgt

SEQ ID NO: 99460 - DNA, 20 bp, Artificial Sequence
  chemically synthesized
aaaaagacctcacaaagctt

SEQ ID NO: 99461 - DNA, 20 bp, Artificial Sequence
  chemically synthesized
tgtattcctgtttagatctt

SEQ ID NO: 99462 - DNA, 20 bp, Artificial Sequence
  chemically synthesized
cacaaagcttaagatctaaa

SEQ ID NO: 99463 - DNA, 20 bp, Artificial Sequence
  chemically synthesized
acaaagcttaagatctaaac

SEQ ID NO: 99464 - DNA, 20 bp, Artificial Sequence
  chemically synthesized
catgaatttgtattcctgtt

SEQ ID NO: 99465 - DNA, 20 bp, Artificial Sequence
  chemically synthesized
taaacaggaatacaaattca

SEQ ID NO: 99466 - DNA, 20 bp, Artificial Sequence
  chemically synthesized
aaacaggaatacaaattcat

SEQ ID NO: 99467 - DNA, 20 bp, Artificial Sequence
  chemically synthesized
tgggcaattgaaataccata

SEQ ID NO: 99468 - DNA, 20 bp, Artificial Sequence
  chemically synthesized
aattgaaataccatatggca

SEQ ID NO: 99469 - DNA, 20 bp, Artificial Sequence
  chemically synthesized
ttgtcttaccctttgccata

SEQ ID NO: 99470 - DNA, 20 bp, Artificial Sequence
  chemically synthesized
attgaaataccatatggcaa

SEQ ID NO: 99471 - DNA, 20 bp, Artificial Sequence
  chemically synthesized
ttgaaataccatatggcaaa

SEQ ID NO: 99472 - DNA, 20 bp, Artificial Sequence
  chemically synthesized
aataccatatggcaaagggt

SEQ ID NO: 99473 - DNA, 20 bp, Artificial Sequence
  chemically synthesized
agggtaagacaaatgtactg

SEQ ID NO: 99474 - DNA, 20 bp, Artificial Sequence
  chemically synthesized
gtaagacaaatgtactgaag

SEQ ID NO: 99475 - DNA, 20 bp, Artificial Sequence
  chemically synthesized
gcaccttcaatgtgctactt

SEQ ID NO: 99476 - DNA, 20 bp, Artificial Sequence
  chemically synthesized
tgtactgaagtagcacattg

SEQ ID NO: 99477 - DNA, 20 bp, Artificial Sequence
  chemically synthesized
gtactgaagtagcacattga

SEQ ID NO: 99478 - DNA, 20 bp, Artificial Sequence
  chemically synthesized
gaagtagcacattgaaggtg

SEQ ID NO: 99479 - DNA, 20 bp, Artificial Sequence
  chemically synthesized
aagtagcacattgaaggtgc

SEQ ID NO: 99480 - DNA, 20 bp, Artificial Sequence
  chemically synthesized
gtagcacattgaaggtgcag

SEQ ID NO: 99481 - DNA, 20 bp, Artificial Sequence
  chemically synthesized
cattgaaggtgcaggagatc

SEQ ID NO: 99482 - DNA, 20 bp, Artificial Sequence
  chemically synthesized
aaggtgcaggagatccggtt

SEQ ID NO: 99483 - DNA, 20 bp, Artificial Sequence
  chemically synthesized
aggtgcaggagatccggttt

SEQ ID NO: 99484 - DNA, 20 bp, Artificial Sequence
  chemically synthesized
gattcctgaacatcccaaac

SEQ ID NO: 99485 - DNA, 20 bp, Artificial Sequence
  chemically synthesized
gagatccggtttgggatgtt

SEQ ID NO: 99486 - DNA, 20 bp, Artificial Sequence
  chemically synthesized
agatccggtttgggatgttc

SEQ ID NO: 99487 - DNA, 20 bp, Artificial Sequence
  chemically synthesized
atgttcaggaatctatttat

SEQ ID NO: 99488 - DNA, 20 bp, Artificial Sequence
  chemically synthesized
tgttcaggaatctatttatg

SEQ ID NO: 99489 - DNA, 20 bp, Artificial Sequence
  chemically synthesized
ttcagacagcacctcataaa

SEQ ID NO: 99490 - DNA, 20 bp, Artificial Sequence
  chemically synthesized
tttatgaggtgctgtctgaa

SEQ ID NO: 99491 - DNA, 20 bp, Artificial Sequence
  chemically synthesized
ttatgaggtgctgtctgaaa

SEQ ID NO: 99492 - DNA, 20 bp, Artificial Sequence
  chemically synthesized
gttaataatcccttttcaga

SEQ ID NO: 99493 - DNA, 20 bp, Artificial Sequence
  chemically synthesized
tatgaggtgctgtctgaaaa

SEQ ID NO: 99494 - DNA, 20 bp, Artificial Sequence
  chemically synthesized
gctagttaataatccctttt

SEQ ID NO: 99495 - DNA, 20 bp, Artificial Sequence
  chemically synthesized
tctgaaaagggattattaac

SEQ ID NO: 99496 - DNA, 20 bp, Artificial Sequence
  chemically synthesized
ctctatcacctttgtttagc

SEQ ID NO: 99497 - DNA, 20 bp, Artificial Sequence
  chemically synthesized
gattattaactagctaaaca

SEQ ID NO: 99498 - DNA, 20 bp, Artificial Sequence
  chemically synthesized
attattaactagctaaacaa

SEQ ID NO: 99499 - DNA, 20 bp, Artificial Sequence
  chemically synthesized
tctcctctatcacctttgtt

SEQ ID NO: 99500 - DNA, 20 bp, Artificial Sequence
  chemically synthesized
aactagctaaacaaaggtga

SEQ ID NO: 99501 - DNA, 20 bp, Artificial Sequence
  chemically synthesized
ctagctaaacaaaggtgata

SEQ ID NO: 99502 - DNA, 20 bp, Artificial Sequence
  chemically synthesized
tagctaaacaaaggtgatag

SEQ ID NO: 99503 - DNA, 20 bp, Artificial Sequence
  chemically synthesized
gctaaacaaaggtgatagag

SEQ ID NO: 99504 - DNA, 20 bp, Artificial Sequence
  chemically synthesized
taaacaaaggtgatagagga

SEQ ID NO: 99505 - DNA, 20 bp, Artificial Sequence
  chemically synthesized
caaaggtgatagaggagaga

SEQ ID NO: 99506 - DNA, 20 bp, Artificial Sequence
  chemically synthesized
gaggagagacagattgttcc

SEQ ID NO: 99507 - DNA, 20 bp, Artificial Sequence
  chemically synthesized
aggagagacagattgttcct

SEQ ID NO: 99508 - DNA, 20 bp, Artificial Sequence
  chemically synthesized
gagagacagattgttcctag

SEQ ID NO: 99509 - DNA, 20 bp, Artificial Sequence
  chemically synthesized
gagacagattgttcctagga

SEQ ID NO: 99510 - DNA, 20 bp, Artificial Sequence
  chemically synthesized
agacagattgttcctaggag

SEQ ID NO: 99511 - DNA, 20 bp, Artificial Sequence
  chemically synthesized
gacagattgttcctaggaga

SEQ ID NO: 99512 - DNA, 20 bp, Artificial Sequence
  chemically synthesized
atcaaatggctccctctcct

SEQ ID NO: 99513 - DNA, 20 bp, Artificial Sequence
  chemically synthesized
cagattgttcctaggagagg

SEQ ID NO: 99514 - DNA, 20 bp, Artificial Sequence
  chemically synthesized
catcaaatggctccctctcc

SEQ ID NO: 99515 - DNA, 20 bp, Artificial Sequence
  chemically synthesized
taggagagggagccatttga

SEQ ID NO: 99516 - DNA, 20 bp, Artificial Sequence
  chemically synthesized
ggagagggagccatttgatg

SEQ ID NO: 99517 - DNA, 20 bp, Artificial Sequence
  chemically synthesized
gcttctggccctccatcaaa

SEQ ID NO: 99518 - DNA, 20 bp, Artificial Sequence
  chemically synthesized
gagagggagccatttgatgg

SEQ ID NO: 99519 - DNA, 20 bp, Artificial Sequence
  chemically synthesized
agagggagccatttgatgga

SEQ ID NO: 99520 - DNA, 20 bp, Artificial Sequence
  chemically synthesized
ggagccatttgatggagggc

SEQ ID NO: 99521 - DNA, 20 bp, Artificial Sequence
  chemically synthesized
gccatttgatggagggccag

SEQ ID NO: 99522 - DNA, 20 bp, Artificial Sequence
  chemically synthesized
tttgatggagggccagaagc

SEQ ID NO: 99523 - DNA, 20 bp, Artificial Sequence
  chemically synthesized
atatctttgtttcttgcttc

SEQ ID NO: 99524 - DNA, 20 bp, Artificial Sequence
  chemically synthesized
agggccagaagcaagaaaca

SEQ ID NO: 99525 - DNA, 20 bp, Artificial Sequence
  chemically synthesized
aaagatattttatttgattg

SEQ ID NO: 99526 - DNA, 20 bp, Artificial Sequence
  chemically synthesized
agatattttatttgattgta

SEQ ID NO: 99527 - DNA, 20 bp, Artificial Sequence
  chemically synthesized
ttttatttgattgtagagtt

SEQ ID NO: 99528 - DNA, 20 bp, Artificial Sequence
  chemically synthesized
tttgattgtagagttcagta

SEQ ID NO: 99529 - DNA, 20 bp, Artificial Sequence
  chemically synthesized
tgattgtagagttcagtaaa

SEQ ID NO: 99530 - DNA, 20 bp, Artificial Sequence
  chemically synthesized
gattgtagagttcagtaaag

SEQ ID NO: 99531 - DNA, 20 bp, Artificial Sequence
  chemically synthesized
attgtagagttcagtaaaga

SEQ ID NO: 99532 - DNA, 20 bp, Artificial Sequence
  chemically synthesized
agagttcagtaaagagggat

SEQ ID NO: 99533 - DNA, 20 bp, Artificial Sequence
  chemically synthesized
gagttcagtaaagagggata

SEQ ID NO: 99534 - DNA, 20 bp, Artificial Sequence
  chemically synthesized
agtaaagagggataaggctt

SEQ ID NO: 99535 - DNA, 20 bp, Artificial Sequence
  chemically synthesized
aaagagggataaggcttgag

SEQ ID NO: 99536 - DNA, 20 bp, Artificial Sequence
  chemically synthesized
ctcactccgtgtgaccactc

SEQ ID NO: 99537 - DNA, 20 bp, Artificial Sequence
  chemically synthesized
ataaggcttgagtggtcaca

SEQ ID NO: 99538 - DNA, 20 bp, Artificial Sequence
  chemically synthesized
aaggcttgagtggtcacacg

SEQ ID NO: 99539 - DNA, 20 bp, Artificial Sequence
  chemically synthesized
cttgagtggtcacacggagt

SEQ ID NO: 99540 - DNA, 20 bp, Artificial Sequence
  chemically synthesized
tgagtggtcacacggagtga

SEQ ID NO: 99541 - DNA, 20 bp, Artificial Sequence
  chemically synthesized
tcacacggagtgagagcatg

SEQ ID NO: 99542 - DNA, 20 bp, Artificial Sequence
  chemically synthesized
cacacggagtgagagcatga

SEQ ID NO: 99543 - DNA, 20 bp, Artificial Sequence
  chemically synthesized
acacggagtgagagcatgaa

SEQ ID NO: 99544 - DNA, 20 bp, Artificial Sequence
  chemically synthesized
gagagcatgaagggccatgt

SEQ ID NO: 99545 - DNA, 20 bp, Artificial Sequence
  chemically synthesized
agcatgaagggccatgtaag

SEQ ID NO: 99546 - DNA, 20 bp, Artificial Sequence
  chemically synthesized
ctagcattccactacttaca

SEQ ID NO: 99547 - DNA, 20 bp, Artificial Sequence
  chemically synthesized
atgaagggccatgtaagtag

SEQ ID NO: 99548 - DNA, 20 bp, Artificial Sequence
  chemically synthesized
ccatgtaagtagtggaatgc

SEQ ID NO: 99549 - DNA, 20 bp, Artificial Sequence
  chemically synthesized
gccagttatttgacatttac

SEQ ID NO: 99550 - DNA, 20 bp, Artificial Sequence
  chemically synthesized
gctagtaaatgtcaaataac

SEQ ID NO: 99551 - DNA, 20 bp, Artificial Sequence
  chemically synthesized
aaatgtcaaataactggctc

SEQ ID NO: 99552 - DNA, 20 bp, Artificial Sequence
  chemically synthesized
aatgtcaaataactggctct

SEQ ID NO: 99553 - DNA, 20 bp, Artificial Sequence
  chemically synthesized
atgtcaaataactggctcta

SEQ ID NO: 99554 - DNA, 20 bp, Artificial Sequence
  chemically synthesized
tgtcaaataactggctctag

SEQ ID NO: 99555 - DNA, 20 bp, Artificial Sequence
  chemically synthesized
ccactgccctcccctagagc

SEQ ID NO: 99556 - DNA, 20 bp, Artificial Sequence
  chemically synthesized
tcaaataactggctctaggg

SEQ ID NO: 99557 - DNA, 20 bp, Artificial Sequence
  chemically synthesized
caaataactggctctagggg

SEQ ID NO: 99558 - DNA, 20 bp, Artificial Sequence
  chemically synthesized
aaataactggctctagggga

SEQ ID NO: 99559 - DNA, 20 bp, Artificial Sequence
  chemically synthesized
agcgccactgccctccccta

SEQ ID NO: 99560 - DNA, 20 bp, Artificial Sequence
  chemically synthesized
ttagcgccactgccctcccc

SEQ ID NO: 99561 - DNA, 20 bp, Artificial Sequence
  chemically synthesized
taactggctctaggggaggg

SEQ ID NO: 99562 - DNA, 20 bp, Artificial Sequence
  chemically synthesized
ctggctctaggggagggcag

SEQ ID NO: 99563 - DNA, 20 bp, Artificial Sequence
  chemically synthesized
gagggcagtggcgctaattg

SEQ ID NO: 99564 - DNA, 20 bp, Artificial Sequence
  chemically synthesized
aaattggcaaatgctacaat

SEQ ID NO: 99565 - DNA, 20 bp, Artificial Sequence
  chemically synthesized
gtagcatttgccaatttctg

SEQ ID NO: 99566 - DNA, 20 bp, Artificial Sequence
  chemically synthesized
agcacttacaccacagaaat

SEQ ID NO: 99567 - DNA, 20 bp, Artificial Sequence
  chemically synthesized
tttgccaatttctgtggtgt

SEQ ID NO: 99568 - DNA, 20 bp, Artificial Sequence
  chemically synthesized
ttgtgagagcacttacacca

SEQ ID NO: 99569 - DNA, 20 bp, Artificial Sequence
  chemically synthesized
tggtgtaagtgctctcacaa

SEQ ID NO: 99570 - DNA, 20 bp, Artificial Sequence
  chemically synthesized
cttgaaatcagctattgtga

SEQ ID NO: 99571 - DNA, 20 bp, Artificial Sequence
  chemically synthesized
tgcttgaaatcagctattgt

SEQ ID NO: 99572 - DNA, 20 bp, Artificial Sequence
  chemically synthesized
ctctcacaatagctgatttc

SEQ ID NO: 99573 - DNA, 20 bp, Artificial Sequence
  chemically synthesized
tcaagttagttgcttgaaat

SEQ ID NO: 99574 - DNA, 20 bp, Artificial Sequence
  chemically synthesized
ttcattcaatgacatcaagt

SEQ ID NO: 99575 - DNA, 20 bp, Artificial Sequence
  chemically synthesized
gttcttcattcaatgacatc

SEQ ID NO: 99576 - DNA, 20 bp, Artificial Sequence
  chemically synthesized
taacttgatgtcattgaatg

SEQ ID NO: 99577 - DNA, 20 bp, Artificial Sequence
  chemically synthesized
atgtcattgaatgaagaact

SEQ ID NO: 99578 - DNA, 20 bp, Artificial Sequence
  chemically synthesized
tcattgaatgaagaactcag

SEQ ID NO: 99579 - DNA, 20 bp, Artificial Sequence
  chemically synthesized
tgaatgaagaactcagtgga

SEQ ID NO: 99580 - DNA, 20 bp, Artificial Sequence
  chemically synthesized
tatgtgtatctctttccact

SEQ ID NO: 99581 - DNA, 20 bp, Artificial Sequence
  chemically synthesized
aatgaagaactcagtggaaa

SEQ ID NO: 99582 - DNA, 20 bp, Artificial Sequence
  chemically synthesized
tggaaagagatacacataat

SEQ ID NO: 99583 - DNA, 20 bp, Artificial Sequence
  chemically synthesized
agatacacataattggctct

SEQ ID NO: 99584 - DNA, 20 bp, Artificial Sequence
  chemically synthesized
ttctaattaacacattccaa

SEQ ID NO: 99585 - DNA, 20 bp, Artificial Sequence
  chemically synthesized
tcttctaattaacacattcc

SEQ ID NO: 99586 - DNA, 20 bp, Artificial Sequence
  chemically synthesized
ggctcttggaatgtgttaat

SEQ ID NO: 99587 - DNA, 20 bp, Artificial Sequence
  chemically synthesized
tcttggaatgtgttaattag

SEQ ID NO: 99588 - DNA, 20 bp, Artificial Sequence
  chemically synthesized
gaatgtgttaattagaagat

SEQ ID NO: 99589 - DNA, 20 bp, Artificial Sequence
  chemically synthesized
tgtgttaattagaagataag

SEQ ID NO: 99590 - DNA, 20 bp, Artificial Sequence
  chemically synthesized
ttaattagaagataagtagt

SEQ ID NO: 99591 - DNA, 20 bp, Artificial Sequence
  chemically synthesized
ttagaagataagtagttagc

SEQ ID NO: 99592 - DNA, 20 bp, Artificial Sequence
  chemically synthesized
gaagataagtagttagcaag

SEQ ID NO: 99593 - DNA, 20 bp, Artificial Sequence
  chemically synthesized
agataagtagttagcaagca

SEQ ID NO: 99594 - DNA, 20 bp, Artificial Sequence
  chemically synthesized
gagcatgtgtgtactaaaca

SEQ ID NO: 99595 - DNA, 20 bp, Artificial Sequence
  chemically synthesized
tatccctcactatctatgtt

SEQ ID NO: 99596 - DNA, 20 bp, Artificial Sequence
  chemically synthesized
atgtgtgtactaaacataga

SEQ ID NO: 99597 - DNA, 20 bp, Artificial Sequence
  chemically synthesized
gtgtactaaacatagatagt

SEQ ID NO: 99598 - DNA, 20 bp, Artificial Sequence
  chemically synthesized
tgtactaaacatagatagtg

SEQ ID NO: 99599 - DNA, 20 bp, Artificial Sequence
  chemically synthesized
gtactaaacatagatagtga

SEQ ID NO: 99600 - DNA, 20 bp, Artificial Sequence
  chemically synthesized
taaacatagatagtgaggga

SEQ ID NO: 99601 - DNA, 20 bp, Artificial Sequence
  chemically synthesized
acatagatagtgagggatag

SEQ ID NO: 99602 - DNA, 20 bp, Artificial Sequence
  chemically synthesized
catagatagtgagggataga

SEQ ID NO: 99603 - DNA, 20 bp, Artificial Sequence
  chemically synthesized
gtgagggatagaaggaccaa

SEQ ID NO: 99604 - DNA, 20 bp, Artificial Sequence
  chemically synthesized
catgaatattgggtatcttt

SEQ ID NO: 99605 - DNA, 20 bp, Artificial Sequence
  chemically synthesized
ccaggtgcctcatgaatatt

SEQ ID NO: 99606 - DNA, 20 bp, Artificial Sequence
  chemically synthesized
cccaggtgcctcatgaatat

SEQ ID NO: 99607 - DNA, 20 bp, Artificial Sequence
  chemically synthesized
aaaagatacccaatattcat

SEQ ID NO: 99608 - DNA, 20 bp, Artificial Sequence
  chemically synthesized
aaagatacccaatattcatg

SEQ ID NO: 99609 - DNA, 20 bp, Artificial Sequence
  chemically synthesized
cccaatattcatgaggcacc

SEQ ID NO: 99610 - DNA, 20 bp, Artificial Sequence
  chemically synthesized
ccaatattcatgaggcacct

SEQ ID NO: 99611 - DNA, 20 bp, Artificial Sequence
  chemically synthesized
attatgaatatttagtaccc

SEQ ID NO: 99612 - DNA, 20 bp, Artificial Sequence
  chemically synthesized
tattatgaatatttagtacc

SEQ ID NO: 99613 - DNA, 20 bp, Artificial Sequence
  chemically synthesized
tttagcatattatgaatatt

SEQ ID NO: 99614 - DNA, 20 bp, Artificial Sequence
  chemically synthesized
tatttggtctcatgtgtatt

SEQ ID NO: 99615 - DNA, 20 bp, Artificial Sequence
  chemically synthesized
ataatatgctaaatacacat

SEQ ID NO: 99616 - DNA, 20 bp, Artificial Sequence
  chemically synthesized
acacatgagaccaaatatac

SEQ ID NO: 99617 - DNA, 20 bp, Artificial Sequence
  chemically synthesized
tttagtgcctcttgtatatt

SEQ ID NO: 99618 - DNA, 20 bp, Artificial Sequence
  chemically synthesized
acatgagaccaaatatacaa

SEQ ID NO: 99619 - DNA, 20 bp, Artificial Sequence
  chemically synthesized
catgagaccaaatatacaag

SEQ ID NO: 99620 - DNA, 20 bp, Artificial Sequence
  chemically synthesized
acaagaggcactaaatattc

SEQ ID NO: 99621 - DNA, 20 bp, Artificial Sequence
  chemically synthesized
tttatttgatcttgaatatt

SEQ ID NO: 99622 - DNA, 20 bp, Artificial Sequence
  chemically synthesized
aagatcaaataaatacacat

SEQ ID NO: 99623 - DNA, 20 bp, Artificial Sequence
  chemically synthesized
attaagaccttgtgaacatt

SEQ ID NO: 99624 - DNA, 20 bp, Artificial Sequence
  chemically synthesized
catgagcacttaatgttcac

SEQ ID NO: 99625 - DNA, 20 bp, Artificial Sequence
  chemically synthesized
atgagcacttaatgttcaca

SEQ ID NO: 99626 - DNA, 20 bp, Artificial Sequence
  chemically synthesized
atgttcacaaggtcttaatt

SEQ ID NO: 99627 - DNA, 20 bp, Artificial Sequence
  chemically synthesized
tgttcacaaggtcttaattc

SEQ ID NO: 99628 - DNA, 20 bp, Artificial Sequence
  chemically synthesized
cacctatggatgcctgaatt

SEQ ID NO: 99629 - DNA, 20 bp, Artificial Sequence
  chemically synthesized
ggtcttaattcaggcatcca

SEQ ID NO: 99630 - DNA, 20 bp, Artificial Sequence
  chemically synthesized
gtcttaattcaggcatccat

SEQ ID NO: 99631 - DNA, 20 bp, Artificial Sequence
  chemically synthesized
gctggaataggtatcaccta

SEQ ID NO: 99632 - DNA, 20 bp, Artificial Sequence
  chemically synthesized
tccataggtgatacctattc

SEQ ID NO: 99633 - DNA, 20 bp, Artificial Sequence
  chemically synthesized
aagacttacggtgctggaat

SEQ ID NO: 99634 - DNA, 20 bp, Artificial Sequence
  chemically synthesized
gaagacttacggtgctggaa

SEQ ID NO: 99635 - DNA, 20 bp, Artificial Sequence
  chemically synthesized
gatacctattccagcaccgt

SEQ ID NO: 99636 - DNA, 20 bp, Artificial Sequence
  chemically synthesized
aggcagaagacttacggtgc

SEQ ID NO: 99637 - DNA, 20 bp, Artificial Sequence
  chemically synthesized
attctcaggcagaagactta

SEQ ID NO: 99638 - DNA, 20 bp, Artificial Sequence
  chemically synthesized
gcaccgtaagtcttctgcct

SEQ ID NO: 99639 - DNA, 20 bp, Artificial Sequence
  chemically synthesized
gccatgtaattctcaggcag

SEQ ID NO: 99640 - DNA, 20 bp, Artificial Sequence
  chemically synthesized
ctagccatgtaattctcagg

SEQ ID NO: 99641 - DNA, 20 bp, Artificial Sequence
  chemically synthesized
tgactagccatgtaattctc

SEQ ID NO: 99642 - DNA, 20 bp, Artificial Sequence
  chemically synthesized
atgactagccatgtaattct

SEQ ID NO: 99643 - DNA, 20 bp, Artificial Sequence
  chemically synthesized
tcttctgcctgagaattaca

SEQ ID NO: 99644 - DNA, 20 bp, Artificial Sequence
  chemically synthesized
ctgcctgagaattacatggc

SEQ ID NO: 99645 - DNA, 20 bp, Artificial Sequence
  chemically synthesized
agaattacatggctagtcat

SEQ ID NO: 99646 - DNA, 20 bp, Artificial Sequence
  chemically synthesized
gaattacatggctagtcatc

SEQ ID NO: 99647 - DNA, 20 bp, Artificial Sequence
  chemically synthesized
tgccaaaatagcctgatgac

SEQ ID NO: 99648 - DNA, 20 bp, Artificial Sequence
  chemically synthesized
ggctagtcatcaggctattt

SEQ ID NO: 99649 - DNA, 20 bp, Artificial Sequence
  chemically synthesized
agtcatcaggctattttggc

SEQ ID NO: 99650 - DNA, 20 bp, Artificial Sequence
  chemically synthesized
acagctgtaacttgccaaaa

SEQ ID NO: 99651 - DNA, 20 bp, Artificial Sequence
  chemically synthesized
caggctattttggcaagtta

SEQ ID NO: 99652 - DNA, 20 bp, Artificial Sequence
  chemically synthesized
attttggcaagttacagctg

SEQ ID NO: 99653 - DNA, 20 bp, Artificial Sequence
  chemically synthesized
gagacaagaatgcatggcca

SEQ ID NO: 99654 - DNA, 20 bp, Artificial Sequence
  chemically synthesized
gacacagagacaagaatgca

SEQ ID NO: 99655 - DNA, 20 bp, Artificial Sequence
  chemically synthesized
tttatcagagacacagagac

SEQ ID NO: 99656 - DNA, 20 bp, Artificial Sequence
  chemically synthesized
tgtggtttatcagagacaca

SEQ ID NO: 99657 - DNA, 20 bp, Artificial Sequence
  chemically synthesized
catgtggtttatcagagaca

SEQ ID NO: 99658 - DNA, 20 bp, Artificial Sequence
  chemically synthesized
cagtggcatgtggtttatca

SEQ ID NO: 99659 - DNA, 20 bp, Artificial Sequence
  chemically synthesized
ttcagtggcatgtggtttat

SEQ ID NO: 99660 - DNA, 20 bp, Artificial Sequence
  chemically synthesized
gtgcctgattcagtggcatg

SEQ ID NO: 99661 - DNA, 20 bp, Artificial Sequence
  chemically synthesized
taaaccacatgccactgaat

SEQ ID NO: 99662 - DNA, 20 bp, Artificial Sequence
  chemically synthesized
aaaccacatgccactgaatc

SEQ ID NO: 99663 - DNA, 20 bp, Artificial Sequence
  chemically synthesized
atgggtggtgcctgattcag

SEQ ID NO: 99664 - DNA, 20 bp, Artificial Sequence
  chemically synthesized
aaaatgggtggtgcctgatt

SEQ ID NO: 99665 - DNA, 20 bp, Artificial Sequence
  chemically synthesized
gaatcaggcaccacccattt

SEQ ID NO: 99666 - DNA, 20 bp, Artificial Sequence
  chemically synthesized
acaagggagtccaaaatggg

SEQ ID NO: 99667 - DNA, 20 bp, Artificial Sequence
  chemically synthesized
ccaacaagggagtccaaaat

SEQ ID NO: 99668 - DNA, 20 bp, Artificial Sequence
  chemically synthesized
cccaacaagggagtccaaaa

SEQ ID NO: 99669 - DNA, 20 bp, Artificial Sequence
  chemically synthesized
cccattttggactcccttgt

SEQ ID NO: 99670 - DNA, 20 bp, Artificial Sequence
  chemically synthesized
ccattttggactcccttgtt

SEQ ID NO: 99671 - DNA, 20 bp, Artificial Sequence
  chemically synthesized
aagttgacttcccaacaagg

SEQ ID NO: 99672 - DNA, 20 bp, Artificial Sequence
  chemically synthesized
caaagttgacttcccaacaa

SEQ ID NO: 99673 - DNA, 20 bp, Artificial Sequence
  chemically synthesized
ttttggactcccttgttggg

SEQ ID NO: 99674 - DNA, 20 bp, Artificial Sequence
  chemically synthesized
ccaaagttgacttcccaaca

SEQ ID NO: 99675 - DNA, 20 bp, Artificial Sequence
  chemically synthesized
accaaagttgacttcccaac

SEQ ID NO: 99676 - DNA, 20 bp, Artificial Sequence
  chemically synthesized
ccttgttgggaagtcaactt

SEQ ID NO: 99677 - DNA, 20 bp, Artificial Sequence
  chemically synthesized
tggtgtgcttacaaggacca

SEQ ID NO: 99678 - DNA, 20 bp, Artificial Sequence
  chemically synthesized
aagtcaactttggtccttgt

SEQ ID NO: 99679 - DNA, 20 bp, Artificial Sequence
  chemically synthesized
ccaattatggtgtgcttaca

SEQ ID NO: 99680 - DNA, 20 bp, Artificial Sequence
  chemically synthesized
cccaattatggtgtgcttac

SEQ ID NO: 99681 - DNA, 20 bp, Artificial Sequence
  chemically synthesized
ccttgtaagcacaccataat

SEQ ID NO: 99682 - DNA, 20 bp, Artificial Sequence
  chemically synthesized
cttgtaagcacaccataatt

SEQ ID NO: 99683 - DNA, 20 bp, Artificial Sequence
  chemically synthesized
tgcatcagccttcccaatta

SEQ ID NO: 99684 - DNA, 20 bp, Artificial Sequence
  chemically synthesized
gtaagcacaccataattggg

SEQ ID NO: 99685 - DNA, 20 bp, Artificial Sequence
  chemically synthesized
taagcacaccataattggga

SEQ ID NO: 99686 - DNA, 20 bp, Artificial Sequence
  chemically synthesized
tgtctgtctctgtattgcat

SEQ ID NO: 99687 - DNA, 20 bp, Artificial Sequence
  chemically synthesized
ttgggaaggctgatgcaata

SEQ ID NO: 99688 - DNA, 20 bp, Artificial Sequence
  chemically synthesized
gggaaggctgatgcaataca

SEQ ID NO: 99689 - DNA, 20 bp, Artificial Sequence
  chemically synthesized
aggctgatgcaatacagaga

SEQ ID NO: 99690 - DNA, 20 bp, Artificial Sequence
  chemically synthesized
gatgcaatacagagacagac

SEQ ID NO: 99691 - DNA, 20 bp, Artificial Sequence
  chemically synthesized
acatataatgttgtgtactg

SEQ ID NO: 99692 - DNA, 20 bp, Artificial Sequence
  chemically synthesized
attagagtacttgaattctg

SEQ ID NO: 99693 - DNA, 20 bp, Artificial Sequence
  chemically synthesized
tgttgtgtactgcagaattc

SEQ ID NO: 99694 - DNA, 20 bp, Artificial Sequence
  chemically synthesized
taagcagactgtgaagatta

SEQ ID NO: 99695 - DNA, 20 bp, Artificial Sequence
  chemically synthesized
ttcaagtactctaatcttca

SEQ ID NO: 99696 - DNA, 20 bp, Artificial Sequence
  chemically synthesized
tgtaagcagactgtgaagat

SEQ ID NO: 99697 - DNA, 20 bp, Artificial Sequence
  chemically synthesized
tagagtgtaagcagactgtg

SEQ ID NO: 99698 - DNA, 20 bp, Artificial Sequence
  chemically synthesized
cgcttagaatagagtgtaag

SEQ ID NO: 99699 - DNA, 20 bp, Artificial Sequence
  chemically synthesized
acacgcttagaatagagtgt

SEQ ID NO: 99700 - DNA, 20 bp, Artificial Sequence
  chemically synthesized
gtctgcttacactctattct

SEQ ID NO: 99701 - DNA, 20 bp, Artificial Sequence
  chemically synthesized
aagttaacacgcttagaata

SEQ ID NO: 99702 - DNA, 20 bp, Artificial Sequence
  chemically synthesized
ctaagttaacacgcttagaa

SEQ ID NO: 99703 - DNA, 20 bp, Artificial Sequence
  chemically synthesized
atgtgctaagttaacacgct

SEQ ID NO: 99704 - DNA, 20 bp, Artificial Sequence
  chemically synthesized
ctattctaagcgtgttaact

SEQ ID NO: 99705 - DNA, 20 bp, Artificial Sequence
  chemically synthesized
aaacgggaaagatatgtgct

SEQ ID NO: 99706 - DNA, 20 bp, Artificial Sequence
  chemically synthesized
acagtgagaagcaaacggga

SEQ ID NO: 99707 - DNA, 20 bp, Artificial Sequence
  chemically synthesized
aatcacagtgagaagcaaac

SEQ ID NO: 99708 - DNA, 20 bp, Artificial Sequence
  chemically synthesized
aaatcacagtgagaagcaaa

SEQ ID NO: 99709 - DNA, 20 bp, Artificial Sequence
  chemically synthesized
tttattaaaatcacagtgag

SEQ ID NO: 99710 - DNA, 20 bp, Artificial Sequence
  chemically synthesized
gagtttattaaaatcacagt

SEQ ID NO: 99711 - DNA, 20 bp, Artificial Sequence
  chemically synthesized
cacagagtttattaaaatca

SEQ ID NO: 99712 - DNA, 20 bp, Artificial Sequence
  chemically synthesized
attaaaatacttgaatcaca

SEQ ID NO: 99713 - DNA, 20 bp, Artificial Sequence
  chemically synthesized
tttaataaactctgtgattc

SEQ ID NO: 99714 - DNA, 20 bp, Artificial Sequence
  chemically synthesized
aaattaaaatacttgaatca

SEQ ID NO: 99715 - DNA, 20 bp, Artificial Sequence
  chemically synthesized
gtgattcaagtattttaatt

SEQ ID NO: 99716 - DNA, 20 bp, Artificial Sequence
  chemically synthesized
agtattttaatttggtctat

SEQ ID NO: 99717 - DNA, 20 bp, Artificial Sequence
  chemically synthesized
tcatgaaacagaaaggctca

SEQ ID NO: 99718 - DNA, 20 bp, Artificial Sequence
  chemically synthesized
atccaaatcatgaaacagaa

SEQ ID NO: 99719 - DNA, 20 bp, Artificial Sequence
  chemically synthesized
tatccaaatcatgaaacaga

SEQ ID NO: 99720 - DNA, 20 bp, Artificial Sequence
  chemically synthesized
agcctatccaaatcatgaaa

SEQ ID NO: 99721 - DNA, 20 bp, Artificial Sequence
  chemically synthesized
agcctttctgtttcatgatt
